United States Patent 11,492,591 (UNIVERSAL DONOR STEM CELLS AND RELATED METHODS) - sequence listing, part 17

SEQ ID NO: 537129 - DNA, 20 bp, Artificial
  CRISPR gRNA sequence
gataagcttcacttaggcat

SEQ ID NO: 537130 - DNA, 20 bp, Artificial
  CRISPR gRNA sequence
cttcacttaggcatgagtta

SEQ ID NO: 537131 - DNA, 20 bp, Artificial
  CRISPR gRNA sequence
ggcatgagttacagtgctgt

SEQ ID NO: 537132 - DNA, 20 bp, Artificial
  CRISPR gRNA sequence
gttacagtgctgttggctat

SEQ ID NO: 537133 - DNA, 20 bp, Artificial
  CRISPR gRNA sequence
gtgctgttggctatgagttc

SEQ ID NO: 537134 - DNA, 20 bp, Artificial
  CRISPR gRNA sequence
tgctgttggctatgagttca

SEQ ID NO: 537135 - DNA, 20 bp, Artificial
  CRISPR gRNA sequence
ataaatcaacactatatatt

SEQ ID NO: 537136 - DNA, 20 bp, Artificial
  CRISPR gRNA sequence
taaatcaacactatatatta

SEQ ID NO: 537137 - DNA, 20 bp, Artificial
  CRISPR gRNA sequence
tatattaaggtttatttaaa

SEQ ID NO: 537138 - DNA, 20 bp, Artificial
  CRISPR gRNA sequence
tattaaggtttatttaaaca

SEQ ID NO: 537139 - DNA, 20 bp, Artificial
  CRISPR gRNA sequence
aacagagacacacataaaac

SEQ ID NO: 537140 - DNA, 20 bp, Artificial
  CRISPR gRNA sequence
acagagacacacataaaaca

SEQ ID NO: 537141 - DNA, 20 bp, Artificial
  CRISPR gRNA sequence
acataaaacaaggttataaa

SEQ ID NO: 537142 - DNA, 20 bp, Artificial
  CRISPR gRNA sequence
attaacaaaaatcttatgac

SEQ ID NO: 537143 - DNA, 20 bp, Artificial
  CRISPR gRNA sequence
taacaaaaatcttatgacta

SEQ ID NO: 537144 - DNA, 20 bp, Artificial
  CRISPR gRNA sequence
aacaaaaatcttatgactag

SEQ ID NO: 537145 - DNA, 20 bp, Artificial
  CRISPR gRNA sequence
atcttatgactagaggctca

SEQ ID NO: 537146 - DNA, 20 bp, Artificial
  CRISPR gRNA sequence
tcttatgactagaggctcac

SEQ ID NO: 537147 - DNA, 20 bp, Artificial
  CRISPR gRNA sequence
acctacccctgtatttcccc

SEQ ID NO: 537148 - DNA, 20 bp, Artificial
  CRISPR gRNA sequence
cctacccctgtatttccccc

SEQ ID NO: 537149 - DNA, 20 bp, Artificial
  CRISPR gRNA sequence
tcactgttaacttgactctg

SEQ ID NO: 537150 - DNA, 20 bp, Artificial
  CRISPR gRNA sequence
gtagaactaatatgaataac

SEQ ID NO: 537151 - DNA, 20 bp, Artificial
  CRISPR gRNA sequence
ctaaacaaacttatatgcac

SEQ ID NO: 537152 - DNA, 20 bp, Artificial
  CRISPR gRNA sequence
tgcacaagcttgatacattc

SEQ ID NO: 537153 - DNA, 20 bp, Artificial
  CRISPR gRNA sequence
gaccctgtgttatttaataa

SEQ ID NO: 537154 - DNA, 20 bp, Artificial
  CRISPR gRNA sequence
cctgtgttatttaataaaag

SEQ ID NO: 537155 - DNA, 20 bp, Artificial
  CRISPR gRNA sequence
tgttatttaataaaagaagc

SEQ ID NO: 537156 - DNA, 20 bp, Artificial
  CRISPR gRNA sequence
aaaagaagcaagtgttccac

SEQ ID NO: 537157 - DNA, 20 bp, Artificial
  CRISPR gRNA sequence
agaagcaagtgttccactag

SEQ ID NO: 537158 - DNA, 20 bp, Artificial
  CRISPR gRNA sequence
gaagcaagtgttccactaga

SEQ ID NO: 537159 - DNA, 20 bp, Artificial
  CRISPR gRNA sequence
ttctgaccatctcatactgc

SEQ ID NO: 537160 - DNA, 20 bp, Artificial
  CRISPR gRNA sequence
tgaccatctcatactgccag

SEQ ID NO: 537161 - DNA, 20 bp, Artificial
  CRISPR gRNA sequence
ccatctcatactgccagtgg

SEQ ID NO: 537162 - DNA, 20 bp, Artificial
  CRISPR gRNA sequence
tctcatactgccagtggaag

SEQ ID NO: 537163 - DNA, 20 bp, Artificial
  CRISPR gRNA sequence
ctgccagtggaagcagaact

SEQ ID NO: 537164 - DNA, 20 bp, Artificial
  CRISPR gRNA sequence
gcagaacttggcattgtgtt

SEQ ID NO: 537165 - DNA, 20 bp, Artificial
  CRISPR gRNA sequence
gaacttggcattgtgtttgg

SEQ ID NO: 537166 - DNA, 20 bp, Artificial
  CRISPR gRNA sequence
aacttggcattgtgtttggt

SEQ ID NO: 537167 - DNA, 20 bp, Artificial
  CRISPR gRNA sequence
acttggcattgtgtttggta

SEQ ID NO: 537168 - DNA, 20 bp, Artificial
  CRISPR gRNA sequence
tgtgtttggtagggcaattc

SEQ ID NO: 537169 - DNA, 20 bp, Artificial
  CRISPR gRNA sequence
gtttggtagggcaattctgg

SEQ ID NO: 537170 - DNA, 20 bp, Artificial
  CRISPR gRNA sequence
ttctggcagttgtatataat

SEQ ID NO: 537171 - DNA, 20 bp, Artificial
  CRISPR gRNA sequence
ccttaaaaatatttatcatg

SEQ ID NO: 537172 - DNA, 20 bp, Artificial
  CRISPR gRNA sequence
aatatttatcatgaagcatc

SEQ ID NO: 537173 - DNA, 20 bp, Artificial
  CRISPR gRNA sequence
aagcatctagacattgcact

SEQ ID NO: 537174 - DNA, 20 bp, Artificial
  CRISPR gRNA sequence
tgcactaagtcatgtgccta

SEQ ID NO: 537175 - DNA, 20 bp, Artificial
  CRISPR gRNA sequence
catgtgcctatagtctcact

SEQ ID NO: 537176 - DNA, 20 bp, Artificial
  CRISPR gRNA sequence
tcactaagtcattacaatgt

SEQ ID NO: 537177 - DNA, 20 bp, Artificial
  CRISPR gRNA sequence
cactaagtcattacaatgtt

SEQ ID NO: 537178 - DNA, 20 bp, Artificial
  CRISPR gRNA sequence
aagtcattacaatgttgggc

SEQ ID NO: 537179 - DNA, 20 bp, Artificial
  CRISPR gRNA sequence
gggcaagtgccttaacctct

SEQ ID NO: 537180 - DNA, 20 bp, Artificial
  CRISPR gRNA sequence
tcagtgcctccattttctca

SEQ ID NO: 537181 - DNA, 20 bp, Artificial
  CRISPR gRNA sequence
cagtgcctccattttctcac

SEQ ID NO: 537182 - DNA, 20 bp, Artificial
  CRISPR gRNA sequence
agtgcctccattttctcaca

SEQ ID NO: 537183 - DNA, 20 bp, Artificial
  CRISPR gRNA sequence
ctcacagggtaactatactc

SEQ ID NO: 537184 - DNA, 20 bp, Artificial
  CRISPR gRNA sequence
taataaatatacttatctca

SEQ ID NO: 537185 - DNA, 20 bp, Artificial
  CRISPR gRNA sequence
aataaatatacttatctcat

SEQ ID NO: 537186 - DNA, 20 bp, Artificial
  CRISPR gRNA sequence
ataaatatacttatctcata

SEQ ID NO: 537187 - DNA, 20 bp, Artificial
  CRISPR gRNA sequence
aatatacttatctcataggg

SEQ ID NO: 537188 - DNA, 20 bp, Artificial
  CRISPR gRNA sequence
ctcatagggtagttgcattt

SEQ ID NO: 537189 - DNA, 20 bp, Artificial
  CRISPR gRNA sequence
agggtagttgcatttaagaa

SEQ ID NO: 537190 - DNA, 20 bp, Artificial
  CRISPR gRNA sequence
tatactgtcattaacctatt

SEQ ID NO: 537191 - DNA, 20 bp, Artificial
  CRISPR gRNA sequence
actgtcattaacctattgag

SEQ ID NO: 537192 - DNA, 20 bp, Artificial
  CRISPR gRNA sequence
acctattgagtagatgttat

SEQ ID NO: 537193 - DNA, 20 bp, Artificial
  CRISPR gRNA sequence
gactctgcaattccatttct

SEQ ID NO: 537194 - DNA, 20 bp, Artificial
  CRISPR gRNA sequence
ccatttctaagatgttatcc

SEQ ID NO: 537195 - DNA, 20 bp, Artificial
  CRISPR gRNA sequence
catttctaagatgttatcct

SEQ ID NO: 537196 - DNA, 20 bp, Artificial
  CRISPR gRNA sequence
atttctaagatgttatcctg

SEQ ID NO: 537197 - DNA, 20 bp, Artificial
  CRISPR gRNA sequence
gcccttctactccccgcaaa

SEQ ID NO: 537198 - DNA, 20 bp, Artificial
  CRISPR gRNA sequence
cccttctactccccgcaaaa

SEQ ID NO: 537199 - DNA, 20 bp, Artificial
  CRISPR gRNA sequence
actccccgcaaaaaggcaca

SEQ ID NO: 537200 - DNA, 20 bp, Artificial
  CRISPR gRNA sequence
aggcacaaagatatttactg

SEQ ID NO: 537201 - DNA, 20 bp, Artificial
  CRISPR gRNA sequence
agccttacttaatataccat

SEQ ID NO: 537202 - DNA, 20 bp, Artificial
  CRISPR gRNA sequence
gccttacttaatataccata

SEQ ID NO: 537203 - DNA, 20 bp, Artificial
  CRISPR gRNA sequence
ccataaggcaaaaacaacct

SEQ ID NO: 537204 - DNA, 20 bp, Artificial
  CRISPR gRNA sequence
aacaacctaagttgttttca

SEQ ID NO: 537205 - DNA, 20 bp, Artificial
  CRISPR gRNA sequence
aacctaagttgttttcacag

SEQ ID NO: 537206 - DNA, 20 bp, Artificial
  CRISPR gRNA sequence
cttgttttcacaaaaaactg

SEQ ID NO: 537207 - DNA, 20 bp, Artificial
  CRISPR gRNA sequence
aaaaactgtggtatgttcac

SEQ ID NO: 537208 - DNA, 20 bp, Artificial
  CRISPR gRNA sequence
aaaactgtggtatgttcaca

SEQ ID NO: 537209 - DNA, 20 bp, Artificial
  CRISPR gRNA sequence
ttcacaaggtaaactctatc

SEQ ID NO: 537210 - DNA, 20 bp, Artificial
  CRISPR gRNA sequence
agctattgaaaatccaaaat

SEQ ID NO: 537211 - DNA, 20 bp, Artificial
  CRISPR gRNA sequence
ctattgaaaatccaaaatca

SEQ ID NO: 537212 - DNA, 20 bp, Artificial
  CRISPR gRNA sequence
gagtacacaatgcactgcta

SEQ ID NO: 537213 - DNA, 20 bp, Artificial
  CRISPR gRNA sequence
agtacacaatgcactgctaa

SEQ ID NO: 537214 - DNA, 20 bp, Artificial
  CRISPR gRNA sequence
acaatgcactgctaaaggat

SEQ ID NO: 537215 - DNA, 20 bp, Artificial
  CRISPR gRNA sequence
caatgcactgctaaaggatt

SEQ ID NO: 537216 - DNA, 20 bp, Artificial
  CRISPR gRNA sequence
aatgcactgctaaaggattg

SEQ ID NO: 537217 - DNA, 20 bp, Artificial
  CRISPR gRNA sequence
tgcactgctaaaggattggg

SEQ ID NO: 537218 - DNA, 20 bp, Artificial
  CRISPR gRNA sequence
gcactgctaaaggattgggg

SEQ ID NO: 537219 - DNA, 20 bp, Artificial
  CRISPR gRNA sequence
cactgctaaaggattgggga

SEQ ID NO: 537220 - DNA, 20 bp, Artificial
  CRISPR gRNA sequence
actgctaaaggattggggag

SEQ ID NO: 537221 - DNA, 20 bp, Artificial
  CRISPR gRNA sequence
aggattggggaggggtcact

SEQ ID NO: 537222 - DNA, 20 bp, Artificial
  CRISPR gRNA sequence
cactaagaacaaatgtgaca

SEQ ID NO: 537223 - DNA, 20 bp, Artificial
  CRISPR gRNA sequence
gaacaaatgtgacatggata

SEQ ID NO: 537224 - DNA, 20 bp, Artificial
  CRISPR gRNA sequence
aacaaatgtgacatggatat

SEQ ID NO: 537225 - DNA, 20 bp, Artificial
  CRISPR gRNA sequence
aatgtgacatggatatggga

SEQ ID NO: 537226 - DNA, 20 bp, Artificial
  CRISPR gRNA sequence
atgtgacatggatatgggaa

SEQ ID NO: 537227 - DNA, 20 bp, Artificial
  CRISPR gRNA sequence
tgacatggatatgggaaagg

SEQ ID NO: 537228 - DNA, 20 bp, Artificial
  CRISPR gRNA sequence
gacatggatatgggaaagga

SEQ ID NO: 537229 - DNA, 20 bp, Artificial
  CRISPR gRNA sequence
acatggatatgggaaaggaa

SEQ ID NO: 537230 - DNA, 20 bp, Artificial
  CRISPR gRNA sequence
ggatatgggaaaggaaggga

SEQ ID NO: 537231 - DNA, 20 bp, Artificial
  CRISPR gRNA sequence
gatatgggaaaggaagggaa

SEQ ID NO: 537232 - DNA, 20 bp, Artificial
  CRISPR gRNA sequence
atgggaaaggaagggaaagg

SEQ ID NO: 537233 - DNA, 20 bp, Artificial
  CRISPR gRNA sequence
tgggaaaggaagggaaagga

SEQ ID NO: 537234 - DNA, 20 bp, Artificial
  CRISPR gRNA sequence
gggaaaggaagggaaaggaa

SEQ ID NO: 537235 - DNA, 20 bp, Artificial
  CRISPR gRNA sequence
gaaaggaagggaaaggaagg

SEQ ID NO: 537236 - DNA, 20 bp, Artificial
  CRISPR gRNA sequence
aaggaagggaaaggaaggga

SEQ ID NO: 537237 - DNA, 20 bp, Artificial
  CRISPR gRNA sequence
aggaagggaaaggaagggag

SEQ ID NO: 537238 - DNA, 20 bp, Artificial
  CRISPR gRNA sequence
gaagggaaaggaagggagag

SEQ ID NO: 537239 - DNA, 20 bp, Artificial
  CRISPR gRNA sequence
aagggaaaggaagggagagg

SEQ ID NO: 537240 - DNA, 20 bp, Artificial
  CRISPR gRNA sequence
ggaaaggaagggagaggagg

SEQ ID NO: 537241 - DNA, 20 bp, Artificial
  CRISPR gRNA sequence
aaaggaagggagaggaggaa

SEQ ID NO: 537242 - DNA, 20 bp, Artificial
  CRISPR gRNA sequence
aggaagggagaggaggaaga

SEQ ID NO: 537243 - DNA, 20 bp, Artificial
  CRISPR gRNA sequence
gaagggagaggaggaagaga

SEQ ID NO: 537244 - DNA, 20 bp, Artificial
  CRISPR gRNA sequence
agggagaggaggaagagaga

SEQ ID NO: 537245 - DNA, 20 bp, Artificial
  CRISPR gRNA sequence
gagaaaatgaatgaataaat

SEQ ID NO: 537246 - DNA, 20 bp, Artificial
  CRISPR gRNA sequence
atgaatgaataaatgagaat

SEQ ID NO: 537247 - DNA, 20 bp, Artificial
  CRISPR gRNA sequence
tgaatgaataaatgagaata

SEQ ID NO: 537248 - DNA, 20 bp, Artificial
  CRISPR gRNA sequence
tgatcacactttccttttat

SEQ ID NO: 537249 - DNA, 20 bp, Artificial
  CRISPR gRNA sequence
gatcacactttccttttatt

SEQ ID NO: 537250 - DNA, 20 bp, Artificial
  CRISPR gRNA sequence
ctttccttttattaggaaca

SEQ ID NO: 537251 - DNA, 20 bp, Artificial
  CRISPR gRNA sequence
tttccttttattaggaacac

SEQ ID NO: 537252 - DNA, 20 bp, Artificial
  CRISPR gRNA sequence
tattaggaacacaggtgtgt

SEQ ID NO: 537253 - DNA, 20 bp, Artificial
  CRISPR gRNA sequence
ttaggaacacaggtgtgttg

SEQ ID NO: 537254 - DNA, 20 bp, Artificial
  CRISPR gRNA sequence
cacaggtgtgttggagcaaa

SEQ ID NO: 537255 - DNA, 20 bp, Artificial
  CRISPR gRNA sequence
acaggtgtgttggagcaaat

SEQ ID NO: 537256 - DNA, 20 bp, Artificial
  CRISPR gRNA sequence
ggtgtgttggagcaaatagg

SEQ ID NO: 537257 - DNA, 20 bp, Artificial
  CRISPR gRNA sequence
gcaaataggcagtcacctat

SEQ ID NO: 537258 - DNA, 20 bp, Artificial
  CRISPR gRNA sequence
ataggcagtcacctattggt

SEQ ID NO: 537259 - DNA, 20 bp, Artificial
  CRISPR gRNA sequence
gtcacctattggtcagattt

SEQ ID NO: 537260 - DNA, 20 bp, Artificial
  CRISPR gRNA sequence
acctattggtcagatttgag

SEQ ID NO: 537261 - DNA, 20 bp, Artificial
  CRISPR gRNA sequence
ggtcagatttgagaagaccc

SEQ ID NO: 537262 - DNA, 20 bp, Artificial
  CRISPR gRNA sequence
agatttgagaagaccctggc

SEQ ID NO: 537263 - DNA, 20 bp, Artificial
  CRISPR gRNA sequence
agaccctggccagaaactgc

SEQ ID NO: 537264 - DNA, 20 bp, Artificial
  CRISPR gRNA sequence
gaccctggccagaaactgct

SEQ ID NO: 537265 - DNA, 20 bp, Artificial
  CRISPR gRNA sequence
gaacatcattttcccttctt

SEQ ID NO: 537266 - DNA, 20 bp, Artificial
  CRISPR gRNA sequence
catcattttcccttctttag

SEQ ID NO: 537267 - DNA, 20 bp, Artificial
  CRISPR gRNA sequence
ccttctttagtagcaaaatt

SEQ ID NO: 537268 - DNA, 20 bp, Artificial
  CRISPR gRNA sequence
agcaaaattcagatattcct

SEQ ID NO: 537269 - DNA, 20 bp, Artificial
  CRISPR gRNA sequence
ccttggcaataatactcccc

SEQ ID NO: 537270 - DNA, 20 bp, Artificial
  CRISPR gRNA sequence
tggcaataatactccccaag

SEQ ID NO: 537271 - DNA, 20 bp, Artificial
  CRISPR gRNA sequence
tagtgtttgtatacttccct

SEQ ID NO: 537272 - DNA, 20 bp, Artificial
  CRISPR gRNA sequence
agtgtttgtatacttccctt

SEQ ID NO: 537273 - DNA, 20 bp, Artificial
  CRISPR gRNA sequence
gtttgtatacttcccttagg

SEQ ID NO: 537274 - DNA, 20 bp, Artificial
  CRISPR gRNA sequence
cttaggtggcatacgatgcc

SEQ ID NO: 537275 - DNA, 20 bp, Artificial
  CRISPR gRNA sequence
tgcttttcttttcatgatgt

SEQ ID NO: 537276 - DNA, 20 bp, Artificial
  CRISPR gRNA sequence
tcatgatgtcagtgccactg

SEQ ID NO: 537277 - DNA, 20 bp, Artificial
  CRISPR gRNA sequence
tgccactgaagatcattgtc

SEQ ID NO: 537278 - DNA, 20 bp, Artificial
  CRISPR gRNA sequence
ccactgaagatcattgtcta

SEQ ID NO: 537279 - DNA, 20 bp, Artificial
  CRISPR gRNA sequence
agatcattgtctagagccat

SEQ ID NO: 537280 - DNA, 20 bp, Artificial
  CRISPR gRNA sequence
tctagagccataagttcatc

SEQ ID NO: 537281 - DNA, 20 bp, Artificial
  CRISPR gRNA sequence
ctagagccataagttcatca

SEQ ID NO: 537282 - DNA, 20 bp, Artificial
  CRISPR gRNA sequence
tagagccataagttcatcaa

SEQ ID NO: 537283 - DNA, 20 bp, Artificial
  CRISPR gRNA sequence
aagttcatcaagggtttgca

SEQ ID NO: 537284 - DNA, 20 bp, Artificial
  CRISPR gRNA sequence
ttcatcaagggtttgcaaag

SEQ ID NO: 537285 - DNA, 20 bp, Artificial
  CRISPR gRNA sequence
caagggtttgcaaagtggtt

SEQ ID NO: 537286 - DNA, 20 bp, Artificial
  CRISPR gRNA sequence
ctaactacaatcttcacata

SEQ ID NO: 537287 - DNA, 20 bp, Artificial
  CRISPR gRNA sequence
actgcccctcatcaacaatg

SEQ ID NO: 537288 - DNA, 20 bp, Artificial
  CRISPR gRNA sequence
atcaacaatgtggttactct

SEQ ID NO: 537289 - DNA, 20 bp, Artificial
  CRISPR gRNA sequence
tcaacaatgtggttactctg

SEQ ID NO: 537290 - DNA, 20 bp, Artificial
  CRISPR gRNA sequence
actctgaggttcaatttata

SEQ ID NO: 537291 - DNA, 20 bp, Artificial
  CRISPR gRNA sequence
ctctgaggttcaatttatat

SEQ ID NO: 537292 - DNA, 20 bp, Artificial
  CRISPR gRNA sequence
aggttcaatttatataggaa

SEQ ID NO: 537293 - DNA, 20 bp, Artificial
  CRISPR gRNA sequence
ttcaatttatataggaaaag

SEQ ID NO: 537294 - DNA, 20 bp, Artificial
  CRISPR gRNA sequence
ttatcgtttttcaaaataat

SEQ ID NO: 537295 - DNA, 20 bp, Artificial
  CRISPR gRNA sequence
cgtttttcaaaataatgagt

SEQ ID NO: 537296 - DNA, 20 bp, Artificial
  CRISPR gRNA sequence
aaaataatgagttagctccc

SEQ ID NO: 537297 - DNA, 20 bp, Artificial
  CRISPR gRNA sequence
gttagctcccaagcattctc

SEQ ID NO: 537298 - DNA, 20 bp, Artificial
  CRISPR gRNA sequence
tagctcccaagcattctcta

SEQ ID NO: 537299 - DNA, 20 bp, Artificial
  CRISPR gRNA sequence
aagcattctctagagatgac

SEQ ID NO: 537300 - DNA, 20 bp, Artificial
  CRISPR gRNA sequence
attctctagagatgaccagt

SEQ ID NO: 537301 - DNA, 20 bp, Artificial
  CRISPR gRNA sequence
tgagtttttaaatttgtttt

SEQ ID NO: 537302 - DNA, 20 bp, Artificial
  CRISPR gRNA sequence
acattatgaacgcatgaact

SEQ ID NO: 537303 - DNA, 20 bp, Artificial
  CRISPR gRNA sequence
tgatgtgtttcaatctactg

SEQ ID NO: 537304 - DNA, 20 bp, Artificial
  CRISPR gRNA sequence
tgttccaattgtcttatttt

SEQ ID NO: 537305 - DNA, 20 bp, Artificial
  CRISPR gRNA sequence
ccaattgtcttatttttggc

SEQ ID NO: 537306 - DNA, 20 bp, Artificial
  CRISPR gRNA sequence
aattgtcttatttttggcca

SEQ ID NO: 537307 - DNA, 20 bp, Artificial
  CRISPR gRNA sequence
attgtcttatttttggccag

SEQ ID NO: 537308 - DNA, 20 bp, Artificial
  CRISPR gRNA sequence
ttgtcttatttttggccaga

SEQ ID NO: 537309 - DNA, 20 bp, Artificial
  CRISPR gRNA sequence
ttggccagagggaacctctt

SEQ ID NO: 537310 - DNA, 20 bp, Artificial
  CRISPR gRNA sequence
ggccagagggaacctcttca

SEQ ID NO: 537311 - DNA, 20 bp, Artificial
  CRISPR gRNA sequence
cagagggaacctcttcagag

SEQ ID NO: 537312 - DNA, 20 bp, Artificial
  CRISPR gRNA sequence
acctcttcagagtggctcct

SEQ ID NO: 537313 - DNA, 20 bp, Artificial
  CRISPR gRNA sequence
cctgttcgtaccatcatgtt

SEQ ID NO: 537314 - DNA, 20 bp, Artificial
  CRISPR gRNA sequence
atcatgttaagtctttttga

SEQ ID NO: 537315 - DNA, 20 bp, Artificial
  CRISPR gRNA sequence
ttgatagctttcttgttctg

SEQ ID NO: 537316 - DNA, 20 bp, Artificial
  CRISPR gRNA sequence
ttcttgttctgtggtaaaat

SEQ ID NO: 537317 - DNA, 20 bp, Artificial
  CRISPR gRNA sequence
tgtggtaaaataagatactc

SEQ ID NO: 537318 - DNA, 20 bp, Artificial
  CRISPR gRNA sequence
gtggtaaaataagatactca

SEQ ID NO: 537319 - DNA, 20 bp, Artificial
  CRISPR gRNA sequence
ttttaatgcattccatgccc

SEQ ID NO: 537320 - DNA, 20 bp, Artificial
  CRISPR gRNA sequence
tttaatgcattccatgcccc

SEQ ID NO: 537321 - DNA, 20 bp, Artificial
  CRISPR gRNA sequence
tgcattccatgccccaggta

SEQ ID NO: 537322 - DNA, 20 bp, Artificial
  CRISPR gRNA sequence
ccatgccccaggtatggaat

SEQ ID NO: 537323 - DNA, 20 bp, Artificial
  CRISPR gRNA sequence
ggaatcagccaactgtccca

SEQ ID NO: 537324 - DNA, 20 bp, Artificial
  CRISPR gRNA sequence
gaatcagccaactgtcccaa

SEQ ID NO: 537325 - DNA, 20 bp, Artificial
  CRISPR gRNA sequence
gccaactgtcccaaaggccc

SEQ ID NO: 537326 - DNA, 20 bp, Artificial
  CRISPR gRNA sequence
aaggccctagttcattttca

SEQ ID NO: 537327 - DNA, 20 bp, Artificial
  CRISPR gRNA sequence
aggccctagttcattttcat

SEQ ID NO: 537328 - DNA, 20 bp, Artificial
  CRISPR gRNA sequence
ttttcatgggaaatgataat

SEQ ID NO: 537329 - DNA, 20 bp, Artificial
  CRISPR gRNA sequence
tttcatgggaaatgataatt

SEQ ID NO: 537330 - DNA, 20 bp, Artificial
  CRISPR gRNA sequence
gataattaggtaccataatc

SEQ ID NO: 537331 - DNA, 20 bp, Artificial
  CRISPR gRNA sequence
ataattaggtaccataatct

SEQ ID NO: 537332 - DNA, 20 bp, Artificial
  CRISPR gRNA sequence
taggtaccataatctgggtg

SEQ ID NO: 537333 - DNA, 20 bp, Artificial
  CRISPR gRNA sequence
aggtaccataatctgggtga

SEQ ID NO: 537334 - DNA, 20 bp, Artificial
  CRISPR gRNA sequence
taccataatctgggtgaagg

SEQ ID NO: 537335 - DNA, 20 bp, Artificial
  CRISPR gRNA sequence
gtgaaggtggccaatcatcc

SEQ ID NO: 537336 - DNA, 20 bp, Artificial
  CRISPR gRNA sequence
tcctggttttcctgaaactg

SEQ ID NO: 537337 - DNA, 20 bp, Artificial
  CRISPR gRNA sequence
ctggttttcctgaaactgaa

SEQ ID NO: 537338 - DNA, 20 bp, Artificial
  CRISPR gRNA sequence
cctgaaactgaagagtttcc

SEQ ID NO: 537339 - DNA, 20 bp, Artificial
  CRISPR gRNA sequence
ctgaaactgaagagtttcct

SEQ ID NO: 537340 - DNA, 20 bp, Artificial
  CRISPR gRNA sequence
gtttcctgggatatgaaatt

SEQ ID NO: 537341 - DNA, 20 bp, Artificial
  CRISPR gRNA sequence
tttcctgggatatgaaattc

SEQ ID NO: 537342 - DNA, 20 bp, Artificial
  CRISPR gRNA sequence
tgaaattcgggtgctgaaac

SEQ ID NO: 537343 - DNA, 20 bp, Artificial
  CRISPR gRNA sequence
gaaattcgggtgctgaaact

SEQ ID NO: 537344 - DNA, 20 bp, Artificial
  CRISPR gRNA sequence
attcgggtgctgaaactggg

SEQ ID NO: 537345 - DNA, 20 bp, Artificial
  CRISPR gRNA sequence
ggtgctgaaactgggaagtc

SEQ ID NO: 537346 - DNA, 20 bp, Artificial
  CRISPR gRNA sequence
gtgctgaaactgggaagtct

SEQ ID NO: 537347 - DNA, 20 bp, Artificial
  CRISPR gRNA sequence
actgggaagtctgggcacac

SEQ ID NO: 537348 - DNA, 20 bp, Artificial
  CRISPR gRNA sequence
ctgggaagtctgggcacacc

SEQ ID NO: 537349 - DNA, 20 bp, Artificial
  CRISPR gRNA sequence
ctgggcacaccaggtaacac

SEQ ID NO: 537350 - DNA, 20 bp, Artificial
  CRISPR gRNA sequence
taacactggtcactcaaatc

SEQ ID NO: 537351 - DNA, 20 bp, Artificial
  CRISPR gRNA sequence
aacactggtcactcaaatct

SEQ ID NO: 537352 - DNA, 20 bp, Artificial
  CRISPR gRNA sequence
ggtcactcaaatctgggtcc

SEQ ID NO: 537353 - DNA, 20 bp, Artificial
  CRISPR gRNA sequence
caaatctgggtccaagaacc

SEQ ID NO: 537354 - DNA, 20 bp, Artificial
  CRISPR gRNA sequence
atctgggtccaagaaccaag

SEQ ID NO: 537355 - DNA, 20 bp, Artificial
  CRISPR gRNA sequence
aagaagcatgcaaattgcta

SEQ ID NO: 537356 - DNA, 20 bp, Artificial
  CRISPR gRNA sequence
agaagcatgcaaattgctac

SEQ ID NO: 537357 - DNA, 20 bp, Artificial
  CRISPR gRNA sequence
catgcaaattgctacaggac

SEQ ID NO: 537358 - DNA, 20 bp, Artificial
  CRISPR gRNA sequence
acaggactggctcttgtttc

SEQ ID NO: 537359 - DNA, 20 bp, Artificial
  CRISPR gRNA sequence
ttgtttctagaacatttcaa

SEQ ID NO: 537360 - DNA, 20 bp, Artificial
  CRISPR gRNA sequence
ttctagaacatttcaatgga

SEQ ID NO: 537361 - DNA, 20 bp, Artificial
  CRISPR gRNA sequence
aacatttcaatggacagaac

SEQ ID NO: 537362 - DNA, 20 bp, Artificial
  CRISPR gRNA sequence
acatttcaatggacagaacc

SEQ ID NO: 537363 - DNA, 20 bp, Artificial
  CRISPR gRNA sequence
caggaaatacacaattttct

SEQ ID NO: 537364 - DNA, 20 bp, Artificial
  CRISPR gRNA sequence
ggaaatacacaattttctaa

SEQ ID NO: 537365 - DNA, 20 bp, Artificial
  CRISPR gRNA sequence
taagagacaaaatacattaa

SEQ ID NO: 537366 - DNA, 20 bp, Artificial
  CRISPR gRNA sequence
aagagacaaaatacattaat

SEQ ID NO: 537367 - DNA, 20 bp, Artificial
  CRISPR gRNA sequence
aatacattaatgggtcatgc

SEQ ID NO: 537368 - DNA, 20 bp, Artificial
  CRISPR gRNA sequence
gcattatgctgaaccctatt

SEQ ID NO: 537369 - DNA, 20 bp, Artificial
  CRISPR gRNA sequence
ctgaaccctattaagctgcc

SEQ ID NO: 537370 - DNA, 20 bp, Artificial
  CRISPR gRNA sequence
attaagctgccaagattcaa

SEQ ID NO: 537371 - DNA, 20 bp, Artificial
  CRISPR gRNA sequence
aagattcaatggtttttgac

SEQ ID NO: 537372 - DNA, 20 bp, Artificial
  CRISPR gRNA sequence
gattcaatggtttttgacta

SEQ ID NO: 537373 - DNA, 20 bp, Artificial
  CRISPR gRNA sequence
atggtttttgactagagaaa

SEQ ID NO: 537374 - DNA, 20 bp, Artificial
  CRISPR gRNA sequence
agagaaacagcaatttcata

SEQ ID NO: 537375 - DNA, 20 bp, Artificial
  CRISPR gRNA sequence
ttaatacctttaaataaatc

SEQ ID NO: 537376 - DNA, 20 bp, Artificial
  CRISPR gRNA sequence
taatacctttaaataaatcc

SEQ ID NO: 537377 - DNA, 20 bp, Artificial
  CRISPR gRNA sequence
aatacctttaaataaatcca

SEQ ID NO: 537378 - DNA, 20 bp, Artificial
  CRISPR gRNA sequence
tacttaacctaatcaattta

SEQ ID NO: 537379 - DNA, 20 bp, Artificial
  CRISPR gRNA sequence
ttcctgcaatacatactcaa

SEQ ID NO: 537380 - DNA, 20 bp, Artificial
  CRISPR gRNA sequence
actcaacagtaaccaaatac

SEQ ID NO: 537381 - DNA, 20 bp, Artificial
  CRISPR gRNA sequence
cattacaatttttttcttta

SEQ ID NO: 537382 - DNA, 20 bp, Artificial
  CRISPR gRNA sequence
tttatagttctttttatcct

SEQ ID NO: 537383 - DNA, 20 bp, Artificial
  CRISPR gRNA sequence
ttctttttatccttagaatg

SEQ ID NO: 537384 - DNA, 20 bp, Artificial
  CRISPR gRNA sequence
tactatgttttgaaaacact

SEQ ID NO: 537385 - DNA, 20 bp, Artificial
  CRISPR gRNA sequence
tgttttgaaaacacttggaa

SEQ ID NO: 537386 - DNA, 20 bp, Artificial
  CRISPR gRNA sequence
cttggaatggttcctctatt

SEQ ID NO: 537387 - DNA, 20 bp, Artificial
  CRISPR gRNA sequence
ttggaatggttcctctattt

SEQ ID NO: 537388 - DNA, 20 bp, Artificial
  CRISPR gRNA sequence
tggaatggttcctctatttg

SEQ ID NO: 537389 - DNA, 20 bp, Artificial
  CRISPR gRNA sequence
tattccacaaacttgattca

SEQ ID NO: 537390 - DNA, 20 bp, Artificial
  CRISPR gRNA sequence
cacaaacttgattcatggct

SEQ ID NO: 537391 - DNA, 20 bp, Artificial
  CRISPR gRNA sequence
aacttgattcatggcttagt

SEQ ID NO: 537392 - DNA, 20 bp, Artificial
  CRISPR gRNA sequence
tgattcatggcttagtaagt

SEQ ID NO: 537393 - DNA, 20 bp, Artificial
  CRISPR gRNA sequence
cttagtaagttagcttcact

SEQ ID NO: 537394 - DNA, 20 bp, Artificial
  CRISPR gRNA sequence
cacttggctttaaatatttt

SEQ ID NO: 537395 - DNA, 20 bp, Artificial
  CRISPR gRNA sequence
gctttaaatattttgagttt

SEQ ID NO: 537396 - DNA, 20 bp, Artificial
  CRISPR gRNA sequence
ctttaaatattttgagtttc

SEQ ID NO: 537397 - DNA, 20 bp, Artificial
  CRISPR gRNA sequence
ttcaggttcacaacaaaact

SEQ ID NO: 537398 - DNA, 20 bp, Artificial
  CRISPR gRNA sequence
aggttcacaacaaaactgag

SEQ ID NO: 537399 - DNA, 20 bp, Artificial
  CRISPR gRNA sequence
ttcacaacaaaactgagcag

SEQ ID NO: 537400 - DNA, 20 bp, Artificial
  CRISPR gRNA sequence
acaaaactgagcagaagtta

SEQ ID NO: 537401 - DNA, 20 bp, Artificial
  CRISPR gRNA sequence
aactgagcagaagttacaga

SEQ ID NO: 537402 - DNA, 20 bp, Artificial
  CRISPR gRNA sequence
atcctgcccctacacatgca

SEQ ID NO: 537403 - DNA, 20 bp, Artificial
  CRISPR gRNA sequence
ccattatcaatatccctcac

SEQ ID NO: 537404 - DNA, 20 bp, Artificial
  CRISPR gRNA sequence
attatcaatatccctcacca

SEQ ID NO: 537405 - DNA, 20 bp, Artificial
  CRISPR gRNA sequence
atcaatatccctcaccagag

SEQ ID NO: 537406 - DNA, 20 bp, Artificial
  CRISPR gRNA sequence
caccagagtggtacattttt

SEQ ID NO: 537407 - DNA, 20 bp, Artificial
  CRISPR gRNA sequence
aaaaaatccacactttacat

SEQ ID NO: 537408 - DNA, 20 bp, Artificial
  CRISPR gRNA sequence
ccacactttacattagcatt

SEQ ID NO: 537409 - DNA, 20 bp, Artificial
  CRISPR gRNA sequence
gcattcagttgtacattctg

SEQ ID NO: 537410 - DNA, 20 bp, Artificial
  CRISPR gRNA sequence
cattcagttgtacattctgt

SEQ ID NO: 537411 - DNA, 20 bp, Artificial
  CRISPR gRNA sequence
agttgtacattctgtgggtt

SEQ ID NO: 537412 - DNA, 20 bp, Artificial
  CRISPR gRNA sequence
aatgtataataacatcgtta

SEQ ID NO: 537413 - DNA, 20 bp, Artificial
  CRISPR gRNA sequence
aacatcgttacagtatcata

SEQ ID NO: 537414 - DNA, 20 bp, Artificial
  CRISPR gRNA sequence
catcgttacagtatcataca

SEQ ID NO: 537415 - DNA, 20 bp, Artificial
  CRISPR gRNA sequence
gccaactactaatcttttta

SEQ ID NO: 537416 - DNA, 20 bp, Artificial
  CRISPR gRNA sequence
taatctttttacagtctcca

SEQ ID NO: 537417 - DNA, 20 bp, Artificial
  CRISPR gRNA sequence
ctccacagttttgccttttc

SEQ ID NO: 537418 - DNA, 20 bp, Artificial
  CRISPR gRNA sequence
gccttttccagaatgtcaca

SEQ ID NO: 537419 - DNA, 20 bp, Artificial
  CRISPR gRNA sequence
ccttttccagaatgtcacat

SEQ ID NO: 537420 - DNA, 20 bp, Artificial
  CRISPR gRNA sequence
tcacataggtaaaatttgca

SEQ ID NO: 537421 - DNA, 20 bp, Artificial
  CRISPR gRNA sequence
ggtaaaatttgcatagcatg

SEQ ID NO: 537422 - DNA, 20 bp, Artificial
  CRISPR gRNA sequence
tgcatagcatgtagcctgtt

SEQ ID NO: 537423 - DNA, 20 bp, Artificial
  CRISPR gRNA sequence
agcatgtagcctgttcagat

SEQ ID NO: 537424 - DNA, 20 bp, Artificial
  CRISPR gRNA sequence
ttgacttataatatgcattt

SEQ ID NO: 537425 - DNA, 20 bp, Artificial
  CRISPR gRNA sequence
gtttcctccatgtcttttca

SEQ ID NO: 537426 - DNA, 20 bp, Artificial
  CRISPR gRNA sequence
catgtcttttcatggcttga

SEQ ID NO: 537427 - DNA, 20 bp, Artificial
  CRISPR gRNA sequence
catggcttgatagttctttt

SEQ ID NO: 537428 - DNA, 20 bp, Artificial
  CRISPR gRNA sequence
tctattgtctgtatgtacca

SEQ ID NO: 537429 - DNA, 20 bp, Artificial
  CRISPR gRNA sequence
atttgtccattcacttactg

SEQ ID NO: 537430 - DNA, 20 bp, Artificial
  CRISPR gRNA sequence
tttgtccattcacttactga

SEQ ID NO: 537431 - DNA, 20 bp, Artificial
  CRISPR gRNA sequence
tcacttactgaaggacatct

SEQ ID NO: 537432 - DNA, 20 bp, Artificial
  CRISPR gRNA sequence
aggacatcttggttgcttcc

SEQ ID NO: 537433 - DNA, 20 bp, Artificial
  CRISPR gRNA sequence
agttttgacaattattaata

SEQ ID NO: 537434 - DNA, 20 bp, Artificial
  CRISPR gRNA sequence
atgctataaccatccatgtg

SEQ ID NO: 537435 - DNA, 20 bp, Artificial
  CRISPR gRNA sequence
tgctataaccatccatgtga

SEQ ID NO: 537436 - DNA, 20 bp, Artificial
  CRISPR gRNA sequence
gaaggtttttatgtcaacat

SEQ ID NO: 537437 - DNA, 20 bp, Artificial
  CRISPR gRNA sequence
acataagtttttaatgcctt

SEQ ID NO: 537438 - DNA, 20 bp, Artificial
  CRISPR gRNA sequence
cataagtttttaatgccttc

SEQ ID NO: 537439 - DNA, 20 bp, Artificial
  CRISPR gRNA sequence
ttttaatgccttcgggtaaa

SEQ ID NO: 537440 - DNA, 20 bp, Artificial
  CRISPR gRNA sequence
aatgccttcgggtaaatagc

SEQ ID NO: 537441 - DNA, 20 bp, Artificial
  CRISPR gRNA sequence
gccttcgggtaaatagcaag

SEQ ID NO: 537442 - DNA, 20 bp, Artificial
  CRISPR gRNA sequence
gtaaatagcaagaagcatga

SEQ ID NO: 537443 - DNA, 20 bp, Artificial
  CRISPR gRNA sequence
agcatgacagttgtgttgaa

SEQ ID NO: 537444 - DNA, 20 bp, Artificial
  CRISPR gRNA sequence
tgacagttgtgttgaatggt

SEQ ID NO: 537445 - DNA, 20 bp, Artificial
  CRISPR gRNA sequence
acagttgtgttgaatggtaa

SEQ ID NO: 537446 - DNA, 20 bp, Artificial
  CRISPR gRNA sequence
ttgaatggtaagagtacata

SEQ ID NO: 537447 - DNA, 20 bp, Artificial
  CRISPR gRNA sequence
aagagtacatacagttttgt

SEQ ID NO: 537448 - DNA, 20 bp, Artificial
  CRISPR gRNA sequence
aactgccaaactgtcttcca

SEQ ID NO: 537449 - DNA, 20 bp, Artificial
  CRISPR gRNA sequence
tgccaaactgtcttccaaag

SEQ ID NO: 537450 - DNA, 20 bp, Artificial
  CRISPR gRNA sequence
cattcccacctgcaatgaat

SEQ ID NO: 537451 - DNA, 20 bp, Artificial
  CRISPR gRNA sequence
ttcccacctgcaatgaatga

SEQ ID NO: 537452 - DNA, 20 bp, Artificial
  CRISPR gRNA sequence
gagttgctccacatcctcac

SEQ ID NO: 537453 - DNA, 20 bp, Artificial
  CRISPR gRNA sequence
tccacatcctcactggcatt

SEQ ID NO: 537454 - DNA, 20 bp, Artificial
  CRISPR gRNA sequence
tcactggcatttggtgctgt

SEQ ID NO: 537455 - DNA, 20 bp, Artificial
  CRISPR gRNA sequence
atttggtgctgtcagtgttc

SEQ ID NO: 537456 - DNA, 20 bp, Artificial
  CRISPR gRNA sequence
gctgtcagtgttctagattt

SEQ ID NO: 537457 - DNA, 20 bp, Artificial
  CRISPR gRNA sequence
tcagtgttctagattttggc

SEQ ID NO: 537458 - DNA, 20 bp, Artificial
  CRISPR gRNA sequence
ctagattttggccagtgtga

SEQ ID NO: 537459 - DNA, 20 bp, Artificial
  CRISPR gRNA sequence
tagattttggccagtgtgat

SEQ ID NO: 537460 - DNA, 20 bp, Artificial
  CRISPR gRNA sequence
tggccagtgtgataggcgtg

SEQ ID NO: 537461 - DNA, 20 bp, Artificial
  CRISPR gRNA sequence
ccagtgtgataggcgtgaag

SEQ ID NO: 537462 - DNA, 20 bp, Artificial
  CRISPR gRNA sequence
gtggtatttcattgttgtct

SEQ ID NO: 537463 - DNA, 20 bp, Artificial
  CRISPR gRNA sequence
ttccctgttgcctgttgaca

SEQ ID NO: 537464 - DNA, 20 bp, Artificial
  CRISPR gRNA sequence
tccctgttgcctgttgacat

SEQ ID NO: 537465 - DNA, 20 bp, Artificial
  CRISPR gRNA sequence
ctgttgacataggacatgcc

SEQ ID NO: 537466 - DNA, 20 bp, Artificial
  CRISPR gRNA sequence
atttttgtatttttacaaaa

SEQ ID NO: 537467 - DNA, 20 bp, Artificial
  CRISPR gRNA sequence
tatttttacaaaatagaaaa

SEQ ID NO: 537468 - DNA, 20 bp, Artificial
  CRISPR gRNA sequence
ttttacaaaatagaaaatag

SEQ ID NO: 537469 - DNA, 20 bp, Artificial
  CRISPR gRNA sequence
aaaatagaaaatagtagaaa

SEQ ID NO: 537470 - DNA, 20 bp, Artificial
  CRISPR gRNA sequence
aaatagaaaatagtagaaat

SEQ ID NO: 537471 - DNA, 20 bp, Artificial
  CRISPR gRNA sequence
aatagaaaatagtagaaatg

SEQ ID NO: 537472 - DNA, 20 bp, Artificial
  CRISPR gRNA sequence
gaaatggggtttccccatgt

SEQ ID NO: 537473 - DNA, 20 bp, Artificial
  CRISPR gRNA sequence
tggggtttccccatgttggc

SEQ ID NO: 537474 - DNA, 20 bp, Artificial
  CRISPR gRNA sequence
ggggtttccccatgttggcc

SEQ ID NO: 537475 - DNA, 20 bp, Artificial
  CRISPR gRNA sequence
tttccccatgttggccaggc

SEQ ID NO: 537476 - DNA, 20 bp, Artificial
  CRISPR gRNA sequence
tggtcttgaactcctgacct

SEQ ID NO: 537477 - DNA, 20 bp, Artificial
  CRISPR gRNA sequence
ggtcttgaactcctgacctc

SEQ ID NO: 537478 - DNA, 20 bp, Artificial
  CRISPR gRNA sequence
ctcaggtgatccgcctgcct

SEQ ID NO: 537479 - DNA, 20 bp, Artificial
  CRISPR gRNA sequence
ccgcctgcctcggcctccca

SEQ ID NO: 537480 - DNA, 20 bp, Artificial
  CRISPR gRNA sequence
gcctcggcctcccaaagtgc

SEQ ID NO: 537481 - DNA, 20 bp, Artificial
  CRISPR gRNA sequence
cctcggcctcccaaagtgct

SEQ ID NO: 537482 - DNA, 20 bp, Artificial
  CRISPR gRNA sequence
ctcccaaagtgctgggatta

SEQ ID NO: 537483 - DNA, 20 bp, Artificial
  CRISPR gRNA sequence
tcccaaagtgctgggattac

SEQ ID NO: 537484 - DNA, 20 bp, Artificial
  CRISPR gRNA sequence
agtgctgggattacaggtgt

SEQ ID NO: 537485 - DNA, 20 bp, Artificial
  CRISPR gRNA sequence
caggtgtgagccaccgcacc

SEQ ID NO: 537486 - DNA, 20 bp, Artificial
  CRISPR gRNA sequence
gtgagccaccgcacccggcc

SEQ ID NO: 537487 - DNA, 20 bp, Artificial
  CRISPR gRNA sequence
tgagccaccgcacccggccc

SEQ ID NO: 537488 - DNA, 20 bp, Artificial
  CRISPR gRNA sequence
agccaccgcacccggcccag

SEQ ID NO: 537489 - DNA, 20 bp, Artificial
  CRISPR gRNA sequence
tgccatctgtataccttcct

SEQ ID NO: 537490 - DNA, 20 bp, Artificial
  CRISPR gRNA sequence
ccatctgtataccttccttg

SEQ ID NO: 537491 - DNA, 20 bp, Artificial
  CRISPR gRNA sequence
tctgtataccttccttggag

SEQ ID NO: 537492 - DNA, 20 bp, Artificial
  CRISPR gRNA sequence
tccttggagaagtgtgtgat

SEQ ID NO: 537493 - DNA, 20 bp, Artificial
  CRISPR gRNA sequence
tctttgactcattttttaat

SEQ ID NO: 537494 - DNA, 20 bp, Artificial
  CRISPR gRNA sequence
ctttgactcattttttaatt

SEQ ID NO: 537495 - DNA, 20 bp, Artificial
  CRISPR gRNA sequence
ttgtttgtgtttttcttgtt

SEQ ID NO: 537496 - DNA, 20 bp, Artificial
  CRISPR gRNA sequence
tttttcttgttgagttttaa

SEQ ID NO: 537497 - DNA, 20 bp, Artificial
  CRISPR gRNA sequence
taaaagttttttgtatattt

SEQ ID NO: 537498 - DNA, 20 bp, Artificial
  CRISPR gRNA sequence
tttttgtatattttggataa

SEQ ID NO: 537499 - DNA, 20 bp, Artificial
  CRISPR gRNA sequence
tttggataacagtcttttat

SEQ ID NO: 537500 - DNA, 20 bp, Artificial
  CRISPR gRNA sequence
cttttgcaaatattttctcc

SEQ ID NO: 537501 - DNA, 20 bp, Artificial
  CRISPR gRNA sequence
aaatattttctcccagtctg

SEQ ID NO: 537502 - DNA, 20 bp, Artificial
  CRISPR gRNA sequence
ttttctcccagtctgtggct

SEQ ID NO: 537503 - DNA, 20 bp, Artificial
  CRISPR gRNA sequence
tctcttgaaattgtctttca

SEQ ID NO: 537504 - DNA, 20 bp, Artificial
  CRISPR gRNA sequence
tcttgaaattgtctttcata

SEQ ID NO: 537505 - DNA, 20 bp, Artificial
  CRISPR gRNA sequence
caatgtttttaattttaatg

SEQ ID NO: 537506 - DNA, 20 bp, Artificial
  CRISPR gRNA sequence
tttttaattttaatgaagta

SEQ ID NO: 537507 - DNA, 20 bp, Artificial
  CRISPR gRNA sequence
tctttcatgaatcatgtctt

SEQ ID NO: 537508 - DNA, 20 bp, Artificial
  CRISPR gRNA sequence
tctttggtgttgtatctaaa

SEQ ID NO: 537509 - DNA, 20 bp, Artificial
  CRISPR gRNA sequence
ctaaaaagtcatcatatcca

SEQ ID NO: 537510 - DNA, 20 bp, Artificial
  CRISPR gRNA sequence
tcatcatatccaaagttatc

SEQ ID NO: 537511 - DNA, 20 bp, Artificial
  CRISPR gRNA sequence
catcatatccaaagttatct

SEQ ID NO: 537512 - DNA, 20 bp, Artificial
  CRISPR gRNA sequence
ctaggttttctcttatgttt

SEQ ID NO: 537513 - DNA, 20 bp, Artificial
  CRISPR gRNA sequence
taggttttctcttatgtttt

SEQ ID NO: 537514 - DNA, 20 bp, Artificial
  CRISPR gRNA sequence
ggttttctcttatgttttag

SEQ ID NO: 537515 - DNA, 20 bp, Artificial
  CRISPR gRNA sequence
cttatgttttaggagtctta

SEQ ID NO: 537516 - DNA, 20 bp, Artificial
  CRISPR gRNA sequence
atggttttgcattttacatt

SEQ ID NO: 537517 - DNA, 20 bp, Artificial
  CRISPR gRNA sequence
gcattttacatttagatcta

SEQ ID NO: 537518 - DNA, 20 bp, Artificial
  CRISPR gRNA sequence
ttagatctatggtccatttt

SEQ ID NO: 537519 - DNA, 20 bp, Artificial
  CRISPR gRNA sequence
attttgagtaaaattttgtg

SEQ ID NO: 537520 - DNA, 20 bp, Artificial
  CRISPR gRNA sequence
ttttgagtaaaattttgtga

SEQ ID NO: 537521 - DNA, 20 bp, Artificial
  CRISPR gRNA sequence
tttgagtaaaattttgtgaa

SEQ ID NO: 537522 - DNA, 20 bp, Artificial
  CRISPR gRNA sequence
taaaattttgtgaagggcat

SEQ ID NO: 537523 - DNA, 20 bp, Artificial
  CRISPR gRNA sequence
aaaattttgtgaagggcata

SEQ ID NO: 537524 - DNA, 20 bp, Artificial
  CRISPR gRNA sequence
aagggcataaggtctgtgtt

SEQ ID NO: 537525 - DNA, 20 bp, Artificial
  CRISPR gRNA sequence
tagattcatttttttgcatg

SEQ ID NO: 537526 - DNA, 20 bp, Artificial
  CRISPR gRNA sequence
tttttttgcatgtggatgtc

SEQ ID NO: 537527 - DNA, 20 bp, Artificial
  CRISPR gRNA sequence
atgtggatgtccagttgtta

SEQ ID NO: 537528 - DNA, 20 bp, Artificial
  CRISPR gRNA sequence
ttacagcactatttgttgaa

SEQ ID NO: 537529 - DNA, 20 bp, Artificial
  CRISPR gRNA sequence
ttgcctttgctcctttgtca

SEQ ID NO: 537530 - DNA, 20 bp, Artificial
  CRISPR gRNA sequence
tttgctcctttgtcaaagat

SEQ ID NO: 537531 - DNA, 20 bp, Artificial
  CRISPR gRNA sequence
tcagttgaccatatttatgt

SEQ ID NO: 537532 - DNA, 20 bp, Artificial
  CRISPR gRNA sequence
tatttatgttggtttatttc

SEQ ID NO: 537533 - DNA, 20 bp, Artificial
  CRISPR gRNA sequence
atttatgttggtttatttct

SEQ ID NO: 537534 - DNA, 20 bp, Artificial
  CRISPR gRNA sequence
tttgtcttttatttttccac

SEQ ID NO: 537535 - DNA, 20 bp, Artificial
  CRISPR gRNA sequence
ccacactatgttgactactg

SEQ ID NO: 537536 - DNA, 20 bp, Artificial
  CRISPR gRNA sequence
tgttgactactgtagcttta

SEQ ID NO: 537537 - DNA, 20 bp, Artificial
  CRISPR gRNA sequence
gactactgtagctttatagt

SEQ ID NO: 537538 - DNA, 20 bp, Artificial
  CRISPR gRNA sequence
tagctttatagtaagtcttg

SEQ ID NO: 537539 - DNA, 20 bp, Artificial
  CRISPR gRNA sequence
ttatagtaagtcttgaagtt

SEQ ID NO: 537540 - DNA, 20 bp, Artificial
  CRISPR gRNA sequence
tagtaagtcttgaagttgag

SEQ ID NO: 537541 - DNA, 20 bp, Artificial
  CRISPR gRNA sequence
gtcttgaagttgagtagtat

SEQ ID NO: 537542 - DNA, 20 bp, Artificial
  CRISPR gRNA sequence
gttctccttcaatattttgc

SEQ ID NO: 537543 - DNA, 20 bp, Artificial
  CRISPR gRNA sequence
caatattttgctggctattc

SEQ ID NO: 537544 - DNA, 20 bp, Artificial
  CRISPR gRNA sequence
tgcccatttaaccttaaaat

SEQ ID NO: 537545 - DNA, 20 bp, Artificial
  CRISPR gRNA sequence
atgacttctgatattttgct

SEQ ID NO: 537546 - DNA, 20 bp, Artificial
  CRISPR gRNA sequence
tgacttctgatattttgctt

SEQ ID NO: 537547 - DNA, 20 bp, Artificial
  CRISPR gRNA sequence
ttgggattgcactgaattta

SEQ ID NO: 537548 - DNA, 20 bp, Artificial
  CRISPR gRNA sequence
gggattgcactgaatttata

SEQ ID NO: 537549 - DNA, 20 bp, Artificial
  CRISPR gRNA sequence
actgaatttatagagtaaat

SEQ ID NO: 537550 - DNA, 20 bp, Artificial
  CRISPR gRNA sequence
ataactgacatcttcacaat

SEQ ID NO: 537551 - DNA, 20 bp, Artificial
  CRISPR gRNA sequence
taactgacatcttcacaata

SEQ ID NO: 537552 - DNA, 20 bp, Artificial
  CRISPR gRNA sequence
actgacatcttcacaataag

SEQ ID NO: 537553 - DNA, 20 bp, Artificial
  CRISPR gRNA sequence
agtcttcctatctatgaaca

SEQ ID NO: 537554 - DNA, 20 bp, Artificial
  CRISPR gRNA sequence
agaatatctctccatttatt

SEQ ID NO: 537555 - DNA, 20 bp, Artificial
  CRISPR gRNA sequence
tcttctttgattttgttcat

SEQ ID NO: 537556 - DNA, 20 bp, Artificial
  CRISPR gRNA sequence
ttgattttctcatataaatc

SEQ ID NO: 537557 - DNA, 20 bp, Artificial
  CRISPR gRNA sequence
tgattttctcatataaatct

SEQ ID NO: 537558 - DNA, 20 bp, Artificial
  CRISPR gRNA sequence
catattttgttattgtacct

SEQ ID NO: 537559 - DNA, 20 bp, Artificial
  CRISPR gRNA sequence
gtacctaagtattgcatttt

SEQ ID NO: 537560 - DNA, 20 bp, Artificial
  CRISPR gRNA sequence
tacctaagtattgcattttt

SEQ ID NO: 537561 - DNA, 20 bp, Artificial
  CRISPR gRNA sequence
acctaagtattgcatttttg

SEQ ID NO: 537562 - DNA, 20 bp, Artificial
  CRISPR gRNA sequence
tattgcatttttggggtgct

SEQ ID NO: 537563 - DNA, 20 bp, Artificial
  CRISPR gRNA sequence
attgcatttttggggtgcta

SEQ ID NO: 537564 - DNA, 20 bp, Artificial
  CRISPR gRNA sequence
ttttggggtgctaaggtaaa

SEQ ID NO: 537565 - DNA, 20 bp, Artificial
  CRISPR gRNA sequence
ccacttgttcattgctgtta

SEQ ID NO: 537566 - DNA, 20 bp, Artificial
  CRISPR gRNA sequence
tgttcattgctgttatagaa

SEQ ID NO: 537567 - DNA, 20 bp, Artificial
  CRISPR gRNA sequence
tgtatcctacaaatgtgcta

SEQ ID NO: 537568 - DNA, 20 bp, Artificial
  CRISPR gRNA sequence
aatgtgctatagttttttat

SEQ ID NO: 537569 - DNA, 20 bp, Artificial
  CRISPR gRNA sequence
ctatagttttttattagttc

SEQ ID NO: 537570 - DNA, 20 bp, Artificial
  CRISPR gRNA sequence
tatagttttttattagttcc

SEQ ID NO: 537571 - DNA, 20 bp, Artificial
  CRISPR gRNA sequence
tagttttttattagttccag

SEQ ID NO: 537572 - DNA, 20 bp, Artificial
  CRISPR gRNA sequence
agttttttattagttccagg

SEQ ID NO: 537573 - DNA, 20 bp, Artificial
  CRISPR gRNA sequence
tattagttccaggaggtttt

SEQ ID NO: 537574 - DNA, 20 bp, Artificial
  CRISPR gRNA sequence
aggtttttggtcaattcgtt

SEQ ID NO: 537575 - DNA, 20 bp, Artificial
  CRISPR gRNA sequence
attcgtttggattgtataca

SEQ ID NO: 537576 - DNA, 20 bp, Artificial
  CRISPR gRNA sequence
catagatattcatgtcatct

SEQ ID NO: 537577 - DNA, 20 bp, Artificial
  CRISPR gRNA sequence
tatttccttttcttgtctta

SEQ ID NO: 537578 - DNA, 20 bp, Artificial
  CRISPR gRNA sequence
cttttcttgtcttatggcat

SEQ ID NO: 537579 - DNA, 20 bp, Artificial
  CRISPR gRNA sequence
tcttgtcttatggcattagt

SEQ ID NO: 537580 - DNA, 20 bp, Artificial
  CRISPR gRNA sequence
atggcattagttagtgctta

SEQ ID NO: 537581 - DNA, 20 bp, Artificial
  CRISPR gRNA sequence
gcttatagtacaatactgaa

SEQ ID NO: 537582 - DNA, 20 bp, Artificial
  CRISPR gRNA sequence
cttatagtacaatactgaaa

SEQ ID NO: 537583 - DNA, 20 bp, Artificial
  CRISPR gRNA sequence
tatagtacaatactgaaaag

SEQ ID NO: 537584 - DNA, 20 bp, Artificial
  CRISPR gRNA sequence
agtacaatactgaaaaggag

SEQ ID NO: 537585 - DNA, 20 bp, Artificial
  CRISPR gRNA sequence
caatactgaaaaggagtggt

SEQ ID NO: 537586 - DNA, 20 bp, Artificial
  CRISPR gRNA sequence
tactgaaaaggagtggtgag

SEQ ID NO: 537587 - DNA, 20 bp, Artificial
  CRISPR gRNA sequence
gaacattatttccttattct

SEQ ID NO: 537588 - DNA, 20 bp, Artificial
  CRISPR gRNA sequence
tatttccttattcttggtct

SEQ ID NO: 537589 - DNA, 20 bp, Artificial
  CRISPR gRNA sequence
tccttattcttggtcttagt

SEQ ID NO: 537590 - DNA, 20 bp, Artificial
  CRISPR gRNA sequence
tattcttggtcttagttgga

SEQ ID NO: 537591 - DNA, 20 bp, Artificial
  CRISPR gRNA sequence
ggtcttagttggaaagcttc

SEQ ID NO: 537592 - DNA, 20 bp, Artificial
  CRISPR gRNA sequence
cttcaagtttctcaccatta

SEQ ID NO: 537593 - DNA, 20 bp, Artificial
  CRISPR gRNA sequence
ctcaccattacagatgatgt

SEQ ID NO: 537594 - DNA, 20 bp, Artificial
  CRISPR gRNA sequence
attacagatgatgttagctg

SEQ ID NO: 537595 - DNA, 20 bp, Artificial
  CRISPR gRNA sequence
ttacagatgatgttagctgc

SEQ ID NO: 537596 - DNA, 20 bp, Artificial
  CRISPR gRNA sequence
tacagatgatgttagctgca

SEQ ID NO: 537597 - DNA, 20 bp, Artificial
  CRISPR gRNA sequence
gttagctgcagggttttttg

SEQ ID NO: 537598 - DNA, 20 bp, Artificial
  CRISPR gRNA sequence
ttagctgcagggttttttgt

SEQ ID NO: 537599 - DNA, 20 bp, Artificial
  CRISPR gRNA sequence
ttttgtaggcatttgttaac

SEQ ID NO: 537600 - DNA, 20 bp, Artificial
  CRISPR gRNA sequence
catttgttaacaagttgaaa

SEQ ID NO: 537601 - DNA, 20 bp, Artificial
  CRISPR gRNA sequence
aaaagtttcccctctattcc

SEQ ID NO: 537602 - DNA, 20 bp, Artificial
  CRISPR gRNA sequence
ccctctattcctagtttact

SEQ ID NO: 537603 - DNA, 20 bp, Artificial
  CRISPR gRNA sequence
ctctattcctagtttactga

SEQ ID NO: 537604 - DNA, 20 bp, Artificial
  CRISPR gRNA sequence
tttttatcataaattgatgt

SEQ ID NO: 537605 - DNA, 20 bp, Artificial
  CRISPR gRNA sequence
aatgctttttctgtatctat

SEQ ID NO: 537606 - DNA, 20 bp, Artificial
  CRISPR gRNA sequence
atcatgtgatttttctttca

SEQ ID NO: 537607 - DNA, 20 bp, Artificial
  CRISPR gRNA sequence
ttcatagtctgtcaatgtga

SEQ ID NO: 537608 - DNA, 20 bp, Artificial
  CRISPR gRNA sequence
tgaacctgccttgcacacct

SEQ ID NO: 537609 - DNA, 20 bp, Artificial
  CRISPR gRNA sequence
cacctgagataaataccact

SEQ ID NO: 537610 - DNA, 20 bp, Artificial
  CRISPR gRNA sequence
taattctttctatatgctgt

SEQ ID NO: 537611 - DNA, 20 bp, Artificial
  CRISPR gRNA sequence
aatttgctaatattttgttt

SEQ ID NO: 537612 - DNA, 20 bp, Artificial
  CRISPR gRNA sequence
atttgctaatattttgttta

SEQ ID NO: 537613 - DNA, 20 bp, Artificial
  CRISPR gRNA sequence
gtttctacatgtatgttcat

SEQ ID NO: 537614 - DNA, 20 bp, Artificial
  CRISPR gRNA sequence
tcttttcttgtattgttctt

SEQ ID NO: 537615 - DNA, 20 bp, Artificial
  CRISPR gRNA sequence
cttgtattgttctttggttt

SEQ ID NO: 537616 - DNA, 20 bp, Artificial
  CRISPR gRNA sequence
ttgttctttggttttagcac

SEQ ID NO: 537617 - DNA, 20 bp, Artificial
  CRISPR gRNA sequence
ttttagcacaagaataatgc

SEQ ID NO: 537618 - DNA, 20 bp, Artificial
  CRISPR gRNA sequence
gctggcctcataaaatgaat

SEQ ID NO: 537619 - DNA, 20 bp, Artificial
  CRISPR gRNA sequence
gcctcataaaatgaattgga

SEQ ID NO: 537620 - DNA, 20 bp, Artificial
  CRISPR gRNA sequence
cctctgcttctatcttctaa

SEQ ID NO: 537621 - DNA, 20 bp, Artificial
  CRISPR gRNA sequence
tctgcttctatcttctaaaa

SEQ ID NO: 537622 - DNA, 20 bp, Artificial
  CRISPR gRNA sequence
ctatcttctaaaagagatta

SEQ ID NO: 537623 - DNA, 20 bp, Artificial
  CRISPR gRNA sequence
atcttctaaaagagattata

SEQ ID NO: 537624 - DNA, 20 bp, Artificial
  CRISPR gRNA sequence
taaaagagattatagagaat

SEQ ID NO: 537625 - DNA, 20 bp, Artificial
  CRISPR gRNA sequence
gtatttcttccttaaatatc

SEQ ID NO: 537626 - DNA, 20 bp, Artificial
  CRISPR gRNA sequence
tttcttccttaaatatctgg

SEQ ID NO: 537627 - DNA, 20 bp, Artificial
  CRISPR gRNA sequence
ccaatgaacccatctgaacc

SEQ ID NO: 537628 - DNA, 20 bp, Artificial
  CRISPR gRNA sequence
gaacctggtgctttctgttt

SEQ ID NO: 537629 - DNA, 20 bp, Artificial
  CRISPR gRNA sequence
cctggtgctttctgttttgg

SEQ ID NO: 537630 - DNA, 20 bp, Artificial
  CRISPR gRNA sequence
atctgatttatttaaactgc

SEQ ID NO: 537631 - DNA, 20 bp, Artificial
  CRISPR gRNA sequence
tctgatttatttaaactgcc

SEQ ID NO: 537632 - DNA, 20 bp, Artificial
  CRISPR gRNA sequence
ttatttaaactgccaggctg

SEQ ID NO: 537633 - DNA, 20 bp, Artificial
  CRISPR gRNA sequence
ctgaagtgatcctcccacct

SEQ ID NO: 537634 - DNA, 20 bp, Artificial
  CRISPR gRNA sequence
tcctcccacctcagtctccc

SEQ ID NO: 537635 - DNA, 20 bp, Artificial
  CRISPR gRNA sequence
tcccacctcagtctcccaag

SEQ ID NO: 537636 - DNA, 20 bp, Artificial
  CRISPR gRNA sequence
acctcagtctcccaagtagc

SEQ ID NO: 537637 - DNA, 20 bp, Artificial
  CRISPR gRNA sequence
cctcagtctcccaagtagct

SEQ ID NO: 537638 - DNA, 20 bp, Artificial
  CRISPR gRNA sequence
ctcccaagtagctaggacta

SEQ ID NO: 537639 - DNA, 20 bp, Artificial
  CRISPR gRNA sequence
agacacatgccacaacacct

SEQ ID NO: 537640 - DNA, 20 bp, Artificial
  CRISPR gRNA sequence
ctcagtaactttttaatttt

SEQ ID NO: 537641 - DNA, 20 bp, Artificial
  CRISPR gRNA sequence
agtaactttttaatttttag

SEQ ID NO: 537642 - DNA, 20 bp, Artificial
  CRISPR gRNA sequence
taactttttaatttttagta

SEQ ID NO: 537643 - DNA, 20 bp, Artificial
  CRISPR gRNA sequence
tttttaatttttagtagaga

SEQ ID NO: 537644 - DNA, 20 bp, Artificial
  CRISPR gRNA sequence
ttttaatttttagtagagat

SEQ ID NO: 537645 - DNA, 20 bp, Artificial
  CRISPR gRNA sequence
tttaatttttagtagagata

SEQ ID NO: 537646 - DNA, 20 bp, Artificial
  CRISPR gRNA sequence
tagggtctccctatgttgcc

SEQ ID NO: 537647 - DNA, 20 bp, Artificial
  CRISPR gRNA sequence
agggtctccctatgttgccc

SEQ ID NO: 537648 - DNA, 20 bp, Artificial
  CRISPR gRNA sequence
tctccctatgttgcccaggc

SEQ ID NO: 537649 - DNA, 20 bp, Artificial
  CRISPR gRNA sequence
ccaggctggtctcgaactct

SEQ ID NO: 537650 - DNA, 20 bp, Artificial
  CRISPR gRNA sequence
ggtctcgaactctcagcctc

SEQ ID NO: 537651 - DNA, 20 bp, Artificial
  CRISPR gRNA sequence
ctcaagcaatcctcccgtct

SEQ ID NO: 537652 - DNA, 20 bp, Artificial
  CRISPR gRNA sequence
cctcccgtcttggcctcaca

SEQ ID NO: 537653 - DNA, 20 bp, Artificial
  CRISPR gRNA sequence
gtcttggcctcacaaagtgt

SEQ ID NO: 537654 - DNA, 20 bp, Artificial
  CRISPR gRNA sequence
tcttggcctcacaaagtgtt

SEQ ID NO: 537655 - DNA, 20 bp, Artificial
  CRISPR gRNA sequence
ctcacaaagtgttgggatta

SEQ ID NO: 537656 - DNA, 20 bp, Artificial
  CRISPR gRNA sequence
tcacaaagtgttgggattat

SEQ ID NO: 537657 - DNA, 20 bp, Artificial
  CRISPR gRNA sequence
agtgttgggattataggcat

SEQ ID NO: 537658 - DNA, 20 bp, Artificial
  CRISPR gRNA sequence
taggcataagccactgcacg

SEQ ID NO: 537659 - DNA, 20 bp, Artificial
  CRISPR gRNA sequence
cgttctttctcaatttttaa

SEQ ID NO: 537660 - DNA, 20 bp, Artificial
  CRISPR gRNA sequence
tctttctcaatttttaaaag

SEQ ID NO: 537661 - DNA, 20 bp, Artificial
  CRISPR gRNA sequence
tttctcaatttttaaaagca

SEQ ID NO: 537662 - DNA, 20 bp, Artificial
  CRISPR gRNA sequence
ttcttaatcactattcttcc

SEQ ID NO: 537663 - DNA, 20 bp, Artificial
  CRISPR gRNA sequence
ttaatcactattcttcccag

SEQ ID NO: 537664 - DNA, 20 bp, Artificial
  CRISPR gRNA sequence
tcactattcttcccagtgga

SEQ ID NO: 537665 - DNA, 20 bp, Artificial
  CRISPR gRNA sequence
ttcccagtggaaagtcataa

SEQ ID NO: 537666 - DNA, 20 bp, Artificial
  CRISPR gRNA sequence
tggaaagtcataaaagtcac

SEQ ID NO: 537667 - DNA, 20 bp, Artificial
  CRISPR gRNA sequence
gaaagtcataaaagtcacaa

SEQ ID NO: 537668 - DNA, 20 bp, Artificial
  CRISPR gRNA sequence
cacaagagaccaacttaaat

SEQ ID NO: 537669 - DNA, 20 bp, Artificial
  CRISPR gRNA sequence
tctgcctgttacatttcatc

SEQ ID NO: 537670 - DNA, 20 bp, Artificial
  CRISPR gRNA sequence
attcttaacattctttatct

SEQ ID NO: 537671 - DNA, 20 bp, Artificial
  CRISPR gRNA sequence
ccaatttctctcttttttct

SEQ ID NO: 537672 - DNA, 20 bp, Artificial
  CRISPR gRNA sequence
caatttctctcttttttctt

SEQ ID NO: 537673 - DNA, 20 bp, Artificial
  CRISPR gRNA sequence
atttctctcttttttcttag

SEQ ID NO: 537674 - DNA, 20 bp, Artificial
  CRISPR gRNA sequence
ctctcttttttcttaggagt

SEQ ID NO: 537675 - DNA, 20 bp, Artificial
  CRISPR gRNA sequence
ttttcttaggagtaagatca

SEQ ID NO: 537676 - DNA, 20 bp, Artificial
  CRISPR gRNA sequence
tttcttaggagtaagatcaa

SEQ ID NO: 537677 - DNA, 20 bp, Artificial
  CRISPR gRNA sequence
ttcttaggagtaagatcaaa

SEQ ID NO: 537678 - DNA, 20 bp, Artificial
  CRISPR gRNA sequence
agatcaaagggtgttttttt

SEQ ID NO: 537679 - DNA, 20 bp, Artificial
  CRISPR gRNA sequence
gatcaaagggtgtttttttg

SEQ ID NO: 537680 - DNA, 20 bp, Artificial
  CRISPR gRNA sequence
tttttttgaggctctacctt

SEQ ID NO: 537681 - DNA, 20 bp, Artificial
  CRISPR gRNA sequence
cttcagtgacttactccctg

SEQ ID NO: 537682 - DNA, 20 bp, Artificial
  CRISPR gRNA sequence
ttcagtgacttactccctgc

SEQ ID NO: 537683 - DNA, 20 bp, Artificial
  CRISPR gRNA sequence
caggtaacataatgtccaca

SEQ ID NO: 537684 - DNA, 20 bp, Artificial
  CRISPR gRNA sequence
taatgtccacacagctatga

SEQ ID NO: 537685 - DNA, 20 bp, Artificial
  CRISPR gRNA sequence
gtccacacagctatgaaaga

SEQ ID NO: 537686 - DNA, 20 bp, Artificial
  CRISPR gRNA sequence
gctatgaaagaaagatcatc

SEQ ID NO: 537687 - DNA, 20 bp, Artificial
  CRISPR gRNA sequence
aaagatcatctagttgaact

SEQ ID NO: 537688 - DNA, 20 bp, Artificial
  CRISPR gRNA sequence
atgtttgttctacataactt

SEQ ID NO: 537689 - DNA, 20 bp, Artificial
  CRISPR gRNA sequence
tgtttgttctacataacttc

SEQ ID NO: 537690 - DNA, 20 bp, Artificial
  CRISPR gRNA sequence
tgttctacataacttcaggt

SEQ ID NO: 537691 - DNA, 20 bp, Artificial
  CRISPR gRNA sequence
caatgtttcttttatgttct

SEQ ID NO: 537692 - DNA, 20 bp, Artificial
  CRISPR gRNA sequence
tggtccataaatgtgtacaa

SEQ ID NO: 537693 - DNA, 20 bp, Artificial
  CRISPR gRNA sequence
ccataaatgtgtacaacagt

SEQ ID NO: 537694 - DNA, 20 bp, Artificial
  CRISPR gRNA sequence
tgtgtacaacagttggaaac

SEQ ID NO: 537695 - DNA, 20 bp, Artificial
  CRISPR gRNA sequence
acagttggaaactggtactc

SEQ ID NO: 537696 - DNA, 20 bp, Artificial
  CRISPR gRNA sequence
agttggaaactggtactcta

SEQ ID NO: 537697 - DNA, 20 bp, Artificial
  CRISPR gRNA sequence
caaaaaatgtgccctttccc

SEQ ID NO: 537698 - DNA, 20 bp, Artificial
  CRISPR gRNA sequence
aaaaaatgtgccctttccct

SEQ ID NO: 537699 - DNA, 20 bp, Artificial
  CRISPR gRNA sequence
cctttccctaggctcccatt

SEQ ID NO: 537700 - DNA, 20 bp, Artificial
  CRISPR gRNA sequence
tttccctaggctcccattta

SEQ ID NO: 537701 - DNA, 20 bp, Artificial
  CRISPR gRNA sequence
tttagagttctgtgtcaatg

SEQ ID NO: 537702 - DNA, 20 bp, Artificial
  CRISPR gRNA sequence
tagagttctgtgtcaatgtg

SEQ ID NO: 537703 - DNA, 20 bp, Artificial
  CRISPR gRNA sequence
agagttctgtgtcaatgtgg

SEQ ID NO: 537704 - DNA, 20 bp, Artificial
  CRISPR gRNA sequence
gagttctgtgtcaatgtgga

SEQ ID NO: 537705 - DNA, 20 bp, Artificial
  CRISPR gRNA sequence
acaatcatcctacttcttcc

SEQ ID NO: 537706 - DNA, 20 bp, Artificial
  CRISPR gRNA sequence
atcatcctacttcttcccag

SEQ ID NO: 537707 - DNA, 20 bp, Artificial
  CRISPR gRNA sequence
tcttcccagcagttatctaa

SEQ ID NO: 537708 - DNA, 20 bp, Artificial
  CRISPR gRNA sequence
ttcccagcagttatctaaaa

SEQ ID NO: 537709 - DNA, 20 bp, Artificial
  CRISPR gRNA sequence
agcagttatctaaaagagaa

SEQ ID NO: 537710 - DNA, 20 bp, Artificial
  CRISPR gRNA sequence
ttatctaaaagagaatggtg

SEQ ID NO: 537711 - DNA, 20 bp, Artificial
  CRISPR gRNA sequence
aagagaatggtgaagtgcac

SEQ ID NO: 537712 - DNA, 20 bp, Artificial
  CRISPR gRNA sequence
agagaatggtgaagtgcact

SEQ ID NO: 537713 - DNA, 20 bp, Artificial
  CRISPR gRNA sequence
gtgcactgggtttctttacc

SEQ ID NO: 537714 - DNA, 20 bp, Artificial
  CRISPR gRNA sequence
tgggtttctttacctggaaa

SEQ ID NO: 537715 - DNA, 20 bp, Artificial
  CRISPR gRNA sequence
gaaatagcctttgactctca

SEQ ID NO: 537716 - DNA, 20 bp, Artificial
  CRISPR gRNA sequence
aaatagcctttgactctcaa

SEQ ID NO: 537717 - DNA, 20 bp, Artificial
  CRISPR gRNA sequence
ctttgactctcaaaggtact

SEQ ID NO: 537718 - DNA, 20 bp, Artificial
  CRISPR gRNA sequence
gattttattttcctctttca

SEQ ID NO: 537719 - DNA, 20 bp, Artificial
  CRISPR gRNA sequence
ttcacagccaaatatataac

SEQ ID NO: 537720 - DNA, 20 bp, Artificial
  CRISPR gRNA sequence
caaatatataactggcctat

SEQ ID NO: 537721 - DNA, 20 bp, Artificial
  CRISPR gRNA sequence
actacccctcttcttactta

SEQ ID NO: 537722 - DNA, 20 bp, Artificial
  CRISPR gRNA sequence
ccctcttcttacttaaagcc

SEQ ID NO: 537723 - DNA, 20 bp, Artificial
  CRISPR gRNA sequence
cctcttcttacttaaagccc

SEQ ID NO: 537724 - DNA, 20 bp, Artificial
  CRISPR gRNA sequence
ttacttaaagcccaggaatc

SEQ ID NO: 537725 - DNA, 20 bp, Artificial
  CRISPR gRNA sequence
tcctaccctcatctattcac

SEQ ID NO: 537726 - DNA, 20 bp, Artificial
  CRISPR gRNA sequence
cctaccctcatctattcaca

SEQ ID NO: 537727 - DNA, 20 bp, Artificial
  CRISPR gRNA sequence
tctgtcaacaatgacctcct

SEQ ID NO: 537728 - DNA, 20 bp, Artificial
  CRISPR gRNA sequence
cattgtcctccttaaaccat

SEQ ID NO: 537729 - DNA, 20 bp, Artificial
  CRISPR gRNA sequence
cctgtatcctgaataacaac

SEQ ID NO: 537730 - DNA, 20 bp, Artificial
  CRISPR gRNA sequence
gtatcctgaataacaactag

SEQ ID NO: 537731 - DNA, 20 bp, Artificial
  CRISPR gRNA sequence
aataacaactagcagtttta

SEQ ID NO: 537732 - DNA, 20 bp, Artificial
  CRISPR gRNA sequence
gctattttatttaatttcct

SEQ ID NO: 537733 - DNA, 20 bp, Artificial
  CRISPR gRNA sequence
taatttcctcagcccttgta

SEQ ID NO: 537734 - DNA, 20 bp, Artificial
  CRISPR gRNA sequence
ttcctcagcccttgtaaagt

SEQ ID NO: 537735 - DNA, 20 bp, Artificial
  CRISPR gRNA sequence
atcccccacattcacactgc

SEQ ID NO: 537736 - DNA, 20 bp, Artificial
  CRISPR gRNA sequence
cccacattcacactgccagt

SEQ ID NO: 537737 - DNA, 20 bp, Artificial
  CRISPR gRNA sequence
ctgccagtaagcaatgaaat

SEQ ID NO: 537738 - DNA, 20 bp, Artificial
  CRISPR gRNA sequence
tgccagtaagcaatgaaatc

SEQ ID NO: 537739 - DNA, 20 bp, Artificial
  CRISPR gRNA sequence
gtaagcaatgaaatcaggtc

SEQ ID NO: 537740 - DNA, 20 bp, Artificial
  CRISPR gRNA sequence
taagcaatgaaatcaggtct

SEQ ID NO: 537741 - DNA, 20 bp, Artificial
  CRISPR gRNA sequence
atgaaatcaggtctaggacc

SEQ ID NO: 537742 - DNA, 20 bp, Artificial
  CRISPR gRNA sequence
tgaaatcaggtctaggacct

SEQ ID NO: 537743 - DNA, 20 bp, Artificial
  CRISPR gRNA sequence
atcccatgttctcttctatc

SEQ ID NO: 537744 - DNA, 20 bp, Artificial
  CRISPR gRNA sequence
ctcaattttctaatctgtat

SEQ ID NO: 537745 - DNA, 20 bp, Artificial
  CRISPR gRNA sequence
attcacgtgctgccataaac

SEQ ID NO: 537746 - DNA, 20 bp, Artificial
  CRISPR gRNA sequence
taaaccagctttctgacctt

SEQ ID NO: 537747 - DNA, 20 bp, Artificial
  CRISPR gRNA sequence
ttgagatctctgaacatctg

SEQ ID NO: 537748 - DNA, 20 bp, Artificial
  CRISPR gRNA sequence
atctctgaacatctgtagca

SEQ ID NO: 537749 - DNA, 20 bp, Artificial
  CRISPR gRNA sequence
tctctgaacatctgtagcat

SEQ ID NO: 537750 - DNA, 20 bp, Artificial
  CRISPR gRNA sequence
catgctatctactctgaccg

SEQ ID NO: 537751 - DNA, 20 bp, Artificial
  CRISPR gRNA sequence
tatctactctgaccgcagat

SEQ ID NO: 537752 - DNA, 20 bp, Artificial
  CRISPR gRNA sequence
atctactctgaccgcagata

SEQ ID NO: 537753 - DNA, 20 bp, Artificial
  CRISPR gRNA sequence
ctactctgaccgcagataag

SEQ ID NO: 537754 - DNA, 20 bp, Artificial
  CRISPR gRNA sequence
ctgaccgcagataaggagat

SEQ ID NO: 537755 - DNA, 20 bp, Artificial
  CRISPR gRNA sequence
tgaccgcagataaggagata

SEQ ID NO: 537756 - DNA, 20 bp, Artificial
  CRISPR gRNA sequence
accgcagataaggagataag

SEQ ID NO: 537757 - DNA, 20 bp, Artificial
  CRISPR gRNA sequence
ccgcagataaggagataagg

SEQ ID NO: 537758 - DNA, 20 bp, Artificial
  CRISPR gRNA sequence
gcagataaggagataaggag

SEQ ID NO: 537759 - DNA, 20 bp, Artificial
  CRISPR gRNA sequence
agataaggaggagcaaaatg

SEQ ID NO: 537760 - DNA, 20 bp, Artificial
  CRISPR gRNA sequence
gataaggaggagcaaaatgt

SEQ ID NO: 537761 - DNA, 20 bp, Artificial
  CRISPR gRNA sequence
taaggaggagcaaaatgtag

SEQ ID NO: 537762 - DNA, 20 bp, Artificial
  CRISPR gRNA sequence
aaatgtaggagcatgacaca

SEQ ID NO: 537763 - DNA, 20 bp, Artificial
  CRISPR gRNA sequence
aatgtaggagcatgacacaa

SEQ ID NO: 537764 - DNA, 20 bp, Artificial
  CRISPR gRNA sequence
taggagcatgacacaaaggc

SEQ ID NO: 537765 - DNA, 20 bp, Artificial
  CRISPR gRNA sequence
ggcaagaaataattgctcac

SEQ ID NO: 537766 - DNA, 20 bp, Artificial
  CRISPR gRNA sequence
ctttccatctcccaatgcct

SEQ ID NO: 537767 - DNA, 20 bp, Artificial
  CRISPR gRNA sequence
ttccatctcccaatgccttg

SEQ ID NO: 537768 - DNA, 20 bp, Artificial
  CRISPR gRNA sequence
ttggagctgcaattttcaaa

SEQ ID NO: 537769 - DNA, 20 bp, Artificial
  CRISPR gRNA sequence
attttcaaacggttaaccaa

SEQ ID NO: 537770 - DNA, 20 bp, Artificial
  CRISPR gRNA sequence
ttcaaacggttaaccaatgg

SEQ ID NO: 537771 - DNA, 20 bp, Artificial
  CRISPR gRNA sequence
tggaagtaaattccaaattc

SEQ ID NO: 537772 - DNA, 20 bp, Artificial
  CRISPR gRNA sequence
gattataattctccatctct

SEQ ID NO: 537773 - DNA, 20 bp, Artificial
  CRISPR gRNA sequence
atcttcttacttttacttcc

SEQ ID NO: 537774 - DNA, 20 bp, Artificial
  CRISPR gRNA sequence
cttacttttacttcccagta

SEQ ID NO: 537775 - DNA, 20 bp, Artificial
  CRISPR gRNA sequence
acttttacttcccagtacag

SEQ ID NO: 537776 - DNA, 20 bp, Artificial
  CRISPR gRNA sequence
cttttacttcccagtacagt

SEQ ID NO: 537777 - DNA, 20 bp, Artificial
  CRISPR gRNA sequence
ttttacttcccagtacagtg

SEQ ID NO: 537778 - DNA, 20 bp, Artificial
  CRISPR gRNA sequence
tacttcccagtacagtgggg

SEQ ID NO: 537779 - DNA, 20 bp, Artificial
  CRISPR gRNA sequence
ccagtacagtggggaagaca

SEQ ID NO: 537780 - DNA, 20 bp, Artificial
  CRISPR gRNA sequence
tggggaagacacagtgcttt

SEQ ID NO: 537781 - DNA, 20 bp, Artificial
  CRISPR gRNA sequence
aagacacagtgctttgagtt

SEQ ID NO: 537782 - DNA, 20 bp, Artificial
  CRISPR gRNA sequence
cacagtgctttgagttcaga

SEQ ID NO: 537783 - DNA, 20 bp, Artificial
  CRISPR gRNA sequence
cagtgctttgagttcagatg

SEQ ID NO: 537784 - DNA, 20 bp, Artificial
  CRISPR gRNA sequence
gctttgagttcagatggagt

SEQ ID NO: 537785 - DNA, 20 bp, Artificial
  CRISPR gRNA sequence
tggagttggatgtcaaatcc

SEQ ID NO: 537786 - DNA, 20 bp, Artificial
  CRISPR gRNA sequence
tcttaataaatgtgtatatt

SEQ ID NO: 537787 - DNA, 20 bp, Artificial
  CRISPR gRNA sequence
ataaatgtgtatatttggtc

SEQ ID NO: 537788 - DNA, 20 bp, Artificial
  CRISPR gRNA sequence
tatttaacctcactgtgcct

SEQ ID NO: 537789 - DNA, 20 bp, Artificial
  CRISPR gRNA sequence
tttataaatacccacaccac

SEQ ID NO: 537790 - DNA, 20 bp, Artificial
  CRISPR gRNA sequence
ttataaatacccacaccact

SEQ ID NO: 537791 - DNA, 20 bp, Artificial
  CRISPR gRNA sequence
cacaccactgggttgttgtg

SEQ ID NO: 537792 - DNA, 20 bp, Artificial
  CRISPR gRNA sequence
acatttatgtaaatcattta

SEQ ID NO: 537793 - DNA, 20 bp, Artificial
  CRISPR gRNA sequence
catttatgtaaatcatttac

SEQ ID NO: 537794 - DNA, 20 bp, Artificial
  CRISPR gRNA sequence
tttatgtaaatcatttacag

SEQ ID NO: 537795 - DNA, 20 bp, Artificial
  CRISPR gRNA sequence
tcatttacaggagtttgttg

SEQ ID NO: 537796 - DNA, 20 bp, Artificial
  CRISPR gRNA sequence
atttacaggagtttgttgtg

SEQ ID NO: 537797 - DNA, 20 bp, Artificial
  CRISPR gRNA sequence
tacaggagtttgttgtggag

SEQ ID NO: 537798 - DNA, 20 bp, Artificial
  CRISPR gRNA sequence
acaggagtttgttgtggagc

SEQ ID NO: 537799 - DNA, 20 bp, Artificial
  CRISPR gRNA sequence
tttgttgtggagcaggcctt

SEQ ID NO: 537800 - DNA, 20 bp, Artificial
  CRISPR gRNA sequence
ttgtggagcaggccttcagt

SEQ ID NO: 537801 - DNA, 20 bp, Artificial
  CRISPR gRNA sequence
agcaggccttcagtaagtat

SEQ ID NO: 537802 - DNA, 20 bp, Artificial
  CRISPR gRNA sequence
taagtattagttcattcccc

SEQ ID NO: 537803 - DNA, 20 bp, Artificial
  CRISPR gRNA sequence
tcattcccccagtacaatac

SEQ ID NO: 537804 - DNA, 20 bp, Artificial
  CRISPR gRNA sequence
tcccccagtacaatacgagt

SEQ ID NO: 537805 - DNA, 20 bp, Artificial
  CRISPR gRNA sequence
cagtacaatacgagttggac

SEQ ID NO: 537806 - DNA, 20 bp, Artificial
  CRISPR gRNA sequence
ctgtctctaaaattctcctt

SEQ ID NO: 537807 - DNA, 20 bp, Artificial
  CRISPR gRNA sequence
tcctttagattgtgtttaac

SEQ ID NO: 537808 - DNA, 20 bp, Artificial
  CRISPR gRNA sequence
ttagattgtgtttaactagt

SEQ ID NO: 537809 - DNA, 20 bp, Artificial
  CRISPR gRNA sequence
taaccccatcgccccatttc

SEQ ID NO: 537810 - DNA, 20 bp, Artificial
  CRISPR gRNA sequence
aaccccatcgccccatttct

SEQ ID NO: 537811 - DNA, 20 bp, Artificial
  CRISPR gRNA sequence
atcgccccatttctgggttg

SEQ ID NO: 537812 - DNA, 20 bp, Artificial
  CRISPR gRNA sequence
ccatttctgggttgcagtga

SEQ ID NO: 537813 - DNA, 20 bp, Artificial
  CRISPR gRNA sequence
gggttgcagtgacggtatga

SEQ ID NO: 537814 - DNA, 20 bp, Artificial
  CRISPR gRNA sequence
ttgcagtgacggtatgacag

SEQ ID NO: 537815 - DNA, 20 bp, Artificial
  CRISPR gRNA sequence
aaatgatgacaaaccacaaa

SEQ ID NO: 537816 - DNA, 20 bp, Artificial
  CRISPR gRNA sequence
aatgatgacaaaccacaaaa

SEQ ID NO: 537817 - DNA, 20 bp, Artificial
  CRISPR gRNA sequence
aaaccacaaaaaggtcctac

SEQ ID NO: 537818 - DNA, 20 bp, Artificial
  CRISPR gRNA sequence
cctactagacaaaatgttac

SEQ ID NO: 537819 - DNA, 20 bp, Artificial
  CRISPR gRNA sequence
caaaatgttacaagaaacat

SEQ ID NO: 537820 - DNA, 20 bp, Artificial
  CRISPR gRNA sequence
tacaagaaacatgagataat

SEQ ID NO: 537821 - DNA, 20 bp, Artificial
  CRISPR gRNA sequence
acaagaaacatgagataatg

SEQ ID NO: 537822 - DNA, 20 bp, Artificial
  CRISPR gRNA sequence
agataatgaggtaaaaaatt

SEQ ID NO: 537823 - DNA, 20 bp, Artificial
  CRISPR gRNA sequence
atctactatgtatatctata

SEQ ID NO: 537824 - DNA, 20 bp, Artificial
  CRISPR gRNA sequence
ctatgtatatctatatagta

SEQ ID NO: 537825 - DNA, 20 bp, Artificial
  CRISPR gRNA sequence
tatgtatatctatatagtat

SEQ ID NO: 537826 - DNA, 20 bp, Artificial
  CRISPR gRNA sequence
ctatatagtatgggtttctc

SEQ ID NO: 537827 - DNA, 20 bp, Artificial
  CRISPR gRNA sequence
tcattcatatgaataaatca

SEQ ID NO: 537828 - DNA, 20 bp, Artificial
  CRISPR gRNA sequence
ttgatttattttgaaacgta

SEQ ID NO: 537829 - DNA, 20 bp, Artificial
  CRISPR gRNA sequence
gatttattttgaaacgtata

SEQ ID NO: 537830 - DNA, 20 bp, Artificial
  CRISPR gRNA sequence
tttattttgaaacgtataga

SEQ ID NO: 537831 - DNA, 20 bp, Artificial
  CRISPR gRNA sequence
ttttgaaacgtatagagagt

SEQ ID NO: 537832 - DNA, 20 bp, Artificial
  CRISPR gRNA sequence
tttgaaacgtatagagagtc

SEQ ID NO: 537833 - DNA, 20 bp, Artificial
  CRISPR gRNA sequence
aaacgtatagagagtcagga

SEQ ID NO: 537834 - DNA, 20 bp, Artificial
  CRISPR gRNA sequence
ggtatcatacaaaaacactc

SEQ ID NO: 537835 - DNA, 20 bp, Artificial
  CRISPR gRNA sequence
caaaaacactctggaattca

SEQ ID NO: 537836 - DNA, 20 bp, Artificial
  CRISPR gRNA sequence
taattctatctccaatactt

SEQ ID NO: 537837 - DNA, 20 bp, Artificial
  CRISPR gRNA sequence
ctccaatacttaagtgaccc

SEQ ID NO: 537838 - DNA, 20 bp, Artificial
  CRISPR gRNA sequence
tccaatacttaagtgaccct

SEQ ID NO: 537839 - DNA, 20 bp, Artificial
  CRISPR gRNA sequence
atacttaagtgaccctgggc

SEQ ID NO: 537840 - DNA, 20 bp, Artificial
  CRISPR gRNA sequence
cctgggcaagtcaccccacc

SEQ ID NO: 537841 - DNA, 20 bp, Artificial
  CRISPR gRNA sequence
tcattctttttttttttttt

SEQ ID NO: 537842 - DNA, 20 bp, Artificial
  CRISPR gRNA sequence
tcttttttttttttttgaga

SEQ ID NO: 537843 - DNA, 20 bp, Artificial
  CRISPR gRNA sequence
cggaatctcactctgtcacc

SEQ ID NO: 537844 - DNA, 20 bp, Artificial
  CRISPR gRNA sequence
ggaatctcactctgtcaccc

SEQ ID NO: 537845 - DNA, 20 bp, Artificial
  CRISPR gRNA sequence
tctcactctgtcacccaggc

SEQ ID NO: 537846 - DNA, 20 bp, Artificial
  CRISPR gRNA sequence
tcactctgtcacccaggctg

SEQ ID NO: 537847 - DNA, 20 bp, Artificial
  CRISPR gRNA sequence
ctgtcacccaggctggagtg

SEQ ID NO: 537848 - DNA, 20 bp, Artificial
  CRISPR gRNA sequence
tcacccaggctggagtgcag

SEQ ID NO: 537849 - DNA, 20 bp, Artificial
  CRISPR gRNA sequence
caggctggagtgcagtggtg

SEQ ID NO: 537850 - DNA, 20 bp, Artificial
  CRISPR gRNA sequence
ggagtgcagtggtgtggtct

SEQ ID NO: 537851 - DNA, 20 bp, Artificial
  CRISPR gRNA sequence
gtgtggtctcagctcactgc

SEQ ID NO: 537852 - DNA, 20 bp, Artificial
  CRISPR gRNA sequence
tcactgccagctccgcctcc

SEQ ID NO: 537853 - DNA, 20 bp, Artificial
  CRISPR gRNA sequence
cactgccagctccgcctccc

SEQ ID NO: 537854 - DNA, 20 bp, Artificial
  CRISPR gRNA sequence
ttcatgccattctcctgcct

SEQ ID NO: 537855 - DNA, 20 bp, Artificial
  CRISPR gRNA sequence
ttctcctgcctcagcctccc

SEQ ID NO: 537856 - DNA, 20 bp, Artificial
  CRISPR gRNA sequence
tcctgcctcagcctcccaag

SEQ ID NO: 537857 - DNA, 20 bp, Artificial
  CRISPR gRNA sequence
gcctcagcctcccaagtagc

SEQ ID NO: 537858 - DNA, 20 bp, Artificial
  CRISPR gRNA sequence
cctcagcctcccaagtagct

SEQ ID NO: 537859 - DNA, 20 bp, Artificial
  CRISPR gRNA sequence
ctcccaagtagctgggacta

SEQ ID NO: 537860 - DNA, 20 bp, Artificial
  CRISPR gRNA sequence
tcccaagtagctgggactac

SEQ ID NO: 537861 - DNA, 20 bp, Artificial
  CRISPR gRNA sequence
tgactaattttttgtatttt

SEQ ID NO: 537862 - DNA, 20 bp, Artificial
  CRISPR gRNA sequence
aattttttgtatttttagta

SEQ ID NO: 537863 - DNA, 20 bp, Artificial
  CRISPR gRNA sequence
ttttgtatttttagtacaga

SEQ ID NO: 537864 - DNA, 20 bp, Artificial
  CRISPR gRNA sequence
tttgtatttttagtacagac

SEQ ID NO: 537865 - DNA, 20 bp, Artificial
  CRISPR gRNA sequence
ttgtatttttagtacagacg

SEQ ID NO: 537866 - DNA, 20 bp, Artificial
  CRISPR gRNA sequence
cagacggggtttcaccgtgt

SEQ ID NO: 537867 - DNA, 20 bp, Artificial
  CRISPR gRNA sequence
cggggtttcaccgtgttagc

SEQ ID NO: 537868 - DNA, 20 bp, Artificial
  CRISPR gRNA sequence
ggggtttcaccgtgttagcc

SEQ ID NO: 537869 - DNA, 20 bp, Artificial
  CRISPR gRNA sequence
tttcaccgtgttagccagga

SEQ ID NO: 537870 - DNA, 20 bp, Artificial
  CRISPR gRNA sequence
acctcgtgatccacccgcct

SEQ ID NO: 537871 - DNA, 20 bp, Artificial
  CRISPR gRNA sequence
ccacccgcctcagcctccca

SEQ ID NO: 537872 - DNA, 20 bp, Artificial
  CRISPR gRNA sequence
gcctcagcctcccaaagtgt

SEQ ID NO: 537873 - DNA, 20 bp, Artificial
  CRISPR gRNA sequence
cctcagcctcccaaagtgtt

SEQ ID NO: 537874 - DNA, 20 bp, Artificial
  CRISPR gRNA sequence
ctcccaaagtgttgggatta

SEQ ID NO: 537875 - DNA, 20 bp, Artificial
  CRISPR gRNA sequence
tcccaaagtgttgggattac

SEQ ID NO: 537876 - DNA, 20 bp, Artificial
  CRISPR gRNA sequence
agtgttgggattacaggtgt

SEQ ID NO: 537877 - DNA, 20 bp, Artificial
  CRISPR gRNA sequence
caggtgtgagccaccgcacc

SEQ ID NO: 537878 - DNA, 20 bp, Artificial
  CRISPR gRNA sequence
acctgtctcctcattcttaa

SEQ ID NO: 537879 - DNA, 20 bp, Artificial
  CRISPR gRNA sequence
cctgtctcctcattcttaaa

SEQ ID NO: 537880 - DNA, 20 bp, Artificial
  CRISPR gRNA sequence
tctcctcattcttaaaaggt

SEQ ID NO: 537881 - DNA, 20 bp, Artificial
  CRISPR gRNA sequence
aaaggtaagtaacaactgtc

SEQ ID NO: 537882 - DNA, 20 bp, Artificial
  CRISPR gRNA sequence
gtctggccaatctaaaatga

SEQ ID NO: 537883 - DNA, 20 bp, Artificial
  CRISPR gRNA sequence
tggccaatctaaaatgatag

SEQ ID NO: 537884 - DNA, 20 bp, Artificial
  CRISPR gRNA sequence
caatctaaaatgatagtggt

SEQ ID NO: 537885 - DNA, 20 bp, Artificial
  CRISPR gRNA sequence
aatctaaaatgatagtggtg

SEQ ID NO: 537886 - DNA, 20 bp, Artificial
  CRISPR gRNA sequence
tctaaaatgatagtggtgag

SEQ ID NO: 537887 - DNA, 20 bp, Artificial
  CRISPR gRNA sequence
gatagtggtgaggagcaaat

SEQ ID NO: 537888 - DNA, 20 bp, Artificial
  CRISPR gRNA sequence
atagtggtgaggagcaaatg

SEQ ID NO: 537889 - DNA, 20 bp, Artificial
  CRISPR gRNA sequence
gcaaatgaggcatttatttg

SEQ ID NO: 537890 - DNA, 20 bp, Artificial
  CRISPR gRNA sequence
caaatgaggcatttatttga

SEQ ID NO: 537891 - DNA, 20 bp, Artificial
  CRISPR gRNA sequence
aaatgaggcatttatttgaa

SEQ ID NO: 537892 - DNA, 20 bp, Artificial
  CRISPR gRNA sequence
tttatttgaagggtttgcta

SEQ ID NO: 537893 - DNA, 20 bp, Artificial
  CRISPR gRNA sequence
ttatttgaagggtttgctaa

SEQ ID NO: 537894 - DNA, 20 bp, Artificial
  CRISPR gRNA sequence
atttgaagggtttgctaaag

SEQ ID NO: 537895 - DNA, 20 bp, Artificial
  CRISPR gRNA sequence
ttgaagggtttgctaaagga

SEQ ID NO: 537896 - DNA, 20 bp, Artificial
  CRISPR gRNA sequence
aagggtttgctaaaggagag

SEQ ID NO: 537897 - DNA, 20 bp, Artificial
  CRISPR gRNA sequence
agggtttgctaaaggagagc

SEQ ID NO: 537898 - DNA, 20 bp, Artificial
  CRISPR gRNA sequence
tttgctaaaggagagcaggc

SEQ ID NO: 537899 - DNA, 20 bp, Artificial
  CRISPR gRNA sequence
gagagcaggctagtcaatgt

SEQ ID NO: 537900 - DNA, 20 bp, Artificial
  CRISPR gRNA sequence
gcaggctagtcaatgtgagt

SEQ ID NO: 537901 - DNA, 20 bp, Artificial
  CRISPR gRNA sequence
gttagtttgcttcactgata

SEQ ID NO: 537902 - DNA, 20 bp, Artificial
  CRISPR gRNA sequence
ttgcttcactgataaagcat

SEQ ID NO: 537903 - DNA, 20 bp, Artificial
  CRISPR gRNA sequence
ttcactgataaagcattgga

SEQ ID NO: 537904 - DNA, 20 bp, Artificial
  CRISPR gRNA sequence
tgataaagcattggaaagtt

SEQ ID NO: 537905 - DNA, 20 bp, Artificial
  CRISPR gRNA sequence
aagcattggaaagtttagat

SEQ ID NO: 537906 - DNA, 20 bp, Artificial
  CRISPR gRNA sequence
tgagaaatcaaaacctgaaa

SEQ ID NO: 537907 - DNA, 20 bp, Artificial
  CRISPR gRNA sequence
aaatcaaaacctgaaaaagt

SEQ ID NO: 537908 - DNA, 20 bp, Artificial
  CRISPR gRNA sequence
aaacctgaaaaagtaagatc

SEQ ID NO: 537909 - DNA, 20 bp, Artificial
  CRISPR gRNA sequence
atttaactgttatactttca

SEQ ID NO: 537910 - DNA, 20 bp, Artificial
  CRISPR gRNA sequence
tgtatctattatgatgcatg

SEQ ID NO: 537911 - DNA, 20 bp, Artificial
  CRISPR gRNA sequence
atgcatgtggttccacacaa

SEQ ID NO: 537912 - DNA, 20 bp, Artificial
  CRISPR gRNA sequence
aaagcattcaaaaatcatct

SEQ ID NO: 537913 - DNA, 20 bp, Artificial
  CRISPR gRNA sequence
aaaatcatctcagaaaaaaa

SEQ ID NO: 537914 - DNA, 20 bp, Artificial
  CRISPR gRNA sequence
tctcagaaaaaaaaagatcc

SEQ ID NO: 537915 - DNA, 20 bp, Artificial
  CRISPR gRNA sequence
cctagactgttactgttcaa

SEQ ID NO: 537916 - DNA, 20 bp, Artificial
  CRISPR gRNA sequence
tactgttcaaaagaaccatt

SEQ ID NO: 537917 - DNA, 20 bp, Artificial
  CRISPR gRNA sequence
aaagaaccattaagatcatt

SEQ ID NO: 537918 - DNA, 20 bp, Artificial
  CRISPR gRNA sequence
accattaagatcattaagtt

SEQ ID NO: 537919 - DNA, 20 bp, Artificial
  CRISPR gRNA sequence
agatcattaagttcagctcc

SEQ ID NO: 537920 - DNA, 20 bp, Artificial
  CRISPR gRNA sequence
gctcctggtttgcattttaa

SEQ ID NO: 537921 - DNA, 20 bp, Artificial
  CRISPR gRNA sequence
ctcctggtttgcattttaaa

SEQ ID NO: 537922 - DNA, 20 bp, Artificial
  CRISPR gRNA sequence
cctggtttgcattttaaaag

SEQ ID NO: 537923 - DNA, 20 bp, Artificial
  CRISPR gRNA sequence
ggtttgcattttaaaaggag

SEQ ID NO: 537924 - DNA, 20 bp, Artificial
  CRISPR gRNA sequence
gtttgcattttaaaaggaga

SEQ ID NO: 537925 - DNA, 20 bp, Artificial
  CRISPR gRNA sequence
ggagaaggtcctccaatatt

SEQ ID NO: 537926 - DNA, 20 bp, Artificial
  CRISPR gRNA sequence
gtcctccaatatttggttaa

SEQ ID NO: 537927 - DNA, 20 bp, Artificial
  CRISPR gRNA sequence
aatatttggttaacagaaac

SEQ ID NO: 537928 - DNA, 20 bp, Artificial
  CRISPR gRNA sequence
atatttggttaacagaaacc

SEQ ID NO: 537929 - DNA, 20 bp, Artificial
  CRISPR gRNA sequence
tatttggttaacagaaacca

SEQ ID NO: 537930 - DNA, 20 bp, Artificial
  CRISPR gRNA sequence
tggttaacagaaaccagggt

SEQ ID NO: 537931 - DNA, 20 bp, Artificial
  CRISPR gRNA sequence
ttaacagaaaccagggtcag

SEQ ID NO: 537932 - DNA, 20 bp, Artificial
  CRISPR gRNA sequence
agaaaccagggtcagaagcc

SEQ ID NO: 537933 - DNA, 20 bp, Artificial
  CRISPR gRNA sequence
agaagcccagacatatgtct

SEQ ID NO: 537934 - DNA, 20 bp, Artificial
  CRISPR gRNA sequence
ctcagatgtcaacactactc

SEQ ID NO: 537935 - DNA, 20 bp, Artificial
  CRISPR gRNA sequence
tcagatgtcaacactactcc

SEQ ID NO: 537936 - DNA, 20 bp, Artificial
  CRISPR gRNA sequence
ctactccaggatttaaacct

SEQ ID NO: 537937 - DNA, 20 bp, Artificial
  CRISPR gRNA sequence
atttaaacctaagacctatc

SEQ ID NO: 537938 - DNA, 20 bp, Artificial
  CRISPR gRNA sequence
atatatgtgaactatcaatt

SEQ ID NO: 537939 - DNA, 20 bp, Artificial
  CRISPR gRNA sequence
tatgtgaactatcaatttgg

SEQ ID NO: 537940 - DNA, 20 bp, Artificial
  CRISPR gRNA sequence
caatttggaagaaaatgtaa

SEQ ID NO: 537941 - DNA, 20 bp, Artificial
  CRISPR gRNA sequence
tttggaagaaaatgtaaaag

SEQ ID NO: 537942 - DNA, 20 bp, Artificial
  CRISPR gRNA sequence
ttggaagaaaatgtaaaaga

SEQ ID NO: 537943 - DNA, 20 bp, Artificial
  CRISPR gRNA sequence
caccattatttaataattaa

SEQ ID NO: 537944 - DNA, 20 bp, Artificial
  CRISPR gRNA sequence
aaagaattttttcaaattaa

SEQ ID NO: 537945 - DNA, 20 bp, Artificial
  CRISPR gRNA sequence
agtacttatttcaaatcaat

SEQ ID NO: 537946 - DNA, 20 bp, Artificial
  CRISPR gRNA sequence
tacttatttcaaatcaataa

SEQ ID NO: 537947 - DNA, 20 bp, Artificial
  CRISPR gRNA sequence
acttatttcaaatcaataag

SEQ ID NO: 537948 - DNA, 20 bp, Artificial
  CRISPR gRNA sequence
ttcctcttatgatcttttac

SEQ ID NO: 537949 - DNA, 20 bp, Artificial
  CRISPR gRNA sequence
atcttttaccagactattta

SEQ ID NO: 537950 - DNA, 20 bp, Artificial
  CRISPR gRNA sequence
tcttttaccagactatttac

SEQ ID NO: 537951 - DNA, 20 bp, Artificial
  CRISPR gRNA sequence
cttttaccagactatttaca

SEQ ID NO: 537952 - DNA, 20 bp, Artificial
  CRISPR gRNA sequence
taccagactatttacaggga

SEQ ID NO: 537953 - DNA, 20 bp, Artificial
  CRISPR gRNA sequence
agggaaagtaatcttacttt

SEQ ID NO: 537954 - DNA, 20 bp, Artificial
  CRISPR gRNA sequence
aaagtaatcttactttcagt

SEQ ID NO: 537955 - DNA, 20 bp, Artificial
  CRISPR gRNA sequence
agtaatcttactttcagtaa

SEQ ID NO: 537956 - DNA, 20 bp, Artificial
  CRISPR gRNA sequence
tttgtgtcttcaaattctaa

SEQ ID NO: 537957 - DNA, 20 bp, Artificial
  CRISPR gRNA sequence
aaattctaatggcaaacata

SEQ ID NO: 537958 - DNA, 20 bp, Artificial
  CRISPR gRNA sequence
caaacataaagttaaacata

SEQ ID NO: 537959 - DNA, 20 bp, Artificial
  CRISPR gRNA sequence
agttaaacataaagttttgc

SEQ ID NO: 537960 - DNA, 20 bp, Artificial
  CRISPR gRNA sequence
gttaaacataaagttttgca

SEQ ID NO: 537961 - DNA, 20 bp, Artificial
  CRISPR gRNA sequence
ttaaacataaagttttgcaa

SEQ ID NO: 537962 - DNA, 20 bp, Artificial
  CRISPR gRNA sequence
aaatattccatgtaattcta

SEQ ID NO: 537963 - DNA, 20 bp, Artificial
  CRISPR gRNA sequence
atattccatgtaattctata

SEQ ID NO: 537964 - DNA, 20 bp, Artificial
  CRISPR gRNA sequence
tattccatgtaattctatag

SEQ ID NO: 537965 - DNA, 20 bp, Artificial
  CRISPR gRNA sequence
attccatgtaattctataga

SEQ ID NO: 537966 - DNA, 20 bp, Artificial
  CRISPR gRNA sequence
ttctatagagggatcttact

SEQ ID NO: 537967 - DNA, 20 bp, Artificial
  CRISPR gRNA sequence
actcagaaattatttccttc

SEQ ID NO: 537968 - DNA, 20 bp, Artificial
  CRISPR gRNA sequence
ccttcaagtattttgtctct

SEQ ID NO: 537969 - DNA, 20 bp, Artificial
  CRISPR gRNA sequence
tggaacacttaaaacttttc

SEQ ID NO: 537970 - DNA, 20 bp, Artificial
  CRISPR gRNA sequence
ttgcttgctctgtctatatg

SEQ ID NO: 537971 - DNA, 20 bp, Artificial
  CRISPR gRNA sequence
gtcatcttcttcccccttgt

SEQ ID NO: 537972 - DNA, 20 bp, Artificial
  CRISPR gRNA sequence
tcttcttcccccttgtcagt

SEQ ID NO: 537973 - DNA, 20 bp, Artificial
  CRISPR gRNA sequence
tcccccttgtcagttagatg

SEQ ID NO: 537974 - DNA, 20 bp, Artificial
  CRISPR gRNA sequence
atgcagcacacatataccaa

SEQ ID NO: 537975 - DNA, 20 bp, Artificial
  CRISPR gRNA sequence
tgcagcacacatataccaaa

SEQ ID NO: 537976 - DNA, 20 bp, Artificial
  CRISPR gRNA sequence
acacatataccaaaaggcaa

SEQ ID NO: 537977 - DNA, 20 bp, Artificial
  CRISPR gRNA sequence
accaaaaggcaaaagcacac

SEQ ID NO: 537978 - DNA, 20 bp, Artificial
  CRISPR gRNA sequence
tttttgttgttcccattata

SEQ ID NO: 537979 - DNA, 20 bp, Artificial
  CRISPR gRNA sequence
catttccatatcgtatgcct

SEQ ID NO: 537980 - DNA, 20 bp, Artificial
  CRISPR gRNA sequence
atttccatatcgtatgcctt

SEQ ID NO: 537981 - DNA, 20 bp, Artificial
  CRISPR gRNA sequence
gggtattatgtaacactcaa

SEQ ID NO: 537982 - DNA, 20 bp, Artificial
  CRISPR gRNA sequence
ggtattatgtaacactcaaa

SEQ ID NO: 537983 - DNA, 20 bp, Artificial
  CRISPR gRNA sequence
attatgtaacactcaaaagg

SEQ ID NO: 537984 - DNA, 20 bp, Artificial
  CRISPR gRNA sequence
ctcaaaaggtggaattaata

SEQ ID NO: 537985 - DNA, 20 bp, Artificial
  CRISPR gRNA sequence
tcaaaaggtggaattaataa

SEQ ID NO: 537986 - DNA, 20 bp, Artificial
  CRISPR gRNA sequence
aataaaggaatgtttgctcc

SEQ ID NO: 537987 - DNA, 20 bp, Artificial
  CRISPR gRNA sequence
gcttaactattttaactttg

SEQ ID NO: 537988 - DNA, 20 bp, Artificial
  CRISPR gRNA sequence
aattgtgtgacttgtacaaa

SEQ ID NO: 537989 - DNA, 20 bp, Artificial
  CRISPR gRNA sequence
tgtacaaacagtgctccttt

SEQ ID NO: 537990 - DNA, 20 bp, Artificial
  CRISPR gRNA sequence
tcctttgagtgacacctctg

SEQ ID NO: 537991 - DNA, 20 bp, Artificial
  CRISPR gRNA sequence
cctttgagtgacacctctgt

SEQ ID NO: 537992 - DNA, 20 bp, Artificial
  CRISPR gRNA sequence
tcttcaaaaatcaaatctat

SEQ ID NO: 537993 - DNA, 20 bp, Artificial
  CRISPR gRNA sequence
caaatctatcagttataaat

SEQ ID NO: 537994 - DNA, 20 bp, Artificial
  CRISPR gRNA sequence
aaatctatcagttataaatt

SEQ ID NO: 537995 - DNA, 20 bp, Artificial
  CRISPR gRNA sequence
tccgtgtttcataactttaa

SEQ ID NO: 537996 - DNA, 20 bp, Artificial
  CRISPR gRNA sequence
caaattgaaaacactgtatt

SEQ ID NO: 537997 - DNA, 20 bp, Artificial
  CRISPR gRNA sequence
ttcagttataaatgtgttct

SEQ ID NO: 537998 - DNA, 20 bp, Artificial
  CRISPR gRNA sequence
tcagttataaatgtgttcta

SEQ ID NO: 537999 - DNA, 20 bp, Artificial
  CRISPR gRNA sequence
ttataaatgtgttctaaggt

SEQ ID NO: 538000 - DNA, 20 bp, Artificial
  CRISPR gRNA sequence
tataaatgtgttctaaggtt

SEQ ID NO: 538001 - DNA, 20 bp, Artificial
  CRISPR gRNA sequence
atgtgttctaaggttaggct

SEQ ID NO: 538002 - DNA, 20 bp, Artificial
  CRISPR gRNA sequence
gttaggctgagcactctcta

SEQ ID NO: 538003 - DNA, 20 bp, Artificial
  CRISPR gRNA sequence
ttaggctgagcactctctac

SEQ ID NO: 538004 - DNA, 20 bp, Artificial
  CRISPR gRNA sequence
ctgagcactctctacaggcc

SEQ ID NO: 538005 - DNA, 20 bp, Artificial
  CRISPR gRNA sequence
gcactctctacaggcctggt

SEQ ID NO: 538006 - DNA, 20 bp, Artificial
  CRISPR gRNA sequence
ctctacaggcctggtcagcg

SEQ ID NO: 538007 - DNA, 20 bp, Artificial
  CRISPR gRNA sequence
caggcctggtcagcgcggac

SEQ ID NO: 538008 - DNA, 20 bp, Artificial
  CRISPR gRNA sequence
aggcctggtcagcgcggaca

SEQ ID NO: 538009 - DNA, 20 bp, Artificial
  CRISPR gRNA sequence
agcgcggacaaggccatccc

SEQ ID NO: 538010 - DNA, 20 bp, Artificial
  CRISPR gRNA sequence
aaggccatccccggctgcca

SEQ ID NO: 538011 - DNA, 20 bp, Artificial
  CRISPR gRNA sequence
ggccatccccggctgccaca

SEQ ID NO: 538012 - DNA, 20 bp, Artificial
  CRISPR gRNA sequence
acagagcgctgtcacccact

SEQ ID NO: 538013 - DNA, 20 bp, Artificial
  CRISPR gRNA sequence
cacttggaaaccccactcac

SEQ ID NO: 538014 - DNA, 20 bp, Artificial
  CRISPR gRNA sequence
cccactcaccagccaccaac

SEQ ID NO: 538015 - DNA, 20 bp, Artificial
  CRISPR gRNA sequence
caccaaccggtcacaccaac

SEQ ID NO: 538016 - DNA, 20 bp, Artificial
  CRISPR gRNA sequence
accaaccggtcacaccaacc

SEQ ID NO: 538017 - DNA, 20 bp, Artificial
  CRISPR gRNA sequence
gtcacaccaaccaggacctt

SEQ ID NO: 538018 - DNA, 20 bp, Artificial
  CRISPR gRNA sequence
caccaaccaggaccttcaga

SEQ ID NO: 538019 - DNA, 20 bp, Artificial
  CRISPR gRNA sequence
accaaccaggaccttcagac

SEQ ID NO: 538020 - DNA, 20 bp, Artificial
  CRISPR gRNA sequence
ggaccttcagacaggatgaa

SEQ ID NO: 538021 - DNA, 20 bp, Artificial
  CRISPR gRNA sequence
ccttcagacaggatgaatgg

SEQ ID NO: 538022 - DNA, 20 bp, Artificial
  CRISPR gRNA sequence
cttcagacaggatgaatggt

SEQ ID NO: 538023 - DNA, 20 bp, Artificial
  CRISPR gRNA sequence
ttcagacaggatgaatggtg

SEQ ID NO: 538024 - DNA, 20 bp, Artificial
  CRISPR gRNA sequence
acaggatgaatggtggggcc

SEQ ID NO: 538025 - DNA, 20 bp, Artificial
  CRISPR gRNA sequence
tgaatggtggggcccagcaa

SEQ ID NO: 538026 - DNA, 20 bp, Artificial
  CRISPR gRNA sequence
gaatggtggggcccagcaat

SEQ ID NO: 538027 - DNA, 20 bp, Artificial
  CRISPR gRNA sequence
ggcccagcaatgggactact

SEQ ID NO: 538028 - DNA, 20 bp, Artificial
  CRISPR gRNA sequence
cagcaatgggactactgaga

SEQ ID NO: 538029 - DNA, 20 bp, Artificial
  CRISPR gRNA sequence
caatgggactactgagaaag

SEQ ID NO: 538030 - DNA, 20 bp, Artificial
  CRISPR gRNA sequence
aatgggactactgagaaagc

SEQ ID NO: 538031 - DNA, 20 bp, Artificial
  CRISPR gRNA sequence
tcatatgctcaaatgaaacg

SEQ ID NO: 538032 - DNA, 20 bp, Artificial
  CRISPR gRNA sequence
catatgctcaaatgaaacgc

SEQ ID NO: 538033 - DNA, 20 bp, Artificial
  CRISPR gRNA sequence
aaatgaaacgcaggacttcc

SEQ ID NO: 538034 - DNA, 20 bp, Artificial
  CRISPR gRNA sequence
aaacgcaggacttcccagcc

SEQ ID NO: 538035 - DNA, 20 bp, Artificial
  CRISPR gRNA sequence
ttcccagcccagcccctcac

SEQ ID NO: 538036 - DNA, 20 bp, Artificial
  CRISPR gRNA sequence
cccagcccagcccctcactg

SEQ ID NO: 538037 - DNA, 20 bp, Artificial
  CRISPR gRNA sequence
acactgccgaatcccaactc

SEQ ID NO: 538038 - DNA, 20 bp, Artificial
  CRISPR gRNA sequence
ctgccgaatcccaactccgg

SEQ ID NO: 538039 - DNA, 20 bp, Artificial
  CRISPR gRNA sequence
ccgaatcccaactccggcag

SEQ ID NO: 538040 - DNA, 20 bp, Artificial
  CRISPR gRNA sequence
cgaatcccaactccggcagc

SEQ ID NO: 538041 - DNA, 20 bp, Artificial
  CRISPR gRNA sequence
gaatcccaactccggcagca

SEQ ID NO: 538042 - DNA, 20 bp, Artificial
  CRISPR gRNA sequence
tcccaactccggcagcaggg

SEQ ID NO: 538043 - DNA, 20 bp, Artificial
  CRISPR gRNA sequence
cagggcggtgcctgtgtcac

SEQ ID NO: 538044 - DNA, 20 bp, Artificial
  CRISPR gRNA sequence
agggcggtgcctgtgtcacg

SEQ ID NO: 538045 - DNA, 20 bp, Artificial
  CRISPR gRNA sequence
cggtgcctgtgtcacgagga

SEQ ID NO: 538046 - DNA, 20 bp, Artificial
  CRISPR gRNA sequence
ggtgcctgtgtcacgaggac

SEQ ID NO: 538047 - DNA, 20 bp, Artificial
  CRISPR gRNA sequence
cgaggacaggctcgcgtctt

SEQ ID NO: 538048 - DNA, 20 bp, Artificial
  CRISPR gRNA sequence
caggctcgcgtcttcagccc

SEQ ID NO: 538049 - DNA, 20 bp, Artificial
  CRISPR gRNA sequence
gctcgcgtcttcagccctgg

SEQ ID NO: 538050 - DNA, 20 bp, Artificial
  CRISPR gRNA sequence
cgcgtcttcagccctggtgg

SEQ ID NO: 538051 - DNA, 20 bp, Artificial
  CRISPR gRNA sequence
gcgtcttcagccctggtggc

SEQ ID NO: 538052 - DNA, 20 bp, Artificial
  CRISPR gRNA sequence
tcttcagccctggtggcagg

SEQ ID NO: 538053 - DNA, 20 bp, Artificial
  CRISPR gRNA sequence
tcagccctggtggcaggaag

SEQ ID NO: 538054 - DNA, 20 bp, Artificial
  CRISPR gRNA sequence
gaagcagtgtttcttccgca

SEQ ID NO: 538055 - DNA, 20 bp, Artificial
  CRISPR gRNA sequence
cgcacagcccttgctcctgc

SEQ ID NO: 538056 - DNA, 20 bp, Artificial
  CRISPR gRNA sequence
gcacagcccttgctcctgct

SEQ ID NO: 538057 - DNA, 20 bp, Artificial
  CRISPR gRNA sequence
cagcccttgctcctgctagg

SEQ ID NO: 538058 - DNA, 20 bp, Artificial
  CRISPR gRNA sequence
cccttgctcctgctaggaag

SEQ ID NO: 538059 - DNA, 20 bp, Artificial
  CRISPR gRNA sequence
aagtggcacatcttcctgct

SEQ ID NO: 538060 - DNA, 20 bp, Artificial
  CRISPR gRNA sequence
agtggcacatcttcctgctc

SEQ ID NO: 538061 - DNA, 20 bp, Artificial
  CRISPR gRNA sequence
catcttcctgctcaggtcac

SEQ ID NO: 538062 - DNA, 20 bp, Artificial
  CRISPR gRNA sequence
atcttcctgctcaggtcacc

SEQ ID NO: 538063 - DNA, 20 bp, Artificial
  CRISPR gRNA sequence
tcttcctgctcaggtcacca

SEQ ID NO: 538064 - DNA, 20 bp, Artificial
  CRISPR gRNA sequence
tcctgctcaggtcaccaggg

SEQ ID NO: 538065 - DNA, 20 bp, Artificial
  CRISPR gRNA sequence
ctcaggtcaccagggtggtt

SEQ ID NO: 538066 - DNA, 20 bp, Artificial
  CRISPR gRNA sequence
tcaccagggtggttcagaaa

SEQ ID NO: 538067 - DNA, 20 bp, Artificial
  CRISPR gRNA sequence
cagggtggttcagaaatggc

SEQ ID NO: 538068 - DNA, 20 bp, Artificial
  CRISPR gRNA sequence
agggtggttcagaaatggca

SEQ ID NO: 538069 - DNA, 20 bp, Artificial
  CRISPR gRNA sequence
ggttcagaaatggcaaggac

SEQ ID NO: 538070 - DNA, 20 bp, Artificial
  CRISPR gRNA sequence
gaaatggcaaggacgagcga

SEQ ID NO: 538071 - DNA, 20 bp, Artificial
  CRISPR gRNA sequence
gcaaggacgagcgacagcaa

SEQ ID NO: 538072 - DNA, 20 bp, Artificial
  CRISPR gRNA sequence
caaggacgagcgacagcaaa

SEQ ID NO: 538073 - DNA, 20 bp, Artificial
  CRISPR gRNA sequence
cgagcgacagcaaaaggccg

SEQ ID NO: 538074 - DNA, 20 bp, Artificial
  CRISPR gRNA sequence
gcaaaaggccgcagtcctca

SEQ ID NO: 538075 - DNA, 20 bp, Artificial
  CRISPR gRNA sequence
caaaaggccgcagtcctcac

SEQ ID NO: 538076 - DNA, 20 bp, Artificial
  CRISPR gRNA sequence
aggccgcagtcctcacaggc

SEQ ID NO: 538077 - DNA, 20 bp, Artificial
  CRISPR gRNA sequence
ccgcagtcctcacaggcaag

SEQ ID NO: 538078 - DNA, 20 bp, Artificial
  CRISPR gRNA sequence
cgcagtcctcacaggcaaga

SEQ ID NO: 538079 - DNA, 20 bp, Artificial
  CRISPR gRNA sequence
gcagtcctcacaggcaagaa

SEQ ID NO: 538080 - DNA, 20 bp, Artificial
  CRISPR gRNA sequence
aagaagggataaataaatat

SEQ ID NO: 538081 - DNA, 20 bp, Artificial
  CRISPR gRNA sequence
agaagggataaataaatatg

SEQ ID NO: 538082 - DNA, 20 bp, Artificial
  CRISPR gRNA sequence
aataaatatgaggtgacccg

SEQ ID NO: 538083 - DNA, 20 bp, Artificial
  CRISPR gRNA sequence
aaatatgaggtgacccgtgg

SEQ ID NO: 538084 - DNA, 20 bp, Artificial
  CRISPR gRNA sequence
acccgtggcagctctcgcct

SEQ ID NO: 538085 - DNA, 20 bp, Artificial
  CRISPR gRNA sequence
gtggcagctctcgcctgagc

SEQ ID NO: 538086 - DNA, 20 bp, Artificial
  CRISPR gRNA sequence
ccctgacccaacccttaaaa

SEQ ID NO: 538087 - DNA, 20 bp, Artificial
  CRISPR gRNA sequence
tgacccaacccttaaaaaag

SEQ ID NO: 538088 - DNA, 20 bp, Artificial
  CRISPR gRNA sequence
ccttaaaaaagaagatcaaa

SEQ ID NO: 538089 - DNA, 20 bp, Artificial
  CRISPR gRNA sequence
agatcaaaaagcaacatcct

SEQ ID NO: 538090 - DNA, 20 bp, Artificial
  CRISPR gRNA sequence
gatcaaaaagcaacatccta

SEQ ID NO: 538091 - DNA, 20 bp, Artificial
  CRISPR gRNA sequence
tcaaaaagcaacatcctaag

SEQ ID NO: 538092 - DNA, 20 bp, Artificial
  CRISPR gRNA sequence
gcaacatcctaaggagaata

SEQ ID NO: 538093 - DNA, 20 bp, Artificial
  CRISPR gRNA sequence
gaatacggccctactctaca

SEQ ID NO: 538094 - DNA, 20 bp, Artificial
  CRISPR gRNA sequence
ctactctacacggcccttct

SEQ ID NO: 538095 - DNA, 20 bp, Artificial
  CRISPR gRNA sequence
cacggcccttctgagatgat

SEQ ID NO: 538096 - DNA, 20 bp, Artificial
  CRISPR gRNA sequence
cttctgagatgattagcata

SEQ ID NO: 538097 - DNA, 20 bp, Artificial
  CRISPR gRNA sequence
ctgagatgattagcatacag

SEQ ID NO: 538098 - DNA, 20 bp, Artificial
  CRISPR gRNA sequence
tgagatgattagcatacagc

SEQ ID NO: 538099 - DNA, 20 bp, Artificial
  CRISPR gRNA sequence
ttagcatacagcaggtgatg

SEQ ID NO: 538100 - DNA, 20 bp, Artificial
  CRISPR gRNA sequence
tagcatacagcaggtgatgc

SEQ ID NO: 538101 - DNA, 20 bp, Artificial
  CRISPR gRNA sequence
ggtgatgcaggctgcacact

SEQ ID NO: 538102 - DNA, 20 bp, Artificial
  CRISPR gRNA sequence
gatgcaggctgcacactcag

SEQ ID NO: 538103 - DNA, 20 bp, Artificial
  CRISPR gRNA sequence
ggctgcacactcagcagatt

SEQ ID NO: 538104 - DNA, 20 bp, Artificial
  CRISPR gRNA sequence
tgcacactcagcagattaag

SEQ ID NO: 538105 - DNA, 20 bp, Artificial
  CRISPR gRNA sequence
gcagattaagcagctgaaaa

SEQ ID NO: 538106 - DNA, 20 bp, Artificial
  CRISPR gRNA sequence
attaagcagctgaaaacagc

SEQ ID NO: 538107 - DNA, 20 bp, Artificial
  CRISPR gRNA sequence
aagcagctgaaaacagcgag

SEQ ID NO: 538108 - DNA, 20 bp, Artificial
  CRISPR gRNA sequence
agcagctgaaaacagcgagt

SEQ ID NO: 538109 - DNA, 20 bp, Artificial
  CRISPR gRNA sequence
gagtgggtttcttcaaatga

SEQ ID NO: 538110 - DNA, 20 bp, Artificial
  CRISPR gRNA sequence
agtgggtttcttcaaatgaa

SEQ ID NO: 538111 - DNA, 20 bp, Artificial
  CRISPR gRNA sequence
ggtttcttcaaatgaaagga

SEQ ID NO: 538112 - DNA, 20 bp, Artificial
  CRISPR gRNA sequence
tcaaatgaaaggaaagaatt

SEQ ID NO: 538113 - DNA, 20 bp, Artificial
  CRISPR gRNA sequence
gaaagaattcagtccaactg

SEQ ID NO: 538114 - DNA, 20 bp, Artificial
  CRISPR gRNA sequence
aaagaattcagtccaactgc

SEQ ID NO: 538115 - DNA, 20 bp, Artificial
  CRISPR gRNA sequence
agaattcagtccaactgcag

SEQ ID NO: 538116 - DNA, 20 bp, Artificial
  CRISPR gRNA sequence
attcagtccaactgcaggag

SEQ ID NO: 538117 - DNA, 20 bp, Artificial
  CRISPR gRNA sequence
cagtccaactgcaggagtgg

SEQ ID NO: 538118 - DNA, 20 bp, Artificial
  CRISPR gRNA sequence
agtccaactgcaggagtggt

SEQ ID NO: 538119 - DNA, 20 bp, Artificial
  CRISPR gRNA sequence
tccaactgcaggagtggtag

SEQ ID NO: 538120 - DNA, 20 bp, Artificial
  CRISPR gRNA sequence
caactgcaggagtggtagga

SEQ ID NO: 538121 - DNA, 20 bp, Artificial
  CRISPR gRNA sequence
aactgcaggagtggtaggag

SEQ ID NO: 538122 - DNA, 20 bp, Artificial
  CRISPR gRNA sequence
aggagtggtaggagaggttc

SEQ ID NO: 538123 - DNA, 20 bp, Artificial
  CRISPR gRNA sequence
taggagaggttctagatccc

SEQ ID NO: 538124 - DNA, 20 bp, Artificial
  CRISPR gRNA sequence
gatccctggaacctcatcac

SEQ ID NO: 538125 - DNA, 20 bp, Artificial
  CRISPR gRNA sequence
ggaacctcatcaccagacct

SEQ ID NO: 538126 - DNA, 20 bp, Artificial
  CRISPR gRNA sequence
tcaccagacctcggcccttt

SEQ ID NO: 538127 - DNA, 20 bp, Artificial
  CRISPR gRNA sequence
agacctcggcccttttagcc

SEQ ID NO: 538128 - DNA, 20 bp, Artificial
  CRISPR gRNA sequence
cccatcccaccccaccccaa

SEQ ID NO: 538129 - DNA, 20 bp, Artificial
  CRISPR gRNA sequence
ccatcccaccccaccccaat

SEQ ID NO: 538130 - DNA, 20 bp, Artificial
  CRISPR gRNA sequence
catcccaccccaccccaatg

SEQ ID NO: 538131 - DNA, 20 bp, Artificial
  CRISPR gRNA sequence
ccccaccccaatggggtcta

SEQ ID NO: 538132 - DNA, 20 bp, Artificial
  CRISPR gRNA sequence
cccaccccaatggggtctat

SEQ ID NO: 538133 - DNA, 20 bp, Artificial
  CRISPR gRNA sequence
ccaccccaatggggtctatg

SEQ ID NO: 538134 - DNA, 20 bp, Artificial
  CRISPR gRNA sequence
gggtctatggggccctcccg

SEQ ID NO: 538135 - DNA, 20 bp, Artificial
  CRISPR gRNA sequence
ggtctatggggccctcccgc

SEQ ID NO: 538136 - DNA, 20 bp, Artificial
  CRISPR gRNA sequence
gtctatggggccctcccgca

SEQ ID NO: 538137 - DNA, 20 bp, Artificial
  CRISPR gRNA sequence
tatggggccctcccgcaggg

SEQ ID NO: 538138 - DNA, 20 bp, Artificial
  CRISPR gRNA sequence
atggggccctcccgcaggga

SEQ ID NO: 538139 - DNA, 20 bp, Artificial
  CRISPR gRNA sequence
tggggccctcccgcagggaa

SEQ ID NO: 538140 - DNA, 20 bp, Artificial
  CRISPR gRNA sequence
ccctcccgcagggaagggtc

SEQ ID NO: 538141 - DNA, 20 bp, Artificial
  CRISPR gRNA sequence
cctcccgcagggaagggtcc

SEQ ID NO: 538142 - DNA, 20 bp, Artificial
  CRISPR gRNA sequence
ccgcagggaagggtccaggc

SEQ ID NO: 538143 - DNA, 20 bp, Artificial
  CRISPR gRNA sequence
gggaagggtccaggcaagtc

SEQ ID NO: 538144 - DNA, 20 bp, Artificial
  CRISPR gRNA sequence
gaagggtccaggcaagtcca

SEQ ID NO: 538145 - DNA, 20 bp, Artificial
  CRISPR gRNA sequence
tccaggcaagtccagagcta

SEQ ID NO: 538146 - DNA, 20 bp, Artificial
  CRISPR gRNA sequence
ccaggcaagtccagagctac

SEQ ID NO: 538147 - DNA, 20 bp, Artificial
  CRISPR gRNA sequence
agtccagagctacaggcacc

SEQ ID NO: 538148 - DNA, 20 bp, Artificial
  CRISPR gRNA sequence
gtccagagctacaggcacca

SEQ ID NO: 538149 - DNA, 20 bp, Artificial
  CRISPR gRNA sequence
agctacaggcaccaaggctg

SEQ ID NO: 538150 - DNA, 20 bp, Artificial
  CRISPR gRNA sequence
ctacaggcaccaaggctgca

SEQ ID NO: 538151 - DNA, 20 bp, Artificial
  CRISPR gRNA sequence
tacaggcaccaaggctgcag

SEQ ID NO: 538152 - DNA, 20 bp, Artificial
  CRISPR gRNA sequence
acaggcaccaaggctgcaga

SEQ ID NO: 538153 - DNA, 20 bp, Artificial
  CRISPR gRNA sequence
accaaggctgcagagggtat

SEQ ID NO: 538154 - DNA, 20 bp, Artificial
  CRISPR gRNA sequence
cctatttctgaaatgcattt

SEQ ID NO: 538155 - DNA, 20 bp, Artificial
  CRISPR gRNA sequence
cagttgccactgtacacatt

SEQ ID NO: 538156 - DNA, 20 bp, Artificial
  CRISPR gRNA sequence
tacacattaagcaaaataat

SEQ ID NO: 538157 - DNA, 20 bp, Artificial
  CRISPR gRNA sequence
acacattaagcaaaataata

SEQ ID NO: 538158 - DNA, 20 bp, Artificial
  CRISPR gRNA sequence
taagcaaaataataaggaaa

SEQ ID NO: 538159 - DNA, 20 bp, Artificial
  CRISPR gRNA sequence
aagcaaaataataaggaaaa

SEQ ID NO: 538160 - DNA, 20 bp, Artificial
  CRISPR gRNA sequence
aaataataaggaaaaaggaa

SEQ ID NO: 538161 - DNA, 20 bp, Artificial
  CRISPR gRNA sequence
taaggaaaaaggaaaagtga

SEQ ID NO: 538162 - DNA, 20 bp, Artificial
  CRISPR gRNA sequence
atcatgcacttgaaaacgat

SEQ ID NO: 538163 - DNA, 20 bp, Artificial
  CRISPR gRNA sequence
tgcacttgaaaacgattaga

SEQ ID NO: 538164 - DNA, 20 bp, Artificial
  CRISPR gRNA sequence
cacttgaaaacgattagatg

SEQ ID NO: 538165 - DNA, 20 bp, Artificial
  CRISPR gRNA sequence
tgaaaacgattagatggagt

SEQ ID NO: 538166 - DNA, 20 bp, Artificial
  CRISPR gRNA sequence
gatggagtaagcgctgtcga

SEQ ID NO: 538167 - DNA, 20 bp, Artificial
  CRISPR gRNA sequence
atggagtaagcgctgtcgac

SEQ ID NO: 538168 - DNA, 20 bp, Artificial
  CRISPR gRNA sequence
cgacgggattgtgccgcatg

SEQ ID NO: 538169 - DNA, 20 bp, Artificial
  CRISPR gRNA sequence
ggattgtgccgcatgcggca

SEQ ID NO: 538170 - DNA, 20 bp, Artificial
  CRISPR gRNA sequence
tgccgcatgcggcaaagact

SEQ ID NO: 538171 - DNA, 20 bp, Artificial
  CRISPR gRNA sequence
gccgcatgcggcaaagactg

SEQ ID NO: 538172 - DNA, 20 bp, Artificial
  CRISPR gRNA sequence
aagactgaggcctcccgcta

SEQ ID NO: 538173 - DNA, 20 bp, Artificial
  CRISPR gRNA sequence
agactgaggcctcccgctac

SEQ ID NO: 538174 - DNA, 20 bp, Artificial
  CRISPR gRNA sequence
gaggcctcccgctacaggcc

SEQ ID NO: 538175 - DNA, 20 bp, Artificial
  CRISPR gRNA sequence
ggcctcccgctacaggcccg

SEQ ID NO: 538176 - DNA, 20 bp, Artificial
  CRISPR gRNA sequence
ctacaggcccggagtcgcga

SEQ ID NO: 538177 - DNA, 20 bp, Artificial
  CRISPR gRNA sequence
aggcccggagtcgcgacagc

SEQ ID NO: 538178 - DNA, 20 bp, Artificial
  CRISPR gRNA sequence
agtcgcgacagccggtctgc

SEQ ID NO: 538179 - DNA, 20 bp, Artificial
  CRISPR gRNA sequence
gtcgcgacagccggtctgcc

SEQ ID NO: 538180 - DNA, 20 bp, Artificial
  CRISPR gRNA sequence
tactgctgcttgcattccgc

SEQ ID NO: 538181 - DNA, 20 bp, Artificial
  CRISPR gRNA sequence
gctgcttgcattccgccggc

SEQ ID NO: 538182 - DNA, 20 bp, Artificial
  CRISPR gRNA sequence
cttgcattccgccggctggc

SEQ ID NO: 538183 - DNA, 20 bp, Artificial
  CRISPR gRNA sequence
ttgcattccgccggctggct

SEQ ID NO: 538184 - DNA, 20 bp, Artificial
  CRISPR gRNA sequence
cggctggctgggttccttgt

SEQ ID NO: 538185 - DNA, 20 bp, Artificial
  CRISPR gRNA sequence
ggctggctgggttccttgtt

SEQ ID NO: 538186 - DNA, 20 bp, Artificial
  CRISPR gRNA sequence
caaaattgtcatcatccttt

SEQ ID NO: 538187 - DNA, 20 bp, Artificial
  CRISPR gRNA sequence
aaaattgtcatcatccttta

SEQ ID NO: 538188 - DNA, 20 bp, Artificial
  CRISPR gRNA sequence
atcatcctttaaggcctccc

SEQ ID NO: 538189 - DNA, 20 bp, Artificial
  CRISPR gRNA sequence
cctttaaggcctccccagcg

SEQ ID NO: 538190 - DNA, 20 bp, Artificial
  CRISPR gRNA sequence
aaggcctccccagcgaagta

SEQ ID NO: 538191 - DNA, 20 bp, Artificial
  CRISPR gRNA sequence
ctccccagcgaagtacagca

SEQ ID NO: 538192 - DNA, 20 bp, Artificial
  CRISPR gRNA sequence
gcgaagtacagcacagcctg

SEQ ID NO: 538193 - DNA, 20 bp, Artificial
  CRISPR gRNA sequence
cacagcctgtggtccgctca

SEQ ID NO: 538194 - DNA, 20 bp, Artificial
  CRISPR gRNA sequence
ctgtggtccgctcacggaaa

SEQ ID NO: 538195 - DNA, 20 bp, Artificial
  CRISPR gRNA sequence
aaagtgtccaatttcaaaat

SEQ ID NO: 538196 - DNA, 20 bp, Artificial
  CRISPR gRNA sequence
agtgtccaatttcaaaatca

SEQ ID NO: 538197 - DNA, 20 bp, Artificial
  CRISPR gRNA sequence
gtgtccaatttcaaaatcag

SEQ ID NO: 538198 - DNA, 20 bp, Artificial
  CRISPR gRNA sequence
atcagaggctaatacgaatt

SEQ ID NO: 538199 - DNA, 20 bp, Artificial
  CRISPR gRNA sequence
acgaattcagaatctttatc

SEQ ID NO: 538200 - DNA, 20 bp, Artificial
  CRISPR gRNA sequence
atccagtgattctccgtccc

SEQ ID NO: 538201 - DNA, 20 bp, Artificial
  CRISPR gRNA sequence
tctccgtccccagatgcttt

SEQ ID NO: 538202 - DNA, 20 bp, Artificial
  CRISPR gRNA sequence
ccgtccccagatgctttcag

SEQ ID NO: 538203 - DNA, 20 bp, Artificial
  CRISPR gRNA sequence
cagatgctttcagtggattg

SEQ ID NO: 538204 - DNA, 20 bp, Artificial
  CRISPR gRNA sequence
atgctttcagtggattgaag

SEQ ID NO: 538205 - DNA, 20 bp, Artificial
  CRISPR gRNA sequence
gaagttgaaaaatgactcat

SEQ ID NO: 538206 - DNA, 20 bp, Artificial
  CRISPR gRNA sequence
tgactcattggatacttgtt

SEQ ID NO: 538207 - DNA, 20 bp, Artificial
  CRISPR gRNA sequence
ttgtttggtaattgttctaa

SEQ ID NO: 538208 - DNA, 20 bp, Artificial
  CRISPR gRNA sequence
gtaattgttctaacagtgcc

SEQ ID NO: 538209 - DNA, 20 bp, Artificial
  CRISPR gRNA sequence
acgcttctgctttttcttga

SEQ ID NO: 538210 - DNA, 20 bp, Artificial
  CRISPR gRNA sequence
ctttttcttgatggttttga

SEQ ID NO: 538211 - DNA, 20 bp, Artificial
  CRISPR gRNA sequence
taacattctttcctttcttc

SEQ ID NO: 538212 - DNA, 20 bp, Artificial
  CRISPR gRNA sequence
ctttcctttcttccagtcaa

SEQ ID NO: 538213 - DNA, 20 bp, Artificial
  CRISPR gRNA sequence
agtcaatagtacacccatcg

SEQ ID NO: 538214 - DNA, 20 bp, Artificial
  CRISPR gRNA sequence
cccatcgcagtccatgatct

SEQ ID NO: 538215 - DNA, 20 bp, Artificial
  CRISPR gRNA sequence
ccatcgcagtccatgatctc

SEQ ID NO: 538216 - DNA, 20 bp, Artificial
  CRISPR gRNA sequence
tctcaggacctgcaaatgaa

SEQ ID NO: 538217 - DNA, 20 bp, Artificial
  CRISPR gRNA sequence
ctcaggacctgcaaatgaaa

SEQ ID NO: 538218 - DNA, 20 bp, Artificial
  CRISPR gRNA sequence
tcaggacctgcaaatgaaaa

SEQ ID NO: 538219 - DNA, 20 bp, Artificial
  CRISPR gRNA sequence
acctgcaaatgaaaagggat

SEQ ID NO: 538220 - DNA, 20 bp, Artificial
  CRISPR gRNA sequence
gaaaagggatcagccttatc

SEQ ID NO: 538221 - DNA, 20 bp, Artificial
  CRISPR gRNA sequence
ctggttctgatttcatcttg

SEQ ID NO: 538222 - DNA, 20 bp, Artificial
  CRISPR gRNA sequence
tggttctgatttcatcttgc

SEQ ID NO: 538223 - DNA, 20 bp, Artificial
  CRISPR gRNA sequence
ttcatcttgcaggtttttgt

SEQ ID NO: 538224 - DNA, 20 bp, Artificial
  CRISPR gRNA sequence
tcatcttgcaggtttttgtc

SEQ ID NO: 538225 - DNA, 20 bp, Artificial
  CRISPR gRNA sequence
tgcaggtttttgtcaggact

SEQ ID NO: 538226 - DNA, 20 bp, Artificial
  CRISPR gRNA sequence
ggtttttgtcaggactgagt

SEQ ID NO: 538227 - DNA, 20 bp, Artificial
  CRISPR gRNA sequence
ttgtcaggactgagttggca

SEQ ID NO: 538228 - DNA, 20 bp, Artificial
  CRISPR gRNA sequence
tcaggactgagttggcaaag

SEQ ID NO: 538229 - DNA, 20 bp, Artificial
  CRISPR gRNA sequence
tgagttggcaaagcagtcat

SEQ ID NO: 538230 - DNA, 20 bp, Artificial
  CRISPR gRNA sequence
gagttggcaaagcagtcatt

SEQ ID NO: 538231 - DNA, 20 bp, Artificial
  CRISPR gRNA sequence
caaagcagtcattgggttga

SEQ ID NO: 538232 - DNA, 20 bp, Artificial
  CRISPR gRNA sequence
agcagtcattgggttgaaag

SEQ ID NO: 538233 - DNA, 20 bp, Artificial
  CRISPR gRNA sequence
aagtggaactcttaatatga

SEQ ID NO: 538234 - DNA, 20 bp, Artificial
  CRISPR gRNA sequence
aactcttaatatgaaagaca

SEQ ID NO: 538235 - DNA, 20 bp, Artificial
  CRISPR gRNA sequence
actcttaatatgaaagacat

SEQ ID NO: 538236 - DNA, 20 bp, Artificial
  CRISPR gRNA sequence
tatgaaagacataggctgtc

SEQ ID NO: 538237 - DNA, 20 bp, Artificial
  CRISPR gRNA sequence
atgaaagacataggctgtcc

SEQ ID NO: 538238 - DNA, 20 bp, Artificial
  CRISPR gRNA sequence
tgaaagacataggctgtcca

SEQ ID NO: 538239 - DNA, 20 bp, Artificial
  CRISPR gRNA sequence
agacataggctgtccagggt

SEQ ID NO: 538240 - DNA, 20 bp, Artificial
  CRISPR gRNA sequence
aacttcactttaatatcctg

SEQ ID NO: 538241 - DNA, 20 bp, Artificial
  CRISPR gRNA sequence
acttcactttaatatcctgc

SEQ ID NO: 538242 - DNA, 20 bp, Artificial
  CRISPR gRNA sequence
taatatcctgcaggtatttc

SEQ ID NO: 538243 - DNA, 20 bp, Artificial
  CRISPR gRNA sequence
tcctgcaggtatttcaagat

SEQ ID NO: 538244 - DNA, 20 bp, Artificial
  CRISPR gRNA sequence
agattggttcatcatattcc

SEQ ID NO: 538245 - DNA, 20 bp, Artificial
  CRISPR gRNA sequence
tattcctggactaattcact

SEQ ID NO: 538246 - DNA, 20 bp, Artificial
  CRISPR gRNA sequence
ttagcatatctacatttcta

SEQ ID NO: 538247 - DNA, 20 bp, Artificial
  CRISPR gRNA sequence
catatctacatttctaaaga

SEQ ID NO: 538248 - DNA, 20 bp, Artificial
  CRISPR gRNA sequence
catttctaaagatggtaaac

SEQ ID NO: 538249 - DNA, 20 bp, Artificial
  CRISPR gRNA sequence
aagatggtaaaccagaactc

SEQ ID NO: 538250 - DNA, 20 bp, Artificial
  CRISPR gRNA sequence
ccagaactctggaattcctt

SEQ ID NO: 538251 - DNA, 20 bp, Artificial
  CRISPR gRNA sequence
cagaactctggaattccttt

SEQ ID NO: 538252 - DNA, 20 bp, Artificial
  CRISPR gRNA sequence
tctggaattcctttgggatt

SEQ ID NO: 538253 - DNA, 20 bp, Artificial
  CRISPR gRNA sequence
tcctttgggatttggctctt

SEQ ID NO: 538254 - DNA, 20 bp, Artificial
  CRISPR gRNA sequence
tactttatttttcctgtctc

SEQ ID NO: 538255 - DNA, 20 bp, Artificial
  CRISPR gRNA sequence
tctcctcctcttcattttca

SEQ ID NO: 538256 - DNA, 20 bp, Artificial
  CRISPR gRNA sequence
gtgccattctgattccatat

SEQ ID NO: 538257 - DNA, 20 bp, Artificial
  CRISPR gRNA sequence
tctgattccatatcagatgt

SEQ ID NO: 538258 - DNA, 20 bp, Artificial
  CRISPR gRNA sequence
agatgttggttcaacatcac

SEQ ID NO: 538259 - DNA, 20 bp, Artificial
  CRISPR gRNA sequence
taaattctcttctctcgtca

SEQ ID NO: 538260 - DNA, 20 bp, Artificial
  CRISPR gRNA sequence
aattctcttctctcgtcaaa

SEQ ID NO: 538261 - DNA, 20 bp, Artificial
  CRISPR gRNA sequence
ttctcttctctcgtcaaaga

SEQ ID NO: 538262 - DNA, 20 bp, Artificial
  CRISPR gRNA sequence
tctcttctctcgtcaaagag

SEQ ID NO: 538263 - DNA, 20 bp, Artificial
  CRISPR gRNA sequence
ttctctcgtcaaagagaggc

SEQ ID NO: 538264 - DNA, 20 bp, Artificial
  CRISPR gRNA sequence
atgctgcatattttctttcc

SEQ ID NO: 538265 - DNA, 20 bp, Artificial
  CRISPR gRNA sequence
ccaagtcatgaacttcttca

SEQ ID NO: 538266 - DNA, 20 bp, Artificial
  CRISPR gRNA sequence
atgaacttcttcatagaact

SEQ ID NO: 538267 - DNA, 20 bp, Artificial
  CRISPR gRNA sequence
atagaacttggcttctatat

SEQ ID NO: 538268 - DNA, 20 bp, Artificial
  CRISPR gRNA sequence
aattcttctttttactgctt

SEQ ID NO: 538269 - DNA, 20 bp, Artificial
  CRISPR gRNA sequence
attcttctttttactgcttt

SEQ ID NO: 538270 - DNA, 20 bp, Artificial
  CRISPR gRNA sequence
tctttttactgctttaggta

SEQ ID NO: 538271 - DNA, 20 bp, Artificial
  CRISPR gRNA sequence
ctttaggtaaagtttcgatg

SEQ ID NO: 538272 - DNA, 20 bp, Artificial
  CRISPR gRNA sequence
aggtaaagtttcgatgtagc

SEQ ID NO: 538273 - DNA, 20 bp, Artificial
  CRISPR gRNA sequence
taaagtttcgatgtagctgg

SEQ ID NO: 538274 - DNA, 20 bp, Artificial
  CRISPR gRNA sequence
aaagtttcgatgtagctgga

SEQ ID NO: 538275 - DNA, 20 bp, Artificial
  CRISPR gRNA sequence
aagtttcgatgtagctggaa

SEQ ID NO: 538276 - DNA, 20 bp, Artificial
  CRISPR gRNA sequence
agtttcgatgtagctggaag

SEQ ID NO: 538277 - DNA, 20 bp, Artificial
  CRISPR gRNA sequence
gatgtagctggaaggggtgt

SEQ ID NO: 538278 - DNA, 20 bp, Artificial
  CRISPR gRNA sequence
atgtagctggaaggggtgtg

SEQ ID NO: 538279 - DNA, 20 bp, Artificial
  CRISPR gRNA sequence
tgtagctggaaggggtgtga

SEQ ID NO: 538280 - DNA, 20 bp, Artificial
  CRISPR gRNA sequence
gtagctggaaggggtgtgag

SEQ ID NO: 538281 - DNA, 20 bp, Artificial
  CRISPR gRNA sequence
ggggtgtgaggggcattgtc

SEQ ID NO: 538282 - DNA, 20 bp, Artificial
  CRISPR gRNA sequence
attgtcaagtcgctcctgta

SEQ ID NO: 538283 - DNA, 20 bp, Artificial
  CRISPR gRNA sequence
ctgtaaagctgccaaaactc

SEQ ID NO: 538284 - DNA, 20 bp, Artificial
  CRISPR gRNA sequence
tgtaaagctgccaaaactcc

SEQ ID NO: 538285 - DNA, 20 bp, Artificial
  CRISPR gRNA sequence
ttctgcatcacctgatccgt

SEQ ID NO: 538286 - DNA, 20 bp, Artificial
  CRISPR gRNA sequence
ttccgtcttacttgcatttt

SEQ ID NO: 538287 - DNA, 20 bp, Artificial
  CRISPR gRNA sequence
cgtcttacttgcatttttag

SEQ ID NO: 538288 - DNA, 20 bp, Artificial
  CRISPR gRNA sequence
agcagcttccacgaaatctg

SEQ ID NO: 538289 - DNA, 20 bp, Artificial
  CRISPR gRNA sequence
gcagcttccacgaaatctga

SEQ ID NO: 538290 - DNA, 20 bp, Artificial
  CRISPR gRNA sequence
aatgtttttatccccttgtc

SEQ ID NO: 538291 - DNA, 20 bp, Artificial
  CRISPR gRNA sequence
atccccttgtctggtaaacc

SEQ ID NO: 538292 - DNA, 20 bp, Artificial
  CRISPR gRNA sequence
tctggtaaaccaagtcccgt

SEQ ID NO: 538293 - DNA, 20 bp, Artificial
  CRISPR gRNA sequence
aaccaagtcccgtgagtaac

SEQ ID NO: 538294 - DNA, 20 bp, Artificial
  CRISPR gRNA sequence
accaagtcccgtgagtaact

SEQ ID NO: 538295 - DNA, 20 bp, Artificial
  CRISPR gRNA sequence
gtcccgtgagtaactaggct

SEQ ID NO: 538296 - DNA, 20 bp, Artificial
  CRISPR gRNA sequence
tcccgtgagtaactaggcta

SEQ ID NO: 538297 - DNA, 20 bp, Artificial
  CRISPR gRNA sequence
agtaactaggctaaggcact

SEQ ID NO: 538298 - DNA, 20 bp, Artificial
  CRISPR gRNA sequence
gtaactaggctaaggcactc

SEQ ID NO: 538299 - DNA, 20 bp, Artificial
  CRISPR gRNA sequence
ctaggctaaggcactcaggc

SEQ ID NO: 538300 - DNA, 20 bp, Artificial
  CRISPR gRNA sequence
aaggcactcaggccagtcct

SEQ ID NO: 538301 - DNA, 20 bp, Artificial
  CRISPR gRNA sequence
aggcactcaggccagtcctc

SEQ ID NO: 538302 - DNA, 20 bp, Artificial
  CRISPR gRNA sequence
ggcactcaggccagtcctcg

SEQ ID NO: 538303 - DNA, 20 bp, Artificial
  CRISPR gRNA sequence
cactcaggccagtcctcggg

SEQ ID NO: 538304 - DNA, 20 bp, Artificial
  CRISPR gRNA sequence
gggagcacacgccgcccatc

SEQ ID NO: 538305 - DNA, 20 bp, Artificial
  CRISPR gRNA sequence
cccatctggctcgcaccgca

SEQ ID NO: 538306 - DNA, 20 bp, Artificial
  CRISPR gRNA sequence
tcgcaccgcacagctcccaa

SEQ ID NO: 538307 - DNA, 20 bp, Artificial
  CRISPR gRNA sequence
ccgcacagctcccaacagct

SEQ ID NO: 538308 - DNA, 20 bp, Artificial
  CRISPR gRNA sequence
aacagctgagatgcaatgcc

SEQ ID NO: 538309 - DNA, 20 bp, Artificial
  CRISPR gRNA sequence
acagctgagatgcaatgcca

SEQ ID NO: 538310 - DNA, 20 bp, Artificial
  CRISPR gRNA sequence
ccaaggactttcttccccat

SEQ ID NO: 538311 - DNA, 20 bp, Artificial
  CRISPR gRNA sequence
gaaacttacaatcaaaaccc

SEQ ID NO: 538312 - DNA, 20 bp, Artificial
  CRISPR gRNA sequence
cttacaatcaaaaccccagt

SEQ ID NO: 538313 - DNA, 20 bp, Artificial
  CRISPR gRNA sequence
aatcaaaaccccagttagcc

SEQ ID NO: 538314 - DNA, 20 bp, Artificial
  CRISPR gRNA sequence
gttagcccagcctgacccca

SEQ ID NO: 538315 - DNA, 20 bp, Artificial
  CRISPR gRNA sequence
tcacgatgaccatcgcccta

SEQ ID NO: 538316 - DNA, 20 bp, Artificial
  CRISPR gRNA sequence
aaattcctaaacatctaata

SEQ ID NO: 538317 - DNA, 20 bp, Artificial
  CRISPR gRNA sequence
attcctaaacatctaataaa

SEQ ID NO: 538318 - DNA, 20 bp, Artificial
  CRISPR gRNA sequence
ttcctaaacatctaataaag

SEQ ID NO: 538319 - DNA, 20 bp, Artificial
  CRISPR gRNA sequence
aacatctaataaagaggtcc

SEQ ID NO: 538320 - DNA, 20 bp, Artificial
  CRISPR gRNA sequence
ggacgtctccaccttaaaaa

SEQ ID NO: 538321 - DNA, 20 bp, Artificial
  CRISPR gRNA sequence
gacgtctccaccttaaaaac

SEQ ID NO: 538322 - DNA, 20 bp, Artificial
  CRISPR gRNA sequence
gtctccaccttaaaaacggg

SEQ ID NO: 538323 - DNA, 20 bp, Artificial
  CRISPR gRNA sequence
gggaagcctgaatgctcctc

SEQ ID NO: 538324 - DNA, 20 bp, Artificial
  CRISPR gRNA sequence
ggaagcctgaatgctcctcc

SEQ ID NO: 538325 - DNA, 20 bp, Artificial
  CRISPR gRNA sequence
atgctcctccgggtgcgccg

SEQ ID NO: 538326 - DNA, 20 bp, Artificial
  CRISPR gRNA sequence
ccgggtgcgccgcggccctc

SEQ ID NO: 538327 - DNA, 20 bp, Artificial
  CRISPR gRNA sequence
cgggtgcgccgcggccctcc

SEQ ID NO: 538328 - DNA, 20 bp, Artificial
  CRISPR gRNA sequence
gccgcggccctccgggtacg

SEQ ID NO: 538329 - DNA, 20 bp, Artificial
  CRISPR gRNA sequence
ccgcggccctccgggtacgc

SEQ ID NO: 538330 - DNA, 20 bp, Artificial
  CRISPR gRNA sequence
cgcggccctccgggtacgcg

SEQ ID NO: 538331 - DNA, 20 bp, Artificial
  CRISPR gRNA sequence
gccctccgggtacgcggggc

SEQ ID NO: 538332 - DNA, 20 bp, Artificial
  CRISPR gRNA sequence
tccgggtacgcggggctggc

SEQ ID NO: 538333 - DNA, 20 bp, Artificial
  CRISPR gRNA sequence
ccgggtacgcggggctggct

SEQ ID NO: 538334 - DNA, 20 bp, Artificial
  CRISPR gRNA sequence
gtacgcggggctggctgggc

SEQ ID NO: 538335 - DNA, 20 bp, Artificial
  CRISPR gRNA sequence
cgcggggctggctgggctag

SEQ ID NO: 538336 - DNA, 20 bp, Artificial
  CRISPR gRNA sequence
gcggggctggctgggctagc

SEQ ID NO: 538337 - DNA, 20 bp, Artificial
  CRISPR gRNA sequence
ggggctggctgggctagcgg

SEQ ID NO: 538338 - DNA, 20 bp, Artificial
  CRISPR gRNA sequence
gctgggctagcgggagattt

SEQ ID NO: 538339 - DNA, 20 bp, Artificial
  CRISPR gRNA sequence
tagcgggagatttgagctgc

SEQ ID NO: 538340 - DNA, 20 bp, Artificial
  CRISPR gRNA sequence
gccctctacgcctcctccgc

SEQ ID NO: 538341 - DNA, 20 bp, Artificial
  CRISPR gRNA sequence
ccctctacgcctcctccgct

SEQ ID NO: 538342 - DNA, 20 bp, Artificial
  CRISPR gRNA sequence
cgcctcctccgctgggccgc

SEQ ID NO: 538343 - DNA, 20 bp, Artificial
  CRISPR gRNA sequence
tcctccgctgggccgccggc

SEQ ID NO: 538344 - DNA, 20 bp, Artificial
  CRISPR gRNA sequence
cctccgctgggccgccggcg

SEQ ID NO: 538345 - DNA, 20 bp, Artificial
  CRISPR gRNA sequence
ccgctgggccgccggcgagg

SEQ ID NO: 538346 - DNA, 20 bp, Artificial
  CRISPR gRNA sequence
gccggcgaggaagccgcccg

SEQ ID NO: 538347 - DNA, 20 bp, Artificial
  CRISPR gRNA sequence
cgaggaagccgcccgcagcg

SEQ ID NO: 538348 - DNA, 20 bp, Artificial
  CRISPR gRNA sequence
gccgcccgcagcgcagaaca

SEQ ID NO: 538349 - DNA, 20 bp, Artificial
  CRISPR gRNA sequence
gaacaaagcgacttgacctt

SEQ ID NO: 538350 - DNA, 20 bp, Artificial
  CRISPR gRNA sequence
aacaaagcgacttgaccttc

SEQ ID NO: 538351 - DNA, 20 bp, Artificial
  CRISPR gRNA sequence
acaaagcgacttgaccttca

SEQ ID NO: 538352 - DNA, 20 bp, Artificial
  CRISPR gRNA sequence
aagcgacttgaccttcaggg

SEQ ID NO: 538353 - DNA, 20 bp, Artificial
  CRISPR gRNA sequence
cgacttgaccttcagggcag

SEQ ID NO: 538354 - DNA, 20 bp, Artificial
  CRISPR gRNA sequence
gacttgaccttcagggcagt

SEQ ID NO: 538355 - DNA, 20 bp, Artificial
  CRISPR gRNA sequence
ttgaccttcagggcagtggg

SEQ ID NO: 538356 - DNA, 20 bp, Artificial
  CRISPR gRNA sequence
accttcagggcagtgggcgg

SEQ ID NO: 538357 - DNA, 20 bp, Artificial
  CRISPR gRNA sequence
ccttcagggcagtgggcggc

SEQ ID NO: 538358 - DNA, 20 bp, Artificial
  CRISPR gRNA sequence
cttcagggcagtgggcggca

SEQ ID NO: 538359 - DNA, 20 bp, Artificial
  CRISPR gRNA sequence
cagggcagtgggcggcaggg

SEQ ID NO: 538360 - DNA, 20 bp, Artificial
  CRISPR gRNA sequence
agggcagtgggcggcagggc

SEQ ID NO: 538361 - DNA, 20 bp, Artificial
  CRISPR gRNA sequence
gggcagtgggcggcagggca

SEQ ID NO: 538362 - DNA, 20 bp, Artificial
  CRISPR gRNA sequence
ggcagtgggcggcagggcag

SEQ ID NO: 538363 - DNA, 20 bp, Artificial
  CRISPR gRNA sequence
gcggcagggcaggggcgcac

SEQ ID NO: 538364 - DNA, 20 bp, Artificial
  CRISPR gRNA sequence
cggcagggcaggggcgcacc

SEQ ID NO: 538365 - DNA, 20 bp, Artificial
  CRISPR gRNA sequence
ggcaggggcgcaccgggtgc

SEQ ID NO: 538366 - DNA, 20 bp, Artificial
  CRISPR gRNA sequence
gcaggggcgcaccgggtgct

SEQ ID NO: 538367 - DNA, 20 bp, Artificial
  CRISPR gRNA sequence
aggggcgcaccgggtgctgg

SEQ ID NO: 538368 - DNA, 20 bp, Artificial
  CRISPR gRNA sequence
ggggcgcaccgggtgctggg

SEQ ID NO: 538369 - DNA, 20 bp, Artificial
  CRISPR gRNA sequence
gggcgcaccgggtgctggga

SEQ ID NO: 538370 - DNA, 20 bp, Artificial
  CRISPR gRNA sequence
ggcgcaccgggtgctgggag

SEQ ID NO: 538371 - DNA, 20 bp, Artificial
  CRISPR gRNA sequence
ggtgctgggaggggccgctc

SEQ ID NO: 538372 - DNA, 20 bp, Artificial
  CRISPR gRNA sequence
gtgctgggaggggccgctcc

SEQ ID NO: 538373 - DNA, 20 bp, Artificial
  CRISPR gRNA sequence
gaggggccgctccaggcccc

SEQ ID NO: 538374 - DNA, 20 bp, Artificial
  CRISPR gRNA sequence
ccgctccaggccccaagccc

SEQ ID NO: 538375 - DNA, 20 bp, Artificial
  CRISPR gRNA sequence
cgctccaggccccaagcccc

SEQ ID NO: 538376 - DNA, 20 bp, Artificial
  CRISPR gRNA sequence
cccaagccccaggcccgccg

SEQ ID NO: 538377 - DNA, 20 bp, Artificial
  CRISPR gRNA sequence
aagccccaggcccgccgcgg

SEQ ID NO: 538378 - DNA, 20 bp, Artificial
  CRISPR gRNA sequence
gcggcgctgcccaccctgac

SEQ ID NO: 538379 - DNA, 20 bp, Artificial
  CRISPR gRNA sequence
cggcgctgcccaccctgacg

SEQ ID NO: 538380 - DNA, 20 bp, Artificial
  CRISPR gRNA sequence
aaatgtctttcctttcccaa

SEQ ID NO: 538381 - DNA, 20 bp, Artificial
  CRISPR gRNA sequence
tgaaaataatataactttaa

SEQ ID NO: 538382 - DNA, 20 bp, Artificial
  CRISPR gRNA sequence
aatataactttaatggcttt

SEQ ID NO: 538383 - DNA, 20 bp, Artificial
  CRISPR gRNA sequence
ggctttaagttattgtttga

SEQ ID NO: 538384 - DNA, 20 bp, Artificial
  CRISPR gRNA sequence
gctttaagttattgtttgaa

SEQ ID NO: 538385 - DNA, 20 bp, Artificial
  CRISPR gRNA sequence
ctttaagttattgtttgaaa

SEQ ID NO: 538386 - DNA, 20 bp, Artificial
  CRISPR gRNA sequence
agttattgtttgaaagggtt

SEQ ID NO: 538387 - DNA, 20 bp, Artificial
  CRISPR gRNA sequence
ttgtttgaaagggttcagaa

SEQ ID NO: 538388 - DNA, 20 bp, Artificial
  CRISPR gRNA sequence
ggttcagaaaagacaataaa

SEQ ID NO: 538389 - DNA, 20 bp, Artificial
  CRISPR gRNA sequence
gttcagaaaagacaataaat

SEQ ID NO: 538390 - DNA, 20 bp, Artificial
  CRISPR gRNA sequence
tcagaaaagacaataaatgg

SEQ ID NO: 538391 - DNA, 20 bp, Artificial
  CRISPR gRNA sequence
aagacaataaatgggagact

SEQ ID NO: 538392 - DNA, 20 bp, Artificial
  CRISPR gRNA sequence
aataaatgggagacttagaa

SEQ ID NO: 538393 - DNA, 20 bp, Artificial
  CRISPR gRNA sequence
ggagacttagaatggctcac

SEQ ID NO: 538394 - DNA, 20 bp, Artificial
  CRISPR gRNA sequence
tggctcaccagttaaaatcc

SEQ ID NO: 538395 - DNA, 20 bp, Artificial
  CRISPR gRNA sequence
ctaatttcccttatctgttt

SEQ ID NO: 538396 - DNA, 20 bp, Artificial
  CRISPR gRNA sequence
atctgtttcagctgcttgtt

SEQ ID NO: 538397 - DNA, 20 bp, Artificial
  CRISPR gRNA sequence
gttcagaaaaatttcattca

SEQ ID NO: 538398 - DNA, 20 bp, Artificial
  CRISPR gRNA sequence
ttcatagactcaccttatcc

SEQ ID NO: 538399 - DNA, 20 bp, Artificial
  CRISPR gRNA sequence
gactcaccttatcccagccc

SEQ ID NO: 538400 - DNA, 20 bp, Artificial
  CRISPR gRNA sequence
ctcaccttatcccagcccta

SEQ ID NO: 538401 - DNA, 20 bp, Artificial
  CRISPR gRNA sequence
ctcatattctctatttgccc

SEQ ID NO: 538402 - DNA, 20 bp, Artificial
  CRISPR gRNA sequence
aattatattattctgaataa

SEQ ID NO: 538403 - DNA, 20 bp, Artificial
  CRISPR gRNA sequence
tattttaataaaccactttc

SEQ ID NO: 538404 - DNA, 20 bp, Artificial
  CRISPR gRNA sequence
gacctttttgtttgttaaac

SEQ ID NO: 538405 - DNA, 20 bp, Artificial
  CRISPR gRNA sequence
acctttttgtttgttaaact

SEQ ID NO: 538406 - DNA, 20 bp, Artificial
  CRISPR gRNA sequence
cctttttgtttgttaaactg

SEQ ID NO: 538407 - DNA, 20 bp, Artificial
  CRISPR gRNA sequence
tggggatataatgtaaaaaa

SEQ ID NO: 538408 - DNA, 20 bp, Artificial
  CRISPR gRNA sequence
aaataatactaaaacaacat

SEQ ID NO: 538409 - DNA, 20 bp, Artificial
  CRISPR gRNA sequence
aaaacaacattagaaaatca

SEQ ID NO: 538410 - DNA, 20 bp, Artificial
  CRISPR gRNA sequence
aacattagaaaatcatagcc

SEQ ID NO: 538411 - DNA, 20 bp, Artificial
  CRISPR gRNA sequence
ttagaaaatcatagccaaga

SEQ ID NO: 538412 - DNA, 20 bp, Artificial
  CRISPR gRNA sequence
agattgtcatgatattaact

SEQ ID NO: 538413 - DNA, 20 bp, Artificial
  CRISPR gRNA sequence
tcatgatattaacttagtgt

SEQ ID NO: 538414 - DNA, 20 bp, Artificial
  CRISPR gRNA sequence
catgatattaacttagtgtt

SEQ ID NO: 538415 - DNA, 20 bp, Artificial
  CRISPR gRNA sequence
attaacttagtgttaggcct

SEQ ID NO: 538416 - DNA, 20 bp, Artificial
  CRISPR gRNA sequence
ttaacttagtgttaggccta

SEQ ID NO: 538417 - DNA, 20 bp, Artificial
  CRISPR gRNA sequence
atatcaaatgcatgttcctg

SEQ ID NO: 538418 - DNA, 20 bp, Artificial
  CRISPR gRNA sequence
tcaaatgcatgttcctgtag

SEQ ID NO: 538419 - DNA, 20 bp, Artificial
  CRISPR gRNA sequence
gtagtagatatgtaaccttt

SEQ ID NO: 538420 - DNA, 20 bp, Artificial
  CRISPR gRNA sequence
gatattataacaatattata

SEQ ID NO: 538421 - DNA, 20 bp, Artificial
  CRISPR gRNA sequence
attataacaatattataaag

SEQ ID NO: 538422 - DNA, 20 bp, Artificial
  CRISPR gRNA sequence
ttataaagcagcattgtgaa

SEQ ID NO: 538423 - DNA, 20 bp, Artificial
  CRISPR gRNA sequence
attgtgaatagttaaaacca

SEQ ID NO: 538424 - DNA, 20 bp, Artificial
  CRISPR gRNA sequence
ttgtgaatagttaaaaccat

SEQ ID NO: 538425 - DNA, 20 bp, Artificial
  CRISPR gRNA sequence
atagttaaaaccatgggctc

SEQ ID NO: 538426 - DNA, 20 bp, Artificial
  CRISPR gRNA sequence
agttaaaaccatgggctcta

SEQ ID NO: 538427 - DNA, 20 bp, Artificial
  CRISPR gRNA sequence
aaaaccatgggctctagagc

SEQ ID NO: 538428 - DNA, 20 bp, Artificial
  CRISPR gRNA sequence
ccatgggctctagagccaga

SEQ ID NO: 538429 - DNA, 20 bp, Artificial
  CRISPR gRNA sequence
agccagatagcctctactca

SEQ ID NO: 538430 - DNA, 20 bp, Artificial
  CRISPR gRNA sequence
agatagcctctactcaaagc

SEQ ID NO: 538431 - DNA, 20 bp, Artificial
  CRISPR gRNA sequence
gatagcctctactcaaagcc

SEQ ID NO: 538432 - DNA, 20 bp, Artificial
  CRISPR gRNA sequence
agccaggttctgccacttac

SEQ ID NO: 538433 - DNA, 20 bp, Artificial
  CRISPR gRNA sequence
cacttactagctgttacctt

SEQ ID NO: 538434 - DNA, 20 bp, Artificial
  CRISPR gRNA sequence
aacttaaactctctctctgt

SEQ ID NO: 538435 - DNA, 20 bp, Artificial
  CRISPR gRNA sequence
tctctctgttggtttctcac

SEQ ID NO: 538436 - DNA, 20 bp, Artificial
  CRISPR gRNA sequence
ctctctgttggtttctcacc

SEQ ID NO: 538437 - DNA, 20 bp, Artificial
  CRISPR gRNA sequence
gttggtttctcaccaggaaa

SEQ ID NO: 538438 - DNA, 20 bp, Artificial
  CRISPR gRNA sequence
ttggtttctcaccaggaaac

SEQ ID NO: 538439 - DNA, 20 bp, Artificial
  CRISPR gRNA sequence
tggtttctcaccaggaaaca

SEQ ID NO: 538440 - DNA, 20 bp, Artificial
  CRISPR gRNA sequence
tctcaccaggaaacagggat

SEQ ID NO: 538441 - DNA, 20 bp, Artificial
  CRISPR gRNA sequence
caggaaacagggataagtac

SEQ ID NO: 538442 - DNA, 20 bp, Artificial
  CRISPR gRNA sequence
aagtactagtacacaactta

SEQ ID NO: 538443 - DNA, 20 bp, Artificial
  CRISPR gRNA sequence
agtactagtacacaacttat

SEQ ID NO: 538444 - DNA, 20 bp, Artificial
  CRISPR gRNA sequence
acacaacttataggttgtat

SEQ ID NO: 538445 - DNA, 20 bp, Artificial
  CRISPR gRNA sequence
cacaacttataggttgtatg

SEQ ID NO: 538446 - DNA, 20 bp, Artificial
  CRISPR gRNA sequence
gttgtatgaggattgatgtg

SEQ ID NO: 538447 - DNA, 20 bp, Artificial
  CRISPR gRNA sequence
gaattaattaacatatgtat

SEQ ID NO: 538448 - DNA, 20 bp, Artificial
  CRISPR gRNA sequence
aattaacatatgtattagaa

SEQ ID NO: 538449 - DNA, 20 bp, Artificial
  CRISPR gRNA sequence
tattagaatggtgctcaaca

SEQ ID NO: 538450 - DNA, 20 bp, Artificial
  CRISPR gRNA sequence
agaatggtgctcaacacaga

SEQ ID NO: 538451 - DNA, 20 bp, Artificial
  CRISPR gRNA sequence
cagaaagtgctaaataatgt

SEQ ID NO: 538452 - DNA, 20 bp, Artificial
  CRISPR gRNA sequence
tgttagctttgtatctataa

SEQ ID NO: 538453 - DNA, 20 bp, Artificial
  CRISPR gRNA sequence
gttagctttgtatctataat

SEQ ID NO: 538454 - DNA, 20 bp, Artificial
  CRISPR gRNA sequence
ttagctttgtatctataatg

SEQ ID NO: 538455 - DNA, 20 bp, Artificial
  CRISPR gRNA sequence
tgttaaaaattgtaacttgt

SEQ ID NO: 538456 - DNA, 20 bp, Artificial
  CRISPR gRNA sequence
aaaaattgtaacttgttggc

SEQ ID NO: 538457 - DNA, 20 bp, Artificial
  CRISPR gRNA sequence
aaaattgtaacttgttggcc

SEQ ID NO: 538458 - DNA, 20 bp, Artificial
  CRISPR gRNA sequence
tgtaacttgttggccgggcg

SEQ ID NO: 538459 - DNA, 20 bp, Artificial
  CRISPR gRNA sequence
aacttgttggccgggcgcgg

SEQ ID NO: 538460 - DNA, 20 bp, Artificial
  CRISPR gRNA sequence
gtggctcacgcctgtaatcc

SEQ ID NO: 538461 - DNA, 20 bp, Artificial
  CRISPR gRNA sequence
cgcctgtaatcccagcactt

SEQ ID NO: 538462 - DNA, 20 bp, Artificial
  CRISPR gRNA sequence
gcctgtaatcccagcacttt

SEQ ID NO: 538463 - DNA, 20 bp, Artificial
  CRISPR gRNA sequence
ctgtaatcccagcactttgg

SEQ ID NO: 538464 - DNA, 20 bp, Artificial
  CRISPR gRNA sequence
tgtaatcccagcactttggg

SEQ ID NO: 538465 - DNA, 20 bp, Artificial
  CRISPR gRNA sequence
tcccagcactttgggaggcc

SEQ ID NO: 538466 - DNA, 20 bp, Artificial
  CRISPR gRNA sequence
cccagcactttgggaggccg

SEQ ID NO: 538467 - DNA, 20 bp, Artificial
  CRISPR gRNA sequence
agcactttgggaggccgagg

SEQ ID NO: 538468 - DNA, 20 bp, Artificial
  CRISPR gRNA sequence
gcactttgggaggccgaggc

SEQ ID NO: 538469 - DNA, 20 bp, Artificial
  CRISPR gRNA sequence
ctttgggaggccgaggcggg

SEQ ID NO: 538470 - DNA, 20 bp, Artificial
  CRISPR gRNA sequence
ggccgaggcgggcggatcac

SEQ ID NO: 538471 - DNA, 20 bp, Artificial
  CRISPR gRNA sequence
gccgaggcgggcggatcacg

SEQ ID NO: 538472 - DNA, 20 bp, Artificial
  CRISPR gRNA sequence
aggcgggcggatcacgaggt

SEQ ID NO: 538473 - DNA, 20 bp, Artificial
  CRISPR gRNA sequence
ggcgggcggatcacgaggtc

SEQ ID NO: 538474 - DNA, 20 bp, Artificial
  CRISPR gRNA sequence
cgggcggatcacgaggtcag

SEQ ID NO: 538475 - DNA, 20 bp, Artificial
  CRISPR gRNA sequence
gatcacgaggtcaggagatc

SEQ ID NO: 538476 - DNA, 20 bp, Artificial
  CRISPR gRNA sequence
tcaggagatcgagaccatcc

SEQ ID NO: 538477 - DNA, 20 bp, Artificial
  CRISPR gRNA sequence
cgagaccatcctggctaaca

SEQ ID NO: 538478 - DNA, 20 bp, Artificial
  CRISPR gRNA sequence
ctactaaaaatacaaaaaat

SEQ ID NO: 538479 - DNA, 20 bp, Artificial
  CRISPR gRNA sequence
taaaaatacaaaaaattagc

SEQ ID NO: 538480 - DNA, 20 bp, Artificial
  CRISPR gRNA sequence
aaaaatacaaaaaattagcc

SEQ ID NO: 538481 - DNA, 20 bp, Artificial
  CRISPR gRNA sequence
tacaaaaaattagccgggcg

SEQ ID NO: 538482 - DNA, 20 bp, Artificial
  CRISPR gRNA sequence
aaaaaattagccgggcgtgg

SEQ ID NO: 538483 - DNA, 20 bp, Artificial
  CRISPR gRNA sequence
aaattagccgggcgtggtgg

SEQ ID NO: 538484 - DNA, 20 bp, Artificial
  CRISPR gRNA sequence
aattagccgggcgtggtggc

SEQ ID NO: 538485 - DNA, 20 bp, Artificial
  CRISPR gRNA sequence
ggcgtggtggcgggcgcctg

SEQ ID NO: 538486 - DNA, 20 bp, Artificial
  CRISPR gRNA sequence
gtggcgggcgcctgtagtcc

SEQ ID NO: 538487 - DNA, 20 bp, Artificial
  CRISPR gRNA sequence
cgcctgtagtcccagctact

SEQ ID NO: 538488 - DNA, 20 bp, Artificial
  CRISPR gRNA sequence
gcctgtagtcccagctactc

SEQ ID NO: 538489 - DNA, 20 bp, Artificial
  CRISPR gRNA sequence
ctgtagtcccagctactcgg

SEQ ID NO: 538490 - DNA, 20 bp, Artificial
  CRISPR gRNA sequence
tgtagtcccagctactcggg

SEQ ID NO: 538491 - DNA, 20 bp, Artificial
  CRISPR gRNA sequence
tcccagctactcgggaggct

SEQ ID NO: 538492 - DNA, 20 bp, Artificial
  CRISPR gRNA sequence
cccagctactcgggaggctg

SEQ ID NO: 538493 - DNA, 20 bp, Artificial
  CRISPR gRNA sequence
agctactcgggaggctgagg

SEQ ID NO: 538494 - DNA, 20 bp, Artificial
  CRISPR gRNA sequence
gctactcgggaggctgaggc

SEQ ID NO: 538495 - DNA, 20 bp, Artificial
  CRISPR gRNA sequence
tactcgggaggctgaggcag

SEQ ID NO: 538496 - DNA, 20 bp, Artificial
  CRISPR gRNA sequence
gggaggctgaggcaggagaa

SEQ ID NO: 538497 - DNA, 20 bp, Artificial
  CRISPR gRNA sequence
gcaggagaatggcgtgaacc

SEQ ID NO: 538498 - DNA, 20 bp, Artificial
  CRISPR gRNA sequence
caggagaatggcgtgaaccc

SEQ ID NO: 538499 - DNA, 20 bp, Artificial
  CRISPR gRNA sequence
ggagaatggcgtgaacccag

SEQ ID NO: 538500 - DNA, 20 bp, Artificial
  CRISPR gRNA sequence
gagaatggcgtgaacccagg

SEQ ID NO: 538501 - DNA, 20 bp, Artificial
  CRISPR gRNA sequence
aatggcgtgaacccaggagg

SEQ ID NO: 538502 - DNA, 20 bp, Artificial
  CRISPR gRNA sequence
tggcgtgaacccaggaggcg

SEQ ID NO: 538503 - DNA, 20 bp, Artificial
  CRISPR gRNA sequence
aacccaggaggcggagcttg

SEQ ID NO: 538504 - DNA, 20 bp, Artificial
  CRISPR gRNA sequence
caggaggcggagcttgcagt

SEQ ID NO: 538505 - DNA, 20 bp, Artificial
  CRISPR gRNA sequence
ggcggagcttgcagtgagcc

SEQ ID NO: 538506 - DNA, 20 bp, Artificial
  CRISPR gRNA sequence
gagatcgcgccactgcactc

SEQ ID NO: 538507 - DNA, 20 bp, Artificial
  CRISPR gRNA sequence
cgcgccactgcactccagcc

SEQ ID NO: 538508 - DNA, 20 bp, Artificial
  CRISPR gRNA sequence
gcgccactgcactccagcct

SEQ ID NO: 538509 - DNA, 20 bp, Artificial
  CRISPR gRNA sequence
ctgcactccagcctgggcga

SEQ ID NO: 538510 - DNA, 20 bp, Artificial
  CRISPR gRNA sequence
gcactccagcctgggcgaca

SEQ ID NO: 538511 - DNA, 20 bp, Artificial
  CRISPR gRNA sequence
tccagcctgggcgacagagc

SEQ ID NO: 538512 - DNA, 20 bp, Artificial
  CRISPR gRNA sequence
caaaattgtgaaccttgtgt

SEQ ID NO: 538513 - DNA, 20 bp, Artificial
  CRISPR gRNA sequence
tgtgttagtcaccacatctg

SEQ ID NO: 538514 - DNA, 20 bp, Artificial
  CRISPR gRNA sequence
tcaccacatctgtggtctga

SEQ ID NO: 538515 - DNA, 20 bp, Artificial
  CRISPR gRNA sequence
gaaagcctccatgacacatt

SEQ ID NO: 538516 - DNA, 20 bp, Artificial
  CRISPR gRNA sequence
gttatttactcaccgctgct

SEQ ID NO: 538517 - DNA, 20 bp, Artificial
  CRISPR gRNA sequence
ttatttactcaccgctgctt

SEQ ID NO: 538518 - DNA, 20 bp, Artificial
  CRISPR gRNA sequence
actcaccgctgcttgggata

SEQ ID NO: 538519 - DNA, 20 bp, Artificial
  CRISPR gRNA sequence
ctcaccgctgcttgggatac

SEQ ID NO: 538520 - DNA, 20 bp, Artificial
  CRISPR gRNA sequence
gatgatgttgtattaaataa

SEQ ID NO: 538521 - DNA, 20 bp, Artificial
  CRISPR gRNA sequence
gtattaaataatggattgct

SEQ ID NO: 538522 - DNA, 20 bp, Artificial
  CRISPR gRNA sequence
attaaataatggattgctaa

SEQ ID NO: 538523 - DNA, 20 bp, Artificial
  CRISPR gRNA sequence
agagtacactgtattttttg

SEQ ID NO: 538524 - DNA, 20 bp, Artificial
  CRISPR gRNA sequence
gtacactgtattttttgtgg

SEQ ID NO: 538525 - DNA, 20 bp, Artificial
  CRISPR gRNA sequence
ttccatcttaaaatatatac

SEQ ID NO: 538526 - DNA, 20 bp, Artificial
  CRISPR gRNA sequence
tcttaaaatatatactggtt

SEQ ID NO: 538527 - DNA, 20 bp, Artificial
  CRISPR gRNA sequence
gttacgtttacattgctcca

SEQ ID NO: 538528 - DNA, 20 bp, Artificial
  CRISPR gRNA sequence
ttacgtttacattgctccat

SEQ ID NO: 538529 - DNA, 20 bp, Artificial
  CRISPR gRNA sequence
gctccataggacaatcccat

SEQ ID NO: 538530 - DNA, 20 bp, Artificial
  CRISPR gRNA sequence
caatcccatgagtacattat

SEQ ID NO: 538531 - DNA, 20 bp, Artificial
  CRISPR gRNA sequence
agtacattataagtcctcga

SEQ ID NO: 538532 - DNA, 20 bp, Artificial
  CRISPR gRNA sequence
cgatggctgttgtaatgctc

SEQ ID NO: 538533 - DNA, 20 bp, Artificial
  CRISPR gRNA sequence
aatgctctggtatcatgcat

SEQ ID NO: 538534 - DNA, 20 bp, Artificial
  CRISPR gRNA sequence
ttggacttcaatgcttccat

SEQ ID NO: 538535 - DNA, 20 bp, Artificial
  CRISPR gRNA sequence
gcttccattagtcaatgcac

SEQ ID NO: 538536 - DNA, 20 bp, Artificial
  CRISPR gRNA sequence
ccattagtcaatgcacaagt

SEQ ID NO: 538537 - DNA, 20 bp, Artificial
  CRISPR gRNA sequence
agtcaatgcacaagttagtg

SEQ ID NO: 538538 - DNA, 20 bp, Artificial
  CRISPR gRNA sequence
gtcaatgcacaagttagtgt

SEQ ID NO: 538539 - DNA, 20 bp, Artificial
  CRISPR gRNA sequence
caatgcacaagttagtgtgg

SEQ ID NO: 538540 - DNA, 20 bp, Artificial
  CRISPR gRNA sequence
gcacaagttagtgtgggaga

SEQ ID NO: 538541 - DNA, 20 bp, Artificial
  CRISPR gRNA sequence
caagttagtgtgggagatgg

SEQ ID NO: 538542 - DNA, 20 bp, Artificial
  CRISPR gRNA sequence
agttagtgtgggagatggaa

SEQ ID NO: 538543 - DNA, 20 bp, Artificial
  CRISPR gRNA sequence
gtgggagatggaagagactc

SEQ ID NO: 538544 - DNA, 20 bp, Artificial
  CRISPR gRNA sequence
ggaagagactctggaaaaaa

SEQ ID NO: 538545 - DNA, 20 bp, Artificial
  CRISPR gRNA sequence
ggaaaaaaaagtataatatt

SEQ ID NO: 538546 - DNA, 20 bp, Artificial
  CRISPR gRNA sequence
aaaaagtataatatttagta

SEQ ID NO: 538547 - DNA, 20 bp, Artificial
  CRISPR gRNA sequence
ataatatttagtacagaaaa

SEQ ID NO: 538548 - DNA, 20 bp, Artificial
  CRISPR gRNA sequence
gtacagaaaatagtaatatt

SEQ ID NO: 538549 - DNA, 20 bp, Artificial
  CRISPR gRNA sequence
ttatcatctgcaaatttatg

SEQ ID NO: 538550 - DNA, 20 bp, Artificial
  CRISPR gRNA sequence
atcatctgcaaatttatgaa

SEQ ID NO: 538551 - DNA, 20 bp, Artificial
  CRISPR gRNA sequence
agagctcgcaacctccttac

SEQ ID NO: 538552 - DNA, 20 bp, Artificial
  CRISPR gRNA sequence
caacctccttacaagcttga

SEQ ID NO: 538553 - DNA, 20 bp, Artificial
  CRISPR gRNA sequence
aacctccttacaagcttgaa

SEQ ID NO: 538554 - DNA, 20 bp, Artificial
  CRISPR gRNA sequence
ccttacaagcttgaaaggat

SEQ ID NO: 538555 - DNA, 20 bp, Artificial
  CRISPR gRNA sequence
tacaagcttgaaaggatgag

SEQ ID NO: 538556 - DNA, 20 bp, Artificial
  CRISPR gRNA sequence
gatgagcagacaaactcctt

SEQ ID NO: 538557 - DNA, 20 bp, Artificial
  CRISPR gRNA sequence
agacaaactccttgagcatc

SEQ ID NO: 538558 - DNA, 20 bp, Artificial
  CRISPR gRNA sequence
gacaaactccttgagcatca

SEQ ID NO: 538559 - DNA, 20 bp, Artificial
  CRISPR gRNA sequence
caaactccttgagcatcaag

SEQ ID NO: 538560 - DNA, 20 bp, Artificial
  CRISPR gRNA sequence
ctccttgagcatcaaggagc

SEQ ID NO: 538561 - DNA, 20 bp, Artificial
  CRISPR gRNA sequence
gcgagaattctttcttttgc

SEQ ID NO: 538562 - DNA, 20 bp, Artificial
  CRISPR gRNA sequence
cgagaattctttcttttgct

SEQ ID NO: 538563 - DNA, 20 bp, Artificial
  CRISPR gRNA sequence
aattctttcttttgctaggt

SEQ ID NO: 538564 - DNA, 20 bp, Artificial
  CRISPR gRNA sequence
atctacctgttcaaatttaa

SEQ ID NO: 538565 - DNA, 20 bp, Artificial
  CRISPR gRNA sequence
caaatttaacagaataaatt

SEQ ID NO: 538566 - DNA, 20 bp, Artificial
  CRISPR gRNA sequence
aataaattcagaccctgata

SEQ ID NO: 538567 - DNA, 20 bp, Artificial
  CRISPR gRNA sequence
attcagaccctgatatggtt

SEQ ID NO: 538568 - DNA, 20 bp, Artificial
  CRISPR gRNA sequence
accctgatatggtttggctc

SEQ ID NO: 538569 - DNA, 20 bp, Artificial
  CRISPR gRNA sequence
ccctgatatggtttggctct

SEQ ID NO: 538570 - DNA, 20 bp, Artificial
  CRISPR gRNA sequence
aattgtaattcccatgtgtc

SEQ ID NO: 538571 - DNA, 20 bp, Artificial
  CRISPR gRNA sequence
ttgtaattcccatgtgtcga

SEQ ID NO: 538572 - DNA, 20 bp, Artificial
  CRISPR gRNA sequence
gtaattcccatgtgtcgaga

SEQ ID NO: 538573 - DNA, 20 bp, Artificial
  CRISPR gRNA sequence
taattcccatgtgtcgagag

SEQ ID NO: 538574 - DNA, 20 bp, Artificial
  CRISPR gRNA sequence
aattcccatgtgtcgagaga

SEQ ID NO: 538575 - DNA, 20 bp, Artificial
  CRISPR gRNA sequence
catgtgtcgagagagggacc

SEQ ID NO: 538576 - DNA, 20 bp, Artificial
  CRISPR gRNA sequence
gtgtcgagagagggacctgg

SEQ ID NO: 538577 - DNA, 20 bp, Artificial
  CRISPR gRNA sequence
tgtcgagagagggacctggt

SEQ ID NO: 538578 - DNA, 20 bp, Artificial
  CRISPR gRNA sequence
tcgagagagggacctggtgg

SEQ ID NO: 538579 - DNA, 20 bp, Artificial
  CRISPR gRNA sequence
cgagagagggacctggtggg

SEQ ID NO: 538580 - DNA, 20 bp, Artificial
  CRISPR gRNA sequence
ggtgggaggtgattgtacca

SEQ ID NO: 538581 - DNA, 20 bp, Artificial
  CRISPR gRNA sequence
gtgggaggtgattgtaccat

SEQ ID NO: 538582 - DNA, 20 bp, Artificial
  CRISPR gRNA sequence
tgggaggtgattgtaccatg

SEQ ID NO: 538583 - DNA, 20 bp, Artificial
  CRISPR gRNA sequence
gggaggtgattgtaccatgg

SEQ ID NO: 538584 - DNA, 20 bp, Artificial
  CRISPR gRNA sequence
ggtgattgtaccatggggga

SEQ ID NO: 538585 - DNA, 20 bp, Artificial
  CRISPR gRNA sequence
atggtttccccatgctattc

SEQ ID NO: 538586 - DNA, 20 bp, Artificial
  CRISPR gRNA sequence
tccccatgctattctagtga

SEQ ID NO: 538587 - DNA, 20 bp, Artificial
  CRISPR gRNA sequence
cccatgctattctagtgata

SEQ ID NO: 538588 - DNA, 20 bp, Artificial
  CRISPR gRNA sequence
catgctattctagtgataga

SEQ ID NO: 538589 - DNA, 20 bp, Artificial
  CRISPR gRNA sequence
ctattctagtgatagagagt

SEQ ID NO: 538590 - DNA, 20 bp, Artificial
  CRISPR gRNA sequence
tgagttctcatgacatctgt

SEQ ID NO: 538591 - DNA, 20 bp, Artificial
  CRISPR gRNA sequence
catgacatctgttggtttaa

SEQ ID NO: 538592 - DNA, 20 bp, Artificial
  CRISPR gRNA sequence
tctgttggtttaaaagtgtg

SEQ ID NO: 538593 - DNA, 20 bp, Artificial
  CRISPR gRNA sequence
gttggtttaaaagtgtgtgg

SEQ ID NO: 538594 - DNA, 20 bp, Artificial
  CRISPR gRNA sequence
ctcctgctgccttgtgaaaa

SEQ ID NO: 538595 - DNA, 20 bp, Artificial
  CRISPR gRNA sequence
tcgccttctgccatgattgt

SEQ ID NO: 538596 - DNA, 20 bp, Artificial
  CRISPR gRNA sequence
gccatgattgtaagtttccc

SEQ ID NO: 538597 - DNA, 20 bp, Artificial
  CRISPR gRNA sequence
ccatgattgtaagtttcccg

SEQ ID NO: 538598 - DNA, 20 bp, Artificial
  CRISPR gRNA sequence
taagtttcccgaggcctccc

SEQ ID NO: 538599 - DNA, 20 bp, Artificial
  CRISPR gRNA sequence
ccgaggcctccccagccatg

SEQ ID NO: 538600 - DNA, 20 bp, Artificial
  CRISPR gRNA sequence
ccccagccatgtggaactgt

SEQ ID NO: 538601 - DNA, 20 bp, Artificial
  CRISPR gRNA sequence
tcttttctttataaattacc

SEQ ID NO: 538602 - DNA, 20 bp, Artificial
  CRISPR gRNA sequence
ctttataaattacccagttt

SEQ ID NO: 538603 - DNA, 20 bp, Artificial
  CRISPR gRNA sequence
tttataaattacccagtttc

SEQ ID NO: 538604 - DNA, 20 bp, Artificial
  CRISPR gRNA sequence
ataaattacccagtttcagg

SEQ ID NO: 538605 - DNA, 20 bp, Artificial
  CRISPR gRNA sequence
cagtttcaggtagttcttta

SEQ ID NO: 538606 - DNA, 20 bp, Artificial
  CRISPR gRNA sequence
tttcaggtagttctttatag

SEQ ID NO: 538607 - DNA, 20 bp, Artificial
  CRISPR gRNA sequence
tctttatagcagtgtgaaaa

SEQ ID NO: 538608 - DNA, 20 bp, Artificial
  CRISPR gRNA sequence
agtgtgaaaacagaccaata

SEQ ID NO: 538609 - DNA, 20 bp, Artificial
  CRISPR gRNA sequence
gtgtgaaaacagaccaatac

SEQ ID NO: 538610 - DNA, 20 bp, Artificial
  CRISPR gRNA sequence
cttaaatcaaaaaatctctg

SEQ ID NO: 538611 - DNA, 20 bp, Artificial
  CRISPR gRNA sequence
caaaaaatctctgaagccaa

SEQ ID NO: 538612 - DNA, 20 bp, Artificial
  CRISPR gRNA sequence
aaaaatctctgaagccaaaa

SEQ ID NO: 538613 - DNA, 20 bp, Artificial
  CRISPR gRNA sequence
gaagccaaaagagtcttcgc

SEQ ID NO: 538614 - DNA, 20 bp, Artificial
  CRISPR gRNA sequence
ccaaaagagtcttcgcaagt

SEQ ID NO: 538615 - DNA, 20 bp, Artificial
  CRISPR gRNA sequence
aaagagtcttcgcaagttgg

SEQ ID NO: 538616 - DNA, 20 bp, Artificial
  CRISPR gRNA sequence
aagttggtagcaaaatcgtt

SEQ ID NO: 538617 - DNA, 20 bp, Artificial
  CRISPR gRNA sequence
gacctgacctgaattaacac

SEQ ID NO: 538618 - DNA, 20 bp, Artificial
  CRISPR gRNA sequence
acctgacctgaattaacaca

SEQ ID NO: 538619 - DNA, 20 bp, Artificial
  CRISPR gRNA sequence
ctgaattaacacaaggattt

SEQ ID NO: 538620 - DNA, 20 bp, Artificial
  CRISPR gRNA sequence
cacaaaaatattcctgtgct

SEQ ID NO: 538621 - DNA, 20 bp, Artificial
  CRISPR gRNA sequence
aaaaatattcctgtgcttgg

SEQ ID NO: 538622 - DNA, 20 bp, Artificial
  CRISPR gRNA sequence
aaaatattcctgtgcttggc

SEQ ID NO: 538623 - DNA, 20 bp, Artificial
  CRISPR gRNA sequence
ttcctgtgcttggcaggaca

SEQ ID NO: 538624 - DNA, 20 bp, Artificial
  CRISPR gRNA sequence
ctgtgcttggcaggacacag

SEQ ID NO: 538625 - DNA, 20 bp, Artificial
  CRISPR gRNA sequence
tggcaggacacagtggctca

SEQ ID NO: 538626 - DNA, 20 bp, Artificial
  CRISPR gRNA sequence
gtggctcatggctatactcc

SEQ ID NO: 538627 - DNA, 20 bp, Artificial
  CRISPR gRNA sequence
tggctatactcccagcactt

SEQ ID NO: 538628 - DNA, 20 bp, Artificial
  CRISPR gRNA sequence
ggctatactcccagcacttt

SEQ ID NO: 538629 - DNA, 20 bp, Artificial
  CRISPR gRNA sequence
ctatactcccagcactttgg

SEQ ID NO: 538630 - DNA, 20 bp, Artificial
  CRISPR gRNA sequence
tatactcccagcactttggg

SEQ ID NO: 538631 - DNA, 20 bp, Artificial
  CRISPR gRNA sequence
tcccagcactttgggaggct

SEQ ID NO: 538632 - DNA, 20 bp, Artificial
  CRISPR gRNA sequence
cccagcactttgggaggctg

SEQ ID NO: 538633 - DNA, 20 bp, Artificial
  CRISPR gRNA sequence
agcactttgggaggctgagg

SEQ ID NO: 538634 - DNA, 20 bp, Artificial
  CRISPR gRNA sequence
gcactttgggaggctgaggc

SEQ ID NO: 538635 - DNA, 20 bp, Artificial
  CRISPR gRNA sequence
actttgggaggctgaggcag

SEQ ID NO: 538636 - DNA, 20 bp, Artificial
  CRISPR gRNA sequence
ctttgggaggctgaggcagg

SEQ ID NO: 538637 - DNA, 20 bp, Artificial
  CRISPR gRNA sequence
gggaggctgaggcaggagga

SEQ ID NO: 538638 - DNA, 20 bp, Artificial
  CRISPR gRNA sequence
ctgaggcaggaggatggctt

SEQ ID NO: 538639 - DNA, 20 bp, Artificial
  CRISPR gRNA sequence
tgaggcaggaggatggcttg

SEQ ID NO: 538640 - DNA, 20 bp, Artificial
  CRISPR gRNA sequence
gcaggaggatggcttgaggc

SEQ ID NO: 538641 - DNA, 20 bp, Artificial
  CRISPR gRNA sequence
caggaggatggcttgaggcc

SEQ ID NO: 538642 - DNA, 20 bp, Artificial
  CRISPR gRNA sequence
ggaggatggcttgaggccag

SEQ ID NO: 538643 - DNA, 20 bp, Artificial
  CRISPR gRNA sequence
tggcttgaggccaggagttc

SEQ ID NO: 538644 - DNA, 20 bp, Artificial
  CRISPR gRNA sequence
tgaggccaggagttcaagac

SEQ ID NO: 538645 - DNA, 20 bp, Artificial
  CRISPR gRNA sequence
ccaggagttcaagaccagcc

SEQ ID NO: 538646 - DNA, 20 bp, Artificial
  CRISPR gRNA sequence
caggagttcaagaccagcct

SEQ ID NO: 538647 - DNA, 20 bp, Artificial
  CRISPR gRNA sequence
caagaccagcctgggcaaca

SEQ ID NO: 538648 - DNA, 20 bp, Artificial
  CRISPR gRNA sequence
accagcctgggcaacatagc

SEQ ID NO: 538649 - DNA, 20 bp, Artificial
  CRISPR gRNA sequence
caagaccctgtctttataaa

SEQ ID NO: 538650 - DNA, 20 bp, Artificial
  CRISPR gRNA sequence
ctgtctttataaaaagttta

SEQ ID NO: 538651 - DNA, 20 bp, Artificial
  CRISPR gRNA sequence
tttataaaaagtttaaagat

SEQ ID NO: 538652 - DNA, 20 bp, Artificial
  CRISPR gRNA sequence
taaaaagtttaaagattagc

SEQ ID NO: 538653 - DNA, 20 bp, Artificial
  CRISPR gRNA sequence
taaagattagccagccatga

SEQ ID NO: 538654 - DNA, 20 bp, Artificial
  CRISPR gRNA sequence
gccatgatggctcctgcctg

SEQ ID NO: 538655 - DNA, 20 bp, Artificial
  CRISPR gRNA sequence
atggctcctgcctgtagtct

SEQ ID NO: 538656 - DNA, 20 bp, Artificial
  CRISPR gRNA sequence
tacttgcaactgcttgaacc

SEQ ID NO: 538657 - DNA, 20 bp, Artificial
  CRISPR gRNA sequence
acttgcaactgcttgaacca

SEQ ID NO: 538658 - DNA, 20 bp, Artificial
  CRISPR gRNA sequence
tgcttgaaccaaggaatctg

SEQ ID NO: 538659 - DNA, 20 bp, Artificial
  CRISPR gRNA sequence
aaccaaggaatctgaagcta

SEQ ID NO: 538660 - DNA, 20 bp, Artificial
  CRISPR gRNA sequence
aaggaatctgaagctacagt

SEQ ID NO: 538661 - DNA, 20 bp, Artificial
  CRISPR gRNA sequence
acagtgagttataattgtgc

SEQ ID NO: 538662 - DNA, 20 bp, Artificial
  CRISPR gRNA sequence
ataattgtgccagtgcactc

SEQ ID NO: 538663 - DNA, 20 bp, Artificial
  CRISPR gRNA sequence
gcactctagctcactacaca

SEQ ID NO: 538664 - DNA, 20 bp, Artificial
  CRISPR gRNA sequence
ctctagctcactacacacag

SEQ ID NO: 538665 - DNA, 20 bp, Artificial
  CRISPR gRNA sequence
tctagctcactacacacagt

SEQ ID NO: 538666 - DNA, 20 bp, Artificial
  CRISPR gRNA sequence
acagtgggctatgattgcat

SEQ ID NO: 538667 - DNA, 20 bp, Artificial
  CRISPR gRNA sequence
ggctatgattgcatcagact

SEQ ID NO: 538668 - DNA, 20 bp, Artificial
  CRISPR gRNA sequence
agaccttgtctttaaatata

SEQ ID NO: 538669 - DNA, 20 bp, Artificial
  CRISPR gRNA sequence
gaccttgtctttaaatatat

SEQ ID NO: 538670 - DNA, 20 bp, Artificial
  CRISPR gRNA sequence
tctttaaatatataggaatg

SEQ ID NO: 538671 - DNA, 20 bp, Artificial
  CRISPR gRNA sequence
ttgttcctatgcttgaccca

SEQ ID NO: 538672 - DNA, 20 bp, Artificial
  CRISPR gRNA sequence
tgttcctatgcttgacccat

SEQ ID NO: 538673 - DNA, 20 bp, Artificial
  CRISPR gRNA sequence
gttcctatgcttgacccata

SEQ ID NO: 538674 - DNA, 20 bp, Artificial
  CRISPR gRNA sequence
atagggtgctccccataatt

SEQ ID NO: 538675 - DNA, 20 bp, Artificial
  CRISPR gRNA sequence
gggtgctccccataattaag

SEQ ID NO: 538676 - DNA, 20 bp, Artificial
  CRISPR gRNA sequence
ggtgctccccataattaagt

SEQ ID NO: 538677 - DNA, 20 bp, Artificial
  CRISPR gRNA sequence
gtgctccccataattaagtg

SEQ ID NO: 538678 - DNA, 20 bp, Artificial
  CRISPR gRNA sequence
taagtggggtgcttaatatg

SEQ ID NO: 538679 - DNA, 20 bp, Artificial
  CRISPR gRNA sequence
agtggggtgcttaatatgca

SEQ ID NO: 538680 - DNA, 20 bp, Artificial
  CRISPR gRNA sequence
gtggggtgcttaatatgcag

SEQ ID NO: 538681 - DNA, 20 bp, Artificial
  CRISPR gRNA sequence
tccataacacgtctgactca

SEQ ID NO: 538682 - DNA, 20 bp, Artificial
  CRISPR gRNA sequence
tgactcaaagcattttgtga

SEQ ID NO: 538683 - DNA, 20 bp, Artificial
  CRISPR gRNA sequence
gactcaaagcattttgtgaa

SEQ ID NO: 538684 - DNA, 20 bp, Artificial
  CRISPR gRNA sequence
caaagcattttgtgaaagga

SEQ ID NO: 538685 - DNA, 20 bp, Artificial
  CRISPR gRNA sequence
tgactcaatacattttgtga

SEQ ID NO: 538686 - DNA, 20 bp, Artificial
  CRISPR gRNA sequence
gactcaatacattttgtgaa

SEQ ID NO: 538687 - DNA, 20 bp, Artificial
  CRISPR gRNA sequence
tcaatacattttgtgaaagg

SEQ ID NO: 538688 - DNA, 20 bp, Artificial
  CRISPR gRNA sequence
aatacattttgtgaaaggtg

SEQ ID NO: 538689 - DNA, 20 bp, Artificial
  CRISPR gRNA sequence
ttgtgaaaggtggagctaca

SEQ ID NO: 538690 - DNA, 20 bp, Artificial
  CRISPR gRNA sequence
gtgaaaggtggagctacaca

SEQ ID NO: 538691 - DNA, 20 bp, Artificial
  CRISPR gRNA sequence
ggagctacacagagccttgt

SEQ ID NO: 538692 - DNA, 20 bp, Artificial
  CRISPR gRNA sequence
gagctacacagagccttgtc

SEQ ID NO: 538693 - DNA, 20 bp, Artificial
  CRISPR gRNA sequence
ccttgtcgggccctgcctat

SEQ ID NO: 538694 - DNA, 20 bp, Artificial
  CRISPR gRNA sequence
gtcgggccctgcctattggt

SEQ ID NO: 538695 - DNA, 20 bp, Artificial
  CRISPR gRNA sequence
tcgggccctgcctattggtt

SEQ ID NO: 538696 - DNA, 20 bp, Artificial
  CRISPR gRNA sequence
gccctgcctattggttgggc

SEQ ID NO: 538697 - DNA, 20 bp, Artificial
  CRISPR gRNA sequence
ggttgggctggacctgttaa

SEQ ID NO: 538698 - DNA, 20 bp, Artificial
  CRISPR gRNA sequence
gttgggctggacctgttaat

SEQ ID NO: 538699 - DNA, 20 bp, Artificial
  CRISPR gRNA sequence
gggctggacctgttaatagg

SEQ ID NO: 538700 - DNA, 20 bp, Artificial
  CRISPR gRNA sequence
ggacctgttaataggcagtg

SEQ ID NO: 538701 - DNA, 20 bp, Artificial
  CRISPR gRNA sequence
gacctgttaataggcagtgc

SEQ ID NO: 538702 - DNA, 20 bp, Artificial
  CRISPR gRNA sequence
acctgttaataggcagtgca

SEQ ID NO: 538703 - DNA, 20 bp, Artificial
  CRISPR gRNA sequence
ctgttaataggcagtgcagg

SEQ ID NO: 538704 - DNA, 20 bp, Artificial
  CRISPR gRNA sequence
ttaataggcagtgcagggag

SEQ ID NO: 538705 - DNA, 20 bp, Artificial
  CRISPR gRNA sequence
gcagggagcagcatgtgtca

SEQ ID NO: 538706 - DNA, 20 bp, Artificial
  CRISPR gRNA sequence
gtgtcacagacctgcctgtc

SEQ ID NO: 538707 - DNA, 20 bp, Artificial
  CRISPR gRNA sequence
gtcacagacctgcctgtcca

SEQ ID NO: 538708 - DNA, 20 bp, Artificial
  CRISPR gRNA sequence
tcacagacctgcctgtccag

SEQ ID NO: 538709 - DNA, 20 bp, Artificial
  CRISPR gRNA sequence
cctcactcccacccttcttc

SEQ ID NO: 538710 - DNA, 20 bp, Artificial
  CRISPR gRNA sequence
ctcactcccacccttcttct

SEQ ID NO: 538711 - DNA, 20 bp, Artificial
  CRISPR gRNA sequence
actcccacccttcttctagg

SEQ ID NO: 538712 - DNA, 20 bp, Artificial
  CRISPR gRNA sequence
ttctaggaagtgcctcctat

SEQ ID NO: 538713 - DNA, 20 bp, Artificial
  CRISPR gRNA sequence
ggaagtgcctcctattggct

SEQ ID NO: 538714 - DNA, 20 bp, Artificial
  CRISPR gRNA sequence
gaagtgcctcctattggcta

SEQ ID NO: 538715 - DNA, 20 bp, Artificial
  CRISPR gRNA sequence
gtgcctcctattggctaagg

SEQ ID NO: 538716 - DNA, 20 bp, Artificial
  CRISPR gRNA sequence
tcctattggctaaggcagca

SEQ ID NO: 538717 - DNA, 20 bp, Artificial
  CRISPR gRNA sequence
ctaaggcagcatggacctac

SEQ ID NO: 538718 - DNA, 20 bp, Artificial
  CRISPR gRNA sequence
taaggcagcatggacctaca

SEQ ID NO: 538719 - DNA, 20 bp, Artificial
  CRISPR gRNA sequence
cagcatggacctacaaggat

SEQ ID NO: 538720 - DNA, 20 bp, Artificial
  CRISPR gRNA sequence
tggacctacaaggatgagtt

SEQ ID NO: 538721 - DNA, 20 bp, Artificial
  CRISPR gRNA sequence
ctgccattgttgccctttaa

SEQ ID NO: 538722 - DNA, 20 bp, Artificial
  CRISPR gRNA sequence
tgttgccctttaaaagcctc

SEQ ID NO: 538723 - DNA, 20 bp, Artificial
  CRISPR gRNA sequence
gttgccctttaaaagcctca

SEQ ID NO: 538724 - DNA, 20 bp, Artificial
  CRISPR gRNA sequence
ggctaattactttgtcctat

SEQ ID NO: 538725 - DNA, 20 bp, Artificial
  CRISPR gRNA sequence
tcatatgccttcttgcgtct

SEQ ID NO: 538726 - DNA, 20 bp, Artificial
  CRISPR gRNA sequence
cttgcgtctcagctaccctc

SEQ ID NO: 538727 - DNA, 20 bp, Artificial
  CRISPR gRNA sequence
accctccagcaattaatcat

SEQ ID NO: 538728 - DNA, 20 bp, Artificial
  CRISPR gRNA sequence
cctccagcaattaatcataa

SEQ ID NO: 538729 - DNA, 20 bp, Artificial
  CRISPR gRNA sequence
ctccagcaattaatcataag

SEQ ID NO: 538730 - DNA, 20 bp, Artificial
  CRISPR gRNA sequence
caattaatcataagaggcct

SEQ ID NO: 538731 - DNA, 20 bp, Artificial
  CRISPR gRNA sequence
aattaatcataagaggcctg

SEQ ID NO: 538732 - DNA, 20 bp, Artificial
  CRISPR gRNA sequence
acatatgtaatatacaacaa

SEQ ID NO: 538733 - DNA, 20 bp, Artificial
  CRISPR gRNA sequence
gtaatatacaacaatggtca

SEQ ID NO: 538734 - DNA, 20 bp, Artificial
  CRISPR gRNA sequence
atatacaacaatggtcatgg

SEQ ID NO: 538735 - DNA, 20 bp, Artificial
  CRISPR gRNA sequence
aacaatggtcatggtagcac

SEQ ID NO: 538736 - DNA, 20 bp, Artificial
  CRISPR gRNA sequence
acaatggtcatggtagcact

SEQ ID NO: 538737 - DNA, 20 bp, Artificial
  CRISPR gRNA sequence
atggtagcactgggataata

SEQ ID NO: 538738 - DNA, 20 bp, Artificial
  CRISPR gRNA sequence
cattataaacgtctactaaa

SEQ ID NO: 538739 - DNA, 20 bp, Artificial
  CRISPR gRNA sequence
ttataaacgtctactaaaaa

SEQ ID NO: 538740 - DNA, 20 bp, Artificial
  CRISPR gRNA sequence
gtctactaaaaagagcattt

SEQ ID NO: 538741 - DNA, 20 bp, Artificial
  CRISPR gRNA sequence
aaagagcatttaagtaaatt

SEQ ID NO: 538742 - DNA, 20 bp, Artificial
  CRISPR gRNA sequence
aagagcatttaagtaaattt

SEQ ID NO: 538743 - DNA, 20 bp, Artificial
  CRISPR gRNA sequence
taagtaaatttaggttcacc

SEQ ID NO: 538744 - DNA, 20 bp, Artificial
  CRISPR gRNA sequence
atttaggttcaccaagataa

SEQ ID NO: 538745 - DNA, 20 bp, Artificial
  CRISPR gRNA sequence
catttaaaatgatgttttct

SEQ ID NO: 538746 - DNA, 20 bp, Artificial
  CRISPR gRNA sequence
aaaatgatgttttctaagac

SEQ ID NO: 538747 - DNA, 20 bp, Artificial
  CRISPR gRNA sequence
aattataatctgaaaaataa

SEQ ID NO: 538748 - DNA, 20 bp, Artificial
  CRISPR gRNA sequence
tgaaaaataaaagcatttaa

SEQ ID NO: 538749 - DNA, 20 bp, Artificial
  CRISPR gRNA sequence
ctcctgaattccttctcgct

SEQ ID NO: 538750 - DNA, 20 bp, Artificial
  CRISPR gRNA sequence
ccttctcgctcagttaaata

SEQ ID NO: 538751 - DNA, 20 bp, Artificial
  CRISPR gRNA sequence
gctcagttaaataaagtacc

SEQ ID NO: 538752 - DNA, 20 bp, Artificial
  CRISPR gRNA sequence
ataaagtacccagcctgcct

SEQ ID NO: 538753 - DNA, 20 bp, Artificial
  CRISPR gRNA sequence
aagtacccagcctgccttgg

SEQ ID NO: 538754 - DNA, 20 bp, Artificial
  CRISPR gRNA sequence
cagcctgccttggtagaaac

SEQ ID NO: 538755 - DNA, 20 bp, Artificial
  CRISPR gRNA sequence
gcctgccttggtagaaacca

SEQ ID NO: 538756 - DNA, 20 bp, Artificial
  CRISPR gRNA sequence
cactgacttccctttctact

SEQ ID NO: 538757 - DNA, 20 bp, Artificial
  CRISPR gRNA sequence
actgacttccctttctactt

SEQ ID NO: 538758 - DNA, 20 bp, Artificial
  CRISPR gRNA sequence
ctgacttccctttctacttg

SEQ ID NO: 538759 - DNA, 20 bp, Artificial
  CRISPR gRNA sequence
cctttctacttggggcttcc

SEQ ID NO: 538760 - DNA, 20 bp, Artificial
  CRISPR gRNA sequence
cttggggcttcctagttttt

SEQ ID NO: 538761 - DNA, 20 bp, Artificial
  CRISPR gRNA sequence
cctagtttttaagtttaatc

SEQ ID NO: 538762 - DNA, 20 bp, Artificial
  CRISPR gRNA sequence
aagtttaatctagctcacac

SEQ ID NO: 538763 - DNA, 20 bp, Artificial
  CRISPR gRNA sequence
aagtccttacatacttcctt

SEQ ID NO: 538764 - DNA, 20 bp, Artificial
  CRISPR gRNA sequence
taagattttctttaattaaa

SEQ ID NO: 538765 - DNA, 20 bp, Artificial
  CRISPR gRNA sequence
aagacttttaatcatctttt

SEQ ID NO: 538766 - DNA, 20 bp, Artificial
  CRISPR gRNA sequence
acttttaatcatcttttaag

SEQ ID NO: 538767 - DNA, 20 bp, Artificial
  CRISPR gRNA sequence
tttaatcatcttttaagcag

SEQ ID NO: 538768 - DNA, 20 bp, Artificial
  CRISPR gRNA sequence
ttttaagcagtggaatttct

SEQ ID NO: 538769 - DNA, 20 bp, Artificial
  CRISPR gRNA sequence
atttctcagaattaaatctt

SEQ ID NO: 538770 - DNA, 20 bp, Artificial
  CRISPR gRNA sequence
tctcagaattaaatcttcag

SEQ ID NO: 538771 - DNA, 20 bp, Artificial
  CRISPR gRNA sequence
tcagtggcaatccaatccaa

SEQ ID NO: 538772 - DNA, 20 bp, Artificial
  CRISPR gRNA sequence
ggcaatccaatccaatggat

SEQ ID NO: 538773 - DNA, 20 bp, Artificial
  CRISPR gRNA sequence
aatccaatccaatggataag

SEQ ID NO: 538774 - DNA, 20 bp, Artificial
  CRISPR gRNA sequence
caatggataagaagttgctc

SEQ ID NO: 538775 - DNA, 20 bp, Artificial
  CRISPR gRNA sequence
tctagttgactcaaaattga

SEQ ID NO: 538776 - DNA, 20 bp, Artificial
  CRISPR gRNA sequence
ttgactcaaaattgaaagcc

SEQ ID NO: 538777 - DNA, 20 bp, Artificial
  CRISPR gRNA sequence
gactcaaaattgaaagccta

SEQ ID NO: 538778 - DNA, 20 bp, Artificial
  CRISPR gRNA sequence
cctgctctcctaacttcctc

SEQ ID NO: 538779 - DNA, 20 bp, Artificial
  CRISPR gRNA sequence
cttttgcccaccccacccca

SEQ ID NO: 538780 - DNA, 20 bp, Artificial
  CRISPR gRNA sequence
ttgcccaccccaccccatag

SEQ ID NO: 538781 - DNA, 20 bp, Artificial
  CRISPR gRNA sequence
ccccaccccatagcagccct

SEQ ID NO: 538782 - DNA, 20 bp, Artificial
  CRISPR gRNA sequence
cccaccccatagcagccctc

SEQ ID NO: 538783 - DNA, 20 bp, Artificial
  CRISPR gRNA sequence
ccaccccatagcagccctca

SEQ ID NO: 538784 - DNA, 20 bp, Artificial
  CRISPR gRNA sequence
caccccatagcagccctcag

SEQ ID NO: 538785 - DNA, 20 bp, Artificial
  CRISPR gRNA sequence
gcagccctcaggggacttcc

SEQ ID NO: 538786 - DNA, 20 bp, Artificial
  CRISPR gRNA sequence
cagccctcaggggacttcca

SEQ ID NO: 538787 - DNA, 20 bp, Artificial
  CRISPR gRNA sequence
ttccaaggaacatgcatccc

SEQ ID NO: 538788 - DNA, 20 bp, Artificial
  CRISPR gRNA sequence
aggaacatgcatccccagaa

SEQ ID NO: 538789 - DNA, 20 bp, Artificial
  CRISPR gRNA sequence
agttcaaaaatgcctgttct

SEQ ID NO: 538790 - DNA, 20 bp, Artificial
  CRISPR gRNA sequence
cttatgcctgcctctgtaac

SEQ ID NO: 538791 - DNA, 20 bp, Artificial
  CRISPR gRNA sequence
ttatgcctgcctctgtaact

SEQ ID NO: 538792 - DNA, 20 bp, Artificial
  CRISPR gRNA sequence
gcctgcctctgtaactaggc

SEQ ID NO: 538793 - DNA, 20 bp, Artificial
  CRISPR gRNA sequence
cctgcctctgtaactaggct

SEQ ID NO: 538794 - DNA, 20 bp, Artificial
  CRISPR gRNA sequence
taactaggctgggcatttct

SEQ ID NO: 538795 - DNA, 20 bp, Artificial
  CRISPR gRNA sequence
aactaggctgggcatttctc

SEQ ID NO: 538796 - DNA, 20 bp, Artificial
  CRISPR gRNA sequence
actaggctgggcatttctca

SEQ ID NO: 538797 - DNA, 20 bp, Artificial
  CRISPR gRNA sequence
ctaggctgggcatttctcag

SEQ ID NO: 538798 - DNA, 20 bp, Artificial
  CRISPR gRNA sequence
ggctgggcatttctcagggg

SEQ ID NO: 538799 - DNA, 20 bp, Artificial
  CRISPR gRNA sequence
tttctcaggggcagaaaacc

SEQ ID NO: 538800 - DNA, 20 bp, Artificial
  CRISPR gRNA sequence
aaccaagctttctacctcct

SEQ ID NO: 538801 - DNA, 20 bp, Artificial
  CRISPR gRNA sequence
gctttctacctccttagaaa

SEQ ID NO: 538802 - DNA, 20 bp, Artificial
  CRISPR gRNA sequence
tccttagaaatggtcctttg

SEQ ID NO: 538803 - DNA, 20 bp, Artificial
  CRISPR gRNA sequence
tgaagcatttctcaaatttt

SEQ ID NO: 538804 - DNA, 20 bp, Artificial
  CRISPR gRNA sequence
gaagcatttctcaaatttta

SEQ ID NO: 538805 - DNA, 20 bp, Artificial
  CRISPR gRNA sequence
tctcaaattttaaggtgcct

SEQ ID NO: 538806 - DNA, 20 bp, Artificial
  CRISPR gRNA sequence
taaggtgcctaagaatcacc

SEQ ID NO: 538807 - DNA, 20 bp, Artificial
  CRISPR gRNA sequence
aaggtgcctaagaatcacca

SEQ ID NO: 538808 - DNA, 20 bp, Artificial
  CRISPR gRNA sequence
aggtgcctaagaatcaccaa

SEQ ID NO: 538809 - DNA, 20 bp, Artificial
  CRISPR gRNA sequence
aagggtgcttgttaaaaata

SEQ ID NO: 538810 - DNA, 20 bp, Artificial
  CRISPR gRNA sequence
tgttaaaaatacagattcct

SEQ ID NO: 538811 - DNA, 20 bp, Artificial
  CRISPR gRNA sequence
attcctgagccccaccatcc

SEQ ID NO: 538812 - DNA, 20 bp, Artificial
  CRISPR gRNA sequence
ttcctgagccccaccatccc

SEQ ID NO: 538813 - DNA, 20 bp, Artificial
  CRISPR gRNA sequence
ccaggtgcttctgatgtatg

SEQ ID NO: 538814 - DNA, 20 bp, Artificial
  CRISPR gRNA sequence
gtggcctgtttgttctgttg

SEQ ID NO: 538815 - DNA, 20 bp, Artificial
  CRISPR gRNA sequence
cagattctaatgtattgatc

SEQ ID NO: 538816 - DNA, 20 bp, Artificial
  CRISPR gRNA sequence
gatctagctctgccaatgtc

SEQ ID NO: 538817 - DNA, 20 bp, Artificial
  CRISPR gRNA sequence
ccaatgtctagtctttcatc

SEQ ID NO: 538818 - DNA, 20 bp, Artificial
  CRISPR gRNA sequence
ccagcactttctgaactgaa

SEQ ID NO: 538819 - DNA, 20 bp, Artificial
  CRISPR gRNA sequence
agcactttctgaactgaaca

SEQ ID NO: 538820 - DNA, 20 bp, Artificial
  CRISPR gRNA sequence
gcactttctgaactgaacag

SEQ ID NO: 538821 - DNA, 20 bp, Artificial
  CRISPR gRNA sequence
actgaacagaggtgcatcat

SEQ ID NO: 538822 - DNA, 20 bp, Artificial
  CRISPR gRNA sequence
cagaggtgcatcatcagccc

SEQ ID NO: 538823 - DNA, 20 bp, Artificial
  CRISPR gRNA sequence
gaggtgcatcatcagcccca

SEQ ID NO: 538824 - DNA, 20 bp, Artificial
  CRISPR gRNA sequence
ccccagagactgtgtatctt

SEQ ID NO: 538825 - DNA, 20 bp, Artificial
  CRISPR gRNA sequence
ccagagactgtgtatctttg

SEQ ID NO: 538826 - DNA, 20 bp, Artificial
  CRISPR gRNA sequence
cagagactgtgtatctttgg

SEQ ID NO: 538827 - DNA, 20 bp, Artificial
  CRISPR gRNA sequence
agagactgtgtatctttgga

SEQ ID NO: 538828 - DNA, 20 bp, Artificial
  CRISPR gRNA sequence
ctgtgtatctttggagggca

SEQ ID NO: 538829 - DNA, 20 bp, Artificial
  CRISPR gRNA sequence
tatctttggagggcaaagac

SEQ ID NO: 538830 - DNA, 20 bp, Artificial
  CRISPR gRNA sequence
atctttggagggcaaagact

SEQ ID NO: 538831 - DNA, 20 bp, Artificial
  CRISPR gRNA sequence
tatgactcacctttcaacca

SEQ ID NO: 538832 - DNA, 20 bp, Artificial
  CRISPR gRNA sequence
cacagcacatgacataatgc

SEQ ID NO: 538833 - DNA, 20 bp, Artificial
  CRISPR gRNA sequence
acagcacatgacataatgca

SEQ ID NO: 538834 - DNA, 20 bp, Artificial
  CRISPR gRNA sequence
atgacataatgcaaggcaca

SEQ ID NO: 538835 - DNA, 20 bp, Artificial
  CRISPR gRNA sequence
cataatgcaaggcacacaga

SEQ ID NO: 538836 - DNA, 20 bp, Artificial
  CRISPR gRNA sequence
gcacacagatggctcctcac

SEQ ID NO: 538837 - DNA, 20 bp, Artificial
  CRISPR gRNA sequence
cacagatggctcctcacaag

SEQ ID NO: 538838 - DNA, 20 bp, Artificial
  CRISPR gRNA sequence
atggctcctcacaagcagta

SEQ ID NO: 538839 - DNA, 20 bp, Artificial
  CRISPR gRNA sequence
tggctcctcacaagcagtac

SEQ ID NO: 538840 - DNA, 20 bp, Artificial
  CRISPR gRNA sequence
tcctcacaagcagtacagga

SEQ ID NO: 538841 - DNA, 20 bp, Artificial
  CRISPR gRNA sequence
cacaagcagtacaggacaga

SEQ ID NO: 538842 - DNA, 20 bp, Artificial
  CRISPR gRNA sequence
acaagcagtacaggacagat

SEQ ID NO: 538843 - DNA, 20 bp, Artificial
  CRISPR gRNA sequence
caagcagtacaggacagatg

SEQ ID NO: 538844 - DNA, 20 bp, Artificial
  CRISPR gRNA sequence
agcagtacaggacagatggg

SEQ ID NO: 538845 - DNA, 20 bp, Artificial
  CRISPR gRNA sequence
gtacaggacagatggggaga

SEQ ID NO: 538846 - DNA, 20 bp, Artificial
  CRISPR gRNA sequence
aggacagatggggagacaga

SEQ ID NO: 538847 - DNA, 20 bp, Artificial
  CRISPR gRNA sequence
cagatggggagacagatgga

SEQ ID NO: 538848 - DNA, 20 bp, Artificial
  CRISPR gRNA sequence
atggggagacagatggatag

SEQ ID NO: 538849 - DNA, 20 bp, Artificial
  CRISPR gRNA sequence
tggggagacagatggataga

SEQ ID NO: 538850 - DNA, 20 bp, Artificial
  CRISPR gRNA sequence
gagacagatggatagaagga

SEQ ID NO: 538851 - DNA, 20 bp, Artificial
  CRISPR gRNA sequence
gatggatagaaggatagatt

SEQ ID NO: 538852 - DNA, 20 bp, Artificial
  CRISPR gRNA sequence
tggatagaaggatagattca

SEQ ID NO: 538853 - DNA, 20 bp, Artificial
  CRISPR gRNA sequence
gatagaaggatagattcaga

SEQ ID NO: 538854 - DNA, 20 bp, Artificial
  CRISPR gRNA sequence
gaaggatagattcagagaga

SEQ ID NO: 538855 - DNA, 20 bp, Artificial
  CRISPR gRNA sequence
tcttctacccgctatctcca

SEQ ID NO: 538856 - DNA, 20 bp, Artificial
  CRISPR gRNA sequence
ttctacccgctatctccaaa

SEQ ID NO: 538857 - DNA, 20 bp, Artificial
  CRISPR gRNA sequence
tctacccgctatctccaaag

SEQ ID NO: 538858 - DNA, 20 bp, Artificial
  CRISPR gRNA sequence
ccgctatctccaaagaggta

SEQ ID NO: 538859 - DNA, 20 bp, Artificial
  CRISPR gRNA sequence
atctccaaagaggtacagta

SEQ ID NO: 538860 - DNA, 20 bp, Artificial
  CRISPR gRNA sequence
aagaggtacagtatggtgtt

SEQ ID NO: 538861 - DNA, 20 bp, Artificial
  CRISPR gRNA sequence
gtacagtatggtgtttagca

SEQ ID NO: 538862 - DNA, 20 bp, Artificial
  CRISPR gRNA sequence
tatggtgtttagcatggact

SEQ ID NO: 538863 - DNA, 20 bp, Artificial
  CRISPR gRNA sequence
ggtgtttagcatggactcag

SEQ ID NO: 538864 - DNA, 20 bp, Artificial
  CRISPR gRNA sequence
ttagcatggactcagaagcc

SEQ ID NO: 538865 - DNA, 20 bp, Artificial
  CRISPR gRNA sequence
actcagaagcccagctgcct

SEQ ID NO: 538866 - DNA, 20 bp, Artificial
  CRISPR gRNA sequence
agctgcctgagtgcatatcc

SEQ ID NO: 538867 - DNA, 20 bp, Artificial
  CRISPR gRNA sequence
catatcccagcttcatgact

SEQ ID NO: 538868 - DNA, 20 bp, Artificial
  CRISPR gRNA sequence
tatcccagcttcatgactaa

SEQ ID NO: 538869 - DNA, 20 bp, Artificial
  CRISPR gRNA sequence
gactaagagccatttgacat

SEQ ID NO: 538870 - DNA, 20 bp, Artificial
  CRISPR gRNA sequence
actaagagccatttgacatt

SEQ ID NO: 538871 - DNA, 20 bp, Artificial
  CRISPR gRNA sequence
agagccatttgacattgggc

SEQ ID NO: 538872 - DNA, 20 bp, Artificial
  CRISPR gRNA sequence
tacttaaatcaccttgtgtc

SEQ ID NO: 538873 - DNA, 20 bp, Artificial
  CRISPR gRNA sequence
acttaaatcaccttgtgtct

SEQ ID NO: 538874 - DNA, 20 bp, Artificial
  CRISPR gRNA sequence
ggtttcctcctctctacaat

SEQ ID NO: 538875 - DNA, 20 bp, Artificial
  CRISPR gRNA sequence
gtttcctcctctctacaata

SEQ ID NO: 538876 - DNA, 20 bp, Artificial
  CRISPR gRNA sequence
ctctacaataaggacacaaa

SEQ ID NO: 538877 - DNA, 20 bp, Artificial
  CRISPR gRNA sequence
acaaatagtacttactctat

SEQ ID NO: 538878 - DNA, 20 bp, Artificial
  CRISPR gRNA sequence
ttactctatcagactgtaat

SEQ ID NO: 538879 - DNA, 20 bp, Artificial
  CRISPR gRNA sequence
agactgtaatgagattaaat

SEQ ID NO: 538880 - DNA, 20 bp, Artificial
  CRISPR gRNA sequence
tgagattaaatgagttaaca

SEQ ID NO: 538881 - DNA, 20 bp, Artificial
  CRISPR gRNA sequence
tcaacatatgaattaacatg

SEQ ID NO: 538882 - DNA, 20 bp, Artificial
  CRISPR gRNA sequence
attaacatgtagtgcctgca

SEQ ID NO: 538883 - DNA, 20 bp, Artificial
  CRISPR gRNA sequence
taacatgtagtgcctgcaca

SEQ ID NO: 538884 - DNA, 20 bp, Artificial
  CRISPR gRNA sequence
atgtagtgcctgcacagagt

SEQ ID NO: 538885 - DNA, 20 bp, Artificial
  CRISPR gRNA sequence
agtaagtacttaacaaatgc

SEQ ID NO: 538886 - DNA, 20 bp, Artificial
  CRISPR gRNA sequence
ttaacaaatgctagctgtaa

SEQ ID NO: 538887 - DNA, 20 bp, Artificial
  CRISPR gRNA sequence
aacaaatgctagctgtaata

SEQ ID NO: 538888 - DNA, 20 bp, Artificial
  CRISPR gRNA sequence
gctagctgtaatagagcaca

SEQ ID NO: 538889 - DNA, 20 bp, Artificial
  CRISPR gRNA sequence
gtaatagagcacacggccat

SEQ ID NO: 538890 - DNA, 20 bp, Artificial
  CRISPR gRNA sequence
agcacacggccattggctgt

SEQ ID NO: 538891 - DNA, 20 bp, Artificial
  CRISPR gRNA sequence
tggctgtgagtttccaactc

SEQ ID NO: 538892 - DNA, 20 bp, Artificial
  CRISPR gRNA sequence
ggctgtgagtttccaactcc

SEQ ID NO: 538893 - DNA, 20 bp, Artificial
  CRISPR gRNA sequence
tgtgagtttccaactccagg

SEQ ID NO: 538894 - DNA, 20 bp, Artificial
  CRISPR gRNA sequence
gtttccaactccaggaagcc

SEQ ID NO: 538895 - DNA, 20 bp, Artificial
  CRISPR gRNA sequence
tttccaactccaggaagccg

SEQ ID NO: 538896 - DNA, 20 bp, Artificial
  CRISPR gRNA sequence
tccaggaagccgaggctccc

SEQ ID NO: 538897 - DNA, 20 bp, Artificial
  CRISPR gRNA sequence
caggaagccgaggctccccg

SEQ ID NO: 538898 - DNA, 20 bp, Artificial
  CRISPR gRNA sequence
aggaagccgaggctccccgg

SEQ ID NO: 538899 - DNA, 20 bp, Artificial
  CRISPR gRNA sequence
ggaagccgaggctccccgga

SEQ ID NO: 538900 - DNA, 20 bp, Artificial
  CRISPR gRNA sequence
cggagggtatgtgatatgat

SEQ ID NO: 538901 - DNA, 20 bp, Artificial
  CRISPR gRNA sequence
agggtatgtgatatgatgag

SEQ ID NO: 538902 - DNA, 20 bp, Artificial
  CRISPR gRNA sequence
ggtatgtgatatgatgagaa

SEQ ID NO: 538903 - DNA, 20 bp, Artificial
  CRISPR gRNA sequence
atatgatgagaagagtcact

SEQ ID NO: 538904 - DNA, 20 bp, Artificial
  CRISPR gRNA sequence
tgatgagaagagtcactgag

SEQ ID NO: 538905 - DNA, 20 bp, Artificial
  CRISPR gRNA sequence
gatgagaagagtcactgagt

SEQ ID NO: 538906 - DNA, 20 bp, Artificial
  CRISPR gRNA sequence
tgagaagagtcactgagtag

SEQ ID NO: 538907 - DNA, 20 bp, Artificial
  CRISPR gRNA sequence
aagagtcactgagtaggagt

SEQ ID NO: 538908 - DNA, 20 bp, Artificial
  CRISPR gRNA sequence
agagtcactgagtaggagtt

SEQ ID NO: 538909 - DNA, 20 bp, Artificial
  CRISPR gRNA sequence
agtcactgagtaggagttgg

SEQ ID NO: 538910 - DNA, 20 bp, Artificial
  CRISPR gRNA sequence
gtcactgagtaggagttggg

SEQ ID NO: 538911 - DNA, 20 bp, Artificial
  CRISPR gRNA sequence
aggagttgggaggtttgatc

SEQ ID NO: 538912 - DNA, 20 bp, Artificial
  CRISPR gRNA sequence
tgggaggtttgatcaagcct

SEQ ID NO: 538913 - DNA, 20 bp, Artificial
  CRISPR gRNA sequence
gtttgatcaagccttagcct

SEQ ID NO: 538914 - DNA, 20 bp, Artificial
  CRISPR gRNA sequence
ccttggcctgctgtgtgacc

SEQ ID NO: 538915 - DNA, 20 bp, Artificial
  CRISPR gRNA sequence
cttggcctgctgtgtgacct

SEQ ID NO: 538916 - DNA, 20 bp, Artificial
  CRISPR gRNA sequence
ttggcctgctgtgtgacctg

SEQ ID NO: 538917 - DNA, 20 bp, Artificial
  CRISPR gRNA sequence
tgctgtgtgacctggggcca

SEQ ID NO: 538918 - DNA, 20 bp, Artificial
  CRISPR gRNA sequence
acctggggccacagtccttt

SEQ ID NO: 538919 - DNA, 20 bp, Artificial
  CRISPR gRNA sequence
cctggggccacagtcctttt

SEQ ID NO: 538920 - DNA, 20 bp, Artificial
  CRISPR gRNA sequence
tggggccacagtccttttag

SEQ ID NO: 538921 - DNA, 20 bp, Artificial
  CRISPR gRNA sequence
gccacagtccttttaggagc

SEQ ID NO: 538922 - DNA, 20 bp, Artificial
  CRISPR gRNA sequence
acagtccttttaggagctgg

SEQ ID NO: 538923 - DNA, 20 bp, Artificial
  CRISPR gRNA sequence
agtccttttaggagctggaa

SEQ ID NO: 538924 - DNA, 20 bp, Artificial
  CRISPR gRNA sequence
ttaggagctggaagagtttt

SEQ ID NO: 538925 - DNA, 20 bp, Artificial
  CRISPR gRNA sequence
gagctggaagagttttaaga

SEQ ID NO: 538926 - DNA, 20 bp, Artificial
  CRISPR gRNA sequence
gttttaagaaagcatccatc

SEQ ID NO: 538927 - DNA, 20 bp, Artificial
  CRISPR gRNA sequence
ttttaagaaagcatccatcc

SEQ ID NO: 538928 - DNA, 20 bp, Artificial
  CRISPR gRNA sequence
caggtctcttgttctactta

SEQ ID NO: 538929 - DNA, 20 bp, Artificial
  CRISPR gRNA sequence
ggtctcttgttctacttaca

SEQ ID NO: 538930 - DNA, 20 bp, Artificial
  CRISPR gRNA sequence
ttgttctacttacagagaaa

SEQ ID NO: 538931 - DNA, 20 bp, Artificial
  CRISPR gRNA sequence
tgtcttattttcatctgtga

SEQ ID NO: 538932 - DNA, 20 bp, Artificial
  CRISPR gRNA sequence
gtcttattttcatctgtgaa

SEQ ID NO: 538933 - DNA, 20 bp, Artificial
  CRISPR gRNA sequence
tcttattttcatctgtgaaa

SEQ ID NO: 538934 - DNA, 20 bp, Artificial
  CRISPR gRNA sequence
tgtgaaagggaatgctgtat

SEQ ID NO: 538935 - DNA, 20 bp, Artificial
  CRISPR gRNA sequence
gtgaaagggaatgctgtatc

SEQ ID NO: 538936 - DNA, 20 bp, Artificial
  CRISPR gRNA sequence
tgctgtatcaggtcactgta

SEQ ID NO: 538937 - DNA, 20 bp, Artificial
  CRISPR gRNA sequence
gctgtatcaggtcactgtaa

SEQ ID NO: 538938 - DNA, 20 bp, Artificial
  CRISPR gRNA sequence
aggtcactgtaaaggtcaaa

SEQ ID NO: 538939 - DNA, 20 bp, Artificial
  CRISPR gRNA sequence
aggtcaaacagaatatgact

SEQ ID NO: 538940 - DNA, 20 bp, Artificial
  CRISPR gRNA sequence
atatgactgagtgccacatg

SEQ ID NO: 538941 - DNA, 20 bp, Artificial
  CRISPR gRNA sequence
tatgactgagtgccacatgc

SEQ ID NO: 538942 - DNA, 20 bp, Artificial
  CRISPR gRNA sequence
atgactgagtgccacatgca

SEQ ID NO: 538943 - DNA, 20 bp, Artificial
  CRISPR gRNA sequence
cacatgcagggtttgtaaaa

SEQ ID NO: 538944 - DNA, 20 bp, Artificial
  CRISPR gRNA sequence
gcagggtttgtaaaaaagaa

SEQ ID NO: 538945 - DNA, 20 bp, Artificial
  CRISPR gRNA sequence
gtttgtaaaaaagaaaagaa

SEQ ID NO: 538946 - DNA, 20 bp, Artificial
  CRISPR gRNA sequence
taaaaaagaaaagaaaagaa

SEQ ID NO: 538947 - DNA, 20 bp, Artificial
  CRISPR gRNA sequence
aagaaaagaaaagaaaagaa

SEQ ID NO: 538948 - DNA, 20 bp, Artificial
  CRISPR gRNA sequence
agaaaagaaaagaaaaaaaa

SEQ ID NO: 538949 - DNA, 20 bp, Artificial
  CRISPR gRNA sequence
agaaaaaaaacagaatatga

SEQ ID NO: 538950 - DNA, 20 bp, Artificial
  CRISPR gRNA sequence
acagaatatgaaagtaattt

SEQ ID NO: 538951 - DNA, 20 bp, Artificial
  CRISPR gRNA sequence
cagaatatgaaagtaatttc

SEQ ID NO: 538952 - DNA, 20 bp, Artificial
  CRISPR gRNA sequence
agaatatgaaagtaatttca

SEQ ID NO: 538953 - DNA, 20 bp, Artificial
  CRISPR gRNA sequence
gaatatgaaagtaatttcag

SEQ ID NO: 538954 - DNA, 20 bp, Artificial
  CRISPR gRNA sequence
gtaatttcaggggaaacatg

SEQ ID NO: 538955 - DNA, 20 bp, Artificial
  CRISPR gRNA sequence
atttcaggggaaacatgaag

SEQ ID NO: 538956 - DNA, 20 bp, Artificial
  CRISPR gRNA sequence
ggggaaacatgaagaagtgt

SEQ ID NO: 538957 - DNA, 20 bp, Artificial
  CRISPR gRNA sequence
aagtgttagtattatcttct

SEQ ID NO: 538958 - DNA, 20 bp, Artificial
  CRISPR gRNA sequence
agtattatcttctaagttgc

SEQ ID NO: 538959 - DNA, 20 bp, Artificial
  CRISPR gRNA sequence
gttgctagaactcccttgac

SEQ ID NO: 538960 - DNA, 20 bp, Artificial
  CRISPR gRNA sequence
ttgctagaactcccttgact

SEQ ID NO: 538961 - DNA, 20 bp, Artificial
  CRISPR gRNA sequence
ctagaactcccttgactagg

SEQ ID NO: 538962 - DNA, 20 bp, Artificial
  CRISPR gRNA sequence
gaactcccttgactaggtag

SEQ ID NO: 538963 - DNA, 20 bp, Artificial
  CRISPR gRNA sequence
gactaggtagaagctctttc

SEQ ID NO: 538964 - DNA, 20 bp, Artificial
  CRISPR gRNA sequence
ctggctatctcattacacaa

SEQ ID NO: 538965 - DNA, 20 bp, Artificial
  CRISPR gRNA sequence
tctcattacacaacagttgc

SEQ ID NO: 538966 - DNA, 20 bp, Artificial
  CRISPR gRNA sequence
attacacaacagttgccaga

SEQ ID NO: 538967 - DNA, 20 bp, Artificial
  CRISPR gRNA sequence
acaacagttgccagatggca

SEQ ID NO: 538968 - DNA, 20 bp, Artificial
  CRISPR gRNA sequence
caacagttgccagatggcaa

SEQ ID NO: 538969 - DNA, 20 bp, Artificial
  CRISPR gRNA sequence
cagttgccagatggcaaagg

SEQ ID NO: 538970 - DNA, 20 bp, Artificial
  CRISPR gRNA sequence
ttgccagatggcaaaggtag

SEQ ID NO: 538971 - DNA, 20 bp, Artificial
  CRISPR gRNA sequence
tgcctatccaactcatctaa

SEQ ID NO: 538972 - DNA, 20 bp, Artificial
  CRISPR gRNA sequence
caactcatctaaaagtgtgc

SEQ ID NO: 538973 - DNA, 20 bp, Artificial
  CRISPR gRNA sequence
aaagtgtgcaagcctttctg

SEQ ID NO: 538974 - DNA, 20 bp, Artificial
  CRISPR gRNA sequence
gcaagcctttctgcagcacc

SEQ ID NO: 538975 - DNA, 20 bp, Artificial
  CRISPR gRNA sequence
tttctgcagcacctagatca

SEQ ID NO: 538976 - DNA, 20 bp, Artificial
  CRISPR gRNA sequence
agatcacagtttctacacct

SEQ ID NO: 538977 - DNA, 20 bp, Artificial
  CRISPR gRNA sequence
tcatattttcttgctgcccg

SEQ ID NO: 538978 - DNA, 20 bp, Artificial
  CRISPR gRNA sequence
catattttcttgctgcccgt

SEQ ID NO: 538979 - DNA, 20 bp, Artificial
  CRISPR gRNA sequence
gctgcccgtgggacttacca

SEQ ID NO: 538980 - DNA, 20 bp, Artificial
  CRISPR gRNA sequence
attcgttatacctctacttt

SEQ ID NO: 538981 - DNA, 20 bp, Artificial
  CRISPR gRNA sequence
cgttatacctctactttaag

SEQ ID NO: 538982 - DNA, 20 bp, Artificial
  CRISPR gRNA sequence
tactttaagcagcattaaac

SEQ ID NO: 538983 - DNA, 20 bp, Artificial
  CRISPR gRNA sequence
ttaagcagcattaaactggc

SEQ ID NO: 538984 - DNA, 20 bp, Artificial
  CRISPR gRNA sequence
aatgtgcctacttcctccct

SEQ ID NO: 538985 - DNA, 20 bp, Artificial
  CRISPR gRNA sequence
tacttcctccctaagacaat

SEQ ID NO: 538986 - DNA, 20 bp, Artificial
  CRISPR gRNA sequence
caatttataattaatgaatt

SEQ ID NO: 538987 - DNA, 20 bp, Artificial
  CRISPR gRNA sequence
ttcactgctgtgtaaaaaat

SEQ ID NO: 538988 - DNA, 20 bp, Artificial
  CRISPR gRNA sequence
acatatctgatgacatttta

SEQ ID NO: 538989 - DNA, 20 bp, Artificial
  CRISPR gRNA sequence
gtgtatattttcacgaattt

SEQ ID NO: 538990 - DNA, 20 bp, Artificial
  CRISPR gRNA sequence
tattttcacgaattttagta

SEQ ID NO: 538991 - DNA, 20 bp, Artificial
  CRISPR gRNA sequence
attttcacgaattttagtaa

SEQ ID NO: 538992 - DNA, 20 bp, Artificial
  CRISPR gRNA sequence
cacgaattttagtaaaggtc

SEQ ID NO: 538993 - DNA, 20 bp, Artificial
  CRISPR gRNA sequence
gtaaaggtcaagtatcaatc

SEQ ID NO: 538994 - DNA, 20 bp, Artificial
  CRISPR gRNA sequence
ggtcaagtatcaatccagcc

SEQ ID NO: 538995 - DNA, 20 bp, Artificial
  CRISPR gRNA sequence
agtatcaatccagcccagtt

SEQ ID NO: 538996 - DNA, 20 bp, Artificial
  CRISPR gRNA sequence
gtatcaatccagcccagtta

SEQ ID NO: 538997 - DNA, 20 bp, Artificial
  CRISPR gRNA sequence
caatccagcccagttaagga

SEQ ID NO: 538998 - DNA, 20 bp, Artificial
  CRISPR gRNA sequence
aatccagcccagttaaggac

SEQ ID NO: 538999 - DNA, 20 bp, Artificial
  CRISPR gRNA sequence
atccagcccagttaaggaca

SEQ ID NO: 539000 - DNA, 20 bp, Artificial
  CRISPR gRNA sequence
cagcccagttaaggacaggg

SEQ ID NO: 539001 - DNA, 20 bp, Artificial
  CRISPR gRNA sequence
ttacataaaaatcatcatct

SEQ ID NO: 539002 - DNA, 20 bp, Artificial
  CRISPR gRNA sequence
tcatcatctgagatgtgatg

SEQ ID NO: 539003 - DNA, 20 bp, Artificial
  CRISPR gRNA sequence
catcatctgagatgtgatga

SEQ ID NO: 539004 - DNA, 20 bp, Artificial
  CRISPR gRNA sequence
atgtgatgaaggtccataaa

SEQ ID NO: 539005 - DNA, 20 bp, Artificial
  CRISPR gRNA sequence
gatgaaggtccataaaaaga

SEQ ID NO: 539006 - DNA, 20 bp, Artificial
  CRISPR gRNA sequence
atgaaggtccataaaaagat

SEQ ID NO: 539007 - DNA, 20 bp, Artificial
  CRISPR gRNA sequence
aggtccataaaaagatggga

SEQ ID NO: 539008 - DNA, 20 bp, Artificial
  CRISPR gRNA sequence
ggtccataaaaagatgggaa

SEQ ID NO: 539009 - DNA, 20 bp, Artificial
  CRISPR gRNA sequence
gggaaaggactaataaacct

SEQ ID NO: 539010 - DNA, 20 bp, Artificial
  CRISPR gRNA sequence
aaaggactaataaacctcag

SEQ ID NO: 539011 - DNA, 20 bp, Artificial
  CRISPR gRNA sequence
ggactaataaacctcagaag

SEQ ID NO: 539012 - DNA, 20 bp, Artificial
  CRISPR gRNA sequence
acctcagaagtagaaatttt

SEQ ID NO: 539013 - DNA, 20 bp, Artificial
  CRISPR gRNA sequence
cctcagaagtagaaatttta

SEQ ID NO: 539014 - DNA, 20 bp, Artificial
  CRISPR gRNA sequence
ctcagaagtagaaattttaa

SEQ ID NO: 539015 - DNA, 20 bp, Artificial
  CRISPR gRNA sequence
tcagaagtagaaattttaag

SEQ ID NO: 539016 - DNA, 20 bp, Artificial
  CRISPR gRNA sequence
agaaattttaaggggacttt

SEQ ID NO: 539017 - DNA, 20 bp, Artificial
  CRISPR gRNA sequence
gaaattttaaggggactttt

SEQ ID NO: 539018 - DNA, 20 bp, Artificial
  CRISPR gRNA sequence
tttaaggggacttttgggta

SEQ ID NO: 539019 - DNA, 20 bp, Artificial
  CRISPR gRNA sequence
taaggggacttttgggtatg

SEQ ID NO: 539020 - DNA, 20 bp, Artificial
  CRISPR gRNA sequence
aaggggacttttgggtatgg

SEQ ID NO: 539021 - DNA, 20 bp, Artificial
  CRISPR gRNA sequence
ggacttttgggtatggagga

SEQ ID NO: 539022 - DNA, 20 bp, Artificial
  CRISPR gRNA sequence
ttttgggtatggaggaaagc

SEQ ID NO: 539023 - DNA, 20 bp, Artificial
  CRISPR gRNA sequence
gccagatctcaatgtacaca

SEQ ID NO: 539024 - DNA, 20 bp, Artificial
  CRISPR gRNA sequence
agatctcaatgtacacacag

SEQ ID NO: 539025 - DNA, 20 bp, Artificial
  CRISPR gRNA sequence
gatctcaatgtacacacaga

SEQ ID NO: 539026 - DNA, 20 bp, Artificial
  CRISPR gRNA sequence
ctcaatgtacacacagaagg

SEQ ID NO: 539027 - DNA, 20 bp, Artificial
  CRISPR gRNA sequence
aatgtacacacagaaggaag

SEQ ID NO: 539028 - DNA, 20 bp, Artificial
  CRISPR gRNA sequence
ggaagtggatgccctgaatt

SEQ ID NO: 539029 - DNA, 20 bp, Artificial
  CRISPR gRNA sequence
gaagtggatgccctgaattt

SEQ ID NO: 539030 - DNA, 20 bp, Artificial
  CRISPR gRNA sequence
gtggatgccctgaatttagg

SEQ ID NO: 539031 - DNA, 20 bp, Artificial
  CRISPR gRNA sequence
gccctgaatttaggaagtgc

SEQ ID NO: 539032 - DNA, 20 bp, Artificial
  CRISPR gRNA sequence
ccctgaatttaggaagtgcc

SEQ ID NO: 539033 - DNA, 20 bp, Artificial
  CRISPR gRNA sequence
cctgtccaaaatatgctcac

SEQ ID NO: 539034 - DNA, 20 bp, Artificial
  CRISPR gRNA sequence
gtccaaaatatgctcactgg

SEQ ID NO: 539035 - DNA, 20 bp, Artificial
  CRISPR gRNA sequence
gctcactggaagtctcctat

SEQ ID NO: 539036 - DNA, 20 bp, Artificial
  CRISPR gRNA sequence
ctcactggaagtctcctatt

SEQ ID NO: 539037 - DNA, 20 bp, Artificial
  CRISPR gRNA sequence
tggaagtctcctattaggtc

SEQ ID NO: 539038 - DNA, 20 bp, Artificial
  CRISPR gRNA sequence
cctattaggtctggtgtctc

SEQ ID NO: 539039 - DNA, 20 bp, Artificial
  CRISPR gRNA sequence
attaggtctggtgtctctag

SEQ ID NO: 539040 - DNA, 20 bp, Artificial
  CRISPR gRNA sequence
tggtgtctctagaagattac

SEQ ID NO: 539041 - DNA, 20 bp, Artificial
  CRISPR gRNA sequence
ggtgtctctagaagattacc

SEQ ID NO: 539042 - DNA, 20 bp, Artificial
  CRISPR gRNA sequence
gattaccaggttactaaaac

SEQ ID NO: 539043 - DNA, 20 bp, Artificial
  CRISPR gRNA sequence
acaagtgttaacattacctc

SEQ ID NO: 539044 - DNA, 20 bp, Artificial
  CRISPR gRNA sequence
caagtgttaacattacctca

SEQ ID NO: 539045 - DNA, 20 bp, Artificial
  CRISPR gRNA sequence
gtgttaacattacctcaagg

SEQ ID NO: 539046 - DNA, 20 bp, Artificial
  CRISPR gRNA sequence
ttcttaaaaaaaaaaaaaaa

SEQ ID NO: 539047 - DNA, 20 bp, Artificial
  CRISPR gRNA sequence
tgaccaatcattttatcatg

SEQ ID NO: 539048 - DNA, 20 bp, Artificial
  CRISPR gRNA sequence
tatcatgcagatgtgaaacc

SEQ ID NO: 539049 - DNA, 20 bp, Artificial
  CRISPR gRNA sequence
tcatgcagatgtgaaaccta

SEQ ID NO: 539050 - DNA, 20 bp, Artificial
  CRISPR gRNA sequence
caaccaaaacctacatcttg

SEQ ID NO: 539051 - DNA, 20 bp, Artificial
  CRISPR gRNA sequence
acatcttgcagactctttct

SEQ ID NO: 539052 - DNA, 20 bp, Artificial
  CRISPR gRNA sequence
tcttggaccctctatctacc

SEQ ID NO: 539053 - DNA, 20 bp, Artificial
  CRISPR gRNA sequence
ccctctatctacctggatga

SEQ ID NO: 539054 - DNA, 20 bp, Artificial
  CRISPR gRNA sequence
tctatctacctggatgatag

SEQ ID NO: 539055 - DNA, 20 bp, Artificial
  CRISPR gRNA sequence
tcctctctttaatccatcat

SEQ ID NO: 539056 - DNA, 20 bp, Artificial
  CRISPR gRNA sequence
ttccaaaaatgtattttatc

SEQ ID NO: 539057 - DNA, 20 bp, Artificial
  CRISPR gRNA sequence
atcaagtcacttccttgctc

SEQ ID NO: 539058 - DNA, 20 bp, Artificial
  CRISPR gRNA sequence
gtcacttccttgctccagta

SEQ ID NO: 539059 - DNA, 20 bp, Artificial
  CRISPR gRNA sequence
tcacttccttgctccagtat

SEQ ID NO: 539060 - DNA, 20 bp, Artificial
  CRISPR gRNA sequence
tgctccagtataggacacaa

SEQ ID NO: 539061 - DNA, 20 bp, Artificial
  CRISPR gRNA sequence
caatggctccccactgctac

SEQ ID NO: 539062 - DNA, 20 bp, Artificial
  CRISPR gRNA sequence
cactgctacaagctgatgtc

SEQ ID NO: 539063 - DNA, 20 bp, Artificial
  CRISPR gRNA sequence
tgatgtccagactctcaaac

SEQ ID NO: 539064 - DNA, 20 bp, Artificial
  CRISPR gRNA sequence
gatgtccagactctcaaacc

SEQ ID NO: 539065 - DNA, 20 bp, Artificial
  CRISPR gRNA sequence
gactctcaaaccaggacttt

SEQ ID NO: 539066 - DNA, 20 bp, Artificial
  CRISPR gRNA sequence
ccctgtactttactcctctg

SEQ ID NO: 539067 - DNA, 20 bp, Artificial
  CRISPR gRNA sequence
cctgtactttactcctctgc

SEQ ID NO: 539068 - DNA, 20 bp, Artificial
  CRISPR gRNA sequence
tactcctctgcaggcttcct

SEQ ID NO: 539069 - DNA, 20 bp, Artificial
  CRISPR gRNA sequence
actcctctgcaggcttccta

SEQ ID NO: 539070 - DNA, 20 bp, Artificial
  CRISPR gRNA sequence
caggcttcctaaggtctatc

SEQ ID NO: 539071 - DNA, 20 bp, Artificial
  CRISPR gRNA sequence
cttcctaaggtctatccagt

SEQ ID NO: 539072 - DNA, 20 bp, Artificial
  CRISPR gRNA sequence
aacaaaaccatacctttgct

SEQ ID NO: 539073 - DNA, 20 bp, Artificial
  CRISPR gRNA sequence
acaaaaccatacctttgctg

SEQ ID NO: 539074 - DNA, 20 bp, Artificial
  CRISPR gRNA sequence
atacctttgctgaggtgcca

SEQ ID NO: 539075 - DNA, 20 bp, Artificial
  CRISPR gRNA sequence
ttttatttaattaatttatt

SEQ ID NO: 539076 - DNA, 20 bp, Artificial
  CRISPR gRNA sequence
atttaattaatttatttagc

SEQ ID NO: 539077 - DNA, 20 bp, Artificial
  CRISPR gRNA sequence
tttatttagctagttatttt

SEQ ID NO: 539078 - DNA, 20 bp, Artificial
  CRISPR gRNA sequence
ttatttagctagttattttg

SEQ ID NO: 539079 - DNA, 20 bp, Artificial
  CRISPR gRNA sequence
tttagctagttattttgagg

SEQ ID NO: 539080 - DNA, 20 bp, Artificial
  CRISPR gRNA sequence
ttagctagttattttgaggc

SEQ ID NO: 539081 - DNA, 20 bp, Artificial
  CRISPR gRNA sequence
tagctagttattttgaggca

SEQ ID NO: 539082 - DNA, 20 bp, Artificial
  CRISPR gRNA sequence
gttattttgaggcagggtct

SEQ ID NO: 539083 - DNA, 20 bp, Artificial
  CRISPR gRNA sequence
cagggtcttggtctgtcacc

SEQ ID NO: 539084 - DNA, 20 bp, Artificial
  CRISPR gRNA sequence
tcttggtctgtcacccagac

SEQ ID NO: 539085 - DNA, 20 bp, Artificial
  CRISPR gRNA sequence
ttggtctgtcacccagactg

SEQ ID NO: 539086 - DNA, 20 bp, Artificial
  CRISPR gRNA sequence
ctgtcacccagactggagtg

SEQ ID NO: 539087 - DNA, 20 bp, Artificial
  CRISPR gRNA sequence
gtcacccagactggagtgca

SEQ ID NO: 539088 - DNA, 20 bp, Artificial
  CRISPR gRNA sequence
tcacccagactggagtgcag

SEQ ID NO: 539089 - DNA, 20 bp, Artificial
  CRISPR gRNA sequence
ggagtgcagaggtgcaatca

SEQ ID NO: 539090 - DNA, 20 bp, Artificial
  CRISPR gRNA sequence
ggtgcaatcatggctcactg

SEQ ID NO: 539091 - DNA, 20 bp, Artificial
  CRISPR gRNA sequence
atcatggctcactgcagcct

SEQ ID NO: 539092 - DNA, 20 bp, Artificial
  CRISPR gRNA sequence
tcactgcagcctcagcctcc

SEQ ID NO: 539093 - DNA, 20 bp, Artificial
  CRISPR gRNA sequence
cactgcagcctcagcctcct

SEQ ID NO: 539094 - DNA, 20 bp, Artificial
  CRISPR gRNA sequence
agcctcagcctcctgggctc

SEQ ID NO: 539095 - DNA, 20 bp, Artificial
  CRISPR gRNA sequence
gcctcagcctcctgggctca

SEQ ID NO: 539096 - DNA, 20 bp, Artificial
  CRISPR gRNA sequence
cctcagcctcctgggctcaa

SEQ ID NO: 539097 - DNA, 20 bp, Artificial
  CRISPR gRNA sequence
ctcaagggatcctcccacct

SEQ ID NO: 539098 - DNA, 20 bp, Artificial
  CRISPR gRNA sequence
tcctcccacctcagcctctt

SEQ ID NO: 539099 - DNA, 20 bp, Artificial
  CRISPR gRNA sequence
tcccacctcagcctcttgag

SEQ ID NO: 539100 - DNA, 20 bp, Artificial
  CRISPR gRNA sequence
acctcagcctcttgagtagc

SEQ ID NO: 539101 - DNA, 20 bp, Artificial
  CRISPR gRNA sequence
cctcagcctcttgagtagct

SEQ ID NO: 539102 - DNA, 20 bp, Artificial
  CRISPR gRNA sequence
ctcttgagtagctgggacta

SEQ ID NO: 539103 - DNA, 20 bp, Artificial
  CRISPR gRNA sequence
tcttgagtagctgggactac

SEQ ID NO: 539104 - DNA, 20 bp, Artificial
  CRISPR gRNA sequence
caggcatgcaccaccatgcc

SEQ ID NO: 539105 - DNA, 20 bp, Artificial
  CRISPR gRNA sequence
ggttaattattttatttttg

SEQ ID NO: 539106 - DNA, 20 bp, Artificial
  CRISPR gRNA sequence
ttaattattttatttttgta

SEQ ID NO: 539107 - DNA, 20 bp, Artificial
  CRISPR gRNA sequence
ttattttatttttgtagaga

SEQ ID NO: 539108 - DNA, 20 bp, Artificial
  CRISPR gRNA sequence
attttatttttgtagagatg

SEQ ID NO: 539109 - DNA, 20 bp, Artificial
  CRISPR gRNA sequence
tggagtcttgctatgttgcc

SEQ ID NO: 539110 - DNA, 20 bp, Artificial
  CRISPR gRNA sequence
ggagtcttgctatgttgcct

SEQ ID NO: 539111 - DNA, 20 bp, Artificial
  CRISPR gRNA sequence
tcttgctatgttgcctagga

SEQ ID NO: 539112 - DNA, 20 bp, Artificial
  CRISPR gRNA sequence
ctaggatggtcttgaactac

SEQ ID NO: 539113 - DNA, 20 bp, Artificial
  CRISPR gRNA sequence
taggatggtcttgaactact

SEQ ID NO: 539114 - DNA, 20 bp, Artificial
  CRISPR gRNA sequence
ggtcttgaactactgggctt

SEQ ID NO: 539115 - DNA, 20 bp, Artificial
  CRISPR gRNA sequence
cttaagcaaccctccctcct

SEQ ID NO: 539116 - DNA, 20 bp, Artificial
  CRISPR gRNA sequence
cctccctcctcagcctcaca

SEQ ID NO: 539117 - DNA, 20 bp, Artificial
  CRISPR gRNA sequence
tcctcagcctcacaaagtgc

SEQ ID NO: 539118 - DNA, 20 bp, Artificial
  CRISPR gRNA sequence
cctcagcctcacaaagtgct

SEQ ID NO: 539119 - DNA, 20 bp, Artificial
  CRISPR gRNA sequence
ctcacaaagtgctgggatta

SEQ ID NO: 539120 - DNA, 20 bp, Artificial
  CRISPR gRNA sequence
agtgctgggattatagcctt

SEQ ID NO: 539121 - DNA, 20 bp, Artificial
  CRISPR gRNA sequence
tagccttgagccacaatgcc

SEQ ID NO: 539122 - DNA, 20 bp, Artificial
  CRISPR gRNA sequence
ttgagccacaatgcccggcc

SEQ ID NO: 539123 - DNA, 20 bp, Artificial
  CRISPR gRNA sequence
tattttaaattattttaaaa

SEQ ID NO: 539124 - DNA, 20 bp, Artificial
  CRISPR gRNA sequence
ttattttaaaacagttcatc

SEQ ID NO: 539125 - DNA, 20 bp, Artificial
  CRISPR gRNA sequence
taaaacagttcatcaagttt

SEQ ID NO: 539126 - DNA, 20 bp, Artificial
  CRISPR gRNA sequence
aaacagttcatcaagtttaa

SEQ ID NO: 539127 - DNA, 20 bp, Artificial
  CRISPR gRNA sequence
aacagttcatcaagtttaag

SEQ ID NO: 539128 - DNA, 20 bp, Artificial
  CRISPR gRNA sequence
cagttcatcaagtttaagag

SEQ ID NO: 539129 - DNA, 20 bp, Artificial
  CRISPR gRNA sequence
tttattcaaatgttttgaat

SEQ ID NO: 539130 - DNA, 20 bp, Artificial
  CRISPR gRNA sequence
agttttacaaactctataaa

SEQ ID NO: 539131 - DNA, 20 bp, Artificial
  CRISPR gRNA sequence
gttttacaaactctataaaa

SEQ ID NO: 539132 - DNA, 20 bp, Artificial
  CRISPR gRNA sequence
ttttacaaactctataaaaa

SEQ ID NO: 539133 - DNA, 20 bp, Artificial
  CRISPR gRNA sequence
gactcaatcctcttgtttgt

SEQ ID NO: 539134 - DNA, 20 bp, Artificial
  CRISPR gRNA sequence
tggccctatctataaattat

SEQ ID NO: 539135 - DNA, 20 bp, Artificial
  CRISPR gRNA sequence
tccccaatgtccatgtttca

SEQ ID NO: 539136 - DNA, 20 bp, Artificial
  CRISPR gRNA sequence
ttcaaagattctactttttc

SEQ ID NO: 539137 - DNA, 20 bp, Artificial
  CRISPR gRNA sequence
tcaaagattctactttttca

SEQ ID NO: 539138 - DNA, 20 bp, Artificial
  CRISPR gRNA sequence
ctttttcaaggaaatcttct

SEQ ID NO: 539139 - DNA, 20 bp, Artificial
  CRISPR gRNA sequence
ttttcaaggaaatcttctaa

SEQ ID NO: 539140 - DNA, 20 bp, Artificial
  CRISPR gRNA sequence
tttcaaggaaatcttctaag

SEQ ID NO: 539141 - DNA, 20 bp, Artificial
  CRISPR gRNA sequence
aagaggatactttgacatct

SEQ ID NO: 539142 - DNA, 20 bp, Artificial
  CRISPR gRNA sequence
ggatactttgacatcttagc

SEQ ID NO: 539143 - DNA, 20 bp, Artificial
  CRISPR gRNA sequence
gcaagctgtatttgtctaaa

SEQ ID NO: 539144 - DNA, 20 bp, Artificial
  CRISPR gRNA sequence
aagctgtatttgtctaaata

SEQ ID NO: 539145 - DNA, 20 bp, Artificial
  CRISPR gRNA sequence
atttgtctaaatagagtcca

SEQ ID NO: 539146 - DNA, 20 bp, Artificial
  CRISPR gRNA sequence
tttgtctaaatagagtccac

SEQ ID NO: 539147 - DNA, 20 bp, Artificial
  CRISPR gRNA sequence
ttgtctaaatagagtccaca

SEQ ID NO: 539148 - DNA, 20 bp, Artificial
  CRISPR gRNA sequence
tgtctaaatagagtccacag

SEQ ID NO: 539149 - DNA, 20 bp, Artificial
  CRISPR gRNA sequence
taaatagagtccacaggggt

SEQ ID NO: 539150 - DNA, 20 bp, Artificial
  CRISPR gRNA sequence
cacaggggtcagacctcaca

SEQ ID NO: 539151 - DNA, 20 bp, Artificial
  CRISPR gRNA sequence
cagacctcacatagccttgc

SEQ ID NO: 539152 - DNA, 20 bp, Artificial
  CRISPR gRNA sequence
gcaagtcgctttacacattt

SEQ ID NO: 539153 - DNA, 20 bp, Artificial
  CRISPR gRNA sequence
tttacacattttagctttaa

SEQ ID NO: 539154 - DNA, 20 bp, Artificial
  CRISPR gRNA sequence
tacacattttagctttaaca

SEQ ID NO: 539155 - DNA, 20 bp, Artificial
  CRISPR gRNA sequence
cattttagctttaacagagt

SEQ ID NO: 539156 - DNA, 20 bp, Artificial
  CRISPR gRNA sequence
ttagctttaacagagttaga

SEQ ID NO: 539157 - DNA, 20 bp, Artificial
  CRISPR gRNA sequence
tagctttaacagagttagat

SEQ ID NO: 539158 - DNA, 20 bp, Artificial
  CRISPR gRNA sequence
agctttaacagagttagatg

SEQ ID NO: 539159 - DNA, 20 bp, Artificial
  CRISPR gRNA sequence
acagagttagatggggccat

SEQ ID NO: 539160 - DNA, 20 bp, Artificial
  CRISPR gRNA sequence
agttagatggggccattaga

SEQ ID NO: 539161 - DNA, 20 bp, Artificial
  CRISPR gRNA sequence
ggccattagaaagttccaca

SEQ ID NO: 539162 - DNA, 20 bp, Artificial
  CRISPR gRNA sequence
ttagaaagttccacacagat

SEQ ID NO: 539163 - DNA, 20 bp, Artificial
  CRISPR gRNA sequence
gatctgacttctgttttaaa

SEQ ID NO: 539164 - DNA, 20 bp, Artificial
  CRISPR gRNA sequence
ctgttttaaaaagatcattc

SEQ ID NO: 539165 - DNA, 20 bp, Artificial
  CRISPR gRNA sequence
ttttaaaaagatcattctgg

SEQ ID NO: 539166 - DNA, 20 bp, Artificial
  CRISPR gRNA sequence
gtagaaccaatacaacttcc

SEQ ID NO: 539167 - DNA, 20 bp, Artificial
  CRISPR gRNA sequence
gaaccaatacaacttcctgg

SEQ ID NO: 539168 - DNA, 20 bp, Artificial
  CRISPR gRNA sequence
accaatacaacttcctggta

SEQ ID NO: 539169 - DNA, 20 bp, Artificial
  CRISPR gRNA sequence
acttcctggtagagtgaatg

SEQ ID NO: 539170 - DNA, 20 bp, Artificial
  CRISPR gRNA sequence
gtagagtgaatgtggtattc

SEQ ID NO: 539171 - DNA, 20 bp, Artificial
  CRISPR gRNA sequence
tgaatgtggtattcaagaaa

SEQ ID NO: 539172 - DNA, 20 bp, Artificial
  CRISPR gRNA sequence
aatgtggtattcaagaaaaa

SEQ ID NO: 539173 - DNA, 20 bp, Artificial
  CRISPR gRNA sequence
tgtggtattcaagaaaaaga

SEQ ID NO: 539174 - DNA, 20 bp, Artificial
  CRISPR gRNA sequence
gtggtattcaagaaaaagag

SEQ ID NO: 539175 - DNA, 20 bp, Artificial
  CRISPR gRNA sequence
tcaagaaaaagagaggtatc

SEQ ID NO: 539176 - DNA, 20 bp, Artificial
  CRISPR gRNA sequence
caagaaaaagagaggtatca

SEQ ID NO: 539177 - DNA, 20 bp, Artificial
  CRISPR gRNA sequence
aggtatcaaggatgacatcc

SEQ ID NO: 539178 - DNA, 20 bp, Artificial
  CRISPR gRNA sequence
caaggatgacatcccggttt

SEQ ID NO: 539179 - DNA, 20 bp, Artificial
  CRISPR gRNA sequence
catcccggtttcagactgac

SEQ ID NO: 539180 - DNA, 20 bp, Artificial
  CRISPR gRNA sequence
gtttcagactgaccagctga

SEQ ID NO: 539181 - DNA, 20 bp, Artificial
  CRISPR gRNA sequence
tttcagactgaccagctgaa

SEQ ID NO: 539182 - DNA, 20 bp, Artificial
  CRISPR gRNA sequence
agactgaccagctgaaagga

SEQ ID NO: 539183 - DNA, 20 bp, Artificial
  CRISPR gRNA sequence
gactgaccagctgaaaggat

SEQ ID NO: 539184 - DNA, 20 bp, Artificial
  CRISPR gRNA sequence
actgaccagctgaaaggatg

SEQ ID NO: 539185 - DNA, 20 bp, Artificial
  CRISPR gRNA sequence
atggggctgccattaaccaa

SEQ ID NO: 539186 - DNA, 20 bp, Artificial
  CRISPR gRNA sequence
tggggctgccattaaccaaa

SEQ ID NO: 539187 - DNA, 20 bp, Artificial
  CRISPR gRNA sequence
ggggctgccattaaccaaaa

SEQ ID NO: 539188 - DNA, 20 bp, Artificial
  CRISPR gRNA sequence
tgccattaaccaaaagggaa

SEQ ID NO: 539189 - DNA, 20 bp, Artificial
  CRISPR gRNA sequence
taaccaaaagggaaaagatt

SEQ ID NO: 539190 - DNA, 20 bp, Artificial
  CRISPR gRNA sequence
aaccaaaagggaaaagattt

SEQ ID NO: 539191 - DNA, 20 bp, Artificial
  CRISPR gRNA sequence
accaaaagggaaaagatttg

SEQ ID NO: 539192 - DNA, 20 bp, Artificial
  CRISPR gRNA sequence
caaaagggaaaagatttggg

SEQ ID NO: 539193 - DNA, 20 bp, Artificial
  CRISPR gRNA sequence
aaaagggaaaagatttgggg

SEQ ID NO: 539194 - DNA, 20 bp, Artificial
  CRISPR gRNA sequence
aagggaaaagatttggggag

SEQ ID NO: 539195 - DNA, 20 bp, Artificial
  CRISPR gRNA sequence
ggaaaagatttggggaggag

SEQ ID NO: 539196 - DNA, 20 bp, Artificial
  CRISPR gRNA sequence
aaagatttggggaggagcag

SEQ ID NO: 539197 - DNA, 20 bp, Artificial
  CRISPR gRNA sequence
aagatttggggaggagcagc

SEQ ID NO: 539198 - DNA, 20 bp, Artificial
  CRISPR gRNA sequence
ggggaggagcagcaggtttt

SEQ ID NO: 539199 - DNA, 20 bp, Artificial
  CRISPR gRNA sequence
gggaggagcagcaggtttta

SEQ ID NO: 539200 - DNA, 20 bp, Artificial
  CRISPR gRNA sequence
ggaggagcagcaggttttaa

SEQ ID NO: 539201 - DNA, 20 bp, Artificial
  CRISPR gRNA sequence
gaggagcagcaggttttaag

SEQ ID NO: 539202 - DNA, 20 bp, Artificial
  CRISPR gRNA sequence
gagcagcaggttttaagggg

SEQ ID NO: 539203 - DNA, 20 bp, Artificial
  CRISPR gRNA sequence
ggttttaaggggaagataat

SEQ ID NO: 539204 - DNA, 20 bp, Artificial
  CRISPR gRNA sequence
gaagataatgagcttacttt

SEQ ID NO: 539205 - DNA, 20 bp, Artificial
  CRISPR gRNA sequence
tttggacttgtgatatttga

SEQ ID NO: 539206 - DNA, 20 bp, Artificial
  CRISPR gRNA sequence
ttggacttgtgatatttgaa

SEQ ID NO: 539207 - DNA, 20 bp, Artificial
  CRISPR gRNA sequence
gtgatatttgaaaggccaat

SEQ ID NO: 539208 - DNA, 20 bp, Artificial
  CRISPR gRNA sequence
aggccaattagatgtctgac

SEQ ID NO: 539209 - DNA, 20 bp, Artificial
  CRISPR gRNA sequence
gccaattagatgtctgactg

SEQ ID NO: 539210 - DNA, 20 bp, Artificial
  CRISPR gRNA sequence
caattagatgtctgactgga

SEQ ID NO: 539211 - DNA, 20 bp, Artificial
  CRISPR gRNA sequence
aattagatgtctgactggag

SEQ ID NO: 539212 - DNA, 20 bp, Artificial
  CRISPR gRNA sequence
gtctgactggagaggtacac

SEQ ID NO: 539213 - DNA, 20 bp, Artificial
  CRISPR gRNA sequence
tctgactggagaggtacact

SEQ ID NO: 539214 - DNA, 20 bp, Artificial
  CRISPR gRNA sequence
gactggagaggtacactggg

SEQ ID NO: 539215 - DNA, 20 bp, Artificial
  CRISPR gRNA sequence
ggagaggtacactgggcagt

SEQ ID NO: 539216 - DNA, 20 bp, Artificial
  CRISPR gRNA sequence
gagaggtacactgggcagtc

SEQ ID NO: 539217 - DNA, 20 bp, Artificial
  CRISPR gRNA sequence
gggcagtcaggtatacacat

SEQ ID NO: 539218 - DNA, 20 bp, Artificial
  CRISPR gRNA sequence
ggcagtcaggtatacacata

SEQ ID NO: 539219 - DNA, 20 bp, Artificial
  CRISPR gRNA sequence
cagtcaggtatacacataag

SEQ ID NO: 539220 - DNA, 20 bp, Artificial
  CRISPR gRNA sequence
aggtatacacataaggagct

SEQ ID NO: 539221 - DNA, 20 bp, Artificial
  CRISPR gRNA sequence
tatacacataaggagctcgg

SEQ ID NO: 539222 - DNA, 20 bp, Artificial
  CRISPR gRNA sequence
atacacataaggagctcggc

SEQ ID NO: 539223 - DNA, 20 bp, Artificial
  CRISPR gRNA sequence
tacacataaggagctcggcg

SEQ ID NO: 539224 - DNA, 20 bp, Artificial
  CRISPR gRNA sequence
aggagctcggcggggtactc

SEQ ID NO: 539225 - DNA, 20 bp, Artificial
  CRISPR gRNA sequence
ggagctcggcggggtactct

SEQ ID NO: 539226 - DNA, 20 bp, Artificial
  CRISPR gRNA sequence
ctcggcggggtactctgggc

SEQ ID NO: 539227 - DNA, 20 bp, Artificial
  CRISPR gRNA sequence
cggcggggtactctgggcta

SEQ ID NO: 539228 - DNA, 20 bp, Artificial
  CRISPR gRNA sequence
ggtactctgggctagagctc

SEQ ID NO: 539229 - DNA, 20 bp, Artificial
  CRISPR gRNA sequence
gctctagatctgtacattat

SEQ ID NO: 539230 - DNA, 20 bp, Artificial
  CRISPR gRNA sequence
atctgtacattattagcatt

SEQ ID NO: 539231 - DNA, 20 bp, Artificial
  CRISPR gRNA sequence
tagcattgagatgatattta

SEQ ID NO: 539232 - DNA, 20 bp, Artificial
  CRISPR gRNA sequence
tgatatttaaagccctgaca

SEQ ID NO: 539233 - DNA, 20 bp, Artificial
  CRISPR gRNA sequence
gatatttaaagccctgacat

SEQ ID NO: 539234 - DNA, 20 bp, Artificial
  CRISPR gRNA sequence
ttaaagccctgacatgggat

SEQ ID NO: 539235 - DNA, 20 bp, Artificial
  CRISPR gRNA sequence
catgggatgagctcacccac

SEQ ID NO: 539236 - DNA, 20 bp, Artificial
  CRISPR gRNA sequence
tcacccactggctatgaacg

SEQ ID NO: 539237 - DNA, 20 bp, Artificial
  CRISPR gRNA sequence
ccactggctatgaacgcaga

SEQ ID NO: 539238 - DNA, 20 bp, Artificial
  CRISPR gRNA sequence
ggctatgaacgcagacagaa

SEQ ID NO: 539239 - DNA, 20 bp, Artificial
  CRISPR gRNA sequence
gctatgaacgcagacagaaa

SEQ ID NO: 539240 - DNA, 20 bp, Artificial
  CRISPR gRNA sequence
tgaacgcagacagaaaagga

SEQ ID NO: 539241 - DNA, 20 bp, Artificial
  CRISPR gRNA sequence
aacgcagacagaaaaggaaa

SEQ ID NO: 539242 - DNA, 20 bp, Artificial
  CRISPR gRNA sequence
acagaaaaggaaagagacct

SEQ ID NO: 539243 - DNA, 20 bp, Artificial
  CRISPR gRNA sequence
cagaaaaggaaagagaccta

SEQ ID NO: 539244 - DNA, 20 bp, Artificial
  CRISPR gRNA sequence
aggaaagagacctaaggctt

SEQ ID NO: 539245 - DNA, 20 bp, Artificial
  CRISPR gRNA sequence
ggcttaagccttgatgtttc

SEQ ID NO: 539246 - DNA, 20 bp, Artificial
  CRISPR gRNA sequence
gccttgatgtttccagtgtt

SEQ ID NO: 539247 - DNA, 20 bp, Artificial
  CRISPR gRNA sequence
cttgatgtttccagtgttaa

SEQ ID NO: 539248 - DNA, 20 bp, Artificial
  CRISPR gRNA sequence
ttgatgtttccagtgttaag

SEQ ID NO: 539249 - DNA, 20 bp, Artificial
  CRISPR gRNA sequence
tgtttccagtgttaagaggt

SEQ ID NO: 539250 - DNA, 20 bp, Artificial
  CRISPR gRNA sequence
gtttccagtgttaagaggtt

SEQ ID NO: 539251 - DNA, 20 bp, Artificial
  CRISPR gRNA sequence
tttccagtgttaagaggttg

SEQ ID NO: 539252 - DNA, 20 bp, Artificial
  CRISPR gRNA sequence
tgttaagaggttggggaaac

SEQ ID NO: 539253 - DNA, 20 bp, Artificial
  CRISPR gRNA sequence
gttaagaggttggggaaaca

SEQ ID NO: 539254 - DNA, 20 bp, Artificial
  CRISPR gRNA sequence
ggttggggaaacaaggaaac

SEQ ID NO: 539255 - DNA, 20 bp, Artificial
  CRISPR gRNA sequence
ggaaacaaggaaactagcaa

SEQ ID NO: 539256 - DNA, 20 bp, Artificial
  CRISPR gRNA sequence
aacaaggaaactagcaaaag

SEQ ID NO: 539257 - DNA, 20 bp, Artificial
  CRISPR gRNA sequence
aactagcaaaagaagctgaa

SEQ ID NO: 539258 - DNA, 20 bp, Artificial
  CRISPR gRNA sequence
actagcaaaagaagctgaaa

SEQ ID NO: 539259 - DNA, 20 bp, Artificial
  CRISPR gRNA sequence
caaaagaagctgaaaaggaa

SEQ ID NO: 539260 - DNA, 20 bp, Artificial
  CRISPR gRNA sequence
agaagctgaaaaggaatagt

SEQ ID NO: 539261 - DNA, 20 bp, Artificial
  CRISPR gRNA sequence
aaaaggaatagtcagtgtgt

SEQ ID NO: 539262 - DNA, 20 bp, Artificial
  CRISPR gRNA sequence
ggaatagtcagtgtgttaga

SEQ ID NO: 539263 - DNA, 20 bp, Artificial
  CRISPR gRNA sequence
gtgtgttagaaagaaatgtg

SEQ ID NO: 539264 - DNA, 20 bp, Artificial
  CRISPR gRNA sequence
gttagaaagaaatgtgaagc

SEQ ID NO: 539265 - DNA, 20 bp, Artificial
  CRISPR gRNA sequence
ttagaaagaaatgtgaagcc

SEQ ID NO: 539266 - DNA, 20 bp, Artificial
  CRISPR gRNA sequence
aagaaatgtgaagccaggca

SEQ ID NO: 539267 - DNA, 20 bp, Artificial
  CRISPR gRNA sequence
aaatgtgaagccaggcacag

SEQ ID NO: 539268 - DNA, 20 bp, Artificial
  CRISPR gRNA sequence
cacctgtaatcccaacactt

SEQ ID NO: 539269 - DNA, 20 bp, Artificial
  CRISPR gRNA sequence
acctgtaatcccaacacttt

SEQ ID NO: 539270 - DNA, 20 bp, Artificial
  CRISPR gRNA sequence
ctgtaatcccaacactttgg

SEQ ID NO: 539271 - DNA, 20 bp, Artificial
  CRISPR gRNA sequence
tgtaatcccaacactttggg

SEQ ID NO: 539272 - DNA, 20 bp, Artificial
  CRISPR gRNA sequence
tcccaacactttgggaggcc

SEQ ID NO: 539273 - DNA, 20 bp, Artificial
  CRISPR gRNA sequence
cccaacactttgggaggcca

SEQ ID NO: 539274 - DNA, 20 bp, Artificial
  CRISPR gRNA sequence
aacactttgggaggccaagg

SEQ ID NO: 539275 - DNA, 20 bp, Artificial
  CRISPR gRNA sequence
acactttgggaggccaaggc

SEQ ID NO: 539276 - DNA, 20 bp, Artificial
  CRISPR gRNA sequence
ctttgggaggccaaggcagg

SEQ ID NO: 539277 - DNA, 20 bp, Artificial
  CRISPR gRNA sequence
ccaaggcaggtggatcacct

SEQ ID NO: 539278 - DNA, 20 bp, Artificial
  CRISPR gRNA sequence
caaggcaggtggatcacctg

SEQ ID NO: 539279 - DNA, 20 bp, Artificial
  CRISPR gRNA sequence
gcaggtggatcacctgaggt

SEQ ID NO: 539280 - DNA, 20 bp, Artificial
  CRISPR gRNA sequence
caggtggatcacctgaggtc

SEQ ID NO: 539281 - DNA, 20 bp, Artificial
  CRISPR gRNA sequence
ggtggatcacctgaggtcag

SEQ ID NO: 539282 - DNA, 20 bp, Artificial
  CRISPR gRNA sequence
tcacctgaggtcaggagttc

SEQ ID NO: 539283 - DNA, 20 bp, Artificial
  CRISPR gRNA sequence
tgaggtcaggagttcaagac

SEQ ID NO: 539284 - DNA, 20 bp, Artificial
  CRISPR gRNA sequence
caagaccagcctgaccaaca

SEQ ID NO: 539285 - DNA, 20 bp, Artificial
  CRISPR gRNA sequence
ctctactaaaaatacaaaat

SEQ ID NO: 539286 - DNA, 20 bp, Artificial
  CRISPR gRNA sequence
actaaaaatacaaaattagc

SEQ ID NO: 539287 - DNA, 20 bp, Artificial
  CRISPR gRNA sequence
ctaaaaatacaaaattagcc

SEQ ID NO: 539288 - DNA, 20 bp, Artificial
  CRISPR gRNA sequence
aatacaaaattagccaggca

SEQ ID NO: 539289 - DNA, 20 bp, Artificial
  CRISPR gRNA sequence
acaaaattagccaggcatgg

SEQ ID NO: 539290 - DNA, 20 bp, Artificial
  CRISPR gRNA sequence
tgcctgtaatctcaactgtt

SEQ ID NO: 539291 - DNA, 20 bp, Artificial
  CRISPR gRNA sequence
gcctgtaatctcaactgttc

SEQ ID NO: 539292 - DNA, 20 bp, Artificial
  CRISPR gRNA sequence
ctgtaatctcaactgttcag

SEQ ID NO: 539293 - DNA, 20 bp, Artificial
  CRISPR gRNA sequence
tgtaatctcaactgttcagg

SEQ ID NO: 539294 - DNA, 20 bp, Artificial
  CRISPR gRNA sequence
tctcaactgttcaggaggct

SEQ ID NO: 539295 - DNA, 20 bp, Artificial
  CRISPR gRNA sequence
ctcaactgttcaggaggctg

SEQ ID NO: 539296 - DNA, 20 bp, Artificial
  CRISPR gRNA sequence
aactgttcaggaggctgagg

SEQ ID NO: 539297 - DNA, 20 bp, Artificial
  CRISPR gRNA sequence
tgttcaggaggctgaggcag

SEQ ID NO: 539298 - DNA, 20 bp, Artificial
  CRISPR gRNA sequence
gcagaagattcacttgaacc

SEQ ID NO: 539299 - DNA, 20 bp, Artificial
  CRISPR gRNA sequence
cagaagattcacttgaaccc

SEQ ID NO: 539300 - DNA, 20 bp, Artificial
  CRISPR gRNA sequence
gaagattcacttgaacccgg

SEQ ID NO: 539301 - DNA, 20 bp, Artificial
  CRISPR gRNA sequence
aagattcacttgaacccggg

SEQ ID NO: 539302 - DNA, 20 bp, Artificial
  CRISPR gRNA sequence
tcacttgaacccgggaggca

SEQ ID NO: 539303 - DNA, 20 bp, Artificial
  CRISPR gRNA sequence
cacttgaacccgggaggcat

SEQ ID NO: 539304 - DNA, 20 bp, Artificial
  CRISPR gRNA sequence
aacccgggaggcataggttg

SEQ ID NO: 539305 - DNA, 20 bp, Artificial
  CRISPR gRNA sequence
cgggaggcataggttgcagt

SEQ ID NO: 539306 - DNA, 20 bp, Artificial
  CRISPR gRNA sequence
ggcataggttgcagtgagct

SEQ ID NO: 539307 - DNA, 20 bp, Artificial
  CRISPR gRNA sequence
gagatcgcgccattgcattc

SEQ ID NO: 539308 - DNA, 20 bp, Artificial
  CRISPR gRNA sequence
cgcgccattgcattccagcc

SEQ ID NO: 539309 - DNA, 20 bp, Artificial
  CRISPR gRNA sequence
gcgccattgcattccagcct

SEQ ID NO: 539310 - DNA, 20 bp, Artificial
  CRISPR gRNA sequence
tgcattccagcctgggcaac

SEQ ID NO: 539311 - DNA, 20 bp, Artificial
  CRISPR gRNA sequence
gcattccagcctgggcaaca

SEQ ID NO: 539312 - DNA, 20 bp, Artificial
  CRISPR gRNA sequence
cattccagcctgggcaacaa

SEQ ID NO: 539313 - DNA, 20 bp, Artificial
  CRISPR gRNA sequence
caagggcgaaaccccctctc

SEQ ID NO: 539314 - DNA, 20 bp, Artificial
  CRISPR gRNA sequence
aagggcgaaaccccctctca

SEQ ID NO: 539315 - DNA, 20 bp, Artificial
  CRISPR gRNA sequence
aaaccccctctcaaggaaaa

SEQ ID NO: 539316 - DNA, 20 bp, Artificial
  CRISPR gRNA sequence
accccctctcaaggaaaaaa

SEQ ID NO: 539317 - DNA, 20 bp, Artificial
  CRISPR gRNA sequence
cctctcaaggaaaaaagaga

SEQ ID NO: 539318 - DNA, 20 bp, Artificial
  CRISPR gRNA sequence
aaaagagaaagaaacatgaa

SEQ ID NO: 539319 - DNA, 20 bp, Artificial
  CRISPR gRNA sequence
aaagagaaagaaacatgaat

SEQ ID NO: 539320 - DNA, 20 bp, Artificial
  CRISPR gRNA sequence
aagagaaagaaacatgaata

SEQ ID NO: 539321 - DNA, 20 bp, Artificial
  CRISPR gRNA sequence
agaaagaaacatgaataggg

SEQ ID NO: 539322 - DNA, 20 bp, Artificial
  CRISPR gRNA sequence
acatgaatagggtggtatcc

SEQ ID NO: 539323 - DNA, 20 bp, Artificial
  CRISPR gRNA sequence
agggtggtatcctggatgtc

SEQ ID NO: 539324 - DNA, 20 bp, Artificial
  CRISPR gRNA sequence
ggtatcctggatgtcaagtg

SEQ ID NO: 539325 - DNA, 20 bp, Artificial
  CRISPR gRNA sequence
tcctggatgtcaagtgaaga

SEQ ID NO: 539326 - DNA, 20 bp, Artificial
  CRISPR gRNA sequence
tgtcaagtgaagacagtact

SEQ ID NO: 539327 - DNA, 20 bp, Artificial
  CRISPR gRNA sequence
tcaagtgaagacagtacttg

SEQ ID NO: 539328 - DNA, 20 bp, Artificial
  CRISPR gRNA sequence
caagtgaagacagtacttgg

SEQ ID NO: 539329 - DNA, 20 bp, Artificial
  CRISPR gRNA sequence
agtgaagacagtacttggag

SEQ ID NO: 539330 - DNA, 20 bp, Artificial
  CRISPR gRNA sequence
gtgaagacagtacttggagg

SEQ ID NO: 539331 - DNA, 20 bp, Artificial
  CRISPR gRNA sequence
tgaagacagtacttggagga

SEQ ID NO: 539332 - DNA, 20 bp, Artificial
  CRISPR gRNA sequence
aagacagtacttggaggagg

SEQ ID NO: 539333 - DNA, 20 bp, Artificial
  CRISPR gRNA sequence
tacttggaggagggagtgat

SEQ ID NO: 539334 - DNA, 20 bp, Artificial
  CRISPR gRNA sequence
ggagtgatcagctatgtcaa

SEQ ID NO: 539335 - DNA, 20 bp, Artificial
  CRISPR gRNA sequence
cagctatgtcaaaagctgct

SEQ ID NO: 539336 - DNA, 20 bp, Artificial
  CRISPR gRNA sequence
ctatgtcaaaagctgctgag

SEQ ID NO: 539337 - DNA, 20 bp, Artificial
  CRISPR gRNA sequence
tcaaaagctgctgagaagtc

SEQ ID NO: 539338 - DNA, 20 bp, Artificial
  CRISPR gRNA sequence
ctgagaagtcaagaatgaca

SEQ ID NO: 539339 - DNA, 20 bp, Artificial
  CRISPR gRNA sequence
agtcaagaatgacatggact

SEQ ID NO: 539340 - DNA, 20 bp, Artificial
  CRISPR gRNA sequence
atggactgagaatgaaccac

SEQ ID NO: 539341 - DNA, 20 bp, Artificial
  CRISPR gRNA sequence
gaaccactggatttattaac

SEQ ID NO: 539342 - DNA, 20 bp, Artificial
  CRISPR gRNA sequence
aaccactggatttattaaca

SEQ ID NO: 539343 - DNA, 20 bp, Artificial
  CRISPR gRNA sequence
ccactggatttattaacaag

SEQ ID NO: 539344 - DNA, 20 bp, Artificial
  CRISPR gRNA sequence
cactggatttattaacaagg

SEQ ID NO: 539345 - DNA, 20 bp, Artificial
  CRISPR gRNA sequence
gatttattaacaaggaggtc

SEQ ID NO: 539346 - DNA, 20 bp, Artificial
  CRISPR gRNA sequence
tttattaacaaggaggtcta

SEQ ID NO: 539347 - DNA, 20 bp, Artificial
  CRISPR gRNA sequence
ttattaacaaggaggtctag

SEQ ID NO: 539348 - DNA, 20 bp, Artificial
  CRISPR gRNA sequence
attaacaaggaggtctagag

SEQ ID NO: 539349 - DNA, 20 bp, Artificial
  CRISPR gRNA sequence
aaggaggtctagaggagttt

SEQ ID NO: 539350 - DNA, 20 bp, Artificial
  CRISPR gRNA sequence
ggtctagaggagttttggca

SEQ ID NO: 539351 - DNA, 20 bp, Artificial
  CRISPR gRNA sequence
ctagaggagttttggcatag

SEQ ID NO: 539352 - DNA, 20 bp, Artificial
  CRISPR gRNA sequence
ggagttttggcatagcagtg

SEQ ID NO: 539353 - DNA, 20 bp, Artificial
  CRISPR gRNA sequence
tggcatagcagtgcagatga

SEQ ID NO: 539354 - DNA, 20 bp, Artificial
  CRISPR gRNA sequence
agtgcagatgaaagcctatt

SEQ ID NO: 539355 - DNA, 20 bp, Artificial
  CRISPR gRNA sequence
tgcagatgaaagcctatttg

SEQ ID NO: 539356 - DNA, 20 bp, Artificial
  CRISPR gRNA sequence
agatgaaagcctatttggag

SEQ ID NO: 539357 - DNA, 20 bp, Artificial
  CRISPR gRNA sequence
gatgaaagcctatttggagt

SEQ ID NO: 539358 - DNA, 20 bp, Artificial
  CRISPR gRNA sequence
gcctatttggagtgggttaa

SEQ ID NO: 539359 - DNA, 20 bp, Artificial
  CRISPR gRNA sequence
agtgggttaaaagtgaatat

SEQ ID NO: 539360 - DNA, 20 bp, Artificial
  CRISPR gRNA sequence
gtgggttaaaagtgaatata

SEQ ID NO: 539361 - DNA, 20 bp, Artificial
  CRISPR gRNA sequence
tgggttaaaagtgaatataa

SEQ ID NO: 539362 - DNA, 20 bp, Artificial
  CRISPR gRNA sequence
taaaagtgaatataagggat

SEQ ID NO: 539363 - DNA, 20 bp, Artificial
  CRISPR gRNA sequence
tgaatataagggatcagaat

SEQ ID NO: 539364 - DNA, 20 bp, Artificial
  CRISPR gRNA sequence
gggatcagaataagtgaata

SEQ ID NO: 539365 - DNA, 20 bp, Artificial
  CRISPR gRNA sequence
tgaatatggacaacttcttc

SEQ ID NO: 539366 - DNA, 20 bp, Artificial
  CRISPR gRNA sequence
gaatatggacaacttcttca

SEQ ID NO: 539367 - DNA, 20 bp, Artificial
  CRISPR gRNA sequence
atatggacaacttcttcaag

SEQ ID NO: 539368 - DNA, 20 bp, Artificial
  CRISPR gRNA sequence
cttcaaggagattttctata

SEQ ID NO: 539369 - DNA, 20 bp, Artificial
  CRISPR gRNA sequence
aggagattttctataaagtg

SEQ ID NO: 539370 - DNA, 20 bp, Artificial
  CRISPR gRNA sequence
gattttctataaagtgaaga

SEQ ID NO: 539371 - DNA, 20 bp, Artificial
  CRISPR gRNA sequence
tttctataaagtgaagacag

SEQ ID NO: 539372 - DNA, 20 bp, Artificial
  CRISPR gRNA sequence
ttctataaagtgaagacagc

SEQ ID NO: 539373 - DNA, 20 bp, Artificial
  CRISPR gRNA sequence
tataaagtgaagacagcagg

SEQ ID NO: 539374 - DNA, 20 bp, Artificial
  CRISPR gRNA sequence
aaagtgaagacagcaggtgg

SEQ ID NO: 539375 - DNA, 20 bp, Artificial
  CRISPR gRNA sequence
gtgaagacagcaggtggtgg

SEQ ID NO: 539376 - DNA, 20 bp, Artificial
  CRISPR gRNA sequence
agacagcaggtggtggtggc

SEQ ID NO: 539377 - DNA, 20 bp, Artificial
  CRISPR gRNA sequence
acagcaggtggtggtggctg

SEQ ID NO: 539378 - DNA, 20 bp, Artificial
  CRISPR gRNA sequence
cagcaggtggtggtggctgg

SEQ ID NO: 539379 - DNA, 20 bp, Artificial
  CRISPR gRNA sequence
agcaggtggtggtggctgga

SEQ ID NO: 539380 - DNA, 20 bp, Artificial
  CRISPR gRNA sequence
gcaggtggtggtggctggag

SEQ ID NO: 539381 - DNA, 20 bp, Artificial
  CRISPR gRNA sequence
tggtggtggctggaggggta

SEQ ID NO: 539382 - DNA, 20 bp, Artificial
  CRISPR gRNA sequence
ggtggtggctggaggggtac

SEQ ID NO: 539383 - DNA, 20 bp, Artificial
  CRISPR gRNA sequence
gtggtggctggaggggtaca

SEQ ID NO: 539384 - DNA, 20 bp, Artificial
  CRISPR gRNA sequence
tggaggggtacagggatcat

SEQ ID NO: 539385 - DNA, 20 bp, Artificial
  CRISPR gRNA sequence
ggggtacagggatcatgaga

SEQ ID NO: 539386 - DNA, 20 bp, Artificial
  CRISPR gRNA sequence
tcatgagaaagttttaatga

SEQ ID NO: 539387 - DNA, 20 bp, Artificial
  CRISPR gRNA sequence
taaaatgaaccatcaactta

SEQ ID NO: 539388 - DNA, 20 bp, Artificial
  CRISPR gRNA sequence
aaaatgaaccatcaacttat

SEQ ID NO: 539389 - DNA, 20 bp, Artificial
  CRISPR gRNA sequence
aaatgaaccatcaacttatg

SEQ ID NO: 539390 - DNA, 20 bp, Artificial
  CRISPR gRNA sequence
aatgaaccatcaacttatgg

SEQ ID NO: 539391 - DNA, 20 bp, Artificial
  CRISPR gRNA sequence
cttatgggggaaattctcat

SEQ ID NO: 539392 - DNA, 20 bp, Artificial
  CRISPR gRNA sequence
ttatgggggaaattctcatc

SEQ ID NO: 539393 - DNA, 20 bp, Artificial
  CRISPR gRNA sequence
atgggggaaattctcatcag

SEQ ID NO: 539394 - DNA, 20 bp, Artificial
  CRISPR gRNA sequence
gggggaaattctcatcagga

SEQ ID NO: 539395 - DNA, 20 bp, Artificial
  CRISPR gRNA sequence
gggaaattctcatcaggaga

SEQ ID NO: 539396 - DNA, 20 bp, Artificial
  CRISPR gRNA sequence
aaattctcatcaggagagag

SEQ ID NO: 539397 - DNA, 20 bp, Artificial
  CRISPR gRNA sequence
aattctcatcaggagagagt

SEQ ID NO: 539398 - DNA, 20 bp, Artificial
  CRISPR gRNA sequence
tctcatcaggagagagtggg

SEQ ID NO: 539399 - DNA, 20 bp, Artificial
  CRISPR gRNA sequence
catcaggagagagtgggtag

SEQ ID NO: 539400 - DNA, 20 bp, Artificial
  CRISPR gRNA sequence
gagagagtgggtagaagcac

SEQ ID NO: 539401 - DNA, 20 bp, Artificial
  CRISPR gRNA sequence
agagagtgggtagaagcact

SEQ ID NO: 539402 - DNA, 20 bp, Artificial
  CRISPR gRNA sequence
gagagtgggtagaagcacta

SEQ ID NO: 539403 - DNA, 20 bp, Artificial
  CRISPR gRNA sequence
agcactagggtgatattccc

SEQ ID NO: 539404 - DNA, 20 bp, Artificial
  CRISPR gRNA sequence
gcactagggtgatattcccg

SEQ ID NO: 539405 - DNA, 20 bp, Artificial
  CRISPR gRNA sequence
tagggtgatattcccgagga

SEQ ID NO: 539406 - DNA, 20 bp, Artificial
  CRISPR gRNA sequence
gtgatattcccgaggacggc

SEQ ID NO: 539407 - DNA, 20 bp, Artificial
  CRISPR gRNA sequence
gatattcccgaggacggcaa

SEQ ID NO: 539408 - DNA, 20 bp, Artificial
  CRISPR gRNA sequence
atattcccgaggacggcaag

SEQ ID NO: 539409 - DNA, 20 bp, Artificial
  CRISPR gRNA sequence
attcccgaggacggcaagag

SEQ ID NO: 539410 - DNA, 20 bp, Artificial
  CRISPR gRNA sequence
ttcccgaggacggcaagagg

SEQ ID NO: 539411 - DNA, 20 bp, Artificial
  CRISPR gRNA sequence
ccgaggacggcaagaggagg

SEQ ID NO: 539412 - DNA, 20 bp, Artificial
  CRISPR gRNA sequence
cgaggacggcaagaggaggt

SEQ ID NO: 539413 - DNA, 20 bp, Artificial
  CRISPR gRNA sequence
cggcaagaggaggtgggatc

SEQ ID NO: 539414 - DNA, 20 bp, Artificial
  CRISPR gRNA sequence
ggcaagaggaggtgggatcc

SEQ ID NO: 539415 - DNA, 20 bp, Artificial
  CRISPR gRNA sequence
gcaagaggaggtgggatcca

SEQ ID NO: 539416 - DNA, 20 bp, Artificial
  CRISPR gRNA sequence
ggtgggatccagggcacacg

SEQ ID NO: 539417 - DNA, 20 bp, Artificial
  CRISPR gRNA sequence
ggatccagggcacacgtgga

SEQ ID NO: 539418 - DNA, 20 bp, Artificial
  CRISPR gRNA sequence
acacgtggaaagtttaactt

SEQ ID NO: 539419 - DNA, 20 bp, Artificial
  CRISPR gRNA sequence
cacgtggaaagtttaacttc

SEQ ID NO: 539420 - DNA, 20 bp, Artificial
  CRISPR gRNA sequence
tggaaagtttaacttcaggt

SEQ ID NO: 539421 - DNA, 20 bp, Artificial
  CRISPR gRNA sequence
tttaacttcaggtgagaact

SEQ ID NO: 539422 - DNA, 20 bp, Artificial
  CRISPR gRNA sequence
acttcaggtgagaactcaga

SEQ ID NO: 539423 - DNA, 20 bp, Artificial
  CRISPR gRNA sequence
ctcagaaagtccattcatat

SEQ ID NO: 539424 - DNA, 20 bp, Artificial
  CRISPR gRNA sequence
tcagaaagtccattcatatc

SEQ ID NO: 539425 - DNA, 20 bp, Artificial
  CRISPR gRNA sequence
agaaagtccattcatatcag

SEQ ID NO: 539426 - DNA, 20 bp, Artificial
  CRISPR gRNA sequence
aaagtccattcatatcagga

SEQ ID NO: 539427 - DNA, 20 bp, Artificial
  CRISPR gRNA sequence
tccattcatatcaggagaga

SEQ ID NO: 539428 - DNA, 20 bp, Artificial
  CRISPR gRNA sequence
attcatatcaggagagaaag

SEQ ID NO: 539429 - DNA, 20 bp, Artificial
  CRISPR gRNA sequence
ttcatatcaggagagaaagc

SEQ ID NO: 539430 - DNA, 20 bp, Artificial
  CRISPR gRNA sequence
tcatatcaggagagaaagca

SEQ ID NO: 539431 - DNA, 20 bp, Artificial
  CRISPR gRNA sequence
aggagagaaagcagggccta

SEQ ID NO: 539432 - DNA, 20 bp, Artificial
  CRISPR gRNA sequence
ggagagaaagcagggcctac

SEQ ID NO: 539433 - DNA, 20 bp, Artificial
  CRISPR gRNA sequence
gaaagcagggcctacaggct

SEQ ID NO: 539434 - DNA, 20 bp, Artificial
  CRISPR gRNA sequence
aaagcagggcctacaggctc

SEQ ID NO: 539435 - DNA, 20 bp, Artificial
  CRISPR gRNA sequence
agggcctacaggctcaggta

SEQ ID NO: 539436 - DNA, 20 bp, Artificial
  CRISPR gRNA sequence
gggcctacaggctcaggtat

SEQ ID NO: 539437 - DNA, 20 bp, Artificial
  CRISPR gRNA sequence
cctacaggctcaggtatggg

SEQ ID NO: 539438 - DNA, 20 bp, Artificial
  CRISPR gRNA sequence
ctacaggctcaggtatgggt

SEQ ID NO: 539439 - DNA, 20 bp, Artificial
  CRISPR gRNA sequence
caggctcaggtatgggtagg

SEQ ID NO: 539440 - DNA, 20 bp, Artificial
  CRISPR gRNA sequence
aggctcaggtatgggtagga

SEQ ID NO: 539441 - DNA, 20 bp, Artificial
  CRISPR gRNA sequence
ctcaggtatgggtaggaagg

SEQ ID NO: 539442 - DNA, 20 bp, Artificial
  CRISPR gRNA sequence
tcaggtatgggtaggaaggt

SEQ ID NO: 539443 - DNA, 20 bp, Artificial
  CRISPR gRNA sequence
ggtatgggtaggaaggtagg

SEQ ID NO: 539444 - DNA, 20 bp, Artificial
  CRISPR gRNA sequence
gtatgggtaggaaggtaggc

SEQ ID NO: 539445 - DNA, 20 bp, Artificial
  CRISPR gRNA sequence
tgggtaggaaggtaggcagg

SEQ ID NO: 539446 - DNA, 20 bp, Artificial
  CRISPR gRNA sequence
taggaaggtaggcaggtggt

SEQ ID NO: 539447 - DNA, 20 bp, Artificial
  CRISPR gRNA sequence
ggaaggtaggcaggtggtga

SEQ ID NO: 539448 - DNA, 20 bp, Artificial
  CRISPR gRNA sequence
aggcaggtggtgagagcttg

SEQ ID NO: 539449 - DNA, 20 bp, Artificial
  CRISPR gRNA sequence
ctctgattgcttattctcct

SEQ ID NO: 539450 - DNA, 20 bp, Artificial
  CRISPR gRNA sequence
cttattctccttagtgaaat

SEQ ID NO: 539451 - DNA, 20 bp, Artificial
  CRISPR gRNA sequence
attctccttagtgaaataag

SEQ ID NO: 539452 - DNA, 20 bp, Artificial
  CRISPR gRNA sequence
ccttagtgaaataagaagca

SEQ ID NO: 539453 - DNA, 20 bp, Artificial
  CRISPR gRNA sequence
gaaataagaagcaaagcctt

SEQ ID NO: 539454 - DNA, 20 bp, Artificial
  CRISPR gRNA sequence
agaagcaaagccttcagctg

SEQ ID NO: 539455 - DNA, 20 bp, Artificial
  CRISPR gRNA sequence
aagcaaagccttcagctgaa

SEQ ID NO: 539456 - DNA, 20 bp, Artificial
  CRISPR gRNA sequence
aaagccttcagctgaagagt

SEQ ID NO: 539457 - DNA, 20 bp, Artificial
  CRISPR gRNA sequence
cttcagctgaagagtcagtc

SEQ ID NO: 539458 - DNA, 20 bp, Artificial
  CRISPR gRNA sequence
tcagctgaagagtcagtcta

SEQ ID NO: 539459 - DNA, 20 bp, Artificial
  CRISPR gRNA sequence
gctgaagagtcagtctagag

SEQ ID NO: 539460 - DNA, 20 bp, Artificial
  CRISPR gRNA sequence
ctgaagagtcagtctagaga

SEQ ID NO: 539461 - DNA, 20 bp, Artificial
  CRISPR gRNA sequence
gaagagtcagtctagagaag

SEQ ID NO: 539462 - DNA, 20 bp, Artificial
  CRISPR gRNA sequence
aagagtcagtctagagaagg

SEQ ID NO: 539463 - DNA, 20 bp, Artificial
  CRISPR gRNA sequence
gtctagagaaggaggtattc

SEQ ID NO: 539464 - DNA, 20 bp, Artificial
  CRISPR gRNA sequence
gaaggaggtattcaagattt

SEQ ID NO: 539465 - DNA, 20 bp, Artificial
  CRISPR gRNA sequence
aaggaggtattcaagatttg

SEQ ID NO: 539466 - DNA, 20 bp, Artificial
  CRISPR gRNA sequence
ggaggtattcaagatttgag

SEQ ID NO: 539467 - DNA, 20 bp, Artificial
  CRISPR gRNA sequence
aggtattcaagatttgagga

SEQ ID NO: 539468 - DNA, 20 bp, Artificial
  CRISPR gRNA sequence
tcaagatttgaggagagaaa

SEQ ID NO: 539469 - DNA, 20 bp, Artificial
  CRISPR gRNA sequence
aggagagaaaaagtaactgc

SEQ ID NO: 539470 - DNA, 20 bp, Artificial
  CRISPR gRNA sequence
ggagagaaaaagtaactgct

SEQ ID NO: 539471 - DNA, 20 bp, Artificial
  CRISPR gRNA sequence
agagaaaaagtaactgctag

SEQ ID NO: 539472 - DNA, 20 bp, Artificial
  CRISPR gRNA sequence
agaaaaagtaactgctagga

SEQ ID NO: 539473 - DNA, 20 bp, Artificial
  CRISPR gRNA sequence
aaaagtaactgctaggagag

SEQ ID NO: 539474 - DNA, 20 bp, Artificial
  CRISPR gRNA sequence
aaagtaactgctaggagagt

SEQ ID NO: 539475 - DNA, 20 bp, Artificial
  CRISPR gRNA sequence
taactgctaggagagtgggt

SEQ ID NO: 539476 - DNA, 20 bp, Artificial
  CRISPR gRNA sequence
taggagagtgggtaagtgaa

SEQ ID NO: 539477 - DNA, 20 bp, Artificial
  CRISPR gRNA sequence
aggagagtgggtaagtgaac

SEQ ID NO: 539478 - DNA, 20 bp, Artificial
  CRISPR gRNA sequence
gagtgggtaagtgaacaggc

SEQ ID NO: 539479 - DNA, 20 bp, Artificial
  CRISPR gRNA sequence
agtgggtaagtgaacaggct

SEQ ID NO: 539480 - DNA, 20 bp, Artificial
  CRISPR gRNA sequence
taggaaataccaacttaatt

SEQ ID NO: 539481 - DNA, 20 bp, Artificial
  CRISPR gRNA sequence
aggaaataccaacttaattg

SEQ ID NO: 539482 - DNA, 20 bp, Artificial
  CRISPR gRNA sequence
aataccaacttaattgaggt

SEQ ID NO: 539483 - DNA, 20 bp, Artificial
  CRISPR gRNA sequence
acttaattgaggtaagtgat

SEQ ID NO: 539484 - DNA, 20 bp, Artificial
  CRISPR gRNA sequence
ttaattgaggtaagtgatta

SEQ ID NO: 539485 - DNA, 20 bp, Artificial
  CRISPR gRNA sequence
taagtgattagagaaattaa

SEQ ID NO: 539486 - DNA, 20 bp, Artificial
  CRISPR gRNA sequence
gattagagaaattaaaagtg

SEQ ID NO: 539487 - DNA, 20 bp, Artificial
  CRISPR gRNA sequence
attagagaaattaaaagtgc

SEQ ID NO: 539488 - DNA, 20 bp, Artificial
  CRISPR gRNA sequence
attaaaagtgcaggactttg

SEQ ID NO: 539489 - DNA, 20 bp, Artificial
  CRISPR gRNA sequence
ttaaaagtgcaggactttgt

SEQ ID NO: 539490 - DNA, 20 bp, Artificial
  CRISPR gRNA sequence
taaaagtgcaggactttgta

SEQ ID NO: 539491 - DNA, 20 bp, Artificial
  CRISPR gRNA sequence
aagtgcaggactttgtaggg

SEQ ID NO: 539492 - DNA, 20 bp, Artificial
  CRISPR gRNA sequence
tgtatttttctgcaaccaca

SEQ ID NO: 539493 - DNA, 20 bp, Artificial
  CRISPR gRNA sequence
gtatttttctgcaaccacat

SEQ ID NO: 539494 - DNA, 20 bp, Artificial
  CRISPR gRNA sequence
ttctgcaaccacatgggtgt

SEQ ID NO: 539495 - DNA, 20 bp, Artificial
  CRISPR gRNA sequence
caaccacatgggtgtgagca

SEQ ID NO: 539496 - DNA, 20 bp, Artificial
  CRISPR gRNA sequence
acatgggtgtgagcacagaa

SEQ ID NO: 539497 - DNA, 20 bp, Artificial
  CRISPR gRNA sequence
catgggtgtgagcacagaat

SEQ ID NO: 539498 - DNA, 20 bp, Artificial
  CRISPR gRNA sequence
gtgtgagcacagaataggca

SEQ ID NO: 539499 - DNA, 20 bp, Artificial
  CRISPR gRNA sequence
tgagcacagaataggcaaag

SEQ ID NO: 539500 - DNA, 20 bp, Artificial
  CRISPR gRNA sequence
gcacagaataggcaaagcag

SEQ ID NO: 539501 - DNA, 20 bp, Artificial
  CRISPR gRNA sequence
gcaaagcagcggacttaatc

SEQ ID NO: 539502 - DNA, 20 bp, Artificial
  CRISPR gRNA sequence
gacttaatctagctgtaatc

SEQ ID NO: 539503 - DNA, 20 bp, Artificial
  CRISPR gRNA sequence
tagctgtaatctggccatgc

SEQ ID NO: 539504 - DNA, 20 bp, Artificial
  CRISPR gRNA sequence
tctggccatgcgagtatgac

SEQ ID NO: 539505 - DNA, 20 bp, Artificial
  CRISPR gRNA sequence
gccatgcgagtatgacaagc

SEQ ID NO: 539506 - DNA, 20 bp, Artificial
  CRISPR gRNA sequence
gcgagtatgacaagccagca

SEQ ID NO: 539507 - DNA, 20 bp, Artificial
  CRISPR gRNA sequence
cgagtatgacaagccagcaa

SEQ ID NO: 539508 - DNA, 20 bp, Artificial
  CRISPR gRNA sequence
agtatgacaagccagcaaag

SEQ ID NO: 539509 - DNA, 20 bp, Artificial
  CRISPR gRNA sequence
tgacaagccagcaaaggagc

SEQ ID NO: 539510 - DNA, 20 bp, Artificial
  CRISPR gRNA sequence
gacaagccagcaaaggagca

SEQ ID NO: 539511 - DNA, 20 bp, Artificial
  CRISPR gRNA sequence
aagccagcaaaggagcaagg

SEQ ID NO: 539512 - DNA, 20 bp, Artificial
  CRISPR gRNA sequence
agcaaaggagcaaggaagct

SEQ ID NO: 539513 - DNA, 20 bp, Artificial
  CRISPR gRNA sequence
gaagctaagtgtgtctgcaa

SEQ ID NO: 539514 - DNA, 20 bp, Artificial
  CRISPR gRNA sequence
aagtgtgtctgcaacggact

SEQ ID NO: 539515 - DNA, 20 bp, Artificial
  CRISPR gRNA sequence
tgtctgcaacggactgagtc

SEQ ID NO: 539516 - DNA, 20 bp, Artificial
  CRISPR gRNA sequence
tgcaacggactgagtctagt

SEQ ID NO: 539517 - DNA, 20 bp, Artificial
  CRISPR gRNA sequence
ctgagtctagtgagtgacaa

SEQ ID NO: 539518 - DNA, 20 bp, Artificial
  CRISPR gRNA sequence
tagtgagtgacaacagcact

SEQ ID NO: 539519 - DNA, 20 bp, Artificial
  CRISPR gRNA sequence
agtgagtgacaacagcactc

SEQ ID NO: 539520 - DNA, 20 bp, Artificial
  CRISPR gRNA sequence
gtgacaacagcactcaggct

SEQ ID NO: 539521 - DNA, 20 bp, Artificial
  CRISPR gRNA sequence
acaacagcactcaggctgag

SEQ ID NO: 539522 - DNA, 20 bp, Artificial
  CRISPR gRNA sequence
caacagcactcaggctgagt

SEQ ID NO: 539523 - DNA, 20 bp, Artificial
  CRISPR gRNA sequence
aacagcactcaggctgagta

SEQ ID NO: 539524 - DNA, 20 bp, Artificial
  CRISPR gRNA sequence
cagcactcaggctgagtagg

SEQ ID NO: 539525 - DNA, 20 bp, Artificial
  CRISPR gRNA sequence
agcactcaggctgagtaggg

SEQ ID NO: 539526 - DNA, 20 bp, Artificial
  CRISPR gRNA sequence
gcactcaggctgagtaggga

SEQ ID NO: 539527 - DNA, 20 bp, Artificial
  CRISPR gRNA sequence
ctcaggctgagtagggaggg

SEQ ID NO: 539528 - DNA, 20 bp, Artificial
  CRISPR gRNA sequence
aggctgagtagggagggcag

SEQ ID NO: 539529 - DNA, 20 bp, Artificial
  CRISPR gRNA sequence
ggctgagtagggagggcagc

SEQ ID NO: 539530 - DNA, 20 bp, Artificial
  CRISPR gRNA sequence
gctgagtagggagggcagca

SEQ ID NO: 539531 - DNA, 20 bp, Artificial
  CRISPR gRNA sequence
agggagggcagcagggacat

SEQ ID NO: 539532 - DNA, 20 bp, Artificial
  CRISPR gRNA sequence
gggagggcagcagggacatc

SEQ ID NO: 539533 - DNA, 20 bp, Artificial
  CRISPR gRNA sequence
gcagggacatcaggtgtgtg

SEQ ID NO: 539534 - DNA, 20 bp, Artificial
  CRISPR gRNA sequence
cagggacatcaggtgtgtga

SEQ ID NO: 539535 - DNA, 20 bp, Artificial
  CRISPR gRNA sequence
tcaggtgtgtgaaggactgt

SEQ ID NO: 539536 - DNA, 20 bp, Artificial
  CRISPR gRNA sequence
gtgtgaaggactgtcagcat

SEQ ID NO: 539537 - DNA, 20 bp, Artificial
  CRISPR gRNA sequence
ctgtcagcatcagcatcatc

SEQ ID NO: 539538 - DNA, 20 bp, Artificial
  CRISPR gRNA sequence
tgtcagcatcagcatcatca

SEQ ID NO: 539539 - DNA, 20 bp, Artificial
  CRISPR gRNA sequence
agcatcagcatcatcaagga

SEQ ID NO: 539540 - DNA, 20 bp, Artificial
  CRISPR gRNA sequence
gcatcagcatcatcaaggac

SEQ ID NO: 539541 - DNA, 20 bp, Artificial
  CRISPR gRNA sequence
catcagcatcatcaaggaca

SEQ ID NO: 539542 - DNA, 20 bp, Artificial
  CRISPR gRNA sequence
gcatcatcaaggacagggca

SEQ ID NO: 539543 - DNA, 20 bp, Artificial
  CRISPR gRNA sequence
tcatcaaggacagggcatgg

SEQ ID NO: 539544 - DNA, 20 bp, Artificial
  CRISPR gRNA sequence
caaggacagggcatggtggt

SEQ ID NO: 539545 - DNA, 20 bp, Artificial
  CRISPR gRNA sequence
aggacagggcatggtggtca

SEQ ID NO: 539546 - DNA, 20 bp, Artificial
  CRISPR gRNA sequence
cagggcatggtggtcagagt

SEQ ID NO: 539547 - DNA, 20 bp, Artificial
  CRISPR gRNA sequence
agagtgagacacctgacatt

SEQ ID NO: 539548 - DNA, 20 bp, Artificial
  CRISPR gRNA sequence
gagtgagacacctgacattg

SEQ ID NO: 539549 - DNA, 20 bp, Artificial
  CRISPR gRNA sequence
cctgacattgaggtaatgat

SEQ ID NO: 539550 - DNA, 20 bp, Artificial
  CRISPR gRNA sequence
ttgaggtaatgatgagttct

SEQ ID NO: 539551 - DNA, 20 bp, Artificial
  CRISPR gRNA sequence
tgagttctcggttacatcca

SEQ ID NO: 539552 - DNA, 20 bp, Artificial
  CRISPR gRNA sequence
gagttctcggttacatccat

SEQ ID NO: 539553 - DNA, 20 bp, Artificial
  CRISPR gRNA sequence
ttctcggttacatccatggg

SEQ ID NO: 539554 - DNA, 20 bp, Artificial
  CRISPR gRNA sequence
tcggttacatccatgggtag

SEQ ID NO: 539555 - DNA, 20 bp, Artificial
  CRISPR gRNA sequence
cggttacatccatgggtagt

SEQ ID NO: 539556 - DNA, 20 bp, Artificial
  CRISPR gRNA sequence
tccatgggtagtgggtaacg

SEQ ID NO: 539557 - DNA, 20 bp, Artificial
  CRISPR gRNA sequence
catgggtagtgggtaacgta

SEQ ID NO: 539558 - DNA, 20 bp, Artificial
  CRISPR gRNA sequence
atgggtagtgggtaacgtag

SEQ ID NO: 539559 - DNA, 20 bp, Artificial
  CRISPR gRNA sequence
tagtgggtaacgtagaggaa

SEQ ID NO: 539560 - DNA, 20 bp, Artificial
  CRISPR gRNA sequence
cgtagaggaaaagatcctta

SEQ ID NO: 539561 - DNA, 20 bp, Artificial
  CRISPR gRNA sequence
gtagaggaaaagatccttac

SEQ ID NO: 539562 - DNA, 20 bp, Artificial
  CRISPR gRNA sequence
agaggaaaagatccttacag

SEQ ID NO: 539563 - DNA, 20 bp, Artificial
  CRISPR gRNA sequence
aggaaaagatccttacagga

SEQ ID NO: 539564 - DNA, 20 bp, Artificial
  CRISPR gRNA sequence
ggaaaagatccttacaggag

SEQ ID NO: 539565 - DNA, 20 bp, Artificial
  CRISPR gRNA sequence
tccttacaggagaggcgatc

SEQ ID NO: 539566 - DNA, 20 bp, Artificial
  CRISPR gRNA sequence
ccttacaggagaggcgatca

SEQ ID NO: 539567 - DNA, 20 bp, Artificial
  CRISPR gRNA sequence
gcgatcaaggacaatattga

SEQ ID NO: 539568 - DNA, 20 bp, Artificial
  CRISPR gRNA sequence
atttaaatattgcaaccacc

SEQ ID NO: 539569 - DNA, 20 bp, Artificial
  CRISPR gRNA sequence
tattgcaaccaccaagacac

SEQ ID NO: 539570 - DNA, 20 bp, Artificial
  CRISPR gRNA sequence
attgcaaccaccaagacacc

SEQ ID NO: 539571 - DNA, 20 bp, Artificial
  CRISPR gRNA sequence
caccaagacaccaggaatgt

SEQ ID NO: 539572 - DNA, 20 bp, Artificial
  CRISPR gRNA sequence
atgtcagaaacaatgaaaat

SEQ ID NO: 539573 - DNA, 20 bp, Artificial
  CRISPR gRNA sequence
tgtcagaaacaatgaaaatg

SEQ ID NO: 539574 - DNA, 20 bp, Artificial
  CRISPR gRNA sequence
cagaaacaatgaaaatgagg

SEQ ID NO: 539575 - DNA, 20 bp, Artificial
  CRISPR gRNA sequence
agaaacaatgaaaatgaggc

SEQ ID NO: 539576 - DNA, 20 bp, Artificial
  CRISPR gRNA sequence
aggcaggccttaaaatgacc

SEQ ID NO: 539577 - DNA, 20 bp, Artificial
  CRISPR gRNA sequence
ttaaaatgaccaagaaacac

SEQ ID NO: 539578 - DNA, 20 bp, Artificial
  CRISPR gRNA sequence
accaagaaacactggcatgt

SEQ ID NO: 539579 - DNA, 20 bp, Artificial
  CRISPR gRNA sequence
ccaagaaacactggcatgtg

SEQ ID NO: 539580 - DNA, 20 bp, Artificial
  CRISPR gRNA sequence
agaaacactggcatgtgagg

SEQ ID NO: 539581 - DNA, 20 bp, Artificial
  CRISPR gRNA sequence
gaaacactggcatgtgaggc

SEQ ID NO: 539582 - DNA, 20 bp, Artificial
  CRISPR gRNA sequence
aaacactggcatgtgaggca

SEQ ID NO: 539583 - DNA, 20 bp, Artificial
  CRISPR gRNA sequence
aacactggcatgtgaggcag

SEQ ID NO: 539584 - DNA, 20 bp, Artificial
  CRISPR gRNA sequence
tgtgaggcaggggcctatac

SEQ ID NO: 539585 - DNA, 20 bp, Artificial
  CRISPR gRNA sequence
tatacaagactgcaacacaa

SEQ ID NO: 539586 - DNA, 20 bp, Artificial
  CRISPR gRNA sequence
atacaagactgcaacacaaa

SEQ ID NO: 539587 - DNA, 20 bp, Artificial
  CRISPR gRNA sequence
tacaagactgcaacacaaaa

SEQ ID NO: 539588 - DNA, 20 bp, Artificial
  CRISPR gRNA sequence
acaagactgcaacacaaaag

SEQ ID NO: 539589 - DNA, 20 bp, Artificial
  CRISPR gRNA sequence
ctgcaacacaaaaggggctt

SEQ ID NO: 539590 - DNA, 20 bp, Artificial
  CRISPR gRNA sequence
gcaacacaaaaggggcttta

SEQ ID NO: 539591 - DNA, 20 bp, Artificial
  CRISPR gRNA sequence
acaaaaggggctttagagac

SEQ ID NO: 539592 - DNA, 20 bp, Artificial
  CRISPR gRNA sequence
caaaaggggctttagagacc

SEQ ID NO: 539593 - DNA, 20 bp, Artificial
  CRISPR gRNA sequence
aaaaggggctttagagacca

SEQ ID NO: 539594 - DNA, 20 bp, Artificial
  CRISPR gRNA sequence
aaggggctttagagaccagg

SEQ ID NO: 539595 - DNA, 20 bp, Artificial
  CRISPR gRNA sequence
aggggctttagagaccaggg

SEQ ID NO: 539596 - DNA, 20 bp, Artificial
  CRISPR gRNA sequence
gggctttagagaccagggag

SEQ ID NO: 539597 - DNA, 20 bp, Artificial
  CRISPR gRNA sequence
tagagaccagggaggagtgt

SEQ ID NO: 539598 - DNA, 20 bp, Artificial
  CRISPR gRNA sequence
gaccagggaggagtgtcagt

SEQ ID NO: 539599 - DNA, 20 bp, Artificial
  CRISPR gRNA sequence
cagggaggagtgtcagtgag

SEQ ID NO: 539600 - DNA, 20 bp, Artificial
  CRISPR gRNA sequence
ggaggagtgtcagtgagaag

SEQ ID NO: 539601 - DNA, 20 bp, Artificial
  CRISPR gRNA sequence
gaggagtgtcagtgagaagc

SEQ ID NO: 539602 - DNA, 20 bp, Artificial
  CRISPR gRNA sequence
aggagtgtcagtgagaagca

SEQ ID NO: 539603 - DNA, 20 bp, Artificial
  CRISPR gRNA sequence
gagtgtcagtgagaagcagg

SEQ ID NO: 539604 - DNA, 20 bp, Artificial
  CRISPR gRNA sequence
agaaatgtgtcccctctctc

SEQ ID NO: 539605 - DNA, 20 bp, Artificial
  CRISPR gRNA sequence
gtgtcccctctctctagttt

SEQ ID NO: 539606 - DNA, 20 bp, Artificial
  CRISPR gRNA sequence
tctctagtttcagtttaaaa

SEQ ID NO: 539607 - DNA, 20 bp, Artificial
  CRISPR gRNA sequence
agtttcagtttaaaatggtg

SEQ ID NO: 539608 - DNA, 20 bp, Artificial
  CRISPR gRNA sequence
gtttcagtttaaaatggtgc

SEQ ID NO: 539609 - DNA, 20 bp, Artificial
  CRISPR gRNA sequence
ttcagtttaaaatggtgcag

SEQ ID NO: 539610 - DNA, 20 bp, Artificial
  CRISPR gRNA sequence
gtttaaaatggtgcaggagc

SEQ ID NO: 539611 - DNA, 20 bp, Artificial
  CRISPR gRNA sequence
tttaaaatggtgcaggagct

SEQ ID NO: 539612 - DNA, 20 bp, Artificial
  CRISPR gRNA sequence
aatggtgcaggagctgggtg

SEQ ID NO: 539613 - DNA, 20 bp, Artificial
  CRISPR gRNA sequence
ggtgcaggagctgggtgtgg

SEQ ID NO: 539614 - DNA, 20 bp, Artificial
  CRISPR gRNA sequence
agctgggtgtggtggctcat

SEQ ID NO: 539615 - DNA, 20 bp, Artificial
  CRISPR gRNA sequence
gtggctcatgagtgtaatcc

SEQ ID NO: 539616 - DNA, 20 bp, Artificial
  CRISPR gRNA sequence
tgagtgtaatcccagcactt

SEQ ID NO: 539617 - DNA, 20 bp, Artificial
  CRISPR gRNA sequence
gagtgtaatcccagcacttt

SEQ ID NO: 539618 - DNA, 20 bp, Artificial
  CRISPR gRNA sequence
gtgtaatcccagcactttgg

SEQ ID NO: 539619 - DNA, 20 bp, Artificial
  CRISPR gRNA sequence
tgtaatcccagcactttggg

SEQ ID NO: 539620 - DNA, 20 bp, Artificial
  CRISPR gRNA sequence
tcccagcactttgggaggct

SEQ ID NO: 539621 - DNA, 20 bp, Artificial
  CRISPR gRNA sequence
cccagcactttgggaggctg

SEQ ID NO: 539622 - DNA, 20 bp, Artificial
  CRISPR gRNA sequence
agcactttgggaggctgagg

SEQ ID NO: 539623 - DNA, 20 bp, Artificial
  CRISPR gRNA sequence
gcactttgggaggctgaggc

SEQ ID NO: 539624 - DNA, 20 bp, Artificial
  CRISPR gRNA sequence
ctttgggaggctgaggcggg

SEQ ID NO: 539625 - DNA, 20 bp, Artificial
  CRISPR gRNA sequence
ctgaggcgggtggatcacct

SEQ ID NO: 539626 - DNA, 20 bp, Artificial
  CRISPR gRNA sequence
gcgggtggatcacctgagct

SEQ ID NO: 539627 - DNA, 20 bp, Artificial
  CRISPR gRNA sequence
cgggtggatcacctgagctc

SEQ ID NO: 539628 - DNA, 20 bp, Artificial
  CRISPR gRNA sequence
ggtggatcacctgagctcag

SEQ ID NO: 539629 - DNA, 20 bp, Artificial
  CRISPR gRNA sequence
tcacctgagctcaggagttt

SEQ ID NO: 539630 - DNA, 20 bp, Artificial
  CRISPR gRNA sequence
tgagctcaggagtttgagac

SEQ ID NO: 539631 - DNA, 20 bp, Artificial
  CRISPR gRNA sequence
tcaggagtttgagaccagcc

SEQ ID NO: 539632 - DNA, 20 bp, Artificial
  CRISPR gRNA sequence
tgagaccagcctggccaaca

SEQ ID NO: 539633 - DNA, 20 bp, Artificial
  CRISPR gRNA sequence
ctctactaaaatacaaaaat

SEQ ID NO: 539634 - DNA, 20 bp, Artificial
  CRISPR gRNA sequence
actaaaatacaaaaattagc

SEQ ID NO: 539635 - DNA, 20 bp, Artificial
  CRISPR gRNA sequence
ctaaaatacaaaaattagct

SEQ ID NO: 539636 - DNA, 20 bp, Artificial
  CRISPR gRNA sequence
atacaaaaattagctgggca

SEQ ID NO: 539637 - DNA, 20 bp, Artificial
  CRISPR gRNA sequence
caaaaattagctgggcatgg

SEQ ID NO: 539638 - DNA, 20 bp, Artificial
  CRISPR gRNA sequence
attagctgggcatggtggtg

SEQ ID NO: 539639 - DNA, 20 bp, Artificial
  CRISPR gRNA sequence
ttagctgggcatggtggtgc

SEQ ID NO: 539640 - DNA, 20 bp, Artificial
  CRISPR gRNA sequence
ggcatggtggtgcgggcctg

SEQ ID NO: 539641 - DNA, 20 bp, Artificial
  CRISPR gRNA sequence
gtggtgcgggcctgtagtcc

SEQ ID NO: 539642 - DNA, 20 bp, Artificial
  CRISPR gRNA sequence
ggcctgtagtcccagctact

SEQ ID NO: 539643 - DNA, 20 bp, Artificial
  CRISPR gRNA sequence
gcctgtagtcccagctactt

SEQ ID NO: 539644 - DNA, 20 bp, Artificial
  CRISPR gRNA sequence
ctgtagtcccagctacttgg

SEQ ID NO: 539645 - DNA, 20 bp, Artificial
  CRISPR gRNA sequence
tgtagtcccagctacttggg

SEQ ID NO: 539646 - DNA, 20 bp, Artificial
  CRISPR gRNA sequence
tcccagctacttgggaggct

SEQ ID NO: 539647 - DNA, 20 bp, Artificial
  CRISPR gRNA sequence
agctacttgggaggctgaga

SEQ ID NO: 539648 - DNA, 20 bp, Artificial
  CRISPR gRNA sequence
cagtaaaatcactttgaacc

SEQ ID NO: 539649 - DNA, 20 bp, Artificial
  CRISPR gRNA sequence
agtaaaatcactttgaacct

SEQ ID NO: 539650 - DNA, 20 bp, Artificial
  CRISPR gRNA sequence
taaaatcactttgaacctgg

SEQ ID NO: 539651 - DNA, 20 bp, Artificial
  CRISPR gRNA sequence
aaaatcactttgaacctggg

SEQ ID NO: 539652 - DNA, 20 bp, Artificial
  CRISPR gRNA sequence
atcactttgaacctgggagg

SEQ ID NO: 539653 - DNA, 20 bp, Artificial
  CRISPR gRNA sequence
cactttgaacctgggaggca

SEQ ID NO: 539654 - DNA, 20 bp, Artificial
  CRISPR gRNA sequence
actttgaacctgggaggcag

SEQ ID NO: 539655 - DNA, 20 bp, Artificial
  CRISPR gRNA sequence
aacctgggaggcagaggttg

SEQ ID NO: 539656 - DNA, 20 bp, Artificial
  CRISPR gRNA sequence
tgggaggcagaggttgcagt

SEQ ID NO: 539657 - DNA, 20 bp, Artificial
  CRISPR gRNA sequence
ggcagaggttgcagtcagcc

SEQ ID NO: 539658 - DNA, 20 bp, Artificial
  CRISPR gRNA sequence
aagattgtgccactgcactc

SEQ ID NO: 539659 - DNA, 20 bp, Artificial
  CRISPR gRNA sequence
gtgccactgcactctggcct

SEQ ID NO: 539660 - DNA, 20 bp, Artificial
  CRISPR gRNA sequence
ctgcactctggccttggtaa

SEQ ID NO: 539661 - DNA, 20 bp, Artificial
  CRISPR gRNA sequence
gcactctggccttggtaaca

SEQ ID NO: 539662 - DNA, 20 bp, Artificial
  CRISPR gRNA sequence
tctggccttggtaacagagt

SEQ ID NO: 539663 - DNA, 20 bp, Artificial
  CRISPR gRNA sequence
aataaattaattaaataaaa

SEQ ID NO: 539664 - DNA, 20 bp, Artificial
  CRISPR gRNA sequence
attaattaaataaaatggtg

SEQ ID NO: 539665 - DNA, 20 bp, Artificial
  CRISPR gRNA sequence
ttaattaaataaaatggtgc

SEQ ID NO: 539666 - DNA, 20 bp, Artificial
  CRISPR gRNA sequence
aattaaataaaatggtgcag

SEQ ID NO: 539667 - DNA, 20 bp, Artificial
  CRISPR gRNA sequence
attaaataaaatggtgcagg

SEQ ID NO: 539668 - DNA, 20 bp, Artificial
  CRISPR gRNA sequence
aaaacaatctccccgctgtg

SEQ ID NO: 539669 - DNA, 20 bp, Artificial
  CRISPR gRNA sequence
aaacaatctccccgctgtgt

SEQ ID NO: 539670 - DNA, 20 bp, Artificial
  CRISPR gRNA sequence
aacaatctccccgctgtgtg

SEQ ID NO: 539671 - DNA, 20 bp, Artificial
  CRISPR gRNA sequence
aatctccccgctgtgtgggg

SEQ ID NO: 539672 - DNA, 20 bp, Artificial
  CRISPR gRNA sequence
ctccccgctgtgtggggaag

SEQ ID NO: 539673 - DNA, 20 bp, Artificial
  CRISPR gRNA sequence
tccccgctgtgtggggaagc

SEQ ID NO: 539674 - DNA, 20 bp, Artificial
  CRISPR gRNA sequence
gtggggaagcaggaacttta

SEQ ID NO: 539675 - DNA, 20 bp, Artificial
  CRISPR gRNA sequence
ggggaagcaggaactttata

SEQ ID NO: 539676 - DNA, 20 bp, Artificial
  CRISPR gRNA sequence
ctttatagagtaacatctat

SEQ ID NO: 539677 - DNA, 20 bp, Artificial
  CRISPR gRNA sequence
tatagagtaacatctatcag

SEQ ID NO: 539678 - DNA, 20 bp, Artificial
  CRISPR gRNA sequence
tagagtaacatctatcagtg

SEQ ID NO: 539679 - DNA, 20 bp, Artificial
  CRISPR gRNA sequence
acatctatcagtggagccca

SEQ ID NO: 539680 - DNA, 20 bp, Artificial
  CRISPR gRNA sequence
atctatcagtggagcccaaa

SEQ ID NO: 539681 - DNA, 20 bp, Artificial
  CRISPR gRNA sequence
agtggagcccaaagagttct

SEQ ID NO: 539682 - DNA, 20 bp, Artificial
  CRISPR gRNA sequence
atctctttccaaaacattcc

SEQ ID NO: 539683 - DNA, 20 bp, Artificial
  CRISPR gRNA sequence
ctttccaaaacattcctagt

SEQ ID NO: 539684 - DNA, 20 bp, Artificial
  CRISPR gRNA sequence
tgatactgttctccccacct

SEQ ID NO: 539685 - DNA, 20 bp, Artificial
  CRISPR gRNA sequence
actgttctccccaccttggt

SEQ ID NO: 539686 - DNA, 20 bp, Artificial
  CRISPR gRNA sequence
ggttagattctctcctcacc

SEQ ID NO: 539687 - DNA, 20 bp, Artificial
  CRISPR gRNA sequence
ttagattctctcctcaccca

SEQ ID NO: 539688 - DNA, 20 bp, Artificial
  CRISPR gRNA sequence
tagattctctcctcacccag

SEQ ID NO: 539689 - DNA, 20 bp, Artificial
  CRISPR gRNA sequence
cctcacccagaggaatgaca

SEQ ID NO: 539690 - DNA, 20 bp, Artificial
  CRISPR gRNA sequence
ctcacccagaggaatgacaa

SEQ ID NO: 539691 - DNA, 20 bp, Artificial
  CRISPR gRNA sequence
aggaatgacaaaggaattga

SEQ ID NO: 539692 - DNA, 20 bp, Artificial
  CRISPR gRNA sequence
aatgacaaaggaattgaaag

SEQ ID NO: 539693 - DNA, 20 bp, Artificial
  CRISPR gRNA sequence
acaaaggaattgaaagtagc

SEQ ID NO: 539694 - DNA, 20 bp, Artificial
  CRISPR gRNA sequence
agtagctagctcctctatac

SEQ ID NO: 539695 - DNA, 20 bp, Artificial
  CRISPR gRNA sequence
ctagctcctctataccagaa

SEQ ID NO: 539696 - DNA, 20 bp, Artificial
  CRISPR gRNA sequence
tagctcctctataccagaaa

SEQ ID NO: 539697 - DNA, 20 bp, Artificial
  CRISPR gRNA sequence
gctcctctataccagaaaag

SEQ ID NO: 539698 - DNA, 20 bp, Artificial
  CRISPR gRNA sequence
aaaggagaaaaccctgacaa

SEQ ID NO: 539699 - DNA, 20 bp, Artificial
  CRISPR gRNA sequence
aaggagaaaaccctgacaac

SEQ ID NO: 539700 - DNA, 20 bp, Artificial
  CRISPR gRNA sequence
aacatctaattcttttctca

SEQ ID NO: 539701 - DNA, 20 bp, Artificial
  CRISPR gRNA sequence
catagaccattaatttgtgc

SEQ ID NO: 539702 - DNA, 20 bp, Artificial
  CRISPR gRNA sequence
tttgtgctagtctctgaaaa

SEQ ID NO: 539703 - DNA, 20 bp, Artificial
  CRISPR gRNA sequence
ctgaaaacagactaaaaaaa

SEQ ID NO: 539704 - DNA, 20 bp, Artificial
  CRISPR gRNA sequence
attttaaacaaatcaactta

SEQ ID NO: 539705 - DNA, 20 bp, Artificial
  CRISPR gRNA sequence
caacttatggaatactcacc

SEQ ID NO: 539706 - DNA, 20 bp, Artificial
  CRISPR gRNA sequence
gaatactcaccaagcacata

SEQ ID NO: 539707 - DNA, 20 bp, Artificial
  CRISPR gRNA sequence
actcaccaagcacataaaga

SEQ ID NO: 539708 - DNA, 20 bp, Artificial
  CRISPR gRNA sequence
cacataaagaaagaacttca

SEQ ID NO: 539709 - DNA, 20 bp, Artificial
  CRISPR gRNA sequence
aagaaagaacttcatggtat

SEQ ID NO: 539710 - DNA, 20 bp, Artificial
  CRISPR gRNA sequence
ttcatggtatcagtaatatt

SEQ ID NO: 539711 - DNA, 20 bp, Artificial
  CRISPR gRNA sequence
catcttcatctgatgatgtt

SEQ ID NO: 539712 - DNA, 20 bp, Artificial
  CRISPR gRNA sequence
catctgatgatgttaagttg

SEQ ID NO: 539713 - DNA, 20 bp, Artificial
  CRISPR gRNA sequence
tgatgatgttaagttgtaga

SEQ ID NO: 539714 - DNA, 20 bp, Artificial
  CRISPR gRNA sequence
gatgttaagttgtagatagt

SEQ ID NO: 539715 - DNA, 20 bp, Artificial
  CRISPR gRNA sequence
atgttaagttgtagatagtg

SEQ ID NO: 539716 - DNA, 20 bp, Artificial
  CRISPR gRNA sequence
gatagtgaggctacctgaca

SEQ ID NO: 539717 - DNA, 20 bp, Artificial
  CRISPR gRNA sequence
taaataaaccctatttttaa

SEQ ID NO: 539718 - DNA, 20 bp, Artificial
  CRISPR gRNA sequence
aaaccctatttttaaaagat

SEQ ID NO: 539719 - DNA, 20 bp, Artificial
  CRISPR gRNA sequence
cctatttttaaaagatgaga

SEQ ID NO: 539720 - DNA, 20 bp, Artificial
  CRISPR gRNA sequence
agatgagaaagctctgaatt

SEQ ID NO: 539721 - DNA, 20 bp, Artificial
  CRISPR gRNA sequence
gctctgaattcagaattttc

SEQ ID NO: 539722 - DNA, 20 bp, Artificial
  CRISPR gRNA sequence
ttatccttttgttttttcca

SEQ ID NO: 539723 - DNA, 20 bp, Artificial
  CRISPR gRNA sequence
tatccttttgttttttccat

SEQ ID NO: 539724 - DNA, 20 bp, Artificial
  CRISPR gRNA sequence
tttccataggacctctttta

SEQ ID NO: 539725 - DNA, 20 bp, Artificial
  CRISPR gRNA sequence
ttccataggacctcttttaa

SEQ ID NO: 539726 - DNA, 20 bp, Artificial
  CRISPR gRNA sequence
tcttttaaaggcacattgct

SEQ ID NO: 539727 - DNA, 20 bp, Artificial
  CRISPR gRNA sequence
aaggcacattgcttggtaca

SEQ ID NO: 539728 - DNA, 20 bp, Artificial
  CRISPR gRNA sequence
cacattgcttggtacatgga

SEQ ID NO: 539729 - DNA, 20 bp, Artificial
  CRISPR gRNA sequence
acacaacaccatatatttgt

SEQ ID NO: 539730 - DNA, 20 bp, Artificial
  CRISPR gRNA sequence
cacaacaccatatatttgtt

SEQ ID NO: 539731 - DNA, 20 bp, Artificial
  CRISPR gRNA sequence
catatatttgttgggaaaaa

SEQ ID NO: 539732 - DNA, 20 bp, Artificial
  CRISPR gRNA sequence
gaaaaacagctgatgaaacc

SEQ ID NO: 539733 - DNA, 20 bp, Artificial
  CRISPR gRNA sequence
aaaaacagctgatgaaacct

SEQ ID NO: 539734 - DNA, 20 bp, Artificial
  CRISPR gRNA sequence
aaacagctgatgaaacctag

SEQ ID NO: 539735 - DNA, 20 bp, Artificial
  CRISPR gRNA sequence
acagctgatgaaacctagga

SEQ ID NO: 539736 - DNA, 20 bp, Artificial
  CRISPR gRNA sequence
cctaggagagaaaaaaaaat

SEQ ID NO: 539737 - DNA, 20 bp, Artificial
  CRISPR gRNA sequence
ggagagaaaaaaaaattggt

SEQ ID NO: 539738 - DNA, 20 bp, Artificial
  CRISPR gRNA sequence
tagaaaaaacaacatgactt

SEQ ID NO: 539739 - DNA, 20 bp, Artificial
  CRISPR gRNA sequence
aaaaaacaacatgactttgg

SEQ ID NO: 539740 - DNA, 20 bp, Artificial
  CRISPR gRNA sequence
aaacaacatgactttggtgg

SEQ ID NO: 539741 - DNA, 20 bp, Artificial
  CRISPR gRNA sequence
tggtggcagaaattattcat

SEQ ID NO: 539742 - DNA, 20 bp, Artificial
  CRISPR gRNA sequence
ggtggcagaaattattcatc

SEQ ID NO: 539743 - DNA, 20 bp, Artificial
  CRISPR gRNA sequence
catcaggtactttttgtgct

SEQ ID NO: 539744 - DNA, 20 bp, Artificial
  CRISPR gRNA sequence
caaactgctgacacaaaata

SEQ ID NO: 539745 - DNA, 20 bp, Artificial
  CRISPR gRNA sequence
aaactgctgacacaaaatac

SEQ ID NO: 539746 - DNA, 20 bp, Artificial
  CRISPR gRNA sequence
ctgctgacacaaaatacagg

SEQ ID NO: 539747 - DNA, 20 bp, Artificial
  CRISPR gRNA sequence
tgacacaaaatacaggaagt

SEQ ID NO: 539748 - DNA, 20 bp, Artificial
  CRISPR gRNA sequence
taagaacatgtttgaccatg

SEQ ID NO: 539749 - DNA, 20 bp, Artificial
  CRISPR gRNA sequence
agaacatgtttgaccatgtg

SEQ ID NO: 539750 - DNA, 20 bp, Artificial
  CRISPR gRNA sequence
atgtggagcttactctttaa

SEQ ID NO: 539751 - DNA, 20 bp, Artificial
  CRISPR gRNA sequence
cttactctttaatagaaaac

SEQ ID NO: 539752 - DNA, 20 bp, Artificial
  CRISPR gRNA sequence
ttactctttaatagaaaact

SEQ ID NO: 539753 - DNA, 20 bp, Artificial
  CRISPR gRNA sequence
actgggacctgcataaatcc

SEQ ID NO: 539754 - DNA, 20 bp, Artificial
  CRISPR gRNA sequence
acctgcataaatccaagaaa

SEQ ID NO: 539755 - DNA, 20 bp, Artificial
  CRISPR gRNA sequence
agaaatggacccgacattca

SEQ ID NO: 539756 - DNA, 20 bp, Artificial
  CRISPR gRNA sequence
aaatggacccgacattcatg

SEQ ID NO: 539757 - DNA, 20 bp, Artificial
  CRISPR gRNA sequence
atggagcaccaaccatctgc

SEQ ID NO: 539758 - DNA, 20 bp, Artificial
  CRISPR gRNA sequence
tggagcaccaaccatctgcc

SEQ ID NO: 539759 - DNA, 20 bp, Artificial
  CRISPR gRNA sequence
agcaccaaccatctgccagg

SEQ ID NO: 539760 - DNA, 20 bp, Artificial
  CRISPR gRNA sequence
caaccatctgccaggtagta

SEQ ID NO: 539761 - DNA, 20 bp, Artificial
  CRISPR gRNA sequence
aaccatctgccaggtagtac

SEQ ID NO: 539762 - DNA, 20 bp, Artificial
  CRISPR gRNA sequence
atctgccaggtagtacgggc

SEQ ID NO: 539763 - DNA, 20 bp, Artificial
  CRISPR gRNA sequence
tctgccaggtagtacgggct

SEQ ID NO: 539764 - DNA, 20 bp, Artificial
  CRISPR gRNA sequence
ccaggtagtacgggctgggc

SEQ ID NO: 539765 - DNA, 20 bp, Artificial
  CRISPR gRNA sequence
caggtagtacgggctgggct

SEQ ID NO: 539766 - DNA, 20 bp, Artificial
  CRISPR gRNA sequence
tacgggctgggctgggaata

SEQ ID NO: 539767 - DNA, 20 bp, Artificial
  CRISPR gRNA sequence
acgggctgggctgggaatat

SEQ ID NO: 539768 - DNA, 20 bp, Artificial
  CRISPR gRNA sequence
cgggctgggctgggaatatg

SEQ ID NO: 539769 - DNA, 20 bp, Artificial
  CRISPR gRNA sequence
ctgggaatatggggttgttc

SEQ ID NO: 539770 - DNA, 20 bp, Artificial
  CRISPR gRNA sequence
tgggaatatggggttgttcc

SEQ ID NO: 539771 - DNA, 20 bp, Artificial
  CRISPR gRNA sequence
tggggttgttccaggccctc

SEQ ID NO: 539772 - DNA, 20 bp, Artificial
  CRISPR gRNA sequence
ggggttgttccaggccctcc

SEQ ID NO: 539773 - DNA, 20 bp, Artificial
  CRISPR gRNA sequence
ggttgttccaggccctccag

SEQ ID NO: 539774 - DNA, 20 bp, Artificial
  CRISPR gRNA sequence
ccctccaggagcctcacgtg

SEQ ID NO: 539775 - DNA, 20 bp, Artificial
  CRISPR gRNA sequence
ctccaggagcctcacgtgtg

SEQ ID NO: 539776 - DNA, 20 bp, Artificial
  CRISPR gRNA sequence
caggagcctcacgtgtggag

SEQ ID NO: 539777 - DNA, 20 bp, Artificial
  CRISPR gRNA sequence
agcctcacgtgtggagaaga

SEQ ID NO: 539778 - DNA, 20 bp, Artificial
  CRISPR gRNA sequence
gcctcacgtgtggagaagac

SEQ ID NO: 539779 - DNA, 20 bp, Artificial
  CRISPR gRNA sequence
cctcacgtgtggagaagaca

SEQ ID NO: 539780 - DNA, 20 bp, Artificial
  CRISPR gRNA sequence
tcacgtgtggagaagacagg

SEQ ID NO: 539781 - DNA, 20 bp, Artificial
  CRISPR gRNA sequence
cgtgtggagaagacagggag

SEQ ID NO: 539782 - DNA, 20 bp, Artificial
  CRISPR gRNA sequence
gtgtggagaagacagggagc

SEQ ID NO: 539783 - DNA, 20 bp, Artificial
  CRISPR gRNA sequence
acagggagcaggctctacat

SEQ ID NO: 539784 - DNA, 20 bp, Artificial
  CRISPR gRNA sequence
cagggagcaggctctacatc

SEQ ID NO: 539785 - DNA, 20 bp, Artificial
  CRISPR gRNA sequence
agggagcaggctctacatca

SEQ ID NO: 539786 - DNA, 20 bp, Artificial
  CRISPR gRNA sequence
gggagcaggctctacatcag

SEQ ID NO: 539787 - DNA, 20 bp, Artificial
  CRISPR gRNA sequence
ctctacatcaggggctgcat

SEQ ID NO: 539788 - DNA, 20 bp, Artificial
  CRISPR gRNA sequence
tctacatcaggggctgcatg

SEQ ID NO: 539789 - DNA, 20 bp, Artificial
  CRISPR gRNA sequence
ctacatcaggggctgcatga

SEQ ID NO: 539790 - DNA, 20 bp, Artificial
  CRISPR gRNA sequence
tacatcaggggctgcatgag

SEQ ID NO: 539791 - DNA, 20 bp, Artificial
  CRISPR gRNA sequence
catcaggggctgcatgaggg

SEQ ID NO: 539792 - DNA, 20 bp, Artificial
  CRISPR gRNA sequence
gctgcatgaggggagctgcc

SEQ ID NO: 539793 - DNA, 20 bp, Artificial
  CRISPR gRNA sequence
atgaggggagctgcctggtc

SEQ ID NO: 539794 - DNA, 20 bp, Artificial
  CRISPR gRNA sequence
tgaggggagctgcctggtct

SEQ ID NO: 539795 - DNA, 20 bp, Artificial
  CRISPR gRNA sequence
gaggggagctgcctggtcta

SEQ ID NO: 539796 - DNA, 20 bp, Artificial
  CRISPR gRNA sequence
gcctggtctagggcctcccc

SEQ ID NO: 539797 - DNA, 20 bp, Artificial
  CRISPR gRNA sequence
cctggtctagggcctcccca

SEQ ID NO: 539798 - DNA, 20 bp, Artificial
  CRISPR gRNA sequence
ggtctagggcctccccaagg

SEQ ID NO: 539799 - DNA, 20 bp, Artificial
  CRISPR gRNA sequence
cctccccaaggaagtcatgc

SEQ ID NO: 539800 - DNA, 20 bp, Artificial
  CRISPR gRNA sequence
acataacgtgcaaatcactg

SEQ ID NO: 539801 - DNA, 20 bp, Artificial
  CRISPR gRNA sequence
cataacgtgcaaatcactga

SEQ ID NO: 539802 - DNA, 20 bp, Artificial
  CRISPR gRNA sequence
tgcaaatcactgaaggataa

SEQ ID NO: 539803 - DNA, 20 bp, Artificial
  CRISPR gRNA sequence
gcaaatcactgaaggataaa

SEQ ID NO: 539804 - DNA, 20 bp, Artificial
  CRISPR gRNA sequence
aatcactgaaggataaaagg

SEQ ID NO: 539805 - DNA, 20 bp, Artificial
  CRISPR gRNA sequence
actgaaggataaaaggcagt

SEQ ID NO: 539806 - DNA, 20 bp, Artificial
  CRISPR gRNA sequence
ctgaaggataaaaggcagtt

SEQ ID NO: 539807 - DNA, 20 bp, Artificial
  CRISPR gRNA sequence
gataaaaggcagttaggccg

SEQ ID NO: 539808 - DNA, 20 bp, Artificial
  CRISPR gRNA sequence
ataaaaggcagttaggccgc

SEQ ID NO: 539809 - DNA, 20 bp, Artificial
  CRISPR gRNA sequence
taaaaggcagttaggccgca

SEQ ID NO: 539810 - DNA, 20 bp, Artificial
  CRISPR gRNA sequence
aggcagttaggccgcagggc

SEQ ID NO: 539811 - DNA, 20 bp, Artificial
  CRISPR gRNA sequence
ggcagttaggccgcagggct

SEQ ID NO: 539812 - DNA, 20 bp, Artificial
  CRISPR gRNA sequence
agttaggccgcagggctggg

SEQ ID NO: 539813 - DNA, 20 bp, Artificial
  CRISPR gRNA sequence
gttaggccgcagggctgggt

SEQ ID NO: 539814 - DNA, 20 bp, Artificial
  CRISPR gRNA sequence
ggccgcagggctgggtaggt

SEQ ID NO: 539815 - DNA, 20 bp, Artificial
  CRISPR gRNA sequence
cgcagggctgggtaggtgag

SEQ ID NO: 539816 - DNA, 20 bp, Artificial
  CRISPR gRNA sequence
gcagggctgggtaggtgagt

SEQ ID NO: 539817 - DNA, 20 bp, Artificial
  CRISPR gRNA sequence
gggctgggtaggtgagtggg

SEQ ID NO: 539818 - DNA, 20 bp, Artificial
  CRISPR gRNA sequence
ggctgggtaggtgagtgggt

SEQ ID NO: 539819 - DNA, 20 bp, Artificial
  CRISPR gRNA sequence
gctgggtaggtgagtgggtg

SEQ ID NO: 539820 - DNA, 20 bp, Artificial
  CRISPR gRNA sequence
tgggtaggtgagtgggtggg

SEQ ID NO: 539821 - DNA, 20 bp, Artificial
  CRISPR gRNA sequence
gtaggtgagtgggtggggag

SEQ ID NO: 539822 - DNA, 20 bp, Artificial
  CRISPR gRNA sequence
ggtgagtgggtggggagtgg

SEQ ID NO: 539823 - DNA, 20 bp, Artificial
  CRISPR gRNA sequence
gagtgggtggggagtggaag

SEQ ID NO: 539824 - DNA, 20 bp, Artificial
  CRISPR gRNA sequence
gtgggtggggagtggaagaa

SEQ ID NO: 539825 - DNA, 20 bp, Artificial
  CRISPR gRNA sequence
tggaagaagagatgatcata

SEQ ID NO: 539826 - DNA, 20 bp, Artificial
  CRISPR gRNA sequence
gagatgatcatacagatata

SEQ ID NO: 539827 - DNA, 20 bp, Artificial
  CRISPR gRNA sequence
agatgatcatacagatatat

SEQ ID NO: 539828 - DNA, 20 bp, Artificial
  CRISPR gRNA sequence
tgatcatacagatatatagg

SEQ ID NO: 539829 - DNA, 20 bp, Artificial
  CRISPR gRNA sequence
tcatacagatatataggaag

SEQ ID NO: 539830 - DNA, 20 bp, Artificial
  CRISPR gRNA sequence
tataggaagcagcaccccca

SEQ ID NO: 539831 - DNA, 20 bp, Artificial
  CRISPR gRNA sequence
ataggaagcagcacccccaa

SEQ ID NO: 539832 - DNA, 20 bp, Artificial
  CRISPR gRNA sequence
ggaagcagcacccccaaagg

SEQ ID NO: 539833 - DNA, 20 bp, Artificial
  CRISPR gRNA sequence
gaagcagcacccccaaagga

SEQ ID NO: 539834 - DNA, 20 bp, Artificial
  CRISPR gRNA sequence
ccccaaaggaaggccctgaa

SEQ ID NO: 539835 - DNA, 20 bp, Artificial
  CRISPR gRNA sequence
ccaaaggaaggccctgaatg

SEQ ID NO: 539836 - DNA, 20 bp, Artificial
  CRISPR gRNA sequence
aggaaggccctgaatggaga

SEQ ID NO: 539837 - DNA, 20 bp, Artificial
  CRISPR gRNA sequence
gaaggccctgaatggagaaa

SEQ ID NO: 539838 - DNA, 20 bp, Artificial
  CRISPR gRNA sequence
ccctgaatggagaaagagca

SEQ ID NO: 539839 - DNA, 20 bp, Artificial
  CRISPR gRNA sequence
agaaagagcatggtgtgctt

SEQ ID NO: 539840 - DNA, 20 bp, Artificial
  CRISPR gRNA sequence
gaaagagcatggtgtgcttg

SEQ ID NO: 539841 - DNA, 20 bp, Artificial
  CRISPR gRNA sequence
gatacacacgtgattcctaa

SEQ ID NO: 539842 - DNA, 20 bp, Artificial
  CRISPR gRNA sequence
cacacgtgattcctaacagc

SEQ ID NO: 539843 - DNA, 20 bp, Artificial
  CRISPR gRNA sequence
tgattcctaacagctagaat

SEQ ID NO: 539844 - DNA, 20 bp, Artificial
  CRISPR gRNA sequence
gattcctaacagctagaatg

SEQ ID NO: 539845 - DNA, 20 bp, Artificial
  CRISPR gRNA sequence
ttcctaacagctagaatgag

SEQ ID NO: 539846 - DNA, 20 bp, Artificial
  CRISPR gRNA sequence
tcctaacagctagaatgagg

SEQ ID NO: 539847 - DNA, 20 bp, Artificial
  CRISPR gRNA sequence
cctaacagctagaatgagga

SEQ ID NO: 539848 - DNA, 20 bp, Artificial
  CRISPR gRNA sequence
acagctagaatgaggagggc

SEQ ID NO: 539849 - DNA, 20 bp, Artificial
  CRISPR gRNA sequence
cagctagaatgaggagggca

SEQ ID NO: 539850 - DNA, 20 bp, Artificial
  CRISPR gRNA sequence
agctagaatgaggagggcaa

SEQ ID NO: 539851 - DNA, 20 bp, Artificial
  CRISPR gRNA sequence
gctagaatgaggagggcaag

SEQ ID NO: 539852 - DNA, 20 bp, Artificial
  CRISPR gRNA sequence
agaatgaggagggcaagggg

SEQ ID NO: 539853 - DNA, 20 bp, Artificial
  CRISPR gRNA sequence
tgaggagggcaaggggtggc

SEQ ID NO: 539854 - DNA, 20 bp, Artificial
  CRISPR gRNA sequence
ggagggcaaggggtggctgg

SEQ ID NO: 539855 - DNA, 20 bp, Artificial
  CRISPR gRNA sequence
gagggcaaggggtggctggt

SEQ ID NO: 539856 - DNA, 20 bp, Artificial
  CRISPR gRNA sequence
agggcaaggggtggctggtg

SEQ ID NO: 539857 - DNA, 20 bp, Artificial
  CRISPR gRNA sequence
aggggtggctggtggggaac

SEQ ID NO: 539858 - DNA, 20 bp, Artificial
  CRISPR gRNA sequence
gtggctggtggggaacaaga

SEQ ID NO: 539859 - DNA, 20 bp, Artificial
  CRISPR gRNA sequence
ggtggggaacaagacagaca

SEQ ID NO: 539860 - DNA, 20 bp, Artificial
  CRISPR gRNA sequence
gtggggaacaagacagacaa

SEQ ID NO: 539861 - DNA, 20 bp, Artificial
  CRISPR gRNA sequence
ggaacaagacagacaaaggc

SEQ ID NO: 539862 - DNA, 20 bp, Artificial
  CRISPR gRNA sequence
gacagacaaaggccagccca

SEQ ID NO: 539863 - DNA, 20 bp, Artificial
  CRISPR gRNA sequence
cccacagcctatgtgtgcta

SEQ ID NO: 539864 - DNA, 20 bp, Artificial
  CRISPR gRNA sequence
cagcctatgtgtgctaaagt

SEQ ID NO: 539865 - DNA, 20 bp, Artificial
  CRISPR gRNA sequence
agcctatgtgtgctaaagta

SEQ ID NO: 539866 - DNA, 20 bp, Artificial
  CRISPR gRNA sequence
gtgctaaagtaaggaacgct

SEQ ID NO: 539867 - DNA, 20 bp, Artificial
  CRISPR gRNA sequence
tgctaaagtaaggaacgcta

SEQ ID NO: 539868 - DNA, 20 bp, Artificial
  CRISPR gRNA sequence
gctaaagtaaggaacgctaa

SEQ ID NO: 539869 - DNA, 20 bp, Artificial
  CRISPR gRNA sequence
agtaaggaacgctaagggtt

SEQ ID NO: 539870 - DNA, 20 bp, Artificial
  CRISPR gRNA sequence
agggtttggactgatcctaa

SEQ ID NO: 539871 - DNA, 20 bp, Artificial
  CRISPR gRNA sequence
ggtttggactgatcctaatg

SEQ ID NO: 539872 - DNA, 20 bp, Artificial
  CRISPR gRNA sequence
tttggactgatcctaatgga

SEQ ID NO: 539873 - DNA, 20 bp, Artificial
  CRISPR gRNA sequence
ttggactgatcctaatggag

SEQ ID NO: 539874 - DNA, 20 bp, Artificial
  CRISPR gRNA sequence
gactgatcctaatggagagg

SEQ ID NO: 539875 - DNA, 20 bp, Artificial
  CRISPR gRNA sequence
tcctaatggagaggaagcca

SEQ ID NO: 539876 - DNA, 20 bp, Artificial
  CRISPR gRNA sequence
aatggagaggaagccacaga

SEQ ID NO: 539877 - DNA, 20 bp, Artificial
  CRISPR gRNA sequence
atggagaggaagccacagaa

SEQ ID NO: 539878 - DNA, 20 bp, Artificial
  CRISPR gRNA sequence
gccacagaaaggtttttaac

SEQ ID NO: 539879 - DNA, 20 bp, Artificial
  CRISPR gRNA sequence
agaaaggtttttaacaagac

SEQ ID NO: 539880 - DNA, 20 bp, Artificial
  CRISPR gRNA sequence
agactggcctaacataattt

SEQ ID NO: 539881 - DNA, 20 bp, Artificial
  CRISPR gRNA sequence
gcctaacataatttaagtgt

SEQ ID NO: 539882 - DNA, 20 bp, Artificial
  CRISPR gRNA sequence
taacataatttaagtgtcag

SEQ ID NO: 539883 - DNA, 20 bp, Artificial
  CRISPR gRNA sequence
aacataatttaagtgtcagc

SEQ ID NO: 539884 - DNA, 20 bp, Artificial
  CRISPR gRNA sequence
gtcagcaggctgactgtctt

SEQ ID NO: 539885 - DNA, 20 bp, Artificial
  CRISPR gRNA sequence
cagcaggctgactgtcttta

SEQ ID NO: 539886 - DNA, 20 bp, Artificial
  CRISPR gRNA sequence
caggctgactgtctttagag

SEQ ID NO: 539887 - DNA, 20 bp, Artificial
  CRISPR gRNA sequence
ggctgactgtctttagagta

SEQ ID NO: 539888 - DNA, 20 bp, Artificial
  CRISPR gRNA sequence
ctgactgtctttagagtaga

SEQ ID NO: 539889 - DNA, 20 bp, Artificial
  CRISPR gRNA sequence
actgtctttagagtagagag

SEQ ID NO: 539890 - DNA, 20 bp, Artificial
  CRISPR gRNA sequence
ttagagtagagagcggctga

SEQ ID NO: 539891 - DNA, 20 bp, Artificial
  CRISPR gRNA sequence
tagagtagagagcggctgac

SEQ ID NO: 539892 - DNA, 20 bp, Artificial
  CRISPR gRNA sequence
agagtagagagcggctgaca

SEQ ID NO: 539893 - DNA, 20 bp, Artificial
  CRISPR gRNA sequence
gagtagagagcggctgacag

SEQ ID NO: 539894 - DNA, 20 bp, Artificial
  CRISPR gRNA sequence
agagagcggctgacaggggc

SEQ ID NO: 539895 - DNA, 20 bp, Artificial
  CRISPR gRNA sequence
gcggctgacaggggccagca

SEQ ID NO: 539896 - DNA, 20 bp, Artificial
  CRISPR gRNA sequence
ggctgacaggggccagcaca

SEQ ID NO: 539897 - DNA, 20 bp, Artificial
  CRISPR gRNA sequence
gctgacaggggccagcacag

SEQ ID NO: 539898 - DNA, 20 bp, Artificial
  CRISPR gRNA sequence
gacaggggccagcacagagg

SEQ ID NO: 539899 - DNA, 20 bp, Artificial
  CRISPR gRNA sequence
acaggggccagcacagaggc

SEQ ID NO: 539900 - DNA, 20 bp, Artificial
  CRISPR gRNA sequence
caggggccagcacagaggca

SEQ ID NO: 539901 - DNA, 20 bp, Artificial
  CRISPR gRNA sequence
aggcagggaaattataatga

SEQ ID NO: 539902 - DNA, 20 bp, Artificial
  CRISPR gRNA sequence
tataatgaaagtcaatgctg

SEQ ID NO: 539903 - DNA, 20 bp, Artificial
  CRISPR gRNA sequence
aagtcaatgctgtagcaatg

SEQ ID NO: 539904 - DNA, 20 bp, Artificial
  CRISPR gRNA sequence
tgctgtagcaatgaagtcca

SEQ ID NO: 539905 - DNA, 20 bp, Artificial
  CRISPR gRNA sequence
gtagcaatgaagtccatgga

SEQ ID NO: 539906 - DNA, 20 bp, Artificial
  CRISPR gRNA sequence
tagcaatgaagtccatggac

SEQ ID NO: 539907 - DNA, 20 bp, Artificial
  CRISPR gRNA sequence
aatgaagtccatggacagga

SEQ ID NO: 539908 - DNA, 20 bp, Artificial
  CRISPR gRNA sequence
agtccatggacaggacagac

SEQ ID NO: 539909 - DNA, 20 bp, Artificial
  CRISPR gRNA sequence
tccatggacaggacagacca

SEQ ID NO: 539910 - DNA, 20 bp, Artificial
  CRISPR gRNA sequence
atggacaggacagaccagag

SEQ ID NO: 539911 - DNA, 20 bp, Artificial
  CRISPR gRNA sequence
tggacaggacagaccagagc

SEQ ID NO: 539912 - DNA, 20 bp, Artificial
  CRISPR gRNA sequence
ggacaggacagaccagagca

SEQ ID NO: 539913 - DNA, 20 bp, Artificial
  CRISPR gRNA sequence
agaccagagcagggtgtttg

SEQ ID NO: 539914 - DNA, 20 bp, Artificial
  CRISPR gRNA sequence
ccagagcagggtgtttgtag

SEQ ID NO: 539915 - DNA, 20 bp, Artificial
  CRISPR gRNA sequence
cagagcagggtgtttgtagt

SEQ ID NO: 539916 - DNA, 20 bp, Artificial
  CRISPR gRNA sequence
agagcagggtgtttgtagtg

SEQ ID NO: 539917 - DNA, 20 bp, Artificial
  CRISPR gRNA sequence
cagggtgtttgtagtgggga

SEQ ID NO: 539918 - DNA, 20 bp, Artificial
  CRISPR gRNA sequence
tgtttgtagtggggacagac

SEQ ID NO: 539919 - DNA, 20 bp, Artificial
  CRISPR gRNA sequence
ttgtagtggggacagacaag

SEQ ID NO: 539920 - DNA, 20 bp, Artificial
  CRISPR gRNA sequence
agtggggacagacaagcgga

SEQ ID NO: 539921 - DNA, 20 bp, Artificial
  CRISPR gRNA sequence
gacagacaagcggacagact

SEQ ID NO: 539922 - DNA, 20 bp, Artificial
  CRISPR gRNA sequence
acagacaagcggacagactc

SEQ ID NO: 539923 - DNA, 20 bp, Artificial
  CRISPR gRNA sequence
agacaagcggacagactcag

SEQ ID NO: 539924 - DNA, 20 bp, Artificial
  CRISPR gRNA sequence
cggacagactcaggagatgc

SEQ ID NO: 539925 - DNA, 20 bp, Artificial
  CRISPR gRNA sequence
gacagactcaggagatgctg

SEQ ID NO: 539926 - DNA, 20 bp, Artificial
  CRISPR gRNA sequence
cagactcaggagatgctgga

SEQ ID NO: 539927 - DNA, 20 bp, Artificial
  CRISPR gRNA sequence
gactcaggagatgctggaga

SEQ ID NO: 539928 - DNA, 20 bp, Artificial
  CRISPR gRNA sequence
tcaggagatgctggagagag

SEQ ID NO: 539929 - DNA, 20 bp, Artificial
  CRISPR gRNA sequence
atgctggagagagaagtcaa

SEQ ID NO: 539930 - DNA, 20 bp, Artificial
  CRISPR gRNA sequence
tgctggagagagaagtcaac

SEQ ID NO: 539931 - DNA, 20 bp, Artificial
  CRISPR gRNA sequence
agagagaagtcaacaggatt

SEQ ID NO: 539932 - DNA, 20 bp, Artificial
  CRISPR gRNA sequence
agtcaacaggattcagtgat

SEQ ID NO: 539933 - DNA, 20 bp, Artificial
  CRISPR gRNA sequence
gtcaacaggattcagtgatg

SEQ ID NO: 539934 - DNA, 20 bp, Artificial
  CRISPR gRNA sequence
tcaacaggattcagtgatga

SEQ ID NO: 539935 - DNA, 20 bp, Artificial
  CRISPR gRNA sequence
acaggattcagtgatgaggg

SEQ ID NO: 539936 - DNA, 20 bp, Artificial
  CRISPR gRNA sequence
caggattcagtgatgagggt

SEQ ID NO: 539937 - DNA, 20 bp, Artificial
  CRISPR gRNA sequence
aggattcagtgatgagggtg

SEQ ID NO: 539938 - DNA, 20 bp, Artificial
  CRISPR gRNA sequence
ggattcagtgatgagggtgg

SEQ ID NO: 539939 - DNA, 20 bp, Artificial
  CRISPR gRNA sequence
ttcagtgatgagggtggggg

SEQ ID NO: 539940 - DNA, 20 bp, Artificial
  CRISPR gRNA sequence
agtgatgagggtgggggaag

SEQ ID NO: 539941 - DNA, 20 bp, Artificial
  CRISPR gRNA sequence
atgagggtgggggaagtgga

SEQ ID NO: 539942 - DNA, 20 bp, Artificial
  CRISPR gRNA sequence
tgagggtgggggaagtggat

SEQ ID NO: 539943 - DNA, 20 bp, Artificial
  CRISPR gRNA sequence
ggggaagtggatgggactgt

SEQ ID NO: 539944 - DNA, 20 bp, Artificial
  CRISPR gRNA sequence
gggaagtggatgggactgtc

SEQ ID NO: 539945 - DNA, 20 bp, Artificial
  CRISPR gRNA sequence
atgggactgtcaggtctcct

SEQ ID NO: 539946 - DNA, 20 bp, Artificial
  CRISPR gRNA sequence
tcaggtctccttggctgact

SEQ ID NO: 539947 - DNA, 20 bp, Artificial
  CRISPR gRNA sequence
aggtctccttggctgactga

SEQ ID NO: 539948 - DNA, 20 bp, Artificial
  CRISPR gRNA sequence
ggtctccttggctgactgag

SEQ ID NO: 539949 - DNA, 20 bp, Artificial
  CRISPR gRNA sequence
actgagaggcatcattaact

SEQ ID NO: 539950 - DNA, 20 bp, Artificial
  CRISPR gRNA sequence
gaggcatcattaactgagat

SEQ ID NO: 539951 - DNA, 20 bp, Artificial
  CRISPR gRNA sequence
ttaactgagatcagaaacaa

SEQ ID NO: 539952 - DNA, 20 bp, Artificial
  CRISPR gRNA sequence
ctgagatcagaaacaatggc

SEQ ID NO: 539953 - DNA, 20 bp, Artificial
  CRISPR gRNA sequence
tgagatcagaaacaatggct

SEQ ID NO: 539954 - DNA, 20 bp, Artificial
  CRISPR gRNA sequence
gatcagaaacaatggctggg

SEQ ID NO: 539955 - DNA, 20 bp, Artificial
  CRISPR gRNA sequence
agaaacaatggctgggaagc

SEQ ID NO: 539956 - DNA, 20 bp, Artificial
  CRISPR gRNA sequence
caatggctgggaagcaagtc

SEQ ID NO: 539957 - DNA, 20 bp, Artificial
  CRISPR gRNA sequence
aatggctgggaagcaagtcg

SEQ ID NO: 539958 - DNA, 20 bp, Artificial
  CRISPR gRNA sequence
atggctgggaagcaagtcga

SEQ ID NO: 539959 - DNA, 20 bp, Artificial
  CRISPR gRNA sequence
agcaagtcgagggtgtgatg

SEQ ID NO: 539960 - DNA, 20 bp, Artificial
  CRISPR gRNA sequence
tcgagggtgtgatgaagatt

SEQ ID NO: 539961 - DNA, 20 bp, Artificial
  CRISPR gRNA sequence
tgtgatgaagattaagaact

SEQ ID NO: 539962 - DNA, 20 bp, Artificial
  CRISPR gRNA sequence
gtgatgaagattaagaactc

SEQ ID NO: 539963 - DNA, 20 bp, Artificial
  CRISPR gRNA sequence
tgatgaagattaagaactca

SEQ ID NO: 539964 - DNA, 20 bp, Artificial
  CRISPR gRNA sequence
aagattaagaactcagggat

SEQ ID NO: 539965 - DNA, 20 bp, Artificial
  CRISPR gRNA sequence
agattaagaactcagggatt

SEQ ID NO: 539966 - DNA, 20 bp, Artificial
  CRISPR gRNA sequence
aagaactcagggattgggtg

SEQ ID NO: 539967 - DNA, 20 bp, Artificial
  CRISPR gRNA sequence
aactcagggattgggtgcag

SEQ ID NO: 539968 - DNA, 20 bp, Artificial
  CRISPR gRNA sequence
tcagggattgggtgcagtgg

SEQ ID NO: 539969 - DNA, 20 bp, Artificial
  CRISPR gRNA sequence
cagggattgggtgcagtggt

SEQ ID NO: 539970 - DNA, 20 bp, Artificial
  CRISPR gRNA sequence
gattgggtgcagtggtgggt

SEQ ID NO: 539971 - DNA, 20 bp, Artificial
  CRISPR gRNA sequence
ttgggtgcagtggtgggttg

SEQ ID NO: 539972 - DNA, 20 bp, Artificial
  CRISPR gRNA sequence
gtgcagtggtgggttggagc

SEQ ID NO: 539973 - DNA, 20 bp, Artificial
  CRISPR gRNA sequence
tgcagtggtgggttggagcc

SEQ ID NO: 539974 - DNA, 20 bp, Artificial
  CRISPR gRNA sequence
ccaggtccacctgccctcat

SEQ ID NO: 539975 - DNA, 20 bp, Artificial
  CRISPR gRNA sequence
tgccctcatgagccaattgt

SEQ ID NO: 539976 - DNA, 20 bp, Artificial
  CRISPR gRNA sequence
caattgttagcatctctgcc

SEQ ID NO: 539977 - DNA, 20 bp, Artificial
  CRISPR gRNA sequence
gcatctctgcccagccctat

SEQ ID NO: 539978 - DNA, 20 bp, Artificial
  CRISPR gRNA sequence
catctctgcccagccctatt

SEQ ID NO: 539979 - DNA, 20 bp, Artificial
  CRISPR gRNA sequence
atctctgcccagccctatta

SEQ ID NO: 539980 - DNA, 20 bp, Artificial
  CRISPR gRNA sequence
cagccctattagggaacatc

SEQ ID NO: 539981 - DNA, 20 bp, Artificial
  CRISPR gRNA sequence
tattagggaacatctagtaa

SEQ ID NO: 539982 - DNA, 20 bp, Artificial
  CRISPR gRNA sequence
gggaacatctagtaacagca

SEQ ID NO: 539983 - DNA, 20 bp, Artificial
  CRISPR gRNA sequence
aactgactaatgcttcacat

SEQ ID NO: 539984 - DNA, 20 bp, Artificial
  CRISPR gRNA sequence
tcagaacctccataccaacc

SEQ ID NO: 539985 - DNA, 20 bp, Artificial
  CRISPR gRNA sequence
cctagttgttaaacatttat

SEQ ID NO: 539986 - DNA, 20 bp, Artificial
  CRISPR gRNA sequence
taaacatttattagaaccac

SEQ ID NO: 539987 - DNA, 20 bp, Artificial
  CRISPR gRNA sequence
atttattagaaccacaagat

SEQ ID NO: 539988 - DNA, 20 bp, Artificial
  CRISPR gRNA sequence
tttattagaaccacaagatt

SEQ ID NO: 539989 - DNA, 20 bp, Artificial
  CRISPR gRNA sequence
gggatatttttgatacccca

SEQ ID NO: 539990 - DNA, 20 bp, Artificial
  CRISPR gRNA sequence
atatttttgataccccaaag

SEQ ID NO: 539991 - DNA, 20 bp, Artificial
  CRISPR gRNA sequence
tatttttgataccccaaagt

SEQ ID NO: 539992 - DNA, 20 bp, Artificial
  CRISPR gRNA sequence
ggtttaaatgcatcttgctc

SEQ ID NO: 539993 - DNA, 20 bp, Artificial
  CRISPR gRNA sequence
gtttaaatgcatcttgctct

SEQ ID NO: 539994 - DNA, 20 bp, Artificial
  CRISPR gRNA sequence
tctaggacttgtctcttgtt

SEQ ID NO: 539995 - DNA, 20 bp, Artificial
  CRISPR gRNA sequence
taggacttgtctcttgttaa

SEQ ID NO: 539996 - DNA, 20 bp, Artificial
  CRISPR gRNA sequence
ggacttgtctcttgttaaga

SEQ ID NO: 539997 - DNA, 20 bp, Artificial
  CRISPR gRNA sequence
tgtctcttgttaagagagaa

SEQ ID NO: 539998 - DNA, 20 bp, Artificial
  CRISPR gRNA sequence
ctcttgttaagagagaacag

SEQ ID NO: 539999 - DNA, 20 bp, Artificial
  CRISPR gRNA sequence
tgttaagagagaacagcagc

SEQ ID NO: 540000 - DNA, 20 bp, Artificial
  CRISPR gRNA sequence
gttaagagagaacagcagct

SEQ ID NO: 540001 - DNA, 20 bp, Artificial
  CRISPR gRNA sequence
agaacagcagctgggtcctg

SEQ ID NO: 540002 - DNA, 20 bp, Artificial
  CRISPR gRNA sequence
gtcctgtggttcatgcctgt

SEQ ID NO: 540003 - DNA, 20 bp, Artificial
  CRISPR gRNA sequence
gtggttcatgcctgtaagtc

SEQ ID NO: 540004 - DNA, 20 bp, Artificial
  CRISPR gRNA sequence
tgcctgtaagtccagcattt

SEQ ID NO: 540005 - DNA, 20 bp, Artificial
  CRISPR gRNA sequence
gcctgtaagtccagcatttt

SEQ ID NO: 540006 - DNA, 20 bp, Artificial
  CRISPR gRNA sequence
ctgtaagtccagcattttgg

SEQ ID NO: 540007 - DNA, 20 bp, Artificial
  CRISPR gRNA sequence
tgtaagtccagcattttggg

SEQ ID NO: 540008 - DNA, 20 bp, Artificial
  CRISPR gRNA sequence
gtccagcattttgggaggcc

SEQ ID NO: 540009 - DNA, 20 bp, Artificial
  CRISPR gRNA sequence
tccagcattttgggaggcca

SEQ ID NO: 540010 - DNA, 20 bp, Artificial
  CRISPR gRNA sequence
agcattttgggaggccaagg

SEQ ID NO: 540011 - DNA, 20 bp, Artificial
  CRISPR gRNA sequence
ttttgggaggccaaggtggt

SEQ ID NO: 540012 - DNA, 20 bp, Artificial
  CRISPR gRNA sequence
ccaaggtggttggattgctt

SEQ ID NO: 540013 - DNA, 20 bp, Artificial
  CRISPR gRNA sequence
gtggttggattgcttgagtt

SEQ ID NO: 540014 - DNA, 20 bp, Artificial
  CRISPR gRNA sequence
tggttggattgcttgagttc

SEQ ID NO: 540015 - DNA, 20 bp, Artificial
  CRISPR gRNA sequence
gttggattgcttgagttcag

SEQ ID NO: 540016 - DNA, 20 bp, Artificial
  CRISPR gRNA sequence
ttgcttgagttcaggagttc

SEQ ID NO: 540017 - DNA, 20 bp, Artificial
  CRISPR gRNA sequence
tcaggagttcaagaccaacc

SEQ ID NO: 540018 - DNA, 20 bp, Artificial
  CRISPR gRNA sequence
caggagttcaagaccaacct

SEQ ID NO: 540019 - DNA, 20 bp, Artificial
  CRISPR gRNA sequence
caagaccaacctgggtaaaa

SEQ ID NO: 540020 - DNA, 20 bp, Artificial
  CRISPR gRNA sequence
cgaaaccccatctttacgaa

SEQ ID NO: 540021 - DNA, 20 bp, Artificial
  CRISPR gRNA sequence
ttacgaaaagtacaaaaaat

SEQ ID NO: 540022 - DNA, 20 bp, Artificial
  CRISPR gRNA sequence
gaaaagtacaaaaaattagc

SEQ ID NO: 540023 - DNA, 20 bp, Artificial
  CRISPR gRNA sequence
aaaagtacaaaaaattagct

SEQ ID NO: 540024 - DNA, 20 bp, Artificial
  CRISPR gRNA sequence
tacaaaaaattagctgggca

SEQ ID NO: 540025 - DNA, 20 bp, Artificial
  CRISPR gRNA sequence
ctgggcatggcacacacctg

SEQ ID NO: 540026 - DNA, 20 bp, Artificial
  CRISPR gRNA sequence
tggcacacacctgtggtccc

SEQ ID NO: 540027 - DNA, 20 bp, Artificial
  CRISPR gRNA sequence
acctgtggtccccagctact

SEQ ID NO: 540028 - DNA, 20 bp, Artificial
  CRISPR gRNA sequence
cctgtggtccccagctactt

SEQ ID NO: 540029 - DNA, 20 bp, Artificial
  CRISPR gRNA sequence
tgtggtccccagctacttgg

SEQ ID NO: 540030 - DNA, 20 bp, Artificial
  CRISPR gRNA sequence
gtggtccccagctacttggg

SEQ ID NO: 540031 - DNA, 20 bp, Artificial
  CRISPR gRNA sequence
cccagctacttgggaggctg

SEQ ID NO: 540032 - DNA, 20 bp, Artificial
  CRISPR gRNA sequence
cagctacttgggaggctgaa

SEQ ID NO: 540033 - DNA, 20 bp, Artificial
  CRISPR gRNA sequence
agctacttgggaggctgaag

SEQ ID NO: 540034 - DNA, 20 bp, Artificial
  CRISPR gRNA sequence
aggctgaagaggattacttg

SEQ ID NO: 540035 - DNA, 20 bp, Artificial
  CRISPR gRNA sequence
agaggattacttgaagccat

SEQ ID NO: 540036 - DNA, 20 bp, Artificial
  CRISPR gRNA sequence
gaggattacttgaagccatg

SEQ ID NO: 540037 - DNA, 20 bp, Artificial
  CRISPR gRNA sequence
gattacttgaagccatgagg

SEQ ID NO: 540038 - DNA, 20 bp, Artificial
  CRISPR gRNA sequence
ttacttgaagccatgaggca

SEQ ID NO: 540039 - DNA, 20 bp, Artificial
  CRISPR gRNA sequence
aagccatgaggcagagattg

SEQ ID NO: 540040 - DNA, 20 bp, Artificial
  CRISPR gRNA sequence
catgaggcagagattgcagt

SEQ ID NO: 540041 - DNA, 20 bp, Artificial
  CRISPR gRNA sequence
atgattgtgccactgcactc

SEQ ID NO: 540042 - DNA, 20 bp, Artificial
  CRISPR gRNA sequence
tgtgccactgcactccagcc

SEQ ID NO: 540043 - DNA, 20 bp, Artificial
  CRISPR gRNA sequence
gtgccactgcactccagcct

SEQ ID NO: 540044 - DNA, 20 bp, Artificial
  CRISPR gRNA sequence
ctgcactccagcctgggtga

SEQ ID NO: 540045 - DNA, 20 bp, Artificial
  CRISPR gRNA sequence
gcactccagcctgggtgaca

SEQ ID NO: 540046 - DNA, 20 bp, Artificial
  CRISPR gRNA sequence
aacaaacaaacaaaaaactg

SEQ ID NO: 540047 - DNA, 20 bp, Artificial
  CRISPR gRNA sequence
caaaaaactgcagctatttt

SEQ ID NO: 540048 - DNA, 20 bp, Artificial
  CRISPR gRNA sequence
gctattttaagttaacatta

SEQ ID NO: 540049 - DNA, 20 bp, Artificial
  CRISPR gRNA sequence
tattttaagttaacattaaa

SEQ ID NO: 540050 - DNA, 20 bp, Artificial
  CRISPR gRNA sequence
gagcaattaaaatttgactg

SEQ ID NO: 540051 - DNA, 20 bp, Artificial
  CRISPR gRNA sequence
atttgactgaagtttttgcc

SEQ ID NO: 540052 - DNA, 20 bp, Artificial
  CRISPR gRNA sequence
tgactgaagtttttgcctag

SEQ ID NO: 540053 - DNA, 20 bp, Artificial
  CRISPR gRNA sequence
agtttttgcctagtagcaat

SEQ ID NO: 540054 - DNA, 20 bp, Artificial
  CRISPR gRNA sequence
gtttttgcctagtagcaatt

SEQ ID NO: 540055 - DNA, 20 bp, Artificial
  CRISPR gRNA sequence
tttttgcctagtagcaatta

SEQ ID NO: 540056 - DNA, 20 bp, Artificial
  CRISPR gRNA sequence
ttagggtaattgaaataata

SEQ ID NO: 540057 - DNA, 20 bp, Artificial
  CRISPR gRNA sequence
tagggtaattgaaataatac

SEQ ID NO: 540058 - DNA, 20 bp, Artificial
  CRISPR gRNA sequence
agggtaattgaaataataca

SEQ ID NO: 540059 - DNA, 20 bp, Artificial
  CRISPR gRNA sequence
gggtaattgaaataatacag

SEQ ID NO: 540060 - DNA, 20 bp, Artificial
  CRISPR gRNA sequence
gaaataatacaggggaaatc

SEQ ID NO: 540061 - DNA, 20 bp, Artificial
  CRISPR gRNA sequence
aatcaagaacactgaatgac

SEQ ID NO: 540062 - DNA, 20 bp, Artificial
  CRISPR gRNA sequence
gaacactgaatgaccagttg

SEQ ID NO: 540063 - DNA, 20 bp, Artificial
  CRISPR gRNA sequence
ccagttgtagacaactgtgt

SEQ ID NO: 540064 - DNA, 20 bp, Artificial
  CRISPR gRNA sequence
gacaactgtgttagtaattt

SEQ ID NO: 540065 - DNA, 20 bp, Artificial
  CRISPR gRNA sequence
ctgtgttagtaatttcagat

SEQ ID NO: 540066 - DNA, 20 bp, Artificial
  CRISPR gRNA sequence
tgttagtaatttcagataag

SEQ ID NO: 540067 - DNA, 20 bp, Artificial
  CRISPR gRNA sequence
tcacccatttgtttatctac

SEQ ID NO: 540068 - DNA, 20 bp, Artificial
  CRISPR gRNA sequence
cacccatttgtttatctaca

SEQ ID NO: 540069 - DNA, 20 bp, Artificial
  CRISPR gRNA sequence
gtttatctacaaggactttt

SEQ ID NO: 540070 - DNA, 20 bp, Artificial
  CRISPR gRNA sequence
agaacccatctcccttaatt

SEQ ID NO: 540071 - DNA, 20 bp, Artificial
  CRISPR gRNA sequence
gaacccatctcccttaatta

SEQ ID NO: 540072 - DNA, 20 bp, Artificial
  CRISPR gRNA sequence
aacccatctcccttaattaa

SEQ ID NO: 540073 - DNA, 20 bp, Artificial
  CRISPR gRNA sequence
acccatctcccttaattaag

SEQ ID NO: 540074 - DNA, 20 bp, Artificial
  CRISPR gRNA sequence
aactgccctcaaaaacacac

SEQ ID NO: 540075 - DNA, 20 bp, Artificial
  CRISPR gRNA sequence
gcattatttcctccactcaa

SEQ ID NO: 540076 - DNA, 20 bp, Artificial
  CRISPR gRNA sequence
attatttcctccactcaaca

SEQ ID NO: 540077 - DNA, 20 bp, Artificial
  CRISPR gRNA sequence
cctccactcaacagagtatg

SEQ ID NO: 540078 - DNA, 20 bp, Artificial
  CRISPR gRNA sequence
ctccactcaacagagtatgt

SEQ ID NO: 540079 - DNA, 20 bp, Artificial
  CRISPR gRNA sequence
cactcaacagagtatgtggg

SEQ ID NO: 540080 - DNA, 20 bp, Artificial
  CRISPR gRNA sequence
actcaacagagtatgtggga

SEQ ID NO: 540081 - DNA, 20 bp, Artificial
  CRISPR gRNA sequence
cagagtatgtgggaaggcac

SEQ ID NO: 540082 - DNA, 20 bp, Artificial
  CRISPR gRNA sequence
atgtgggaaggcacaagaaa

SEQ ID NO: 540083 - DNA, 20 bp, Artificial
  CRISPR gRNA sequence
ggaaggcacaagaaaaagta

SEQ ID NO: 540084 - DNA, 20 bp, Artificial
  CRISPR gRNA sequence
caagaaaaagtacagaattc

SEQ ID NO: 540085 - DNA, 20 bp, Artificial
  CRISPR gRNA sequence
aagaaaaagtacagaattca

SEQ ID NO: 540086 - DNA, 20 bp, Artificial
  CRISPR gRNA sequence
agaaaaagtacagaattcaa

SEQ ID NO: 540087 - DNA, 20 bp, Artificial
  CRISPR gRNA sequence
gaaaaagtacagaattcaag

SEQ ID NO: 540088 - DNA, 20 bp, Artificial
  CRISPR gRNA sequence
aagtacagaattcaaggggt

SEQ ID NO: 540089 - DNA, 20 bp, Artificial
  CRISPR gRNA sequence
gtacagaattcaaggggtga

SEQ ID NO: 540090 - DNA, 20 bp, Artificial
  CRISPR gRNA sequence
tgagagtctaccacacacaa

SEQ ID NO: 540091 - DNA, 20 bp, Artificial
  CRISPR gRNA sequence
gagtctaccacacacaatag

SEQ ID NO: 540092 - DNA, 20 bp, Artificial
  CRISPR gRNA sequence
ataaatgtaaatgaaacaat

SEQ ID NO: 540093 - DNA, 20 bp, Artificial
  CRISPR gRNA sequence
gtaaatgaaacaatgagtga

SEQ ID NO: 540094 - DNA, 20 bp, Artificial
  CRISPR gRNA sequence
aaatgaaacaatgagtgata

SEQ ID NO: 540095 - DNA, 20 bp, Artificial
  CRISPR gRNA sequence
aatgaaacaatgagtgatag

SEQ ID NO: 540096 - DNA, 20 bp, Artificial
  CRISPR gRNA sequence
atgaaacaatgagtgataga

SEQ ID NO: 540097 - DNA, 20 bp, Artificial
  CRISPR gRNA sequence
aaacaatgagtgatagaggg

SEQ ID NO: 540098 - DNA, 20 bp, Artificial
  CRISPR gRNA sequence
aacaatgagtgatagagggc

SEQ ID NO: 540099 - DNA, 20 bp, Artificial
  CRISPR gRNA sequence
acaatgagtgatagagggca

SEQ ID NO: 540100 - DNA, 20 bp, Artificial
  CRISPR gRNA sequence
atgagtgatagagggcaggg

SEQ ID NO: 540101 - DNA, 20 bp, Artificial
  CRISPR gRNA sequence
agtgatagagggcagggtgg

SEQ ID NO: 540102 - DNA, 20 bp, Artificial
  CRISPR gRNA sequence
agagggcagggtggtggtga

SEQ ID NO: 540103 - DNA, 20 bp, Artificial
  CRISPR gRNA sequence
agggcagggtggtggtgaaa

SEQ ID NO: 540104 - DNA, 20 bp, Artificial
  CRISPR gRNA sequence
gcagggtggtggtgaaagag

SEQ ID NO: 540105 - DNA, 20 bp, Artificial
  CRISPR gRNA sequence
cagggtggtggtgaaagagt

SEQ ID NO: 540106 - DNA, 20 bp, Artificial
  CRISPR gRNA sequence
ggtggtgaaagagtaggtat

SEQ ID NO: 540107 - DNA, 20 bp, Artificial
  CRISPR gRNA sequence
tgagataaactgccataccc

SEQ ID NO: 540108 - DNA, 20 bp, Artificial
  CRISPR gRNA sequence
gataaactgccataccctgg

SEQ ID NO: 540109 - DNA, 20 bp, Artificial
  CRISPR gRNA sequence
tgccataccctggcggcatg

SEQ ID NO: 540110 - DNA, 20 bp, Artificial
  CRISPR gRNA sequence
aagatgtcttttgtctttcc

SEQ ID NO: 540111 - DNA, 20 bp, Artificial
  CRISPR gRNA sequence
agatgtcttttgtctttccc

SEQ ID NO: 540112 - DNA, 20 bp, Artificial
  CRISPR gRNA sequence
gatgtcttttgtctttccca

SEQ ID NO: 540113 - DNA, 20 bp, Artificial
  CRISPR gRNA sequence
tgtcttttgtctttcccagg

SEQ ID NO: 540114 - DNA, 20 bp, Artificial
  CRISPR gRNA sequence
tcttttgtctttcccaggga

SEQ ID NO: 540115 - DNA, 20 bp, Artificial
  CRISPR gRNA sequence
cagggagagctgatgtatcc

SEQ ID NO: 540116 - DNA, 20 bp, Artificial
  CRISPR gRNA sequence
agggagagctgatgtatcct

SEQ ID NO: 540117 - DNA, 20 bp, Artificial
  CRISPR gRNA sequence
agctgatgtatcctgggctt

SEQ ID NO: 540118 - DNA, 20 bp, Artificial
  CRISPR gRNA sequence
atgtatcctgggcttgagaa

SEQ ID NO: 540119 - DNA, 20 bp, Artificial
  CRISPR gRNA sequence
tatcctgggcttgagaacag

SEQ ID NO: 540120 - DNA, 20 bp, Artificial
  CRISPR gRNA sequence
cctgggcttgagaacagtag

SEQ ID NO: 540121 - DNA, 20 bp, Artificial
  CRISPR gRNA sequence
ggcttgagaacagtagaaga

SEQ ID NO: 540122 - DNA, 20 bp, Artificial
  CRISPR gRNA sequence
ttgagaacagtagaagaaag

SEQ ID NO: 540123 - DNA, 20 bp, Artificial
  CRISPR gRNA sequence
gaacagtagaagaaagtagt

SEQ ID NO: 540124 - DNA, 20 bp, Artificial
  CRISPR gRNA sequence
aacagtagaagaaagtagtc

SEQ ID NO: 540125 - DNA, 20 bp, Artificial
  CRISPR gRNA sequence
tagaagaaagtagtcaggaa

SEQ ID NO: 540126 - DNA, 20 bp, Artificial
  CRISPR gRNA sequence
gaagaaagtagtcaggaatg

SEQ ID NO: 540127 - DNA, 20 bp, Artificial
  CRISPR gRNA sequence
aaagtagtcaggaatggagc

SEQ ID NO: 540128 - DNA, 20 bp, Artificial
  CRISPR gRNA sequence
gtagtcaggaatggagctag

SEQ ID NO: 540129 - DNA, 20 bp, Artificial
  CRISPR gRNA sequence
gtcaggaatggagctagtgg

SEQ ID NO: 540130 - DNA, 20 bp, Artificial
  CRISPR gRNA sequence
caggaatggagctagtggtg

SEQ ID NO: 540131 - DNA, 20 bp, Artificial
  CRISPR gRNA sequence
aggaatggagctagtggtgg

SEQ ID NO: 540132 - DNA, 20 bp, Artificial
  CRISPR gRNA sequence
ggaatggagctagtggtgga

SEQ ID NO: 540133 - DNA, 20 bp, Artificial
  CRISPR gRNA sequence
atggagctagtggtggaggg

SEQ ID NO: 540134 - DNA, 20 bp, Artificial
  CRISPR gRNA sequence
agctagtggtggagggaagt

SEQ ID NO: 540135 - DNA, 20 bp, Artificial
  CRISPR gRNA sequence
gctagtggtggagggaagtg

SEQ ID NO: 540136 - DNA, 20 bp, Artificial
  CRISPR gRNA sequence
ctagtggtggagggaagtga

SEQ ID NO: 540137 - DNA, 20 bp, Artificial
  CRISPR gRNA sequence
gtggtggagggaagtgaggg

SEQ ID NO: 540138 - DNA, 20 bp, Artificial
  CRISPR gRNA sequence
ggtggagggaagtgagggta

SEQ ID NO: 540139 - DNA, 20 bp, Artificial
  CRISPR gRNA sequence
gagggaagtgagggtagaga

SEQ ID NO: 540140 - DNA, 20 bp, Artificial
  CRISPR gRNA sequence
agggaagtgagggtagagaa

SEQ ID NO: 540141 - DNA, 20 bp, Artificial
  CRISPR gRNA sequence
gggaagtgagggtagagaaa

SEQ ID NO: 540142 - DNA, 20 bp, Artificial
  CRISPR gRNA sequence
ggaagtgagggtagagaaag

SEQ ID NO: 540143 - DNA, 20 bp, Artificial
  CRISPR gRNA sequence
aagtgagggtagagaaaggg

SEQ ID NO: 540144 - DNA, 20 bp, Artificial
  CRISPR gRNA sequence
ggtagagaaaggggagactg

SEQ ID NO: 540145 - DNA, 20 bp, Artificial
  CRISPR gRNA sequence
agaaaggggagactgcagct

SEQ ID NO: 540146 - DNA, 20 bp, Artificial
  CRISPR gRNA sequence
aaggggagactgcagctcag

SEQ ID NO: 540147 - DNA, 20 bp, Artificial
  CRISPR gRNA sequence
ctgcagctcagaagaaatca

SEQ ID NO: 540148 - DNA, 20 bp, Artificial
  CRISPR gRNA sequence
gctcagaagaaatcaaagta

SEQ ID NO: 540149 - DNA, 20 bp, Artificial
  CRISPR gRNA sequence
cagttgacccttgaacaaca

SEQ ID NO: 540150 - DNA, 20 bp, Artificial
  CRISPR gRNA sequence
agttgacccttgaacaacat

SEQ ID NO: 540151 - DNA, 20 bp, Artificial
  CRISPR gRNA sequence
cccttgaacaacatgggttt

SEQ ID NO: 540152 - DNA, 20 bp, Artificial
  CRISPR gRNA sequence
caacatgggtttgagctgtg

SEQ ID NO: 540153 - DNA, 20 bp, Artificial
  CRISPR gRNA sequence
aacatgggtttgagctgtgt

SEQ ID NO: 540154 - DNA, 20 bp, Artificial
  CRISPR gRNA sequence
tgtgtgggtccacttacatg

SEQ ID NO: 540155 - DNA, 20 bp, Artificial
  CRISPR gRNA sequence
cttccgcctctgccatccct

SEQ ID NO: 540156 - DNA, 20 bp, Artificial
  CRISPR gRNA sequence
cgcctctgccatccctgaga

SEQ ID NO: 540157 - DNA, 20 bp, Artificial
  CRISPR gRNA sequence
tctgccatccctgagatagc

SEQ ID NO: 540158 - DNA, 20 bp, Artificial
  CRISPR gRNA sequence
gaccaacccctcctcccact

SEQ ID NO: 540159 - DNA, 20 bp, Artificial
  CRISPR gRNA sequence
acttagcctgctttaacgtg

SEQ ID NO: 540160 - DNA, 20 bp, Artificial
  CRISPR gRNA sequence
tgctttaacgtgaagataat

SEQ ID NO: 540161 - DNA, 20 bp, Artificial
  CRISPR gRNA sequence
gctttaacgtgaagataatg

SEQ ID NO: 540162 - DNA, 20 bp, Artificial
  CRISPR gRNA sequence
acgtgaagataatgaggatg

SEQ ID NO: 540163 - DNA, 20 bp, Artificial
  CRISPR gRNA sequence
tttgatgatccactttcact

SEQ ID NO: 540164 - DNA, 20 bp, Artificial
  CRISPR gRNA sequence
atgatccactttcacttagt

SEQ ID NO: 540165 - DNA, 20 bp, Artificial
  CRISPR gRNA sequence
ttttattactattatctcaa

SEQ ID NO: 540166 - DNA, 20 bp, Artificial
  CRISPR gRNA sequence
tactattatctcaatagttt

SEQ ID NO: 540167 - DNA, 20 bp, Artificial
  CRISPR gRNA sequence
actattatctcaatagtttt

SEQ ID NO: 540168 - DNA, 20 bp, Artificial
  CRISPR gRNA sequence
ctattatctcaatagttttg

SEQ ID NO: 540169 - DNA, 20 bp, Artificial
  CRISPR gRNA sequence
tattatctcaatagttttgg

SEQ ID NO: 540170 - DNA, 20 bp, Artificial
  CRISPR gRNA sequence
tctcaatagttttgggggaa

SEQ ID NO: 540171 - DNA, 20 bp, Artificial
  CRISPR gRNA sequence
ctcaatagttttgggggaac

SEQ ID NO: 540172 - DNA, 20 bp, Artificial
  CRISPR gRNA sequence
ttgggggaacaggtgatgtt

SEQ ID NO: 540173 - DNA, 20 bp, Artificial
  CRISPR gRNA sequence
acaggtgatgtttggttaca

SEQ ID NO: 540174 - DNA, 20 bp, Artificial
  CRISPR gRNA sequence
tgatgtttggttacatggat

SEQ ID NO: 540175 - DNA, 20 bp, Artificial
  CRISPR gRNA sequence
ataagttttttttttttttt

SEQ ID NO: 540176 - DNA, 20 bp, Artificial
  CRISPR gRNA sequence
tttttttttttttagttatt

SEQ ID NO: 540177 - DNA, 20 bp, Artificial
  CRISPR gRNA sequence
ttttttttttttagttattt

SEQ ID NO: 540178 - DNA, 20 bp, Artificial
  CRISPR gRNA sequence
gttatttgggtgtgatttct

SEQ ID NO: 540179 - DNA, 20 bp, Artificial
  CRISPR gRNA sequence
gggtgtgatttctgagattc

SEQ ID NO: 540180 - DNA, 20 bp, Artificial
  CRISPR gRNA sequence
attctggtgtacactgtacc

SEQ ID NO: 540181 - DNA, 20 bp, Artificial
  CRISPR gRNA sequence
tgtacactgtacccagtgtg

SEQ ID NO: 540182 - DNA, 20 bp, Artificial
  CRISPR gRNA sequence
cccatcccacccttctccac

SEQ ID NO: 540183 - DNA, 20 bp, Artificial
  CRISPR gRNA sequence
cccttctccacaagtcccca

SEQ ID NO: 540184 - DNA, 20 bp, Artificial
  CRISPR gRNA sequence
ttcactgtatcattcttaca

SEQ ID NO: 540185 - DNA, 20 bp, Artificial
  CRISPR gRNA sequence
tgtatcattcttacatagct

SEQ ID NO: 540186 - DNA, 20 bp, Artificial
  CRISPR gRNA sequence
atagcttagctcccacttgt

SEQ ID NO: 540187 - DNA, 20 bp, Artificial
  CRISPR gRNA sequence
cttagctcccacttgtaagt

SEQ ID NO: 540188 - DNA, 20 bp, Artificial
  CRISPR gRNA sequence
tgtaagttagaacatatgtt

SEQ ID NO: 540189 - DNA, 20 bp, Artificial
  CRISPR gRNA sequence
atgtttggttttccattcct

SEQ ID NO: 540190 - DNA, 20 bp, Artificial
  CRISPR gRNA sequence
cattcctgagttacttcact

SEQ ID NO: 540191 - DNA, 20 bp, Artificial
  CRISPR gRNA sequence
agttacttcacttagaataa

SEQ ID NO: 540192 - DNA, 20 bp, Artificial
  CRISPR gRNA sequence
tcacttagaataatggtctc

SEQ ID NO: 540193 - DNA, 20 bp, Artificial
  CRISPR gRNA sequence
taatggtctccagttccatc

SEQ ID NO: 540194 - DNA, 20 bp, Artificial
  CRISPR gRNA sequence
aatggtctccagttccatcc

SEQ ID NO: 540195 - DNA, 20 bp, Artificial
  CRISPR gRNA sequence
tttttttttttttttctttt

SEQ ID NO: 540196 - DNA, 20 bp, Artificial
  CRISPR gRNA sequence
tttttttttttcttttgaga

SEQ ID NO: 540197 - DNA, 20 bp, Artificial
  CRISPR gRNA sequence
tttttttttcttttgagaca

SEQ ID NO: 540198 - DNA, 20 bp, Artificial
  CRISPR gRNA sequence
acagagtctcgctctgtccc

SEQ ID NO: 540199 - DNA, 20 bp, Artificial
  CRISPR gRNA sequence
cagagtctcgctctgtcccc

SEQ ID NO: 540200 - DNA, 20 bp, Artificial
  CRISPR gRNA sequence
gtctcgctctgtccccaggc

SEQ ID NO: 540201 - DNA, 20 bp, Artificial
  CRISPR gRNA sequence
ctcgctctgtccccaggctg

SEQ ID NO: 540202 - DNA, 20 bp, Artificial
  CRISPR gRNA sequence
tctgtccccaggctggagtg

SEQ ID NO: 540203 - DNA, 20 bp, Artificial
  CRISPR gRNA sequence
gtccccaggctggagtgcag

SEQ ID NO: 540204 - DNA, 20 bp, Artificial
  CRISPR gRNA sequence
ggagtgcagtggcgtgatct

SEQ ID NO: 540205 - DNA, 20 bp, Artificial
  CRISPR gRNA sequence
gcgtgatctcggctcactaa

SEQ ID NO: 540206 - DNA, 20 bp, Artificial
  CRISPR gRNA sequence
tcactaaaagttccacctcc

SEQ ID NO: 540207 - DNA, 20 bp, Artificial
  CRISPR gRNA sequence
cactaaaagttccacctccc

SEQ ID NO: 540208 - DNA, 20 bp, Artificial
  CRISPR gRNA sequence
ctcacgccattctcctgcct

SEQ ID NO: 540209 - DNA, 20 bp, Artificial
  CRISPR gRNA sequence
ttctcctgcctcagcctcct

SEQ ID NO: 540210 - DNA, 20 bp, Artificial
  CRISPR gRNA sequence
tcctgcctcagcctcctgag

SEQ ID NO: 540211 - DNA, 20 bp, Artificial
  CRISPR gRNA sequence
gcctcagcctcctgagtagc

SEQ ID NO: 540212 - DNA, 20 bp, Artificial
  CRISPR gRNA sequence
cctcagcctcctgagtagct

SEQ ID NO: 540213 - DNA, 20 bp, Artificial
  CRISPR gRNA sequence
ctcctgagtagctgggacta

SEQ ID NO: 540214 - DNA, 20 bp, Artificial
  CRISPR gRNA sequence
tcctgagtagctgggactac

SEQ ID NO: 540215 - DNA, 20 bp, Artificial
  CRISPR gRNA sequence
caggcgcccaccaccatgcc

SEQ ID NO: 540216 - DNA, 20 bp, Artificial
  CRISPR gRNA sequence
taattttttttttgtatttt

SEQ ID NO: 540217 - DNA, 20 bp, Artificial
  CRISPR gRNA sequence
ttttttttgtatttttagta

SEQ ID NO: 540218 - DNA, 20 bp, Artificial
  CRISPR gRNA sequence
ttttgtatttttagtaaaga

SEQ ID NO: 540219 - DNA, 20 bp, Artificial
  CRISPR gRNA sequence
tttgtatttttagtaaagac

SEQ ID NO: 540220 - DNA, 20 bp, Artificial
  CRISPR gRNA sequence
ttgtatttttagtaaagacg

SEQ ID NO: 540221 - DNA, 20 bp, Artificial
  CRISPR gRNA sequence
aagacggggtttcaccatgt

SEQ ID NO: 540222 - DNA, 20 bp, Artificial
  CRISPR gRNA sequence
cggggtttcaccatgttagc

SEQ ID NO: 540223 - DNA, 20 bp, Artificial
  CRISPR gRNA sequence
ggggtttcaccatgttagcc

SEQ ID NO: 540224 - DNA, 20 bp, Artificial
  CRISPR gRNA sequence
tttcaccatgttagccagga

SEQ ID NO: 540225 - DNA, 20 bp, Artificial
  CRISPR gRNA sequence
acctcgtgatctgcccgcct

SEQ ID NO: 540226 - DNA, 20 bp, Artificial
  CRISPR gRNA sequence
ctgcccgccttggcctccca

SEQ ID NO: 540227 - DNA, 20 bp, Artificial
  CRISPR gRNA sequence
gccttggcctcccaaagtgc

SEQ ID NO: 540228 - DNA, 20 bp, Artificial
  CRISPR gRNA sequence
ccttggcctcccaaagtgct

SEQ ID NO: 540229 - DNA, 20 bp, Artificial
  CRISPR gRNA sequence
ctcccaaagtgctgggatta

SEQ ID NO: 540230 - DNA, 20 bp, Artificial
  CRISPR gRNA sequence
agtgctgggattacagacac

SEQ ID NO: 540231 - DNA, 20 bp, Artificial
  CRISPR gRNA sequence
cagacacgagccaccgcgcc

SEQ ID NO: 540232 - DNA, 20 bp, Artificial
  CRISPR gRNA sequence
gcctattatgttccttttta

SEQ ID NO: 540233 - DNA, 20 bp, Artificial
  CRISPR gRNA sequence
tttatccactcattgattga

SEQ ID NO: 540234 - DNA, 20 bp, Artificial
  CRISPR gRNA sequence
ttatccactcattgattgat

SEQ ID NO: 540235 - DNA, 20 bp, Artificial
  CRISPR gRNA sequence
ttccatatttttgcaattgc

SEQ ID NO: 540236 - DNA, 20 bp, Artificial
  CRISPR gRNA sequence
ttgcgagttgtgccactata

SEQ ID NO: 540237 - DNA, 20 bp, Artificial
  CRISPR gRNA sequence
taaaatgacttgttttcctc

SEQ ID NO: 540238 - DNA, 20 bp, Artificial
  CRISPR gRNA sequence
aaaatgacttgttttcctct

SEQ ID NO: 540239 - DNA, 20 bp, Artificial
  CRISPR gRNA sequence
atgacttgttttcctctggg

SEQ ID NO: 540240 - DNA, 20 bp, Artificial
  CRISPR gRNA sequence
ttttcctctgggtagatacc

SEQ ID NO: 540241 - DNA, 20 bp, Artificial
  CRISPR gRNA sequence
tctgggtagatacccagtaa

SEQ ID NO: 540242 - DNA, 20 bp, Artificial
  CRISPR gRNA sequence
ctgggtagatacccagtaat

SEQ ID NO: 540243 - DNA, 20 bp, Artificial
  CRISPR gRNA sequence
atacccagtaatgggattgc

SEQ ID NO: 540244 - DNA, 20 bp, Artificial
  CRISPR gRNA sequence
aatgggattgctggatcaaa

SEQ ID NO: 540245 - DNA, 20 bp, Artificial
  CRISPR gRNA sequence
gggattgctggatcaaatgg

SEQ ID NO: 540246 - DNA, 20 bp, Artificial
  CRISPR gRNA sequence
tcaaatggtagttctacttt

SEQ ID NO: 540247 - DNA, 20 bp, Artificial
  CRISPR gRNA sequence
agttctacttttagttgctt

SEQ ID NO: 540248 - DNA, 20 bp, Artificial
  CRISPR gRNA sequence
agttgcttaagaaatctcca

SEQ ID NO: 540249 - DNA, 20 bp, Artificial
  CRISPR gRNA sequence
tgcttaagaaatctccatag

SEQ ID NO: 540250 - DNA, 20 bp, Artificial
  CRISPR gRNA sequence
aatctccatagtggttgtac

SEQ ID NO: 540251 - DNA, 20 bp, Artificial
  CRISPR gRNA sequence
gtactagtttacattcccac

SEQ ID NO: 540252 - DNA, 20 bp, Artificial
  CRISPR gRNA sequence
ctagtttacattcccaccag

SEQ ID NO: 540253 - DNA, 20 bp, Artificial
  CRISPR gRNA sequence
acattcccaccagcagtgta

SEQ ID NO: 540254 - DNA, 20 bp, Artificial
  CRISPR gRNA sequence
cattcccaccagcagtgtac

SEQ ID NO: 540255 - DNA, 20 bp, Artificial
  CRISPR gRNA sequence
attttttgatttttaaatta

SEQ ID NO: 540256 - DNA, 20 bp, Artificial
  CRISPR gRNA sequence
ttaaattacggccattcttg

SEQ ID NO: 540257 - DNA, 20 bp, Artificial
  CRISPR gRNA sequence
taaattacggccattcttgc

SEQ ID NO: 540258 - DNA, 20 bp, Artificial
  CRISPR gRNA sequence
aattacggccattcttgcag

SEQ ID NO: 540259 - DNA, 20 bp, Artificial
  CRISPR gRNA sequence
acggccattcttgcaggagt

SEQ ID NO: 540260 - DNA, 20 bp, Artificial
  CRISPR gRNA sequence
cggccattcttgcaggagta

SEQ ID NO: 540261 - DNA, 20 bp, Artificial
  CRISPR gRNA sequence
ccattcttgcaggagtaagg

SEQ ID NO: 540262 - DNA, 20 bp, Artificial
  CRISPR gRNA sequence
agtaaggtggtattgcattg

SEQ ID NO: 540263 - DNA, 20 bp, Artificial
  CRISPR gRNA sequence
atttgcatttccctgataat

SEQ ID NO: 540264 - DNA, 20 bp, Artificial
  CRISPR gRNA sequence
ccctgataattagtaatgtt

SEQ ID NO: 540265 - DNA, 20 bp, Artificial
  CRISPR gRNA sequence
gcattttttcatatgtttgt

SEQ ID NO: 540266 - DNA, 20 bp, Artificial
  CRISPR gRNA sequence
ccatttgtatatcctccttt

SEQ ID NO: 540267 - DNA, 20 bp, Artificial
  CRISPR gRNA sequence
gaactgtctattcatgtcct

SEQ ID NO: 540268 - DNA, 20 bp, Artificial
  CRISPR gRNA sequence
gtccttggcccactttttga

SEQ ID NO: 540269 - DNA, 20 bp, Artificial
  CRISPR gRNA sequence
tccttggcccactttttgat

SEQ ID NO: 540270 - DNA, 20 bp, Artificial
  CRISPR gRNA sequence
tgatttgtttgacttcctta

SEQ ID NO: 540271 - DNA, 20 bp, Artificial
  CRISPR gRNA sequence
tttgacttccttatagattc

SEQ ID NO: 540272 - DNA, 20 bp, Artificial
  CRISPR gRNA sequence
tccttatagattctggatat

SEQ ID NO: 540273 - DNA, 20 bp, Artificial
  CRISPR gRNA sequence
tctggatattggtcctttgt

SEQ ID NO: 540274 - DNA, 20 bp, Artificial
  CRISPR gRNA sequence
ttggtcctttgtcagataca

SEQ ID NO: 540275 - DNA, 20 bp, Artificial
  CRISPR gRNA sequence
gaatattttctcccactttg

SEQ ID NO: 540276 - DNA, 20 bp, Artificial
  CRISPR gRNA sequence
aatattttctcccactttgt

SEQ ID NO: 540277 - DNA, 20 bp, Artificial
  CRISPR gRNA sequence
tgattgtttatattgctgta

SEQ ID NO: 540278 - DNA, 20 bp, Artificial
  CRISPR gRNA sequence
ttgtttatattgctgtacag

SEQ ID NO: 540279 - DNA, 20 bp, Artificial
  CRISPR gRNA sequence
gtacagaagctttttaattt

SEQ ID NO: 540280 - DNA, 20 bp, Artificial
  CRISPR gRNA sequence
gtttttgttgcatttgtttt

SEQ ID NO: 540281 - DNA, 20 bp, Artificial
  CRISPR gRNA sequence
tttttgttgcatttgttttt

SEQ ID NO: 540282 - DNA, 20 bp, Artificial
  CRISPR gRNA sequence
tgcatttgtttttgggttct

SEQ ID NO: 540283 - DNA, 20 bp, Artificial
  CRISPR gRNA sequence
ttggtcatgaccttttgcct

SEQ ID NO: 540284 - DNA, 20 bp, Artificial
  CRISPR gRNA sequence
atgaccttttgcctaagcca

SEQ ID NO: 540285 - DNA, 20 bp, Artificial
  CRISPR gRNA sequence
cttttgcctaagccaaagtc

SEQ ID NO: 540286 - DNA, 20 bp, Artificial
  CRISPR gRNA sequence
ttgcctaagccaaagtctag

SEQ ID NO: 540287 - DNA, 20 bp, Artificial
  CRISPR gRNA sequence
gcctaagccaaagtctagaa

SEQ ID NO: 540288 - DNA, 20 bp, Artificial
  CRISPR gRNA sequence
gtttttctgatgttatcttc

SEQ ID NO: 540289 - DNA, 20 bp, Artificial
  CRISPR gRNA sequence
gttatcttctagaattttta

SEQ ID NO: 540290 - DNA, 20 bp, Artificial
  CRISPR gRNA sequence
ttctagaatttttatggctt

SEQ ID NO: 540291 - DNA, 20 bp, Artificial
  CRISPR gRNA sequence
tctagaatttttatggcttc

SEQ ID NO: 540292 - DNA, 20 bp, Artificial
  CRISPR gRNA sequence
atttttatggcttcaggtct

SEQ ID NO: 540293 - DNA, 20 bp, Artificial
  CRISPR gRNA sequence
tggcttcaggtcttagattt

SEQ ID NO: 540294 - DNA, 20 bp, Artificial
  CRISPR gRNA sequence
ttaagtttttgatccacctt

SEQ ID NO: 540295 - DNA, 20 bp, Artificial
  CRISPR gRNA sequence
ccttgagttgatttttatat

SEQ ID NO: 540296 - DNA, 20 bp, Artificial
  CRISPR gRNA sequence
cttgagttgatttttatata

SEQ ID NO: 540297 - DNA, 20 bp, Artificial
  CRISPR gRNA sequence
ttgatttttatataaggtga

SEQ ID NO: 540298 - DNA, 20 bp, Artificial
  CRISPR gRNA sequence
ttttatataaggtgaaagat

SEQ ID NO: 540299 - DNA, 20 bp, Artificial
  CRISPR gRNA sequence
tttatataaggtgaaagatg

SEQ ID NO: 540300 - DNA, 20 bp, Artificial
  CRISPR gRNA sequence
taaggtgaaagatgaggatc

SEQ ID NO: 540301 - DNA, 20 bp, Artificial
  CRISPR gRNA sequence
caccttatgcttttcctaat

SEQ ID NO: 540302 - DNA, 20 bp, Artificial
  CRISPR gRNA sequence
tcctaataagttcttttctc

SEQ ID NO: 540303 - DNA, 20 bp, Artificial
  CRISPR gRNA sequence
ttcttttctctagcttaatt

SEQ ID NO: 540304 - DNA, 20 bp, Artificial
  CRISPR gRNA sequence
tctctagcttaatttagtgt

SEQ ID NO: 540305 - DNA, 20 bp, Artificial
  CRISPR gRNA sequence
aacatgcaatgcatataaca

SEQ ID NO: 540306 - DNA, 20 bp, Artificial
  CRISPR gRNA sequence
atatgtgttgtttatgttat

SEQ ID NO: 540307 - DNA, 20 bp, Artificial
  CRISPR gRNA sequence
gtgttgtttatgttattggt

SEQ ID NO: 540308 - DNA, 20 bp, Artificial
  CRISPR gRNA sequence
tgttgtttatgttattggta

SEQ ID NO: 540309 - DNA, 20 bp, Artificial
  CRISPR gRNA sequence
tatgttattggtaaggcttc

SEQ ID NO: 540310 - DNA, 20 bp, Artificial
  CRISPR gRNA sequence
gttattggtaaggcttctgg

SEQ ID NO: 540311 - DNA, 20 bp, Artificial
  CRISPR gRNA sequence
ttattggtaaggcttctggt

SEQ ID NO: 540312 - DNA, 20 bp, Artificial
  CRISPR gRNA sequence
taaggcttctggtaggctat

SEQ ID NO: 540313 - DNA, 20 bp, Artificial
  CRISPR gRNA sequence
ggcttctggtaggctattag

SEQ ID NO: 540314 - DNA, 20 bp, Artificial
  CRISPR gRNA sequence
ctggtaggctattagcagtt

SEQ ID NO: 540315 - DNA, 20 bp, Artificial
  CRISPR gRNA sequence
gctattagcagttaagtttt

SEQ ID NO: 540316 - DNA, 20 bp, Artificial
  CRISPR gRNA sequence
ctattagcagttaagttttt

SEQ ID NO: 540317 - DNA, 20 bp, Artificial
  CRISPR gRNA sequence
attagcagttaagtttttgg

SEQ ID NO: 540318 - DNA, 20 bp, Artificial
  CRISPR gRNA sequence
cagttaagtttttgggagtc

SEQ ID NO: 540319 - DNA, 20 bp, Artificial
  CRISPR gRNA sequence
gttaagtttttgggagtcaa

SEQ ID NO: 540320 - DNA, 20 bp, Artificial
  CRISPR gRNA sequence
acataaatttttgactgctc

SEQ ID NO: 540321 - DNA, 20 bp, Artificial
  CRISPR gRNA sequence
cataaatttttgactgctca

SEQ ID NO: 540322 - DNA, 20 bp, Artificial
  CRISPR gRNA sequence
ataaatttttgactgctcaa

SEQ ID NO: 540323 - DNA, 20 bp, Artificial
  CRISPR gRNA sequence
taaatttttgactgctcaag

SEQ ID NO: 540324 - DNA, 20 bp, Artificial
  CRISPR gRNA sequence
tttttgactgctcaaggggt

SEQ ID NO: 540325 - DNA, 20 bp, Artificial
  CRISPR gRNA sequence
ccctaattgccatgttgttc

SEQ ID NO: 540326 - DNA, 20 bp, Artificial
  CRISPR gRNA sequence
cctaattgccatgttgttca

SEQ ID NO: 540327 - DNA, 20 bp, Artificial
  CRISPR gRNA sequence
ctaattgccatgttgttcaa

SEQ ID NO: 540328 - DNA, 20 bp, Artificial
  CRISPR gRNA sequence
ggtcaactataattttgaac

SEQ ID NO: 540329 - DNA, 20 bp, Artificial
  CRISPR gRNA sequence
caactataattttgaactag

SEQ ID NO: 540330 - DNA, 20 bp, Artificial
  CRISPR gRNA sequence
aagaaactctaaaaattatt

SEQ ID NO: 540331 - DNA, 20 bp, Artificial
  CRISPR gRNA sequence
tcaaattactcccatttcac

SEQ ID NO: 540332 - DNA, 20 bp, Artificial
  CRISPR gRNA sequence
ttactcccatttcactggtg

SEQ ID NO: 540333 - DNA, 20 bp, Artificial
  CRISPR gRNA sequence
catttcactggtgaagtgac

SEQ ID NO: 540334 - DNA, 20 bp, Artificial
  CRISPR gRNA sequence
tggtgaagtgacaagacacc

SEQ ID NO: 540335 - DNA, 20 bp, Artificial
  CRISPR gRNA sequence
caagacaccaagaaaaatat

SEQ ID NO: 540336 - DNA, 20 bp, Artificial
  CRISPR gRNA sequence
aagacaccaagaaaaatata

SEQ ID NO: 540337 - DNA, 20 bp, Artificial
  CRISPR gRNA sequence
attgaatgcttactctctgc

SEQ ID NO: 540338 - DNA, 20 bp, Artificial
  CRISPR gRNA sequence
tccctctccatgtctacctg

SEQ ID NO: 540339 - DNA, 20 bp, Artificial
  CRISPR gRNA sequence
ctctccatgtctacctgcag

SEQ ID NO: 540340 - DNA, 20 bp, Artificial
  CRISPR gRNA sequence
tctccatgtctacctgcagt

SEQ ID NO: 540341 - DNA, 20 bp, Artificial
  CRISPR gRNA sequence
ggtgttattaaccccattta

SEQ ID NO: 540342 - DNA, 20 bp, Artificial
  CRISPR gRNA sequence
gtgttattaaccccatttac

SEQ ID NO: 540343 - DNA, 20 bp, Artificial
  CRISPR gRNA sequence
ttattaaccccatttacagg

SEQ ID NO: 540344 - DNA, 20 bp, Artificial
  CRISPR gRNA sequence
tattaaccccatttacaggt

SEQ ID NO: 540345 - DNA, 20 bp, Artificial
  CRISPR gRNA sequence
aaccccatttacaggtagga

SEQ ID NO: 540346 - DNA, 20 bp, Artificial
  CRISPR gRNA sequence
cccatttacaggtaggaaag

SEQ ID NO: 540347 - DNA, 20 bp, Artificial
  CRISPR gRNA sequence
ccatttacaggtaggaaagc

SEQ ID NO: 540348 - DNA, 20 bp, Artificial
  CRISPR gRNA sequence
caggtaggaaagcaggctcc

SEQ ID NO: 540349 - DNA, 20 bp, Artificial
  CRISPR gRNA sequence
ggtaggaaagcaggctccaa

SEQ ID NO: 540350 - DNA, 20 bp, Artificial
  CRISPR gRNA sequence
gtaggaaagcaggctccaag

SEQ ID NO: 540351 - DNA, 20 bp, Artificial
  CRISPR gRNA sequence
tcaccttgctccatgtctct

SEQ ID NO: 540352 - DNA, 20 bp, Artificial
  CRISPR gRNA sequence
cttgctccatgtctctcagc

SEQ ID NO: 540353 - DNA, 20 bp, Artificial
  CRISPR gRNA sequence
catgtctctcagcaagttta

SEQ ID NO: 540354 - DNA, 20 bp, Artificial
  CRISPR gRNA sequence
gtctctcagcaagtttatgg

SEQ ID NO: 540355 - DNA, 20 bp, Artificial
  CRISPR gRNA sequence
gtttatggcggcacaatgac

SEQ ID NO: 540356 - DNA, 20 bp, Artificial
  CRISPR gRNA sequence
acacacattgtctgactcct

SEQ ID NO: 540357 - DNA, 20 bp, Artificial
  CRISPR gRNA sequence
acattgtctgactccttggt

SEQ ID NO: 540358 - DNA, 20 bp, Artificial
  CRISPR gRNA sequence
ctccttggtcagtgcccttt

SEQ ID NO: 540359 - DNA, 20 bp, Artificial
  CRISPR gRNA sequence
tggtcagtgccctttcagaa

SEQ ID NO: 540360 - DNA, 20 bp, Artificial
  CRISPR gRNA sequence
agtgccctttcagaacagcg

SEQ ID NO: 540361 - DNA, 20 bp, Artificial
  CRISPR gRNA sequence
gaacagcgtggtcccacatt

SEQ ID NO: 540362 - DNA, 20 bp, Artificial
  CRISPR gRNA sequence
aacagcgtggtcccacattc

SEQ ID NO: 540363 - DNA, 20 bp, Artificial
  CRISPR gRNA sequence
gcgtggtcccacattcagga

SEQ ID NO: 540364 - DNA, 20 bp, Artificial
  CRISPR gRNA sequence
cgtggtcccacattcaggat

SEQ ID NO: 540365 - DNA, 20 bp, Artificial
  CRISPR gRNA sequence
gattcatttattcattcact

SEQ ID NO: 540366 - DNA, 20 bp, Artificial
  CRISPR gRNA sequence
attcatttattcattcactc

SEQ ID NO: 540367 - DNA, 20 bp, Artificial
  CRISPR gRNA sequence
ttcactcaggaaatattcat

SEQ ID NO: 540368 - DNA, 20 bp, Artificial
  CRISPR gRNA sequence
tcactcaggaaatattcatt

SEQ ID NO: 540369 - DNA, 20 bp, Artificial
  CRISPR gRNA sequence
attgggcatctattctatat

SEQ ID NO: 540370 - DNA, 20 bp, Artificial
  CRISPR gRNA sequence
ctattctatataagatcctt

SEQ ID NO: 540371 - DNA, 20 bp, Artificial
  CRISPR gRNA sequence
tatataagatccttgagaac

SEQ ID NO: 540372 - DNA, 20 bp, Artificial
  CRISPR gRNA sequence
taagatccttgagaacaaga

SEQ ID NO: 540373 - DNA, 20 bp, Artificial
  CRISPR gRNA sequence
agacaccgtcccttccttct

SEQ ID NO: 540374 - DNA, 20 bp, Artificial
  CRISPR gRNA sequence
acaccgtcccttccttctta

SEQ ID NO: 540375 - DNA, 20 bp, Artificial
  CRISPR gRNA sequence
tcttagagttgacattctat

SEQ ID NO: 540376 - DNA, 20 bp, Artificial
  CRISPR gRNA sequence
cttagagttgacattctatt

SEQ ID NO: 540377 - DNA, 20 bp, Artificial
  CRISPR gRNA sequence
ttagagttgacattctatta

SEQ ID NO: 540378 - DNA, 20 bp, Artificial
  CRISPR gRNA sequence
tagagttgacattctattag

SEQ ID NO: 540379 - DNA, 20 bp, Artificial
  CRISPR gRNA sequence
gagttgacattctattaggg

SEQ ID NO: 540380 - DNA, 20 bp, Artificial
  CRISPR gRNA sequence
agttgacattctattagggg

SEQ ID NO: 540381 - DNA, 20 bp, Artificial
  CRISPR gRNA sequence
tgacattctattaggggagg

SEQ ID NO: 540382 - DNA, 20 bp, Artificial
  CRISPR gRNA sequence
gcagaatttacacaaataat

SEQ ID NO: 540383 - DNA, 20 bp, Artificial
  CRISPR gRNA sequence
caactgtgataattgctgct

SEQ ID NO: 540384 - DNA, 20 bp, Artificial
  CRISPR gRNA sequence
tgataattgctgctaagtaa

SEQ ID NO: 540385 - DNA, 20 bp, Artificial
  CRISPR gRNA sequence
ttgctgctaagtaaaagcat

SEQ ID NO: 540386 - DNA, 20 bp, Artificial
  CRISPR gRNA sequence
tgctgctaagtaaaagcatc

SEQ ID NO: 540387 - DNA, 20 bp, Artificial
  CRISPR gRNA sequence
taaaagcatcaggtgtcaat

SEQ ID NO: 540388 - DNA, 20 bp, Artificial
  CRISPR gRNA sequence
tgtcaataagaacatttact

SEQ ID NO: 540389 - DNA, 20 bp, Artificial
  CRISPR gRNA sequence
gtcaataagaacatttactt

SEQ ID NO: 540390 - DNA, 20 bp, Artificial
  CRISPR gRNA sequence
tcaataagaacatttactta

SEQ ID NO: 540391 - DNA, 20 bp, Artificial
  CRISPR gRNA sequence
catttacttagggaactaac

SEQ ID NO: 540392 - DNA, 20 bp, Artificial
  CRISPR gRNA sequence
atttacttagggaactaaca

SEQ ID NO: 540393 - DNA, 20 bp, Artificial
  CRISPR gRNA sequence
tttacttagggaactaacaa

SEQ ID NO: 540394 - DNA, 20 bp, Artificial
  CRISPR gRNA sequence
ttacttagggaactaacaag

SEQ ID NO: 540395 - DNA, 20 bp, Artificial
  CRISPR gRNA sequence
ttagggaactaacaaggggt

SEQ ID NO: 540396 - DNA, 20 bp, Artificial
  CRISPR gRNA sequence
tagggaactaacaaggggtt

SEQ ID NO: 540397 - DNA, 20 bp, Artificial
  CRISPR gRNA sequence
agggaactaacaaggggtta

SEQ ID NO: 540398 - DNA, 20 bp, Artificial
  CRISPR gRNA sequence
gaactaacaaggggttaggg

SEQ ID NO: 540399 - DNA, 20 bp, Artificial
  CRISPR gRNA sequence
aactaacaaggggttaggga

SEQ ID NO: 540400 - DNA, 20 bp, Artificial
  CRISPR gRNA sequence
taacaaggggttagggaagg

SEQ ID NO: 540401 - DNA, 20 bp, Artificial
  CRISPR gRNA sequence
aaggcagttcccttccctaa

SEQ ID NO: 540402 - DNA, 20 bp, Artificial
  CRISPR gRNA sequence
gcagttcccttccctaaaag

SEQ ID NO: 540403 - DNA, 20 bp, Artificial
  CRISPR gRNA sequence
ccttccctaaaagaagttct

SEQ ID NO: 540404 - DNA, 20 bp, Artificial
  CRISPR gRNA sequence
cttccctaaaagaagttctg

SEQ ID NO: 540405 - DNA, 20 bp, Artificial
  CRISPR gRNA sequence
taaaagaagttctgaggcac

SEQ ID NO: 540406 - DNA, 20 bp, Artificial
  CRISPR gRNA sequence
aagaagttctgaggcacaag

SEQ ID NO: 540407 - DNA, 20 bp, Artificial
  CRISPR gRNA sequence
aagttctgaggcacaagcag

SEQ ID NO: 540408 - DNA, 20 bp, Artificial
  CRISPR gRNA sequence
aagcagcagttaactatgcc

SEQ ID NO: 540409 - DNA, 20 bp, Artificial
  CRISPR gRNA sequence
agcagcagttaactatgccc

SEQ ID NO: 540410 - DNA, 20 bp, Artificial
  CRISPR gRNA sequence
cagcagttaactatgcccag

SEQ ID NO: 540411 - DNA, 20 bp, Artificial
  CRISPR gRNA sequence
gcagttaactatgcccagga

SEQ ID NO: 540412 - DNA, 20 bp, Artificial
  CRISPR gRNA sequence
gttaactatgcccaggagag

SEQ ID NO: 540413 - DNA, 20 bp, Artificial
  CRISPR gRNA sequence
ttaactatgcccaggagagc

SEQ ID NO: 540414 - DNA, 20 bp, Artificial
  CRISPR gRNA sequence
taactatgcccaggagagca

SEQ ID NO: 540415 - DNA, 20 bp, Artificial
  CRISPR gRNA sequence
ctatgcccaggagagcaggg

SEQ ID NO: 540416 - DNA, 20 bp, Artificial
  CRISPR gRNA sequence
tatgcccaggagagcagggc

SEQ ID NO: 540417 - DNA, 20 bp, Artificial
  CRISPR gRNA sequence
gagcagggcaggtccccatt

SEQ ID NO: 540418 - DNA, 20 bp, Artificial
  CRISPR gRNA sequence
gcagggcaggtccccattaa

SEQ ID NO: 540419 - DNA, 20 bp, Artificial
  CRISPR gRNA sequence
ccattaagagaacaattatg

SEQ ID NO: 540420 - DNA, 20 bp, Artificial
  CRISPR gRNA sequence
gaacaattatgcagaccttg

SEQ ID NO: 540421 - DNA, 20 bp, Artificial
  CRISPR gRNA sequence
caattatgcagaccttgaag

SEQ ID NO: 540422 - DNA, 20 bp, Artificial
  CRISPR gRNA sequence
aattatgcagaccttgaagc

SEQ ID NO: 540423 - DNA, 20 bp, Artificial
  CRISPR gRNA sequence
ttatgcagaccttgaagcag

SEQ ID NO: 540424 - DNA, 20 bp, Artificial
  CRISPR gRNA sequence
agaccttgaagcaggagcaa

SEQ ID NO: 540425 - DNA, 20 bp, Artificial
  CRISPR gRNA sequence
tgaagcaggagcaatggcat

SEQ ID NO: 540426 - DNA, 20 bp, Artificial
  CRISPR gRNA sequence
caggagcaatggcatgagaa

SEQ ID NO: 540427 - DNA, 20 bp, Artificial
  CRISPR gRNA sequence
gagcaatggcatgagaaaag

SEQ ID NO: 540428 - DNA, 20 bp, Artificial
  CRISPR gRNA sequence
tggcatgagaaaagtagcat

SEQ ID NO: 540429 - DNA, 20 bp, Artificial
  CRISPR gRNA sequence
tgagaaaagtagcataagcc

SEQ ID NO: 540430 - DNA, 20 bp, Artificial
  CRISPR gRNA sequence
ataagccgagctgcatacac

SEQ ID NO: 540431 - DNA, 20 bp, Artificial
  CRISPR gRNA sequence
ccgagctgcatacacaagca

SEQ ID NO: 540432 - DNA, 20 bp, Artificial
  CRISPR gRNA sequence
gctgcatacacaagcacagc

SEQ ID NO: 540433 - DNA, 20 bp, Artificial
  CRISPR gRNA sequence
caagcacagccagcccttgc

SEQ ID NO: 540434 - DNA, 20 bp, Artificial
  CRISPR gRNA sequence
aagcacagccagcccttgca

SEQ ID NO: 540435 - DNA, 20 bp, Artificial
  CRISPR gRNA sequence
gcatcaaacaaacacaattc

SEQ ID NO: 540436 - DNA, 20 bp, Artificial
  CRISPR gRNA sequence
caaacacaattctagtattg

SEQ ID NO: 540437 - DNA, 20 bp, Artificial
  CRISPR gRNA sequence
acaattctagtattgaagta

SEQ ID NO: 540438 - DNA, 20 bp, Artificial
  CRISPR gRNA sequence
ttctagtattgaagtaaaga

SEQ ID NO: 540439 - DNA, 20 bp, Artificial
  CRISPR gRNA sequence
tattgaagtaaagaaagcca

SEQ ID NO: 540440 - DNA, 20 bp, Artificial
  CRISPR gRNA sequence
tgaagtaaagaaagccatag

SEQ ID NO: 540441 - DNA, 20 bp, Artificial
  CRISPR gRNA sequence
aagtaaagaaagccatagaa

SEQ ID NO: 540442 - DNA, 20 bp, Artificial
  CRISPR gRNA sequence
agccatagaagagtttcaaa

SEQ ID NO: 540443 - DNA, 20 bp, Artificial
  CRISPR gRNA sequence
gccatagaagagtttcaaac

SEQ ID NO: 540444 - DNA, 20 bp, Artificial
  CRISPR gRNA sequence
tagaagagtttcaaacagga

SEQ ID NO: 540445 - DNA, 20 bp, Artificial
  CRISPR gRNA sequence
agaagagtttcaaacaggat

SEQ ID NO: 540446 - DNA, 20 bp, Artificial
  CRISPR gRNA sequence
gaagagtttcaaacaggatg

SEQ ID NO: 540447 - DNA, 20 bp, Artificial
  CRISPR gRNA sequence
aaacaggatggggacaaaat

SEQ ID NO: 540448 - DNA, 20 bp, Artificial
  CRISPR gRNA sequence
acaggatggggacaaaataa

SEQ ID NO: 540449 - DNA, 20 bp, Artificial
  CRISPR gRNA sequence
tttaaaacataaattataca

SEQ ID NO: 540450 - DNA, 20 bp, Artificial
  CRISPR gRNA sequence
ctaatgaaaaacgatcatat

SEQ ID NO: 540451 - DNA, 20 bp, Artificial
  CRISPR gRNA sequence
cgatcatataagtatttttt

SEQ ID NO: 540452 - DNA, 20 bp, Artificial
  CRISPR gRNA sequence
attttttcagtcctcttatc

SEQ ID NO: 540453 - DNA, 20 bp, Artificial
  CRISPR gRNA sequence
ttttttcagtcctcttatct

SEQ ID NO: 540454 - DNA, 20 bp, Artificial
  CRISPR gRNA sequence
cttaaccccataacaatctc

SEQ ID NO: 540455 - DNA, 20 bp, Artificial
  CRISPR gRNA sequence
tataatctacattaacaaat

SEQ ID NO: 540456 - DNA, 20 bp, Artificial
  CRISPR gRNA sequence
ttcaatatttttctctcata

SEQ ID NO: 540457 - DNA, 20 bp, Artificial
  CRISPR gRNA sequence
ttttctctcatatagtcaaa

SEQ ID NO: 540458 - DNA, 20 bp, Artificial
  CRISPR gRNA sequence
caaacatgtatcacatataa

SEQ ID NO: 540459 - DNA, 20 bp, Artificial
  CRISPR gRNA sequence
tcacatataatggatacaca

SEQ ID NO: 540460 - DNA, 20 bp, Artificial
  CRISPR gRNA sequence
cacatataatggatacacac

SEQ ID NO: 540461 - DNA, 20 bp, Artificial
  CRISPR gRNA sequence
ataatggatacacacaggta

SEQ ID NO: 540462 - DNA, 20 bp, Artificial
  CRISPR gRNA sequence
atacacacaggtatagcttg

SEQ ID NO: 540463 - DNA, 20 bp, Artificial
  CRISPR gRNA sequence
ggtatagcttgaagataccg

SEQ ID NO: 540464 - DNA, 20 bp, Artificial
  CRISPR gRNA sequence
gtatagcttgaagataccgt

SEQ ID NO: 540465 - DNA, 20 bp, Artificial
  CRISPR gRNA sequence
gcttgaagataccgtgggtt

SEQ ID NO: 540466 - DNA, 20 bp, Artificial
  CRISPR gRNA sequence
agataccgtgggtttggtcc

SEQ ID NO: 540467 - DNA, 20 bp, Artificial
  CRISPR gRNA sequence
gtgggtttggtcccagacaa

SEQ ID NO: 540468 - DNA, 20 bp, Artificial
  CRISPR gRNA sequence
aacagcaatcatgtaaatat

SEQ ID NO: 540469 - DNA, 20 bp, Artificial
  CRISPR gRNA sequence
cagcaatcatgtaaatatca

SEQ ID NO: 540470 - DNA, 20 bp, Artificial
  CRISPR gRNA sequence
atcatgtaaatatcagagta

SEQ ID NO: 540471 - DNA, 20 bp, Artificial
  CRISPR gRNA sequence
agtgtgtcacacaaattttc

SEQ ID NO: 540472 - DNA, 20 bp, Artificial
  CRISPR gRNA sequence
acacaaattttctggtttcc

SEQ ID NO: 540473 - DNA, 20 bp, Artificial
  CRISPR gRNA sequence
cacaaattttctggtttccc

SEQ ID NO: 540474 - DNA, 20 bp, Artificial
  CRISPR gRNA sequence
acaaattttctggtttccca

SEQ ID NO: 540475 - DNA, 20 bp, Artificial
  CRISPR gRNA sequence
gttatgtttacactatactg

SEQ ID NO: 540476 - DNA, 20 bp, Artificial
  CRISPR gRNA sequence
cactatactgtagtctatta

SEQ ID NO: 540477 - DNA, 20 bp, Artificial
  CRISPR gRNA sequence
tagtctattaaagtgttcaa

SEQ ID NO: 540478 - DNA, 20 bp, Artificial
  CRISPR gRNA sequence
aaacatgctaacaatcattt

SEQ ID NO: 540479 - DNA, 20 bp, Artificial
  CRISPR gRNA sequence
ctaacaatcatttgagcctt

SEQ ID NO: 540480 - DNA, 20 bp, Artificial
  CRISPR gRNA sequence
caatcatttgagccttcagc

SEQ ID NO: 540481 - DNA, 20 bp, Artificial
  CRISPR gRNA sequence
gcaagtcctaatatttttgc

SEQ ID NO: 540482 - DNA, 20 bp, Artificial
  CRISPR gRNA sequence
cctaatatttttgctggtga

SEQ ID NO: 540483 - DNA, 20 bp, Artificial
  CRISPR gRNA sequence
ctaatatttttgctggtgaa

SEQ ID NO: 540484 - DNA, 20 bp, Artificial
  CRISPR gRNA sequence
aggtcttgcctcaatgttga

SEQ ID NO: 540485 - DNA, 20 bp, Artificial
  CRISPR gRNA sequence
gttgatggctgctgactgat

SEQ ID NO: 540486 - DNA, 20 bp, Artificial
  CRISPR gRNA sequence
ttgatggctgctgactgatc

SEQ ID NO: 540487 - DNA, 20 bp, Artificial
  CRISPR gRNA sequence
tgatggctgctgactgatca

SEQ ID NO: 540488 - DNA, 20 bp, Artificial
  CRISPR gRNA sequence
ctgctgactgatcagggtgt

SEQ ID NO: 540489 - DNA, 20 bp, Artificial
  CRISPR gRNA sequence
gatcagggtgttggttgcta

SEQ ID NO: 540490 - DNA, 20 bp, Artificial
  CRISPR gRNA sequence
atcagggtgttggttgctaa

SEQ ID NO: 540491 - DNA, 20 bp, Artificial
  CRISPR gRNA sequence
ttggttgctaaaggctgcaa

SEQ ID NO: 540492 - DNA, 20 bp, Artificial
  CRISPR gRNA sequence
gctaaaggctgcaatggctg

SEQ ID NO: 540493 - DNA, 20 bp, Artificial
  CRISPR gRNA sequence
tggctgtggcaatttcttaa

SEQ ID NO: 540494 - DNA, 20 bp, Artificial
  CRISPR gRNA sequence
ctgtggcaatttcttaaaag

SEQ ID NO: 540495 - DNA, 20 bp, Artificial
  CRISPR gRNA sequence
tcttaaaagaagacaatgat

SEQ ID NO: 540496 - DNA, 20 bp, Artificial
  CRISPR gRNA sequence
gatgagttttgctgcatcaa

SEQ ID NO: 540497 - DNA, 20 bp, Artificial
  CRISPR gRNA sequence
tcctttcacaaaatatttct

SEQ ID NO: 540498 - DNA, 20 bp, Artificial
  CRISPR gRNA sequence
ctttcacaaaatatttctca

SEQ ID NO: 540499 - DNA, 20 bp, Artificial
  CRISPR gRNA sequence
tttcacaaaatatttctcag

SEQ ID NO: 540500 - DNA, 20 bp, Artificial
  CRISPR gRNA sequence
aggcatccaatgctgtttga

SEQ ID NO: 540501 - DNA, 20 bp, Artificial
  CRISPR gRNA sequence
gtttgatagaattttactca

SEQ ID NO: 540502 - DNA, 20 bp, Artificial
  CRISPR gRNA sequence
agtaaaactgctttcaaaat

SEQ ID NO: 540503 - DNA, 20 bp, Artificial
  CRISPR gRNA sequence
taaaactgctttcaaaatta

SEQ ID NO: 540504 - DNA, 20 bp, Artificial
  CRISPR gRNA sequence
tgtcatttaaacaatgttca

SEQ ID NO: 540505 - DNA, 20 bp, Artificial
  CRISPR gRNA sequence
aatgttcacagcatcttcac

SEQ ID NO: 540506 - DNA, 20 bp, Artificial
  CRISPR gRNA sequence
atgttcacagcatcttcacc

SEQ ID NO: 540507 - DNA, 20 bp, Artificial
  CRISPR gRNA sequence
gttcacagcatcttcaccag

SEQ ID NO: 540508 - DNA, 20 bp, Artificial
  CRISPR gRNA sequence
cagcatcttcaccaggagta

SEQ ID NO: 540509 - DNA, 20 bp, Artificial
  CRISPR gRNA sequence
aggagtatagatgccatctg

SEQ ID NO: 540510 - DNA, 20 bp, Artificial
  CRISPR gRNA sequence
cactttctttgctcatccat

SEQ ID NO: 540511 - DNA, 20 bp, Artificial
  CRISPR gRNA sequence
tttctttgctcatccataag

SEQ ID NO: 540512 - DNA, 20 bp, Artificial
  CRISPR gRNA sequence
cataagaagcaactcctcat

SEQ ID NO: 540513 - DNA, 20 bp, Artificial
  CRISPR gRNA sequence
attggctcaattttcatcat

SEQ ID NO: 540514 - DNA, 20 bp, Artificial
  CRISPR gRNA sequence
caattttcatcatgagattg

SEQ ID NO: 540515 - DNA, 20 bp, Artificial
  CRISPR gRNA sequence
atcatgagattgtggcaact

SEQ ID NO: 540516 - DNA, 20 bp, Artificial
  CRISPR gRNA sequence
tggcaactgagtgacatatt

SEQ ID NO: 540517 - DNA, 20 bp, Artificial
  CRISPR gRNA sequence
ggcaactgagtgacatattc

SEQ ID NO: 540518 - DNA, 20 bp, Artificial
  CRISPR gRNA sequence
cttgctatttccacccttca

SEQ ID NO: 540519 - DNA, 20 bp, Artificial
  CRISPR gRNA sequence
cacccttcaaagtcatccat

SEQ ID NO: 540520 - DNA, 20 bp, Artificial
  CRISPR gRNA sequence
acccttcaaagtcatccatg

SEQ ID NO: 540521 - DNA, 20 bp, Artificial
  CRISPR gRNA sequence
tcaaagtcatccatgaggat

SEQ ID NO: 540522 - DNA, 20 bp, Artificial
  CRISPR gRNA sequence
tgatattttgacctgacgat

SEQ ID NO: 540523 - DNA, 20 bp, Artificial
  CRISPR gRNA sequence
caaatattcttaatgacatc

SEQ ID NO: 540524 - DNA, 20 bp, Artificial
  CRISPR gRNA sequence
tctagaatgctgaatccttt

SEQ ID NO: 540525 - DNA, 20 bp, Artificial
  CRISPR gRNA sequence
agaatgctgaatcctttcag

SEQ ID NO: 540526 - DNA, 20 bp, Artificial
  CRISPR gRNA sequence
gaatgctgaatcctttcaga

SEQ ID NO: 540527 - DNA, 20 bp, Artificial
  CRISPR gRNA sequence
ggttgtcaatttactttgcc

SEQ ID NO: 540528 - DNA, 20 bp, Artificial
  CRISPR gRNA sequence
tttactttgcccagattcat

SEQ ID NO: 540529 - DNA, 20 bp, Artificial
  CRISPR gRNA sequence
actttgcccagattcatcag

SEQ ID NO: 540530 - DNA, 20 bp, Artificial
  CRISPR gRNA sequence
atcagaagaataattatcta

SEQ ID NO: 540531 - DNA, 20 bp, Artificial
  CRISPR gRNA sequence
agaagaataattatctatgg

SEQ ID NO: 540532 - DNA, 20 bp, Artificial
  CRISPR gRNA sequence
ataattatctatggcagcta

SEQ ID NO: 540533 - DNA, 20 bp, Artificial
  CRISPR gRNA sequence
atggcagctatagccttacc

SEQ ID NO: 540534 - DNA, 20 bp, Artificial
  CRISPR gRNA sequence
caagtgtattcctacataat

SEQ ID NO: 540535 - DNA, 20 bp, Artificial
  CRISPR gRNA sequence
tcctacataataagacttca

SEQ ID NO: 540536 - DNA, 20 bp, Artificial
  CRISPR gRNA sequence
cctacataataagacttcaa

SEQ ID NO: 540537 - DNA, 20 bp, Artificial
  CRISPR gRNA sequence
caaaattactccttgatcca

SEQ ID NO: 540538 - DNA, 20 bp, Artificial
  CRISPR gRNA sequence
aaaattactccttgatccat

SEQ ID NO: 540539 - DNA, 20 bp, Artificial
  CRISPR gRNA sequence
actccttgatccatgggctg

SEQ ID NO: 540540 - DNA, 20 bp, Artificial
  CRISPR gRNA sequence
ttgatccatgggctgcagaa

SEQ ID NO: 540541 - DNA, 20 bp, Artificial
  CRISPR gRNA sequence
ctgcagaatggatgttgtat

SEQ ID NO: 540542 - DNA, 20 bp, Artificial
  CRISPR gRNA sequence
agaatggatgttgtattagc

SEQ ID NO: 540543 - DNA, 20 bp, Artificial
  CRISPR gRNA sequence
atctccttgtacatctccat

SEQ ID NO: 540544 - DNA, 20 bp, Artificial
  CRISPR gRNA sequence
ctccttgtacatctccatca

SEQ ID NO: 540545 - DNA, 20 bp, Artificial
  CRISPR gRNA sequence
tacatctccatcagagctct

SEQ ID NO: 540546 - DNA, 20 bp, Artificial
  CRISPR gRNA sequence
acatctccatcagagctctt

SEQ ID NO: 540547 - DNA, 20 bp, Artificial
  CRISPR gRNA sequence
catcagagctcttgggtgat

SEQ ID NO: 540548 - DNA, 20 bp, Artificial
  CRISPR gRNA sequence
atcagagctcttgggtgatt

SEQ ID NO: 540549 - DNA, 20 bp, Artificial
  CRISPR gRNA sequence
tgattaggtgcattgtcaac

SEQ ID NO: 540550 - DNA, 20 bp, Artificial
  CRISPR gRNA sequence
gaaatgaatcttttttttct

SEQ ID NO: 540551 - DNA, 20 bp, Artificial
  CRISPR gRNA sequence
atgaatcttttttttctaag

SEQ ID NO: 540552 - DNA, 20 bp, Artificial
  CRISPR gRNA sequence
atcttttttttctaagcagt

SEQ ID NO: 540553 - DNA, 20 bp, Artificial
  CRISPR gRNA sequence
ttctaagcagtaagtattaa

SEQ ID NO: 540554 - DNA, 20 bp, Artificial
  CRISPR gRNA sequence
taagcagtaagtattaacag

SEQ ID NO: 540555 - DNA, 20 bp, Artificial
  CRISPR gRNA sequence
aagcagtaagtattaacagt

SEQ ID NO: 540556 - DNA, 20 bp, Artificial
  CRISPR gRNA sequence
aacagtgggcttacaatatt

SEQ ID NO: 540557 - DNA, 20 bp, Artificial
  CRISPR gRNA sequence
tcagtaaaccatgctgtaaa

SEQ ID NO: 540558 - DNA, 20 bp, Artificial
  CRISPR gRNA sequence
taaacagatgtgctgtcatc

SEQ ID NO: 540559 - DNA, 20 bp, Artificial
  CRISPR gRNA sequence
cagcctgttgttccatttta

SEQ ID NO: 540560 - DNA, 20 bp, Artificial
  CRISPR gRNA sequence
gcctgttgttccattttata

SEQ ID NO: 540561 - DNA, 20 bp, Artificial
  CRISPR gRNA sequence
tgttccattttatagagcac

SEQ ID NO: 540562 - DNA, 20 bp, Artificial
  CRISPR gRNA sequence
tccattttatagagcacaag

SEQ ID NO: 540563 - DNA, 20 bp, Artificial
  CRISPR gRNA sequence
tttatagagcacaagcagaa

SEQ ID NO: 540564 - DNA, 20 bp, Artificial
  CRISPR gRNA sequence
gagcacaagcagaatagatt

SEQ ID NO: 540565 - DNA, 20 bp, Artificial
  CRISPR gRNA sequence
atagatttagcctaattctt

SEQ ID NO: 540566 - DNA, 20 bp, Artificial
  CRISPR gRNA sequence
tagatttagcctaattctta

SEQ ID NO: 540567 - DNA, 20 bp, Artificial
  CRISPR gRNA sequence
agatttagcctaattcttaa

SEQ ID NO: 540568 - DNA, 20 bp, Artificial
  CRISPR gRNA sequence
ttaagggccctaaaaatttt

SEQ ID NO: 540569 - DNA, 20 bp, Artificial
  CRISPR gRNA sequence
aagggccctaaaaattttca

SEQ ID NO: 540570 - DNA, 20 bp, Artificial
  CRISPR gRNA sequence
ggccctaaaaattttcagag

SEQ ID NO: 540571 - DNA, 20 bp, Artificial
  CRISPR gRNA sequence
aaattttcagagtggtaaat

SEQ ID NO: 540572 - DNA, 20 bp, Artificial
  CRISPR gRNA sequence
tcagagtggtaaatgagcac

SEQ ID NO: 540573 - DNA, 20 bp, Artificial
  CRISPR gRNA sequence
tgagcactggcttcaactta

SEQ ID NO: 540574 - DNA, 20 bp, Artificial
  CRISPR gRNA sequence
tggcttcaacttaaagtcat

SEQ ID NO: 540575 - DNA, 20 bp, Artificial
  CRISPR gRNA sequence
cttaaagtcatcagctgcat

SEQ ID NO: 540576 - DNA, 20 bp, Artificial
  CRISPR gRNA sequence
gctgcattagcccacacaac

SEQ ID NO: 540577 - DNA, 20 bp, Artificial
  CRISPR gRNA sequence
tgcattagcccacacaacaa

SEQ ID NO: 540578 - DNA, 20 bp, Artificial
  CRISPR gRNA sequence
cattagcccacacaacaaga

SEQ ID NO: 540579 - DNA, 20 bp, Artificial
  CRISPR gRNA sequence
agcccacacaacaagagagt

SEQ ID NO: 540580 - DNA, 20 bp, Artificial
  CRISPR gRNA sequence
agagagtcagctgtcctttc

SEQ ID NO: 540581 - DNA, 20 bp, Artificial
  CRISPR gRNA sequence
cagctgtcctttcaagcctg

SEQ ID NO: 540582 - DNA, 20 bp, Artificial
  CRISPR gRNA sequence
tgaagttgacttctcctgtc

SEQ ID NO: 540583 - DNA, 20 bp, Artificial
  CRISPR gRNA sequence
tgacttctcctgtctagcta

SEQ ID NO: 540584 - DNA, 20 bp, Artificial
  CRISPR gRNA sequence
cttctcctgtctagctatgg

SEQ ID NO: 540585 - DNA, 20 bp, Artificial
  CRISPR gRNA sequence
ctgtctagctatggaagtcc

SEQ ID NO: 540586 - DNA, 20 bp, Artificial
  CRISPR gRNA sequence
ctagctatggaagtcctaga

SEQ ID NO: 540587 - DNA, 20 bp, Artificial
  CRISPR gRNA sequence
tcctagatggcatcttcttc

SEQ ID NO: 540588 - DNA, 20 bp, Artificial
  CRISPR gRNA sequence
tagatggcatcttcttccag

SEQ ID NO: 540589 - DNA, 20 bp, Artificial
  CRISPR gRNA sequence
atggcatcttcttccagtag

SEQ ID NO: 540590 - DNA, 20 bp, Artificial
  CRISPR gRNA sequence
tggcatcttcttccagtaga

SEQ ID NO: 540591 - DNA, 20 bp, Artificial
  CRISPR gRNA sequence
ttgtttcatgtatcctgcac

SEQ ID NO: 540592 - DNA, 20 bp, Artificial
  CRISPR gRNA sequence
gtatcctgcaccagtaatct

SEQ ID NO: 540593 - DNA, 20 bp, Artificial
  CRISPR gRNA sequence
accagtaatcttagatcttc

SEQ ID NO: 540594 - DNA, 20 bp, Artificial
  CRISPR gRNA sequence
atcttctggataatttcttg

SEQ ID NO: 540595 - DNA, 20 bp, Artificial
  CRISPR gRNA sequence
acacttgctgctttacttca

SEQ ID NO: 540596 - DNA, 20 bp, Artificial
  CRISPR gRNA sequence
tacttcacagttttatgtta

SEQ ID NO: 540597 - DNA, 20 bp, Artificial
  CRISPR gRNA sequence
cttcacagttttatgttatg

SEQ ID NO: 540598 - DNA, 20 bp, Artificial
  CRISPR gRNA sequence
acagttttatgttatggaga

SEQ ID NO: 540599 - DNA, 20 bp, Artificial
  CRISPR gRNA sequence
atggagatggctttcttcct

SEQ ID NO: 540600 - DNA, 20 bp, Artificial
  CRISPR gRNA sequence
tctcatgaactaacctctga

SEQ ID NO: 540601 - DNA, 20 bp, Artificial
  CRISPR gRNA sequence
agcttcaaacttttctcctg

SEQ ID NO: 540602 - DNA, 20 bp, Artificial
  CRISPR gRNA sequence
tgcagctttctcacctctct

SEQ ID NO: 540603 - DNA, 20 bp, Artificial
  CRISPR gRNA sequence
ctcacctctctcagccttca

SEQ ID NO: 540604 - DNA, 20 bp, Artificial
  CRISPR gRNA sequence
tctcagccttcacagaacta

SEQ ID NO: 540605 - DNA, 20 bp, Artificial
  CRISPR gRNA sequence
tcagccttcacagaactaaa

SEQ ID NO: 540606 - DNA, 20 bp, Artificial
  CRISPR gRNA sequence
agccttcacagaactaaaga

SEQ ID NO: 540607 - DNA, 20 bp, Artificial
  CRISPR gRNA sequence
ttcacagaactaaagagagt

SEQ ID NO: 540608 - DNA, 20 bp, Artificial
  CRISPR gRNA sequence
tcacagaactaaagagagtt

SEQ ID NO: 540609 - DNA, 20 bp, Artificial
  CRISPR gRNA sequence
cacagaactaaagagagtta

SEQ ID NO: 540610 - DNA, 20 bp, Artificial
  CRISPR gRNA sequence
agagagttagggtcttgctc

SEQ ID NO: 540611 - DNA, 20 bp, Artificial
  CRISPR gRNA sequence
gttagggtcttgctctggat

SEQ ID NO: 540612 - DNA, 20 bp, Artificial
  CRISPR gRNA sequence
ttagggtcttgctctggatt

SEQ ID NO: 540613 - DNA, 20 bp, Artificial
  CRISPR gRNA sequence
tcttgctctggattaggctt

SEQ ID NO: 540614 - DNA, 20 bp, Artificial
  CRISPR gRNA sequence
tctggattaggctttggatt

SEQ ID NO: 540615 - DNA, 20 bp, Artificial
  CRISPR gRNA sequence
ctggattaggctttggatta

SEQ ID NO: 540616 - DNA, 20 bp, Artificial
  CRISPR gRNA sequence
tggattaggctttggattaa

SEQ ID NO: 540617 - DNA, 20 bp, Artificial
  CRISPR gRNA sequence
tttggattaagggaatgttg

SEQ ID NO: 540618 - DNA, 20 bp, Artificial
  CRISPR gRNA sequence
gattaagggaatgttgtagc

SEQ ID NO: 540619 - DNA, 20 bp, Artificial
  CRISPR gRNA sequence
agctggcttgatcttctatg

SEQ ID NO: 540620 - DNA, 20 bp, Artificial
  CRISPR gRNA sequence
tcttatttatgtgttcactg

SEQ ID NO: 540621 - DNA, 20 bp, Artificial
  CRISPR gRNA sequence
tatttatgtgttcactgaag

SEQ ID NO: 540622 - DNA, 20 bp, Artificial
  CRISPR gRNA sequence
tagcacttttaatttccttc

SEQ ID NO: 540623 - DNA, 20 bp, Artificial
  CRISPR gRNA sequence
tcacaacttcactaactctt

SEQ ID NO: 540624 - DNA, 20 bp, Artificial
  CRISPR gRNA sequence
tcactaactctttggcataa

SEQ ID NO: 540625 - DNA, 20 bp, Artificial
  CRISPR gRNA sequence
cactaactctttggcataaa

SEQ ID NO: 540626 - DNA, 20 bp, Artificial
  CRISPR gRNA sequence
actctttggcataaaaggcc

SEQ ID NO: 540627 - DNA, 20 bp, Artificial
  CRISPR gRNA sequence
ggcataaaaggcctagtttt

SEQ ID NO: 540628 - DNA, 20 bp, Artificial
  CRISPR gRNA sequence
gcctagttttcagcccatcg

SEQ ID NO: 540629 - DNA, 20 bp, Artificial
  CRISPR gRNA sequence
tctttttttttttttttctt

SEQ ID NO: 540630 - DNA, 20 bp, Artificial
  CRISPR gRNA sequence
tttttttttttttcttcaga

SEQ ID NO: 540631 - DNA, 20 bp, Artificial
  CRISPR gRNA sequence
tttttttttttcttcagaca

SEQ ID NO: 540632 - DNA, 20 bp, Artificial
  CRISPR gRNA sequence
cagacagagtttcattcttg

SEQ ID NO: 540633 - DNA, 20 bp, Artificial
  CRISPR gRNA sequence
agagtttcattcttgtagcc

SEQ ID NO: 540634 - DNA, 20 bp, Artificial
  CRISPR gRNA sequence
ttcattcttgtagcccagac

SEQ ID NO: 540635 - DNA, 20 bp, Artificial
  CRISPR gRNA sequence
cattcttgtagcccagactg

SEQ ID NO: 540636 - DNA, 20 bp, Artificial
  CRISPR gRNA sequence
tagcccagactggagtgcaa

SEQ ID NO: 540637 - DNA, 20 bp, Artificial
  CRISPR gRNA sequence
ggagtgcaatagtgccatct

SEQ ID NO: 540638 - DNA, 20 bp, Artificial
  CRISPR gRNA sequence
tcactgcaacatctgccttt

SEQ ID NO: 540639 - DNA, 20 bp, Artificial
  CRISPR gRNA sequence
cactgcaacatctgcctttc

SEQ ID NO: 540640 - DNA, 20 bp, Artificial
  CRISPR gRNA sequence
aacatctgcctttcaggttc

SEQ ID NO: 540641 - DNA, 20 bp, Artificial
  CRISPR gRNA sequence
ttcaagcgattctcctgcct

SEQ ID NO: 540642 - DNA, 20 bp, Artificial
  CRISPR gRNA sequence
tcctgcctcagcctcccaac

SEQ ID NO: 540643 - DNA, 20 bp, Artificial
  CRISPR gRNA sequence
gcctcagcctcccaaccagc

SEQ ID NO: 540644 - DNA, 20 bp, Artificial
  CRISPR gRNA sequence
cctcagcctcccaaccagct

SEQ ID NO: 540645 - DNA, 20 bp, Artificial
  CRISPR gRNA sequence
ctcccaaccagctgggatta

SEQ ID NO: 540646 - DNA, 20 bp, Artificial
  CRISPR gRNA sequence
tcccaaccagctgggattac

SEQ ID NO: 540647 - DNA, 20 bp, Artificial
  CRISPR gRNA sequence
caggtgcccaccaccacacc

SEQ ID NO: 540648 - DNA, 20 bp, Artificial
  CRISPR gRNA sequence
ccagctaatttttgtatttt

SEQ ID NO: 540649 - DNA, 20 bp, Artificial
  CRISPR gRNA sequence
gctaatttttgtatttttag

SEQ ID NO: 540650 - DNA, 20 bp, Artificial
  CRISPR gRNA sequence
taatttttgtatttttagta

SEQ ID NO: 540651 - DNA, 20 bp, Artificial
  CRISPR gRNA sequence
ttttgtatttttagtagaga

SEQ ID NO: 540652 - DNA, 20 bp, Artificial
  CRISPR gRNA sequence
tttgtatttttagtagagac

SEQ ID NO: 540653 - DNA, 20 bp, Artificial
  CRISPR gRNA sequence
ttgtatttttagtagagacg

SEQ ID NO: 540654 - DNA, 20 bp, Artificial
  CRISPR gRNA sequence
gagacggggtttcgccatgt

SEQ ID NO: 540655 - DNA, 20 bp, Artificial
  CRISPR gRNA sequence
cggggtttcgccatgttggc

SEQ ID NO: 540656 - DNA, 20 bp, Artificial
  CRISPR gRNA sequence
ggggtttcgccatgttggcc

SEQ ID NO: 540657 - DNA, 20 bp, Artificial
  CRISPR gRNA sequence
tttcgccatgttggccaggt

SEQ ID NO: 540658 - DNA, 20 bp, Artificial
  CRISPR gRNA sequence
tggtctcaaacttctgacct

SEQ ID NO: 540659 - DNA, 20 bp, Artificial
  CRISPR gRNA sequence
ggtctcaaacttctgacctc

SEQ ID NO: 540660 - DNA, 20 bp, Artificial
  CRISPR gRNA sequence
ctcaggtgatccacccacct

SEQ ID NO: 540661 - DNA, 20 bp, Artificial
  CRISPR gRNA sequence
ccacccaccttggcctccca

SEQ ID NO: 540662 - DNA, 20 bp, Artificial
  CRISPR gRNA sequence
accttggcctcccaaagtgc

SEQ ID NO: 540663 - DNA, 20 bp, Artificial
  CRISPR gRNA sequence
ccttggcctcccaaagtgct

SEQ ID NO: 540664 - DNA, 20 bp, Artificial
  CRISPR gRNA sequence
ctcccaaagtgctgggatta

SEQ ID NO: 540665 - DNA, 20 bp, Artificial
  CRISPR gRNA sequence
agtgctgggattacagttgt

SEQ ID NO: 540666 - DNA, 20 bp, Artificial
  CRISPR gRNA sequence
cagttgtgagccaccacgcc

SEQ ID NO: 540667 - DNA, 20 bp, Artificial
  CRISPR gRNA sequence
ccacgcccggccacctgtca

SEQ ID NO: 540668 - DNA, 20 bp, Artificial
  CRISPR gRNA sequence
tttcacatgccttcctcact

SEQ ID NO: 540669 - DNA, 20 bp, Artificial
  CRISPR gRNA sequence
tcactaagcttaatcatttc

SEQ ID NO: 540670 - DNA, 20 bp, Artificial
  CRISPR gRNA sequence
catttctagtttttaattta

SEQ ID NO: 540671 - DNA, 20 bp, Artificial
  CRISPR gRNA sequence
tctagtttttaatttaaagt

SEQ ID NO: 540672 - DNA, 20 bp, Artificial
  CRISPR gRNA sequence
tagtttttaatttaaagtga

SEQ ID NO: 540673 - DNA, 20 bp, Artificial
  CRISPR gRNA sequence
ttttaatttaaagtgagaga

SEQ ID NO: 540674 - DNA, 20 bp, Artificial
  CRISPR gRNA sequence
tgcaactcttcttttcactt

SEQ ID NO: 540675 - DNA, 20 bp, Artificial
  CRISPR gRNA sequence
cttcttttcacttgagcact

SEQ ID NO: 540676 - DNA, 20 bp, Artificial
  CRISPR gRNA sequence
cttttcacttgagcacttag

SEQ ID NO: 540677 - DNA, 20 bp, Artificial
  CRISPR gRNA sequence
tgagcacttagaagccattg

SEQ ID NO: 540678 - DNA, 20 bp, Artificial
  CRISPR gRNA sequence
gagcacttagaagccattgc

SEQ ID NO: 540679 - DNA, 20 bp, Artificial
  CRISPR gRNA sequence
agcacttagaagccattgca

SEQ ID NO: 540680 - DNA, 20 bp, Artificial
  CRISPR gRNA sequence
ccattgcagggttattaaat

SEQ ID NO: 540681 - DNA, 20 bp, Artificial
  CRISPR gRNA sequence
ttattaaattggcctaattt

SEQ ID NO: 540682 - DNA, 20 bp, Artificial
  CRISPR gRNA sequence
taatttcagtatcattgtct

SEQ ID NO: 540683 - DNA, 20 bp, Artificial
  CRISPR gRNA sequence
aatttcagtatcattgtctc

SEQ ID NO: 540684 - DNA, 20 bp, Artificial
  CRISPR gRNA sequence
gtatcattgtctcaggtgac

SEQ ID NO: 540685 - DNA, 20 bp, Artificial
  CRISPR gRNA sequence
tatcattgtctcaggtgaca

SEQ ID NO: 540686 - DNA, 20 bp, Artificial
  CRISPR gRNA sequence
atcattgtctcaggtgacaa

SEQ ID NO: 540687 - DNA, 20 bp, Artificial
  CRISPR gRNA sequence
cattgtctcaggtgacaagg

SEQ ID NO: 540688 - DNA, 20 bp, Artificial
  CRISPR gRNA sequence
attgtctcaggtgacaaggg

SEQ ID NO: 540689 - DNA, 20 bp, Artificial
  CRISPR gRNA sequence
tctcaggtgacaagggaggc

SEQ ID NO: 540690 - DNA, 20 bp, Artificial
  CRISPR gRNA sequence
ctcaggtgacaagggaggcc

SEQ ID NO: 540691 - DNA, 20 bp, Artificial
  CRISPR gRNA sequence
caggtgacaagggaggccag

SEQ ID NO: 540692 - DNA, 20 bp, Artificial
  CRISPR gRNA sequence
gtgacaagggaggccaggag

SEQ ID NO: 540693 - DNA, 20 bp, Artificial
  CRISPR gRNA sequence
tgacaagggaggccaggaga

SEQ ID NO: 540694 - DNA, 20 bp, Artificial
  CRISPR gRNA sequence
acaagggaggccaggagaag

SEQ ID NO: 540695 - DNA, 20 bp, Artificial
  CRISPR gRNA sequence
gggaggccaggagaaggaga

SEQ ID NO: 540696 - DNA, 20 bp, Artificial
  CRISPR gRNA sequence
ggccaggagaaggagaaaga

SEQ ID NO: 540697 - DNA, 20 bp, Artificial
  CRISPR gRNA sequence
gccaggagaaggagaaagat

SEQ ID NO: 540698 - DNA, 20 bp, Artificial
  CRISPR gRNA sequence
ccaggagaaggagaaagatg

SEQ ID NO: 540699 - DNA, 20 bp, Artificial
  CRISPR gRNA sequence
aggagaaggagaaagatggg

SEQ ID NO: 540700 - DNA, 20 bp, Artificial
  CRISPR gRNA sequence
aaggagaaagatggggagaa

SEQ ID NO: 540701 - DNA, 20 bp, Artificial
  CRISPR gRNA sequence
agaaagatggggagaacagc

SEQ ID NO: 540702 - DNA, 20 bp, Artificial
  CRISPR gRNA sequence
agatggggagaacagccagt

SEQ ID NO: 540703 - DNA, 20 bp, Artificial
  CRISPR gRNA sequence
tggggagaacagccagtcag

SEQ ID NO: 540704 - DNA, 20 bp, Artificial
  CRISPR gRNA sequence
gggagaacagccagtcagtg

SEQ ID NO: 540705 - DNA, 20 bp, Artificial
  CRISPR gRNA sequence
agaacagccagtcagtggag

SEQ ID NO: 540706 - DNA, 20 bp, Artificial
  CRISPR gRNA sequence
cagccagtcagtggagcagt

SEQ ID NO: 540707 - DNA, 20 bp, Artificial
  CRISPR gRNA sequence
tggagcagtcagaacacaca

SEQ ID NO: 540708 - DNA, 20 bp, Artificial
  CRISPR gRNA sequence
acacatagcatttatcaatt

SEQ ID NO: 540709 - DNA, 20 bp, Artificial
  CRISPR gRNA sequence
agttcaccgtcttatacgca

SEQ ID NO: 540710 - DNA, 20 bp, Artificial
  CRISPR gRNA sequence
cgtcttatacgcatggttct

SEQ ID NO: 540711 - DNA, 20 bp, Artificial
  CRISPR gRNA sequence
gcatcccaaaacaatgacaa

SEQ ID NO: 540712 - DNA, 20 bp, Artificial
  CRISPR gRNA sequence
caatgacaacagtaacatca

SEQ ID NO: 540713 - DNA, 20 bp, Artificial
  CRISPR gRNA sequence
acatcaaagatcactgatca

SEQ ID NO: 540714 - DNA, 20 bp, Artificial
  CRISPR gRNA sequence
ctgatcacagatcaccataa

SEQ ID NO: 540715 - DNA, 20 bp, Artificial
  CRISPR gRNA sequence
taacagatatgataatgaaa

SEQ ID NO: 540716 - DNA, 20 bp, Artificial
  CRISPR gRNA sequence
tgaaaaagcgttaaatattg

SEQ ID NO: 540717 - DNA, 20 bp, Artificial
  CRISPR gRNA sequence
gaaaaagcgttaaatattgt

SEQ ID NO: 540718 - DNA, 20 bp, Artificial
  CRISPR gRNA sequence
tgggaattactaaaatgtaa

SEQ ID NO: 540719 - DNA, 20 bp, Artificial
  CRISPR gRNA sequence
ggaattactaaaatgtaaca

SEQ ID NO: 540720 - DNA, 20 bp, Artificial
  CRISPR gRNA sequence
aattactaaaatgtaacaga

SEQ ID NO: 540721 - DNA, 20 bp, Artificial
  CRISPR gRNA sequence
taacagagagacaaaacata

SEQ ID NO: 540722 - DNA, 20 bp, Artificial
  CRISPR gRNA sequence
agagagacaaaacataaagt

SEQ ID NO: 540723 - DNA, 20 bp, Artificial
  CRISPR gRNA sequence
gagagacaaaacataaagtt

SEQ ID NO: 540724 - DNA, 20 bp, Artificial
  CRISPR gRNA sequence
aacataaagttaggcactga

SEQ ID NO: 540725 - DNA, 20 bp, Artificial
  CRISPR gRNA sequence
ggcactgatggacttgctta

SEQ ID NO: 540726 - DNA, 20 bp, Artificial
  CRISPR gRNA sequence
ctgatggacttgcttaaagc

SEQ ID NO: 540727 - DNA, 20 bp, Artificial
  CRISPR gRNA sequence
tgatggacttgcttaaagct

SEQ ID NO: 540728 - DNA, 20 bp, Artificial
  CRISPR gRNA sequence
acgaaccttcaatttgtaaa

SEQ ID NO: 540729 - DNA, 20 bp, Artificial
  CRISPR gRNA sequence
taaaaagcacattatctgtg

SEQ ID NO: 540730 - DNA, 20 bp, Artificial
  CRISPR gRNA sequence
attatctgtgaagtgcaata

SEQ ID NO: 540731 - DNA, 20 bp, Artificial
  CRISPR gRNA sequence
aataaagtgaaatgcaataa

SEQ ID NO: 540732 - DNA, 20 bp, Artificial
  CRISPR gRNA sequence
ataaagtgaaatgcaataaa

SEQ ID NO: 540733 - DNA, 20 bp, Artificial
  CRISPR gRNA sequence
aaagtgaaatgcaataaaag

SEQ ID NO: 540734 - DNA, 20 bp, Artificial
  CRISPR gRNA sequence
aagtgaaatgcaataaaagg

SEQ ID NO: 540735 - DNA, 20 bp, Artificial
  CRISPR gRNA sequence
caataaaaggaggtgtgcct

SEQ ID NO: 540736 - DNA, 20 bp, Artificial
  CRISPR gRNA sequence
aataaaaggaggtgtgcctg

SEQ ID NO: 540737 - DNA, 20 bp, Artificial
  CRISPR gRNA sequence
ataaaaggaggtgtgcctga

SEQ ID NO: 540738 - DNA, 20 bp, Artificial
  CRISPR gRNA sequence
ttaccattctttaataaaaa

SEQ ID NO: 540739 - DNA, 20 bp, Artificial
  CRISPR gRNA sequence
aaaatctccttgaaatcaac

SEQ ID NO: 540740 - DNA, 20 bp, Artificial
  CRISPR gRNA sequence
ctccttgaaatcaactggta

SEQ ID NO: 540741 - DNA, 20 bp, Artificial
  CRISPR gRNA sequence
ttaataactacataatattc

SEQ ID NO: 540742 - DNA, 20 bp, Artificial
  CRISPR gRNA sequence
aataactacataatattcca

SEQ ID NO: 540743 - DNA, 20 bp, Artificial
  CRISPR gRNA sequence
tacataatattccagagcat

SEQ ID NO: 540744 - DNA, 20 bp, Artificial
  CRISPR gRNA sequence
acataatattccagagcatg

SEQ ID NO: 540745 - DNA, 20 bp, Artificial
  CRISPR gRNA sequence
cataatattccagagcatga

SEQ ID NO: 540746 - DNA, 20 bp, Artificial
  CRISPR gRNA sequence
actgatgaacactccttttg

SEQ ID NO: 540747 - DNA, 20 bp, Artificial
  CRISPR gRNA sequence
atgaacactccttttgtggc

SEQ ID NO: 540748 - DNA, 20 bp, Artificial
  CRISPR gRNA sequence
gtggctagctttgtctattg

SEQ ID NO: 540749 - DNA, 20 bp, Artificial
  CRISPR gRNA sequence
catatgtcctgatgtattta

SEQ ID NO: 540750 - DNA, 20 bp, Artificial
  CRISPR gRNA sequence
tttatggtttcatatttatg

SEQ ID NO: 540751 - DNA, 20 bp, Artificial
  CRISPR gRNA sequence
ttatggtttcatatttatgt

SEQ ID NO: 540752 - DNA, 20 bp, Artificial
  CRISPR gRNA sequence
atggtttcatatttatgtgg

SEQ ID NO: 540753 - DNA, 20 bp, Artificial
  CRISPR gRNA sequence
gtttcatatttatgtgggag

SEQ ID NO: 540754 - DNA, 20 bp, Artificial
  CRISPR gRNA sequence
ttcatatttatgtgggagta

SEQ ID NO: 540755 - DNA, 20 bp, Artificial
  CRISPR gRNA sequence
atatttatgtgggagtagag

SEQ ID NO: 540756 - DNA, 20 bp, Artificial
  CRISPR gRNA sequence
atttatgtgggagtagagtg

SEQ ID NO: 540757 - DNA, 20 bp, Artificial
  CRISPR gRNA sequence
atgtgggagtagagtggagc

SEQ ID NO: 540758 - DNA, 20 bp, Artificial
  CRISPR gRNA sequence
tgtgggagtagagtggagct

SEQ ID NO: 540759 - DNA, 20 bp, Artificial
  CRISPR gRNA sequence
tgggagtagagtggagctgg

SEQ ID NO: 540760 - DNA, 20 bp, Artificial
  CRISPR gRNA sequence
gctgggagttgctacatcaa

SEQ ID NO: 540761 - DNA, 20 bp, Artificial
  CRISPR gRNA sequence
ctgggagttgctacatcaaa

SEQ ID NO: 540762 - DNA, 20 bp, Artificial
  CRISPR gRNA sequence
ttgctacatcaaaaggtaaa

SEQ ID NO: 540763 - DNA, 20 bp, Artificial
  CRISPR gRNA sequence
atagattttttttattttaa

SEQ ID NO: 540764 - DNA, 20 bp, Artificial
  CRISPR gRNA sequence
gattttttttattttaatag

SEQ ID NO: 540765 - DNA, 20 bp, Artificial
  CRISPR gRNA sequence
ttgctgcattgtttacaaaa

SEQ ID NO: 540766 - DNA, 20 bp, Artificial
  CRISPR gRNA sequence
attgtttacaaaaaagactt

SEQ ID NO: 540767 - DNA, 20 bp, Artificial
  CRISPR gRNA sequence
ttggcaatttacatctccat

SEQ ID NO: 540768 - DNA, 20 bp, Artificial
  CRISPR gRNA sequence
catctccatcagtaatgcct

SEQ ID NO: 540769 - DNA, 20 bp, Artificial
  CRISPR gRNA sequence
tgcctgagttgccctttcct

SEQ ID NO: 540770 - DNA, 20 bp, Artificial
  CRISPR gRNA sequence
ccctttccttggactcctga

SEQ ID NO: 540771 - DNA, 20 bp, Artificial
  CRISPR gRNA sequence
ccttggactcctgacagcat

SEQ ID NO: 540772 - DNA, 20 bp, Artificial
  CRISPR gRNA sequence
cttggactcctgacagcatt

SEQ ID NO: 540773 - DNA, 20 bp, Artificial
  CRISPR gRNA sequence
ttttttttatgtttaatttt

SEQ ID NO: 540774 - DNA, 20 bp, Artificial
  CRISPR gRNA sequence
tttttttatgtttaattttt

SEQ ID NO: 540775 - DNA, 20 bp, Artificial
  CRISPR gRNA sequence
atgtttaatttttgggcaaa

SEQ ID NO: 540776 - DNA, 20 bp, Artificial
  CRISPR gRNA sequence
ttcccaacctttaaaaattt

SEQ ID NO: 540777 - DNA, 20 bp, Artificial
  CRISPR gRNA sequence
atctcttctgcttgttgatt

SEQ ID NO: 540778 - DNA, 20 bp, Artificial
  CRISPR gRNA sequence
tgatttggatttctttttct

SEQ ID NO: 540779 - DNA, 20 bp, Artificial
  CRISPR gRNA sequence
cacatcctctttttttgtat

SEQ ID NO: 540780 - DNA, 20 bp, Artificial
  CRISPR gRNA sequence
tgtttgtttttttcttctca

SEQ ID NO: 540781 - DNA, 20 bp, Artificial
  CRISPR gRNA sequence
ttttttcttctcaaagttta

SEQ ID NO: 540782 - DNA, 20 bp, Artificial
  CRISPR gRNA sequence
tttttcttctcaaagtttaa

SEQ ID NO: 540783 - DNA, 20 bp, Artificial
  CRISPR gRNA sequence
atatatttttatctgtatta

SEQ ID NO: 540784 - DNA, 20 bp, Artificial
  CRISPR gRNA sequence
ttatagttttttttcaaata

SEQ ID NO: 540785 - DNA, 20 bp, Artificial
  CRISPR gRNA sequence
aaatgaatatcttccataca

SEQ ID NO: 540786 - DNA, 20 bp, Artificial
  CRISPR gRNA sequence
tctatatttttacataatga

SEQ ID NO: 540787 - DNA, 20 bp, Artificial
  CRISPR gRNA sequence
atgaaagtgtttatcttttc

SEQ ID NO: 540788 - DNA, 20 bp, Artificial
  CRISPR gRNA sequence
gtgtttatcttttctggcta

SEQ ID NO: 540789 - DNA, 20 bp, Artificial
  CRISPR gRNA sequence
tatcttttctggctatggtg

SEQ ID NO: 540790 - DNA, 20 bp, Artificial
  CRISPR gRNA sequence
cttttctggctatggtgtgg

SEQ ID NO: 540791 - DNA, 20 bp, Artificial
  CRISPR gRNA sequence
gctatggtgtggaagactga

SEQ ID NO: 540792 - DNA, 20 bp, Artificial
  CRISPR gRNA sequence
ctatggtgtggaagactgat

SEQ ID NO: 540793 - DNA, 20 bp, Artificial
  CRISPR gRNA sequence
atggtgtggaagactgatgg

SEQ ID NO: 540794 - DNA, 20 bp, Artificial
  CRISPR gRNA sequence
tggtgtggaagactgatggg

SEQ ID NO: 540795 - DNA, 20 bp, Artificial
  CRISPR gRNA sequence
ggtgtggaagactgatggga

SEQ ID NO: 540796 - DNA, 20 bp, Artificial
  CRISPR gRNA sequence
gtgtggaagactgatgggag

SEQ ID NO: 540797 - DNA, 20 bp, Artificial
  CRISPR gRNA sequence
ggaagactgatgggaggggt

SEQ ID NO: 540798 - DNA, 20 bp, Artificial
  CRISPR gRNA sequence
actgatgggaggggtaagac

SEQ ID NO: 540799 - DNA, 20 bp, Artificial
  CRISPR gRNA sequence
atgggaggggtaagactaga

SEQ ID NO: 540800 - DNA, 20 bp, Artificial
  CRISPR gRNA sequence
gaggggtaagactagatagc

SEQ ID NO: 540801 - DNA, 20 bp, Artificial
  CRISPR gRNA sequence
ggggtaagactagatagcaa

SEQ ID NO: 540802 - DNA, 20 bp, Artificial
  CRISPR gRNA sequence
ctagatagcaagagatccat

SEQ ID NO: 540803 - DNA, 20 bp, Artificial
  CRISPR gRNA sequence
atagcaagagatccatcaga

SEQ ID NO: 540804 - DNA, 20 bp, Artificial
  CRISPR gRNA sequence
gatccatcagacagcaattt

SEQ ID NO: 540805 - DNA, 20 bp, Artificial
  CRISPR gRNA sequence
atcagacagcaatttcagac

SEQ ID NO: 540806 - DNA, 20 bp, Artificial
  CRISPR gRNA sequence
acagcaatttcagactggtc

SEQ ID NO: 540807 - DNA, 20 bp, Artificial
  CRISPR gRNA sequence
agcaatttcagactggtcaa

SEQ ID NO: 540808 - DNA, 20 bp, Artificial
  CRISPR gRNA sequence
gcaatttcagactggtcaag

SEQ ID NO: 540809 - DNA, 20 bp, Artificial
  CRISPR gRNA sequence
atttcagactggtcaagagg

SEQ ID NO: 540810 - DNA, 20 bp, Artificial
  CRISPR gRNA sequence
gtcaagaggcagcattgtgc

SEQ ID NO: 540811 - DNA, 20 bp, Artificial
  CRISPR gRNA sequence
tcaagaggcagcattgtgct

SEQ ID NO: 540812 - DNA, 20 bp, Artificial
  CRISPR gRNA sequence
aggcagcattgtgctaggca

SEQ ID NO: 540813 - DNA, 20 bp, Artificial
  CRISPR gRNA sequence
cagcattgtgctaggcaaag

SEQ ID NO: 540814 - DNA, 20 bp, Artificial
  CRISPR gRNA sequence
tgtgctaggcaaagtggttc

SEQ ID NO: 540815 - DNA, 20 bp, Artificial
  CRISPR gRNA sequence
tgctaggcaaagtggttcaa

SEQ ID NO: 540816 - DNA, 20 bp, Artificial
  CRISPR gRNA sequence
caaagtggttcaagagacat

SEQ ID NO: 540817 - DNA, 20 bp, Artificial
  CRISPR gRNA sequence
aaagtggttcaagagacatt

SEQ ID NO: 540818 - DNA, 20 bp, Artificial
  CRISPR gRNA sequence
aagtggttcaagagacatta

SEQ ID NO: 540819 - DNA, 20 bp, Artificial
  CRISPR gRNA sequence
gtggttcaagagacattagg

SEQ ID NO: 540820 - DNA, 20 bp, Artificial
  CRISPR gRNA sequence
tggttcaagagacattaggg

SEQ ID NO: 540821 - DNA, 20 bp, Artificial
  CRISPR gRNA sequence
agacattagggaggtaaaac

SEQ ID NO: 540822 - DNA, 20 bp, Artificial
  CRISPR gRNA sequence
gacattagggaggtaaaact

SEQ ID NO: 540823 - DNA, 20 bp, Artificial
  CRISPR gRNA sequence
cattagggaggtaaaactgg

SEQ ID NO: 540824 - DNA, 20 bp, Artificial
  CRISPR gRNA sequence
ggaggtaaaactgggagaac

SEQ ID NO: 540825 - DNA, 20 bp, Artificial
  CRISPR gRNA sequence
tgggagaactagatgattga

SEQ ID NO: 540826 - DNA, 20 bp, Artificial
  CRISPR gRNA sequence
actagatgattgacagcata

SEQ ID NO: 540827 - DNA, 20 bp, Artificial
  CRISPR gRNA sequence
ctagatgattgacagcatat

SEQ ID NO: 540828 - DNA, 20 bp, Artificial
  CRISPR gRNA sequence
tagatgattgacagcatatg

SEQ ID NO: 540829 - DNA, 20 bp, Artificial
  CRISPR gRNA sequence
gattgacagcatatggggta

SEQ ID NO: 540830 - DNA, 20 bp, Artificial
  CRISPR gRNA sequence
attgacagcatatggggtaa

SEQ ID NO: 540831 - DNA, 20 bp, Artificial
  CRISPR gRNA sequence
tgacagcatatggggtaaag

SEQ ID NO: 540832 - DNA, 20 bp, Artificial
  CRISPR gRNA sequence
gacagcatatggggtaaagg

SEQ ID NO: 540833 - DNA, 20 bp, Artificial
  CRISPR gRNA sequence
cagcatatggggtaaaggag

SEQ ID NO: 540834 - DNA, 20 bp, Artificial
  CRISPR gRNA sequence
agcatatggggtaaaggagg

SEQ ID NO: 540835 - DNA, 20 bp, Artificial
  CRISPR gRNA sequence
catatggggtaaaggaggag

SEQ ID NO: 540836 - DNA, 20 bp, Artificial
  CRISPR gRNA sequence
tatggggtaaaggaggagga

SEQ ID NO: 540837 - DNA, 20 bp, Artificial
  CRISPR gRNA sequence
atggggtaaaggaggaggag

SEQ ID NO: 540838 - DNA, 20 bp, Artificial
  CRISPR gRNA sequence
ggggtaaaggaggaggagag

SEQ ID NO: 540839 - DNA, 20 bp, Artificial
  CRISPR gRNA sequence
gggtaaaggaggaggagagg

SEQ ID NO: 540840 - DNA, 20 bp, Artificial
  CRISPR gRNA sequence
aggaggaggagaggaggtgc

SEQ ID NO: 540841 - DNA, 20 bp, Artificial
  CRISPR gRNA sequence
ggaggaggagaggaggtgcc

SEQ ID NO: 540842 - DNA, 20 bp, Artificial
  CRISPR gRNA sequence
aggaggagaggaggtgccag

SEQ ID NO: 540843 - DNA, 20 bp, Artificial
  CRISPR gRNA sequence
ggaggagaggaggtgccagg

SEQ ID NO: 540844 - DNA, 20 bp, Artificial
  CRISPR gRNA sequence
gaggagaggaggtgccagga

SEQ ID NO: 540845 - DNA, 20 bp, Artificial
  CRISPR gRNA sequence
agaggaggtgccaggagggc

SEQ ID NO: 540846 - DNA, 20 bp, Artificial
  CRISPR gRNA sequence
gaggaggtgccaggagggcc

SEQ ID NO: 540847 - DNA, 20 bp, Artificial
  CRISPR gRNA sequence
aggagggccaggatgaatca

SEQ ID NO: 540848 - DNA, 20 bp, Artificial
  CRISPR gRNA sequence
tcacagctcttacttcctcc

SEQ ID NO: 540849 - DNA, 20 bp, Artificial
  CRISPR gRNA sequence
cacagctcttacttcctcct

SEQ ID NO: 540850 - DNA, 20 bp, Artificial
  CRISPR gRNA sequence
agctcttacttcctcctagg

SEQ ID NO: 540851 - DNA, 20 bp, Artificial
  CRISPR gRNA sequence
gctcttacttcctcctaggt

SEQ ID NO: 540852 - DNA, 20 bp, Artificial
  CRISPR gRNA sequence
acttcctcctaggtgggttg

SEQ ID NO: 540853 - DNA, 20 bp, Artificial
  CRISPR gRNA sequence
gggttgtggtgtctttccct

SEQ ID NO: 540854 - DNA, 20 bp, Artificial
  CRISPR gRNA sequence
tgtggtgtctttccctaaga

SEQ ID NO: 540855 - DNA, 20 bp, Artificial
  CRISPR gRNA sequence
gtggtgtctttccctaagaa

SEQ ID NO: 540856 - DNA, 20 bp, Artificial
  CRISPR gRNA sequence
tttccctaagaaaggaaaca

SEQ ID NO: 540857 - DNA, 20 bp, Artificial
  CRISPR gRNA sequence
ccctaagaaaggaaacacag

SEQ ID NO: 540858 - DNA, 20 bp, Artificial
  CRISPR gRNA sequence
cctaagaaaggaaacacagc

SEQ ID NO: 540859 - DNA, 20 bp, Artificial
  CRISPR gRNA sequence
aagaaaggaaacacagcagg

SEQ ID NO: 540860 - DNA, 20 bp, Artificial
  CRISPR gRNA sequence
ggaaacacagcaggaagact

SEQ ID NO: 540861 - DNA, 20 bp, Artificial
  CRISPR gRNA sequence
cacagcaggaagactaagac

SEQ ID NO: 540862 - DNA, 20 bp, Artificial
  CRISPR gRNA sequence
caggaagactaagactggcc

SEQ ID NO: 540863 - DNA, 20 bp, Artificial
  CRISPR gRNA sequence
ggcctggaacatcatgcttt

SEQ ID NO: 540864 - DNA, 20 bp, Artificial
  CRISPR gRNA sequence
gctttcagtttgacactgtt

SEQ ID NO: 540865 - DNA, 20 bp, Artificial
  CRISPR gRNA sequence
agtttgacactgttcagtgt

SEQ ID NO: 540866 - DNA, 20 bp, Artificial
  CRISPR gRNA sequence
gtttgacactgttcagtgtg

SEQ ID NO: 540867 - DNA, 20 bp, Artificial
  CRISPR gRNA sequence
tttgacactgttcagtgtga

SEQ ID NO: 540868 - DNA, 20 bp, Artificial
  CRISPR gRNA sequence
ttgacactgttcagtgtgag

SEQ ID NO: 540869 - DNA, 20 bp, Artificial
  CRISPR gRNA sequence
gttcagtgtgaggggtctgt

SEQ ID NO: 540870 - DNA, 20 bp, Artificial
  CRISPR gRNA sequence
gaggggtctgtgagacatcc

SEQ ID NO: 540871 - DNA, 20 bp, Artificial
  CRISPR gRNA sequence
gtctgtgagacatccaagca

SEQ ID NO: 540872 - DNA, 20 bp, Artificial
  CRISPR gRNA sequence
gacatccaagcaaagatgcc

SEQ ID NO: 540873 - DNA, 20 bp, Artificial
  CRISPR gRNA sequence
atccaagcaaagatgcccag

SEQ ID NO: 540874 - DNA, 20 bp, Artificial
  CRISPR gRNA sequence
aaagatgcccagtagctgct

SEQ ID NO: 540875 - DNA, 20 bp, Artificial
  CRISPR gRNA sequence
cccagtagctgctaagtaca

SEQ ID NO: 540876 - DNA, 20 bp, Artificial
  CRISPR gRNA sequence
ccagtagctgctaagtacac

SEQ ID NO: 540877 - DNA, 20 bp, Artificial
  CRISPR gRNA sequence
agctgctaagtacacaggtc

SEQ ID NO: 540878 - DNA, 20 bp, Artificial
  CRISPR gRNA sequence
gctgctaagtacacaggtct

SEQ ID NO: 540879 - DNA, 20 bp, Artificial
  CRISPR gRNA sequence
gtacacaggtctgggactca

SEQ ID NO: 540880 - DNA, 20 bp, Artificial
  CRISPR gRNA sequence
tacacaggtctgggactcac

SEQ ID NO: 540881 - DNA, 20 bp, Artificial
  CRISPR gRNA sequence
caggtctgggactcacagga

SEQ ID NO: 540882 - DNA, 20 bp, Artificial
  CRISPR gRNA sequence
aggtctgggactcacaggaa

SEQ ID NO: 540883 - DNA, 20 bp, Artificial
  CRISPR gRNA sequence
gggactcacaggaaaggata

SEQ ID NO: 540884 - DNA, 20 bp, Artificial
  CRISPR gRNA sequence
cacaggaaaggatacagatt

SEQ ID NO: 540885 - DNA, 20 bp, Artificial
  CRISPR gRNA sequence
acaggaaaggatacagattt

SEQ ID NO: 540886 - DNA, 20 bp, Artificial
  CRISPR gRNA sequence
aggaaaggatacagatttgg

SEQ ID NO: 540887 - DNA, 20 bp, Artificial
  CRISPR gRNA sequence
tttgggagtcatcacatttc

SEQ ID NO: 540888 - DNA, 20 bp, Artificial
  CRISPR gRNA sequence
gggagtcatcacatttctag

SEQ ID NO: 540889 - DNA, 20 bp, Artificial
  CRISPR gRNA sequence
cacatttctagtggctccaa

SEQ ID NO: 540890 - DNA, 20 bp, Artificial
  CRISPR gRNA sequence
catttctagtggctccaatg

SEQ ID NO: 540891 - DNA, 20 bp, Artificial
  CRISPR gRNA sequence
atttctagtggctccaatgg

SEQ ID NO: 540892 - DNA, 20 bp, Artificial
  CRISPR gRNA sequence
gtggctccaatggaggccat

SEQ ID NO: 540893 - DNA, 20 bp, Artificial
  CRISPR gRNA sequence
tggctccaatggaggccatt

SEQ ID NO: 540894 - DNA, 20 bp, Artificial
  CRISPR gRNA sequence
ggccattaggaccatcacct

SEQ ID NO: 540895 - DNA, 20 bp, Artificial
  CRISPR gRNA sequence
gccattaggaccatcacctt

SEQ ID NO: 540896 - DNA, 20 bp, Artificial
  CRISPR gRNA sequence
cattaggaccatcaccttgg

SEQ ID NO: 540897 - DNA, 20 bp, Artificial
  CRISPR gRNA sequence
ttaggaccatcaccttggga

SEQ ID NO: 540898 - DNA, 20 bp, Artificial
  CRISPR gRNA sequence
tcaccttgggagagcgtatg

SEQ ID NO: 540899 - DNA, 20 bp, Artificial
  CRISPR gRNA sequence
ccttgggagagcgtatgaag

SEQ ID NO: 540900 - DNA, 20 bp, Artificial
  CRISPR gRNA sequence
cttgggagagcgtatgaagt

SEQ ID NO: 540901 - DNA, 20 bp, Artificial
  CRISPR gRNA sequence
gagagcgtatgaagtgggaa

SEQ ID NO: 540902 - DNA, 20 bp, Artificial
  CRISPR gRNA sequence
agagcgtatgaagtgggaaa

SEQ ID NO: 540903 - DNA, 20 bp, Artificial
  CRISPR gRNA sequence
gcgtatgaagtgggaaaagg

SEQ ID NO: 540904 - DNA, 20 bp, Artificial
  CRISPR gRNA sequence
tgaagtgggaaaaggcagct

SEQ ID NO: 540905 - DNA, 20 bp, Artificial
  CRISPR gRNA sequence
cagcttggacctgtgcttta

SEQ ID NO: 540906 - DNA, 20 bp, Artificial
  CRISPR gRNA sequence
tggacctgtgctttaaagct

SEQ ID NO: 540907 - DNA, 20 bp, Artificial
  CRISPR gRNA sequence
cctgtgctttaaagcttggc

SEQ ID NO: 540908 - DNA, 20 bp, Artificial
  CRISPR gRNA sequence
tgtgctttaaagcttggcta

SEQ ID NO: 540909 - DNA, 20 bp, Artificial
  CRISPR gRNA sequence
gtgctttaaagcttggctag

SEQ ID NO: 540910 - DNA, 20 bp, Artificial
  CRISPR gRNA sequence
tgctttaaagcttggctaga

SEQ ID NO: 540911 - DNA, 20 bp, Artificial
  CRISPR gRNA sequence
gctttaaagcttggctagag

SEQ ID NO: 540912 - DNA, 20 bp, Artificial
  CRISPR gRNA sequence
ttggctagaggggaaaacac

SEQ ID NO: 540913 - DNA, 20 bp, Artificial
  CRISPR gRNA sequence
tagaggggaaaacactggct

SEQ ID NO: 540914 - DNA, 20 bp, Artificial
  CRISPR gRNA sequence
agaggggaaaacactggcta

SEQ ID NO: 540915 - DNA, 20 bp, Artificial
  CRISPR gRNA sequence
aggggaaaacactggctaag

SEQ ID NO: 540916 - DNA, 20 bp, Artificial
  CRISPR gRNA sequence
aaacactggctaaggagact

SEQ ID NO: 540917 - DNA, 20 bp, Artificial
  CRISPR gRNA sequence
acactggctaaggagactga

SEQ ID NO: 540918 - DNA, 20 bp, Artificial
  CRISPR gRNA sequence
actggctaaggagactgaga

SEQ ID NO: 540919 - DNA, 20 bp, Artificial
  CRISPR gRNA sequence
taaggagactgagagagacc

SEQ ID NO: 540920 - DNA, 20 bp, Artificial
  CRISPR gRNA sequence
aaggagactgagagagacct

SEQ ID NO: 540921 - DNA, 20 bp, Artificial
  CRISPR gRNA sequence
gagactgagagagacctggg

SEQ ID NO: 540922 - DNA, 20 bp, Artificial
  CRISPR gRNA sequence
actgagagagacctgggaag

SEQ ID NO: 540923 - DNA, 20 bp, Artificial
  CRISPR gRNA sequence
gagagagacctgggaagtag

SEQ ID NO: 540924 - DNA, 20 bp, Artificial
  CRISPR gRNA sequence
gagacctgggaagtagaaga

SEQ ID NO: 540925 - DNA, 20 bp, Artificial
  CRISPR gRNA sequence
agacctgggaagtagaagaa

SEQ ID NO: 540926 - DNA, 20 bp, Artificial
  CRISPR gRNA sequence
ctgggaagtagaagaaaggc

SEQ ID NO: 540927 - DNA, 20 bp, Artificial
  CRISPR gRNA sequence
tgggaagtagaagaaaggcc

SEQ ID NO: 540928 - DNA, 20 bp, Artificial
  CRISPR gRNA sequence
ggaagtagaagaaaggccag

SEQ ID NO: 540929 - DNA, 20 bp, Artificial
  CRISPR gRNA sequence
gaagtagaagaaaggccagg

SEQ ID NO: 540930 - DNA, 20 bp, Artificial
  CRISPR gRNA sequence
aagtagaagaaaggccagga

SEQ ID NO: 540931 - DNA, 20 bp, Artificial
  CRISPR gRNA sequence
agtagaagaaaggccaggag

SEQ ID NO: 540932 - DNA, 20 bp, Artificial
  CRISPR gRNA sequence
gtagaagaaaggccaggagg

SEQ ID NO: 540933 - DNA, 20 bp, Artificial
  CRISPR gRNA sequence
aagaaaggccaggaggggga

SEQ ID NO: 540934 - DNA, 20 bp, Artificial
  CRISPR gRNA sequence
ggggatggcatcataactcc

SEQ ID NO: 540935 - DNA, 20 bp, Artificial
  CRISPR gRNA sequence
tggcatcataactccaagac

SEQ ID NO: 540936 - DNA, 20 bp, Artificial
  CRISPR gRNA sequence
gcatcataactccaagacaa

SEQ ID NO: 540937 - DNA, 20 bp, Artificial
  CRISPR gRNA sequence
ccaagacaagagtcaacatg

SEQ ID NO: 540938 - DNA, 20 bp, Artificial
  CRISPR gRNA sequence
aagacaagagtcaacatgtg

SEQ ID NO: 540939 - DNA, 20 bp, Artificial
  CRISPR gRNA sequence
gtggagacttgactgaataa

SEQ ID NO: 540940 - DNA, 20 bp, Artificial
  CRISPR gRNA sequence
tggagacttgactgaataaa

SEQ ID NO: 540941 - DNA, 20 bp, Artificial
  CRISPR gRNA sequence
cttgactgaataaaaggcac

SEQ ID NO: 540942 - DNA, 20 bp, Artificial
  CRISPR gRNA sequence
aaggcactagtgatattact

SEQ ID NO: 540943 - DNA, 20 bp, Artificial
  CRISPR gRNA sequence
cactagtgatattactcaga

SEQ ID NO: 540944 - DNA, 20 bp, Artificial
  CRISPR gRNA sequence
tagtgatattactcagatag

SEQ ID NO: 540945 - DNA, 20 bp, Artificial
  CRISPR gRNA sequence
agtgatattactcagatagt

SEQ ID NO: 540946 - DNA, 20 bp, Artificial
  CRISPR gRNA sequence
attactcagatagtaggaaa

SEQ ID NO: 540947 - DNA, 20 bp, Artificial
  CRISPR gRNA sequence
ctcagatagtaggaaaaaga

SEQ ID NO: 540948 - DNA, 20 bp, Artificial
  CRISPR gRNA sequence
agatagtaggaaaaagatgg

SEQ ID NO: 540949 - DNA, 20 bp, Artificial
  CRISPR gRNA sequence
atggaagaaaattcaaatgt

SEQ ID NO: 540950 - DNA, 20 bp, Artificial
  CRISPR gRNA sequence
gaagaaaattcaaatgtaag

SEQ ID NO: 540951 - DNA, 20 bp, Artificial
  CRISPR gRNA sequence
tatttttgcttatgctctaa

SEQ ID NO: 540952 - DNA, 20 bp, Artificial
  CRISPR gRNA sequence
ttatgctctaaaagaacctg

SEQ ID NO: 540953 - DNA, 20 bp, Artificial
  CRISPR gRNA sequence
cctgtagtttcactgaatac

SEQ ID NO: 540954 - DNA, 20 bp, Artificial
  CRISPR gRNA sequence
ctgtagtttcactgaatact

SEQ ID NO: 540955 - DNA, 20 bp, Artificial
  CRISPR gRNA sequence
tttcactgaatactgggatc

SEQ ID NO: 540956 - DNA, 20 bp, Artificial
  CRISPR gRNA sequence
ttcactgaatactgggatct

SEQ ID NO: 540957 - DNA, 20 bp, Artificial
  CRISPR gRNA sequence
ggatctgggtgatatttatt

SEQ ID NO: 540958 - DNA, 20 bp, Artificial
  CRISPR gRNA sequence
gatctgggtgatatttattc

SEQ ID NO: 540959 - DNA, 20 bp, Artificial
  CRISPR gRNA sequence
gatgttaacaaataaaacaa

SEQ ID NO: 540960 - DNA, 20 bp, Artificial
  CRISPR gRNA sequence
acaatagtataacctacata

SEQ ID NO: 540961 - DNA, 20 bp, Artificial
  CRISPR gRNA sequence
aatagtataacctacataaa

SEQ ID NO: 540962 - DNA, 20 bp, Artificial
  CRISPR gRNA sequence
gcataatgatattcatttta

SEQ ID NO: 540963 - DNA, 20 bp, Artificial
  CRISPR gRNA sequence
cattttaaagttatctatac

SEQ ID NO: 540964 - DNA, 20 bp, Artificial
  CRISPR gRNA sequence
tatactagtaaataataatc

SEQ ID NO: 540965 - DNA, 20 bp, Artificial
  CRISPR gRNA sequence
taaataataatctagtctaa

SEQ ID NO: 540966 - DNA, 20 bp, Artificial
  CRISPR gRNA sequence
agtctaatagttaaacaatt

SEQ ID NO: 540967 - DNA, 20 bp, Artificial
  CRISPR gRNA sequence
aacaatttagtattatgcca

SEQ ID NO: 540968 - DNA, 20 bp, Artificial
  CRISPR gRNA sequence
ttatgccatggcttactatg

SEQ ID NO: 540969 - DNA, 20 bp, Artificial
  CRISPR gRNA sequence
actatgtggttattttaaaa

SEQ ID NO: 540970 - DNA, 20 bp, Artificial
  CRISPR gRNA sequence
ctatgtggttattttaaaaa

SEQ ID NO: 540971 - DNA, 20 bp, Artificial
  CRISPR gRNA sequence
ggttattttaaaaaaggaaa

SEQ ID NO: 540972 - DNA, 20 bp, Artificial
  CRISPR gRNA sequence
gttattttaaaaaaggaaac

SEQ ID NO: 540973 - DNA, 20 bp, Artificial
  CRISPR gRNA sequence
ggatattctccttttattat

SEQ ID NO: 540974 - DNA, 20 bp, Artificial
  CRISPR gRNA sequence
gatattctccttttattatt

SEQ ID NO: 540975 - DNA, 20 bp, Artificial
  CRISPR gRNA sequence
tccttttattattgggaatt

SEQ ID NO: 540976 - DNA, 20 bp, Artificial
  CRISPR gRNA sequence
ttcttaatattaaaaataaa

SEQ ID NO: 540977 - DNA, 20 bp, Artificial
  CRISPR gRNA sequence
atattaaaaataaaaagtta

SEQ ID NO: 540978 - DNA, 20 bp, Artificial
  CRISPR gRNA sequence
aagttatagaaatatatatg

SEQ ID NO: 540979 - DNA, 20 bp, Artificial
  CRISPR gRNA sequence
tcctctttttaaaaacaata

SEQ ID NO: 540980 - DNA, 20 bp, Artificial
  CRISPR gRNA sequence
ctctttttaaaaacaataaa

SEQ ID NO: 540981 - DNA, 20 bp, Artificial
  CRISPR gRNA sequence
tctttttaaaaacaataaag

SEQ ID NO: 540982 - DNA, 20 bp, Artificial
  CRISPR gRNA sequence
tttaaaaacaataaagaggc

SEQ ID NO: 540983 - DNA, 20 bp, Artificial
  CRISPR gRNA sequence
aacaataaagaggccagatg

SEQ ID NO: 540984 - DNA, 20 bp, Artificial
  CRISPR gRNA sequence
aataaagaggccagatgtgg

SEQ ID NO: 540985 - DNA, 20 bp, Artificial
  CRISPR gRNA sequence
gtggctcatgcctacaattc

SEQ ID NO: 540986 - DNA, 20 bp, Artificial
  CRISPR gRNA sequence
tgcctacaattctagcactt

SEQ ID NO: 540987 - DNA, 20 bp, Artificial
  CRISPR gRNA sequence
ctacaattctagcactttgg

SEQ ID NO: 540988 - DNA, 20 bp, Artificial
  CRISPR gRNA sequence
tacaattctagcactttggt

SEQ ID NO: 540989 - DNA, 20 bp, Artificial
  CRISPR gRNA sequence
tctagcactttggtaggcca

SEQ ID NO: 540990 - DNA, 20 bp, Artificial
  CRISPR gRNA sequence
agcactttggtaggccaaag

SEQ ID NO: 540991 - DNA, 20 bp, Artificial
  CRISPR gRNA sequence
actttggtaggccaaagtgg

SEQ ID NO: 540992 - DNA, 20 bp, Artificial
  CRISPR gRNA sequence
ctttggtaggccaaagtgga

SEQ ID NO: 540993 - DNA, 20 bp, Artificial
  CRISPR gRNA sequence
ccaaagtggaaggatcactt

SEQ ID NO: 540994 - DNA, 20 bp, Artificial
  CRISPR gRNA sequence
gtggaaggatcacttgagcc

SEQ ID NO: 540995 - DNA, 20 bp, Artificial
  CRISPR gRNA sequence
tggaaggatcacttgagccc

SEQ ID NO: 540996 - DNA, 20 bp, Artificial
  CRISPR gRNA sequence
gaaggatcacttgagcccag

SEQ ID NO: 540997 - DNA, 20 bp, Artificial
  CRISPR gRNA sequence
tgagcccaggagtttgatac

SEQ ID NO: 540998 - DNA, 20 bp, Artificial
  CRISPR gRNA sequence
ccaggagtttgataccagcc

SEQ ID NO: 540999 - DNA, 20 bp, Artificial
  CRISPR gRNA sequence
caggagtttgataccagcct

SEQ ID NO: 541000 - DNA, 20 bp, Artificial
  CRISPR gRNA sequence
tgataccagcctgggcaatg

SEQ ID NO: 541001 - DNA, 20 bp, Artificial
  CRISPR gRNA sequence
accagcctgggcaatgtagt

SEQ ID NO: 541002 - DNA, 20 bp, Artificial
  CRISPR gRNA sequence
atatatattttaactataaa

SEQ ID NO: 541003 - DNA, 20 bp, Artificial
  CRISPR gRNA sequence
attctcacttgctctttttt

SEQ ID NO: 541004 - DNA, 20 bp, Artificial
  CRISPR gRNA sequence
cacttgctctttttttagac

SEQ ID NO: 541005 - DNA, 20 bp, Artificial
  CRISPR gRNA sequence
tgctctttttttagactgga

SEQ ID NO: 541006 - DNA, 20 bp, Artificial
  CRISPR gRNA sequence
ctctttttttagactggaaa

SEQ ID NO: 541007 - DNA, 20 bp, Artificial
  CRISPR gRNA sequence
gagacaccctaaatgattaa

SEQ ID NO: 541008 - DNA, 20 bp, Artificial
  CRISPR gRNA sequence
acaccctaaatgattaacag

SEQ ID NO: 541009 - DNA, 20 bp, Artificial
  CRISPR gRNA sequence
attaacagtggttgttttta

SEQ ID NO: 541010 - DNA, 20 bp, Artificial
  CRISPR gRNA sequence
ggttgtttttaaagtaacca

SEQ ID NO: 541011 - DNA, 20 bp, Artificial
  CRISPR gRNA sequence
taaagtaaccacggttactt

SEQ ID NO: 541012 - DNA, 20 bp, Artificial
  CRISPR gRNA sequence
aagtaaccacggttacttta

SEQ ID NO: 541013 - DNA, 20 bp, Artificial
  CRISPR gRNA sequence
cacggttactttagagattg

SEQ ID NO: 541014 - DNA, 20 bp, Artificial
  CRISPR gRNA sequence
tactttagagattgtggtga

SEQ ID NO: 541015 - DNA, 20 bp, Artificial
  CRISPR gRNA sequence
ttagagattgtggtgatggt

SEQ ID NO: 541016 - DNA, 20 bp, Artificial
  CRISPR gRNA sequence
ttattacttattacttaata

SEQ ID NO: 541017 - DNA, 20 bp, Artificial
  CRISPR gRNA sequence
tattacttattacttaatac

SEQ ID NO: 541018 - DNA, 20 bp, Artificial
  CRISPR gRNA sequence
tgaaaaatatgttacttttg

SEQ ID NO: 541019 - DNA, 20 bp, Artificial
  CRISPR gRNA sequence
ctatgtaaattttttttaaa

SEQ ID NO: 541020 - DNA, 20 bp, Artificial
  CRISPR gRNA sequence
ttaaatagaattattcaacc

SEQ ID NO: 541021 - DNA, 20 bp, Artificial
  CRISPR gRNA sequence
aaatagaattattcaaccaa

SEQ ID NO: 541022 - DNA, 20 bp, Artificial
  CRISPR gRNA sequence
aatagaattattcaaccaag

SEQ ID NO: 541023 - DNA, 20 bp, Artificial
  CRISPR gRNA sequence
tagaattattcaaccaagag

SEQ ID NO: 541024 - DNA, 20 bp, Artificial
  CRISPR gRNA sequence
agaattattcaaccaagagg

SEQ ID NO: 541025 - DNA, 20 bp, Artificial
  CRISPR gRNA sequence
aattattcaaccaagaggag

SEQ ID NO: 541026 - DNA, 20 bp, Artificial
  CRISPR gRNA sequence
aaccaagaggaggagttgtt

SEQ ID NO: 541027 - DNA, 20 bp, Artificial
  CRISPR gRNA sequence
ctacctctactttgtgtgca

SEQ ID NO: 541028 - DNA, 20 bp, Artificial
  CRISPR gRNA sequence
tacctctactttgtgtgcat

SEQ ID NO: 541029 - DNA, 20 bp, Artificial
  CRISPR gRNA sequence
tatctattatttccttccta

SEQ ID NO: 541030 - DNA, 20 bp, Artificial
  CRISPR gRNA sequence
attatttccttcctacagta

SEQ ID NO: 541031 - DNA, 20 bp, Artificial
  CRISPR gRNA sequence
gtcttttctgttgcacttcc

SEQ ID NO: 541032 - DNA, 20 bp, Artificial
  CRISPR gRNA sequence
tcttttctgttgcacttcca

SEQ ID NO: 541033 - DNA, 20 bp, Artificial
  CRISPR gRNA sequence
cacttccaaggccaacacta

SEQ ID NO: 541034 - DNA, 20 bp, Artificial
  CRISPR gRNA sequence
tccaaggccaacactaaagt

SEQ ID NO: 541035 - DNA, 20 bp, Artificial
  CRISPR gRNA sequence
caacactaaagtaagttgct

SEQ ID NO: 541036 - DNA, 20 bp, Artificial
  CRISPR gRNA sequence
agataatttctaatgaacaa

SEQ ID NO: 541037 - DNA, 20 bp, Artificial
  CRISPR gRNA sequence
tctaatgaacaaaagaacaa

SEQ ID NO: 541038 - DNA, 20 bp, Artificial
  CRISPR gRNA sequence
aatgaacaaaagaacaatag

SEQ ID NO: 541039 - DNA, 20 bp, Artificial
  CRISPR gRNA sequence
aacaaaagaacaatagaaga

SEQ ID NO: 541040 - DNA, 20 bp, Artificial
  CRISPR gRNA sequence
acaaaagaacaatagaagaa

SEQ ID NO: 541041 - DNA, 20 bp, Artificial
  CRISPR gRNA sequence
caaaagaacaatagaagaaa

SEQ ID NO: 541042 - DNA, 20 bp, Artificial
  CRISPR gRNA sequence
aaaagaacaatagaagaaag

SEQ ID NO: 541043 - DNA, 20 bp, Artificial
  CRISPR gRNA sequence
aagaacaatagaagaaaggg

SEQ ID NO: 541044 - DNA, 20 bp, Artificial
  CRISPR gRNA sequence
acaatagaagaaaggggagt

SEQ ID NO: 541045 - DNA, 20 bp, Artificial
  CRISPR gRNA sequence
ggggagtgagttttttctca

SEQ ID NO: 541046 - DNA, 20 bp, Artificial
  CRISPR gRNA sequence
gggagtgagttttttctcaa

SEQ ID NO: 541047 - DNA, 20 bp, Artificial
  CRISPR gRNA sequence
ttctcaaaggtcacaaacca

SEQ ID NO: 541048 - DNA, 20 bp, Artificial
  CRISPR gRNA sequence
tgaatgaatgaatacacaaa

SEQ ID NO: 541049 - DNA, 20 bp, Artificial
  CRISPR gRNA sequence
gaatgaatgaatacacaaat

SEQ ID NO: 541050 - DNA, 20 bp, Artificial
  CRISPR gRNA sequence
atgaatgaatacacaaatag

SEQ ID NO: 541051 - DNA, 20 bp, Artificial
  CRISPR gRNA sequence
tgaatacacaaataggagca

SEQ ID NO: 541052 - DNA, 20 bp, Artificial
  CRISPR gRNA sequence
gaatacacaaataggagcaa

SEQ ID NO: 541053 - DNA, 20 bp, Artificial
  CRISPR gRNA sequence
cacaaataggagcaaaggaa

SEQ ID NO: 541054 - DNA, 20 bp, Artificial
  CRISPR gRNA sequence
gagcaaaggaatggtgtcaa

SEQ ID NO: 541055 - DNA, 20 bp, Artificial
  CRISPR gRNA sequence
aaaggaatggtgtcaacagt

SEQ ID NO: 541056 - DNA, 20 bp, Artificial
  CRISPR gRNA sequence
gttgctttgctgataccact

SEQ ID NO: 541057 - DNA, 20 bp, Artificial
  CRISPR gRNA sequence
gctttgctgataccactgag

SEQ ID NO: 541058 - DNA, 20 bp, Artificial
  CRISPR gRNA sequence
tgctgataccactgagtggt

SEQ ID NO: 541059 - DNA, 20 bp, Artificial
  CRISPR gRNA sequence
ataccactgagtggtcagaa

SEQ ID NO: 541060 - DNA, 20 bp, Artificial
  CRISPR gRNA sequence
taccactgagtggtcagaaa

SEQ ID NO: 541061 - DNA, 20 bp, Artificial
  CRISPR gRNA sequence
accactgagtggtcagaaaa

SEQ ID NO: 541062 - DNA, 20 bp, Artificial
  CRISPR gRNA sequence
agtggtcagaaaagggactg

SEQ ID NO: 541063 - DNA, 20 bp, Artificial
  CRISPR gRNA sequence
gtggtcagaaaagggactgt

SEQ ID NO: 541064 - DNA, 20 bp, Artificial
  CRISPR gRNA sequence
tggtcagaaaagggactgta

SEQ ID NO: 541065 - DNA, 20 bp, Artificial
  CRISPR gRNA sequence
agggacgctaataaccatgc

SEQ ID NO: 541066 - DNA, 20 bp, Artificial
  CRISPR gRNA sequence
ggacgctaataaccatgcca

SEQ ID NO: 541067 - DNA, 20 bp, Artificial
  CRISPR gRNA sequence
ctaataaccatgccagagtg

SEQ ID NO: 541068 - DNA, 20 bp, Artificial
  CRISPR gRNA sequence
aaccatgccagagtgcagaa

SEQ ID NO: 541069 - DNA, 20 bp, Artificial
  CRISPR gRNA sequence
ccatgccagagtgcagaaca

SEQ ID NO: 541070 - DNA, 20 bp, Artificial
  CRISPR gRNA sequence
atgccagagtgcagaacaga

SEQ ID NO: 541071 - DNA, 20 bp, Artificial
  CRISPR gRNA sequence
agtgcagaacagagagtgcc

SEQ ID NO: 541072 - DNA, 20 bp, Artificial
  CRISPR gRNA sequence
cagagagtgcccagattttg

SEQ ID NO: 541073 - DNA, 20 bp, Artificial
  CRISPR gRNA sequence
gagtgcccagattttgaagc

SEQ ID NO: 541074 - DNA, 20 bp, Artificial
  CRISPR gRNA sequence
gcccagattttgaagccagc

SEQ ID NO: 541075 - DNA, 20 bp, Artificial
  CRISPR gRNA sequence
cccagattttgaagccagca

SEQ ID NO: 541076 - DNA, 20 bp, Artificial
  CRISPR gRNA sequence
attttgaagccagcaaggcc

SEQ ID NO: 541077 - DNA, 20 bp, Artificial
  CRISPR gRNA sequence
ttttgaagccagcaaggccc

SEQ ID NO: 541078 - DNA, 20 bp, Artificial
  CRISPR gRNA sequence
tttgaagccagcaaggccca

SEQ ID NO: 541079 - DNA, 20 bp, Artificial
  CRISPR gRNA sequence
aggcccagggtgaactccca

SEQ ID NO: 541080 - DNA, 20 bp, Artificial
  CRISPR gRNA sequence
ggcccagggtgaactcccaa

SEQ ID NO: 541081 - DNA, 20 bp, Artificial
  CRISPR gRNA sequence
tcccaaaggcctccccacac

SEQ ID NO: 541082 - DNA, 20 bp, Artificial
  CRISPR gRNA sequence
ctccccacactagatctcct

SEQ ID NO: 541083 - DNA, 20 bp, Artificial
  CRISPR gRNA sequence
actagatctcctcagctgtg

SEQ ID NO: 541084 - DNA, 20 bp, Artificial
  CRISPR gRNA sequence
agatctcctcagctgtgaag

SEQ ID NO: 541085 - DNA, 20 bp, Artificial
  CRISPR gRNA sequence
aatcataatgcccaccataa

SEQ ID NO: 541086 - DNA, 20 bp, Artificial
  CRISPR gRNA sequence
ccaccataaaagattgtttt

SEQ ID NO: 541087 - DNA, 20 bp, Artificial
  CRISPR gRNA sequence
caccataaaagattgttttc

SEQ ID NO: 541088 - DNA, 20 bp, Artificial
  CRISPR gRNA sequence
tttcaggtttgaataaaatt

SEQ ID NO: 541089 - DNA, 20 bp, Artificial
  CRISPR gRNA sequence
tcaggtttgaataaaattga

SEQ ID NO: 541090 - DNA, 20 bp, Artificial
  CRISPR gRNA sequence
aattgagagtctttttacac

SEQ ID NO: 541091 - DNA, 20 bp, Artificial
  CRISPR gRNA sequence
tctttttacactggttgaca

SEQ ID NO: 541092 - DNA, 20 bp, Artificial
  CRISPR gRNA sequence
ttacactggttgacatggaa

SEQ ID NO: 541093 - DNA, 20 bp, Artificial
  CRISPR gRNA sequence
tacactggttgacatggaat

SEQ ID NO: 541094 - DNA, 20 bp, Artificial
  CRISPR gRNA sequence
tgacatggaataggctttca

SEQ ID NO: 541095 - DNA, 20 bp, Artificial
  CRISPR gRNA sequence
gacatggaataggctttcaa

SEQ ID NO: 541096 - DNA, 20 bp, Artificial
  CRISPR gRNA sequence
ttctctctttttcttttaat

SEQ ID NO: 541097 - DNA, 20 bp, Artificial
  CRISPR gRNA sequence
ctctttttcttttaatgagt

SEQ ID NO: 541098 - DNA, 20 bp, Artificial
  CRISPR gRNA sequence
tctttttcttttaatgagtt

SEQ ID NO: 541099 - DNA, 20 bp, Artificial
  CRISPR gRNA sequence
taatgagttaggtcaacatc

SEQ ID NO: 541100 - DNA, 20 bp, Artificial
  CRISPR gRNA sequence
aatgagttaggtcaacatca

SEQ ID NO: 541101 - DNA, 20 bp, Artificial
  CRISPR gRNA sequence
ttcacactgtctgaattaac

SEQ ID NO: 541102 - DNA, 20 bp, Artificial
  CRISPR gRNA sequence
tcacactgtctgaattaact

SEQ ID NO: 541103 - DNA, 20 bp, Artificial
  CRISPR gRNA sequence
actgtctgaattaactgggt

SEQ ID NO: 541104 - DNA, 20 bp, Artificial
  CRISPR gRNA sequence
tgaattaactgggtgagaac

SEQ ID NO: 541105 - DNA, 20 bp, Artificial
  CRISPR gRNA sequence
gaattaactgggtgagaact

SEQ ID NO: 541106 - DNA, 20 bp, Artificial
  CRISPR gRNA sequence
aactgggtgagaactgggca

SEQ ID NO: 541107 - DNA, 20 bp, Artificial
  CRISPR gRNA sequence
actgggtgagaactgggcat

SEQ ID NO: 541108 - DNA, 20 bp, Artificial
  CRISPR gRNA sequence
ctgggtgagaactgggcatg

SEQ ID NO: 541109 - DNA, 20 bp, Artificial
  CRISPR gRNA sequence
gtgagaactgggcatggggt

SEQ ID NO: 541110 - DNA, 20 bp, Artificial
  CRISPR gRNA sequence
ggtgagtttttgctgtttaa

SEQ ID NO: 541111 - DNA, 20 bp, Artificial
  CRISPR gRNA sequence
gtttttgctgtttaaaagca

SEQ ID NO: 541112 - DNA, 20 bp, Artificial
  CRISPR gRNA sequence
ttttgctgtttaaaagcaaa

SEQ ID NO: 541113 - DNA, 20 bp, Artificial
  CRISPR gRNA sequence
ttgctgtttaaaagcaaaga

SEQ ID NO: 541114 - DNA, 20 bp, Artificial
  CRISPR gRNA sequence
tgtttaaaagcaaagagaga

SEQ ID NO: 541115 - DNA, 20 bp, Artificial
  CRISPR gRNA sequence
tttaaaagcaaagagagatg

SEQ ID NO: 541116 - DNA, 20 bp, Artificial
  CRISPR gRNA sequence
ttaaaagcaaagagagatgg

SEQ ID NO: 541117 - DNA, 20 bp, Artificial
  CRISPR gRNA sequence
taaaagcaaagagagatgga

SEQ ID NO: 541118 - DNA, 20 bp, Artificial
  CRISPR gRNA sequence
aaagcaaagagagatggagg

SEQ ID NO: 541119 - DNA, 20 bp, Artificial
  CRISPR gRNA sequence
aagcaaagagagatggaggg

SEQ ID NO: 541120 - DNA, 20 bp, Artificial
  CRISPR gRNA sequence
agcaaagagagatggaggga

SEQ ID NO: 541121 - DNA, 20 bp, Artificial
  CRISPR gRNA sequence
agggagggaaaaaattttat

SEQ ID NO: 541122 - DNA, 20 bp, Artificial
  CRISPR gRNA sequence
tttatcagtgatcgcctaaa

SEQ ID NO: 541123 - DNA, 20 bp, Artificial
  CRISPR gRNA sequence
cctaaaaagattttctatgc

SEQ ID NO: 541124 - DNA, 20 bp, Artificial
  CRISPR gRNA sequence
aaaagattttctatgctagc

SEQ ID NO: 541125 - DNA, 20 bp, Artificial
  CRISPR gRNA sequence
tgctagccagataatttttg

SEQ ID NO: 541126 - DNA, 20 bp, Artificial
  CRISPR gRNA sequence
gctagccagataatttttga

SEQ ID NO: 541127 - DNA, 20 bp, Artificial
  CRISPR gRNA sequence
ttgaaggtttttttgttttg

SEQ ID NO: 541128 - DNA, 20 bp, Artificial
  CRISPR gRNA sequence
ttttgaattttttttaaata

SEQ ID NO: 541129 - DNA, 20 bp, Artificial
  CRISPR gRNA sequence
ttttttttaaataaagatat

SEQ ID NO: 541130 - DNA, 20 bp, Artificial
  CRISPR gRNA sequence
tttttttaaataaagatatg

SEQ ID NO: 541131 - DNA, 20 bp, Artificial
  CRISPR gRNA sequence
ttttttaaataaagatatga

SEQ ID NO: 541132 - DNA, 20 bp, Artificial
  CRISPR gRNA sequence
gagggtacctaatacctaat

SEQ ID NO: 541133 - DNA, 20 bp, Artificial
  CRISPR gRNA sequence
cctaatcagcactacatgta

SEQ ID NO: 541134 - DNA, 20 bp, Artificial
  CRISPR gRNA sequence
taatcagcactacatgtata

SEQ ID NO: 541135 - DNA, 20 bp, Artificial
  CRISPR gRNA sequence
agtgatcacatatctaaaaa

SEQ ID NO: 541136 - DNA, 20 bp, Artificial
  CRISPR gRNA sequence
gtgatcacatatctaaaaac

SEQ ID NO: 541137 - DNA, 20 bp, Artificial
  CRISPR gRNA sequence
tgatctcaaatattctgttg

SEQ ID NO: 541138 - DNA, 20 bp, Artificial
  CRISPR gRNA sequence
catcaacacctcaattttaa

SEQ ID NO: 541139 - DNA, 20 bp, Artificial
  CRISPR gRNA sequence
ttttaatagttctttttgta

SEQ ID NO: 541140 - DNA, 20 bp, Artificial
  CRISPR gRNA sequence
agttctttttgtatggcctg

SEQ ID NO: 541141 - DNA, 20 bp, Artificial
  CRISPR gRNA sequence
gtatggcctgaagttgtaac

SEQ ID NO: 541142 - DNA, 20 bp, Artificial
  CRISPR gRNA sequence
tgaagttgtaactggaaccc

SEQ ID NO: 541143 - DNA, 20 bp, Artificial
  CRISPR gRNA sequence
taactggaacccaagtttta

SEQ ID NO: 541144 - DNA, 20 bp, Artificial
  CRISPR gRNA sequence
gaacccaagttttatagatg

SEQ ID NO: 541145 - DNA, 20 bp, Artificial
  CRISPR gRNA sequence
aagtatcctgatttcttatt

SEQ ID NO: 541146 - DNA, 20 bp, Artificial
  CRISPR gRNA sequence
gatttcttatttagaaaatc

SEQ ID NO: 541147 - DNA, 20 bp, Artificial
  CRISPR gRNA sequence
aatctggtcaccgttaacta

SEQ ID NO: 541148 - DNA, 20 bp, Artificial
  CRISPR gRNA sequence
atctggtcaccgttaactat

SEQ ID NO: 541149 - DNA, 20 bp, Artificial
  CRISPR gRNA sequence
gttaactatgggttaatgaa

SEQ ID NO: 541150 - DNA, 20 bp, Artificial
  CRISPR gRNA sequence
ttaactatgggttaatgaaa

SEQ ID NO: 541151 - DNA, 20 bp, Artificial
  CRISPR gRNA sequence
gaaaaggaactctcaacccc

SEQ ID NO: 541152 - DNA, 20 bp, Artificial
  CRISPR gRNA sequence
ttcctctgcaaattattact

SEQ ID NO: 541153 - DNA, 20 bp, Artificial
  CRISPR gRNA sequence
tcctctgcaaattattactc

SEQ ID NO: 541154 - DNA, 20 bp, Artificial
  CRISPR gRNA sequence
cctctgcaaattattactca

SEQ ID NO: 541155 - DNA, 20 bp, Artificial
  CRISPR gRNA sequence
caaattattactcagggcct

SEQ ID NO: 541156 - DNA, 20 bp, Artificial
  CRISPR gRNA sequence
attactcagggcctgagatt

SEQ ID NO: 541157 - DNA, 20 bp, Artificial
  CRISPR gRNA sequence
ggcctgagattcagattgac

SEQ ID NO: 541158 - DNA, 20 bp, Artificial
  CRISPR gRNA sequence
tacttaatctaacacttgta

SEQ ID NO: 541159 - DNA, 20 bp, Artificial
  CRISPR gRNA sequence
atctaacacttgtatggccc

SEQ ID NO: 541160 - DNA, 20 bp, Artificial
  CRISPR gRNA sequence
gtatggccctggctctgtgc

SEQ ID NO: 541161 - DNA, 20 bp, Artificial
  CRISPR gRNA sequence
tatggccctggctctgtgcc

SEQ ID NO: 541162 - DNA, 20 bp, Artificial
  CRISPR gRNA sequence
tctgtgccaggcactgttgc

SEQ ID NO: 541163 - DNA, 20 bp, Artificial
  CRISPR gRNA sequence
ctgtgccaggcactgttgca

SEQ ID NO: 541164 - DNA, 20 bp, Artificial
  CRISPR gRNA sequence
tgtgccaggcactgttgcaa

SEQ ID NO: 541165 - DNA, 20 bp, Artificial
  CRISPR gRNA sequence
tgttgcaagggctctataaa

SEQ ID NO: 541166 - DNA, 20 bp, Artificial
  CRISPR gRNA sequence
gttgcaagggctctataaat

SEQ ID NO: 541167 - DNA, 20 bp, Artificial
  CRISPR gRNA sequence
tataaataggtactcaccac

SEQ ID NO: 541168 - DNA, 20 bp, Artificial
  CRISPR gRNA sequence
ataaataggtactcaccact

SEQ ID NO: 541169 - DNA, 20 bp, Artificial
  CRISPR gRNA sequence
aaataggtactcaccactgg

SEQ ID NO: 541170 - DNA, 20 bp, Artificial
  CRISPR gRNA sequence
taggtactcaccactgggag

SEQ ID NO: 541171 - DNA, 20 bp, Artificial
  CRISPR gRNA sequence
gtactcaccactgggagcag

SEQ ID NO: 541172 - DNA, 20 bp, Artificial
  CRISPR gRNA sequence
gtggctcatgcctgtaatcc

SEQ ID NO: 541173 - DNA, 20 bp, Artificial
  CRISPR gRNA sequence
tgcctgtaatcccagcactt

SEQ ID NO: 541174 - DNA, 20 bp, Artificial
  CRISPR gRNA sequence
gcctgtaatcccagcacttt

SEQ ID NO: 541175 - DNA, 20 bp, Artificial
  CRISPR gRNA sequence
ctgtaatcccagcactttgg

SEQ ID NO: 541176 - DNA, 20 bp, Artificial
  CRISPR gRNA sequence
tgtaatcccagcactttggg

SEQ ID NO: 541177 - DNA, 20 bp, Artificial
  CRISPR gRNA sequence
tcccagcactttgggaggcc

SEQ ID NO: 541178 - DNA, 20 bp, Artificial
  CRISPR gRNA sequence
cccagcactttgggaggcca

SEQ ID NO: 541179 - DNA, 20 bp, Artificial
  CRISPR gRNA sequence
agcactttgggaggccaagg

SEQ ID NO: 541180 - DNA, 20 bp, Artificial
  CRISPR gRNA sequence
gcactttgggaggccaaggc

SEQ ID NO: 541181 - DNA, 20 bp, Artificial
  CRISPR gRNA sequence
ctttgggaggccaaggcagg

SEQ ID NO: 541182 - DNA, 20 bp, Artificial
  CRISPR gRNA sequence
ccaaggcaggtggatcactt

SEQ ID NO: 541183 - DNA, 20 bp, Artificial
  CRISPR gRNA sequence
caaggcaggtggatcacttg

SEQ ID NO: 541184 - DNA, 20 bp, Artificial
  CRISPR gRNA sequence
gcaggtggatcacttgaggt

SEQ ID NO: 541185 - DNA, 20 bp, Artificial
  CRISPR gRNA sequence
caggtggatcacttgaggtc

SEQ ID NO: 541186 - DNA, 20 bp, Artificial
  CRISPR gRNA sequence
ggtggatcacttgaggtcag

SEQ ID NO: 541187 - DNA, 20 bp, Artificial
  CRISPR gRNA sequence
tcacttgaggtcaggagttc

SEQ ID NO: 541188 - DNA, 20 bp, Artificial
  CRISPR gRNA sequence
tgaggtcaggagttccagac

SEQ ID NO: 541189 - DNA, 20 bp, Artificial
  CRISPR gRNA sequence
tcaggagttccagaccagcc

SEQ ID NO: 541190 - DNA, 20 bp, Artificial
  CRISPR gRNA sequence
ccagaccagcctggccaaca

SEQ ID NO: 541191 - DNA, 20 bp, Artificial
  CRISPR gRNA sequence
ctctactaaaaatacaaaat

SEQ ID NO: 541192 - DNA, 20 bp, Artificial
  CRISPR gRNA sequence
actaaaaatacaaaattagc

SEQ ID NO: 541193 - DNA, 20 bp, Artificial
  CRISPR gRNA sequence
ctaaaaatacaaaattagct

SEQ ID NO: 541194 - DNA, 20 bp, Artificial
  CRISPR gRNA sequence
aatacaaaattagctgggcg

SEQ ID NO: 541195 - DNA, 20 bp, Artificial
  CRISPR gRNA sequence
acaaaattagctgggcgtgg

SEQ ID NO: 541196 - DNA, 20 bp, Artificial
  CRISPR gRNA sequence
gtggcactcgcctgtaatcc

SEQ ID NO: 541197 - DNA, 20 bp, Artificial
  CRISPR gRNA sequence
cgcctgtaatcccagttaca

SEQ ID NO: 541198 - DNA, 20 bp, Artificial
  CRISPR gRNA sequence
gcctgtaatcccagttacat

SEQ ID NO: 541199 - DNA, 20 bp, Artificial
  CRISPR gRNA sequence
ctgtaatcccagttacatgg

SEQ ID NO: 541200 - DNA, 20 bp, Artificial
  CRISPR gRNA sequence
tgtaatcccagttacatggg

SEQ ID NO: 541201 - DNA, 20 bp, Artificial
  CRISPR gRNA sequence
tcccagttacatgggaggct

SEQ ID NO: 541202 - DNA, 20 bp, Artificial
  CRISPR gRNA sequence
cccagttacatgggaggctg

SEQ ID NO: 541203 - DNA, 20 bp, Artificial
  CRISPR gRNA sequence
agttacatgggaggctgagg

SEQ ID NO: 541204 - DNA, 20 bp, Artificial
  CRISPR gRNA sequence
gttacatgggaggctgaggc

SEQ ID NO: 541205 - DNA, 20 bp, Artificial
  CRISPR gRNA sequence
tacatgggaggctgaggcag

SEQ ID NO: 541206 - DNA, 20 bp, Artificial
  CRISPR gRNA sequence
gcaggagaatcgcttgaacc

SEQ ID NO: 541207 - DNA, 20 bp, Artificial
  CRISPR gRNA sequence
caggagaatcgcttgaaccc

SEQ ID NO: 541208 - DNA, 20 bp, Artificial
  CRISPR gRNA sequence
ggagaatcgcttgaacccgg

SEQ ID NO: 541209 - DNA, 20 bp, Artificial
  CRISPR gRNA sequence
gagaatcgcttgaacccggg

SEQ ID NO: 541210 - DNA, 20 bp, Artificial
  CRISPR gRNA sequence
aatcgcttgaacccgggagg

SEQ ID NO: 541211 - DNA, 20 bp, Artificial
  CRISPR gRNA sequence
tcgcttgaacccgggaggtg

SEQ ID NO: 541212 - DNA, 20 bp, Artificial
  CRISPR gRNA sequence
cgcttgaacccgggaggtgg

SEQ ID NO: 541213 - DNA, 20 bp, Artificial
  CRISPR gRNA sequence
aacccgggaggtggaggttg

SEQ ID NO: 541214 - DNA, 20 bp, Artificial
  CRISPR gRNA sequence
ccgggaggtggaggttgcag

SEQ ID NO: 541215 - DNA, 20 bp, Artificial
  CRISPR gRNA sequence
aggtggaggttgcagtggcc

SEQ ID NO: 541216 - DNA, 20 bp, Artificial
  CRISPR gRNA sequence
aagactgtgccactgcactc

SEQ ID NO: 541217 - DNA, 20 bp, Artificial
  CRISPR gRNA sequence
tgtgccactgcactccagcc

SEQ ID NO: 541218 - DNA, 20 bp, Artificial
  CRISPR gRNA sequence
gtgccactgcactccagcct

SEQ ID NO: 541219 - DNA, 20 bp, Artificial
  CRISPR gRNA sequence
ctgcactccagcctgggtga

SEQ ID NO: 541220 - DNA, 20 bp, Artificial
  CRISPR gRNA sequence
gcactccagcctgggtgaca

SEQ ID NO: 541221 - DNA, 20 bp, Artificial
  CRISPR gRNA sequence
tccagcctgggtgacagagc

SEQ ID NO: 541222 - DNA, 20 bp, Artificial
  CRISPR gRNA sequence
gacagagcaagactccatct

SEQ ID NO: 541223 - DNA, 20 bp, Artificial
  CRISPR gRNA sequence
aaaaaaaaaaaaaaaaaaat

SEQ ID NO: 541224 - DNA, 20 bp, Artificial
  CRISPR gRNA sequence
cagaatcctaaaaacatatt

SEQ ID NO: 541225 - DNA, 20 bp, Artificial
  CRISPR gRNA sequence
aatcctaaaaacatattaag

SEQ ID NO: 541226 - DNA, 20 bp, Artificial
  CRISPR gRNA sequence
atcctaaaaacatattaaga

SEQ ID NO: 541227 - DNA, 20 bp, Artificial
  CRISPR gRNA sequence
tttctaaccttattattttg

SEQ ID NO: 541228 - DNA, 20 bp, Artificial
  CRISPR gRNA sequence
ttctaaccttattattttgc

SEQ ID NO: 541229 - DNA, 20 bp, Artificial
  CRISPR gRNA sequence
aaccttattattttgcaggt

SEQ ID NO: 541230 - DNA, 20 bp, Artificial
  CRISPR gRNA sequence
accttattattttgcaggtg

SEQ ID NO: 541231 - DNA, 20 bp, Artificial
  CRISPR gRNA sequence
attttgcaggtgaggaaact

SEQ ID NO: 541232 - DNA, 20 bp, Artificial
  CRISPR gRNA sequence
ttttgcaggtgaggaaactg

SEQ ID NO: 541233 - DNA, 20 bp, Artificial
  CRISPR gRNA sequence
aactgaggcacaacaatgtt

SEQ ID NO: 541234 - DNA, 20 bp, Artificial
  CRISPR gRNA sequence
cacaacaatgttaagtaatg

SEQ ID NO: 541235 - DNA, 20 bp, Artificial
  CRISPR gRNA sequence
acaatgttaagtaatgaagc

SEQ ID NO: 541236 - DNA, 20 bp, Artificial
  CRISPR gRNA sequence
aatgaagccagatttgaacc

SEQ ID NO: 541237 - DNA, 20 bp, Artificial
  CRISPR gRNA sequence
gaacctggacaatctgactg

SEQ ID NO: 541238 - DNA, 20 bp, Artificial
  CRISPR gRNA sequence
ggacaatctgactgcagaat

SEQ ID NO: 541239 - DNA, 20 bp, Artificial
  CRISPR gRNA sequence
cttaaccattgtttcttatt

SEQ ID NO: 541240 - DNA, 20 bp, Artificial
  CRISPR gRNA sequence
ttcttatttagcttgctaca

SEQ ID NO: 541241 - DNA, 20 bp, Artificial
  CRISPR gRNA sequence
tttagcttgctacatggcat

SEQ ID NO: 541242 - DNA, 20 bp, Artificial
  CRISPR gRNA sequence
ttagcttgctacatggcata

SEQ ID NO: 541243 - DNA, 20 bp, Artificial
  CRISPR gRNA sequence
tacatggcataaggctctta

SEQ ID NO: 541244 - DNA, 20 bp, Artificial
  CRISPR gRNA sequence
tggcataaggctcttaaaga

SEQ ID NO: 541245 - DNA, 20 bp, Artificial
  CRISPR gRNA sequence
ttaaagatagtgacatgatg

SEQ ID NO: 541246 - DNA, 20 bp, Artificial
  CRISPR gRNA sequence
taaagatagtgacatgatgc

SEQ ID NO: 541247 - DNA, 20 bp, Artificial
  CRISPR gRNA sequence
aaagatagtgacatgatgca

SEQ ID NO: 541248 - DNA, 20 bp, Artificial
  CRISPR gRNA sequence
tgacatgatgcagggtttct

SEQ ID NO: 541249 - DNA, 20 bp, Artificial
  CRISPR gRNA sequence
gacatgatgcagggtttctc

SEQ ID NO: 541250 - DNA, 20 bp, Artificial
  CRISPR gRNA sequence
gtttctcaggatacaatcta

SEQ ID NO: 541251 - DNA, 20 bp, Artificial
  CRISPR gRNA sequence
ctcaggatacaatctataga

SEQ ID NO: 541252 - DNA, 20 bp, Artificial
  CRISPR gRNA sequence
atacaatctatagacagcat

SEQ ID NO: 541253 - DNA, 20 bp, Artificial
  CRISPR gRNA sequence
atctatagacagcattggaa

SEQ ID NO: 541254 - DNA, 20 bp, Artificial
  CRISPR gRNA sequence
tatagacagcattggaacag

SEQ ID NO: 541255 - DNA, 20 bp, Artificial
  CRISPR gRNA sequence
gaacagcagatgttgcaaat

SEQ ID NO: 541256 - DNA, 20 bp, Artificial
  CRISPR gRNA sequence
agcagatgttgcaaatgaga

SEQ ID NO: 541257 - DNA, 20 bp, Artificial
  CRISPR gRNA sequence
gcaaatgagaaagtcaaact

SEQ ID NO: 541258 - DNA, 20 bp, Artificial
  CRISPR gRNA sequence
tgagaaagtcaaactgagtt

SEQ ID NO: 541259 - DNA, 20 bp, Artificial
  CRISPR gRNA sequence
taagcacacctccaaaccta

SEQ ID NO: 541260 - DNA, 20 bp, Artificial
  CRISPR gRNA sequence
aagcacacctccaaacctac

SEQ ID NO: 541261 - DNA, 20 bp, Artificial
  CRISPR gRNA sequence
acacctccaaacctacaggt

SEQ ID NO: 541262 - DNA, 20 bp, Artificial
  CRISPR gRNA sequence
cacctccaaacctacaggtg

SEQ ID NO: 541263 - DNA, 20 bp, Artificial
  CRISPR gRNA sequence
aaacctacaggtgaggcact

SEQ ID NO: 541264 - DNA, 20 bp, Artificial
  CRISPR gRNA sequence
aggtgaggcactaagctctg

SEQ ID NO: 541265 - DNA, 20 bp, Artificial
  CRISPR gRNA sequence
gtttccaaatcatcgaatgc

SEQ ID NO: 541266 - DNA, 20 bp, Artificial
  CRISPR gRNA sequence
ttccaaatcatcgaatgcta

SEQ ID NO: 541267 - DNA, 20 bp, Artificial
  CRISPR gRNA sequence
atcatcgaatgctagagctg

SEQ ID NO: 541268 - DNA, 20 bp, Artificial
  CRISPR gRNA sequence
catcgaatgctagagctgaa

SEQ ID NO: 541269 - DNA, 20 bp, Artificial
  CRISPR gRNA sequence
atcgaatgctagagctgaag

SEQ ID NO: 541270 - DNA, 20 bp, Artificial
  CRISPR gRNA sequence
tcgaatgctagagctgaaga

SEQ ID NO: 541271 - DNA, 20 bp, Artificial
  CRISPR gRNA sequence
gctagagctgaagagggcct

SEQ ID NO: 541272 - DNA, 20 bp, Artificial
  CRISPR gRNA sequence
tagagctgaagagggcctca

SEQ ID NO: 541273 - DNA, 20 bp, Artificial
  CRISPR gRNA sequence
gagctgaagagggcctcaga

SEQ ID NO: 541274 - DNA, 20 bp, Artificial
  CRISPR gRNA sequence
tgaagagggcctcagagagc

SEQ ID NO: 541275 - DNA, 20 bp, Artificial
  CRISPR gRNA sequence
ggcctcagagagcaagactc

SEQ ID NO: 541276 - DNA, 20 bp, Artificial
  CRISPR gRNA sequence
cagagagcaagactccagtc

SEQ ID NO: 541277 - DNA, 20 bp, Artificial
  CRISPR gRNA sequence
agagagcaagactccagtca

SEQ ID NO: 541278 - DNA, 20 bp, Artificial
  CRISPR gRNA sequence
gagcaagactccagtcaagg

SEQ ID NO: 541279 - DNA, 20 bp, Artificial
  CRISPR gRNA sequence
gactccagtcaaggaagaaa

SEQ ID NO: 541280 - DNA, 20 bp, Artificial
  CRISPR gRNA sequence
ccagtcaaggaagaaaaagc

SEQ ID NO: 541281 - DNA, 20 bp, Artificial
  CRISPR gRNA sequence
caaggaagaaaaagccagac

SEQ ID NO: 541282 - DNA, 20 bp, Artificial
  CRISPR gRNA sequence
gccagaccagaaacaataaa

SEQ ID NO: 541283 - DNA, 20 bp, Artificial
  CRISPR gRNA sequence
agaaacaataaaaagaaaac

SEQ ID NO: 541284 - DNA, 20 bp, Artificial
  CRISPR gRNA sequence
aaaaagaaaacgagcaaaca

SEQ ID NO: 541285 - DNA, 20 bp, Artificial
  CRISPR gRNA sequence
aaaagaaaacgagcaaacaa

SEQ ID NO: 541286 - DNA, 20 bp, Artificial
  CRISPR gRNA sequence
aagaaaacgagcaaacaaag

SEQ ID NO: 541287 - DNA, 20 bp, Artificial
  CRISPR gRNA sequence
gagcaaacaaaggagtcaca

SEQ ID NO: 541288 - DNA, 20 bp, Artificial
  CRISPR gRNA sequence
acaaaggagtcacaaagaaa

SEQ ID NO: 541289 - DNA, 20 bp, Artificial
  CRISPR gRNA sequence
gtcacaaagaaacagaactg

SEQ ID NO: 541290 - DNA, 20 bp, Artificial
  CRISPR gRNA sequence
aactgtggcaaatgacgcat

SEQ ID NO: 541291 - DNA, 20 bp, Artificial
  CRISPR gRNA sequence
ggcaaatgacgcattagacg

SEQ ID NO: 541292 - DNA, 20 bp, Artificial
  CRISPR gRNA sequence
atgacgcattagacgaagac

SEQ ID NO: 541293 - DNA, 20 bp, Artificial
  CRISPR gRNA sequence
aagaccagcaattccaccca

SEQ ID NO: 541294 - DNA, 20 bp, Artificial
  CRISPR gRNA sequence
gaccagcaattccacccaca

SEQ ID NO: 541295 - DNA, 20 bp, Artificial
  CRISPR gRNA sequence
accagcaattccacccacag

SEQ ID NO: 541296 - DNA, 20 bp, Artificial
  CRISPR gRNA sequence
cagcaattccacccacagag

SEQ ID NO: 541297 - DNA, 20 bp, Artificial
  CRISPR gRNA sequence
tccacccacagaggagatac

SEQ ID NO: 541298 - DNA, 20 bp, Artificial
  CRISPR gRNA sequence
acccacagaggagataccag

SEQ ID NO: 541299 - DNA, 20 bp, Artificial
  CRISPR gRNA sequence
cccacagaggagataccagc

SEQ ID NO: 541300 - DNA, 20 bp, Artificial
  CRISPR gRNA sequence
agaggagataccagcgggcc

SEQ ID NO: 541301 - DNA, 20 bp, Artificial
  CRISPR gRNA sequence
gataccagcgggccaagtgt

SEQ ID NO: 541302 - DNA, 20 bp, Artificial
  CRISPR gRNA sequence
ccagcgggccaagtgtgagt

SEQ ID NO: 541303 - DNA, 20 bp, Artificial
  CRISPR gRNA sequence
gcgggccaagtgtgagtcag

SEQ ID NO: 541304 - DNA, 20 bp, Artificial
  CRISPR gRNA sequence
cgggccaagtgtgagtcaga

SEQ ID NO: 541305 - DNA, 20 bp, Artificial
  CRISPR gRNA sequence
gggccaagtgtgagtcagaa

SEQ ID NO: 541306 - DNA, 20 bp, Artificial
  CRISPR gRNA sequence
aagtgtgagtcagaagggac

SEQ ID NO: 541307 - DNA, 20 bp, Artificial
  CRISPR gRNA sequence
gtgagtcagaagggactggt

SEQ ID NO: 541308 - DNA, 20 bp, Artificial
  CRISPR gRNA sequence
tgagtcagaagggactggtg

SEQ ID NO: 541309 - DNA, 20 bp, Artificial
  CRISPR gRNA sequence
actggtgaggacttgcgcac

SEQ ID NO: 541310 - DNA, 20 bp, Artificial
  CRISPR gRNA sequence
gtgaggacttgcgcaccagt

SEQ ID NO: 541311 - DNA, 20 bp, Artificial
  CRISPR gRNA sequence
cttgcgcaccagtgagccta

SEQ ID NO: 541312 - DNA, 20 bp, Artificial
  CRISPR gRNA sequence
ttgcgcaccagtgagcctac

SEQ ID NO: 541313 - DNA, 20 bp, Artificial
  CRISPR gRNA sequence
tgcgcaccagtgagcctaca

SEQ ID NO: 541314 - DNA, 20 bp, Artificial
  CRISPR gRNA sequence
cgcaccagtgagcctacagg

SEQ ID NO: 541315 - DNA, 20 bp, Artificial
  CRISPR gRNA sequence
gcaccagtgagcctacaggg

SEQ ID NO: 541316 - DNA, 20 bp, Artificial
  CRISPR gRNA sequence
caccagtgagcctacaggga

SEQ ID NO: 541317 - DNA, 20 bp, Artificial
  CRISPR gRNA sequence
accagtgagcctacagggag

SEQ ID NO: 541318 - DNA, 20 bp, Artificial
  CRISPR gRNA sequence
acagggaggggcctgccatg

SEQ ID NO: 541319 - DNA, 20 bp, Artificial
  CRISPR gRNA sequence
aggggcctgccatgtggaaa

SEQ ID NO: 541320 - DNA, 20 bp, Artificial
  CRISPR gRNA sequence
ggggcctgccatgtggaaac

SEQ ID NO: 541321 - DNA, 20 bp, Artificial
  CRISPR gRNA sequence
ggcctgccatgtggaaacag

SEQ ID NO: 541322 - DNA, 20 bp, Artificial
  CRISPR gRNA sequence
tggaaacaggagctgtgcct

SEQ ID NO: 541323 - DNA, 20 bp, Artificial
  CRISPR gRNA sequence
gtgcctcagctcctgccatg

SEQ ID NO: 541324 - DNA, 20 bp, Artificial
  CRISPR gRNA sequence
cagctcctgccatgtggaaa

SEQ ID NO: 541325 - DNA, 20 bp, Artificial
  CRISPR gRNA sequence
gctcctgccatgtggaaaca

SEQ ID NO: 541326 - DNA, 20 bp, Artificial
  CRISPR gRNA sequence
ctcctgccatgtggaaacag

SEQ ID NO: 541327 - DNA, 20 bp, Artificial
  CRISPR gRNA sequence
aaacagaggcccaccattgc

SEQ ID NO: 541328 - DNA, 20 bp, Artificial
  CRISPR gRNA sequence
aacagaggcccaccattgcc

SEQ ID NO: 541329 - DNA, 20 bp, Artificial
  CRISPR gRNA sequence
ggttcccaatttttcaaaaa

SEQ ID NO: 541330 - DNA, 20 bp, Artificial
  CRISPR gRNA sequence
cccaatttttcaaaaaaagc

SEQ ID NO: 541331 - DNA, 20 bp, Artificial
  CRISPR gRNA sequence
gtgaaaattcctgttcttga

SEQ ID NO: 541332 - DNA, 20 bp, Artificial
  CRISPR gRNA sequence
aaattcctgttcttgaaagt

SEQ ID NO: 541333 - DNA, 20 bp, Artificial
  CRISPR gRNA sequence
ttggcaactaattcaaatct

SEQ ID NO: 541334 - DNA, 20 bp, Artificial
  CRISPR gRNA sequence
aactaattcaaatctgagct

SEQ ID NO: 541335 - DNA, 20 bp, Artificial
  CRISPR gRNA sequence
actaattcaaatctgagctt

SEQ ID NO: 541336 - DNA, 20 bp, Artificial
  CRISPR gRNA sequence
ctaattcaaatctgagctta

SEQ ID NO: 541337 - DNA, 20 bp, Artificial
  CRISPR gRNA sequence
taattcaaatctgagcttag

SEQ ID NO: 541338 - DNA, 20 bp, Artificial
  CRISPR gRNA sequence
tctgagcttaggggtaaccc

SEQ ID NO: 541339 - DNA, 20 bp, Artificial
  CRISPR gRNA sequence
agcttaggggtaaccccagc

SEQ ID NO: 541340 - DNA, 20 bp, Artificial
  CRISPR gRNA sequence
gcttaggggtaaccccagcc

SEQ ID NO: 541341 - DNA, 20 bp, Artificial
  CRISPR gRNA sequence
aggggtaaccccagccaggc

SEQ ID NO: 541342 - DNA, 20 bp, Artificial
  CRISPR gRNA sequence
cccagccaggctagccctat

SEQ ID NO: 541343 - DNA, 20 bp, Artificial
  CRISPR gRNA sequence
ccagccaggctagccctatc

SEQ ID NO: 541344 - DNA, 20 bp, Artificial
  CRISPR gRNA sequence
caggctagccctatcaggac

SEQ ID NO: 541345 - DNA, 20 bp, Artificial
  CRISPR gRNA sequence
aggctagccctatcaggaca

SEQ ID NO: 541346 - DNA, 20 bp, Artificial
  CRISPR gRNA sequence
gccctatcaggacaaggaca

SEQ ID NO: 541347 - DNA, 20 bp, Artificial
  CRISPR gRNA sequence
ccctatcaggacaaggacaa

SEQ ID NO: 541348 - DNA, 20 bp, Artificial
  CRISPR gRNA sequence
gacaaaggtgttcctgtttt

SEQ ID NO: 541349 - DNA, 20 bp, Artificial
  CRISPR gRNA sequence
tggctgtatccccatatgtc

SEQ ID NO: 541350 - DNA, 20 bp, Artificial
  CRISPR gRNA sequence
atccccatatgtctggcata

SEQ ID NO: 541351 - DNA, 20 bp, Artificial
  CRISPR gRNA sequence
attaaaatacaacttaaatg

SEQ ID NO: 541352 - DNA, 20 bp, Artificial
  CRISPR gRNA sequence
acaacttaaatgtagttcaa

SEQ ID NO: 541353 - DNA, 20 bp, Artificial
  CRISPR gRNA sequence
ttaaatgtagttcaaaagat

SEQ ID NO: 541354 - DNA, 20 bp, Artificial
  CRISPR gRNA sequence
taaatgtagttcaaaagata

SEQ ID NO: 541355 - DNA, 20 bp, Artificial
  CRISPR gRNA sequence
caaaagataaggcttcctga

SEQ ID NO: 541356 - DNA, 20 bp, Artificial
  CRISPR gRNA sequence
gataaggcttcctgacagaa

SEQ ID NO: 541357 - DNA, 20 bp, Artificial
  CRISPR gRNA sequence
gacagaatagcaaaatttga

SEQ ID NO: 541358 - DNA, 20 bp, Artificial
  CRISPR gRNA sequence
ttgacagtcaccccaaaccc

SEQ ID NO: 541359 - DNA, 20 bp, Artificial
  CRISPR gRNA sequence
tgacagtcaccccaaaccct

SEQ ID NO: 541360 - DNA, 20 bp, Artificial
  CRISPR gRNA sequence
tgtgaaatcccaaattgctg

SEQ ID NO: 541361 - DNA, 20 bp, Artificial
  CRISPR gRNA sequence
tcccaaattgctgtggaacc

SEQ ID NO: 541362 - DNA, 20 bp, Artificial
  CRISPR gRNA sequence
attgctgtggaacctggctg

SEQ ID NO: 541363 - DNA, 20 bp, Artificial
  CRISPR gRNA sequence
gctgtggaacctggctgaag

SEQ ID NO: 541364 - DNA, 20 bp, Artificial
  CRISPR gRNA sequence
ctgtggaacctggctgaaga

SEQ ID NO: 541365 - DNA, 20 bp, Artificial
  CRISPR gRNA sequence
gtggaacctggctgaagaag

SEQ ID NO: 541366 - DNA, 20 bp, Artificial
  CRISPR gRNA sequence
tggaacctggctgaagaagg

SEQ ID NO: 541367 - DNA, 20 bp, Artificial
  CRISPR gRNA sequence
ctgaagaaggaggacttcgt

SEQ ID NO: 541368 - DNA, 20 bp, Artificial
  CRISPR gRNA sequence
tgaagaaggaggacttcgta

SEQ ID NO: 541369 - DNA, 20 bp, Artificial
  CRISPR gRNA sequence
aagaaggaggacttcgtaag

SEQ ID NO: 541370 - DNA, 20 bp, Artificial
  CRISPR gRNA sequence
gaaggaggacttcgtaagga

SEQ ID NO: 541371 - DNA, 20 bp, Artificial
  CRISPR gRNA sequence
gaggacttcgtaaggagaga

SEQ ID NO: 541372 - DNA, 20 bp, Artificial
  CRISPR gRNA sequence
ggacttcgtaaggagagatg

SEQ ID NO: 541373 - DNA, 20 bp, Artificial
  CRISPR gRNA sequence
ttcgtaaggagagatggaga

SEQ ID NO: 541374 - DNA, 20 bp, Artificial
  CRISPR gRNA sequence
gtaaggagagatggagaaag

SEQ ID NO: 541375 - DNA, 20 bp, Artificial
  CRISPR gRNA sequence
gatggagaaagaagtttaac

SEQ ID NO: 541376 - DNA, 20 bp, Artificial
  CRISPR gRNA sequence
tggagaaagaagtttaactg

SEQ ID NO: 541377 - DNA, 20 bp, Artificial
  CRISPR gRNA sequence
actggagcttaaaaataaaa

SEQ ID NO: 541378 - DNA, 20 bp, Artificial
  CRISPR gRNA sequence
agcttaaaaataaaatggct

SEQ ID NO: 541379 - DNA, 20 bp, Artificial
  CRISPR gRNA sequence
gcttaaaaataaaatggctc

SEQ ID NO: 541380 - DNA, 20 bp, Artificial
  CRISPR gRNA sequence
ttaaaaataaaatggctcag

SEQ ID NO: 541381 - DNA, 20 bp, Artificial
  CRISPR gRNA sequence
gccctcatatacaaccaaaa

SEQ ID NO: 541382 - DNA, 20 bp, Artificial
  CRISPR gRNA sequence
atatacaaccaaaacagact

SEQ ID NO: 541383 - DNA, 20 bp, Artificial
  CRISPR gRNA sequence
ccaaaacagactcagttttt

SEQ ID NO: 541384 - DNA, 20 bp, Artificial
  CRISPR gRNA sequence
cactttctgcctcatcacca

SEQ ID NO: 541385 - DNA, 20 bp, Artificial
  CRISPR gRNA sequence
ttctgcctcatcaccaaagc

SEQ ID NO: 541386 - DNA, 20 bp, Artificial
  CRISPR gRNA sequence
gcctcatcaccaaagcaaga

SEQ ID NO: 541387 - DNA, 20 bp, Artificial
  CRISPR gRNA sequence
cctcatcaccaaagcaagat

SEQ ID NO: 541388 - DNA, 20 bp, Artificial
  CRISPR gRNA sequence
tcatcaccaaagcaagatgg

SEQ ID NO: 541389 - DNA, 20 bp, Artificial
  CRISPR gRNA sequence
catcaccaaagcaagatggg

SEQ ID NO: 541390 - DNA, 20 bp, Artificial
  CRISPR gRNA sequence
aagcaagatgggaggacctg

SEQ ID NO: 541391 - DNA, 20 bp, Artificial
  CRISPR gRNA sequence
agcaagatgggaggacctgc

SEQ ID NO: 541392 - DNA, 20 bp, Artificial
  CRISPR gRNA sequence
gctccaccttcccaactcca

SEQ ID NO: 541393 - DNA, 20 bp, Artificial
  CRISPR gRNA sequence
actccacagctgtccctttt

SEQ ID NO: 541394 - DNA, 20 bp, Artificial
  CRISPR gRNA sequence
cttttgagatgttccctctc

SEQ ID NO: 541395 - DNA, 20 bp, Artificial
  CRISPR gRNA sequence
agatgttccctctcaagttt

SEQ ID NO: 541396 - DNA, 20 bp, Artificial
  CRISPR gRNA sequence
tgttccctctcaagtttaag

SEQ ID NO: 541397 - DNA, 20 bp, Artificial
  CRISPR gRNA sequence
ttaagtagattttaccaact

SEQ ID NO: 541398 - DNA, 20 bp, Artificial
  CRISPR gRNA sequence
attttaccaactaagtgtta

SEQ ID NO: 541399 - DNA, 20 bp, Artificial
  CRISPR gRNA sequence
ttttaccaactaagtgttat

SEQ ID NO: 541400 - DNA, 20 bp, Artificial
  CRISPR gRNA sequence
caactaagtgttataggatg

SEQ ID NO: 541401 - DNA, 20 bp, Artificial
  CRISPR gRNA sequence
aactaagtgttataggatgc

SEQ ID NO: 541402 - DNA, 20 bp, Artificial
  CRISPR gRNA sequence
actaagtgttataggatgca

SEQ ID NO: 541403 - DNA, 20 bp, Artificial
  CRISPR gRNA sequence
taggatgcagggcaccacac

SEQ ID NO: 541404 - DNA, 20 bp, Artificial
  CRISPR gRNA sequence
gataaacttgtacccactca

SEQ ID NO: 541405 - DNA, 20 bp, Artificial
  CRISPR gRNA sequence
ttgtacccactcatggatgt

SEQ ID NO: 541406 - DNA, 20 bp, Artificial
  CRISPR gRNA sequence
tcagccccaatcaaacttaa

SEQ ID NO: 541407 - DNA, 20 bp, Artificial
  CRISPR gRNA sequence
caaacttaacagcctcgcta

SEQ ID NO: 541408 - DNA, 20 bp, Artificial
  CRISPR gRNA sequence
taacagcctcgctatggttt

SEQ ID NO: 541409 - DNA, 20 bp, Artificial
  CRISPR gRNA sequence
aacagcctcgctatggtttg

SEQ ID NO: 541410 - DNA, 20 bp, Artificial
  CRISPR gRNA sequence
cagcctcgctatggtttgag

SEQ ID NO: 541411 - DNA, 20 bp, Artificial
  CRISPR gRNA sequence
agcctcgctatggtttgagg

SEQ ID NO: 541412 - DNA, 20 bp, Artificial
  CRISPR gRNA sequence
ccttccttcctttttctttt

SEQ ID NO: 541413 - DNA, 20 bp, Artificial
  CRISPR gRNA sequence
ttccttcctttttctttttg

SEQ ID NO: 541414 - DNA, 20 bp, Artificial
  CRISPR gRNA sequence
ttcctttttctttttggaga

SEQ ID NO: 541415 - DNA, 20 bp, Artificial
  CRISPR gRNA sequence
tcctttttctttttggagac

SEQ ID NO: 541416 - DNA, 20 bp, Artificial
  CRISPR gRNA sequence
cctttttctttttggagaca

SEQ ID NO: 541417 - DNA, 20 bp, Artificial
  CRISPR gRNA sequence
cagggtctcattctgtcacc

SEQ ID NO: 541418 - DNA, 20 bp, Artificial
  CRISPR gRNA sequence
agggtctcattctgtcaccc

SEQ ID NO: 541419 - DNA, 20 bp, Artificial
  CRISPR gRNA sequence
tctcattctgtcacccaggt

SEQ ID NO: 541420 - DNA, 20 bp, Artificial
  CRISPR gRNA sequence
ctgtcacccaggttggtgtg

SEQ ID NO: 541421 - DNA, 20 bp, Artificial
  CRISPR gRNA sequence
tcacccaggttggtgtgcag

SEQ ID NO: 541422 - DNA, 20 bp, Artificial
  CRISPR gRNA sequence
ggtgtgcagtggtgcaatcg

SEQ ID NO: 541423 - DNA, 20 bp, Artificial
  CRISPR gRNA sequence
ggtgcaatcgtggctcactg

SEQ ID NO: 541424 - DNA, 20 bp, Artificial
  CRISPR gRNA sequence
tcactgtagcttcaacctcc

SEQ ID NO: 541425 - DNA, 20 bp, Artificial
  CRISPR gRNA sequence
cactgtagcttcaacctcct

SEQ ID NO: 541426 - DNA, 20 bp, Artificial
  CRISPR gRNA sequence
agcttcaacctcctgggctc

SEQ ID NO: 541427 - DNA, 20 bp, Artificial
  CRISPR gRNA sequence
ctcaagtgatccttctgcct

SEQ ID NO: 541428 - DNA, 20 bp, Artificial
  CRISPR gRNA sequence
tccttctgcctcagcctccc

SEQ ID NO: 541429 - DNA, 20 bp, Artificial
  CRISPR gRNA sequence
ttctgcctcagcctcccaag

SEQ ID NO: 541430 - DNA, 20 bp, Artificial
  CRISPR gRNA sequence
gcctcagcctcccaagtagc

SEQ ID NO: 541431 - DNA, 20 bp, Artificial
  CRISPR gRNA sequence
ctcccaagtagctagaacta

SEQ ID NO: 541432 - DNA, 20 bp, Artificial
  CRISPR gRNA sequence
cagttgcatgccaccacgcc

SEQ ID NO: 541433 - DNA, 20 bp, Artificial
  CRISPR gRNA sequence
gctaatttttatattttttg

SEQ ID NO: 541434 - DNA, 20 bp, Artificial
  CRISPR gRNA sequence
tttatattttttgtagaaac

SEQ ID NO: 541435 - DNA, 20 bp, Artificial
  CRISPR gRNA sequence
ttatattttttgtagaaaca

SEQ ID NO: 541436 - DNA, 20 bp, Artificial
  CRISPR gRNA sequence
caaggtctcactatgttgct

SEQ ID NO: 541437 - DNA, 20 bp, Artificial
  CRISPR gRNA sequence
aaggtctcactatgttgctc

SEQ ID NO: 541438 - DNA, 20 bp, Artificial
  CRISPR gRNA sequence
tcaggctgatctcaaactcg

SEQ ID NO: 541439 - DNA, 20 bp, Artificial
  CRISPR gRNA sequence
caggctgatctcaaactcgt

SEQ ID NO: 541440 - DNA, 20 bp, Artificial
  CRISPR gRNA sequence
gatctcaaactcgtgggctc

SEQ ID NO: 541441 - DNA, 20 bp, Artificial
  CRISPR gRNA sequence
gctcaagtgatcctcctccc

SEQ ID NO: 541442 - DNA, 20 bp, Artificial
  CRISPR gRNA sequence
ctcaagtgatcctcctccct

SEQ ID NO: 541443 - DNA, 20 bp, Artificial
  CRISPR gRNA sequence
cctcctccctgggccttctg

SEQ ID NO: 541444 - DNA, 20 bp, Artificial
  CRISPR gRNA sequence
cctgggccttctgaagtgct

SEQ ID NO: 541445 - DNA, 20 bp, Artificial
  CRISPR gRNA sequence
ttctgaagtgctgagattac

SEQ ID NO: 541446 - DNA, 20 bp, Artificial
  CRISPR gRNA sequence
agtgctgagattacaagcat

SEQ ID NO: 541447 - DNA, 20 bp, Artificial
  CRISPR gRNA sequence
caagcatgagccaccatgcc

SEQ ID NO: 541448 - DNA, 20 bp, Artificial
  CRISPR gRNA sequence
gcccagccaatgccatacct

SEQ ID NO: 541449 - DNA, 20 bp, Artificial
  CRISPR gRNA sequence
ccagccaatgccatacctta

SEQ ID NO: 541450 - DNA, 20 bp, Artificial
  CRISPR gRNA sequence
caatgccataccttagagac

SEQ ID NO: 541451 - DNA, 20 bp, Artificial
  CRISPR gRNA sequence
agacaagctaatcactcttc

SEQ ID NO: 541452 - DNA, 20 bp, Artificial
  CRISPR gRNA sequence
gacaagctaatcactcttcc

SEQ ID NO: 541453 - DNA, 20 bp, Artificial
  CRISPR gRNA sequence
aatcactcttccgggatttg

SEQ ID NO: 541454 - DNA, 20 bp, Artificial
  CRISPR gRNA sequence
atcactcttccgggatttga

SEQ ID NO: 541455 - DNA, 20 bp, Artificial
  CRISPR gRNA sequence
ctcttccgggatttgaagga

SEQ ID NO: 541456 - DNA, 20 bp, Artificial
  CRISPR gRNA sequence
tcttccgggatttgaaggaa

SEQ ID NO: 541457 - DNA, 20 bp, Artificial
  CRISPR gRNA sequence
cttccgggatttgaaggaaa

SEQ ID NO: 541458 - DNA, 20 bp, Artificial
  CRISPR gRNA sequence
ttgaaggaaagggttttctt

SEQ ID NO: 541459 - DNA, 20 bp, Artificial
  CRISPR gRNA sequence
ggttttcttgagtttgttct

SEQ ID NO: 541460 - DNA, 20 bp, Artificial
  CRISPR gRNA sequence
gaaataaacaatgtaatttt

SEQ ID NO: 541461 - DNA, 20 bp, Artificial
  CRISPR gRNA sequence
ctctctctctaaaatatttt

SEQ ID NO: 541462 - DNA, 20 bp, Artificial
  CRISPR gRNA sequence
tctctctctaaaatatttta

SEQ ID NO: 541463 - DNA, 20 bp, Artificial
  CRISPR gRNA sequence
tttaaggctcacactgcctg

SEQ ID NO: 541464 - DNA, 20 bp, Artificial
  CRISPR gRNA sequence
ctcacactgcctgcagattt

SEQ ID NO: 541465 - DNA, 20 bp, Artificial
  CRISPR gRNA sequence
acactgcctgcagattttag

SEQ ID NO: 541466 - DNA, 20 bp, Artificial
  CRISPR gRNA sequence
cactgcctgcagattttagc

SEQ ID NO: 541467 - DNA, 20 bp, Artificial
  CRISPR gRNA sequence
cctgcagattttagcaggta

SEQ ID NO: 541468 - DNA, 20 bp, Artificial
  CRISPR gRNA sequence
gattttagcaggtaaagtaa

SEQ ID NO: 541469 - DNA, 20 bp, Artificial
  CRISPR gRNA sequence
ttgaccaaaaaaaaaaaaaa

SEQ ID NO: 541470 - DNA, 20 bp, Artificial
  CRISPR gRNA sequence
ccaaaaaaaaaaaaaaaaga

SEQ ID NO: 541471 - DNA, 20 bp, Artificial
  CRISPR gRNA sequence
aaaaaaaaaaagaaagaaaa

SEQ ID NO: 541472 - DNA, 20 bp, Artificial
  CRISPR gRNA sequence
aaaaagaaaaattcccttaa

SEQ ID NO: 541473 - DNA, 20 bp, Artificial
  CRISPR gRNA sequence
aaaaattcccttaaaagttt

SEQ ID NO: 541474 - DNA, 20 bp, Artificial
  CRISPR gRNA sequence
gtacctgaatatatgaatat

SEQ ID NO: 541475 - DNA, 20 bp, Artificial
  CRISPR gRNA sequence
tggtatttccctctgaatat

SEQ ID NO: 541476 - DNA, 20 bp, Artificial
  CRISPR gRNA sequence
ctgaatataagacatcataa

SEQ ID NO: 541477 - DNA, 20 bp, Artificial
  CRISPR gRNA sequence
tcataatggtgattcattta

SEQ ID NO: 541478 - DNA, 20 bp, Artificial
  CRISPR gRNA sequence
attcatttaaagcctcgtgc

SEQ ID NO: 541479 - DNA, 20 bp, Artificial
  CRISPR gRNA sequence
tttaaagcctcgtgcaagcc

SEQ ID NO: 541480 - DNA, 20 bp, Artificial
  CRISPR gRNA sequence
taaagcctcgtgcaagccca

SEQ ID NO: 541481 - DNA, 20 bp, Artificial
  CRISPR gRNA sequence
gcctcgtgcaagcccagaga

SEQ ID NO: 541482 - DNA, 20 bp, Artificial
  CRISPR gRNA sequence
tcgtgcaagcccagagatag

SEQ ID NO: 541483 - DNA, 20 bp, Artificial
  CRISPR gRNA sequence
cgtgcaagcccagagatagc

SEQ ID NO: 541484 - DNA, 20 bp, Artificial
  CRISPR gRNA sequence
gtgcaagcccagagatagca

SEQ ID NO: 541485 - DNA, 20 bp, Artificial
  CRISPR gRNA sequence
gcccagagatagcagggtct

SEQ ID NO: 541486 - DNA, 20 bp, Artificial
  CRISPR gRNA sequence
cccagagatagcagggtctt

SEQ ID NO: 541487 - DNA, 20 bp, Artificial
  CRISPR gRNA sequence
ccagagatagcagggtcttg

SEQ ID NO: 541488 - DNA, 20 bp, Artificial
  CRISPR gRNA sequence
cttggggcatttttgctccc

SEQ ID NO: 541489 - DNA, 20 bp, Artificial
  CRISPR gRNA sequence
gggcatttttgctcccaagt

SEQ ID NO: 541490 - DNA, 20 bp, Artificial
  CRISPR gRNA sequence
catttttgctcccaagtgag

SEQ ID NO: 541491 - DNA, 20 bp, Artificial
  CRISPR gRNA sequence
tttgctcccaagtgagcaga

SEQ ID NO: 541492 - DNA, 20 bp, Artificial
  CRISPR gRNA sequence
gagcagatggatttctcatc

SEQ ID NO: 541493 - DNA, 20 bp, Artificial
  CRISPR gRNA sequence
atggatttctcatctggata

SEQ ID NO: 541494 - DNA, 20 bp, Artificial
  CRISPR gRNA sequence
tggatttctcatctggatat

SEQ ID NO: 541495 - DNA, 20 bp, Artificial
  CRISPR gRNA sequence
tcatctggatatgggtcact

SEQ ID NO: 541496 - DNA, 20 bp, Artificial
  CRISPR gRNA sequence
tggatatgggtcactgagca

SEQ ID NO: 541497 - DNA, 20 bp, Artificial
  CRISPR gRNA sequence
ccctctcacttctctgcgtt

SEQ ID NO: 541498 - DNA, 20 bp, Artificial
  CRISPR gRNA sequence
tgcgtttggtcttcacatca

SEQ ID NO: 541499 - DNA, 20 bp, Artificial
  CRISPR gRNA sequence
ttcacatcacggcacatttt

SEQ ID NO: 541500 - DNA, 20 bp, Artificial
  CRISPR gRNA sequence
tttcagttgatgcctacttg

SEQ ID NO: 541501 - DNA, 20 bp, Artificial
  CRISPR gRNA sequence
ttgatgcctacttgcagtat

SEQ ID NO: 541502 - DNA, 20 bp, Artificial
  CRISPR gRNA sequence
tgatgcctacttgcagtatc

SEQ ID NO: 541503 - DNA, 20 bp, Artificial
  CRISPR gRNA sequence
acttgcagtatcaggatgtg

SEQ ID NO: 541504 - DNA, 20 bp, Artificial
  CRISPR gRNA sequence
tatcaggatgtgtggcaatc

SEQ ID NO: 541505 - DNA, 20 bp, Artificial
  CRISPR gRNA sequence
atcaggatgtgtggcaatct

SEQ ID NO: 541506 - DNA, 20 bp, Artificial
  CRISPR gRNA sequence
aggatgtgtggcaatctggg

SEQ ID NO: 541507 - DNA, 20 bp, Artificial
  CRISPR gRNA sequence
cacacccatatatgcattta

SEQ ID NO: 541508 - DNA, 20 bp, Artificial
  CRISPR gRNA sequence
atatatgcatttatagtatt

SEQ ID NO: 541509 - DNA, 20 bp, Artificial
  CRISPR gRNA sequence
tatatgcatttatagtattg

SEQ ID NO: 541510 - DNA, 20 bp, Artificial
  CRISPR gRNA sequence
tatgcatttatagtattgag

SEQ ID NO: 541511 - DNA, 20 bp, Artificial
  CRISPR gRNA sequence
gcatttatagtattgaggag

SEQ ID NO: 541512 - DNA, 20 bp, Artificial
  CRISPR gRNA sequence
ggccaatctcctaaaatgtc

SEQ ID NO: 541513 - DNA, 20 bp, Artificial
  CRISPR gRNA sequence
gccaatctcctaaaatgtct

SEQ ID NO: 541514 - DNA, 20 bp, Artificial
  CRISPR gRNA sequence
atctcctaaaatgtctaggc

SEQ ID NO: 541515 - DNA, 20 bp, Artificial
  CRISPR gRNA sequence
atcaaataacctgtcctatt

SEQ ID NO: 541516 - DNA, 20 bp, Artificial
  CRISPR gRNA sequence
tcaaataacctgtcctatta

SEQ ID NO: 541517 - DNA, 20 bp, Artificial
  CRISPR gRNA sequence
ggccataaatattctcatat

SEQ ID NO: 541518 - DNA, 20 bp, Artificial
  CRISPR gRNA sequence
ataaatattctcatattagt

SEQ ID NO: 541519 - DNA, 20 bp, Artificial
  CRISPR gRNA sequence
atattagtcagtcccaattt

SEQ ID NO: 541520 - DNA, 20 bp, Artificial
  CRISPR gRNA sequence
tattagtcagtcccaatttt

SEQ ID NO: 541521 - DNA, 20 bp, Artificial
  CRISPR gRNA sequence
attagtcagtcccaattttg

SEQ ID NO: 541522 - DNA, 20 bp, Artificial
  CRISPR gRNA sequence
ttagtcagtcccaattttgg

SEQ ID NO: 541523 - DNA, 20 bp, Artificial
  CRISPR gRNA sequence
gtcagtcccaattttggggg

SEQ ID NO: 541524 - DNA, 20 bp, Artificial
  CRISPR gRNA sequence
ggggtagaaaatgtgcttac

SEQ ID NO: 541525 - DNA, 20 bp, Artificial
  CRISPR gRNA sequence
gggtagaaaatgtgcttacc

SEQ ID NO: 541526 - DNA, 20 bp, Artificial
  CRISPR gRNA sequence
gaaaatgtgcttaccaggca

SEQ ID NO: 541527 - DNA, 20 bp, Artificial
  CRISPR gRNA sequence
aaatgtgcttaccaggcatg

SEQ ID NO: 541528 - DNA, 20 bp, Artificial
  CRISPR gRNA sequence
taccaggcatggagataata

SEQ ID NO: 541529 - DNA, 20 bp, Artificial
  CRISPR gRNA sequence
ccaggcatggagataataaa

SEQ ID NO: 541530 - DNA, 20 bp, Artificial
  CRISPR gRNA sequence
caggcatggagataataaag

SEQ ID NO: 541531 - DNA, 20 bp, Artificial
  CRISPR gRNA sequence
ggcatggagataataaagag

SEQ ID NO: 541532 - DNA, 20 bp, Artificial
  CRISPR gRNA sequence
atggagataataaagaggag

SEQ ID NO: 541533 - DNA, 20 bp, Artificial
  CRISPR gRNA sequence
ctgtttgttttaactcaatc

SEQ ID NO: 541534 - DNA, 20 bp, Artificial
  CRISPR gRNA sequence
taactcaatcaagtttcata

SEQ ID NO: 541535 - DNA, 20 bp, Artificial
  CRISPR gRNA sequence
atacagttgtgactcttgcc

SEQ ID NO: 541536 - DNA, 20 bp, Artificial
  CRISPR gRNA sequence
tgtgactcttgcctagctct

SEQ ID NO: 541537 - DNA, 20 bp, Artificial
  CRISPR gRNA sequence
actcttgcctagctcttagc

SEQ ID NO: 541538 - DNA, 20 bp, Artificial
  CRISPR gRNA sequence
gctcttagcaagtccaatcc

SEQ ID NO: 541539 - DNA, 20 bp, Artificial
  CRISPR gRNA sequence
ctcttagcaagtccaatcca

SEQ ID NO: 541540 - DNA, 20 bp, Artificial
  CRISPR gRNA sequence
cttagcaagtccaatccaag

SEQ ID NO: 541541 - DNA, 20 bp, Artificial
  CRISPR gRNA sequence
aagtccaatccaaggagccc

SEQ ID NO: 541542 - DNA, 20 bp, Artificial
  CRISPR gRNA sequence
agtccaatccaaggagccct

SEQ ID NO: 541543 - DNA, 20 bp, Artificial
  CRISPR gRNA sequence
caatccaaggagccctaggc

SEQ ID NO: 541544 - DNA, 20 bp, Artificial
  CRISPR gRNA sequence
caaggagccctaggccagct

SEQ ID NO: 541545 - DNA, 20 bp, Artificial
  CRISPR gRNA sequence
gccctaggccagctcagcct

SEQ ID NO: 541546 - DNA, 20 bp, Artificial
  CRISPR gRNA sequence
gcctcagtaataatatttaa

SEQ ID NO: 541547 - DNA, 20 bp, Artificial
  CRISPR gRNA sequence
tcagtaataatatttaacag

SEQ ID NO: 541548 - DNA, 20 bp, Artificial
  CRISPR gRNA sequence
gtaataatatttaacagtag

SEQ ID NO: 541549 - DNA, 20 bp, Artificial
  CRISPR gRNA sequence
ataatatttaacagtagcag

SEQ ID NO: 541550 - DNA, 20 bp, Artificial
  CRISPR gRNA sequence
ttaacagtagcagcagcacg

SEQ ID NO: 541551 - DNA, 20 bp, Artificial
  CRISPR gRNA sequence
agcagcacgaagattcactg

SEQ ID NO: 541552 - DNA, 20 bp, Artificial
  CRISPR gRNA sequence
gcagcacgaagattcactgc

SEQ ID NO: 541553 - DNA, 20 bp, Artificial
  CRISPR gRNA sequence
ctgcaggcttactatgtgac

SEQ ID NO: 541554 - DNA, 20 bp, Artificial
  CRISPR gRNA sequence
atgtgacaagcacttgttcc

SEQ ID NO: 541555 - DNA, 20 bp, Artificial
  CRISPR gRNA sequence
gtgacaagcacttgttccaa

SEQ ID NO: 541556 - DNA, 20 bp, Artificial
  CRISPR gRNA sequence
ttaatcctcaactcaactct

SEQ ID NO: 541557 - DNA, 20 bp, Artificial
  CRISPR gRNA sequence
taatcctcaactcaactctg

SEQ ID NO: 541558 - DNA, 20 bp, Artificial
  CRISPR gRNA sequence
tcctcaactcaactctgagg

SEQ ID NO: 541559 - DNA, 20 bp, Artificial
  CRISPR gRNA sequence
atttgttcatcaaatgttca

SEQ ID NO: 541560 - DNA, 20 bp, Artificial
  CRISPR gRNA sequence
ttgttcatcaaatgttcatg

SEQ ID NO: 541561 - DNA, 20 bp, Artificial
  CRISPR gRNA sequence
atggagtcctgcctatgtgc

SEQ ID NO: 541562 - DNA, 20 bp, Artificial
  CRISPR gRNA sequence
tatgtgccagacactgaaat

SEQ ID NO: 541563 - DNA, 20 bp, Artificial
  CRISPR gRNA sequence
gtgccagacactgaaataag

SEQ ID NO: 541564 - DNA, 20 bp, Artificial
  CRISPR gRNA sequence
tgccagacactgaaataagc

SEQ ID NO: 541565 - DNA, 20 bp, Artificial
  CRISPR gRNA sequence
cagacactgaaataagcagg

SEQ ID NO: 541566 - DNA, 20 bp, Artificial
  CRISPR gRNA sequence
agacactgaaataagcaggc

SEQ ID NO: 541567 - DNA, 20 bp, Artificial
  CRISPR gRNA sequence
tgaaataagcaggcaggata

SEQ ID NO: 541568 - DNA, 20 bp, Artificial
  CRISPR gRNA sequence
ggatatagcaatgaacaaaa

SEQ ID NO: 541569 - DNA, 20 bp, Artificial
  CRISPR gRNA sequence
gaacaaaacagacaaaatcc

SEQ ID NO: 541570 - DNA, 20 bp, Artificial
  CRISPR gRNA sequence
agacaaaatcccagccctct

SEQ ID NO: 541571 - DNA, 20 bp, Artificial
  CRISPR gRNA sequence
acaaaatcccagccctcttg

SEQ ID NO: 541572 - DNA, 20 bp, Artificial
  CRISPR gRNA sequence
ccctcttggagtctattttt

SEQ ID NO: 541573 - DNA, 20 bp, Artificial
  CRISPR gRNA sequence
tcttggagtctatttttcag

SEQ ID NO: 541574 - DNA, 20 bp, Artificial
  CRISPR gRNA sequence
ttggagtctatttttcagtg

SEQ ID NO: 541575 - DNA, 20 bp, Artificial
  CRISPR gRNA sequence
tggagtctatttttcagtgg

SEQ ID NO: 541576 - DNA, 20 bp, Artificial
  CRISPR gRNA sequence
ggagtctatttttcagtgga

SEQ ID NO: 541577 - DNA, 20 bp, Artificial
  CRISPR gRNA sequence
gtctatttttcagtggaggg

SEQ ID NO: 541578 - DNA, 20 bp, Artificial
  CRISPR gRNA sequence
gaagaacataataaatgaaa

SEQ ID NO: 541579 - DNA, 20 bp, Artificial
  CRISPR gRNA sequence
aaaagtaaatatcttttatt

SEQ ID NO: 541580 - DNA, 20 bp, Artificial
  CRISPR gRNA sequence
atcttttatttggatgatgt

SEQ ID NO: 541581 - DNA, 20 bp, Artificial
  CRISPR gRNA sequence
ggatgatgttggatgatgtt

SEQ ID NO: 541582 - DNA, 20 bp, Artificial
  CRISPR gRNA sequence
ttggatgatgttaagtgcta

SEQ ID NO: 541583 - DNA, 20 bp, Artificial
  CRISPR gRNA sequence
ggatgatgttaagtgctata

SEQ ID NO: 541584 - DNA, 20 bp, Artificial
  CRISPR gRNA sequence
aagtgctatagagaaaaata

SEQ ID NO: 541585 - DNA, 20 bp, Artificial
  CRISPR gRNA sequence
tgctatagagaaaaataaag

SEQ ID NO: 541586 - DNA, 20 bp, Artificial
  CRISPR gRNA sequence
ctatagagaaaaataaagca

SEQ ID NO: 541587 - DNA, 20 bp, Artificial
  CRISPR gRNA sequence
gagaaaaataaagcagagtg

SEQ ID NO: 541588 - DNA, 20 bp, Artificial
  CRISPR gRNA sequence
agaaaaataaagcagagtgt

SEQ ID NO: 541589 - DNA, 20 bp, Artificial
  CRISPR gRNA sequence
gaaaaataaagcagagtgtg

SEQ ID NO: 541590 - DNA, 20 bp, Artificial
  CRISPR gRNA sequence
aaaaataaagcagagtgtgg

SEQ ID NO: 541591 - DNA, 20 bp, Artificial
  CRISPR gRNA sequence
taaagcagagtgtgggggct

SEQ ID NO: 541592 - DNA, 20 bp, Artificial
  CRISPR gRNA sequence
aaagcagagtgtgggggctg

SEQ ID NO: 541593 - DNA, 20 bp, Artificial
  CRISPR gRNA sequence
agcagagtgtgggggctgag

SEQ ID NO: 541594 - DNA, 20 bp, Artificial
  CRISPR gRNA sequence
gtgtgggggctgaggagtac

SEQ ID NO: 541595 - DNA, 20 bp, Artificial
  CRISPR gRNA sequence
gggggctgaggagtactggt

SEQ ID NO: 541596 - DNA, 20 bp, Artificial
  CRISPR gRNA sequence
ggggctgaggagtactggta

SEQ ID NO: 541597 - DNA, 20 bp, Artificial
  CRISPR gRNA sequence
ctgaggagtactggtaagga

SEQ ID NO: 541598 - DNA, 20 bp, Artificial
  CRISPR gRNA sequence
tgaggagtactggtaaggaa

SEQ ID NO: 541599 - DNA, 20 bp, Artificial
  CRISPR gRNA sequence
aggagtactggtaaggaaag

SEQ ID NO: 541600 - DNA, 20 bp, Artificial
  CRISPR gRNA sequence
gtactggtaaggaaaggagt

SEQ ID NO: 541601 - DNA, 20 bp, Artificial
  CRISPR gRNA sequence
tggtaaggaaaggagttgga

SEQ ID NO: 541602 - DNA, 20 bp, Artificial
  CRISPR gRNA sequence
aggaaaggagttggatggca

SEQ ID NO: 541603 - DNA, 20 bp, Artificial
  CRISPR gRNA sequence
ggaaaggagttggatggcat

SEQ ID NO: 541604 - DNA, 20 bp, Artificial
  CRISPR gRNA sequence
gaaaggagttggatggcatg

SEQ ID NO: 541605 - DNA, 20 bp, Artificial
  CRISPR gRNA sequence
aaaggagttggatggcatgg

SEQ ID NO: 541606 - DNA, 20 bp, Artificial
  CRISPR gRNA sequence
aaggagttggatggcatggg

SEQ ID NO: 541607 - DNA, 20 bp, Artificial
  CRISPR gRNA sequence
gagttggatggcatgggggg

SEQ ID NO: 541608 - DNA, 20 bp, Artificial
  CRISPR gRNA sequence
atggcatggggggcagtcat

SEQ ID NO: 541609 - DNA, 20 bp, Artificial
  CRISPR gRNA sequence
catggggggcagtcataagt

SEQ ID NO: 541610 - DNA, 20 bp, Artificial
  CRISPR gRNA sequence
gcagtcataagttggcatct

SEQ ID NO: 541611 - DNA, 20 bp, Artificial
  CRISPR gRNA sequence
gtcataagttggcatctgag

SEQ ID NO: 541612 - DNA, 20 bp, Artificial
  CRISPR gRNA sequence
cataagttggcatctgagca

SEQ ID NO: 541613 - DNA, 20 bp, Artificial
  CRISPR gRNA sequence
gttggcatctgagcagagtc

SEQ ID NO: 541614 - DNA, 20 bp, Artificial
  CRISPR gRNA sequence
catctgagcagagtccagaa

SEQ ID NO: 541615 - DNA, 20 bp, Artificial
  CRISPR gRNA sequence
ctgagcagagtccagaaaag

SEQ ID NO: 541616 - DNA, 20 bp, Artificial
  CRISPR gRNA sequence
tgagcagagtccagaaaagc

SEQ ID NO: 541617 - DNA, 20 bp, Artificial
  CRISPR gRNA sequence
gagcagagtccagaaaagca

SEQ ID NO: 541618 - DNA, 20 bp, Artificial
  CRISPR gRNA sequence
agcagagtccagaaaagcag

SEQ ID NO: 541619 - DNA, 20 bp, Artificial
  CRISPR gRNA sequence
cagagtccagaaaagcaggg

SEQ ID NO: 541620 - DNA, 20 bp, Artificial
  CRISPR gRNA sequence
gtccagaaaagcaggggagc

SEQ ID NO: 541621 - DNA, 20 bp, Artificial
  CRISPR gRNA sequence
aaaagcaggggagcgagcct

SEQ ID NO: 541622 - DNA, 20 bp, Artificial
  CRISPR gRNA sequence
ggagcgagcctaagaacatc

SEQ ID NO: 541623 - DNA, 20 bp, Artificial
  CRISPR gRNA sequence
gagcgagcctaagaacatct

SEQ ID NO: 541624 - DNA, 20 bp, Artificial
  CRISPR gRNA sequence
agcgagcctaagaacatctg

SEQ ID NO: 541625 - DNA, 20 bp, Artificial
  CRISPR gRNA sequence
agcctaagaacatctggggt

SEQ ID NO: 541626 - DNA, 20 bp, Artificial
  CRISPR gRNA sequence
cctaagaacatctggggtga

SEQ ID NO: 541627 - DNA, 20 bp, Artificial
  CRISPR gRNA sequence
agaacatctggggtgagagt

SEQ ID NO: 541628 - DNA, 20 bp, Artificial
  CRISPR gRNA sequence
catctggggtgagagtgaga

SEQ ID NO: 541629 - DNA, 20 bp, Artificial
  CRISPR gRNA sequence
atctggggtgagagtgagaa

SEQ ID NO: 541630 - DNA, 20 bp, Artificial
  CRISPR gRNA sequence
ctggggtgagagtgagaaag

SEQ ID NO: 541631 - DNA, 20 bp, Artificial
  CRISPR gRNA sequence
tgagaaaggagttatttctt

SEQ ID NO: 541632 - DNA, 20 bp, Artificial
  CRISPR gRNA sequence
tcttgagaacacgcctatca

SEQ ID NO: 541633 - DNA, 20 bp, Artificial
  CRISPR gRNA sequence
gagaacacgcctatcaaagt

SEQ ID NO: 541634 - DNA, 20 bp, Artificial
  CRISPR gRNA sequence
agaacacgcctatcaaagta

SEQ ID NO: 541635 - DNA, 20 bp, Artificial
  CRISPR gRNA sequence
acacgcctatcaaagtaagg

SEQ ID NO: 541636 - DNA, 20 bp, Artificial
  CRISPR gRNA sequence
agtaaggtggtttgctccgc

SEQ ID NO: 541637 - DNA, 20 bp, Artificial
  CRISPR gRNA sequence
ggtttgctccgctggacact

SEQ ID NO: 541638 - DNA, 20 bp, Artificial
  CRISPR gRNA sequence
tccgctggacacttggttga

SEQ ID NO: 541639 - DNA, 20 bp, Artificial
  CRISPR gRNA sequence
cgctggacacttggttgata

SEQ ID NO: 541640 - DNA, 20 bp, Artificial
  CRISPR gRNA sequence
tggacacttggttgatagag

SEQ ID NO: 541641 - DNA, 20 bp, Artificial
  CRISPR gRNA sequence
ggacacttggttgatagaga

SEQ ID NO: 541642 - DNA, 20 bp, Artificial
  CRISPR gRNA sequence
ttggttgatagagaaggtca

SEQ ID NO: 541643 - DNA, 20 bp, Artificial
  CRISPR gRNA sequence
agagaaggtcaaagattccg

SEQ ID NO: 541644 - DNA, 20 bp, Artificial
  CRISPR gRNA sequence
ggtcaaagattccgaagcac

SEQ ID NO: 541645 - DNA, 20 bp, Artificial
  CRISPR gRNA sequence
gtcaaagattccgaagcacc

SEQ ID NO: 541646 - DNA, 20 bp, Artificial
  CRISPR gRNA sequence
gattccgaagcaccaggcta

SEQ ID NO: 541647 - DNA, 20 bp, Artificial
  CRISPR gRNA sequence
gaagcaccaggctacagatg

SEQ ID NO: 541648 - DNA, 20 bp, Artificial
  CRISPR gRNA sequence
ccaggctacagatgaagaaa

SEQ ID NO: 541649 - DNA, 20 bp, Artificial
  CRISPR gRNA sequence
tacagatgaagaaatggact

SEQ ID NO: 541650 - DNA, 20 bp, Artificial
  CRISPR gRNA sequence
cagatgaagaaatggactga

SEQ ID NO: 541651 - DNA, 20 bp, Artificial
  CRISPR gRNA sequence
agatgaagaaatggactgag

SEQ ID NO: 541652 - DNA, 20 bp, Artificial
  CRISPR gRNA sequence
gatgaagaaatggactgaga

SEQ ID NO: 541653 - DNA, 20 bp, Artificial
  CRISPR gRNA sequence
aagaaatggactgagagggt

SEQ ID NO: 541654 - DNA, 20 bp, Artificial
  CRISPR gRNA sequence
gtcagctgactgcattcact

SEQ ID NO: 541655 - DNA, 20 bp, Artificial
  CRISPR gRNA sequence
gctgactgcattcactcagc

SEQ ID NO: 541656 - DNA, 20 bp, Artificial
  CRISPR gRNA sequence
actgcattcactcagctagc

SEQ ID NO: 541657 - DNA, 20 bp, Artificial
  CRISPR gRNA sequence
ctgcattcactcagctagca

SEQ ID NO: 541658 - DNA, 20 bp, Artificial
  CRISPR gRNA sequence
tgcattcactcagctagcaa

SEQ ID NO: 541659 - DNA, 20 bp, Artificial
  CRISPR gRNA sequence
gcattcactcagctagcaag

SEQ ID NO: 541660 - DNA, 20 bp, Artificial
  CRISPR gRNA sequence
ttcactcagctagcaagggg

SEQ ID NO: 541661 - DNA, 20 bp, Artificial
  CRISPR gRNA sequence
cactcagctagcaaggggca

SEQ ID NO: 541662 - DNA, 20 bp, Artificial
  CRISPR gRNA sequence
cagctagcaaggggcagagc

SEQ ID NO: 541663 - DNA, 20 bp, Artificial
  CRISPR gRNA sequence
caaggggcagagctggtgtc

SEQ ID NO: 541664 - DNA, 20 bp, Artificial
  CRISPR gRNA sequence
gcagagctggtgtccagaca

SEQ ID NO: 541665 - DNA, 20 bp, Artificial
  CRISPR gRNA sequence
cagagctggtgtccagacac

SEQ ID NO: 541666 - DNA, 20 bp, Artificial
  CRISPR gRNA sequence
agctggtgtccagacacagg

SEQ ID NO: 541667 - DNA, 20 bp, Artificial
  CRISPR gRNA sequence
ggtgtccagacacaggcagt

SEQ ID NO: 541668 - DNA, 20 bp, Artificial
  CRISPR gRNA sequence
cagacacaggcagtcggccc

SEQ ID NO: 541669 - DNA, 20 bp, Artificial
  CRISPR gRNA sequence
gacacaggcagtcggcccca

SEQ ID NO: 541670 - DNA, 20 bp, Artificial
  CRISPR gRNA sequence
ggccccagagcctgcactgt

SEQ ID NO: 541671 - DNA, 20 bp, Artificial
  CRISPR gRNA sequence
ccagagcctgcactgttggc

SEQ ID NO: 541672 - DNA, 20 bp, Artificial
  CRISPR gRNA sequence
tgcactgttggccagaacat

SEQ ID NO: 541673 - DNA, 20 bp, Artificial
  CRISPR gRNA sequence
ggccagaacatcagatgcct

SEQ ID NO: 541674 - DNA, 20 bp, Artificial
  CRISPR gRNA sequence
agaacatcagatgccttggt

SEQ ID NO: 541675 - DNA, 20 bp, Artificial
  CRISPR gRNA sequence
gaacatcagatgccttggtt

SEQ ID NO: 541676 - DNA, 20 bp, Artificial
  CRISPR gRNA sequence
aacatcagatgccttggttg

SEQ ID NO: 541677 - DNA, 20 bp, Artificial
  CRISPR gRNA sequence
ttcctgatcgattccaccct

SEQ ID NO: 541678 - DNA, 20 bp, Artificial
  CRISPR gRNA sequence
tgatcgattccacccttagc

SEQ ID NO: 541679 - DNA, 20 bp, Artificial
  CRISPR gRNA sequence
attccacccttagccggtcc

SEQ ID NO: 541680 - DNA, 20 bp, Artificial
  CRISPR gRNA sequence
cacccttagccggtcccagt

SEQ ID NO: 541681 - DNA, 20 bp, Artificial
  CRISPR gRNA sequence
gtgacttctcttatttcctt

SEQ ID NO: 541682 - DNA, 20 bp, Artificial
  CRISPR gRNA sequence
cttctcttatttccttaaga

SEQ ID NO: 541683 - DNA, 20 bp, Artificial
  CRISPR gRNA sequence
tctcttatttccttaagaca

SEQ ID NO: 541684 - DNA, 20 bp, Artificial
  CRISPR gRNA sequence
agacagagatttactgattt

SEQ ID NO: 541685 - DNA, 20 bp, Artificial
  CRISPR gRNA sequence
gatttcagccacaccaccac

SEQ ID NO: 541686 - DNA, 20 bp, Artificial
  CRISPR gRNA sequence
tctacttcatactgaaactg

SEQ ID NO: 541687 - DNA, 20 bp, Artificial
  CRISPR gRNA sequence
tgcagccacctgtctcccaa

SEQ ID NO: 541688 - DNA, 20 bp, Artificial
  CRISPR gRNA sequence
tcccaacggttacaaaccct

SEQ ID NO: 541689 - DNA, 20 bp, Artificial
  CRISPR gRNA sequence
gttacaaaccctcggtcccc

SEQ ID NO: 541690 - DNA, 20 bp, Artificial
  CRISPR gRNA sequence
ttacaaaccctcggtcccca

SEQ ID NO: 541691 - DNA, 20 bp, Artificial
  CRISPR gRNA sequence
aaaccctcggtccccaaggc

SEQ ID NO: 541692 - DNA, 20 bp, Artificial
  CRISPR gRNA sequence
accctcggtccccaaggcca

SEQ ID NO: 541693 - DNA, 20 bp, Artificial
  CRISPR gRNA sequence
tcggtccccaaggccagagc

SEQ ID NO: 541694 - DNA, 20 bp, Artificial
  CRISPR gRNA sequence
cggtccccaaggccagagca

SEQ ID NO: 541695 - DNA, 20 bp, Artificial
  CRISPR gRNA sequence
caaggccagagcaaggttcc

SEQ ID NO: 541696 - DNA, 20 bp, Artificial
  CRISPR gRNA sequence
aggttcccggaccttgctct

SEQ ID NO: 541697 - DNA, 20 bp, Artificial
  CRISPR gRNA sequence
tgtcaatctgcctcctcgat

SEQ ID NO: 541698 - DNA, 20 bp, Artificial
  CRISPR gRNA sequence
gcctcctcgataagttcatc

SEQ ID NO: 541699 - DNA, 20 bp, Artificial
  CRISPR gRNA sequence
cgataagttcatcaagaatt

SEQ ID NO: 541700 - DNA, 20 bp, Artificial
  CRISPR gRNA sequence
ttcatcaagaattaagatgt

SEQ ID NO: 541701 - DNA, 20 bp, Artificial
  CRISPR gRNA sequence
cttctaatatgatgctaaaa

SEQ ID NO: 541702 - DNA, 20 bp, Artificial
  CRISPR gRNA sequence
taacctatttcttctttctc

SEQ ID NO: 541703 - DNA, 20 bp, Artificial
  CRISPR gRNA sequence
tttctcaagatgtttccctt

SEQ ID NO: 541704 - DNA, 20 bp, Artificial
  CRISPR gRNA sequence
tagacctatgcaatccatca

SEQ ID NO: 541705 - DNA, 20 bp, Artificial
  CRISPR gRNA sequence
acctatgcaatccatcaaag

SEQ ID NO: 541706 - DNA, 20 bp, Artificial
  CRISPR gRNA sequence
caatccatcaaagtagctac

SEQ ID NO: 541707 - DNA, 20 bp, Artificial
  CRISPR gRNA sequence
tcaaagtagctaccagctac

SEQ ID NO: 541708 - DNA, 20 bp, Artificial
  CRISPR gRNA sequence
aagtagctaccagctacaag

SEQ ID NO: 541709 - DNA, 20 bp, Artificial
  CRISPR gRNA sequence
agctaccagctacaagtggc

SEQ ID NO: 541710 - DNA, 20 bp, Artificial
  CRISPR gRNA sequence
accagctacaagtggctagt

SEQ ID NO: 541711 - DNA, 20 bp, Artificial
  CRISPR gRNA sequence
gctagtgagaacctgaaata

SEQ ID NO: 541712 - DNA, 20 bp, Artificial
  CRISPR gRNA sequence
gtgagaacctgaaatatggt

SEQ ID NO: 541713 - DNA, 20 bp, Artificial
  CRISPR gRNA sequence
tgaaatatggttagttcaaa

SEQ ID NO: 541714 - DNA, 20 bp, Artificial
  CRISPR gRNA sequence
aaatatggttagttcaaatg

SEQ ID NO: 541715 - DNA, 20 bp, Artificial
  CRISPR gRNA sequence
ttcaaatggagatgtgttct

SEQ ID NO: 541716 - DNA, 20 bp, Artificial
  CRISPR gRNA sequence
tctgagtatcaaatacacac

SEQ ID NO: 541717 - DNA, 20 bp, Artificial
  CRISPR gRNA sequence
caaatacacaccagaatctg

SEQ ID NO: 541718 - DNA, 20 bp, Artificial
  CRISPR gRNA sequence
cacaccagaatctgaagacc

SEQ ID NO: 541719 - DNA, 20 bp, Artificial
  CRISPR gRNA sequence
tctgaagacctggtattaaa

SEQ ID NO: 541720 - DNA, 20 bp, Artificial
  CRISPR gRNA sequence
gaagacctggtattaaaaag

SEQ ID NO: 541721 - DNA, 20 bp, Artificial
  CRISPR gRNA sequence
ctcttgttaatatttttttg

SEQ ID NO: 541722 - DNA, 20 bp, Artificial
  CRISPR gRNA sequence
tatttttttgtagtaactac

SEQ ID NO: 541723 - DNA, 20 bp, Artificial
  CRISPR gRNA sequence
atttttttgtagtaactact

SEQ ID NO: 541724 - DNA, 20 bp, Artificial
  CRISPR gRNA sequence
ttttgtagtaactactaggt

SEQ ID NO: 541725 - DNA, 20 bp, Artificial
  CRISPR gRNA sequence
taactactaggttagtgcaa

SEQ ID NO: 541726 - DNA, 20 bp, Artificial
  CRISPR gRNA sequence
gttagtgcaaaagtaattgc

SEQ ID NO: 541727 - DNA, 20 bp, Artificial
  CRISPR gRNA sequence
tttttgccattaaaaaaaaa

SEQ ID NO: 541728 - DNA, 20 bp, Artificial
  CRISPR gRNA sequence
atgtcgaaatgaaaatatta

SEQ ID NO: 541729 - DNA, 20 bp, Artificial
  CRISPR gRNA sequence
tgaaaatattatggatatat

SEQ ID NO: 541730 - DNA, 20 bp, Artificial
  CRISPR gRNA sequence
gaaaatattatggatatatt

SEQ ID NO: 541731 - DNA, 20 bp, Artificial
  CRISPR gRNA sequence
tccatattatacttctattt

SEQ ID NO: 541732 - DNA, 20 bp, Artificial
  CRISPR gRNA sequence
catattatacttctatttga

SEQ ID NO: 541733 - DNA, 20 bp, Artificial
  CRISPR gRNA sequence
tctatttgagagcacttctt

SEQ ID NO: 541734 - DNA, 20 bp, Artificial
  CRISPR gRNA sequence
cttctttagcctgttgtttc

SEQ ID NO: 541735 - DNA, 20 bp, Artificial
  CRISPR gRNA sequence
ctcacatcccacctttctca

SEQ ID NO: 541736 - DNA, 20 bp, Artificial
  CRISPR gRNA sequence
tcacatcccacctttctcaa

SEQ ID NO: 541737 - DNA, 20 bp, Artificial
  CRISPR gRNA sequence
gtctttgactgttctcacct

SEQ ID NO: 541738 - DNA, 20 bp, Artificial
  CRISPR gRNA sequence
ttgactgttctcaccttaga

SEQ ID NO: 541739 - DNA, 20 bp, Artificial
  CRISPR gRNA sequence
tgactgttctcaccttagat

SEQ ID NO: 541740 - DNA, 20 bp, Artificial
  CRISPR gRNA sequence
ttctcaccttagataggata

SEQ ID NO: 541741 - DNA, 20 bp, Artificial
  CRISPR gRNA sequence
accttagataggatacagct

SEQ ID NO: 541742 - DNA, 20 bp, Artificial
  CRISPR gRNA sequence
taggatacagctgagatcca

SEQ ID NO: 541743 - DNA, 20 bp, Artificial
  CRISPR gRNA sequence
ctgagatccacagtatgctt

SEQ ID NO: 541744 - DNA, 20 bp, Artificial
  CRISPR gRNA sequence
tgagatccacagtatgcttt

SEQ ID NO: 541745 - DNA, 20 bp, Artificial
  CRISPR gRNA sequence
gagatccacagtatgcttta

SEQ ID NO: 541746 - DNA, 20 bp, Artificial
  CRISPR gRNA sequence
cacagtatgctttagggaat

SEQ ID NO: 541747 - DNA, 20 bp, Artificial
  CRISPR gRNA sequence
acagtatgctttagggaata

SEQ ID NO: 541748 - DNA, 20 bp, Artificial
  CRISPR gRNA sequence
ttagggaataaggttcttac

SEQ ID NO: 541749 - DNA, 20 bp, Artificial
  CRISPR gRNA sequence
gaataaggttcttactagat

SEQ ID NO: 541750 - DNA, 20 bp, Artificial
  CRISPR gRNA sequence
aggttcttactagatcggtt

SEQ ID NO: 541751 - DNA, 20 bp, Artificial
  CRISPR gRNA sequence
ggttcttactagatcggtta

SEQ ID NO: 541752 - DNA, 20 bp, Artificial
  CRISPR gRNA sequence
actagatcggttaaggctgt

SEQ ID NO: 541753 - DNA, 20 bp, Artificial
  CRISPR gRNA sequence
gtttttaaatctattctcca

SEQ ID NO: 541754 - DNA, 20 bp, Artificial
  CRISPR gRNA sequence
tattctccaaagtctgattc

SEQ ID NO: 541755 - DNA, 20 bp, Artificial
  CRISPR gRNA sequence
attctccaaagtctgattca

SEQ ID NO: 541756 - DNA, 20 bp, Artificial
  CRISPR gRNA sequence
tgattcaaggtatttcaata

SEQ ID NO: 541757 - DNA, 20 bp, Artificial
  CRISPR gRNA sequence
tcatttcactaaaattcctt

SEQ ID NO: 541758 - DNA, 20 bp, Artificial
  CRISPR gRNA sequence
tgagaatccttgttattttc

SEQ ID NO: 541759 - DNA, 20 bp, Artificial
  CRISPR gRNA sequence
cttgttattttctagatact

SEQ ID NO: 541760 - DNA, 20 bp, Artificial
  CRISPR gRNA sequence
ctagatactcagttcatcgt

SEQ ID NO: 541761 - DNA, 20 bp, Artificial
  CRISPR gRNA sequence
tagatactcagttcatcgtt

SEQ ID NO: 541762 - DNA, 20 bp, Artificial
  CRISPR gRNA sequence
tcgttgggaaactctattgc

SEQ ID NO: 541763 - DNA, 20 bp, Artificial
  CRISPR gRNA sequence
ttgggaaactctattgcaag

SEQ ID NO: 541764 - DNA, 20 bp, Artificial
  CRISPR gRNA sequence
ctattgcaagtagtttacaa

SEQ ID NO: 541765 - DNA, 20 bp, Artificial
  CRISPR gRNA sequence
gcaagtagtttacaatggca

SEQ ID NO: 541766 - DNA, 20 bp, Artificial
  CRISPR gRNA sequence
ttacaatggcacagcctcat

SEQ ID NO: 541767 - DNA, 20 bp, Artificial
  CRISPR gRNA sequence
attttcttctaatttttaac

SEQ ID NO: 541768 - DNA, 20 bp, Artificial
  CRISPR gRNA sequence
cttctaatttttaactggca

SEQ ID NO: 541769 - DNA, 20 bp, Artificial
  CRISPR gRNA sequence
ttctaatttttaactggcat

SEQ ID NO: 541770 - DNA, 20 bp, Artificial
  CRISPR gRNA sequence
taatttttaactggcatagg

SEQ ID NO: 541771 - DNA, 20 bp, Artificial
  CRISPR gRNA sequence
ggcataggaagaaaatgttc

SEQ ID NO: 541772 - DNA, 20 bp, Artificial
  CRISPR gRNA sequence
agaaaatgttcaagaaacta

SEQ ID NO: 541773 - DNA, 20 bp, Artificial
  CRISPR gRNA sequence
atgttcaagaaactacagac

SEQ ID NO: 541774 - DNA, 20 bp, Artificial
  CRISPR gRNA sequence
tcaagaaactacagactggt

SEQ ID NO: 541775 - DNA, 20 bp, Artificial
  CRISPR gRNA sequence
aaactacagactggtcagcc

SEQ ID NO: 541776 - DNA, 20 bp, Artificial
  CRISPR gRNA sequence
ctacagactggtcagcccag

SEQ ID NO: 541777 - DNA, 20 bp, Artificial
  CRISPR gRNA sequence
tggtcagcccagtggaaatt

SEQ ID NO: 541778 - DNA, 20 bp, Artificial
  CRISPR gRNA sequence
ggtcagcccagtggaaattc

SEQ ID NO: 541779 - DNA, 20 bp, Artificial
  CRISPR gRNA sequence
aattcaggcactaatctcaa

SEQ ID NO: 541780 - DNA, 20 bp, Artificial
  CRISPR gRNA sequence
actaatctcaacagacattt

SEQ ID NO: 541781 - DNA, 20 bp, Artificial
  CRISPR gRNA sequence
ctaatctcaacagacatttt

SEQ ID NO: 541782 - DNA, 20 bp, Artificial
  CRISPR gRNA sequence
taatctcaacagacattttg

SEQ ID NO: 541783 - DNA, 20 bp, Artificial
  CRISPR gRNA sequence
acattttggggaacattgta

SEQ ID NO: 541784 - DNA, 20 bp, Artificial
  CRISPR gRNA sequence
tttggggaacattgtaaagt

SEQ ID NO: 541785 - DNA, 20 bp, Artificial
  CRISPR gRNA sequence
ggaacattgtaaagtaagca

SEQ ID NO: 541786 - DNA, 20 bp, Artificial
  CRISPR gRNA sequence
gtaaagtaagcaaagttcac

SEQ ID NO: 541787 - DNA, 20 bp, Artificial
  CRISPR gRNA sequence
aaagttcactagaacctata

SEQ ID NO: 541788 - DNA, 20 bp, Artificial
  CRISPR gRNA sequence
gaacctataaagtaaccaaa

SEQ ID NO: 541789 - DNA, 20 bp, Artificial
  CRISPR gRNA sequence
taaccaaaaagcattttcct

SEQ ID NO: 541790 - DNA, 20 bp, Artificial
  CRISPR gRNA sequence
accaaaaagcattttccttg

SEQ ID NO: 541791 - DNA, 20 bp, Artificial
  CRISPR gRNA sequence
ccaaaaagcattttccttgg

SEQ ID NO: 541792 - DNA, 20 bp, Artificial
  CRISPR gRNA sequence
gcattttccttggaggctga

SEQ ID NO: 541793 - DNA, 20 bp, Artificial
  CRISPR gRNA sequence
cattttccttggaggctgat

SEQ ID NO: 541794 - DNA, 20 bp, Artificial
  CRISPR gRNA sequence
tttccttggaggctgatggg

SEQ ID NO: 541795 - DNA, 20 bp, Artificial
  CRISPR gRNA sequence
ttccttggaggctgatgggc

SEQ ID NO: 541796 - DNA, 20 bp, Artificial
  CRISPR gRNA sequence
ggctgatgggcaggcactga

SEQ ID NO: 541797 - DNA, 20 bp, Artificial
  CRISPR gRNA sequence
ggcactgaaagttatctcca

SEQ ID NO: 541798 - DNA, 20 bp, Artificial
  CRISPR gRNA sequence
cactgaaagttatctccaaa

SEQ ID NO: 541799 - DNA, 20 bp, Artificial
  CRISPR gRNA sequence
actgaaagttatctccaaag

SEQ ID NO: 541800 - DNA, 20 bp, Artificial
  CRISPR gRNA sequence
aatgttttcccctccttttc

SEQ ID NO: 541801 - DNA, 20 bp, Artificial
  CRISPR gRNA sequence
atgttttcccctccttttct

SEQ ID NO: 541802 - DNA, 20 bp, Artificial
  CRISPR gRNA sequence
tgttttcccctccttttcta

SEQ ID NO: 541803 - DNA, 20 bp, Artificial
  CRISPR gRNA sequence
ttcccctccttttctaggga

SEQ ID NO: 541804 - DNA, 20 bp, Artificial
  CRISPR gRNA sequence
gggacagtctctgtatctta

SEQ ID NO: 541805 - DNA, 20 bp, Artificial
  CRISPR gRNA sequence
attcaaacctgaacttatct

SEQ ID NO: 541806 - DNA, 20 bp, Artificial
  CRISPR gRNA sequence
aacctgaacttatctgagaa

SEQ ID NO: 541807 - DNA, 20 bp, Artificial
  CRISPR gRNA sequence
cctgaacttatctgagaaaa

SEQ ID NO: 541808 - DNA, 20 bp, Artificial
  CRISPR gRNA sequence
cttatctgagaaaagagaaa

SEQ ID NO: 541809 - DNA, 20 bp, Artificial
  CRISPR gRNA sequence
aaagagaaacggctgcatcc

SEQ ID NO: 541810 - DNA, 20 bp, Artificial
  CRISPR gRNA sequence
ctggtttcacttacaaccct

SEQ ID NO: 541811 - DNA, 20 bp, Artificial
  CRISPR gRNA sequence
tttcacttacaaccctgaga

SEQ ID NO: 541812 - DNA, 20 bp, Artificial
  CRISPR gRNA sequence
cacttacaaccctgagatgg

SEQ ID NO: 541813 - DNA, 20 bp, Artificial
  CRISPR gRNA sequence
acaaccctgagatggaagtt

SEQ ID NO: 541814 - DNA, 20 bp, Artificial
  CRISPR gRNA sequence
gaagttgagatttgtcattg

SEQ ID NO: 541815 - DNA, 20 bp, Artificial
  CRISPR gRNA sequence
gatttgtcattgcagaattt

SEQ ID NO: 541816 - DNA, 20 bp, Artificial
  CRISPR gRNA sequence
atttgtcattgcagaattta

SEQ ID NO: 541817 - DNA, 20 bp, Artificial
  CRISPR gRNA sequence
tttgtcattgcagaatttaa

SEQ ID NO: 541818 - DNA, 20 bp, Artificial
  CRISPR gRNA sequence
atttaagggtctgtgtcctt

SEQ ID NO: 541819 - DNA, 20 bp, Artificial
  CRISPR gRNA sequence
tgtccttaagtaaaaccttc

SEQ ID NO: 541820 - DNA, 20 bp, Artificial
  CRISPR gRNA sequence
aaaccttctggtcacccctc

SEQ ID NO: 541821 - DNA, 20 bp, Artificial
  CRISPR gRNA sequence
ttctggtcacccctcaagta

SEQ ID NO: 541822 - DNA, 20 bp, Artificial
  CRISPR gRNA sequence
cctcaagtaaagcttcaaaa

SEQ ID NO: 541823 - DNA, 20 bp, Artificial
  CRISPR gRNA sequence
agtaaagcttcaaaaaagct

SEQ ID NO: 541824 - DNA, 20 bp, Artificial
  CRISPR gRNA sequence
gtaaagcttcaaaaaagctt

SEQ ID NO: 541825 - DNA, 20 bp, Artificial
  CRISPR gRNA sequence
aaaaagcttaggcacttgtg

SEQ ID NO: 541826 - DNA, 20 bp, Artificial
  CRISPR gRNA sequence
cttaggcacttgtgcagaaa

SEQ ID NO: 541827 - DNA, 20 bp, Artificial
  CRISPR gRNA sequence
cacttgtgcagaaacagcat

SEQ ID NO: 541828 - DNA, 20 bp, Artificial
  CRISPR gRNA sequence
ttgtgcagaaacagcatgag

SEQ ID NO: 541829 - DNA, 20 bp, Artificial
  CRISPR gRNA sequence
acagcatgagaagaaaccaa

SEQ ID NO: 541830 - DNA, 20 bp, Artificial
  CRISPR gRNA sequence
cagcatgagaagaaaccaaa

SEQ ID NO: 541831 - DNA, 20 bp, Artificial
  CRISPR gRNA sequence
catgagaagaaaccaaaagg

SEQ ID NO: 541832 - DNA, 20 bp, Artificial
  CRISPR gRNA sequence
ggcagaaaacttacacatat

SEQ ID NO: 541833 - DNA, 20 bp, Artificial
  CRISPR gRNA sequence
gcagaaaacttacacatata

SEQ ID NO: 541834 - DNA, 20 bp, Artificial
  CRISPR gRNA sequence
cagaaaacttacacatataa

SEQ ID NO: 541835 - DNA, 20 bp, Artificial
  CRISPR gRNA sequence
tataagggctgatttatgca

SEQ ID NO: 541836 - DNA, 20 bp, Artificial
  CRISPR gRNA sequence
gcaaagtttctacttttaaa

SEQ ID NO: 541837 - DNA, 20 bp, Artificial
  CRISPR gRNA sequence
aaagtttctacttttaaaca

SEQ ID NO: 541838 - DNA, 20 bp, Artificial
  CRISPR gRNA sequence
gaaaccaatacctaccctca

SEQ ID NO: 541839 - DNA, 20 bp, Artificial
  CRISPR gRNA sequence
ctcaaagcctgtatttacta

SEQ ID NO: 541840 - DNA, 20 bp, Artificial
  CRISPR gRNA sequence
tgtatttactaaagaaatgt

SEQ ID NO: 541841 - DNA, 20 bp, Artificial
  CRISPR gRNA sequence
tatttactaaagaaatgtta

SEQ ID NO: 541842 - DNA, 20 bp, Artificial
  CRISPR gRNA sequence
taaagaaatgttagagtgac

SEQ ID NO: 541843 - DNA, 20 bp, Artificial
  CRISPR gRNA sequence
aaagaaatgttagagtgaca

SEQ ID NO: 541844 - DNA, 20 bp, Artificial
  CRISPR gRNA sequence
agaaatgttagagtgacaag

SEQ ID NO: 541845 - DNA, 20 bp, Artificial
  CRISPR gRNA sequence
gaaatgttagagtgacaagg

SEQ ID NO: 541846 - DNA, 20 bp, Artificial
  CRISPR gRNA sequence
taaaataaattattcaaatc

SEQ ID NO: 541847 - DNA, 20 bp, Artificial
  CRISPR gRNA sequence
attcaaatctggttcttaaa

SEQ ID NO: 541848 - DNA, 20 bp, Artificial
  CRISPR gRNA sequence
tcaaatctggttcttaaaaa

SEQ ID NO: 541849 - DNA, 20 bp, Artificial
  CRISPR gRNA sequence
caaatctggttcttaaaaag

SEQ ID NO: 541850 - DNA, 20 bp, Artificial
  CRISPR gRNA sequence
ggttcttaaaaagaggttct

SEQ ID NO: 541851 - DNA, 20 bp, Artificial
  CRISPR gRNA sequence
gactattttaaaacttctga

SEQ ID NO: 541852 - DNA, 20 bp, Artificial
  CRISPR gRNA sequence
aaaattaaaacaaaaaaaca

SEQ ID NO: 541853 - DNA, 20 bp, Artificial
  CRISPR gRNA sequence
aacatagcaacgaatacaat

SEQ ID NO: 541854 - DNA, 20 bp, Artificial
  CRISPR gRNA sequence
tacaatgagtgaaacttgat

SEQ ID NO: 541855 - DNA, 20 bp, Artificial
  CRISPR gRNA sequence
gagtgaaacttgattagatc

SEQ ID NO: 541856 - DNA, 20 bp, Artificial
  CRISPR gRNA sequence
agtgaaacttgattagatcc

SEQ ID NO: 541857 - DNA, 20 bp, Artificial
  CRISPR gRNA sequence
agatccgggttttttaacaa

SEQ ID NO: 541858 - DNA, 20 bp, Artificial
  CRISPR gRNA sequence
acaaaagacactcttgtgac

SEQ ID NO: 541859 - DNA, 20 bp, Artificial
  CRISPR gRNA sequence
aaagacactcttgtgacaag

SEQ ID NO: 541860 - DNA, 20 bp, Artificial
  CRISPR gRNA sequence
aagacactcttgtgacaagt

SEQ ID NO: 541861 - DNA, 20 bp, Artificial
  CRISPR gRNA sequence
agacactcttgtgacaagtg

SEQ ID NO: 541862 - DNA, 20 bp, Artificial
  CRISPR gRNA sequence
caagtggggaaatctgaata

SEQ ID NO: 541863 - DNA, 20 bp, Artificial
  CRISPR gRNA sequence
aagtggggaaatctgaatac

SEQ ID NO: 541864 - DNA, 20 bp, Artificial
  CRISPR gRNA sequence
ggaaatctgaatacgggtaa

SEQ ID NO: 541865 - DNA, 20 bp, Artificial
  CRISPR gRNA sequence
atctgaatacgggtaaaagt

SEQ ID NO: 541866 - DNA, 20 bp, Artificial
  CRISPR gRNA sequence
tctgaatacgggtaaaagtt

SEQ ID NO: 541867 - DNA, 20 bp, Artificial
  CRISPR gRNA sequence
gtaaaagttaggtgatgtta

SEQ ID NO: 541868 - DNA, 20 bp, Artificial
  CRISPR gRNA sequence
taaaagttaggtgatgttac

SEQ ID NO: 541869 - DNA, 20 bp, Artificial
  CRISPR gRNA sequence
gttaggtgatgttacaggat

SEQ ID NO: 541870 - DNA, 20 bp, Artificial
  CRISPR gRNA sequence
aggattagtgttaatattta

SEQ ID NO: 541871 - DNA, 20 bp, Artificial
  CRISPR gRNA sequence
atagatgttatgatgttatt

SEQ ID NO: 541872 - DNA, 20 bp, Artificial
  CRISPR gRNA sequence
atgttattgagattatgcaa

SEQ ID NO: 541873 - DNA, 20 bp, Artificial
  CRISPR gRNA sequence
tgagattatgcaaaagtgtc

SEQ ID NO: 541874 - DNA, 20 bp, Artificial
  CRISPR gRNA sequence
gagattatgcaaaagtgtct

SEQ ID NO: 541875 - DNA, 20 bp, Artificial
  CRISPR gRNA sequence
gattatgcaaaagtgtctag

SEQ ID NO: 541876 - DNA, 20 bp, Artificial
  CRISPR gRNA sequence
aagtgtctaggagtgaaatg

SEQ ID NO: 541877 - DNA, 20 bp, Artificial
  CRISPR gRNA sequence
agtgtctaggagtgaaatgt

SEQ ID NO: 541878 - DNA, 20 bp, Artificial
  CRISPR gRNA sequence
aggagtgaaatgtgggtacc

SEQ ID NO: 541879 - DNA, 20 bp, Artificial
  CRISPR gRNA sequence
gagtgaaatgtgggtaccta

SEQ ID NO: 541880 - DNA, 20 bp, Artificial
  CRISPR gRNA sequence
attgtaaattctatgtccca

SEQ ID NO: 541881 - DNA, 20 bp, Artificial
  CRISPR gRNA sequence
gtaaattctatgtcccaaag

SEQ ID NO: 541882 - DNA, 20 bp, Artificial
  CRISPR gRNA sequence
taaatacaattttgcatgac

SEQ ID NO: 541883 - DNA, 20 bp, Artificial
  CRISPR gRNA sequence
gacctatatttcccatgttt

SEQ ID NO: 541884 - DNA, 20 bp, Artificial
  CRISPR gRNA sequence
ctatatttcccatgttttag

SEQ ID NO: 541885 - DNA, 20 bp, Artificial
  CRISPR gRNA sequence
atgttttagcagaatttcat

SEQ ID NO: 541886 - DNA, 20 bp, Artificial
  CRISPR gRNA sequence
attggacaatgtatacatgt

SEQ ID NO: 541887 - DNA, 20 bp, Artificial
  CRISPR gRNA sequence
aatgtatacatgttggatat

SEQ ID NO: 541888 - DNA, 20 bp, Artificial
  CRISPR gRNA sequence
acatgttggatataagaaat

SEQ ID NO: 541889 - DNA, 20 bp, Artificial
  CRISPR gRNA sequence
tgttggatataagaaatcag

SEQ ID NO: 541890 - DNA, 20 bp, Artificial
  CRISPR gRNA sequence
cagtagtactcatcttcaaa

SEQ ID NO: 541891 - DNA, 20 bp, Artificial
  CRISPR gRNA sequence
ctcatcttcaaaaagttgct

SEQ ID NO: 541892 - DNA, 20 bp, Artificial
  CRISPR gRNA sequence
atcttcaaaaagttgcttag

SEQ ID NO: 541893 - DNA, 20 bp, Artificial
  CRISPR gRNA sequence
aaaagttgcttagtggatct

SEQ ID NO: 541894 - DNA, 20 bp, Artificial
  CRISPR gRNA sequence
aaagttgcttagtggatctc

SEQ ID NO: 541895 - DNA, 20 bp, Artificial
  CRISPR gRNA sequence
ttgcttagtggatctcaggc

SEQ ID NO: 541896 - DNA, 20 bp, Artificial
  CRISPR gRNA sequence
tgcttagtggatctcaggct

SEQ ID NO: 541897 - DNA, 20 bp, Artificial
  CRISPR gRNA sequence
gcttagtggatctcaggcta

SEQ ID NO: 541898 - DNA, 20 bp, Artificial
  CRISPR gRNA sequence
atctcaggctagggatacaa

SEQ ID NO: 541899 - DNA, 20 bp, Artificial
  CRISPR gRNA sequence
ctcaggctagggatacaaca

SEQ ID NO: 541900 - DNA, 20 bp, Artificial
  CRISPR gRNA sequence
gggatacaacagagcatata

SEQ ID NO: 541901 - DNA, 20 bp, Artificial
  CRISPR gRNA sequence
ggatacaacagagcatataa

SEQ ID NO: 541902 - DNA, 20 bp, Artificial
  CRISPR gRNA sequence
caacagagcatataaaggaa

SEQ ID NO: 541903 - DNA, 20 bp, Artificial
  CRISPR gRNA sequence
aacagagcatataaaggaat

SEQ ID NO: 541904 - DNA, 20 bp, Artificial
  CRISPR gRNA sequence
taaaggaataggttctgatt

SEQ ID NO: 541905 - DNA, 20 bp, Artificial
  CRISPR gRNA sequence
aaggaataggttctgattca

SEQ ID NO: 541906 - DNA, 20 bp, Artificial
  CRISPR gRNA sequence
ggaataggttctgattcaga

SEQ ID NO: 541907 - DNA, 20 bp, Artificial
  CRISPR gRNA sequence
ttctgattcagagagaatca

SEQ ID NO: 541908 - DNA, 20 bp, Artificial
  CRISPR gRNA sequence
ttcagagagaatcaaagttc

SEQ ID NO: 541909 - DNA, 20 bp, Artificial
  CRISPR gRNA sequence
acttatttgctgtgtgaact

SEQ ID NO: 541910 - DNA, 20 bp, Artificial
  CRISPR gRNA sequence
acacattactgaacctacct

SEQ ID NO: 541911 - DNA, 20 bp, Artificial
  CRISPR gRNA sequence
tgttccctatgtaataaaat

SEQ ID NO: 541912 - DNA, 20 bp, Artificial
  CRISPR gRNA sequence
ataaaaacatctcaaatctg

SEQ ID NO: 541913 - DNA, 20 bp, Artificial
  CRISPR gRNA sequence
aacatctcaaatctgaagca

SEQ ID NO: 541914 - DNA, 20 bp, Artificial
  CRISPR gRNA sequence
caaatctgaagcatagctcc

SEQ ID NO: 541915 - DNA, 20 bp, Artificial
  CRISPR gRNA sequence
ctgaagcatagctcctggca

SEQ ID NO: 541916 - DNA, 20 bp, Artificial
  CRISPR gRNA sequence
gaagcatagctcctggcaca

SEQ ID NO: 541917 - DNA, 20 bp, Artificial
  CRISPR gRNA sequence
gcatagctcctggcacagag

SEQ ID NO: 541918 - DNA, 20 bp, Artificial
  CRISPR gRNA sequence
catagctcctggcacagagc

SEQ ID NO: 541919 - DNA, 20 bp, Artificial
  CRISPR gRNA sequence
cagagcaggtacttacctcc

SEQ ID NO: 541920 - DNA, 20 bp, Artificial
  CRISPR gRNA sequence
agcaggtacttacctcctag

SEQ ID NO: 541921 - DNA, 20 bp, Artificial
  CRISPR gRNA sequence
cttacactctgttataacac

SEQ ID NO: 541922 - DNA, 20 bp, Artificial
  CRISPR gRNA sequence
ttacactctgttataacact

SEQ ID NO: 541923 - DNA, 20 bp, Artificial
  CRISPR gRNA sequence
ctctgttataacactgggcc

SEQ ID NO: 541924 - DNA, 20 bp, Artificial
  CRISPR gRNA sequence
cactgggcctagttttccta

SEQ ID NO: 541925 - DNA, 20 bp, Artificial
  CRISPR gRNA sequence
actgggcctagttttcctat

SEQ ID NO: 541926 - DNA, 20 bp, Artificial
  CRISPR gRNA sequence
cacacaacactattttaact

SEQ ID NO: 541927 - DNA, 20 bp, Artificial
  CRISPR gRNA sequence
ctttgctaaataaaaaaaca

SEQ ID NO: 541928 - DNA, 20 bp, Artificial
  CRISPR gRNA sequence
taaaaaaacacagactgtct

SEQ ID NO: 541929 - DNA, 20 bp, Artificial
  CRISPR gRNA sequence
gactgtctaagtctcaactc

SEQ ID NO: 541930 - DNA, 20 bp, Artificial
  CRISPR gRNA sequence
tctaagtctcaactccagca

SEQ ID NO: 541931 - DNA, 20 bp, Artificial
  CRISPR gRNA sequence
ctccagcaaagcacatgaac

SEQ ID NO: 541932 - DNA, 20 bp, Artificial
  CRISPR gRNA sequence
caagtctcacataataatgt

SEQ ID NO: 541933 - DNA, 20 bp, Artificial
  CRISPR gRNA sequence
taatgtgagataatttcaaa

SEQ ID NO: 541934 - DNA, 20 bp, Artificial
  CRISPR gRNA sequence
atgtgagataatttcaaatg

SEQ ID NO: 541935 - DNA, 20 bp, Artificial
  CRISPR gRNA sequence
aatttcaaatggagaaatgc

SEQ ID NO: 541936 - DNA, 20 bp, Artificial
  CRISPR gRNA sequence
atacattgtcatctaatgtt

SEQ ID NO: 541937 - DNA, 20 bp, Artificial
  CRISPR gRNA sequence
tctttactattaaaaaaaaa

SEQ ID NO: 541938 - DNA, 20 bp, Artificial
  CRISPR gRNA sequence
aaaaaaaaacagatcaatat

SEQ ID NO: 541939 - DNA, 20 bp, Artificial
  CRISPR gRNA sequence
aaaaaaaacagatcaatata

SEQ ID NO: 541940 - DNA, 20 bp, Artificial
  CRISPR gRNA sequence
aatacatgacttctgcatac

SEQ ID NO: 541941 - DNA, 20 bp, Artificial
  CRISPR gRNA sequence
atacatgacttctgcataca

SEQ ID NO: 541942 - DNA, 20 bp, Artificial
  CRISPR gRNA sequence
catacaaggaacttaaaatc

SEQ ID NO: 541943 - DNA, 20 bp, Artificial
  CRISPR gRNA sequence
gaacttaaaatctagttatg

SEQ ID NO: 541944 - DNA, 20 bp, Artificial
  CRISPR gRNA sequence
ttaaaatctagttatgcaga

SEQ ID NO: 541945 - DNA, 20 bp, Artificial
  CRISPR gRNA sequence
aatctagttatgcagatagt

SEQ ID NO: 541946 - DNA, 20 bp, Artificial
  CRISPR gRNA sequence
tatgcagatagttggcaata

SEQ ID NO: 541947 - DNA, 20 bp, Artificial
  CRISPR gRNA sequence
atgcagatagttggcaataa

SEQ ID NO: 541948 - DNA, 20 bp, Artificial
  CRISPR gRNA sequence
gatctgtaaaatgtcaacaa

SEQ ID NO: 541949 - DNA, 20 bp, Artificial
  CRISPR gRNA sequence
ctgtaaaatgtcaacaacag

SEQ ID NO: 541950 - DNA, 20 bp, Artificial
  CRISPR gRNA sequence
aatgtcaacaacagcagaat

SEQ ID NO: 541951 - DNA, 20 bp, Artificial
  CRISPR gRNA sequence
tcaacaacagcagaataaga

SEQ ID NO: 541952 - DNA, 20 bp, Artificial
  CRISPR gRNA sequence
agactctgttaataataaaa

SEQ ID NO: 541953 - DNA, 20 bp, Artificial
  CRISPR gRNA sequence
tatttttttgctctgttacc

SEQ ID NO: 541954 - DNA, 20 bp, Artificial
  CRISPR gRNA sequence
atttttttgctctgttaccc

SEQ ID NO: 541955 - DNA, 20 bp, Artificial
  CRISPR gRNA sequence
ttttgctctgttacccaggc

SEQ ID NO: 541956 - DNA, 20 bp, Artificial
  CRISPR gRNA sequence
ctgttacccaggctggaatg

SEQ ID NO: 541957 - DNA, 20 bp, Artificial
  CRISPR gRNA sequence
ggaatgcagttgtgtcatca

SEQ ID NO: 541958 - DNA, 20 bp, Artificial
  CRISPR gRNA sequence
tgtgtcatcatggctcactg

SEQ ID NO: 541959 - DNA, 20 bp, Artificial
  CRISPR gRNA sequence
tcactgcagcctcaaattcc

SEQ ID NO: 541960 - DNA, 20 bp, Artificial
  CRISPR gRNA sequence
agcctcaaattcccagactc

SEQ ID NO: 541961 - DNA, 20 bp, Artificial
  CRISPR gRNA sequence
tcccagactcaagcaattgc

SEQ ID NO: 541962 - DNA, 20 bp, Artificial
  CRISPR gRNA sequence
cccagactcaagcaattgcc

SEQ ID NO: 541963 - DNA, 20 bp, Artificial
  CRISPR gRNA sequence
agcaattgccaggctcatct

SEQ ID NO: 541964 - DNA, 20 bp, Artificial
  CRISPR gRNA sequence
caggctcatctcagcctcct

SEQ ID NO: 541965 - DNA, 20 bp, Artificial
  CRISPR gRNA sequence
gctcatctcagcctcctgag

SEQ ID NO: 541966 - DNA, 20 bp, Artificial
  CRISPR gRNA sequence
atctcagcctcctgagtagc

SEQ ID NO: 541967 - DNA, 20 bp, Artificial
  CRISPR gRNA sequence
tctcagcctcctgagtagct

SEQ ID NO: 541968 - DNA, 20 bp, Artificial
  CRISPR gRNA sequence
ctcctgagtagctgggacta

SEQ ID NO: 541969 - DNA, 20 bp, Artificial
  CRISPR gRNA sequence
tcctgagtagctgggactac

SEQ ID NO: 541970 - DNA, 20 bp, Artificial
  CRISPR gRNA sequence
caggcgtgcaccaccacacc

SEQ ID NO: 541971 - DNA, 20 bp, Artificial
  CRISPR gRNA sequence
cacacctggctaactttttg

SEQ ID NO: 541972 - DNA, 20 bp, Artificial
  CRISPR gRNA sequence
cacctggctaactttttgta

SEQ ID NO: 541973 - DNA, 20 bp, Artificial
  CRISPR gRNA sequence
tggctaactttttgtagaga

SEQ ID NO: 541974 - DNA, 20 bp, Artificial
  CRISPR gRNA sequence
ggctaactttttgtagagat

SEQ ID NO: 541975 - DNA, 20 bp, Artificial
  CRISPR gRNA sequence
gctaactttttgtagagatg

SEQ ID NO: 541976 - DNA, 20 bp, Artificial
  CRISPR gRNA sequence
tttgtagagatggggtgtat

SEQ ID NO: 541977 - DNA, 20 bp, Artificial
  CRISPR gRNA sequence
ctgctaataatgacatacat

SEQ ID NO: 541978 - DNA, 20 bp, Artificial
  CRISPR gRNA sequence
aataatgacatacatgagac

SEQ ID NO: 541979 - DNA, 20 bp, Artificial
  CRISPR gRNA sequence
ataatgacatacatgagact

SEQ ID NO: 541980 - DNA, 20 bp, Artificial
  CRISPR gRNA sequence
atgagactgggtaatttatc

SEQ ID NO: 541981 - DNA, 20 bp, Artificial
  CRISPR gRNA sequence
tgagactgggtaatttatca

SEQ ID NO: 541982 - DNA, 20 bp, Artificial
  CRISPR gRNA sequence
actgggtaatttatcaagga

SEQ ID NO: 541983 - DNA, 20 bp, Artificial
  CRISPR gRNA sequence
tgggtaatttatcaaggaaa

SEQ ID NO: 541984 - DNA, 20 bp, Artificial
  CRISPR gRNA sequence
gggtaatttatcaaggaaag

SEQ ID NO: 541985 - DNA, 20 bp, Artificial
  CRISPR gRNA sequence
tatcaaggaaagaggctcaa

SEQ ID NO: 541986 - DNA, 20 bp, Artificial
  CRISPR gRNA sequence
aaagaggctcaatggactca

SEQ ID NO: 541987 - DNA, 20 bp, Artificial
  CRISPR gRNA sequence
aatggactcacagttccaca

SEQ ID NO: 541988 - DNA, 20 bp, Artificial
  CRISPR gRNA sequence
gactcacagttccacatggc

SEQ ID NO: 541989 - DNA, 20 bp, Artificial
  CRISPR gRNA sequence
actcacagttccacatggcc

SEQ ID NO: 541990 - DNA, 20 bp, Artificial
  CRISPR gRNA sequence
ctcacagttccacatggcca

SEQ ID NO: 541991 - DNA, 20 bp, Artificial
  CRISPR gRNA sequence
ccagggaaacctcacaatca

SEQ ID NO: 541992 - DNA, 20 bp, Artificial
  CRISPR gRNA sequence
gggaaacctcacaatcatgg

SEQ ID NO: 541993 - DNA, 20 bp, Artificial
  CRISPR gRNA sequence
aaacctcacaatcatggcag

SEQ ID NO: 541994 - DNA, 20 bp, Artificial
  CRISPR gRNA sequence
aacctcacaatcatggcaga

SEQ ID NO: 541995 - DNA, 20 bp, Artificial
  CRISPR gRNA sequence
cacaatcatggcagaaggca

SEQ ID NO: 541996 - DNA, 20 bp, Artificial
  CRISPR gRNA sequence
acaatcatggcagaaggcaa

SEQ ID NO: 541997 - DNA, 20 bp, Artificial
  CRISPR gRNA sequence
aatcatggcagaaggcaaag

SEQ ID NO: 541998 - DNA, 20 bp, Artificial
  CRISPR gRNA sequence
catggcagaaggcaaaggag

SEQ ID NO: 541999 - DNA, 20 bp, Artificial
  CRISPR gRNA sequence
cagaaggcaaaggagaagca

SEQ ID NO: 542000 - DNA, 20 bp, Artificial
  CRISPR gRNA sequence
gaagcaaagtcatgtcttaa

SEQ ID NO: 542001 - DNA, 20 bp, Artificial
  CRISPR gRNA sequence
gcaaagtcatgtcttaatgg

SEQ ID NO: 542002 - DNA, 20 bp, Artificial
  CRISPR gRNA sequence
aagtcatgtcttaatggtgg

SEQ ID NO: 542003 - DNA, 20 bp, Artificial
  CRISPR gRNA sequence
agtcatgtcttaatggtggc

SEQ ID NO: 542004 - DNA, 20 bp, Artificial
  CRISPR gRNA sequence
atgtcttaatggtggcaggc

SEQ ID NO: 542005 - DNA, 20 bp, Artificial
  CRISPR gRNA sequence
gtcttaatggtggcaggcaa

SEQ ID NO: 542006 - DNA, 20 bp, Artificial
  CRISPR gRNA sequence
cttaatggtggcaggcaaga

SEQ ID NO: 542007 - DNA, 20 bp, Artificial
  CRISPR gRNA sequence
taatggtggcaggcaagaga

SEQ ID NO: 542008 - DNA, 20 bp, Artificial
  CRISPR gRNA sequence
caggcaagagagagcgtgtg

SEQ ID NO: 542009 - DNA, 20 bp, Artificial
  CRISPR gRNA sequence
aggcaagagagagcgtgtgc

SEQ ID NO: 542010 - DNA, 20 bp, Artificial
  CRISPR gRNA sequence
ggcaagagagagcgtgtgca

SEQ ID NO: 542011 - DNA, 20 bp, Artificial
  CRISPR gRNA sequence
gcaagagagagcgtgtgcag

SEQ ID NO: 542012 - DNA, 20 bp, Artificial
  CRISPR gRNA sequence
actcccctttatgaaaccat

SEQ ID NO: 542013 - DNA, 20 bp, Artificial
  CRISPR gRNA sequence
atgaaaccatcagatcttgt

SEQ ID NO: 542014 - DNA, 20 bp, Artificial
  CRISPR gRNA sequence
tgagacttattcactatcac

SEQ ID NO: 542015 - DNA, 20 bp, Artificial
  CRISPR gRNA sequence
cttattcactatcacaagaa

SEQ ID NO: 542016 - DNA, 20 bp, Artificial
  CRISPR gRNA sequence
tcactatcacaagaacagta

SEQ ID NO: 542017 - DNA, 20 bp, Artificial
  CRISPR gRNA sequence
actatcacaagaacagtata

SEQ ID NO: 542018 - DNA, 20 bp, Artificial
  CRISPR gRNA sequence
ctatcacaagaacagtatag

SEQ ID NO: 542019 - DNA, 20 bp, Artificial
  CRISPR gRNA sequence
atgattcaattatctccacc

SEQ ID NO: 542020 - DNA, 20 bp, Artificial
  CRISPR gRNA sequence
ctggccctgcccttgacaca

SEQ ID NO: 542021 - DNA, 20 bp, Artificial
  CRISPR gRNA sequence
tggccctgcccttgacacac

SEQ ID NO: 542022 - DNA, 20 bp, Artificial
  CRISPR gRNA sequence
ggccctgcccttgacacacg

SEQ ID NO: 542023 - DNA, 20 bp, Artificial
  CRISPR gRNA sequence
cacggggattattacaattc

SEQ ID NO: 542024 - DNA, 20 bp, Artificial
  CRISPR gRNA sequence
acggggattattacaattca

SEQ ID NO: 542025 - DNA, 20 bp, Artificial
  CRISPR gRNA sequence
ggattattacaattcaaggt

SEQ ID NO: 542026 - DNA, 20 bp, Artificial
  CRISPR gRNA sequence
ttacaattcaaggtgagatt

SEQ ID NO: 542027 - DNA, 20 bp, Artificial
  CRISPR gRNA sequence
tacaattcaaggtgagattt

SEQ ID NO: 542028 - DNA, 20 bp, Artificial
  CRISPR gRNA sequence
aattcaaggtgagatttggg

SEQ ID NO: 542029 - DNA, 20 bp, Artificial
  CRISPR gRNA sequence
attcaaggtgagatttgggt

SEQ ID NO: 542030 - DNA, 20 bp, Artificial
  CRISPR gRNA sequence
ttcaaggtgagatttgggtg

SEQ ID NO: 542031 - DNA, 20 bp, Artificial
  CRISPR gRNA sequence
gtgagatttgggtggggaca

SEQ ID NO: 542032 - DNA, 20 bp, Artificial
  CRISPR gRNA sequence
caaaccatatcattccaccc

SEQ ID NO: 542033 - DNA, 20 bp, Artificial
  CRISPR gRNA sequence
acacaataatgcccttccaa

SEQ ID NO: 542034 - DNA, 20 bp, Artificial
  CRISPR gRNA sequence
ctcaaaatcttaacttattc

SEQ ID NO: 542035 - DNA, 20 bp, Artificial
  CRISPR gRNA sequence
ttattccagcattaatccaa

SEQ ID NO: 542036 - DNA, 20 bp, Artificial
  CRISPR gRNA sequence
aatccaaaagtctaaatcca

SEQ ID NO: 542037 - DNA, 20 bp, Artificial
  CRISPR gRNA sequence
gtctaaatccaaagtctcat

SEQ ID NO: 542038 - DNA, 20 bp, Artificial
  CRISPR gRNA sequence
ctaaatccaaagtctcatcg

SEQ ID NO: 542039 - DNA, 20 bp, Artificial
  CRISPR gRNA sequence
tccaaagtctcatcggagat

SEQ ID NO: 542040 - DNA, 20 bp, Artificial
  CRISPR gRNA sequence
ccaaagtctcatcggagata

SEQ ID NO: 542041 - DNA, 20 bp, Artificial
  CRISPR gRNA sequence
agtctcatcggagataaggc

SEQ ID NO: 542042 - DNA, 20 bp, Artificial
  CRISPR gRNA sequence
ggcaagtaccttccacctat

SEQ ID NO: 542043 - DNA, 20 bp, Artificial
  CRISPR gRNA sequence
cctatgagcctgtaaaatca

SEQ ID NO: 542044 - DNA, 20 bp, Artificial
  CRISPR gRNA sequence
ctatgagcctgtaaaatcaa

SEQ ID NO: 542045 - DNA, 20 bp, Artificial
  CRISPR gRNA sequence
gagcctgtaaaatcaaaggc

SEQ ID NO: 542046 - DNA, 20 bp, Artificial
  CRISPR gRNA sequence
ctgtaaaatcaaaggcaagt

SEQ ID NO: 542047 - DNA, 20 bp, Artificial
  CRISPR gRNA sequence
aaggcaagttagttacttcc

SEQ ID NO: 542048 - DNA, 20 bp, Artificial
  CRISPR gRNA sequence
tagttacttcctagatacaa

SEQ ID NO: 542049 - DNA, 20 bp, Artificial
  CRISPR gRNA sequence
agttacttcctagatacaat

SEQ ID NO: 542050 - DNA, 20 bp, Artificial
  CRISPR gRNA sequence
gttacttcctagatacaatg

SEQ ID NO: 542051 - DNA, 20 bp, Artificial
  CRISPR gRNA sequence
ttacttcctagatacaatgg

SEQ ID NO: 542052 - DNA, 20 bp, Artificial
  CRISPR gRNA sequence
tcctagatacaatgggggta

SEQ ID NO: 542053 - DNA, 20 bp, Artificial
  CRISPR gRNA sequence
cctagatacaatgggggtac

SEQ ID NO: 542054 - DNA, 20 bp, Artificial
  CRISPR gRNA sequence
acaatgggggtacaggtgct

SEQ ID NO: 542055 - DNA, 20 bp, Artificial
  CRISPR gRNA sequence
gtaaatatatccattccaaa

SEQ ID NO: 542056 - DNA, 20 bp, Artificial
  CRISPR gRNA sequence
taaatatatccattccaaat

SEQ ID NO: 542057 - DNA, 20 bp, Artificial
  CRISPR gRNA sequence
aatatatccattccaaatgg

SEQ ID NO: 542058 - DNA, 20 bp, Artificial
  CRISPR gRNA sequence
ggagaaattgtccaaaacaa

SEQ ID NO: 542059 - DNA, 20 bp, Artificial
  CRISPR gRNA sequence
gagaaattgtccaaaacaaa

SEQ ID NO: 542060 - DNA, 20 bp, Artificial
  CRISPR gRNA sequence
agaaattgtccaaaacaaaa

SEQ ID NO: 542061 - DNA, 20 bp, Artificial
  CRISPR gRNA sequence
tgtccaaaacaaaagggcta

SEQ ID NO: 542062 - DNA, 20 bp, Artificial
  CRISPR gRNA sequence
gtccaaaacaaaagggctac

SEQ ID NO: 542063 - DNA, 20 bp, Artificial
  CRISPR gRNA sequence
aagggctacaggccccatgc

SEQ ID NO: 542064 - DNA, 20 bp, Artificial
  CRISPR gRNA sequence
catgcaagtcctaaatccaa

SEQ ID NO: 542065 - DNA, 20 bp, Artificial
  CRISPR gRNA sequence
atgcaagtcctaaatccaat

SEQ ID NO: 542066 - DNA, 20 bp, Artificial
  CRISPR gRNA sequence
tgcaagtcctaaatccaata

SEQ ID NO: 542067 - DNA, 20 bp, Artificial
  CRISPR gRNA sequence
aagtcctaaatccaataggg

SEQ ID NO: 542068 - DNA, 20 bp, Artificial
  CRISPR gRNA sequence
tagggcagtcttaaacctta

SEQ ID NO: 542069 - DNA, 20 bp, Artificial
  CRISPR gRNA sequence
ttgactccatgcctcacatc

SEQ ID NO: 542070 - DNA, 20 bp, Artificial
  CRISPR gRNA sequence
tgactccatgcctcacatcc

SEQ ID NO: 542071 - DNA, 20 bp, Artificial
  CRISPR gRNA sequence
gcctcacatccaggtgacgc

SEQ ID NO: 542072 - DNA, 20 bp, Artificial
  CRISPR gRNA sequence
ctcacatccaggtgacgcaa

SEQ ID NO: 542073 - DNA, 20 bp, Artificial
  CRISPR gRNA sequence
catccaggtgacgcaagaga

SEQ ID NO: 542074 - DNA, 20 bp, Artificial
  CRISPR gRNA sequence
atccaggtgacgcaagagat

SEQ ID NO: 542075 - DNA, 20 bp, Artificial
  CRISPR gRNA sequence
gagatgggctcccacaacct

SEQ ID NO: 542076 - DNA, 20 bp, Artificial
  CRISPR gRNA sequence
agatgggctcccacaacctt

SEQ ID NO: 542077 - DNA, 20 bp, Artificial
  CRISPR gRNA sequence
tgggctcccacaaccttggg

SEQ ID NO: 542078 - DNA, 20 bp, Artificial
  CRISPR gRNA sequence
cttgggcagctcttcccctg

SEQ ID NO: 542079 - DNA, 20 bp, Artificial
  CRISPR gRNA sequence
gctcttcccctgtggctttg

SEQ ID NO: 542080 - DNA, 20 bp, Artificial
  CRISPR gRNA sequence
ctcttcccctgtggctttgc

SEQ ID NO: 542081 - DNA, 20 bp, Artificial
  CRISPR gRNA sequence
tcttcccctgtggctttgca

SEQ ID NO: 542082 - DNA, 20 bp, Artificial
  CRISPR gRNA sequence
ccctgtggctttgcagggta

SEQ ID NO: 542083 - DNA, 20 bp, Artificial
  CRISPR gRNA sequence
gcagggtacagccatcctcc

SEQ ID NO: 542084 - DNA, 20 bp, Artificial
  CRISPR gRNA sequence
atcctcctggctgctttcat

SEQ ID NO: 542085 - DNA, 20 bp, Artificial
  CRISPR gRNA sequence
tcctggctgctttcatgagc

SEQ ID NO: 542086 - DNA, 20 bp, Artificial
  CRISPR gRNA sequence
tgctttcatgagctggcatt

SEQ ID NO: 542087 - DNA, 20 bp, Artificial
  CRISPR gRNA sequence
gagctggcattaagtgtctg

SEQ ID NO: 542088 - DNA, 20 bp, Artificial
  CRISPR gRNA sequence
ttaagtgtctgtggcttttc

SEQ ID NO: 542089 - DNA, 20 bp, Artificial
  CRISPR gRNA sequence
taagtgtctgtggcttttcc

SEQ ID NO: 542090 - DNA, 20 bp, Artificial
  CRISPR gRNA sequence
ctgtggcttttccaggtaca

SEQ ID NO: 542091 - DNA, 20 bp, Artificial
  CRISPR gRNA sequence
cttttccaggtacacggtgc

SEQ ID NO: 542092 - DNA, 20 bp, Artificial
  CRISPR gRNA sequence
aggtacacggtgcaagctct

SEQ ID NO: 542093 - DNA, 20 bp, Artificial
  CRISPR gRNA sequence
tacacggtgcaagctctcgg

SEQ ID NO: 542094 - DNA, 20 bp, Artificial
  CRISPR gRNA sequence
tctcggtggatctaccattc

SEQ ID NO: 542095 - DNA, 20 bp, Artificial
  CRISPR gRNA sequence
ctcggtggatctaccattcc

SEQ ID NO: 542096 - DNA, 20 bp, Artificial
  CRISPR gRNA sequence
tcggtggatctaccattccg

SEQ ID NO: 542097 - DNA, 20 bp, Artificial
  CRISPR gRNA sequence
ggatctaccattccggggtc

SEQ ID NO: 542098 - DNA, 20 bp, Artificial
  CRISPR gRNA sequence
tctaccattccggggtctgg

SEQ ID NO: 542099 - DNA, 20 bp, Artificial
  CRISPR gRNA sequence
ttccggggtctggtggatga

SEQ ID NO: 542100 - DNA, 20 bp, Artificial
  CRISPR gRNA sequence
ggatgatggccctcttctca

SEQ ID NO: 542101 - DNA, 20 bp, Artificial
  CRISPR gRNA sequence
ccctcttctcacagctccac

SEQ ID NO: 542102 - DNA, 20 bp, Artificial
  CRISPR gRNA sequence
cctcttctcacagctccact

SEQ ID NO: 542103 - DNA, 20 bp, Artificial
  CRISPR gRNA sequence
cttctcacagctccactagg

SEQ ID NO: 542104 - DNA, 20 bp, Artificial
  CRISPR gRNA sequence
agctccactaggcggtgccc

SEQ ID NO: 542105 - DNA, 20 bp, Artificial
  CRISPR gRNA sequence
tccactaggcggtgccccag

SEQ ID NO: 542106 - DNA, 20 bp, Artificial
  CRISPR gRNA sequence
ccactaggcggtgccccagt

SEQ ID NO: 542107 - DNA, 20 bp, Artificial
  CRISPR gRNA sequence
cactaggcggtgccccagtg

SEQ ID NO: 542108 - DNA, 20 bp, Artificial
  CRISPR gRNA sequence
gccccagtggggactctgtg

SEQ ID NO: 542109 - DNA, 20 bp, Artificial
  CRISPR gRNA sequence
ccccagtggggactctgtgt

SEQ ID NO: 542110 - DNA, 20 bp, Artificial
  CRISPR gRNA sequence
cccagtggggactctgtgtg

SEQ ID NO: 542111 - DNA, 20 bp, Artificial
  CRISPR gRNA sequence
ccagtggggactctgtgtgg

SEQ ID NO: 542112 - DNA, 20 bp, Artificial
  CRISPR gRNA sequence
atttcccttccacactgccc

SEQ ID NO: 542113 - DNA, 20 bp, Artificial
  CRISPR gRNA sequence
tcccttccacactgccctag

SEQ ID NO: 542114 - DNA, 20 bp, Artificial
  CRISPR gRNA sequence
ccttccacactgccctagca

SEQ ID NO: 542115 - DNA, 20 bp, Artificial
  CRISPR gRNA sequence
cttccacactgccctagcag

SEQ ID NO: 542116 - DNA, 20 bp, Artificial
  CRISPR gRNA sequence
ccctagcagaggttctccat

SEQ ID NO: 542117 - DNA, 20 bp, Artificial
  CRISPR gRNA sequence
cctagcagaggttctccatg

SEQ ID NO: 542118 - DNA, 20 bp, Artificial
  CRISPR gRNA sequence
ctagcagaggttctccatga

SEQ ID NO: 542119 - DNA, 20 bp, Artificial
  CRISPR gRNA sequence
ccatgagggtcccactcctg

SEQ ID NO: 542120 - DNA, 20 bp, Artificial
  CRISPR gRNA sequence
tcctgcagcaaacttctgcc

SEQ ID NO: 542121 - DNA, 20 bp, Artificial
  CRISPR gRNA sequence
caaacttctgcctggacatc

SEQ ID NO: 542122 - DNA, 20 bp, Artificial
  CRISPR gRNA sequence
aaacttctgcctggacatcc

SEQ ID NO: 542123 - DNA, 20 bp, Artificial
  CRISPR gRNA sequence
tccatacatcctctgaaatc

SEQ ID NO: 542124 - DNA, 20 bp, Artificial
  CRISPR gRNA sequence
ccatacatcctctgaaatct

SEQ ID NO: 542125 - DNA, 20 bp, Artificial
  CRISPR gRNA sequence
tacatcctctgaaatctagg

SEQ ID NO: 542126 - DNA, 20 bp, Artificial
  CRISPR gRNA sequence
catcctctgaaatctaggca

SEQ ID NO: 542127 - DNA, 20 bp, Artificial
  CRISPR gRNA sequence
atcctctgaaatctaggcag

SEQ ID NO: 542128 - DNA, 20 bp, Artificial
  CRISPR gRNA sequence
tcttgacttctgtgcatcca

SEQ ID NO: 542129 - DNA, 20 bp, Artificial
  CRISPR gRNA sequence
cttgacttctgtgcatccac

SEQ ID NO: 542130 - DNA, 20 bp, Artificial
  CRISPR gRNA sequence
acaggcccaacaccacatgt

SEQ ID NO: 542131 - DNA, 20 bp, Artificial
  CRISPR gRNA sequence
aacaccacatgtaagccacc

SEQ ID NO: 542132 - DNA, 20 bp, Artificial
  CRISPR gRNA sequence
acaccacatgtaagccacca

SEQ ID NO: 542133 - DNA, 20 bp, Artificial
  CRISPR gRNA sequence
ccaccaaggcttaccctctg

SEQ ID NO: 542134 - DNA, 20 bp, Artificial
  CRISPR gRNA sequence
aggcttaccctctgaagcaa

SEQ ID NO: 542135 - DNA, 20 bp, Artificial
  CRISPR gRNA sequence
accctctgaagcaacagcct

SEQ ID NO: 542136 - DNA, 20 bp, Artificial
  CRISPR gRNA sequence
ctctgaagcaacagcctgag

SEQ ID NO: 542137 - DNA, 20 bp, Artificial
  CRISPR gRNA sequence
caacagcctgagtggtatgt

SEQ ID NO: 542138 - DNA, 20 bp, Artificial
  CRISPR gRNA sequence
agtggtatgttggccccttt

SEQ ID NO: 542139 - DNA, 20 bp, Artificial
  CRISPR gRNA sequence
atgttggccccttttagcca

SEQ ID NO: 542140 - DNA, 20 bp, Artificial
  CRISPR gRNA sequence
tggccccttttagccatggc

SEQ ID NO: 542141 - DNA, 20 bp, Artificial
  CRISPR gRNA sequence
gccccttttagccatggctg

SEQ ID NO: 542142 - DNA, 20 bp, Artificial
  CRISPR gRNA sequence
agccatggctggagctaaaa

SEQ ID NO: 542143 - DNA, 20 bp, Artificial
  CRISPR gRNA sequence
atggctggagctaaaacagc

SEQ ID NO: 542144 - DNA, 20 bp, Artificial
  CRISPR gRNA sequence
gagctaaaacagctggcatg

SEQ ID NO: 542145 - DNA, 20 bp, Artificial
  CRISPR gRNA sequence
agctaaaacagctggcatgc

SEQ ID NO: 542146 - DNA, 20 bp, Artificial
  CRISPR gRNA sequence
gctaaaacagctggcatgca

SEQ ID NO: 542147 - DNA, 20 bp, Artificial
  CRISPR gRNA sequence
ggcatgcagggctccatgtt

SEQ ID NO: 542148 - DNA, 20 bp, Artificial
  CRISPR gRNA sequence
catgcagggctccatgtttg

SEQ ID NO: 542149 - DNA, 20 bp, Artificial
  CRISPR gRNA sequence
atgcagggctccatgtttgg

SEQ ID NO: 542150 - DNA, 20 bp, Artificial
  CRISPR gRNA sequence
ctccatgtttggaggctgca

SEQ ID NO: 542151 - DNA, 20 bp, Artificial
  CRISPR gRNA sequence
ccatgtttggaggctgcaaa

SEQ ID NO: 542152 - DNA, 20 bp, Artificial
  CRISPR gRNA sequence
tgtttggaggctgcaaagag

SEQ ID NO: 542153 - DNA, 20 bp, Artificial
  CRISPR gRNA sequence
gtttggaggctgcaaagagc

SEQ ID NO: 542154 - DNA, 20 bp, Artificial
  CRISPR gRNA sequence
tttggaggctgcaaagagca

SEQ ID NO: 542155 - DNA, 20 bp, Artificial
  CRISPR gRNA sequence
ttggaggctgcaaagagcag

SEQ ID NO: 542156 - DNA, 20 bp, Artificial
  CRISPR gRNA sequence
tggaggctgcaaagagcagg

SEQ ID NO: 542157 - DNA, 20 bp, Artificial
  CRISPR gRNA sequence
ggaggctgcaaagagcaggg

SEQ ID NO: 542158 - DNA, 20 bp, Artificial
  CRISPR gRNA sequence
tgcaaagagcaggggggccc

SEQ ID NO: 542159 - DNA, 20 bp, Artificial
  CRISPR gRNA sequence
gcaaagagcaggggggccct

SEQ ID NO: 542160 - DNA, 20 bp, Artificial
  CRISPR gRNA sequence
gagcaggggggccctgggtc

SEQ ID NO: 542161 - DNA, 20 bp, Artificial
  CRISPR gRNA sequence
atgaaacaatttttccctcc

SEQ ID NO: 542162 - DNA, 20 bp, Artificial
  CRISPR gRNA sequence
tgaaacaatttttccctcca

SEQ ID NO: 542163 - DNA, 20 bp, Artificial
  CRISPR gRNA sequence
atttttccctccaaggcctc

SEQ ID NO: 542164 - DNA, 20 bp, Artificial
  CRISPR gRNA sequence
tttttccctccaaggcctcc

SEQ ID NO: 542165 - DNA, 20 bp, Artificial
  CRISPR gRNA sequence
caaggcctccaggcctgtga

SEQ ID NO: 542166 - DNA, 20 bp, Artificial
  CRISPR gRNA sequence
aaggcctccaggcctgtgat

SEQ ID NO: 542167 - DNA, 20 bp, Artificial
  CRISPR gRNA sequence
ggcctccaggcctgtgatag

SEQ ID NO: 542168 - DNA, 20 bp, Artificial
  CRISPR gRNA sequence
gcctccaggcctgtgatagg

SEQ ID NO: 542169 - DNA, 20 bp, Artificial
  CRISPR gRNA sequence
cctccaggcctgtgatagga

SEQ ID NO: 542170 - DNA, 20 bp, Artificial
  CRISPR gRNA sequence
ctccaggcctgtgataggag

SEQ ID NO: 542171 - DNA, 20 bp, Artificial
  CRISPR gRNA sequence
tgataggaggggctgccatg

SEQ ID NO: 542172 - DNA, 20 bp, Artificial
  CRISPR gRNA sequence
gataggaggggctgccatga

SEQ ID NO: 542173 - DNA, 20 bp, Artificial
  CRISPR gRNA sequence
tgaaggtttctgatatgccc

SEQ ID NO: 542174 - DNA, 20 bp, Artificial
  CRISPR gRNA sequence
aaggtttctgatatgccctg

SEQ ID NO: 542175 - DNA, 20 bp, Artificial
  CRISPR gRNA sequence
ttgtcttcgtgattaacatt

SEQ ID NO: 542176 - DNA, 20 bp, Artificial
  CRISPR gRNA sequence
ttacttaatgcaaatttctg

SEQ ID NO: 542177 - DNA, 20 bp, Artificial
  CRISPR gRNA sequence
ttaatgcaaatttctgcagc

SEQ ID NO: 542178 - DNA, 20 bp, Artificial
  CRISPR gRNA sequence
agctggcttgaatttttcct

SEQ ID NO: 542179 - DNA, 20 bp, Artificial
  CRISPR gRNA sequence
gcttgaatttttcctcagaa

SEQ ID NO: 542180 - DNA, 20 bp, Artificial
  CRISPR gRNA sequence
cttgaatttttcctcagaaa

SEQ ID NO: 542181 - DNA, 20 bp, Artificial
  CRISPR gRNA sequence
ttgaatttttcctcagaaaa

SEQ ID NO: 542182 - DNA, 20 bp, Artificial
  CRISPR gRNA sequence
tgaatttttcctcagaaaag

SEQ ID NO: 542183 - DNA, 20 bp, Artificial
  CRISPR gRNA sequence
tttcttttctattgcatcat

SEQ ID NO: 542184 - DNA, 20 bp, Artificial
  CRISPR gRNA sequence
ttcttttctattgcatcatt

SEQ ID NO: 542185 - DNA, 20 bp, Artificial
  CRISPR gRNA sequence
cctgctatccttttaaacat

SEQ ID NO: 542186 - DNA, 20 bp, Artificial
  CRISPR gRNA sequence
ataaaactgaatgcttttaa

SEQ ID NO: 542187 - DNA, 20 bp, Artificial
  CRISPR gRNA sequence
gaatgcttttaacagcaacc

SEQ ID NO: 542188 - DNA, 20 bp, Artificial
  CRISPR gRNA sequence
ctcttgaatgctttgctgct

SEQ ID NO: 542189 - DNA, 20 bp, Artificial
  CRISPR gRNA sequence
tgcttagaaatttcttccac

SEQ ID NO: 542190 - DNA, 20 bp, Artificial
  CRISPR gRNA sequence
tgccctaaataatttctctc

SEQ ID NO: 542191 - DNA, 20 bp, Artificial
  CRISPR gRNA sequence
aataatttctctcaagttca

SEQ ID NO: 542192 - DNA, 20 bp, Artificial
  CRISPR gRNA sequence
ttcaaagttccacgtatctt

SEQ ID NO: 542193 - DNA, 20 bp, Artificial
  CRISPR gRNA sequence
tcaaagttccacgtatcttt

SEQ ID NO: 542194 - DNA, 20 bp, Artificial
  CRISPR gRNA sequence
caaagttccacgtatcttta

SEQ ID NO: 542195 - DNA, 20 bp, Artificial
  CRISPR gRNA sequence
ttccacgtatctttagggca

SEQ ID NO: 542196 - DNA, 20 bp, Artificial
  CRISPR gRNA sequence
tccacgtatctttagggcac

SEQ ID NO: 542197 - DNA, 20 bp, Artificial
  CRISPR gRNA sequence
gggcacaggcaaaatgctgc

SEQ ID NO: 542198 - DNA, 20 bp, Artificial
  CRISPR gRNA sequence
tctctttgctaaaacatatt

SEQ ID NO: 542199 - DNA, 20 bp, Artificial
  CRISPR gRNA sequence
tctttgctaaaacatattaa

SEQ ID NO: 542200 - DNA, 20 bp, Artificial
  CRISPR gRNA sequence
attaagagtcacctttattc

SEQ ID NO: 542201 - DNA, 20 bp, Artificial
  CRISPR gRNA sequence
attgttcctcatctccatct

SEQ ID NO: 542202 - DNA, 20 bp, Artificial
  CRISPR gRNA sequence
tcctcatctccatctgagat

SEQ ID NO: 542203 - DNA, 20 bp, Artificial
  CRISPR gRNA sequence
tcatctccatctgagatgag

SEQ ID NO: 542204 - DNA, 20 bp, Artificial
  CRISPR gRNA sequence
catctgagatgagcagcatt

SEQ ID NO: 542205 - DNA, 20 bp, Artificial
  CRISPR gRNA sequence
agatgagcagcatttggtca

SEQ ID NO: 542206 - DNA, 20 bp, Artificial
  CRISPR gRNA sequence
tttggtcaaagccattcaac

SEQ ID NO: 542207 - DNA, 20 bp, Artificial
  CRISPR gRNA sequence
aaagccattcaacaagtctc

SEQ ID NO: 542208 - DNA, 20 bp, Artificial
  CRISPR gRNA sequence
aagccattcaacaagtctct

SEQ ID NO: 542209 - DNA, 20 bp, Artificial
  CRISPR gRNA sequence
ccattcaacaagtctctagg

SEQ ID NO: 542210 - DNA, 20 bp, Artificial
  CRISPR gRNA sequence
acatcttcctgtcttcttct

SEQ ID NO: 542211 - DNA, 20 bp, Artificial
  CRISPR gRNA sequence
tccaatccctgcctgttacc

SEQ ID NO: 542212 - DNA, 20 bp, Artificial
  CRISPR gRNA sequence
ctgcctgttacccagttcca

SEQ ID NO: 542213 - DNA, 20 bp, Artificial
  CRISPR gRNA sequence
caaagttgcttccacatttt

SEQ ID NO: 542214 - DNA, 20 bp, Artificial
  CRISPR gRNA sequence
aaagttgcttccacattttc

SEQ ID NO: 542215 - DNA, 20 bp, Artificial
  CRISPR gRNA sequence
cacattttcaggtatctttg

SEQ ID NO: 542216 - DNA, 20 bp, Artificial
  CRISPR gRNA sequence
attttcaggtatctttgcag

SEQ ID NO: 542217 - DNA, 20 bp, Artificial
  CRISPR gRNA sequence
tgcagcagtgccccactacc

SEQ ID NO: 542218 - DNA, 20 bp, Artificial
  CRISPR gRNA sequence
ccagtaccaatttactatat

SEQ ID NO: 542219 - DNA, 20 bp, Artificial
  CRISPR gRNA sequence
ccattctcatgctgctaata

SEQ ID NO: 542220 - DNA, 20 bp, Artificial
  CRISPR gRNA sequence
ctgctaataaagacataccc

SEQ ID NO: 542221 - DNA, 20 bp, Artificial
  CRISPR gRNA sequence
aataaagacatacccaagac

SEQ ID NO: 542222 - DNA, 20 bp, Artificial
  CRISPR gRNA sequence
ataaagacatacccaagact

SEQ ID NO: 542223 - DNA, 20 bp, Artificial
  CRISPR gRNA sequence
ccaagactgggtaatttata

SEQ ID NO: 542224 - DNA, 20 bp, Artificial
  CRISPR gRNA sequence
caagactgggtaatttataa

SEQ ID NO: 542225 - DNA, 20 bp, Artificial
  CRISPR gRNA sequence
actgggtaatttataaagga

SEQ ID NO: 542226 - DNA, 20 bp, Artificial
  CRISPR gRNA sequence
gggtaatttataaaggaaag

SEQ ID NO: 542227 - DNA, 20 bp, Artificial
  CRISPR gRNA sequence
aaagaagttcaatgaactca

SEQ ID NO: 542228 - DNA, 20 bp, Artificial
  CRISPR gRNA sequence
aatgaactcacagttccacc

SEQ ID NO: 542229 - DNA, 20 bp, Artificial
  CRISPR gRNA sequence
aactcacagttccacctggc

SEQ ID NO: 542230 - DNA, 20 bp, Artificial
  CRISPR gRNA sequence
actcacagttccacctggcc

SEQ ID NO: 542231 - DNA, 20 bp, Artificial
  CRISPR gRNA sequence
ctcacagttccacctggcca

SEQ ID NO: 542232 - DNA, 20 bp, Artificial
  CRISPR gRNA sequence
cacagttccacctggccagg

SEQ ID NO: 542233 - DNA, 20 bp, Artificial
  CRISPR gRNA sequence
acagttccacctggccaggg

SEQ ID NO: 542234 - DNA, 20 bp, Artificial
  CRISPR gRNA sequence
ccagggaggccccacaatca

SEQ ID NO: 542235 - DNA, 20 bp, Artificial
  CRISPR gRNA sequence
gggaggccccacaatcatgg

SEQ ID NO: 542236 - DNA, 20 bp, Artificial
  CRISPR gRNA sequence
cacaatcatggcagaatgca

SEQ ID NO: 542237 - DNA, 20 bp, Artificial
  CRISPR gRNA sequence
acaatcatggcagaatgcaa

SEQ ID NO: 542238 - DNA, 20 bp, Artificial
  CRISPR gRNA sequence
aatcatggcagaatgcaaag

SEQ ID NO: 542239 - DNA, 20 bp, Artificial
  CRISPR gRNA sequence
catggcagaatgcaaaggag

SEQ ID NO: 542240 - DNA, 20 bp, Artificial
  CRISPR gRNA sequence
gcagaatgcaaaggagaagt

SEQ ID NO: 542241 - DNA, 20 bp, Artificial
  CRISPR gRNA sequence
cagaatgcaaaggagaagta

SEQ ID NO: 542242 - DNA, 20 bp, Artificial
  CRISPR gRNA sequence
gaagtaaggcacatcttaca

SEQ ID NO: 542243 - DNA, 20 bp, Artificial
  CRISPR gRNA sequence
gtaaggcacatcttacatgg

SEQ ID NO: 542244 - DNA, 20 bp, Artificial
  CRISPR gRNA sequence
aggcacatcttacatggcag

SEQ ID NO: 542245 - DNA, 20 bp, Artificial
  CRISPR gRNA sequence
ggcacatcttacatggcagt

SEQ ID NO: 542246 - DNA, 20 bp, Artificial
  CRISPR gRNA sequence
catcttacatggcagtaggc

SEQ ID NO: 542247 - DNA, 20 bp, Artificial
  CRISPR gRNA sequence
tcttacatggcagtaggcaa

SEQ ID NO: 542248 - DNA, 20 bp, Artificial
  CRISPR gRNA sequence
ttacatggcagtaggcaaga

SEQ ID NO: 542249 - DNA, 20 bp, Artificial
  CRISPR gRNA sequence
acatggcagtaggcaagaga

SEQ ID NO: 542250 - DNA, 20 bp, Artificial
  CRISPR gRNA sequence
taggcaagagagagcttgtg

SEQ ID NO: 542251 - DNA, 20 bp, Artificial
  CRISPR gRNA sequence
aggcaagagagagcttgtgc

SEQ ID NO: 542252 - DNA, 20 bp, Artificial
  CRISPR gRNA sequence
ggcaagagagagcttgtgca

SEQ ID NO: 542253 - DNA, 20 bp, Artificial
  CRISPR gRNA sequence
gcaagagagagcttgtgcag

SEQ ID NO: 542254 - DNA, 20 bp, Artificial
  CRISPR gRNA sequence
ataaaatcatcaaatattgt

SEQ ID NO: 542255 - DNA, 20 bp, Artificial
  CRISPR gRNA sequence
gtgagacttattcactatct

SEQ ID NO: 542256 - DNA, 20 bp, Artificial
  CRISPR gRNA sequence
acttattcactatctgagaa

SEQ ID NO: 542257 - DNA, 20 bp, Artificial
  CRISPR gRNA sequence
ttcactatctgagaacagta

SEQ ID NO: 542258 - DNA, 20 bp, Artificial
  CRISPR gRNA sequence
tcactatctgagaacagtat

SEQ ID NO: 542259 - DNA, 20 bp, Artificial
  CRISPR gRNA sequence
cactatctgagaacagtatg

SEQ ID NO: 542260 - DNA, 20 bp, Artificial
  CRISPR gRNA sequence
actatctgagaacagtatgg

SEQ ID NO: 542261 - DNA, 20 bp, Artificial
  CRISPR gRNA sequence
atgattcaattatctccacc

SEQ ID NO: 542262 - DNA, 20 bp, Artificial
  CRISPR gRNA sequence
ctagccctgcccttgacata

SEQ ID NO: 542263 - DNA, 20 bp, Artificial
  CRISPR gRNA sequence
tagccctgcccttgacatat

SEQ ID NO: 542264 - DNA, 20 bp, Artificial
  CRISPR gRNA sequence
agccctgcccttgacatatg

SEQ ID NO: 542265 - DNA, 20 bp, Artificial
  CRISPR gRNA sequence
ggattattacaattcaacgt

SEQ ID NO: 542266 - DNA, 20 bp, Artificial
  CRISPR gRNA sequence
ttacaattcaacgtaagatt

SEQ ID NO: 542267 - DNA, 20 bp, Artificial
  CRISPR gRNA sequence
tacaattcaacgtaagattt

SEQ ID NO: 542268 - DNA, 20 bp, Artificial
  CRISPR gRNA sequence
aattcaacgtaagatttggg

SEQ ID NO: 542269 - DNA, 20 bp, Artificial
  CRISPR gRNA sequence
attcaacgtaagatttgggt

SEQ ID NO: 542270 - DNA, 20 bp, Artificial
  CRISPR gRNA sequence
gtaagatttgggtgggaaca

SEQ ID NO: 542271 - DNA, 20 bp, Artificial
  CRISPR gRNA sequence
aagatttgggtgggaacaca

SEQ ID NO: 542272 - DNA, 20 bp, Artificial
  CRISPR gRNA sequence
cacagagccaaaccatatca

SEQ ID NO: 542273 - DNA, 20 bp, Artificial
  CRISPR gRNA sequence
acagagccaaaccatatcat

SEQ ID NO: 542274 - DNA, 20 bp, Artificial
  CRISPR gRNA sequence
cagagccaaaccatatcatg

SEQ ID NO: 542275 - DNA, 20 bp, Artificial
  CRISPR gRNA sequence
caaaccatatcatggggttt

SEQ ID NO: 542276 - DNA, 20 bp, Artificial
  CRISPR gRNA sequence
tggggtttcagcatgttgct

SEQ ID NO: 542277 - DNA, 20 bp, Artificial
  CRISPR gRNA sequence
ggggtttcagcatgttgctt

SEQ ID NO: 542278 - DNA, 20 bp, Artificial
  CRISPR gRNA sequence
tttcagcatgttgcttagga

SEQ ID NO: 542279 - DNA, 20 bp, Artificial
  CRISPR gRNA sequence
ttaggatggtctcgaactcc

SEQ ID NO: 542280 - DNA, 20 bp, Artificial
  CRISPR gRNA sequence
taggatggtctcgaactcct

SEQ ID NO: 542281 - DNA, 20 bp, Artificial
  CRISPR gRNA sequence
tctcgaactcctgggctcaa

SEQ ID NO: 542282 - DNA, 20 bp, Artificial
  CRISPR gRNA sequence
ctcaaaagatctgcccacct

SEQ ID NO: 542283 - DNA, 20 bp, Artificial
  CRISPR gRNA sequence
atctgcccacctcagcctct

SEQ ID NO: 542284 - DNA, 20 bp, Artificial
  CRISPR gRNA sequence
ccacctcagcctctcagtgc

SEQ ID NO: 542285 - DNA, 20 bp, Artificial
  CRISPR gRNA sequence
cacctcagcctctcagtgct

SEQ ID NO: 542286 - DNA, 20 bp, Artificial
  CRISPR gRNA sequence
gcctctcagtgctaggatta

SEQ ID NO: 542287 - DNA, 20 bp, Artificial
  CRISPR gRNA sequence
cctctcagtgctaggattac

SEQ ID NO: 542288 - DNA, 20 bp, Artificial
  CRISPR gRNA sequence
caggcatgcaccaccactct

SEQ ID NO: 542289 - DNA, 20 bp, Artificial
  CRISPR gRNA sequence
atgcaccaccactctcagcc

SEQ ID NO: 542290 - DNA, 20 bp, Artificial
  CRISPR gRNA sequence
tcagccaagttcatactttt

SEQ ID NO: 542291 - DNA, 20 bp, Artificial
  CRISPR gRNA sequence
ttgagttcttgctacttgcc

SEQ ID NO: 542292 - DNA, 20 bp, Artificial
  CRISPR gRNA sequence
gctacttgcccagcactatc

SEQ ID NO: 542293 - DNA, 20 bp, Artificial
  CRISPR gRNA sequence
ctacttgcccagcactatcc

SEQ ID NO: 542294 - DNA, 20 bp, Artificial
  CRISPR gRNA sequence
acatgtcattccactaatgc

SEQ ID NO: 542295 - DNA, 20 bp, Artificial
  CRISPR gRNA sequence
aagcccacaccaaatcctgc

SEQ ID NO: 542296 - DNA, 20 bp, Artificial
  CRISPR gRNA sequence
ctccaccttcaaaacacatc

SEQ ID NO: 542297 - DNA, 20 bp, Artificial
  CRISPR gRNA sequence
atccagatatctcccacccc

SEQ ID NO: 542298 - DNA, 20 bp, Artificial
  CRISPR gRNA sequence
cctttcctgcattgcccctg

SEQ ID NO: 542299 - DNA, 20 bp, Artificial
  CRISPR gRNA sequence
tcttccttttctctcctcta

SEQ ID NO: 542300 - DNA, 20 bp, Artificial
  CRISPR gRNA sequence
tcctctacagactattcatc

SEQ ID NO: 542301 - DNA, 20 bp, Artificial
  CRISPR gRNA sequence
tctacagactattcatccag

SEQ ID NO: 542302 - DNA, 20 bp, Artificial
  CRISPR gRNA sequence
cagactattcatccagcagc

SEQ ID NO: 542303 - DNA, 20 bp, Artificial
  CRISPR gRNA sequence
aataattcttttaaacatcc

SEQ ID NO: 542304 - DNA, 20 bp, Artificial
  CRISPR gRNA sequence
caaaatccttcaaaactttc

SEQ ID NO: 542305 - DNA, 20 bp, Artificial
  CRISPR gRNA sequence
caaaactttccagtcactga

SEQ ID NO: 542306 - DNA, 20 bp, Artificial
  CRISPR gRNA sequence
ttccagtcactgaaagcaaa

SEQ ID NO: 542307 - DNA, 20 bp, Artificial
  CRISPR gRNA sequence
tccagtcactgaaagcaaaa

SEQ ID NO: 542308 - DNA, 20 bp, Artificial
  CRISPR gRNA sequence
aaaaaggccaaaatatttaa

SEQ ID NO: 542309 - DNA, 20 bp, Artificial
  CRISPR gRNA sequence
aaaaggccaaaatatttaaa

SEQ ID NO: 542310 - DNA, 20 bp, Artificial
  CRISPR gRNA sequence
ggccctaaaaactttatcta

SEQ ID NO: 542311 - DNA, 20 bp, Artificial
  CRISPR gRNA sequence
gccctaaaaactttatctac

SEQ ID NO: 542312 - DNA, 20 bp, Artificial
  CRISPR gRNA sequence
tctaccactctccaccacaa

SEQ ID NO: 542313 - DNA, 20 bp, Artificial
  CRISPR gRNA sequence
ccaccacaatggtatccttg

SEQ ID NO: 542314 - DNA, 20 bp, Artificial
  CRISPR gRNA sequence
tgaagtttcttaaacgcttg

SEQ ID NO: 542315 - DNA, 20 bp, Artificial
  CRISPR gRNA sequence
taaacgcttgaagcctatct

SEQ ID NO: 542316 - DNA, 20 bp, Artificial
  CRISPR gRNA sequence
aaacgcttgaagcctatctc

SEQ ID NO: 542317 - DNA, 20 bp, Artificial
  CRISPR gRNA sequence
aacgcttgaagcctatctca

SEQ ID NO: 542318 - DNA, 20 bp, Artificial
  CRISPR gRNA sequence
gaagcctatctcagggtcct

SEQ ID NO: 542319 - DNA, 20 bp, Artificial
  CRISPR gRNA sequence
gcctatctcagggtcctgag

SEQ ID NO: 542320 - DNA, 20 bp, Artificial
  CRISPR gRNA sequence
tatctcagggtcctgagtag

SEQ ID NO: 542321 - DNA, 20 bp, Artificial
  CRISPR gRNA sequence
agggtcctgagtagtagacc

SEQ ID NO: 542322 - DNA, 20 bp, Artificial
  CRISPR gRNA sequence
gacctggaatatcactcccc

SEQ ID NO: 542323 - DNA, 20 bp, Artificial
  CRISPR gRNA sequence
tggaatatcactcccccaga

SEQ ID NO: 542324 - DNA, 20 bp, Artificial
  CRISPR gRNA sequence
cactcccccagatagccttg

SEQ ID NO: 542325 - DNA, 20 bp, Artificial
  CRISPR gRNA sequence
ggcctatctctcacttcctt

SEQ ID NO: 542326 - DNA, 20 bp, Artificial
  CRISPR gRNA sequence
gatcaattgtcaccctatta

SEQ ID NO: 542327 - DNA, 20 bp, Artificial
  CRISPR gRNA sequence
tcaattgtcaccctattaaa

SEQ ID NO: 542328 - DNA, 20 bp, Artificial
  CRISPR gRNA sequence
ccacactatgtaatactaac

SEQ ID NO: 542329 - DNA, 20 bp, Artificial
  CRISPR gRNA sequence
cactatgtaatactaaccag

SEQ ID NO: 542330 - DNA, 20 bp, Artificial
  CRISPR gRNA sequence
ctatgtaatactaaccagca

SEQ ID NO: 542331 - DNA, 20 bp, Artificial
  CRISPR gRNA sequence
tatgtaatactaaccagcag

SEQ ID NO: 542332 - DNA, 20 bp, Artificial
  CRISPR gRNA sequence
atgtaatactaaccagcaga

SEQ ID NO: 542333 - DNA, 20 bp, Artificial
  CRISPR gRNA sequence
taatactaaccagcagaggg

SEQ ID NO: 542334 - DNA, 20 bp, Artificial
  CRISPR gRNA sequence
tagctgaatgaactaccata

SEQ ID NO: 542335 - DNA, 20 bp, Artificial
  CRISPR gRNA sequence
ctaccatatagccaccctat

SEQ ID NO: 542336 - DNA, 20 bp, Artificial
  CRISPR gRNA sequence
taccatatagccaccctatg

SEQ ID NO: 542337 - DNA, 20 bp, Artificial
  CRISPR gRNA sequence
accatatagccaccctatga

SEQ ID NO: 542338 - DNA, 20 bp, Artificial
  CRISPR gRNA sequence
ccaccctatgagggactgta

SEQ ID NO: 542339 - DNA, 20 bp, Artificial
  CRISPR gRNA sequence
gggactgtacagctgtgaaa

SEQ ID NO: 542340 - DNA, 20 bp, Artificial
  CRISPR gRNA sequence
gtacagctgtgaaaaagaat

SEQ ID NO: 542341 - DNA, 20 bp, Artificial
  CRISPR gRNA sequence
tacagctgtgaaaaagaatg

SEQ ID NO: 542342 - DNA, 20 bp, Artificial
  CRISPR gRNA sequence
agctgtgaaaaagaatgagg

SEQ ID NO: 542343 - DNA, 20 bp, Artificial
  CRISPR gRNA sequence
gaatgaggtggatctctatg

SEQ ID NO: 542344 - DNA, 20 bp, Artificial
  CRISPR gRNA sequence
ggtggatctctatgaagtga

SEQ ID NO: 542345 - DNA, 20 bp, Artificial
  CRISPR gRNA sequence
gtggatctctatgaagtgat

SEQ ID NO: 542346 - DNA, 20 bp, Artificial
  CRISPR gRNA sequence
tggatctctatgaagtgata

SEQ ID NO: 542347 - DNA, 20 bp, Artificial
  CRISPR gRNA sequence
agtgatagggaatgattttc

SEQ ID NO: 542348 - DNA, 20 bp, Artificial
  CRISPR gRNA sequence
ggaatgattttccagatgta

SEQ ID NO: 542349 - DNA, 20 bp, Artificial
  CRISPR gRNA sequence
gattttccagatgtatggtt

SEQ ID NO: 542350 - DNA, 20 bp, Artificial
  CRISPR gRNA sequence
tatggttaagtgacaaaaat

SEQ ID NO: 542351 - DNA, 20 bp, Artificial
  CRISPR gRNA sequence
atgagatacaaaaaaataca

SEQ ID NO: 542352 - DNA, 20 bp, Artificial
  CRISPR gRNA sequence
gagatacaaaaaaatacata

SEQ ID NO: 542353 - DNA, 20 bp, Artificial
  CRISPR gRNA sequence
catagagtgttaccttgttt

SEQ ID NO: 542354 - DNA, 20 bp, Artificial
  CRISPR gRNA sequence
agagtgttaccttgtttaag

SEQ ID NO: 542355 - DNA, 20 bp, Artificial
  CRISPR gRNA sequence
gagtgttaccttgtttaaga

SEQ ID NO: 542356 - DNA, 20 bp, Artificial
  CRISPR gRNA sequence
agtgttaccttgtttaagaa

SEQ ID NO: 542357 - DNA, 20 bp, Artificial
  CRISPR gRNA sequence
gttaccttgtttaagaaggg

SEQ ID NO: 542358 - DNA, 20 bp, Artificial
  CRISPR gRNA sequence
ccttgtttaagaagggtagt

SEQ ID NO: 542359 - DNA, 20 bp, Artificial
  CRISPR gRNA sequence
gggtagttagaaaaaaaaaa

SEQ ID NO: 542360 - DNA, 20 bp, Artificial
  CRISPR gRNA sequence
tttttttgtttttttttttt

SEQ ID NO: 542361 - DNA, 20 bp, Artificial
  CRISPR gRNA sequence
tttgttttttttttttgaga

SEQ ID NO: 542362 - DNA, 20 bp, Artificial
  CRISPR gRNA sequence
tgttttttttttttgagaca

SEQ ID NO: 542363 - DNA, 20 bp, Artificial
  CRISPR gRNA sequence
cagagtctcactccgtcacc

SEQ ID NO: 542364 - DNA, 20 bp, Artificial
  CRISPR gRNA sequence
agagtctcactccgtcaccc

SEQ ID NO: 542365 - DNA, 20 bp, Artificial
  CRISPR gRNA sequence
tctcactccgtcacccaggc

SEQ ID NO: 542366 - DNA, 20 bp, Artificial
  CRISPR gRNA sequence
tcactccgtcacccaggctg

SEQ ID NO: 542367 - DNA, 20 bp, Artificial
  CRISPR gRNA sequence
ccgtcacccaggctggagtg

SEQ ID NO: 542368 - DNA, 20 bp, Artificial
  CRISPR gRNA sequence
ggagtgcagtgttgtaatct

SEQ ID NO: 542369 - DNA, 20 bp, Artificial
  CRISPR gRNA sequence
gttgtaatcttggctcactg

SEQ ID NO: 542370 - DNA, 20 bp, Artificial
  CRISPR gRNA sequence
tcactgcagtctctgcctcc

SEQ ID NO: 542371 - DNA, 20 bp, Artificial
  CRISPR gRNA sequence
gcagtctctgcctcctggtt

SEQ ID NO: 542372 - DNA, 20 bp, Artificial
  CRISPR gRNA sequence
cagtctctgcctcctggttc

SEQ ID NO: 542373 - DNA, 20 bp, Artificial
  CRISPR gRNA sequence
ttcaggccattctcctgcct

SEQ ID NO: 542374 - DNA, 20 bp, Artificial
  CRISPR gRNA sequence
attctcctgcctcagcctcc

SEQ ID NO: 542375 - DNA, 20 bp, Artificial
  CRISPR gRNA sequence
ttctcctgcctcagcctcct

SEQ ID NO: 542376 - DNA, 20 bp, Artificial
  CRISPR gRNA sequence
tcctgcctcagcctcctagg

SEQ ID NO: 542377 - DNA, 20 bp, Artificial
  CRISPR gRNA sequence
gcctcagcctcctaggtagc

SEQ ID NO: 542378 - DNA, 20 bp, Artificial
  CRISPR gRNA sequence
ctcctaggtagctggaatta

SEQ ID NO: 542379 - DNA, 20 bp, Artificial
  CRISPR gRNA sequence
tcctaggtagctggaattac

SEQ ID NO: 542380 - DNA, 20 bp, Artificial
  CRISPR gRNA sequence
caggcgtgtgccaccatgcc

SEQ ID NO: 542381 - DNA, 20 bp, Artificial
  CRISPR gRNA sequence
gcccagctaattttttgttt

SEQ ID NO: 542382 - DNA, 20 bp, Artificial
  CRISPR gRNA sequence
cagctaattttttgttttag

SEQ ID NO: 542383 - DNA, 20 bp, Artificial
  CRISPR gRNA sequence
gctaattttttgttttagta

SEQ ID NO: 542384 - DNA, 20 bp, Artificial
  CRISPR gRNA sequence
attttttgttttagtagaga

SEQ ID NO: 542385 - DNA, 20 bp, Artificial
  CRISPR gRNA sequence
ttttttgttttagtagagac

SEQ ID NO: 542386 - DNA, 20 bp, Artificial
  CRISPR gRNA sequence
tttttgttttagtagagaca

SEQ ID NO: 542387 - DNA, 20 bp, Artificial
  CRISPR gRNA sequence
gagacagggtttcactgcgt

SEQ ID NO: 542388 - DNA, 20 bp, Artificial
  CRISPR gRNA sequence
cagggtttcactgcgttagc

SEQ ID NO: 542389 - DNA, 20 bp, Artificial
  CRISPR gRNA sequence
agggtttcactgcgttagcc

SEQ ID NO: 542390 - DNA, 20 bp, Artificial
  CRISPR gRNA sequence
tttcactgcgttagccagga

SEQ ID NO: 542391 - DNA, 20 bp, Artificial
  CRISPR gRNA sequence
accttgtgatccgcccgcct

SEQ ID NO: 542392 - DNA, 20 bp, Artificial
  CRISPR gRNA sequence
ccgcccgccttggcctccca

SEQ ID NO: 542393 - DNA, 20 bp, Artificial
  CRISPR gRNA sequence
gccttggcctcccaaagtgc

SEQ ID NO: 542394 - DNA, 20 bp, Artificial
  CRISPR gRNA sequence
ccttggcctcccaaagtgct

SEQ ID NO: 542395 - DNA, 20 bp, Artificial
  CRISPR gRNA sequence
ctcccaaagtgctgggatta

SEQ ID NO: 542396 - DNA, 20 bp, Artificial
  CRISPR gRNA sequence
agtgctgggattacagtcat

SEQ ID NO: 542397 - DNA, 20 bp, Artificial
  CRISPR gRNA sequence
cagtcatgagtcactgcacc

SEQ ID NO: 542398 - DNA, 20 bp, Artificial
  CRISPR gRNA sequence
catgagtcactgcacccggc

SEQ ID NO: 542399 - DNA, 20 bp, Artificial
  CRISPR gRNA sequence
actgcacccggccagaatcc

SEQ ID NO: 542400 - DNA, 20 bp, Artificial
  CRISPR gRNA sequence
atccaagtaacttttgaata

SEQ ID NO: 542401 - DNA, 20 bp, Artificial
  CRISPR gRNA sequence
atatagtattgcatattcac

SEQ ID NO: 542402 - DNA, 20 bp, Artificial
  CRISPR gRNA sequence
tatagtattgcatattcact

SEQ ID NO: 542403 - DNA, 20 bp, Artificial
  CRISPR gRNA sequence
tgcatattcactgggatata

SEQ ID NO: 542404 - DNA, 20 bp, Artificial
  CRISPR gRNA sequence
tatacagatatttcttatta

SEQ ID NO: 542405 - DNA, 20 bp, Artificial
  CRISPR gRNA sequence
tacagatatttcttattatg

SEQ ID NO: 542406 - DNA, 20 bp, Artificial
  CRISPR gRNA sequence
atatcttgaaaaactcattg

SEQ ID NO: 542407 - DNA, 20 bp, Artificial
  CRISPR gRNA sequence
atcttgaaaaactcattgta

SEQ ID NO: 542408 - DNA, 20 bp, Artificial
  CRISPR gRNA sequence
ttgtagagttgaaaaatctt

SEQ ID NO: 542409 - DNA, 20 bp, Artificial
  CRISPR gRNA sequence
tcttaagtcgaaccattgct

SEQ ID NO: 542410 - DNA, 20 bp, Artificial
  CRISPR gRNA sequence
aagtcgaaccattgctaagt

SEQ ID NO: 542411 - DNA, 20 bp, Artificial
  CRISPR gRNA sequence
gtcgaaccattgctaagttg

SEQ ID NO: 542412 - DNA, 20 bp, Artificial
  CRISPR gRNA sequence
gagactgtaatgaaaaataa

SEQ ID NO: 542413 - DNA, 20 bp, Artificial
  CRISPR gRNA sequence
agactgtaatgaaaaataaa

SEQ ID NO: 542414 - DNA, 20 bp, Artificial
  CRISPR gRNA sequence
gaaaaataaaaggaactgta

SEQ ID NO: 542415 - DNA, 20 bp, Artificial
  CRISPR gRNA sequence
aagaaatctttaactgtatt

SEQ ID NO: 542416 - DNA, 20 bp, Artificial
  CRISPR gRNA sequence
aatctttaactgtatttagt

SEQ ID NO: 542417 - DNA, 20 bp, Artificial
  CRISPR gRNA sequence
aactgtatttagtaagtttg

SEQ ID NO: 542418 - DNA, 20 bp, Artificial
  CRISPR gRNA sequence
gtatttagtaagtttgtagt

SEQ ID NO: 542419 - DNA, 20 bp, Artificial
  CRISPR gRNA sequence
tttagtaagtttgtagttgg

SEQ ID NO: 542420 - DNA, 20 bp, Artificial
  CRISPR gRNA sequence
agtaagtttgtagttggtag

SEQ ID NO: 542421 - DNA, 20 bp, Artificial
  CRISPR gRNA sequence
gtttgtagttggtagtagat

SEQ ID NO: 542422 - DNA, 20 bp, Artificial
  CRISPR gRNA sequence
tagttggtagtagattggta

SEQ ID NO: 542423 - DNA, 20 bp, Artificial
  CRISPR gRNA sequence
atagcaactgtaaaatgatt

SEQ ID NO: 542424 - DNA, 20 bp, Artificial
  CRISPR gRNA sequence
tagcaactgtaaaatgattt

SEQ ID NO: 542425 - DNA, 20 bp, Artificial
  CRISPR gRNA sequence
agcaactgtaaaatgatttg

SEQ ID NO: 542426 - DNA, 20 bp, Artificial
  CRISPR gRNA sequence
aaatgatttggggtttaatg

SEQ ID NO: 542427 - DNA, 20 bp, Artificial
  CRISPR gRNA sequence
atttggggtttaatgtagat

SEQ ID NO: 542428 - DNA, 20 bp, Artificial
  CRISPR gRNA sequence
tttggggtttaatgtagatt

SEQ ID NO: 542429 - DNA, 20 bp, Artificial
  CRISPR gRNA sequence
gaaaatatactgatgctact

SEQ ID NO: 542430 - DNA, 20 bp, Artificial
  CRISPR gRNA sequence
tatactgatgctactaagaa

SEQ ID NO: 542431 - DNA, 20 bp, Artificial
  CRISPR gRNA sequence
tactgatgctactaagaaca

SEQ ID NO: 542432 - DNA, 20 bp, Artificial
  CRISPR gRNA sequence
taagaacagagttctcactg

SEQ ID NO: 542433 - DNA, 20 bp, Artificial
  CRISPR gRNA sequence
aagaacagagttctcactgt

SEQ ID NO: 542434 - DNA, 20 bp, Artificial
  CRISPR gRNA sequence
gaacagagttctcactgtgg

SEQ ID NO: 542435 - DNA, 20 bp, Artificial
  CRISPR gRNA sequence
agagttctcactgtgggagt

SEQ ID NO: 542436 - DNA, 20 bp, Artificial
  CRISPR gRNA sequence
gagttctcactgtgggagta

SEQ ID NO: 542437 - DNA, 20 bp, Artificial
  CRISPR gRNA sequence
gttctcactgtgggagtaag

SEQ ID NO: 542438 - DNA, 20 bp, Artificial
  CRISPR gRNA sequence
ggagtaaggagatgcaaata

SEQ ID NO: 542439 - DNA, 20 bp, Artificial
  CRISPR gRNA sequence
gtaaggagatgcaaatatgg

SEQ ID NO: 542440 - DNA, 20 bp, Artificial
  CRISPR gRNA sequence
aaggagatgcaaatatggaa

SEQ ID NO: 542441 - DNA, 20 bp, Artificial
  CRISPR gRNA sequence
gagatgcaaatatggaagag

SEQ ID NO: 542442 - DNA, 20 bp, Artificial
  CRISPR gRNA sequence
atgcaaatatggaagagcag

SEQ ID NO: 542443 - DNA, 20 bp, Artificial
  CRISPR gRNA sequence
gcaaatatggaagagcagaa

SEQ ID NO: 542444 - DNA, 20 bp, Artificial
  CRISPR gRNA sequence
caaatatggaagagcagaag

SEQ ID NO: 542445 - DNA, 20 bp, Artificial
  CRISPR gRNA sequence
atatggaagagcagaagagg

SEQ ID NO: 542446 - DNA, 20 bp, Artificial
  CRISPR gRNA sequence
tggaagagcagaagaggcag

SEQ ID NO: 542447 - DNA, 20 bp, Artificial
  CRISPR gRNA sequence
gcagaagaggcagaagaact

SEQ ID NO: 542448 - DNA, 20 bp, Artificial
  CRISPR gRNA sequence
gaagaggcagaagaactaag

SEQ ID NO: 542449 - DNA, 20 bp, Artificial
  CRISPR gRNA sequence
aggcagaagaactaagcagc

SEQ ID NO: 542450 - DNA, 20 bp, Artificial
  CRISPR gRNA sequence
gaactaagcagcaagattat

SEQ ID NO: 542451 - DNA, 20 bp, Artificial
  CRISPR gRNA sequence
agcagcaagattattagtgt

SEQ ID NO: 542452 - DNA, 20 bp, Artificial
  CRISPR gRNA sequence
agcaagattattagtgttag

SEQ ID NO: 542453 - DNA, 20 bp, Artificial
  CRISPR gRNA sequence
attattagtgttagaagtat

SEQ ID NO: 542454 - DNA, 20 bp, Artificial
  CRISPR gRNA sequence
ttattagtgttagaagtatc

SEQ ID NO: 542455 - DNA, 20 bp, Artificial
  CRISPR gRNA sequence
tattagtgttagaagtatca

SEQ ID NO: 542456 - DNA, 20 bp, Artificial
  CRISPR gRNA sequence
tcttaactttgaaaactgac

SEQ ID NO: 542457 - DNA, 20 bp, Artificial
  CRISPR gRNA sequence
cttaactttgaaaactgaca

SEQ ID NO: 542458 - DNA, 20 bp, Artificial
  CRISPR gRNA sequence
ctttgaaaactgacaaggct

SEQ ID NO: 542459 - DNA, 20 bp, Artificial
  CRISPR gRNA sequence
tgaaaactgacaaggctgag

SEQ ID NO: 542460 - DNA, 20 bp, Artificial
  CRISPR gRNA sequence
aggctgagaagcaatgactc

SEQ ID NO: 542461 - DNA, 20 bp, Artificial
  CRISPR gRNA sequence
agcaatgactctggtacctg

SEQ ID NO: 542462 - DNA, 20 bp, Artificial
  CRISPR gRNA sequence
gcaatgactctggtacctgt

SEQ ID NO: 542463 - DNA, 20 bp, Artificial
  CRISPR gRNA sequence
ctgtgggcacactttgcacc

SEQ ID NO: 542464 - DNA, 20 bp, Artificial
  CRISPR gRNA sequence
taaataccatctctcactaa

SEQ ID NO: 542465 - DNA, 20 bp, Artificial
  CRISPR gRNA sequence
catctctcactaaaagaaac

SEQ ID NO: 542466 - DNA, 20 bp, Artificial
  CRISPR gRNA sequence
atctctcactaaaagaaacc

SEQ ID NO: 542467 - DNA, 20 bp, Artificial
  CRISPR gRNA sequence
tctctcactaaaagaaacca

SEQ ID NO: 542468 - DNA, 20 bp, Artificial
  CRISPR gRNA sequence
ccagggaacctaatgattcg

SEQ ID NO: 542469 - DNA, 20 bp, Artificial
  CRISPR gRNA sequence
cagggaacctaatgattcga

SEQ ID NO: 542470 - DNA, 20 bp, Artificial
  CRISPR gRNA sequence
aacctaatgattcgaaggct

SEQ ID NO: 542471 - DNA, 20 bp, Artificial
  CRISPR gRNA sequence
acctaatgattcgaaggctg

SEQ ID NO: 542472 - DNA, 20 bp, Artificial
  CRISPR gRNA sequence
taatgattcgaaggctgagg

SEQ ID NO: 542473 - DNA, 20 bp, Artificial
  CRISPR gRNA sequence
aatgattcgaaggctgaggc

SEQ ID NO: 542474 - DNA, 20 bp, Artificial
  CRISPR gRNA sequence
ggctgaggcaggaacactac

SEQ ID NO: 542475 - DNA, 20 bp, Artificial
  CRISPR gRNA sequence
aggcaggaacactacaagat

SEQ ID NO: 542476 - DNA, 20 bp, Artificial
  CRISPR gRNA sequence
ggaacactacaagatgagtc

SEQ ID NO: 542477 - DNA, 20 bp, Artificial
  CRISPR gRNA sequence
tccagaacatctttctgtgc

SEQ ID NO: 542478 - DNA, 20 bp, Artificial
  CRISPR gRNA sequence
gaacatctttctgtgccaga

SEQ ID NO: 542479 - DNA, 20 bp, Artificial
  CRISPR gRNA sequence
atctttctgtgccagaaagt

SEQ ID NO: 542480 - DNA, 20 bp, Artificial
  CRISPR gRNA sequence
tctttctgtgccagaaagta

SEQ ID NO: 542481 - DNA, 20 bp, Artificial
  CRISPR gRNA sequence
ttctgtgccagaaagtaagg

SEQ ID NO: 542482 - DNA, 20 bp, Artificial
  CRISPR gRNA sequence
aggaagtgtttaaaatcaaa

SEQ ID NO: 542483 - DNA, 20 bp, Artificial
  CRISPR gRNA sequence
ggaagtgtttaaaatcaaac

SEQ ID NO: 542484 - DNA, 20 bp, Artificial
  CRISPR gRNA sequence
taaaatcaaacaggaacaaa

SEQ ID NO: 542485 - DNA, 20 bp, Artificial
  CRISPR gRNA sequence
aaatcaaacaggaacaaaca

SEQ ID NO: 542486 - DNA, 20 bp, Artificial
  CRISPR gRNA sequence
aacaggaacaaacagagcaa

SEQ ID NO: 542487 - DNA, 20 bp, Artificial
  CRISPR gRNA sequence
acaggaacaaacagagcaaa

SEQ ID NO: 542488 - DNA, 20 bp, Artificial
  CRISPR gRNA sequence
aacagagcaaaaggactctg

SEQ ID NO: 542489 - DNA, 20 bp, Artificial
  CRISPR gRNA sequence
caaaaggactctgaagcttg

SEQ ID NO: 542490 - DNA, 20 bp, Artificial
  CRISPR gRNA sequence
aaaaggactctgaagcttga

SEQ ID NO: 542491 - DNA, 20 bp, Artificial
  CRISPR gRNA sequence
gtgttcccacttgtcaaatg

SEQ ID NO: 542492 - DNA, 20 bp, Artificial
  CRISPR gRNA sequence
tgttcccacttgtcaaatgt

SEQ ID NO: 542493 - DNA, 20 bp, Artificial
  CRISPR gRNA sequence
gttcccacttgtcaaatgtg

SEQ ID NO: 542494 - DNA, 20 bp, Artificial
  CRISPR gRNA sequence
ttgtcaaatgtggggttgcc

SEQ ID NO: 542495 - DNA, 20 bp, Artificial
  CRISPR gRNA sequence
ggggttgccgagcatcaaaa

SEQ ID NO: 542496 - DNA, 20 bp, Artificial
  CRISPR gRNA sequence
ccgagcatcaaaatggatga

SEQ ID NO: 542497 - DNA, 20 bp, Artificial
  CRISPR gRNA sequence
cgagcatcaaaatggatgac

SEQ ID NO: 542498 - DNA, 20 bp, Artificial
  CRISPR gRNA sequence
caggaatgccatatttaaaa

SEQ ID NO: 542499 - DNA, 20 bp, Artificial
  CRISPR gRNA sequence
atatttaaaaaagaatccat

SEQ ID NO: 542500 - DNA, 20 bp, Artificial
  CRISPR gRNA sequence
cacataaccttctaaaataa

SEQ ID NO: 542501 - DNA, 20 bp, Artificial
  CRISPR gRNA sequence
cttctaaaataaaagaaaaa

SEQ ID NO: 542502 - DNA, 20 bp, Artificial
  CRISPR gRNA sequence
ttctaaaataaaagaaaaaa

SEQ ID NO: 542503 - DNA, 20 bp, Artificial
  CRISPR gRNA sequence
tctaaaataaaagaaaaaaa

SEQ ID NO: 542504 - DNA, 20 bp, Artificial
  CRISPR gRNA sequence
taaaataaaagaaaaaaagg

SEQ ID NO: 542505 - DNA, 20 bp, Artificial
  CRISPR gRNA sequence
aaaataaaagaaaaaaaggg

SEQ ID NO: 542506 - DNA, 20 bp, Artificial
  CRISPR gRNA sequence
aagggaggatgtgtgtgcaa

SEQ ID NO: 542507 - DNA, 20 bp, Artificial
  CRISPR gRNA sequence
taaactaataaatatatata

SEQ ID NO: 542508 - DNA, 20 bp, Artificial
  CRISPR gRNA sequence
aactaataaatatatatata

SEQ ID NO: 542509 - DNA, 20 bp, Artificial
  CRISPR gRNA sequence
ctaataaatatatatataga

SEQ ID NO: 542510 - DNA, 20 bp, Artificial
  CRISPR gRNA sequence
aatatatatatagagagaaa

SEQ ID NO: 542511 - DNA, 20 bp, Artificial
  CRISPR gRNA sequence
atatatatagagagaaacag

SEQ ID NO: 542512 - DNA, 20 bp, Artificial
  CRISPR gRNA sequence
atatatagagagaaacagaa

SEQ ID NO: 542513 - DNA, 20 bp, Artificial
  CRISPR gRNA sequence
gaaacagaagagaaaattgc

SEQ ID NO: 542514 - DNA, 20 bp, Artificial
  CRISPR gRNA sequence
aaacagaagagaaaattgct

SEQ ID NO: 542515 - DNA, 20 bp, Artificial
  CRISPR gRNA sequence
cagaagagaaaattgctggg

SEQ ID NO: 542516 - DNA, 20 bp, Artificial
  CRISPR gRNA sequence
tgcctataatcccgacactt

SEQ ID NO: 542517 - DNA, 20 bp, Artificial
  CRISPR gRNA sequence
gcctataatcccgacacttt

SEQ ID NO: 542518 - DNA, 20 bp, Artificial
  CRISPR gRNA sequence
gacactttgggaaactgact

SEQ ID NO: 542519 - DNA, 20 bp, Artificial
  CRISPR gRNA sequence
acactttgggaaactgactt

SEQ ID NO: 542520 - DNA, 20 bp, Artificial
  CRISPR gRNA sequence
actttgggaaactgacttgg

SEQ ID NO: 542521 - DNA, 20 bp, Artificial
  CRISPR gRNA sequence
ctttgggaaactgacttggg

SEQ ID NO: 542522 - DNA, 20 bp, Artificial
  CRISPR gRNA sequence
ctgacttgggaggattgctt

SEQ ID NO: 542523 - DNA, 20 bp, Artificial
  CRISPR gRNA sequence
ttgggaggattgcttgagcc

SEQ ID NO: 542524 - DNA, 20 bp, Artificial
  CRISPR gRNA sequence
tgggaggattgcttgagccc

SEQ ID NO: 542525 - DNA, 20 bp, Artificial
  CRISPR gRNA sequence
ggaggattgcttgagcccag

SEQ ID NO: 542526 - DNA, 20 bp, Artificial
  CRISPR gRNA sequence
ttgcttgagcccaggagttc

SEQ ID NO: 542527 - DNA, 20 bp, Artificial
  CRISPR gRNA sequence
tgagcccaggagttcaagac

SEQ ID NO: 542528 - DNA, 20 bp, Artificial
  CRISPR gRNA sequence
ccaggagttcaagaccagcc

SEQ ID NO: 542529 - DNA, 20 bp, Artificial
  CRISPR gRNA sequence
caggagttcaagaccagcct

SEQ ID NO: 542530 - DNA, 20 bp, Artificial
  CRISPR gRNA sequence
caagaccagcctgggcaaca

SEQ ID NO: 542531 - DNA, 20 bp, Artificial
  CRISPR gRNA sequence
tataaaaaatacaaaaaaat

SEQ ID NO: 542532 - DNA, 20 bp, Artificial
  CRISPR gRNA sequence
ataaaaaatacaaaaaaatt

SEQ ID NO: 542533 - DNA, 20 bp, Artificial
  CRISPR gRNA sequence
aaaaatacaaaaaaattagg

SEQ ID NO: 542534 - DNA, 20 bp, Artificial
  CRISPR gRNA sequence
aaaaaaattaggtggacgtg

SEQ ID NO: 542535 - DNA, 20 bp, Artificial
  CRISPR gRNA sequence
aaaaaattaggtggacgtga

SEQ ID NO: 542536 - DNA, 20 bp, Artificial
  CRISPR gRNA sequence
gacgtgaaggcatgtccctg

SEQ ID NO: 542537 - DNA, 20 bp, Artificial
  CRISPR gRNA sequence
aaggcatgtccctgtagtcc

SEQ ID NO: 542538 - DNA, 20 bp, Artificial
  CRISPR gRNA sequence
tccctgtagtcccagctatt

SEQ ID NO: 542539 - DNA, 20 bp, Artificial
  CRISPR gRNA sequence
gtcccagctatttggaaact

SEQ ID NO: 542540 - DNA, 20 bp, Artificial
  CRISPR gRNA sequence
tcccagctatttggaaactg

SEQ ID NO: 542541 - DNA, 20 bp, Artificial
  CRISPR gRNA sequence
cagctatttggaaactgagg

SEQ ID NO: 542542 - DNA, 20 bp, Artificial
  CRISPR gRNA sequence
agctatttggaaactgaggt

SEQ ID NO: 542543 - DNA, 20 bp, Artificial
  CRISPR gRNA sequence
ctatttggaaactgaggtgg

SEQ ID NO: 542544 - DNA, 20 bp, Artificial
  CRISPR gRNA sequence
tatttggaaactgaggtggg

SEQ ID NO: 542545 - DNA, 20 bp, Artificial
  CRISPR gRNA sequence
ctgaggtgggaggatcgctt

SEQ ID NO: 542546 - DNA, 20 bp, Artificial
  CRISPR gRNA sequence
gtgggaggatcgcttgagtc

SEQ ID NO: 542547 - DNA, 20 bp, Artificial
  CRISPR gRNA sequence
tgggaggatcgcttgagtct

SEQ ID NO: 542548 - DNA, 20 bp, Artificial
  CRISPR gRNA sequence
ggaggatcgcttgagtctgg

SEQ ID NO: 542549 - DNA, 20 bp, Artificial
  CRISPR gRNA sequence
tcgcttgagtctgggagatc

SEQ ID NO: 542550 - DNA, 20 bp, Artificial
  CRISPR gRNA sequence
cgcttgagtctgggagatca

SEQ ID NO: 542551 - DNA, 20 bp, Artificial
  CRISPR gRNA sequence
agtctgggagatcaaggctg

SEQ ID NO: 542552 - DNA, 20 bp, Artificial
  CRISPR gRNA sequence
tgggagatcaaggctgcagt

SEQ ID NO: 542553 - DNA, 20 bp, Artificial
  CRISPR gRNA sequence
ataattgtgtcactatactc

SEQ ID NO: 542554 - DNA, 20 bp, Artificial
  CRISPR gRNA sequence
tgtgtcactatactctagcc

SEQ ID NO: 542555 - DNA, 20 bp, Artificial
  CRISPR gRNA sequence
gtgtcactatactctagcct

SEQ ID NO: 542556 - DNA, 20 bp, Artificial
  CRISPR gRNA sequence
ctatactctagcctgggcaa

SEQ ID NO: 542557 - DNA, 20 bp, Artificial
  CRISPR gRNA sequence
atactctagcctgggcaaca

SEQ ID NO: 542558 - DNA, 20 bp, Artificial
  CRISPR gRNA sequence
tctagcctgggcaacagagt

SEQ ID NO: 542559 - DNA, 20 bp, Artificial
  CRISPR gRNA sequence
agagtgagactgtgtctcaa

SEQ ID NO: 542560 - DNA, 20 bp, Artificial
  CRISPR gRNA sequence
gagactgtgtctcaaaagaa

SEQ ID NO: 542561 - DNA, 20 bp, Artificial
  CRISPR gRNA sequence
gactgtgtctcaaaagaaaa

SEQ ID NO: 542562 - DNA, 20 bp, Artificial
  CRISPR gRNA sequence
tgtctcaaaagaaaagagaa

SEQ ID NO: 542563 - DNA, 20 bp, Artificial
  CRISPR gRNA sequence
gtctcaaaagaaaagagaaa

SEQ ID NO: 542564 - DNA, 20 bp, Artificial
  CRISPR gRNA sequence
agagaaaaggcaatgaaaca

SEQ ID NO: 542565 - DNA, 20 bp, Artificial
  CRISPR gRNA sequence
gaaaaggcaatgaaacaaag

SEQ ID NO: 542566 - DNA, 20 bp, Artificial
  CRISPR gRNA sequence
aaaaggcaatgaaacaaaga

SEQ ID NO: 542567 - DNA, 20 bp, Artificial
  CRISPR gRNA sequence
ggcaatgaaacaaagaagga

SEQ ID NO: 542568 - DNA, 20 bp, Artificial
  CRISPR gRNA sequence
aatgaaacaaagaaggaaag

SEQ ID NO: 542569 - DNA, 20 bp, Artificial
  CRISPR gRNA sequence
atgaaacaaagaaggaaaga

SEQ ID NO: 542570 - DNA, 20 bp, Artificial
  CRISPR gRNA sequence
tgaaacaaagaaggaaagaa

SEQ ID NO: 542571 - DNA, 20 bp, Artificial
  CRISPR gRNA sequence
aacaaagaaggaaagaaggg

SEQ ID NO: 542572 - DNA, 20 bp, Artificial
  CRISPR gRNA sequence
acaaagaaggaaagaaggga

SEQ ID NO: 542573 - DNA, 20 bp, Artificial
  CRISPR gRNA sequence
caaagaaggaaagaagggaa

SEQ ID NO: 542574 - DNA, 20 bp, Artificial
  CRISPR gRNA sequence
agaaggaaagaagggaaggg

SEQ ID NO: 542575 - DNA, 20 bp, Artificial
  CRISPR gRNA sequence
gaaggaaagaagggaaggga

SEQ ID NO: 542576 - DNA, 20 bp, Artificial
  CRISPR gRNA sequence
aaggaaagaagggaagggaa

SEQ ID NO: 542577 - DNA, 20 bp, Artificial
  CRISPR gRNA sequence
gaaagaagggaagggaaggg

SEQ ID NO: 542578 - DNA, 20 bp, Artificial
  CRISPR gRNA sequence
aaagaagggaagggaaggga

SEQ ID NO: 542579 - DNA, 20 bp, Artificial
  CRISPR gRNA sequence
aagaagggaagggaagggaa

SEQ ID NO: 542580 - DNA, 20 bp, Artificial
  CRISPR gRNA sequence
aagggaagggaagggaaggg

SEQ ID NO: 542581 - DNA, 20 bp, Artificial
  CRISPR gRNA sequence
agggaagggaagggaaggga

SEQ ID NO: 542582 - DNA, 20 bp, Artificial
  CRISPR gRNA sequence
gggaagggaagggaagggaa

SEQ ID NO: 542583 - DNA, 20 bp, Artificial
  CRISPR gRNA sequence
aagggaagggaagggaaggg

SEQ ID NO: 542584 - DNA, 20 bp, Artificial
  CRISPR gRNA sequence
agggaagggaagggaaggga

SEQ ID NO: 542585 - DNA, 20 bp, Artificial
  CRISPR gRNA sequence
gggaagggaagggaagggaa

SEQ ID NO: 542586 - DNA, 20 bp, Artificial
  CRISPR gRNA sequence
agggaagggaagggaaggga

SEQ ID NO: 542587 - DNA, 20 bp, Artificial
  CRISPR gRNA sequence
gggaagggaagggaagggac

SEQ ID NO: 542588 - DNA, 20 bp, Artificial
  CRISPR gRNA sequence
aagggaagggaagggacagg

SEQ ID NO: 542589 - DNA, 20 bp, Artificial
  CRISPR gRNA sequence
agggaagggaagggacagga

SEQ ID NO: 542590 - DNA, 20 bp, Artificial
  CRISPR gRNA sequence
gggaagggaagggacaggaa

SEQ ID NO: 542591 - DNA, 20 bp, Artificial
  CRISPR gRNA sequence
gaagggaagggacaggaagg

SEQ ID NO: 542592 - DNA, 20 bp, Artificial
  CRISPR gRNA sequence
aagggaagggacaggaaggg

SEQ ID NO: 542593 - DNA, 20 bp, Artificial
  CRISPR gRNA sequence
agggaagggacaggaaggga

SEQ ID NO: 542594 - DNA, 20 bp, Artificial
  CRISPR gRNA sequence
gggaagggacaggaagggag

SEQ ID NO: 542595 - DNA, 20 bp, Artificial
  CRISPR gRNA sequence
ggaagggacaggaagggagg

SEQ ID NO: 542596 - DNA, 20 bp, Artificial
  CRISPR gRNA sequence
aagggacaggaagggagggg

SEQ ID NO: 542597 - DNA, 20 bp, Artificial
  CRISPR gRNA sequence
agggacaggaagggaggggg

SEQ ID NO: 542598 - DNA, 20 bp, Artificial
  CRISPR gRNA sequence
gggacaggaagggaggggga

SEQ ID NO: 542599 - DNA, 20 bp, Artificial
  CRISPR gRNA sequence
ggacaggaagggagggggag

SEQ ID NO: 542600 - DNA, 20 bp, Artificial
  CRISPR gRNA sequence
acaggaagggagggggaggg

SEQ ID NO: 542601 - DNA, 20 bp, Artificial
  CRISPR gRNA sequence
caggaagggagggggagggg

SEQ ID NO: 542602 - DNA, 20 bp, Artificial
  CRISPR gRNA sequence
aggaagggagggggagggga

SEQ ID NO: 542603 - DNA, 20 bp, Artificial
  CRISPR gRNA sequence
agggagggggaggggaggga

SEQ ID NO: 542604 - DNA, 20 bp, Artificial
  CRISPR gRNA sequence
gggagggggaggggagggaa

SEQ ID NO: 542605 - DNA, 20 bp, Artificial
  CRISPR gRNA sequence
ggagggggaggggagggaaa

SEQ ID NO: 542606 - DNA, 20 bp, Artificial
  CRISPR gRNA sequence
agggggaggggagggaaagg

SEQ ID NO: 542607 - DNA, 20 bp, Artificial
  CRISPR gRNA sequence
gggggaggggagggaaaggg

SEQ ID NO: 542608 - DNA, 20 bp, Artificial
  CRISPR gRNA sequence
ggggaggggagggaaaggga

SEQ ID NO: 542609 - DNA, 20 bp, Artificial
  CRISPR gRNA sequence
gggaggggagggaaagggag

SEQ ID NO: 542610 - DNA, 20 bp, Artificial
  CRISPR gRNA sequence
gaggggagggaaagggaggg

SEQ ID NO: 542611 - DNA, 20 bp, Artificial
  CRISPR gRNA sequence
aggggagggaaagggagggg

SEQ ID NO: 542612 - DNA, 20 bp, Artificial
  CRISPR gRNA sequence
ggggagggaaagggagggga

SEQ ID NO: 542613 - DNA, 20 bp, Artificial
  CRISPR gRNA sequence
gggagggaaagggaggggag

SEQ ID NO: 542614 - DNA, 20 bp, Artificial
  CRISPR gRNA sequence
gagggaaagggaggggaggg

SEQ ID NO: 542615 - DNA, 20 bp, Artificial
  CRISPR gRNA sequence
agggaaagggaggggagggg

SEQ ID NO: 542616 - DNA, 20 bp, Artificial
  CRISPR gRNA sequence
gggaaagggaggggagggga

SEQ ID NO: 542617 - DNA, 20 bp, Artificial
  CRISPR gRNA sequence
gaaagggaggggaggggagg

SEQ ID NO: 542618 - DNA, 20 bp, Artificial
  CRISPR gRNA sequence
aaagggaggggaggggaggg

SEQ ID NO: 542619 - DNA, 20 bp, Artificial
  CRISPR gRNA sequence
aagggaggggaggggaggga

SEQ ID NO: 542620 - DNA, 20 bp, Artificial
  CRISPR gRNA sequence
gggaggggaggggagggagg

SEQ ID NO: 542621 - DNA, 20 bp, Artificial
  CRISPR gRNA sequence
ggaggggaggggagggaggg

SEQ ID NO: 542622 - DNA, 20 bp, Artificial
  CRISPR gRNA sequence
gaggggaggggagggaggga

SEQ ID NO: 542623 - DNA, 20 bp, Artificial
  CRISPR gRNA sequence
aggggaggggagggagggag

SEQ ID NO: 542624 - DNA, 20 bp, Artificial
  CRISPR gRNA sequence
gggaggggagggagggaggg

SEQ ID NO: 542625 - DNA, 20 bp, Artificial
  CRISPR gRNA sequence
ggaggggagggagggagggg

SEQ ID NO: 542626 - DNA, 20 bp, Artificial
  CRISPR gRNA sequence
gaggggagggagggagggga

SEQ ID NO: 542627 - DNA, 20 bp, Artificial
  CRISPR gRNA sequence
aggggagggagggaggggag

SEQ ID NO: 542628 - DNA, 20 bp, Artificial
  CRISPR gRNA sequence
gggagggagggaggggaggg

SEQ ID NO: 542629 - DNA, 20 bp, Artificial
  CRISPR gRNA sequence
gagggagggaggggagggga

SEQ ID NO: 542630 - DNA, 20 bp, Artificial
  CRISPR gRNA sequence
gggagggaggggaggggaga

SEQ ID NO: 542631 - DNA, 20 bp, Artificial
  CRISPR gRNA sequence
ggagggaggggaggggagag

SEQ ID NO: 542632 - DNA, 20 bp, Artificial
  CRISPR gRNA sequence
gggaggggaggggagagagg

SEQ ID NO: 542633 - DNA, 20 bp, Artificial
  CRISPR gRNA sequence
ggaggggaggggagagagga

SEQ ID NO: 542634 - DNA, 20 bp, Artificial
  CRISPR gRNA sequence
gggaggggagagaggaagga

SEQ ID NO: 542635 - DNA, 20 bp, Artificial
  CRISPR gRNA sequence
aggggagagaggaaggatgg

SEQ ID NO: 542636 - DNA, 20 bp, Artificial
  CRISPR gRNA sequence
ggggagagaggaaggatgga

SEQ ID NO: 542637 - DNA, 20 bp, Artificial
  CRISPR gRNA sequence
gagagaggaaggatggaagg

SEQ ID NO: 542638 - DNA, 20 bp, Artificial
  CRISPR gRNA sequence
agagaggaaggatggaagga

SEQ ID NO: 542639 - DNA, 20 bp, Artificial
  CRISPR gRNA sequence
gagaggaaggatggaaggaa

SEQ ID NO: 542640 - DNA, 20 bp, Artificial
  CRISPR gRNA sequence
gaggaaggatggaaggaagg

SEQ ID NO: 542641 - DNA, 20 bp, Artificial
  CRISPR gRNA sequence
aggaaggatggaaggaaggg

SEQ ID NO: 542642 - DNA, 20 bp, Artificial
  CRISPR gRNA sequence
ggaaggatggaaggaaggga

SEQ ID NO: 542643 - DNA, 20 bp, Artificial
  CRISPR gRNA sequence
aaggatggaaggaagggagg

SEQ ID NO: 542644 - DNA, 20 bp, Artificial
  CRISPR gRNA sequence
aggatggaaggaagggaggg

SEQ ID NO: 542645 - DNA, 20 bp, Artificial
  CRISPR gRNA sequence
ggatggaaggaagggaggga

SEQ ID NO: 542646 - DNA, 20 bp, Artificial
  CRISPR gRNA sequence
atggaaggaagggagggagg

SEQ ID NO: 542647 - DNA, 20 bp, Artificial
  CRISPR gRNA sequence
gaaggaagggagggagggag

SEQ ID NO: 542648 - DNA, 20 bp, Artificial
  CRISPR gRNA sequence
gaagggagggagggagaaga

SEQ ID NO: 542649 - DNA, 20 bp, Artificial
  CRISPR gRNA sequence
aagggagggagggagaagaa

SEQ ID NO: 542650 - DNA, 20 bp, Artificial
  CRISPR gRNA sequence
agggagggagggagaagaaa

SEQ ID NO: 542651 - DNA, 20 bp, Artificial
  CRISPR gRNA sequence
gggagggagaagaaagggac

SEQ ID NO: 542652 - DNA, 20 bp, Artificial
  CRISPR gRNA sequence
ggagggagaagaaagggaca

SEQ ID NO: 542653 - DNA, 20 bp, Artificial
  CRISPR gRNA sequence
gagggagaagaaagggacaa

SEQ ID NO: 542654 - DNA, 20 bp, Artificial
  CRISPR gRNA sequence
ggagaagaaagggacaaggg

SEQ ID NO: 542655 - DNA, 20 bp, Artificial
  CRISPR gRNA sequence
gagaagaaagggacaagggt

SEQ ID NO: 542656 - DNA, 20 bp, Artificial
  CRISPR gRNA sequence
agaagaaagggacaagggtg

SEQ ID NO: 542657 - DNA, 20 bp, Artificial
  CRISPR gRNA sequence
gaagaaagggacaagggtgg

SEQ ID NO: 542658 - DNA, 20 bp, Artificial
  CRISPR gRNA sequence
gaaagggacaagggtggggg

SEQ ID NO: 542659 - DNA, 20 bp, Artificial
  CRISPR gRNA sequence
attaccatttgaaaatattt

SEQ ID NO: 542660 - DNA, 20 bp, Artificial
  CRISPR gRNA sequence
accatttgaaaatattttag

SEQ ID NO: 542661 - DNA, 20 bp, Artificial
  CRISPR gRNA sequence
tttgaaaatattttagtggc

SEQ ID NO: 542662 - DNA, 20 bp, Artificial
  CRISPR gRNA sequence
aatattttagtggctggatg

SEQ ID NO: 542663 - DNA, 20 bp, Artificial
  CRISPR gRNA sequence
attttagtggctggatgtgg

SEQ ID NO: 542664 - DNA, 20 bp, Artificial
  CRISPR gRNA sequence
tgcctgtaatcccaacactt

SEQ ID NO: 542665 - DNA, 20 bp, Artificial
  CRISPR gRNA sequence
ctgtaatcccaacacttcgg

SEQ ID NO: 542666 - DNA, 20 bp, Artificial
  CRISPR gRNA sequence
tgtaatcccaacacttcggt

SEQ ID NO: 542667 - DNA, 20 bp, Artificial
  CRISPR gRNA sequence
tcccaacacttcggtaggcc

SEQ ID NO: 542668 - DNA, 20 bp, Artificial
  CRISPR gRNA sequence
cccaacacttcggtaggcca

SEQ ID NO: 542669 - DNA, 20 bp, Artificial
  CRISPR gRNA sequence
caacacttcggtaggccaag

SEQ ID NO: 542670 - DNA, 20 bp, Artificial
  CRISPR gRNA sequence
aacacttcggtaggccaagg

SEQ ID NO: 542671 - DNA, 20 bp, Artificial
  CRISPR gRNA sequence
acacttcggtaggccaagga

SEQ ID NO: 542672 - DNA, 20 bp, Artificial
  CRISPR gRNA sequence
acttcggtaggccaaggagg

SEQ ID NO: 542673 - DNA, 20 bp, Artificial
  CRISPR gRNA sequence
cttcggtaggccaaggaggg

SEQ ID NO: 542674 - DNA, 20 bp, Artificial
  CRISPR gRNA sequence
ccaaggagggaggatcactt

SEQ ID NO: 542675 - DNA, 20 bp, Artificial
  CRISPR gRNA sequence
gagggaggatcacttgagcc

SEQ ID NO: 542676 - DNA, 20 bp, Artificial
  CRISPR gRNA sequence
agggaggatcacttgagccc

SEQ ID NO: 542677 - DNA, 20 bp, Artificial
  CRISPR gRNA sequence
ggaggatcacttgagcccag

SEQ ID NO: 542678 - DNA, 20 bp, Artificial
  CRISPR gRNA sequence
tcacttgagcccaggagttt

SEQ ID NO: 542679 - DNA, 20 bp, Artificial
  CRISPR gRNA sequence
tgagcccaggagtttaagac

SEQ ID NO: 542680 - DNA, 20 bp, Artificial
  CRISPR gRNA sequence
ccaggagtttaagaccagtc

SEQ ID NO: 542681 - DNA, 20 bp, Artificial
  CRISPR gRNA sequence
caggagtttaagaccagtct

SEQ ID NO: 542682 - DNA, 20 bp, Artificial
  CRISPR gRNA sequence
taagaccagtctgggcaaca

SEQ ID NO: 542683 - DNA, 20 bp, Artificial
  CRISPR gRNA sequence
aagaccagtctgggcaacat

SEQ ID NO: 542684 - DNA, 20 bp, Artificial
  CRISPR gRNA sequence
agaccagtctgggcaacata

SEQ ID NO: 542685 - DNA, 20 bp, Artificial
  CRISPR gRNA sequence
tacaaaaactaaaaaaaaat

SEQ ID NO: 542686 - DNA, 20 bp, Artificial
  CRISPR gRNA sequence
aaactaaaaaaaaattagcc

SEQ ID NO: 542687 - DNA, 20 bp, Artificial
  CRISPR gRNA sequence
aaaaaaaaattagccaagca

SEQ ID NO: 542688 - DNA, 20 bp, Artificial
  CRISPR gRNA sequence
aaaaaattagccaagcatgg

SEQ ID NO: 542689 - DNA, 20 bp, Artificial
  CRISPR gRNA sequence
agcatggtggcatgcacctg

SEQ ID NO: 542690 - DNA, 20 bp, Artificial
  CRISPR gRNA sequence
gtggcatgcacctgtagtcc

SEQ ID NO: 542691 - DNA, 20 bp, Artificial
  CRISPR gRNA sequence
cacctgtagtcctggctact

SEQ ID NO: 542692 - DNA, 20 bp, Artificial
  CRISPR gRNA sequence
ctgtagtcctggctactcag

SEQ ID NO: 542693 - DNA, 20 bp, Artificial
  CRISPR gRNA sequence
tgtagtcctggctactcaga

SEQ ID NO: 542694 - DNA, 20 bp, Artificial
  CRISPR gRNA sequence
tcctggctactcagaaggct

SEQ ID NO: 542695 - DNA, 20 bp, Artificial
  CRISPR gRNA sequence
cctggctactcagaaggctg

SEQ ID NO: 542696 - DNA, 20 bp, Artificial
  CRISPR gRNA sequence
ggctactcagaaggctgagg

SEQ ID NO: 542697 - DNA, 20 bp, Artificial
  CRISPR gRNA sequence
tactcagaaggctgaggtgg

SEQ ID NO: 542698 - DNA, 20 bp, Artificial
  CRISPR gRNA sequence
ctgaggtggcagaattgctt

SEQ ID NO: 542699 - DNA, 20 bp, Artificial
  CRISPR gRNA sequence
tggcagaattgcttgagcct

SEQ ID NO: 542700 - DNA, 20 bp, Artificial
  CRISPR gRNA sequence
gcagaattgcttgagcctca

SEQ ID NO: 542701 - DNA, 20 bp, Artificial
  CRISPR gRNA sequence
cagaattgcttgagcctcag

SEQ ID NO: 542702 - DNA, 20 bp, Artificial
  CRISPR gRNA sequence
ttgcttgagcctcagaggtc

SEQ ID NO: 542703 - DNA, 20 bp, Artificial
  CRISPR gRNA sequence
tgcttgagcctcagaggtcg

SEQ ID NO: 542704 - DNA, 20 bp, Artificial
  CRISPR gRNA sequence
tgagcctcagaggtcgaggc

SEQ ID NO: 542705 - DNA, 20 bp, Artificial
  CRISPR gRNA sequence
agcctcagaggtcgaggctg

SEQ ID NO: 542706 - DNA, 20 bp, Artificial
  CRISPR gRNA sequence
tcagaggtcgaggctggagt

SEQ ID NO: 542707 - DNA, 20 bp, Artificial
  CRISPR gRNA sequence
gaggctggagttagctgtga

SEQ ID NO: 542708 - DNA, 20 bp, Artificial
  CRISPR gRNA sequence
gtgatagcacccctgtactc

SEQ ID NO: 542709 - DNA, 20 bp, Artificial
  CRISPR gRNA sequence
agcacccctgtactccagcc

SEQ ID NO: 542710 - DNA, 20 bp, Artificial
  CRISPR gRNA sequence
gcacccctgtactccagcct

SEQ ID NO: 542711 - DNA, 20 bp, Artificial
  CRISPR gRNA sequence
gtactccagcctgggtgaca

SEQ ID NO: 542712 - DNA, 20 bp, Artificial
  CRISPR gRNA sequence
tccagcctgggtgacacagt

SEQ ID NO: 542713 - DNA, 20 bp, Artificial
  CRISPR gRNA sequence
aaaaataaaataaaatattt

SEQ ID NO: 542714 - DNA, 20 bp, Artificial
  CRISPR gRNA sequence
ataaaatattttagtgataa

SEQ ID NO: 542715 - DNA, 20 bp, Artificial
  CRISPR gRNA sequence
attttagtgataatggattc

SEQ ID NO: 542716 - DNA, 20 bp, Artificial
  CRISPR gRNA sequence
ttttagtgataatggattct

SEQ ID NO: 542717 - DNA, 20 bp, Artificial
  CRISPR gRNA sequence
tagtgataatggattctggg

SEQ ID NO: 542718 - DNA, 20 bp, Artificial
  CRISPR gRNA sequence
gattctgggaagaatcacca

SEQ ID NO: 542719 - DNA, 20 bp, Artificial
  CRISPR gRNA sequence
attctgggaagaatcaccat

SEQ ID NO: 542720 - DNA, 20 bp, Artificial
  CRISPR gRNA sequence
taaaaccactgaatgaacaa

SEQ ID NO: 542721 - DNA, 20 bp, Artificial
  CRISPR gRNA sequence
accactgaatgaacaatggc

SEQ ID NO: 542722 - DNA, 20 bp, Artificial
  CRISPR gRNA sequence
cactgaatgaacaatggctg

SEQ ID NO: 542723 - DNA, 20 bp, Artificial
  CRISPR gRNA sequence
aatgaacaatggctggagaa

SEQ ID NO: 542724 - DNA, 20 bp, Artificial
  CRISPR gRNA sequence
atgaacaatggctggagaac

SEQ ID NO: 542725 - DNA, 20 bp, Artificial
  CRISPR gRNA sequence
cacatcatttattacttaca

SEQ ID NO: 542726 - DNA, 20 bp, Artificial
  CRISPR gRNA sequence
acatcatttattacttacaa

SEQ ID NO: 542727 - DNA, 20 bp, Artificial
  CRISPR gRNA sequence
tattacttacaaaggtaaaa

SEQ ID NO: 542728 - DNA, 20 bp, Artificial
  CRISPR gRNA sequence
gtaaaatggtgcctctacaa

SEQ ID NO: 542729 - DNA, 20 bp, Artificial
  CRISPR gRNA sequence
aaaatggtgcctctacaatg

SEQ ID NO: 542730 - DNA, 20 bp, Artificial
  CRISPR gRNA sequence
gcctctacaatggagaaatc

SEQ ID NO: 542731 - DNA, 20 bp, Artificial
  CRISPR gRNA sequence
ttcactttaaccaaatgtca

SEQ ID NO: 542732 - DNA, 20 bp, Artificial
  CRISPR gRNA sequence
atctccaataatgtgacaaa

SEQ ID NO: 542733 - DNA, 20 bp, Artificial
  CRISPR gRNA sequence
tcttcctgatgtgacacact

SEQ ID NO: 542734 - DNA, 20 bp, Artificial
  CRISPR gRNA sequence
tcctgatgtgacacactgag

SEQ ID NO: 542735 - DNA, 20 bp, Artificial
  CRISPR gRNA sequence
cctgatgtgacacactgaga

SEQ ID NO: 542736 - DNA, 20 bp, Artificial
  CRISPR gRNA sequence
acactgagaaggacccaaca

SEQ ID NO: 542737 - DNA, 20 bp, Artificial
  CRISPR gRNA sequence
aaggacccaacatagctatg

SEQ ID NO: 542738 - DNA, 20 bp, Artificial
  CRISPR gRNA sequence
tatgaagtattcctgctaca

SEQ ID NO: 542739 - DNA, 20 bp, Artificial
  CRISPR gRNA sequence
tgaagtattcctgctacaaa

SEQ ID NO: 542740 - DNA, 20 bp, Artificial
  CRISPR gRNA sequence
ctgctacaaagagttacaac

SEQ ID NO: 542741 - DNA, 20 bp, Artificial
  CRISPR gRNA sequence
tacaaccagaatctgatcat

SEQ ID NO: 542742 - DNA, 20 bp, Artificial
  CRISPR gRNA sequence
acaaccagaatctgatcatg

SEQ ID NO: 542743 - DNA, 20 bp, Artificial
  CRISPR gRNA sequence
gaatctgatcatgaggaaac

SEQ ID NO: 542744 - DNA, 20 bp, Artificial
  CRISPR gRNA sequence
tctgatcatgaggaaacaag

SEQ ID NO: 542745 - DNA, 20 bp, Artificial
  CRISPR gRNA sequence
ctgatcatgaggaaacaagc

SEQ ID NO: 542746 - DNA, 20 bp, Artificial
  CRISPR gRNA sequence
aagcaggcaatccacatcca

SEQ ID NO: 542747 - DNA, 20 bp, Artificial
  CRISPR gRNA sequence
agcaggcaatccacatccaa

SEQ ID NO: 542748 - DNA, 20 bp, Artificial
  CRISPR gRNA sequence
gcaggcaatccacatccaaa

SEQ ID NO: 542749 - DNA, 20 bp, Artificial
  CRISPR gRNA sequence
tccacatccaaagggacatt

SEQ ID NO: 542750 - DNA, 20 bp, Artificial
  CRISPR gRNA sequence
atccaaagggacattcggta

SEQ ID NO: 542751 - DNA, 20 bp, Artificial
  CRISPR gRNA sequence
gggacattcggtaaagcaac

SEQ ID NO: 542752 - DNA, 20 bp, Artificial
  CRISPR gRNA sequence
attcggtaaagcaactagcc

SEQ ID NO: 542753 - DNA, 20 bp, Artificial
  CRISPR gRNA sequence
tcaaaaatgatgatgtctta

SEQ ID NO: 542754 - DNA, 20 bp, Artificial
  CRISPR gRNA sequence
ccaaaaaaaaaaaaaaaaaa

SEQ ID NO: 542755 - DNA, 20 bp, Artificial
  CRISPR gRNA sequence
aaaaaaaaaaaaaaaagcaa

SEQ ID NO: 542756 - DNA, 20 bp, Artificial
  CRISPR gRNA sequence
aaaaaaaaaagcaacagttt

SEQ ID NO: 542757 - DNA, 20 bp, Artificial
  CRISPR gRNA sequence
aaaaaaaaagcaacagtttt

SEQ ID NO: 542758 - DNA, 20 bp, Artificial
  CRISPR gRNA sequence
aaagcaacagttttaggtta

SEQ ID NO: 542759 - DNA, 20 bp, Artificial
  CRISPR gRNA sequence
aagcaacagttttaggttaa

SEQ ID NO: 542760 - DNA, 20 bp, Artificial
  CRISPR gRNA sequence
agcaacagttttaggttaaa

SEQ ID NO: 542761 - DNA, 20 bp, Artificial
  CRISPR gRNA sequence
gcaacagttttaggttaaag

SEQ ID NO: 542762 - DNA, 20 bp, Artificial
  CRISPR gRNA sequence
caacagttttaggttaaagg

SEQ ID NO: 542763 - DNA, 20 bp, Artificial
  CRISPR gRNA sequence
ttaggttaaagggggttaaa

SEQ ID NO: 542764 - DNA, 20 bp, Artificial
  CRISPR gRNA sequence
taggttaaagggggttaaaa

SEQ ID NO: 542765 - DNA, 20 bp, Artificial
  CRISPR gRNA sequence
aaaggcatgattatcaaatg

SEQ ID NO: 542766 - DNA, 20 bp, Artificial
  CRISPR gRNA sequence
tgattatcaaatgaagtatg

SEQ ID NO: 542767 - DNA, 20 bp, Artificial
  CRISPR gRNA sequence
atcaaatgaagtatgtggtg

SEQ ID NO: 542768 - DNA, 20 bp, Artificial
  CRISPR gRNA sequence
tcaaatgaagtatgtggtgc

SEQ ID NO: 542769 - DNA, 20 bp, Artificial
  CRISPR gRNA sequence
tgaagtatgtggtgcaggac

SEQ ID NO: 542770 - DNA, 20 bp, Artificial
  CRISPR gRNA sequence
tgtggtgcaggactggcttc

SEQ ID NO: 542771 - DNA, 20 bp, Artificial
  CRISPR gRNA sequence
gtggtgcaggactggcttct

SEQ ID NO: 542772 - DNA, 20 bp, Artificial
  CRISPR gRNA sequence
ctggcttctgggttctctac

SEQ ID NO: 542773 - DNA, 20 bp, Artificial
  CRISPR gRNA sequence
tggcttctgggttctctacc

SEQ ID NO: 542774 - DNA, 20 bp, Artificial
  CRISPR gRNA sequence
ctgggttctctaccaggaaa

SEQ ID NO: 542775 - DNA, 20 bp, Artificial
  CRISPR gRNA sequence
ttgtatcaatgccacatttc

SEQ ID NO: 542776 - DNA, 20 bp, Artificial
  CRISPR gRNA sequence
atgatgattctgtgacttgt

SEQ ID NO: 542777 - DNA, 20 bp, Artificial
  CRISPR gRNA sequence
gatgattctgtgacttgttg

SEQ ID NO: 542778 - DNA, 20 bp, Artificial
  CRISPR gRNA sequence
gagaatgctcttgttcttat

SEQ ID NO: 542779 - DNA, 20 bp, Artificial
  CRISPR gRNA sequence
ttcttatgagacatatgata

SEQ ID NO: 542780 - DNA, 20 bp, Artificial
  CRISPR gRNA sequence
agacatatgataaagaatta

SEQ ID NO: 542781 - DNA, 20 bp, Artificial
  CRISPR gRNA sequence
gacatatgataaagaattac

SEQ ID NO: 542782 - DNA, 20 bp, Artificial
  CRISPR gRNA sequence
tatgataaagaattacaggt

SEQ ID NO: 542783 - DNA, 20 bp, Artificial
  CRISPR gRNA sequence
atgataaagaattacaggtg

SEQ ID NO: 542784 - DNA, 20 bp, Artificial
  CRISPR gRNA sequence
aattacaggtgaggtgtcat

SEQ ID NO: 542785 - DNA, 20 bp, Artificial
  CRISPR gRNA sequence
tgagatctgaaactctcaaa

SEQ ID NO: 542786 - DNA, 20 bp, Artificial
  CRISPR gRNA sequence
tctgaaactctcaaatggtt

SEQ ID NO: 542787 - DNA, 20 bp, Artificial
  CRISPR gRNA sequence
aaatggtttggcaaaaataa

SEQ ID NO: 542788 - DNA, 20 bp, Artificial
  CRISPR gRNA sequence
ggtttggcaaaaataacaga

SEQ ID NO: 542789 - DNA, 20 bp, Artificial
  CRISPR gRNA sequence
aacagatggcaaaaataaca

SEQ ID NO: 542790 - DNA, 20 bp, Artificial
  CRISPR gRNA sequence
aacaaagaaaactaatgtga

SEQ ID NO: 542791 - DNA, 20 bp, Artificial
  CRISPR gRNA sequence
aaactaatgtgacagttaac

SEQ ID NO: 542792 - DNA, 20 bp, Artificial
  CRISPR gRNA sequence
tgacagttaactggtgattc

SEQ ID NO: 542793 - DNA, 20 bp, Artificial
  CRISPR gRNA sequence
gacagttaactggtgattca

SEQ ID NO: 542794 - DNA, 20 bp, Artificial
  CRISPR gRNA sequence
cagttaactggtgattcaag

SEQ ID NO: 542795 - DNA, 20 bp, Artificial
  CRISPR gRNA sequence
taactggtgattcaaggaga

SEQ ID NO: 542796 - DNA, 20 bp, Artificial
  CRISPR gRNA sequence
ctaattttgcaactgtccta

SEQ ID NO: 542797 - DNA, 20 bp, Artificial
  CRISPR gRNA sequence
tcaaaaaaaaccctaaactg

SEQ ID NO: 542798 - DNA, 20 bp, Artificial
  CRISPR gRNA sequence
tgctttactcatctctgtac

SEQ ID NO: 542799 - DNA, 20 bp, Artificial
  CRISPR gRNA sequence
atgtttactttatcaccatc

SEQ ID NO: 542800 - DNA, 20 bp, Artificial
  CRISPR gRNA sequence
ctgtctctctccctcactat

SEQ ID NO: 542801 - DNA, 20 bp, Artificial
  CRISPR gRNA sequence
tgtctctctccctcactata

SEQ ID NO: 542802 - DNA, 20 bp, Artificial
  CRISPR gRNA sequence
tctctccctcactataaggt

SEQ ID NO: 542803 - DNA, 20 bp, Artificial
  CRISPR gRNA sequence
actataaggtgagcttcaca

SEQ ID NO: 542804 - DNA, 20 bp, Artificial
  CRISPR gRNA sequence
ctataaggtgagcttcacaa

SEQ ID NO: 542805 - DNA, 20 bp, Artificial
  CRISPR gRNA sequence
taaggtgagcttcacaaagg

SEQ ID NO: 542806 - DNA, 20 bp, Artificial
  CRISPR gRNA sequence
aaggtgagcttcacaaaggc

SEQ ID NO: 542807 - DNA, 20 bp, Artificial
  CRISPR gRNA sequence
aggtgagcttcacaaaggca

SEQ ID NO: 542808 - DNA, 20 bp, Artificial
  CRISPR gRNA sequence
caaaggcagggaactgtgca

SEQ ID NO: 542809 - DNA, 20 bp, Artificial
  CRISPR gRNA sequence
tgtatcccccgtccattgtg

SEQ ID NO: 542810 - DNA, 20 bp, Artificial
  CRISPR gRNA sequence
cttaacatataattgacact

SEQ ID NO: 542811 - DNA, 20 bp, Artificial
  CRISPR gRNA sequence
tattgcatgactgatgttcc

SEQ ID NO: 542812 - DNA, 20 bp, Artificial
  CRISPR gRNA sequence
atgttcccagtaattctatg

SEQ ID NO: 542813 - DNA, 20 bp, Artificial
  CRISPR gRNA sequence
ttcccagtaattctatgaag

SEQ ID NO: 542814 - DNA, 20 bp, Artificial
  CRISPR gRNA sequence
tcccagtaattctatgaagt

SEQ ID NO: 542815 - DNA, 20 bp, Artificial
  CRISPR gRNA sequence
tattctcctttccctcatgt

SEQ ID NO: 542816 - DNA, 20 bp, Artificial
  CRISPR gRNA sequence
tctcctttccctcatgtgag

SEQ ID NO: 542817 - DNA, 20 bp, Artificial
  CRISPR gRNA sequence
gtgagtggtactctcttcaa

SEQ ID NO: 542818 - DNA, 20 bp, Artificial
  CRISPR gRNA sequence
tggtactctcttcaaaagtg

SEQ ID NO: 542819 - DNA, 20 bp, Artificial
  CRISPR gRNA sequence
ggtactctcttcaaaagtga

SEQ ID NO: 542820 - DNA, 20 bp, Artificial
  CRISPR gRNA sequence
cttcaaaagtgaaggtactg

SEQ ID NO: 542821 - DNA, 20 bp, Artificial
  CRISPR gRNA sequence
aaagtgaaggtactgaagtg

SEQ ID NO: 542822 - DNA, 20 bp, Artificial
  CRISPR gRNA sequence
agtgaaggtactgaagtgaa

SEQ ID NO: 542823 - DNA, 20 bp, Artificial
  CRISPR gRNA sequence
gaaggtactgaagtgaagag

SEQ ID NO: 542824 - DNA, 20 bp, Artificial
  CRISPR gRNA sequence
gtactgaagtgaagagaagt

SEQ ID NO: 542825 - DNA, 20 bp, Artificial
  CRISPR gRNA sequence
tactgaagtgaagagaagtt

SEQ ID NO: 542826 - DNA, 20 bp, Artificial
  CRISPR gRNA sequence
actgaagtgaagagaagtta

SEQ ID NO: 542827 - DNA, 20 bp, Artificial
  CRISPR gRNA sequence
agaagttagggaactcacac

SEQ ID NO: 542828 - DNA, 20 bp, Artificial
  CRISPR gRNA sequence
actcacacaagttcatgact

SEQ ID NO: 542829 - DNA, 20 bp, Artificial
  CRISPR gRNA sequence
ctcacacaagttcatgactc

SEQ ID NO: 542830 - DNA, 20 bp, Artificial
  CRISPR gRNA sequence
cacaagttcatgactcaggt

SEQ ID NO: 542831 - DNA, 20 bp, Artificial
  CRISPR gRNA sequence
acaagttcatgactcaggtg

SEQ ID NO: 542832 - DNA, 20 bp, Artificial
  CRISPR gRNA sequence
aagttcatgactcaggtgag

SEQ ID NO: 542833 - DNA, 20 bp, Artificial
  CRISPR gRNA sequence
ttcatgactcaggtgaggag

SEQ ID NO: 542834 - DNA, 20 bp, Artificial
  CRISPR gRNA sequence
tcatgactcaggtgaggagt

SEQ ID NO: 542835 - DNA, 20 bp, Artificial
  CRISPR gRNA sequence
catgactcaggtgaggagtg

SEQ ID NO: 542836 - DNA, 20 bp, Artificial
  CRISPR gRNA sequence
actcaggtgaggagtggggc

SEQ ID NO: 542837 - DNA, 20 bp, Artificial
  CRISPR gRNA sequence
ctcaggtgaggagtggggcc

SEQ ID NO: 542838 - DNA, 20 bp, Artificial
  CRISPR gRNA sequence
aggagtggggccaggatcca

SEQ ID NO: 542839 - DNA, 20 bp, Artificial
  CRISPR gRNA sequence
gtggggccaggatccaaagc

SEQ ID NO: 542840 - DNA, 20 bp, Artificial
  CRISPR gRNA sequence
tggggccaggatccaaagct

SEQ ID NO: 542841 - DNA, 20 bp, Artificial
  CRISPR gRNA sequence
caaagctaggcatctgaccc

SEQ ID NO: 542842 - DNA, 20 bp, Artificial
  CRISPR gRNA sequence
aagctaggcatctgacccca

SEQ ID NO: 542843 - DNA, 20 bp, Artificial
  CRISPR gRNA sequence
gctgttaatcactgcatttg

SEQ ID NO: 542844 - DNA, 20 bp, Artificial
  CRISPR gRNA sequence
gcatttgcagcttccctaat

SEQ ID NO: 542845 - DNA, 20 bp, Artificial
  CRISPR gRNA sequence
catttgcagcttccctaatg

SEQ ID NO: 542846 - DNA, 20 bp, Artificial
  CRISPR gRNA sequence
ttgcagcttccctaatgagg

SEQ ID NO: 542847 - DNA, 20 bp, Artificial
  CRISPR gRNA sequence
tgcagcttccctaatgaggc

SEQ ID NO: 542848 - DNA, 20 bp, Artificial
  CRISPR gRNA sequence
cttccctaatgaggcaggct

SEQ ID NO: 542849 - DNA, 20 bp, Artificial
  CRISPR gRNA sequence
ttccctaatgaggcaggctt

SEQ ID NO: 542850 - DNA, 20 bp, Artificial
  CRISPR gRNA sequence
aggcaggcttgggtccccaa

SEQ ID NO: 542851 - DNA, 20 bp, Artificial
  CRISPR gRNA sequence
ggcaggcttgggtccccaaa

SEQ ID NO: 542852 - DNA, 20 bp, Artificial
  CRISPR gRNA sequence
gcaggcttgggtccccaaaa

SEQ ID NO: 542853 - DNA, 20 bp, Artificial
  CRISPR gRNA sequence
caggcttgggtccccaaaag

SEQ ID NO: 542854 - DNA, 20 bp, Artificial
  CRISPR gRNA sequence
caaaaggggatatacccatt

SEQ ID NO: 542855 - DNA, 20 bp, Artificial
  CRISPR gRNA sequence
tacccattcagtcttgtctt

SEQ ID NO: 542856 - DNA, 20 bp, Artificial
  CRISPR gRNA sequence
ttcagtcttgtctttagttt

SEQ ID NO: 542857 - DNA, 20 bp, Artificial
  CRISPR gRNA sequence
tcagtcttgtctttagttta

SEQ ID NO: 542858 - DNA, 20 bp, Artificial
  CRISPR gRNA sequence
tctttagtttaaggcctatg

SEQ ID NO: 542859 - DNA, 20 bp, Artificial
  CRISPR gRNA sequence
tttagtttaaggcctatgca

SEQ ID NO: 542860 - DNA, 20 bp, Artificial
  CRISPR gRNA sequence
agtttaaggcctatgcagag

SEQ ID NO: 542861 - DNA, 20 bp, Artificial
  CRISPR gRNA sequence
ttctgaatgaatacatgaat

SEQ ID NO: 542862 - DNA, 20 bp, Artificial
  CRISPR gRNA sequence
tctgaatgaatacatgaatt

SEQ ID NO: 542863 - DNA, 20 bp, Artificial
  CRISPR gRNA sequence
aatgaatacatgaattaggt

SEQ ID NO: 542864 - DNA, 20 bp, Artificial
  CRISPR gRNA sequence
tgaatacatgaattaggtga

SEQ ID NO: 542865 - DNA, 20 bp, Artificial
  CRISPR gRNA sequence
aatacatgaattaggtgaga

SEQ ID NO: 542866 - DNA, 20 bp, Artificial
  CRISPR gRNA sequence
aattaggtgagagagatcac

SEQ ID NO: 542867 - DNA, 20 bp, Artificial
  CRISPR gRNA sequence
attaggtgagagagatcacc

SEQ ID NO: 542868 - DNA, 20 bp, Artificial
  CRISPR gRNA sequence
aggtgagagagatcaccagg

SEQ ID NO: 542869 - DNA, 20 bp, Artificial
  CRISPR gRNA sequence
ggtgagagagatcaccagga

SEQ ID NO: 542870 - DNA, 20 bp, Artificial
  CRISPR gRNA sequence
gtgagagagatcaccaggaa

SEQ ID NO: 542871 - DNA, 20 bp, Artificial
  CRISPR gRNA sequence
gagagatcaccaggaaggga

SEQ ID NO: 542872 - DNA, 20 bp, Artificial
  CRISPR gRNA sequence
ggacagttcaaataatctgt

SEQ ID NO: 542873 - DNA, 20 bp, Artificial
  CRISPR gRNA sequence
acagttcaaataatctgttg

SEQ ID NO: 542874 - DNA, 20 bp, Artificial
  CRISPR gRNA sequence
cagttcaaataatctgttgg

SEQ ID NO: 542875 - DNA, 20 bp, Artificial
  CRISPR gRNA sequence
ttcaaataatctgttggagg

SEQ ID NO: 542876 - DNA, 20 bp, Artificial
  CRISPR gRNA sequence
caaataatctgttggaggtg

SEQ ID NO: 542877 - DNA, 20 bp, Artificial
  CRISPR gRNA sequence
aatctgttggaggtggagct

SEQ ID NO: 542878 - DNA, 20 bp, Artificial
  CRISPR gRNA sequence
atctgttggaggtggagctt

SEQ ID NO: 542879 - DNA, 20 bp, Artificial
  CRISPR gRNA sequence
gaggtggagcttgggcaaac

SEQ ID NO: 542880 - DNA, 20 bp, Artificial
  CRISPR gRNA sequence
aggtggagcttgggcaaact

SEQ ID NO: 542881 - DNA, 20 bp, Artificial
  CRISPR gRNA sequence
gcttgggcaaactgggtttg

SEQ ID NO: 542882 - DNA, 20 bp, Artificial
  CRISPR gRNA sequence
tgggcaaactgggtttgcag

SEQ ID NO: 542883 - DNA, 20 bp, Artificial
  CRISPR gRNA sequence
gcaaactgggtttgcagtgg

SEQ ID NO: 542884 - DNA, 20 bp, Artificial
  CRISPR gRNA sequence
caaactgggtttgcagtgga

SEQ ID NO: 542885 - DNA, 20 bp, Artificial
  CRISPR gRNA sequence
aaactgggtttgcagtggaa

SEQ ID NO: 542886 - DNA, 20 bp, Artificial
  CRISPR gRNA sequence
actgggtttgcagtggaagg

SEQ ID NO: 542887 - DNA, 20 bp, Artificial
  CRISPR gRNA sequence
ttgcagtggaagggagaaca

SEQ ID NO: 542888 - DNA, 20 bp, Artificial
  CRISPR gRNA sequence
tgcagtggaagggagaacac

SEQ ID NO: 542889 - DNA, 20 bp, Artificial
  CRISPR gRNA sequence
tggaagggagaacacaggta

SEQ ID NO: 542890 - DNA, 20 bp, Artificial
  CRISPR gRNA sequence
ggaagggagaacacaggtac

SEQ ID NO: 542891 - DNA, 20 bp, Artificial
  CRISPR gRNA sequence
agggagaacacaggtacagg

SEQ ID NO: 542892 - DNA, 20 bp, Artificial
  CRISPR gRNA sequence
gagaacacaggtacaggcag

SEQ ID NO: 542893 - DNA, 20 bp, Artificial
  CRISPR gRNA sequence
ggtacaggcagcagtgaccc

SEQ ID NO: 542894 - DNA, 20 bp, Artificial
  CRISPR gRNA sequence
gtacaggcagcagtgaccca

SEQ ID NO: 542895 - DNA, 20 bp, Artificial
  CRISPR gRNA sequence
gcagcagtgacccaaggtgc

SEQ ID NO: 542896 - DNA, 20 bp, Artificial
  CRISPR gRNA sequence
cagcagtgacccaaggtgcc

SEQ ID NO: 542897 - DNA, 20 bp, Artificial
  CRISPR gRNA sequence
agcagtgacccaaggtgcca

SEQ ID NO: 542898 - DNA, 20 bp, Artificial
  CRISPR gRNA sequence
gacccaaggtgccagggaat

SEQ ID NO: 542899 - DNA, 20 bp, Artificial
  CRISPR gRNA sequence
acccaaggtgccagggaatg

SEQ ID NO: 542900 - DNA, 20 bp, Artificial
  CRISPR gRNA sequence
cccaaggtgccagggaatga

SEQ ID NO: 542901 - DNA, 20 bp, Artificial
  CRISPR gRNA sequence
ggtgccagggaatgagggac

SEQ ID NO: 542902 - DNA, 20 bp, Artificial
  CRISPR gRNA sequence
gaatgagggaccagcttgcc

SEQ ID NO: 542903 - DNA, 20 bp, Artificial
  CRISPR gRNA sequence
atgagggaccagcttgcctg

SEQ ID NO: 542904 - DNA, 20 bp, Artificial
  CRISPR gRNA sequence
tgagggaccagcttgcctgg

SEQ ID NO: 542905 - DNA, 20 bp, Artificial
  CRISPR gRNA sequence
agggaccagcttgcctggag

SEQ ID NO: 542906 - DNA, 20 bp, Artificial
  CRISPR gRNA sequence
ggaccagcttgcctggagga

SEQ ID NO: 542907 - DNA, 20 bp, Artificial
  CRISPR gRNA sequence
tttgtatctcttcttttccc

SEQ ID NO: 542908 - DNA, 20 bp, Artificial
  CRISPR gRNA sequence
ccacccgcacatgaactccc

SEQ ID NO: 542909 - DNA, 20 bp, Artificial
  CRISPR gRNA sequence
acccgcacatgaactcccca

SEQ ID NO: 542910 - DNA, 20 bp, Artificial
  CRISPR gRNA sequence
atgaactccccagagctatt

SEQ ID NO: 542911 - DNA, 20 bp, Artificial
  CRISPR gRNA sequence
tgaactccccagagctattt

SEQ ID NO: 542912 - DNA, 20 bp, Artificial
  CRISPR gRNA sequence
gagctatttgggccctgtga

SEQ ID NO: 542913 - DNA, 20 bp, Artificial
  CRISPR gRNA sequence
ctatttgggccctgtgatgg

SEQ ID NO: 542914 - DNA, 20 bp, Artificial
  CRISPR gRNA sequence
cctgtgatggtagtccaccc

SEQ ID NO: 542915 - DNA, 20 bp, Artificial
  CRISPR gRNA sequence
ggtagtccaccctggccttc

SEQ ID NO: 542916 - DNA, 20 bp, Artificial
  CRISPR gRNA sequence
cctccaattcctcctgactg

SEQ ID NO: 542917 - DNA, 20 bp, Artificial
  CRISPR gRNA sequence
gccttcctctttgttgctaa

SEQ ID NO: 542918 - DNA, 20 bp, Artificial
  CRISPR gRNA sequence
tgctaacagattcttcttcc

SEQ ID NO: 542919 - DNA, 20 bp, Artificial
  CRISPR gRNA sequence
gctaacagattcttcttccc

SEQ ID NO: 542920 - DNA, 20 bp, Artificial
  CRISPR gRNA sequence
gattcttcttcccaggcgca

SEQ ID NO: 542921 - DNA, 20 bp, Artificial
  CRISPR gRNA sequence
gcgcatggtcctgatcctgt

SEQ ID NO: 542922 - DNA, 20 bp, Artificial
  CRISPR gRNA sequence
cgcatggtcctgatcctgta

SEQ ID NO: 542923 - DNA, 20 bp, Artificial
  CRISPR gRNA sequence
ggtcctgatcctgtaaggcc

SEQ ID NO: 542924 - DNA, 20 bp, Artificial
  CRISPR gRNA sequence
gtcctgatcctgtaaggccc

SEQ ID NO: 542925 - DNA, 20 bp, Artificial
  CRISPR gRNA sequence
cctgatcctgtaaggcccag

SEQ ID NO: 542926 - DNA, 20 bp, Artificial
  CRISPR gRNA sequence
gatcctgtaaggcccaggag

SEQ ID NO: 542927 - DNA, 20 bp, Artificial
  CRISPR gRNA sequence
aggcccaggagaagctctct

SEQ ID NO: 542928 - DNA, 20 bp, Artificial
  CRISPR gRNA sequence
caggagaagctctctcagct

SEQ ID NO: 542929 - DNA, 20 bp, Artificial
  CRISPR gRNA sequence
ggagaagctctctcagctca

SEQ ID NO: 542930 - DNA, 20 bp, Artificial
  CRISPR gRNA sequence
ctctctcagctcagagaatc

SEQ ID NO: 542931 - DNA, 20 bp, Artificial
  CRISPR gRNA sequence
tcagagaatccagactccct

SEQ ID NO: 542932 - DNA, 20 bp, Artificial
  CRISPR gRNA sequence
cagagaatccagactcccta

SEQ ID NO: 542933 - DNA, 20 bp, Artificial
  CRISPR gRNA sequence
agagaatccagactccctaa

SEQ ID NO: 542934 - DNA, 20 bp, Artificial
  CRISPR gRNA sequence
gagaatccagactccctaag

SEQ ID NO: 542935 - DNA, 20 bp, Artificial
  CRISPR gRNA sequence
agactccctaaggggacact

SEQ ID NO: 542936 - DNA, 20 bp, Artificial
  CRISPR gRNA sequence
atcacatgtccacacatcac

SEQ ID NO: 542937 - DNA, 20 bp, Artificial
  CRISPR gRNA sequence
ccacacatcaccagtccttg

SEQ ID NO: 542938 - DNA, 20 bp, Artificial
  CRISPR gRNA sequence
cacacatcaccagtccttga

SEQ ID NO: 542939 - DNA, 20 bp, Artificial
  CRISPR gRNA sequence
catcaccagtccttgaaggc

SEQ ID NO: 542940 - DNA, 20 bp, Artificial
  CRISPR gRNA sequence
atcaccagtccttgaaggct

SEQ ID NO: 542941 - DNA, 20 bp, Artificial
  CRISPR gRNA sequence
caaatatcctccctcccatg

SEQ ID NO: 542942 - DNA, 20 bp, Artificial
  CRISPR gRNA sequence
ccatgaagactgcttcacaa

SEQ ID NO: 542943 - DNA, 20 bp, Artificial
  CRISPR gRNA sequence
aaagacacttgatttcacaa

SEQ ID NO: 542944 - DNA, 20 bp, Artificial
  CRISPR gRNA sequence
agacacttgatttcacaaaa

SEQ ID NO: 542945 - DNA, 20 bp, Artificial
  CRISPR gRNA sequence
ttcttccctctgtaccctca

SEQ ID NO: 542946 - DNA, 20 bp, Artificial
  CRISPR gRNA sequence
tttttttttttttttttttt

SEQ ID NO: 542947 - DNA, 20 bp, Artificial
  CRISPR gRNA sequence
ttttttttttttttttgaga

SEQ ID NO: 542948 - DNA, 20 bp, Artificial
  CRISPR gRNA sequence
tttttttttttttttgagac

SEQ ID NO: 542949 - DNA, 20 bp, Artificial
  CRISPR gRNA sequence
acaggtcatattctgtcacc

SEQ ID NO: 542950 - DNA, 20 bp, Artificial
  CRISPR gRNA sequence
caggtcatattctgtcaccc

SEQ ID NO: 542951 - DNA, 20 bp, Artificial
  CRISPR gRNA sequence
tcatattctgtcacccaggc

SEQ ID NO: 542952 - DNA, 20 bp, Artificial
  CRISPR gRNA sequence
atattctgtcacccaggctg

SEQ ID NO: 542953 - DNA, 20 bp, Artificial
  CRISPR gRNA sequence
ctgtcacccaggctggagtt

SEQ ID NO: 542954 - DNA, 20 bp, Artificial
  CRISPR gRNA sequence
tcacccaggctggagttcag

SEQ ID NO: 542955 - DNA, 20 bp, Artificial
  CRISPR gRNA sequence
ggagttcagtggcacaatca

SEQ ID NO: 542956 - DNA, 20 bp, Artificial
  CRISPR gRNA sequence
ctcactgcatcctctgcctc

SEQ ID NO: 542957 - DNA, 20 bp, Artificial
  CRISPR gRNA sequence
tcactgcatcctctgcctcc

SEQ ID NO: 542958 - DNA, 20 bp, Artificial
  CRISPR gRNA sequence
catcctctgcctccgggact

SEQ ID NO: 542959 - DNA, 20 bp, Artificial
  CRISPR gRNA sequence
atcctctgcctccgggactc

SEQ ID NO: 542960 - DNA, 20 bp, Artificial
  CRISPR gRNA sequence
ctcaggtgattctcccacct

SEQ ID NO: 542961 - DNA, 20 bp, Artificial
  CRISPR gRNA sequence
ttctcccacctcagccttcc

SEQ ID NO: 542962 - DNA, 20 bp, Artificial
  CRISPR gRNA sequence
tcccacctcagccttccgag

SEQ ID NO: 542963 - DNA, 20 bp, Artificial
  CRISPR gRNA sequence
acctcagccttccgagtagc

SEQ ID NO: 542964 - DNA, 20 bp, Artificial
  CRISPR gRNA sequence
cctcagccttccgagtagct

SEQ ID NO: 542965 - DNA, 20 bp, Artificial
  CRISPR gRNA sequence
cttccgagtagctgggacta

SEQ ID NO: 542966 - DNA, 20 bp, Artificial
  CRISPR gRNA sequence
ttccgagtagctgggactat

SEQ ID NO: 542967 - DNA, 20 bp, Artificial
  CRISPR gRNA sequence
taggtatgcgccaccacgct

SEQ ID NO: 542968 - DNA, 20 bp, Artificial
  CRISPR gRNA sequence
gctaatttttgtattttttg

SEQ ID NO: 542969 - DNA, 20 bp, Artificial
  CRISPR gRNA sequence
taatttttgtattttttgta

SEQ ID NO: 542970 - DNA, 20 bp, Artificial
  CRISPR gRNA sequence
gagccgatctttcaccgtgt

SEQ ID NO: 542971 - DNA, 20 bp, Artificial
  CRISPR gRNA sequence
tttcaccgtgttggccctgc

SEQ ID NO: 542972 - DNA, 20 bp, Artificial
  CRISPR gRNA sequence
ccctgctggtctccgattcc

SEQ ID NO: 542973 - DNA, 20 bp, Artificial
  CRISPR gRNA sequence
ggtctccgattcctggcctc

SEQ ID NO: 542974 - DNA, 20 bp, Artificial
  CRISPR gRNA sequence
ctcaagtgatccacctgcct

SEQ ID NO: 542975 - DNA, 20 bp, Artificial
  CRISPR gRNA sequence
ccacctgcctcagcctccca

SEQ ID NO: 542976 - DNA, 20 bp, Artificial
  CRISPR gRNA sequence
gcctcagcctcccaaagtgc

SEQ ID NO: 542977 - DNA, 20 bp, Artificial
  CRISPR gRNA sequence
cctcagcctcccaaagtgct

SEQ ID NO: 542978 - DNA, 20 bp, Artificial
  CRISPR gRNA sequence
ctcccaaagtgctaggatga

SEQ ID NO: 542979 - DNA, 20 bp, Artificial
  CRISPR gRNA sequence
tcccaaagtgctaggatgac

SEQ ID NO: 542980 - DNA, 20 bp, Artificial
  CRISPR gRNA sequence
agtgctaggatgacaggtgt

SEQ ID NO: 542981 - DNA, 20 bp, Artificial
  CRISPR gRNA sequence
caggtgtaagccaccacgcc

SEQ ID NO: 542982 - DNA, 20 bp, Artificial
  CRISPR gRNA sequence
gtaagccaccacgcccagcc

SEQ ID NO: 542983 - DNA, 20 bp, Artificial
  CRISPR gRNA sequence
taagccaccacgcccagccc

SEQ ID NO: 542984 - DNA, 20 bp, Artificial
  CRISPR gRNA sequence
cactgacttatctgatcgtg

SEQ ID NO: 542985 - DNA, 20 bp, Artificial
  CRISPR gRNA sequence
actgacttatctgatcgtgc

SEQ ID NO: 542986 - DNA, 20 bp, Artificial
  CRISPR gRNA sequence
ctgatcgtgcgggtactttt

SEQ ID NO: 542987 - DNA, 20 bp, Artificial
  CRISPR gRNA sequence
ctatctcaacccctccccct

SEQ ID NO: 542988 - DNA, 20 bp, Artificial
  CRISPR gRNA sequence
tcccccttggctgtcttcca

SEQ ID NO: 542989 - DNA, 20 bp, Artificial
  CRISPR gRNA sequence
agatgcacacgcgcacctcc

SEQ ID NO: 542990 - DNA, 20 bp, Artificial
  CRISPR gRNA sequence
gatgcacacgcgcacctccc

SEQ ID NO: 542991 - DNA, 20 bp, Artificial
  CRISPR gRNA sequence
gcacacgcgcacctcccggg

SEQ ID NO: 542992 - DNA, 20 bp, Artificial
  CRISPR gRNA sequence
cacacgcgcacctcccgggc

SEQ ID NO: 542993 - DNA, 20 bp, Artificial
  CRISPR gRNA sequence
acgcgcacctcccgggcagg

SEQ ID NO: 542994 - DNA, 20 bp, Artificial
  CRISPR gRNA sequence
cgcacctcccgggcaggcag

SEQ ID NO: 542995 - DNA, 20 bp, Artificial
  CRISPR gRNA sequence
ccgggcaggcagcggacgct

SEQ ID NO: 542996 - DNA, 20 bp, Artificial
  CRISPR gRNA sequence
ggcagcggacgctgagcaaa

SEQ ID NO: 542997 - DNA, 20 bp, Artificial
  CRISPR gRNA sequence
gcggacgctgagcaaacgga

SEQ ID NO: 542998 - DNA, 20 bp, Artificial
  CRISPR gRNA sequence
acgctgagcaaacggacgga

SEQ ID NO: 542999 - DNA, 20 bp, Artificial
  CRISPR gRNA sequence
cgctgagcaaacggacggac

SEQ ID NO: 543000 - DNA, 20 bp, Artificial
  CRISPR gRNA sequence
gagcaaacggacggacgggc

SEQ ID NO: 543001 - DNA, 20 bp, Artificial
  CRISPR gRNA sequence
gcaaacggacggacgggctg

SEQ ID NO: 543002 - DNA, 20 bp, Artificial
  CRISPR gRNA sequence
caaacggacggacgggctgg

SEQ ID NO: 543003 - DNA, 20 bp, Artificial
  CRISPR gRNA sequence
aaacggacggacgggctgga

SEQ ID NO: 543004 - DNA, 20 bp, Artificial
  CRISPR gRNA sequence
ggacggacgggctggagggc

SEQ ID NO: 543005 - DNA, 20 bp, Artificial
  CRISPR gRNA sequence
cggacgggctggagggctgg

SEQ ID NO: 543006 - DNA, 20 bp, Artificial
  CRISPR gRNA sequence
acgggctggagggctggcag

SEQ ID NO: 543007 - DNA, 20 bp, Artificial
  CRISPR gRNA sequence
cgggctggagggctggcagt

SEQ ID NO: 543008 - DNA, 20 bp, Artificial
  CRISPR gRNA sequence
gggctggagggctggcagtg

SEQ ID NO: 543009 - DNA, 20 bp, Artificial
  CRISPR gRNA sequence
ggagggctggcagtggggtg

SEQ ID NO: 543010 - DNA, 20 bp, Artificial
  CRISPR gRNA sequence
gagggctggcagtggggtgc

SEQ ID NO: 543011 - DNA, 20 bp, Artificial
  CRISPR gRNA sequence
gggctggcagtggggtgcag

SEQ ID NO: 543012 - DNA, 20 bp, Artificial
  CRISPR gRNA sequence
tggcagtggggtgcaggagc

SEQ ID NO: 543013 - DNA, 20 bp, Artificial
  CRISPR gRNA sequence
ggggtgcaggagccagccat

SEQ ID NO: 543014 - DNA, 20 bp, Artificial
  CRISPR gRNA sequence
gccagccatgagaacccctc

SEQ ID NO: 543015 - DNA, 20 bp, Artificial
  CRISPR gRNA sequence
ccatgagaacccctcaagta

SEQ ID NO: 543016 - DNA, 20 bp, Artificial
  CRISPR gRNA sequence
tcaagtacagttgaactcgc

SEQ ID NO: 543017 - DNA, 20 bp, Artificial
  CRISPR gRNA sequence
caagtacagttgaactcgct

SEQ ID NO: 543018 - DNA, 20 bp, Artificial
  CRISPR gRNA sequence
agtacagttgaactcgctgg

SEQ ID NO: 543019 - DNA, 20 bp, Artificial
  CRISPR gRNA sequence
gtacagttgaactcgctggg

SEQ ID NO: 543020 - DNA, 20 bp, Artificial
  CRISPR gRNA sequence
ggaggttactgctgtactcc

SEQ ID NO: 543021 - DNA, 20 bp, Artificial
  CRISPR gRNA sequence
gaggttactgctgtactccc

SEQ ID NO: 543022 - DNA, 20 bp, Artificial
  CRISPR gRNA sequence
aggttactgctgtactcccg

SEQ ID NO: 543023 - DNA, 20 bp, Artificial
  CRISPR gRNA sequence
gtactcccggggttttgcta

SEQ ID NO: 543024 - DNA, 20 bp, Artificial
  CRISPR gRNA sequence
gggttttgctatggcctgac

SEQ ID NO: 543025 - DNA, 20 bp, Artificial
  CRISPR gRNA sequence
ggttttgctatggcctgact

SEQ ID NO: 543026 - DNA, 20 bp, Artificial
  CRISPR gRNA sequence
gttttgctatggcctgactg

SEQ ID NO: 543027 - DNA, 20 bp, Artificial
  CRISPR gRNA sequence
gcctgactggggccaatgtg

SEQ ID NO: 543028 - DNA, 20 bp, Artificial
  CRISPR gRNA sequence
ctgactggggccaatgtgtg

SEQ ID NO: 543029 - DNA, 20 bp, Artificial
  CRISPR gRNA sequence
tgactggggccaatgtgtgg

SEQ ID NO: 543030 - DNA, 20 bp, Artificial
  CRISPR gRNA sequence
gactggggccaatgtgtgga

SEQ ID NO: 543031 - DNA, 20 bp, Artificial
  CRISPR gRNA sequence
gggccaatgtgtggagggtg

SEQ ID NO: 543032 - DNA, 20 bp, Artificial
  CRISPR gRNA sequence
ggccaatgtgtggagggtga

SEQ ID NO: 543033 - DNA, 20 bp, Artificial
  CRISPR gRNA sequence
ccaatgtgtggagggtgaag

SEQ ID NO: 543034 - DNA, 20 bp, Artificial
  CRISPR gRNA sequence
caatgtgtggagggtgaagg

SEQ ID NO: 543035 - DNA, 20 bp, Artificial
  CRISPR gRNA sequence
gtgtggagggtgaaggagga

SEQ ID NO: 543036 - DNA, 20 bp, Artificial
  CRISPR gRNA sequence
tgtggagggtgaaggaggat

SEQ ID NO: 543037 - DNA, 20 bp, Artificial
  CRISPR gRNA sequence
gtggagggtgaaggaggatg

SEQ ID NO: 543038 - DNA, 20 bp, Artificial
  CRISPR gRNA sequence
ggagggtgaaggaggatggg

SEQ ID NO: 543039 - DNA, 20 bp, Artificial
  CRISPR gRNA sequence
gagggtgaaggaggatgggg

SEQ ID NO: 543040 - DNA, 20 bp, Artificial
  CRISPR gRNA sequence
aggaggatggggaggcaaaa

SEQ ID NO: 543041 - DNA, 20 bp, Artificial
  CRISPR gRNA sequence
ggaggatggggaggcaaaat

SEQ ID NO: 543042 - DNA, 20 bp, Artificial
  CRISPR gRNA sequence
ggatggggaggcaaaatggg

SEQ ID NO: 543043 - DNA, 20 bp, Artificial
  CRISPR gRNA sequence
tggggaggcaaaatgggaag

SEQ ID NO: 543044 - DNA, 20 bp, Artificial
  CRISPR gRNA sequence
ggggaggcaaaatgggaaga

SEQ ID NO: 543045 - DNA, 20 bp, Artificial
  CRISPR gRNA sequence
gggaggcaaaatgggaagaa

SEQ ID NO: 543046 - DNA, 20 bp, Artificial
  CRISPR gRNA sequence
ggaggcaaaatgggaagaag

SEQ ID NO: 543047 - DNA, 20 bp, Artificial
  CRISPR gRNA sequence
aagaaggggacctatttcct

SEQ ID NO: 543048 - DNA, 20 bp, Artificial
  CRISPR gRNA sequence
agaaggggacctatttcctg

SEQ ID NO: 543049 - DNA, 20 bp, Artificial
  CRISPR gRNA sequence
ctgaggttgttgtgacgact

SEQ ID NO: 543050 - DNA, 20 bp, Artificial
  CRISPR gRNA sequence
acgacttggctgacaacaca

SEQ ID NO: 543051 - DNA, 20 bp, Artificial
  CRISPR gRNA sequence
gacttggctgacaacacacg

SEQ ID NO: 543052 - DNA, 20 bp, Artificial
  CRISPR gRNA sequence
cttggctgacaacacacgga

SEQ ID NO: 543053 - DNA, 20 bp, Artificial
  CRISPR gRNA sequence
ttggctgacaacacacggag

SEQ ID NO: 543054 - DNA, 20 bp, Artificial
  CRISPR gRNA sequence
ctgacaacacacggagagga

SEQ ID NO: 543055 - DNA, 20 bp, Artificial
  CRISPR gRNA sequence
acacacggagaggatggaac

SEQ ID NO: 543056 - DNA, 20 bp, Artificial
  CRISPR gRNA sequence
gatggaaccagttctgatac

SEQ ID NO: 543057 - DNA, 20 bp, Artificial
  CRISPR gRNA sequence
ccagttctgatactagtttt

SEQ ID NO: 543058 - DNA, 20 bp, Artificial
  CRISPR gRNA sequence
cagttctgatactagttttt

SEQ ID NO: 543059 - DNA, 20 bp, Artificial
  CRISPR gRNA sequence
gatactagtttttaggattt

SEQ ID NO: 543060 - DNA, 20 bp, Artificial
  CRISPR gRNA sequence
atactagtttttaggatttg

SEQ ID NO: 543061 - DNA, 20 bp, Artificial
  CRISPR gRNA sequence
tactagtttttaggatttga

SEQ ID NO: 543062 - DNA, 20 bp, Artificial
  CRISPR gRNA sequence
actagtttttaggatttgag

SEQ ID NO: 543063 - DNA, 20 bp, Artificial
  CRISPR gRNA sequence
tagtttttaggatttgaggg

SEQ ID NO: 543064 - DNA, 20 bp, Artificial
  CRISPR gRNA sequence
agtttttaggatttgagggg

SEQ ID NO: 543065 - DNA, 20 bp, Artificial
  CRISPR gRNA sequence
taggatttgaggggaggaaa

SEQ ID NO: 543066 - DNA, 20 bp, Artificial
  CRISPR gRNA sequence
aggatttgaggggaggaaaa

SEQ ID NO: 543067 - DNA, 20 bp, Artificial
  CRISPR gRNA sequence
gatttgaggggaggaaaaag

SEQ ID NO: 543068 - DNA, 20 bp, Artificial
  CRISPR gRNA sequence
ttgaggggaggaaaaaggag

SEQ ID NO: 543069 - DNA, 20 bp, Artificial
  CRISPR gRNA sequence
tgaggggaggaaaaaggagc

SEQ ID NO: 543070 - DNA, 20 bp, Artificial
  CRISPR gRNA sequence
aggggaggaaaaaggagcag

SEQ ID NO: 543071 - DNA, 20 bp, Artificial
  CRISPR gRNA sequence
ggagcaggagtcgcaccact

SEQ ID NO: 543072 - DNA, 20 bp, Artificial
  CRISPR gRNA sequence
gagcaggagtcgcaccactt

SEQ ID NO: 543073 - DNA, 20 bp, Artificial
  CRISPR gRNA sequence
ccacttaggaatcccaacgt

SEQ ID NO: 543074 - DNA, 20 bp, Artificial
  CRISPR gRNA sequence
cacttaggaatcccaacgtg

SEQ ID NO: 543075 - DNA, 20 bp, Artificial
  CRISPR gRNA sequence
aacgtgaggccgctgccgac

SEQ ID NO: 543076 - DNA, 20 bp, Artificial
  CRISPR gRNA sequence
acgtgaggccgctgccgact

SEQ ID NO: 543077 - DNA, 20 bp, Artificial
  CRISPR gRNA sequence
ccgctgccgactgggcttcc

SEQ ID NO: 543078 - DNA, 20 bp, Artificial
  CRISPR gRNA sequence
tgcctacccgctcctcgctg

SEQ ID NO: 543079 - DNA, 20 bp, Artificial
  CRISPR gRNA sequence
gcctacccgctcctcgctgt

SEQ ID NO: 543080 - DNA, 20 bp, Artificial
  CRISPR gRNA sequence
cctacccgctcctcgctgtg

SEQ ID NO: 543081 - DNA, 20 bp, Artificial
  CRISPR gRNA sequence
cgctgtggggcgattctgaa

SEQ ID NO: 543082 - DNA, 20 bp, Artificial
  CRISPR gRNA sequence
aaaagtcctctctgctgata

SEQ ID NO: 543083 - DNA, 20 bp, Artificial
  CRISPR gRNA sequence
agtcctctctgctgatacgg

SEQ ID NO: 543084 - DNA, 20 bp, Artificial
  CRISPR gRNA sequence
ctgatacggcggacgccgcg

SEQ ID NO: 543085 - DNA, 20 bp, Artificial
  CRISPR gRNA sequence
tgatacggcggacgccgcgc

SEQ ID NO: 543086 - DNA, 20 bp, Artificial
  CRISPR gRNA sequence
tacggcggacgccgcgcggg

SEQ ID NO: 543087 - DNA, 20 bp, Artificial
  CRISPR gRNA sequence
acggcggacgccgcgcgggc

SEQ ID NO: 543088 - DNA, 20 bp, Artificial
  CRISPR gRNA sequence
cggcggacgccgcgcgggcg

SEQ ID NO: 543089 - DNA, 20 bp, Artificial
  CRISPR gRNA sequence
ggacgccgcgcgggcgggga

SEQ ID NO: 543090 - DNA, 20 bp, Artificial
  CRISPR gRNA sequence
cgggcggggacggcaccgcg

SEQ ID NO: 543091 - DNA, 20 bp, Artificial
  CRISPR gRNA sequence
gggcggggacggcaccgcgc

SEQ ID NO: 543092 - DNA, 20 bp, Artificial
  CRISPR gRNA sequence
ggcggggacggcaccgcgcg

SEQ ID NO: 543093 - DNA, 20 bp, Artificial
  CRISPR gRNA sequence
cggggacggcaccgcgcggg

SEQ ID NO: 543094 - DNA, 20 bp, Artificial
  CRISPR gRNA sequence
ggggacggcaccgcgcgggg

SEQ ID NO: 543095 - DNA, 20 bp, Artificial
  CRISPR gRNA sequence
gggacggcaccgcgcgggga

SEQ ID NO: 543096 - DNA, 20 bp, Artificial
  CRISPR gRNA sequence
acggcaccgcgcggggaggg

SEQ ID NO: 543097 - DNA, 20 bp, Artificial
  CRISPR gRNA sequence
gcaccgcgcggggagggcag

SEQ ID NO: 543098 - DNA, 20 bp, Artificial
  CRISPR gRNA sequence
caccgcgcggggagggcagc

SEQ ID NO: 543099 - DNA, 20 bp, Artificial
  CRISPR gRNA sequence
gggcagcaggcgtcgccctc

SEQ ID NO: 543100 - DNA, 20 bp, Artificial
  CRISPR gRNA sequence
cagcaggcgtcgccctcgag

SEQ ID NO: 543101 - DNA, 20 bp, Artificial
  CRISPR gRNA sequence
agcaggcgtcgccctcgagc

SEQ ID NO: 543102 - DNA, 20 bp, Artificial
  CRISPR gRNA sequence
aggcgtcgccctcgagcagg

SEQ ID NO: 543103 - DNA, 20 bp, Artificial
  CRISPR gRNA sequence
tccgcgcccgctccccgtcc

SEQ ID NO: 543104 - DNA, 20 bp, Artificial
  CRISPR gRNA sequence
ccgcgcccgctccccgtccc

SEQ ID NO: 543105 - DNA, 20 bp, Artificial
  CRISPR gRNA sequence
ccccgtcccgggcgcgttca

SEQ ID NO: 543106 - DNA, 20 bp, Artificial
  CRISPR gRNA sequence
gtcccgggcgcgttcacggc

SEQ ID NO: 543107 - DNA, 20 bp, Artificial
  CRISPR gRNA sequence
tcccgggcgcgttcacggct

SEQ ID NO: 543108 - DNA, 20 bp, Artificial
  CRISPR gRNA sequence
cacggctgggaaaaattttg

SEQ ID NO: 543109 - DNA, 20 bp, Artificial
  CRISPR gRNA sequence
aaaaattttgcagtccgctg

SEQ ID NO: 543110 - DNA, 20 bp, Artificial
  CRISPR gRNA sequence
ttgcagtccgctgaagcgct

SEQ ID NO: 543111 - DNA, 20 bp, Artificial
  CRISPR gRNA sequence
gaagcgctcagcgacgttac

SEQ ID NO: 543112 - DNA, 20 bp, Artificial
  CRISPR gRNA sequence
aagcgctcagcgacgttact

SEQ ID NO: 543113 - DNA, 20 bp, Artificial
  CRISPR gRNA sequence
agcgctcagcgacgttactg

SEQ ID NO: 543114 - DNA, 20 bp, Artificial
  CRISPR gRNA sequence
gctcagcgacgttactgggg

SEQ ID NO: 543115 - DNA, 20 bp, Artificial
  CRISPR gRNA sequence
gcgacgttactggggaagcc

SEQ ID NO: 543116 - DNA, 20 bp, Artificial
  CRISPR gRNA sequence
cgacgttactggggaagccc

SEQ ID NO: 543117 - DNA, 20 bp, Artificial
  CRISPR gRNA sequence
cgttactggggaagcccagg

SEQ ID NO: 543118 - DNA, 20 bp, Artificial
  CRISPR gRNA sequence
gttactggggaagcccagga

SEQ ID NO: 543119 - DNA, 20 bp, Artificial
  CRISPR gRNA sequence
gggaagcccaggaaggaact

SEQ ID NO: 543120 - DNA, 20 bp, Artificial
  CRISPR gRNA sequence
ccaggaaggaacttggtcac

SEQ ID NO: 543121 - DNA, 20 bp, Artificial
  CRISPR gRNA sequence
aggaaggaacttggtcactg

SEQ ID NO: 543122 - DNA, 20 bp, Artificial
  CRISPR gRNA sequence
ggaacttggtcactggagct

SEQ ID NO: 543123 - DNA, 20 bp, Artificial
  CRISPR gRNA sequence
gaacttggtcactggagctc

SEQ ID NO: 543124 - DNA, 20 bp, Artificial
  CRISPR gRNA sequence
acttggtcactggagctcgg

SEQ ID NO: 543125 - DNA, 20 bp, Artificial
  CRISPR gRNA sequence
cttggtcactggagctcggg

SEQ ID NO: 543126 - DNA, 20 bp, Artificial
  CRISPR gRNA sequence
ttggtcactggagctcggga

SEQ ID NO: 543127 - DNA, 20 bp, Artificial
  CRISPR gRNA sequence
tggtcactggagctcgggag

SEQ ID NO: 543128 - DNA, 20 bp, Artificial
  CRISPR gRNA sequence
ggtcactggagctcgggagg

SEQ ID NO: 543129 - DNA, 20 bp, Artificial
  CRISPR gRNA sequence
actggagctcgggagggggc

SEQ ID NO: 543130 - DNA, 20 bp, Artificial
  CRISPR gRNA sequence
ggagctcgggagggggccgg

SEQ ID NO: 543131 - DNA, 20 bp, Artificial
  CRISPR gRNA sequence
gagctcgggagggggccggc

SEQ ID NO: 543132 - DNA, 20 bp, Artificial
  CRISPR gRNA sequence
agctcgggagggggccggcg

SEQ ID NO: 543133 - DNA, 20 bp, Artificial
  CRISPR gRNA sequence
gctcgggagggggccggcgg

SEQ ID NO: 543134 - DNA, 20 bp, Artificial
  CRISPR gRNA sequence
ctcgggagggggccggcggg

SEQ ID NO: 543135 - DNA, 20 bp, Artificial
  CRISPR gRNA sequence
tcgggagggggccggcgggg

SEQ ID NO: 543136 - DNA, 20 bp, Artificial
  CRISPR gRNA sequence
agggggccggcgggggggcg

SEQ ID NO: 543137 - DNA, 20 bp, Artificial
  CRISPR gRNA sequence
gggggccggcgggggggcgc

SEQ ID NO: 543138 - DNA, 20 bp, Artificial
  CRISPR gRNA sequence
gcgggggggcgcaggccccg

SEQ ID NO: 543139 - DNA, 20 bp, Artificial
  CRISPR gRNA sequence
cgggggggcgcaggccccgc

SEQ ID NO: 543140 - DNA, 20 bp, Artificial
  CRISPR gRNA sequence
ggggggcgcaggccccgcag

SEQ ID NO: 543141 - DNA, 20 bp, Artificial
  CRISPR gRNA sequence
ggggcgcaggccccgcagga

SEQ ID NO: 543142 - DNA, 20 bp, Artificial
  CRISPR gRNA sequence
gggcgcaggccccgcaggag

SEQ ID NO: 543143 - DNA, 20 bp, Artificial
  CRISPR gRNA sequence
gcaggccccgcaggagaggc

SEQ ID NO: 543144 - DNA, 20 bp, Artificial
  CRISPR gRNA sequence
ggccccgcaggagaggctag

SEQ ID NO: 543145 - DNA, 20 bp, Artificial
  CRISPR gRNA sequence
gccccgcaggagaggctagc

SEQ ID NO: 543146 - DNA, 20 bp, Artificial
  CRISPR gRNA sequence
cgcaggagaggctagcgggc

SEQ ID NO: 543147 - DNA, 20 bp, Artificial
  CRISPR gRNA sequence
caggagaggctagcgggccg

SEQ ID NO: 543148 - DNA, 20 bp, Artificial
  CRISPR gRNA sequence
gccggagcccgtccttccct

SEQ ID NO: 543149 - DNA, 20 bp, Artificial
  CRISPR gRNA sequence
ccggagcccgtccttcccta

SEQ ID NO: 543150 - DNA, 20 bp, Artificial
  CRISPR gRNA sequence
cgtccttccctaaggccaca

SEQ ID NO: 543151 - DNA, 20 bp, Artificial
  CRISPR gRNA sequence
cagttccttgctgactccat

SEQ ID NO: 543152 - DNA, 20 bp, Artificial
  CRISPR gRNA sequence
agttccttgctgactccatg

SEQ ID NO: 543153 - DNA, 20 bp, Artificial
  CRISPR gRNA sequence
gttccttgctgactccatga

SEQ ID NO: 543154 - DNA, 20 bp, Artificial
  CRISPR gRNA sequence
gctgactccatgagggacac

SEQ ID NO: 543155 - DNA, 20 bp, Artificial
  CRISPR gRNA sequence
aacaactttctcttcctgaa

SEQ ID NO: 543156 - DNA, 20 bp, Artificial
  CRISPR gRNA sequence
acaactttctcttcctgaaa

SEQ ID NO: 543157 - DNA, 20 bp, Artificial
  CRISPR gRNA sequence
tcttcctgaaaaggctccca

SEQ ID NO: 543158 - DNA, 20 bp, Artificial
  CRISPR gRNA sequence
ctgaaaaggctcccacggct

SEQ ID NO: 543159 - DNA, 20 bp, Artificial
  CRISPR gRNA sequence
tcccacggctgagttgttcc

SEQ ID NO: 543160 - DNA, 20 bp, Artificial
  CRISPR gRNA sequence
gctgagttgttcccggccca

SEQ ID NO: 543161 - DNA, 20 bp, Artificial
  CRISPR gRNA sequence
cgtccccacccgtctctgat

SEQ ID NO: 543162 - DNA, 20 bp, Artificial
  CRISPR gRNA sequence
ctctgatcggcaaccgcctc

SEQ ID NO: 543163 - DNA, 20 bp, Artificial
  CRISPR gRNA sequence
atcggcaaccgcctcgagcc

SEQ ID NO: 543164 - DNA, 20 bp, Artificial
  CRISPR gRNA sequence
tcgagcccggcgcgtccacc

SEQ ID NO: 543165 - DNA, 20 bp, Artificial
  CRISPR gRNA sequence
cccggcgcgtccacccagcc

SEQ ID NO: 543166 - DNA, 20 bp, Artificial
  CRISPR gRNA sequence
ccggcgcgtccacccagcct

SEQ ID NO: 543167 - DNA, 20 bp, Artificial
  CRISPR gRNA sequence
cacccagcctgggtgctgcc

SEQ ID NO: 543168 - DNA, 20 bp, Artificial
  CRISPR gRNA sequence
gggtgctgcccagtacccgc

SEQ ID NO: 543169 - DNA, 20 bp, Artificial
  CRISPR gRNA sequence
gctgcccagtacccgccggc

SEQ ID NO: 543170 - DNA, 20 bp, Artificial
  CRISPR gRNA sequence
ccagtacccgccggccggcg

SEQ ID NO: 543171 - DNA, 20 bp, Artificial
  CRISPR gRNA sequence
cagtacccgccggccggcgc

SEQ ID NO: 543172 - DNA, 20 bp, Artificial
  CRISPR gRNA sequence
agtacccgccggccggcgcg

SEQ ID NO: 543173 - DNA, 20 bp, Artificial
  CRISPR gRNA sequence
gccggccggcgcggggcccc

SEQ ID NO: 543174 - DNA, 20 bp, Artificial
  CRISPR gRNA sequence
ccggccggcgcggggcccct

SEQ ID NO: 543175 - DNA, 20 bp, Artificial
  CRISPR gRNA sequence
cggccggcgcggggcccctg

SEQ ID NO: 543176 - DNA, 20 bp, Artificial
  CRISPR gRNA sequence
ccggcgcggggcccctgggg

SEQ ID NO: 543177 - DNA, 20 bp, Artificial
  CRISPR gRNA sequence
cggcgcggggcccctggggc

SEQ ID NO: 543178 - DNA, 20 bp, Artificial
  CRISPR gRNA sequence
ggggcaggcttcactcacca

SEQ ID NO: 543179 - DNA, 20 bp, Artificial
  CRISPR gRNA sequence
gcaggcttcactcaccaaag

SEQ ID NO: 543180 - DNA, 20 bp, Artificial
  CRISPR gRNA sequence
cttcactcaccaaagcagtg

SEQ ID NO: 543181 - DNA, 20 bp, Artificial
  CRISPR gRNA sequence
cactcaccaaagcagtgcag

SEQ ID NO: 543182 - DNA, 20 bp, Artificial
  CRISPR gRNA sequence
actcaccaaagcagtgcagc

SEQ ID NO: 543183 - DNA, 20 bp, Artificial
  CRISPR gRNA sequence
caccaaagcagtgcagcagg

SEQ ID NO: 543184 - DNA, 20 bp, Artificial
  CRISPR gRNA sequence
tgcagcaggcagaccacgct

SEQ ID NO: 543185 - DNA, 20 bp, Artificial
  CRISPR gRNA sequence
gcagcaggcagaccacgctg

SEQ ID NO: 543186 - DNA, 20 bp, Artificial
  CRISPR gRNA sequence
cagaccacgctgaggacccc

SEQ ID NO: 543187 - DNA, 20 bp, Artificial
  CRISPR gRNA sequence
agaccacgctgaggaccccc

SEQ ID NO: 543188 - DNA, 20 bp, Artificial
  CRISPR gRNA sequence
gaccacgctgaggaccccca

SEQ ID NO: 543189 - DNA, 20 bp, Artificial
  CRISPR gRNA sequence
ggcccgccccgcgtcgctcc

SEQ ID NO: 543190 - DNA, 20 bp, Artificial
  CRISPR gRNA sequence
cgcgtcgctcccagcaacca

SEQ ID NO: 543191 - DNA, 20 bp, Artificial
  CRISPR gRNA sequence
tcccagcaaccatggctcgt

SEQ ID NO: 543192 - DNA, 20 bp, Artificial
  CRISPR gRNA sequence
cccagcaaccatggctcgtc

SEQ ID NO: 543193 - DNA, 20 bp, Artificial
  CRISPR gRNA sequence
gcaaccatggctcgtcgggc

SEQ ID NO: 543194 - DNA, 20 bp, Artificial
  CRISPR gRNA sequence
cgtcgggccggcctctgcgc

SEQ ID NO: 543195 - DNA, 20 bp, Artificial
  CRISPR gRNA sequence
ccggcctctgcgcgagtgcc

SEQ ID NO: 543196 - DNA, 20 bp, Artificial
  CRISPR gRNA sequence
ctgcgcgagtgcccagccac

SEQ ID NO: 543197 - DNA, 20 bp, Artificial
  CRISPR gRNA sequence
cgcgagtgcccagccacaag

SEQ ID NO: 543198 - DNA, 20 bp, Artificial
  CRISPR gRNA sequence
gcccagccacaagcagccct

SEQ ID NO: 543199 - DNA, 20 bp, Artificial
  CRISPR gRNA sequence
ccacaagcagccctaagttc

SEQ ID NO: 543200 - DNA, 20 bp, Artificial
  CRISPR gRNA sequence
aagttcaagcaccgcctacg

SEQ ID NO: 543201 - DNA, 20 bp, Artificial
  CRISPR gRNA sequence
tcaagcaccgcctacgcggt

SEQ ID NO: 543202 - DNA, 20 bp, Artificial
  CRISPR gRNA sequence
gcaccgcctacgcggtcggc

SEQ ID NO: 543203 - DNA, 20 bp, Artificial
  CRISPR gRNA sequence
ccgcctacgcggtcggccag

SEQ ID NO: 543204 - DNA, 20 bp, Artificial
  CRISPR gRNA sequence
cctacgcggtcggccagaag

SEQ ID NO: 543205 - DNA, 20 bp, Artificial
  CRISPR gRNA sequence
ctacgcggtcggccagaagt

SEQ ID NO: 543206 - DNA, 20 bp, Artificial
  CRISPR gRNA sequence
tacgcggtcggccagaagta

SEQ ID NO: 543207 - DNA, 20 bp, Artificial
  CRISPR gRNA sequence
agtagggctccgccccgccc

SEQ ID NO: 543208 - DNA, 20 bp, Artificial
  CRISPR gRNA sequence
gtagggctccgccccgccct

SEQ ID NO: 543209 - DNA, 20 bp, Artificial
  CRISPR gRNA sequence
ggctccgccccgccctgggc

SEQ ID NO: 543210 - DNA, 20 bp, Artificial
  CRISPR gRNA sequence
tccgccccgccctgggctgg

SEQ ID NO: 543211 - DNA, 20 bp, Artificial
  CRISPR gRNA sequence
ccccgccctgggctggcagc

SEQ ID NO: 543212 - DNA, 20 bp, Artificial
  CRISPR gRNA sequence
cgccctgggctggcagccgg

SEQ ID NO: 543213 - DNA, 20 bp, Artificial
  CRISPR gRNA sequence
tggcagccggcggcccgccc

SEQ ID NO: 543214 - DNA, 20 bp, Artificial
  CRISPR gRNA sequence
ccttcctcccccaccctccg

SEQ ID NO: 543215 - DNA, 20 bp, Artificial
  CRISPR gRNA sequence
gtcttcgcgcttccactccc

SEQ ID NO: 543216 - DNA, 20 bp, Artificial
  CRISPR gRNA sequence
tcttcgcgcttccactcccc

SEQ ID NO: 543217 - DNA, 20 bp, Artificial
  CRISPR gRNA sequence
ccactccccgggcgcgcctc

SEQ ID NO: 543218 - DNA, 20 bp, Artificial
  CRISPR gRNA sequence
cccgggcgcgcctctggcct

SEQ ID NO: 543219 - DNA, 20 bp, Artificial
  CRISPR gRNA sequence
ggaaggaggcgcgcagagcc

SEQ ID NO: 543220 - DNA, 20 bp, Artificial
  CRISPR gRNA sequence
gaaggaggcgcgcagagccg

SEQ ID NO: 543221 - DNA, 20 bp, Artificial
  CRISPR gRNA sequence
gaggcgcgcagagccgaggc

SEQ ID NO: 543222 - DNA, 20 bp, Artificial
  CRISPR gRNA sequence
ggcgcgcagagccgaggcca

SEQ ID NO: 543223 - DNA, 20 bp, Artificial
  CRISPR gRNA sequence
gcgcgcagagccgaggccag

SEQ ID NO: 543224 - DNA, 20 bp, Artificial
  CRISPR gRNA sequence
gccgaggccagaggcgcgcc

SEQ ID NO: 543225 - DNA, 20 bp, Artificial
  CRISPR gRNA sequence
ccgaggccagaggcgcgccc

SEQ ID NO: 543226 - DNA, 20 bp, Artificial
  CRISPR gRNA sequence
cgaggccagaggcgcgcccg

SEQ ID NO: 543227 - DNA, 20 bp, Artificial
  CRISPR gRNA sequence
aggccagaggcgcgcccggg

SEQ ID NO: 543228 - DNA, 20 bp, Artificial
  CRISPR gRNA sequence
ccagaggcgcgcccggggag

SEQ ID NO: 543229 - DNA, 20 bp, Artificial
  CRISPR gRNA sequence
gaggcgcgcccggggagtgg

SEQ ID NO: 543230 - DNA, 20 bp, Artificial
  CRISPR gRNA sequence
gcccggggagtggaagcgcg

SEQ ID NO: 543231 - DNA, 20 bp, Artificial
  CRISPR gRNA sequence
tggaagcgcgaagacaaacg

SEQ ID NO: 543232 - DNA, 20 bp, Artificial
  CRISPR gRNA sequence
cgaagacaaacgcggcgccg

SEQ ID NO: 543233 - DNA, 20 bp, Artificial
  CRISPR gRNA sequence
aagacaaacgcggcgccgcg

SEQ ID NO: 543234 - DNA, 20 bp, Artificial
  CRISPR gRNA sequence
agacaaacgcggcgccgcgg

SEQ ID NO: 543235 - DNA, 20 bp, Artificial
  CRISPR gRNA sequence
gacaaacgcggcgccgcgga

SEQ ID NO: 543236 - DNA, 20 bp, Artificial
  CRISPR gRNA sequence
aaacgcggcgccgcggaggg

SEQ ID NO: 543237 - DNA, 20 bp, Artificial
  CRISPR gRNA sequence
aacgcggcgccgcggagggt

SEQ ID NO: 543238 - DNA, 20 bp, Artificial
  CRISPR gRNA sequence
acgcggcgccgcggagggtg

SEQ ID NO: 543239 - DNA, 20 bp, Artificial
  CRISPR gRNA sequence
cgcggcgccgcggagggtgg

SEQ ID NO: 543240 - DNA, 20 bp, Artificial
  CRISPR gRNA sequence
cggcgccgcggagggtgggg

SEQ ID NO: 543241 - DNA, 20 bp, Artificial
  CRISPR gRNA sequence
ggcgccgcggagggtggggg

SEQ ID NO: 543242 - DNA, 20 bp, Artificial
  CRISPR gRNA sequence
gccgcggagggtgggggagg

SEQ ID NO: 543243 - DNA, 20 bp, Artificial
  CRISPR gRNA sequence
ccgcggagggtgggggagga

SEQ ID NO: 543244 - DNA, 20 bp, Artificial
  CRISPR gRNA sequence
cgcggagggtgggggaggaa

SEQ ID NO: 543245 - DNA, 20 bp, Artificial
  CRISPR gRNA sequence
gagggtgggggaggaagggc

SEQ ID NO: 543246 - DNA, 20 bp, Artificial
  CRISPR gRNA sequence
agggtgggggaggaagggcc

SEQ ID NO: 543247 - DNA, 20 bp, Artificial
  CRISPR gRNA sequence
gggtgggggaggaagggccg

SEQ ID NO: 543248 - DNA, 20 bp, Artificial
  CRISPR gRNA sequence
tgggggaggaagggccgggg

SEQ ID NO: 543249 - DNA, 20 bp, Artificial
  CRISPR gRNA sequence
gggggaggaagggccggggc

SEQ ID NO: 543250 - DNA, 20 bp, Artificial
  CRISPR gRNA sequence
gaagggccggggcgggccgc

SEQ ID NO: 543251 - DNA, 20 bp, Artificial
  CRISPR gRNA sequence
cggggcgggccgccggctgc

SEQ ID NO: 543252 - DNA, 20 bp, Artificial
  CRISPR gRNA sequence
cgggccgccggctgccagcc

SEQ ID NO: 543253 - DNA, 20 bp, Artificial
  CRISPR gRNA sequence
gggccgccggctgccagccc

SEQ ID NO: 543254 - DNA, 20 bp, Artificial
  CRISPR gRNA sequence
ggccgccggctgccagccca

SEQ ID NO: 543255 - DNA, 20 bp, Artificial
  CRISPR gRNA sequence
cgccggctgccagcccaggg

SEQ ID NO: 543256 - DNA, 20 bp, Artificial
  CRISPR gRNA sequence
gccggctgccagcccagggc

SEQ ID NO: 543257 - DNA, 20 bp, Artificial
  CRISPR gRNA sequence
ccggctgccagcccagggcg

SEQ ID NO: 543258 - DNA, 20 bp, Artificial
  CRISPR gRNA sequence
gctgccagcccagggcgggg

SEQ ID NO: 543259 - DNA, 20 bp, Artificial
  CRISPR gRNA sequence
tgccagcccagggcggggcg

SEQ ID NO: 543260 - DNA, 20 bp, Artificial
  CRISPR gRNA sequence
gcggggcggagccctacttc

SEQ ID NO: 543261 - DNA, 20 bp, Artificial
  CRISPR gRNA sequence
cctacttctggccgaccgcg

SEQ ID NO: 543262 - DNA, 20 bp, Artificial
  CRISPR gRNA sequence
ctacttctggccgaccgcgt

SEQ ID NO: 543263 - DNA, 20 bp, Artificial
  CRISPR gRNA sequence
cttctggccgaccgcgtagg

SEQ ID NO: 543264 - DNA, 20 bp, Artificial
  CRISPR gRNA sequence
gcgtaggcggtgcttgaact

SEQ ID NO: 543265 - DNA, 20 bp, Artificial
  CRISPR gRNA sequence
cgtaggcggtgcttgaactt

SEQ ID NO: 543266 - DNA, 20 bp, Artificial
  CRISPR gRNA sequence
gtaggcggtgcttgaactta

SEQ ID NO: 543267 - DNA, 20 bp, Artificial
  CRISPR gRNA sequence
cttgaacttagggctgcttg

SEQ ID NO: 543268 - DNA, 20 bp, Artificial
  CRISPR gRNA sequence
aacttagggctgcttgtggc

SEQ ID NO: 543269 - DNA, 20 bp, Artificial
  CRISPR gRNA sequence
acttagggctgcttgtggct

SEQ ID NO: 543270 - DNA, 20 bp, Artificial
  CRISPR gRNA sequence
cttgtggctgggcactcgcg

SEQ ID NO: 543271 - DNA, 20 bp, Artificial
  CRISPR gRNA sequence
tgtggctgggcactcgcgca

SEQ ID NO: 543272 - DNA, 20 bp, Artificial
  CRISPR gRNA sequence
gtggctgggcactcgcgcag

SEQ ID NO: 543273 - DNA, 20 bp, Artificial
  CRISPR gRNA sequence
ctgggcactcgcgcagaggc

SEQ ID NO: 543274 - DNA, 20 bp, Artificial
  CRISPR gRNA sequence
cgcgcagaggccggcccgac

SEQ ID NO: 543275 - DNA, 20 bp, Artificial
  CRISPR gRNA sequence
gaggccggcccgacgagcca

SEQ ID NO: 543276 - DNA, 20 bp, Artificial
  CRISPR gRNA sequence
gcccgacgagccatggttgc

SEQ ID NO: 543277 - DNA, 20 bp, Artificial
  CRISPR gRNA sequence
cccgacgagccatggttgct

SEQ ID NO: 543278 - DNA, 20 bp, Artificial
  CRISPR gRNA sequence
cgacgagccatggttgctgg

SEQ ID NO: 543279 - DNA, 20 bp, Artificial
  CRISPR gRNA sequence
catggttgctgggagcgacg

SEQ ID NO: 543280 - DNA, 20 bp, Artificial
  CRISPR gRNA sequence
atggttgctgggagcgacgc

SEQ ID NO: 543281 - DNA, 20 bp, Artificial
  CRISPR gRNA sequence
tggttgctgggagcgacgcg

SEQ ID NO: 543282 - DNA, 20 bp, Artificial
  CRISPR gRNA sequence
ttgctgggagcgacgcgggg

SEQ ID NO: 543283 - DNA, 20 bp, Artificial
  CRISPR gRNA sequence
tgctgggagcgacgcggggc

SEQ ID NO: 543284 - DNA, 20 bp, Artificial
  CRISPR gRNA sequence
gagcgacgcggggcgggccc

SEQ ID NO: 543285 - DNA, 20 bp, Artificial
  CRISPR gRNA sequence
agcgacgcggggcgggccct

SEQ ID NO: 543286 - DNA, 20 bp, Artificial
  CRISPR gRNA sequence
gcgacgcggggcgggccctg

SEQ ID NO: 543287 - DNA, 20 bp, Artificial
  CRISPR gRNA sequence
cgacgcggggcgggccctgg

SEQ ID NO: 543288 - DNA, 20 bp, Artificial
  CRISPR gRNA sequence
gggcgggccctgggggtcct

SEQ ID NO: 543289 - DNA, 20 bp, Artificial
  CRISPR gRNA sequence
ggccctgggggtcctcagcg

SEQ ID NO: 543290 - DNA, 20 bp, Artificial
  CRISPR gRNA sequence
gtctgcctgctgcactgctt

SEQ ID NO: 543291 - DNA, 20 bp, Artificial
  CRISPR gRNA sequence
gcctgctgcactgctttggt

SEQ ID NO: 543292 - DNA, 20 bp, Artificial
  CRISPR gRNA sequence
ctgcactgctttggtgagtg

SEQ ID NO: 543293 - DNA, 20 bp, Artificial
  CRISPR gRNA sequence
ttggtgagtgaagcctgccc

SEQ ID NO: 543294 - DNA, 20 bp, Artificial
  CRISPR gRNA sequence
tggtgagtgaagcctgcccc

SEQ ID NO: 543295 - DNA, 20 bp, Artificial
  CRISPR gRNA sequence
ggtgagtgaagcctgcccca

SEQ ID NO: 543296 - DNA, 20 bp, Artificial
  CRISPR gRNA sequence
gtgagtgaagcctgccccag

SEQ ID NO: 543297 - DNA, 20 bp, Artificial
  CRISPR gRNA sequence
ctgccccaggggccccgcgc

SEQ ID NO: 543298 - DNA, 20 bp, Artificial
  CRISPR gRNA sequence
cccaggggccccgcgccggc

SEQ ID NO: 543299 - DNA, 20 bp, Artificial
  CRISPR gRNA sequence
aggggccccgcgccggccgg

SEQ ID NO: 543300 - DNA, 20 bp, Artificial
  CRISPR gRNA sequence
ggggccccgcgccggccggc

SEQ ID NO: 543301 - DNA, 20 bp, Artificial
  CRISPR gRNA sequence
ccgcgccggccggcgggtac

SEQ ID NO: 543302 - DNA, 20 bp, Artificial
  CRISPR gRNA sequence
cgcgccggccggcgggtact

SEQ ID NO: 543303 - DNA, 20 bp, Artificial
  CRISPR gRNA sequence
gccggccggcgggtactggg

SEQ ID NO: 543304 - DNA, 20 bp, Artificial
  CRISPR gRNA sequence
ggcgggtactgggcagcacc

SEQ ID NO: 543305 - DNA, 20 bp, Artificial
  CRISPR gRNA sequence
gcgggtactgggcagcaccc

SEQ ID NO: 543306 - DNA, 20 bp, Artificial
  CRISPR gRNA sequence
gtactgggcagcacccaggc

SEQ ID NO: 543307 - DNA, 20 bp, Artificial
  CRISPR gRNA sequence
tactgggcagcacccaggct

SEQ ID NO: 543308 - DNA, 20 bp, Artificial
  CRISPR gRNA sequence
tgggcagcacccaggctggg

SEQ ID NO: 543309 - DNA, 20 bp, Artificial
  CRISPR gRNA sequence
cccaggctgggtggacgcgc

SEQ ID NO: 543310 - DNA, 20 bp, Artificial
  CRISPR gRNA sequence
ccaggctgggtggacgcgcc

SEQ ID NO: 543311 - DNA, 20 bp, Artificial
  CRISPR gRNA sequence
tgggtggacgcgccgggctc

SEQ ID NO: 543312 - DNA, 20 bp, Artificial
  CRISPR gRNA sequence
gggtggacgcgccgggctcg

SEQ ID NO: 543313 - DNA, 20 bp, Artificial
  CRISPR gRNA sequence
tggacgcgccgggctcgagg

SEQ ID NO: 543314 - DNA, 20 bp, Artificial
  CRISPR gRNA sequence
ggctcgaggcggttgccgat

SEQ ID NO: 543315 - DNA, 20 bp, Artificial
  CRISPR gRNA sequence
ctcgaggcggttgccgatca

SEQ ID NO: 543316 - DNA, 20 bp, Artificial
  CRISPR gRNA sequence
aggcggttgccgatcagaga

SEQ ID NO: 543317 - DNA, 20 bp, Artificial
  CRISPR gRNA sequence
ggcggttgccgatcagagac

SEQ ID NO: 543318 - DNA, 20 bp, Artificial
  CRISPR gRNA sequence
ggttgccgatcagagacggg

SEQ ID NO: 543319 - DNA, 20 bp, Artificial
  CRISPR gRNA sequence
gttgccgatcagagacgggt

SEQ ID NO: 543320 - DNA, 20 bp, Artificial
  CRISPR gRNA sequence
ttgccgatcagagacgggtg

SEQ ID NO: 543321 - DNA, 20 bp, Artificial
  CRISPR gRNA sequence
cgatcagagacgggtgggga

SEQ ID NO: 543322 - DNA, 20 bp, Artificial
  CRISPR gRNA sequence
gatcagagacgggtggggac

SEQ ID NO: 543323 - DNA, 20 bp, Artificial
  CRISPR gRNA sequence
cgggtggggacgggtcgctg

SEQ ID NO: 543324 - DNA, 20 bp, Artificial
  CRISPR gRNA sequence
gggtggggacgggtcgctgt

SEQ ID NO: 543325 - DNA, 20 bp, Artificial
  CRISPR gRNA sequence
ggggacgggtcgctgtgggc

SEQ ID NO: 543326 - DNA, 20 bp, Artificial
  CRISPR gRNA sequence
gggacgggtcgctgtgggcc

SEQ ID NO: 543327 - DNA, 20 bp, Artificial
  CRISPR gRNA sequence
gctgtgggccgggaacaact

SEQ ID NO: 543328 - DNA, 20 bp, Artificial
  CRISPR gRNA sequence
ggccgggaacaactcagccg

SEQ ID NO: 543329 - DNA, 20 bp, Artificial
  CRISPR gRNA sequence
gccgggaacaactcagccgt

SEQ ID NO: 543330 - DNA, 20 bp, Artificial
  CRISPR gRNA sequence
cgggaacaactcagccgtgg

SEQ ID NO: 543331 - DNA, 20 bp, Artificial
  CRISPR gRNA sequence
ctcagccgtgggagcctttt

SEQ ID NO: 543332 - DNA, 20 bp, Artificial
  CRISPR gRNA sequence
tcagccgtgggagccttttc

SEQ ID NO: 543333 - DNA, 20 bp, Artificial
  CRISPR gRNA sequence
gccgtgggagccttttcagg

SEQ ID NO: 543334 - DNA, 20 bp, Artificial
  CRISPR gRNA sequence
cgtgggagccttttcaggaa

SEQ ID NO: 543335 - DNA, 20 bp, Artificial
  CRISPR gRNA sequence
ggagccttttcaggaagaga

SEQ ID NO: 543336 - DNA, 20 bp, Artificial
  CRISPR gRNA sequence
gaaagttgttatttcatcgc

SEQ ID NO: 543337 - DNA, 20 bp, Artificial
  CRISPR gRNA sequence
ttcatcgccagtgtccctca

SEQ ID NO: 543338 - DNA, 20 bp, Artificial
  CRISPR gRNA sequence
catcgccagtgtccctcatg

SEQ ID NO: 543339 - DNA, 20 bp, Artificial
  CRISPR gRNA sequence
gccagtgtccctcatggagt

SEQ ID NO: 543340 - DNA, 20 bp, Artificial
  CRISPR gRNA sequence
gtgtccctcatggagtcagc

SEQ ID NO: 543341 - DNA, 20 bp, Artificial
  CRISPR gRNA sequence
tgtccctcatggagtcagca

SEQ ID NO: 543342 - DNA, 20 bp, Artificial
  CRISPR gRNA sequence
ggagtcagcaaggaactgtg

SEQ ID NO: 543343 - DNA, 20 bp, Artificial
  CRISPR gRNA sequence
agcaaggaactgtgtggcct

SEQ ID NO: 543344 - DNA, 20 bp, Artificial
  CRISPR gRNA sequence
gcaaggaactgtgtggcctt

SEQ ID NO: 543345 - DNA, 20 bp, Artificial
  CRISPR gRNA sequence
caaggaactgtgtggcctta

SEQ ID NO: 543346 - DNA, 20 bp, Artificial
  CRISPR gRNA sequence
ggaactgtgtggccttaggg

SEQ ID NO: 543347 - DNA, 20 bp, Artificial
  CRISPR gRNA sequence
gaactgtgtggccttaggga

SEQ ID NO: 543348 - DNA, 20 bp, Artificial
  CRISPR gRNA sequence
tgtgtggccttagggaagga

SEQ ID NO: 543349 - DNA, 20 bp, Artificial
  CRISPR gRNA sequence
gtgtggccttagggaaggac

SEQ ID NO: 543350 - DNA, 20 bp, Artificial
  CRISPR gRNA sequence
ccttagggaaggacgggctc

SEQ ID NO: 543351 - DNA, 20 bp, Artificial
  CRISPR gRNA sequence
aaggacgggctccggcccgc

SEQ ID NO: 543352 - DNA, 20 bp, Artificial
  CRISPR gRNA sequence
cggcccgctagcctctcctg

SEQ ID NO: 543353 - DNA, 20 bp, Artificial
  CRISPR gRNA sequence
ggcccgctagcctctcctgc

SEQ ID NO: 543354 - DNA, 20 bp, Artificial
  CRISPR gRNA sequence
gcccgctagcctctcctgcg

SEQ ID NO: 543355 - DNA, 20 bp, Artificial
  CRISPR gRNA sequence
cggggcctgcgcccccccgc

SEQ ID NO: 543356 - DNA, 20 bp, Artificial
  CRISPR gRNA sequence
ccccccgccggccccctccc

SEQ ID NO: 543357 - DNA, 20 bp, Artificial
  CRISPR gRNA sequence
gccggccccctcccgagctc

SEQ ID NO: 543358 - DNA, 20 bp, Artificial
  CRISPR gRNA sequence
cctcccgagctccagtgacc

SEQ ID NO: 543359 - DNA, 20 bp, Artificial
  CRISPR gRNA sequence
ccagtgaccaagttccttcc

SEQ ID NO: 543360 - DNA, 20 bp, Artificial
  CRISPR gRNA sequence
cagtgaccaagttccttcct

SEQ ID NO: 543361 - DNA, 20 bp, Artificial
  CRISPR gRNA sequence
agttccttcctgggcttccc

SEQ ID NO: 543362 - DNA, 20 bp, Artificial
  CRISPR gRNA sequence
gcttccccagtaacgtcgct

SEQ ID NO: 543363 - DNA, 20 bp, Artificial
  CRISPR gRNA sequence
agtaacgtcgctgagcgctt

SEQ ID NO: 543364 - DNA, 20 bp, Artificial
  CRISPR gRNA sequence
aacgtcgctgagcgcttcag

SEQ ID NO: 543365 - DNA, 20 bp, Artificial
  CRISPR gRNA sequence
gcggactgcaaaatttttcc

SEQ ID NO: 543366 - DNA, 20 bp, Artificial
  CRISPR gRNA sequence
ttcccagccgtgaacgcgcc

SEQ ID NO: 543367 - DNA, 20 bp, Artificial
  CRISPR gRNA sequence
tcccagccgtgaacgcgccc

SEQ ID NO: 543368 - DNA, 20 bp, Artificial
  CRISPR gRNA sequence
agccgtgaacgcgcccggga

SEQ ID NO: 543369 - DNA, 20 bp, Artificial
  CRISPR gRNA sequence
gccgtgaacgcgcccgggac

SEQ ID NO: 543370 - DNA, 20 bp, Artificial
  CRISPR gRNA sequence
ccgtgaacgcgcccgggacg

SEQ ID NO: 543371 - DNA, 20 bp, Artificial
  CRISPR gRNA sequence
gtgaacgcgcccgggacggg

SEQ ID NO: 543372 - DNA, 20 bp, Artificial
  CRISPR gRNA sequence
aacgcgcccgggacggggag

SEQ ID NO: 543373 - DNA, 20 bp, Artificial
  CRISPR gRNA sequence
acgcgcccgggacggggagc

SEQ ID NO: 543374 - DNA, 20 bp, Artificial
  CRISPR gRNA sequence
cccgggacggggagcgggcg

SEQ ID NO: 543375 - DNA, 20 bp, Artificial
  CRISPR gRNA sequence
ggcgcggatgccacctgctc

SEQ ID NO: 543376 - DNA, 20 bp, Artificial
  CRISPR gRNA sequence
gcgcggatgccacctgctcg

SEQ ID NO: 543377 - DNA, 20 bp, Artificial
  CRISPR gRNA sequence
cgcggatgccacctgctcga

SEQ ID NO: 543378 - DNA, 20 bp, Artificial
  CRISPR gRNA sequence
cgcctgctgccctccccgcg

SEQ ID NO: 543379 - DNA, 20 bp, Artificial
  CRISPR gRNA sequence
cggtgccgtccccgcccgcg

SEQ ID NO: 543380 - DNA, 20 bp, Artificial
  CRISPR gRNA sequence
ccgcgcggcgtccgccgtat

SEQ ID NO: 543381 - DNA, 20 bp, Artificial
  CRISPR gRNA sequence
cgcggcgtccgccgtatcag

SEQ ID NO: 543382 - DNA, 20 bp, Artificial
  CRISPR gRNA sequence
cggcgtccgccgtatcagca

SEQ ID NO: 543383 - DNA, 20 bp, Artificial
  CRISPR gRNA sequence
gcgtccgccgtatcagcaga

SEQ ID NO: 543384 - DNA, 20 bp, Artificial
  CRISPR gRNA sequence
cgtccgccgtatcagcagag

SEQ ID NO: 543385 - DNA, 20 bp, Artificial
  CRISPR gRNA sequence
tatcagcagagaggactttt

SEQ ID NO: 543386 - DNA, 20 bp, Artificial
  CRISPR gRNA sequence
gacttttcagaatcgcccca

SEQ ID NO: 543387 - DNA, 20 bp, Artificial
  CRISPR gRNA sequence
tttcagaatcgccccacagc

SEQ ID NO: 543388 - DNA, 20 bp, Artificial
  CRISPR gRNA sequence
ttcagaatcgccccacagcg

SEQ ID NO: 543389 - DNA, 20 bp, Artificial
  CRISPR gRNA sequence
cagaatcgccccacagcgag

SEQ ID NO: 543390 - DNA, 20 bp, Artificial
  CRISPR gRNA sequence
aatcgccccacagcgaggag

SEQ ID NO: 543391 - DNA, 20 bp, Artificial
  CRISPR gRNA sequence
atcgccccacagcgaggagc

SEQ ID NO: 543392 - DNA, 20 bp, Artificial
  CRISPR gRNA sequence
gccccacagcgaggagcggg

SEQ ID NO: 543393 - DNA, 20 bp, Artificial
  CRISPR gRNA sequence
ccccacagcgaggagcgggt

SEQ ID NO: 543394 - DNA, 20 bp, Artificial
  CRISPR gRNA sequence
gcgaggagcgggtaggcaac

SEQ ID NO: 543395 - DNA, 20 bp, Artificial
  CRISPR gRNA sequence
cgaggagcgggtaggcaact

SEQ ID NO: 543396 - DNA, 20 bp, Artificial
  CRISPR gRNA sequence
ggagcgggtaggcaactagg

SEQ ID NO: 543397 - DNA, 20 bp, Artificial
  CRISPR gRNA sequence
gggtaggcaactaggaagcc

SEQ ID NO: 543398 - DNA, 20 bp, Artificial
  CRISPR gRNA sequence
aggcaactaggaagcccagt

SEQ ID NO: 543399 - DNA, 20 bp, Artificial
  CRISPR gRNA sequence
caactaggaagcccagtcgg

SEQ ID NO: 543400 - DNA, 20 bp, Artificial
  CRISPR gRNA sequence
ctaggaagcccagtcggcag

SEQ ID NO: 543401 - DNA, 20 bp, Artificial
  CRISPR gRNA sequence
agtcggcagcggcctcacgt

SEQ ID NO: 543402 - DNA, 20 bp, Artificial
  CRISPR gRNA sequence
gtcggcagcggcctcacgtt

SEQ ID NO: 543403 - DNA, 20 bp, Artificial
  CRISPR gRNA sequence
ggcctcacgttgggattcct

SEQ ID NO: 543404 - DNA, 20 bp, Artificial
  CRISPR gRNA sequence
ctcacgttgggattcctaag

SEQ ID NO: 543405 - DNA, 20 bp, Artificial
  CRISPR gRNA sequence
tcccctcaaatcctaaaaac

SEQ ID NO: 543406 - DNA, 20 bp, Artificial
  CRISPR gRNA sequence
caaatcctaaaaactagtat

SEQ ID NO: 543407 - DNA, 20 bp, Artificial
  CRISPR gRNA sequence
ctaaaaactagtatcagaac

SEQ ID NO: 543408 - DNA, 20 bp, Artificial
  CRISPR gRNA sequence
ccatcctctccgtgtgttgt

SEQ ID NO: 543409 - DNA, 20 bp, Artificial
  CRISPR gRNA sequence
ctctccgtgtgttgtcagcc

SEQ ID NO: 543410 - DNA, 20 bp, Artificial
  CRISPR gRNA sequence
ccaagtcgtcacaacaacct

SEQ ID NO: 543411 - DNA, 20 bp, Artificial
  CRISPR gRNA sequence
caagtcgtcacaacaacctc

SEQ ID NO: 543412 - DNA, 20 bp, Artificial
  CRISPR gRNA sequence
gtcacaacaacctcaggaaa

SEQ ID NO: 543413 - DNA, 20 bp, Artificial
  CRISPR gRNA sequence
tcacaacaacctcaggaaat

SEQ ID NO: 543414 - DNA, 20 bp, Artificial
  CRISPR gRNA sequence
ctccttcaccctccacacat

SEQ ID NO: 543415 - DNA, 20 bp, Artificial
  CRISPR gRNA sequence
caccctccacacattggccc

SEQ ID NO: 543416 - DNA, 20 bp, Artificial
  CRISPR gRNA sequence
ctccacacattggccccagt

SEQ ID NO: 543417 - DNA, 20 bp, Artificial
  CRISPR gRNA sequence
tccacacattggccccagtc

SEQ ID NO: 543418 - DNA, 20 bp, Artificial
  CRISPR gRNA sequence
cattggccccagtcaggcca

SEQ ID NO: 543419 - DNA, 20 bp, Artificial
  CRISPR gRNA sequence
gtcaggccatagcaaaaccc

SEQ ID NO: 543420 - DNA, 20 bp, Artificial
  CRISPR gRNA sequence
tcaggccatagcaaaacccc

SEQ ID NO: 543421 - DNA, 20 bp, Artificial
  CRISPR gRNA sequence
aggccatagcaaaaccccgg

SEQ ID NO: 543422 - DNA, 20 bp, Artificial
  CRISPR gRNA sequence
atagcaaaaccccgggagta

SEQ ID NO: 543423 - DNA, 20 bp, Artificial
  CRISPR gRNA sequence
gcaaaaccccgggagtacag

SEQ ID NO: 543424 - DNA, 20 bp, Artificial
  CRISPR gRNA sequence
ggagtacagcagtaacctcc

SEQ ID NO: 543425 - DNA, 20 bp, Artificial
  CRISPR gRNA sequence
tacagcagtaacctcccagc

SEQ ID NO: 543426 - DNA, 20 bp, Artificial
  CRISPR gRNA sequence
cagcgagttcaactgtactt

SEQ ID NO: 543427 - DNA, 20 bp, Artificial
  CRISPR gRNA sequence
agcgagttcaactgtacttg

SEQ ID NO: 543428 - DNA, 20 bp, Artificial
  CRISPR gRNA sequence
gcgagttcaactgtacttga

SEQ ID NO: 543429 - DNA, 20 bp, Artificial
  CRISPR gRNA sequence
cgagttcaactgtacttgag

SEQ ID NO: 543430 - DNA, 20 bp, Artificial
  CRISPR gRNA sequence
ctgtacttgaggggttctca

SEQ ID NO: 543431 - DNA, 20 bp, Artificial
  CRISPR gRNA sequence
acttgaggggttctcatggc

SEQ ID NO: 543432 - DNA, 20 bp, Artificial
  CRISPR gRNA sequence
tggctcctgcaccccactgc

SEQ ID NO: 543433 - DNA, 20 bp, Artificial
  CRISPR gRNA sequence
gcaccccactgccagccctc

SEQ ID NO: 543434 - DNA, 20 bp, Artificial
  CRISPR gRNA sequence
agcccgtccgtccgtttgct

SEQ ID NO: 543435 - DNA, 20 bp, Artificial
  CRISPR gRNA sequence
ctcagcgtccgctgcctgcc

SEQ ID NO: 543436 - DNA, 20 bp, Artificial
  CRISPR gRNA sequence
tcagcgtccgctgcctgccc

SEQ ID NO: 543437 - DNA, 20 bp, Artificial
  CRISPR gRNA sequence
agcgtccgctgcctgcccgg

SEQ ID NO: 543438 - DNA, 20 bp, Artificial
  CRISPR gRNA sequence
gcgtccgctgcctgcccggg

SEQ ID NO: 543439 - DNA, 20 bp, Artificial
  CRISPR gRNA sequence
gaggtgcgcgtgtgcatcta

SEQ ID NO: 543440 - DNA, 20 bp, Artificial
  CRISPR gRNA sequence
gtgcgcgtgtgcatctatgg

SEQ ID NO: 543441 - DNA, 20 bp, Artificial
  CRISPR gRNA sequence
gcgtgtgcatctatggaaga

SEQ ID NO: 543442 - DNA, 20 bp, Artificial
  CRISPR gRNA sequence
tgcatctatggaagacagcc

SEQ ID NO: 543443 - DNA, 20 bp, Artificial
  CRISPR gRNA sequence
gcatctatggaagacagcca

SEQ ID NO: 543444 - DNA, 20 bp, Artificial
  CRISPR gRNA sequence
catctatggaagacagccaa

SEQ ID NO: 543445 - DNA, 20 bp, Artificial
  CRISPR gRNA sequence
atctatggaagacagccaag

SEQ ID NO: 543446 - DNA, 20 bp, Artificial
  CRISPR gRNA sequence
tctatggaagacagccaagg

SEQ ID NO: 543447 - DNA, 20 bp, Artificial
  CRISPR gRNA sequence
tatggaagacagccaagggg

SEQ ID NO: 543448 - DNA, 20 bp, Artificial
  CRISPR gRNA sequence
atggaagacagccaaggggg

SEQ ID NO: 543449 - DNA, 20 bp, Artificial
  CRISPR gRNA sequence
tggaagacagccaaggggga

SEQ ID NO: 543450 - DNA, 20 bp, Artificial
  CRISPR gRNA sequence
ggaagacagccaagggggag

SEQ ID NO: 543451 - DNA, 20 bp, Artificial
  CRISPR gRNA sequence
acagccaagggggaggggtt

SEQ ID NO: 543452 - DNA, 20 bp, Artificial
  CRISPR gRNA sequence
ccaagggggaggggttgaga

SEQ ID NO: 543453 - DNA, 20 bp, Artificial
  CRISPR gRNA sequence
aggggttgagatagactcaa

SEQ ID NO: 543454 - DNA, 20 bp, Artificial
  CRISPR gRNA sequence
ctcaaaagtacccgcacgat

SEQ ID NO: 543455 - DNA, 20 bp, Artificial
  CRISPR gRNA sequence
aagtacccgcacgatcagat

SEQ ID NO: 543456 - DNA, 20 bp, Artificial
  CRISPR gRNA sequence
acccgcacgatcagataagt

SEQ ID NO: 543457 - DNA, 20 bp, Artificial
  CRISPR gRNA sequence
atcagataagtcagtgttgt

SEQ ID NO: 543458 - DNA, 20 bp, Artificial
  CRISPR gRNA sequence
cagataagtcagtgttgtaa

SEQ ID NO: 543459 - DNA, 20 bp, Artificial
  CRISPR gRNA sequence
agataagtcagtgttgtaag

SEQ ID NO: 543460 - DNA, 20 bp, Artificial
  CRISPR gRNA sequence
agtcagtgttgtaagaggcc

SEQ ID NO: 543461 - DNA, 20 bp, Artificial
  CRISPR gRNA sequence
gtcagtgttgtaagaggcct

SEQ ID NO: 543462 - DNA, 20 bp, Artificial
  CRISPR gRNA sequence
gtgttgtaagaggcctgggc

SEQ ID NO: 543463 - DNA, 20 bp, Artificial
  CRISPR gRNA sequence
tgttgtaagaggcctgggct

SEQ ID NO: 543464 - DNA, 20 bp, Artificial
  CRISPR gRNA sequence
taagaggcctgggctgggcg

SEQ ID NO: 543465 - DNA, 20 bp, Artificial
  CRISPR gRNA sequence
gaggcctgggctgggcgtgg

SEQ ID NO: 543466 - DNA, 20 bp, Artificial
  CRISPR gRNA sequence
gtggcttacacctgtcatcc

SEQ ID NO: 543467 - DNA, 20 bp, Artificial
  CRISPR gRNA sequence
cacctgtcatcctagcactt

SEQ ID NO: 543468 - DNA, 20 bp, Artificial
  CRISPR gRNA sequence
acctgtcatcctagcacttt

SEQ ID NO: 543469 - DNA, 20 bp, Artificial
  CRISPR gRNA sequence
ctgtcatcctagcactttgg

SEQ ID NO: 543470 - DNA, 20 bp, Artificial
  CRISPR gRNA sequence
tgtcatcctagcactttggg

SEQ ID NO: 543471 - DNA, 20 bp, Artificial
  CRISPR gRNA sequence
tcctagcactttgggaggct

SEQ ID NO: 543472 - DNA, 20 bp, Artificial
  CRISPR gRNA sequence
cctagcactttgggaggctg

SEQ ID NO: 543473 - DNA, 20 bp, Artificial
  CRISPR gRNA sequence
agcactttgggaggctgagg

SEQ ID NO: 543474 - DNA, 20 bp, Artificial
  CRISPR gRNA sequence
gcactttgggaggctgaggc

SEQ ID NO: 543475 - DNA, 20 bp, Artificial
  CRISPR gRNA sequence
ctttgggaggctgaggcagg

SEQ ID NO: 543476 - DNA, 20 bp, Artificial
  CRISPR gRNA sequence
ctgaggcaggtggatcactt

SEQ ID NO: 543477 - DNA, 20 bp, Artificial
  CRISPR gRNA sequence
tgaggcaggtggatcacttg

SEQ ID NO: 543478 - DNA, 20 bp, Artificial
  CRISPR gRNA sequence
gcaggtggatcacttgaggc

SEQ ID NO: 543479 - DNA, 20 bp, Artificial
  CRISPR gRNA sequence
caggtggatcacttgaggcc

SEQ ID NO: 543480 - DNA, 20 bp, Artificial
  CRISPR gRNA sequence
gatcacttgaggccaggaat

SEQ ID NO: 543481 - DNA, 20 bp, Artificial
  CRISPR gRNA sequence
tcacttgaggccaggaatcg

SEQ ID NO: 543482 - DNA, 20 bp, Artificial
  CRISPR gRNA sequence
tgaggccaggaatcggagac

SEQ ID NO: 543483 - DNA, 20 bp, Artificial
  CRISPR gRNA sequence
ggccaggaatcggagaccag

SEQ ID NO: 543484 - DNA, 20 bp, Artificial
  CRISPR gRNA sequence
gccaggaatcggagaccagc

SEQ ID NO: 543485 - DNA, 20 bp, Artificial
  CRISPR gRNA sequence
ccaggaatcggagaccagca

SEQ ID NO: 543486 - DNA, 20 bp, Artificial
  CRISPR gRNA sequence
ggagaccagcagggccaaca

SEQ ID NO: 543487 - DNA, 20 bp, Artificial
  CRISPR gRNA sequence
cagcagggccaacacggtga

SEQ ID NO: 543488 - DNA, 20 bp, Artificial
  CRISPR gRNA sequence
gggccaacacggtgaaagat

SEQ ID NO: 543489 - DNA, 20 bp, Artificial
  CRISPR gRNA sequence
tctacaaaaaatacaaaaat

SEQ ID NO: 543490 - DNA, 20 bp, Artificial
  CRISPR gRNA sequence
aaaaaatacaaaaattagct

SEQ ID NO: 543491 - DNA, 20 bp, Artificial
  CRISPR gRNA sequence
atacaaaaattagctgagcg

SEQ ID NO: 543492 - DNA, 20 bp, Artificial
  CRISPR gRNA sequence
caaaaattagctgagcgtgg

SEQ ID NO: 543493 - DNA, 20 bp, Artificial
  CRISPR gRNA sequence
agcgtggtggcgcataccta

SEQ ID NO: 543494 - DNA, 20 bp, Artificial
  CRISPR gRNA sequence
gtggcgcatacctatagtcc

SEQ ID NO: 543495 - DNA, 20 bp, Artificial
  CRISPR gRNA sequence
tacctatagtcccagctact

SEQ ID NO: 543496 - DNA, 20 bp, Artificial
  CRISPR gRNA sequence
ctatagtcccagctactcgg

SEQ ID NO: 543497 - DNA, 20 bp, Artificial
  CRISPR gRNA sequence
tatagtcccagctactcgga

SEQ ID NO: 543498 - DNA, 20 bp, Artificial
  CRISPR gRNA sequence
tcccagctactcggaaggct

SEQ ID NO: 543499 - DNA, 20 bp, Artificial
  CRISPR gRNA sequence
cccagctactcggaaggctg

SEQ ID NO: 543500 - DNA, 20 bp, Artificial
  CRISPR gRNA sequence
agctactcggaaggctgagg

SEQ ID NO: 543501 - DNA, 20 bp, Artificial
  CRISPR gRNA sequence
gctactcggaaggctgaggt

SEQ ID NO: 543502 - DNA, 20 bp, Artificial
  CRISPR gRNA sequence
tactcggaaggctgaggtgg

SEQ ID NO: 543503 - DNA, 20 bp, Artificial
  CRISPR gRNA sequence
ctgaggtgggagaatcacct

SEQ ID NO: 543504 - DNA, 20 bp, Artificial
  CRISPR gRNA sequence
tgggagaatcacctgagtcc

SEQ ID NO: 543505 - DNA, 20 bp, Artificial
  CRISPR gRNA sequence
ggagaatcacctgagtcccg

SEQ ID NO: 543506 - DNA, 20 bp, Artificial
  CRISPR gRNA sequence
gagaatcacctgagtcccgg

SEQ ID NO: 543507 - DNA, 20 bp, Artificial
  CRISPR gRNA sequence
aatcacctgagtcccggagg

SEQ ID NO: 543508 - DNA, 20 bp, Artificial
  CRISPR gRNA sequence
tcacctgagtcccggaggca

SEQ ID NO: 543509 - DNA, 20 bp, Artificial
  CRISPR gRNA sequence
cacctgagtcccggaggcag

SEQ ID NO: 543510 - DNA, 20 bp, Artificial
  CRISPR gRNA sequence
agtcccggaggcagaggatg

SEQ ID NO: 543511 - DNA, 20 bp, Artificial
  CRISPR gRNA sequence
ccggaggcagaggatgcagt

SEQ ID NO: 543512 - DNA, 20 bp, Artificial
  CRISPR gRNA sequence
gtgattgtgccactgaactc

SEQ ID NO: 543513 - DNA, 20 bp, Artificial
  CRISPR gRNA sequence
tgtgccactgaactccagcc

SEQ ID NO: 543514 - DNA, 20 bp, Artificial
  CRISPR gRNA sequence
gtgccactgaactccagcct

SEQ ID NO: 543515 - DNA, 20 bp, Artificial
  CRISPR gRNA sequence
ctgaactccagcctgggtga

SEQ ID NO: 543516 - DNA, 20 bp, Artificial
  CRISPR gRNA sequence
aaaaaaaaaaaaaaaaaaaa

SEQ ID NO: 543517 - DNA, 20 bp, Artificial
  CRISPR gRNA sequence
aaaaaaaaaaaaaaaaaaaa

SEQ ID NO: 543518 - DNA, 20 bp, Artificial
  CRISPR gRNA sequence
aaaaaaaaaaaaaaaaaggt

SEQ ID NO: 543519 - DNA, 20 bp, Artificial
  CRISPR gRNA sequence
aaaaaaaaaaggtgagctgt

SEQ ID NO: 543520 - DNA, 20 bp, Artificial
  CRISPR gRNA sequence
aaaaaaaaaggtgagctgtg

SEQ ID NO: 543521 - DNA, 20 bp, Artificial
  CRISPR gRNA sequence
aaaaaaaaggtgagctgtga

SEQ ID NO: 543522 - DNA, 20 bp, Artificial
  CRISPR gRNA sequence
aaaggtgagctgtgagggta

SEQ ID NO: 543523 - DNA, 20 bp, Artificial
  CRISPR gRNA sequence
aggtgagctgtgagggtaca

SEQ ID NO: 543524 - DNA, 20 bp, Artificial
  CRISPR gRNA sequence
ggtgagctgtgagggtacag

SEQ ID NO: 543525 - DNA, 20 bp, Artificial
  CRISPR gRNA sequence
gtgagctgtgagggtacaga

SEQ ID NO: 543526 - DNA, 20 bp, Artificial
  CRISPR gRNA sequence
agctgtgagggtacagaggg

SEQ ID NO: 543527 - DNA, 20 bp, Artificial
  CRISPR gRNA sequence
tgtgagggtacagagggaag

SEQ ID NO: 543528 - DNA, 20 bp, Artificial
  CRISPR gRNA sequence
gagggtacagagggaagaag

SEQ ID NO: 543529 - DNA, 20 bp, Artificial
  CRISPR gRNA sequence
agggtacagagggaagaaga

SEQ ID NO: 543530 - DNA, 20 bp, Artificial
  CRISPR gRNA sequence
gtacagagggaagaagaagg

SEQ ID NO: 543531 - DNA, 20 bp, Artificial
  CRISPR gRNA sequence
gcagtctcttttgtgaaatc

SEQ ID NO: 543532 - DNA, 20 bp, Artificial
  CRISPR gRNA sequence
gaaatcaagtgtcttttgtg

SEQ ID NO: 543533 - DNA, 20 bp, Artificial
  CRISPR gRNA sequence
atcaagtgtcttttgtgaag

SEQ ID NO: 543534 - DNA, 20 bp, Artificial
  CRISPR gRNA sequence
cttttgtgaagcagtcttca

SEQ ID NO: 543535 - DNA, 20 bp, Artificial
  CRISPR gRNA sequence
ttttgtgaagcagtcttcat

SEQ ID NO: 543536 - DNA, 20 bp, Artificial
  CRISPR gRNA sequence
ttgtgaagcagtcttcatgg

SEQ ID NO: 543537 - DNA, 20 bp, Artificial
  CRISPR gRNA sequence
tgtgaagcagtcttcatggg

SEQ ID NO: 543538 - DNA, 20 bp, Artificial
  CRISPR gRNA sequence
gtgaagcagtcttcatggga

SEQ ID NO: 543539 - DNA, 20 bp, Artificial
  CRISPR gRNA sequence
gaagcagtcttcatgggagg

SEQ ID NO: 543540 - DNA, 20 bp, Artificial
  CRISPR gRNA sequence
aagcagtcttcatgggaggg

SEQ ID NO: 543541 - DNA, 20 bp, Artificial
  CRISPR gRNA sequence
tcatgggagggaggatattt

SEQ ID NO: 543542 - DNA, 20 bp, Artificial
  CRISPR gRNA sequence
ggagggaggatatttgagcc

SEQ ID NO: 543543 - DNA, 20 bp, Artificial
  CRISPR gRNA sequence
gatatttgagcccagccttc

SEQ ID NO: 543544 - DNA, 20 bp, Artificial
  CRISPR gRNA sequence
atatttgagcccagccttca

SEQ ID NO: 543545 - DNA, 20 bp, Artificial
  CRISPR gRNA sequence
tgagcccagccttcaaggac

SEQ ID NO: 543546 - DNA, 20 bp, Artificial
  CRISPR gRNA sequence
cttcaaggactggtgatgtg

SEQ ID NO: 543547 - DNA, 20 bp, Artificial
  CRISPR gRNA sequence
tgtgtggacatgtgataatg

SEQ ID NO: 543548 - DNA, 20 bp, Artificial
  CRISPR gRNA sequence
gtgtggacatgtgataatgt

SEQ ID NO: 543549 - DNA, 20 bp, Artificial
  CRISPR gRNA sequence
gacatgtgataatgtgggaa

SEQ ID NO: 543550 - DNA, 20 bp, Artificial
  CRISPR gRNA sequence
taatgtgggaaaagattgct

SEQ ID NO: 543551 - DNA, 20 bp, Artificial
  CRISPR gRNA sequence
aagattgctgagtgtcccct

SEQ ID NO: 543552 - DNA, 20 bp, Artificial
  CRISPR gRNA sequence
agattgctgagtgtcccctt

SEQ ID NO: 543553 - DNA, 20 bp, Artificial
  CRISPR gRNA sequence
gattgctgagtgtcccctta

SEQ ID NO: 543554 - DNA, 20 bp, Artificial
  CRISPR gRNA sequence
ttgctgagtgtccccttagg

SEQ ID NO: 543555 - DNA, 20 bp, Artificial
  CRISPR gRNA sequence
gagtgtccccttagggagtc

SEQ ID NO: 543556 - DNA, 20 bp, Artificial
  CRISPR gRNA sequence
ttagggagtctggattctct

SEQ ID NO: 543557 - DNA, 20 bp, Artificial
  CRISPR gRNA sequence
gagtctggattctctgagct

SEQ ID NO: 543558 - DNA, 20 bp, Artificial
  CRISPR gRNA sequence
gtctggattctctgagctga

SEQ ID NO: 543559 - DNA, 20 bp, Artificial
  CRISPR gRNA sequence
ctggattctctgagctgaga

SEQ ID NO: 543560 - DNA, 20 bp, Artificial
  CRISPR gRNA sequence
tgagctgagagagcttctcc

SEQ ID NO: 543561 - DNA, 20 bp, Artificial
  CRISPR gRNA sequence
gagctgagagagcttctcct

SEQ ID NO: 543562 - DNA, 20 bp, Artificial
  CRISPR gRNA sequence
agagcttctcctgggcctta

SEQ ID NO: 543563 - DNA, 20 bp, Artificial
  CRISPR gRNA sequence
gagcttctcctgggccttac

SEQ ID NO: 543564 - DNA, 20 bp, Artificial
  CRISPR gRNA sequence
tctcctgggccttacaggat

SEQ ID NO: 543565 - DNA, 20 bp, Artificial
  CRISPR gRNA sequence
ctcctgggccttacaggatc

SEQ ID NO: 543566 - DNA, 20 bp, Artificial
  CRISPR gRNA sequence
caggatcaggaccatgcgcc

SEQ ID NO: 543567 - DNA, 20 bp, Artificial
  CRISPR gRNA sequence
aggatcaggaccatgcgcct

SEQ ID NO: 543568 - DNA, 20 bp, Artificial
  CRISPR gRNA sequence
atcaggaccatgcgcctggg

SEQ ID NO: 543569 - DNA, 20 bp, Artificial
  CRISPR gRNA sequence
aggaccatgcgcctgggaag

SEQ ID NO: 543570 - DNA, 20 bp, Artificial
  CRISPR gRNA sequence
gcctgggaagaagaatctgt

SEQ ID NO: 543571 - DNA, 20 bp, Artificial
  CRISPR gRNA sequence
agaagaatctgttagcaaca

SEQ ID NO: 543572 - DNA, 20 bp, Artificial
  CRISPR gRNA sequence
aagaatctgttagcaacaaa

SEQ ID NO: 543573 - DNA, 20 bp, Artificial
  CRISPR gRNA sequence
agaatctgttagcaacaaag

SEQ ID NO: 543574 - DNA, 20 bp, Artificial
  CRISPR gRNA sequence
atctgttagcaacaaagagg

SEQ ID NO: 543575 - DNA, 20 bp, Artificial
  CRISPR gRNA sequence
tctgttagcaacaaagagga

SEQ ID NO: 543576 - DNA, 20 bp, Artificial
  CRISPR gRNA sequence
agcaacaaagaggaaggctg

SEQ ID NO: 543577 - DNA, 20 bp, Artificial
  CRISPR gRNA sequence
acaaagaggaaggctgcagt

SEQ ID NO: 543578 - DNA, 20 bp, Artificial
  CRISPR gRNA sequence
caaagaggaaggctgcagtc

SEQ ID NO: 543579 - DNA, 20 bp, Artificial
  CRISPR gRNA sequence
aagaggaaggctgcagtcag

SEQ ID NO: 543580 - DNA, 20 bp, Artificial
  CRISPR gRNA sequence
agaggaaggctgcagtcagg

SEQ ID NO: 543581 - DNA, 20 bp, Artificial
  CRISPR gRNA sequence
aggctgcagtcaggaggaat

SEQ ID NO: 543582 - DNA, 20 bp, Artificial
  CRISPR gRNA sequence
gctgcagtcaggaggaattg

SEQ ID NO: 543583 - DNA, 20 bp, Artificial
  CRISPR gRNA sequence
ctgcagtcaggaggaattgg

SEQ ID NO: 543584 - DNA, 20 bp, Artificial
  CRISPR gRNA sequence
cagtcaggaggaattggagg

SEQ ID NO: 543585 - DNA, 20 bp, Artificial
  CRISPR gRNA sequence
agtcaggaggaattggaggc

SEQ ID NO: 543586 - DNA, 20 bp, Artificial
  CRISPR gRNA sequence
gtcaggaggaattggaggca

SEQ ID NO: 543587 - DNA, 20 bp, Artificial
  CRISPR gRNA sequence
caggaggaattggaggcagg

SEQ ID NO: 543588 - DNA, 20 bp, Artificial
  CRISPR gRNA sequence
aggaggaattggaggcaggg

SEQ ID NO: 543589 - DNA, 20 bp, Artificial
  CRISPR gRNA sequence
ggaattggaggcagggaggc

SEQ ID NO: 543590 - DNA, 20 bp, Artificial
  CRISPR gRNA sequence
attggaggcagggaggccag

SEQ ID NO: 543591 - DNA, 20 bp, Artificial
  CRISPR gRNA sequence
ttggaggcagggaggccaga

SEQ ID NO: 543592 - DNA, 20 bp, Artificial
  CRISPR gRNA sequence
aggcagggaggccagaaggc

SEQ ID NO: 543593 - DNA, 20 bp, Artificial
  CRISPR gRNA sequence
ggcagggaggccagaaggcc

SEQ ID NO: 543594 - DNA, 20 bp, Artificial
  CRISPR gRNA sequence
gcagggaggccagaaggcca

SEQ ID NO: 543595 - DNA, 20 bp, Artificial
  CRISPR gRNA sequence
gggaggccagaaggccaggg

SEQ ID NO: 543596 - DNA, 20 bp, Artificial
  CRISPR gRNA sequence
gccagggtggactaccatca

SEQ ID NO: 543597 - DNA, 20 bp, Artificial
  CRISPR gRNA sequence
ccagggtggactaccatcac

SEQ ID NO: 543598 - DNA, 20 bp, Artificial
  CRISPR gRNA sequence
cagggtggactaccatcaca

SEQ ID NO: 543599 - DNA, 20 bp, Artificial
  CRISPR gRNA sequence
ctaccatcacagggcccaaa

SEQ ID NO: 543600 - DNA, 20 bp, Artificial
  CRISPR gRNA sequence
tcacagggcccaaatagctc

SEQ ID NO: 543601 - DNA, 20 bp, Artificial
  CRISPR gRNA sequence
cacagggcccaaatagctct

SEQ ID NO: 543602 - DNA, 20 bp, Artificial
  CRISPR gRNA sequence
acagggcccaaatagctctg

SEQ ID NO: 543603 - DNA, 20 bp, Artificial
  CRISPR gRNA sequence
agggcccaaatagctctggg

SEQ ID NO: 543604 - DNA, 20 bp, Artificial
  CRISPR gRNA sequence
agctctggggagttcatgtg

SEQ ID NO: 543605 - DNA, 20 bp, Artificial
  CRISPR gRNA sequence
gctctggggagttcatgtgc

SEQ ID NO: 543606 - DNA, 20 bp, Artificial
  CRISPR gRNA sequence
ctggggagttcatgtgcggg

SEQ ID NO: 543607 - DNA, 20 bp, Artificial
  CRISPR gRNA sequence
ggagttcatgtgcgggtggc

SEQ ID NO: 543608 - DNA, 20 bp, Artificial
  CRISPR gRNA sequence
gagttcatgtgcgggtggct

SEQ ID NO: 543609 - DNA, 20 bp, Artificial
  CRISPR gRNA sequence
agttcatgtgcgggtggctg

SEQ ID NO: 543610 - DNA, 20 bp, Artificial
  CRISPR gRNA sequence
atgtgcgggtggctggggaa

SEQ ID NO: 543611 - DNA, 20 bp, Artificial
  CRISPR gRNA sequence
tgcgggtggctggggaaaag

SEQ ID NO: 543612 - DNA, 20 bp, Artificial
  CRISPR gRNA sequence
cgggtggctggggaaaagaa

SEQ ID NO: 543613 - DNA, 20 bp, Artificial
  CRISPR gRNA sequence
gggaaaagaagagatacaaa

SEQ ID NO: 543614 - DNA, 20 bp, Artificial
  CRISPR gRNA sequence
ggaaaagaagagatacaaac

SEQ ID NO: 543615 - DNA, 20 bp, Artificial
  CRISPR gRNA sequence
gaaaagaagagatacaaaca

SEQ ID NO: 543616 - DNA, 20 bp, Artificial
  CRISPR gRNA sequence
acaaacagggattaattgaa

SEQ ID NO: 543617 - DNA, 20 bp, Artificial
  CRISPR gRNA sequence
acagggattaattgaatgga

SEQ ID NO: 543618 - DNA, 20 bp, Artificial
  CRISPR gRNA sequence
cagggattaattgaatggat

SEQ ID NO: 543619 - DNA, 20 bp, Artificial
  CRISPR gRNA sequence
agggattaattgaatggatg

SEQ ID NO: 543620 - DNA, 20 bp, Artificial
  CRISPR gRNA sequence
tggatggggtaactctcctc

SEQ ID NO: 543621 - DNA, 20 bp, Artificial
  CRISPR gRNA sequence
ggatggggtaactctcctcc

SEQ ID NO: 543622 - DNA, 20 bp, Artificial
  CRISPR gRNA sequence
ggggtaactctcctccaggc

SEQ ID NO: 543623 - DNA, 20 bp, Artificial
  CRISPR gRNA sequence
taactctcctccaggcaagc

SEQ ID NO: 543624 - DNA, 20 bp, Artificial
  CRISPR gRNA sequence
caagctggtccctcattccc

SEQ ID NO: 543625 - DNA, 20 bp, Artificial
  CRISPR gRNA sequence
tccctcattccctggcacct

SEQ ID NO: 543626 - DNA, 20 bp, Artificial
  CRISPR gRNA sequence
ccctcattccctggcacctt

SEQ ID NO: 543627 - DNA, 20 bp, Artificial
  CRISPR gRNA sequence
tctcccttccactgcaaacc

SEQ ID NO: 543628 - DNA, 20 bp, Artificial
  CRISPR gRNA sequence
actgcaaacccagtttgccc

SEQ ID NO: 543629 - DNA, 20 bp, Artificial
  CRISPR gRNA sequence
tgcccaagctccacctccaa

SEQ ID NO: 543630 - DNA, 20 bp, Artificial
  CRISPR gRNA sequence
ttatttgaactgtcccttcc

SEQ ID NO: 543631 - DNA, 20 bp, Artificial
  CRISPR gRNA sequence
acctaattcatgtattcatt

SEQ ID NO: 543632 - DNA, 20 bp, Artificial
  CRISPR gRNA sequence
taattcatgtattcattcag

SEQ ID NO: 543633 - DNA, 20 bp, Artificial
  CRISPR gRNA sequence
cattcagaagtcatttgatt

SEQ ID NO: 543634 - DNA, 20 bp, Artificial
  CRISPR gRNA sequence
tatttataaactgctctgca

SEQ ID NO: 543635 - DNA, 20 bp, Artificial
  CRISPR gRNA sequence
atttataaactgctctgcat

SEQ ID NO: 543636 - DNA, 20 bp, Artificial
  CRISPR gRNA sequence
tctgcataggccttaaacta

SEQ ID NO: 543637 - DNA, 20 bp, Artificial
  CRISPR gRNA sequence
ataggccttaaactaaagac

SEQ ID NO: 543638 - DNA, 20 bp, Artificial
  CRISPR gRNA sequence
aaactaaagacaagactgaa

SEQ ID NO: 543639 - DNA, 20 bp, Artificial
  CRISPR gRNA sequence
aactaaagacaagactgaat

SEQ ID NO: 543640 - DNA, 20 bp, Artificial
  CRISPR gRNA sequence
tgaatgggtatatccccttt

SEQ ID NO: 543641 - DNA, 20 bp, Artificial
  CRISPR gRNA sequence
gaatgggtatatcccctttt

SEQ ID NO: 543642 - DNA, 20 bp, Artificial
  CRISPR gRNA sequence
aatgggtatatccccttttg

SEQ ID NO: 543643 - DNA, 20 bp, Artificial
  CRISPR gRNA sequence
atatccccttttggggaccc

SEQ ID NO: 543644 - DNA, 20 bp, Artificial
  CRISPR gRNA sequence
gggacccaagcctgcctcat

SEQ ID NO: 543645 - DNA, 20 bp, Artificial
  CRISPR gRNA sequence
ggacccaagcctgcctcatt

SEQ ID NO: 543646 - DNA, 20 bp, Artificial
  CRISPR gRNA sequence
gacccaagcctgcctcatta

SEQ ID NO: 543647 - DNA, 20 bp, Artificial
  CRISPR gRNA sequence
ccaagcctgcctcattaggg

SEQ ID NO: 543648 - DNA, 20 bp, Artificial
  CRISPR gRNA sequence
cattagggaagctgcaaatg

SEQ ID NO: 543649 - DNA, 20 bp, Artificial
  CRISPR gRNA sequence
gctgcaaatgcagtgattaa

SEQ ID NO: 543650 - DNA, 20 bp, Artificial
  CRISPR gRNA sequence
aatgcagtgattaacagcat

SEQ ID NO: 543651 - DNA, 20 bp, Artificial
  CRISPR gRNA sequence
gtgattaacagcatcagctc

SEQ ID NO: 543652 - DNA, 20 bp, Artificial
  CRISPR gRNA sequence
tgattaacagcatcagctct

SEQ ID NO: 543653 - DNA, 20 bp, Artificial
  CRISPR gRNA sequence
gattaacagcatcagctctg

SEQ ID NO: 543654 - DNA, 20 bp, Artificial
  CRISPR gRNA sequence
aacagcatcagctctggggt

SEQ ID NO: 543655 - DNA, 20 bp, Artificial
  CRISPR gRNA sequence
cagctctggggtcagatgcc

SEQ ID NO: 543656 - DNA, 20 bp, Artificial
  CRISPR gRNA sequence
tggggtcagatgcctagctt

SEQ ID NO: 543657 - DNA, 20 bp, Artificial
  CRISPR gRNA sequence
agatgcctagctttggatcc

SEQ ID NO: 543658 - DNA, 20 bp, Artificial
  CRISPR gRNA sequence
cctggccccactcctcacct

SEQ ID NO: 543659 - DNA, 20 bp, Artificial
  CRISPR gRNA sequence
cctgagtcatgaacttgtgt

SEQ ID NO: 543660 - DNA, 20 bp, Artificial
  CRISPR gRNA sequence
tccctaacttctcttcactt

SEQ ID NO: 543661 - DNA, 20 bp, Artificial
  CRISPR gRNA sequence
cttcagtaccttcacttttg

SEQ ID NO: 543662 - DNA, 20 bp, Artificial
  CRISPR gRNA sequence
tcagtaccttcacttttgaa

SEQ ID NO: 543663 - DNA, 20 bp, Artificial
  CRISPR gRNA sequence
agtaccttcacttttgaaga

SEQ ID NO: 543664 - DNA, 20 bp, Artificial
  CRISPR gRNA sequence
gaagagagtaccactcacat

SEQ ID NO: 543665 - DNA, 20 bp, Artificial
  CRISPR gRNA sequence
aagagagtaccactcacatg

SEQ ID NO: 543666 - DNA, 20 bp, Artificial
  CRISPR gRNA sequence
agagagtaccactcacatga

SEQ ID NO: 543667 - DNA, 20 bp, Artificial
  CRISPR gRNA sequence
agtaccactcacatgaggga

SEQ ID NO: 543668 - DNA, 20 bp, Artificial
  CRISPR gRNA sequence
gtaccactcacatgagggaa

SEQ ID NO: 543669 - DNA, 20 bp, Artificial
  CRISPR gRNA sequence
accactcacatgagggaaag

SEQ ID NO: 543670 - DNA, 20 bp, Artificial
  CRISPR gRNA sequence
agaataataaacccacttca

SEQ ID NO: 543671 - DNA, 20 bp, Artificial
  CRISPR gRNA sequence
aacccacttcatagaattac

SEQ ID NO: 543672 - DNA, 20 bp, Artificial
  CRISPR gRNA sequence
acccacttcatagaattact

SEQ ID NO: 543673 - DNA, 20 bp, Artificial
  CRISPR gRNA sequence
catagaattactgggaacat

SEQ ID NO: 543674 - DNA, 20 bp, Artificial
  CRISPR gRNA sequence
tcatgcaataaatatttact

SEQ ID NO: 543675 - DNA, 20 bp, Artificial
  CRISPR gRNA sequence
ctgagtgtcaattatatgtt

SEQ ID NO: 543676 - DNA, 20 bp, Artificial
  CRISPR gRNA sequence
atatgttaagcactgcacaa

SEQ ID NO: 543677 - DNA, 20 bp, Artificial
  CRISPR gRNA sequence
gttaagcactgcacaatgga

SEQ ID NO: 543678 - DNA, 20 bp, Artificial
  CRISPR gRNA sequence
ttaagcactgcacaatggac

SEQ ID NO: 543679 - DNA, 20 bp, Artificial
  CRISPR gRNA sequence
taagcactgcacaatggacg

SEQ ID NO: 543680 - DNA, 20 bp, Artificial
  CRISPR gRNA sequence
aagcactgcacaatggacgg

SEQ ID NO: 543681 - DNA, 20 bp, Artificial
  CRISPR gRNA sequence
tgcacaatggacgggggata

SEQ ID NO: 543682 - DNA, 20 bp, Artificial
  CRISPR gRNA sequence
caatggacgggggatacagc

SEQ ID NO: 543683 - DNA, 20 bp, Artificial
  CRISPR gRNA sequence
gggatacagcaagctatgca

SEQ ID NO: 543684 - DNA, 20 bp, Artificial
  CRISPR gRNA sequence
cacagttccctgcctttgtg

SEQ ID NO: 543685 - DNA, 20 bp, Artificial
  CRISPR gRNA sequence
cctttgtgaagctcacctta

SEQ ID NO: 543686 - DNA, 20 bp, Artificial
  CRISPR gRNA sequence
tgtgaagctcaccttatagt

SEQ ID NO: 543687 - DNA, 20 bp, Artificial
  CRISPR gRNA sequence
gtgaagctcaccttatagtg

SEQ ID NO: 543688 - DNA, 20 bp, Artificial
  CRISPR gRNA sequence
tgaagctcaccttatagtga

SEQ ID NO: 543689 - DNA, 20 bp, Artificial
  CRISPR gRNA sequence
aagctcaccttatagtgagg

SEQ ID NO: 543690 - DNA, 20 bp, Artificial
  CRISPR gRNA sequence
gctcaccttatagtgaggga

SEQ ID NO: 543691 - DNA, 20 bp, Artificial
  CRISPR gRNA sequence
tcaccttatagtgagggaga

SEQ ID NO: 543692 - DNA, 20 bp, Artificial
  CRISPR gRNA sequence
cttatagtgagggagagaga

SEQ ID NO: 543693 - DNA, 20 bp, Artificial
  CRISPR gRNA sequence
tagtgagggagagagacagt

SEQ ID NO: 543694 - DNA, 20 bp, Artificial
  CRISPR gRNA sequence
gagagagacagtaagtaaat

SEQ ID NO: 543695 - DNA, 20 bp, Artificial
  CRISPR gRNA sequence
taagtaaatgagtaaaaaca

SEQ ID NO: 543696 - DNA, 20 bp, Artificial
  CRISPR gRNA sequence
atgagtaaaaacatggatgc

SEQ ID NO: 543697 - DNA, 20 bp, Artificial
  CRISPR gRNA sequence
gtaaaaacatggatgctgga

SEQ ID NO: 543698 - DNA, 20 bp, Artificial
  CRISPR gRNA sequence
atggatgctggatggtgata

SEQ ID NO: 543699 - DNA, 20 bp, Artificial
  CRISPR gRNA sequence
gtgataaagtaaacatttac

SEQ ID NO: 543700 - DNA, 20 bp, Artificial
  CRISPR gRNA sequence
aaagtaaacatttactagta

SEQ ID NO: 543701 - DNA, 20 bp, Artificial
  CRISPR gRNA sequence
agtaaacatttactagtaca

SEQ ID NO: 543702 - DNA, 20 bp, Artificial
  CRISPR gRNA sequence
acatttactagtacagagat

SEQ ID NO: 543703 - DNA, 20 bp, Artificial
  CRISPR gRNA sequence
tactagtacagagatgagta

SEQ ID NO: 543704 - DNA, 20 bp, Artificial
  CRISPR gRNA sequence
gtacagagatgagtaaagca

SEQ ID NO: 543705 - DNA, 20 bp, Artificial
  CRISPR gRNA sequence
agagatgagtaaagcaaaga

SEQ ID NO: 543706 - DNA, 20 bp, Artificial
  CRISPR gRNA sequence
gagatgagtaaagcaaagaa

SEQ ID NO: 543707 - DNA, 20 bp, Artificial
  CRISPR gRNA sequence
agatgagtaaagcaaagaaa

SEQ ID NO: 543708 - DNA, 20 bp, Artificial
  CRISPR gRNA sequence
gatgagtaaagcaaagaaag

SEQ ID NO: 543709 - DNA, 20 bp, Artificial
  CRISPR gRNA sequence
taaagcaaagaaaggggtga

SEQ ID NO: 543710 - DNA, 20 bp, Artificial
  CRISPR gRNA sequence
agcaaagaaaggggtgatgg

SEQ ID NO: 543711 - DNA, 20 bp, Artificial
  CRISPR gRNA sequence
gatggaagtcgttaatactt

SEQ ID NO: 543712 - DNA, 20 bp, Artificial
  CRISPR gRNA sequence
aagtcgttaatacttcagtt

SEQ ID NO: 543713 - DNA, 20 bp, Artificial
  CRISPR gRNA sequence
agtcgttaatacttcagttt

SEQ ID NO: 543714 - DNA, 20 bp, Artificial
  CRISPR gRNA sequence
gtcgttaatacttcagttta

SEQ ID NO: 543715 - DNA, 20 bp, Artificial
  CRISPR gRNA sequence
tagggttttttttgaaattt

SEQ ID NO: 543716 - DNA, 20 bp, Artificial
  CRISPR gRNA sequence
tttagaacaattaaaatctt

SEQ ID NO: 543717 - DNA, 20 bp, Artificial
  CRISPR gRNA sequence
ttagaacaattaaaatcttt

SEQ ID NO: 543718 - DNA, 20 bp, Artificial
  CRISPR gRNA sequence
aacaattaaaatctttagga

SEQ ID NO: 543719 - DNA, 20 bp, Artificial
  CRISPR gRNA sequence
ctttaggacagttgcaaaat

SEQ ID NO: 543720 - DNA, 20 bp, Artificial
  CRISPR gRNA sequence
ggacagttgcaaaattagta

SEQ ID NO: 543721 - DNA, 20 bp, Artificial
  CRISPR gRNA sequence
gtactttctccttgaatcac

SEQ ID NO: 543722 - DNA, 20 bp, Artificial
  CRISPR gRNA sequence
tcaccagttaactgtcacat

SEQ ID NO: 543723 - DNA, 20 bp, Artificial
  CRISPR gRNA sequence
ttatttttgccaaaccattt

SEQ ID NO: 543724 - DNA, 20 bp, Artificial
  CRISPR gRNA sequence
atttttgccaaaccatttga

SEQ ID NO: 543725 - DNA, 20 bp, Artificial
  CRISPR gRNA sequence
gccaaaccatttgagagttt

SEQ ID NO: 543726 - DNA, 20 bp, Artificial
  CRISPR gRNA sequence
ttctttatcatatgtctcat

SEQ ID NO: 543727 - DNA, 20 bp, Artificial
  CRISPR gRNA sequence
atcatatgtctcataagaac

SEQ ID NO: 543728 - DNA, 20 bp, Artificial
  CRISPR gRNA sequence
catatgtctcataagaacaa

SEQ ID NO: 543729 - DNA, 20 bp, Artificial
  CRISPR gRNA sequence
gaacaagagcattctccaac

SEQ ID NO: 543730 - DNA, 20 bp, Artificial
  CRISPR gRNA sequence
gagcattctccaacaagtca

SEQ ID NO: 543731 - DNA, 20 bp, Artificial
  CRISPR gRNA sequence
gtcacagaatcatcataatc

SEQ ID NO: 543732 - DNA, 20 bp, Artificial
  CRISPR gRNA sequence
atcatcataatctggaaatg

SEQ ID NO: 543733 - DNA, 20 bp, Artificial
  CRISPR gRNA sequence
attgatacaatactgtttcc

SEQ ID NO: 543734 - DNA, 20 bp, Artificial
  CRISPR gRNA sequence
gatacaatactgtttcctgg

SEQ ID NO: 543735 - DNA, 20 bp, Artificial
  CRISPR gRNA sequence
tacaatactgtttcctggta

SEQ ID NO: 543736 - DNA, 20 bp, Artificial
  CRISPR gRNA sequence
ctgtttcctggtagagaacc

SEQ ID NO: 543737 - DNA, 20 bp, Artificial
  CRISPR gRNA sequence
tttcctggtagagaacccag

SEQ ID NO: 543738 - DNA, 20 bp, Artificial
  CRISPR gRNA sequence
ctggtagagaacccagaagc

SEQ ID NO: 543739 - DNA, 20 bp, Artificial
  CRISPR gRNA sequence
cttttttttttttttttttt

SEQ ID NO: 543740 - DNA, 20 bp, Artificial
  CRISPR gRNA sequence
ttttttttttttggtacttt

SEQ ID NO: 543741 - DNA, 20 bp, Artificial
  CRISPR gRNA sequence
ttaagacatcatcatttttg

SEQ ID NO: 543742 - DNA, 20 bp, Artificial
  CRISPR gRNA sequence
atcatcatttttgaagtgtc

SEQ ID NO: 543743 - DNA, 20 bp, Artificial
  CRISPR gRNA sequence
tcatcatttttgaagtgtct

SEQ ID NO: 543744 - DNA, 20 bp, Artificial
  CRISPR gRNA sequence
catttttgaagtgtctgggc

SEQ ID NO: 543745 - DNA, 20 bp, Artificial
  CRISPR gRNA sequence
tgctttaccgaatgtccctt

SEQ ID NO: 543746 - DNA, 20 bp, Artificial
  CRISPR gRNA sequence
accgaatgtccctttggatg

SEQ ID NO: 543747 - DNA, 20 bp, Artificial
  CRISPR gRNA sequence
cctgcttgtttcctcatgat

SEQ ID NO: 543748 - DNA, 20 bp, Artificial
  CRISPR gRNA sequence
gtttcctcatgatcagattc

SEQ ID NO: 543749 - DNA, 20 bp, Artificial
  CRISPR gRNA sequence
attctggttgtaactctttg

SEQ ID NO: 543750 - DNA, 20 bp, Artificial
  CRISPR gRNA sequence
ctggttgtaactctttgtag

SEQ ID NO: 543751 - DNA, 20 bp, Artificial
  CRISPR gRNA sequence
tggttgtaactctttgtagc

SEQ ID NO: 543752 - DNA, 20 bp, Artificial
  CRISPR gRNA sequence
tttgtagcaggaatacttca

SEQ ID NO: 543753 - DNA, 20 bp, Artificial
  CRISPR gRNA sequence
ggaatacttcatagctatgt

SEQ ID NO: 543754 - DNA, 20 bp, Artificial
  CRISPR gRNA sequence
gaatacttcatagctatgtt

SEQ ID NO: 543755 - DNA, 20 bp, Artificial
  CRISPR gRNA sequence
tagctatgttgggtccttct

SEQ ID NO: 543756 - DNA, 20 bp, Artificial
  CRISPR gRNA sequence
tccttctcagtgtgtcacat

SEQ ID NO: 543757 - DNA, 20 bp, Artificial
  CRISPR gRNA sequence
ccttctcagtgtgtcacatc

SEQ ID NO: 543758 - DNA, 20 bp, Artificial
  CRISPR gRNA sequence
tctcagtgtgtcacatcagg

SEQ ID NO: 543759 - DNA, 20 bp, Artificial
  CRISPR gRNA sequence
tgtgtcacatcaggaagatg

SEQ ID NO: 543760 - DNA, 20 bp, Artificial
  CRISPR gRNA sequence
tggtctgtttgtcacattat

SEQ ID NO: 543761 - DNA, 20 bp, Artificial
  CRISPR gRNA sequence
gtctgtttgtcacattattg

SEQ ID NO: 543762 - DNA, 20 bp, Artificial
  CRISPR gRNA sequence
gagatgttaactttgacatt

SEQ ID NO: 543763 - DNA, 20 bp, Artificial
  CRISPR gRNA sequence
ttaactttgacatttggtta

SEQ ID NO: 543764 - DNA, 20 bp, Artificial
  CRISPR gRNA sequence
tttgacatttggttaaagtg

SEQ ID NO: 543765 - DNA, 20 bp, Artificial
  CRISPR gRNA sequence
ttggttaaagtgaagtttac

SEQ ID NO: 543766 - DNA, 20 bp, Artificial
  CRISPR gRNA sequence
tttaccagatttctccattg

SEQ ID NO: 543767 - DNA, 20 bp, Artificial
  CRISPR gRNA sequence
taccagatttctccattgta

SEQ ID NO: 543768 - DNA, 20 bp, Artificial
  CRISPR gRNA sequence
accagatttctccattgtag

SEQ ID NO: 543769 - DNA, 20 bp, Artificial
  CRISPR gRNA sequence
aggcaccattttacctttgt

SEQ ID NO: 543770 - DNA, 20 bp, Artificial
  CRISPR gRNA sequence
taagtaataaatgatgtgtt

SEQ ID NO: 543771 - DNA, 20 bp, Artificial
  CRISPR gRNA sequence
gatgtgttaagtgatgtttt

SEQ ID NO: 543772 - DNA, 20 bp, Artificial
  CRISPR gRNA sequence
atgtgttaagtgatgttttg

SEQ ID NO: 543773 - DNA, 20 bp, Artificial
  CRISPR gRNA sequence
ttaagtgatgttttgaggtt

SEQ ID NO: 543774 - DNA, 20 bp, Artificial
  CRISPR gRNA sequence
tgagtgaatatcctgttctc

SEQ ID NO: 543775 - DNA, 20 bp, Artificial
  CRISPR gRNA sequence
ttctccagccattgttcatt

SEQ ID NO: 543776 - DNA, 20 bp, Artificial
  CRISPR gRNA sequence
tccagccattgttcattcag

SEQ ID NO: 543777 - DNA, 20 bp, Artificial
  CRISPR gRNA sequence
cattgttcattcagtggttt

SEQ ID NO: 543778 - DNA, 20 bp, Artificial
  CRISPR gRNA sequence
tcagtggttttagtatccta

SEQ ID NO: 543779 - DNA, 20 bp, Artificial
  CRISPR gRNA sequence
tatcctatggtgattcttcc

SEQ ID NO: 543780 - DNA, 20 bp, Artificial
  CRISPR gRNA sequence
aatattttattttatttttt

SEQ ID NO: 543781 - DNA, 20 bp, Artificial
  CRISPR gRNA sequence
ttttattttattttttgaga

SEQ ID NO: 543782 - DNA, 20 bp, Artificial
  CRISPR gRNA sequence
tttattttattttttgagac

SEQ ID NO: 543783 - DNA, 20 bp, Artificial
  CRISPR gRNA sequence
ttattttattttttgagaca

SEQ ID NO: 543784 - DNA, 20 bp, Artificial
  CRISPR gRNA sequence
cagggtctcactgtgtcacc

SEQ ID NO: 543785 - DNA, 20 bp, Artificial
  CRISPR gRNA sequence
agggtctcactgtgtcaccc

SEQ ID NO: 543786 - DNA, 20 bp, Artificial
  CRISPR gRNA sequence
tctcactgtgtcacccaggc

SEQ ID NO: 543787 - DNA, 20 bp, Artificial
  CRISPR gRNA sequence
tcactgtgtcacccaggctg

SEQ ID NO: 543788 - DNA, 20 bp, Artificial
  CRISPR gRNA sequence
gtgtcacccaggctggagta

SEQ ID NO: 543789 - DNA, 20 bp, Artificial
  CRISPR gRNA sequence
tgtcacccaggctggagtac

SEQ ID NO: 543790 - DNA, 20 bp, Artificial
  CRISPR gRNA sequence
gtcacccaggctggagtaca

SEQ ID NO: 543791 - DNA, 20 bp, Artificial
  CRISPR gRNA sequence
tcacccaggctggagtacag

SEQ ID NO: 543792 - DNA, 20 bp, Artificial
  CRISPR gRNA sequence
ggagtacaggggtgctatca

SEQ ID NO: 543793 - DNA, 20 bp, Artificial
  CRISPR gRNA sequence
ggtgctatcacagctaactc

SEQ ID NO: 543794 - DNA, 20 bp, Artificial
  CRISPR gRNA sequence
taactccagcctcgacctct

SEQ ID NO: 543795 - DNA, 20 bp, Artificial
  CRISPR gRNA sequence
aactccagcctcgacctctg

SEQ ID NO: 543796 - DNA, 20 bp, Artificial
  CRISPR gRNA sequence
agcctcgacctctgaggctc

SEQ ID NO: 543797 - DNA, 20 bp, Artificial
  CRISPR gRNA sequence
ctcaagcaattctgccacct

SEQ ID NO: 543798 - DNA, 20 bp, Artificial
  CRISPR gRNA sequence
ttctgccacctcagccttct

SEQ ID NO: 543799 - DNA, 20 bp, Artificial
  CRISPR gRNA sequence
tgccacctcagccttctgag

SEQ ID NO: 543800 - DNA, 20 bp, Artificial
  CRISPR gRNA sequence
acctcagccttctgagtagc

SEQ ID NO: 543801 - DNA, 20 bp, Artificial
  CRISPR gRNA sequence
cctcagccttctgagtagcc

SEQ ID NO: 543802 - DNA, 20 bp, Artificial
  CRISPR gRNA sequence
cttctgagtagccaggacta

SEQ ID NO: 543803 - DNA, 20 bp, Artificial
  CRISPR gRNA sequence
ttctgagtagccaggactac

SEQ ID NO: 543804 - DNA, 20 bp, Artificial
  CRISPR gRNA sequence
caggtgcatgccaccatgct

SEQ ID NO: 543805 - DNA, 20 bp, Artificial
  CRISPR gRNA sequence
atgcttggctaatttttttt

SEQ ID NO: 543806 - DNA, 20 bp, Artificial
  CRISPR gRNA sequence
taatttttttttagtttttg

SEQ ID NO: 543807 - DNA, 20 bp, Artificial
  CRISPR gRNA sequence
ttttttagtttttgtagaaa

SEQ ID NO: 543808 - DNA, 20 bp, Artificial
  CRISPR gRNA sequence
tttttagtttttgtagaaac

SEQ ID NO: 543809 - DNA, 20 bp, Artificial
  CRISPR gRNA sequence
ttttagtttttgtagaaaca

SEQ ID NO: 543810 - DNA, 20 bp, Artificial
  CRISPR gRNA sequence
cagggtttccctatgttgcc

SEQ ID NO: 543811 - DNA, 20 bp, Artificial
  CRISPR gRNA sequence
tttccctatgttgcccagac

SEQ ID NO: 543812 - DNA, 20 bp, Artificial
  CRISPR gRNA sequence
ccagactggtcttaaactcc

SEQ ID NO: 543813 - DNA, 20 bp, Artificial
  CRISPR gRNA sequence
cagactggtcttaaactcct

SEQ ID NO: 543814 - DNA, 20 bp, Artificial
  CRISPR gRNA sequence
ggtcttaaactcctgggctc

SEQ ID NO: 543815 - DNA, 20 bp, Artificial
  CRISPR gRNA sequence
ctcaagtgatcctccctcct

SEQ ID NO: 543816 - DNA, 20 bp, Artificial
  CRISPR gRNA sequence
cctccctccttggcctaccg

SEQ ID NO: 543817 - DNA, 20 bp, Artificial
  CRISPR gRNA sequence
tccttggcctaccgaagtgt

SEQ ID NO: 543818 - DNA, 20 bp, Artificial
  CRISPR gRNA sequence
ccttggcctaccgaagtgtt

SEQ ID NO: 543819 - DNA, 20 bp, Artificial
  CRISPR gRNA sequence
ctaccgaagtgttgggatta

SEQ ID NO: 543820 - DNA, 20 bp, Artificial
  CRISPR gRNA sequence
taccgaagtgttgggattac

SEQ ID NO: 543821 - DNA, 20 bp, Artificial
  CRISPR gRNA sequence
caggcatgaaccaccacatc

SEQ ID NO: 543822 - DNA, 20 bp, Artificial
  CRISPR gRNA sequence
gccactaaaatattttcaaa

SEQ ID NO: 543823 - DNA, 20 bp, Artificial
  CRISPR gRNA sequence
tgccttttctcttttctttt

SEQ ID NO: 543824 - DNA, 20 bp, Artificial
  CRISPR gRNA sequence
ttctcttttcttttgagaca

SEQ ID NO: 543825 - DNA, 20 bp, Artificial
  CRISPR gRNA sequence
cacagtctcactctgttgcc

SEQ ID NO: 543826 - DNA, 20 bp, Artificial
  CRISPR gRNA sequence
acagtctcactctgttgccc

SEQ ID NO: 543827 - DNA, 20 bp, Artificial
  CRISPR gRNA sequence
tctcactctgttgcccaggc

SEQ ID NO: 543828 - DNA, 20 bp, Artificial
  CRISPR gRNA sequence
tcactctgttgcccaggcta

SEQ ID NO: 543829 - DNA, 20 bp, Artificial
  CRISPR gRNA sequence
ctgttgcccaggctagagta

SEQ ID NO: 543830 - DNA, 20 bp, Artificial
  CRISPR gRNA sequence
agagtatagtgacacaatta

SEQ ID NO: 543831 - DNA, 20 bp, Artificial
  CRISPR gRNA sequence
gacacaattatggctcactg

SEQ ID NO: 543832 - DNA, 20 bp, Artificial
  CRISPR gRNA sequence
tcactgcagccttgatctcc

SEQ ID NO: 543833 - DNA, 20 bp, Artificial
  CRISPR gRNA sequence
agccttgatctcccagactc

SEQ ID NO: 543834 - DNA, 20 bp, Artificial
  CRISPR gRNA sequence
ctcaagcgatcctcccacct

SEQ ID NO: 543835 - DNA, 20 bp, Artificial
  CRISPR gRNA sequence
ctcccacctcagtttccaaa

SEQ ID NO: 543836 - DNA, 20 bp, Artificial
  CRISPR gRNA sequence
cacctcagtttccaaatagc

SEQ ID NO: 543837 - DNA, 20 bp, Artificial
  CRISPR gRNA sequence
acctcagtttccaaatagct

SEQ ID NO: 543838 - DNA, 20 bp, Artificial
  CRISPR gRNA sequence
tttccaaatagctgggacta

SEQ ID NO: 543839 - DNA, 20 bp, Artificial
  CRISPR gRNA sequence
ttccaaatagctgggactac

SEQ ID NO: 543840 - DNA, 20 bp, Artificial
  CRISPR gRNA sequence
tccaaatagctgggactaca

SEQ ID NO: 543841 - DNA, 20 bp, Artificial
  CRISPR gRNA sequence
taatttttttgtatttttta

SEQ ID NO: 543842 - DNA, 20 bp, Artificial
  CRISPR gRNA sequence
atttttttgtattttttata

SEQ ID NO: 543843 - DNA, 20 bp, Artificial
  CRISPR gRNA sequence
ttttgtattttttatagaga

SEQ ID NO: 543844 - DNA, 20 bp, Artificial
  CRISPR gRNA sequence
tttgtattttttatagagac

SEQ ID NO: 543845 - DNA, 20 bp, Artificial
  CRISPR gRNA sequence
ttgtattttttatagagacg

SEQ ID NO: 543846 - DNA, 20 bp, Artificial
  CRISPR gRNA sequence
cggggttttgccatgttgcc

SEQ ID NO: 543847 - DNA, 20 bp, Artificial
  CRISPR gRNA sequence
ggggttttgccatgttgccc

SEQ ID NO: 543848 - DNA, 20 bp, Artificial
  CRISPR gRNA sequence
ttttgccatgttgcccaggc

SEQ ID NO: 543849 - DNA, 20 bp, Artificial
  CRISPR gRNA sequence
ccaggctggtcttgaactcc

SEQ ID NO: 543850 - DNA, 20 bp, Artificial
  CRISPR gRNA sequence
caggctggtcttgaactcct

SEQ ID NO: 543851 - DNA, 20 bp, Artificial
  CRISPR gRNA sequence
ggtcttgaactcctgggctc

SEQ ID NO: 543852 - DNA, 20 bp, Artificial
  CRISPR gRNA sequence
tgggctcaagcaatcctccc

SEQ ID NO: 543853 - DNA, 20 bp, Artificial
  CRISPR gRNA sequence
ctcaagcaatcctcccaagt

SEQ ID NO: 543854 - DNA, 20 bp, Artificial
  CRISPR gRNA sequence
cctcccaagtcagtttccca

SEQ ID NO: 543855 - DNA, 20 bp, Artificial
  CRISPR gRNA sequence
aagtcagtttcccaaagtgt

SEQ ID NO: 543856 - DNA, 20 bp, Artificial
  CRISPR gRNA sequence
agtcagtttcccaaagtgtc

SEQ ID NO: 543857 - DNA, 20 bp, Artificial
  CRISPR gRNA sequence
ttcccaaagtgtcgggatta

SEQ ID NO: 543858 - DNA, 20 bp, Artificial
  CRISPR gRNA sequence
tcccaaagtgtcgggattat

SEQ ID NO: 543859 - DNA, 20 bp, Artificial
  CRISPR gRNA sequence
agtgtcgggattataggcat

SEQ ID NO: 543860 - DNA, 20 bp, Artificial
  CRISPR gRNA sequence
gattataggcatgagccacc

SEQ ID NO: 543861 - DNA, 20 bp, Artificial
  CRISPR gRNA sequence
ctctctatatatatatttat

SEQ ID NO: 543862 - DNA, 20 bp, Artificial
  CRISPR gRNA sequence
atttattagtttacattgtt

SEQ ID NO: 543863 - DNA, 20 bp, Artificial
  CRISPR gRNA sequence
tagtttacattgttcagtaa

SEQ ID NO: 543864 - DNA, 20 bp, Artificial
  CRISPR gRNA sequence
ttacattgttcagtaatgga

SEQ ID NO: 543865 - DNA, 20 bp, Artificial
  CRISPR gRNA sequence
tccctttttttcttttattt

SEQ ID NO: 543866 - DNA, 20 bp, Artificial
  CRISPR gRNA sequence
ctttttttcttttattttag

SEQ ID NO: 543867 - DNA, 20 bp, Artificial
  CRISPR gRNA sequence
tttttttcttttattttaga

SEQ ID NO: 543868 - DNA, 20 bp, Artificial
  CRISPR gRNA sequence
ttttattttagaaggttatg

SEQ ID NO: 543869 - DNA, 20 bp, Artificial
  CRISPR gRNA sequence
tagaaggttatgtggactca

SEQ ID NO: 543870 - DNA, 20 bp, Artificial
  CRISPR gRNA sequence
catggattcttttttaaata

SEQ ID NO: 543871 - DNA, 20 bp, Artificial
  CRISPR gRNA sequence
ctgtcatccattttgatgct

SEQ ID NO: 543872 - DNA, 20 bp, Artificial
  CRISPR gRNA sequence
tcggcaaccccacatttgac

SEQ ID NO: 543873 - DNA, 20 bp, Artificial
  CRISPR gRNA sequence
gcaaccccacatttgacaag

SEQ ID NO: 543874 - DNA, 20 bp, Artificial
  CRISPR gRNA sequence
caaccccacatttgacaagt

SEQ ID NO: 543875 - DNA, 20 bp, Artificial
  CRISPR gRNA sequence
tgacaagtgggaacaccttc

SEQ ID NO: 543876 - DNA, 20 bp, Artificial
  CRISPR gRNA sequence
gtgggaacaccttcaagctt

SEQ ID NO: 543877 - DNA, 20 bp, Artificial
  CRISPR gRNA sequence
gggaacaccttcaagcttca

SEQ ID NO: 543878 - DNA, 20 bp, Artificial
  CRISPR gRNA sequence
ttaaacacttccttactttc

SEQ ID NO: 543879 - DNA, 20 bp, Artificial
  CRISPR gRNA sequence
cacttccttactttctggca

SEQ ID NO: 543880 - DNA, 20 bp, Artificial
  CRISPR gRNA sequence
tccttactttctggcacaga

SEQ ID NO: 543881 - DNA, 20 bp, Artificial
  CRISPR gRNA sequence
tctggcacagaaagatgttc

SEQ ID NO: 543882 - DNA, 20 bp, Artificial
  CRISPR gRNA sequence
gatgttctggactcatcttg

SEQ ID NO: 543883 - DNA, 20 bp, Artificial
  CRISPR gRNA sequence
atcttgtagtgttcctgcct

SEQ ID NO: 543884 - DNA, 20 bp, Artificial
  CRISPR gRNA sequence
tgcctcagccttcgaatcat

SEQ ID NO: 543885 - DNA, 20 bp, Artificial
  CRISPR gRNA sequence
gcctcagccttcgaatcatt

SEQ ID NO: 543886 - DNA, 20 bp, Artificial
  CRISPR gRNA sequence
cttcgaatcattaggttccc

SEQ ID NO: 543887 - DNA, 20 bp, Artificial
  CRISPR gRNA sequence
ttaggttccctggtttcttt

SEQ ID NO: 543888 - DNA, 20 bp, Artificial
  CRISPR gRNA sequence
gttccctggtttcttttagt

SEQ ID NO: 543889 - DNA, 20 bp, Artificial
  CRISPR gRNA sequence
tccctggtttcttttagtga

SEQ ID NO: 543890 - DNA, 20 bp, Artificial
  CRISPR gRNA sequence
tggtttcttttagtgagaga

SEQ ID NO: 543891 - DNA, 20 bp, Artificial
  CRISPR gRNA sequence
ttttagtgagagatggtatt

SEQ ID NO: 543892 - DNA, 20 bp, Artificial
  CRISPR gRNA sequence
agagatggtatttagaaatc

SEQ ID NO: 543893 - DNA, 20 bp, Artificial
  CRISPR gRNA sequence
ggtatttagaaatcaagttc

SEQ ID NO: 543894 - DNA, 20 bp, Artificial
  CRISPR gRNA sequence
gtatttagaaatcaagttct

SEQ ID NO: 543895 - DNA, 20 bp, Artificial
  CRISPR gRNA sequence
gaaatcaagttctgggtgca

SEQ ID NO: 543896 - DNA, 20 bp, Artificial
  CRISPR gRNA sequence
ctgggtgcaaagtgtgccca

SEQ ID NO: 543897 - DNA, 20 bp, Artificial
  CRISPR gRNA sequence
tgggtgcaaagtgtgcccac

SEQ ID NO: 543898 - DNA, 20 bp, Artificial
  CRISPR gRNA sequence
caaagtgtgcccacaggtac

SEQ ID NO: 543899 - DNA, 20 bp, Artificial
  CRISPR gRNA sequence
aagtgtgcccacaggtacca

SEQ ID NO: 543900 - DNA, 20 bp, Artificial
  CRISPR gRNA sequence
gtaccagagtcattgcttct

SEQ ID NO: 543901 - DNA, 20 bp, Artificial
  CRISPR gRNA sequence
tcattgcttctcagccttgt

SEQ ID NO: 543902 - DNA, 20 bp, Artificial
  CRISPR gRNA sequence
ctcagccttgtcagttttca

SEQ ID NO: 543903 - DNA, 20 bp, Artificial
  CRISPR gRNA sequence
ccttgtcagttttcaaagtt

SEQ ID NO: 543904 - DNA, 20 bp, Artificial
  CRISPR gRNA sequence
cagttttcaaagttaagaaa

SEQ ID NO: 543905 - DNA, 20 bp, Artificial
  CRISPR gRNA sequence
gttttcaaagttaagaaata

SEQ ID NO: 543906 - DNA, 20 bp, Artificial
  CRISPR gRNA sequence
taagaaatagagtttttaca

SEQ ID NO: 543907 - DNA, 20 bp, Artificial
  CRISPR gRNA sequence
aaatagagtttttacaaagt

SEQ ID NO: 543908 - DNA, 20 bp, Artificial
  CRISPR gRNA sequence
aatagagtttttacaaagtc

SEQ ID NO: 543909 - DNA, 20 bp, Artificial
  CRISPR gRNA sequence
tagagtttttacaaagtcag

SEQ ID NO: 543910 - DNA, 20 bp, Artificial
  CRISPR gRNA sequence
acactaataatcttgctgct

SEQ ID NO: 543911 - DNA, 20 bp, Artificial
  CRISPR gRNA sequence
tttgcatctccttactccca

SEQ ID NO: 543912 - DNA, 20 bp, Artificial
  CRISPR gRNA sequence
catctccttactcccacagt

SEQ ID NO: 543913 - DNA, 20 bp, Artificial
  CRISPR gRNA sequence
cacagtgagaactctgttct

SEQ ID NO: 543914 - DNA, 20 bp, Artificial
  CRISPR gRNA sequence
agtgagaactctgttcttag

SEQ ID NO: 543915 - DNA, 20 bp, Artificial
  CRISPR gRNA sequence
aactctgttcttagtagcat

SEQ ID NO: 543916 - DNA, 20 bp, Artificial
  CRISPR gRNA sequence
ttaaaccccaaatcatttta

SEQ ID NO: 543917 - DNA, 20 bp, Artificial
  CRISPR gRNA sequence
aactacaaacttactaaata

SEQ ID NO: 543918 - DNA, 20 bp, Artificial
  CRISPR gRNA sequence
aaacttactaaatacagtta

SEQ ID NO: 543919 - DNA, 20 bp, Artificial
  CRISPR gRNA sequence
tacagttaaagatttcttta

SEQ ID NO: 543920 - DNA, 20 bp, Artificial
  CRISPR gRNA sequence
gttccttttatttttcatta

SEQ ID NO: 543921 - DNA, 20 bp, Artificial
  CRISPR gRNA sequence
tttcattacagtctccaact

SEQ ID NO: 543922 - DNA, 20 bp, Artificial
  CRISPR gRNA sequence
tacagtctccaacttagcaa

SEQ ID NO: 543923 - DNA, 20 bp, Artificial
  CRISPR gRNA sequence
acttagcaatggttcgactt

SEQ ID NO: 543924 - DNA, 20 bp, Artificial
  CRISPR gRNA sequence
agatttttcaactctacaat

SEQ ID NO: 543925 - DNA, 20 bp, Artificial
  CRISPR gRNA sequence
aactctacaatgagtttttc

SEQ ID NO: 543926 - DNA, 20 bp, Artificial
  CRISPR gRNA sequence
tcaagatataactccataat

SEQ ID NO: 543927 - DNA, 20 bp, Artificial
  CRISPR gRNA sequence
taagaaatatctgtatatcc

SEQ ID NO: 543928 - DNA, 20 bp, Artificial
  CRISPR gRNA sequence
atatgcaatactatattcaa

SEQ ID NO: 543929 - DNA, 20 bp, Artificial
  CRISPR gRNA sequence
tactatattcaaaagttact

SEQ ID NO: 543930 - DNA, 20 bp, Artificial
  CRISPR gRNA sequence
ttcaaaagttacttggattc

SEQ ID NO: 543931 - DNA, 20 bp, Artificial
  CRISPR gRNA sequence
aaagttacttggattctggc

SEQ ID NO: 543932 - DNA, 20 bp, Artificial
  CRISPR gRNA sequence
aagttacttggattctggcc

SEQ ID NO: 543933 - DNA, 20 bp, Artificial
  CRISPR gRNA sequence
acttggattctggccgggtg

SEQ ID NO: 543934 - DNA, 20 bp, Artificial
  CRISPR gRNA sequence
gtgactcatgactgtaatcc

SEQ ID NO: 543935 - DNA, 20 bp, Artificial
  CRISPR gRNA sequence
tgactgtaatcccagcactt

SEQ ID NO: 543936 - DNA, 20 bp, Artificial
  CRISPR gRNA sequence
gactgtaatcccagcacttt

SEQ ID NO: 543937 - DNA, 20 bp, Artificial
  CRISPR gRNA sequence
ctgtaatcccagcactttgg

SEQ ID NO: 543938 - DNA, 20 bp, Artificial
  CRISPR gRNA sequence
tgtaatcccagcactttggg

SEQ ID NO: 543939 - DNA, 20 bp, Artificial
  CRISPR gRNA sequence
tcccagcactttgggaggcc

SEQ ID NO: 543940 - DNA, 20 bp, Artificial
  CRISPR gRNA sequence
cccagcactttgggaggcca

SEQ ID NO: 543941 - DNA, 20 bp, Artificial
  CRISPR gRNA sequence
agcactttgggaggccaagg

SEQ ID NO: 543942 - DNA, 20 bp, Artificial
  CRISPR gRNA sequence
gcactttgggaggccaaggc

SEQ ID NO: 543943 - DNA, 20 bp, Artificial
  CRISPR gRNA sequence
ctttgggaggccaaggcggg

SEQ ID NO: 543944 - DNA, 20 bp, Artificial
  CRISPR gRNA sequence
ggccaaggcgggcggatcac

SEQ ID NO: 543945 - DNA, 20 bp, Artificial
  CRISPR gRNA sequence
gccaaggcgggcggatcaca

SEQ ID NO: 543946 - DNA, 20 bp, Artificial
  CRISPR gRNA sequence
aggcgggcggatcacaaggt

SEQ ID NO: 543947 - DNA, 20 bp, Artificial
  CRISPR gRNA sequence
ggcgggcggatcacaaggtc

SEQ ID NO: 543948 - DNA, 20 bp, Artificial
  CRISPR gRNA sequence
cgggcggatcacaaggtcag

SEQ ID NO: 543949 - DNA, 20 bp, Artificial
  CRISPR gRNA sequence
gatcacaaggtcaggagatt

SEQ ID NO: 543950 - DNA, 20 bp, Artificial
  CRISPR gRNA sequence
tcaggagattgagaccatcc

SEQ ID NO: 543951 - DNA, 20 bp, Artificial
  CRISPR gRNA sequence
tgagaccatcctggctaacg

SEQ ID NO: 543952 - DNA, 20 bp, Artificial
  CRISPR gRNA sequence
tctctactaaaacaaaaaat

SEQ ID NO: 543953 - DNA, 20 bp, Artificial
  CRISPR gRNA sequence
tactaaaacaaaaaattagc

SEQ ID NO: 543954 - DNA, 20 bp, Artificial
  CRISPR gRNA sequence
actaaaacaaaaaattagct

SEQ ID NO: 543955 - DNA, 20 bp, Artificial
  CRISPR gRNA sequence
aacaaaaaattagctgggca

SEQ ID NO: 543956 - DNA, 20 bp, Artificial
  CRISPR gRNA sequence
aaaaaattagctgggcatgg

SEQ ID NO: 543957 - DNA, 20 bp, Artificial
  CRISPR gRNA sequence
gtggcacacgcctgtaattc

SEQ ID NO: 543958 - DNA, 20 bp, Artificial
  CRISPR gRNA sequence
cgcctgtaattccagctacc

SEQ ID NO: 543959 - DNA, 20 bp, Artificial
  CRISPR gRNA sequence
gcctgtaattccagctacct

SEQ ID NO: 543960 - DNA, 20 bp, Artificial
  CRISPR gRNA sequence
ctgtaattccagctacctag

SEQ ID NO: 543961 - DNA, 20 bp, Artificial
  CRISPR gRNA sequence
tgtaattccagctacctagg

SEQ ID NO: 543962 - DNA, 20 bp, Artificial
  CRISPR gRNA sequence
ttccagctacctaggaggct

SEQ ID NO: 543963 - DNA, 20 bp, Artificial
  CRISPR gRNA sequence
tccagctacctaggaggctg

SEQ ID NO: 543964 - DNA, 20 bp, Artificial
  CRISPR gRNA sequence
agctacctaggaggctgagg

SEQ ID NO: 543965 - DNA, 20 bp, Artificial
  CRISPR gRNA sequence
gctacctaggaggctgaggc

SEQ ID NO: 543966 - DNA, 20 bp, Artificial
  CRISPR gRNA sequence
tacctaggaggctgaggcag

SEQ ID NO: 543967 - DNA, 20 bp, Artificial
  CRISPR gRNA sequence
aggaggctgaggcaggagaa

SEQ ID NO: 543968 - DNA, 20 bp, Artificial
  CRISPR gRNA sequence
ggcaggagaatggcctgaac

SEQ ID NO: 543969 - DNA, 20 bp, Artificial
  CRISPR gRNA sequence
gcaggagaatggcctgaacc

SEQ ID NO: 543970 - DNA, 20 bp, Artificial
  CRISPR gRNA sequence
aggagaatggcctgaaccag

SEQ ID NO: 543971 - DNA, 20 bp, Artificial
  CRISPR gRNA sequence
ggagaatggcctgaaccagg

SEQ ID NO: 543972 - DNA, 20 bp, Artificial
  CRISPR gRNA sequence
gaatggcctgaaccaggagg

SEQ ID NO: 543973 - DNA, 20 bp, Artificial
  CRISPR gRNA sequence
atggcctgaaccaggaggca

SEQ ID NO: 543974 - DNA, 20 bp, Artificial
  CRISPR gRNA sequence
gaaccaggaggcagagactg

SEQ ID NO: 543975 - DNA, 20 bp, Artificial
  CRISPR gRNA sequence
caggaggcagagactgcagt

SEQ ID NO: 543976 - DNA, 20 bp, Artificial
  CRISPR gRNA sequence
ggcagagactgcagtgagcc

SEQ ID NO: 543977 - DNA, 20 bp, Artificial
  CRISPR gRNA sequence
aagattacaacactgcactc

SEQ ID NO: 543978 - DNA, 20 bp, Artificial
  CRISPR gRNA sequence
tacaacactgcactccagcc

SEQ ID NO: 543979 - DNA, 20 bp, Artificial
  CRISPR gRNA sequence
acaacactgcactccagcct

SEQ ID NO: 543980 - DNA, 20 bp, Artificial
  CRISPR gRNA sequence
ctgcactccagcctgggtga

SEQ ID NO: 543981 - DNA, 20 bp, Artificial
  CRISPR gRNA sequence
gcactccagcctgggtgacg

SEQ ID NO: 543982 - DNA, 20 bp, Artificial
  CRISPR gRNA sequence
tccagcctgggtgacggagt

SEQ ID NO: 543983 - DNA, 20 bp, Artificial
  CRISPR gRNA sequence
aaacaaaacaaaacaaaaaa

SEQ ID NO: 543984 - DNA, 20 bp, Artificial
  CRISPR gRNA sequence
caaaacaaaaaaaagttatt

SEQ ID NO: 543985 - DNA, 20 bp, Artificial
  CRISPR gRNA sequence
tctaactacccttcttaaac

SEQ ID NO: 543986 - DNA, 20 bp, Artificial
  CRISPR gRNA sequence
ctaactacccttcttaaaca

SEQ ID NO: 543987 - DNA, 20 bp, Artificial
  CRISPR gRNA sequence
ttgtcacttaaccatacatc

SEQ ID NO: 543988 - DNA, 20 bp, Artificial
  CRISPR gRNA sequence
aatcattccctatcacttca

SEQ ID NO: 543989 - DNA, 20 bp, Artificial
  CRISPR gRNA sequence
tcattccctatcacttcata

SEQ ID NO: 543990 - DNA, 20 bp, Artificial
  CRISPR gRNA sequence
atccacctcattctttttca

SEQ ID NO: 543991 - DNA, 20 bp, Artificial
  CRISPR gRNA sequence
cattctttttcacagctgta

SEQ ID NO: 543992 - DNA, 20 bp, Artificial
  CRISPR gRNA sequence
cacagctgtacagtccctca

SEQ ID NO: 543993 - DNA, 20 bp, Artificial
  CRISPR gRNA sequence
acagctgtacagtccctcat

SEQ ID NO: 543994 - DNA, 20 bp, Artificial
  CRISPR gRNA sequence
cagctgtacagtccctcata

SEQ ID NO: 543995 - DNA, 20 bp, Artificial
  CRISPR gRNA sequence
ctgtacagtccctcataggg

SEQ ID NO: 543996 - DNA, 20 bp, Artificial
  CRISPR gRNA sequence
tccctcatagggtggctata

SEQ ID NO: 543997 - DNA, 20 bp, Artificial
  CRISPR gRNA sequence
ctcatagggtggctatatgg

SEQ ID NO: 543998 - DNA, 20 bp, Artificial
  CRISPR gRNA sequence
tggctatatggtagttcatt

SEQ ID NO: 543999 - DNA, 20 bp, Artificial
  CRISPR gRNA sequence
ttcattcagctaccctctgc

SEQ ID NO: 544000 - DNA, 20 bp, Artificial
  CRISPR gRNA sequence
ttcagctaccctctgctggt

SEQ ID NO: 544001 - DNA, 20 bp, Artificial
  CRISPR gRNA sequence
ctctgctggttagtattaca

SEQ ID NO: 544002 - DNA, 20 bp, Artificial
  CRISPR gRNA sequence
ctggttagtattacatagtg

SEQ ID NO: 544003 - DNA, 20 bp, Artificial
  CRISPR gRNA sequence
ttagtattacatagtgtggt

SEQ ID NO: 544004 - DNA, 20 bp, Artificial
  CRISPR gRNA sequence
tagtattacatagtgtggtc

SEQ ID NO: 544005 - DNA, 20 bp, Artificial
  CRISPR gRNA sequence
agtattacatagtgtggtca

SEQ ID NO: 544006 - DNA, 20 bp, Artificial
  CRISPR gRNA sequence
tattacatagtgtggtcagg

SEQ ID NO: 544007 - DNA, 20 bp, Artificial
  CRISPR gRNA sequence
attacatagtgtggtcaggg

SEQ ID NO: 544008 - DNA, 20 bp, Artificial
  CRISPR gRNA sequence
ttacatagtgtggtcaggga

SEQ ID NO: 544009 - DNA, 20 bp, Artificial
  CRISPR gRNA sequence
gtcagggagggtctctttaa

SEQ ID NO: 544010 - DNA, 20 bp, Artificial
  CRISPR gRNA sequence
tcagggagggtctctttaat

SEQ ID NO: 544011 - DNA, 20 bp, Artificial
  CRISPR gRNA sequence
cagggagggtctctttaata

SEQ ID NO: 544012 - DNA, 20 bp, Artificial
  CRISPR gRNA sequence
tgacaattgatcatacactt

SEQ ID NO: 544013 - DNA, 20 bp, Artificial
  CRISPR gRNA sequence
gacaattgatcatacactta

SEQ ID NO: 544014 - DNA, 20 bp, Artificial
  CRISPR gRNA sequence
aattgatcatacacttaagg

SEQ ID NO: 544015 - DNA, 20 bp, Artificial
  CRISPR gRNA sequence
gatcatacacttaaggaagt

SEQ ID NO: 544016 - DNA, 20 bp, Artificial
  CRISPR gRNA sequence
tcatacacttaaggaagtga

SEQ ID NO: 544017 - DNA, 20 bp, Artificial
  CRISPR gRNA sequence
acacttaaggaagtgagaga

SEQ ID NO: 544018 - DNA, 20 bp, Artificial
  CRISPR gRNA sequence
cacttaaggaagtgagagat

SEQ ID NO: 544019 - DNA, 20 bp, Artificial
  CRISPR gRNA sequence
ggaagtgagagataggccac

SEQ ID NO: 544020 - DNA, 20 bp, Artificial
  CRISPR gRNA sequence
gaagtgagagataggccaca

SEQ ID NO: 544021 - DNA, 20 bp, Artificial
  CRISPR gRNA sequence
agataggccacaaggctatc

SEQ ID NO: 544022 - DNA, 20 bp, Artificial
  CRISPR gRNA sequence
gataggccacaaggctatct

SEQ ID NO: 544023 - DNA, 20 bp, Artificial
  CRISPR gRNA sequence
ataggccacaaggctatctg

SEQ ID NO: 544024 - DNA, 20 bp, Artificial
  CRISPR gRNA sequence
taggccacaaggctatctgg

SEQ ID NO: 544025 - DNA, 20 bp, Artificial
  CRISPR gRNA sequence
ggccacaaggctatctgggg

SEQ ID NO: 544026 - DNA, 20 bp, Artificial
  CRISPR gRNA sequence
tatctgggggagtgatattc

SEQ ID NO: 544027 - DNA, 20 bp, Artificial
  CRISPR gRNA sequence
atctgggggagtgatattcc

SEQ ID NO: 544028 - DNA, 20 bp, Artificial
  CRISPR gRNA sequence
gatattccaggtctactact

SEQ ID NO: 544029 - DNA, 20 bp, Artificial
  CRISPR gRNA sequence
atattccaggtctactactc

SEQ ID NO: 544030 - DNA, 20 bp, Artificial
  CRISPR gRNA sequence
ggtctactactcaggaccct

SEQ ID NO: 544031 - DNA, 20 bp, Artificial
  CRISPR gRNA sequence
tactactcaggaccctgaga

SEQ ID NO: 544032 - DNA, 20 bp, Artificial
  CRISPR gRNA sequence
actactcaggaccctgagat

SEQ ID NO: 544033 - DNA, 20 bp, Artificial
  CRISPR gRNA sequence
aggaccctgagataggcttc

SEQ ID NO: 544034 - DNA, 20 bp, Artificial
  CRISPR gRNA sequence
gagataggcttcaagcgttt

SEQ ID NO: 544035 - DNA, 20 bp, Artificial
  CRISPR gRNA sequence
tcaagcgtttaagaaacttc

SEQ ID NO: 544036 - DNA, 20 bp, Artificial
  CRISPR gRNA sequence
caagcgtttaagaaacttca

SEQ ID NO: 544037 - DNA, 20 bp, Artificial
  CRISPR gRNA sequence
aaacttcaaggataccattg

SEQ ID NO: 544038 - DNA, 20 bp, Artificial
  CRISPR gRNA sequence
cttcaaggataccattgtgg

SEQ ID NO: 544039 - DNA, 20 bp, Artificial
  CRISPR gRNA sequence
tcaaggataccattgtggtg

SEQ ID NO: 544040 - DNA, 20 bp, Artificial
  CRISPR gRNA sequence
aaggataccattgtggtgga

SEQ ID NO: 544041 - DNA, 20 bp, Artificial
  CRISPR gRNA sequence
gataccattgtggtggagag

SEQ ID NO: 544042 - DNA, 20 bp, Artificial
  CRISPR gRNA sequence
accattgtggtggagagtgg

SEQ ID NO: 544043 - DNA, 20 bp, Artificial
  CRISPR gRNA sequence
gtggagagtggtagaaaatg

SEQ ID NO: 544044 - DNA, 20 bp, Artificial
  CRISPR gRNA sequence
ggtagaaaatgaagttataa

SEQ ID NO: 544045 - DNA, 20 bp, Artificial
  CRISPR gRNA sequence
agaaaatgaagttataaaag

SEQ ID NO: 544046 - DNA, 20 bp, Artificial
  CRISPR gRNA sequence
aatgaagttataaaagtagt

SEQ ID NO: 544047 - DNA, 20 bp, Artificial
  CRISPR gRNA sequence
atgaagttataaaagtagtc

SEQ ID NO: 544048 - DNA, 20 bp, Artificial
  CRISPR gRNA sequence
tgaagttataaaagtagtca

SEQ ID NO: 544049 - DNA, 20 bp, Artificial
  CRISPR gRNA sequence
gttataaaagtagtcagggt

SEQ ID NO: 544050 - DNA, 20 bp, Artificial
  CRISPR gRNA sequence
gtagtcagggttggatcctg

SEQ ID NO: 544051 - DNA, 20 bp, Artificial
  CRISPR gRNA sequence
agggttggatcctgtagata

SEQ ID NO: 544052 - DNA, 20 bp, Artificial
  CRISPR gRNA sequence
gatcctgtagataaagtttt

SEQ ID NO: 544053 - DNA, 20 bp, Artificial
  CRISPR gRNA sequence
atcctgtagataaagttttt

SEQ ID NO: 544054 - DNA, 20 bp, Artificial
  CRISPR gRNA sequence
tcctgtagataaagttttta

SEQ ID NO: 544055 - DNA, 20 bp, Artificial
  CRISPR gRNA sequence
ttagggccttttaaatattt

SEQ ID NO: 544056 - DNA, 20 bp, Artificial
  CRISPR gRNA sequence
tattttggcctttttgcttt

SEQ ID NO: 544057 - DNA, 20 bp, Artificial
  CRISPR gRNA sequence
gcctttttgctttcagtgac

SEQ ID NO: 544058 - DNA, 20 bp, Artificial
  CRISPR gRNA sequence
ttttgctttcagtgactgga

SEQ ID NO: 544059 - DNA, 20 bp, Artificial
  CRISPR gRNA sequence
tcagtgactggaaagttttg

SEQ ID NO: 544060 - DNA, 20 bp, Artificial
  CRISPR gRNA sequence
cagtgactggaaagttttga

SEQ ID NO: 544061 - DNA, 20 bp, Artificial
  CRISPR gRNA sequence
aagttttgaaggattttgaa

SEQ ID NO: 544062 - DNA, 20 bp, Artificial
  CRISPR gRNA sequence
agttttgaaggattttgaac

SEQ ID NO: 544063 - DNA, 20 bp, Artificial
  CRISPR gRNA sequence
ttttgaaggattttgaacag

SEQ ID NO: 544064 - DNA, 20 bp, Artificial
  CRISPR gRNA sequence
ggagtgaaattatgatgact

SEQ ID NO: 544065 - DNA, 20 bp, Artificial
  CRISPR gRNA sequence
atgatgacttggatgtttaa

SEQ ID NO: 544066 - DNA, 20 bp, Artificial
  CRISPR gRNA sequence
gatgtttaaaagaattattc

SEQ ID NO: 544067 - DNA, 20 bp, Artificial
  CRISPR gRNA sequence
aaaagaattattctggctgc

SEQ ID NO: 544068 - DNA, 20 bp, Artificial
  CRISPR gRNA sequence
tattctggctgctggatgaa

SEQ ID NO: 544069 - DNA, 20 bp, Artificial
  CRISPR gRNA sequence
gctgctggatgaatagtctg

SEQ ID NO: 544070 - DNA, 20 bp, Artificial
  CRISPR gRNA sequence
tgctggatgaatagtctgta

SEQ ID NO: 544071 - DNA, 20 bp, Artificial
  CRISPR gRNA sequence
gctggatgaatagtctgtag

SEQ ID NO: 544072 - DNA, 20 bp, Artificial
  CRISPR gRNA sequence
tggatgaatagtctgtagag

SEQ ID NO: 544073 - DNA, 20 bp, Artificial
  CRISPR gRNA sequence
gatgaatagtctgtagagga

SEQ ID NO: 544074 - DNA, 20 bp, Artificial
  CRISPR gRNA sequence
atagtctgtagaggagagaa

SEQ ID NO: 544075 - DNA, 20 bp, Artificial
  CRISPR gRNA sequence
tagtctgtagaggagagaaa

SEQ ID NO: 544076 - DNA, 20 bp, Artificial
  CRISPR gRNA sequence
tctgtagaggagagaaaagg

SEQ ID NO: 544077 - DNA, 20 bp, Artificial
  CRISPR gRNA sequence
tgtagaggagagaaaaggaa

SEQ ID NO: 544078 - DNA, 20 bp, Artificial
  CRISPR gRNA sequence
agaggagagaaaaggaagag

SEQ ID NO: 544079 - DNA, 20 bp, Artificial
  CRISPR gRNA sequence
gaggagagaaaaggaagagc

SEQ ID NO: 544080 - DNA, 20 bp, Artificial
  CRISPR gRNA sequence
aggagagaaaaggaagagca

SEQ ID NO: 544081 - DNA, 20 bp, Artificial
  CRISPR gRNA sequence
gagagaaaaggaagagcagg

SEQ ID NO: 544082 - DNA, 20 bp, Artificial
  CRISPR gRNA sequence
agagaaaaggaagagcaggg

SEQ ID NO: 544083 - DNA, 20 bp, Artificial
  CRISPR gRNA sequence
aaaaggaagagcagggaggt

SEQ ID NO: 544084 - DNA, 20 bp, Artificial
  CRISPR gRNA sequence
ggaagagcagggaggttggt

SEQ ID NO: 544085 - DNA, 20 bp, Artificial
  CRISPR gRNA sequence
gaagagcagggaggttggtt

SEQ ID NO: 544086 - DNA, 20 bp, Artificial
  CRISPR gRNA sequence
cagggaggttggttaggctg

SEQ ID NO: 544087 - DNA, 20 bp, Artificial
  CRISPR gRNA sequence
agggaggttggttaggctgc

SEQ ID NO: 544088 - DNA, 20 bp, Artificial
  CRISPR gRNA sequence
gggaggttggttaggctgca

SEQ ID NO: 544089 - DNA, 20 bp, Artificial
  CRISPR gRNA sequence
ggaggttggttaggctgcag

SEQ ID NO: 544090 - DNA, 20 bp, Artificial
  CRISPR gRNA sequence
gttaggctgcaggggcaatg

SEQ ID NO: 544091 - DNA, 20 bp, Artificial
  CRISPR gRNA sequence
ttaggctgcaggggcaatgc

SEQ ID NO: 544092 - DNA, 20 bp, Artificial
  CRISPR gRNA sequence
gctgcaggggcaatgcagga

SEQ ID NO: 544093 - DNA, 20 bp, Artificial
  CRISPR gRNA sequence
ctgcaggggcaatgcaggaa

SEQ ID NO: 544094 - DNA, 20 bp, Artificial
  CRISPR gRNA sequence
caatgcaggaaaggaatcac

SEQ ID NO: 544095 - DNA, 20 bp, Artificial
  CRISPR gRNA sequence
aatgcaggaaaggaatcact

SEQ ID NO: 544096 - DNA, 20 bp, Artificial
  CRISPR gRNA sequence
atgcaggaaaggaatcactg

SEQ ID NO: 544097 - DNA, 20 bp, Artificial
  CRISPR gRNA sequence
tgcaggaaaggaatcactgg

SEQ ID NO: 544098 - DNA, 20 bp, Artificial
  CRISPR gRNA sequence
aggaaaggaatcactggggg

SEQ ID NO: 544099 - DNA, 20 bp, Artificial
  CRISPR gRNA sequence
ggaaaggaatcactgggggt

SEQ ID NO: 544100 - DNA, 20 bp, Artificial
  CRISPR gRNA sequence
aaaggaatcactgggggtgg

SEQ ID NO: 544101 - DNA, 20 bp, Artificial
  CRISPR gRNA sequence
cactgggggtgggagatatc

SEQ ID NO: 544102 - DNA, 20 bp, Artificial
  CRISPR gRNA sequence
agatatctggatgtgttttg

SEQ ID NO: 544103 - DNA, 20 bp, Artificial
  CRISPR gRNA sequence
gatatctggatgtgttttga

SEQ ID NO: 544104 - DNA, 20 bp, Artificial
  CRISPR gRNA sequence
atctggatgtgttttgaagg

SEQ ID NO: 544105 - DNA, 20 bp, Artificial
  CRISPR gRNA sequence
ctggatgtgttttgaaggtg

SEQ ID NO: 544106 - DNA, 20 bp, Artificial
  CRISPR gRNA sequence
atgtgttttgaaggtggagc

SEQ ID NO: 544107 - DNA, 20 bp, Artificial
  CRISPR gRNA sequence
tgttttgaaggtggagctgg

SEQ ID NO: 544108 - DNA, 20 bp, Artificial
  CRISPR gRNA sequence
gttttgaaggtggagctggc

SEQ ID NO: 544109 - DNA, 20 bp, Artificial
  CRISPR gRNA sequence
aaggtggagctggcaggatt

SEQ ID NO: 544110 - DNA, 20 bp, Artificial
  CRISPR gRNA sequence
ggagctggcaggatttggtg

SEQ ID NO: 544111 - DNA, 20 bp, Artificial
  CRISPR gRNA sequence
gagctggcaggatttggtgt

SEQ ID NO: 544112 - DNA, 20 bp, Artificial
  CRISPR gRNA sequence
gatttggtgtgggcttgcat

SEQ ID NO: 544113 - DNA, 20 bp, Artificial
  CRISPR gRNA sequence
ttggtgtgggcttgcattag

SEQ ID NO: 544114 - DNA, 20 bp, Artificial
  CRISPR gRNA sequence
tgcattagtggaatgacatg

SEQ ID NO: 544115 - DNA, 20 bp, Artificial
  CRISPR gRNA sequence
ttagtggaatgacatgtgga

SEQ ID NO: 544116 - DNA, 20 bp, Artificial
  CRISPR gRNA sequence
tagtggaatgacatgtggat

SEQ ID NO: 544117 - DNA, 20 bp, Artificial
  CRISPR gRNA sequence
agtggaatgacatgtggata

SEQ ID NO: 544118 - DNA, 20 bp, Artificial
  CRISPR gRNA sequence
aatgacatgtggatagggcc

SEQ ID NO: 544119 - DNA, 20 bp, Artificial
  CRISPR gRNA sequence
acatgtggatagggcctgga

SEQ ID NO: 544120 - DNA, 20 bp, Artificial
  CRISPR gRNA sequence
ggatagggcctggatagtgc

SEQ ID NO: 544121 - DNA, 20 bp, Artificial
  CRISPR gRNA sequence
gatagggcctggatagtgct

SEQ ID NO: 544122 - DNA, 20 bp, Artificial
  CRISPR gRNA sequence
gggcctggatagtgctgggc

SEQ ID NO: 544123 - DNA, 20 bp, Artificial
  CRISPR gRNA sequence
cctggatagtgctgggcaag

SEQ ID NO: 544124 - DNA, 20 bp, Artificial
  CRISPR gRNA sequence
gatagtgctgggcaagtagc

SEQ ID NO: 544125 - DNA, 20 bp, Artificial
  CRISPR gRNA sequence
ggcaagtagcaagaactcaa

SEQ ID NO: 544126 - DNA, 20 bp, Artificial
  CRISPR gRNA sequence
agaactcaaaagtatgaact

SEQ ID NO: 544127 - DNA, 20 bp, Artificial
  CRISPR gRNA sequence
tcaaaagtatgaacttggct

SEQ ID NO: 544128 - DNA, 20 bp, Artificial
  CRISPR gRNA sequence
aaaagtatgaacttggctga

SEQ ID NO: 544129 - DNA, 20 bp, Artificial
  CRISPR gRNA sequence
agtatgaacttggctgagag

SEQ ID NO: 544130 - DNA, 20 bp, Artificial
  CRISPR gRNA sequence
atgaacttggctgagagtgg

SEQ ID NO: 544131 - DNA, 20 bp, Artificial
  CRISPR gRNA sequence
gtggtgcatgcctgtaatcc

SEQ ID NO: 544132 - DNA, 20 bp, Artificial
  CRISPR gRNA sequence
atgcctgtaatcctagcact

SEQ ID NO: 544133 - DNA, 20 bp, Artificial
  CRISPR gRNA sequence
gcctgtaatcctagcactga

SEQ ID NO: 544134 - DNA, 20 bp, Artificial
  CRISPR gRNA sequence
cctgtaatcctagcactgag

SEQ ID NO: 544135 - DNA, 20 bp, Artificial
  CRISPR gRNA sequence
aatcctagcactgagaggct

SEQ ID NO: 544136 - DNA, 20 bp, Artificial
  CRISPR gRNA sequence
atcctagcactgagaggctg

SEQ ID NO: 544137 - DNA, 20 bp, Artificial
  CRISPR gRNA sequence
ctagcactgagaggctgagg

SEQ ID NO: 544138 - DNA, 20 bp, Artificial
  CRISPR gRNA sequence
tagcactgagaggctgaggt

SEQ ID NO: 544139 - DNA, 20 bp, Artificial
  CRISPR gRNA sequence
cactgagaggctgaggtggg

SEQ ID NO: 544140 - DNA, 20 bp, Artificial
  CRISPR gRNA sequence
ctgaggtgggcagatctttt

SEQ ID NO: 544141 - DNA, 20 bp, Artificial
  CRISPR gRNA sequence
gtgggcagatcttttgagcc

SEQ ID NO: 544142 - DNA, 20 bp, Artificial
  CRISPR gRNA sequence
tgggcagatcttttgagccc

SEQ ID NO: 544143 - DNA, 20 bp, Artificial
  CRISPR gRNA sequence
ggcagatcttttgagcccag

SEQ ID NO: 544144 - DNA, 20 bp, Artificial
  CRISPR gRNA sequence
tcttttgagcccaggagttc

SEQ ID NO: 544145 - DNA, 20 bp, Artificial
  CRISPR gRNA sequence
caggagttcgagaccatcct

SEQ ID NO: 544146 - DNA, 20 bp, Artificial
  CRISPR gRNA sequence
catgctgaaaccccatgata

SEQ ID NO: 544147 - DNA, 20 bp, Artificial
  CRISPR gRNA sequence
tgaaaccccatgatatggtt

SEQ ID NO: 544148 - DNA, 20 bp, Artificial
  CRISPR gRNA sequence
tgtaataatccccatatgtc

SEQ ID NO: 544149 - DNA, 20 bp, Artificial
  CRISPR gRNA sequence
gtaataatccccatatgtca

SEQ ID NO: 544150 - DNA, 20 bp, Artificial
  CRISPR gRNA sequence
taataatccccatatgtcaa

SEQ ID NO: 544151 - DNA, 20 bp, Artificial
  CRISPR gRNA sequence
taatccccatatgtcaaggg

SEQ ID NO: 544152 - DNA, 20 bp, Artificial
  CRISPR gRNA sequence
aatccccatatgtcaagggc

SEQ ID NO: 544153 - DNA, 20 bp, Artificial
  CRISPR gRNA sequence
atccccatatgtcaagggca

SEQ ID NO: 544154 - DNA, 20 bp, Artificial
  CRISPR gRNA sequence
ccatatgtcaagggcagggc

SEQ ID NO: 544155 - DNA, 20 bp, Artificial
  CRISPR gRNA sequence
catatgtcaagggcagggct

SEQ ID NO: 544156 - DNA, 20 bp, Artificial
  CRISPR gRNA sequence
atgtcaagggcagggctagg

SEQ ID NO: 544157 - DNA, 20 bp, Artificial
  CRISPR gRNA sequence
gtcaagggcagggctaggtg

SEQ ID NO: 544158 - DNA, 20 bp, Artificial
  CRISPR gRNA sequence
ggtggagataattgaatcat

SEQ ID NO: 544159 - DNA, 20 bp, Artificial
  CRISPR gRNA sequence
gtggagataattgaatcata

SEQ ID NO: 544160 - DNA, 20 bp, Artificial
  CRISPR gRNA sequence
tggagataattgaatcataa

SEQ ID NO: 544161 - DNA, 20 bp, Artificial
  CRISPR gRNA sequence
agataattgaatcataaggg

SEQ ID NO: 544162 - DNA, 20 bp, Artificial
  CRISPR gRNA sequence
agtttcccccatactgttct

SEQ ID NO: 544163 - DNA, 20 bp, Artificial
  CRISPR gRNA sequence
tcccccatactgttctcaga

SEQ ID NO: 544164 - DNA, 20 bp, Artificial
  CRISPR gRNA sequence
actgttctcagatagtgaat

SEQ ID NO: 544165 - DNA, 20 bp, Artificial
  CRISPR gRNA sequence
atatttgatgattttataaa

SEQ ID NO: 544166 - DNA, 20 bp, Artificial
  CRISPR gRNA sequence
tatttgatgattttataaat

SEQ ID NO: 544167 - DNA, 20 bp, Artificial
  CRISPR gRNA sequence
atttgatgattttataaatg

SEQ ID NO: 544168 - DNA, 20 bp, Artificial
  CRISPR gRNA sequence
aaatggggattcccctgcac

SEQ ID NO: 544169 - DNA, 20 bp, Artificial
  CRISPR gRNA sequence
tctcttgcctactgccatgt

SEQ ID NO: 544170 - DNA, 20 bp, Artificial
  CRISPR gRNA sequence
tttgcattctgccatgattg

SEQ ID NO: 544171 - DNA, 20 bp, Artificial
  CRISPR gRNA sequence
ttgcattctgccatgattgt

SEQ ID NO: 544172 - DNA, 20 bp, Artificial
  CRISPR gRNA sequence
tgcattctgccatgattgtg

SEQ ID NO: 544173 - DNA, 20 bp, Artificial
  CRISPR gRNA sequence
ccatgattgtggggcctccc

SEQ ID NO: 544174 - DNA, 20 bp, Artificial
  CRISPR gRNA sequence
gattgtggggcctccctggc

SEQ ID NO: 544175 - DNA, 20 bp, Artificial
  CRISPR gRNA sequence
attgtggggcctccctggcc

SEQ ID NO: 544176 - DNA, 20 bp, Artificial
  CRISPR gRNA sequence
gtggggcctccctggccagg

SEQ ID NO: 544177 - DNA, 20 bp, Artificial
  CRISPR gRNA sequence
ccctggccaggtggaactgt

SEQ ID NO: 544178 - DNA, 20 bp, Artificial
  CRISPR gRNA sequence
tctttcctttataaattacc

SEQ ID NO: 544179 - DNA, 20 bp, Artificial
  CRISPR gRNA sequence
ctttataaattacccagtct

SEQ ID NO: 544180 - DNA, 20 bp, Artificial
  CRISPR gRNA sequence
tttataaattacccagtctt

SEQ ID NO: 544181 - DNA, 20 bp, Artificial
  CRISPR gRNA sequence
agtcttgggtatgtctttat

SEQ ID NO: 544182 - DNA, 20 bp, Artificial
  CRISPR gRNA sequence
cttgggtatgtctttattag

SEQ ID NO: 544183 - DNA, 20 bp, Artificial
  CRISPR gRNA sequence
tatgtctttattagcagcat

SEQ ID NO: 544184 - DNA, 20 bp, Artificial
  CRISPR gRNA sequence
ctttattagcagcatgagaa

SEQ ID NO: 544185 - DNA, 20 bp, Artificial
  CRISPR gRNA sequence
agcatgagaatggactaata

SEQ ID NO: 544186 - DNA, 20 bp, Artificial
  CRISPR gRNA sequence
aatggactaatatagtaaat

SEQ ID NO: 544187 - DNA, 20 bp, Artificial
  CRISPR gRNA sequence
ctaatatagtaaattggtac

SEQ ID NO: 544188 - DNA, 20 bp, Artificial
  CRISPR gRNA sequence
taatatagtaaattggtact

SEQ ID NO: 544189 - DNA, 20 bp, Artificial
  CRISPR gRNA sequence
tatagtaaattggtactggg

SEQ ID NO: 544190 - DNA, 20 bp, Artificial
  CRISPR gRNA sequence
agtaaattggtactgggtag

SEQ ID NO: 544191 - DNA, 20 bp, Artificial
  CRISPR gRNA sequence
gtaaattggtactgggtagt

SEQ ID NO: 544192 - DNA, 20 bp, Artificial
  CRISPR gRNA sequence
taaattggtactgggtagtg

SEQ ID NO: 544193 - DNA, 20 bp, Artificial
  CRISPR gRNA sequence
ggtagtggggcactgctgca

SEQ ID NO: 544194 - DNA, 20 bp, Artificial
  CRISPR gRNA sequence
tgcaaagatacctgaaaatg

SEQ ID NO: 544195 - DNA, 20 bp, Artificial
  CRISPR gRNA sequence
aaagatacctgaaaatgtgg

SEQ ID NO: 544196 - DNA, 20 bp, Artificial
  CRISPR gRNA sequence
tgaaaatgtggaagcaactt

SEQ ID NO: 544197 - DNA, 20 bp, Artificial
  CRISPR gRNA sequence
tgtggaagcaactttggaac

SEQ ID NO: 544198 - DNA, 20 bp, Artificial
  CRISPR gRNA sequence
gtggaagcaactttggaact

SEQ ID NO: 544199 - DNA, 20 bp, Artificial
  CRISPR gRNA sequence
gcaactttggaactgggtaa

SEQ ID NO: 544200 - DNA, 20 bp, Artificial
  CRISPR gRNA sequence
caactttggaactgggtaac

SEQ ID NO: 544201 - DNA, 20 bp, Artificial
  CRISPR gRNA sequence
ctttggaactgggtaacagg

SEQ ID NO: 544202 - DNA, 20 bp, Artificial
  CRISPR gRNA sequence
tttggaactgggtaacaggc

SEQ ID NO: 544203 - DNA, 20 bp, Artificial
  CRISPR gRNA sequence
ttggaactgggtaacaggca

SEQ ID NO: 544204 - DNA, 20 bp, Artificial
  CRISPR gRNA sequence
actgggtaacaggcagggat

SEQ ID NO: 544205 - DNA, 20 bp, Artificial
  CRISPR gRNA sequence
gtaacaggcagggattggaa

SEQ ID NO: 544206 - DNA, 20 bp, Artificial
  CRISPR gRNA sequence
aggcagggattggaatagtt

SEQ ID NO: 544207 - DNA, 20 bp, Artificial
  CRISPR gRNA sequence
cagggattggaatagtttgg

SEQ ID NO: 544208 - DNA, 20 bp, Artificial
  CRISPR gRNA sequence
ttggaatagtttggaagact

SEQ ID NO: 544209 - DNA, 20 bp, Artificial
  CRISPR gRNA sequence
gaatagtttggaagactcag

SEQ ID NO: 544210 - DNA, 20 bp, Artificial
  CRISPR gRNA sequence
tagtttggaagactcagaag

SEQ ID NO: 544211 - DNA, 20 bp, Artificial
  CRISPR gRNA sequence
ttggaagactcagaagaaga

SEQ ID NO: 544212 - DNA, 20 bp, Artificial
  CRISPR gRNA sequence
tggaagactcagaagaagac

SEQ ID NO: 544213 - DNA, 20 bp, Artificial
  CRISPR gRNA sequence
aagactcagaagaagacagg

SEQ ID NO: 544214 - DNA, 20 bp, Artificial
  CRISPR gRNA sequence
cagaagaagacaggaagatg

SEQ ID NO: 544215 - DNA, 20 bp, Artificial
  CRISPR gRNA sequence
agaagaagacaggaagatgt

SEQ ID NO: 544216 - DNA, 20 bp, Artificial
  CRISPR gRNA sequence
gaagacaggaagatgtggga

SEQ ID NO: 544217 - DNA, 20 bp, Artificial
  CRISPR gRNA sequence
caggaagatgtgggaaagtt

SEQ ID NO: 544218 - DNA, 20 bp, Artificial
  CRISPR gRNA sequence
tgggaaagtttggaacttcc

SEQ ID NO: 544219 - DNA, 20 bp, Artificial
  CRISPR gRNA sequence
ggaaagtttggaacttccta

SEQ ID NO: 544220 - DNA, 20 bp, Artificial
  CRISPR gRNA sequence
cttcctagagacttgttgaa

SEQ ID NO: 544221 - DNA, 20 bp, Artificial
  CRISPR gRNA sequence
tgaccaaatgctgctcatct

SEQ ID NO: 544222 - DNA, 20 bp, Artificial
  CRISPR gRNA sequence
caaatgctgctcatctcaga

SEQ ID NO: 544223 - DNA, 20 bp, Artificial
  CRISPR gRNA sequence
aatgctgctcatctcagatg

SEQ ID NO: 544224 - DNA, 20 bp, Artificial
  CRISPR gRNA sequence
tgctcatctcagatggagat

SEQ ID NO: 544225 - DNA, 20 bp, Artificial
  CRISPR gRNA sequence
gctcatctcagatggagatg

SEQ ID NO: 544226 - DNA, 20 bp, Artificial
  CRISPR gRNA sequence
tggagatgaggaacaattgt

SEQ ID NO: 544227 - DNA, 20 bp, Artificial
  CRISPR gRNA sequence
ggagatgaggaacaattgtt

SEQ ID NO: 544228 - DNA, 20 bp, Artificial
  CRISPR gRNA sequence
gaggaacaattgttgggaac

SEQ ID NO: 544229 - DNA, 20 bp, Artificial
  CRISPR gRNA sequence
aattgttgggaactggaata

SEQ ID NO: 544230 - DNA, 20 bp, Artificial
  CRISPR gRNA sequence
attgttgggaactggaataa

SEQ ID NO: 544231 - DNA, 20 bp, Artificial
  CRISPR gRNA sequence
aggtgactcttaatatgttt

SEQ ID NO: 544232 - DNA, 20 bp, Artificial
  CRISPR gRNA sequence
actcttaatatgttttagca

SEQ ID NO: 544233 - DNA, 20 bp, Artificial
  CRISPR gRNA sequence
tcttaatatgttttagcaaa

SEQ ID NO: 544234 - DNA, 20 bp, Artificial
  CRISPR gRNA sequence
atatgttttagcaaagagac

SEQ ID NO: 544235 - DNA, 20 bp, Artificial
  CRISPR gRNA sequence
tgttttagcaaagagactgg

SEQ ID NO: 544236 - DNA, 20 bp, Artificial
  CRISPR gRNA sequence
agcattttgcctgtgcccta

SEQ ID NO: 544237 - DNA, 20 bp, Artificial
  CRISPR gRNA sequence
gcctgtgccctaaagatacg

SEQ ID NO: 544238 - DNA, 20 bp, Artificial
  CRISPR gRNA sequence
atacgtggaactttgaactt

SEQ ID NO: 544239 - DNA, 20 bp, Artificial
  CRISPR gRNA sequence
acgtggaactttgaacttga

SEQ ID NO: 544240 - DNA, 20 bp, Artificial
  CRISPR gRNA sequence
tgaacttgagagaaattatt

SEQ ID NO: 544241 - DNA, 20 bp, Artificial
  CRISPR gRNA sequence
gaacttgagagaaattattt

SEQ ID NO: 544242 - DNA, 20 bp, Artificial
  CRISPR gRNA sequence
aacttgagagaaattattta

SEQ ID NO: 544243 - DNA, 20 bp, Artificial
  CRISPR gRNA sequence
gagaaattatttagggcatc

SEQ ID NO: 544244 - DNA, 20 bp, Artificial
  CRISPR gRNA sequence
aaattatttagggcatctgg

SEQ ID NO: 544245 - DNA, 20 bp, Artificial
  CRISPR gRNA sequence
ttatttagggcatctggtgg

SEQ ID NO: 544246 - DNA, 20 bp, Artificial
  CRISPR gRNA sequence
atctggtggaagaaatttct

SEQ ID NO: 544247 - DNA, 20 bp, Artificial
  CRISPR gRNA sequence
tggtggaagaaatttctaag

SEQ ID NO: 544248 - DNA, 20 bp, Artificial
  CRISPR gRNA sequence
gaagaaatttctaagcagca

SEQ ID NO: 544249 - DNA, 20 bp, Artificial
  CRISPR gRNA sequence
ttctaagcagcaaagcattc

SEQ ID NO: 544250 - DNA, 20 bp, Artificial
  CRISPR gRNA sequence
ctaagcagcaaagcattcaa

SEQ ID NO: 544251 - DNA, 20 bp, Artificial
  CRISPR gRNA sequence
taagcagcaaagcattcaag

SEQ ID NO: 544252 - DNA, 20 bp, Artificial
  CRISPR gRNA sequence
gcagcaaagcattcaagagg

SEQ ID NO: 544253 - DNA, 20 bp, Artificial
  CRISPR gRNA sequence
aaagcattcaagaggtggct

SEQ ID NO: 544254 - DNA, 20 bp, Artificial
  CRISPR gRNA sequence
ggtggcttggttgctgttaa

SEQ ID NO: 544255 - DNA, 20 bp, Artificial
  CRISPR gRNA sequence
tggttgctgttaaaagcatt

SEQ ID NO: 544256 - DNA, 20 bp, Artificial
  CRISPR gRNA sequence
ttcagttttatatgttcaca

SEQ ID NO: 544257 - DNA, 20 bp, Artificial
  CRISPR gRNA sequence
tttatatgttcacaaagatg

SEQ ID NO: 544258 - DNA, 20 bp, Artificial
  CRISPR gRNA sequence
atgttcacaaagatgtggtt

SEQ ID NO: 544259 - DNA, 20 bp, Artificial
  CRISPR gRNA sequence
acaaagatgtggtttggaat

SEQ ID NO: 544260 - DNA, 20 bp, Artificial
  CRISPR gRNA sequence
gaattggaacttatgtttaa

SEQ ID NO: 544261 - DNA, 20 bp, Artificial
  CRISPR gRNA sequence
aattggaacttatgtttaaa

SEQ ID NO: 544262 - DNA, 20 bp, Artificial
  CRISPR gRNA sequence
ggaacttatgtttaaaagga

SEQ ID NO: 544263 - DNA, 20 bp, Artificial
  CRISPR gRNA sequence
acttatgtttaaaaggatag

SEQ ID NO: 544264 - DNA, 20 bp, Artificial
  CRISPR gRNA sequence
cttatgtttaaaaggatagc

SEQ ID NO: 544265 - DNA, 20 bp, Artificial
  CRISPR gRNA sequence
ttatgtttaaaaggatagca

SEQ ID NO: 544266 - DNA, 20 bp, Artificial
  CRISPR gRNA sequence
aaaaggatagcagggcataa

SEQ ID NO: 544267 - DNA, 20 bp, Artificial
  CRISPR gRNA sequence
ataaaagttcaaaaaatttg

SEQ ID NO: 544268 - DNA, 20 bp, Artificial
  CRISPR gRNA sequence
tttgcagcccaatgatgcaa

SEQ ID NO: 544269 - DNA, 20 bp, Artificial
  CRISPR gRNA sequence
agcccaatgatgcaatagaa

SEQ ID NO: 544270 - DNA, 20 bp, Artificial
  CRISPR gRNA sequence
aaaagaaaaaccccttttct

SEQ ID NO: 544271 - DNA, 20 bp, Artificial
  CRISPR gRNA sequence
aaagaaaaaccccttttctg

SEQ ID NO: 544272 - DNA, 20 bp, Artificial
  CRISPR gRNA sequence
ccttttctgaggaaaaattc

SEQ ID NO: 544273 - DNA, 20 bp, Artificial
  CRISPR gRNA sequence
ttctgaggaaaaattcaagc

SEQ ID NO: 544274 - DNA, 20 bp, Artificial
  CRISPR gRNA sequence
ggaaaaattcaagccagctg

SEQ ID NO: 544275 - DNA, 20 bp, Artificial
  CRISPR gRNA sequence
cagctgcagaaatttgcatt

SEQ ID NO: 544276 - DNA, 20 bp, Artificial
  CRISPR gRNA sequence
agaaatttgcattaagtaat

SEQ ID NO: 544277 - DNA, 20 bp, Artificial
  CRISPR gRNA sequence
gaaatttgcattaagtaatg

SEQ ID NO: 544278 - DNA, 20 bp, Artificial
  CRISPR gRNA sequence
aatttgcattaagtaatgag

SEQ ID NO: 544279 - DNA, 20 bp, Artificial
  CRISPR gRNA sequence
ggagccaaatgttaatcacg

SEQ ID NO: 544280 - DNA, 20 bp, Artificial
  CRISPR gRNA sequence
aatgttaatcacgaagacaa

SEQ ID NO: 544281 - DNA, 20 bp, Artificial
  CRISPR gRNA sequence
atgttaatcacgaagacaat

SEQ ID NO: 544282 - DNA, 20 bp, Artificial
  CRISPR gRNA sequence
tgttaatcacgaagacaatg

SEQ ID NO: 544283 - DNA, 20 bp, Artificial
  CRISPR gRNA sequence
gacaatggggaaaatgtctc

SEQ ID NO: 544284 - DNA, 20 bp, Artificial
  CRISPR gRNA sequence
acaatggggaaaatgtctcc

SEQ ID NO: 544285 - DNA, 20 bp, Artificial
  CRISPR gRNA sequence
caatggggaaaatgtctcca

SEQ ID NO: 544286 - DNA, 20 bp, Artificial
  CRISPR gRNA sequence
aaaatgtctccagggcatat

SEQ ID NO: 544287 - DNA, 20 bp, Artificial
  CRISPR gRNA sequence
gggcatatcagaaaccttca

SEQ ID NO: 544288 - DNA, 20 bp, Artificial
  CRISPR gRNA sequence
catatcagaaaccttcatgg

SEQ ID NO: 544289 - DNA, 20 bp, Artificial
  CRISPR gRNA sequence
catggcagcccctcctatca

SEQ ID NO: 544290 - DNA, 20 bp, Artificial
  CRISPR gRNA sequence
atggcagcccctcctatcac

SEQ ID NO: 544291 - DNA, 20 bp, Artificial
  CRISPR gRNA sequence
agcccctcctatcacaggcc

SEQ ID NO: 544292 - DNA, 20 bp, Artificial
  CRISPR gRNA sequence
cccctcctatcacaggcctg

SEQ ID NO: 544293 - DNA, 20 bp, Artificial
  CRISPR gRNA sequence
ccctcctatcacaggcctgg

SEQ ID NO: 544294 - DNA, 20 bp, Artificial
  CRISPR gRNA sequence
tatcacaggcctggaggcct

SEQ ID NO: 544295 - DNA, 20 bp, Artificial
  CRISPR gRNA sequence
tcacaggcctggaggccttg

SEQ ID NO: 544296 - DNA, 20 bp, Artificial
  CRISPR gRNA sequence
cacaggcctggaggccttgg

SEQ ID NO: 544297 - DNA, 20 bp, Artificial
  CRISPR gRNA sequence
acaggcctggaggccttgga

SEQ ID NO: 544298 - DNA, 20 bp, Artificial
  CRISPR gRNA sequence
tggagggaaaaattgtttca

SEQ ID NO: 544299 - DNA, 20 bp, Artificial
  CRISPR gRNA sequence
ggagggaaaaattgtttcat

SEQ ID NO: 544300 - DNA, 20 bp, Artificial
  CRISPR gRNA sequence
ggaaaaattgtttcatgggc

SEQ ID NO: 544301 - DNA, 20 bp, Artificial
  CRISPR gRNA sequence
attgtttcatgggctggacc

SEQ ID NO: 544302 - DNA, 20 bp, Artificial
  CRISPR gRNA sequence
ttgtttcatgggctggaccc

SEQ ID NO: 544303 - DNA, 20 bp, Artificial
  CRISPR gRNA sequence
tgtttcatgggctggaccca

SEQ ID NO: 544304 - DNA, 20 bp, Artificial
  CRISPR gRNA sequence
cagggcccccctgctctttg

SEQ ID NO: 544305 - DNA, 20 bp, Artificial
  CRISPR gRNA sequence
ctctttgcagcctccaaaca

SEQ ID NO: 544306 - DNA, 20 bp, Artificial
  CRISPR gRNA sequence
ctttgcagcctccaaacatg

SEQ ID NO: 544307 - DNA, 20 bp, Artificial
  CRISPR gRNA sequence
aaacatggagccctgcatgc

SEQ ID NO: 544308 - DNA, 20 bp, Artificial
  CRISPR gRNA sequence
gccctgcatgccagctgttt

SEQ ID NO: 544309 - DNA, 20 bp, Artificial
  CRISPR gRNA sequence
catgccagctgttttagctc

SEQ ID NO: 544310 - DNA, 20 bp, Artificial
  CRISPR gRNA sequence
agctgttttagctccagcca

SEQ ID NO: 544311 - DNA, 20 bp, Artificial
  CRISPR gRNA sequence
ttagctccagccatggctaa

SEQ ID NO: 544312 - DNA, 20 bp, Artificial
  CRISPR gRNA sequence
tagctccagccatggctaaa

SEQ ID NO: 544313 - DNA, 20 bp, Artificial
  CRISPR gRNA sequence
agctccagccatggctaaaa

SEQ ID NO: 544314 - DNA, 20 bp, Artificial
  CRISPR gRNA sequence
gctccagccatggctaaaag

SEQ ID NO: 544315 - DNA, 20 bp, Artificial
  CRISPR gRNA sequence
aaaggggccaacataccact

SEQ ID NO: 544316 - DNA, 20 bp, Artificial
  CRISPR gRNA sequence
aaggggccaacataccactc

SEQ ID NO: 544317 - DNA, 20 bp, Artificial
  CRISPR gRNA sequence
taccactcaggctgttgctt

SEQ ID NO: 544318 - DNA, 20 bp, Artificial
  CRISPR gRNA sequence
ccactcaggctgttgcttca

SEQ ID NO: 544319 - DNA, 20 bp, Artificial
  CRISPR gRNA sequence
cactcaggctgttgcttcag

SEQ ID NO: 544320 - DNA, 20 bp, Artificial
  CRISPR gRNA sequence
actcaggctgttgcttcaga

SEQ ID NO: 544321 - DNA, 20 bp, Artificial
  CRISPR gRNA sequence
aggctgttgcttcagagggt

SEQ ID NO: 544322 - DNA, 20 bp, Artificial
  CRISPR gRNA sequence
ttgcttcagagggtaagcct

SEQ ID NO: 544323 - DNA, 20 bp, Artificial
  CRISPR gRNA sequence
cttcagagggtaagccttgg

SEQ ID NO: 544324 - DNA, 20 bp, Artificial
  CRISPR gRNA sequence
aagccttggtggcttacatg

SEQ ID NO: 544325 - DNA, 20 bp, Artificial
  CRISPR gRNA sequence
tggtggcttacatgtggtgt

SEQ ID NO: 544326 - DNA, 20 bp, Artificial
  CRISPR gRNA sequence
ggtggcttacatgtggtgtt

SEQ ID NO: 544327 - DNA, 20 bp, Artificial
  CRISPR gRNA sequence
tacatgtggtgttgggcctg

SEQ ID NO: 544328 - DNA, 20 bp, Artificial
  CRISPR gRNA sequence
gtgttgggcctgtggatgca

SEQ ID NO: 544329 - DNA, 20 bp, Artificial
  CRISPR gRNA sequence
ttgggcctgtggatgcacag

SEQ ID NO: 544330 - DNA, 20 bp, Artificial
  CRISPR gRNA sequence
cctgtggatgcacagaagtc

SEQ ID NO: 544331 - DNA, 20 bp, Artificial
  CRISPR gRNA sequence
atgcacagaagtcaagaatt

SEQ ID NO: 544332 - DNA, 20 bp, Artificial
  CRISPR gRNA sequence
tgcacagaagtcaagaattg

SEQ ID NO: 544333 - DNA, 20 bp, Artificial
  CRISPR gRNA sequence
gaagtcaagaattgaggttt

SEQ ID NO: 544334 - DNA, 20 bp, Artificial
  CRISPR gRNA sequence
gaggtttgagaacctctgcc

SEQ ID NO: 544335 - DNA, 20 bp, Artificial
  CRISPR gRNA sequence
gagaacctctgcctagattt

SEQ ID NO: 544336 - DNA, 20 bp, Artificial
  CRISPR gRNA sequence
gaacctctgcctagatttca

SEQ ID NO: 544337 - DNA, 20 bp, Artificial
  CRISPR gRNA sequence
aacctctgcctagatttcag

SEQ ID NO: 544338 - DNA, 20 bp, Artificial
  CRISPR gRNA sequence
cctagatttcagaggatgta

SEQ ID NO: 544339 - DNA, 20 bp, Artificial
  CRISPR gRNA sequence
agaggatgtatggaaatgcc

SEQ ID NO: 544340 - DNA, 20 bp, Artificial
  CRISPR gRNA sequence
tatggaaatgcctggatgtc

SEQ ID NO: 544341 - DNA, 20 bp, Artificial
  CRISPR gRNA sequence
atggaaatgcctggatgtcc

SEQ ID NO: 544342 - DNA, 20 bp, Artificial
  CRISPR gRNA sequence
gaaatgcctggatgtccagg

SEQ ID NO: 544343 - DNA, 20 bp, Artificial
  CRISPR gRNA sequence
atgcctggatgtccaggcag

SEQ ID NO: 544344 - DNA, 20 bp, Artificial
  CRISPR gRNA sequence
gtccaggcagaagtttgctg

SEQ ID NO: 544345 - DNA, 20 bp, Artificial
  CRISPR gRNA sequence
tccaggcagaagtttgctgc

SEQ ID NO: 544346 - DNA, 20 bp, Artificial
  CRISPR gRNA sequence
caggcagaagtttgctgcag

SEQ ID NO: 544347 - DNA, 20 bp, Artificial
  CRISPR gRNA sequence
gcagaagtttgctgcaggag

SEQ ID NO: 544348 - DNA, 20 bp, Artificial
  CRISPR gRNA sequence
cagaagtttgctgcaggagt

SEQ ID NO: 544349 - DNA, 20 bp, Artificial
  CRISPR gRNA sequence
ctgcaggagtgggaccctca

SEQ ID NO: 544350 - DNA, 20 bp, Artificial
  CRISPR gRNA sequence
gcaggagtgggaccctcatg

SEQ ID NO: 544351 - DNA, 20 bp, Artificial
  CRISPR gRNA sequence
ccctcatggagaacctctgc

SEQ ID NO: 544352 - DNA, 20 bp, Artificial
  CRISPR gRNA sequence
cctcatggagaacctctgct

SEQ ID NO: 544353 - DNA, 20 bp, Artificial
  CRISPR gRNA sequence
ctcatggagaacctctgcta

SEQ ID NO: 544354 - DNA, 20 bp, Artificial
  CRISPR gRNA sequence
atggagaacctctgctaggg

SEQ ID NO: 544355 - DNA, 20 bp, Artificial
  CRISPR gRNA sequence
gaacctctgctagggcagtg

SEQ ID NO: 544356 - DNA, 20 bp, Artificial
  CRISPR gRNA sequence
cctctgctagggcagtgtgg

SEQ ID NO: 544357 - DNA, 20 bp, Artificial
  CRISPR gRNA sequence
ctctgctagggcagtgtgga

SEQ ID NO: 544358 - DNA, 20 bp, Artificial
  CRISPR gRNA sequence
tctgctagggcagtgtggaa

SEQ ID NO: 544359 - DNA, 20 bp, Artificial
  CRISPR gRNA sequence
ggcagtgtggaagggaaatg

SEQ ID NO: 544360 - DNA, 20 bp, Artificial
  CRISPR gRNA sequence
cagtgtggaagggaaatgtg

SEQ ID NO: 544361 - DNA, 20 bp, Artificial
  CRISPR gRNA sequence
gtggaagggaaatgtggagt

SEQ ID NO: 544362 - DNA, 20 bp, Artificial
  CRISPR gRNA sequence
ggaagggaaatgtggagttg

SEQ ID NO: 544363 - DNA, 20 bp, Artificial
  CRISPR gRNA sequence
gtggagttggagcccccaca

SEQ ID NO: 544364 - DNA, 20 bp, Artificial
  CRISPR gRNA sequence
ggagttggagcccccacaca

SEQ ID NO: 544365 - DNA, 20 bp, Artificial
  CRISPR gRNA sequence
cccccacacagagtccccac

SEQ ID NO: 544366 - DNA, 20 bp, Artificial
  CRISPR gRNA sequence
ccccacacagagtccccact

SEQ ID NO: 544367 - DNA, 20 bp, Artificial
  CRISPR gRNA sequence
cccacacagagtccccactg

SEQ ID NO: 544368 - DNA, 20 bp, Artificial
  CRISPR gRNA sequence
gtccccactggggcaccgcc

SEQ ID NO: 544369 - DNA, 20 bp, Artificial
  CRISPR gRNA sequence
cccactggggcaccgcctag

SEQ ID NO: 544370 - DNA, 20 bp, Artificial
  CRISPR gRNA sequence
cactggggcaccgcctagtg

SEQ ID NO: 544371 - DNA, 20 bp, Artificial
  CRISPR gRNA sequence
gcaccgcctagtggagctgt

SEQ ID NO: 544372 - DNA, 20 bp, Artificial
  CRISPR gRNA sequence
ccgcctagtggagctgtgag

SEQ ID NO: 544373 - DNA, 20 bp, Artificial
  CRISPR gRNA sequence
gcctagtggagctgtgagaa

SEQ ID NO: 544374 - DNA, 20 bp, Artificial
  CRISPR gRNA sequence
cctagtggagctgtgagaag

SEQ ID NO: 544375 - DNA, 20 bp, Artificial
  CRISPR gRNA sequence
ctagtggagctgtgagaaga

SEQ ID NO: 544376 - DNA, 20 bp, Artificial
  CRISPR gRNA sequence
agaagagggccatcatccac

SEQ ID NO: 544377 - DNA, 20 bp, Artificial
  CRISPR gRNA sequence
ggccatcatccaccagaccc

SEQ ID NO: 544378 - DNA, 20 bp, Artificial
  CRISPR gRNA sequence
tcatccaccagaccccggaa

SEQ ID NO: 544379 - DNA, 20 bp, Artificial
  CRISPR gRNA sequence
tccaccagaccccggaatgg

SEQ ID NO: 544380 - DNA, 20 bp, Artificial
  CRISPR gRNA sequence
cccggaatggtagatccacc

SEQ ID NO: 544381 - DNA, 20 bp, Artificial
  CRISPR gRNA sequence
cggaatggtagatccaccga

SEQ ID NO: 544382 - DNA, 20 bp, Artificial
  CRISPR gRNA sequence
gagagcttgcaccgtgtacc

SEQ ID NO: 544383 - DNA, 20 bp, Artificial
  CRISPR gRNA sequence
cttgcaccgtgtacctggaa

SEQ ID NO: 544384 - DNA, 20 bp, Artificial
  CRISPR gRNA sequence
ccgtgtacctggaaaagcca

SEQ ID NO: 544385 - DNA, 20 bp, Artificial
  CRISPR gRNA sequence
aagccacagacacttaatgc

SEQ ID NO: 544386 - DNA, 20 bp, Artificial
  CRISPR gRNA sequence
cacttaatgccagctcatga

SEQ ID NO: 544387 - DNA, 20 bp, Artificial
  CRISPR gRNA sequence
ttaatgccagctcatgaaag

SEQ ID NO: 544388 - DNA, 20 bp, Artificial
  CRISPR gRNA sequence
tgccagctcatgaaagcagc

SEQ ID NO: 544389 - DNA, 20 bp, Artificial
  CRISPR gRNA sequence
gccagctcatgaaagcagcc

SEQ ID NO: 544390 - DNA, 20 bp, Artificial
  CRISPR gRNA sequence
cagctcatgaaagcagccag

SEQ ID NO: 544391 - DNA, 20 bp, Artificial
  CRISPR gRNA sequence
agctcatgaaagcagccagg

SEQ ID NO: 544392 - DNA, 20 bp, Artificial
  CRISPR gRNA sequence
catgaaagcagccaggagga

SEQ ID NO: 544393 - DNA, 20 bp, Artificial
  CRISPR gRNA sequence
gaggatggctgtaccctgca

SEQ ID NO: 544394 - DNA, 20 bp, Artificial
  CRISPR gRNA sequence
ggctgtaccctgcaaagcca

SEQ ID NO: 544395 - DNA, 20 bp, Artificial
  CRISPR gRNA sequence
gctgtaccctgcaaagccac

SEQ ID NO: 544396 - DNA, 20 bp, Artificial
  CRISPR gRNA sequence
ctgtaccctgcaaagccaca

SEQ ID NO: 544397 - DNA, 20 bp, Artificial
  CRISPR gRNA sequence
tgtaccctgcaaagccacag

SEQ ID NO: 544398 - DNA, 20 bp, Artificial
  CRISPR gRNA sequence
accctgcaaagccacagggg

SEQ ID NO: 544399 - DNA, 20 bp, Artificial
  CRISPR gRNA sequence
cctgcaaagccacaggggaa

SEQ ID NO: 544400 - DNA, 20 bp, Artificial
  CRISPR gRNA sequence
ccacaggggaagagctgccc

SEQ ID NO: 544401 - DNA, 20 bp, Artificial
  CRISPR gRNA sequence
cacaggggaagagctgccca

SEQ ID NO: 544402 - DNA, 20 bp, Artificial
  CRISPR gRNA sequence
ggaagagctgcccaaggttg

SEQ ID NO: 544403 - DNA, 20 bp, Artificial
  CRISPR gRNA sequence
gaagagctgcccaaggttgt

SEQ ID NO: 544404 - DNA, 20 bp, Artificial
  CRISPR gRNA sequence
agagctgcccaaggttgtgg

SEQ ID NO: 544405 - DNA, 20 bp, Artificial
  CRISPR gRNA sequence
agcccatctcttgcgtcacc

SEQ ID NO: 544406 - DNA, 20 bp, Artificial
  CRISPR gRNA sequence
ctcttgcgtcacctggatgt

SEQ ID NO: 544407 - DNA, 20 bp, Artificial
  CRISPR gRNA sequence
tcttgcgtcacctggatgtg

SEQ ID NO: 544408 - DNA, 20 bp, Artificial
  CRISPR gRNA sequence
cgtcacctggatgtgaggca

SEQ ID NO: 544409 - DNA, 20 bp, Artificial
  CRISPR gRNA sequence
tcacctggatgtgaggcatg

SEQ ID NO: 544410 - DNA, 20 bp, Artificial
  CRISPR gRNA sequence
ggatgtgaggcatggagtca

SEQ ID NO: 544411 - DNA, 20 bp, Artificial
  CRISPR gRNA sequence
gatgtgaggcatggagtcaa

SEQ ID NO: 544412 - DNA, 20 bp, Artificial
  CRISPR gRNA sequence
tgtgaggcatggagtcaaag

SEQ ID NO: 544413 - DNA, 20 bp, Artificial
  CRISPR gRNA sequence
ggagtcaaaggagatcattt

SEQ ID NO: 544414 - DNA, 20 bp, Artificial
  CRISPR gRNA sequence
ggagatcattttggaacttt

SEQ ID NO: 544415 - DNA, 20 bp, Artificial
  CRISPR gRNA sequence
gagatcattttggaacttta

SEQ ID NO: 544416 - DNA, 20 bp, Artificial
  CRISPR gRNA sequence
attttggaactttaaggttt

SEQ ID NO: 544417 - DNA, 20 bp, Artificial
  CRISPR gRNA sequence
aaggtttaagactgccctat

SEQ ID NO: 544418 - DNA, 20 bp, Artificial
  CRISPR gRNA sequence
taagactgccctattggatt

SEQ ID NO: 544419 - DNA, 20 bp, Artificial
  CRISPR gRNA sequence
aagactgccctattggattt

SEQ ID NO: 544420 - DNA, 20 bp, Artificial
  CRISPR gRNA sequence
tattggatttaggacttgca

SEQ ID NO: 544421 - DNA, 20 bp, Artificial
  CRISPR gRNA sequence
attggatttaggacttgcat

SEQ ID NO: 544422 - DNA, 20 bp, Artificial
  CRISPR gRNA sequence
ttggatttaggacttgcatg

SEQ ID NO: 544423 - DNA, 20 bp, Artificial
  CRISPR gRNA sequence
taggacttgcatggggcctg

SEQ ID NO: 544424 - DNA, 20 bp, Artificial
  CRISPR gRNA sequence
ggcctgtagcccttttgttt

SEQ ID NO: 544425 - DNA, 20 bp, Artificial
  CRISPR gRNA sequence
tttggacaatttctcccatt

SEQ ID NO: 544426 - DNA, 20 bp, Artificial
  CRISPR gRNA sequence
acaatttctcccatttggaa

SEQ ID NO: 544427 - DNA, 20 bp, Artificial
  CRISPR gRNA sequence
ttggaatggatatatttact

SEQ ID NO: 544428 - DNA, 20 bp, Artificial
  CRISPR gRNA sequence
acctgtacccccattgtatc

SEQ ID NO: 544429 - DNA, 20 bp, Artificial
  CRISPR gRNA sequence
cctgtacccccattgtatct

SEQ ID NO: 544430 - DNA, 20 bp, Artificial
  CRISPR gRNA sequence
gtacccccattgtatctagg

SEQ ID NO: 544431 - DNA, 20 bp, Artificial
  CRISPR gRNA sequence
ctaacttgcctttgatttta

SEQ ID NO: 544432 - DNA, 20 bp, Artificial
  CRISPR gRNA sequence
taacttgcctttgattttac

SEQ ID NO: 544433 - DNA, 20 bp, Artificial
  CRISPR gRNA sequence
cctttgattttacaggctca

SEQ ID NO: 544434 - DNA, 20 bp, Artificial
  CRISPR gRNA sequence
ctttgattttacaggctcat

SEQ ID NO: 544435 - DNA, 20 bp, Artificial
  CRISPR gRNA sequence
tgattttacaggctcatagg

SEQ ID NO: 544436 - DNA, 20 bp, Artificial
  CRISPR gRNA sequence
ttttacaggctcataggtgg

SEQ ID NO: 544437 - DNA, 20 bp, Artificial
  CRISPR gRNA sequence
tttacaggctcataggtgga

SEQ ID NO: 544438 - DNA, 20 bp, Artificial
  CRISPR gRNA sequence
gtacttgccttatctccgat

SEQ ID NO: 544439 - DNA, 20 bp, Artificial
  CRISPR gRNA sequence
ccttatctccgatgagactt

SEQ ID NO: 544440 - DNA, 20 bp, Artificial
  CRISPR gRNA sequence
ctccgatgagactttggatt

SEQ ID NO: 544441 - DNA, 20 bp, Artificial
  CRISPR gRNA sequence
agactttggatttagacttt

SEQ ID NO: 544442 - DNA, 20 bp, Artificial
  CRISPR gRNA sequence
ttagacttttggattaatgc

SEQ ID NO: 544443 - DNA, 20 bp, Artificial
  CRISPR gRNA sequence
ttttggattaatgctggaat

SEQ ID NO: 544444 - DNA, 20 bp, Artificial
  CRISPR gRNA sequence
gattaatgctggaataagtt

SEQ ID NO: 544445 - DNA, 20 bp, Artificial
  CRISPR gRNA sequence
ctggaataagttaagatttt

SEQ ID NO: 544446 - DNA, 20 bp, Artificial
  CRISPR gRNA sequence
tggaataagttaagattttg

SEQ ID NO: 544447 - DNA, 20 bp, Artificial
  CRISPR gRNA sequence
ggaataagttaagattttga

SEQ ID NO: 544448 - DNA, 20 bp, Artificial
  CRISPR gRNA sequence
ttaagattttgagggactgt

SEQ ID NO: 544449 - DNA, 20 bp, Artificial
  CRISPR gRNA sequence
agattttgagggactgttgg

SEQ ID NO: 544450 - DNA, 20 bp, Artificial
  CRISPR gRNA sequence
gattttgagggactgttgga

SEQ ID NO: 544451 - DNA, 20 bp, Artificial
  CRISPR gRNA sequence
attttgagggactgttggaa

SEQ ID NO: 544452 - DNA, 20 bp, Artificial
  CRISPR gRNA sequence
attattgtgttttgaaatgt

SEQ ID NO: 544453 - DNA, 20 bp, Artificial
  CRISPR gRNA sequence
ttattgtgttttgaaatgtg

SEQ ID NO: 544454 - DNA, 20 bp, Artificial
  CRISPR gRNA sequence
gttttgaaatgtgaggacat

SEQ ID NO: 544455 - DNA, 20 bp, Artificial
  CRISPR gRNA sequence
aaatgtgaggacatgagatt

SEQ ID NO: 544456 - DNA, 20 bp, Artificial
  CRISPR gRNA sequence
aatgtgaggacatgagattt

SEQ ID NO: 544457 - DNA, 20 bp, Artificial
  CRISPR gRNA sequence
tgtgaggacatgagatttgg

SEQ ID NO: 544458 - DNA, 20 bp, Artificial
  CRISPR gRNA sequence
gtgaggacatgagatttggg

SEQ ID NO: 544459 - DNA, 20 bp, Artificial
  CRISPR gRNA sequence
tgaggacatgagatttggga

SEQ ID NO: 544460 - DNA, 20 bp, Artificial
  CRISPR gRNA sequence
gaggacatgagatttgggag

SEQ ID NO: 544461 - DNA, 20 bp, Artificial
  CRISPR gRNA sequence
acatgagatttgggaggggc

SEQ ID NO: 544462 - DNA, 20 bp, Artificial
  CRISPR gRNA sequence
catgagatttgggaggggcc

SEQ ID NO: 544463 - DNA, 20 bp, Artificial
  CRISPR gRNA sequence
atgagatttgggaggggccg

SEQ ID NO: 544464 - DNA, 20 bp, Artificial
  CRISPR gRNA sequence
agatttgggaggggccgggg

SEQ ID NO: 544465 - DNA, 20 bp, Artificial
  CRISPR gRNA sequence
ggggccggggtggaatgata

SEQ ID NO: 544466 - DNA, 20 bp, Artificial
  CRISPR gRNA sequence
cggggtggaatgatatggtt

SEQ ID NO: 544467 - DNA, 20 bp, Artificial
  CRISPR gRNA sequence
tgtaataatccccgtgtgtc

SEQ ID NO: 544468 - DNA, 20 bp, Artificial
  CRISPR gRNA sequence
gtaataatccccgtgtgtca

SEQ ID NO: 544469 - DNA, 20 bp, Artificial
  CRISPR gRNA sequence
taataatccccgtgtgtcaa

SEQ ID NO: 544470 - DNA, 20 bp, Artificial
  CRISPR gRNA sequence
taatccccgtgtgtcaaggg

SEQ ID NO: 544471 - DNA, 20 bp, Artificial
  CRISPR gRNA sequence
aatccccgtgtgtcaagggc

SEQ ID NO: 544472 - DNA, 20 bp, Artificial
  CRISPR gRNA sequence
atccccgtgtgtcaagggca

SEQ ID NO: 544473 - DNA, 20 bp, Artificial
  CRISPR gRNA sequence
ccgtgtgtcaagggcagggc

SEQ ID NO: 544474 - DNA, 20 bp, Artificial
  CRISPR gRNA sequence
cgtgtgtcaagggcagggcc

SEQ ID NO: 544475 - DNA, 20 bp, Artificial
  CRISPR gRNA sequence
gtgtcaagggcagggccagg

SEQ ID NO: 544476 - DNA, 20 bp, Artificial
  CRISPR gRNA sequence
gtcaagggcagggccaggtg

SEQ ID NO: 544477 - DNA, 20 bp, Artificial
  CRISPR gRNA sequence
ggtggagataattgaatcat

SEQ ID NO: 544478 - DNA, 20 bp, Artificial
  CRISPR gRNA sequence
gtggagataattgaatcatg

SEQ ID NO: 544479 - DNA, 20 bp, Artificial
  CRISPR gRNA sequence
tggagataattgaatcatga

SEQ ID NO: 544480 - DNA, 20 bp, Artificial
  CRISPR gRNA sequence
agataattgaatcatgaggg

SEQ ID NO: 544481 - DNA, 20 bp, Artificial
  CRISPR gRNA sequence
cctctatactgttcttgtga

SEQ ID NO: 544482 - DNA, 20 bp, Artificial
  CRISPR gRNA sequence
ctgttcttgtgatagtgaat

SEQ ID NO: 544483 - DNA, 20 bp, Artificial
  CRISPR gRNA sequence
tgatagtgaataagtctcac

SEQ ID NO: 544484 - DNA, 20 bp, Artificial
  CRISPR gRNA sequence
ataagtctcacaagatctga

SEQ ID NO: 544485 - DNA, 20 bp, Artificial
  CRISPR gRNA sequence
caagatctgatggtttcata

SEQ ID NO: 544486 - DNA, 20 bp, Artificial
  CRISPR gRNA sequence
aagatctgatggtttcataa

SEQ ID NO: 544487 - DNA, 20 bp, Artificial
  CRISPR gRNA sequence
agatctgatggtttcataaa

SEQ ID NO: 544488 - DNA, 20 bp, Artificial
  CRISPR gRNA sequence
gatctgatggtttcataaag

SEQ ID NO: 544489 - DNA, 20 bp, Artificial
  CRISPR gRNA sequence
tctgatggtttcataaaggg

SEQ ID NO: 544490 - DNA, 20 bp, Artificial
  CRISPR gRNA sequence
ctctcttgcctgccaccatt

SEQ ID NO: 544491 - DNA, 20 bp, Artificial
  CRISPR gRNA sequence
ttgccttctgccatgattgt

SEQ ID NO: 544492 - DNA, 20 bp, Artificial
  CRISPR gRNA sequence
tgccttctgccatgattgtg

SEQ ID NO: 544493 - DNA, 20 bp, Artificial
  CRISPR gRNA sequence
ccatgattgtgaggtttccc

SEQ ID NO: 544494 - DNA, 20 bp, Artificial
  CRISPR gRNA sequence
gtgaggtttccctggccatg

SEQ ID NO: 544495 - DNA, 20 bp, Artificial
  CRISPR gRNA sequence
ccctggccatgtggaactgt

SEQ ID NO: 544496 - DNA, 20 bp, Artificial
  CRISPR gRNA sequence
tgtggaactgtgagtccatt

SEQ ID NO: 544497 - DNA, 20 bp, Artificial
  CRISPR gRNA sequence
tctttccttgataaattacc

SEQ ID NO: 544498 - DNA, 20 bp, Artificial
  CRISPR gRNA sequence
agtctcatgtatgtcattat

SEQ ID NO: 544499 - DNA, 20 bp, Artificial
  CRISPR gRNA sequence
ctcatgtatgtcattattag

SEQ ID NO: 544500 - DNA, 20 bp, Artificial
  CRISPR gRNA sequence
tatgtcattattagcagtgc

SEQ ID NO: 544501 - DNA, 20 bp, Artificial
  CRISPR gRNA sequence
cattattagcagtgcgagaa

SEQ ID NO: 544502 - DNA, 20 bp, Artificial
  CRISPR gRNA sequence
atacaccccatctctacaaa

SEQ ID NO: 544503 - DNA, 20 bp, Artificial
  CRISPR gRNA sequence
accccatctctacaaaaagt

SEQ ID NO: 544504 - DNA, 20 bp, Artificial
  CRISPR gRNA sequence
catctctacaaaaagttagc

SEQ ID NO: 544505 - DNA, 20 bp, Artificial
  CRISPR gRNA sequence
atctctacaaaaagttagcc

SEQ ID NO: 544506 - DNA, 20 bp, Artificial
  CRISPR gRNA sequence
tacaaaaagttagccaggtg

SEQ ID NO: 544507 - DNA, 20 bp, Artificial
  CRISPR gRNA sequence
aaaaagttagccaggtgtgg

SEQ ID NO: 544508 - DNA, 20 bp, Artificial
  CRISPR gRNA sequence
ggtgtggtggtgcacgcctg

SEQ ID NO: 544509 - DNA, 20 bp, Artificial
  CRISPR gRNA sequence
gtggtgcacgcctgtagtcc

SEQ ID NO: 544510 - DNA, 20 bp, Artificial
  CRISPR gRNA sequence
cgcctgtagtcccagctact

SEQ ID NO: 544511 - DNA, 20 bp, Artificial
  CRISPR gRNA sequence
gcctgtagtcccagctactc

SEQ ID NO: 544512 - DNA, 20 bp, Artificial
  CRISPR gRNA sequence
ctgtagtcccagctactcag

SEQ ID NO: 544513 - DNA, 20 bp, Artificial
  CRISPR gRNA sequence
tgtagtcccagctactcagg

SEQ ID NO: 544514 - DNA, 20 bp, Artificial
  CRISPR gRNA sequence
tcccagctactcaggaggct

SEQ ID NO: 544515 - DNA, 20 bp, Artificial
  CRISPR gRNA sequence
gctactcaggaggctgagat

SEQ ID NO: 544516 - DNA, 20 bp, Artificial
  CRISPR gRNA sequence
tcaggaggctgagatgagcc

SEQ ID NO: 544517 - DNA, 20 bp, Artificial
  CRISPR gRNA sequence
gatgagcctggcaattgctt

SEQ ID NO: 544518 - DNA, 20 bp, Artificial
  CRISPR gRNA sequence
gcctggcaattgcttgagtc

SEQ ID NO: 544519 - DNA, 20 bp, Artificial
  CRISPR gRNA sequence
cctggcaattgcttgagtct

SEQ ID NO: 544520 - DNA, 20 bp, Artificial
  CRISPR gRNA sequence
ttgcttgagtctgggaattt

SEQ ID NO: 544521 - DNA, 20 bp, Artificial
  CRISPR gRNA sequence
tgcttgagtctgggaatttg

SEQ ID NO: 544522 - DNA, 20 bp, Artificial
  CRISPR gRNA sequence
agtctgggaatttgaggctg

SEQ ID NO: 544523 - DNA, 20 bp, Artificial
  CRISPR gRNA sequence
tgggaatttgaggctgcagt

SEQ ID NO: 544524 - DNA, 20 bp, Artificial
  CRISPR gRNA sequence
atgatgacacaactgcattc

SEQ ID NO: 544525 - DNA, 20 bp, Artificial
  CRISPR gRNA sequence
gacacaactgcattccagcc

SEQ ID NO: 544526 - DNA, 20 bp, Artificial
  CRISPR gRNA sequence
acacaactgcattccagcct

SEQ ID NO: 544527 - DNA, 20 bp, Artificial
  CRISPR gRNA sequence
ctgcattccagcctgggtaa

SEQ ID NO: 544528 - DNA, 20 bp, Artificial
  CRISPR gRNA sequence
gcattccagcctgggtaaca

SEQ ID NO: 544529 - DNA, 20 bp, Artificial
  CRISPR gRNA sequence
gcaaaaaaataaaaaataaa

SEQ ID NO: 544530 - DNA, 20 bp, Artificial
  CRISPR gRNA sequence
caaaaaaataaaaaataaaa

SEQ ID NO: 544531 - DNA, 20 bp, Artificial
  CRISPR gRNA sequence
aaaaataaaaaataaaaagg

SEQ ID NO: 544532 - DNA, 20 bp, Artificial
  CRISPR gRNA sequence
aaaataaaaaataaaaaggt

SEQ ID NO: 544533 - DNA, 20 bp, Artificial
  CRISPR gRNA sequence
aggaactattttattattaa

SEQ ID NO: 544534 - DNA, 20 bp, Artificial
  CRISPR gRNA sequence
gaactattttattattaaca

SEQ ID NO: 544535 - DNA, 20 bp, Artificial
  CRISPR gRNA sequence
ctgctgttgttgacatttta

SEQ ID NO: 544536 - DNA, 20 bp, Artificial
  CRISPR gRNA sequence
ttgccaactatctgcataac

SEQ ID NO: 544537 - DNA, 20 bp, Artificial
  CRISPR gRNA sequence
tatctgcataactagatttt

SEQ ID NO: 544538 - DNA, 20 bp, Artificial
  CRISPR gRNA sequence
gattttaagttccttgtatg

SEQ ID NO: 544539 - DNA, 20 bp, Artificial
  CRISPR gRNA sequence
tttaagttccttgtatgcag

SEQ ID NO: 544540 - DNA, 20 bp, Artificial
  CRISPR gRNA sequence
attgatctgtttttttttaa

SEQ ID NO: 544541 - DNA, 20 bp, Artificial
  CRISPR gRNA sequence
tctgtttttttttaatagta

SEQ ID NO: 544542 - DNA, 20 bp, Artificial
  CRISPR gRNA sequence
agattgttgaatctgaacat

SEQ ID NO: 544543 - DNA, 20 bp, Artificial
  CRISPR gRNA sequence
tagatgacaatgtatttgtc

SEQ ID NO: 544544 - DNA, 20 bp, Artificial
  CRISPR gRNA sequence
attatctcacattattatgt

SEQ ID NO: 544545 - DNA, 20 bp, Artificial
  CRISPR gRNA sequence
gacttgttcatgtgctttgc

SEQ ID NO: 544546 - DNA, 20 bp, Artificial
  CRISPR gRNA sequence
cttgttcatgtgctttgctg

SEQ ID NO: 544547 - DNA, 20 bp, Artificial
  CRISPR gRNA sequence
tcatgtgctttgctggagtt

SEQ ID NO: 544548 - DNA, 20 bp, Artificial
  CRISPR gRNA sequence
gctttgctggagttgagact

SEQ ID NO: 544549 - DNA, 20 bp, Artificial
  CRISPR gRNA sequence
tgctggagttgagacttaga

SEQ ID NO: 544550 - DNA, 20 bp, Artificial
  CRISPR gRNA sequence
acagtctgtgtttttttatt

SEQ ID NO: 544551 - DNA, 20 bp, Artificial
  CRISPR gRNA sequence
ctgtgtttttttatttagca

SEQ ID NO: 544552 - DNA, 20 bp, Artificial
  CRISPR gRNA sequence
ttatttagcaaagataatcc

SEQ ID NO: 544553 - DNA, 20 bp, Artificial
  CRISPR gRNA sequence
aaagataatccaagttaaaa

SEQ ID NO: 544554 - DNA, 20 bp, Artificial
  CRISPR gRNA sequence
aatagtgttgtgtgttccta

SEQ ID NO: 544555 - DNA, 20 bp, Artificial
  CRISPR gRNA sequence
atagtgttgtgtgttcctat

SEQ ID NO: 544556 - DNA, 20 bp, Artificial
  CRISPR gRNA sequence
gtgtgttcctataggaaaac

SEQ ID NO: 544557 - DNA, 20 bp, Artificial
  CRISPR gRNA sequence
tgtgttcctataggaaaact

SEQ ID NO: 544558 - DNA, 20 bp, Artificial
  CRISPR gRNA sequence
tcctataggaaaactaggcc

SEQ ID NO: 544559 - DNA, 20 bp, Artificial
  CRISPR gRNA sequence
aactaggcccagtgttataa

SEQ ID NO: 544560 - DNA, 20 bp, Artificial
  CRISPR gRNA sequence
ctaggcccagtgttataaca

SEQ ID NO: 544561 - DNA, 20 bp, Artificial
  CRISPR gRNA sequence
ccagtgttataacagagtgt

SEQ ID NO: 544562 - DNA, 20 bp, Artificial
  CRISPR gRNA sequence
taacagagtgtaagtaataa

SEQ ID NO: 544563 - DNA, 20 bp, Artificial
  CRISPR gRNA sequence
gtgtaagtaataatagccac

SEQ ID NO: 544564 - DNA, 20 bp, Artificial
  CRISPR gRNA sequence
tgtaagtaataatagccact

SEQ ID NO: 544565 - DNA, 20 bp, Artificial
  CRISPR gRNA sequence
taagtaataatagccactag

SEQ ID NO: 544566 - DNA, 20 bp, Artificial
  CRISPR gRNA sequence
aagtaataatagccactagg

SEQ ID NO: 544567 - DNA, 20 bp, Artificial
  CRISPR gRNA sequence
aataatagccactaggaggt

SEQ ID NO: 544568 - DNA, 20 bp, Artificial
  CRISPR gRNA sequence
ggtaagtacctgctctgtgc

SEQ ID NO: 544569 - DNA, 20 bp, Artificial
  CRISPR gRNA sequence
gtaagtacctgctctgtgcc

SEQ ID NO: 544570 - DNA, 20 bp, Artificial
  CRISPR gRNA sequence
aagtacctgctctgtgccag

SEQ ID NO: 544571 - DNA, 20 bp, Artificial
  CRISPR gRNA sequence
ctgtgccaggagctatgctt

SEQ ID NO: 544572 - DNA, 20 bp, Artificial
  CRISPR gRNA sequence
aggagctatgcttcagattt

SEQ ID NO: 544573 - DNA, 20 bp, Artificial
  CRISPR gRNA sequence
gtcacactgattttattaca

SEQ ID NO: 544574 - DNA, 20 bp, Artificial
  CRISPR gRNA sequence
tcacactgattttattacat

SEQ ID NO: 544575 - DNA, 20 bp, Artificial
  CRISPR gRNA sequence
cacactgattttattacata

SEQ ID NO: 544576 - DNA, 20 bp, Artificial
  CRISPR gRNA sequence
attacatagggaacatttaa

SEQ ID NO: 544577 - DNA, 20 bp, Artificial
  CRISPR gRNA sequence
ttacatagggaacatttaat

SEQ ID NO: 544578 - DNA, 20 bp, Artificial
  CRISPR gRNA sequence
acatagggaacatttaatag

SEQ ID NO: 544579 - DNA, 20 bp, Artificial
  CRISPR gRNA sequence
gaacatttaataggagaaca

SEQ ID NO: 544580 - DNA, 20 bp, Artificial
  CRISPR gRNA sequence
tttaataggagaacaaagct

SEQ ID NO: 544581 - DNA, 20 bp, Artificial
  CRISPR gRNA sequence
ttaataggagaacaaagctt

SEQ ID NO: 544582 - DNA, 20 bp, Artificial
  CRISPR gRNA sequence
ataggagaacaaagcttagg

SEQ ID NO: 544583 - DNA, 20 bp, Artificial
  CRISPR gRNA sequence
taggagaacaaagcttaggt

SEQ ID NO: 544584 - DNA, 20 bp, Artificial
  CRISPR gRNA sequence
gaacaaagcttaggtaggtt

SEQ ID NO: 544585 - DNA, 20 bp, Artificial
  CRISPR gRNA sequence
gtaggttcagtaatgtgtcc

SEQ ID NO: 544586 - DNA, 20 bp, Artificial
  CRISPR gRNA sequence
gtaatgtgtccaagttcaca

SEQ ID NO: 544587 - DNA, 20 bp, Artificial
  CRISPR gRNA sequence
tccaagttcacacagcaaat

SEQ ID NO: 544588 - DNA, 20 bp, Artificial
  CRISPR gRNA sequence
aagttcacacagcaaataag

SEQ ID NO: 544589 - DNA, 20 bp, Artificial
  CRISPR gRNA sequence
ttcacacagcaaataagtgg

SEQ ID NO: 544590 - DNA, 20 bp, Artificial
  CRISPR gRNA sequence
cacacagcaaataagtggca

SEQ ID NO: 544591 - DNA, 20 bp, Artificial
  CRISPR gRNA sequence
aactttgattctctctgaat

SEQ ID NO: 544592 - DNA, 20 bp, Artificial
  CRISPR gRNA sequence
tatatgctctgttgtatccc

SEQ ID NO: 544593 - DNA, 20 bp, Artificial
  CRISPR gRNA sequence
ctctgttgtatccctagcct

SEQ ID NO: 544594 - DNA, 20 bp, Artificial
  CRISPR gRNA sequence
tccctagcctgagatccact

SEQ ID NO: 544595 - DNA, 20 bp, Artificial
  CRISPR gRNA sequence
atccactaagcaactttttg

SEQ ID NO: 544596 - DNA, 20 bp, Artificial
  CRISPR gRNA sequence
ctaagcaactttttgaagat

SEQ ID NO: 544597 - DNA, 20 bp, Artificial
  CRISPR gRNA sequence
aatgaaattctgctaaaaca

SEQ ID NO: 544598 - DNA, 20 bp, Artificial
  CRISPR gRNA sequence
atgaaattctgctaaaacat

SEQ ID NO: 544599 - DNA, 20 bp, Artificial
  CRISPR gRNA sequence
ctgctaaaacatgggaaata

SEQ ID NO: 544600 - DNA, 20 bp, Artificial
  CRISPR gRNA sequence
tgctaaaacatgggaaatat

SEQ ID NO: 544601 - DNA, 20 bp, Artificial
  CRISPR gRNA sequence
aaaacatgggaaatataggt

SEQ ID NO: 544602 - DNA, 20 bp, Artificial
  CRISPR gRNA sequence
atataggtcagcacaattac

SEQ ID NO: 544603 - DNA, 20 bp, Artificial
  CRISPR gRNA sequence
tttaatatcataatttgtaa

SEQ ID NO: 544604 - DNA, 20 bp, Artificial
  CRISPR gRNA sequence
atatcataatttgtaatggt

SEQ ID NO: 544605 - DNA, 20 bp, Artificial
  CRISPR gRNA sequence
tatcataatttgtaatggtg

SEQ ID NO: 544606 - DNA, 20 bp, Artificial
  CRISPR gRNA sequence
atcataatttgtaatggtga

SEQ ID NO: 544607 - DNA, 20 bp, Artificial
  CRISPR gRNA sequence
tcataatttgtaatggtgag

SEQ ID NO: 544608 - DNA, 20 bp, Artificial
  CRISPR gRNA sequence
aatggtgaggggtgcttctt

SEQ ID NO: 544609 - DNA, 20 bp, Artificial
  CRISPR gRNA sequence
atggtgaggggtgcttcttt

SEQ ID NO: 544610 - DNA, 20 bp, Artificial
  CRISPR gRNA sequence
aggggtgcttctttgggaca

SEQ ID NO: 544611 - DNA, 20 bp, Artificial
  CRISPR gRNA sequence
ttgggacatagaatttacaa

SEQ ID NO: 544612 - DNA, 20 bp, Artificial
  CRISPR gRNA sequence
attattatatttacattctc

SEQ ID NO: 544613 - DNA, 20 bp, Artificial
  CRISPR gRNA sequence
ttattatatttacattctct

SEQ ID NO: 544614 - DNA, 20 bp, Artificial
  CRISPR gRNA sequence
aggtacccacatttcactcc

SEQ ID NO: 544615 - DNA, 20 bp, Artificial
  CRISPR gRNA sequence
acctaacttttacccgtatt

SEQ ID NO: 544616 - DNA, 20 bp, Artificial
  CRISPR gRNA sequence
cagatttccccacttgtcac

SEQ ID NO: 544617 - DNA, 20 bp, Artificial
  CRISPR gRNA sequence
gatttccccacttgtcacaa

SEQ ID NO: 544618 - DNA, 20 bp, Artificial
  CRISPR gRNA sequence
gtgtcttttgttaaaaaacc

SEQ ID NO: 544619 - DNA, 20 bp, Artificial
  CRISPR gRNA sequence
taaaaaacccggatctaatc

SEQ ID NO: 544620 - DNA, 20 bp, Artificial
  CRISPR gRNA sequence
tttttttgttttaattttga

SEQ ID NO: 544621 - DNA, 20 bp, Artificial
  CRISPR gRNA sequence
ttttttgttttaattttgat

SEQ ID NO: 544622 - DNA, 20 bp, Artificial
  CRISPR gRNA sequence
taattttgatgggcatcttt

SEQ ID NO: 544623 - DNA, 20 bp, Artificial
  CRISPR gRNA sequence
ttttgatgggcatctttcag

SEQ ID NO: 544624 - DNA, 20 bp, Artificial
  CRISPR gRNA sequence
atctttcagaagttttaaaa

SEQ ID NO: 544625 - DNA, 20 bp, Artificial
  CRISPR gRNA sequence
cagaagttttaaaatagtct

SEQ ID NO: 544626 - DNA, 20 bp, Artificial
  CRISPR gRNA sequence
tagtcttagaacctcttttt

SEQ ID NO: 544627 - DNA, 20 bp, Artificial
  CRISPR gRNA sequence
tagaacctctttttaagaac

SEQ ID NO: 544628 - DNA, 20 bp, Artificial
  CRISPR gRNA sequence
ttgtcactctaacatttctt

SEQ ID NO: 544629 - DNA, 20 bp, Artificial
  CRISPR gRNA sequence
taacatttctttagtaaata

SEQ ID NO: 544630 - DNA, 20 bp, Artificial
  CRISPR gRNA sequence
aacatttctttagtaaatac

SEQ ID NO: 544631 - DNA, 20 bp, Artificial
  CRISPR gRNA sequence
ctttagtaaatacaggcttt

SEQ ID NO: 544632 - DNA, 20 bp, Artificial
  CRISPR gRNA sequence
tttagtaaatacaggctttg

SEQ ID NO: 544633 - DNA, 20 bp, Artificial
  CRISPR gRNA sequence
ttagtaaatacaggctttga

SEQ ID NO: 544634 - DNA, 20 bp, Artificial
  CRISPR gRNA sequence
gtaaatacaggctttgaggg

SEQ ID NO: 544635 - DNA, 20 bp, Artificial
  CRISPR gRNA sequence
taaatacaggctttgagggt

SEQ ID NO: 544636 - DNA, 20 bp, Artificial
  CRISPR gRNA sequence
caggctttgagggtaggtat

SEQ ID NO: 544637 - DNA, 20 bp, Artificial
  CRISPR gRNA sequence
gtattggtttctctgtttaa

SEQ ID NO: 544638 - DNA, 20 bp, Artificial
  CRISPR gRNA sequence
ttggtttctctgtttaaaag

SEQ ID NO: 544639 - DNA, 20 bp, Artificial
  CRISPR gRNA sequence
agtagaaactttgcataaat

SEQ ID NO: 544640 - DNA, 20 bp, Artificial
  CRISPR gRNA sequence
aaatcagcccttatatgtgt

SEQ ID NO: 544641 - DNA, 20 bp, Artificial
  CRISPR gRNA sequence
tgtgtaagttttctgccttt

SEQ ID NO: 544642 - DNA, 20 bp, Artificial
  CRISPR gRNA sequence
ttctcatgctgtttctgcac

SEQ ID NO: 544643 - DNA, 20 bp, Artificial
  CRISPR gRNA sequence
ctgtttctgcacaagtgcct

SEQ ID NO: 544644 - DNA, 20 bp, Artificial
  CRISPR gRNA sequence
caagtgcctaagcttttttg

SEQ ID NO: 544645 - DNA, 20 bp, Artificial
  CRISPR gRNA sequence
gcttttttgaagctttactt

SEQ ID NO: 544646 - DNA, 20 bp, Artificial
  CRISPR gRNA sequence
cttttttgaagctttacttg

SEQ ID NO: 544647 - DNA, 20 bp, Artificial
  CRISPR gRNA sequence
ttttttgaagctttacttga

SEQ ID NO: 544648 - DNA, 20 bp, Artificial
  CRISPR gRNA sequence
tttttgaagctttacttgag

SEQ ID NO: 544649 - DNA, 20 bp, Artificial
  CRISPR gRNA sequence
agctttacttgaggggtgac

SEQ ID NO: 544650 - DNA, 20 bp, Artificial
  CRISPR gRNA sequence
tttacttgaggggtgaccag

SEQ ID NO: 544651 - DNA, 20 bp, Artificial
  CRISPR gRNA sequence
ttacttgaggggtgaccaga

SEQ ID NO: 544652 - DNA, 20 bp, Artificial
  CRISPR gRNA sequence
gtgaccagaaggttttactt

SEQ ID NO: 544653 - DNA, 20 bp, Artificial
  CRISPR gRNA sequence
tgaccagaaggttttactta

SEQ ID NO: 544654 - DNA, 20 bp, Artificial
  CRISPR gRNA sequence
gaaggttttacttaaggaca

SEQ ID NO: 544655 - DNA, 20 bp, Artificial
  CRISPR gRNA sequence
acaaatctcaacttccatct

SEQ ID NO: 544656 - DNA, 20 bp, Artificial
  CRISPR gRNA sequence
caaatctcaacttccatctc

SEQ ID NO: 544657 - DNA, 20 bp, Artificial
  CRISPR gRNA sequence
aaatctcaacttccatctca

SEQ ID NO: 544658 - DNA, 20 bp, Artificial
  CRISPR gRNA sequence
aacttccatctcagggttgt

SEQ ID NO: 544659 - DNA, 20 bp, Artificial
  CRISPR gRNA sequence
ctcagggttgtaagtgaaac

SEQ ID NO: 544660 - DNA, 20 bp, Artificial
  CRISPR gRNA sequence
tcagggttgtaagtgaaacc

SEQ ID NO: 544661 - DNA, 20 bp, Artificial
  CRISPR gRNA sequence
ttgtaagtgaaaccaggatg

SEQ ID NO: 544662 - DNA, 20 bp, Artificial
  CRISPR gRNA sequence
tgcagccgtttctcttttct

SEQ ID NO: 544663 - DNA, 20 bp, Artificial
  CRISPR gRNA sequence
ccgtttctcttttctcagat

SEQ ID NO: 544664 - DNA, 20 bp, Artificial
  CRISPR gRNA sequence
tctcttttctcagataagtt

SEQ ID NO: 544665 - DNA, 20 bp, Artificial
  CRISPR gRNA sequence
ctcttttctcagataagttc

SEQ ID NO: 544666 - DNA, 20 bp, Artificial
  CRISPR gRNA sequence
taagttcaggtttgaatata

SEQ ID NO: 544667 - DNA, 20 bp, Artificial
  CRISPR gRNA sequence
tgaatataaagtgtgactat

SEQ ID NO: 544668 - DNA, 20 bp, Artificial
  CRISPR gRNA sequence
taaagtgtgactataagata

SEQ ID NO: 544669 - DNA, 20 bp, Artificial
  CRISPR gRNA sequence
aagtgtgactataagataca

SEQ ID NO: 544670 - DNA, 20 bp, Artificial
  CRISPR gRNA sequence
taagatacagagactgtccc

SEQ ID NO: 544671 - DNA, 20 bp, Artificial
  CRISPR gRNA sequence
tacagagactgtccctagaa

SEQ ID NO: 544672 - DNA, 20 bp, Artificial
  CRISPR gRNA sequence
acagagactgtccctagaaa

SEQ ID NO: 544673 - DNA, 20 bp, Artificial
  CRISPR gRNA sequence
agagactgtccctagaaaag

SEQ ID NO: 544674 - DNA, 20 bp, Artificial
  CRISPR gRNA sequence
gagactgtccctagaaaagg

SEQ ID NO: 544675 - DNA, 20 bp, Artificial
  CRISPR gRNA sequence
agactgtccctagaaaagga

SEQ ID NO: 544676 - DNA, 20 bp, Artificial
  CRISPR gRNA sequence
gactgtccctagaaaaggag

SEQ ID NO: 544677 - DNA, 20 bp, Artificial
  CRISPR gRNA sequence
aaaaggaggggaaaacattt

SEQ ID NO: 544678 - DNA, 20 bp, Artificial
  CRISPR gRNA sequence
aggaggggaaaacattttag

SEQ ID NO: 544679 - DNA, 20 bp, Artificial
  CRISPR gRNA sequence
acattttagcagttcctctt

SEQ ID NO: 544680 - DNA, 20 bp, Artificial
  CRISPR gRNA sequence
attttagcagttcctctttg

SEQ ID NO: 544681 - DNA, 20 bp, Artificial
  CRISPR gRNA sequence
tcctctttggagataacttt

SEQ ID NO: 544682 - DNA, 20 bp, Artificial
  CRISPR gRNA sequence
aactttcagtgcctgcccat

SEQ ID NO: 544683 - DNA, 20 bp, Artificial
  CRISPR gRNA sequence
gtgcctgcccatcagcctcc

SEQ ID NO: 544684 - DNA, 20 bp, Artificial
  CRISPR gRNA sequence
tgcctgcccatcagcctcca

SEQ ID NO: 544685 - DNA, 20 bp, Artificial
  CRISPR gRNA sequence
cctccaaggaaaatgctttt

SEQ ID NO: 544686 - DNA, 20 bp, Artificial
  CRISPR gRNA sequence
aatgctttttggttacttta

SEQ ID NO: 544687 - DNA, 20 bp, Artificial
  CRISPR gRNA sequence
atgctttttggttactttat

SEQ ID NO: 544688 - DNA, 20 bp, Artificial
  CRISPR gRNA sequence
tttggttactttataggttc

SEQ ID NO: 544689 - DNA, 20 bp, Artificial
  CRISPR gRNA sequence
tgttccccaaaatgtctgtt

SEQ ID NO: 544690 - DNA, 20 bp, Artificial
  CRISPR gRNA sequence
cccaaaatgtctgttgagat

SEQ ID NO: 544691 - DNA, 20 bp, Artificial
  CRISPR gRNA sequence
attagtgcctgaatttccac

SEQ ID NO: 544692 - DNA, 20 bp, Artificial
  CRISPR gRNA sequence
ttagtgcctgaatttccact

SEQ ID NO: 544693 - DNA, 20 bp, Artificial
  CRISPR gRNA sequence
tgaatttccactgggctgac

SEQ ID NO: 544694 - DNA, 20 bp, Artificial
  CRISPR gRNA sequence
ccactgggctgaccagtctg

SEQ ID NO: 544695 - DNA, 20 bp, Artificial
  CRISPR gRNA sequence
tgaacattttcttcctatgc

SEQ ID NO: 544696 - DNA, 20 bp, Artificial
  CRISPR gRNA sequence
ttcctatgccagttaaaaat

SEQ ID NO: 544697 - DNA, 20 bp, Artificial
  CRISPR gRNA sequence
ctatgccagttaaaaattag

SEQ ID NO: 544698 - DNA, 20 bp, Artificial
  CRISPR gRNA sequence
taaaaattagaagaaaattg

SEQ ID NO: 544699 - DNA, 20 bp, Artificial
  CRISPR gRNA sequence
tgaagtttaacatacacatt

SEQ ID NO: 544700 - DNA, 20 bp, Artificial
  CRISPR gRNA sequence
ttcagaaaaaaataaaaaat

SEQ ID NO: 544701 - DNA, 20 bp, Artificial
  CRISPR gRNA sequence
aaataaaaaatcagattaat

SEQ ID NO: 544702 - DNA, 20 bp, Artificial
  CRISPR gRNA sequence
cagattaataagaaactaat

SEQ ID NO: 544703 - DNA, 20 bp, Artificial
  CRISPR gRNA sequence
agattaataagaaactaatg

SEQ ID NO: 544704 - DNA, 20 bp, Artificial
  CRISPR gRNA sequence
ccattgtaaactacttgcaa

SEQ ID NO: 544705 - DNA, 20 bp, Artificial
  CRISPR gRNA sequence
attgtaaactacttgcaata

SEQ ID NO: 544706 - DNA, 20 bp, Artificial
  CRISPR gRNA sequence
gagtttcccaacgatgaact

SEQ ID NO: 544707 - DNA, 20 bp, Artificial
  CRISPR gRNA sequence
ccaacgatgaactgagtatc

SEQ ID NO: 544708 - DNA, 20 bp, Artificial
  CRISPR gRNA sequence
ctgagtatctagaaaataac

SEQ ID NO: 544709 - DNA, 20 bp, Artificial
  CRISPR gRNA sequence
tgagtatctagaaaataaca

SEQ ID NO: 544710 - DNA, 20 bp, Artificial
  CRISPR gRNA sequence
agaaaataacaaggattctc

SEQ ID NO: 544711 - DNA, 20 bp, Artificial
  CRISPR gRNA sequence
gaaaataacaaggattctca

SEQ ID NO: 544712 - DNA, 20 bp, Artificial
  CRISPR gRNA sequence
caaggattctcaaggaattt

SEQ ID NO: 544713 - DNA, 20 bp, Artificial
  CRISPR gRNA sequence
aggaattttagtgaaatgat

SEQ ID NO: 544714 - DNA, 20 bp, Artificial
  CRISPR gRNA sequence
tgtattgaaataccttgaat

SEQ ID NO: 544715 - DNA, 20 bp, Artificial
  CRISPR gRNA sequence
aaataccttgaatcagactt

SEQ ID NO: 544716 - DNA, 20 bp, Artificial
  CRISPR gRNA sequence
ataccttgaatcagactttg

SEQ ID NO: 544717 - DNA, 20 bp, Artificial
  CRISPR gRNA sequence
ttgaatcagactttggagaa

SEQ ID NO: 544718 - DNA, 20 bp, Artificial
  CRISPR gRNA sequence
aatagatttaaaaacactca

SEQ ID NO: 544719 - DNA, 20 bp, Artificial
  CRISPR gRNA sequence
actcacagccttaaccgatc

SEQ ID NO: 544720 - DNA, 20 bp, Artificial
  CRISPR gRNA sequence
acagccttaaccgatctagt

SEQ ID NO: 544721 - DNA, 20 bp, Artificial
  CRISPR gRNA sequence
agtaagaaccttattcccta

SEQ ID NO: 544722 - DNA, 20 bp, Artificial
  CRISPR gRNA sequence
ttattccctaaagcatactg

SEQ ID NO: 544723 - DNA, 20 bp, Artificial
  CRISPR gRNA sequence
ctaaagcatactgtggatct

SEQ ID NO: 544724 - DNA, 20 bp, Artificial
  CRISPR gRNA sequence
atctcagctgtatcctatct

SEQ ID NO: 544725 - DNA, 20 bp, Artificial
  CRISPR gRNA sequence
tctcagctgtatcctatcta

SEQ ID NO: 544726 - DNA, 20 bp, Artificial
  CRISPR gRNA sequence
agctgtatcctatctaaggt

SEQ ID NO: 544727 - DNA, 20 bp, Artificial
  CRISPR gRNA sequence
tatcctatctaaggtgagaa

SEQ ID NO: 544728 - DNA, 20 bp, Artificial
  CRISPR gRNA sequence
atctaaggtgagaacagtca

SEQ ID NO: 544729 - DNA, 20 bp, Artificial
  CRISPR gRNA sequence
agaacagtcaaagacaaatg

SEQ ID NO: 544730 - DNA, 20 bp, Artificial
  CRISPR gRNA sequence
caaagacaaatgtggccttt

SEQ ID NO: 544731 - DNA, 20 bp, Artificial
  CRISPR gRNA sequence
gacaaatgtggcctttgaga

SEQ ID NO: 544732 - DNA, 20 bp, Artificial
  CRISPR gRNA sequence
acaaatgtggcctttgagaa

SEQ ID NO: 544733 - DNA, 20 bp, Artificial
  CRISPR gRNA sequence
aatgtggcctttgagaaagg

SEQ ID NO: 544734 - DNA, 20 bp, Artificial
  CRISPR gRNA sequence
atgtggcctttgagaaaggt

SEQ ID NO: 544735 - DNA, 20 bp, Artificial
  CRISPR gRNA sequence
ctttgagaaaggtgggatgt

SEQ ID NO: 544736 - DNA, 20 bp, Artificial
  CRISPR gRNA sequence
atgtgagtgtcttgaaacaa

SEQ ID NO: 544737 - DNA, 20 bp, Artificial
  CRISPR gRNA sequence
tgtgagtgtcttgaaacaac

SEQ ID NO: 544738 - DNA, 20 bp, Artificial
  CRISPR gRNA sequence
tgtcttgaaacaacaggcta

SEQ ID NO: 544739 - DNA, 20 bp, Artificial
  CRISPR gRNA sequence
cttgaaacaacaggctaaag

SEQ ID NO: 544740 - DNA, 20 bp, Artificial
  CRISPR gRNA sequence
gctaaagaagtgctctcaaa

SEQ ID NO: 544741 - DNA, 20 bp, Artificial
  CRISPR gRNA sequence
aaagaagtgctctcaaatag

SEQ ID NO: 544742 - DNA, 20 bp, Artificial
  CRISPR gRNA sequence
tctcaaatagaagtataata

SEQ ID NO: 544743 - DNA, 20 bp, Artificial
  CRISPR gRNA sequence
ttaattttaataatatattt

SEQ ID NO: 544744 - DNA, 20 bp, Artificial
  CRISPR gRNA sequence
attttcatttcgacatgtat

SEQ ID NO: 544745 - DNA, 20 bp, Artificial
  CRISPR gRNA sequence
ttttcatttcgacatgtatt

SEQ ID NO: 544746 - DNA, 20 bp, Artificial
  CRISPR gRNA sequence
catttcgacatgtattaggt

SEQ ID NO: 544747 - DNA, 20 bp, Artificial
  CRISPR gRNA sequence
catgtattaggttggtgcaa

SEQ ID NO: 544748 - DNA, 20 bp, Artificial
  CRISPR gRNA sequence
ggttggtgcaaaagttattg

SEQ ID NO: 544749 - DNA, 20 bp, Artificial
  CRISPR gRNA sequence
tttttgctatttttttttaa

SEQ ID NO: 544750 - DNA, 20 bp, Artificial
  CRISPR gRNA sequence
ttttttttaatggcaaaaac

SEQ ID NO: 544751 - DNA, 20 bp, Artificial
  CRISPR gRNA sequence
caattacttttgcactaacc

SEQ ID NO: 544752 - DNA, 20 bp, Artificial
  CRISPR gRNA sequence
ttacttttgcactaacctag

SEQ ID NO: 544753 - DNA, 20 bp, Artificial
  CRISPR gRNA sequence
tactacaaaaaaatattaac

SEQ ID NO: 544754 - DNA, 20 bp, Artificial
  CRISPR gRNA sequence
ctacaaaaaaatattaacaa

SEQ ID NO: 544755 - DNA, 20 bp, Artificial
  CRISPR gRNA sequence
tatgttccactttttaatac

SEQ ID NO: 544756 - DNA, 20 bp, Artificial
  CRISPR gRNA sequence
atgttccactttttaatacc

SEQ ID NO: 544757 - DNA, 20 bp, Artificial
  CRISPR gRNA sequence
actttttaataccaggtctt

SEQ ID NO: 544758 - DNA, 20 bp, Artificial
  CRISPR gRNA sequence
aataccaggtcttcagattc

SEQ ID NO: 544759 - DNA, 20 bp, Artificial
  CRISPR gRNA sequence
tctggtgtgtatttgatact

SEQ ID NO: 544760 - DNA, 20 bp, Artificial
  CRISPR gRNA sequence
catttgaactaaccatattt

SEQ ID NO: 544761 - DNA, 20 bp, Artificial
  CRISPR gRNA sequence
atttgaactaaccatatttc

SEQ ID NO: 544762 - DNA, 20 bp, Artificial
  CRISPR gRNA sequence
accatatttcaggttctcac

SEQ ID NO: 544763 - DNA, 20 bp, Artificial
  CRISPR gRNA sequence
aggttctcactagccacttg

SEQ ID NO: 544764 - DNA, 20 bp, Artificial
  CRISPR gRNA sequence
tctcactagccacttgtagc

SEQ ID NO: 544765 - DNA, 20 bp, Artificial
  CRISPR gRNA sequence
cactagccacttgtagctgg

SEQ ID NO: 544766 - DNA, 20 bp, Artificial
  CRISPR gRNA sequence
gtagctggtagctactttga

SEQ ID NO: 544767 - DNA, 20 bp, Artificial
  CRISPR gRNA sequence
agctactttgatggattgca

SEQ ID NO: 544768 - DNA, 20 bp, Artificial
  CRISPR gRNA sequence
gctactttgatggattgcat

SEQ ID NO: 544769 - DNA, 20 bp, Artificial
  CRISPR gRNA sequence
tgatggattgcataggtcta

SEQ ID NO: 544770 - DNA, 20 bp, Artificial
  CRISPR gRNA sequence
gatggattgcataggtctaa

SEQ ID NO: 544771 - DNA, 20 bp, Artificial
  CRISPR gRNA sequence
atggattgcataggtctaaa

SEQ ID NO: 544772 - DNA, 20 bp, Artificial
  CRISPR gRNA sequence
ggtctaaagggaaacatctt

SEQ ID NO: 544773 - DNA, 20 bp, Artificial
  CRISPR gRNA sequence
taaagggaaacatcttgaga

SEQ ID NO: 544774 - DNA, 20 bp, Artificial
  CRISPR gRNA sequence
agggaaacatcttgagaaag

SEQ ID NO: 544775 - DNA, 20 bp, Artificial
  CRISPR gRNA sequence
acatcttgagaaagaagaaa

SEQ ID NO: 544776 - DNA, 20 bp, Artificial
  CRISPR gRNA sequence
catcttgagaaagaagaaat

SEQ ID NO: 544777 - DNA, 20 bp, Artificial
  CRISPR gRNA sequence
tgagaaagaagaaataggtt

SEQ ID NO: 544778 - DNA, 20 bp, Artificial
  CRISPR gRNA sequence
agaagaaataggttaagtgc

SEQ ID NO: 544779 - DNA, 20 bp, Artificial
  CRISPR gRNA sequence
aataggttaagtgcaagaac

SEQ ID NO: 544780 - DNA, 20 bp, Artificial
  CRISPR gRNA sequence
gtgcaagaacaagaattaaa

SEQ ID NO: 544781 - DNA, 20 bp, Artificial
  CRISPR gRNA sequence
tgcaagaacaagaattaaaa

SEQ ID NO: 544782 - DNA, 20 bp, Artificial
  CRISPR gRNA sequence
aattaaaaaggaaactattt

SEQ ID NO: 544783 - DNA, 20 bp, Artificial
  CRISPR gRNA sequence
aaactattttagcatcatat

SEQ ID NO: 544784 - DNA, 20 bp, Artificial
  CRISPR gRNA sequence
ctattttagcatcatattag

SEQ ID NO: 544785 - DNA, 20 bp, Artificial
  CRISPR gRNA sequence
tattttagcatcatattaga

SEQ ID NO: 544786 - DNA, 20 bp, Artificial
  CRISPR gRNA sequence
ttagcatcatattagaagga

SEQ ID NO: 544787 - DNA, 20 bp, Artificial
  CRISPR gRNA sequence
atcatattagaaggaaagta

SEQ ID NO: 544788 - DNA, 20 bp, Artificial
  CRISPR gRNA sequence
tattagaaggaaagtacaga

SEQ ID NO: 544789 - DNA, 20 bp, Artificial
  CRISPR gRNA sequence
tagaaggaaagtacagaaag

SEQ ID NO: 544790 - DNA, 20 bp, Artificial
  CRISPR gRNA sequence
agtacagaaagaagttgatt

SEQ ID NO: 544791 - DNA, 20 bp, Artificial
  CRISPR gRNA sequence
tacagaaagaagttgattta

SEQ ID NO: 544792 - DNA, 20 bp, Artificial
  CRISPR gRNA sequence
taattcttgatgaacttatc

SEQ ID NO: 544793 - DNA, 20 bp, Artificial
  CRISPR gRNA sequence
aattcttgatgaacttatcg

SEQ ID NO: 544794 - DNA, 20 bp, Artificial
  CRISPR gRNA sequence
ttcttgatgaacttatcgag

SEQ ID NO: 544795 - DNA, 20 bp, Artificial
  CRISPR gRNA sequence
tcttgatgaacttatcgagg

SEQ ID NO: 544796 - DNA, 20 bp, Artificial
  CRISPR gRNA sequence
tgatgaacttatcgaggagg

SEQ ID NO: 544797 - DNA, 20 bp, Artificial
  CRISPR gRNA sequence
ttatcgaggaggcagattga

SEQ ID NO: 544798 - DNA, 20 bp, Artificial
  CRISPR gRNA sequence
gaggaggcagattgacagct

SEQ ID NO: 544799 - DNA, 20 bp, Artificial
  CRISPR gRNA sequence
ggaggcagattgacagctga

SEQ ID NO: 544800 - DNA, 20 bp, Artificial
  CRISPR gRNA sequence
gcagattgacagctgagagc

SEQ ID NO: 544801 - DNA, 20 bp, Artificial
  CRISPR gRNA sequence
cagattgacagctgagagca

SEQ ID NO: 544802 - DNA, 20 bp, Artificial
  CRISPR gRNA sequence
tgacagctgagagcaaggtc

SEQ ID NO: 544803 - DNA, 20 bp, Artificial
  CRISPR gRNA sequence
gacagctgagagcaaggtcc

SEQ ID NO: 544804 - DNA, 20 bp, Artificial
  CRISPR gRNA sequence
aaggtccgggaaccttgctc

SEQ ID NO: 544805 - DNA, 20 bp, Artificial
  CRISPR gRNA sequence
cgggaaccttgctctggcct

SEQ ID NO: 544806 - DNA, 20 bp, Artificial
  CRISPR gRNA sequence
gggaaccttgctctggcctt

SEQ ID NO: 544807 - DNA, 20 bp, Artificial
  CRISPR gRNA sequence
ggaaccttgctctggccttg

SEQ ID NO: 544808 - DNA, 20 bp, Artificial
  CRISPR gRNA sequence
ttgctctggccttggggacc

SEQ ID NO: 544809 - DNA, 20 bp, Artificial
  CRISPR gRNA sequence
tgctctggccttggggaccg

SEQ ID NO: 544810 - DNA, 20 bp, Artificial
  CRISPR gRNA sequence
gctctggccttggggaccga

SEQ ID NO: 544811 - DNA, 20 bp, Artificial
  CRISPR gRNA sequence
gaccgagggtttgtaaccgt

SEQ ID NO: 544812 - DNA, 20 bp, Artificial
  CRISPR gRNA sequence
accgagggtttgtaaccgtt

SEQ ID NO: 544813 - DNA, 20 bp, Artificial
  CRISPR gRNA sequence
cgagggtttgtaaccgttgg

SEQ ID NO: 544814 - DNA, 20 bp, Artificial
  CRISPR gRNA sequence
ggtttgtaaccgttgggaga

SEQ ID NO: 544815 - DNA, 20 bp, Artificial
  CRISPR gRNA sequence
gtttgtaaccgttgggagac

SEQ ID NO: 544816 - DNA, 20 bp, Artificial
  CRISPR gRNA sequence
tgtaaccgttgggagacagg

SEQ ID NO: 544817 - DNA, 20 bp, Artificial
  CRISPR gRNA sequence
cgttgggagacaggtggctg

SEQ ID NO: 544818 - DNA, 20 bp, Artificial
  CRISPR gRNA sequence
gagacaggtggctgcagttt

SEQ ID NO: 544819 - DNA, 20 bp, Artificial
  CRISPR gRNA sequence
gtggctgcagtttcagtatg

SEQ ID NO: 544820 - DNA, 20 bp, Artificial
  CRISPR gRNA sequence
gctgcagtttcagtatgaag

SEQ ID NO: 544821 - DNA, 20 bp, Artificial
  CRISPR gRNA sequence
agtttcagtatgaagtagat

SEQ ID NO: 544822 - DNA, 20 bp, Artificial
  CRISPR gRNA sequence
gtttcagtatgaagtagatg

SEQ ID NO: 544823 - DNA, 20 bp, Artificial
  CRISPR gRNA sequence
tttcagtatgaagtagatga

SEQ ID NO: 544824 - DNA, 20 bp, Artificial
  CRISPR gRNA sequence
cagtatgaagtagatgaggg

SEQ ID NO: 544825 - DNA, 20 bp, Artificial
  CRISPR gRNA sequence
agtatgaagtagatgagggc

SEQ ID NO: 544826 - DNA, 20 bp, Artificial
  CRISPR gRNA sequence
gtatgaagtagatgagggca

SEQ ID NO: 544827 - DNA, 20 bp, Artificial
  CRISPR gRNA sequence
gtagatgagggcagggaaac

SEQ ID NO: 544828 - DNA, 20 bp, Artificial
  CRISPR gRNA sequence
gatgagggcagggaaactgg

SEQ ID NO: 544829 - DNA, 20 bp, Artificial
  CRISPR gRNA sequence
gagggcagggaaactggtgg

SEQ ID NO: 544830 - DNA, 20 bp, Artificial
  CRISPR gRNA sequence
cagggaaactggtggtggtg

SEQ ID NO: 544831 - DNA, 20 bp, Artificial
  CRISPR gRNA sequence
ggtggtggtgtggctgaaat

SEQ ID NO: 544832 - DNA, 20 bp, Artificial
  CRISPR gRNA sequence
aatcagtaaatctctgtctt

SEQ ID NO: 544833 - DNA, 20 bp, Artificial
  CRISPR gRNA sequence
atcagtaaatctctgtctta

SEQ ID NO: 544834 - DNA, 20 bp, Artificial
  CRISPR gRNA sequence
aatctctgtcttaaggaaat

SEQ ID NO: 544835 - DNA, 20 bp, Artificial
  CRISPR gRNA sequence
tctctgtcttaaggaaataa

SEQ ID NO: 544836 - DNA, 20 bp, Artificial
  CRISPR gRNA sequence
ctgtcttaaggaaataagag

SEQ ID NO: 544837 - DNA, 20 bp, Artificial
  CRISPR gRNA sequence
aaataagagaagtcactaac

SEQ ID NO: 544838 - DNA, 20 bp, Artificial
  CRISPR gRNA sequence
aataagagaagtcactaact

SEQ ID NO: 544839 - DNA, 20 bp, Artificial
  CRISPR gRNA sequence
gagaagtcactaactgggac

SEQ ID NO: 544840 - DNA, 20 bp, Artificial
  CRISPR gRNA sequence
gtcactaactgggaccggct

SEQ ID NO: 544841 - DNA, 20 bp, Artificial
  CRISPR gRNA sequence
tcactaactgggaccggcta

SEQ ID NO: 544842 - DNA, 20 bp, Artificial
  CRISPR gRNA sequence
cactaactgggaccggctaa

SEQ ID NO: 544843 - DNA, 20 bp, Artificial
  CRISPR gRNA sequence
taactgggaccggctaaggg

SEQ ID NO: 544844 - DNA, 20 bp, Artificial
  CRISPR gRNA sequence
cggctaagggtggaatcgat

SEQ ID NO: 544845 - DNA, 20 bp, Artificial
  CRISPR gRNA sequence
ggctaagggtggaatcgatc

SEQ ID NO: 544846 - DNA, 20 bp, Artificial
  CRISPR gRNA sequence
ggtggaatcgatcaggaaaa

SEQ ID NO: 544847 - DNA, 20 bp, Artificial
  CRISPR gRNA sequence
tggaatcgatcaggaaaaaa

SEQ ID NO: 544848 - DNA, 20 bp, Artificial
  CRISPR gRNA sequence
ggaatcgatcaggaaaaaag

SEQ ID NO: 544849 - DNA, 20 bp, Artificial
  CRISPR gRNA sequence
cgatcaggaaaaaagaggaa

SEQ ID NO: 544850 - DNA, 20 bp, Artificial
  CRISPR gRNA sequence
aaagaggaatggccccaacc

SEQ ID NO: 544851 - DNA, 20 bp, Artificial
  CRISPR gRNA sequence
aagaggaatggccccaacca

SEQ ID NO: 544852 - DNA, 20 bp, Artificial
  CRISPR gRNA sequence
aaccaaggcatctgatgttc

SEQ ID NO: 544853 - DNA, 20 bp, Artificial
  CRISPR gRNA sequence
gcatctgatgttctggccaa

SEQ ID NO: 544854 - DNA, 20 bp, Artificial
  CRISPR gRNA sequence
tgatgttctggccaacagtg

SEQ ID NO: 544855 - DNA, 20 bp, Artificial
  CRISPR gRNA sequence
gatgttctggccaacagtgc

SEQ ID NO: 544856 - DNA, 20 bp, Artificial
  CRISPR gRNA sequence
ctggccaacagtgcaggctc

SEQ ID NO: 544857 - DNA, 20 bp, Artificial
  CRISPR gRNA sequence
tggccaacagtgcaggctct

SEQ ID NO: 544858 - DNA, 20 bp, Artificial
  CRISPR gRNA sequence
ggccaacagtgcaggctctg

SEQ ID NO: 544859 - DNA, 20 bp, Artificial
  CRISPR gRNA sequence
tggggccgactgcctgtgtc

SEQ ID NO: 544860 - DNA, 20 bp, Artificial
  CRISPR gRNA sequence
gactgcctgtgtctggacac

SEQ ID NO: 544861 - DNA, 20 bp, Artificial
  CRISPR gRNA sequence
acaccagctctgccccttgc

SEQ ID NO: 544862 - DNA, 20 bp, Artificial
  CRISPR gRNA sequence
agctctgccccttgctagct

SEQ ID NO: 544863 - DNA, 20 bp, Artificial
  CRISPR gRNA sequence
ccttgctagctgagtgaatg

SEQ ID NO: 544864 - DNA, 20 bp, Artificial
  CRISPR gRNA sequence
gctagctgagtgaatgcagt

SEQ ID NO: 544865 - DNA, 20 bp, Artificial
  CRISPR gRNA sequence
atgcagtcagctgaccctct

SEQ ID NO: 544866 - DNA, 20 bp, Artificial
  CRISPR gRNA sequence
tcagtccatttcttcatctg

SEQ ID NO: 544867 - DNA, 20 bp, Artificial
  CRISPR gRNA sequence
ccatttcttcatctgtagcc

SEQ ID NO: 544868 - DNA, 20 bp, Artificial
  CRISPR gRNA sequence
tcatctgtagcctggtgctt

SEQ ID NO: 544869 - DNA, 20 bp, Artificial
  CRISPR gRNA sequence
tttgaccttctctatcaacc

SEQ ID NO: 544870 - DNA, 20 bp, Artificial
  CRISPR gRNA sequence
ttctctatcaaccaagtgtc

SEQ ID NO: 544871 - DNA, 20 bp, Artificial
  CRISPR gRNA sequence
tctatcaaccaagtgtccag

SEQ ID NO: 544872 - DNA, 20 bp, Artificial
  CRISPR gRNA sequence
tatcaaccaagtgtccagcg

SEQ ID NO: 544873 - DNA, 20 bp, Artificial
  CRISPR gRNA sequence
agcaaaccaccttactttga

SEQ ID NO: 544874 - DNA, 20 bp, Artificial
  CRISPR gRNA sequence
gcaaaccaccttactttgat

SEQ ID NO: 544875 - DNA, 20 bp, Artificial
  CRISPR gRNA sequence
actttgataggcgtgttctc

SEQ ID NO: 544876 - DNA, 20 bp, Artificial
  CRISPR gRNA sequence
ctcctttctcactctcaccc

SEQ ID NO: 544877 - DNA, 20 bp, Artificial
  CRISPR gRNA sequence
actctcaccccagatgttct

SEQ ID NO: 544878 - DNA, 20 bp, Artificial
  CRISPR gRNA sequence
ctctcaccccagatgttctt

SEQ ID NO: 544879 - DNA, 20 bp, Artificial
  CRISPR gRNA sequence
ggctcgctcccctgcttttc

SEQ ID NO: 544880 - DNA, 20 bp, Artificial
  CRISPR gRNA sequence
ctgcttttctggactctgct

SEQ ID NO: 544881 - DNA, 20 bp, Artificial
  CRISPR gRNA sequence
catccaactcctttccttac

SEQ ID NO: 544882 - DNA, 20 bp, Artificial
  CRISPR gRNA sequence
ctttccttaccagtactcct

SEQ ID NO: 544883 - DNA, 20 bp, Artificial
  CRISPR gRNA sequence
ctctgctttatttttctcta

SEQ ID NO: 544884 - DNA, 20 bp, Artificial
  CRISPR gRNA sequence
atccaacatcatccaaataa

SEQ ID NO: 544885 - DNA, 20 bp, Artificial
  CRISPR gRNA sequence
ttcttccctccactgaaaaa

SEQ ID NO: 544886 - DNA, 20 bp, Artificial
  CRISPR gRNA sequence
tccactgaaaaatagactcc

SEQ ID NO: 544887 - DNA, 20 bp, Artificial
  CRISPR gRNA sequence
cactgaaaaatagactccaa

SEQ ID NO: 544888 - DNA, 20 bp, Artificial
  CRISPR gRNA sequence
actgaaaaatagactccaag

SEQ ID NO: 544889 - DNA, 20 bp, Artificial
  CRISPR gRNA sequence
ctgaaaaatagactccaaga

SEQ ID NO: 544890 - DNA, 20 bp, Artificial
  CRISPR gRNA sequence
aaaatagactccaagagggc

SEQ ID NO: 544891 - DNA, 20 bp, Artificial
  CRISPR gRNA sequence
aaatagactccaagagggct

SEQ ID NO: 544892 - DNA, 20 bp, Artificial
  CRISPR gRNA sequence
tatatcctgcctgcttattt

SEQ ID NO: 544893 - DNA, 20 bp, Artificial
  CRISPR gRNA sequence
tgcctgcttatttcagtgtc

SEQ ID NO: 544894 - DNA, 20 bp, Artificial
  CRISPR gRNA sequence
ttatttcagtgtctggcaca

SEQ ID NO: 544895 - DNA, 20 bp, Artificial
  CRISPR gRNA sequence
tatttcagtgtctggcacat

SEQ ID NO: 544896 - DNA, 20 bp, Artificial
  CRISPR gRNA sequence
ttcagtgtctggcacatagg

SEQ ID NO: 544897 - DNA, 20 bp, Artificial
  CRISPR gRNA sequence
tcagtgtctggcacataggc

SEQ ID NO: 544898 - DNA, 20 bp, Artificial
  CRISPR gRNA sequence
tgaacaaataaatgaataat

SEQ ID NO: 544899 - DNA, 20 bp, Artificial
  CRISPR gRNA sequence
atgaataataagaactacct

SEQ ID NO: 544900 - DNA, 20 bp, Artificial
  CRISPR gRNA sequence
gaataataagaactacctca

SEQ ID NO: 544901 - DNA, 20 bp, Artificial
  CRISPR gRNA sequence
ataagaactacctcagagtt

SEQ ID NO: 544902 - DNA, 20 bp, Artificial
  CRISPR gRNA sequence
aactacctcagagttgagtt

SEQ ID NO: 544903 - DNA, 20 bp, Artificial
  CRISPR gRNA sequence
actacctcagagttgagttg

SEQ ID NO: 544904 - DNA, 20 bp, Artificial
  CRISPR gRNA sequence
agttgagttgaggattaaat

SEQ ID NO: 544905 - DNA, 20 bp, Artificial
  CRISPR gRNA sequence
taaatgagttaatacacaaa

SEQ ID NO: 544906 - DNA, 20 bp, Artificial
  CRISPR gRNA sequence
gttaatacacaaacagctct

SEQ ID NO: 544907 - DNA, 20 bp, Artificial
  CRISPR gRNA sequence
acacaaacagctcttggaac

SEQ ID NO: 544908 - DNA, 20 bp, Artificial
  CRISPR gRNA sequence
tggaacaagtgcttgtcaca

SEQ ID NO: 544909 - DNA, 20 bp, Artificial
  CRISPR gRNA sequence
acaagtgcttgtcacatagt

SEQ ID NO: 544910 - DNA, 20 bp, Artificial
  CRISPR gRNA sequence
cttgtcacatagtaagcctg

SEQ ID NO: 544911 - DNA, 20 bp, Artificial
  CRISPR gRNA sequence
tactgttaaatattattact

SEQ ID NO: 544912 - DNA, 20 bp, Artificial
  CRISPR gRNA sequence
actgttaaatattattactg

SEQ ID NO: 544913 - DNA, 20 bp, Artificial
  CRISPR gRNA sequence
taaatattattactgaggct

SEQ ID NO: 544914 - DNA, 20 bp, Artificial
  CRISPR gRNA sequence
tattattactgaggctgagc

SEQ ID NO: 544915 - DNA, 20 bp, Artificial
  CRISPR gRNA sequence
ttactgaggctgagctggcc

SEQ ID NO: 544916 - DNA, 20 bp, Artificial
  CRISPR gRNA sequence
tactgaggctgagctggcct

SEQ ID NO: 544917 - DNA, 20 bp, Artificial
  CRISPR gRNA sequence
actgaggctgagctggccta

SEQ ID NO: 544918 - DNA, 20 bp, Artificial
  CRISPR gRNA sequence
tgagctggcctagggctcct

SEQ ID NO: 544919 - DNA, 20 bp, Artificial
  CRISPR gRNA sequence
tggcctagggctccttggat

SEQ ID NO: 544920 - DNA, 20 bp, Artificial
  CRISPR gRNA sequence
ctccttggattggacttgct

SEQ ID NO: 544921 - DNA, 20 bp, Artificial
  CRISPR gRNA sequence
ccttggattggacttgctaa

SEQ ID NO: 544922 - DNA, 20 bp, Artificial
  CRISPR gRNA sequence
ggattggacttgctaagagc

SEQ ID NO: 544923 - DNA, 20 bp, Artificial
  CRISPR gRNA sequence
gattggacttgctaagagct

SEQ ID NO: 544924 - DNA, 20 bp, Artificial
  CRISPR gRNA sequence
ggacttgctaagagctaggc

SEQ ID NO: 544925 - DNA, 20 bp, Artificial
  CRISPR gRNA sequence
acttgctaagagctaggcaa

SEQ ID NO: 544926 - DNA, 20 bp, Artificial
  CRISPR gRNA sequence
caactgtatgaaacttgatt

SEQ ID NO: 544927 - DNA, 20 bp, Artificial
  CRISPR gRNA sequence
cttgattgagttaaaacaaa

SEQ ID NO: 544928 - DNA, 20 bp, Artificial
  CRISPR gRNA sequence
ctctttattatctccatgcc

SEQ ID NO: 544929 - DNA, 20 bp, Artificial
  CRISPR gRNA sequence
ttattatctccatgcctggt

SEQ ID NO: 544930 - DNA, 20 bp, Artificial
  CRISPR gRNA sequence
acattttctacccccaaaat

SEQ ID NO: 544931 - DNA, 20 bp, Artificial
  CRISPR gRNA sequence
cattttctacccccaaaatt

SEQ ID NO: 544932 - DNA, 20 bp, Artificial
  CRISPR gRNA sequence
aaattgggactgactaatat

SEQ ID NO: 544933 - DNA, 20 bp, Artificial
  CRISPR gRNA sequence
gactaatatgagaatattta

SEQ ID NO: 544934 - DNA, 20 bp, Artificial
  CRISPR gRNA sequence
gagaatatttatggccttaa

SEQ ID NO: 544935 - DNA, 20 bp, Artificial
  CRISPR gRNA sequence
agaatatttatggccttaat

SEQ ID NO: 544936 - DNA, 20 bp, Artificial
  CRISPR gRNA sequence
tatttatggccttaatagga

SEQ ID NO: 544937 - DNA, 20 bp, Artificial
  CRISPR gRNA sequence
atttatggccttaataggac

SEQ ID NO: 544938 - DNA, 20 bp, Artificial
  CRISPR gRNA sequence
aggttatttgatacaattac

SEQ ID NO: 544939 - DNA, 20 bp, Artificial
  CRISPR gRNA sequence
atttgatacaattactagcc

SEQ ID NO: 544940 - DNA, 20 bp, Artificial
  CRISPR gRNA sequence
aattactagcctagacattt

SEQ ID NO: 544941 - DNA, 20 bp, Artificial
  CRISPR gRNA sequence
attactagcctagacatttt

SEQ ID NO: 544942 - DNA, 20 bp, Artificial
  CRISPR gRNA sequence
tactagcctagacattttag

SEQ ID NO: 544943 - DNA, 20 bp, Artificial
  CRISPR gRNA sequence
gcctagacattttaggagat

SEQ ID NO: 544944 - DNA, 20 bp, Artificial
  CRISPR gRNA sequence
caatactataaatgcatata

SEQ ID NO: 544945 - DNA, 20 bp, Artificial
  CRISPR gRNA sequence
aatactataaatgcatatat

SEQ ID NO: 544946 - DNA, 20 bp, Artificial
  CRISPR gRNA sequence
taaatgcatatatgggtgtg

SEQ ID NO: 544947 - DNA, 20 bp, Artificial
  CRISPR gRNA sequence
tgcatatatgggtgtgtaga

SEQ ID NO: 544948 - DNA, 20 bp, Artificial
  CRISPR gRNA sequence
catatatgggtgtgtagata

SEQ ID NO: 544949 - DNA, 20 bp, Artificial
  CRISPR gRNA sequence
tagatagagatgttgcttcc

SEQ ID NO: 544950 - DNA, 20 bp, Artificial
  CRISPR gRNA sequence
gccacacatcctgatactgc

SEQ ID NO: 544951 - DNA, 20 bp, Artificial
  CRISPR gRNA sequence
acacatcctgatactgcaag

SEQ ID NO: 544952 - DNA, 20 bp, Artificial
  CRISPR gRNA sequence
cacatcctgatactgcaagt

SEQ ID NO: 544953 - DNA, 20 bp, Artificial
  CRISPR gRNA sequence
tgaaaatgtgccgtgatgtg

SEQ ID NO: 544954 - DNA, 20 bp, Artificial
  CRISPR gRNA sequence
cgtgatgtgaagaccaaacg

SEQ ID NO: 544955 - DNA, 20 bp, Artificial
  CRISPR gRNA sequence
tgatgtgaagaccaaacgca

SEQ ID NO: 544956 - DNA, 20 bp, Artificial
  CRISPR gRNA sequence
tgtgaagaccaaacgcagag

SEQ ID NO: 544957 - DNA, 20 bp, Artificial
  CRISPR gRNA sequence
aagaccaaacgcagagaagt

SEQ ID NO: 544958 - DNA, 20 bp, Artificial
  CRISPR gRNA sequence
gaccaaacgcagagaagtga

SEQ ID NO: 544959 - DNA, 20 bp, Artificial
  CRISPR gRNA sequence
accaaacgcagagaagtgag

SEQ ID NO: 544960 - DNA, 20 bp, Artificial
  CRISPR gRNA sequence
ccaaacgcagagaagtgaga

SEQ ID NO: 544961 - DNA, 20 bp, Artificial
  CRISPR gRNA sequence
cgcagagaagtgagagggac

SEQ ID NO: 544962 - DNA, 20 bp, Artificial
  CRISPR gRNA sequence
gcagagaagtgagagggaca

SEQ ID NO: 544963 - DNA, 20 bp, Artificial
  CRISPR gRNA sequence
gagagggacaaggctgtgct

SEQ ID NO: 544964 - DNA, 20 bp, Artificial
  CRISPR gRNA sequence
tgtgctcagtgacccatatc

SEQ ID NO: 544965 - DNA, 20 bp, Artificial
  CRISPR gRNA sequence
tcagtgacccatatccagat

SEQ ID NO: 544966 - DNA, 20 bp, Artificial
  CRISPR gRNA sequence
gagaaatccatctgctcact

SEQ ID NO: 544967 - DNA, 20 bp, Artificial
  CRISPR gRNA sequence
agaaatccatctgctcactt

SEQ ID NO: 544968 - DNA, 20 bp, Artificial
  CRISPR gRNA sequence
aaatccatctgctcacttgg

SEQ ID NO: 544969 - DNA, 20 bp, Artificial
  CRISPR gRNA sequence
cttgggagcaaaaatgcccc

SEQ ID NO: 544970 - DNA, 20 bp, Artificial
  CRISPR gRNA sequence
ccccaagaccctgctatctc

SEQ ID NO: 544971 - DNA, 20 bp, Artificial
  CRISPR gRNA sequence
cccaagaccctgctatctct

SEQ ID NO: 544972 - DNA, 20 bp, Artificial
  CRISPR gRNA sequence
tgctatctctgggcttgcac

SEQ ID NO: 544973 - DNA, 20 bp, Artificial
  CRISPR gRNA sequence
gctatctctgggcttgcacg

SEQ ID NO: 544974 - DNA, 20 bp, Artificial
  CRISPR gRNA sequence
ccattatgatgtcttatatt

SEQ ID NO: 544975 - DNA, 20 bp, Artificial
  CRISPR gRNA sequence
attatgatgtcttatattca

SEQ ID NO: 544976 - DNA, 20 bp, Artificial
  CRISPR gRNA sequence
ttatgatgtcttatattcag

SEQ ID NO: 544977 - DNA, 20 bp, Artificial
  CRISPR gRNA sequence
tatgatgtcttatattcaga

SEQ ID NO: 544978 - DNA, 20 bp, Artificial
  CRISPR gRNA sequence
aataccaatattcatatatt

SEQ ID NO: 544979 - DNA, 20 bp, Artificial
  CRISPR gRNA sequence
ataccaatattcatatattc

SEQ ID NO: 544980 - DNA, 20 bp, Artificial
  CRISPR gRNA sequence
attcaggtactgaaactttt

SEQ ID NO: 544981 - DNA, 20 bp, Artificial
  CRISPR gRNA sequence
ttcaggtactgaaactttta

SEQ ID NO: 544982 - DNA, 20 bp, Artificial
  CRISPR gRNA sequence
tcaggtactgaaacttttaa

SEQ ID NO: 544983 - DNA, 20 bp, Artificial
  CRISPR gRNA sequence
ctttcttttttttttttttt

SEQ ID NO: 544984 - DNA, 20 bp, Artificial
  CRISPR gRNA sequence
actttacctgctaaaatctg

SEQ ID NO: 544985 - DNA, 20 bp, Artificial
  CRISPR gRNA sequence
ctttacctgctaaaatctgc

SEQ ID NO: 544986 - DNA, 20 bp, Artificial
  CRISPR gRNA sequence
tacctgctaaaatctgcagg

SEQ ID NO: 544987 - DNA, 20 bp, Artificial
  CRISPR gRNA sequence
ctaaaatctgcaggcagtgt

SEQ ID NO: 544988 - DNA, 20 bp, Artificial
  CRISPR gRNA sequence
gtgtgagccttaaaatattt

SEQ ID NO: 544989 - DNA, 20 bp, Artificial
  CRISPR gRNA sequence
gtgagccttaaaatatttta

SEQ ID NO: 544990 - DNA, 20 bp, Artificial
  CRISPR gRNA sequence
gagccttaaaatattttaga

SEQ ID NO: 544991 - DNA, 20 bp, Artificial
  CRISPR gRNA sequence
gccttaaaatattttagaga

SEQ ID NO: 544992 - DNA, 20 bp, Artificial
  CRISPR gRNA sequence
cttaaaatattttagagaga

SEQ ID NO: 544993 - DNA, 20 bp, Artificial
  CRISPR gRNA sequence
taaaatattttagagagaga

SEQ ID NO: 544994 - DNA, 20 bp, Artificial
  CRISPR gRNA sequence
aaatattttagagagagaga

SEQ ID NO: 544995 - DNA, 20 bp, Artificial
  CRISPR gRNA sequence
tattttagagagagagagag

SEQ ID NO: 544996 - DNA, 20 bp, Artificial
  CRISPR gRNA sequence
aaattacattgtttatttct

SEQ ID NO: 544997 - DNA, 20 bp, Artificial
  CRISPR gRNA sequence
ttatttctaagaacaaactc

SEQ ID NO: 544998 - DNA, 20 bp, Artificial
  CRISPR gRNA sequence
aaaccctttccttcaaatcc

SEQ ID NO: 544999 - DNA, 20 bp, Artificial
  CRISPR gRNA sequence
ccctttccttcaaatcccgg

SEQ ID NO: 545000 - DNA, 20 bp, Artificial
  CRISPR gRNA sequence
ctttccttcaaatcccggaa

SEQ ID NO: 545001 - DNA, 20 bp, Artificial
  CRISPR gRNA sequence
tcaaatcccggaagagtgat

SEQ ID NO: 545002 - DNA, 20 bp, Artificial
  CRISPR gRNA sequence
agagtgattagcttgtctct

SEQ ID NO: 545003 - DNA, 20 bp, Artificial
  CRISPR gRNA sequence
gagtgattagcttgtctcta

SEQ ID NO: 545004 - DNA, 20 bp, Artificial
  CRISPR gRNA sequence
attagcttgtctctaaggta

SEQ ID NO: 545005 - DNA, 20 bp, Artificial
  CRISPR gRNA sequence
ttgtctctaaggtatggcat

SEQ ID NO: 545006 - DNA, 20 bp, Artificial
  CRISPR gRNA sequence
ctctaaggtatggcattggc

SEQ ID NO: 545007 - DNA, 20 bp, Artificial
  CRISPR gRNA sequence
tctaaggtatggcattggct

SEQ ID NO: 545008 - DNA, 20 bp, Artificial
  CRISPR gRNA sequence
ggtatggcattggctgggca

SEQ ID NO: 545009 - DNA, 20 bp, Artificial
  CRISPR gRNA sequence
atggcattggctgggcatgg

SEQ ID NO: 545010 - DNA, 20 bp, Artificial
  CRISPR gRNA sequence
gtggctcatgcttgtaatct

SEQ ID NO: 545011 - DNA, 20 bp, Artificial
  CRISPR gRNA sequence
tgcttgtaatctcagcactt

SEQ ID NO: 545012 - DNA, 20 bp, Artificial
  CRISPR gRNA sequence
ttgtaatctcagcacttcag

SEQ ID NO: 545013 - DNA, 20 bp, Artificial
  CRISPR gRNA sequence
tgtaatctcagcacttcaga

SEQ ID NO: 545014 - DNA, 20 bp, Artificial
  CRISPR gRNA sequence
tctcagcacttcagaaggcc

SEQ ID NO: 545015 - DNA, 20 bp, Artificial
  CRISPR gRNA sequence
ctcagcacttcagaaggccc

SEQ ID NO: 545016 - DNA, 20 bp, Artificial
  CRISPR gRNA sequence
tcagcacttcagaaggccca

SEQ ID NO: 545017 - DNA, 20 bp, Artificial
  CRISPR gRNA sequence
agcacttcagaaggcccagg

SEQ ID NO: 545018 - DNA, 20 bp, Artificial
  CRISPR gRNA sequence
gcacttcagaaggcccaggg

SEQ ID NO: 545019 - DNA, 20 bp, Artificial
  CRISPR gRNA sequence
acttcagaaggcccagggag

SEQ ID NO: 545020 - DNA, 20 bp, Artificial
  CRISPR gRNA sequence
cttcagaaggcccagggagg

SEQ ID NO: 545021 - DNA, 20 bp, Artificial
  CRISPR gRNA sequence
cccagggaggaggatcactt

SEQ ID NO: 545022 - DNA, 20 bp, Artificial
  CRISPR gRNA sequence
ggaggatcacttgagcccac

SEQ ID NO: 545023 - DNA, 20 bp, Artificial
  CRISPR gRNA sequence
tcacttgagcccacgagttt

SEQ ID NO: 545024 - DNA, 20 bp, Artificial
  CRISPR gRNA sequence
tgagcccacgagtttgagat

SEQ ID NO: 545025 - DNA, 20 bp, Artificial
  CRISPR gRNA sequence
cacgagtttgagatcagcct

SEQ ID NO: 545026 - DNA, 20 bp, Artificial
  CRISPR gRNA sequence
tgagatcagcctgagcaaca

SEQ ID NO: 545027 - DNA, 20 bp, Artificial
  CRISPR gRNA sequence
atcagcctgagcaacatagt

SEQ ID NO: 545028 - DNA, 20 bp, Artificial
  CRISPR gRNA sequence
tctacaaaaaatataaaaat

SEQ ID NO: 545029 - DNA, 20 bp, Artificial
  CRISPR gRNA sequence
caaaaaatataaaaattagc

SEQ ID NO: 545030 - DNA, 20 bp, Artificial
  CRISPR gRNA sequence
aaaaaatataaaaattagct

SEQ ID NO: 545031 - DNA, 20 bp, Artificial
  CRISPR gRNA sequence
atataaaaattagctgggcg

SEQ ID NO: 545032 - DNA, 20 bp, Artificial
  CRISPR gRNA sequence
taaaaattagctgggcgtgg

SEQ ID NO: 545033 - DNA, 20 bp, Artificial
  CRISPR gRNA sequence
ggcgtggtggcatgcaactg

SEQ ID NO: 545034 - DNA, 20 bp, Artificial
  CRISPR gRNA sequence
gtggcatgcaactgtagttc

SEQ ID NO: 545035 - DNA, 20 bp, Artificial
  CRISPR gRNA sequence
caactgtagttctagctact

SEQ ID NO: 545036 - DNA, 20 bp, Artificial
  CRISPR gRNA sequence
aactgtagttctagctactt

SEQ ID NO: 545037 - DNA, 20 bp, Artificial
  CRISPR gRNA sequence
ctgtagttctagctacttgg

SEQ ID NO: 545038 - DNA, 20 bp, Artificial
  CRISPR gRNA sequence
tgtagttctagctacttggg

SEQ ID NO: 545039 - DNA, 20 bp, Artificial
  CRISPR gRNA sequence
ttctagctacttgggaggct

SEQ ID NO: 545040 - DNA, 20 bp, Artificial
  CRISPR gRNA sequence
tctagctacttgggaggctg

SEQ ID NO: 545041 - DNA, 20 bp, Artificial
  CRISPR gRNA sequence
agctacttgggaggctgagg

SEQ ID NO: 545042 - DNA, 20 bp, Artificial
  CRISPR gRNA sequence
tacttgggaggctgaggcag

SEQ ID NO: 545043 - DNA, 20 bp, Artificial
  CRISPR gRNA sequence
acttgggaggctgaggcaga

SEQ ID NO: 545044 - DNA, 20 bp, Artificial
  CRISPR gRNA sequence
ctgaggcagaaggatcactt

SEQ ID NO: 545045 - DNA, 20 bp, Artificial
  CRISPR gRNA sequence
gcagaaggatcacttgagcc

SEQ ID NO: 545046 - DNA, 20 bp, Artificial
  CRISPR gRNA sequence
cagaaggatcacttgagccc

SEQ ID NO: 545047 - DNA, 20 bp, Artificial
  CRISPR gRNA sequence
gaaggatcacttgagcccag

SEQ ID NO: 545048 - DNA, 20 bp, Artificial
  CRISPR gRNA sequence
aaggatcacttgagcccagg

SEQ ID NO: 545049 - DNA, 20 bp, Artificial
  CRISPR gRNA sequence
cacttgagcccaggaggttg

SEQ ID NO: 545050 - DNA, 20 bp, Artificial
  CRISPR gRNA sequence
agcccaggaggttgaagcta

SEQ ID NO: 545051 - DNA, 20 bp, Artificial
  CRISPR gRNA sequence
caggaggttgaagctacagt

SEQ ID NO: 545052 - DNA, 20 bp, Artificial
  CRISPR gRNA sequence
tgcaccactgcacaccaacc

SEQ ID NO: 545053 - DNA, 20 bp, Artificial
  CRISPR gRNA sequence
gcaccactgcacaccaacct

SEQ ID NO: 545054 - DNA, 20 bp, Artificial
  CRISPR gRNA sequence
ctgcacaccaacctgggtga

SEQ ID NO: 545055 - DNA, 20 bp, Artificial
  CRISPR gRNA sequence
accaacctgggtgacagaat

SEQ ID NO: 545056 - DNA, 20 bp, Artificial
  CRISPR gRNA sequence
aatgagaccctgtctccaaa

SEQ ID NO: 545057 - DNA, 20 bp, Artificial
  CRISPR gRNA sequence
accctgtctccaaaaagaaa

SEQ ID NO: 545058 - DNA, 20 bp, Artificial
  CRISPR gRNA sequence
ccctgtctccaaaaagaaaa

SEQ ID NO: 545059 - DNA, 20 bp, Artificial
  CRISPR gRNA sequence
tgtctccaaaaagaaaaagg

SEQ ID NO: 545060 - DNA, 20 bp, Artificial
  CRISPR gRNA sequence
gtctccaaaaagaaaaagga

SEQ ID NO: 545061 - DNA, 20 bp, Artificial
  CRISPR gRNA sequence
tccaaaaagaaaaaggaagg

SEQ ID NO: 545062 - DNA, 20 bp, Artificial
  CRISPR gRNA sequence
ccaaaaagaaaaaggaagga

SEQ ID NO: 545063 - DNA, 20 bp, Artificial
  CRISPR gRNA sequence
aaaagaaaaaggaaggaagg

SEQ ID NO: 545064 - DNA, 20 bp, Artificial
  CRISPR gRNA sequence
aaagaaaaaggaaggaagga

SEQ ID NO: 545065 - DNA, 20 bp, Artificial
  CRISPR gRNA sequence
gaaaaaggaaggaaggaagg

SEQ ID NO: 545066 - DNA, 20 bp, Artificial
  CRISPR gRNA sequence
aaaaaggaaggaaggaagga

SEQ ID NO: 545067 - DNA, 20 bp, Artificial
  CRISPR gRNA sequence
aaaaggaaggaaggaaggaa

SEQ ID NO: 545068 - DNA, 20 bp, Artificial
  CRISPR gRNA sequence
aaaggaaggaaggaaggaag

SEQ ID NO: 545069 - DNA, 20 bp, Artificial
  CRISPR gRNA sequence
aggaaggaaggaaggaaggg

SEQ ID NO: 545070 - DNA, 20 bp, Artificial
  CRISPR gRNA sequence
ggaaggaaggaaggaagggg

SEQ ID NO: 545071 - DNA, 20 bp, Artificial
  CRISPR gRNA sequence
gaaggaaggaaggaagggga

SEQ ID NO: 545072 - DNA, 20 bp, Artificial
  CRISPR gRNA sequence
ggaaggaaggaaggggaggg

SEQ ID NO: 545073 - DNA, 20 bp, Artificial
  CRISPR gRNA sequence
gaaggaaggaaggggaggga

SEQ ID NO: 545074 - DNA, 20 bp, Artificial
  CRISPR gRNA sequence
aggaaggaaggggagggaag

SEQ ID NO: 545075 - DNA, 20 bp, Artificial
  CRISPR gRNA sequence
ggaaggaaggggagggaagg

SEQ ID NO: 545076 - DNA, 20 bp, Artificial
  CRISPR gRNA sequence
gaaggaaggggagggaagga

SEQ ID NO: 545077 - DNA, 20 bp, Artificial
  CRISPR gRNA sequence
aggaaggggagggaaggagg

SEQ ID NO: 545078 - DNA, 20 bp, Artificial
  CRISPR gRNA sequence
gaaggggagggaaggaggga

SEQ ID NO: 545079 - DNA, 20 bp, Artificial
  CRISPR gRNA sequence
aggggagggaaggagggaga

SEQ ID NO: 545080 - DNA, 20 bp, Artificial
  CRISPR gRNA sequence
gggagggaaggagggagaga

SEQ ID NO: 545081 - DNA, 20 bp, Artificial
  CRISPR gRNA sequence
gagggaaggagggagagaga

SEQ ID NO: 545082 - DNA, 20 bp, Artificial
  CRISPR gRNA sequence
agggaaggagggagagagag

SEQ ID NO: 545083 - DNA, 20 bp, Artificial
  CRISPR gRNA sequence
gggaaggagggagagagaga

SEQ ID NO: 545084 - DNA, 20 bp, Artificial
  CRISPR gRNA sequence
aggagggagagagagaggga

SEQ ID NO: 545085 - DNA, 20 bp, Artificial
  CRISPR gRNA sequence
gggagagagagagggaaaga

SEQ ID NO: 545086 - DNA, 20 bp, Artificial
  CRISPR gRNA sequence
gagagagagagggaaagaaa

SEQ ID NO: 545087 - DNA, 20 bp, Artificial
  CRISPR gRNA sequence
gaaagaaagagaaaaataaa

SEQ ID NO: 545088 - DNA, 20 bp, Artificial
  CRISPR gRNA sequence
gaaagagaaaaataaaaaga

SEQ ID NO: 545089 - DNA, 20 bp, Artificial
  CRISPR gRNA sequence
agaaaaataaaaagaaagaa

SEQ ID NO: 545090 - DNA, 20 bp, Artificial
  CRISPR gRNA sequence
aaataaaaagaaagaaaaga

SEQ ID NO: 545091 - DNA, 20 bp, Artificial
  CRISPR gRNA sequence
agaaaagaaagaaatgacat

SEQ ID NO: 545092 - DNA, 20 bp, Artificial
  CRISPR gRNA sequence
cagtgaacctcctcaaacca

SEQ ID NO: 545093 - DNA, 20 bp, Artificial
  CRISPR gRNA sequence
gaacctcctcaaaccatagc

SEQ ID NO: 545094 - DNA, 20 bp, Artificial
  CRISPR gRNA sequence
aacctcctcaaaccatagcg

SEQ ID NO: 545095 - DNA, 20 bp, Artificial
  CRISPR gRNA sequence
caaaccatagcgaggctgtt

SEQ ID NO: 545096 - DNA, 20 bp, Artificial
  CRISPR gRNA sequence
gcgaggctgttaagtttgat

SEQ ID NO: 545097 - DNA, 20 bp, Artificial
  CRISPR gRNA sequence
cgaggctgttaagtttgatt

SEQ ID NO: 545098 - DNA, 20 bp, Artificial
  CRISPR gRNA sequence
gaggctgttaagtttgattg

SEQ ID NO: 545099 - DNA, 20 bp, Artificial
  CRISPR gRNA sequence
tgattggggctgacatccat

SEQ ID NO: 545100 - DNA, 20 bp, Artificial
  CRISPR gRNA sequence
ttggggctgacatccatgag

SEQ ID NO: 545101 - DNA, 20 bp, Artificial
  CRISPR gRNA sequence
tggggctgacatccatgagt

SEQ ID NO: 545102 - DNA, 20 bp, Artificial
  CRISPR gRNA sequence
tgacatccatgagtgggtac

SEQ ID NO: 545103 - DNA, 20 bp, Artificial
  CRISPR gRNA sequence
tgagtgggtacaagtttatc

SEQ ID NO: 545104 - DNA, 20 bp, Artificial
  CRISPR gRNA sequence
gggtacaagtttatctggtg

SEQ ID NO: 545105 - DNA, 20 bp, Artificial
  CRISPR gRNA sequence
gccctgcatcctataacact

SEQ ID NO: 545106 - DNA, 20 bp, Artificial
  CRISPR gRNA sequence
tgcatcctataacacttagt

SEQ ID NO: 545107 - DNA, 20 bp, Artificial
  CRISPR gRNA sequence
ggtaaaatctacttaaactt

SEQ ID NO: 545108 - DNA, 20 bp, Artificial
  CRISPR gRNA sequence
taaaatctacttaaacttga

SEQ ID NO: 545109 - DNA, 20 bp, Artificial
  CRISPR gRNA sequence
aaaatctacttaaacttgag

SEQ ID NO: 545110 - DNA, 20 bp, Artificial
  CRISPR gRNA sequence
aaatctacttaaacttgaga

SEQ ID NO: 545111 - DNA, 20 bp, Artificial
  CRISPR gRNA sequence
cttgagagggaacatctcaa

SEQ ID NO: 545112 - DNA, 20 bp, Artificial
  CRISPR gRNA sequence
ttgagagggaacatctcaaa

SEQ ID NO: 545113 - DNA, 20 bp, Artificial
  CRISPR gRNA sequence
tgagagggaacatctcaaaa

SEQ ID NO: 545114 - DNA, 20 bp, Artificial
  CRISPR gRNA sequence
agggaacatctcaaaaggga

SEQ ID NO: 545115 - DNA, 20 bp, Artificial
  CRISPR gRNA sequence
catctcaaaagggacagctg

SEQ ID NO: 545116 - DNA, 20 bp, Artificial
  CRISPR gRNA sequence
tctcaaaagggacagctgtg

SEQ ID NO: 545117 - DNA, 20 bp, Artificial
  CRISPR gRNA sequence
aaaagggacagctgtggagt

SEQ ID NO: 545118 - DNA, 20 bp, Artificial
  CRISPR gRNA sequence
aaagggacagctgtggagtt

SEQ ID NO: 545119 - DNA, 20 bp, Artificial
  CRISPR gRNA sequence
gggacagctgtggagttggg

SEQ ID NO: 545120 - DNA, 20 bp, Artificial
  CRISPR gRNA sequence
ggacagctgtggagttggga

SEQ ID NO: 545121 - DNA, 20 bp, Artificial
  CRISPR gRNA sequence
cagctgtggagttgggaagg

SEQ ID NO: 545122 - DNA, 20 bp, Artificial
  CRISPR gRNA sequence
gctgtggagttgggaaggtg

SEQ ID NO: 545123 - DNA, 20 bp, Artificial
  CRISPR gRNA sequence
agttgggaaggtggagcccg

SEQ ID NO: 545124 - DNA, 20 bp, Artificial
  CRISPR gRNA sequence
gttgggaaggtggagcccgc

SEQ ID NO: 545125 - DNA, 20 bp, Artificial
  CRISPR gRNA sequence
caggtcctcccatcttgctt

SEQ ID NO: 545126 - DNA, 20 bp, Artificial
  CRISPR gRNA sequence
tcccatcttgctttggtgat

SEQ ID NO: 545127 - DNA, 20 bp, Artificial
  CRISPR gRNA sequence
cccatcttgctttggtgatg

SEQ ID NO: 545128 - DNA, 20 bp, Artificial
  CRISPR gRNA sequence
atcttgctttggtgatgagg

SEQ ID NO: 545129 - DNA, 20 bp, Artificial
  CRISPR gRNA sequence
tgctttggtgatgaggcaga

SEQ ID NO: 545130 - DNA, 20 bp, Artificial
  CRISPR gRNA sequence
tttggtgatgaggcagaaag

SEQ ID NO: 545131 - DNA, 20 bp, Artificial
  CRISPR gRNA sequence
ttggtgatgaggcagaaagt

SEQ ID NO: 545132 - DNA, 20 bp, Artificial
  CRISPR gRNA sequence
tggtgatgaggcagaaagtg

SEQ ID NO: 545133 - DNA, 20 bp, Artificial
  CRISPR gRNA sequence
gaaagtggggctgaaaaact

SEQ ID NO: 545134 - DNA, 20 bp, Artificial
  CRISPR gRNA sequence
ctgaaaaactgagtctgttt

SEQ ID NO: 545135 - DNA, 20 bp, Artificial
  CRISPR gRNA sequence
agtctgttttggttgtatat

SEQ ID NO: 545136 - DNA, 20 bp, Artificial
  CRISPR gRNA sequence
gtctgttttggttgtatatg

SEQ ID NO: 545137 - DNA, 20 bp, Artificial
  CRISPR gRNA sequence
tctgttttggttgtatatga

SEQ ID NO: 545138 - DNA, 20 bp, Artificial
  CRISPR gRNA sequence
ggttgtatatgagggctcct

SEQ ID NO: 545139 - DNA, 20 bp, Artificial
  CRISPR gRNA sequence
tcctgagccattttattttt

SEQ ID NO: 545140 - DNA, 20 bp, Artificial
  CRISPR gRNA sequence
gccattttatttttaagctc

SEQ ID NO: 545141 - DNA, 20 bp, Artificial
  CRISPR gRNA sequence
tttctccatctctccttacg

SEQ ID NO: 545142 - DNA, 20 bp, Artificial
  CRISPR gRNA sequence
cttacgaagtcctccttctt

SEQ ID NO: 545143 - DNA, 20 bp, Artificial
  CRISPR gRNA sequence
cgaagtcctccttcttcagc

SEQ ID NO: 545144 - DNA, 20 bp, Artificial
  CRISPR gRNA sequence
gaagtcctccttcttcagcc

SEQ ID NO: 545145 - DNA, 20 bp, Artificial
  CRISPR gRNA sequence
ccttcttcagccaggttcca

SEQ ID NO: 545146 - DNA, 20 bp, Artificial
  CRISPR gRNA sequence
agccaggttccacagcaatt

SEQ ID NO: 545147 - DNA, 20 bp, Artificial
  CRISPR gRNA sequence
gccaggttccacagcaattt

SEQ ID NO: 545148 - DNA, 20 bp, Artificial
  CRISPR gRNA sequence
cagcaatttgggatttcaca

SEQ ID NO: 545149 - DNA, 20 bp, Artificial
  CRISPR gRNA sequence
atttgggatttcacaaagcc

SEQ ID NO: 545150 - DNA, 20 bp, Artificial
  CRISPR gRNA sequence
tttgggatttcacaaagccc

SEQ ID NO: 545151 - DNA, 20 bp, Artificial
  CRISPR gRNA sequence
ttgggatttcacaaagccca

SEQ ID NO: 545152 - DNA, 20 bp, Artificial
  CRISPR gRNA sequence
atttcacaaagcccagggtt

SEQ ID NO: 545153 - DNA, 20 bp, Artificial
  CRISPR gRNA sequence
tttcacaaagcccagggttt

SEQ ID NO: 545154 - DNA, 20 bp, Artificial
  CRISPR gRNA sequence
ttcacaaagcccagggtttg

SEQ ID NO: 545155 - DNA, 20 bp, Artificial
  CRISPR gRNA sequence
gtcaaattttgctattctgt

SEQ ID NO: 545156 - DNA, 20 bp, Artificial
  CRISPR gRNA sequence
tcaaattttgctattctgtc

SEQ ID NO: 545157 - DNA, 20 bp, Artificial
  CRISPR gRNA sequence
aattttgctattctgtcagg

SEQ ID NO: 545158 - DNA, 20 bp, Artificial
  CRISPR gRNA sequence
ttatcttttgaactacattt

SEQ ID NO: 545159 - DNA, 20 bp, Artificial
  CRISPR gRNA sequence
aagttgtattttaatcattt

SEQ ID NO: 545160 - DNA, 20 bp, Artificial
  CRISPR gRNA sequence
attttagttaattcattcaa

SEQ ID NO: 545161 - DNA, 20 bp, Artificial
  CRISPR gRNA sequence
attcaacagatatttattga

SEQ ID NO: 545162 - DNA, 20 bp, Artificial
  CRISPR gRNA sequence
tttattgaaagtccatatgc

SEQ ID NO: 545163 - DNA, 20 bp, Artificial
  CRISPR gRNA sequence
aagtccatatgccagacata

SEQ ID NO: 545164 - DNA, 20 bp, Artificial
  CRISPR gRNA sequence
agtccatatgccagacatat

SEQ ID NO: 545165 - DNA, 20 bp, Artificial
  CRISPR gRNA sequence
gtccatatgccagacatatg

SEQ ID NO: 545166 - DNA, 20 bp, Artificial
  CRISPR gRNA sequence
atgccagacatatggggata

SEQ ID NO: 545167 - DNA, 20 bp, Artificial
  CRISPR gRNA sequence
tatggggatacagccaaaaa

SEQ ID NO: 545168 - DNA, 20 bp, Artificial
  CRISPR gRNA sequence
atggggatacagccaaaaac

SEQ ID NO: 545169 - DNA, 20 bp, Artificial
  CRISPR gRNA sequence
cacctttgtccttgtcctga

SEQ ID NO: 545170 - DNA, 20 bp, Artificial
  CRISPR gRNA sequence
acctttgtccttgtcctgat

SEQ ID NO: 545171 - DNA, 20 bp, Artificial
  CRISPR gRNA sequence
cctttgtccttgtcctgata

SEQ ID NO: 545172 - DNA, 20 bp, Artificial
  CRISPR gRNA sequence
tgtccttgtcctgatagggc

SEQ ID NO: 545173 - DNA, 20 bp, Artificial
  CRISPR gRNA sequence
ttgtcctgatagggctagcc

SEQ ID NO: 545174 - DNA, 20 bp, Artificial
  CRISPR gRNA sequence
cctgatagggctagcctggc

SEQ ID NO: 545175 - DNA, 20 bp, Artificial
  CRISPR gRNA sequence
ctgatagggctagcctggct

SEQ ID NO: 545176 - DNA, 20 bp, Artificial
  CRISPR gRNA sequence
tgatagggctagcctggctg

SEQ ID NO: 545177 - DNA, 20 bp, Artificial
  CRISPR gRNA sequence
gcctggctggggttacccct

SEQ ID NO: 545178 - DNA, 20 bp, Artificial
  CRISPR gRNA sequence
gctggggttacccctaagct

SEQ ID NO: 545179 - DNA, 20 bp, Artificial
  CRISPR gRNA sequence
ccctaagctcagatttgaat

SEQ ID NO: 545180 - DNA, 20 bp, Artificial
  CRISPR gRNA sequence
tgaattagttgccaactttc

SEQ ID NO: 545181 - DNA, 20 bp, Artificial
  CRISPR gRNA sequence
tagttgccaactttcaagaa

SEQ ID NO: 545182 - DNA, 20 bp, Artificial
  CRISPR gRNA sequence
agttgccaactttcaagaac

SEQ ID NO: 545183 - DNA, 20 bp, Artificial
  CRISPR gRNA sequence
tcacacaaaatgtgaatatc

SEQ ID NO: 545184 - DNA, 20 bp, Artificial
  CRISPR gRNA sequence
tctggctttttttgaaaaat

SEQ ID NO: 545185 - DNA, 20 bp, Artificial
  CRISPR gRNA sequence
ctggctttttttgaaaaatt

SEQ ID NO: 545186 - DNA, 20 bp, Artificial
  CRISPR gRNA sequence
tttttgaaaaattgggaacc

SEQ ID NO: 545187 - DNA, 20 bp, Artificial
  CRISPR gRNA sequence
aaaaattgggaacctggcaa

SEQ ID NO: 545188 - DNA, 20 bp, Artificial
  CRISPR gRNA sequence
aattgggaacctggcaatgg

SEQ ID NO: 545189 - DNA, 20 bp, Artificial
  CRISPR gRNA sequence
attgggaacctggcaatggt

SEQ ID NO: 545190 - DNA, 20 bp, Artificial
  CRISPR gRNA sequence
ggtgggcctctgtttccaca

SEQ ID NO: 545191 - DNA, 20 bp, Artificial
  CRISPR gRNA sequence
gggcctctgtttccacatgg

SEQ ID NO: 545192 - DNA, 20 bp, Artificial
  CRISPR gRNA sequence
ggcctctgtttccacatggc

SEQ ID NO: 545193 - DNA, 20 bp, Artificial
  CRISPR gRNA sequence
cctctgtttccacatggcag

SEQ ID NO: 545194 - DNA, 20 bp, Artificial
  CRISPR gRNA sequence
gtttccacatggcaggagct

SEQ ID NO: 545195 - DNA, 20 bp, Artificial
  CRISPR gRNA sequence
tttccacatggcaggagctg

SEQ ID NO: 545196 - DNA, 20 bp, Artificial
  CRISPR gRNA sequence
acatggcaggagctgaggca

SEQ ID NO: 545197 - DNA, 20 bp, Artificial
  CRISPR gRNA sequence
gcacagctcctgtttccaca

SEQ ID NO: 545198 - DNA, 20 bp, Artificial
  CRISPR gRNA sequence
cagctcctgtttccacatgg

SEQ ID NO: 545199 - DNA, 20 bp, Artificial
  CRISPR gRNA sequence
agctcctgtttccacatggc

SEQ ID NO: 545200 - DNA, 20 bp, Artificial
  CRISPR gRNA sequence
acatggcaggcccctccctg

SEQ ID NO: 545201 - DNA, 20 bp, Artificial
  CRISPR gRNA sequence
catggcaggcccctccctgt

SEQ ID NO: 545202 - DNA, 20 bp, Artificial
  CRISPR gRNA sequence
gcccctccctgtaggctcac

SEQ ID NO: 545203 - DNA, 20 bp, Artificial
  CRISPR gRNA sequence
ctgtaggctcactggtgcgc

SEQ ID NO: 545204 - DNA, 20 bp, Artificial
  CRISPR gRNA sequence
actggtgcgcaagtcctcac

SEQ ID NO: 545205 - DNA, 20 bp, Artificial
  CRISPR gRNA sequence
agtcccttctgactcacact

SEQ ID NO: 545206 - DNA, 20 bp, Artificial
  CRISPR gRNA sequence
ctgactcacacttggcccgc

SEQ ID NO: 545207 - DNA, 20 bp, Artificial
  CRISPR gRNA sequence
gcccgctggtatctcctctg

SEQ ID NO: 545208 - DNA, 20 bp, Artificial
  CRISPR gRNA sequence
cccgctggtatctcctctgt

SEQ ID NO: 545209 - DNA, 20 bp, Artificial
  CRISPR gRNA sequence
gctggtatctcctctgtggg

SEQ ID NO: 545210 - DNA, 20 bp, Artificial
  CRISPR gRNA sequence
tcctctgtgggtggaattgc

SEQ ID NO: 545211 - DNA, 20 bp, Artificial
  CRISPR gRNA sequence
gtctaatgcgtcatttgcca

SEQ ID NO: 545212 - DNA, 20 bp, Artificial
  CRISPR gRNA sequence
cgttttctttttattgtttc

SEQ ID NO: 545213 - DNA, 20 bp, Artificial
  CRISPR gRNA sequence
tctttttattgtttctggtc

SEQ ID NO: 545214 - DNA, 20 bp, Artificial
  CRISPR gRNA sequence
ctggctttttcttccttgac

SEQ ID NO: 545215 - DNA, 20 bp, Artificial
  CRISPR gRNA sequence
ggctttttcttccttgactg

SEQ ID NO: 545216 - DNA, 20 bp, Artificial
  CRISPR gRNA sequence
tgactggagtcttgctctct

SEQ ID NO: 545217 - DNA, 20 bp, Artificial
  CRISPR gRNA sequence
gactggagtcttgctctctg

SEQ ID NO: 545218 - DNA, 20 bp, Artificial
  CRISPR gRNA sequence
ttgctctctgaggccctctt

SEQ ID NO: 545219 - DNA, 20 bp, Artificial
  CRISPR gRNA sequence
tctgaggccctcttcagctc

SEQ ID NO: 545220 - DNA, 20 bp, Artificial
  CRISPR gRNA sequence
agctctagcattcgatgatt

SEQ ID NO: 545221 - DNA, 20 bp, Artificial
  CRISPR gRNA sequence
attcgatgatttggaaacca

SEQ ID NO: 545222 - DNA, 20 bp, Artificial
  CRISPR gRNA sequence
tcgatgatttggaaaccaca

SEQ ID NO: 545223 - DNA, 20 bp, Artificial
  CRISPR gRNA sequence
gatttggaaaccacagagct

SEQ ID NO: 545224 - DNA, 20 bp, Artificial
  CRISPR gRNA sequence
agagcttagtgcctcacctg

SEQ ID NO: 545225 - DNA, 20 bp, Artificial
  CRISPR gRNA sequence
gagcttagtgcctcacctgt

SEQ ID NO: 545226 - DNA, 20 bp, Artificial
  CRISPR gRNA sequence
tagtgcctcacctgtaggtt

SEQ ID NO: 545227 - DNA, 20 bp, Artificial
  CRISPR gRNA sequence
gtgcctcacctgtaggtttg

SEQ ID NO: 545228 - DNA, 20 bp, Artificial
  CRISPR gRNA sequence
tgcctcacctgtaggtttgg

SEQ ID NO: 545229 - DNA, 20 bp, Artificial
  CRISPR gRNA sequence
gtttggaggtgtgcttaact

SEQ ID NO: 545230 - DNA, 20 bp, Artificial
  CRISPR gRNA sequence
tgctgttccaatgctgtcta

SEQ ID NO: 545231 - DNA, 20 bp, Artificial
  CRISPR gRNA sequence
ctgtctatagattgtatcct

SEQ ID NO: 545232 - DNA, 20 bp, Artificial
  CRISPR gRNA sequence
tgcatcatgtcactatcttt

SEQ ID NO: 545233 - DNA, 20 bp, Artificial
  CRISPR gRNA sequence
catcatgtcactatctttaa

SEQ ID NO: 545234 - DNA, 20 bp, Artificial
  CRISPR gRNA sequence
tttaagagccttatgccatg

SEQ ID NO: 545235 - DNA, 20 bp, Artificial
  CRISPR gRNA sequence
agagccttatgccatgtagc

SEQ ID NO: 545236 - DNA, 20 bp, Artificial
  CRISPR gRNA sequence
tgccatgtagcaagctaaat

SEQ ID NO: 545237 - DNA, 20 bp, Artificial
  CRISPR gRNA sequence
gcaagctaaataagaaacaa

SEQ ID NO: 545238 - DNA, 20 bp, Artificial
  CRISPR gRNA sequence
ctaaataagaaacaatggtt

SEQ ID NO: 545239 - DNA, 20 bp, Artificial
  CRISPR gRNA sequence
aaataagaaacaatggttaa

SEQ ID NO: 545240 - DNA, 20 bp, Artificial
  CRISPR gRNA sequence
ggttaagagcactgattctg

SEQ ID NO: 545241 - DNA, 20 bp, Artificial
  CRISPR gRNA sequence
aagagcactgattctgcagt

SEQ ID NO: 545242 - DNA, 20 bp, Artificial
  CRISPR gRNA sequence
gattctgcagtcagattgtc

SEQ ID NO: 545243 - DNA, 20 bp, Artificial
  CRISPR gRNA sequence
attctgcagtcagattgtcc

SEQ ID NO: 545244 - DNA, 20 bp, Artificial
  CRISPR gRNA sequence
agattgtccaggttcaaatc

SEQ ID NO: 545245 - DNA, 20 bp, Artificial
  CRISPR gRNA sequence
tacttaacattgttgtgcct

SEQ ID NO: 545246 - DNA, 20 bp, Artificial
  CRISPR gRNA sequence
ttcctcacctgcaaaataat

SEQ ID NO: 545247 - DNA, 20 bp, Artificial
  CRISPR gRNA sequence
tcctcacctgcaaaataata

SEQ ID NO: 545248 - DNA, 20 bp, Artificial
  CRISPR gRNA sequence
cacctgcaaaataataaggt

SEQ ID NO: 545249 - DNA, 20 bp, Artificial
  CRISPR gRNA sequence
aaaccttcttaatatgtttt

SEQ ID NO: 545250 - DNA, 20 bp, Artificial
  CRISPR gRNA sequence
aaccttcttaatatgttttt

SEQ ID NO: 545251 - DNA, 20 bp, Artificial
  CRISPR gRNA sequence
ttttttttttttttttttct

SEQ ID NO: 545252 - DNA, 20 bp, Artificial
  CRISPR gRNA sequence
ttttttttttttttctgaga

SEQ ID NO: 545253 - DNA, 20 bp, Artificial
  CRISPR gRNA sequence
ttttttttttttctgagatg

SEQ ID NO: 545254 - DNA, 20 bp, Artificial
  CRISPR gRNA sequence
tggagtcttgctctgtcacc

SEQ ID NO: 545255 - DNA, 20 bp, Artificial
  CRISPR gRNA sequence
ggagtcttgctctgtcaccc

SEQ ID NO: 545256 - DNA, 20 bp, Artificial
  CRISPR gRNA sequence
tcttgctctgtcacccaggc

SEQ ID NO: 545257 - DNA, 20 bp, Artificial
  CRISPR gRNA sequence
ttgctctgtcacccaggctg

SEQ ID NO: 545258 - DNA, 20 bp, Artificial
  CRISPR gRNA sequence
ctgtcacccaggctggagtg

SEQ ID NO: 545259 - DNA, 20 bp, Artificial
  CRISPR gRNA sequence
tcacccaggctggagtgcag

SEQ ID NO: 545260 - DNA, 20 bp, Artificial
  CRISPR gRNA sequence
caggctggagtgcagtggca

SEQ ID NO: 545261 - DNA, 20 bp, Artificial
  CRISPR gRNA sequence
ggagtgcagtggcacagtct

SEQ ID NO: 545262 - DNA, 20 bp, Artificial
  CRISPR gRNA sequence
ccactgcaacctccacctcc

SEQ ID NO: 545263 - DNA, 20 bp, Artificial
  CRISPR gRNA sequence
cactgcaacctccacctccc

SEQ ID NO: 545264 - DNA, 20 bp, Artificial
  CRISPR gRNA sequence
aacctccacctcccgggttc

SEQ ID NO: 545265 - DNA, 20 bp, Artificial
  CRISPR gRNA sequence
ttcaagcgattctcctgcct

SEQ ID NO: 545266 - DNA, 20 bp, Artificial
  CRISPR gRNA sequence
gcctcagcctcccatgtaac

SEQ ID NO: 545267 - DNA, 20 bp, Artificial
  CRISPR gRNA sequence
cctcagcctcccatgtaact

SEQ ID NO: 545268 - DNA, 20 bp, Artificial
  CRISPR gRNA sequence
ctcccatgtaactgggatta

SEQ ID NO: 545269 - DNA, 20 bp, Artificial
  CRISPR gRNA sequence
tcccatgtaactgggattac

SEQ ID NO: 545270 - DNA, 20 bp, Artificial
  CRISPR gRNA sequence
atgtaactgggattacaggc

SEQ ID NO: 545271 - DNA, 20 bp, Artificial
  CRISPR gRNA sequence
caggcgagtgccaccacgcc

SEQ ID NO: 545272 - DNA, 20 bp, Artificial
  CRISPR gRNA sequence
cccagctaattttgtatttt

SEQ ID NO: 545273 - DNA, 20 bp, Artificial
  CRISPR gRNA sequence
agctaattttgtatttttag

SEQ ID NO: 545274 - DNA, 20 bp, Artificial
  CRISPR gRNA sequence
ctaattttgtatttttagta

SEQ ID NO: 545275 - DNA, 20 bp, Artificial
  CRISPR gRNA sequence
ttttgtatttttagtagaga

SEQ ID NO: 545276 - DNA, 20 bp, Artificial
  CRISPR gRNA sequence
tttgtatttttagtagagac

SEQ ID NO: 545277 - DNA, 20 bp, Artificial
  CRISPR gRNA sequence
ttgtatttttagtagagacg

SEQ ID NO: 545278 - DNA, 20 bp, Artificial
  CRISPR gRNA sequence
gagacggggtttcaccatgt

SEQ ID NO: 545279 - DNA, 20 bp, Artificial
  CRISPR gRNA sequence
cggggtttcaccatgttggc

SEQ ID NO: 545280 - DNA, 20 bp, Artificial
  CRISPR gRNA sequence
ggggtttcaccatgttggcc

SEQ ID NO: 545281 - DNA, 20 bp, Artificial
  CRISPR gRNA sequence
tttcaccatgttggccaggc

SEQ ID NO: 545282 - DNA, 20 bp, Artificial
  CRISPR gRNA sequence
ccatgttggccaggctggtc

SEQ ID NO: 545283 - DNA, 20 bp, Artificial
  CRISPR gRNA sequence
ggtctggaactcctgacctc

SEQ ID NO: 545284 - DNA, 20 bp, Artificial
  CRISPR gRNA sequence
ctcaagtgatccacctgcct

SEQ ID NO: 545285 - DNA, 20 bp, Artificial
  CRISPR gRNA sequence
ccacctgccttggcctccca

SEQ ID NO: 545286 - DNA, 20 bp, Artificial
  CRISPR gRNA sequence
gccttggcctcccaaagtgc

SEQ ID NO: 545287 - DNA, 20 bp, Artificial
  CRISPR gRNA sequence
ccttggcctcccaaagtgct

SEQ ID NO: 545288 - DNA, 20 bp, Artificial
  CRISPR gRNA sequence
ctcccaaagtgctgggatta

SEQ ID NO: 545289 - DNA, 20 bp, Artificial
  CRISPR gRNA sequence
tcccaaagtgctgggattac

SEQ ID NO: 545290 - DNA, 20 bp, Artificial
  CRISPR gRNA sequence
agtgctgggattacaggcat

SEQ ID NO: 545291 - DNA, 20 bp, Artificial
  CRISPR gRNA sequence
caggcatgagccactgctcc

SEQ ID NO: 545292 - DNA, 20 bp, Artificial
  CRISPR gRNA sequence
gcatgagccactgctcccag

SEQ ID NO: 545293 - DNA, 20 bp, Artificial
  CRISPR gRNA sequence
gagccactgctcccagtggt

SEQ ID NO: 545294 - DNA, 20 bp, Artificial
  CRISPR gRNA sequence
cagtggtgagtacctattta

SEQ ID NO: 545295 - DNA, 20 bp, Artificial
  CRISPR gRNA sequence
gtggtgagtacctatttata

SEQ ID NO: 545296 - DNA, 20 bp, Artificial
  CRISPR gRNA sequence
tatttatagagcccttgcaa

SEQ ID NO: 545297 - DNA, 20 bp, Artificial
  CRISPR gRNA sequence
agagcccttgcaacagtgcc

SEQ ID NO: 545298 - DNA, 20 bp, Artificial
  CRISPR gRNA sequence
ccttgcaacagtgcctggca

SEQ ID NO: 545299 - DNA, 20 bp, Artificial
  CRISPR gRNA sequence
ttgcaacagtgcctggcaca

SEQ ID NO: 545300 - DNA, 20 bp, Artificial
  CRISPR gRNA sequence
aacagtgcctggcacagagc

SEQ ID NO: 545301 - DNA, 20 bp, Artificial
  CRISPR gRNA sequence
acagtgcctggcacagagcc

SEQ ID NO: 545302 - DNA, 20 bp, Artificial
  CRISPR gRNA sequence
cagtgcctggcacagagcca

SEQ ID NO: 545303 - DNA, 20 bp, Artificial
  CRISPR gRNA sequence
gcacagagccagggccatac

SEQ ID NO: 545304 - DNA, 20 bp, Artificial
  CRISPR gRNA sequence
agccagggccatacaagtgt

SEQ ID NO: 545305 - DNA, 20 bp, Artificial
  CRISPR gRNA sequence
ggccatacaagtgttagatt

SEQ ID NO: 545306 - DNA, 20 bp, Artificial
  CRISPR gRNA sequence
ttagattaagtaaaaaaaaa

SEQ ID NO: 545307 - DNA, 20 bp, Artificial
  CRISPR gRNA sequence
taagtaaaaaaaaaaagtac

SEQ ID NO: 545308 - DNA, 20 bp, Artificial
  CRISPR gRNA sequence
gtaccagtcaatctgaatct

SEQ ID NO: 545309 - DNA, 20 bp, Artificial
  CRISPR gRNA sequence
taccagtcaatctgaatctc

SEQ ID NO: 545310 - DNA, 20 bp, Artificial
  CRISPR gRNA sequence
caatctgaatctcaggccct

SEQ ID NO: 545311 - DNA, 20 bp, Artificial
  CRISPR gRNA sequence
aggccctgagtaataatttg

SEQ ID NO: 545312 - DNA, 20 bp, Artificial
  CRISPR gRNA sequence
gccctgagtaataatttgca

SEQ ID NO: 545313 - DNA, 20 bp, Artificial
  CRISPR gRNA sequence
ccctgagtaataatttgcag

SEQ ID NO: 545314 - DNA, 20 bp, Artificial
  CRISPR gRNA sequence
atttgcagaggaatttgtgc

SEQ ID NO: 545315 - DNA, 20 bp, Artificial
  CRISPR gRNA sequence
tttgcagaggaatttgtgct

SEQ ID NO: 545316 - DNA, 20 bp, Artificial
  CRISPR gRNA sequence
ttgcagaggaatttgtgctg

SEQ ID NO: 545317 - DNA, 20 bp, Artificial
  CRISPR gRNA sequence
tgcagaggaatttgtgctgg

SEQ ID NO: 545318 - DNA, 20 bp, Artificial
  CRISPR gRNA sequence
aggaatttgtgctgggggtt

SEQ ID NO: 545319 - DNA, 20 bp, Artificial
  CRISPR gRNA sequence
gaatttgtgctgggggttga

SEQ ID NO: 545320 - DNA, 20 bp, Artificial
  CRISPR gRNA sequence
agttccttttcattaaccca

SEQ ID NO: 545321 - DNA, 20 bp, Artificial
  CRISPR gRNA sequence
tttcattaacccatagttaa

SEQ ID NO: 545322 - DNA, 20 bp, Artificial
  CRISPR gRNA sequence
aacccatagttaacggtgac

SEQ ID NO: 545323 - DNA, 20 bp, Artificial
  CRISPR gRNA sequence
ggtgaccagattttctaaat

SEQ ID NO: 545324 - DNA, 20 bp, Artificial
  CRISPR gRNA sequence
agattttctaaataagaaat

SEQ ID NO: 545325 - DNA, 20 bp, Artificial
  CRISPR gRNA sequence
gattttctaaataagaaatc

SEQ ID NO: 545326 - DNA, 20 bp, Artificial
  CRISPR gRNA sequence
gatacttcatctataaaact

SEQ ID NO: 545327 - DNA, 20 bp, Artificial
  CRISPR gRNA sequence
atacttcatctataaaactt

SEQ ID NO: 545328 - DNA, 20 bp, Artificial
  CRISPR gRNA sequence
catctataaaacttgggttc

SEQ ID NO: 545329 - DNA, 20 bp, Artificial
  CRISPR gRNA sequence
ttgggttccagttacaactt

SEQ ID NO: 545330 - DNA, 20 bp, Artificial
  CRISPR gRNA sequence
tgggttccagttacaacttc

SEQ ID NO: 545331 - DNA, 20 bp, Artificial
  CRISPR gRNA sequence
acaacttcaggccatacaaa

SEQ ID NO: 545332 - DNA, 20 bp, Artificial
  CRISPR gRNA sequence
caaaaagaactattaaaatt

SEQ ID NO: 545333 - DNA, 20 bp, Artificial
  CRISPR gRNA sequence
aaaaagaactattaaaattg

SEQ ID NO: 545334 - DNA, 20 bp, Artificial
  CRISPR gRNA sequence
attgaggtgttgatgttttg

SEQ ID NO: 545335 - DNA, 20 bp, Artificial
  CRISPR gRNA sequence
gttttgtagaaacactgcaa

SEQ ID NO: 545336 - DNA, 20 bp, Artificial
  CRISPR gRNA sequence
aacactgcaacagaatattt

SEQ ID NO: 545337 - DNA, 20 bp, Artificial
  CRISPR gRNA sequence
tgcaacagaatatttgagat

SEQ ID NO: 545338 - DNA, 20 bp, Artificial
  CRISPR gRNA sequence
tttgagatcagacctgtttt

SEQ ID NO: 545339 - DNA, 20 bp, Artificial
  CRISPR gRNA sequence
atgtgatcactctatacatg

SEQ ID NO: 545340 - DNA, 20 bp, Artificial
  CRISPR gRNA sequence
tctatacatgtagtgctgat

SEQ ID NO: 545341 - DNA, 20 bp, Artificial
  CRISPR gRNA sequence
ctatacatgtagtgctgatt

SEQ ID NO: 545342 - DNA, 20 bp, Artificial
  CRISPR gRNA sequence
atgtagtgctgattaggtat

SEQ ID NO: 545343 - DNA, 20 bp, Artificial
  CRISPR gRNA sequence
tgtagtgctgattaggtatt

SEQ ID NO: 545344 - DNA, 20 bp, Artificial
  CRISPR gRNA sequence
aaaaaccttcaaaaattatc

SEQ ID NO: 545345 - DNA, 20 bp, Artificial
  CRISPR gRNA sequence
accttcaaaaattatctggc

SEQ ID NO: 545346 - DNA, 20 bp, Artificial
  CRISPR gRNA sequence
caaaaattatctggctagca

SEQ ID NO: 545347 - DNA, 20 bp, Artificial
  CRISPR gRNA sequence
gctagcatagaaaatctttt

SEQ ID NO: 545348 - DNA, 20 bp, Artificial
  CRISPR gRNA sequence
ctagcatagaaaatcttttt

SEQ ID NO: 545349 - DNA, 20 bp, Artificial
  CRISPR gRNA sequence
catctctctttgcttttaaa

SEQ ID NO: 545350 - DNA, 20 bp, Artificial
  CRISPR gRNA sequence
gcaaaaactcaccccatgcc

SEQ ID NO: 545351 - DNA, 20 bp, Artificial
  CRISPR gRNA sequence
ccccatgcccagttctcacc

SEQ ID NO: 545352 - DNA, 20 bp, Artificial
  CRISPR gRNA sequence
cagttctcacccagttaatt

SEQ ID NO: 545353 - DNA, 20 bp, Artificial
  CRISPR gRNA sequence
tctcacccagttaattcaga

SEQ ID NO: 545354 - DNA, 20 bp, Artificial
  CRISPR gRNA sequence
atgttgacctaactcattaa

SEQ ID NO: 545355 - DNA, 20 bp, Artificial
  CRISPR gRNA sequence
acctaactcattaaaagaaa

SEQ ID NO: 545356 - DNA, 20 bp, Artificial
  CRISPR gRNA sequence
ctaactcattaaaagaaaaa

SEQ ID NO: 545357 - DNA, 20 bp, Artificial
  CRISPR gRNA sequence
aactcattaaaagaaaaaga

SEQ ID NO: 545358 - DNA, 20 bp, Artificial
  CRISPR gRNA sequence
aaaagagagaaaacctttga

SEQ ID NO: 545359 - DNA, 20 bp, Artificial
  CRISPR gRNA sequence
aaagcctattccatgtcaac

SEQ ID NO: 545360 - DNA, 20 bp, Artificial
  CRISPR gRNA sequence
tccatgtcaaccagtgtaaa

SEQ ID NO: 545361 - DNA, 20 bp, Artificial
  CRISPR gRNA sequence
aacctgaaaacaatctttta

SEQ ID NO: 545362 - DNA, 20 bp, Artificial
  CRISPR gRNA sequence
ctgaaaacaatcttttatgg

SEQ ID NO: 545363 - DNA, 20 bp, Artificial
  CRISPR gRNA sequence
tgaaaacaatcttttatggt

SEQ ID NO: 545364 - DNA, 20 bp, Artificial
  CRISPR gRNA sequence
gcattatgatttctacttca

SEQ ID NO: 545365 - DNA, 20 bp, Artificial
  CRISPR gRNA sequence
atgatttctacttcacagct

SEQ ID NO: 545366 - DNA, 20 bp, Artificial
  CRISPR gRNA sequence
tgatttctacttcacagctg

SEQ ID NO: 545367 - DNA, 20 bp, Artificial
  CRISPR gRNA sequence
atttctacttcacagctgag

SEQ ID NO: 545368 - DNA, 20 bp, Artificial
  CRISPR gRNA sequence
acttcacagctgaggagatc

SEQ ID NO: 545369 - DNA, 20 bp, Artificial
  CRISPR gRNA sequence
acagctgaggagatctagtg

SEQ ID NO: 545370 - DNA, 20 bp, Artificial
  CRISPR gRNA sequence
cagctgaggagatctagtgt

SEQ ID NO: 545371 - DNA, 20 bp, Artificial
  CRISPR gRNA sequence
agctgaggagatctagtgtg

SEQ ID NO: 545372 - DNA, 20 bp, Artificial
  CRISPR gRNA sequence
ctgaggagatctagtgtggg

SEQ ID NO: 545373 - DNA, 20 bp, Artificial
  CRISPR gRNA sequence
tgaggagatctagtgtgggg

SEQ ID NO: 545374 - DNA, 20 bp, Artificial
  CRISPR gRNA sequence
atctagtgtggggaggcctt

SEQ ID NO: 545375 - DNA, 20 bp, Artificial
  CRISPR gRNA sequence
tctagtgtggggaggccttt

SEQ ID NO: 545376 - DNA, 20 bp, Artificial
  CRISPR gRNA sequence
tagtgtggggaggcctttgg

SEQ ID NO: 545377 - DNA, 20 bp, Artificial
  CRISPR gRNA sequence
aggcctttgggagttcaccc

SEQ ID NO: 545378 - DNA, 20 bp, Artificial
  CRISPR gRNA sequence
ggcctttgggagttcaccct

SEQ ID NO: 545379 - DNA, 20 bp, Artificial
  CRISPR gRNA sequence
gagttcaccctgggccttgc

SEQ ID NO: 545380 - DNA, 20 bp, Artificial
  CRISPR gRNA sequence
gccttgctggcttcaaaatc

SEQ ID NO: 545381 - DNA, 20 bp, Artificial
  CRISPR gRNA sequence
ccttgctggcttcaaaatct

SEQ ID NO: 545382 - DNA, 20 bp, Artificial
  CRISPR gRNA sequence
gcactctctgttctgcactc

SEQ ID NO: 545383 - DNA, 20 bp, Artificial
  CRISPR gRNA sequence
ctctgttctgcactctggca

SEQ ID NO: 545384 - DNA, 20 bp, Artificial
  CRISPR gRNA sequence
ctgcactctggcatggttat

SEQ ID NO: 545385 - DNA, 20 bp, Artificial
  CRISPR gRNA sequence
catggttattagcgtcccta

SEQ ID NO: 545386 - DNA, 20 bp, Artificial
  CRISPR gRNA sequence
cagtcccttttctgaccact

SEQ ID NO: 545387 - DNA, 20 bp, Artificial
  CRISPR gRNA sequence
tcccttttctgaccactcag

SEQ ID NO: 545388 - DNA, 20 bp, Artificial
  CRISPR gRNA sequence
ttctgaccactcagtggtat

SEQ ID NO: 545389 - DNA, 20 bp, Artificial
  CRISPR gRNA sequence
accactcagtggtatcagca

SEQ ID NO: 545390 - DNA, 20 bp, Artificial
  CRISPR gRNA sequence
ttcattcattcgttcatcca

SEQ ID NO: 545391 - DNA, 20 bp, Artificial
  CRISPR gRNA sequence
atccatggtttgtgaccttt

SEQ ID NO: 545392 - DNA, 20 bp, Artificial
  CRISPR gRNA sequence
tctattgttcttttgttcat

SEQ ID NO: 545393 - DNA, 20 bp, Artificial
  CRISPR gRNA sequence
ttgttcattagaaattatct

SEQ ID NO: 545394 - DNA, 20 bp, Artificial
  CRISPR gRNA sequence
attatcttagcaacttactt

SEQ ID NO: 545395 - DNA, 20 bp, Artificial
  CRISPR gRNA sequence
ttagcaacttactttagtgt

SEQ ID NO: 545396 - DNA, 20 bp, Artificial
  CRISPR gRNA sequence
acttactttagtgttggcct

SEQ ID NO: 545397 - DNA, 20 bp, Artificial
  CRISPR gRNA sequence
tactttagtgttggccttgg

SEQ ID NO: 545398 - DNA, 20 bp, Artificial
  CRISPR gRNA sequence
tgttggccttggaagtgcaa

SEQ ID NO: 545399 - DNA, 20 bp, Artificial
  CRISPR gRNA sequence
gccttggaagtgcaacagaa

SEQ ID NO: 545400 - DNA, 20 bp, Artificial
  CRISPR gRNA sequence
caacagaaaagactttactg

SEQ ID NO: 545401 - DNA, 20 bp, Artificial
  CRISPR gRNA sequence
aacagaaaagactttactgt

SEQ ID NO: 545402 - DNA, 20 bp, Artificial
  CRISPR gRNA sequence
agaaaagactttactgtagg

SEQ ID NO: 545403 - DNA, 20 bp, Artificial
  CRISPR gRNA sequence
gaaaagactttactgtagga

SEQ ID NO: 545404 - DNA, 20 bp, Artificial
  CRISPR gRNA sequence
ttactgtaggaaggaaataa

SEQ ID NO: 545405 - DNA, 20 bp, Artificial
  CRISPR gRNA sequence
tagatatacccatgcacaca

SEQ ID NO: 545406 - DNA, 20 bp, Artificial
  CRISPR gRNA sequence
atatacccatgcacacaaag

SEQ ID NO: 545407 - DNA, 20 bp, Artificial
  CRISPR gRNA sequence
atacccatgcacacaaagta

SEQ ID NO: 545408 - DNA, 20 bp, Artificial
  CRISPR gRNA sequence
tacccatgcacacaaagtag

SEQ ID NO: 545409 - DNA, 20 bp, Artificial
  CRISPR gRNA sequence
ccatgcacacaaagtagagg

SEQ ID NO: 545410 - DNA, 20 bp, Artificial
  CRISPR gRNA sequence
cacaaagtagaggtagatat

SEQ ID NO: 545411 - DNA, 20 bp, Artificial
  CRISPR gRNA sequence
gtagaggtagatattagttt

SEQ ID NO: 545412 - DNA, 20 bp, Artificial
  CRISPR gRNA sequence
agaggtagatattagtttta

SEQ ID NO: 545413 - DNA, 20 bp, Artificial
  CRISPR gRNA sequence
gtagatattagttttagaga

SEQ ID NO: 545414 - DNA, 20 bp, Artificial
  CRISPR gRNA sequence
ttcttaacaactcctcctct

SEQ ID NO: 545415 - DNA, 20 bp, Artificial
  CRISPR gRNA sequence
ctatttaaaaaaaatttaca

SEQ ID NO: 545416 - DNA, 20 bp, Artificial
  CRISPR gRNA sequence
acatagttttaatattataa

SEQ ID NO: 545417 - DNA, 20 bp, Artificial
  CRISPR gRNA sequence
ttttaatattataatagtaa

SEQ ID NO: 545418 - DNA, 20 bp, Artificial
  CRISPR gRNA sequence
tttaatattataatagtaat

SEQ ID NO: 545419 - DNA, 20 bp, Artificial
  CRISPR gRNA sequence
aataggatatttgtcttcaa

SEQ ID NO: 545420 - DNA, 20 bp, Artificial
  CRISPR gRNA sequence
ttttcaatgtgacctgtatt

SEQ ID NO: 545421 - DNA, 20 bp, Artificial
  CRISPR gRNA sequence
tgtgacctgtattaagtaat

SEQ ID NO: 545422 - DNA, 20 bp, Artificial
  CRISPR gRNA sequence
caccatcaccacaatctcta

SEQ ID NO: 545423 - DNA, 20 bp, Artificial
  CRISPR gRNA sequence
cacaatctctaaagtaaccg

SEQ ID NO: 545424 - DNA, 20 bp, Artificial
  CRISPR gRNA sequence
aacaaccactgttaatcatt

SEQ ID NO: 545425 - DNA, 20 bp, Artificial
  CRISPR gRNA sequence
acaaccactgttaatcattt

SEQ ID NO: 545426 - DNA, 20 bp, Artificial
  CRISPR gRNA sequence
caaccactgttaatcattta

SEQ ID NO: 545427 - DNA, 20 bp, Artificial
  CRISPR gRNA sequence
tcatttagggtgtctctttc

SEQ ID NO: 545428 - DNA, 20 bp, Artificial
  CRISPR gRNA sequence
gtctctttccagtctaaaaa

SEQ ID NO: 545429 - DNA, 20 bp, Artificial
  CRISPR gRNA sequence
ctctttccagtctaaaaaaa

SEQ ID NO: 545430 - DNA, 20 bp, Artificial
  CRISPR gRNA sequence
ttccagtctaaaaaaagagc

SEQ ID NO: 545431 - DNA, 20 bp, Artificial
  CRISPR gRNA sequence
agtctaaaaaaagagcaagt

SEQ ID NO: 545432 - DNA, 20 bp, Artificial
  CRISPR gRNA sequence
catgtattcatgtcttttta

SEQ ID NO: 545433 - DNA, 20 bp, Artificial
  CRISPR gRNA sequence
taaaatatatatatattttt

SEQ ID NO: 545434 - DNA, 20 bp, Artificial
  CRISPR gRNA sequence
aatatatatatattttttgg

SEQ ID NO: 545435 - DNA, 20 bp, Artificial
  CRISPR gRNA sequence
tatatatatattttttggta

SEQ ID NO: 545436 - DNA, 20 bp, Artificial
  CRISPR gRNA sequence
tatatattttttggtagaga

SEQ ID NO: 545437 - DNA, 20 bp, Artificial
  CRISPR gRNA sequence
atatattttttggtagagac

SEQ ID NO: 545438 - DNA, 20 bp, Artificial
  CRISPR gRNA sequence
tatattttttggtagagaca

SEQ ID NO: 545439 - DNA, 20 bp, Artificial
  CRISPR gRNA sequence
cagggtctcactacattgcc

SEQ ID NO: 545440 - DNA, 20 bp, Artificial
  CRISPR gRNA sequence
agggtctcactacattgccc

SEQ ID NO: 545441 - DNA, 20 bp, Artificial
  CRISPR gRNA sequence
tctcactacattgcccaggc

SEQ ID NO: 545442 - DNA, 20 bp, Artificial
  CRISPR gRNA sequence
ccaggctggtatcaaactcc

SEQ ID NO: 545443 - DNA, 20 bp, Artificial
  CRISPR gRNA sequence
caggctggtatcaaactcct

SEQ ID NO: 545444 - DNA, 20 bp, Artificial
  CRISPR gRNA sequence
ggtatcaaactcctgggctc

SEQ ID NO: 545445 - DNA, 20 bp, Artificial
  CRISPR gRNA sequence
ctcaagtgatccttccactt

SEQ ID NO: 545446 - DNA, 20 bp, Artificial
  CRISPR gRNA sequence
ccttccactttggcctacca

SEQ ID NO: 545447 - DNA, 20 bp, Artificial
  CRISPR gRNA sequence
actttggcctaccaaagtgc

SEQ ID NO: 545448 - DNA, 20 bp, Artificial
  CRISPR gRNA sequence
ctaccaaagtgctagaattg

SEQ ID NO: 545449 - DNA, 20 bp, Artificial
  CRISPR gRNA sequence
taccaaagtgctagaattgt

SEQ ID NO: 545450 - DNA, 20 bp, Artificial
  CRISPR gRNA sequence
agtgctagaattgtaggcat

SEQ ID NO: 545451 - DNA, 20 bp, Artificial
  CRISPR gRNA sequence
taggcatgagccaccacatc

SEQ ID NO: 545452 - DNA, 20 bp, Artificial
  CRISPR gRNA sequence
gcctctttattgtttttaaa

SEQ ID NO: 545453 - DNA, 20 bp, Artificial
  CRISPR gRNA sequence
ctctttattgtttttaaaaa

SEQ ID NO: 545454 - DNA, 20 bp, Artificial
  CRISPR gRNA sequence
tctttattgtttttaaaaag

SEQ ID NO: 545455 - DNA, 20 bp, Artificial
  CRISPR gRNA sequence
aactttttatttttaatatt

SEQ ID NO: 545456 - DNA, 20 bp, Artificial
  CRISPR gRNA sequence
ttccaaattcccaataataa

SEQ ID NO: 545457 - DNA, 20 bp, Artificial
  CRISPR gRNA sequence
tccaaattcccaataataaa

SEQ ID NO: 545458 - DNA, 20 bp, Artificial
  CRISPR gRNA sequence
caaattcccaataataaaag

SEQ ID NO: 545459 - DNA, 20 bp, Artificial
  CRISPR gRNA sequence
ccttttttaaaataaccaca

SEQ ID NO: 545460 - DNA, 20 bp, Artificial
  CRISPR gRNA sequence
ttttaaaataaccacatagt

SEQ ID NO: 545461 - DNA, 20 bp, Artificial
  CRISPR gRNA sequence
aataaccacatagtaagcca

SEQ ID NO: 545462 - DNA, 20 bp, Artificial
  CRISPR gRNA sequence
atactaaattgtttaactat

SEQ ID NO: 545463 - DNA, 20 bp, Artificial
  CRISPR gRNA sequence
aaattgtttaactattagac

SEQ ID NO: 545464 - DNA, 20 bp, Artificial
  CRISPR gRNA sequence
tagactagattattatttac

SEQ ID NO: 545465 - DNA, 20 bp, Artificial
  CRISPR gRNA sequence
tagattattatttactagta

SEQ ID NO: 545466 - DNA, 20 bp, Artificial
  CRISPR gRNA sequence
attatgcatatctctttatg

SEQ ID NO: 545467 - DNA, 20 bp, Artificial
  CRISPR gRNA sequence
ttatgcatatctctttatgt

SEQ ID NO: 545468 - DNA, 20 bp, Artificial
  CRISPR gRNA sequence
catcctgaataaatatcacc

SEQ ID NO: 545469 - DNA, 20 bp, Artificial
  CRISPR gRNA sequence
aataaatatcacccagatcc

SEQ ID NO: 545470 - DNA, 20 bp, Artificial
  CRISPR gRNA sequence
atcacccagatcccagtatt

SEQ ID NO: 545471 - DNA, 20 bp, Artificial
  CRISPR gRNA sequence
cccagtattcagtgaaacta

SEQ ID NO: 545472 - DNA, 20 bp, Artificial
  CRISPR gRNA sequence
ccagtattcagtgaaactac

SEQ ID NO: 545473 - DNA, 20 bp, Artificial
  CRISPR gRNA sequence
agtgaaactacaggttcttt

SEQ ID NO: 545474 - DNA, 20 bp, Artificial
  CRISPR gRNA sequence
tgaaactacaggttctttta

SEQ ID NO: 545475 - DNA, 20 bp, Artificial
  CRISPR gRNA sequence
tacaggttcttttagagcat

SEQ ID NO: 545476 - DNA, 20 bp, Artificial
  CRISPR gRNA sequence
ccatctttttcctactatct

SEQ ID NO: 545477 - DNA, 20 bp, Artificial
  CRISPR gRNA sequence
tactatctgagtaatatcac

SEQ ID NO: 545478 - DNA, 20 bp, Artificial
  CRISPR gRNA sequence
tatcactagtgccttttatt

SEQ ID NO: 545479 - DNA, 20 bp, Artificial
  CRISPR gRNA sequence
ctagtgccttttattcagtc

SEQ ID NO: 545480 - DNA, 20 bp, Artificial
  CRISPR gRNA sequence
ccacatgttgactcttgtct

SEQ ID NO: 545481 - DNA, 20 bp, Artificial
  CRISPR gRNA sequence
acatgttgactcttgtcttg

SEQ ID NO: 545482 - DNA, 20 bp, Artificial
  CRISPR gRNA sequence
ttatgatgccatccccctcc

SEQ ID NO: 545483 - DNA, 20 bp, Artificial
  CRISPR gRNA sequence
ctggcctttcttctacttcc

SEQ ID NO: 545484 - DNA, 20 bp, Artificial
  CRISPR gRNA sequence
tggcctttcttctacttccc

SEQ ID NO: 545485 - DNA, 20 bp, Artificial
  CRISPR gRNA sequence
tctacttcccaggtctctct

SEQ ID NO: 545486 - DNA, 20 bp, Artificial
  CRISPR gRNA sequence
caggtctctctcagtctcct

SEQ ID NO: 545487 - DNA, 20 bp, Artificial
  CRISPR gRNA sequence
tctctctcagtctccttagc

SEQ ID NO: 545488 - DNA, 20 bp, Artificial
  CRISPR gRNA sequence
ttagccagtgttttcccctc

SEQ ID NO: 545489 - DNA, 20 bp, Artificial
  CRISPR gRNA sequence
cagtgttttcccctctagcc

SEQ ID NO: 545490 - DNA, 20 bp, Artificial
  CRISPR gRNA sequence
tcccctctagccaagcttta

SEQ ID NO: 545491 - DNA, 20 bp, Artificial
  CRISPR gRNA sequence
tctagccaagctttaaagca

SEQ ID NO: 545492 - DNA, 20 bp, Artificial
  CRISPR gRNA sequence
ctagccaagctttaaagcac

SEQ ID NO: 545493 - DNA, 20 bp, Artificial
  CRISPR gRNA sequence
aagctttaaagcacaggtcc

SEQ ID NO: 545494 - DNA, 20 bp, Artificial
  CRISPR gRNA sequence
cccacttcatacgctctccc

SEQ ID NO: 545495 - DNA, 20 bp, Artificial
  CRISPR gRNA sequence
ccacttcatacgctctccca

SEQ ID NO: 545496 - DNA, 20 bp, Artificial
  CRISPR gRNA sequence
catacgctctcccaaggtga

SEQ ID NO: 545497 - DNA, 20 bp, Artificial
  CRISPR gRNA sequence
tcccaaggtgatggtcctaa

SEQ ID NO: 545498 - DNA, 20 bp, Artificial
  CRISPR gRNA sequence
atggtcctaatggcctccat

SEQ ID NO: 545499 - DNA, 20 bp, Artificial
  CRISPR gRNA sequence
ggtcctaatggcctccattg

SEQ ID NO: 545500 - DNA, 20 bp, Artificial
  CRISPR gRNA sequence
atggcctccattggagccac

SEQ ID NO: 545501 - DNA, 20 bp, Artificial
  CRISPR gRNA sequence
aaatctgtatcctttcctgt

SEQ ID NO: 545502 - DNA, 20 bp, Artificial
  CRISPR gRNA sequence
gtatcctttcctgtgagtcc

SEQ ID NO: 545503 - DNA, 20 bp, Artificial
  CRISPR gRNA sequence
gagtcccagacctgtgtact

SEQ ID NO: 545504 - DNA, 20 bp, Artificial
  CRISPR gRNA sequence
tcccagacctgtgtacttag

SEQ ID NO: 545505 - DNA, 20 bp, Artificial
  CRISPR gRNA sequence
cctgtgtacttagcagctac

SEQ ID NO: 545506 - DNA, 20 bp, Artificial
  CRISPR gRNA sequence
ctgtgtacttagcagctact

SEQ ID NO: 545507 - DNA, 20 bp, Artificial
  CRISPR gRNA sequence
agctactgggcatctttgct

SEQ ID NO: 545508 - DNA, 20 bp, Artificial
  CRISPR gRNA sequence
atctttgcttggatgtctca

SEQ ID NO: 545509 - DNA, 20 bp, Artificial
  CRISPR gRNA sequence
cacagacccctcacactgaa

SEQ ID NO: 545510 - DNA, 20 bp, Artificial
  CRISPR gRNA sequence
actgaacagtgtcaaactga

SEQ ID NO: 545511 - DNA, 20 bp, Artificial
  CRISPR gRNA sequence
aaactgaaagcatgatgttc

SEQ ID NO: 545512 - DNA, 20 bp, Artificial
  CRISPR gRNA sequence
aactgaaagcatgatgttcc

SEQ ID NO: 545513 - DNA, 20 bp, Artificial
  CRISPR gRNA sequence
gaaagcatgatgttccaggc

SEQ ID NO: 545514 - DNA, 20 bp, Artificial
  CRISPR gRNA sequence
atgatgttccaggccagtct

SEQ ID NO: 545515 - DNA, 20 bp, Artificial
  CRISPR gRNA sequence
tcctgctgtgtttcctttct

SEQ ID NO: 545516 - DNA, 20 bp, Artificial
  CRISPR gRNA sequence
cctgctgtgtttcctttctt

SEQ ID NO: 545517 - DNA, 20 bp, Artificial
  CRISPR gRNA sequence
ctgctgtgtttcctttctta

SEQ ID NO: 545518 - DNA, 20 bp, Artificial
  CRISPR gRNA sequence
tgtgtttcctttcttaggga

SEQ ID NO: 545519 - DNA, 20 bp, Artificial
  CRISPR gRNA sequence
gaaagacaccacaacccacc

SEQ ID NO: 545520 - DNA, 20 bp, Artificial
  CRISPR gRNA sequence
aaagacaccacaacccacct

SEQ ID NO: 545521 - DNA, 20 bp, Artificial
  CRISPR gRNA sequence
agacaccacaacccacctag

SEQ ID NO: 545522 - DNA, 20 bp, Artificial
  CRISPR gRNA sequence
gacaccacaacccacctagg

SEQ ID NO: 545523 - DNA, 20 bp, Artificial
  CRISPR gRNA sequence
accacaacccacctaggagg

SEQ ID NO: 545524 - DNA, 20 bp, Artificial
  CRISPR gRNA sequence
caacccacctaggaggaagt

SEQ ID NO: 545525 - DNA, 20 bp, Artificial
  CRISPR gRNA sequence
acccacctaggaggaagtaa

SEQ ID NO: 545526 - DNA, 20 bp, Artificial
  CRISPR gRNA sequence
gtaagagctgtgattcatcc

SEQ ID NO: 545527 - DNA, 20 bp, Artificial
  CRISPR gRNA sequence
gtgattcatcctggccctcc

SEQ ID NO: 545528 - DNA, 20 bp, Artificial
  CRISPR gRNA sequence
cccatatgctgtcaatcatc

SEQ ID NO: 545529 - DNA, 20 bp, Artificial
  CRISPR gRNA sequence
tgtcaatcatctagttctcc

SEQ ID NO: 545530 - DNA, 20 bp, Artificial
  CRISPR gRNA sequence
gtctcttgaaccactttgcc

SEQ ID NO: 545531 - DNA, 20 bp, Artificial
  CRISPR gRNA sequence
gcacaatgctgcctcttgac

SEQ ID NO: 545532 - DNA, 20 bp, Artificial
  CRISPR gRNA sequence
agtctgaaattgctgtctga

SEQ ID NO: 545533 - DNA, 20 bp, Artificial
  CRISPR gRNA sequence
ctgatggatctcttgctatc

SEQ ID NO: 545534 - DNA, 20 bp, Artificial
  CRISPR gRNA sequence
tctagtcttacccctcccat

SEQ ID NO: 545535 - DNA, 20 bp, Artificial
  CRISPR gRNA sequence
cccatcagtcttccacacca

SEQ ID NO: 545536 - DNA, 20 bp, Artificial
  CRISPR gRNA sequence
tcagtcttccacaccatagc

SEQ ID NO: 545537 - DNA, 20 bp, Artificial
  CRISPR gRNA sequence
cttccacaccatagccagaa

SEQ ID NO: 545538 - DNA, 20 bp, Artificial
  CRISPR gRNA sequence
actttcattatgtaaaaata

SEQ ID NO: 545539 - DNA, 20 bp, Artificial
  CRISPR gRNA sequence
aaaaatatagaaactttgta

SEQ ID NO: 545540 - DNA, 20 bp, Artificial
  CRISPR gRNA sequence
aatatagaaactttgtatgg

SEQ ID NO: 545541 - DNA, 20 bp, Artificial
  CRISPR gRNA sequence
ttgtatggaagatattcatt

SEQ ID NO: 545542 - DNA, 20 bp, Artificial
  CRISPR gRNA sequence
tattcatttagtaaattcaa

SEQ ID NO: 545543 - DNA, 20 bp, Artificial
  CRISPR gRNA sequence
attcatttagtaaattcaat

SEQ ID NO: 545544 - DNA, 20 bp, Artificial
  CRISPR gRNA sequence
tttagtaaattcaataggca

SEQ ID NO: 545545 - DNA, 20 bp, Artificial
  CRISPR gRNA sequence
ttagtaaattcaataggcaa

SEQ ID NO: 545546 - DNA, 20 bp, Artificial
  CRISPR gRNA sequence
tttgaaaaaaaactataata

SEQ ID NO: 545547 - DNA, 20 bp, Artificial
  CRISPR gRNA sequence
gataaaaatatataacatat

SEQ ID NO: 545548 - DNA, 20 bp, Artificial
  CRISPR gRNA sequence
ataaaaatatataacatata

SEQ ID NO: 545549 - DNA, 20 bp, Artificial
  CRISPR gRNA sequence
aaaaatatataacatataag

SEQ ID NO: 545550 - DNA, 20 bp, Artificial
  CRISPR gRNA sequence
ataaggagcctttaaacttt

SEQ ID NO: 545551 - DNA, 20 bp, Artificial
  CRISPR gRNA sequence
aggagcctttaaactttgag

SEQ ID NO: 545552 - DNA, 20 bp, Artificial
  CRISPR gRNA sequence
caaacaatctaatacaaaaa

SEQ ID NO: 545553 - DNA, 20 bp, Artificial
  CRISPR gRNA sequence
aacaatctaatacaaaaaaa

SEQ ID NO: 545554 - DNA, 20 bp, Artificial
  CRISPR gRNA sequence
acaatctaatacaaaaaaag

SEQ ID NO: 545555 - DNA, 20 bp, Artificial
  CRISPR gRNA sequence
acaaaaaaagaggatgtgaa

SEQ ID NO: 545556 - DNA, 20 bp, Artificial
  CRISPR gRNA sequence
ggatgtgaaaagacatttct

SEQ ID NO: 545557 - DNA, 20 bp, Artificial
  CRISPR gRNA sequence
gaaaagacatttctcagaaa

SEQ ID NO: 545558 - DNA, 20 bp, Artificial
  CRISPR gRNA sequence
aaaaagaaatccaaatcaac

SEQ ID NO: 545559 - DNA, 20 bp, Artificial
  CRISPR gRNA sequence
aagaaatccaaatcaacaag

SEQ ID NO: 545560 - DNA, 20 bp, Artificial
  CRISPR gRNA sequence
aaatccaaatcaacaagcag

SEQ ID NO: 545561 - DNA, 20 bp, Artificial
  CRISPR gRNA sequence
atccaaatcaacaagcagaa

SEQ ID NO: 545562 - DNA, 20 bp, Artificial
  CRISPR gRNA sequence
aagagatgcttaaattttta

SEQ ID NO: 545563 - DNA, 20 bp, Artificial
  CRISPR gRNA sequence
agagatgcttaaatttttaa

SEQ ID NO: 545564 - DNA, 20 bp, Artificial
  CRISPR gRNA sequence
atgcttaaatttttaaaggt

SEQ ID NO: 545565 - DNA, 20 bp, Artificial
  CRISPR gRNA sequence
tgcttaaatttttaaaggtt

SEQ ID NO: 545566 - DNA, 20 bp, Artificial
  CRISPR gRNA sequence
ggttgggaaaatgcaaattc

SEQ ID NO: 545567 - DNA, 20 bp, Artificial
  CRISPR gRNA sequence
aaaaaattacctaatgctgt

SEQ ID NO: 545568 - DNA, 20 bp, Artificial
  CRISPR gRNA sequence
aaaaattacctaatgctgtc

SEQ ID NO: 545569 - DNA, 20 bp, Artificial
  CRISPR gRNA sequence
aaattacctaatgctgtcag

SEQ ID NO: 545570 - DNA, 20 bp, Artificial
  CRISPR gRNA sequence
cctaatgctgtcaggagtcc

SEQ ID NO: 545571 - DNA, 20 bp, Artificial
  CRISPR gRNA sequence
ctaatgctgtcaggagtcca

SEQ ID NO: 545572 - DNA, 20 bp, Artificial
  CRISPR gRNA sequence
tgctgtcaggagtccaagga

SEQ ID NO: 545573 - DNA, 20 bp, Artificial
  CRISPR gRNA sequence
gctgtcaggagtccaaggaa

SEQ ID NO: 545574 - DNA, 20 bp, Artificial
  CRISPR gRNA sequence
ctgtcaggagtccaaggaaa

SEQ ID NO: 545575 - DNA, 20 bp, Artificial
  CRISPR gRNA sequence
agtccaaggaaagggcaact

SEQ ID NO: 545576 - DNA, 20 bp, Artificial
  CRISPR gRNA sequence
gtccaaggaaagggcaactc

SEQ ID NO: 545577 - DNA, 20 bp, Artificial
  CRISPR gRNA sequence
ggcaactcaggcattactga

SEQ ID NO: 545578 - DNA, 20 bp, Artificial
  CRISPR gRNA sequence
caactcaggcattactgatg

SEQ ID NO: 545579 - DNA, 20 bp, Artificial
  CRISPR gRNA sequence
gatggagatgtaaattgcca

SEQ ID NO: 545580 - DNA, 20 bp, Artificial
  CRISPR gRNA sequence
agtcttttttgtaaacaatg

SEQ ID NO: 545581 - DNA, 20 bp, Artificial
  CRISPR gRNA sequence
aatctatttaccttttgatg

SEQ ID NO: 545582 - DNA, 20 bp, Artificial
  CRISPR gRNA sequence
ccttttgatgtagcaactcc

SEQ ID NO: 545583 - DNA, 20 bp, Artificial
  CRISPR gRNA sequence
atatgaaaccataaatacat

SEQ ID NO: 545584 - DNA, 20 bp, Artificial
  CRISPR gRNA sequence
tatgaaaccataaatacatc

SEQ ID NO: 545585 - DNA, 20 bp, Artificial
  CRISPR gRNA sequence
aatacatcaggacatatgta

SEQ ID NO: 545586 - DNA, 20 bp, Artificial
  CRISPR gRNA sequence
atacatcaggacatatgtac

SEQ ID NO: 545587 - DNA, 20 bp, Artificial
  CRISPR gRNA sequence
atcaggacatatgtacagga

SEQ ID NO: 545588 - DNA, 20 bp, Artificial
  CRISPR gRNA sequence
tatgtacaggatagttattg

SEQ ID NO: 545589 - DNA, 20 bp, Artificial
  CRISPR gRNA sequence
ttattgcggtgtaactgcaa

SEQ ID NO: 545590 - DNA, 20 bp, Artificial
  CRISPR gRNA sequence
cggtgtaactgcaatagaca

SEQ ID NO: 545591 - DNA, 20 bp, Artificial
  CRISPR gRNA sequence
gtaactgcaatagacaaagc

SEQ ID NO: 545592 - DNA, 20 bp, Artificial
  CRISPR gRNA sequence
atagacaaagctagccacaa

SEQ ID NO: 545593 - DNA, 20 bp, Artificial
  CRISPR gRNA sequence
tagacaaagctagccacaaa

SEQ ID NO: 545594 - DNA, 20 bp, Artificial
  CRISPR gRNA sequence
gacaaagctagccacaaaag

SEQ ID NO: 545595 - DNA, 20 bp, Artificial
  CRISPR gRNA sequence
gccacaaaaggagtgttcat

SEQ ID NO: 545596 - DNA, 20 bp, Artificial
  CRISPR gRNA sequence
acaaaaggagtgttcatcag

SEQ ID NO: 545597 - DNA, 20 bp, Artificial
  CRISPR gRNA sequence
aaaggagtgttcatcagtgg

SEQ ID NO: 545598 - DNA, 20 bp, Artificial
  CRISPR gRNA sequence
gagtgttcatcagtggtgga

SEQ ID NO: 545599 - DNA, 20 bp, Artificial
  CRISPR gRNA sequence
tgttcatcagtggtggatgg

SEQ ID NO: 545600 - DNA, 20 bp, Artificial
  CRISPR gRNA sequence
ggtggatggcagattaatta

SEQ ID NO: 545601 - DNA, 20 bp, Artificial
  CRISPR gRNA sequence
attatggttccctcatgctc

SEQ ID NO: 545602 - DNA, 20 bp, Artificial
  CRISPR gRNA sequence
tcatgctctggaatattatg

SEQ ID NO: 545603 - DNA, 20 bp, Artificial
  CRISPR gRNA sequence
aatattatgtagttattaaa

SEQ ID NO: 545604 - DNA, 20 bp, Artificial
  CRISPR gRNA sequence
tgtagttattaaaaagaata

SEQ ID NO: 545605 - DNA, 20 bp, Artificial
  CRISPR gRNA sequence
ttattaaaaagaataaagta

SEQ ID NO: 545606 - DNA, 20 bp, Artificial
  CRISPR gRNA sequence
agaataaagtatagctatac

SEQ ID NO: 545607 - DNA, 20 bp, Artificial
  CRISPR gRNA sequence
tagctataccagttgatttc

SEQ ID NO: 545608 - DNA, 20 bp, Artificial
  CRISPR gRNA sequence
agctataccagttgatttca

SEQ ID NO: 545609 - DNA, 20 bp, Artificial
  CRISPR gRNA sequence
ctataccagttgatttcaag

SEQ ID NO: 545610 - DNA, 20 bp, Artificial
  CRISPR gRNA sequence
gagattttatgacatattaa

SEQ ID NO: 545611 - DNA, 20 bp, Artificial
  CRISPR gRNA sequence
ttttatgacatattaatgga

SEQ ID NO: 545612 - DNA, 20 bp, Artificial
  CRISPR gRNA sequence
tttatgacatattaatggaa

SEQ ID NO: 545613 - DNA, 20 bp, Artificial
  CRISPR gRNA sequence
atgacatattaatggaaagg

SEQ ID NO: 545614 - DNA, 20 bp, Artificial
  CRISPR gRNA sequence
tgacatattaatggaaaggc

SEQ ID NO: 545615 - DNA, 20 bp, Artificial
  CRISPR gRNA sequence
attaatggaaaggcgggatg

SEQ ID NO: 545616 - DNA, 20 bp, Artificial
  CRISPR gRNA sequence
taatggaaaggcgggatgta

SEQ ID NO: 545617 - DNA, 20 bp, Artificial
  CRISPR gRNA sequence
tggaaaggcgggatgtagag

SEQ ID NO: 545618 - DNA, 20 bp, Artificial
  CRISPR gRNA sequence
ggatgtagagaagtgtgcat

SEQ ID NO: 545619 - DNA, 20 bp, Artificial
  CRISPR gRNA sequence
gcataagaccatttttatta

SEQ ID NO: 545620 - DNA, 20 bp, Artificial
  CRISPR gRNA sequence
agaccatttttattaaagaa

SEQ ID NO: 545621 - DNA, 20 bp, Artificial
  CRISPR gRNA sequence
ttaaagaatggtaaatccct

SEQ ID NO: 545622 - DNA, 20 bp, Artificial
  CRISPR gRNA sequence
taaagaatggtaaatccctc

SEQ ID NO: 545623 - DNA, 20 bp, Artificial
  CRISPR gRNA sequence
tttcactttattgcacttca

SEQ ID NO: 545624 - DNA, 20 bp, Artificial
  CRISPR gRNA sequence
aatgtgctttttacaaattg

SEQ ID NO: 545625 - DNA, 20 bp, Artificial
  CRISPR gRNA sequence
atgtgctttttacaaattga

SEQ ID NO: 545626 - DNA, 20 bp, Artificial
  CRISPR gRNA sequence
attgaaggttcgtgacaacc

SEQ ID NO: 545627 - DNA, 20 bp, Artificial
  CRISPR gRNA sequence
gttcgtgacaacccagcttt

SEQ ID NO: 545628 - DNA, 20 bp, Artificial
  CRISPR gRNA sequence
gtgacaacccagctttaagc

SEQ ID NO: 545629 - DNA, 20 bp, Artificial
  CRISPR gRNA sequence
ccagctttaagcaagtccat

SEQ ID NO: 545630 - DNA, 20 bp, Artificial
  CRISPR gRNA sequence
tttgtctctctgttacattt

SEQ ID NO: 545631 - DNA, 20 bp, Artificial
  CRISPR gRNA sequence
tttcattatcatatctgtta

SEQ ID NO: 545632 - DNA, 20 bp, Artificial
  CRISPR gRNA sequence
ctgttatggtgatctgtgat

SEQ ID NO: 545633 - DNA, 20 bp, Artificial
  CRISPR gRNA sequence
tgttactgttgtcattgttt

SEQ ID NO: 545634 - DNA, 20 bp, Artificial
  CRISPR gRNA sequence
gttactgttgtcattgtttt

SEQ ID NO: 545635 - DNA, 20 bp, Artificial
  CRISPR gRNA sequence
tgtcattgttttgggatgcc

SEQ ID NO: 545636 - DNA, 20 bp, Artificial
  CRISPR gRNA sequence
atgccaagaaccatgcgtat

SEQ ID NO: 545637 - DNA, 20 bp, Artificial
  CRISPR gRNA sequence
caagaaccatgcgtataaga

SEQ ID NO: 545638 - DNA, 20 bp, Artificial
  CRISPR gRNA sequence
gttctgactgctccactgac

SEQ ID NO: 545639 - DNA, 20 bp, Artificial
  CRISPR gRNA sequence
ccccatctttctccttctcc

SEQ ID NO: 545640 - DNA, 20 bp, Artificial
  CRISPR gRNA sequence
cctggcctcccttgtcacct

SEQ ID NO: 545641 - DNA, 20 bp, Artificial
  CRISPR gRNA sequence
tgagacaatgatactgaaat

SEQ ID NO: 545642 - DNA, 20 bp, Artificial
  CRISPR gRNA sequence
gagacaatgatactgaaatt

SEQ ID NO: 545643 - DNA, 20 bp, Artificial
  CRISPR gRNA sequence
ccaatttaataaccctgcaa

SEQ ID NO: 545644 - DNA, 20 bp, Artificial
  CRISPR gRNA sequence
ataaccctgcaatggcttct

SEQ ID NO: 545645 - DNA, 20 bp, Artificial
  CRISPR gRNA sequence
gcaatggcttctaagtgctc

SEQ ID NO: 545646 - DNA, 20 bp, Artificial
  CRISPR gRNA sequence
cttctaagtgctcaagtgaa

SEQ ID NO: 545647 - DNA, 20 bp, Artificial
  CRISPR gRNA sequence
ctaagtgctcaagtgaaaag

SEQ ID NO: 545648 - DNA, 20 bp, Artificial
  CRISPR gRNA sequence
aagtgctcaagtgaaaagaa

SEQ ID NO: 545649 - DNA, 20 bp, Artificial
  CRISPR gRNA sequence
tctcactttaaattaaaaac

SEQ ID NO: 545650 - DNA, 20 bp, Artificial
  CRISPR gRNA sequence
attaaaaactagaaatgatt

SEQ ID NO: 545651 - DNA, 20 bp, Artificial
  CRISPR gRNA sequence
aaactagaaatgattaagct

SEQ ID NO: 545652 - DNA, 20 bp, Artificial
  CRISPR gRNA sequence
tagaaatgattaagcttagt

SEQ ID NO: 545653 - DNA, 20 bp, Artificial
  CRISPR gRNA sequence
agaaatgattaagcttagtg

SEQ ID NO: 545654 - DNA, 20 bp, Artificial
  CRISPR gRNA sequence
aatgattaagcttagtgagg

SEQ ID NO: 545655 - DNA, 20 bp, Artificial
  CRISPR gRNA sequence
atgattaagcttagtgagga

SEQ ID NO: 545656 - DNA, 20 bp, Artificial
  CRISPR gRNA sequence
tagtgaggaaggcatgtgaa

SEQ ID NO: 545657 - DNA, 20 bp, Artificial
  CRISPR gRNA sequence
aggcatgtgaaaagccatga

SEQ ID NO: 545658 - DNA, 20 bp, Artificial
  CRISPR gRNA sequence
ggcatgtgaaaagccatgac

SEQ ID NO: 545659 - DNA, 20 bp, Artificial
  CRISPR gRNA sequence
atgtgaaaagccatgacagg

SEQ ID NO: 545660 - DNA, 20 bp, Artificial
  CRISPR gRNA sequence
gaaaagccatgacaggtggc

SEQ ID NO: 545661 - DNA, 20 bp, Artificial
  CRISPR gRNA sequence
aaaagccatgacaggtggcc

SEQ ID NO: 545662 - DNA, 20 bp, Artificial
  CRISPR gRNA sequence
ccatgacaggtggccgggcg

SEQ ID NO: 545663 - DNA, 20 bp, Artificial
  CRISPR gRNA sequence
tgacaggtggccgggcgtgg

SEQ ID NO: 545664 - DNA, 20 bp, Artificial
  CRISPR gRNA sequence
gtggctcacaactgtaatcc

SEQ ID NO: 545665 - DNA, 20 bp, Artificial
  CRISPR gRNA sequence
caactgtaatcccagcactt

SEQ ID NO: 545666 - DNA, 20 bp, Artificial
  CRISPR gRNA sequence
aactgtaatcccagcacttt

SEQ ID NO: 545667 - DNA, 20 bp, Artificial
  CRISPR gRNA sequence
ctgtaatcccagcactttgg

SEQ ID NO: 545668 - DNA, 20 bp, Artificial
  CRISPR gRNA sequence
tgtaatcccagcactttggg

SEQ ID NO: 545669 - DNA, 20 bp, Artificial
  CRISPR gRNA sequence
tcccagcactttgggaggcc

SEQ ID NO: 545670 - DNA, 20 bp, Artificial
  CRISPR gRNA sequence
cccagcactttgggaggcca

SEQ ID NO: 545671 - DNA, 20 bp, Artificial
  CRISPR gRNA sequence
agcactttgggaggccaagg

SEQ ID NO: 545672 - DNA, 20 bp, Artificial
  CRISPR gRNA sequence
gcactttgggaggccaaggt

SEQ ID NO: 545673 - DNA, 20 bp, Artificial
  CRISPR gRNA sequence
ctttgggaggccaaggtggg

SEQ ID NO: 545674 - DNA, 20 bp, Artificial
  CRISPR gRNA sequence
ccaaggtgggtggatcacct

SEQ ID NO: 545675 - DNA, 20 bp, Artificial
  CRISPR gRNA sequence
caaggtgggtggatcacctg

SEQ ID NO: 545676 - DNA, 20 bp, Artificial
  CRISPR gRNA sequence
gtgggtggatcacctgaggt

SEQ ID NO: 545677 - DNA, 20 bp, Artificial
  CRISPR gRNA sequence
ggtggatcacctgaggtcag

SEQ ID NO: 545678 - DNA, 20 bp, Artificial
  CRISPR gRNA sequence
tcacctgaggtcagaagttt

SEQ ID NO: 545679 - DNA, 20 bp, Artificial
  CRISPR gRNA sequence
tcagaagtttgagaccaacc

SEQ ID NO: 545680 - DNA, 20 bp, Artificial
  CRISPR gRNA sequence
tgagaccaacctggccaaca

SEQ ID NO: 545681 - DNA, 20 bp, Artificial
  CRISPR gRNA sequence
tctactaaaaatacaaaaat

SEQ ID NO: 545682 - DNA, 20 bp, Artificial
  CRISPR gRNA sequence
ctaaaaatacaaaaattagc

SEQ ID NO: 545683 - DNA, 20 bp, Artificial
  CRISPR gRNA sequence
taaaaatacaaaaattagct

SEQ ID NO: 545684 - DNA, 20 bp, Artificial
  CRISPR gRNA sequence
atacaaaaattagctgggtg

SEQ ID NO: 545685 - DNA, 20 bp, Artificial
  CRISPR gRNA sequence
caaaaattagctgggtgtgg

SEQ ID NO: 545686 - DNA, 20 bp, Artificial
  CRISPR gRNA sequence
aaattagctgggtgtggtgg

SEQ ID NO: 545687 - DNA, 20 bp, Artificial
  CRISPR gRNA sequence
aattagctgggtgtggtggt

SEQ ID NO: 545688 - DNA, 20 bp, Artificial
  CRISPR gRNA sequence
gtggtgggcacctgtaatcc

SEQ ID NO: 545689 - DNA, 20 bp, Artificial
  CRISPR gRNA sequence
tgggcacctgtaatcccagc

SEQ ID NO: 545690 - DNA, 20 bp, Artificial
  CRISPR gRNA sequence
cacctgtaatcccagctggt

SEQ ID NO: 545691 - DNA, 20 bp, Artificial
  CRISPR gRNA sequence
acctgtaatcccagctggtt

SEQ ID NO: 545692 - DNA, 20 bp, Artificial
  CRISPR gRNA sequence
ctgtaatcccagctggttgg

SEQ ID NO: 545693 - DNA, 20 bp, Artificial
  CRISPR gRNA sequence
tgtaatcccagctggttggg

SEQ ID NO: 545694 - DNA, 20 bp, Artificial
  CRISPR gRNA sequence
tcccagctggttgggaggct

SEQ ID NO: 545695 - DNA, 20 bp, Artificial
  CRISPR gRNA sequence
cccagctggttgggaggctg

SEQ ID NO: 545696 - DNA, 20 bp, Artificial
  CRISPR gRNA sequence
agctggttgggaggctgagg

SEQ ID NO: 545697 - DNA, 20 bp, Artificial
  CRISPR gRNA sequence
gctggttgggaggctgaggc

SEQ ID NO: 545698 - DNA, 20 bp, Artificial
  CRISPR gRNA sequence
tggttgggaggctgaggcag

SEQ ID NO: 545699 - DNA, 20 bp, Artificial
  CRISPR gRNA sequence
ggagaatcgcttgaacctga

SEQ ID NO: 545700 - DNA, 20 bp, Artificial
  CRISPR gRNA sequence
gagaatcgcttgaacctgaa

SEQ ID NO: 545701 - DNA, 20 bp, Artificial
  CRISPR gRNA sequence
aatcgcttgaacctgaaagg

SEQ ID NO: 545702 - DNA, 20 bp, Artificial
  CRISPR gRNA sequence
aacctgaaaggcagatgttg

SEQ ID NO: 545703 - DNA, 20 bp, Artificial
  CRISPR gRNA sequence
tgaaaggcagatgttgcagt

SEQ ID NO: 545704 - DNA, 20 bp, Artificial
  CRISPR gRNA sequence
ggcagatgttgcagtgagcc

SEQ ID NO: 545705 - DNA, 20 bp, Artificial
  CRISPR gRNA sequence
gatgttgcagtgagccaaga

SEQ ID NO: 545706 - DNA, 20 bp, Artificial
  CRISPR gRNA sequence
aagatggcactattgcactc

SEQ ID NO: 545707 - DNA, 20 bp, Artificial
  CRISPR gRNA sequence
ggcactattgcactccagtc

SEQ ID NO: 545708 - DNA, 20 bp, Artificial
  CRISPR gRNA sequence
gcactattgcactccagtct

SEQ ID NO: 545709 - DNA, 20 bp, Artificial
  CRISPR gRNA sequence
tgcactccagtctgggctac

SEQ ID NO: 545710 - DNA, 20 bp, Artificial
  CRISPR gRNA sequence
caagaatgaaactctgtctg

SEQ ID NO: 545711 - DNA, 20 bp, Artificial
  CRISPR gRNA sequence
tctgaagaaaaaaaaaaaaa

SEQ ID NO: 545712 - DNA, 20 bp, Artificial
  CRISPR gRNA sequence
aagaaaaaaaaaaaaaaaga

SEQ ID NO: 545713 - DNA, 20 bp, Artificial
  CRISPR gRNA sequence
aaaaaaaaaaaaaagaaaga

SEQ ID NO: 545714 - DNA, 20 bp, Artificial
  CRISPR gRNA sequence
aagaaagaaagaaaaaaaaa

SEQ ID NO: 545715 - DNA, 20 bp, Artificial
  CRISPR gRNA sequence
agaaaaaaaaaaagccacga

SEQ ID NO: 545716 - DNA, 20 bp, Artificial
  CRISPR gRNA sequence
gaaaaaaaaaaagccacgat

SEQ ID NO: 545717 - DNA, 20 bp, Artificial
  CRISPR gRNA sequence
agccacgatgggctgaaaac

SEQ ID NO: 545718 - DNA, 20 bp, Artificial
  CRISPR gRNA sequence
gccacgatgggctgaaaact

SEQ ID NO: 545719 - DNA, 20 bp, Artificial
  CRISPR gRNA sequence
aaactaggccttttatgcca

SEQ ID NO: 545720 - DNA, 20 bp, Artificial
  CRISPR gRNA sequence
actaggccttttatgccaaa

SEQ ID NO: 545721 - DNA, 20 bp, Artificial
  CRISPR gRNA sequence
ggccttttatgccaaagagt

SEQ ID NO: 545722 - DNA, 20 bp, Artificial
  CRISPR gRNA sequence
tttatgccaaagagttagtg

SEQ ID NO: 545723 - DNA, 20 bp, Artificial
  CRISPR gRNA sequence
ttagtgaagttgtgaattca

SEQ ID NO: 545724 - DNA, 20 bp, Artificial
  CRISPR gRNA sequence
tagtgaagttgtgaattcaa

SEQ ID NO: 545725 - DNA, 20 bp, Artificial
  CRISPR gRNA sequence
aagttgtgaattcaaaggaa

SEQ ID NO: 545726 - DNA, 20 bp, Artificial
  CRISPR gRNA sequence
attcaaaggaaaagttcttg

SEQ ID NO: 545727 - DNA, 20 bp, Artificial
  CRISPR gRNA sequence
ttcaaaggaaaagttcttga

SEQ ID NO: 545728 - DNA, 20 bp, Artificial
  CRISPR gRNA sequence
aagttcttgaaggaaattaa

SEQ ID NO: 545729 - DNA, 20 bp, Artificial
  CRISPR gRNA sequence
ggaaattaaaagtgctactt

SEQ ID NO: 545730 - DNA, 20 bp, Artificial
  CRISPR gRNA sequence
acttcagtgaacacataaat

SEQ ID NO: 545731 - DNA, 20 bp, Artificial
  CRISPR gRNA sequence
cagtgaacacataaataaga

SEQ ID NO: 545732 - DNA, 20 bp, Artificial
  CRISPR gRNA sequence
acataaataagaaagtgaaa

SEQ ID NO: 545733 - DNA, 20 bp, Artificial
  CRISPR gRNA sequence
aaagtgaaacagcgttattg

SEQ ID NO: 545734 - DNA, 20 bp, Artificial
  CRISPR gRNA sequence
tgaaacagcgttattgcaga

SEQ ID NO: 545735 - DNA, 20 bp, Artificial
  CRISPR gRNA sequence
aaacagcgttattgcagatg

SEQ ID NO: 545736 - DNA, 20 bp, Artificial
  CRISPR gRNA sequence
agcgttattgcagatggaga

SEQ ID NO: 545737 - DNA, 20 bp, Artificial
  CRISPR gRNA sequence
attgcagatggagaaagttc

SEQ ID NO: 545738 - DNA, 20 bp, Artificial
  CRISPR gRNA sequence
gcagatggagaaagttcgag

SEQ ID NO: 545739 - DNA, 20 bp, Artificial
  CRISPR gRNA sequence
gaaagttcgagtagtctgca

SEQ ID NO: 545740 - DNA, 20 bp, Artificial
  CRISPR gRNA sequence
agttcgagtagtctgcatag

SEQ ID NO: 545741 - DNA, 20 bp, Artificial
  CRISPR gRNA sequence
agtagtctgcatagaagatc

SEQ ID NO: 545742 - DNA, 20 bp, Artificial
  CRISPR gRNA sequence
gtctgcatagaagatcaagc

SEQ ID NO: 545743 - DNA, 20 bp, Artificial
  CRISPR gRNA sequence
tacaacattcccttaatcca

SEQ ID NO: 545744 - DNA, 20 bp, Artificial
  CRISPR gRNA sequence
ccttaatccaaagcctaatc

SEQ ID NO: 545745 - DNA, 20 bp, Artificial
  CRISPR gRNA sequence
ttaatccaaagcctaatcca

SEQ ID NO: 545746 - DNA, 20 bp, Artificial
  CRISPR gRNA sequence
tccaaagcctaatccagagc

SEQ ID NO: 545747 - DNA, 20 bp, Artificial
  CRISPR gRNA sequence
agcaagaccctaactctctt

SEQ ID NO: 545748 - DNA, 20 bp, Artificial
  CRISPR gRNA sequence
taactctctttagttctgtg

SEQ ID NO: 545749 - DNA, 20 bp, Artificial
  CRISPR gRNA sequence
aactctctttagttctgtga

SEQ ID NO: 545750 - DNA, 20 bp, Artificial
  CRISPR gRNA sequence
tctttagttctgtgaaggct

SEQ ID NO: 545751 - DNA, 20 bp, Artificial
  CRISPR gRNA sequence
tttagttctgtgaaggctga

SEQ ID NO: 545752 - DNA, 20 bp, Artificial
  CRISPR gRNA sequence
tagttctgtgaaggctgaga

SEQ ID NO: 545753 - DNA, 20 bp, Artificial
  CRISPR gRNA sequence
agttctgtgaaggctgagag

SEQ ID NO: 545754 - DNA, 20 bp, Artificial
  CRISPR gRNA sequence
ctgtgaaggctgagagaggt

SEQ ID NO: 545755 - DNA, 20 bp, Artificial
  CRISPR gRNA sequence
gaaggctgagagaggtgaga

SEQ ID NO: 545756 - DNA, 20 bp, Artificial
  CRISPR gRNA sequence
tgagagaggtgagaaagctg

SEQ ID NO: 545757 - DNA, 20 bp, Artificial
  CRISPR gRNA sequence
gagagaggtgagaaagctgc

SEQ ID NO: 545758 - DNA, 20 bp, Artificial
  CRISPR gRNA sequence
gagaggtgagaaagctgcag

SEQ ID NO: 545759 - DNA, 20 bp, Artificial
  CRISPR gRNA sequence
gtgagaaagctgcaggagaa

SEQ ID NO: 545760 - DNA, 20 bp, Artificial
  CRISPR gRNA sequence
agctgcaggagaaaagtttg

SEQ ID NO: 545761 - DNA, 20 bp, Artificial
  CRISPR gRNA sequence
ggagaaaagtttgaagctat

SEQ ID NO: 545762 - DNA, 20 bp, Artificial
  CRISPR gRNA sequence
agaaaagtttgaagctatca

SEQ ID NO: 545763 - DNA, 20 bp, Artificial
  CRISPR gRNA sequence
gaaaagtttgaagctatcag

SEQ ID NO: 545764 - DNA, 20 bp, Artificial
  CRISPR gRNA sequence
agtttgaagctatcagaggt

SEQ ID NO: 545765 - DNA, 20 bp, Artificial
  CRISPR gRNA sequence
gctatcagaggttagttcat

SEQ ID NO: 545766 - DNA, 20 bp, Artificial
  CRISPR gRNA sequence
gaggttagttcatgagatct

SEQ ID NO: 545767 - DNA, 20 bp, Artificial
  CRISPR gRNA sequence
aggttagttcatgagatctt

SEQ ID NO: 545768 - DNA, 20 bp, Artificial
  CRISPR gRNA sequence
ttagttcatgagatcttagg

SEQ ID NO: 545769 - DNA, 20 bp, Artificial
  CRISPR gRNA sequence
ttcatgagatcttaggaaga

SEQ ID NO: 545770 - DNA, 20 bp, Artificial
  CRISPR gRNA sequence
ctccataacataaaactgtg

SEQ ID NO: 545771 - DNA, 20 bp, Artificial
  CRISPR gRNA sequence
taacataaaactgtgaagta

SEQ ID NO: 545772 - DNA, 20 bp, Artificial
  CRISPR gRNA sequence
cataaaactgtgaagtaaag

SEQ ID NO: 545773 - DNA, 20 bp, Artificial
  CRISPR gRNA sequence
aaactgtgaagtaaagcagc

SEQ ID NO: 545774 - DNA, 20 bp, Artificial
  CRISPR gRNA sequence
taaagcagcaagtgttgatg

SEQ ID NO: 545775 - DNA, 20 bp, Artificial
  CRISPR gRNA sequence
agcagcaagtgttgatgtag

SEQ ID NO: 545776 - DNA, 20 bp, Artificial
  CRISPR gRNA sequence
agtgttgatgtagaagctgc

SEQ ID NO: 545777 - DNA, 20 bp, Artificial
  CRISPR gRNA sequence
agaagctgcaagaaattatc

SEQ ID NO: 545778 - DNA, 20 bp, Artificial
  CRISPR gRNA sequence
agctgcaagaaattatccag

SEQ ID NO: 545779 - DNA, 20 bp, Artificial
  CRISPR gRNA sequence
agaaattatccagaagatct

SEQ ID NO: 545780 - DNA, 20 bp, Artificial
  CRISPR gRNA sequence
tccagaagatctaagattac

SEQ ID NO: 545781 - DNA, 20 bp, Artificial
  CRISPR gRNA sequence
aagatctaagattactggtg

SEQ ID NO: 545782 - DNA, 20 bp, Artificial
  CRISPR gRNA sequence
agatctaagattactggtgc

SEQ ID NO: 545783 - DNA, 20 bp, Artificial
  CRISPR gRNA sequence
gtgcaggatacatgaaacaa

SEQ ID NO: 545784 - DNA, 20 bp, Artificial
  CRISPR gRNA sequence
gaaacaacagattttcaatg

SEQ ID NO: 545785 - DNA, 20 bp, Artificial
  CRISPR gRNA sequence
tagacaaaacaaccttctac

SEQ ID NO: 545786 - DNA, 20 bp, Artificial
  CRISPR gRNA sequence
acaaaacaaccttctactgg

SEQ ID NO: 545787 - DNA, 20 bp, Artificial
  CRISPR gRNA sequence
aaacaaccttctactggaag

SEQ ID NO: 545788 - DNA, 20 bp, Artificial
  CRISPR gRNA sequence
tactggaagaagatgccatc

SEQ ID NO: 545789 - DNA, 20 bp, Artificial
  CRISPR gRNA sequence
actggaagaagatgccatct

SEQ ID NO: 545790 - DNA, 20 bp, Artificial
  CRISPR gRNA sequence
gatgccatctaggacttcca

SEQ ID NO: 545791 - DNA, 20 bp, Artificial
  CRISPR gRNA sequence
ccatctaggacttccatagc

SEQ ID NO: 545792 - DNA, 20 bp, Artificial
  CRISPR gRNA sequence
ctaggacttccatagctaga

SEQ ID NO: 545793 - DNA, 20 bp, Artificial
  CRISPR gRNA sequence
taggacttccatagctagac

SEQ ID NO: 545794 - DNA, 20 bp, Artificial
  CRISPR gRNA sequence
ggacttccatagctagacag

SEQ ID NO: 545795 - DNA, 20 bp, Artificial
  CRISPR gRNA sequence
cttccatagctagacaggag

SEQ ID NO: 545796 - DNA, 20 bp, Artificial
  CRISPR gRNA sequence
tagacaggagaagtcaactt

SEQ ID NO: 545797 - DNA, 20 bp, Artificial
  CRISPR gRNA sequence
agacaggagaagtcaacttc

SEQ ID NO: 545798 - DNA, 20 bp, Artificial
  CRISPR gRNA sequence
gaagtcaacttcaggcttga

SEQ ID NO: 545799 - DNA, 20 bp, Artificial
  CRISPR gRNA sequence
aagtcaacttcaggcttgaa

SEQ ID NO: 545800 - DNA, 20 bp, Artificial
  CRISPR gRNA sequence
caacttcaggcttgaaagga

SEQ ID NO: 545801 - DNA, 20 bp, Artificial
  CRISPR gRNA sequence
cagctgactctcttgttgtg

SEQ ID NO: 545802 - DNA, 20 bp, Artificial
  CRISPR gRNA sequence
agctgactctcttgttgtgt

SEQ ID NO: 545803 - DNA, 20 bp, Artificial
  CRISPR gRNA sequence
tcttgttgtgtgggctaatg

SEQ ID NO: 545804 - DNA, 20 bp, Artificial
  CRISPR gRNA sequence
ctaatgcagctgatgacttt

SEQ ID NO: 545805 - DNA, 20 bp, Artificial
  CRISPR gRNA sequence
cagctgatgactttaagttg

SEQ ID NO: 545806 - DNA, 20 bp, Artificial
  CRISPR gRNA sequence
tgatgactttaagttgaagc

SEQ ID NO: 545807 - DNA, 20 bp, Artificial
  CRISPR gRNA sequence
tttaccactctgaaaatttt

SEQ ID NO: 545808 - DNA, 20 bp, Artificial
  CRISPR gRNA sequence
ttaccactctgaaaattttt

SEQ ID NO: 545809 - DNA, 20 bp, Artificial
  CRISPR gRNA sequence
taccactctgaaaattttta

SEQ ID NO: 545810 - DNA, 20 bp, Artificial
  CRISPR gRNA sequence
tgaaaatttttagggccctt

SEQ ID NO: 545811 - DNA, 20 bp, Artificial
  CRISPR gRNA sequence
tttttagggcccttaagaat

SEQ ID NO: 545812 - DNA, 20 bp, Artificial
  CRISPR gRNA sequence
ttttagggcccttaagaatt

SEQ ID NO: 545813 - DNA, 20 bp, Artificial
  CRISPR gRNA sequence
tctgcttgtgctctataaaa

SEQ ID NO: 545814 - DNA, 20 bp, Artificial
  CRISPR gRNA sequence
tgctctataaaatggaacaa

SEQ ID NO: 545815 - DNA, 20 bp, Artificial
  CRISPR gRNA sequence
gctctataaaatggaacaac

SEQ ID NO: 545816 - DNA, 20 bp, Artificial
  CRISPR gRNA sequence
tataaaatggaacaacaggc

SEQ ID NO: 545817 - DNA, 20 bp, Artificial
  CRISPR gRNA sequence
tggaacaacaggctggatga

SEQ ID NO: 545818 - DNA, 20 bp, Artificial
  CRISPR gRNA sequence
gatgacagcacatctgttta

SEQ ID NO: 545819 - DNA, 20 bp, Artificial
  CRISPR gRNA sequence
cagcacatctgtttacagca

SEQ ID NO: 545820 - DNA, 20 bp, Artificial
  CRISPR gRNA sequence
catggtttactgaatattgt

SEQ ID NO: 545821 - DNA, 20 bp, Artificial
  CRISPR gRNA sequence
cactgttaatacttactgct

SEQ ID NO: 545822 - DNA, 20 bp, Artificial
  CRISPR gRNA sequence
tacttactgcttagaaaaaa

SEQ ID NO: 545823 - DNA, 20 bp, Artificial
  CRISPR gRNA sequence
tagaaaaaaaagattcattt

SEQ ID NO: 545824 - DNA, 20 bp, Artificial
  CRISPR gRNA sequence
gacaatgcacctaatcaccc

SEQ ID NO: 545825 - DNA, 20 bp, Artificial
  CRISPR gRNA sequence
caatgcacctaatcacccaa

SEQ ID NO: 545826 - DNA, 20 bp, Artificial
  CRISPR gRNA sequence
taatcacccaagagctctga

SEQ ID NO: 545827 - DNA, 20 bp, Artificial
  CRISPR gRNA sequence
atcacccaagagctctgatg

SEQ ID NO: 545828 - DNA, 20 bp, Artificial
  CRISPR gRNA sequence
gagctctgatggagatgtac

SEQ ID NO: 545829 - DNA, 20 bp, Artificial
  CRISPR gRNA sequence
agctctgatggagatgtaca

SEQ ID NO: 545830 - DNA, 20 bp, Artificial
  CRISPR gRNA sequence
ctctgatggagatgtacaag

SEQ ID NO: 545831 - DNA, 20 bp, Artificial
  CRISPR gRNA sequence
atggagatgtacaaggagat

SEQ ID NO: 545832 - DNA, 20 bp, Artificial
  CRISPR gRNA sequence
ctaatacaacatccattctg

SEQ ID NO: 545833 - DNA, 20 bp, Artificial
  CRISPR gRNA sequence
aacatccattctgcagccca

SEQ ID NO: 545834 - DNA, 20 bp, Artificial
  CRISPR gRNA sequence
cattctgcagcccatggatc

SEQ ID NO: 545835 - DNA, 20 bp, Artificial
  CRISPR gRNA sequence
attctgcagcccatggatca

SEQ ID NO: 545836 - DNA, 20 bp, Artificial
  CRISPR gRNA sequence
tctgcagcccatggatcaag

SEQ ID NO: 545837 - DNA, 20 bp, Artificial
  CRISPR gRNA sequence
aaggagtaattttgcctttg

SEQ ID NO: 545838 - DNA, 20 bp, Artificial
  CRISPR gRNA sequence
gcctttgaagtcttattatg

SEQ ID NO: 545839 - DNA, 20 bp, Artificial
  CRISPR gRNA sequence
cctttgaagtcttattatgt

SEQ ID NO: 545840 - DNA, 20 bp, Artificial
  CRISPR gRNA sequence
ttattatgtaggaatacact

SEQ ID NO: 545841 - DNA, 20 bp, Artificial
  CRISPR gRNA sequence
tatgtaggaatacacttggt

SEQ ID NO: 545842 - DNA, 20 bp, Artificial
  CRISPR gRNA sequence
atgtaggaatacacttggta

SEQ ID NO: 545843 - DNA, 20 bp, Artificial
  CRISPR gRNA sequence
gaatacacttggtaaggcta

SEQ ID NO: 545844 - DNA, 20 bp, Artificial
  CRISPR gRNA sequence
tggtaaggctatagctgcca

SEQ ID NO: 545845 - DNA, 20 bp, Artificial
  CRISPR gRNA sequence
aattattcttctgatgaatc

SEQ ID NO: 545846 - DNA, 20 bp, Artificial
  CRISPR gRNA sequence
attattcttctgatgaatct

SEQ ID NO: 545847 - DNA, 20 bp, Artificial
  CRISPR gRNA sequence
tcttctgatgaatctgggca

SEQ ID NO: 545848 - DNA, 20 bp, Artificial
  CRISPR gRNA sequence
gtaaattgacaaccttctga

SEQ ID NO: 545849 - DNA, 20 bp, Artificial
  CRISPR gRNA sequence
taaattgacaaccttctgaa

SEQ ID NO: 545850 - DNA, 20 bp, Artificial
  CRISPR gRNA sequence
gacaaccttctgaaaggatt

SEQ ID NO: 545851 - DNA, 20 bp, Artificial
  CRISPR gRNA sequence
tctgaaaggattcagcattc

SEQ ID NO: 545852 - DNA, 20 bp, Artificial
  CRISPR gRNA sequence
tcagcattctagatgtcatt

SEQ ID NO: 545853 - DNA, 20 bp, Artificial
  CRISPR gRNA sequence
gatgtcattaagaatatttg

SEQ ID NO: 545854 - DNA, 20 bp, Artificial
  CRISPR gRNA sequence
ttaagaatatttgtggttca

SEQ ID NO: 545855 - DNA, 20 bp, Artificial
  CRISPR gRNA sequence
taagaatatttgtggttcat

SEQ ID NO: 545856 - DNA, 20 bp, Artificial
  CRISPR gRNA sequence
agaatatttgtggttcatgg

SEQ ID NO: 545857 - DNA, 20 bp, Artificial
  CRISPR gRNA sequence
atatttgtggttcatgggag

SEQ ID NO: 545858 - DNA, 20 bp, Artificial
  CRISPR gRNA sequence
gatcaaaatatcaacattaa

SEQ ID NO: 545859 - DNA, 20 bp, Artificial
  CRISPR gRNA sequence
atcaaaatatcaacattaac

SEQ ID NO: 545860 - DNA, 20 bp, Artificial
  CRISPR gRNA sequence
caaaatatcaacattaacag

SEQ ID NO: 545861 - DNA, 20 bp, Artificial
  CRISPR gRNA sequence
tatcaacattaacaggagtt

SEQ ID NO: 545862 - DNA, 20 bp, Artificial
  CRISPR gRNA sequence
caacattaacaggagtttgg

SEQ ID NO: 545863 - DNA, 20 bp, Artificial
  CRISPR gRNA sequence
aagaatttgattccaatcgt

SEQ ID NO: 545864 - DNA, 20 bp, Artificial
  CRISPR gRNA sequence
agaatttgattccaatcgtc

SEQ ID NO: 545865 - DNA, 20 bp, Artificial
  CRISPR gRNA sequence
ggtcaaaatatcaatattaa

SEQ ID NO: 545866 - DNA, 20 bp, Artificial
  CRISPR gRNA sequence
gtcaaaatatcaatattaac

SEQ ID NO: 545867 - DNA, 20 bp, Artificial
  CRISPR gRNA sequence
caaaatatcaatattaacag

SEQ ID NO: 545868 - DNA, 20 bp, Artificial
  CRISPR gRNA sequence
tatcaatattaacaggagtt

SEQ ID NO: 545869 - DNA, 20 bp, Artificial
  CRISPR gRNA sequence
caatattaacaggagtttgg

SEQ ID NO: 545870 - DNA, 20 bp, Artificial
  CRISPR gRNA sequence
gaatttgattccgatcctca

SEQ ID NO: 545871 - DNA, 20 bp, Artificial
  CRISPR gRNA sequence
gatcctcatggatgactttg

SEQ ID NO: 545872 - DNA, 20 bp, Artificial
  CRISPR gRNA sequence
atcctcatggatgactttga

SEQ ID NO: 545873 - DNA, 20 bp, Artificial
  CRISPR gRNA sequence
tcctcatggatgactttgaa

SEQ ID NO: 545874 - DNA, 20 bp, Artificial
  CRISPR gRNA sequence
tcatggatgactttgaaggg

SEQ ID NO: 545875 - DNA, 20 bp, Artificial
  CRISPR gRNA sequence
atgactttgaagggtggaaa

SEQ ID NO: 545876 - DNA, 20 bp, Artificial
  CRISPR gRNA sequence
ctttgaagggtggaaatagc

SEQ ID NO: 545877 - DNA, 20 bp, Artificial
  CRISPR gRNA sequence
ggtggaaatagcaagaaaaa

SEQ ID NO: 545878 - DNA, 20 bp, Artificial
  CRISPR gRNA sequence
ggaaatagcaagaaaaatag

SEQ ID NO: 545879 - DNA, 20 bp, Artificial
  CRISPR gRNA sequence
aatagcaagaaaaatagaag

SEQ ID NO: 545880 - DNA, 20 bp, Artificial
  CRISPR gRNA sequence
tagcaagaaaaatagaagtg

SEQ ID NO: 545881 - DNA, 20 bp, Artificial
  CRISPR gRNA sequence
tggagcctgaatatgtcact

SEQ ID NO: 545882 - DNA, 20 bp, Artificial
  CRISPR gRNA sequence
acaatctcatgatgaaaatt

SEQ ID NO: 545883 - DNA, 20 bp, Artificial
  CRISPR gRNA sequence
atgatgaaaattgagccaat

SEQ ID NO: 545884 - DNA, 20 bp, Artificial
  CRISPR gRNA sequence
tgatgaaaattgagccaatg

SEQ ID NO: 545885 - DNA, 20 bp, Artificial
  CRISPR gRNA sequence
atgaaaattgagccaatgag

SEQ ID NO: 545886 - DNA, 20 bp, Artificial
  CRISPR gRNA sequence
caatgaggagttgcttctta

SEQ ID NO: 545887 - DNA, 20 bp, Artificial
  CRISPR gRNA sequence
aggagttgcttcttatggat

SEQ ID NO: 545888 - DNA, 20 bp, Artificial
  CRISPR gRNA sequence
ttgcttcttatggatgagca

SEQ ID NO: 545889 - DNA, 20 bp, Artificial
  CRISPR gRNA sequence
ttcttatggatgagcaaaga

SEQ ID NO: 545890 - DNA, 20 bp, Artificial
  CRISPR gRNA sequence
ttatggatgagcaaagaaag

SEQ ID NO: 545891 - DNA, 20 bp, Artificial
  CRISPR gRNA sequence
agcaaagaaagtggtttctt

SEQ ID NO: 545892 - DNA, 20 bp, Artificial
  CRISPR gRNA sequence
aagaaagtggtttcttcaga

SEQ ID NO: 545893 - DNA, 20 bp, Artificial
  CRISPR gRNA sequence
tcagatggcatctatactcc

SEQ ID NO: 545894 - DNA, 20 bp, Artificial
  CRISPR gRNA sequence
tggcatctatactcctggtg

SEQ ID NO: 545895 - DNA, 20 bp, Artificial
  CRISPR gRNA sequence
acattgtttaaatgacaaca

SEQ ID NO: 545896 - DNA, 20 bp, Artificial
  CRISPR gRNA sequence
cattgtttaaatgacaacaa

SEQ ID NO: 545897 - DNA, 20 bp, Artificial
  CRISPR gRNA sequence
attgtttaaatgacaacaaa

SEQ ID NO: 545898 - DNA, 20 bp, Artificial
  CRISPR gRNA sequence
ttaaatgacaacaaagggtt

SEQ ID NO: 545899 - DNA, 20 bp, Artificial
  CRISPR gRNA sequence
aaatgacaacaaagggttaa

SEQ ID NO: 545900 - DNA, 20 bp, Artificial
  CRISPR gRNA sequence
ttaagagtattacataaatt

SEQ ID NO: 545901 - DNA, 20 bp, Artificial
  CRISPR gRNA sequence
ttacataaatttagttgata

SEQ ID NO: 545902 - DNA, 20 bp, Artificial
  CRISPR gRNA sequence
cataaatttagttgataaag

SEQ ID NO: 545903 - DNA, 20 bp, Artificial
  CRISPR gRNA sequence
aaatttagttgataaagcag

SEQ ID NO: 545904 - DNA, 20 bp, Artificial
  CRISPR gRNA sequence
tttagttgataaagcagcag

SEQ ID NO: 545905 - DNA, 20 bp, Artificial
  CRISPR gRNA sequence
ttagttgataaagcagcagc

SEQ ID NO: 545906 - DNA, 20 bp, Artificial
  CRISPR gRNA sequence
ataaagcagcagcaggattt

SEQ ID NO: 545907 - DNA, 20 bp, Artificial
  CRISPR gRNA sequence
aaaatttactctaattttga

SEQ ID NO: 545908 - DNA, 20 bp, Artificial
  CRISPR gRNA sequence
atttactctaattttgaaag

SEQ ID NO: 545909 - DNA, 20 bp, Artificial
  CRISPR gRNA sequence
tttgaaagcagttttactgt

SEQ ID NO: 545910 - DNA, 20 bp, Artificial
  CRISPR gRNA sequence
gtgagtaaaattctatcaaa

SEQ ID NO: 545911 - DNA, 20 bp, Artificial
  CRISPR gRNA sequence
aaaattctatcaaacagcat

SEQ ID NO: 545912 - DNA, 20 bp, Artificial
  CRISPR gRNA sequence
aaacagcattggatgcctct

SEQ ID NO: 545913 - DNA, 20 bp, Artificial
  CRISPR gRNA sequence
ctctgagaaatattttgtga

SEQ ID NO: 545914 - DNA, 20 bp, Artificial
  CRISPR gRNA sequence
tctgagaaatattttgtgaa

SEQ ID NO: 545915 - DNA, 20 bp, Artificial
  CRISPR gRNA sequence
gagaaatattttgtgaaagg

SEQ ID NO: 545916 - DNA, 20 bp, Artificial
  CRISPR gRNA sequence
agaaatattttgtgaaagga

SEQ ID NO: 545917 - DNA, 20 bp, Artificial
  CRISPR gRNA sequence
gaaatattttgtgaaaggaa

SEQ ID NO: 545918 - DNA, 20 bp, Artificial
  CRISPR gRNA sequence
aaaggaagggtccattgatg

SEQ ID NO: 545919 - DNA, 20 bp, Artificial
  CRISPR gRNA sequence
actcatcattgtcttctttt

SEQ ID NO: 545920 - DNA, 20 bp, Artificial
  CRISPR gRNA sequence
cttcttttaagaaattgcca

SEQ ID NO: 545921 - DNA, 20 bp, Artificial
  CRISPR gRNA sequence
agaaattgccacagccattg

SEQ ID NO: 545922 - DNA, 20 bp, Artificial
  CRISPR gRNA sequence
gccacagccattgcagcctt

SEQ ID NO: 545923 - DNA, 20 bp, Artificial
  CRISPR gRNA sequence
ttagcaaccaacaccctgat

SEQ ID NO: 545924 - DNA, 20 bp, Artificial
  CRISPR gRNA sequence
caaccaacaccctgatcagt

SEQ ID NO: 545925 - DNA, 20 bp, Artificial
  CRISPR gRNA sequence
ccaacaccctgatcagtcag

SEQ ID NO: 545926 - DNA, 20 bp, Artificial
  CRISPR gRNA sequence
agtcagcagccatcaacatt

SEQ ID NO: 545927 - DNA, 20 bp, Artificial
  CRISPR gRNA sequence
gtcagcagccatcaacattg

SEQ ID NO: 545928 - DNA, 20 bp, Artificial
  CRISPR gRNA sequence
gcagccatcaacattgaggc

SEQ ID NO: 545929 - DNA, 20 bp, Artificial
  CRISPR gRNA sequence
attgaggcaagacctttcac

SEQ ID NO: 545930 - DNA, 20 bp, Artificial
  CRISPR gRNA sequence
cctttcaccagcaaaaatat

SEQ ID NO: 545931 - DNA, 20 bp, Artificial
  CRISPR gRNA sequence
ctttcaccagcaaaaatatt

SEQ ID NO: 545932 - DNA, 20 bp, Artificial
  CRISPR gRNA sequence
aaaaatattaggacttgctg

SEQ ID NO: 545933 - DNA, 20 bp, Artificial
  CRISPR gRNA sequence
aaaatattaggacttgctga

SEQ ID NO: 545934 - DNA, 20 bp, Artificial
  CRISPR gRNA sequence
ctgaaggctcaaatgattgt

SEQ ID NO: 545935 - DNA, 20 bp, Artificial
  CRISPR gRNA sequence
tgttagcatgtttttttttt

SEQ ID NO: 545936 - DNA, 20 bp, Artificial
  CRISPR gRNA sequence
tgttttttttttcagcaata

SEQ ID NO: 545937 - DNA, 20 bp, Artificial
  CRISPR gRNA sequence
aaatatgtacattgtgtttt

SEQ ID NO: 545938 - DNA, 20 bp, Artificial
  CRISPR gRNA sequence
aatgctattgaacactttaa

SEQ ID NO: 545939 - DNA, 20 bp, Artificial
  CRISPR gRNA sequence
ttgaacactttaatagacta

SEQ ID NO: 545940 - DNA, 20 bp, Artificial
  CRISPR gRNA sequence
cactttaatagactacagta

SEQ ID NO: 545941 - DNA, 20 bp, Artificial
  CRISPR gRNA sequence
aacataacatttatatgccc

SEQ ID NO: 545942 - DNA, 20 bp, Artificial
  CRISPR gRNA sequence
acataacatttatatgccct

SEQ ID NO: 545943 - DNA, 20 bp, Artificial
  CRISPR gRNA sequence
atttatatgccctgggaaac

SEQ ID NO: 545944 - DNA, 20 bp, Artificial
  CRISPR gRNA sequence
tttacatgattgctgttgtc

SEQ ID NO: 545945 - DNA, 20 bp, Artificial
  CRISPR gRNA sequence
ttacatgattgctgttgtct

SEQ ID NO: 545946 - DNA, 20 bp, Artificial
  CRISPR gRNA sequence
gttgtctgggaccaaaccca

SEQ ID NO: 545947 - DNA, 20 bp, Artificial
  CRISPR gRNA sequence
accaaacccacggtatcttc

SEQ ID NO: 545948 - DNA, 20 bp, Artificial
  CRISPR gRNA sequence
ttgtatctatttgactatat

SEQ ID NO: 545949 - DNA, 20 bp, Artificial
  CRISPR gRNA sequence
gtatctatttgactatatga

SEQ ID NO: 545950 - DNA, 20 bp, Artificial
  CRISPR gRNA sequence
atatgagagaaaaatattga

SEQ ID NO: 545951 - DNA, 20 bp, Artificial
  CRISPR gRNA sequence
tgtattctgatttgttaatg

SEQ ID NO: 545952 - DNA, 20 bp, Artificial
  CRISPR gRNA sequence
tgatttgttaatgtagatta

SEQ ID NO: 545953 - DNA, 20 bp, Artificial
  CRISPR gRNA sequence
gttaatgtagattatagaac

SEQ ID NO: 545954 - DNA, 20 bp, Artificial
  CRISPR gRNA sequence
taatgtagattatagaactg

SEQ ID NO: 545955 - DNA, 20 bp, Artificial
  CRISPR gRNA sequence
tatagaactggagattgtta

SEQ ID NO: 545956 - DNA, 20 bp, Artificial
  CRISPR gRNA sequence
atagaactggagattgttat

SEQ ID NO: 545957 - DNA, 20 bp, Artificial
  CRISPR gRNA sequence
tagaactggagattgttatg

SEQ ID NO: 545958 - DNA, 20 bp, Artificial
  CRISPR gRNA sequence
ctggagattgttatggggtt

SEQ ID NO: 545959 - DNA, 20 bp, Artificial
  CRISPR gRNA sequence
ggagattgttatggggttaa

SEQ ID NO: 545960 - DNA, 20 bp, Artificial
  CRISPR gRNA sequence
agattgttatggggttaaga

SEQ ID NO: 545961 - DNA, 20 bp, Artificial
  CRISPR gRNA sequence
ttgttatggggttaagagag

SEQ ID NO: 545962 - DNA, 20 bp, Artificial
  CRISPR gRNA sequence
tgttatggggttaagagagt

SEQ ID NO: 545963 - DNA, 20 bp, Artificial
  CRISPR gRNA sequence
atggggttaagagagtgggt

SEQ ID NO: 545964 - DNA, 20 bp, Artificial
  CRISPR gRNA sequence
tggggttaagagagtgggta

SEQ ID NO: 545965 - DNA, 20 bp, Artificial
  CRISPR gRNA sequence
aagagagtgggtaaggcacc

SEQ ID NO: 545966 - DNA, 20 bp, Artificial
  CRISPR gRNA sequence
agtgggtaaggcacccagat

SEQ ID NO: 545967 - DNA, 20 bp, Artificial
  CRISPR gRNA sequence
tgggtaaggcacccagataa

SEQ ID NO: 545968 - DNA, 20 bp, Artificial
  CRISPR gRNA sequence
gggtaaggcacccagataag

SEQ ID NO: 545969 - DNA, 20 bp, Artificial
  CRISPR gRNA sequence
cttatatgatcgtttttcat

SEQ ID NO: 545970 - DNA, 20 bp, Artificial
  CRISPR gRNA sequence
gatcgtttttcattagtgta

SEQ ID NO: 545971 - DNA, 20 bp, Artificial
  CRISPR gRNA sequence
gttttaaaatacatttttta

SEQ ID NO: 545972 - DNA, 20 bp, Artificial
  CRISPR gRNA sequence
taaaatacattttttaaaga

SEQ ID NO: 545973 - DNA, 20 bp, Artificial
  CRISPR gRNA sequence
aaatacattttttaaagaaa

SEQ ID NO: 545974 - DNA, 20 bp, Artificial
  CRISPR gRNA sequence
tcctgtttgaaactcttcta

SEQ ID NO: 545975 - DNA, 20 bp, Artificial
  CRISPR gRNA sequence
ggctttctttacttcaatac

SEQ ID NO: 545976 - DNA, 20 bp, Artificial
  CRISPR gRNA sequence
gtgtttgtttgatgccttgc

SEQ ID NO: 545977 - DNA, 20 bp, Artificial
  CRISPR gRNA sequence
tgtttgtttgatgccttgca

SEQ ID NO: 545978 - DNA, 20 bp, Artificial
  CRISPR gRNA sequence
gtttgtttgatgccttgcaa

SEQ ID NO: 545979 - DNA, 20 bp, Artificial
  CRISPR gRNA sequence
gtttgatgccttgcaagggc

SEQ ID NO: 545980 - DNA, 20 bp, Artificial
  CRISPR gRNA sequence
gctggctgtgcttgtgtatg

SEQ ID NO: 545981 - DNA, 20 bp, Artificial
  CRISPR gRNA sequence
ctgtgcttgtgtatgcagct

SEQ ID NO: 545982 - DNA, 20 bp, Artificial
  CRISPR gRNA sequence
catgccattgctcctgcttc

SEQ ID NO: 545983 - DNA, 20 bp, Artificial
  CRISPR gRNA sequence
atgccattgctcctgcttca

SEQ ID NO: 545984 - DNA, 20 bp, Artificial
  CRISPR gRNA sequence
ctgcataattgttctcttaa

SEQ ID NO: 545985 - DNA, 20 bp, Artificial
  CRISPR gRNA sequence
tgcataattgttctcttaat

SEQ ID NO: 545986 - DNA, 20 bp, Artificial
  CRISPR gRNA sequence
gcataattgttctcttaatg

SEQ ID NO: 545987 - DNA, 20 bp, Artificial
  CRISPR gRNA sequence
ggggacctgccctgctctcc

SEQ ID NO: 545988 - DNA, 20 bp, Artificial
  CRISPR gRNA sequence
gggacctgccctgctctcct

SEQ ID NO: 545989 - DNA, 20 bp, Artificial
  CRISPR gRNA sequence
ctgccctgctctcctgggca

SEQ ID NO: 545990 - DNA, 20 bp, Artificial
  CRISPR gRNA sequence
gttaactgctgcttgtgcct

SEQ ID NO: 545991 - DNA, 20 bp, Artificial
  CRISPR gRNA sequence
ttgtgcctcagaacttcttt

SEQ ID NO: 545992 - DNA, 20 bp, Artificial
  CRISPR gRNA sequence
tgtgcctcagaacttctttt

SEQ ID NO: 545993 - DNA, 20 bp, Artificial
  CRISPR gRNA sequence
gtgcctcagaacttctttta

SEQ ID NO: 545994 - DNA, 20 bp, Artificial
  CRISPR gRNA sequence
cctcagaacttcttttaggg

SEQ ID NO: 545995 - DNA, 20 bp, Artificial
  CRISPR gRNA sequence
ctcagaacttcttttaggga

SEQ ID NO: 545996 - DNA, 20 bp, Artificial
  CRISPR gRNA sequence
tcagaacttcttttagggaa

SEQ ID NO: 545997 - DNA, 20 bp, Artificial
  CRISPR gRNA sequence
tgccttccctaaccccttgt

SEQ ID NO: 545998 - DNA, 20 bp, Artificial
  CRISPR gRNA sequence
taaccccttgttagttccct

SEQ ID NO: 545999 - DNA, 20 bp, Artificial
  CRISPR gRNA sequence
tgacacctgatgcttttact

SEQ ID NO: 546000 - DNA, 20 bp, Artificial
  CRISPR gRNA sequence
cacctgatgcttttacttag

SEQ ID NO: 546001 - DNA, 20 bp, Artificial
  CRISPR gRNA sequence
ttacttagcagcaattatca

SEQ ID NO: 546002 - DNA, 20 bp, Artificial
  CRISPR gRNA sequence
agcagcaattatcacagttg

SEQ ID NO: 546003 - DNA, 20 bp, Artificial
  CRISPR gRNA sequence
gcaattatcacagttgcagt

SEQ ID NO: 546004 - DNA, 20 bp, Artificial
  CRISPR gRNA sequence
caattatcacagttgcagtt

SEQ ID NO: 546005 - DNA, 20 bp, Artificial
  CRISPR gRNA sequence
gtaaattctgcctcccctaa

SEQ ID NO: 546006 - DNA, 20 bp, Artificial
  CRISPR gRNA sequence
cctaatagaatgtcaactct

SEQ ID NO: 546007 - DNA, 20 bp, Artificial
  CRISPR gRNA sequence
aatagaatgtcaactctaag

SEQ ID NO: 546008 - DNA, 20 bp, Artificial
  CRISPR gRNA sequence
atagaatgtcaactctaaga

SEQ ID NO: 546009 - DNA, 20 bp, Artificial
  CRISPR gRNA sequence
gaatgtcaactctaagaagg

SEQ ID NO: 546010 - DNA, 20 bp, Artificial
  CRISPR gRNA sequence
aatgtcaactctaagaagga

SEQ ID NO: 546011 - DNA, 20 bp, Artificial
  CRISPR gRNA sequence
atgtcaactctaagaaggaa

SEQ ID NO: 546012 - DNA, 20 bp, Artificial
  CRISPR gRNA sequence
caactctaagaaggaaggga

SEQ ID NO: 546013 - DNA, 20 bp, Artificial
  CRISPR gRNA sequence
acggtgtctgtcttgttctc

SEQ ID NO: 546014 - DNA, 20 bp, Artificial
  CRISPR gRNA sequence
cggtgtctgtcttgttctca

SEQ ID NO: 546015 - DNA, 20 bp, Artificial
  CRISPR gRNA sequence
ttgttctcaaggatcttata

SEQ ID NO: 546016 - DNA, 20 bp, Artificial
  CRISPR gRNA sequence
ctcaaggatcttatatagaa

SEQ ID NO: 546017 - DNA, 20 bp, Artificial
  CRISPR gRNA sequence
atgcccaatgaatatttcct

SEQ ID NO: 546018 - DNA, 20 bp, Artificial
  CRISPR gRNA sequence
aatgaatcccatcctgaatg

SEQ ID NO: 546019 - DNA, 20 bp, Artificial
  CRISPR gRNA sequence
atgaatcccatcctgaatgt

SEQ ID NO: 546020 - DNA, 20 bp, Artificial
  CRISPR gRNA sequence
gtgggaccacgctgttctga

SEQ ID NO: 546021 - DNA, 20 bp, Artificial
  CRISPR gRNA sequence
tgggaccacgctgttctgaa

SEQ ID NO: 546022 - DNA, 20 bp, Artificial
  CRISPR gRNA sequence
gggaccacgctgttctgaaa

SEQ ID NO: 546023 - DNA, 20 bp, Artificial
  CRISPR gRNA sequence
gttctgaaagggcactgacc

SEQ ID NO: 546024 - DNA, 20 bp, Artificial
  CRISPR gRNA sequence
ttctgaaagggcactgacca

SEQ ID NO: 546025 - DNA, 20 bp, Artificial
  CRISPR gRNA sequence
ctgaaagggcactgaccaag

SEQ ID NO: 546026 - DNA, 20 bp, Artificial
  CRISPR gRNA sequence
aagggcactgaccaaggagt

SEQ ID NO: 546027 - DNA, 20 bp, Artificial
  CRISPR gRNA sequence
gagtcagacaatgtgtgttc

SEQ ID NO: 546028 - DNA, 20 bp, Artificial
  CRISPR gRNA sequence
tgtgccgccataaacttgct

SEQ ID NO: 546029 - DNA, 20 bp, Artificial
  CRISPR gRNA sequence
tgccgccataaacttgctga

SEQ ID NO: 546030 - DNA, 20 bp, Artificial
  CRISPR gRNA sequence
cataaacttgctgagagaca

SEQ ID NO: 546031 - DNA, 20 bp, Artificial
  CRISPR gRNA sequence
taaacttgctgagagacatg

SEQ ID NO: 546032 - DNA, 20 bp, Artificial
  CRISPR gRNA sequence
cttgctgagagacatggagc

SEQ ID NO: 546033 - DNA, 20 bp, Artificial
  CRISPR gRNA sequence
ttgctgagagacatggagca

SEQ ID NO: 546034 - DNA, 20 bp, Artificial
  CRISPR gRNA sequence
gagcaaggtgatatgcctct

SEQ ID NO: 546035 - DNA, 20 bp, Artificial
  CRISPR gRNA sequence
gcaaggtgatatgcctcttg

SEQ ID NO: 546036 - DNA, 20 bp, Artificial
  CRISPR gRNA sequence
cctgctttcctacctgtaaa

SEQ ID NO: 546037 - DNA, 20 bp, Artificial
  CRISPR gRNA sequence
ctgctttcctacctgtaaat

SEQ ID NO: 546038 - DNA, 20 bp, Artificial
  CRISPR gRNA sequence
tgctttcctacctgtaaatg

SEQ ID NO: 546039 - DNA, 20 bp, Artificial
  CRISPR gRNA sequence
ggggttaataacacctactg

SEQ ID NO: 546040 - DNA, 20 bp, Artificial
  CRISPR gRNA sequence
gggttaataacacctactgc

SEQ ID NO: 546041 - DNA, 20 bp, Artificial
  CRISPR gRNA sequence
ttaataacacctactgcagg

SEQ ID NO: 546042 - DNA, 20 bp, Artificial
  CRISPR gRNA sequence
acacctactgcaggtagaca

SEQ ID NO: 546043 - DNA, 20 bp, Artificial
  CRISPR gRNA sequence
acctactgcaggtagacatg

SEQ ID NO: 546044 - DNA, 20 bp, Artificial
  CRISPR gRNA sequence
ctactgcaggtagacatgga

SEQ ID NO: 546045 - DNA, 20 bp, Artificial
  CRISPR gRNA sequence
tactgcaggtagacatggag

SEQ ID NO: 546046 - DNA, 20 bp, Artificial
  CRISPR gRNA sequence
actgcaggtagacatggaga

SEQ ID NO: 546047 - DNA, 20 bp, Artificial
  CRISPR gRNA sequence
tagacatggagagggataaa

SEQ ID NO: 546048 - DNA, 20 bp, Artificial
  CRISPR gRNA sequence
agacatggagagggataaaa

SEQ ID NO: 546049 - DNA, 20 bp, Artificial
  CRISPR gRNA sequence
agagggataaaaaggaatac

SEQ ID NO: 546050 - DNA, 20 bp, Artificial
  CRISPR gRNA sequence
agacaatgtgaacatataac

SEQ ID NO: 546051 - DNA, 20 bp, Artificial
  CRISPR gRNA sequence
caatgtgaacatataaccag

SEQ ID NO: 546052 - DNA, 20 bp, Artificial
  CRISPR gRNA sequence
atgtgaacatataaccagca

SEQ ID NO: 546053 - DNA, 20 bp, Artificial
  CRISPR gRNA sequence
gtgaacatataaccagcaga

SEQ ID NO: 546054 - DNA, 20 bp, Artificial
  CRISPR gRNA sequence
acatataaccagcagagagt

SEQ ID NO: 546055 - DNA, 20 bp, Artificial
  CRISPR gRNA sequence
aaattgccttatatttttct

SEQ ID NO: 546056 - DNA, 20 bp, Artificial
  CRISPR gRNA sequence
ttggtgtcttgtcacttcac

SEQ ID NO: 546057 - DNA, 20 bp, Artificial
  CRISPR gRNA sequence
ttgtcacttcaccagtgaaa

SEQ ID NO: 546058 - DNA, 20 bp, Artificial
  CRISPR gRNA sequence
tgtcacttcaccagtgaaat

SEQ ID NO: 546059 - DNA, 20 bp, Artificial
  CRISPR gRNA sequence
tcacttcaccagtgaaatgg

SEQ ID NO: 546060 - DNA, 20 bp, Artificial
  CRISPR gRNA sequence
taatttgactaaataatttt

SEQ ID NO: 546061 - DNA, 20 bp, Artificial
  CRISPR gRNA sequence
atttgactaaataattttta

SEQ ID NO: 546062 - DNA, 20 bp, Artificial
  CRISPR gRNA sequence
ataatttttagagtttcttc

SEQ ID NO: 546063 - DNA, 20 bp, Artificial
  CRISPR gRNA sequence
tttcttctagttcaaaatta

SEQ ID NO: 546064 - DNA, 20 bp, Artificial
  CRISPR gRNA sequence
tagttgacccttgaacaaca

SEQ ID NO: 546065 - DNA, 20 bp, Artificial
  CRISPR gRNA sequence
cccttgaacaacatggcaat

SEQ ID NO: 546066 - DNA, 20 bp, Artificial
  CRISPR gRNA sequence
ccttgaacaacatggcaatt

SEQ ID NO: 546067 - DNA, 20 bp, Artificial
  CRISPR gRNA sequence
cttgaacaacatggcaatta

SEQ ID NO: 546068 - DNA, 20 bp, Artificial
  CRISPR gRNA sequence
ttgaacaacatggcaattag

SEQ ID NO: 546069 - DNA, 20 bp, Artificial
  CRISPR gRNA sequence
attaggggcaccaacccctt

SEQ ID NO: 546070 - DNA, 20 bp, Artificial
  CRISPR gRNA sequence
aggggcaccaaccccttgag

SEQ ID NO: 546071 - DNA, 20 bp, Artificial
  CRISPR gRNA sequence
cccaaaaacttaactgctaa

SEQ ID NO: 546072 - DNA, 20 bp, Artificial
  CRISPR gRNA sequence
cttaactgctaatagcctac

SEQ ID NO: 546073 - DNA, 20 bp, Artificial
  CRISPR gRNA sequence
aactgctaatagcctaccag

SEQ ID NO: 546074 - DNA, 20 bp, Artificial
  CRISPR gRNA sequence
ttgtattcttacactaaatt

SEQ ID NO: 546075 - DNA, 20 bp, Artificial
  CRISPR gRNA sequence
attcttacactaaattaagc

SEQ ID NO: 546076 - DNA, 20 bp, Artificial
  CRISPR gRNA sequence
tcttacactaaattaagcta

SEQ ID NO: 546077 - DNA, 20 bp, Artificial
  CRISPR gRNA sequence
cactaaattaagctagagaa

SEQ ID NO: 546078 - DNA, 20 bp, Artificial
  CRISPR gRNA sequence
agctagagaaaagaacttat

SEQ ID NO: 546079 - DNA, 20 bp, Artificial
  CRISPR gRNA sequence
gctagagaaaagaacttatt

SEQ ID NO: 546080 - DNA, 20 bp, Artificial
  CRISPR gRNA sequence
agaaaagaacttattaggaa

SEQ ID NO: 546081 - DNA, 20 bp, Artificial
  CRISPR gRNA sequence
gaacttattaggaaaagcat

SEQ ID NO: 546082 - DNA, 20 bp, Artificial
  CRISPR gRNA sequence
aacttattaggaaaagcata

SEQ ID NO: 546083 - DNA, 20 bp, Artificial
  CRISPR gRNA sequence
attaggaaaagcataaggtg

SEQ ID NO: 546084 - DNA, 20 bp, Artificial
  CRISPR gRNA sequence
aggaaaagcataaggtgtag

SEQ ID NO: 546085 - DNA, 20 bp, Artificial
  CRISPR gRNA sequence
aaggtgtagaagaatgaaac

SEQ ID NO: 546086 - DNA, 20 bp, Artificial
  CRISPR gRNA sequence
ccttatataaaaatcaactc

SEQ ID NO: 546087 - DNA, 20 bp, Artificial
  CRISPR gRNA sequence
cttatataaaaatcaactca

SEQ ID NO: 546088 - DNA, 20 bp, Artificial
  CRISPR gRNA sequence
atataaaaatcaactcaagg

SEQ ID NO: 546089 - DNA, 20 bp, Artificial
  CRISPR gRNA sequence
tggatcaaaaacttaaatct

SEQ ID NO: 546090 - DNA, 20 bp, Artificial
  CRISPR gRNA sequence
aaacttaaatctaagacctg

SEQ ID NO: 546091 - DNA, 20 bp, Artificial
  CRISPR gRNA sequence
acctgaagccataaaaattc

SEQ ID NO: 546092 - DNA, 20 bp, Artificial
  CRISPR gRNA sequence
tgaagccataaaaattctag

SEQ ID NO: 546093 - DNA, 20 bp, Artificial
  CRISPR gRNA sequence
aaaattctagaagataacat

SEQ ID NO: 546094 - DNA, 20 bp, Artificial
  CRISPR gRNA sequence
taacatcagaaaaactcttc

SEQ ID NO: 546095 - DNA, 20 bp, Artificial
  CRISPR gRNA sequence
agaaaaactcttctagactt

SEQ ID NO: 546096 - DNA, 20 bp, Artificial
  CRISPR gRNA sequence
aactcttctagactttggct

SEQ ID NO: 546097 - DNA, 20 bp, Artificial
  CRISPR gRNA sequence
actcttctagactttggctt

SEQ ID NO: 546098 - DNA, 20 bp, Artificial
  CRISPR gRNA sequence
ctagactttggcttaggcaa

SEQ ID NO: 546099 - DNA, 20 bp, Artificial
  CRISPR gRNA sequence
tagactttggcttaggcaaa

SEQ ID NO: 546100 - DNA, 20 bp, Artificial
  CRISPR gRNA sequence
ttaggcaaaaggtcatgacc

SEQ ID NO: 546101 - DNA, 20 bp, Artificial
  CRISPR gRNA sequence
aaacaaatgcaacaaaaaca

SEQ ID NO: 546102 - DNA, 20 bp, Artificial
  CRISPR gRNA sequence
gcaacaaaaacaaagataaa

SEQ ID NO: 546103 - DNA, 20 bp, Artificial
  CRISPR gRNA sequence
caaaaacaaagataaataga

SEQ ID NO: 546104 - DNA, 20 bp, Artificial
  CRISPR gRNA sequence
aaaaacaaagataaatagat

SEQ ID NO: 546105 - DNA, 20 bp, Artificial
  CRISPR gRNA sequence
aaaacaaagataaatagatg

SEQ ID NO: 546106 - DNA, 20 bp, Artificial
  CRISPR gRNA sequence
tagatggggcttaaattaaa

SEQ ID NO: 546107 - DNA, 20 bp, Artificial
  CRISPR gRNA sequence
taaattaaaaagcttctgta

SEQ ID NO: 546108 - DNA, 20 bp, Artificial
  CRISPR gRNA sequence
tgtacagcaatataaacaat

SEQ ID NO: 546109 - DNA, 20 bp, Artificial
  CRISPR gRNA sequence
acagcaatataaacaatcag

SEQ ID NO: 546110 - DNA, 20 bp, Artificial
  CRISPR gRNA sequence
agcaatataaacaatcagca

SEQ ID NO: 546111 - DNA, 20 bp, Artificial
  CRISPR gRNA sequence
gagtaaacacacaacccaca

SEQ ID NO: 546112 - DNA, 20 bp, Artificial
  CRISPR gRNA sequence
taaacacacaacccacaaag

SEQ ID NO: 546113 - DNA, 20 bp, Artificial
  CRISPR gRNA sequence
aaacacacaacccacaaagt

SEQ ID NO: 546114 - DNA, 20 bp, Artificial
  CRISPR gRNA sequence
acacacaacccacaaagtgg

SEQ ID NO: 546115 - DNA, 20 bp, Artificial
  CRISPR gRNA sequence
cacaaactatgtatctgaca

SEQ ID NO: 546116 - DNA, 20 bp, Artificial
  CRISPR gRNA sequence
acaaactatgtatctgacaa

SEQ ID NO: 546117 - DNA, 20 bp, Artificial
  CRISPR gRNA sequence
tctgacaaaggaccaatatc

SEQ ID NO: 546118 - DNA, 20 bp, Artificial
  CRISPR gRNA sequence
gaccaatatccagaatctat

SEQ ID NO: 546119 - DNA, 20 bp, Artificial
  CRISPR gRNA sequence
accaatatccagaatctata

SEQ ID NO: 546120 - DNA, 20 bp, Artificial
  CRISPR gRNA sequence
aatatccagaatctataagg

SEQ ID NO: 546121 - DNA, 20 bp, Artificial
  CRISPR gRNA sequence
tataaggaagtcaaacaaat

SEQ ID NO: 546122 - DNA, 20 bp, Artificial
  CRISPR gRNA sequence
aggaagtcaaacaaatcagc

SEQ ID NO: 546123 - DNA, 20 bp, Artificial
  CRISPR gRNA sequence
caaacaaatcagcaagaaaa

SEQ ID NO: 546124 - DNA, 20 bp, Artificial
  CRISPR gRNA sequence
aagcaaacaatcccatcaaa

SEQ ID NO: 546125 - DNA, 20 bp, Artificial
  CRISPR gRNA sequence
caaacaatcccatcaaaaag

SEQ ID NO: 546126 - DNA, 20 bp, Artificial
  CRISPR gRNA sequence
aaacaatcccatcaaaaagt

SEQ ID NO: 546127 - DNA, 20 bp, Artificial
  CRISPR gRNA sequence
atcccatcaaaaagtgggcc

SEQ ID NO: 546128 - DNA, 20 bp, Artificial
  CRISPR gRNA sequence
tcccatcaaaaagtgggcca

SEQ ID NO: 546129 - DNA, 20 bp, Artificial
  CRISPR gRNA sequence
aagtgggccaaggacatgaa

SEQ ID NO: 546130 - DNA, 20 bp, Artificial
  CRISPR gRNA sequence
gggccaaggacatgaataga

SEQ ID NO: 546131 - DNA, 20 bp, Artificial
  CRISPR gRNA sequence
acatgaatagacagttctca

SEQ ID NO: 546132 - DNA, 20 bp, Artificial
  CRISPR gRNA sequence
catgaatagacagttctcaa

SEQ ID NO: 546133 - DNA, 20 bp, Artificial
  CRISPR gRNA sequence
tgaatagacagttctcaaag

SEQ ID NO: 546134 - DNA, 20 bp, Artificial
  CRISPR gRNA sequence
gaatagacagttctcaaagg

SEQ ID NO: 546135 - DNA, 20 bp, Artificial
  CRISPR gRNA sequence
ctcaaaggaggatatacaaa

SEQ ID NO: 546136 - DNA, 20 bp, Artificial
  CRISPR gRNA sequence
tgctcaacattactaattat

SEQ ID NO: 546137 - DNA, 20 bp, Artificial
  CRISPR gRNA sequence
gctcaacattactaattatc

SEQ ID NO: 546138 - DNA, 20 bp, Artificial
  CRISPR gRNA sequence
ctcaacattactaattatca

SEQ ID NO: 546139 - DNA, 20 bp, Artificial
  CRISPR gRNA sequence
caataccaccttactcctgc

SEQ ID NO: 546140 - DNA, 20 bp, Artificial
  CRISPR gRNA sequence
ccaccttactcctgcaagaa

SEQ ID NO: 546141 - DNA, 20 bp, Artificial
  CRISPR gRNA sequence
atttaaaaatcaaaaaataa

SEQ ID NO: 546142 - DNA, 20 bp, Artificial
  CRISPR gRNA sequence
aatcaaaaaataatagatgt

SEQ ID NO: 546143 - DNA, 20 bp, Artificial
  CRISPR gRNA sequence
aaaaataatagatgttggca

SEQ ID NO: 546144 - DNA, 20 bp, Artificial
  CRISPR gRNA sequence
aaaataatagatgttggcat

SEQ ID NO: 546145 - DNA, 20 bp, Artificial
  CRISPR gRNA sequence
aatagatgttggcatgggtg

SEQ ID NO: 546146 - DNA, 20 bp, Artificial
  CRISPR gRNA sequence
agatgttggcatgggtgtgg

SEQ ID NO: 546147 - DNA, 20 bp, Artificial
  CRISPR gRNA sequence
gatgttggcatgggtgtggt

SEQ ID NO: 546148 - DNA, 20 bp, Artificial
  CRISPR gRNA sequence
tggcatgggtgtggtgggaa

SEQ ID NO: 546149 - DNA, 20 bp, Artificial
  CRISPR gRNA sequence
ggcatgggtgtggtgggaaa

SEQ ID NO: 546150 - DNA, 20 bp, Artificial
  CRISPR gRNA sequence
gcatgggtgtggtgggaaaa

SEQ ID NO: 546151 - DNA, 20 bp, Artificial
  CRISPR gRNA sequence
agggaacacctgtacactgc

SEQ ID NO: 546152 - DNA, 20 bp, Artificial
  CRISPR gRNA sequence
gaacacctgtacactgctgg

SEQ ID NO: 546153 - DNA, 20 bp, Artificial
  CRISPR gRNA sequence
aacacctgtacactgctggt

SEQ ID NO: 546154 - DNA, 20 bp, Artificial
  CRISPR gRNA sequence
ctgctggtgggaatgtaaac

SEQ ID NO: 546155 - DNA, 20 bp, Artificial
  CRISPR gRNA sequence
gtaaactagtacaaccacta

SEQ ID NO: 546156 - DNA, 20 bp, Artificial
  CRISPR gRNA sequence
aaactagtacaaccactatg

SEQ ID NO: 546157 - DNA, 20 bp, Artificial
  CRISPR gRNA sequence
aaccactatggagatttctt

SEQ ID NO: 546158 - DNA, 20 bp, Artificial
  CRISPR gRNA sequence
gagatttcttaagcaactaa

SEQ ID NO: 546159 - DNA, 20 bp, Artificial
  CRISPR gRNA sequence
atttcttaagcaactaaaag

SEQ ID NO: 546160 - DNA, 20 bp, Artificial
  CRISPR gRNA sequence
agtagaactaccatttgatc

SEQ ID NO: 546161 - DNA, 20 bp, Artificial
  CRISPR gRNA sequence
tgatccagcaatcccattac

SEQ ID NO: 546162 - DNA, 20 bp, Artificial
  CRISPR gRNA sequence
gatccagcaatcccattact

SEQ ID NO: 546163 - DNA, 20 bp, Artificial
  CRISPR gRNA sequence
cccattactgggtatctacc

SEQ ID NO: 546164 - DNA, 20 bp, Artificial
  CRISPR gRNA sequence
cattactgggtatctaccca

SEQ ID NO: 546165 - DNA, 20 bp, Artificial
  CRISPR gRNA sequence
attactgggtatctacccag

SEQ ID NO: 546166 - DNA, 20 bp, Artificial
  CRISPR gRNA sequence
gtatctacccagaggaaaac

SEQ ID NO: 546167 - DNA, 20 bp, Artificial
  CRISPR gRNA sequence
aaacaagtcattttatgaaa

SEQ ID NO: 546168 - DNA, 20 bp, Artificial
  CRISPR gRNA sequence
tgttgcacacaacatcttta

SEQ ID NO: 546169 - DNA, 20 bp, Artificial
  CRISPR gRNA sequence
tgcacacaacatctttatag

SEQ ID NO: 546170 - DNA, 20 bp, Artificial
  CRISPR gRNA sequence
aactcgcaattgcaaaaata

SEQ ID NO: 546171 - DNA, 20 bp, Artificial
  CRISPR gRNA sequence
caattgcaaaaatatggaat

SEQ ID NO: 546172 - DNA, 20 bp, Artificial
  CRISPR gRNA sequence
ataaatgcccatcaatcaat

SEQ ID NO: 546173 - DNA, 20 bp, Artificial
  CRISPR gRNA sequence
aatgcccatcaatcaatgag

SEQ ID NO: 546174 - DNA, 20 bp, Artificial
  CRISPR gRNA sequence
catcaatcaatgagtggata

SEQ ID NO: 546175 - DNA, 20 bp, Artificial
  CRISPR gRNA sequence
atgagtggataaagaaaatg

SEQ ID NO: 546176 - DNA, 20 bp, Artificial
  CRISPR gRNA sequence
tgagtggataaagaaaatgt

SEQ ID NO: 546177 - DNA, 20 bp, Artificial
  CRISPR gRNA sequence
agtggataaagaaaatgtgg

SEQ ID NO: 546178 - DNA, 20 bp, Artificial
  CRISPR gRNA sequence
atatatgaatatgccataaa

SEQ ID NO: 546179 - DNA, 20 bp, Artificial
  CRISPR gRNA sequence
tatatgaatatgccataaaa

SEQ ID NO: 546180 - DNA, 20 bp, Artificial
  CRISPR gRNA sequence
tgccataaaaaggaacataa

SEQ ID NO: 546181 - DNA, 20 bp, Artificial
  CRISPR gRNA sequence
gccataaaaaggaacataat

SEQ ID NO: 546182 - DNA, 20 bp, Artificial
  CRISPR gRNA sequence
taaaaaggaacataataggc

SEQ ID NO: 546183 - DNA, 20 bp, Artificial
  CRISPR gRNA sequence
aaaaaggaacataataggcc

SEQ ID NO: 546184 - DNA, 20 bp, Artificial
  CRISPR gRNA sequence
ggaacataataggccaggcg

SEQ ID NO: 546185 - DNA, 20 bp, Artificial
  CRISPR gRNA sequence
acataataggccaggcgcgg

SEQ ID NO: 546186 - DNA, 20 bp, Artificial
  CRISPR gRNA sequence
gtggctcgtgtctgtaatcc

SEQ ID NO: 546187 - DNA, 20 bp, Artificial
  CRISPR gRNA sequence
tgtctgtaatcccagcactt

SEQ ID NO: 546188 - DNA, 20 bp, Artificial
  CRISPR gRNA sequence
gtctgtaatcccagcacttt

SEQ ID NO: 546189 - DNA, 20 bp, Artificial
  CRISPR gRNA sequence
ctgtaatcccagcactttgg

SEQ ID NO: 546190 - DNA, 20 bp, Artificial
  CRISPR gRNA sequence
tgtaatcccagcactttggg

SEQ ID NO: 546191 - DNA, 20 bp, Artificial
  CRISPR gRNA sequence
tcccagcactttgggaggcc

SEQ ID NO: 546192 - DNA, 20 bp, Artificial
  CRISPR gRNA sequence
cccagcactttgggaggcca

SEQ ID NO: 546193 - DNA, 20 bp, Artificial
  CRISPR gRNA sequence
agcactttgggaggccaagg

SEQ ID NO: 546194 - DNA, 20 bp, Artificial
  CRISPR gRNA sequence
gcactttgggaggccaaggc

SEQ ID NO: 546195 - DNA, 20 bp, Artificial
  CRISPR gRNA sequence
ctttgggaggccaaggcggg

SEQ ID NO: 546196 - DNA, 20 bp, Artificial
  CRISPR gRNA sequence
ggccaaggcgggcagatcac

SEQ ID NO: 546197 - DNA, 20 bp, Artificial
  CRISPR gRNA sequence
gccaaggcgggcagatcacg

SEQ ID NO: 546198 - DNA, 20 bp, Artificial
  CRISPR gRNA sequence
aggcgggcagatcacgaggt

SEQ ID NO: 546199 - DNA, 20 bp, Artificial
  CRISPR gRNA sequence
ggcgggcagatcacgaggtc

SEQ ID NO: 546200 - DNA, 20 bp, Artificial
  CRISPR gRNA sequence
cgggcagatcacgaggtcag

SEQ ID NO: 546201 - DNA, 20 bp, Artificial
  CRISPR gRNA sequence
gatcacgaggtcaggagatc

SEQ ID NO: 546202 - DNA, 20 bp, Artificial
  CRISPR gRNA sequence
tcaggagatcgagaccatcc

SEQ ID NO: 546203 - DNA, 20 bp, Artificial
  CRISPR gRNA sequence
cgagaccatcctggctaaca

SEQ ID NO: 546204 - DNA, 20 bp, Artificial
  CRISPR gRNA sequence
taaaaatacaaaaaaaaaat

SEQ ID NO: 546205 - DNA, 20 bp, Artificial
  CRISPR gRNA sequence
aatacaaaaaaaaaattagc

SEQ ID NO: 546206 - DNA, 20 bp, Artificial
  CRISPR gRNA sequence
atacaaaaaaaaaattagcc

SEQ ID NO: 546207 - DNA, 20 bp, Artificial
  CRISPR gRNA sequence
aaaaaaaaattagccgggca

SEQ ID NO: 546208 - DNA, 20 bp, Artificial
  CRISPR gRNA sequence
aaaaaattagccgggcatgg

SEQ ID NO: 546209 - DNA, 20 bp, Artificial
  CRISPR gRNA sequence
aaattagccgggcatggtgg

SEQ ID NO: 546210 - DNA, 20 bp, Artificial
  CRISPR gRNA sequence
aattagccgggcatggtggt

SEQ ID NO: 546211 - DNA, 20 bp, Artificial
  CRISPR gRNA sequence
ggcatggtggtgggcgcctg

SEQ ID NO: 546212 - DNA, 20 bp, Artificial
  CRISPR gRNA sequence
gtggtgggcgcctgtagtcc

SEQ ID NO: 546213 - DNA, 20 bp, Artificial
  CRISPR gRNA sequence
cgcctgtagtcccagctact

SEQ ID NO: 546214 - DNA, 20 bp, Artificial
  CRISPR gRNA sequence
gcctgtagtcccagctactc

SEQ ID NO: 546215 - DNA, 20 bp, Artificial
  CRISPR gRNA sequence
ctgtagtcccagctactcag

SEQ ID NO: 546216 - DNA, 20 bp, Artificial
  CRISPR gRNA sequence
tgtagtcccagctactcagg

SEQ ID NO: 546217 - DNA, 20 bp, Artificial
  CRISPR gRNA sequence
tcccagctactcaggaggct

SEQ ID NO: 546218 - DNA, 20 bp, Artificial
  CRISPR gRNA sequence
cccagctactcaggaggctg

SEQ ID NO: 546219 - DNA, 20 bp, Artificial
  CRISPR gRNA sequence
agctactcaggaggctgagg

SEQ ID NO: 546220 - DNA, 20 bp, Artificial
  CRISPR gRNA sequence
gctactcaggaggctgaggc

SEQ ID NO: 546221 - DNA, 20 bp, Artificial
  CRISPR gRNA sequence
tactcaggaggctgaggcag

SEQ ID NO: 546222 - DNA, 20 bp, Artificial
  CRISPR gRNA sequence
aggaggctgaggcaggagaa

SEQ ID NO: 546223 - DNA, 20 bp, Artificial
  CRISPR gRNA sequence
ctgaggcaggagaatggcgt

SEQ ID NO: 546224 - DNA, 20 bp, Artificial
  CRISPR gRNA sequence
gcaggagaatggcgtgagcc

SEQ ID NO: 546225 - DNA, 20 bp, Artificial
  CRISPR gRNA sequence
caggagaatggcgtgagcct

SEQ ID NO: 546226 - DNA, 20 bp, Artificial
  CRISPR gRNA sequence
ggagaatggcgtgagcctgg

SEQ ID NO: 546227 - DNA, 20 bp, Artificial
  CRISPR gRNA sequence
gagaatggcgtgagcctggg

SEQ ID NO: 546228 - DNA, 20 bp, Artificial
  CRISPR gRNA sequence
aatggcgtgagcctgggagg

SEQ ID NO: 546229 - DNA, 20 bp, Artificial
  CRISPR gRNA sequence
agcctgggaggtggaacttt

SEQ ID NO: 546230 - DNA, 20 bp, Artificial
  CRISPR gRNA sequence
tgggaggtggaacttttagt

SEQ ID NO: 546231 - DNA, 20 bp, Artificial
  CRISPR gRNA sequence
ggtggaacttttagtgagcc

SEQ ID NO: 546232 - DNA, 20 bp, Artificial
  CRISPR gRNA sequence
gagatcacgccactgcactc

SEQ ID NO: 546233 - DNA, 20 bp, Artificial
  CRISPR gRNA sequence
cacgccactgcactccagcc

SEQ ID NO: 546234 - DNA, 20 bp, Artificial
  CRISPR gRNA sequence
acgccactgcactccagcct

SEQ ID NO: 546235 - DNA, 20 bp, Artificial
  CRISPR gRNA sequence
cgccactgcactccagcctg

SEQ ID NO: 546236 - DNA, 20 bp, Artificial
  CRISPR gRNA sequence
actgcactccagcctgggga

SEQ ID NO: 546237 - DNA, 20 bp, Artificial
  CRISPR gRNA sequence
tgcactccagcctggggaca

SEQ ID NO: 546238 - DNA, 20 bp, Artificial
  CRISPR gRNA sequence
ctccagcctggggacagagc

SEQ ID NO: 546239 - DNA, 20 bp, Artificial
  CRISPR gRNA sequence
agagcgagactctgtctcaa

SEQ ID NO: 546240 - DNA, 20 bp, Artificial
  CRISPR gRNA sequence
caaaagaaaaaaaaaaaaaa

SEQ ID NO: 546241 - DNA, 20 bp, Artificial
  CRISPR gRNA sequence
aaaaaaaaagaacaaaataa

SEQ ID NO: 546242 - DNA, 20 bp, Artificial
  CRISPR gRNA sequence
gaacaaaataatggcattca

SEQ ID NO: 546243 - DNA, 20 bp, Artificial
  CRISPR gRNA sequence
taatggcattcacagcaacc

SEQ ID NO: 546244 - DNA, 20 bp, Artificial
  CRISPR gRNA sequence
ggcattcacagcaacctgga

SEQ ID NO: 546245 - DNA, 20 bp, Artificial
  CRISPR gRNA sequence
cacagcaacctggatggaac

SEQ ID NO: 546246 - DNA, 20 bp, Artificial
  CRISPR gRNA sequence
cagcaacctggatggaactg

SEQ ID NO: 546247 - DNA, 20 bp, Artificial
  CRISPR gRNA sequence
gaactggagaccattattct

SEQ ID NO: 546248 - DNA, 20 bp, Artificial
  CRISPR gRNA sequence
ggagaccattattctaagtg

SEQ ID NO: 546249 - DNA, 20 bp, Artificial
  CRISPR gRNA sequence
ttattctaagtgaagtaact

SEQ ID NO: 546250 - DNA, 20 bp, Artificial
  CRISPR gRNA sequence
tattctaagtgaagtaactc

SEQ ID NO: 546251 - DNA, 20 bp, Artificial
  CRISPR gRNA sequence
taagtgaagtaactcaggaa

SEQ ID NO: 546252 - DNA, 20 bp, Artificial
  CRISPR gRNA sequence
aaacatatgttctaacttac

SEQ ID NO: 546253 - DNA, 20 bp, Artificial
  CRISPR gRNA sequence
catatgttctaacttacaag

SEQ ID NO: 546254 - DNA, 20 bp, Artificial
  CRISPR gRNA sequence
atatgttctaacttacaagt

SEQ ID NO: 546255 - DNA, 20 bp, Artificial
  CRISPR gRNA sequence
atgttctaacttacaagtgg

SEQ ID NO: 546256 - DNA, 20 bp, Artificial
  CRISPR gRNA sequence
ctaacttacaagtgggagct

SEQ ID NO: 546257 - DNA, 20 bp, Artificial
  CRISPR gRNA sequence
aagtgggagctaagctatgt

SEQ ID NO: 546258 - DNA, 20 bp, Artificial
  CRISPR gRNA sequence
taagctatgtaagaatgata

SEQ ID NO: 546259 - DNA, 20 bp, Artificial
  CRISPR gRNA sequence
aagaatgatacagtgaactt

SEQ ID NO: 546260 - DNA, 20 bp, Artificial
  CRISPR gRNA sequence
agaatgatacagtgaacttt

SEQ ID NO: 546261 - DNA, 20 bp, Artificial
  CRISPR gRNA sequence
gaatgatacagtgaactttg

SEQ ID NO: 546262 - DNA, 20 bp, Artificial
  CRISPR gRNA sequence
cagtgaactttggggacttg

SEQ ID NO: 546263 - DNA, 20 bp, Artificial
  CRISPR gRNA sequence
gtgaactttggggacttgtg

SEQ ID NO: 546264 - DNA, 20 bp, Artificial
  CRISPR gRNA sequence
aactttggggacttgtggag

SEQ ID NO: 546265 - DNA, 20 bp, Artificial
  CRISPR gRNA sequence
actttggggacttgtggaga

SEQ ID NO: 546266 - DNA, 20 bp, Artificial
  CRISPR gRNA sequence
ctttggggacttgtggagaa

SEQ ID NO: 546267 - DNA, 20 bp, Artificial
  CRISPR gRNA sequence
tggggacttgtggagaaggg

SEQ ID NO: 546268 - DNA, 20 bp, Artificial
  CRISPR gRNA sequence
ggggacttgtggagaagggt

SEQ ID NO: 546269 - DNA, 20 bp, Artificial
  CRISPR gRNA sequence
acttgtggagaagggtggga

SEQ ID NO: 546270 - DNA, 20 bp, Artificial
  CRISPR gRNA sequence
cttgtggagaagggtgggat

SEQ ID NO: 546271 - DNA, 20 bp, Artificial
  CRISPR gRNA sequence
ttgtggagaagggtgggatg

SEQ ID NO: 546272 - DNA, 20 bp, Artificial
  CRISPR gRNA sequence
gagaagggtgggatggggat

SEQ ID NO: 546273 - DNA, 20 bp, Artificial
  CRISPR gRNA sequence
agaagggtgggatggggatg

SEQ ID NO: 546274 - DNA, 20 bp, Artificial
  CRISPR gRNA sequence
gaagggtgggatggggatga

SEQ ID NO: 546275 - DNA, 20 bp, Artificial
  CRISPR gRNA sequence
gggatggggatgagggataa

SEQ ID NO: 546276 - DNA, 20 bp, Artificial
  CRISPR gRNA sequence
agggataaaagactacacac

SEQ ID NO: 546277 - DNA, 20 bp, Artificial
  CRISPR gRNA sequence
gggataaaagactacacact

SEQ ID NO: 546278 - DNA, 20 bp, Artificial
  CRISPR gRNA sequence
aaaagactacacactgggta

SEQ ID NO: 546279 - DNA, 20 bp, Artificial
  CRISPR gRNA sequence
acactgggtacagtgtacac

SEQ ID NO: 546280 - DNA, 20 bp, Artificial
  CRISPR gRNA sequence
tacagtgtacaccagaatct

SEQ ID NO: 546281 - DNA, 20 bp, Artificial
  CRISPR gRNA sequence
cctgttcccccaaaactatt

SEQ ID NO: 546282 - DNA, 20 bp, Artificial
  CRISPR gRNA sequence
ccccaaaactattgagataa

SEQ ID NO: 546283 - DNA, 20 bp, Artificial
  CRISPR gRNA sequence
agtaataaaaaaatttaaaa

SEQ ID NO: 546284 - DNA, 20 bp, Artificial
  CRISPR gRNA sequence
aaaatttaaaaaagaaaaaa

SEQ ID NO: 546285 - DNA, 20 bp, Artificial
  CRISPR gRNA sequence
taaaaaagaaaaaaaagcat

SEQ ID NO: 546286 - DNA, 20 bp, Artificial
  CRISPR gRNA sequence
aaaaaagaaaaaaaagcata

SEQ ID NO: 546287 - DNA, 20 bp, Artificial
  CRISPR gRNA sequence
aaagaaaaaaaagcataagg

SEQ ID NO: 546288 - DNA, 20 bp, Artificial
  CRISPR gRNA sequence
aggaagaaaatatacttact

SEQ ID NO: 546289 - DNA, 20 bp, Artificial
  CRISPR gRNA sequence
aaaatatacttactaagtga

SEQ ID NO: 546290 - DNA, 20 bp, Artificial
  CRISPR gRNA sequence
atatacttactaagtgaaag

SEQ ID NO: 546291 - DNA, 20 bp, Artificial
  CRISPR gRNA sequence
taagtgaaagtggatcatca

SEQ ID NO: 546292 - DNA, 20 bp, Artificial
  CRISPR gRNA sequence
aagtgaaagtggatcatcaa

SEQ ID NO: 546293 - DNA, 20 bp, Artificial
  CRISPR gRNA sequence
tcctcattatcttcacgtta

SEQ ID NO: 546294 - DNA, 20 bp, Artificial
  CRISPR gRNA sequence
tcattatcttcacgttaaag

SEQ ID NO: 546295 - DNA, 20 bp, Artificial
  CRISPR gRNA sequence
cattatcttcacgttaaagc

SEQ ID NO: 546296 - DNA, 20 bp, Artificial
  CRISPR gRNA sequence
tcttcacgttaaagcaggct

SEQ ID NO: 546297 - DNA, 20 bp, Artificial
  CRISPR gRNA sequence
tcacgttaaagcaggctaag

SEQ ID NO: 546298 - DNA, 20 bp, Artificial
  CRISPR gRNA sequence
cacgttaaagcaggctaagt

SEQ ID NO: 546299 - DNA, 20 bp, Artificial
  CRISPR gRNA sequence
cgttaaagcaggctaagtgg

SEQ ID NO: 546300 - DNA, 20 bp, Artificial
  CRISPR gRNA sequence
gttaaagcaggctaagtggg

SEQ ID NO: 546301 - DNA, 20 bp, Artificial
  CRISPR gRNA sequence
taaagcaggctaagtgggag

SEQ ID NO: 546302 - DNA, 20 bp, Artificial
  CRISPR gRNA sequence
aaagcaggctaagtgggagg

SEQ ID NO: 546303 - DNA, 20 bp, Artificial
  CRISPR gRNA sequence
aagcaggctaagtgggagga

SEQ ID NO: 546304 - DNA, 20 bp, Artificial
  CRISPR gRNA sequence
agcaggctaagtgggaggag

SEQ ID NO: 546305 - DNA, 20 bp, Artificial
  CRISPR gRNA sequence
ggctaagtgggaggaggggt

SEQ ID NO: 546306 - DNA, 20 bp, Artificial
  CRISPR gRNA sequence
aggggttggtcttgctatct

SEQ ID NO: 546307 - DNA, 20 bp, Artificial
  CRISPR gRNA sequence
ggggttggtcttgctatctc

SEQ ID NO: 546308 - DNA, 20 bp, Artificial
  CRISPR gRNA sequence
gggttggtcttgctatctca

SEQ ID NO: 546309 - DNA, 20 bp, Artificial
  CRISPR gRNA sequence
tggtcttgctatctcaggga

SEQ ID NO: 546310 - DNA, 20 bp, Artificial
  CRISPR gRNA sequence
tcttgctatctcagggatgg

SEQ ID NO: 546311 - DNA, 20 bp, Artificial
  CRISPR gRNA sequence
ttgctatctcagggatggca

SEQ ID NO: 546312 - DNA, 20 bp, Artificial
  CRISPR gRNA sequence
tgctatctcagggatggcag

SEQ ID NO: 546313 - DNA, 20 bp, Artificial
  CRISPR gRNA sequence
tatctcagggatggcagagg

SEQ ID NO: 546314 - DNA, 20 bp, Artificial
  CRISPR gRNA sequence
ctcagggatggcagaggcgg

SEQ ID NO: 546315 - DNA, 20 bp, Artificial
  CRISPR gRNA sequence
gcggaagaaaatccacatgt

SEQ ID NO: 546316 - DNA, 20 bp, Artificial
  CRISPR gRNA sequence
gaagaaaatccacatgtaag

SEQ ID NO: 546317 - DNA, 20 bp, Artificial
  CRISPR gRNA sequence
cacatgtaagtggacccaca

SEQ ID NO: 546318 - DNA, 20 bp, Artificial
  CRISPR gRNA sequence
agctcaaacccatgttgttc

SEQ ID NO: 546319 - DNA, 20 bp, Artificial
  CRISPR gRNA sequence
gctcaaacccatgttgttca

SEQ ID NO: 546320 - DNA, 20 bp, Artificial
  CRISPR gRNA sequence
ctcaaacccatgttgttcaa

SEQ ID NO: 546321 - DNA, 20 bp, Artificial
  CRISPR gRNA sequence
actgtactttgatttcttct

SEQ ID NO: 546322 - DNA, 20 bp, Artificial
  CRISPR gRNA sequence
ctttgatttcttctgagctg

SEQ ID NO: 546323 - DNA, 20 bp, Artificial
  CRISPR gRNA sequence
ccctcacttccctccaccac

SEQ ID NO: 546324 - DNA, 20 bp, Artificial
  CRISPR gRNA sequence
tactttcttctactgttctc

SEQ ID NO: 546325 - DNA, 20 bp, Artificial
  CRISPR gRNA sequence
tcttctactgttctcaagcc

SEQ ID NO: 546326 - DNA, 20 bp, Artificial
  CRISPR gRNA sequence
cttctactgttctcaagccc

SEQ ID NO: 546327 - DNA, 20 bp, Artificial
  CRISPR gRNA sequence
ttctcaagcccaggatacat

SEQ ID NO: 546328 - DNA, 20 bp, Artificial
  CRISPR gRNA sequence
caggatacatcagctctccc

SEQ ID NO: 546329 - DNA, 20 bp, Artificial
  CRISPR gRNA sequence
aggatacatcagctctccct

SEQ ID NO: 546330 - DNA, 20 bp, Artificial
  CRISPR gRNA sequence
tacatcagctctccctggga

SEQ ID NO: 546331 - DNA, 20 bp, Artificial
  CRISPR gRNA sequence
gctctccctgggaaagacaa

SEQ ID NO: 546332 - DNA, 20 bp, Artificial
  CRISPR gRNA sequence
aaaagacatcttcatgccgc

SEQ ID NO: 546333 - DNA, 20 bp, Artificial
  CRISPR gRNA sequence
aaagacatcttcatgccgcc

SEQ ID NO: 546334 - DNA, 20 bp, Artificial
  CRISPR gRNA sequence
aagacatcttcatgccgcca

SEQ ID NO: 546335 - DNA, 20 bp, Artificial
  CRISPR gRNA sequence
atcttcatgccgccagggta

SEQ ID NO: 546336 - DNA, 20 bp, Artificial
  CRISPR gRNA sequence
ttcatgccgccagggtatgg

SEQ ID NO: 546337 - DNA, 20 bp, Artificial
  CRISPR gRNA sequence
attgtttcatttacatttat

SEQ ID NO: 546338 - DNA, 20 bp, Artificial
  CRISPR gRNA sequence
tacatttataagacattttt

SEQ ID NO: 546339 - DNA, 20 bp, Artificial
  CRISPR gRNA sequence
tgagtttccactattgtgtg

SEQ ID NO: 546340 - DNA, 20 bp, Artificial
  CRISPR gRNA sequence
gtttccactattgtgtgtgg

SEQ ID NO: 546341 - DNA, 20 bp, Artificial
  CRISPR gRNA sequence
gccttcccacatactctgtt

SEQ ID NO: 546342 - DNA, 20 bp, Artificial
  CRISPR gRNA sequence
ttcccacatactctgttgag

SEQ ID NO: 546343 - DNA, 20 bp, Artificial
  CRISPR gRNA sequence
cccacatactctgttgagtg

SEQ ID NO: 546344 - DNA, 20 bp, Artificial
  CRISPR gRNA sequence
ccacatactctgttgagtgg

SEQ ID NO: 546345 - DNA, 20 bp, Artificial
  CRISPR gRNA sequence
tggaggaaataatgcataat

SEQ ID NO: 546346 - DNA, 20 bp, Artificial
  CRISPR gRNA sequence
gaaataatgcataatcggca

SEQ ID NO: 546347 - DNA, 20 bp, Artificial
  CRISPR gRNA sequence
atgcataatcggcaaagcaa

SEQ ID NO: 546348 - DNA, 20 bp, Artificial
  CRISPR gRNA sequence
ataatcggcaaagcaatgga

SEQ ID NO: 546349 - DNA, 20 bp, Artificial
  CRISPR gRNA sequence
gcaaagcaatggaaagatgc

SEQ ID NO: 546350 - DNA, 20 bp, Artificial
  CRISPR gRNA sequence
aaagatgctggtgtgttttt

SEQ ID NO: 546351 - DNA, 20 bp, Artificial
  CRISPR gRNA sequence
aagatgctggtgtgtttttg

SEQ ID NO: 546352 - DNA, 20 bp, Artificial
  CRISPR gRNA sequence
agatgctggtgtgtttttga

SEQ ID NO: 546353 - DNA, 20 bp, Artificial
  CRISPR gRNA sequence
tgctggtgtgtttttgaggg

SEQ ID NO: 546354 - DNA, 20 bp, Artificial
  CRISPR gRNA sequence
gagggcagttccccttaatt

SEQ ID NO: 546355 - DNA, 20 bp, Artificial
  CRISPR gRNA sequence
agggcagttccccttaatta

SEQ ID NO: 546356 - DNA, 20 bp, Artificial
  CRISPR gRNA sequence
gggcagttccccttaattaa

SEQ ID NO: 546357 - DNA, 20 bp, Artificial
  CRISPR gRNA sequence
gcagttccccttaattaagg

SEQ ID NO: 546358 - DNA, 20 bp, Artificial
  CRISPR gRNA sequence
ttccccttaattaagggaga

SEQ ID NO: 546359 - DNA, 20 bp, Artificial
  CRISPR gRNA sequence
tccccttaattaagggagat

SEQ ID NO: 546360 - DNA, 20 bp, Artificial
  CRISPR gRNA sequence
taagggagatgggttctaaa

SEQ ID NO: 546361 - DNA, 20 bp, Artificial
  CRISPR gRNA sequence
tgggttctaaaaagtccttg

SEQ ID NO: 546362 - DNA, 20 bp, Artificial
  CRISPR gRNA sequence
agtccttgtagataaacaaa

SEQ ID NO: 546363 - DNA, 20 bp, Artificial
  CRISPR gRNA sequence
gtccttgtagataaacaaat

SEQ ID NO: 546364 - DNA, 20 bp, Artificial
  CRISPR gRNA sequence
cttatctgaaattactaaca

SEQ ID NO: 546365 - DNA, 20 bp, Artificial
  CRISPR gRNA sequence
ctaacacagttgtctacaac

SEQ ID NO: 546366 - DNA, 20 bp, Artificial
  CRISPR gRNA sequence
gttgtctacaactggtcatt

SEQ ID NO: 546367 - DNA, 20 bp, Artificial
  CRISPR gRNA sequence
tcaattaccctaattgctac

SEQ ID NO: 546368 - DNA, 20 bp, Artificial
  CRISPR gRNA sequence
caattaccctaattgctact

SEQ ID NO: 546369 - DNA, 20 bp, Artificial
  CRISPR gRNA sequence
ttgctactaggcaaaaactt

SEQ ID NO: 546370 - DNA, 20 bp, Artificial
  CRISPR gRNA sequence
tctttaatgttaacttaaaa

SEQ ID NO: 546371 - DNA, 20 bp, Artificial
  CRISPR gRNA sequence
atgttaacttaaaatagctg

SEQ ID NO: 546372 - DNA, 20 bp, Artificial
  CRISPR gRNA sequence
cagttttttgtttgtttgtt

SEQ ID NO: 546373 - DNA, 20 bp, Artificial
  CRISPR gRNA sequence
tttttgtttgtttgttgaga

SEQ ID NO: 546374 - DNA, 20 bp, Artificial
  CRISPR gRNA sequence
ttttgtttgtttgttgagac

SEQ ID NO: 546375 - DNA, 20 bp, Artificial
  CRISPR gRNA sequence
acaggtcatgctctgtcacc

SEQ ID NO: 546376 - DNA, 20 bp, Artificial
  CRISPR gRNA sequence
caggtcatgctctgtcaccc

SEQ ID NO: 546377 - DNA, 20 bp, Artificial
  CRISPR gRNA sequence
tcatgctctgtcacccaggc

SEQ ID NO: 546378 - DNA, 20 bp, Artificial
  CRISPR gRNA sequence
atgctctgtcacccaggctg

SEQ ID NO: 546379 - DNA, 20 bp, Artificial
  CRISPR gRNA sequence
ctgtcacccaggctggagtg

SEQ ID NO: 546380 - DNA, 20 bp, Artificial
  CRISPR gRNA sequence
tcacccaggctggagtgcag

SEQ ID NO: 546381 - DNA, 20 bp, Artificial
  CRISPR gRNA sequence
ggagtgcagtggcacaatca

SEQ ID NO: 546382 - DNA, 20 bp, Artificial
  CRISPR gRNA sequence
tgactgcaatctctgcctca

SEQ ID NO: 546383 - DNA, 20 bp, Artificial
  CRISPR gRNA sequence
aatctctgcctcatggcttc

SEQ ID NO: 546384 - DNA, 20 bp, Artificial
  CRISPR gRNA sequence
tggcttcaagtaatcctctt

SEQ ID NO: 546385 - DNA, 20 bp, Artificial
  CRISPR gRNA sequence
gtaatcctcttcagcctccc

SEQ ID NO: 546386 - DNA, 20 bp, Artificial
  CRISPR gRNA sequence
atcctcttcagcctcccaag

SEQ ID NO: 546387 - DNA, 20 bp, Artificial
  CRISPR gRNA sequence
tcttcagcctcccaagtagc

SEQ ID NO: 546388 - DNA, 20 bp, Artificial
  CRISPR gRNA sequence
cttcagcctcccaagtagct

SEQ ID NO: 546389 - DNA, 20 bp, Artificial
  CRISPR gRNA sequence
ttcagcctcccaagtagctg

SEQ ID NO: 546390 - DNA, 20 bp, Artificial
  CRISPR gRNA sequence
tcccaagtagctggggacca

SEQ ID NO: 546391 - DNA, 20 bp, Artificial
  CRISPR gRNA sequence
cccaagtagctggggaccac

SEQ ID NO: 546392 - DNA, 20 bp, Artificial
  CRISPR gRNA sequence
ccacaggtgtgtgccatgcc

SEQ ID NO: 546393 - DNA, 20 bp, Artificial
  CRISPR gRNA sequence
aattttttgtacttttcgta

SEQ ID NO: 546394 - DNA, 20 bp, Artificial
  CRISPR gRNA sequence
ttttgtacttttcgtaaaga

SEQ ID NO: 546395 - DNA, 20 bp, Artificial
  CRISPR gRNA sequence
tttgtacttttcgtaaagat

SEQ ID NO: 546396 - DNA, 20 bp, Artificial
  CRISPR gRNA sequence
ttgtacttttcgtaaagatg

SEQ ID NO: 546397 - DNA, 20 bp, Artificial
  CRISPR gRNA sequence
tggggtttcgccattttacc

SEQ ID NO: 546398 - DNA, 20 bp, Artificial
  CRISPR gRNA sequence
ggggtttcgccattttaccc

SEQ ID NO: 546399 - DNA, 20 bp, Artificial
  CRISPR gRNA sequence
tttcgccattttacccaggt

SEQ ID NO: 546400 - DNA, 20 bp, Artificial
  CRISPR gRNA sequence
ggtcttgaactcctgaactc

SEQ ID NO: 546401 - DNA, 20 bp, Artificial
  CRISPR gRNA sequence
ctcaagcaatccaaccacct

SEQ ID NO: 546402 - DNA, 20 bp, Artificial
  CRISPR gRNA sequence
accttggcctcccaaaatgc

SEQ ID NO: 546403 - DNA, 20 bp, Artificial
  CRISPR gRNA sequence
ctcccaaaatgctggactta

SEQ ID NO: 546404 - DNA, 20 bp, Artificial
  CRISPR gRNA sequence
tcccaaaatgctggacttac

SEQ ID NO: 546405 - DNA, 20 bp, Artificial
  CRISPR gRNA sequence
ggacttacaggcatgaacca

SEQ ID NO: 546406 - DNA, 20 bp, Artificial
  CRISPR gRNA sequence
gacttacaggcatgaaccac

SEQ ID NO: 546407 - DNA, 20 bp, Artificial
  CRISPR gRNA sequence
caggcatgaaccacaggacc

SEQ ID NO: 546408 - DNA, 20 bp, Artificial
  CRISPR gRNA sequence
agctgctgttctctcttaac

SEQ ID NO: 546409 - DNA, 20 bp, Artificial
  CRISPR gRNA sequence
ctgctgttctctcttaacaa

SEQ ID NO: 546410 - DNA, 20 bp, Artificial
  CRISPR gRNA sequence
gttctctcttaacaagagac

SEQ ID NO: 546411 - DNA, 20 bp, Artificial
  CRISPR gRNA sequence
tcttaacaagagacaagtcc

SEQ ID NO: 546412 - DNA, 20 bp, Artificial
  CRISPR gRNA sequence
ttaacaagagacaagtccta

SEQ ID NO: 546413 - DNA, 20 bp, Artificial
  CRISPR gRNA sequence
caagagacaagtcctagagc

SEQ ID NO: 546414 - DNA, 20 bp, Artificial
  CRISPR gRNA sequence
agatgcatttaaacccactt

SEQ ID NO: 546415 - DNA, 20 bp, Artificial
  CRISPR gRNA sequence
gatgcatttaaacccacttt

SEQ ID NO: 546416 - DNA, 20 bp, Artificial
  CRISPR gRNA sequence
atgcatttaaacccactttg

SEQ ID NO: 546417 - DNA, 20 bp, Artificial
  CRISPR gRNA sequence
tcaaaaatatcccaatcttg

SEQ ID NO: 546418 - DNA, 20 bp, Artificial
  CRISPR gRNA sequence
tctaataaatgtttaacaac

SEQ ID NO: 546419 - DNA, 20 bp, Artificial
  CRISPR gRNA sequence
ctaataaatgtttaacaact

SEQ ID NO: 546420 - DNA, 20 bp, Artificial
  CRISPR gRNA sequence
taaatgtttaacaactaggt

SEQ ID NO: 546421 - DNA, 20 bp, Artificial
  CRISPR gRNA sequence
gtttaacaactaggttggta

SEQ ID NO: 546422 - DNA, 20 bp, Artificial
  CRISPR gRNA sequence
ttaacaactaggttggtatg

SEQ ID NO: 546423 - DNA, 20 bp, Artificial
  CRISPR gRNA sequence
taacaactaggttggtatgg

SEQ ID NO: 546424 - DNA, 20 bp, Artificial
  CRISPR gRNA sequence
ggtatggaggttctgatgtg

SEQ ID NO: 546425 - DNA, 20 bp, Artificial
  CRISPR gRNA sequence
gaggttctgatgtgaagcat

SEQ ID NO: 546426 - DNA, 20 bp, Artificial
  CRISPR gRNA sequence
ttctgatgtgaagcattagt

SEQ ID NO: 546427 - DNA, 20 bp, Artificial
  CRISPR gRNA sequence
gtcagtttctgtgctgttac

SEQ ID NO: 546428 - DNA, 20 bp, Artificial
  CRISPR gRNA sequence
tgttactagatgttccctaa

SEQ ID NO: 546429 - DNA, 20 bp, Artificial
  CRISPR gRNA sequence
gttactagatgttccctaat

SEQ ID NO: 546430 - DNA, 20 bp, Artificial
  CRISPR gRNA sequence
ttactagatgttccctaata

SEQ ID NO: 546431 - DNA, 20 bp, Artificial
  CRISPR gRNA sequence
tagatgttccctaatagggc

SEQ ID NO: 546432 - DNA, 20 bp, Artificial
  CRISPR gRNA sequence
agatgttccctaatagggct

SEQ ID NO: 546433 - DNA, 20 bp, Artificial
  CRISPR gRNA sequence
tgttccctaatagggctggg

SEQ ID NO: 546434 - DNA, 20 bp, Artificial
  CRISPR gRNA sequence
ttccctaatagggctgggca

SEQ ID NO: 546435 - DNA, 20 bp, Artificial
  CRISPR gRNA sequence
tgggcagagatgctaacaat

SEQ ID NO: 546436 - DNA, 20 bp, Artificial
  CRISPR gRNA sequence
gatgctaacaattggctcat

SEQ ID NO: 546437 - DNA, 20 bp, Artificial
  CRISPR gRNA sequence
atgctaacaattggctcatg

SEQ ID NO: 546438 - DNA, 20 bp, Artificial
  CRISPR gRNA sequence
tgctaacaattggctcatga

SEQ ID NO: 546439 - DNA, 20 bp, Artificial
  CRISPR gRNA sequence
taacaattggctcatgaggg

SEQ ID NO: 546440 - DNA, 20 bp, Artificial
  CRISPR gRNA sequence
aacaattggctcatgagggc

SEQ ID NO: 546441 - DNA, 20 bp, Artificial
  CRISPR gRNA sequence
aattggctcatgagggcagg

SEQ ID NO: 546442 - DNA, 20 bp, Artificial
  CRISPR gRNA sequence
ctcatgagggcaggtggacc

SEQ ID NO: 546443 - DNA, 20 bp, Artificial
  CRISPR gRNA sequence
caccactgcacccaatccct

SEQ ID NO: 546444 - DNA, 20 bp, Artificial
  CRISPR gRNA sequence
cacaccctcgacttgcttcc

SEQ ID NO: 546445 - DNA, 20 bp, Artificial
  CRISPR gRNA sequence
ccagccattgtttctgatct

SEQ ID NO: 546446 - DNA, 20 bp, Artificial
  CRISPR gRNA sequence
tctcagttaatgatgcctct

SEQ ID NO: 546447 - DNA, 20 bp, Artificial
  CRISPR gRNA sequence
agttaatgatgcctctcagt

SEQ ID NO: 546448 - DNA, 20 bp, Artificial
  CRISPR gRNA sequence
atgatgcctctcagtcagcc

SEQ ID NO: 546449 - DNA, 20 bp, Artificial
  CRISPR gRNA sequence
tgatgcctctcagtcagcca

SEQ ID NO: 546450 - DNA, 20 bp, Artificial
  CRISPR gRNA sequence
atgcctctcagtcagccaag

SEQ ID NO: 546451 - DNA, 20 bp, Artificial
  CRISPR gRNA sequence
agtcagccaaggagacctga

SEQ ID NO: 546452 - DNA, 20 bp, Artificial
  CRISPR gRNA sequence
atcctgttgacttctctctc

SEQ ID NO: 546453 - DNA, 20 bp, Artificial
  CRISPR gRNA sequence
ttctctctccagcatctcct

SEQ ID NO: 546454 - DNA, 20 bp, Artificial
  CRISPR gRNA sequence
ccactacaaacaccctgctc

SEQ ID NO: 546455 - DNA, 20 bp, Artificial
  CRISPR gRNA sequence
gctctggtctgtcctgtcca

SEQ ID NO: 546456 - DNA, 20 bp, Artificial
  CRISPR gRNA sequence
gtccatggacttcattgcta

SEQ ID NO: 546457 - DNA, 20 bp, Artificial
  CRISPR gRNA sequence
taatttccctgcctctgtgc

SEQ ID NO: 546458 - DNA, 20 bp, Artificial
  CRISPR gRNA sequence
gcctctgtgctggcccctgt

SEQ ID NO: 546459 - DNA, 20 bp, Artificial
  CRISPR gRNA sequence
gtcagccgctctctactcta

SEQ ID NO: 546460 - DNA, 20 bp, Artificial
  CRISPR gRNA sequence
gccgctctctactctaaaga

SEQ ID NO: 546461 - DNA, 20 bp, Artificial
  CRISPR gRNA sequence
ctctctactctaaagacagt

SEQ ID NO: 546462 - DNA, 20 bp, Artificial
  CRISPR gRNA sequence
tgctgacacttaaattatgt

SEQ ID NO: 546463 - DNA, 20 bp, Artificial
  CRISPR gRNA sequence
gctgacacttaaattatgtt

SEQ ID NO: 546464 - DNA, 20 bp, Artificial
  CRISPR gRNA sequence
acacttaaattatgttaggc

SEQ ID NO: 546465 - DNA, 20 bp, Artificial
  CRISPR gRNA sequence
tcttgttaaaaacctttctg

SEQ ID NO: 546466 - DNA, 20 bp, Artificial
  CRISPR gRNA sequence
ttctgtggcttcctctccat

SEQ ID NO: 546467 - DNA, 20 bp, Artificial
  CRISPR gRNA sequence
tctgtggcttcctctccatt

SEQ ID NO: 546468 - DNA, 20 bp, Artificial
  CRISPR gRNA sequence
ggcttcctctccattaggat

SEQ ID NO: 546469 - DNA, 20 bp, Artificial
  CRISPR gRNA sequence
ttaggatcagtccaaaccct

SEQ ID NO: 546470 - DNA, 20 bp, Artificial
  CRISPR gRNA sequence
acccttagcgttccttactt

SEQ ID NO: 546471 - DNA, 20 bp, Artificial
  CRISPR gRNA sequence
gttccttactttagcacaca

SEQ ID NO: 546472 - DNA, 20 bp, Artificial
  CRISPR gRNA sequence
ttccttactttagcacacat

SEQ ID NO: 546473 - DNA, 20 bp, Artificial
  CRISPR gRNA sequence
actttagcacacataggctg

SEQ ID NO: 546474 - DNA, 20 bp, Artificial
  CRISPR gRNA sequence
ctttagcacacataggctgt

SEQ ID NO: 546475 - DNA, 20 bp, Artificial
  CRISPR gRNA sequence
agcacacataggctgtgggc

SEQ ID NO: 546476 - DNA, 20 bp, Artificial
  CRISPR gRNA sequence
ttgtctgtcttgttccccac

SEQ ID NO: 546477 - DNA, 20 bp, Artificial
  CRISPR gRNA sequence
accccttgccctcctcattc

SEQ ID NO: 546478 - DNA, 20 bp, Artificial
  CRISPR gRNA sequence
gccctcctcattctagctgt

SEQ ID NO: 546479 - DNA, 20 bp, Artificial
  CRISPR gRNA sequence
ccctcctcattctagctgtt

SEQ ID NO: 546480 - DNA, 20 bp, Artificial
  CRISPR gRNA sequence
ggaatcacgtgtgtatcctc

SEQ ID NO: 546481 - DNA, 20 bp, Artificial
  CRISPR gRNA sequence
caccatgctctttctccatt

SEQ ID NO: 546482 - DNA, 20 bp, Artificial
  CRISPR gRNA sequence
accatgctctttctccattc

SEQ ID NO: 546483 - DNA, 20 bp, Artificial
  CRISPR gRNA sequence
ccatgctctttctccattca

SEQ ID NO: 546484 - DNA, 20 bp, Artificial
  CRISPR gRNA sequence
ctccattcagggccttcctt

SEQ ID NO: 546485 - DNA, 20 bp, Artificial
  CRISPR gRNA sequence
tccattcagggccttccttt

SEQ ID NO: 546486 - DNA, 20 bp, Artificial
  CRISPR gRNA sequence
ccattcagggccttcctttg

SEQ ID NO: 546487 - DNA, 20 bp, Artificial
  CRISPR gRNA sequence
cattcagggccttcctttgg

SEQ ID NO: 546488 - DNA, 20 bp, Artificial
  CRISPR gRNA sequence
tccccacccactcacctacc

SEQ ID NO: 546489 - DNA, 20 bp, Artificial
  CRISPR gRNA sequence
cactcacctacccagccctg

SEQ ID NO: 546490 - DNA, 20 bp, Artificial
  CRISPR gRNA sequence
cctaactgccttttatcctt

SEQ ID NO: 546491 - DNA, 20 bp, Artificial
  CRISPR gRNA sequence
cagtgatttgcacgttatgt

SEQ ID NO: 546492 - DNA, 20 bp, Artificial
  CRISPR gRNA sequence
tttgcacgttatgtcagttc

SEQ ID NO: 546493 - DNA, 20 bp, Artificial
  CRISPR gRNA sequence
cagttccagcatgacttcct

SEQ ID NO: 546494 - DNA, 20 bp, Artificial
  CRISPR gRNA sequence
agttccagcatgacttcctt

SEQ ID NO: 546495 - DNA, 20 bp, Artificial
  CRISPR gRNA sequence
gttccagcatgacttccttg

SEQ ID NO: 546496 - DNA, 20 bp, Artificial
  CRISPR gRNA sequence
tccagcatgacttccttggg

SEQ ID NO: 546497 - DNA, 20 bp, Artificial
  CRISPR gRNA sequence
ccagcatgacttccttgggg

SEQ ID NO: 546498 - DNA, 20 bp, Artificial
  CRISPR gRNA sequence
tgacttccttggggaggccc

SEQ ID NO: 546499 - DNA, 20 bp, Artificial
  CRISPR gRNA sequence
tccttggggaggccctagac

SEQ ID NO: 546500 - DNA, 20 bp, Artificial
  CRISPR gRNA sequence
ccttggggaggccctagacc

SEQ ID NO: 546501 - DNA, 20 bp, Artificial
  CRISPR gRNA sequence
tggggaggccctagaccagg

SEQ ID NO: 546502 - DNA, 20 bp, Artificial
  CRISPR gRNA sequence
accaggcagctcccctcatg

SEQ ID NO: 546503 - DNA, 20 bp, Artificial
  CRISPR gRNA sequence
ccctcatgcagcccctgatg

SEQ ID NO: 546504 - DNA, 20 bp, Artificial
  CRISPR gRNA sequence
ctcatgcagcccctgatgta

SEQ ID NO: 546505 - DNA, 20 bp, Artificial
  CRISPR gRNA sequence
tccctgtcttctccacacgt

SEQ ID NO: 546506 - DNA, 20 bp, Artificial
  CRISPR gRNA sequence
ccctgtcttctccacacgtg

SEQ ID NO: 546507 - DNA, 20 bp, Artificial
  CRISPR gRNA sequence
ttctccacacgtgaggctcc

SEQ ID NO: 546508 - DNA, 20 bp, Artificial
  CRISPR gRNA sequence
ctccacacgtgaggctcctg

SEQ ID NO: 546509 - DNA, 20 bp, Artificial
  CRISPR gRNA sequence
tccacacgtgaggctcctgg

SEQ ID NO: 546510 - DNA, 20 bp, Artificial
  CRISPR gRNA sequence
ccacacgtgaggctcctgga

SEQ ID NO: 546511 - DNA, 20 bp, Artificial
  CRISPR gRNA sequence
cgtgaggctcctggagggcc

SEQ ID NO: 546512 - DNA, 20 bp, Artificial
  CRISPR gRNA sequence
ctggaacaaccccatattcc

SEQ ID NO: 546513 - DNA, 20 bp, Artificial
  CRISPR gRNA sequence
acaaccccatattcccagcc

SEQ ID NO: 546514 - DNA, 20 bp, Artificial
  CRISPR gRNA sequence
ccagcccagcccgtactacc

SEQ ID NO: 546515 - DNA, 20 bp, Artificial
  CRISPR gRNA sequence
gcccagcccgtactacctgg

SEQ ID NO: 546516 - DNA, 20 bp, Artificial
  CRISPR gRNA sequence
agcccgtactacctggcaga

SEQ ID NO: 546517 - DNA, 20 bp, Artificial
  CRISPR gRNA sequence
cgtactacctggcagatggt

SEQ ID NO: 546518 - DNA, 20 bp, Artificial
  CRISPR gRNA sequence
ggttggtgctccatgaatgt

SEQ ID NO: 546519 - DNA, 20 bp, Artificial
  CRISPR gRNA sequence
gttggtgctccatgaatgtc

SEQ ID NO: 546520 - DNA, 20 bp, Artificial
  CRISPR gRNA sequence
tgaatgtcgggtccatttct

SEQ ID NO: 546521 - DNA, 20 bp, Artificial
  CRISPR gRNA sequence
gtccatttcttggatttatg

SEQ ID NO: 546522 - DNA, 20 bp, Artificial
  CRISPR gRNA sequence
tccatttcttggatttatgc

SEQ ID NO: 546523 - DNA, 20 bp, Artificial
  CRISPR gRNA sequence
tcttggatttatgcaggtcc

SEQ ID NO: 546524 - DNA, 20 bp, Artificial
  CRISPR gRNA sequence
caggtcccagttttctatta

SEQ ID NO: 546525 - DNA, 20 bp, Artificial
  CRISPR gRNA sequence
ggtcccagttttctattaaa

SEQ ID NO: 546526 - DNA, 20 bp, Artificial
  CRISPR gRNA sequence
ccagttttctattaaagagt

SEQ ID NO: 546527 - DNA, 20 bp, Artificial
  CRISPR gRNA sequence
attaaagagtaagctccaca

SEQ ID NO: 546528 - DNA, 20 bp, Artificial
  CRISPR gRNA sequence
ttacttcctgtattttgtgt

SEQ ID NO: 546529 - DNA, 20 bp, Artificial
  CRISPR gRNA sequence
cttcctgtattttgtgtcag

SEQ ID NO: 546530 - DNA, 20 bp, Artificial
  CRISPR gRNA sequence
attttgtgtcagcagtttgt

SEQ ID NO: 546531 - DNA, 20 bp, Artificial
  CRISPR gRNA sequence
gtgtcagcagtttgtcagct

SEQ ID NO: 546532 - DNA, 20 bp, Artificial
  CRISPR gRNA sequence
gtttgtcagcttagcacaaa

SEQ ID NO: 546533 - DNA, 20 bp, Artificial
  CRISPR gRNA sequence
atgaataatttctgccacca

SEQ ID NO: 546534 - DNA, 20 bp, Artificial
  CRISPR gRNA sequence
accaatttttttttctctcc

SEQ ID NO: 546535 - DNA, 20 bp, Artificial
  CRISPR gRNA sequence
ccaatttttttttctctcct

SEQ ID NO: 546536 - DNA, 20 bp, Artificial
  CRISPR gRNA sequence
ttttctctcctaggtttcat

SEQ ID NO: 546537 - DNA, 20 bp, Artificial
  CRISPR gRNA sequence
tgtttttcccaacaaatata

SEQ ID NO: 546538 - DNA, 20 bp, Artificial
  CRISPR gRNA sequence
caaatatatggtgttgtgta

SEQ ID NO: 546539 - DNA, 20 bp, Artificial
  CRISPR gRNA sequence
aaatatatggtgttgtgtat

SEQ ID NO: 546540 - DNA, 20 bp, Artificial
  CRISPR gRNA sequence
aatgtaactttccatgtacc

SEQ ID NO: 546541 - DNA, 20 bp, Artificial
  CRISPR gRNA sequence
accaagcaatgtgcctttaa

SEQ ID NO: 546542 - DNA, 20 bp, Artificial
  CRISPR gRNA sequence
caagcaatgtgcctttaaaa

SEQ ID NO: 546543 - DNA, 20 bp, Artificial
  CRISPR gRNA sequence
aagcaatgtgcctttaaaag

SEQ ID NO: 546544 - DNA, 20 bp, Artificial
  CRISPR gRNA sequence
tgcctttaaaagaggtccta

SEQ ID NO: 546545 - DNA, 20 bp, Artificial
  CRISPR gRNA sequence
aggtcctatggaaaaaacaa

SEQ ID NO: 546546 - DNA, 20 bp, Artificial
  CRISPR gRNA sequence
ggtcctatggaaaaaacaaa

SEQ ID NO: 546547 - DNA, 20 bp, Artificial
  CRISPR gRNA sequence
atggaaaaaacaaaaggata

SEQ ID NO: 546548 - DNA, 20 bp, Artificial
  CRISPR gRNA sequence
aaaacaaaaggataaagttg

SEQ ID NO: 546549 - DNA, 20 bp, Artificial
  CRISPR gRNA sequence
aaaggataaagttgcagaac

SEQ ID NO: 546550 - DNA, 20 bp, Artificial
  CRISPR gRNA sequence
gaactggaaaattctgaatt

SEQ ID NO: 546551 - DNA, 20 bp, Artificial
  CRISPR gRNA sequence
actggaaaattctgaattca

SEQ ID NO: 546552 - DNA, 20 bp, Artificial
  CRISPR gRNA sequence
gctttctcatcttttaaaaa

SEQ ID NO: 546553 - DNA, 20 bp, Artificial
  CRISPR gRNA sequence
ctttctcatcttttaaaaat

SEQ ID NO: 546554 - DNA, 20 bp, Artificial
  CRISPR gRNA sequence
tttctcatcttttaaaaata

SEQ ID NO: 546555 - DNA, 20 bp, Artificial
  CRISPR gRNA sequence
ttttaaaaatagggtttatt

SEQ ID NO: 546556 - DNA, 20 bp, Artificial
  CRISPR gRNA sequence
ggtttatttagacactgtgt

SEQ ID NO: 546557 - DNA, 20 bp, Artificial
  CRISPR gRNA sequence
gtttatttagacactgtgtc

SEQ ID NO: 546558 - DNA, 20 bp, Artificial
  CRISPR gRNA sequence
tatttagacactgtgtcagg

SEQ ID NO: 546559 - DNA, 20 bp, Artificial
  CRISPR gRNA sequence
tatctacaacttaacatcat

SEQ ID NO: 546560 - DNA, 20 bp, Artificial
  CRISPR gRNA sequence
caacttaacatcatcagatg

SEQ ID NO: 546561 - DNA, 20 bp, Artificial
  CRISPR gRNA sequence
taacatcatcagatgaagat

SEQ ID NO: 546562 - DNA, 20 bp, Artificial
  CRISPR gRNA sequence
agatgaagatgagtatgaaa

SEQ ID NO: 546563 - DNA, 20 bp, Artificial
  CRISPR gRNA sequence
caaatattactgataccatg

SEQ ID NO: 546564 - DNA, 20 bp, Artificial
  CRISPR gRNA sequence
aagttctttctttatgtgct

SEQ ID NO: 546565 - DNA, 20 bp, Artificial
  CRISPR gRNA sequence
tctttctttatgtgcttggt

SEQ ID NO: 546566 - DNA, 20 bp, Artificial
  CRISPR gRNA sequence
gtgcttggtgagtattccat

SEQ ID NO: 546567 - DNA, 20 bp, Artificial
  CRISPR gRNA sequence
ataagttgatttgtttaaaa

SEQ ID NO: 546568 - DNA, 20 bp, Artificial
  CRISPR gRNA sequence
atggcaaatttccatttttt

SEQ ID NO: 546569 - DNA, 20 bp, Artificial
  CRISPR gRNA sequence
ccatttttttagtctgtttt

SEQ ID NO: 546570 - DNA, 20 bp, Artificial
  CRISPR gRNA sequence
atttttttagtctgttttca

SEQ ID NO: 546571 - DNA, 20 bp, Artificial
  CRISPR gRNA sequence
tttagtctgttttcagagac

SEQ ID NO: 546572 - DNA, 20 bp, Artificial
  CRISPR gRNA sequence
cagagactagcacaaattaa

SEQ ID NO: 546573 - DNA, 20 bp, Artificial
  CRISPR gRNA sequence
agcacaaattaatggtctat

SEQ ID NO: 546574 - DNA, 20 bp, Artificial
  CRISPR gRNA sequence
aaattaatggtctatgagaa

SEQ ID NO: 546575 - DNA, 20 bp, Artificial
  CRISPR gRNA sequence
atggtctatgagaaaagaat

SEQ ID NO: 546576 - DNA, 20 bp, Artificial
  CRISPR gRNA sequence
aattagatgttacctgttgt

SEQ ID NO: 546577 - DNA, 20 bp, Artificial
  CRISPR gRNA sequence
attagatgttacctgttgtc

SEQ ID NO: 546578 - DNA, 20 bp, Artificial
  CRISPR gRNA sequence
ttagatgttacctgttgtca

SEQ ID NO: 546579 - DNA, 20 bp, Artificial
  CRISPR gRNA sequence
gtcagggttttctccttttc

SEQ ID NO: 546580 - DNA, 20 bp, Artificial
  CRISPR gRNA sequence
ggttttctccttttctggta

SEQ ID NO: 546581 - DNA, 20 bp, Artificial
  CRISPR gRNA sequence
ttttctccttttctggtata

SEQ ID NO: 546582 - DNA, 20 bp, Artificial
  CRISPR gRNA sequence
tttctccttttctggtatag

SEQ ID NO: 546583 - DNA, 20 bp, Artificial
  CRISPR gRNA sequence
tctccttttctggtatagag

SEQ ID NO: 546584 - DNA, 20 bp, Artificial
  CRISPR gRNA sequence
cttttctggtatagaggagc

SEQ ID NO: 546585 - DNA, 20 bp, Artificial
  CRISPR gRNA sequence
caattcctttgtcattcctc

SEQ ID NO: 546586 - DNA, 20 bp, Artificial
  CRISPR gRNA sequence
aattcctttgtcattcctct

SEQ ID NO: 546587 - DNA, 20 bp, Artificial
  CRISPR gRNA sequence
cctttgtcattcctctgggt

SEQ ID NO: 546588 - DNA, 20 bp, Artificial
  CRISPR gRNA sequence
ctttgtcattcctctgggtg

SEQ ID NO: 546589 - DNA, 20 bp, Artificial
  CRISPR gRNA sequence
ttgtcattcctctgggtgag

SEQ ID NO: 546590 - DNA, 20 bp, Artificial
  CRISPR gRNA sequence
gtcattcctctgggtgagga

SEQ ID NO: 546591 - DNA, 20 bp, Artificial
  CRISPR gRNA sequence
ggtgaggagagaatctaacc

SEQ ID NO: 546592 - DNA, 20 bp, Artificial
  CRISPR gRNA sequence
gtgaggagagaatctaacca

SEQ ID NO: 546593 - DNA, 20 bp, Artificial
  CRISPR gRNA sequence
aggagagaatctaaccaagg

SEQ ID NO: 546594 - DNA, 20 bp, Artificial
  CRISPR gRNA sequence
ggagagaatctaaccaaggt

SEQ ID NO: 546595 - DNA, 20 bp, Artificial
  CRISPR gRNA sequence
gagagaatctaaccaaggtg

SEQ ID NO: 546596 - DNA, 20 bp, Artificial
  CRISPR gRNA sequence
gagaatctaaccaaggtggg

SEQ ID NO: 546597 - DNA, 20 bp, Artificial
  CRISPR gRNA sequence
tctaaccaaggtggggagaa

SEQ ID NO: 546598 - DNA, 20 bp, Artificial
  CRISPR gRNA sequence
caaggtggggagaacagtat

SEQ ID NO: 546599 - DNA, 20 bp, Artificial
  CRISPR gRNA sequence
aacagtatcagttgtcttac

SEQ ID NO: 546600 - DNA, 20 bp, Artificial
  CRISPR gRNA sequence
acagtatcagttgtcttact

SEQ ID NO: 546601 - DNA, 20 bp, Artificial
  CRISPR gRNA sequence
ttgtcttactaggaatgttt

SEQ ID NO: 546602 - DNA, 20 bp, Artificial
  CRISPR gRNA sequence
cttactaggaatgttttgga

SEQ ID NO: 546603 - DNA, 20 bp, Artificial
  CRISPR gRNA sequence
tactaggaatgttttggaaa

SEQ ID NO: 546604 - DNA, 20 bp, Artificial
  CRISPR gRNA sequence
gaatgttttggaaagagatg

SEQ ID NO: 546605 - DNA, 20 bp, Artificial
  CRISPR gRNA sequence
tttggaaagagatgtagtga

SEQ ID NO: 546606 - DNA, 20 bp, Artificial
  CRISPR gRNA sequence
ggaaagagatgtagtgacag

SEQ ID NO: 546607 - DNA, 20 bp, Artificial
  CRISPR gRNA sequence
agagatgtagtgacagcagt

SEQ ID NO: 546608 - DNA, 20 bp, Artificial
  CRISPR gRNA sequence
tgtagtgacagcagttagct

SEQ ID NO: 546609 - DNA, 20 bp, Artificial
  CRISPR gRNA sequence
gcagttagcttagaactctt

SEQ ID NO: 546610 - DNA, 20 bp, Artificial
  CRISPR gRNA sequence
cagttagcttagaactcttt

SEQ ID NO: 546611 - DNA, 20 bp, Artificial
  CRISPR gRNA sequence
aactctttgggctccactga

SEQ ID NO: 546612 - DNA, 20 bp, Artificial
  CRISPR gRNA sequence
ctgatagatgttactctata

SEQ ID NO: 546613 - DNA, 20 bp, Artificial
  CRISPR gRNA sequence
aaagttcctgcttccccaca

SEQ ID NO: 546614 - DNA, 20 bp, Artificial
  CRISPR gRNA sequence
gttcctgcttccccacacag

SEQ ID NO: 546615 - DNA, 20 bp, Artificial
  CRISPR gRNA sequence
ttcctgcttccccacacagc

SEQ ID NO: 546616 - DNA, 20 bp, Artificial
  CRISPR gRNA sequence
tcctgcttccccacacagcg

SEQ ID NO: 546617 - DNA, 20 bp, Artificial
  CRISPR gRNA sequence
ctgcttccccacacagcggg

SEQ ID NO: 546618 - DNA, 20 bp, Artificial
  CRISPR gRNA sequence
ttaattaatttatttatttt

SEQ ID NO: 546619 - DNA, 20 bp, Artificial
  CRISPR gRNA sequence
attaatttatttattttgag

SEQ ID NO: 546620 - DNA, 20 bp, Artificial
  CRISPR gRNA sequence
ttaatttatttattttgaga

SEQ ID NO: 546621 - DNA, 20 bp, Artificial
  CRISPR gRNA sequence
aatttatttattttgagaag

SEQ ID NO: 546622 - DNA, 20 bp, Artificial
  CRISPR gRNA sequence
aggagtctcactctgttacc

SEQ ID NO: 546623 - DNA, 20 bp, Artificial
  CRISPR gRNA sequence
ggagtctcactctgttacca

SEQ ID NO: 546624 - DNA, 20 bp, Artificial
  CRISPR gRNA sequence
tctcactctgttaccaaggc

SEQ ID NO: 546625 - DNA, 20 bp, Artificial
  CRISPR gRNA sequence
tcactctgttaccaaggcca

SEQ ID NO: 546626 - DNA, 20 bp, Artificial
  CRISPR gRNA sequence
ctgttaccaaggccagagtg

SEQ ID NO: 546627 - DNA, 20 bp, Artificial
  CRISPR gRNA sequence
ttaccaaggccagagtgcag

SEQ ID NO: 546628 - DNA, 20 bp, Artificial
  CRISPR gRNA sequence
agagtgcagtggcacaatct

SEQ ID NO: 546629 - DNA, 20 bp, Artificial
  CRISPR gRNA sequence
tgactgcaacctctgcctcc

SEQ ID NO: 546630 - DNA, 20 bp, Artificial
  CRISPR gRNA sequence
gactgcaacctctgcctccc

SEQ ID NO: 546631 - DNA, 20 bp, Artificial
  CRISPR gRNA sequence
acctctgcctcccaggttca

SEQ ID NO: 546632 - DNA, 20 bp, Artificial
  CRISPR gRNA sequence
tcaaagtgattttactgtct

SEQ ID NO: 546633 - DNA, 20 bp, Artificial
  CRISPR gRNA sequence
ttttactgtctcagcctccc

SEQ ID NO: 546634 - DNA, 20 bp, Artificial
  CRISPR gRNA sequence
tactgtctcagcctcccaag

SEQ ID NO: 546635 - DNA, 20 bp, Artificial
  CRISPR gRNA sequence
gtctcagcctcccaagtagc

SEQ ID NO: 546636 - DNA, 20 bp, Artificial
  CRISPR gRNA sequence
tctcagcctcccaagtagct

SEQ ID NO: 546637 - DNA, 20 bp, Artificial
  CRISPR gRNA sequence
ctcccaagtagctgggacta

SEQ ID NO: 546638 - DNA, 20 bp, Artificial
  CRISPR gRNA sequence
tcccaagtagctgggactac

SEQ ID NO: 546639 - DNA, 20 bp, Artificial
  CRISPR gRNA sequence
caggcccgcaccaccatgcc

SEQ ID NO: 546640 - DNA, 20 bp, Artificial
  CRISPR gRNA sequence
cccagctaatttttgtattt

SEQ ID NO: 546641 - DNA, 20 bp, Artificial
  CRISPR gRNA sequence
agctaatttttgtattttag

SEQ ID NO: 546642 - DNA, 20 bp, Artificial
  CRISPR gRNA sequence
ctaatttttgtattttagta

SEQ ID NO: 546643 - DNA, 20 bp, Artificial
  CRISPR gRNA sequence
tttttgtattttagtagaga

SEQ ID NO: 546644 - DNA, 20 bp, Artificial
  CRISPR gRNA sequence
gagatggtgtttcactgtgt

SEQ ID NO: 546645 - DNA, 20 bp, Artificial
  CRISPR gRNA sequence
tggtgtttcactgtgttggc

SEQ ID NO: 546646 - DNA, 20 bp, Artificial
  CRISPR gRNA sequence
ggtgtttcactgtgttggcc

SEQ ID NO: 546647 - DNA, 20 bp, Artificial
  CRISPR gRNA sequence
tttcactgtgttggccaggc

SEQ ID NO: 546648 - DNA, 20 bp, Artificial
  CRISPR gRNA sequence
caggctggtctcaaactcct

SEQ ID NO: 546649 - DNA, 20 bp, Artificial
  CRISPR gRNA sequence
tggtctcaaactcctgagct

SEQ ID NO: 546650 - DNA, 20 bp, Artificial
  CRISPR gRNA sequence
ggtctcaaactcctgagctc

SEQ ID NO: 546651 - DNA, 20 bp, Artificial
  CRISPR gRNA sequence
ctcaggtgatccacccgcct

SEQ ID NO: 546652 - DNA, 20 bp, Artificial
  CRISPR gRNA sequence
ccacccgcctcagcctccca

SEQ ID NO: 546653 - DNA, 20 bp, Artificial
  CRISPR gRNA sequence
gcctcagcctcccaaagtgc

SEQ ID NO: 546654 - DNA, 20 bp, Artificial
  CRISPR gRNA sequence
cctcagcctcccaaagtgct

SEQ ID NO: 546655 - DNA, 20 bp, Artificial
  CRISPR gRNA sequence
agtgctgggattacactcat

SEQ ID NO: 546656 - DNA, 20 bp, Artificial
  CRISPR gRNA sequence
cactcatgagccaccacacc

SEQ ID NO: 546657 - DNA, 20 bp, Artificial
  CRISPR gRNA sequence
gcaccattttaaactgaaac

SEQ ID NO: 546658 - DNA, 20 bp, Artificial
  CRISPR gRNA sequence
accattttaaactgaaacta

SEQ ID NO: 546659 - DNA, 20 bp, Artificial
  CRISPR gRNA sequence
cattttaaactgaaactaga

SEQ ID NO: 546660 - DNA, 20 bp, Artificial
  CRISPR gRNA sequence
ttttaaactgaaactagaga

SEQ ID NO: 546661 - DNA, 20 bp, Artificial
  CRISPR gRNA sequence
tttaaactgaaactagagag

SEQ ID NO: 546662 - DNA, 20 bp, Artificial
  CRISPR gRNA sequence
ttaaactgaaactagagaga

SEQ ID NO: 546663 - DNA, 20 bp, Artificial
  CRISPR gRNA sequence
taaactgaaactagagagag

SEQ ID NO: 546664 - DNA, 20 bp, Artificial
  CRISPR gRNA sequence
ttctcactgacactcctccc

SEQ ID NO: 546665 - DNA, 20 bp, Artificial
  CRISPR gRNA sequence
acactcctccctggtctcta

SEQ ID NO: 546666 - DNA, 20 bp, Artificial
  CRISPR gRNA sequence
ctaaagccccttttgtgttg

SEQ ID NO: 546667 - DNA, 20 bp, Artificial
  CRISPR gRNA sequence
ttttgtgttgcagtcttgta

SEQ ID NO: 546668 - DNA, 20 bp, Artificial
  CRISPR gRNA sequence
tttgtgttgcagtcttgtat

SEQ ID NO: 546669 - DNA, 20 bp, Artificial
  CRISPR gRNA sequence
taggcccctgcctcacatgc

SEQ ID NO: 546670 - DNA, 20 bp, Artificial
  CRISPR gRNA sequence
cctcacatgccagtgtttct

SEQ ID NO: 546671 - DNA, 20 bp, Artificial
  CRISPR gRNA sequence
cagtgtttcttggtcatttt

SEQ ID NO: 546672 - DNA, 20 bp, Artificial
  CRISPR gRNA sequence
agtgtttcttggtcatttta

SEQ ID NO: 546673 - DNA, 20 bp, Artificial
  CRISPR gRNA sequence
ttcattgtttctgacattcc

SEQ ID NO: 546674 - DNA, 20 bp, Artificial
  CRISPR gRNA sequence
ttctgacattcctggtgtct

SEQ ID NO: 546675 - DNA, 20 bp, Artificial
  CRISPR gRNA sequence
tgacattcctggtgtcttgg

SEQ ID NO: 546676 - DNA, 20 bp, Artificial
  CRISPR gRNA sequence
tccttgatcgcctctcctgt

SEQ ID NO: 546677 - DNA, 20 bp, Artificial
  CRISPR gRNA sequence
ccttgatcgcctctcctgta

SEQ ID NO: 546678 - DNA, 20 bp, Artificial
  CRISPR gRNA sequence
tctacgttacccactaccca

SEQ ID NO: 546679 - DNA, 20 bp, Artificial
  CRISPR gRNA sequence
cactacccatggatgtaacc

SEQ ID NO: 546680 - DNA, 20 bp, Artificial
  CRISPR gRNA sequence
actcatcattacctcaatgt

SEQ ID NO: 546681 - DNA, 20 bp, Artificial
  CRISPR gRNA sequence
ctcatcattacctcaatgtc

SEQ ID NO: 546682 - DNA, 20 bp, Artificial
  CRISPR gRNA sequence
cttgatgatgctgatgctga

SEQ ID NO: 546683 - DNA, 20 bp, Artificial
  CRISPR gRNA sequence
tccctgctgccctccctact

SEQ ID NO: 546684 - DNA, 20 bp, Artificial
  CRISPR gRNA sequence
ctgccctccctactcagcct

SEQ ID NO: 546685 - DNA, 20 bp, Artificial
  CRISPR gRNA sequence
tgagtgctgttgtcactcac

SEQ ID NO: 546686 - DNA, 20 bp, Artificial
  CRISPR gRNA sequence
ctgttgtcactcactagact

SEQ ID NO: 546687 - DNA, 20 bp, Artificial
  CRISPR gRNA sequence
tcactagactcagtccgttg

SEQ ID NO: 546688 - DNA, 20 bp, Artificial
  CRISPR gRNA sequence
cagtccgttgcagacacact

SEQ ID NO: 546689 - DNA, 20 bp, Artificial
  CRISPR gRNA sequence
tagcttccttgctcctttgc

SEQ ID NO: 546690 - DNA, 20 bp, Artificial
  CRISPR gRNA sequence
gctggcttgtcatactcgca

SEQ ID NO: 546691 - DNA, 20 bp, Artificial
  CRISPR gRNA sequence
gcttgtcatactcgcatggc

SEQ ID NO: 546692 - DNA, 20 bp, Artificial
  CRISPR gRNA sequence
atactcgcatggccagatta

SEQ ID NO: 546693 - DNA, 20 bp, Artificial
  CRISPR gRNA sequence
tcgcatggccagattacagc

SEQ ID NO: 546694 - DNA, 20 bp, Artificial
  CRISPR gRNA sequence
ggccagattacagctagatt

SEQ ID NO: 546695 - DNA, 20 bp, Artificial
  CRISPR gRNA sequence
attctgtgctcacacccatg

SEQ ID NO: 546696 - DNA, 20 bp, Artificial
  CRISPR gRNA sequence
tgctcacacccatgtggttg

SEQ ID NO: 546697 - DNA, 20 bp, Artificial
  CRISPR gRNA sequence
gaaaaatacaccaccctaca

SEQ ID NO: 546698 - DNA, 20 bp, Artificial
  CRISPR gRNA sequence
tctaatcacttacctcaatt

SEQ ID NO: 546699 - DNA, 20 bp, Artificial
  CRISPR gRNA sequence
atcacttacctcaattaagt

SEQ ID NO: 546700 - DNA, 20 bp, Artificial
  CRISPR gRNA sequence
tcaattaagttggtatttcc

SEQ ID NO: 546701 - DNA, 20 bp, Artificial
  CRISPR gRNA sequence
tgttcacttacccactctcc

SEQ ID NO: 546702 - DNA, 20 bp, Artificial
  CRISPR gRNA sequence
tcacttacccactctcctag

SEQ ID NO: 546703 - DNA, 20 bp, Artificial
  CRISPR gRNA sequence
atcttgaatacctccttctc

SEQ ID NO: 546704 - DNA, 20 bp, Artificial
  CRISPR gRNA sequence
ccttctctagactgactctt

SEQ ID NO: 546705 - DNA, 20 bp, Artificial
  CRISPR gRNA sequence
ctagactgactcttcagctg

SEQ ID NO: 546706 - DNA, 20 bp, Artificial
  CRISPR gRNA sequence
tagactgactcttcagctga

SEQ ID NO: 546707 - DNA, 20 bp, Artificial
  CRISPR gRNA sequence
gctttgcttcttatttcact

SEQ ID NO: 546708 - DNA, 20 bp, Artificial
  CRISPR gRNA sequence
ctttgcttcttatttcacta

SEQ ID NO: 546709 - DNA, 20 bp, Artificial
  CRISPR gRNA sequence
ttgcttcttatttcactaag

SEQ ID NO: 546710 - DNA, 20 bp, Artificial
  CRISPR gRNA sequence
cttatttcactaaggagaat

SEQ ID NO: 546711 - DNA, 20 bp, Artificial
  CRISPR gRNA sequence
cactaaggagaataagcaat

SEQ ID NO: 546712 - DNA, 20 bp, Artificial
  CRISPR gRNA sequence
ctaaggagaataagcaatca

SEQ ID NO: 546713 - DNA, 20 bp, Artificial
  CRISPR gRNA sequence
taaggagaataagcaatcag

SEQ ID NO: 546714 - DNA, 20 bp, Artificial
  CRISPR gRNA sequence
aaggagaataagcaatcaga

SEQ ID NO: 546715 - DNA, 20 bp, Artificial
  CRISPR gRNA sequence
aatcagagggcaatttccac

SEQ ID NO: 546716 - DNA, 20 bp, Artificial
  CRISPR gRNA sequence
ctaccttcctacccatacct

SEQ ID NO: 546717 - DNA, 20 bp, Artificial
  CRISPR gRNA sequence
cctacccatacctgagcctg

SEQ ID NO: 546718 - DNA, 20 bp, Artificial
  CRISPR gRNA sequence
ctacccatacctgagcctgt

SEQ ID NO: 546719 - DNA, 20 bp, Artificial
  CRISPR gRNA sequence
gctttctctcctgatatgaa

SEQ ID NO: 546720 - DNA, 20 bp, Artificial
  CRISPR gRNA sequence
ctgatatgaatggactttct

SEQ ID NO: 546721 - DNA, 20 bp, Artificial
  CRISPR gRNA sequence
actttctgagttctcacctg

SEQ ID NO: 546722 - DNA, 20 bp, Artificial
  CRISPR gRNA sequence
taaactttccacgtgtgccc

SEQ ID NO: 546723 - DNA, 20 bp, Artificial
  CRISPR gRNA sequence
ccacctcctcttgccgtcct

SEQ ID NO: 546724 - DNA, 20 bp, Artificial
  CRISPR gRNA sequence
cacctcctcttgccgtcctc

SEQ ID NO: 546725 - DNA, 20 bp, Artificial
  CRISPR gRNA sequence
cgtcctcgggaatatcaccc

SEQ ID NO: 546726 - DNA, 20 bp, Artificial
  CRISPR gRNA sequence
tctacccactctctcctgat

SEQ ID NO: 546727 - DNA, 20 bp, Artificial
  CRISPR gRNA sequence
ctgatgagaatttcccccat

SEQ ID NO: 546728 - DNA, 20 bp, Artificial
  CRISPR gRNA sequence
gaatttcccccataagttga

SEQ ID NO: 546729 - DNA, 20 bp, Artificial
  CRISPR gRNA sequence
ataagttgatggttcatttt

SEQ ID NO: 546730 - DNA, 20 bp, Artificial
  CRISPR gRNA sequence
agttgatggttcattttaag

SEQ ID NO: 546731 - DNA, 20 bp, Artificial
  CRISPR gRNA sequence
tcatgatccctgtacccctc

SEQ ID NO: 546732 - DNA, 20 bp, Artificial
  CRISPR gRNA sequence
cacctgctgtcttcacttta

SEQ ID NO: 546733 - DNA, 20 bp, Artificial
  CRISPR gRNA sequence
ctttatagaaaatctccttg

SEQ ID NO: 546734 - DNA, 20 bp, Artificial
  CRISPR gRNA sequence
tatagaaaatctccttgaag

SEQ ID NO: 546735 - DNA, 20 bp, Artificial
  CRISPR gRNA sequence
cacttttaacccactccaaa

SEQ ID NO: 546736 - DNA, 20 bp, Artificial
  CRISPR gRNA sequence
acttttaacccactccaaat

SEQ ID NO: 546737 - DNA, 20 bp, Artificial
  CRISPR gRNA sequence
ctgctatgccaaaactcctc

SEQ ID NO: 546738 - DNA, 20 bp, Artificial
  CRISPR gRNA sequence
gacctccttgttaataaatc

SEQ ID NO: 546739 - DNA, 20 bp, Artificial
  CRISPR gRNA sequence
ctccttgttaataaatccag

SEQ ID NO: 546740 - DNA, 20 bp, Artificial
  CRISPR gRNA sequence
taaatccagtggttcattct

SEQ ID NO: 546741 - DNA, 20 bp, Artificial
  CRISPR gRNA sequence
ccatgtcattcttgacttct

SEQ ID NO: 546742 - DNA, 20 bp, Artificial
  CRISPR gRNA sequence
tgtcattcttgacttctcag

SEQ ID NO: 546743 - DNA, 20 bp, Artificial
  CRISPR gRNA sequence
cttctcagcagcttttgaca

SEQ ID NO: 546744 - DNA, 20 bp, Artificial
  CRISPR gRNA sequence
agctgatcactccctcctcc

SEQ ID NO: 546745 - DNA, 20 bp, Artificial
  CRISPR gRNA sequence
tactgtcttcacttgacatc

SEQ ID NO: 546746 - DNA, 20 bp, Artificial
  CRISPR gRNA sequence
actgtcttcacttgacatcc

SEQ ID NO: 546747 - DNA, 20 bp, Artificial
  CRISPR gRNA sequence
tttctttctcttttttcctt

SEQ ID NO: 546748 - DNA, 20 bp, Artificial
  CRISPR gRNA sequence
tctttctcttttttccttga

SEQ ID NO: 546749 - DNA, 20 bp, Artificial
  CRISPR gRNA sequence
ctttctcttttttccttgag

SEQ ID NO: 546750 - DNA, 20 bp, Artificial
  CRISPR gRNA sequence
tttctcttttttccttgaga

SEQ ID NO: 546751 - DNA, 20 bp, Artificial
  CRISPR gRNA sequence
ttctcttttttccttgagag

SEQ ID NO: 546752 - DNA, 20 bp, Artificial
  CRISPR gRNA sequence
tctcttttttccttgagagg

SEQ ID NO: 546753 - DNA, 20 bp, Artificial
  CRISPR gRNA sequence
ggggtttcgcccttgttgcc

SEQ ID NO: 546754 - DNA, 20 bp, Artificial
  CRISPR gRNA sequence
gggtttcgcccttgttgccc

SEQ ID NO: 546755 - DNA, 20 bp, Artificial
  CRISPR gRNA sequence
ttcgcccttgttgcccaggc

SEQ ID NO: 546756 - DNA, 20 bp, Artificial
  CRISPR gRNA sequence
ttgcccaggctggaatgcaa

SEQ ID NO: 546757 - DNA, 20 bp, Artificial
  CRISPR gRNA sequence
ggaatgcaatggcgcgatct

SEQ ID NO: 546758 - DNA, 20 bp, Artificial
  CRISPR gRNA sequence
tcactgcaacctatgcctcc

SEQ ID NO: 546759 - DNA, 20 bp, Artificial
  CRISPR gRNA sequence
cactgcaacctatgcctccc

SEQ ID NO: 546760 - DNA, 20 bp, Artificial
  CRISPR gRNA sequence
aacctatgcctcccgggttc

SEQ ID NO: 546761 - DNA, 20 bp, Artificial
  CRISPR gRNA sequence
ttcaagtgaatcttctgcct

SEQ ID NO: 546762 - DNA, 20 bp, Artificial
  CRISPR gRNA sequence
ttctgcctcagcctcctgaa

SEQ ID NO: 546763 - DNA, 20 bp, Artificial
  CRISPR gRNA sequence
cctcagcctcctgaacagtt

SEQ ID NO: 546764 - DNA, 20 bp, Artificial
  CRISPR gRNA sequence
ctcctgaacagttgagatta

SEQ ID NO: 546765 - DNA, 20 bp, Artificial
  CRISPR gRNA sequence
tcctgaacagttgagattac

SEQ ID NO: 546766 - DNA, 20 bp, Artificial
  CRISPR gRNA sequence
caggcatgcaccaccatgcc

SEQ ID NO: 546767 - DNA, 20 bp, Artificial
  CRISPR gRNA sequence
cctggctaattttgtatttt

SEQ ID NO: 546768 - DNA, 20 bp, Artificial
  CRISPR gRNA sequence
ggctaattttgtatttttag

SEQ ID NO: 546769 - DNA, 20 bp, Artificial
  CRISPR gRNA sequence
ctaattttgtatttttagta

SEQ ID NO: 546770 - DNA, 20 bp, Artificial
  CRISPR gRNA sequence
ttttgtatttttagtagaga

SEQ ID NO: 546771 - DNA, 20 bp, Artificial
  CRISPR gRNA sequence
tttgtatttttagtagagat

SEQ ID NO: 546772 - DNA, 20 bp, Artificial
  CRISPR gRNA sequence
ttgtatttttagtagagatg

SEQ ID NO: 546773 - DNA, 20 bp, Artificial
  CRISPR gRNA sequence
gagatggggtttcaccatgt

SEQ ID NO: 546774 - DNA, 20 bp, Artificial
  CRISPR gRNA sequence
tggggtttcaccatgttggt

SEQ ID NO: 546775 - DNA, 20 bp, Artificial
  CRISPR gRNA sequence
ggggtttcaccatgttggtc

SEQ ID NO: 546776 - DNA, 20 bp, Artificial
  CRISPR gRNA sequence
tttcaccatgttggtcaggc

SEQ ID NO: 546777 - DNA, 20 bp, Artificial
  CRISPR gRNA sequence
tggtcttgaactcctgacct

SEQ ID NO: 546778 - DNA, 20 bp, Artificial
  CRISPR gRNA sequence
ggtcttgaactcctgacctc

SEQ ID NO: 546779 - DNA, 20 bp, Artificial
  CRISPR gRNA sequence
ctcaggtgatccacctgcct

SEQ ID NO: 546780 - DNA, 20 bp, Artificial
  CRISPR gRNA sequence
ccacctgccttggcctccca

SEQ ID NO: 546781 - DNA, 20 bp, Artificial
  CRISPR gRNA sequence
gccttggcctcccaaagtgt

SEQ ID NO: 546782 - DNA, 20 bp, Artificial
  CRISPR gRNA sequence
ccttggcctcccaaagtgtt

SEQ ID NO: 546783 - DNA, 20 bp, Artificial
  CRISPR gRNA sequence
ctcccaaagtgttgggatta

SEQ ID NO: 546784 - DNA, 20 bp, Artificial
  CRISPR gRNA sequence
tcccaaagtgttgggattac

SEQ ID NO: 546785 - DNA, 20 bp, Artificial
  CRISPR gRNA sequence
agtgttgggattacaggtgt

SEQ ID NO: 546786 - DNA, 20 bp, Artificial
  CRISPR gRNA sequence
caggtgtgagccactgtgcc

SEQ ID NO: 546787 - DNA, 20 bp, Artificial
  CRISPR gRNA sequence
acacactgactattcctttt

SEQ ID NO: 546788 - DNA, 20 bp, Artificial
  CRISPR gRNA sequence
tccttttcagcttcttttgc

SEQ ID NO: 546789 - DNA, 20 bp, Artificial
  CRISPR gRNA sequence
tttccccaacctcttaacac

SEQ ID NO: 546790 - DNA, 20 bp, Artificial
  CRISPR gRNA sequence
ctcttaacactggaaacatc

SEQ ID NO: 546791 - DNA, 20 bp, Artificial
  CRISPR gRNA sequence
tcttaacactggaaacatca

SEQ ID NO: 546792 - DNA, 20 bp, Artificial
  CRISPR gRNA sequence
cactggaaacatcaaggctt

SEQ ID NO: 546793 - DNA, 20 bp, Artificial
  CRISPR gRNA sequence
aaacatcaaggcttaagcct

SEQ ID NO: 546794 - DNA, 20 bp, Artificial
  CRISPR gRNA sequence
aacatcaaggcttaagcctt

SEQ ID NO: 546795 - DNA, 20 bp, Artificial
  CRISPR gRNA sequence
tccttttctgtctgcgttca

SEQ ID NO: 546796 - DNA, 20 bp, Artificial
  CRISPR gRNA sequence
tttctgtctgcgttcatagc

SEQ ID NO: 546797 - DNA, 20 bp, Artificial
  CRISPR gRNA sequence
ctgtctgcgttcatagccag

SEQ ID NO: 546798 - DNA, 20 bp, Artificial
  CRISPR gRNA sequence
tgtctgcgttcatagccagt

SEQ ID NO: 546799 - DNA, 20 bp, Artificial
  CRISPR gRNA sequence
tgcgttcatagccagtgggt

SEQ ID NO: 546800 - DNA, 20 bp, Artificial
  CRISPR gRNA sequence
tgggtgagctcatcccatgt

SEQ ID NO: 546801 - DNA, 20 bp, Artificial
  CRISPR gRNA sequence
gggtgagctcatcccatgtc

SEQ ID NO: 546802 - DNA, 20 bp, Artificial
  CRISPR gRNA sequence
ggtgagctcatcccatgtca

SEQ ID NO: 546803 - DNA, 20 bp, Artificial
  CRISPR gRNA sequence
atctcaatgctaataatgta

SEQ ID NO: 546804 - DNA, 20 bp, Artificial
  CRISPR gRNA sequence
atgctaataatgtacagatc

SEQ ID NO: 546805 - DNA, 20 bp, Artificial
  CRISPR gRNA sequence
gctaataatgtacagatcta

SEQ ID NO: 546806 - DNA, 20 bp, Artificial
  CRISPR gRNA sequence
aatgtacagatctagagctc

SEQ ID NO: 546807 - DNA, 20 bp, Artificial
  CRISPR gRNA sequence
acagatctagagctctagcc

SEQ ID NO: 546808 - DNA, 20 bp, Artificial
  CRISPR gRNA sequence
agatctagagctctagccca

SEQ ID NO: 546809 - DNA, 20 bp, Artificial
  CRISPR gRNA sequence
ctagcccagagtaccccgcc

SEQ ID NO: 546810 - DNA, 20 bp, Artificial
  CRISPR gRNA sequence
tatgtgtatacctgactgcc

SEQ ID NO: 546811 - DNA, 20 bp, Artificial
  CRISPR gRNA sequence
gactgcccagtgtacctctc

SEQ ID NO: 546812 - DNA, 20 bp, Artificial
  CRISPR gRNA sequence
gcccagtgtacctctccagt

SEQ ID NO: 546813 - DNA, 20 bp, Artificial
  CRISPR gRNA sequence
tctccagtcagacatctaat

SEQ ID NO: 546814 - DNA, 20 bp, Artificial
  CRISPR gRNA sequence
attggcctttcaaatatcac

SEQ ID NO: 546815 - DNA, 20 bp, Artificial
  CRISPR gRNA sequence
ttcaaatatcacaagtccaa

SEQ ID NO: 546816 - DNA, 20 bp, Artificial
  CRISPR gRNA sequence
aatatcacaagtccaaaagt

SEQ ID NO: 546817 - DNA, 20 bp, Artificial
  CRISPR gRNA sequence
tccccaaatcttttcccttt

SEQ ID NO: 546818 - DNA, 20 bp, Artificial
  CRISPR gRNA sequence
atcttttcccttttggttaa

SEQ ID NO: 546819 - DNA, 20 bp, Artificial
  CRISPR gRNA sequence
ttttcccttttggttaatgg

SEQ ID NO: 546820 - DNA, 20 bp, Artificial
  CRISPR gRNA sequence
taatggcagccccatccttt

SEQ ID NO: 546821 - DNA, 20 bp, Artificial
  CRISPR gRNA sequence
ggcagccccatcctttcagc

SEQ ID NO: 546822 - DNA, 20 bp, Artificial
  CRISPR gRNA sequence
gccccatcctttcagctggt

SEQ ID NO: 546823 - DNA, 20 bp, Artificial
  CRISPR gRNA sequence
tcagctggtcagtctgaaac

SEQ ID NO: 546824 - DNA, 20 bp, Artificial
  CRISPR gRNA sequence
cagctggtcagtctgaaacc

SEQ ID NO: 546825 - DNA, 20 bp, Artificial
  CRISPR gRNA sequence
gaataccacattcactctac

SEQ ID NO: 546826 - DNA, 20 bp, Artificial
  CRISPR gRNA sequence
aataccacattcactctacc

SEQ ID NO: 546827 - DNA, 20 bp, Artificial
  CRISPR gRNA sequence
accacattcactctaccagg

SEQ ID NO: 546828 - DNA, 20 bp, Artificial
  CRISPR gRNA sequence
actctaccaggaagttgtat

SEQ ID NO: 546829 - DNA, 20 bp, Artificial
  CRISPR gRNA sequence
ggaagttgtattggttctac

SEQ ID NO: 546830 - DNA, 20 bp, Artificial
  CRISPR gRNA sequence
ccagaatgatctttttaaaa

SEQ ID NO: 546831 - DNA, 20 bp, Artificial
  CRISPR gRNA sequence
gaatgatctttttaaaacag

SEQ ID NO: 546832 - DNA, 20 bp, Artificial
  CRISPR gRNA sequence
gatctttttaaaacagaagt

SEQ ID NO: 546833 - DNA, 20 bp, Artificial
  CRISPR gRNA sequence
gatcatgtcactcatctgtg

SEQ ID NO: 546834 - DNA, 20 bp, Artificial
  CRISPR gRNA sequence
atctgtgtggaactttctaa

SEQ ID NO: 546835 - DNA, 20 bp, Artificial
  CRISPR gRNA sequence
ggccccatctaactctgtta

SEQ ID NO: 546836 - DNA, 20 bp, Artificial
  CRISPR gRNA sequence
tgttaaagctaaaatgtgta

SEQ ID NO: 546837 - DNA, 20 bp, Artificial
  CRISPR gRNA sequence
aaatgtgtaaagcgacttgc

SEQ ID NO: 546838 - DNA, 20 bp, Artificial
  CRISPR gRNA sequence
aatgtgtaaagcgacttgca

SEQ ID NO: 546839 - DNA, 20 bp, Artificial
  CRISPR gRNA sequence
agcgacttgcaaggctatgt

SEQ ID NO: 546840 - DNA, 20 bp, Artificial
  CRISPR gRNA sequence
gcgacttgcaaggctatgtg

SEQ ID NO: 546841 - DNA, 20 bp, Artificial
  CRISPR gRNA sequence
tatgtgaggtctgacccctg

SEQ ID NO: 546842 - DNA, 20 bp, Artificial
  CRISPR gRNA sequence
tgacccctgtggactctatt

SEQ ID NO: 546843 - DNA, 20 bp, Artificial
  CRISPR gRNA sequence
ggactctatttagacaaata

SEQ ID NO: 546844 - DNA, 20 bp, Artificial
  CRISPR gRNA sequence
ttagacaaatacagcttgct

SEQ ID NO: 546845 - DNA, 20 bp, Artificial
  CRISPR gRNA sequence
tacagcttgctaagatgtca

SEQ ID NO: 546846 - DNA, 20 bp, Artificial
  CRISPR gRNA sequence
aagatgtcaaagtatcctct

SEQ ID NO: 546847 - DNA, 20 bp, Artificial
  CRISPR gRNA sequence
atgtcaaagtatcctcttag

SEQ ID NO: 546848 - DNA, 20 bp, Artificial
  CRISPR gRNA sequence
cttagaagatttccttgaaa

SEQ ID NO: 546849 - DNA, 20 bp, Artificial
  CRISPR gRNA sequence
agaagatttccttgaaaaag

SEQ ID NO: 546850 - DNA, 20 bp, Artificial
  CRISPR gRNA sequence
aaagtagaatctttgaaaca

SEQ ID NO: 546851 - DNA, 20 bp, Artificial
  CRISPR gRNA sequence
aatctttgaaacatggacat

SEQ ID NO: 546852 - DNA, 20 bp, Artificial
  CRISPR gRNA sequence
atctttgaaacatggacatt

SEQ ID NO: 546853 - DNA, 20 bp, Artificial
  CRISPR gRNA sequence
tctttgaaacatggacattg

SEQ ID NO: 546854 - DNA, 20 bp, Artificial
  CRISPR gRNA sequence
attggggatctgataattta

SEQ ID NO: 546855 - DNA, 20 bp, Artificial
  CRISPR gRNA sequence
gggatctgataatttataga

SEQ ID NO: 546856 - DNA, 20 bp, Artificial
  CRISPR gRNA sequence
ggatctgataatttatagat

SEQ ID NO: 546857 - DNA, 20 bp, Artificial
  CRISPR gRNA sequence
gatctgataatttatagata

SEQ ID NO: 546858 - DNA, 20 bp, Artificial
  CRISPR gRNA sequence
tatagatagggccaacaaac

SEQ ID NO: 546859 - DNA, 20 bp, Artificial
  CRISPR gRNA sequence
tagatagggccaacaaacaa

SEQ ID NO: 546860 - DNA, 20 bp, Artificial
  CRISPR gRNA sequence
agatagggccaacaaacaag

SEQ ID NO: 546861 - DNA, 20 bp, Artificial
  CRISPR gRNA sequence
ggccaacaaacaagaggatt

SEQ ID NO: 546862 - DNA, 20 bp, Artificial
  CRISPR gRNA sequence
aacaaacaagaggattgagt

SEQ ID NO: 546863 - DNA, 20 bp, Artificial
  CRISPR gRNA sequence
aagaggattgagtcagaatt

SEQ ID NO: 546864 - DNA, 20 bp, Artificial
  CRISPR gRNA sequence
gaatttagatcacacatttt

SEQ ID NO: 546865 - DNA, 20 bp, Artificial
  CRISPR gRNA sequence
atttagatcacacattttaa

SEQ ID NO: 546866 - DNA, 20 bp, Artificial
  CRISPR gRNA sequence
cattttaagagcccttttta

SEQ ID NO: 546867 - DNA, 20 bp, Artificial
  CRISPR gRNA sequence
ttttaagagccctttttata

SEQ ID NO: 546868 - DNA, 20 bp, Artificial
  CRISPR gRNA sequence
taaaataatttaaaatattc

SEQ ID NO: 546869 - DNA, 20 bp, Artificial
  CRISPR gRNA sequence
aaaataatttaaaatattct

SEQ ID NO: 546870 - DNA, 20 bp, Artificial
  CRISPR gRNA sequence
taatttaaaatattctaggc

SEQ ID NO: 546871 - DNA, 20 bp, Artificial
  CRISPR gRNA sequence
aatttaaaatattctaggcc

SEQ ID NO: 546872 - DNA, 20 bp, Artificial
  CRISPR gRNA sequence
atattctaggccgggcattg

SEQ ID NO: 546873 - DNA, 20 bp, Artificial
  CRISPR gRNA sequence
taggccgggcattgtggctc

SEQ ID NO: 546874 - DNA, 20 bp, Artificial
  CRISPR gRNA sequence
aggccgggcattgtggctca

SEQ ID NO: 546875 - DNA, 20 bp, Artificial
  CRISPR gRNA sequence
gtggctcaaggctataatcc

SEQ ID NO: 546876 - DNA, 20 bp, Artificial
  CRISPR gRNA sequence
ctataatcccagcactttgt

SEQ ID NO: 546877 - DNA, 20 bp, Artificial
  CRISPR gRNA sequence
tataatcccagcactttgtg

SEQ ID NO: 546878 - DNA, 20 bp, Artificial
  CRISPR gRNA sequence
tcccagcactttgtgaggct

SEQ ID NO: 546879 - DNA, 20 bp, Artificial
  CRISPR gRNA sequence
cccagcactttgtgaggctg

SEQ ID NO: 546880 - DNA, 20 bp, Artificial
  CRISPR gRNA sequence
cagcactttgtgaggctgag

SEQ ID NO: 546881 - DNA, 20 bp, Artificial
  CRISPR gRNA sequence
agcactttgtgaggctgagg

SEQ ID NO: 546882 - DNA, 20 bp, Artificial
  CRISPR gRNA sequence
gcactttgtgaggctgagga

SEQ ID NO: 546883 - DNA, 20 bp, Artificial
  CRISPR gRNA sequence
actttgtgaggctgaggagg

SEQ ID NO: 546884 - DNA, 20 bp, Artificial
  CRISPR gRNA sequence
ctttgtgaggctgaggaggg

SEQ ID NO: 546885 - DNA, 20 bp, Artificial
  CRISPR gRNA sequence
tttgtgaggctgaggaggga

SEQ ID NO: 546886 - DNA, 20 bp, Artificial
  CRISPR gRNA sequence
ctgaggagggagggttgctt

SEQ ID NO: 546887 - DNA, 20 bp, Artificial
  CRISPR gRNA sequence
gagggagggttgcttaagcc

SEQ ID NO: 546888 - DNA, 20 bp, Artificial
  CRISPR gRNA sequence
ggagggttgcttaagcccag

SEQ ID NO: 546889 - DNA, 20 bp, Artificial
  CRISPR gRNA sequence
ttgcttaagcccagtagttc

SEQ ID NO: 546890 - DNA, 20 bp, Artificial
  CRISPR gRNA sequence
ccagtagttcaagaccatcc

SEQ ID NO: 546891 - DNA, 20 bp, Artificial
  CRISPR gRNA sequence
cagtagttcaagaccatcct

SEQ ID NO: 546892 - DNA, 20 bp, Artificial
  CRISPR gRNA sequence
caagaccatcctaggcaaca

SEQ ID NO: 546893 - DNA, 20 bp, Artificial
  CRISPR gRNA sequence
accatcctaggcaacatagc

SEQ ID NO: 546894 - DNA, 20 bp, Artificial
  CRISPR gRNA sequence
acaaaaataaaataattaac

SEQ ID NO: 546895 - DNA, 20 bp, Artificial
  CRISPR gRNA sequence
caaaaataaaataattaacc

SEQ ID NO: 546896 - DNA, 20 bp, Artificial
  CRISPR gRNA sequence
ataaaataattaaccaggca

SEQ ID NO: 546897 - DNA, 20 bp, Artificial
  CRISPR gRNA sequence
aaataattaaccaggcatgg

SEQ ID NO: 546898 - DNA, 20 bp, Artificial
  CRISPR gRNA sequence
ggcatggtggtgcatgcctg

SEQ ID NO: 546899 - DNA, 20 bp, Artificial
  CRISPR gRNA sequence
gtggtgcatgcctgtagtcc

SEQ ID NO: 546900 - DNA, 20 bp, Artificial
  CRISPR gRNA sequence
gcctgtagtcccagctactc

SEQ ID NO: 546901 - DNA, 20 bp, Artificial
  CRISPR gRNA sequence
ctgtagtcccagctactcaa

SEQ ID NO: 546902 - DNA, 20 bp, Artificial
  CRISPR gRNA sequence
tgtagtcccagctactcaag

SEQ ID NO: 546903 - DNA, 20 bp, Artificial
  CRISPR gRNA sequence
tcccagctactcaagaggct

SEQ ID NO: 546904 - DNA, 20 bp, Artificial
  CRISPR gRNA sequence
cccagctactcaagaggctg

SEQ ID NO: 546905 - DNA, 20 bp, Artificial
  CRISPR gRNA sequence
agctactcaagaggctgagg

SEQ ID NO: 546906 - DNA, 20 bp, Artificial
  CRISPR gRNA sequence
gctactcaagaggctgaggt

SEQ ID NO: 546907 - DNA, 20 bp, Artificial
  CRISPR gRNA sequence
tactcaagaggctgaggtgg

SEQ ID NO: 546908 - DNA, 20 bp, Artificial
  CRISPR gRNA sequence
actcaagaggctgaggtggg

SEQ ID NO: 546909 - DNA, 20 bp, Artificial
  CRISPR gRNA sequence
ctgaggtgggaggatccctt

SEQ ID NO: 546910 - DNA, 20 bp, Artificial
  CRISPR gRNA sequence
gtgggaggatcccttgagcc

SEQ ID NO: 546911 - DNA, 20 bp, Artificial
  CRISPR gRNA sequence
tgggaggatcccttgagccc

SEQ ID NO: 546912 - DNA, 20 bp, Artificial
  CRISPR gRNA sequence
ggaggatcccttgagcccag

SEQ ID NO: 546913 - DNA, 20 bp, Artificial
  CRISPR gRNA sequence
gaggatcccttgagcccagg

SEQ ID NO: 546914 - DNA, 20 bp, Artificial
  CRISPR gRNA sequence
tcccttgagcccaggaggct

SEQ ID NO: 546915 - DNA, 20 bp, Artificial
  CRISPR gRNA sequence
cccttgagcccaggaggctg

SEQ ID NO: 546916 - DNA, 20 bp, Artificial
  CRISPR gRNA sequence
agcccaggaggctgaggctg

SEQ ID NO: 546917 - DNA, 20 bp, Artificial
  CRISPR gRNA sequence
caggaggctgaggctgcagt

SEQ ID NO: 546918 - DNA, 20 bp, Artificial
  CRISPR gRNA sequence
atgattgcacctctgcactc

SEQ ID NO: 546919 - DNA, 20 bp, Artificial
  CRISPR gRNA sequence
tgcacctctgcactccagtc

SEQ ID NO: 546920 - DNA, 20 bp, Artificial
  CRISPR gRNA sequence
gcacctctgcactccagtct

SEQ ID NO: 546921 - DNA, 20 bp, Artificial
  CRISPR gRNA sequence
ctgcactccagtctgggtga

SEQ ID NO: 546922 - DNA, 20 bp, Artificial
  CRISPR gRNA sequence
tccagtctgggtgacagacc

SEQ ID NO: 546923 - DNA, 20 bp, Artificial
  CRISPR gRNA sequence
agaccctgcctcaaaataac

SEQ ID NO: 546924 - DNA, 20 bp, Artificial
  CRISPR gRNA sequence
taattaaataaaatattcta

SEQ ID NO: 546925 - DNA, 20 bp, Artificial
  CRISPR gRNA sequence
taaaatattctatggcacct

SEQ ID NO: 546926 - DNA, 20 bp, Artificial
  CRISPR gRNA sequence
tattctatggcacctcagca

SEQ ID NO: 546927 - DNA, 20 bp, Artificial
  CRISPR gRNA sequence
attctatggcacctcagcaa

SEQ ID NO: 546928 - DNA, 20 bp, Artificial
  CRISPR gRNA sequence
atggcacctcagcaaaggta

SEQ ID NO: 546929 - DNA, 20 bp, Artificial
  CRISPR gRNA sequence
cagcaaaggtatggttttgt

SEQ ID NO: 546930 - DNA, 20 bp, Artificial
  CRISPR gRNA sequence
aaaggtatggttttgttagt

SEQ ID NO: 546931 - DNA, 20 bp, Artificial
  CRISPR gRNA sequence
gttttgttagtcagaccaac

SEQ ID NO: 546932 - DNA, 20 bp, Artificial
  CRISPR gRNA sequence
tgttagtcagaccaactgga

SEQ ID NO: 546933 - DNA, 20 bp, Artificial
  CRISPR gRNA sequence
cagaccaactggatagacct

SEQ ID NO: 546934 - DNA, 20 bp, Artificial
  CRISPR gRNA sequence
agaccaactggatagacctt

SEQ ID NO: 546935 - DNA, 20 bp, Artificial
  CRISPR gRNA sequence
ccaactggatagaccttagg

SEQ ID NO: 546936 - DNA, 20 bp, Artificial
  CRISPR gRNA sequence
gatagaccttaggaagcctg

SEQ ID NO: 546937 - DNA, 20 bp, Artificial
  CRISPR gRNA sequence
tagaccttaggaagcctgca

SEQ ID NO: 546938 - DNA, 20 bp, Artificial
  CRISPR gRNA sequence
agaccttaggaagcctgcag

SEQ ID NO: 546939 - DNA, 20 bp, Artificial
  CRISPR gRNA sequence
accttaggaagcctgcagag

SEQ ID NO: 546940 - DNA, 20 bp, Artificial
  CRISPR gRNA sequence
aggaagcctgcagaggagta

SEQ ID NO: 546941 - DNA, 20 bp, Artificial
  CRISPR gRNA sequence
gcctgcagaggagtaaagta

SEQ ID NO: 546942 - DNA, 20 bp, Artificial
  CRISPR gRNA sequence
cctgcagaggagtaaagtac

SEQ ID NO: 546943 - DNA, 20 bp, Artificial
  CRISPR gRNA sequence
ctgcagaggagtaaagtaca

SEQ ID NO: 546944 - DNA, 20 bp, Artificial
  CRISPR gRNA sequence
tgcagaggagtaaagtacag

SEQ ID NO: 546945 - DNA, 20 bp, Artificial
  CRISPR gRNA sequence
cagaggagtaaagtacaggg

SEQ ID NO: 546946 - DNA, 20 bp, Artificial
  CRISPR gRNA sequence
agaggagtaaagtacagggg

SEQ ID NO: 546947 - DNA, 20 bp, Artificial
  CRISPR gRNA sequence
gagtaaagtacaggggaggt

SEQ ID NO: 546948 - DNA, 20 bp, Artificial
  CRISPR gRNA sequence
caggggaggtgagttttgat

SEQ ID NO: 546949 - DNA, 20 bp, Artificial
  CRISPR gRNA sequence
aggggaggtgagttttgatc

SEQ ID NO: 546950 - DNA, 20 bp, Artificial
  CRISPR gRNA sequence
gggaggtgagttttgatcag

SEQ ID NO: 546951 - DNA, 20 bp, Artificial
  CRISPR gRNA sequence
ggaggtgagttttgatcagg

SEQ ID NO: 546952 - DNA, 20 bp, Artificial
  CRISPR gRNA sequence
ggtgagttttgatcaggagg

SEQ ID NO: 546953 - DNA, 20 bp, Artificial
  CRISPR gRNA sequence
tcaggaggcagtgatattga

SEQ ID NO: 546954 - DNA, 20 bp, Artificial
  CRISPR gRNA sequence
gcagtgatattgatagtatt

SEQ ID NO: 546955 - DNA, 20 bp, Artificial
  CRISPR gRNA sequence
gatattgatagtattgagtg

SEQ ID NO: 546956 - DNA, 20 bp, Artificial
  CRISPR gRNA sequence
atattgatagtattgagtgt

SEQ ID NO: 546957 - DNA, 20 bp, Artificial
  CRISPR gRNA sequence
agtattgagtgtgggactta

SEQ ID NO: 546958 - DNA, 20 bp, Artificial
  CRISPR gRNA sequence
gagtgtgggacttaaagtcc

SEQ ID NO: 546959 - DNA, 20 bp, Artificial
  CRISPR gRNA sequence
gggacttaaagtcctggttt

SEQ ID NO: 546960 - DNA, 20 bp, Artificial
  CRISPR gRNA sequence
gacttaaagtcctggtttga

SEQ ID NO: 546961 - DNA, 20 bp, Artificial
  CRISPR gRNA sequence
aaagtcctggtttgagagtc

SEQ ID NO: 546962 - DNA, 20 bp, Artificial
  CRISPR gRNA sequence
tggtttgagagtctggacat

SEQ ID NO: 546963 - DNA, 20 bp, Artificial
  CRISPR gRNA sequence
agagtctggacatcagcttg

SEQ ID NO: 546964 - DNA, 20 bp, Artificial
  CRISPR gRNA sequence
gtctggacatcagcttgtag

SEQ ID NO: 546965 - DNA, 20 bp, Artificial
  CRISPR gRNA sequence
tggacatcagcttgtagcag

SEQ ID NO: 546966 - DNA, 20 bp, Artificial
  CRISPR gRNA sequence
ggacatcagcttgtagcagt

SEQ ID NO: 546967 - DNA, 20 bp, Artificial
  CRISPR gRNA sequence
gacatcagcttgtagcagtg

SEQ ID NO: 546968 - DNA, 20 bp, Artificial
  CRISPR gRNA sequence
catcagcttgtagcagtggg

SEQ ID NO: 546969 - DNA, 20 bp, Artificial
  CRISPR gRNA sequence
ggagccattgtgtcctatac

SEQ ID NO: 546970 - DNA, 20 bp, Artificial
  CRISPR gRNA sequence
agccattgtgtcctatactg

SEQ ID NO: 546971 - DNA, 20 bp, Artificial
  CRISPR gRNA sequence
attgtgtcctatactggagc

SEQ ID NO: 546972 - DNA, 20 bp, Artificial
  CRISPR gRNA sequence
ttgtgtcctatactggagca

SEQ ID NO: 546973 - DNA, 20 bp, Artificial
  CRISPR gRNA sequence
tgtcctatactggagcaagg

SEQ ID NO: 546974 - DNA, 20 bp, Artificial
  CRISPR gRNA sequence
gacttgataaaatacatttt

SEQ ID NO: 546975 - DNA, 20 bp, Artificial
  CRISPR gRNA sequence
ttgataaaatacatttttgg

SEQ ID NO: 546976 - DNA, 20 bp, Artificial
  CRISPR gRNA sequence
tttttggaagattaatgtga

SEQ ID NO: 546977 - DNA, 20 bp, Artificial
  CRISPR gRNA sequence
gtgatggtgcatacttatga

SEQ ID NO: 546978 - DNA, 20 bp, Artificial
  CRISPR gRNA sequence
tgcatacttatgatggatta

SEQ ID NO: 546979 - DNA, 20 bp, Artificial
  CRISPR gRNA sequence
catacttatgatggattaaa

SEQ ID NO: 546980 - DNA, 20 bp, Artificial
  CRISPR gRNA sequence
tacttatgatggattaaaga

SEQ ID NO: 546981 - DNA, 20 bp, Artificial
  CRISPR gRNA sequence
acttatgatggattaaagag

SEQ ID NO: 546982 - DNA, 20 bp, Artificial
  CRISPR gRNA sequence
ttatgatggattaaagagag

SEQ ID NO: 546983 - DNA, 20 bp, Artificial
  CRISPR gRNA sequence
gattaaagagaggagatgtc

SEQ ID NO: 546984 - DNA, 20 bp, Artificial
  CRISPR gRNA sequence
aaagagaggagatgtcaagt

SEQ ID NO: 546985 - DNA, 20 bp, Artificial
  CRISPR gRNA sequence
gagaggagatgtcaagttag

SEQ ID NO: 546986 - DNA, 20 bp, Artificial
  CRISPR gRNA sequence
agttagaagctactatcatc

SEQ ID NO: 546987 - DNA, 20 bp, Artificial
  CRISPR gRNA sequence
gttagaagctactatcatcc

SEQ ID NO: 546988 - DNA, 20 bp, Artificial
  CRISPR gRNA sequence
agaagctactatcatccagg

SEQ ID NO: 546989 - DNA, 20 bp, Artificial
  CRISPR gRNA sequence
gctactatcatccaggtaga

SEQ ID NO: 546990 - DNA, 20 bp, Artificial
  CRISPR gRNA sequence
tactatcatccaggtagata

SEQ ID NO: 546991 - DNA, 20 bp, Artificial
  CRISPR gRNA sequence
actatcatccaggtagatag

SEQ ID NO: 546992 - DNA, 20 bp, Artificial
  CRISPR gRNA sequence
ctatcatccaggtagataga

SEQ ID NO: 546993 - DNA, 20 bp, Artificial
  CRISPR gRNA sequence
tccaggtagatagagggtcc

SEQ ID NO: 546994 - DNA, 20 bp, Artificial
  CRISPR gRNA sequence
ggtagatagagggtccaaga

SEQ ID NO: 546995 - DNA, 20 bp, Artificial
  CRISPR gRNA sequence
tagatagagggtccaagaaa

SEQ ID NO: 546996 - DNA, 20 bp, Artificial
  CRISPR gRNA sequence
gggtccaagaaagagtctgc

SEQ ID NO: 546997 - DNA, 20 bp, Artificial
  CRISPR gRNA sequence
aagaaagagtctgcaagatg

SEQ ID NO: 546998 - DNA, 20 bp, Artificial
  CRISPR gRNA sequence
agaaagagtctgcaagatgt

SEQ ID NO: 546999 - DNA, 20 bp, Artificial
  CRISPR gRNA sequence
agtctgcaagatgtaggttt

SEQ ID NO: 547000 - DNA, 20 bp, Artificial
  CRISPR gRNA sequence
atgtaggttttggttgtaaa

SEQ ID NO: 547001 - DNA, 20 bp, Artificial
  CRISPR gRNA sequence
ttttggttgtaaaaagacat

SEQ ID NO: 547002 - DNA, 20 bp, Artificial
  CRISPR gRNA sequence
aaaaagacataagatgactc

SEQ ID NO: 547003 - DNA, 20 bp, Artificial
  CRISPR gRNA sequence
aaaagacataagatgactct

SEQ ID NO: 547004 - DNA, 20 bp, Artificial
  CRISPR gRNA sequence
catctgcatgataaaatgat

SEQ ID NO: 547005 - DNA, 20 bp, Artificial
  CRISPR gRNA sequence
tactattttttttttttttt

SEQ ID NO: 547006 - DNA, 20 bp, Artificial
  CRISPR gRNA sequence
tttttttttttttttaagaa

SEQ ID NO: 547007 - DNA, 20 bp, Artificial
  CRISPR gRNA sequence
tttttttttttttaagaaaa

SEQ ID NO: 547008 - DNA, 20 bp, Artificial
  CRISPR gRNA sequence
ttttttttttttaagaaaag

SEQ ID NO: 547009 - DNA, 20 bp, Artificial
  CRISPR gRNA sequence
tttttttttaagaaaagagg

SEQ ID NO: 547010 - DNA, 20 bp, Artificial
  CRISPR gRNA sequence
agaggaagtcatacttcctt

SEQ ID NO: 547011 - DNA, 20 bp, Artificial
  CRISPR gRNA sequence
gaggaagtcatacttccttg

SEQ ID NO: 547012 - DNA, 20 bp, Artificial
  CRISPR gRNA sequence
ggtaatgttaacacttgttt

SEQ ID NO: 547013 - DNA, 20 bp, Artificial
  CRISPR gRNA sequence
taacacttgttttagtaacc

SEQ ID NO: 547014 - DNA, 20 bp, Artificial
  CRISPR gRNA sequence
ttagtaacctggtaatcttc

SEQ ID NO: 547015 - DNA, 20 bp, Artificial
  CRISPR gRNA sequence
agtaacctggtaatcttcta

SEQ ID NO: 547016 - DNA, 20 bp, Artificial
  CRISPR gRNA sequence
tggtaatcttctagagacac

SEQ ID NO: 547017 - DNA, 20 bp, Artificial
  CRISPR gRNA sequence
tctagagacaccagacctaa

SEQ ID NO: 547018 - DNA, 20 bp, Artificial
  CRISPR gRNA sequence
ctagagacaccagacctaat

SEQ ID NO: 547019 - DNA, 20 bp, Artificial
  CRISPR gRNA sequence
agagacaccagacctaatag

SEQ ID NO: 547020 - DNA, 20 bp, Artificial
  CRISPR gRNA sequence
cagacctaataggagacttc

SEQ ID NO: 547021 - DNA, 20 bp, Artificial
  CRISPR gRNA sequence
cctaataggagacttccagt

SEQ ID NO: 547022 - DNA, 20 bp, Artificial
  CRISPR gRNA sequence
gacttccagtgagcatattt

SEQ ID NO: 547023 - DNA, 20 bp, Artificial
  CRISPR gRNA sequence
tccagtgagcatattttgga

SEQ ID NO: 547024 - DNA, 20 bp, Artificial
  CRISPR gRNA sequence
ccagtgagcatattttggac

SEQ ID NO: 547025 - DNA, 20 bp, Artificial
  CRISPR gRNA sequence
cagtgagcatattttggaca

SEQ ID NO: 547026 - DNA, 20 bp, Artificial
  CRISPR gRNA sequence
agtgagcatattttggacag

SEQ ID NO: 547027 - DNA, 20 bp, Artificial
  CRISPR gRNA sequence
gtgagcatattttggacagg

SEQ ID NO: 547028 - DNA, 20 bp, Artificial
  CRISPR gRNA sequence
ttttggacagggggatttcc

SEQ ID NO: 547029 - DNA, 20 bp, Artificial
  CRISPR gRNA sequence
ttcctggcacttcctaaatt

SEQ ID NO: 547030 - DNA, 20 bp, Artificial
  CRISPR gRNA sequence
tcctggcacttcctaaattc

SEQ ID NO: 547031 - DNA, 20 bp, Artificial
  CRISPR gRNA sequence
cctggcacttcctaaattca

SEQ ID NO: 547032 - DNA, 20 bp, Artificial
  CRISPR gRNA sequence
cttccttctgtgtgtacatt

SEQ ID NO: 547033 - DNA, 20 bp, Artificial
  CRISPR gRNA sequence
tctgtgtgtacattgagatc

SEQ ID NO: 547034 - DNA, 20 bp, Artificial
  CRISPR gRNA sequence
tggctttcctccatacccaa

SEQ ID NO: 547035 - DNA, 20 bp, Artificial
  CRISPR gRNA sequence
cccttaaaatttctacttct

SEQ ID NO: 547036 - DNA, 20 bp, Artificial
  CRISPR gRNA sequence
ccttaaaatttctacttctg

SEQ ID NO: 547037 - DNA, 20 bp, Artificial
  CRISPR gRNA sequence
tttctacttctgaggtttat

SEQ ID NO: 547038 - DNA, 20 bp, Artificial
  CRISPR gRNA sequence
agtcctttcccatcttttta

SEQ ID NO: 547039 - DNA, 20 bp, Artificial
  CRISPR gRNA sequence
tatggaccttcatcacatct

SEQ ID NO: 547040 - DNA, 20 bp, Artificial
  CRISPR gRNA sequence
tcagatgatgatttttatgt

SEQ ID NO: 547041 - DNA, 20 bp, Artificial
  CRISPR gRNA sequence
gatgatgatttttatgtaag

SEQ ID NO: 547042 - DNA, 20 bp, Artificial
  CRISPR gRNA sequence
ttaactgccctgtccttaac

SEQ ID NO: 547043 - DNA, 20 bp, Artificial
  CRISPR gRNA sequence
taactgccctgtccttaact

SEQ ID NO: 547044 - DNA, 20 bp, Artificial
  CRISPR gRNA sequence
tgccctgtccttaactgggc

SEQ ID NO: 547045 - DNA, 20 bp, Artificial
  CRISPR gRNA sequence
atatttctataaaatgtcat

SEQ ID NO: 547046 - DNA, 20 bp, Artificial
  CRISPR gRNA sequence
aaatgtcatcagatatgtgt

SEQ ID NO: 547047 - DNA, 20 bp, Artificial
  CRISPR gRNA sequence
agaaattctcattttttaca

SEQ ID NO: 547048 - DNA, 20 bp, Artificial
  CRISPR gRNA sequence
aattctcattttttacacag

SEQ ID NO: 547049 - DNA, 20 bp, Artificial
  CRISPR gRNA sequence
tataaattgactaattgtct

SEQ ID NO: 547050 - DNA, 20 bp, Artificial
  CRISPR gRNA sequence
ataaattgactaattgtctt

SEQ ID NO: 547051 - DNA, 20 bp, Artificial
  CRISPR gRNA sequence
taaattgactaattgtctta

SEQ ID NO: 547052 - DNA, 20 bp, Artificial
  CRISPR gRNA sequence
aattgactaattgtcttagg

SEQ ID NO: 547053 - DNA, 20 bp, Artificial
  CRISPR gRNA sequence
attgactaattgtcttaggg

SEQ ID NO: 547054 - DNA, 20 bp, Artificial
  CRISPR gRNA sequence
gactaattgtcttagggagg

SEQ ID NO: 547055 - DNA, 20 bp, Artificial
  CRISPR gRNA sequence
taattgtcttagggaggaag

SEQ ID NO: 547056 - DNA, 20 bp, Artificial
  CRISPR gRNA sequence
aattgtcttagggaggaagt

SEQ ID NO: 547057 - DNA, 20 bp, Artificial
  CRISPR gRNA sequence
gaagtaggcacatttcttgc

SEQ ID NO: 547058 - DNA, 20 bp, Artificial
  CRISPR gRNA sequence
tgccagtttaatgctgctta

SEQ ID NO: 547059 - DNA, 20 bp, Artificial
  CRISPR gRNA sequence
cagtttaatgctgcttaaag

SEQ ID NO: 547060 - DNA, 20 bp, Artificial
  CRISPR gRNA sequence
gtttaatgctgcttaaagta

SEQ ID NO: 547061 - DNA, 20 bp, Artificial
  CRISPR gRNA sequence
tttaatgctgcttaaagtag

SEQ ID NO: 547062 - DNA, 20 bp, Artificial
  CRISPR gRNA sequence
gaggtataacgaatatttgt

SEQ ID NO: 547063 - DNA, 20 bp, Artificial
  CRISPR gRNA sequence
taacgaatatttgttagata

SEQ ID NO: 547064 - DNA, 20 bp, Artificial
  CRISPR gRNA sequence
atatttgttagatacagctg

SEQ ID NO: 547065 - DNA, 20 bp, Artificial
  CRISPR gRNA sequence
ttgttagatacagctgtggt

SEQ ID NO: 547066 - DNA, 20 bp, Artificial
  CRISPR gRNA sequence
tacagctgtggtaagtccca

SEQ ID NO: 547067 - DNA, 20 bp, Artificial
  CRISPR gRNA sequence
acagctgtggtaagtcccac

SEQ ID NO: 547068 - DNA, 20 bp, Artificial
  CRISPR gRNA sequence
gctgtggtaagtcccacggg

SEQ ID NO: 547069 - DNA, 20 bp, Artificial
  CRISPR gRNA sequence
tggtaagtcccacgggcagc

SEQ ID NO: 547070 - DNA, 20 bp, Artificial
  CRISPR gRNA sequence
cgggcagcaagaaaatatga

SEQ ID NO: 547071 - DNA, 20 bp, Artificial
  CRISPR gRNA sequence
aagaaaatatgaaagattta

SEQ ID NO: 547072 - DNA, 20 bp, Artificial
  CRISPR gRNA sequence
aaaatatgaaagatttatag

SEQ ID NO: 547073 - DNA, 20 bp, Artificial
  CRISPR gRNA sequence
aaatatgaaagatttataga

SEQ ID NO: 547074 - DNA, 20 bp, Artificial
  CRISPR gRNA sequence
tgaaagatttatagaaggaa

SEQ ID NO: 547075 - DNA, 20 bp, Artificial
  CRISPR gRNA sequence
tttatagaaggaaaagatct

SEQ ID NO: 547076 - DNA, 20 bp, Artificial
  CRISPR gRNA sequence
ttatagaaggaaaagatctg

SEQ ID NO: 547077 - DNA, 20 bp, Artificial
  CRISPR gRNA sequence
gaaggaaaagatctgaggtg

SEQ ID NO: 547078 - DNA, 20 bp, Artificial
  CRISPR gRNA sequence
gaggtgtagaaactgtgatc

SEQ ID NO: 547079 - DNA, 20 bp, Artificial
  CRISPR gRNA sequence
aggtgtagaaactgtgatct

SEQ ID NO: 547080 - DNA, 20 bp, Artificial
  CRISPR gRNA sequence
aaactgtgatctaggtgctg

SEQ ID NO: 547081 - DNA, 20 bp, Artificial
  CRISPR gRNA sequence
tgtgatctaggtgctgcaga

SEQ ID NO: 547082 - DNA, 20 bp, Artificial
  CRISPR gRNA sequence
gtgatctaggtgctgcagaa

SEQ ID NO: 547083 - DNA, 20 bp, Artificial
  CRISPR gRNA sequence
cagaaaggcttgcacacttt

SEQ ID NO: 547084 - DNA, 20 bp, Artificial
  CRISPR gRNA sequence
aggcttgcacacttttagat

SEQ ID NO: 547085 - DNA, 20 bp, Artificial
  CRISPR gRNA sequence
ttgcacacttttagatgagt

SEQ ID NO: 547086 - DNA, 20 bp, Artificial
  CRISPR gRNA sequence
acacttttagatgagttgga

SEQ ID NO: 547087 - DNA, 20 bp, Artificial
  CRISPR gRNA sequence
cacttttagatgagttggat

SEQ ID NO: 547088 - DNA, 20 bp, Artificial
  CRISPR gRNA sequence
gcacttctacctttgccatc

SEQ ID NO: 547089 - DNA, 20 bp, Artificial
  CRISPR gRNA sequence
tctggcaactgttgtgtaat

SEQ ID NO: 547090 - DNA, 20 bp, Artificial
  CRISPR gRNA sequence
gcaactgttgtgtaatgaga

SEQ ID NO: 547091 - DNA, 20 bp, Artificial
  CRISPR gRNA sequence
ctgttgtgtaatgagatagc

SEQ ID NO: 547092 - DNA, 20 bp, Artificial
  CRISPR gRNA sequence
tgtgtaatgagatagccaga

SEQ ID NO: 547093 - DNA, 20 bp, Artificial
  CRISPR gRNA sequence
tgtaatgagatagccagaaa

SEQ ID NO: 547094 - DNA, 20 bp, Artificial
  CRISPR gRNA sequence
agccagaaagagcttctacc

SEQ ID NO: 547095 - DNA, 20 bp, Artificial
  CRISPR gRNA sequence
gaaagagcttctacctagtc

SEQ ID NO: 547096 - DNA, 20 bp, Artificial
  CRISPR gRNA sequence
aaagagcttctacctagtca

SEQ ID NO: 547097 - DNA, 20 bp, Artificial
  CRISPR gRNA sequence
aagagcttctacctagtcaa

SEQ ID NO: 547098 - DNA, 20 bp, Artificial
  CRISPR gRNA sequence
gagcttctacctagtcaagg

SEQ ID NO: 547099 - DNA, 20 bp, Artificial
  CRISPR gRNA sequence
ctacctagtcaagggagttc

SEQ ID NO: 547100 - DNA, 20 bp, Artificial
  CRISPR gRNA sequence
tcaagggagttctagcaact

SEQ ID NO: 547101 - DNA, 20 bp, Artificial
  CRISPR gRNA sequence
agggagttctagcaacttag

SEQ ID NO: 547102 - DNA, 20 bp, Artificial
  CRISPR gRNA sequence
ttttttacaaaccctgcatg

SEQ ID NO: 547103 - DNA, 20 bp, Artificial
  CRISPR gRNA sequence
caaaccctgcatgtggcact

SEQ ID NO: 547104 - DNA, 20 bp, Artificial
  CRISPR gRNA sequence
catattctgtttgaccttta

SEQ ID NO: 547105 - DNA, 20 bp, Artificial
  CRISPR gRNA sequence
acctttacagtgacctgata

SEQ ID NO: 547106 - DNA, 20 bp, Artificial
  CRISPR gRNA sequence
tgatacagcattccctttca

SEQ ID NO: 547107 - DNA, 20 bp, Artificial
  CRISPR gRNA sequence
tccctttcacagatgaaaat

SEQ ID NO: 547108 - DNA, 20 bp, Artificial
  CRISPR gRNA sequence
tttcacagatgaaaataaga

SEQ ID NO: 547109 - DNA, 20 bp, Artificial
  CRISPR gRNA sequence
cagatgaaaataagacagtt

SEQ ID NO: 547110 - DNA, 20 bp, Artificial
  CRISPR gRNA sequence
agatgaaaataagacagttt

SEQ ID NO: 547111 - DNA, 20 bp, Artificial
  CRISPR gRNA sequence
atgaaaataagacagtttag

SEQ ID NO: 547112 - DNA, 20 bp, Artificial
  CRISPR gRNA sequence
ttaggagtccgtttctctgt

SEQ ID NO: 547113 - DNA, 20 bp, Artificial
  CRISPR gRNA sequence
ggagtccgtttctctgtaag

SEQ ID NO: 547114 - DNA, 20 bp, Artificial
  CRISPR gRNA sequence
cgtttctctgtaagtagaac

SEQ ID NO: 547115 - DNA, 20 bp, Artificial
  CRISPR gRNA sequence
tttctctgtaagtagaacaa

SEQ ID NO: 547116 - DNA, 20 bp, Artificial
  CRISPR gRNA sequence
tgtaagtagaacaagagacc

SEQ ID NO: 547117 - DNA, 20 bp, Artificial
  CRISPR gRNA sequence
agtagaacaagagacctgga

SEQ ID NO: 547118 - DNA, 20 bp, Artificial
  CRISPR gRNA sequence
atgctttcttaaaactcttc

SEQ ID NO: 547119 - DNA, 20 bp, Artificial
  CRISPR gRNA sequence
aaaactcttccagctcctaa

SEQ ID NO: 547120 - DNA, 20 bp, Artificial
  CRISPR gRNA sequence
aaactcttccagctcctaaa

SEQ ID NO: 547121 - DNA, 20 bp, Artificial
  CRISPR gRNA sequence
tccagctcctaaaaggactg

SEQ ID NO: 547122 - DNA, 20 bp, Artificial
  CRISPR gRNA sequence
tcctaaaaggactgtggccc

SEQ ID NO: 547123 - DNA, 20 bp, Artificial
  CRISPR gRNA sequence
cctaaaaggactgtggcccc

SEQ ID NO: 547124 - DNA, 20 bp, Artificial
  CRISPR gRNA sequence
gactgtggccccaggtcaca

SEQ ID NO: 547125 - DNA, 20 bp, Artificial
  CRISPR gRNA sequence
tgtggccccaggtcacacag

SEQ ID NO: 547126 - DNA, 20 bp, Artificial
  CRISPR gRNA sequence
gtggccccaggtcacacagc

SEQ ID NO: 547127 - DNA, 20 bp, Artificial
  CRISPR gRNA sequence
cccaggtcacacagcaggcc

SEQ ID NO: 547128 - DNA, 20 bp, Artificial
  CRISPR gRNA sequence
ccaggtcacacagcaggcca

SEQ ID NO: 547129 - DNA, 20 bp, Artificial
  CRISPR gRNA sequence
tcacacagcaggccaaggct

SEQ ID NO: 547130 - DNA, 20 bp, Artificial
  CRISPR gRNA sequence
cacacagcaggccaaggcta

SEQ ID NO: 547131 - DNA, 20 bp, Artificial
  CRISPR gRNA sequence
caaacctcccaactcctact

SEQ ID NO: 547132 - DNA, 20 bp, Artificial
  CRISPR gRNA sequence
tcatcatatcacataccctc

SEQ ID NO: 547133 - DNA, 20 bp, Artificial
  CRISPR gRNA sequence
catcatatcacataccctcc

SEQ ID NO: 547134 - DNA, 20 bp, Artificial
  CRISPR gRNA sequence
atcatatcacataccctccg

SEQ ID NO: 547135 - DNA, 20 bp, Artificial
  CRISPR gRNA sequence
catatcacataccctccggg

SEQ ID NO: 547136 - DNA, 20 bp, Artificial
  CRISPR gRNA sequence
acataccctccggggagcct

SEQ ID NO: 547137 - DNA, 20 bp, Artificial
  CRISPR gRNA sequence
tccggggagcctcggcttcc

SEQ ID NO: 547138 - DNA, 20 bp, Artificial
  CRISPR gRNA sequence
cggggagcctcggcttcctg

SEQ ID NO: 547139 - DNA, 20 bp, Artificial
  CRISPR gRNA sequence
gagcctcggcttcctggagt

SEQ ID NO: 547140 - DNA, 20 bp, Artificial
  CRISPR gRNA sequence
ttcctggagttggaaactca

SEQ ID NO: 547141 - DNA, 20 bp, Artificial
  CRISPR gRNA sequence
agttggaaactcacagccaa

SEQ ID NO: 547142 - DNA, 20 bp, Artificial
  CRISPR gRNA sequence
aatggccgtgtgctctatta

SEQ ID NO: 547143 - DNA, 20 bp, Artificial
  CRISPR gRNA sequence
gccgtgtgctctattacagc

SEQ ID NO: 547144 - DNA, 20 bp, Artificial
  CRISPR gRNA sequence
tattacagctagcatttgtt

SEQ ID NO: 547145 - DNA, 20 bp, Artificial
  CRISPR gRNA sequence
tgttaagtacttactctgtg

SEQ ID NO: 547146 - DNA, 20 bp, Artificial
  CRISPR gRNA sequence
gttaagtacttactctgtgc

SEQ ID NO: 547147 - DNA, 20 bp, Artificial
  CRISPR gRNA sequence
taactcatttaatctcatta

SEQ ID NO: 547148 - DNA, 20 bp, Artificial
  CRISPR gRNA sequence
ttaatctcattacagtctga

SEQ ID NO: 547149 - DNA, 20 bp, Artificial
  CRISPR gRNA sequence
aatctcattacagtctgata

SEQ ID NO: 547150 - DNA, 20 bp, Artificial
  CRISPR gRNA sequence
tcattacagtctgatagagt

SEQ ID NO: 547151 - DNA, 20 bp, Artificial
  CRISPR gRNA sequence
tactatttgtgtccttattg

SEQ ID NO: 547152 - DNA, 20 bp, Artificial
  CRISPR gRNA sequence
ctatttgtgtccttattgta

SEQ ID NO: 547153 - DNA, 20 bp, Artificial
  CRISPR gRNA sequence
atttgtgtccttattgtaga

SEQ ID NO: 547154 - DNA, 20 bp, Artificial
  CRISPR gRNA sequence
tttgtgtccttattgtagag

SEQ ID NO: 547155 - DNA, 20 bp, Artificial
  CRISPR gRNA sequence
tgtgtccttattgtagagag

SEQ ID NO: 547156 - DNA, 20 bp, Artificial
  CRISPR gRNA sequence
gtgtccttattgtagagagg

SEQ ID NO: 547157 - DNA, 20 bp, Artificial
  CRISPR gRNA sequence
attgtagagaggaggaaacc

SEQ ID NO: 547158 - DNA, 20 bp, Artificial
  CRISPR gRNA sequence
agaggaggaaacctagacac

SEQ ID NO: 547159 - DNA, 20 bp, Artificial
  CRISPR gRNA sequence
gaggaggaaacctagacaca

SEQ ID NO: 547160 - DNA, 20 bp, Artificial
  CRISPR gRNA sequence
acctagacacaaggtgattt

SEQ ID NO: 547161 - DNA, 20 bp, Artificial
  CRISPR gRNA sequence
gtaacttgcccaatgtcaaa

SEQ ID NO: 547162 - DNA, 20 bp, Artificial
  CRISPR gRNA sequence
gcccaatgtcaaatggctct

SEQ ID NO: 547163 - DNA, 20 bp, Artificial
  CRISPR gRNA sequence
tcaaatggctcttagtcatg

SEQ ID NO: 547164 - DNA, 20 bp, Artificial
  CRISPR gRNA sequence
atggctcttagtcatgaagc

SEQ ID NO: 547165 - DNA, 20 bp, Artificial
  CRISPR gRNA sequence
tggctcttagtcatgaagct

SEQ ID NO: 547166 - DNA, 20 bp, Artificial
  CRISPR gRNA sequence
atgaagctgggatatgcact

SEQ ID NO: 547167 - DNA, 20 bp, Artificial
  CRISPR gRNA sequence
tgaagctgggatatgcactc

SEQ ID NO: 547168 - DNA, 20 bp, Artificial
  CRISPR gRNA sequence
agctgggatatgcactcagg

SEQ ID NO: 547169 - DNA, 20 bp, Artificial
  CRISPR gRNA sequence
gggatatgcactcaggcagc

SEQ ID NO: 547170 - DNA, 20 bp, Artificial
  CRISPR gRNA sequence
ggatatgcactcaggcagct

SEQ ID NO: 547171 - DNA, 20 bp, Artificial
  CRISPR gRNA sequence
actcaggcagctgggcttct

SEQ ID NO: 547172 - DNA, 20 bp, Artificial
  CRISPR gRNA sequence
aacaccatactgtacctctt

SEQ ID NO: 547173 - DNA, 20 bp, Artificial
  CRISPR gRNA sequence
caccatactgtacctctttg

SEQ ID NO: 547174 - DNA, 20 bp, Artificial
  CRISPR gRNA sequence
atactgtacctctttggaga

SEQ ID NO: 547175 - DNA, 20 bp, Artificial
  CRISPR gRNA sequence
ctgtacctctttggagatag

SEQ ID NO: 547176 - DNA, 20 bp, Artificial
  CRISPR gRNA sequence
tgtacctctttggagatagc

SEQ ID NO: 547177 - DNA, 20 bp, Artificial
  CRISPR gRNA sequence
acctctttggagatagcggg

SEQ ID NO: 547178 - DNA, 20 bp, Artificial
  CRISPR gRNA sequence
tctttggagatagcgggtag

SEQ ID NO: 547179 - DNA, 20 bp, Artificial
  CRISPR gRNA sequence
aagaatttacattttatttg

SEQ ID NO: 547180 - DNA, 20 bp, Artificial
  CRISPR gRNA sequence
atctgtcctgtactgcttgt

SEQ ID NO: 547181 - DNA, 20 bp, Artificial
  CRISPR gRNA sequence
tctgtcctgtactgcttgtg

SEQ ID NO: 547182 - DNA, 20 bp, Artificial
  CRISPR gRNA sequence
tgtcctgtactgcttgtgag

SEQ ID NO: 547183 - DNA, 20 bp, Artificial
  CRISPR gRNA sequence
ttgcattatgtcatgtgctg

SEQ ID NO: 547184 - DNA, 20 bp, Artificial
  CRISPR gRNA sequence
atgtcatgtgctgtggttga

SEQ ID NO: 547185 - DNA, 20 bp, Artificial
  CRISPR gRNA sequence
tgtcatgtgctgtggttgaa

SEQ ID NO: 547186 - DNA, 20 bp, Artificial
  CRISPR gRNA sequence
atgtgctgtggttgaaaggt

SEQ ID NO: 547187 - DNA, 20 bp, Artificial
  CRISPR gRNA sequence
gttgaaaggtgagtcatacc

SEQ ID NO: 547188 - DNA, 20 bp, Artificial
  CRISPR gRNA sequence
tacctagtctttgccctcca

SEQ ID NO: 547189 - DNA, 20 bp, Artificial
  CRISPR gRNA sequence
ctttgccctccaaagataca

SEQ ID NO: 547190 - DNA, 20 bp, Artificial
  CRISPR gRNA sequence
ctccaaagatacacagtctc

SEQ ID NO: 547191 - DNA, 20 bp, Artificial
  CRISPR gRNA sequence
tccaaagatacacagtctct

SEQ ID NO: 547192 - DNA, 20 bp, Artificial
  CRISPR gRNA sequence
ccaaagatacacagtctctg

SEQ ID NO: 547193 - DNA, 20 bp, Artificial
  CRISPR gRNA sequence
gctgatgatgcacctctgtt

SEQ ID NO: 547194 - DNA, 20 bp, Artificial
  CRISPR gRNA sequence
tgatgcacctctgttcagtt

SEQ ID NO: 547195 - DNA, 20 bp, Artificial
  CRISPR gRNA sequence
gcacctctgttcagttcaga

SEQ ID NO: 547196 - DNA, 20 bp, Artificial
  CRISPR gRNA sequence
ctgttcagttcagaaagtgc

SEQ ID NO: 547197 - DNA, 20 bp, Artificial
  CRISPR gRNA sequence
gttcagaaagtgctggatga

SEQ ID NO: 547198 - DNA, 20 bp, Artificial
  CRISPR gRNA sequence
gaaagtgctggatgaaagac

SEQ ID NO: 547199 - DNA, 20 bp, Artificial
  CRISPR gRNA sequence
ctggatgaaagactagacat

SEQ ID NO: 547200 - DNA, 20 bp, Artificial
  CRISPR gRNA sequence
gatgaaagactagacattgg

SEQ ID NO: 547201 - DNA, 20 bp, Artificial
  CRISPR gRNA sequence
tgaaagactagacattggca

SEQ ID NO: 547202 - DNA, 20 bp, Artificial
  CRISPR gRNA sequence
agactagacattggcagagc

SEQ ID NO: 547203 - DNA, 20 bp, Artificial
  CRISPR gRNA sequence
gcagagctagatcaatacat

SEQ ID NO: 547204 - DNA, 20 bp, Artificial
  CRISPR gRNA sequence
caatacattagaatctgcaa

SEQ ID NO: 547205 - DNA, 20 bp, Artificial
  CRISPR gRNA sequence
agaatctgcaacagaacaaa

SEQ ID NO: 547206 - DNA, 20 bp, Artificial
  CRISPR gRNA sequence
gaatctgcaacagaacaaac

SEQ ID NO: 547207 - DNA, 20 bp, Artificial
  CRISPR gRNA sequence
aacaaacaggccacatacat

SEQ ID NO: 547208 - DNA, 20 bp, Artificial
  CRISPR gRNA sequence
aaacaggccacatacatcag

SEQ ID NO: 547209 - DNA, 20 bp, Artificial
  CRISPR gRNA sequence
ccacatacatcagaagcacc

SEQ ID NO: 547210 - DNA, 20 bp, Artificial
  CRISPR gRNA sequence
cacatacatcagaagcacct

SEQ ID NO: 547211 - DNA, 20 bp, Artificial
  CRISPR gRNA sequence
tacatcagaagcacctggga

SEQ ID NO: 547212 - DNA, 20 bp, Artificial
  CRISPR gRNA sequence
atcagaagcacctgggatgg

SEQ ID NO: 547213 - DNA, 20 bp, Artificial
  CRISPR gRNA sequence
tcagaagcacctgggatggt

SEQ ID NO: 547214 - DNA, 20 bp, Artificial
  CRISPR gRNA sequence
cagaagcacctgggatggtg

SEQ ID NO: 547215 - DNA, 20 bp, Artificial
  CRISPR gRNA sequence
gcacctgggatggtggggct

SEQ ID NO: 547216 - DNA, 20 bp, Artificial
  CRISPR gRNA sequence
cacctgggatggtggggctc

SEQ ID NO: 547217 - DNA, 20 bp, Artificial
  CRISPR gRNA sequence
caggaatctgtatttttaac

SEQ ID NO: 547218 - DNA, 20 bp, Artificial
  CRISPR gRNA sequence
gtatttttaacaagcaccct

SEQ ID NO: 547219 - DNA, 20 bp, Artificial
  CRISPR gRNA sequence
caagcacccttggtgattct

SEQ ID NO: 547220 - DNA, 20 bp, Artificial
  CRISPR gRNA sequence
aagcacccttggtgattctt

SEQ ID NO: 547221 - DNA, 20 bp, Artificial
  CRISPR gRNA sequence
tcttaggcaccttaaaattt

SEQ ID NO: 547222 - DNA, 20 bp, Artificial
  CRISPR gRNA sequence
aaaatttgagaaatgcttca

SEQ ID NO: 547223 - DNA, 20 bp, Artificial
  CRISPR gRNA sequence
aaatttgagaaatgcttcaa

SEQ ID NO: 547224 - DNA, 20 bp, Artificial
  CRISPR gRNA sequence
tgcttcaaaggaccatttct

SEQ ID NO: 547225 - DNA, 20 bp, Artificial
  CRISPR gRNA sequence
gcttcaaaggaccatttcta

SEQ ID NO: 547226 - DNA, 20 bp, Artificial
  CRISPR gRNA sequence
ttcaaaggaccatttctaag

SEQ ID NO: 547227 - DNA, 20 bp, Artificial
  CRISPR gRNA sequence
tcaaaggaccatttctaagg

SEQ ID NO: 547228 - DNA, 20 bp, Artificial
  CRISPR gRNA sequence
aaggaccatttctaaggagg

SEQ ID NO: 547229 - DNA, 20 bp, Artificial
  CRISPR gRNA sequence
accatttctaaggaggtaga

SEQ ID NO: 547230 - DNA, 20 bp, Artificial
  CRISPR gRNA sequence
ttctaaggaggtagaaagct

SEQ ID NO: 547231 - DNA, 20 bp, Artificial
  CRISPR gRNA sequence
aagcttggttttctgcccct

SEQ ID NO: 547232 - DNA, 20 bp, Artificial
  CRISPR gRNA sequence
ttctgcccctgagaaatgcc

SEQ ID NO: 547233 - DNA, 20 bp, Artificial
  CRISPR gRNA sequence
cccctgagaaatgcccagcc

SEQ ID NO: 547234 - DNA, 20 bp, Artificial
  CRISPR gRNA sequence
agaaatgcccagcctagtta

SEQ ID NO: 547235 - DNA, 20 bp, Artificial
  CRISPR gRNA sequence
aaatgcccagcctagttaca

SEQ ID NO: 547236 - DNA, 20 bp, Artificial
  CRISPR gRNA sequence
aatgcccagcctagttacag

SEQ ID NO: 547237 - DNA, 20 bp, Artificial
  CRISPR gRNA sequence
gcccagcctagttacagagg

SEQ ID NO: 547238 - DNA, 20 bp, Artificial
  CRISPR gRNA sequence
cccagcctagttacagaggc

SEQ ID NO: 547239 - DNA, 20 bp, Artificial
  CRISPR gRNA sequence
ctagttacagaggcaggcat

SEQ ID NO: 547240 - DNA, 20 bp, Artificial
  CRISPR gRNA sequence
gcataagtatatgaaatact

SEQ ID NO: 547241 - DNA, 20 bp, Artificial
  CRISPR gRNA sequence
agtatatgaaatactgagaa

SEQ ID NO: 547242 - DNA, 20 bp, Artificial
  CRISPR gRNA sequence
gtatatgaaatactgagaac

SEQ ID NO: 547243 - DNA, 20 bp, Artificial
  CRISPR gRNA sequence
caggcatttttgaactattc

SEQ ID NO: 547244 - DNA, 20 bp, Artificial
  CRISPR gRNA sequence
aggcatttttgaactattct

SEQ ID NO: 547245 - DNA, 20 bp, Artificial
  CRISPR gRNA sequence
ggcatttttgaactattctg

SEQ ID NO: 547246 - DNA, 20 bp, Artificial
  CRISPR gRNA sequence
ttctggggatgcatgttcct

SEQ ID NO: 547247 - DNA, 20 bp, Artificial
  CRISPR gRNA sequence
tggggatgcatgttccttgg

SEQ ID NO: 547248 - DNA, 20 bp, Artificial
  CRISPR gRNA sequence
atgttccttggaagtcccct

SEQ ID NO: 547249 - DNA, 20 bp, Artificial
  CRISPR gRNA sequence
tgttccttggaagtcccctg

SEQ ID NO: 547250 - DNA, 20 bp, Artificial
  CRISPR gRNA sequence
gttccttggaagtcccctga

SEQ ID NO: 547251 - DNA, 20 bp, Artificial
  CRISPR gRNA sequence
aagtcccctgagggctgcta

SEQ ID NO: 547252 - DNA, 20 bp, Artificial
  CRISPR gRNA sequence
agtcccctgagggctgctat

SEQ ID NO: 547253 - DNA, 20 bp, Artificial
  CRISPR gRNA sequence
gtcccctgagggctgctatg

SEQ ID NO: 547254 - DNA, 20 bp, Artificial
  CRISPR gRNA sequence
ccctgagggctgctatgggg

SEQ ID NO: 547255 - DNA, 20 bp, Artificial
  CRISPR gRNA sequence
cctgagggctgctatggggt

SEQ ID NO: 547256 - DNA, 20 bp, Artificial
  CRISPR gRNA sequence
ctgagggctgctatggggtg

SEQ ID NO: 547257 - DNA, 20 bp, Artificial
  CRISPR gRNA sequence
agggctgctatggggtgggg

SEQ ID NO: 547258 - DNA, 20 bp, Artificial
  CRISPR gRNA sequence
gggctgctatggggtggggt

SEQ ID NO: 547259 - DNA, 20 bp, Artificial
  CRISPR gRNA sequence
ctatggggtggggtgggcaa

SEQ ID NO: 547260 - DNA, 20 bp, Artificial
  CRISPR gRNA sequence
tatggggtggggtgggcaaa

SEQ ID NO: 547261 - DNA, 20 bp, Artificial
  CRISPR gRNA sequence
atggggtggggtgggcaaaa

SEQ ID NO: 547262 - DNA, 20 bp, Artificial
  CRISPR gRNA sequence
gtggggtgggcaaaagggac

SEQ ID NO: 547263 - DNA, 20 bp, Artificial
  CRISPR gRNA sequence
ggggtgggcaaaagggacca

SEQ ID NO: 547264 - DNA, 20 bp, Artificial
  CRISPR gRNA sequence
gggtgggcaaaagggaccag

SEQ ID NO: 547265 - DNA, 20 bp, Artificial
  CRISPR gRNA sequence
tgggcaaaagggaccagagg

SEQ ID NO: 547266 - DNA, 20 bp, Artificial
  CRISPR gRNA sequence
caaaagggaccagaggaagt

SEQ ID NO: 547267 - DNA, 20 bp, Artificial
  CRISPR gRNA sequence
aaaagggaccagaggaagtt

SEQ ID NO: 547268 - DNA, 20 bp, Artificial
  CRISPR gRNA sequence
aagggaccagaggaagttag

SEQ ID NO: 547269 - DNA, 20 bp, Artificial
  CRISPR gRNA sequence
gggaccagaggaagttagga

SEQ ID NO: 547270 - DNA, 20 bp, Artificial
  CRISPR gRNA sequence
accagaggaagttaggagag

SEQ ID NO: 547271 - DNA, 20 bp, Artificial
  CRISPR gRNA sequence
ccagaggaagttaggagagc

SEQ ID NO: 547272 - DNA, 20 bp, Artificial
  CRISPR gRNA sequence
cagaggaagttaggagagca

SEQ ID NO: 547273 - DNA, 20 bp, Artificial
  CRISPR gRNA sequence
aagttaggagagcagggctc

SEQ ID NO: 547274 - DNA, 20 bp, Artificial
  CRISPR gRNA sequence
agttaggagagcagggctct

SEQ ID NO: 547275 - DNA, 20 bp, Artificial
  CRISPR gRNA sequence
ggctctaggctttcaatttt

SEQ ID NO: 547276 - DNA, 20 bp, Artificial
  CRISPR gRNA sequence
gctttcaattttgagtcaac

SEQ ID NO: 547277 - DNA, 20 bp, Artificial
  CRISPR gRNA sequence
tttcaattttgagtcaacta

SEQ ID NO: 547278 - DNA, 20 bp, Artificial
  CRISPR gRNA sequence
tagagcaacttcttatccat

SEQ ID NO: 547279 - DNA, 20 bp, Artificial
  CRISPR gRNA sequence
caacttcttatccattggat

SEQ ID NO: 547280 - DNA, 20 bp, Artificial
  CRISPR gRNA sequence
attggattggattgccactg

SEQ ID NO: 547281 - DNA, 20 bp, Artificial
  CRISPR gRNA sequence
gccactgaagatttaattct

SEQ ID NO: 547282 - DNA, 20 bp, Artificial
  CRISPR gRNA sequence
tgagaaattccactgcttaa

SEQ ID NO: 547283 - DNA, 20 bp, Artificial
  CRISPR gRNA sequence
actgcttaaaagatgattaa

SEQ ID NO: 547284 - DNA, 20 bp, Artificial
  CRISPR gRNA sequence
attaaaagtctttttaatta

SEQ ID NO: 547285 - DNA, 20 bp, Artificial
  CRISPR gRNA sequence
ttttaattaaagaaaatctt

SEQ ID NO: 547286 - DNA, 20 bp, Artificial
  CRISPR gRNA sequence
tttaattaaagaaaatctta

SEQ ID NO: 547287 - DNA, 20 bp, Artificial
  CRISPR gRNA sequence
aattaaagaaaatcttaagg

SEQ ID NO: 547288 - DNA, 20 bp, Artificial
  CRISPR gRNA sequence
aaaatcttaaggaagtatgt

SEQ ID NO: 547289 - DNA, 20 bp, Artificial
  CRISPR gRNA sequence
aaatcttaaggaagtatgta

SEQ ID NO: 547290 - DNA, 20 bp, Artificial
  CRISPR gRNA sequence
aagtatgtaaggacttgtgt

SEQ ID NO: 547291 - DNA, 20 bp, Artificial
  CRISPR gRNA sequence
atgtaaggacttgtgtgagc

SEQ ID NO: 547292 - DNA, 20 bp, Artificial
  CRISPR gRNA sequence
gctagattaaacttaaaaac

SEQ ID NO: 547293 - DNA, 20 bp, Artificial
  CRISPR gRNA sequence
ctagattaaacttaaaaact

SEQ ID NO: 547294 - DNA, 20 bp, Artificial
  CRISPR gRNA sequence
gattaaacttaaaaactagg

SEQ ID NO: 547295 - DNA, 20 bp, Artificial
  CRISPR gRNA sequence
cttaaaaactaggaagcccc

SEQ ID NO: 547296 - DNA, 20 bp, Artificial
  CRISPR gRNA sequence
aaaaactaggaagccccaag

SEQ ID NO: 547297 - DNA, 20 bp, Artificial
  CRISPR gRNA sequence
actaggaagccccaagtaga

SEQ ID NO: 547298 - DNA, 20 bp, Artificial
  CRISPR gRNA sequence
ctaggaagccccaagtagaa

SEQ ID NO: 547299 - DNA, 20 bp, Artificial
  CRISPR gRNA sequence
taggaagccccaagtagaaa

SEQ ID NO: 547300 - DNA, 20 bp, Artificial
  CRISPR gRNA sequence
gaagccccaagtagaaaggg

SEQ ID NO: 547301 - DNA, 20 bp, Artificial
  CRISPR gRNA sequence
ccccaagtagaaagggaagt

SEQ ID NO: 547302 - DNA, 20 bp, Artificial
  CRISPR gRNA sequence
gggaagtcagtgtgtgactc

SEQ ID NO: 547303 - DNA, 20 bp, Artificial
  CRISPR gRNA sequence
gtgtgactctggtttctacc

SEQ ID NO: 547304 - DNA, 20 bp, Artificial
  CRISPR gRNA sequence
tgtgactctggtttctacca

SEQ ID NO: 547305 - DNA, 20 bp, Artificial
  CRISPR gRNA sequence
gactctggtttctaccaagg

SEQ ID NO: 547306 - DNA, 20 bp, Artificial
  CRISPR gRNA sequence
actctggtttctaccaaggc

SEQ ID NO: 547307 - DNA, 20 bp, Artificial
  CRISPR gRNA sequence
tggtttctaccaaggcaggc

SEQ ID NO: 547308 - DNA, 20 bp, Artificial
  CRISPR gRNA sequence
ggtttctaccaaggcaggct

SEQ ID NO: 547309 - DNA, 20 bp, Artificial
  CRISPR gRNA sequence
gctgggtactttatttaact

SEQ ID NO: 547310 - DNA, 20 bp, Artificial
  CRISPR gRNA sequence
ggtactttatttaactgagc

SEQ ID NO: 547311 - DNA, 20 bp, Artificial
  CRISPR gRNA sequence
actttatttaactgagcgag

SEQ ID NO: 547312 - DNA, 20 bp, Artificial
  CRISPR gRNA sequence
ctttatttaactgagcgaga

SEQ ID NO: 547313 - DNA, 20 bp, Artificial
  CRISPR gRNA sequence
taactgagcgagaaggaatt

SEQ ID NO: 547314 - DNA, 20 bp, Artificial
  CRISPR gRNA sequence
aactgagcgagaaggaattc

SEQ ID NO: 547315 - DNA, 20 bp, Artificial
  CRISPR gRNA sequence
ctgagcgagaaggaattcag

SEQ ID NO: 547316 - DNA, 20 bp, Artificial
  CRISPR gRNA sequence
tgagcgagaaggaattcagg

SEQ ID NO: 547317 - DNA, 20 bp, Artificial
  CRISPR gRNA sequence
agcgagaaggaattcaggag

SEQ ID NO: 547318 - DNA, 20 bp, Artificial
  CRISPR gRNA sequence
gcgagaaggaattcaggagg

SEQ ID NO: 547319 - DNA, 20 bp, Artificial
  CRISPR gRNA sequence
gagaaggaattcaggaggag

SEQ ID NO: 547320 - DNA, 20 bp, Artificial
  CRISPR gRNA sequence
aaggaattcaggaggaggag

SEQ ID NO: 547321 - DNA, 20 bp, Artificial
  CRISPR gRNA sequence
aattcaggaggaggagaaga

SEQ ID NO: 547322 - DNA, 20 bp, Artificial
  CRISPR gRNA sequence
attcaggaggaggagaagat

SEQ ID NO: 547323 - DNA, 20 bp, Artificial
  CRISPR gRNA sequence
ttcaggaggaggagaagatg

SEQ ID NO: 547324 - DNA, 20 bp, Artificial
  CRISPR gRNA sequence
tcaggaggaggagaagatgg

SEQ ID NO: 547325 - DNA, 20 bp, Artificial
  CRISPR gRNA sequence
cattaaatgcttttattttt

SEQ ID NO: 547326 - DNA, 20 bp, Artificial
  CRISPR gRNA sequence
tttatttttcagattataat

SEQ ID NO: 547327 - DNA, 20 bp, Artificial
  CRISPR gRNA sequence
tatttttcagattataattg

SEQ ID NO: 547328 - DNA, 20 bp, Artificial
  CRISPR gRNA sequence
tcagattataattggagcat

SEQ ID NO: 547329 - DNA, 20 bp, Artificial
  CRISPR gRNA sequence
gcataagcattaacttgtct

SEQ ID NO: 547330 - DNA, 20 bp, Artificial
  CRISPR gRNA sequence
catcattttaaatgacaaca

SEQ ID NO: 547331 - DNA, 20 bp, Artificial
  CRISPR gRNA sequence
aacatagtattccattatct

SEQ ID NO: 547332 - DNA, 20 bp, Artificial
  CRISPR gRNA sequence
atttacttaaatgctctttt

SEQ ID NO: 547333 - DNA, 20 bp, Artificial
  CRISPR gRNA sequence
tacttaaatgctctttttag

SEQ ID NO: 547334 - DNA, 20 bp, Artificial
  CRISPR gRNA sequence
gtatcaatactttattatcc

SEQ ID NO: 547335 - DNA, 20 bp, Artificial
  CRISPR gRNA sequence
tatgtttttgcatgtttcct

SEQ ID NO: 547336 - DNA, 20 bp, Artificial
  CRISPR gRNA sequence
atgtttttgcatgtttcctc

SEQ ID NO: 547337 - DNA, 20 bp, Artificial
  CRISPR gRNA sequence
ggcctcttatgattaattgc

SEQ ID NO: 547338 - DNA, 20 bp, Artificial
  CRISPR gRNA sequence
cctcttatgattaattgctg

SEQ ID NO: 547339 - DNA, 20 bp, Artificial
  CRISPR gRNA sequence
ctcttatgattaattgctgg

SEQ ID NO: 547340 - DNA, 20 bp, Artificial
  CRISPR gRNA sequence
tcttatgattaattgctgga

SEQ ID NO: 547341 - DNA, 20 bp, Artificial
  CRISPR gRNA sequence
tatgattaattgctggaggg

SEQ ID NO: 547342 - DNA, 20 bp, Artificial
  CRISPR gRNA sequence
ttaattgctggagggtagct

SEQ ID NO: 547343 - DNA, 20 bp, Artificial
  CRISPR gRNA sequence
ctggagggtagctgagacgc

SEQ ID NO: 547344 - DNA, 20 bp, Artificial
  CRISPR gRNA sequence
gagggtagctgagacgcaag

SEQ ID NO: 547345 - DNA, 20 bp, Artificial
  CRISPR gRNA sequence
agggtagctgagacgcaaga

SEQ ID NO: 547346 - DNA, 20 bp, Artificial
  CRISPR gRNA sequence
attaacaaataaatgactca

SEQ ID NO: 547347 - DNA, 20 bp, Artificial
  CRISPR gRNA sequence
ttaacaaataaatgactcat

SEQ ID NO: 547348 - DNA, 20 bp, Artificial
  CRISPR gRNA sequence
aataaatgactcataggaca

SEQ ID NO: 547349 - DNA, 20 bp, Artificial
  CRISPR gRNA sequence
gactcataggacaaagtaat

SEQ ID NO: 547350 - DNA, 20 bp, Artificial
  CRISPR gRNA sequence
aggacaaagtaattagcctt

SEQ ID NO: 547351 - DNA, 20 bp, Artificial
  CRISPR gRNA sequence
ggacaaagtaattagccttg

SEQ ID NO: 547352 - DNA, 20 bp, Artificial
  CRISPR gRNA sequence
aattagccttgaggctttta

SEQ ID NO: 547353 - DNA, 20 bp, Artificial
  CRISPR gRNA sequence
attagccttgaggcttttaa

SEQ ID NO: 547354 - DNA, 20 bp, Artificial
  CRISPR gRNA sequence
ttagccttgaggcttttaaa

SEQ ID NO: 547355 - DNA, 20 bp, Artificial
  CRISPR gRNA sequence
aggcttttaaagggcaacaa

SEQ ID NO: 547356 - DNA, 20 bp, Artificial
  CRISPR gRNA sequence
cttttaaagggcaacaatgg

SEQ ID NO: 547357 - DNA, 20 bp, Artificial
  CRISPR gRNA sequence
aatggcagaatgtgacatgt

SEQ ID NO: 547358 - DNA, 20 bp, Artificial
  CRISPR gRNA sequence
agtgtcttaactcatccttg

SEQ ID NO: 547359 - DNA, 20 bp, Artificial
  CRISPR gRNA sequence
gtgtcttaactcatccttgt

SEQ ID NO: 547360 - DNA, 20 bp, Artificial
  CRISPR gRNA sequence
cttgtaggtccatgctgcct

SEQ ID NO: 547361 - DNA, 20 bp, Artificial
  CRISPR gRNA sequence
gtccatgctgccttagccaa

SEQ ID NO: 547362 - DNA, 20 bp, Artificial
  CRISPR gRNA sequence
tccatgctgccttagccaat

SEQ ID NO: 547363 - DNA, 20 bp, Artificial
  CRISPR gRNA sequence
catgctgccttagccaatag

SEQ ID NO: 547364 - DNA, 20 bp, Artificial
  CRISPR gRNA sequence
atgctgccttagccaatagg

SEQ ID NO: 547365 - DNA, 20 bp, Artificial
  CRISPR gRNA sequence
agccaataggaggcacttcc

SEQ ID NO: 547366 - DNA, 20 bp, Artificial
  CRISPR gRNA sequence
caataggaggcacttcctag

SEQ ID NO: 547367 - DNA, 20 bp, Artificial
  CRISPR gRNA sequence
taggaggcacttcctagaag

SEQ ID NO: 547368 - DNA, 20 bp, Artificial
  CRISPR gRNA sequence
aggaggcacttcctagaaga

SEQ ID NO: 547369 - DNA, 20 bp, Artificial
  CRISPR gRNA sequence
ggaggcacttcctagaagaa

SEQ ID NO: 547370 - DNA, 20 bp, Artificial
  CRISPR gRNA sequence
ggcacttcctagaagaaggg

SEQ ID NO: 547371 - DNA, 20 bp, Artificial
  CRISPR gRNA sequence
gcacttcctagaagaagggt

SEQ ID NO: 547372 - DNA, 20 bp, Artificial
  CRISPR gRNA sequence
acttcctagaagaagggtgg

SEQ ID NO: 547373 - DNA, 20 bp, Artificial
  CRISPR gRNA sequence
cctagaagaagggtgggagt

SEQ ID NO: 547374 - DNA, 20 bp, Artificial
  CRISPR gRNA sequence
ctagaagaagggtgggagtg

SEQ ID NO: 547375 - DNA, 20 bp, Artificial
  CRISPR gRNA sequence
aagggtgggagtgaggcctc

SEQ ID NO: 547376 - DNA, 20 bp, Artificial
  CRISPR gRNA sequence
gtgggagtgaggcctctgga

SEQ ID NO: 547377 - DNA, 20 bp, Artificial
  CRISPR gRNA sequence
tgggagtgaggcctctggac

SEQ ID NO: 547378 - DNA, 20 bp, Artificial
  CRISPR gRNA sequence
gagtgaggcctctggacagg

SEQ ID NO: 547379 - DNA, 20 bp, Artificial
  CRISPR gRNA sequence
agtgaggcctctggacaggc

SEQ ID NO: 547380 - DNA, 20 bp, Artificial
  CRISPR gRNA sequence
ctccctgcactgcctattaa

SEQ ID NO: 547381 - DNA, 20 bp, Artificial
  CRISPR gRNA sequence
tccctgcactgcctattaac

SEQ ID NO: 547382 - DNA, 20 bp, Artificial
  CRISPR gRNA sequence
gcactgcctattaacaggtc

SEQ ID NO: 547383 - DNA, 20 bp, Artificial
  CRISPR gRNA sequence
aacaggtccagcccaaccaa

SEQ ID NO: 547384 - DNA, 20 bp, Artificial
  CRISPR gRNA sequence
acaggtccagcccaaccaat

SEQ ID NO: 547385 - DNA, 20 bp, Artificial
  CRISPR gRNA sequence
ggtccagcccaaccaatagg

SEQ ID NO: 547386 - DNA, 20 bp, Artificial
  CRISPR gRNA sequence
gtccagcccaaccaataggc

SEQ ID NO: 547387 - DNA, 20 bp, Artificial
  CRISPR gRNA sequence
tccagcccaaccaataggca

SEQ ID NO: 547388 - DNA, 20 bp, Artificial
  CRISPR gRNA sequence
accaataggcagggcccgac

SEQ ID NO: 547389 - DNA, 20 bp, Artificial
  CRISPR gRNA sequence
ccaataggcagggcccgaca

SEQ ID NO: 547390 - DNA, 20 bp, Artificial
  CRISPR gRNA sequence
gggcccgacaaggctctgtg

SEQ ID NO: 547391 - DNA, 20 bp, Artificial
  CRISPR gRNA sequence
cacctttcacaaaatgtatt

SEQ ID NO: 547392 - DNA, 20 bp, Artificial
  CRISPR gRNA sequence
tttcacaaaatgtattgagt

SEQ ID NO: 547393 - DNA, 20 bp, Artificial
  CRISPR gRNA sequence
gtattgagtcagatgtatta

SEQ ID NO: 547394 - DNA, 20 bp, Artificial
  CRISPR gRNA sequence
ttcctttcacaaaatgcttt

SEQ ID NO: 547395 - DNA, 20 bp, Artificial
  CRISPR gRNA sequence
tttcacaaaatgctttgagt

SEQ ID NO: 547396 - DNA, 20 bp, Artificial
  CRISPR gRNA sequence
gctttgagtcagacgtgtta

SEQ ID NO: 547397 - DNA, 20 bp, Artificial
  CRISPR gRNA sequence
taaaatttttttttacattt

SEQ ID NO: 547398 - DNA, 20 bp, Artificial
  CRISPR gRNA sequence
atttttttttacattttgga

SEQ ID NO: 547399 - DNA, 20 bp, Artificial
  CRISPR gRNA sequence
tttttttttacattttggaa

SEQ ID NO: 547400 - DNA, 20 bp, Artificial
  CRISPR gRNA sequence
cattttggaaaggtaataca

SEQ ID NO: 547401 - DNA, 20 bp, Artificial
  CRISPR gRNA sequence
aagtatttcctctgcatatt

SEQ ID NO: 547402 - DNA, 20 bp, Artificial
  CRISPR gRNA sequence
ttaagcaccccacttaatta

SEQ ID NO: 547403 - DNA, 20 bp, Artificial
  CRISPR gRNA sequence
taagcaccccacttaattat

SEQ ID NO: 547404 - DNA, 20 bp, Artificial
  CRISPR gRNA sequence
aagcaccccacttaattatg

SEQ ID NO: 547405 - DNA, 20 bp, Artificial
  CRISPR gRNA sequence
gcaccccacttaattatggg

SEQ ID NO: 547406 - DNA, 20 bp, Artificial
  CRISPR gRNA sequence
taattatggggagcacccta

SEQ ID NO: 547407 - DNA, 20 bp, Artificial
  CRISPR gRNA sequence
aattatggggagcaccctat

SEQ ID NO: 547408 - DNA, 20 bp, Artificial
  CRISPR gRNA sequence
tggggagcaccctatgggtc

SEQ ID NO: 547409 - DNA, 20 bp, Artificial
  CRISPR gRNA sequence
agcaccctatgggtcaagca

SEQ ID NO: 547410 - DNA, 20 bp, Artificial
  CRISPR gRNA sequence
gcaccctatgggtcaagcat

SEQ ID NO: 547411 - DNA, 20 bp, Artificial
  CRISPR gRNA sequence
tatgggtcaagcataggaac

SEQ ID NO: 547412 - DNA, 20 bp, Artificial
  CRISPR gRNA sequence
acttcattcctatatattta

SEQ ID NO: 547413 - DNA, 20 bp, Artificial
  CRISPR gRNA sequence
attcctatatatttaaagac

SEQ ID NO: 547414 - DNA, 20 bp, Artificial
  CRISPR gRNA sequence
ttcctatatatttaaagaca

SEQ ID NO: 547415 - DNA, 20 bp, Artificial
  CRISPR gRNA sequence
tatatttaaagacaaggtct

SEQ ID NO: 547416 - DNA, 20 bp, Artificial
  CRISPR gRNA sequence
gtctcagtctgatgcaatca

SEQ ID NO: 547417 - DNA, 20 bp, Artificial
  CRISPR gRNA sequence
caatcatagcccactgtgtg

SEQ ID NO: 547418 - DNA, 20 bp, Artificial
  CRISPR gRNA sequence
catagcccactgtgtgtagt

SEQ ID NO: 547419 - DNA, 20 bp, Artificial
  CRISPR gRNA sequence
gcccactgtgtgtagtgagc

SEQ ID NO: 547420 - DNA, 20 bp, Artificial
  CRISPR gRNA sequence
ccactgtgtgtagtgagcta

SEQ ID NO: 547421 - DNA, 20 bp, Artificial
  CRISPR gRNA sequence
tgtagtgagctagagtgcac

SEQ ID NO: 547422 - DNA, 20 bp, Artificial
  CRISPR gRNA sequence
ggcacaattataactcactg

SEQ ID NO: 547423 - DNA, 20 bp, Artificial
  CRISPR gRNA sequence
attataactcactgtagctt

SEQ ID NO: 547424 - DNA, 20 bp, Artificial
  CRISPR gRNA sequence
cactgtagcttcagattcct

SEQ ID NO: 547425 - DNA, 20 bp, Artificial
  CRISPR gRNA sequence
agcttcagattccttggttc

SEQ ID NO: 547426 - DNA, 20 bp, Artificial
  CRISPR gRNA sequence
ttcagattccttggttcaag

SEQ ID NO: 547427 - DNA, 20 bp, Artificial
  CRISPR gRNA sequence
tccttggttcaagcagttgc

SEQ ID NO: 547428 - DNA, 20 bp, Artificial
  CRISPR gRNA sequence
ttggttcaagcagttgcaag

SEQ ID NO: 547429 - DNA, 20 bp, Artificial
  CRISPR gRNA sequence
tcaagcagttgcaagtagct

SEQ ID NO: 547430 - DNA, 20 bp, Artificial
  CRISPR gRNA sequence
gttgcaagtagctgagacta

SEQ ID NO: 547431 - DNA, 20 bp, Artificial
  CRISPR gRNA sequence
ttgcaagtagctgagactac

SEQ ID NO: 547432 - DNA, 20 bp, Artificial
  CRISPR gRNA sequence
caagtagctgagactacagg

SEQ ID NO: 547433 - DNA, 20 bp, Artificial
  CRISPR gRNA sequence
aagtagctgagactacaggc

SEQ ID NO: 547434 - DNA, 20 bp, Artificial
  CRISPR gRNA sequence
gtagctgagactacaggcag

SEQ ID NO: 547435 - DNA, 20 bp, Artificial
  CRISPR gRNA sequence
actacaggcaggagccatca

SEQ ID NO: 547436 - DNA, 20 bp, Artificial
  CRISPR gRNA sequence
caggcaggagccatcatggc

SEQ ID NO: 547437 - DNA, 20 bp, Artificial
  CRISPR gRNA sequence
taatctttaaactttttata

SEQ ID NO: 547438 - DNA, 20 bp, Artificial
  CRISPR gRNA sequence
ctttaaactttttataaaga

SEQ ID NO: 547439 - DNA, 20 bp, Artificial
  CRISPR gRNA sequence
tttaaactttttataaagac

SEQ ID NO: 547440 - DNA, 20 bp, Artificial
  CRISPR gRNA sequence
ttaaactttttataaagaca

SEQ ID NO: 547441 - DNA, 20 bp, Artificial
  CRISPR gRNA sequence
cagggtcttgctatgttgcc

SEQ ID NO: 547442 - DNA, 20 bp, Artificial
  CRISPR gRNA sequence
agggtcttgctatgttgccc

SEQ ID NO: 547443 - DNA, 20 bp, Artificial
  CRISPR gRNA sequence
tcttgctatgttgcccaggc

SEQ ID NO: 547444 - DNA, 20 bp, Artificial
  CRISPR gRNA sequence
ccaggctggtcttgaactcc

SEQ ID NO: 547445 - DNA, 20 bp, Artificial
  CRISPR gRNA sequence
ggtcttgaactcctggcctc

SEQ ID NO: 547446 - DNA, 20 bp, Artificial
  CRISPR gRNA sequence
ctcaagccatcctcctgcct

SEQ ID NO: 547447 - DNA, 20 bp, Artificial
  CRISPR gRNA sequence
cctcctgcctcagcctccca

SEQ ID NO: 547448 - DNA, 20 bp, Artificial
  CRISPR gRNA sequence
gcctcagcctcccaaagtgc

SEQ ID NO: 547449 - DNA, 20 bp, Artificial
  CRISPR gRNA sequence
cctcagcctcccaaagtgct

SEQ ID NO: 547450 - DNA, 20 bp, Artificial
  CRISPR gRNA sequence
tcagcctcccaaagtgctgg

SEQ ID NO: 547451 - DNA, 20 bp, Artificial
  CRISPR gRNA sequence
ctcccaaagtgctgggagta

SEQ ID NO: 547452 - DNA, 20 bp, Artificial
  CRISPR gRNA sequence
agtgctgggagtatagccat

SEQ ID NO: 547453 - DNA, 20 bp, Artificial
  CRISPR gRNA sequence
atgagccactgtgtcctgcc

SEQ ID NO: 547454 - DNA, 20 bp, Artificial
  CRISPR gRNA sequence
ccactgtgtcctgccaagca

SEQ ID NO: 547455 - DNA, 20 bp, Artificial
  CRISPR gRNA sequence
cactgtgtcctgccaagcac

SEQ ID NO: 547456 - DNA, 20 bp, Artificial
  CRISPR gRNA sequence
caagcacaggaatatttttg

SEQ ID NO: 547457 - DNA, 20 bp, Artificial
  CRISPR gRNA sequence
gaaacgataatgaatatttg

SEQ ID NO: 547458 - DNA, 20 bp, Artificial
  CRISPR gRNA sequence
cgataatgaatatttgaagt

SEQ ID NO: 547459 - DNA, 20 bp, Artificial
  CRISPR gRNA sequence
aatgaatatttgaagtgagt

SEQ ID NO: 547460 - DNA, 20 bp, Artificial
  CRISPR gRNA sequence
aatatttgaagtgagtgaga

SEQ ID NO: 547461 - DNA, 20 bp, Artificial
  CRISPR gRNA sequence
ctcaaatccttgtgttaatt

SEQ ID NO: 547462 - DNA, 20 bp, Artificial
  CRISPR gRNA sequence
tcaaatccttgtgttaattc

SEQ ID NO: 547463 - DNA, 20 bp, Artificial
  CRISPR gRNA sequence
atccttgtgttaattcaggt

SEQ ID NO: 547464 - DNA, 20 bp, Artificial
  CRISPR gRNA sequence
tccttgtgttaattcaggtc

SEQ ID NO: 547465 - DNA, 20 bp, Artificial
  CRISPR gRNA sequence
tgtgttaattcaggtcaggt

SEQ ID NO: 547466 - DNA, 20 bp, Artificial
  CRISPR gRNA sequence
gtgttaattcaggtcaggtc

SEQ ID NO: 547467 - DNA, 20 bp, Artificial
  CRISPR gRNA sequence
tcaggtcaggtcaggatttg

SEQ ID NO: 547468 - DNA, 20 bp, Artificial
  CRISPR gRNA sequence
gattttgctaccaacttgcg

SEQ ID NO: 547469 - DNA, 20 bp, Artificial
  CRISPR gRNA sequence
ccaacttgcgaagactcttt

SEQ ID NO: 547470 - DNA, 20 bp, Artificial
  CRISPR gRNA sequence
tgcgaagactcttttggctt

SEQ ID NO: 547471 - DNA, 20 bp, Artificial
  CRISPR gRNA sequence
cgaagactcttttggcttca

SEQ ID NO: 547472 - DNA, 20 bp, Artificial
  CRISPR gRNA sequence
cttcagagattttttgattt

SEQ ID NO: 547473 - DNA, 20 bp, Artificial
  CRISPR gRNA sequence
gattttttgatttaagaatt

SEQ ID NO: 547474 - DNA, 20 bp, Artificial
  CRISPR gRNA sequence
attttttgatttaagaattg

SEQ ID NO: 547475 - DNA, 20 bp, Artificial
  CRISPR gRNA sequence
ttgatttaagaattgaggat

SEQ ID NO: 547476 - DNA, 20 bp, Artificial
  CRISPR gRNA sequence
tgatttaagaattgaggata

SEQ ID NO: 547477 - DNA, 20 bp, Artificial
  CRISPR gRNA sequence
gatttaagaattgaggataa

SEQ ID NO: 547478 - DNA, 20 bp, Artificial
  CRISPR gRNA sequence
agaattgaggataagggatt

SEQ ID NO: 547479 - DNA, 20 bp, Artificial
  CRISPR gRNA sequence
gaattgaggataagggattt

SEQ ID NO: 547480 - DNA, 20 bp, Artificial
  CRISPR gRNA sequence
aattgaggataagggatttg

SEQ ID NO: 547481 - DNA, 20 bp, Artificial
  CRISPR gRNA sequence
aagggatttggggcctgtat

SEQ ID NO: 547482 - DNA, 20 bp, Artificial
  CRISPR gRNA sequence
tctgttttcacactgctata

SEQ ID NO: 547483 - DNA, 20 bp, Artificial
  CRISPR gRNA sequence
tataaagaactacctgaaac

SEQ ID NO: 547484 - DNA, 20 bp, Artificial
  CRISPR gRNA sequence
ataaagaactacctgaaact

SEQ ID NO: 547485 - DNA, 20 bp, Artificial
  CRISPR gRNA sequence
ctgaaactgggtaatttata

SEQ ID NO: 547486 - DNA, 20 bp, Artificial
  CRISPR gRNA sequence
actgggtaatttataaagaa

SEQ ID NO: 547487 - DNA, 20 bp, Artificial
  CRISPR gRNA sequence
tgggtaatttataaagaaaa

SEQ ID NO: 547488 - DNA, 20 bp, Artificial
  CRISPR gRNA sequence
gggtaatttataaagaaaag

SEQ ID NO: 547489 - DNA, 20 bp, Artificial
  CRISPR gRNA sequence
aaagaggtttaattgactca

SEQ ID NO: 547490 - DNA, 20 bp, Artificial
  CRISPR gRNA sequence
aattgactcacagttccaca

SEQ ID NO: 547491 - DNA, 20 bp, Artificial
  CRISPR gRNA sequence
gactcacagttccacatggc

SEQ ID NO: 547492 - DNA, 20 bp, Artificial
  CRISPR gRNA sequence
actcacagttccacatggct

SEQ ID NO: 547493 - DNA, 20 bp, Artificial
  CRISPR gRNA sequence
ctcacagttccacatggctg

SEQ ID NO: 547494 - DNA, 20 bp, Artificial
  CRISPR gRNA sequence
cacagttccacatggctggg

SEQ ID NO: 547495 - DNA, 20 bp, Artificial
  CRISPR gRNA sequence
acagttccacatggctgggg

SEQ ID NO: 547496 - DNA, 20 bp, Artificial
  CRISPR gRNA sequence
ccacatggctggggaggcct

SEQ ID NO: 547497 - DNA, 20 bp, Artificial
  CRISPR gRNA sequence
cacatggctggggaggcctc

SEQ ID NO: 547498 - DNA, 20 bp, Artificial
  CRISPR gRNA sequence
cctcgggaaacttacaatca

SEQ ID NO: 547499 - DNA, 20 bp, Artificial
  CRISPR gRNA sequence
cgggaaacttacaatcatgg

SEQ ID NO: 547500 - DNA, 20 bp, Artificial
  CRISPR gRNA sequence
gaaacttacaatcatggcag

SEQ ID NO: 547501 - DNA, 20 bp, Artificial
  CRISPR gRNA sequence
aaacttacaatcatggcaga

SEQ ID NO: 547502 - DNA, 20 bp, Artificial
  CRISPR gRNA sequence
tacaatcatggcagaaggcg

SEQ ID NO: 547503 - DNA, 20 bp, Artificial
  CRISPR gRNA sequence
acaatcatggcagaaggcga

SEQ ID NO: 547504 - DNA, 20 bp, Artificial
  CRISPR gRNA sequence
aatcatggcagaaggcgaag

SEQ ID NO: 547505 - DNA, 20 bp, Artificial
  CRISPR gRNA sequence
catggcagaaggcgaaggag

SEQ ID NO: 547506 - DNA, 20 bp, Artificial
  CRISPR gRNA sequence
gcagaaggcgaaggagaagc

SEQ ID NO: 547507 - DNA, 20 bp, Artificial
  CRISPR gRNA sequence
gaagcaagcacttttttcac

SEQ ID NO: 547508 - DNA, 20 bp, Artificial
  CRISPR gRNA sequence
aagcaagcacttttttcaca

SEQ ID NO: 547509 - DNA, 20 bp, Artificial
  CRISPR gRNA sequence
caagcacttttttcacaagg

SEQ ID NO: 547510 - DNA, 20 bp, Artificial
  CRISPR gRNA sequence
gcacttttttcacaaggcag

SEQ ID NO: 547511 - DNA, 20 bp, Artificial
  CRISPR gRNA sequence
cacttttttcacaaggcagc

SEQ ID NO: 547512 - DNA, 20 bp, Artificial
  CRISPR gRNA sequence
cttttttcacaaggcagcag

SEQ ID NO: 547513 - DNA, 20 bp, Artificial
  CRISPR gRNA sequence
tttttcacaaggcagcagga

SEQ ID NO: 547514 - DNA, 20 bp, Artificial
  CRISPR gRNA sequence
tttcacaaggcagcaggaga

SEQ ID NO: 547515 - DNA, 20 bp, Artificial
  CRISPR gRNA sequence
tcacaaggcagcaggagaga

SEQ ID NO: 547516 - DNA, 20 bp, Artificial
  CRISPR gRNA sequence
acaaggcagcaggagagaga

SEQ ID NO: 547517 - DNA, 20 bp, Artificial
  CRISPR gRNA sequence
gccacacacttttaaaccaa

SEQ ID NO: 547518 - DNA, 20 bp, Artificial
  CRISPR gRNA sequence
tttaaaccaacagatgtcat

SEQ ID NO: 547519 - DNA, 20 bp, Artificial
  CRISPR gRNA sequence
gagaactcactctctatcac

SEQ ID NO: 547520 - DNA, 20 bp, Artificial
  CRISPR gRNA sequence
ctcactctctatcactagaa

SEQ ID NO: 547521 - DNA, 20 bp, Artificial
  CRISPR gRNA sequence
tctctatcactagaatagca

SEQ ID NO: 547522 - DNA, 20 bp, Artificial
  CRISPR gRNA sequence
ctctatcactagaatagcat

SEQ ID NO: 547523 - DNA, 20 bp, Artificial
  CRISPR gRNA sequence
tctatcactagaatagcatg

SEQ ID NO: 547524 - DNA, 20 bp, Artificial
  CRISPR gRNA sequence
catggggaaaccatccccca

SEQ ID NO: 547525 - DNA, 20 bp, Artificial
  CRISPR gRNA sequence
atggtacaatcacctcccac

SEQ ID NO: 547526 - DNA, 20 bp, Artificial
  CRISPR gRNA sequence
tggtacaatcacctcccacc

SEQ ID NO: 547527 - DNA, 20 bp, Artificial
  CRISPR gRNA sequence
caggtccctctctcgacaca

SEQ ID NO: 547528 - DNA, 20 bp, Artificial
  CRISPR gRNA sequence
aggtccctctctcgacacat

SEQ ID NO: 547529 - DNA, 20 bp, Artificial
  CRISPR gRNA sequence
acacatgggaattacaattc

SEQ ID NO: 547530 - DNA, 20 bp, Artificial
  CRISPR gRNA sequence
tgggaattacaattcaagat

SEQ ID NO: 547531 - DNA, 20 bp, Artificial
  CRISPR gRNA sequence
ttacaattcaagatgagatt

SEQ ID NO: 547532 - DNA, 20 bp, Artificial
  CRISPR gRNA sequence
tacaattcaagatgagattt

SEQ ID NO: 547533 - DNA, 20 bp, Artificial
  CRISPR gRNA sequence
attcaagatgagatttgggt

SEQ ID NO: 547534 - DNA, 20 bp, Artificial
  CRISPR gRNA sequence
ttcaagatgagatttgggtg

SEQ ID NO: 547535 - DNA, 20 bp, Artificial
  CRISPR gRNA sequence
atgagatttgggtgaggacc

SEQ ID NO: 547536 - DNA, 20 bp, Artificial
  CRISPR gRNA sequence
gagatttgggtgaggaccca

SEQ ID NO: 547537 - DNA, 20 bp, Artificial
  CRISPR gRNA sequence
gacccagagccaaaccatat

SEQ ID NO: 547538 - DNA, 20 bp, Artificial
  CRISPR gRNA sequence
acccagagccaaaccatatc

SEQ ID NO: 547539 - DNA, 20 bp, Artificial
  CRISPR gRNA sequence
cccagagccaaaccatatca

SEQ ID NO: 547540 - DNA, 20 bp, Artificial
  CRISPR gRNA sequence
tttattctgttaaatttgaa

SEQ ID NO: 547541 - DNA, 20 bp, Artificial
  CRISPR gRNA sequence
ttattctgttaaatttgaac

SEQ ID NO: 547542 - DNA, 20 bp, Artificial
  CRISPR gRNA sequence
ttctgttaaatttgaacagg

SEQ ID NO: 547543 - DNA, 20 bp, Artificial
  CRISPR gRNA sequence
ttgaacaggtagatctgacc

SEQ ID NO: 547544 - DNA, 20 bp, Artificial
  CRISPR gRNA sequence
aggtagatctgacctagcaa

SEQ ID NO: 547545 - DNA, 20 bp, Artificial
  CRISPR gRNA sequence
agatctgacctagcaaaaga

SEQ ID NO: 547546 - DNA, 20 bp, Artificial
  CRISPR gRNA sequence
attctcgctccttgatgctc

SEQ ID NO: 547547 - DNA, 20 bp, Artificial
  CRISPR gRNA sequence
ttctcgctccttgatgctca

SEQ ID NO: 547548 - DNA, 20 bp, Artificial
  CRISPR gRNA sequence
ctcgctccttgatgctcaag

SEQ ID NO: 547549 - DNA, 20 bp, Artificial
  CRISPR gRNA sequence
gtttgtctgctcatcctttc

SEQ ID NO: 547550 - DNA, 20 bp, Artificial
  CRISPR gRNA sequence
gctcatcctttcaagcttgt

SEQ ID NO: 547551 - DNA, 20 bp, Artificial
  CRISPR gRNA sequence
ctcatcctttcaagcttgta

SEQ ID NO: 547552 - DNA, 20 bp, Artificial
  CRISPR gRNA sequence
catcctttcaagcttgtaag

SEQ ID NO: 547553 - DNA, 20 bp, Artificial
  CRISPR gRNA sequence
atcctttcaagcttgtaagg

SEQ ID NO: 547554 - DNA, 20 bp, Artificial
  CRISPR gRNA sequence
caagcttgtaaggaggttgc

SEQ ID NO: 547555 - DNA, 20 bp, Artificial
  CRISPR gRNA sequence
gcgagctcttcataaatttg

SEQ ID NO: 547556 - DNA, 20 bp, Artificial
  CRISPR gRNA sequence
ttcataaatttgcagatgat

SEQ ID NO: 547557 - DNA, 20 bp, Artificial
  CRISPR gRNA sequence
aaatattatacttttttttc

SEQ ID NO: 547558 - DNA, 20 bp, Artificial
  CRISPR gRNA sequence
atattatacttttttttcca

SEQ ID NO: 547559 - DNA, 20 bp, Artificial
  CRISPR gRNA sequence
ctaacttgtgcattgactaa

SEQ ID NO: 547560 - DNA, 20 bp, Artificial
  CRISPR gRNA sequence
acttgtgcattgactaatgg

SEQ ID NO: 547561 - DNA, 20 bp, Artificial
  CRISPR gRNA sequence
attgactaatggaagcattg

SEQ ID NO: 547562 - DNA, 20 bp, Artificial
  CRISPR gRNA sequence
tgaagtccaatgcatgatac

SEQ ID NO: 547563 - DNA, 20 bp, Artificial
  CRISPR gRNA sequence
aagtccaatgcatgatacca

SEQ ID NO: 547564 - DNA, 20 bp, Artificial
  CRISPR gRNA sequence
atgataccagagcattacaa

SEQ ID NO: 547565 - DNA, 20 bp, Artificial
  CRISPR gRNA sequence
agagcattacaacagccatc

SEQ ID NO: 547566 - DNA, 20 bp, Artificial
  CRISPR gRNA sequence
gagcattacaacagccatcg

SEQ ID NO: 547567 - DNA, 20 bp, Artificial
  CRISPR gRNA sequence
gaggacttataatgtactca

SEQ ID NO: 547568 - DNA, 20 bp, Artificial
  CRISPR gRNA sequence
aggacttataatgtactcat

SEQ ID NO: 547569 - DNA, 20 bp, Artificial
  CRISPR gRNA sequence
gtactcatgggattgtccta

SEQ ID NO: 547570 - DNA, 20 bp, Artificial
  CRISPR gRNA sequence
actcatgggattgtcctatg

SEQ ID NO: 547571 - DNA, 20 bp, Artificial
  CRISPR gRNA sequence
caatgtaaacgtaactcaac

SEQ ID NO: 547572 - DNA, 20 bp, Artificial
  CRISPR gRNA sequence
actcaaccagtatatatttt

SEQ ID NO: 547573 - DNA, 20 bp, Artificial
  CRISPR gRNA sequence
aaccagtatatattttaaga

SEQ ID NO: 547574 - DNA, 20 bp, Artificial
  CRISPR gRNA sequence
atgatcttccacaaaaaata

SEQ ID NO: 547575 - DNA, 20 bp, Artificial
  CRISPR gRNA sequence
caaaaaatacagtgtactct

SEQ ID NO: 547576 - DNA, 20 bp, Artificial
  CRISPR gRNA sequence
attttgacaacctgtatccc

SEQ ID NO: 547577 - DNA, 20 bp, Artificial
  CRISPR gRNA sequence
ttgacaacctgtatcccaag

SEQ ID NO: 547578 - DNA, 20 bp, Artificial
  CRISPR gRNA sequence
acaacctgtatcccaagcag

SEQ ID NO: 547579 - DNA, 20 bp, Artificial
  CRISPR gRNA sequence
cctgtatcccaagcagcggt

SEQ ID NO: 547580 - DNA, 20 bp, Artificial
  CRISPR gRNA sequence
gtaaataactaaatgtgtca

SEQ ID NO: 547581 - DNA, 20 bp, Artificial
  CRISPR gRNA sequence
aaataactaaatgtgtcatg

SEQ ID NO: 547582 - DNA, 20 bp, Artificial
  CRISPR gRNA sequence
aataactaaatgtgtcatgg

SEQ ID NO: 547583 - DNA, 20 bp, Artificial
  CRISPR gRNA sequence
aaatgtgtcatggaggcttt

SEQ ID NO: 547584 - DNA, 20 bp, Artificial
  CRISPR gRNA sequence
tcatggaggctttcagacca

SEQ ID NO: 547585 - DNA, 20 bp, Artificial
  CRISPR gRNA sequence
aggctttcagaccacagatg

SEQ ID NO: 547586 - DNA, 20 bp, Artificial
  CRISPR gRNA sequence
acagatgtggtgactaacac

SEQ ID NO: 547587 - DNA, 20 bp, Artificial
  CRISPR gRNA sequence
cagatgtggtgactaacaca

SEQ ID NO: 547588 - DNA, 20 bp, Artificial
  CRISPR gRNA sequence
acaattttgaaatgtaaaac

SEQ ID NO: 547589 - DNA, 20 bp, Artificial
  CRISPR gRNA sequence
tttttttttttttttttttt

SEQ ID NO: 547590 - DNA, 20 bp, Artificial
  CRISPR gRNA sequence
ttttttttttttttttgaga

SEQ ID NO: 547591 - DNA, 20 bp, Artificial
  CRISPR gRNA sequence
ttttttttttttttgagaca

SEQ ID NO: 547592 - DNA, 20 bp, Artificial
  CRISPR gRNA sequence
cagagtctcgctctgtcgcc

SEQ ID NO: 547593 - DNA, 20 bp, Artificial
  CRISPR gRNA sequence
agagtctcgctctgtcgccc

SEQ ID NO: 547594 - DNA, 20 bp, Artificial
  CRISPR gRNA sequence
tctcgctctgtcgcccaggc

SEQ ID NO: 547595 - DNA, 20 bp, Artificial
  CRISPR gRNA sequence
tcgctctgtcgcccaggctg

SEQ ID NO: 547596 - DNA, 20 bp, Artificial
  CRISPR gRNA sequence
ctgtcgcccaggctggagtg

SEQ ID NO: 547597 - DNA, 20 bp, Artificial
  CRISPR gRNA sequence
tcgcccaggctggagtgcag

SEQ ID NO: 547598 - DNA, 20 bp, Artificial
  CRISPR gRNA sequence
ggagtgcagtggcgcgatct

SEQ ID NO: 547599 - DNA, 20 bp, Artificial
  CRISPR gRNA sequence
gcgcgatctcggctcactgc

SEQ ID NO: 547600 - DNA, 20 bp, Artificial
  CRISPR gRNA sequence
tcactgcaagctccgcctcc

SEQ ID NO: 547601 - DNA, 20 bp, Artificial
  CRISPR gRNA sequence
cactgcaagctccgcctcct

SEQ ID NO: 547602 - DNA, 20 bp, Artificial
  CRISPR gRNA sequence
ttcacgccattctcctgcct

SEQ ID NO: 547603 - DNA, 20 bp, Artificial
  CRISPR gRNA sequence
ttctcctgcctcagcctccc

SEQ ID NO: 547604 - DNA, 20 bp, Artificial
  CRISPR gRNA sequence
tcctgcctcagcctcccgag

SEQ ID NO: 547605 - DNA, 20 bp, Artificial
  CRISPR gRNA sequence
gcctcagcctcccgagtagc

SEQ ID NO: 547606 - DNA, 20 bp, Artificial
  CRISPR gRNA sequence
cctcagcctcccgagtagct

SEQ ID NO: 547607 - DNA, 20 bp, Artificial
  CRISPR gRNA sequence
ctcccgagtagctgggacta

SEQ ID NO: 547608 - DNA, 20 bp, Artificial
  CRISPR gRNA sequence
tcccgagtagctgggactac

SEQ ID NO: 547609 - DNA, 20 bp, Artificial
  CRISPR gRNA sequence
caggcgcccgccaccacgcc

SEQ ID NO: 547610 - DNA, 20 bp, Artificial
  CRISPR gRNA sequence
cggctaattttttgtatttt

SEQ ID NO: 547611 - DNA, 20 bp, Artificial
  CRISPR gRNA sequence
ctaattttttgtatttttag

SEQ ID NO: 547612 - DNA, 20 bp, Artificial
  CRISPR gRNA sequence
aattttttgtatttttagta

SEQ ID NO: 547613 - DNA, 20 bp, Artificial
  CRISPR gRNA sequence
ttttgtatttttagtagaga

SEQ ID NO: 547614 - DNA, 20 bp, Artificial
  CRISPR gRNA sequence
tttgtatttttagtagagac

SEQ ID NO: 547615 - DNA, 20 bp, Artificial
  CRISPR gRNA sequence
ttgtatttttagtagagacg

SEQ ID NO: 547616 - DNA, 20 bp, Artificial
  CRISPR gRNA sequence
gagacggggtttcaccgtgt

SEQ ID NO: 547617 - DNA, 20 bp, Artificial
  CRISPR gRNA sequence
cggggtttcaccgtgttagc

SEQ ID NO: 547618 - DNA, 20 bp, Artificial
  CRISPR gRNA sequence
ggggtttcaccgtgttagcc

SEQ ID NO: 547619 - DNA, 20 bp, Artificial
  CRISPR gRNA sequence
tttcaccgtgttagccagga

SEQ ID NO: 547620 - DNA, 20 bp, Artificial
  CRISPR gRNA sequence
acctcgtgatccgcccgcct

SEQ ID NO: 547621 - DNA, 20 bp, Artificial
  CRISPR gRNA sequence
ccgcccgcctcggcctccca

SEQ ID NO: 547622 - DNA, 20 bp, Artificial
  CRISPR gRNA sequence
gcctcggcctcccaaagtgc

SEQ ID NO: 547623 - DNA, 20 bp, Artificial
  CRISPR gRNA sequence
cctcggcctcccaaagtgct

SEQ ID NO: 547624 - DNA, 20 bp, Artificial
  CRISPR gRNA sequence
ctcccaaagtgctgggatta

SEQ ID NO: 547625 - DNA, 20 bp, Artificial
  CRISPR gRNA sequence
tcccaaagtgctgggattac

SEQ ID NO: 547626 - DNA, 20 bp, Artificial
  CRISPR gRNA sequence
agtgctgggattacaggcgt

SEQ ID NO: 547627 - DNA, 20 bp, Artificial
  CRISPR gRNA sequence
caggcgtgagccaccgcgcc

SEQ ID NO: 547628 - DNA, 20 bp, Artificial
  CRISPR gRNA sequence
agccaccgcgcccggccaac

SEQ ID NO: 547629 - DNA, 20 bp, Artificial
  CRISPR gRNA sequence
caacaagttacaatttttaa

SEQ ID NO: 547630 - DNA, 20 bp, Artificial
  CRISPR gRNA sequence
ttttaacagaaaccccatta

SEQ ID NO: 547631 - DNA, 20 bp, Artificial
  CRISPR gRNA sequence
gaaaccccattatagataca

SEQ ID NO: 547632 - DNA, 20 bp, Artificial
  CRISPR gRNA sequence
gatacaaagctaacattatt

SEQ ID NO: 547633 - DNA, 20 bp, Artificial
  CRISPR gRNA sequence
tatttagcactttctgtgtt

SEQ ID NO: 547634 - DNA, 20 bp, Artificial
  CRISPR gRNA sequence
tcaatcctcatacaacctat

SEQ ID NO: 547635 - DNA, 20 bp, Artificial
  CRISPR gRNA sequence
acaacctataagttgtgtac

SEQ ID NO: 547636 - DNA, 20 bp, Artificial
  CRISPR gRNA sequence
tagtacttatccctgtttcc

SEQ ID NO: 547637 - DNA, 20 bp, Artificial
  CRISPR gRNA sequence
acttatccctgtttcctggt

SEQ ID NO: 547638 - DNA, 20 bp, Artificial
  CRISPR gRNA sequence
gtttcctggtgagaaaccaa

SEQ ID NO: 547639 - DNA, 20 bp, Artificial
  CRISPR gRNA sequence
ttcctggtgagaaaccaaca

SEQ ID NO: 547640 - DNA, 20 bp, Artificial
  CRISPR gRNA sequence
cctggtgagaaaccaacaga

SEQ ID NO: 547641 - DNA, 20 bp, Artificial
  CRISPR gRNA sequence
tggtgagaaaccaacagaga

SEQ ID NO: 547642 - DNA, 20 bp, Artificial
  CRISPR gRNA sequence
gtgagaaaccaacagagaga

SEQ ID NO: 547643 - DNA, 20 bp, Artificial
  CRISPR gRNA sequence
aaccaacagagagagagttt

SEQ ID NO: 547644 - DNA, 20 bp, Artificial
  CRISPR gRNA sequence
agagtttaagttgtttgctc

SEQ ID NO: 547645 - DNA, 20 bp, Artificial
  CRISPR gRNA sequence
gagtttaagttgtttgctca

SEQ ID NO: 547646 - DNA, 20 bp, Artificial
  CRISPR gRNA sequence
aagttgtttgctcaaggtaa

SEQ ID NO: 547647 - DNA, 20 bp, Artificial
  CRISPR gRNA sequence
tgtttgctcaaggtaacagc

SEQ ID NO: 547648 - DNA, 20 bp, Artificial
  CRISPR gRNA sequence
tgctcaaggtaacagctagt

SEQ ID NO: 547649 - DNA, 20 bp, Artificial
  CRISPR gRNA sequence
tcaaggtaacagctagtaag

SEQ ID NO: 547650 - DNA, 20 bp, Artificial
  CRISPR gRNA sequence
aggtaacagctagtaagtgg

SEQ ID NO: 547651 - DNA, 20 bp, Artificial
  CRISPR gRNA sequence
agctagtaagtggcagaacc

SEQ ID NO: 547652 - DNA, 20 bp, Artificial
  CRISPR gRNA sequence
aagtggcagaacctggcttt

SEQ ID NO: 547653 - DNA, 20 bp, Artificial
  CRISPR gRNA sequence
tggcagaacctggctttgag

SEQ ID NO: 547654 - DNA, 20 bp, Artificial
  CRISPR gRNA sequence
gcagaacctggctttgagta

SEQ ID NO: 547655 - DNA, 20 bp, Artificial
  CRISPR gRNA sequence
cagaacctggctttgagtag

SEQ ID NO: 547656 - DNA, 20 bp, Artificial
  CRISPR gRNA sequence
ggctttgagtagaggctatc

SEQ ID NO: 547657 - DNA, 20 bp, Artificial
  CRISPR gRNA sequence
gagtagaggctatctggctc

SEQ ID NO: 547658 - DNA, 20 bp, Artificial
  CRISPR gRNA sequence
gtagaggctatctggctcta

SEQ ID NO: 547659 - DNA, 20 bp, Artificial
  CRISPR gRNA sequence
ctatctggctctagagccca

SEQ ID NO: 547660 - DNA, 20 bp, Artificial
  CRISPR gRNA sequence
ataatatcattatgttctga

SEQ ID NO: 547661 - DNA, 20 bp, Artificial
  CRISPR gRNA sequence
taatatcattatgttctgaa

SEQ ID NO: 547662 - DNA, 20 bp, Artificial
  CRISPR gRNA sequence
gaaaggttacatatctacta

SEQ ID NO: 547663 - DNA, 20 bp, Artificial
  CRISPR gRNA sequence
aaaggttacatatctactac

SEQ ID NO: 547664 - DNA, 20 bp, Artificial
  CRISPR gRNA sequence
atgcatttgatatgtttcct

SEQ ID NO: 547665 - DNA, 20 bp, Artificial
  CRISPR gRNA sequence
tgcatttgatatgtttcctt

SEQ ID NO: 547666 - DNA, 20 bp, Artificial
  CRISPR gRNA sequence
gtttccttaggcctaacact

SEQ ID NO: 547667 - DNA, 20 bp, Artificial
  CRISPR gRNA sequence
aatatcatgacaatctgtct

SEQ ID NO: 547668 - DNA, 20 bp, Artificial
  CRISPR gRNA sequence
atgattttctaatgttgttt

SEQ ID NO: 547669 - DNA, 20 bp, Artificial
  CRISPR gRNA sequence
tgttttttacattatatccc

SEQ ID NO: 547670 - DNA, 20 bp, Artificial
  CRISPR gRNA sequence
tccccagtttaacaaacaaa

SEQ ID NO: 547671 - DNA, 20 bp, Artificial
  CRISPR gRNA sequence
ccccagtttaacaaacaaaa

SEQ ID NO: 547672 - DNA, 20 bp, Artificial
  CRISPR gRNA sequence
agtttaacaaacaaaaaggt

SEQ ID NO: 547673 - DNA, 20 bp, Artificial
  CRISPR gRNA sequence
caaaaaggtcagtgacttga

SEQ ID NO: 547674 - DNA, 20 bp, Artificial
  CRISPR gRNA sequence
aaaggtcagtgacttgaaag

SEQ ID NO: 547675 - DNA, 20 bp, Artificial
  CRISPR gRNA sequence
agtggtttattaaaatataa

SEQ ID NO: 547676 - DNA, 20 bp, Artificial
  CRISPR gRNA sequence
tggtttattaaaatataaaa

SEQ ID NO: 547677 - DNA, 20 bp, Artificial
  CRISPR gRNA sequence
aaatataaaagagacgaaaa

SEQ ID NO: 547678 - DNA, 20 bp, Artificial
  CRISPR gRNA sequence
aaatagtaaatactattatt

SEQ ID NO: 547679 - DNA, 20 bp, Artificial
  CRISPR gRNA sequence
cagaataatataattgtaaa

SEQ ID NO: 547680 - DNA, 20 bp, Artificial
  CRISPR gRNA sequence
atataattgtaaatagtgaa

SEQ ID NO: 547681 - DNA, 20 bp, Artificial
  CRISPR gRNA sequence
tataattgtaaatagtgaac

SEQ ID NO: 547682 - DNA, 20 bp, Artificial
  CRISPR gRNA sequence
gtaaatagtgaacaggattc

SEQ ID NO: 547683 - DNA, 20 bp, Artificial
  CRISPR gRNA sequence
taaatagtgaacaggattcc

SEQ ID NO: 547684 - DNA, 20 bp, Artificial
  CRISPR gRNA sequence
aaatagtgaacaggattcca

SEQ ID NO: 547685 - DNA, 20 bp, Artificial
  CRISPR gRNA sequence
gaacaggattccagggcaaa

SEQ ID NO: 547686 - DNA, 20 bp, Artificial
  CRISPR gRNA sequence
acaggattccagggcaaata

SEQ ID NO: 547687 - DNA, 20 bp, Artificial
  CRISPR gRNA sequence
ccagggcaaatagagaatat

SEQ ID NO: 547688 - DNA, 20 bp, Artificial
  CRISPR gRNA sequence
aaatagagaatatgagtctc

SEQ ID NO: 547689 - DNA, 20 bp, Artificial
  CRISPR gRNA sequence
aatagagaatatgagtctct

SEQ ID NO: 547690 - DNA, 20 bp, Artificial
  CRISPR gRNA sequence
atagagaatatgagtctcta

SEQ ID NO: 547691 - DNA, 20 bp, Artificial
  CRISPR gRNA sequence
agaatatgagtctctagggc

SEQ ID NO: 547692 - DNA, 20 bp, Artificial
  CRISPR gRNA sequence
gaatatgagtctctagggct

SEQ ID NO: 547693 - DNA, 20 bp, Artificial
  CRISPR gRNA sequence
tgagtctctagggctgggat

SEQ ID NO: 547694 - DNA, 20 bp, Artificial
  CRISPR gRNA sequence
gagtctctagggctgggata

SEQ ID NO: 547695 - DNA, 20 bp, Artificial
  CRISPR gRNA sequence
ctctagggctgggataaggt

SEQ ID NO: 547696 - DNA, 20 bp, Artificial
  CRISPR gRNA sequence
tgaatgaaatttttctgaac

SEQ ID NO: 547697 - DNA, 20 bp, Artificial
  CRISPR gRNA sequence
atgaaatttttctgaacaag

SEQ ID NO: 547698 - DNA, 20 bp, Artificial
  CRISPR gRNA sequence
ttctgaacaagcagctgaaa

SEQ ID NO: 547699 - DNA, 20 bp, Artificial
  CRISPR gRNA sequence
aacaagcagctgaaacagat

SEQ ID NO: 547700 - DNA, 20 bp, Artificial
  CRISPR gRNA sequence
acaagcagctgaaacagata

SEQ ID NO: 547701 - DNA, 20 bp, Artificial
  CRISPR gRNA sequence
caagcagctgaaacagataa

SEQ ID NO: 547702 - DNA, 20 bp, Artificial
  CRISPR gRNA sequence
ctgaaacagataagggaaat

SEQ ID NO: 547703 - DNA, 20 bp, Artificial
  CRISPR gRNA sequence
taagggaaattagcaaatac

SEQ ID NO: 547704 - DNA, 20 bp, Artificial
  CRISPR gRNA sequence
tacaagaaatatatgaaact

SEQ ID NO: 547705 - DNA, 20 bp, Artificial
  CRISPR gRNA sequence
tatgaaacttggattttaac

SEQ ID NO: 547706 - DNA, 20 bp, Artificial
  CRISPR gRNA sequence
aaacttggattttaactggt

SEQ ID NO: 547707 - DNA, 20 bp, Artificial
  CRISPR gRNA sequence
tttaactggtgagccattct

SEQ ID NO: 547708 - DNA, 20 bp, Artificial
  CRISPR gRNA sequence
ccctttcaaacaataactta

SEQ ID NO: 547709 - DNA, 20 bp, Artificial
  CRISPR gRNA sequence
acaataacttaaagccatta

SEQ ID NO: 547710 - DNA, 20 bp, Artificial
  CRISPR gRNA sequence
cattaaagttatattatttt

SEQ ID NO: 547711 - DNA, 20 bp, Artificial
  CRISPR gRNA sequence
agttatattattttcagaca

SEQ ID NO: 547712 - DNA, 20 bp, Artificial
  CRISPR gRNA sequence
tatattattttcagacaaag

SEQ ID NO: 547713 - DNA, 20 bp, Artificial
  CRISPR gRNA sequence
tattattttcagacaaagca

SEQ ID NO: 547714 - DNA, 20 bp, Artificial
  CRISPR gRNA sequence
agacaaagcagagtcacttt

SEQ ID NO: 547715 - DNA, 20 bp, Artificial
  CRISPR gRNA sequence
gacaaagcagagtcactttt

SEQ ID NO: 547716 - DNA, 20 bp, Artificial
  CRISPR gRNA sequence
aagcagagtcacttttggga

SEQ ID NO: 547717 - DNA, 20 bp, Artificial
  CRISPR gRNA sequence
agcagagtcacttttgggaa

SEQ ID NO: 547718 - DNA, 20 bp, Artificial
  CRISPR gRNA sequence
gagtcacttttgggaaagga

SEQ ID NO: 547719 - DNA, 20 bp, Artificial
  CRISPR gRNA sequence
ggaaaggaaagacatttttc

SEQ ID NO: 547720 - DNA, 20 bp, Artificial
  CRISPR gRNA sequence
gaaagacatttttcaagaaa

SEQ ID NO: 547721 - DNA, 20 bp, Artificial
  CRISPR gRNA sequence
agacatttttcaagaaaaag

SEQ ID NO: 547722 - DNA, 20 bp, Artificial
  CRISPR gRNA sequence
gaaaaagtagacgtcctcgt

SEQ ID NO: 547723 - DNA, 20 bp, Artificial
  CRISPR gRNA sequence
aaaaagtagacgtcctcgtc

SEQ ID NO: 547724 - DNA, 20 bp, Artificial
  CRISPR gRNA sequence
aaaagtagacgtcctcgtca

SEQ ID NO: 547725 - DNA, 20 bp, Artificial
  CRISPR gRNA sequence
agtagacgtcctcgtcaggg

SEQ ID NO: 547726 - DNA, 20 bp, Artificial
  CRISPR gRNA sequence
gtagacgtcctcgtcagggt

SEQ ID NO: 547727 - DNA, 20 bp, Artificial
  CRISPR gRNA sequence
gacgtcctcgtcagggtggg

SEQ ID NO: 547728 - DNA, 20 bp, Artificial
  CRISPR gRNA sequence
cagggtgggcagcgccgccg

SEQ ID NO: 547729 - DNA, 20 bp, Artificial
  CRISPR gRNA sequence
ggtgggcagcgccgccgcgg

SEQ ID NO: 547730 - DNA, 20 bp, Artificial
  CRISPR gRNA sequence
gtgggcagcgccgccgcggc

SEQ ID NO: 547731 - DNA, 20 bp, Artificial
  CRISPR gRNA sequence
cagcgccgccgcggcgggcc

SEQ ID NO: 547732 - DNA, 20 bp, Artificial
  CRISPR gRNA sequence
agcgccgccgcggcgggcct

SEQ ID NO: 547733 - DNA, 20 bp, Artificial
  CRISPR gRNA sequence
gcgccgccgcggcgggcctg

SEQ ID NO: 547734 - DNA, 20 bp, Artificial
  CRISPR gRNA sequence
gccgcggcgggcctggggct

SEQ ID NO: 547735 - DNA, 20 bp, Artificial
  CRISPR gRNA sequence
ccgcggcgggcctggggctt

SEQ ID NO: 547736 - DNA, 20 bp, Artificial
  CRISPR gRNA sequence
cgcggcgggcctggggcttg

SEQ ID NO: 547737 - DNA, 20 bp, Artificial
  CRISPR gRNA sequence
cgggcctggggcttggggcc

SEQ ID NO: 547738 - DNA, 20 bp, Artificial
  CRISPR gRNA sequence
ggcctggggcttggggcctg

SEQ ID NO: 547739 - DNA, 20 bp, Artificial
  CRISPR gRNA sequence
ctggggcttggggcctggag

SEQ ID NO: 547740 - DNA, 20 bp, Artificial
  CRISPR gRNA sequence
gggcctggagcggcccctcc

SEQ ID NO: 547741 - DNA, 20 bp, Artificial
  CRISPR gRNA sequence
gagcggcccctcccagcacc

SEQ ID NO: 547742 - DNA, 20 bp, Artificial
  CRISPR gRNA sequence
ccctgccgcccactgccctg

SEQ ID NO: 547743 - DNA, 20 bp, Artificial
  CRISPR gRNA sequence
cctgccgcccactgccctga

SEQ ID NO: 547744 - DNA, 20 bp, Artificial
  CRISPR gRNA sequence
cgcccactgccctgaaggtc

SEQ ID NO: 547745 - DNA, 20 bp, Artificial
  CRISPR gRNA sequence
agtcgctttgttctgcgctg

SEQ ID NO: 547746 - DNA, 20 bp, Artificial
  CRISPR gRNA sequence
gtcgctttgttctgcgctgc

SEQ ID NO: 547747 - DNA, 20 bp, Artificial
  CRISPR gRNA sequence
gctttgttctgcgctgcggg

SEQ ID NO: 547748 - DNA, 20 bp, Artificial
  CRISPR gRNA sequence
gctgcgggcggcttcctcgc

SEQ ID NO: 547749 - DNA, 20 bp, Artificial
  CRISPR gRNA sequence
gcgggcggcttcctcgccgg

SEQ ID NO: 547750 - DNA, 20 bp, Artificial
  CRISPR gRNA sequence
cggcttcctcgccggcggcc

SEQ ID NO: 547751 - DNA, 20 bp, Artificial
  CRISPR gRNA sequence
cttcctcgccggcggcccag

SEQ ID NO: 547752 - DNA, 20 bp, Artificial
  CRISPR gRNA sequence
tcctcgccggcggcccagcg

SEQ ID NO: 547753 - DNA, 20 bp, Artificial
  CRISPR gRNA sequence
cctcgccggcggcccagcgg

SEQ ID NO: 547754 - DNA, 20 bp, Artificial
  CRISPR gRNA sequence
tcgccggcggcccagcggag

SEQ ID NO: 547755 - DNA, 20 bp, Artificial
  CRISPR gRNA sequence
cgccggcggcccagcggagg

SEQ ID NO: 547756 - DNA, 20 bp, Artificial
  CRISPR gRNA sequence
gcggcccagcggaggaggcg

SEQ ID NO: 547757 - DNA, 20 bp, Artificial
  CRISPR gRNA sequence
ggcccagcggaggaggcgta

SEQ ID NO: 547758 - DNA, 20 bp, Artificial
  CRISPR gRNA sequence
gcccagcggaggaggcgtag

SEQ ID NO: 547759 - DNA, 20 bp, Artificial
  CRISPR gRNA sequence
cccagcggaggaggcgtaga

SEQ ID NO: 547760 - DNA, 20 bp, Artificial
  CRISPR gRNA sequence
agcggaggaggcgtagaggg

SEQ ID NO: 547761 - DNA, 20 bp, Artificial
  CRISPR gRNA sequence
gaggaggcgtagagggcggc

SEQ ID NO: 547762 - DNA, 20 bp, Artificial
  CRISPR gRNA sequence
gaggcgtagagggcggcgag

SEQ ID NO: 547763 - DNA, 20 bp, Artificial
  CRISPR gRNA sequence
aggcgtagagggcggcgagt

SEQ ID NO: 547764 - DNA, 20 bp, Artificial
  CRISPR gRNA sequence
ggcgtagagggcggcgagtg

SEQ ID NO: 547765 - DNA, 20 bp, Artificial
  CRISPR gRNA sequence
gcgtagagggcggcgagtgg

SEQ ID NO: 547766 - DNA, 20 bp, Artificial
  CRISPR gRNA sequence
agagggcggcgagtgggggc

SEQ ID NO: 547767 - DNA, 20 bp, Artificial
  CRISPR gRNA sequence
gggcggcgagtgggggctgg

SEQ ID NO: 547768 - DNA, 20 bp, Artificial
  CRISPR gRNA sequence
tggcagctcaaatctcccgc

SEQ ID NO: 547769 - DNA, 20 bp, Artificial
  CRISPR gRNA sequence
gctcaaatctcccgctagcc

SEQ ID NO: 547770 - DNA, 20 bp, Artificial
  CRISPR gRNA sequence
aaatctcccgctagcccagc

SEQ ID NO: 547771 - DNA, 20 bp, Artificial
  CRISPR gRNA sequence
cccagccagccccgcgtacc

SEQ ID NO: 547772 - DNA, 20 bp, Artificial
  CRISPR gRNA sequence
cagccagccccgcgtacccg

SEQ ID NO: 547773 - DNA, 20 bp, Artificial
  CRISPR gRNA sequence
agccagccccgcgtacccgg

SEQ ID NO: 547774 - DNA, 20 bp, Artificial
  CRISPR gRNA sequence
gccagccccgcgtacccgga

SEQ ID NO: 547775 - DNA, 20 bp, Artificial
  CRISPR gRNA sequence
cccgcgtacccggagggccg

SEQ ID NO: 547776 - DNA, 20 bp, Artificial
  CRISPR gRNA sequence
ccggagggccgcggcgcacc

SEQ ID NO: 547777 - DNA, 20 bp, Artificial
  CRISPR gRNA sequence
ggagggccgcggcgcacccg

SEQ ID NO: 547778 - DNA, 20 bp, Artificial
  CRISPR gRNA sequence
gagggccgcggcgcacccgg

SEQ ID NO: 547779 - DNA, 20 bp, Artificial
  CRISPR gRNA sequence
gggccgcggcgcacccggag

SEQ ID NO: 547780 - DNA, 20 bp, Artificial
  CRISPR gRNA sequence
ggcgcacccggaggagcatt

SEQ ID NO: 547781 - DNA, 20 bp, Artificial
  CRISPR gRNA sequence
gcgcacccggaggagcattc

SEQ ID NO: 547782 - DNA, 20 bp, Artificial
  CRISPR gRNA sequence
cattcaggcttcccgttttt

SEQ ID NO: 547783 - DNA, 20 bp, Artificial
  CRISPR gRNA sequence
attcaggcttcccgttttta

SEQ ID NO: 547784 - DNA, 20 bp, Artificial
  CRISPR gRNA sequence
caggcttcccgtttttaagg

SEQ ID NO: 547785 - DNA, 20 bp, Artificial
  CRISPR gRNA sequence
ggcttcccgtttttaaggtg

SEQ ID NO: 547786 - DNA, 20 bp, Artificial
  CRISPR gRNA sequence
gtttttaaggtggagacgtc

SEQ ID NO: 547787 - DNA, 20 bp, Artificial
  CRISPR gRNA sequence
tttttaaggtggagacgtcc

SEQ ID NO: 547788 - DNA, 20 bp, Artificial
  CRISPR gRNA sequence
gacgtccaggacctctttat

SEQ ID NO: 547789 - DNA, 20 bp, Artificial
  CRISPR gRNA sequence
ggacctctttattagatgtt

SEQ ID NO: 547790 - DNA, 20 bp, Artificial
  CRISPR gRNA sequence
gacctctttattagatgttt

SEQ ID NO: 547791 - DNA, 20 bp, Artificial
  CRISPR gRNA sequence
tattagatgtttaggaattt

SEQ ID NO: 547792 - DNA, 20 bp, Artificial
  CRISPR gRNA sequence
taggaatttgagtttttccg

SEQ ID NO: 547793 - DNA, 20 bp, Artificial
  CRISPR gRNA sequence
aggaatttgagtttttccgt

SEQ ID NO: 547794 - DNA, 20 bp, Artificial
  CRISPR gRNA sequence
ggaatttgagtttttccgta

SEQ ID NO: 547795 - DNA, 20 bp, Artificial
  CRISPR gRNA sequence
tgagtttttccgtagggcga

SEQ ID NO: 547796 - DNA, 20 bp, Artificial
  CRISPR gRNA sequence
cgtagggcgatggtcatcgt

SEQ ID NO: 547797 - DNA, 20 bp, Artificial
  CRISPR gRNA sequence
atggtcatcgtgagcatctg

SEQ ID NO: 547798 - DNA, 20 bp, Artificial
  CRISPR gRNA sequence
tggtcatcgtgagcatctgt

SEQ ID NO: 547799 - DNA, 20 bp, Artificial
  CRISPR gRNA sequence
ggtcatcgtgagcatctgtg

SEQ ID NO: 547800 - DNA, 20 bp, Artificial
  CRISPR gRNA sequence
atcgtgagcatctgtggggt

SEQ ID NO: 547801 - DNA, 20 bp, Artificial
  CRISPR gRNA sequence
tcgtgagcatctgtggggtc

SEQ ID NO: 547802 - DNA, 20 bp, Artificial
  CRISPR gRNA sequence
gagcatctgtggggtcaggc

SEQ ID NO: 547803 - DNA, 20 bp, Artificial
  CRISPR gRNA sequence
agcatctgtggggtcaggct

SEQ ID NO: 547804 - DNA, 20 bp, Artificial
  CRISPR gRNA sequence
tggggtcaggctgggctaac

SEQ ID NO: 547805 - DNA, 20 bp, Artificial
  CRISPR gRNA sequence
ggggtcaggctgggctaact

SEQ ID NO: 547806 - DNA, 20 bp, Artificial
  CRISPR gRNA sequence
gggtcaggctgggctaactg

SEQ ID NO: 547807 - DNA, 20 bp, Artificial
  CRISPR gRNA sequence
ctaactggggttttgattgt

SEQ ID NO: 547808 - DNA, 20 bp, Artificial
  CRISPR gRNA sequence
ttttgattgtaagtttcgtg

SEQ ID NO: 547809 - DNA, 20 bp, Artificial
  CRISPR gRNA sequence
attgtaagtttcgtgtggac

SEQ ID NO: 547810 - DNA, 20 bp, Artificial
  CRISPR gRNA sequence
ttgtaagtttcgtgtggacg

SEQ ID NO: 547811 - DNA, 20 bp, Artificial
  CRISPR gRNA sequence
tgtaagtttcgtgtggacga

SEQ ID NO: 547812 - DNA, 20 bp, Artificial
  CRISPR gRNA sequence
gtggacgagggcatgtctga

SEQ ID NO: 547813 - DNA, 20 bp, Artificial
  CRISPR gRNA sequence
tggacgagggcatgtctgat

SEQ ID NO: 547814 - DNA, 20 bp, Artificial
  CRISPR gRNA sequence
ggacgagggcatgtctgatg

SEQ ID NO: 547815 - DNA, 20 bp, Artificial
  CRISPR gRNA sequence
cgagggcatgtctgatgggg

SEQ ID NO: 547816 - DNA, 20 bp, Artificial
  CRISPR gRNA sequence
ggcatgtctgatggggaaga

SEQ ID NO: 547817 - DNA, 20 bp, Artificial
  CRISPR gRNA sequence
ctgatggggaagaaagtcct

SEQ ID NO: 547818 - DNA, 20 bp, Artificial
  CRISPR gRNA sequence
aagtccttggcattgcatct

SEQ ID NO: 547819 - DNA, 20 bp, Artificial
  CRISPR gRNA sequence
tggcattgcatctcagctgt

SEQ ID NO: 547820 - DNA, 20 bp, Artificial
  CRISPR gRNA sequence
ggcattgcatctcagctgtt

SEQ ID NO: 547821 - DNA, 20 bp, Artificial
  CRISPR gRNA sequence
cattgcatctcagctgttgg

SEQ ID NO: 547822 - DNA, 20 bp, Artificial
  CRISPR gRNA sequence
ctcagctgttgggagctgtg

SEQ ID NO: 547823 - DNA, 20 bp, Artificial
  CRISPR gRNA sequence
tgttgggagctgtgcggtgc

SEQ ID NO: 547824 - DNA, 20 bp, Artificial
  CRISPR gRNA sequence
gggagctgtgcggtgcgagc

SEQ ID NO: 547825 - DNA, 20 bp, Artificial
  CRISPR gRNA sequence
gctgtgcggtgcgagccaga

SEQ ID NO: 547826 - DNA, 20 bp, Artificial
  CRISPR gRNA sequence
ctgtgcggtgcgagccagat

SEQ ID NO: 547827 - DNA, 20 bp, Artificial
  CRISPR gRNA sequence
tgcggtgcgagccagatggg

SEQ ID NO: 547828 - DNA, 20 bp, Artificial
  CRISPR gRNA sequence
atgggcggcgtgtgctcccc

SEQ ID NO: 547829 - DNA, 20 bp, Artificial
  CRISPR gRNA sequence
tgggcggcgtgtgctccccg

SEQ ID NO: 547830 - DNA, 20 bp, Artificial
  CRISPR gRNA sequence
ggcgtgtgctccccgaggac

SEQ ID NO: 547831 - DNA, 20 bp, Artificial
  CRISPR gRNA sequence
tgctccccgaggactggcct

SEQ ID NO: 547832 - DNA, 20 bp, Artificial
  CRISPR gRNA sequence
gaggactggcctgagtgcct

SEQ ID NO: 547833 - DNA, 20 bp, Artificial
  CRISPR gRNA sequence
ctggcctgagtgccttagcc

SEQ ID NO: 547834 - DNA, 20 bp, Artificial
  CRISPR gRNA sequence
tgccttagcctagttactca

SEQ ID NO: 547835 - DNA, 20 bp, Artificial
  CRISPR gRNA sequence
gccttagcctagttactcac

SEQ ID NO: 547836 - DNA, 20 bp, Artificial
  CRISPR gRNA sequence
gcctagttactcacgggact

SEQ ID NO: 547837 - DNA, 20 bp, Artificial
  CRISPR gRNA sequence
actcacgggacttggtttac

SEQ ID NO: 547838 - DNA, 20 bp, Artificial
  CRISPR gRNA sequence
cgggacttggtttaccagac

SEQ ID NO: 547839 - DNA, 20 bp, Artificial
  CRISPR gRNA sequence
gggacttggtttaccagaca

SEQ ID NO: 547840 - DNA, 20 bp, Artificial
  CRISPR gRNA sequence
ggacttggtttaccagacaa

SEQ ID NO: 547841 - DNA, 20 bp, Artificial
  CRISPR gRNA sequence
gacttggtttaccagacaag

SEQ ID NO: 547842 - DNA, 20 bp, Artificial
  CRISPR gRNA sequence
gacaaggggataaaaacatt

SEQ ID NO: 547843 - DNA, 20 bp, Artificial
  CRISPR gRNA sequence
aggggataaaaacattcaga

SEQ ID NO: 547844 - DNA, 20 bp, Artificial
  CRISPR gRNA sequence
ggataaaaacattcagatgg

SEQ ID NO: 547845 - DNA, 20 bp, Artificial
  CRISPR gRNA sequence
aacattcagatggcagataa

SEQ ID NO: 547846 - DNA, 20 bp, Artificial
  CRISPR gRNA sequence
gatggcagataacagttttt

SEQ ID NO: 547847 - DNA, 20 bp, Artificial
  CRISPR gRNA sequence
gcagataacagtttttcaga

SEQ ID NO: 547848 - DNA, 20 bp, Artificial
  CRISPR gRNA sequence
cagataacagtttttcagat

SEQ ID NO: 547849 - DNA, 20 bp, Artificial
  CRISPR gRNA sequence
agataacagtttttcagatg

SEQ ID NO: 547850 - DNA, 20 bp, Artificial
  CRISPR gRNA sequence
tttttcagatggggttcctt

SEQ ID NO: 547851 - DNA, 20 bp, Artificial
  CRISPR gRNA sequence
tggggttccttcagatttcg

SEQ ID NO: 547852 - DNA, 20 bp, Artificial
  CRISPR gRNA sequence
ggttccttcagatttcgtgg

SEQ ID NO: 547853 - DNA, 20 bp, Artificial
  CRISPR gRNA sequence
gtggaagctgctaaaaatgc

SEQ ID NO: 547854 - DNA, 20 bp, Artificial
  CRISPR gRNA sequence
aagctgctaaaaatgcaagt

SEQ ID NO: 547855 - DNA, 20 bp, Artificial
  CRISPR gRNA sequence
tgctaaaaatgcaagtaaga

SEQ ID NO: 547856 - DNA, 20 bp, Artificial
  CRISPR gRNA sequence
aaaatgcaagtaagacggaa

SEQ ID NO: 547857 - DNA, 20 bp, Artificial
  CRISPR gRNA sequence
aagtaagacggaaaagctca

SEQ ID NO: 547858 - DNA, 20 bp, Artificial
  CRISPR gRNA sequence
agacggaaaagctcacggat

SEQ ID NO: 547859 - DNA, 20 bp, Artificial
  CRISPR gRNA sequence
gacggaaaagctcacggatc

SEQ ID NO: 547860 - DNA, 20 bp, Artificial
  CRISPR gRNA sequence
agctcacggatcaggtgatg

SEQ ID NO: 547861 - DNA, 20 bp, Artificial
  CRISPR gRNA sequence
gatcaggtgatgcagaatcc

SEQ ID NO: 547862 - DNA, 20 bp, Artificial
  CRISPR gRNA sequence
tcaggtgatgcagaatcctg

SEQ ID NO: 547863 - DNA, 20 bp, Artificial
  CRISPR gRNA sequence
gatgcagaatcctggagttt

SEQ ID NO: 547864 - DNA, 20 bp, Artificial
  CRISPR gRNA sequence
gcagaatcctggagttttgg

SEQ ID NO: 547865 - DNA, 20 bp, Artificial
  CRISPR gRNA sequence
ctggagttttggcagcttta

SEQ ID NO: 547866 - DNA, 20 bp, Artificial
  CRISPR gRNA sequence
tggagttttggcagctttac

SEQ ID NO: 547867 - DNA, 20 bp, Artificial
  CRISPR gRNA sequence
gagttttggcagctttacag

SEQ ID NO: 547868 - DNA, 20 bp, Artificial
  CRISPR gRNA sequence
aatgcccctcacaccccttc

SEQ ID NO: 547869 - DNA, 20 bp, Artificial
  CRISPR gRNA sequence
ctacatcgaaactttaccta

SEQ ID NO: 547870 - DNA, 20 bp, Artificial
  CRISPR gRNA sequence
catcgaaactttacctaaag

SEQ ID NO: 547871 - DNA, 20 bp, Artificial
  CRISPR gRNA sequence
actttacctaaagcagtaaa

SEQ ID NO: 547872 - DNA, 20 bp, Artificial
  CRISPR gRNA sequence
ttacctaaagcagtaaaaag

SEQ ID NO: 547873 - DNA, 20 bp, Artificial
  CRISPR gRNA sequence
ttaatgcattgaaacaaatt

SEQ ID NO: 547874 - DNA, 20 bp, Artificial
  CRISPR gRNA sequence
taatgcattgaaacaaattc

SEQ ID NO: 547875 - DNA, 20 bp, Artificial
  CRISPR gRNA sequence
gcattgaaacaaattcaggt

SEQ ID NO: 547876 - DNA, 20 bp, Artificial
  CRISPR gRNA sequence
tcaggtgagatgcgctcata

SEQ ID NO: 547877 - DNA, 20 bp, Artificial
  CRISPR gRNA sequence
ggtgagatgcgctcatatag

SEQ ID NO: 547878 - DNA, 20 bp, Artificial
  CRISPR gRNA sequence
gatgcgctcatatagaagcc

SEQ ID NO: 547879 - DNA, 20 bp, Artificial
  CRISPR gRNA sequence
tatagaagccaagttctatg

SEQ ID NO: 547880 - DNA, 20 bp, Artificial
  CRISPR gRNA sequence
agaagccaagttctatgaag

SEQ ID NO: 547881 - DNA, 20 bp, Artificial
  CRISPR gRNA sequence
ctatgaagaagttcatgact

SEQ ID NO: 547882 - DNA, 20 bp, Artificial
  CRISPR gRNA sequence
gaagaagttcatgacttgga

SEQ ID NO: 547883 - DNA, 20 bp, Artificial
  CRISPR gRNA sequence
tgacttggaaagaaaatatg

SEQ ID NO: 547884 - DNA, 20 bp, Artificial
  CRISPR gRNA sequence
gaaaatatgcagcattatac

SEQ ID NO: 547885 - DNA, 20 bp, Artificial
  CRISPR gRNA sequence
tataccagcctctctttgac

SEQ ID NO: 547886 - DNA, 20 bp, Artificial
  CRISPR gRNA sequence
taccagcctctctttgacga

SEQ ID NO: 547887 - DNA, 20 bp, Artificial
  CRISPR gRNA sequence
cagcctctctttgacgagag

SEQ ID NO: 547888 - DNA, 20 bp, Artificial
  CRISPR gRNA sequence
gcctctctttgacgagagaa

SEQ ID NO: 547889 - DNA, 20 bp, Artificial
  CRISPR gRNA sequence
gagagaagagaatttatcac

SEQ ID NO: 547890 - DNA, 20 bp, Artificial
  CRISPR gRNA sequence
tgttgaaccaacatctgata

SEQ ID NO: 547891 - DNA, 20 bp, Artificial
  CRISPR gRNA sequence
accaacatctgatatggaat

SEQ ID NO: 547892 - DNA, 20 bp, Artificial
  CRISPR gRNA sequence
catctgatatggaatcagaa

SEQ ID NO: 547893 - DNA, 20 bp, Artificial
  CRISPR gRNA sequence
agaatggcaccgtgaaaatg

SEQ ID NO: 547894 - DNA, 20 bp, Artificial
  CRISPR gRNA sequence
aatggcaccgtgaaaatgaa

SEQ ID NO: 547895 - DNA, 20 bp, Artificial
  CRISPR gRNA sequence
atggcaccgtgaaaatgaag

SEQ ID NO: 547896 - DNA, 20 bp, Artificial
  CRISPR gRNA sequence
ggcaccgtgaaaatgaagag

SEQ ID NO: 547897 - DNA, 20 bp, Artificial
  CRISPR gRNA sequence
gcaccgtgaaaatgaagagg

SEQ ID NO: 547898 - DNA, 20 bp, Artificial
  CRISPR gRNA sequence
accgtgaaaatgaagaggag

SEQ ID NO: 547899 - DNA, 20 bp, Artificial
  CRISPR gRNA sequence
aaatgaagaggaggagaaat

SEQ ID NO: 547900 - DNA, 20 bp, Artificial
  CRISPR gRNA sequence
gaagaggaggagaaattggc

SEQ ID NO: 547901 - DNA, 20 bp, Artificial
  CRISPR gRNA sequence
agaggaggagaaattggctg

SEQ ID NO: 547902 - DNA, 20 bp, Artificial
  CRISPR gRNA sequence
gaggagaaattggctggaga

SEQ ID NO: 547903 - DNA, 20 bp, Artificial
  CRISPR gRNA sequence
aggagaaattggctggagac

SEQ ID NO: 547904 - DNA, 20 bp, Artificial
  CRISPR gRNA sequence
ggctggagacaggaaaaata

SEQ ID NO: 547905 - DNA, 20 bp, Artificial
  CRISPR gRNA sequence
tggagacaggaaaaataaag

SEQ ID NO: 547906 - DNA, 20 bp, Artificial
  CRISPR gRNA sequence
gaaaaataaagtagtcataa

SEQ ID NO: 547907 - DNA, 20 bp, Artificial
  CRISPR gRNA sequence
taaagtagtcataacagaaa

SEQ ID NO: 547908 - DNA, 20 bp, Artificial
  CRISPR gRNA sequence
agtagtcataacagaaaaag

SEQ ID NO: 547909 - DNA, 20 bp, Artificial
  CRISPR gRNA sequence
agtcataacagaaaaagcag

SEQ ID NO: 547910 - DNA, 20 bp, Artificial
  CRISPR gRNA sequence
aacagaaaaagcagcagcaa

SEQ ID NO: 547911 - DNA, 20 bp, Artificial
  CRISPR gRNA sequence
aaaagcagcagcaacagctg

SEQ ID NO: 547912 - DNA, 20 bp, Artificial
  CRISPR gRNA sequence
aagcagcagcaacagctgaa

SEQ ID NO: 547913 - DNA, 20 bp, Artificial
  CRISPR gRNA sequence
agctgaagagccaaatccca

SEQ ID NO: 547914 - DNA, 20 bp, Artificial
  CRISPR gRNA sequence
gctgaagagccaaatcccaa

SEQ ID NO: 547915 - DNA, 20 bp, Artificial
  CRISPR gRNA sequence
gccaaatcccaaaggaattc

SEQ ID NO: 547916 - DNA, 20 bp, Artificial
  CRISPR gRNA sequence
caaatcccaaaggaattcca

SEQ ID NO: 547917 - DNA, 20 bp, Artificial
  CRISPR gRNA sequence
ccaaaggaattccagagttc

SEQ ID NO: 547918 - DNA, 20 bp, Artificial
  CRISPR gRNA sequence
gagttctggtttaccatctt

SEQ ID NO: 547919 - DNA, 20 bp, Artificial
  CRISPR gRNA sequence
gtttaccatctttagaaatg

SEQ ID NO: 547920 - DNA, 20 bp, Artificial
  CRISPR gRNA sequence
tttagaaatgtagatatgct

SEQ ID NO: 547921 - DNA, 20 bp, Artificial
  CRISPR gRNA sequence
tgtagatatgctaagtgaat

SEQ ID NO: 547922 - DNA, 20 bp, Artificial
  CRISPR gRNA sequence
atatgctaagtgaattagtc

SEQ ID NO: 547923 - DNA, 20 bp, Artificial
  CRISPR gRNA sequence
tatgctaagtgaattagtcc

SEQ ID NO: 547924 - DNA, 20 bp, Artificial
  CRISPR gRNA sequence
aaccaatcttgaaatacctg

SEQ ID NO: 547925 - DNA, 20 bp, Artificial
  CRISPR gRNA sequence
accaatcttgaaatacctgc

SEQ ID NO: 547926 - DNA, 20 bp, Artificial
  CRISPR gRNA sequence
gaaatacctgcaggatatta

SEQ ID NO: 547927 - DNA, 20 bp, Artificial
  CRISPR gRNA sequence
acctgcaggatattaaagtg

SEQ ID NO: 547928 - DNA, 20 bp, Artificial
  CRISPR gRNA sequence
aaagtgaagttttctgaccc

SEQ ID NO: 547929 - DNA, 20 bp, Artificial
  CRISPR gRNA sequence
tgaagttttctgaccctgga

SEQ ID NO: 547930 - DNA, 20 bp, Artificial
  CRISPR gRNA sequence
cagcctatgtctttcatatt

SEQ ID NO: 547931 - DNA, 20 bp, Artificial
  CRISPR gRNA sequence
gcctatgtctttcatattaa

SEQ ID NO: 547932 - DNA, 20 bp, Artificial
  CRISPR gRNA sequence
caatgactgctttgccaact

SEQ ID NO: 547933 - DNA, 20 bp, Artificial
  CRISPR gRNA sequence
cagtcctgacaaaaacctgc

SEQ ID NO: 547934 - DNA, 20 bp, Artificial
  CRISPR gRNA sequence
aaaaacctgcaagatgaaat

SEQ ID NO: 547935 - DNA, 20 bp, Artificial
  CRISPR gRNA sequence
ctgcaagatgaaatcagaac

SEQ ID NO: 547936 - DNA, 20 bp, Artificial
  CRISPR gRNA sequence
agatgaaatcagaaccagat

SEQ ID NO: 547937 - DNA, 20 bp, Artificial
  CRISPR gRNA sequence
gatgaaatcagaaccagata

SEQ ID NO: 547938 - DNA, 20 bp, Artificial
  CRISPR gRNA sequence
ggctgatcccttttcatttg

SEQ ID NO: 547939 - DNA, 20 bp, Artificial
  CRISPR gRNA sequence
gctgatcccttttcatttgc

SEQ ID NO: 547940 - DNA, 20 bp, Artificial
  CRISPR gRNA sequence
ccttttcatttgcaggtcct

SEQ ID NO: 547941 - DNA, 20 bp, Artificial
  CRISPR gRNA sequence
atttgcaggtcctgagatca

SEQ ID NO: 547942 - DNA, 20 bp, Artificial
  CRISPR gRNA sequence
cctgagatcatggactgcga

SEQ ID NO: 547943 - DNA, 20 bp, Artificial
  CRISPR gRNA sequence
ctgagatcatggactgcgat

SEQ ID NO: 547944 - DNA, 20 bp, Artificial
  CRISPR gRNA sequence
gcgatgggtgtactattgac

SEQ ID NO: 547945 - DNA, 20 bp, Artificial
  CRISPR gRNA sequence
atgggtgtactattgactgg

SEQ ID NO: 547946 - DNA, 20 bp, Artificial
  CRISPR gRNA sequence
gtgtactattgactggaaga

SEQ ID NO: 547947 - DNA, 20 bp, Artificial
  CRISPR gRNA sequence
tgtactattgactggaagaa

SEQ ID NO: 547948 - DNA, 20 bp, Artificial
  CRISPR gRNA sequence
ctattgactggaagaaagga

SEQ ID NO: 547949 - DNA, 20 bp, Artificial
  CRISPR gRNA sequence
atgttactgtcaaaaccatc

SEQ ID NO: 547950 - DNA, 20 bp, Artificial
  CRISPR gRNA sequence
ctgtcaaaaccatcaagaaa

SEQ ID NO: 547951 - DNA, 20 bp, Artificial
  CRISPR gRNA sequence
tcaaaaccatcaagaaaaag

SEQ ID NO: 547952 - DNA, 20 bp, Artificial
  CRISPR gRNA sequence
aaaccatcaagaaaaagcag

SEQ ID NO: 547953 - DNA, 20 bp, Artificial
  CRISPR gRNA sequence
tcaagaaaaagcagaagcgt

SEQ ID NO: 547954 - DNA, 20 bp, Artificial
  CRISPR gRNA sequence
caagaaaaagcagaagcgta

SEQ ID NO: 547955 - DNA, 20 bp, Artificial
  CRISPR gRNA sequence
aagaaaaagcagaagcgtaa

SEQ ID NO: 547956 - DNA, 20 bp, Artificial
  CRISPR gRNA sequence
aaagcagaagcgtaagggtc

SEQ ID NO: 547957 - DNA, 20 bp, Artificial
  CRISPR gRNA sequence
aagcagaagcgtaagggtcc

SEQ ID NO: 547958 - DNA, 20 bp, Artificial
  CRISPR gRNA sequence
cgtaagggtccaggcactgt

SEQ ID NO: 547959 - DNA, 20 bp, Artificial
  CRISPR gRNA sequence
tgttagaacaattaccaaac

SEQ ID NO: 547960 - DNA, 20 bp, Artificial
  CRISPR gRNA sequence
ttaccaaacaagtatccaat

SEQ ID NO: 547961 - DNA, 20 bp, Artificial
  CRISPR gRNA sequence
caacttcttcaatccactga

SEQ ID NO: 547962 - DNA, 20 bp, Artificial
  CRISPR gRNA sequence
ttcaatccactgaaagcatc

SEQ ID NO: 547963 - DNA, 20 bp, Artificial
  CRISPR gRNA sequence
tcaatccactgaaagcatct

SEQ ID NO: 547964 - DNA, 20 bp, Artificial
  CRISPR gRNA sequence
caatccactgaaagcatctg

SEQ ID NO: 547965 - DNA, 20 bp, Artificial
  CRISPR gRNA sequence
ccactgaaagcatctgggga

SEQ ID NO: 547966 - DNA, 20 bp, Artificial
  CRISPR gRNA sequence
actgaaagcatctggggacg

SEQ ID NO: 547967 - DNA, 20 bp, Artificial
  CRISPR gRNA sequence
atctggggacggagaatcac

SEQ ID NO: 547968 - DNA, 20 bp, Artificial
  CRISPR gRNA sequence
ggacggagaatcactggata

SEQ ID NO: 547969 - DNA, 20 bp, Artificial
  CRISPR gRNA sequence
taaagattctgaattcgtat

SEQ ID NO: 547970 - DNA, 20 bp, Artificial
  CRISPR gRNA sequence
ttagcctctgattttgaaat

SEQ ID NO: 547971 - DNA, 20 bp, Artificial
  CRISPR gRNA sequence
aaattggacactttttccgt

SEQ ID NO: 547972 - DNA, 20 bp, Artificial
  CRISPR gRNA sequence
ttggacactttttccgtgag

SEQ ID NO: 547973 - DNA, 20 bp, Artificial
  CRISPR gRNA sequence
ctttttccgtgagcggacca

SEQ ID NO: 547974 - DNA, 20 bp, Artificial
  CRISPR gRNA sequence
tttttccgtgagcggaccac

SEQ ID NO: 547975 - DNA, 20 bp, Artificial
  CRISPR gRNA sequence
caggctgtgctgtacttcgc

SEQ ID NO: 547976 - DNA, 20 bp, Artificial
  CRISPR gRNA sequence
aggctgtgctgtacttcgct

SEQ ID NO: 547977 - DNA, 20 bp, Artificial
  CRISPR gRNA sequence
ggctgtgctgtacttcgctg

SEQ ID NO: 547978 - DNA, 20 bp, Artificial
  CRISPR gRNA sequence
ctgtgctgtacttcgctggg

SEQ ID NO: 547979 - DNA, 20 bp, Artificial
  CRISPR gRNA sequence
tgtgctgtacttcgctgggg

SEQ ID NO: 547980 - DNA, 20 bp, Artificial
  CRISPR gRNA sequence
acttcgctggggaggcctta

SEQ ID NO: 547981 - DNA, 20 bp, Artificial
  CRISPR gRNA sequence
cttcgctggggaggccttaa

SEQ ID NO: 547982 - DNA, 20 bp, Artificial
  CRISPR gRNA sequence
ggatgatgacaattttgacg

SEQ ID NO: 547983 - DNA, 20 bp, Artificial
  CRISPR gRNA sequence
gatgatgacaattttgacga

SEQ ID NO: 547984 - DNA, 20 bp, Artificial
  CRISPR gRNA sequence
tgacaattttgacgaaggtg

SEQ ID NO: 547985 - DNA, 20 bp, Artificial
  CRISPR gRNA sequence
caattttgacgaaggtgaag

SEQ ID NO: 547986 - DNA, 20 bp, Artificial
  CRISPR gRNA sequence
ttttgacgaaggtgaagaag

SEQ ID NO: 547987 - DNA, 20 bp, Artificial
  CRISPR gRNA sequence
ttgacgaaggtgaagaagaa

SEQ ID NO: 547988 - DNA, 20 bp, Artificial
  CRISPR gRNA sequence
tgacgaaggtgaagaagaag

SEQ ID NO: 547989 - DNA, 20 bp, Artificial
  CRISPR gRNA sequence
tgaagaagaagaggacgaat

SEQ ID NO: 547990 - DNA, 20 bp, Artificial
  CRISPR gRNA sequence
agaagaagaggacgaattag

SEQ ID NO: 547991 - DNA, 20 bp, Artificial
  CRISPR gRNA sequence
gaagaagaggacgaattaga

SEQ ID NO: 547992 - DNA, 20 bp, Artificial
  CRISPR gRNA sequence
aggacgaattagaaggtgat

SEQ ID NO: 547993 - DNA, 20 bp, Artificial
  CRISPR gRNA sequence
ggacgaattagaaggtgatg

SEQ ID NO: 547994 - DNA, 20 bp, Artificial
  CRISPR gRNA sequence
acgaattagaaggtgatgag

SEQ ID NO: 547995 - DNA, 20 bp, Artificial
  CRISPR gRNA sequence
cgaattagaaggtgatgagg

SEQ ID NO: 547996 - DNA, 20 bp, Artificial
  CRISPR gRNA sequence
gaattagaaggtgatgagga

SEQ ID NO: 547997 - DNA, 20 bp, Artificial
  CRISPR gRNA sequence
attagaaggtgatgaggagg

SEQ ID NO: 547998 - DNA, 20 bp, Artificial
  CRISPR gRNA sequence
agaaggtgatgaggagggag

SEQ ID NO: 547999 - DNA, 20 bp, Artificial
  CRISPR gRNA sequence
gtgatgaggagggagaagat

SEQ ID NO: 548000 - DNA, 20 bp, Artificial
  CRISPR gRNA sequence
tgatgaggagggagaagatg

SEQ ID NO: 548001 - DNA, 20 bp, Artificial
  CRISPR gRNA sequence
aggagggagaagatgaggat

SEQ ID NO: 548002 - DNA, 20 bp, Artificial
  CRISPR gRNA sequence
ggagggagaagatgaggatg

SEQ ID NO: 548003 - DNA, 20 bp, Artificial
  CRISPR gRNA sequence
gggagaagatgaggatgagg

SEQ ID NO: 548004 - DNA, 20 bp, Artificial
  CRISPR gRNA sequence
aggtggaaattaatcccaac

SEQ ID NO: 548005 - DNA, 20 bp, Artificial
  CRISPR gRNA sequence
ggtggaaattaatcccaaca

SEQ ID NO: 548006 - DNA, 20 bp, Artificial
  CRISPR gRNA sequence
attaatcccaacaaggaacc

SEQ ID NO: 548007 - DNA, 20 bp, Artificial
  CRISPR gRNA sequence
atcccaacaaggaacccagc

SEQ ID NO: 548008 - DNA, 20 bp, Artificial
  CRISPR gRNA sequence
caacaaggaacccagccagc

SEQ ID NO: 548009 - DNA, 20 bp, Artificial
  CRISPR gRNA sequence
caaggaacccagccagccgg

SEQ ID NO: 548010 - DNA, 20 bp, Artificial
  CRISPR gRNA sequence
ccagccagccggcggaatgc

SEQ ID NO: 548011 - DNA, 20 bp, Artificial
  CRISPR gRNA sequence
gccagccggcggaatgcaag

SEQ ID NO: 548012 - DNA, 20 bp, Artificial
  CRISPR gRNA sequence
agccggcggaatgcaagcag

SEQ ID NO: 548013 - DNA, 20 bp, Artificial
  CRISPR gRNA sequence
cggcggaatgcaagcagcag

SEQ ID NO: 548014 - DNA, 20 bp, Artificial
  CRISPR gRNA sequence
ggcggaatgcaagcagcagt

SEQ ID NO: 548015 - DNA, 20 bp, Artificial
  CRISPR gRNA sequence
ggaatgcaagcagcagtagg

SEQ ID NO: 548016 - DNA, 20 bp, Artificial
  CRISPR gRNA sequence
atgcaagcagcagtaggaag

SEQ ID NO: 548017 - DNA, 20 bp, Artificial
  CRISPR gRNA sequence
gcaagcagcagtaggaagtg

SEQ ID NO: 548018 - DNA, 20 bp, Artificial
  CRISPR gRNA sequence
caagcagcagtaggaagtgg

SEQ ID NO: 548019 - DNA, 20 bp, Artificial
  CRISPR gRNA sequence
gcagcagtaggaagtggagg

SEQ ID NO: 548020 - DNA, 20 bp, Artificial
  CRISPR gRNA sequence
cagcagtaggaagtggaggt

SEQ ID NO: 548021 - DNA, 20 bp, Artificial
  CRISPR gRNA sequence
aggaagtggaggtgggcgcc

SEQ ID NO: 548022 - DNA, 20 bp, Artificial
  CRISPR gRNA sequence
aagtggaggtgggcgcctgg

SEQ ID NO: 548023 - DNA, 20 bp, Artificial
  CRISPR gRNA sequence
gaggtgggcgcctggcagac

SEQ ID NO: 548024 - DNA, 20 bp, Artificial
  CRISPR gRNA sequence
cagaccggctgtcgcgactc

SEQ ID NO: 548025 - DNA, 20 bp, Artificial
  CRISPR gRNA sequence
agaccggctgtcgcgactcc

SEQ ID NO: 548026 - DNA, 20 bp, Artificial
  CRISPR gRNA sequence
ctgtcgcgactccgggcctg

SEQ ID NO: 548027 - DNA, 20 bp, Artificial
  CRISPR gRNA sequence
tcgcgactccgggcctgtag

SEQ ID NO: 548028 - DNA, 20 bp, Artificial
  CRISPR gRNA sequence
cgcgactccgggcctgtagc

SEQ ID NO: 548029 - DNA, 20 bp, Artificial
  CRISPR gRNA sequence
cgactccgggcctgtagcgg

SEQ ID NO: 548030 - DNA, 20 bp, Artificial
  CRISPR gRNA sequence
gactccgggcctgtagcggg

SEQ ID NO: 548031 - DNA, 20 bp, Artificial
  CRISPR gRNA sequence
gggcctgtagcgggaggcct

SEQ ID NO: 548032 - DNA, 20 bp, Artificial
  CRISPR gRNA sequence
gcctcagtctttgccgcatg

SEQ ID NO: 548033 - DNA, 20 bp, Artificial
  CRISPR gRNA sequence
atgcggcacaatcccgtcga

SEQ ID NO: 548034 - DNA, 20 bp, Artificial
  CRISPR gRNA sequence
tactccatctaatcgttttc

SEQ ID NO: 548035 - DNA, 20 bp, Artificial
  CRISPR gRNA sequence
attattttgcttaatgtgta

SEQ ID NO: 548036 - DNA, 20 bp, Artificial
  CRISPR gRNA sequence
attttgcttaatgtgtacag

SEQ ID NO: 548037 - DNA, 20 bp, Artificial
  CRISPR gRNA sequence
gtggcaactgaaatgcattt

SEQ ID NO: 548038 - DNA, 20 bp, Artificial
  CRISPR gRNA sequence
actgaaatgcatttcagaaa

SEQ ID NO: 548039 - DNA, 20 bp, Artificial
  CRISPR gRNA sequence
ctgaaatgcatttcagaaat

SEQ ID NO: 548040 - DNA, 20 bp, Artificial
  CRISPR gRNA sequence
gaaatgcatttcagaaatag

SEQ ID NO: 548041 - DNA, 20 bp, Artificial
  CRISPR gRNA sequence
aaatgcatttcagaaatagg

SEQ ID NO: 548042 - DNA, 20 bp, Artificial
  CRISPR gRNA sequence
gttttgtccaataccctctg

SEQ ID NO: 548043 - DNA, 20 bp, Artificial
  CRISPR gRNA sequence
tccaataccctctgcagcct

SEQ ID NO: 548044 - DNA, 20 bp, Artificial
  CRISPR gRNA sequence
ctctgcagccttggtgcctg

SEQ ID NO: 548045 - DNA, 20 bp, Artificial
  CRISPR gRNA sequence
agccttggtgcctgtagctc

SEQ ID NO: 548046 - DNA, 20 bp, Artificial
  CRISPR gRNA sequence
cctgtagctctggacttgcc

SEQ ID NO: 548047 - DNA, 20 bp, Artificial
  CRISPR gRNA sequence
cttgcctggacccttccctg

SEQ ID NO: 548048 - DNA, 20 bp, Artificial
  CRISPR gRNA sequence
ttgcctggacccttccctgc

SEQ ID NO: 548049 - DNA, 20 bp, Artificial
  CRISPR gRNA sequence
gcctggacccttccctgcgg

SEQ ID NO: 548050 - DNA, 20 bp, Artificial
  CRISPR gRNA sequence
cctggacccttccctgcggg

SEQ ID NO: 548051 - DNA, 20 bp, Artificial
  CRISPR gRNA sequence
ctggacccttccctgcggga

SEQ ID NO: 548052 - DNA, 20 bp, Artificial
  CRISPR gRNA sequence
ttccctgcgggagggcccca

SEQ ID NO: 548053 - DNA, 20 bp, Artificial
  CRISPR gRNA sequence
gagggccccatagaccccat

SEQ ID NO: 548054 - DNA, 20 bp, Artificial
  CRISPR gRNA sequence
agggccccatagaccccatt

SEQ ID NO: 548055 - DNA, 20 bp, Artificial
  CRISPR gRNA sequence
gggccccatagaccccattg

SEQ ID NO: 548056 - DNA, 20 bp, Artificial
  CRISPR gRNA sequence
ccccatagaccccattgggg

SEQ ID NO: 548057 - DNA, 20 bp, Artificial
  CRISPR gRNA sequence
cccatagaccccattggggt

SEQ ID NO: 548058 - DNA, 20 bp, Artificial
  CRISPR gRNA sequence
ccatagaccccattggggtg

SEQ ID NO: 548059 - DNA, 20 bp, Artificial
  CRISPR gRNA sequence
tagaccccattggggtgggg

SEQ ID NO: 548060 - DNA, 20 bp, Artificial
  CRISPR gRNA sequence
agaccccattggggtggggt

SEQ ID NO: 548061 - DNA, 20 bp, Artificial
  CRISPR gRNA sequence
cccattggggtggggtggga

SEQ ID NO: 548062 - DNA, 20 bp, Artificial
  CRISPR gRNA sequence
ccattggggtggggtgggat

SEQ ID NO: 548063 - DNA, 20 bp, Artificial
  CRISPR gRNA sequence
cattggggtggggtgggatg

SEQ ID NO: 548064 - DNA, 20 bp, Artificial
  CRISPR gRNA sequence
tggggtggggtgggatgggg

SEQ ID NO: 548065 - DNA, 20 bp, Artificial
  CRISPR gRNA sequence
ggggtggggtgggatggggt

SEQ ID NO: 548066 - DNA, 20 bp, Artificial
  CRISPR gRNA sequence
gggtggggtgggatggggtg

SEQ ID NO: 548067 - DNA, 20 bp, Artificial
  CRISPR gRNA sequence
gggatggggtggggatcact

SEQ ID NO: 548068 - DNA, 20 bp, Artificial
  CRISPR gRNA sequence
ggtggggatcacttggctaa

SEQ ID NO: 548069 - DNA, 20 bp, Artificial
  CRISPR gRNA sequence
gtggggatcacttggctaaa

SEQ ID NO: 548070 - DNA, 20 bp, Artificial
  CRISPR gRNA sequence
tggggatcacttggctaaaa

SEQ ID NO: 548071 - DNA, 20 bp, Artificial
  CRISPR gRNA sequence
atcacttggctaaaagggcc

SEQ ID NO: 548072 - DNA, 20 bp, Artificial
  CRISPR gRNA sequence
tcacttggctaaaagggccg

SEQ ID NO: 548073 - DNA, 20 bp, Artificial
  CRISPR gRNA sequence
tggctaaaagggccgaggtc

SEQ ID NO: 548074 - DNA, 20 bp, Artificial
  CRISPR gRNA sequence
aagggccgaggtctggtgat

SEQ ID NO: 548075 - DNA, 20 bp, Artificial
  CRISPR gRNA sequence
agggccgaggtctggtgatg

SEQ ID NO: 548076 - DNA, 20 bp, Artificial
  CRISPR gRNA sequence
gaggtctggtgatgaggttc

SEQ ID NO: 548077 - DNA, 20 bp, Artificial
  CRISPR gRNA sequence
aggtctggtgatgaggttcc

SEQ ID NO: 548078 - DNA, 20 bp, Artificial
  CRISPR gRNA sequence
ggtctggtgatgaggttcca

SEQ ID NO: 548079 - DNA, 20 bp, Artificial
  CRISPR gRNA sequence
gtgatgaggttccagggatc

SEQ ID NO: 548080 - DNA, 20 bp, Artificial
  CRISPR gRNA sequence
aacctctcctaccactcctg

SEQ ID NO: 548081 - DNA, 20 bp, Artificial
  CRISPR gRNA sequence
tctcctaccactcctgcagt

SEQ ID NO: 548082 - DNA, 20 bp, Artificial
  CRISPR gRNA sequence
gaattctttcctttcatttg

SEQ ID NO: 548083 - DNA, 20 bp, Artificial
  CRISPR gRNA sequence
agaaacccactcgctgtttt

SEQ ID NO: 548084 - DNA, 20 bp, Artificial
  CRISPR gRNA sequence
tttcagctgcttaatctgct

SEQ ID NO: 548085 - DNA, 20 bp, Artificial
  CRISPR gRNA sequence
tgcttaatctgctgagtgtg

SEQ ID NO: 548086 - DNA, 20 bp, Artificial
  CRISPR gRNA sequence
ctgctgtatgctaatcatct

SEQ ID NO: 548087 - DNA, 20 bp, Artificial
  CRISPR gRNA sequence
ctgtatgctaatcatctcag

SEQ ID NO: 548088 - DNA, 20 bp, Artificial
  CRISPR gRNA sequence
tgtatgctaatcatctcaga

SEQ ID NO: 548089 - DNA, 20 bp, Artificial
  CRISPR gRNA sequence
gtatgctaatcatctcagaa

SEQ ID NO: 548090 - DNA, 20 bp, Artificial
  CRISPR gRNA sequence
atcatctcagaagggccgtg

SEQ ID NO: 548091 - DNA, 20 bp, Artificial
  CRISPR gRNA sequence
catctcagaagggccgtgta

SEQ ID NO: 548092 - DNA, 20 bp, Artificial
  CRISPR gRNA sequence
ctcagaagggccgtgtagag

SEQ ID NO: 548093 - DNA, 20 bp, Artificial
  CRISPR gRNA sequence
tcagaagggccgtgtagagt

SEQ ID NO: 548094 - DNA, 20 bp, Artificial
  CRISPR gRNA sequence
cagaagggccgtgtagagta

SEQ ID NO: 548095 - DNA, 20 bp, Artificial
  CRISPR gRNA sequence
gagtagggccgtattctcct

SEQ ID NO: 548096 - DNA, 20 bp, Artificial
  CRISPR gRNA sequence
agtagggccgtattctcctt

SEQ ID NO: 548097 - DNA, 20 bp, Artificial
  CRISPR gRNA sequence
gctttttgatcttctttttt

SEQ ID NO: 548098 - DNA, 20 bp, Artificial
  CRISPR gRNA sequence
ctttttgatcttctttttta

SEQ ID NO: 548099 - DNA, 20 bp, Artificial
  CRISPR gRNA sequence
tttttgatcttcttttttaa

SEQ ID NO: 548100 - DNA, 20 bp, Artificial
  CRISPR gRNA sequence
tgatcttcttttttaagggt

SEQ ID NO: 548101 - DNA, 20 bp, Artificial
  CRISPR gRNA sequence
gatcttcttttttaagggtt

SEQ ID NO: 548102 - DNA, 20 bp, Artificial
  CRISPR gRNA sequence
ttcttttttaagggttgggt

SEQ ID NO: 548103 - DNA, 20 bp, Artificial
  CRISPR gRNA sequence
tcttttttaagggttgggtc

SEQ ID NO: 548104 - DNA, 20 bp, Artificial
  CRISPR gRNA sequence
cttttttaagggttgggtca

SEQ ID NO: 548105 - DNA, 20 bp, Artificial
  CRISPR gRNA sequence
taagggttgggtcagggttg

SEQ ID NO: 548106 - DNA, 20 bp, Artificial
  CRISPR gRNA sequence
gggtcagggttgtggcacac

SEQ ID NO: 548107 - DNA, 20 bp, Artificial
  CRISPR gRNA sequence
agggttgtggcacaccagct

SEQ ID NO: 548108 - DNA, 20 bp, Artificial
  CRISPR gRNA sequence
gggttgtggcacaccagctc

SEQ ID NO: 548109 - DNA, 20 bp, Artificial
  CRISPR gRNA sequence
tgtggcacaccagctcaggc

SEQ ID NO: 548110 - DNA, 20 bp, Artificial
  CRISPR gRNA sequence
tggcacaccagctcaggcga

SEQ ID NO: 548111 - DNA, 20 bp, Artificial
  CRISPR gRNA sequence
agctcaggcgagagctgcca

SEQ ID NO: 548112 - DNA, 20 bp, Artificial
  CRISPR gRNA sequence
gctcaggcgagagctgccac

SEQ ID NO: 548113 - DNA, 20 bp, Artificial
  CRISPR gRNA sequence
atttatcccttcttgcctgt

SEQ ID NO: 548114 - DNA, 20 bp, Artificial
  CRISPR gRNA sequence
tttatcccttcttgcctgtg

SEQ ID NO: 548115 - DNA, 20 bp, Artificial
  CRISPR gRNA sequence
cttcttgcctgtgaggactg

SEQ ID NO: 548116 - DNA, 20 bp, Artificial
  CRISPR gRNA sequence
ttgccatttctgaaccaccc

SEQ ID NO: 548117 - DNA, 20 bp, Artificial
  CRISPR gRNA sequence
ctgaaccaccctggtgacct

SEQ ID NO: 548118 - DNA, 20 bp, Artificial
  CRISPR gRNA sequence
aaccaccctggtgacctgag

SEQ ID NO: 548119 - DNA, 20 bp, Artificial
  CRISPR gRNA sequence
accaccctggtgacctgagc

SEQ ID NO: 548120 - DNA, 20 bp, Artificial
  CRISPR gRNA sequence
accctggtgacctgagcagg

SEQ ID NO: 548121 - DNA, 20 bp, Artificial
  CRISPR gRNA sequence
caggaagatgtgccacttcc

SEQ ID NO: 548122 - DNA, 20 bp, Artificial
  CRISPR gRNA sequence
gaagatgtgccacttcctag

SEQ ID NO: 548123 - DNA, 20 bp, Artificial
  CRISPR gRNA sequence
aagatgtgccacttcctagc

SEQ ID NO: 548124 - DNA, 20 bp, Artificial
  CRISPR gRNA sequence
gatgtgccacttcctagcag

SEQ ID NO: 548125 - DNA, 20 bp, Artificial
  CRISPR gRNA sequence
tgccacttcctagcaggagc

SEQ ID NO: 548126 - DNA, 20 bp, Artificial
  CRISPR gRNA sequence
gccacttcctagcaggagca

SEQ ID NO: 548127 - DNA, 20 bp, Artificial
  CRISPR gRNA sequence
ccacttcctagcaggagcaa

SEQ ID NO: 548128 - DNA, 20 bp, Artificial
  CRISPR gRNA sequence
tagcaggagcaagggctgtg

SEQ ID NO: 548129 - DNA, 20 bp, Artificial
  CRISPR gRNA sequence
caggagcaagggctgtgcgg

SEQ ID NO: 548130 - DNA, 20 bp, Artificial
  CRISPR gRNA sequence
gaaacactgcttcctgccac

SEQ ID NO: 548131 - DNA, 20 bp, Artificial
  CRISPR gRNA sequence
aaacactgcttcctgccacc

SEQ ID NO: 548132 - DNA, 20 bp, Artificial
  CRISPR gRNA sequence
aacactgcttcctgccacca

SEQ ID NO: 548133 - DNA, 20 bp, Artificial
  CRISPR gRNA sequence
gcttcctgccaccagggctg

SEQ ID NO: 548134 - DNA, 20 bp, Artificial
  CRISPR gRNA sequence
gccaccagggctgaagacgc

SEQ ID NO: 548135 - DNA, 20 bp, Artificial
  CRISPR gRNA sequence
gcgagcctgtcctcgtgaca

SEQ ID NO: 548136 - DNA, 20 bp, Artificial
  CRISPR gRNA sequence
cgagcctgtcctcgtgacac

SEQ ID NO: 548137 - DNA, 20 bp, Artificial
  CRISPR gRNA sequence
cacaggcaccgccctgctgc

SEQ ID NO: 548138 - DNA, 20 bp, Artificial
  CRISPR gRNA sequence
caggcaccgccctgctgccg

SEQ ID NO: 548139 - DNA, 20 bp, Artificial
  CRISPR gRNA sequence
caccgccctgctgccggagt

SEQ ID NO: 548140 - DNA, 20 bp, Artificial
  CRISPR gRNA sequence
accgccctgctgccggagtt

SEQ ID NO: 548141 - DNA, 20 bp, Artificial
  CRISPR gRNA sequence
ctgctgccggagttgggatt

SEQ ID NO: 548142 - DNA, 20 bp, Artificial
  CRISPR gRNA sequence
ctgccggagttgggattcgg

SEQ ID NO: 548143 - DNA, 20 bp, Artificial
  CRISPR gRNA sequence
tgggattcggcagtgttctc

SEQ ID NO: 548144 - DNA, 20 bp, Artificial
  CRISPR gRNA sequence
attcggcagtgttctccagt

SEQ ID NO: 548145 - DNA, 20 bp, Artificial
  CRISPR gRNA sequence
ttcggcagtgttctccagtg

SEQ ID NO: 548146 - DNA, 20 bp, Artificial
  CRISPR gRNA sequence
tcggcagtgttctccagtga

SEQ ID NO: 548147 - DNA, 20 bp, Artificial
  CRISPR gRNA sequence
cggcagtgttctccagtgag

SEQ ID NO: 548148 - DNA, 20 bp, Artificial
  CRISPR gRNA sequence
agtgttctccagtgaggggc

SEQ ID NO: 548149 - DNA, 20 bp, Artificial
  CRISPR gRNA sequence
gtgttctccagtgaggggct

SEQ ID NO: 548150 - DNA, 20 bp, Artificial
  CRISPR gRNA sequence
tctccagtgaggggctgggc

SEQ ID NO: 548151 - DNA, 20 bp, Artificial
  CRISPR gRNA sequence
ctccagtgaggggctgggct

SEQ ID NO: 548152 - DNA, 20 bp, Artificial
  CRISPR gRNA sequence
cagtgaggggctgggctggg

SEQ ID NO: 548153 - DNA, 20 bp, Artificial
  CRISPR gRNA sequence
ggaagtcctgcgtttcattt

SEQ ID NO: 548154 - DNA, 20 bp, Artificial
  CRISPR gRNA sequence
tgcgtttcatttgagcatat

SEQ ID NO: 548155 - DNA, 20 bp, Artificial
  CRISPR gRNA sequence
catttgagcatatgagcgtc

SEQ ID NO: 548156 - DNA, 20 bp, Artificial
  CRISPR gRNA sequence
agcgtcaagtcctgctttct

SEQ ID NO: 548157 - DNA, 20 bp, Artificial
  CRISPR gRNA sequence
gtcaagtcctgctttctcag

SEQ ID NO: 548158 - DNA, 20 bp, Artificial
  CRISPR gRNA sequence
tttctcagtagtcccattgc

SEQ ID NO: 548159 - DNA, 20 bp, Artificial
  CRISPR gRNA sequence
ttctcagtagtcccattgct

SEQ ID NO: 548160 - DNA, 20 bp, Artificial
  CRISPR gRNA sequence
cccaccattcatcctgtctg

SEQ ID NO: 548161 - DNA, 20 bp, Artificial
  CRISPR gRNA sequence
ccaccattcatcctgtctga

SEQ ID NO: 548162 - DNA, 20 bp, Artificial
  CRISPR gRNA sequence
ttcatcctgtctgaaggtcc

SEQ ID NO: 548163 - DNA, 20 bp, Artificial
  CRISPR gRNA sequence
tcctgtctgaaggtcctggt

SEQ ID NO: 548164 - DNA, 20 bp, Artificial
  CRISPR gRNA sequence
aaggtcctggttggtgtgac

SEQ ID NO: 548165 - DNA, 20 bp, Artificial
  CRISPR gRNA sequence
tcctggttggtgtgaccggt

SEQ ID NO: 548166 - DNA, 20 bp, Artificial
  CRISPR gRNA sequence
tggttggtgtgaccggttgg

SEQ ID NO: 548167 - DNA, 20 bp, Artificial
  CRISPR gRNA sequence
tggtgtgaccggttggtggc

SEQ ID NO: 548168 - DNA, 20 bp, Artificial
  CRISPR gRNA sequence
gtgaccggttggtggctggt

SEQ ID NO: 548169 - DNA, 20 bp, Artificial
  CRISPR gRNA sequence
accggttggtggctggtgag

SEQ ID NO: 548170 - DNA, 20 bp, Artificial
  CRISPR gRNA sequence
ccggttggtggctggtgagt

SEQ ID NO: 548171 - DNA, 20 bp, Artificial
  CRISPR gRNA sequence
cggttggtggctggtgagtg

SEQ ID NO: 548172 - DNA, 20 bp, Artificial
  CRISPR gRNA sequence
ggctggtgagtggggtttcc

SEQ ID NO: 548173 - DNA, 20 bp, Artificial
  CRISPR gRNA sequence
tggtgagtggggtttccaag

SEQ ID NO: 548174 - DNA, 20 bp, Artificial
  CRISPR gRNA sequence
ggtgagtggggtttccaagt

SEQ ID NO: 548175 - DNA, 20 bp, Artificial
  CRISPR gRNA sequence
tggggtttccaagtgggtga

SEQ ID NO: 548176 - DNA, 20 bp, Artificial
  CRISPR gRNA sequence
aagtgggtgacagcgctctg

SEQ ID NO: 548177 - DNA, 20 bp, Artificial
  CRISPR gRNA sequence
tgggtgacagcgctctgtgg

SEQ ID NO: 548178 - DNA, 20 bp, Artificial
  CRISPR gRNA sequence
tgacagcgctctgtggcagc

SEQ ID NO: 548179 - DNA, 20 bp, Artificial
  CRISPR gRNA sequence
gacagcgctctgtggcagcc

SEQ ID NO: 548180 - DNA, 20 bp, Artificial
  CRISPR gRNA sequence
acagcgctctgtggcagccg

SEQ ID NO: 548181 - DNA, 20 bp, Artificial
  CRISPR gRNA sequence
cgctctgtggcagccgggga

SEQ ID NO: 548182 - DNA, 20 bp, Artificial
  CRISPR gRNA sequence
atggccttgtccgcgctgac

SEQ ID NO: 548183 - DNA, 20 bp, Artificial
  CRISPR gRNA sequence
tggccttgtccgcgctgacc

SEQ ID NO: 548184 - DNA, 20 bp, Artificial
  CRISPR gRNA sequence
gtccgcgctgaccaggcctg

SEQ ID NO: 548185 - DNA, 20 bp, Artificial
  CRISPR gRNA sequence
ccgcgctgaccaggcctgta

SEQ ID NO: 548186 - DNA, 20 bp, Artificial
  CRISPR gRNA sequence
gcgctgaccaggcctgtaga

SEQ ID NO: 548187 - DNA, 20 bp, Artificial
  CRISPR gRNA sequence
ccaggcctgtagagagtgct

SEQ ID NO: 548188 - DNA, 20 bp, Artificial
  CRISPR gRNA sequence
gagagtgctcagcctaacct

SEQ ID NO: 548189 - DNA, 20 bp, Artificial
  CRISPR gRNA sequence
aacacatttataactgaata

SEQ ID NO: 548190 - DNA, 20 bp, Artificial
  CRISPR gRNA sequence
tgttttcaatttgtacataa

SEQ ID NO: 548191 - DNA, 20 bp, Artificial
  CRISPR gRNA sequence
ttcaatttgtacataatagt

SEQ ID NO: 548192 - DNA, 20 bp, Artificial
  CRISPR gRNA sequence
atagttagaatattctatta

SEQ ID NO: 548193 - DNA, 20 bp, Artificial
  CRISPR gRNA sequence
tctattaaagttatgaaaca

SEQ ID NO: 548194 - DNA, 20 bp, Artificial
  CRISPR gRNA sequence
tattaaagttatgaaacacg

SEQ ID NO: 548195 - DNA, 20 bp, Artificial
  CRISPR gRNA sequence
tatgaaacacggagaaaaaa

SEQ ID NO: 548196 - DNA, 20 bp, Artificial
  CRISPR gRNA sequence
acacggagaaaaaaaagaaa

SEQ ID NO: 548197 - DNA, 20 bp, Artificial
  CRISPR gRNA sequence
aaaaaagaaaaagtgcaaat

SEQ ID NO: 548198 - DNA, 20 bp, Artificial
  CRISPR gRNA sequence
gagtcccaatttataactga

SEQ ID NO: 548199 - DNA, 20 bp, Artificial
  CRISPR gRNA sequence
actgatagatttgatttttg

SEQ ID NO: 548200 - DNA, 20 bp, Artificial
  CRISPR gRNA sequence
atagatttgatttttgaaga

SEQ ID NO: 548201 - DNA, 20 bp, Artificial
  CRISPR gRNA sequence
agatttgatttttgaagaca

SEQ ID NO: 548202 - DNA, 20 bp, Artificial
  CRISPR gRNA sequence
tgatttttgaagacagagaa

SEQ ID NO: 548203 - DNA, 20 bp, Artificial
  CRISPR gRNA sequence
cagagaaaagatcaaaccca

SEQ ID NO: 548204 - DNA, 20 bp, Artificial
  CRISPR gRNA sequence
gagaaaagatcaaacccaca

SEQ ID NO: 548205 - DNA, 20 bp, Artificial
  CRISPR gRNA sequence
agaaaagatcaaacccacag

SEQ ID NO: 548206 - DNA, 20 bp, Artificial
  CRISPR gRNA sequence
acccacagaggtgtcactca

SEQ ID NO: 548207 - DNA, 20 bp, Artificial
  CRISPR gRNA sequence
cccacagaggtgtcactcaa

SEQ ID NO: 548208 - DNA, 20 bp, Artificial
  CRISPR gRNA sequence
cacagaggtgtcactcaaag

SEQ ID NO: 548209 - DNA, 20 bp, Artificial
  CRISPR gRNA sequence
caaaggagcactgtttgtac

SEQ ID NO: 548210 - DNA, 20 bp, Artificial
  CRISPR gRNA sequence
tgtacaagtcacacaattgc

SEQ ID NO: 548211 - DNA, 20 bp, Artificial
  CRISPR gRNA sequence
acaagtcacacaattgcaag

SEQ ID NO: 548212 - DNA, 20 bp, Artificial
  CRISPR gRNA sequence
ttgcaagaagtttttaaaac

SEQ ID NO: 548213 - DNA, 20 bp, Artificial
  CRISPR gRNA sequence
agtttttaaaacgagctgca

SEQ ID NO: 548214 - DNA, 20 bp, Artificial
  CRISPR gRNA sequence
aacgagctgcaaagttaaaa

SEQ ID NO: 548215 - DNA, 20 bp, Artificial
  CRISPR gRNA sequence
gctgcaaagttaaaatagtt

SEQ ID NO: 548216 - DNA, 20 bp, Artificial
  CRISPR gRNA sequence
aaagttaaaatagttaagct

SEQ ID NO: 548217 - DNA, 20 bp, Artificial
  CRISPR gRNA sequence
agttaaaatagttaagcttg

SEQ ID NO: 548218 - DNA, 20 bp, Artificial
  CRISPR gRNA sequence
ctttattaattccacctttt

SEQ ID NO: 548219 - DNA, 20 bp, Artificial
  CRISPR gRNA sequence
ttgagtgttacataataccc

SEQ ID NO: 548220 - DNA, 20 bp, Artificial
  CRISPR gRNA sequence
tgagtgttacataataccca

SEQ ID NO: 548221 - DNA, 20 bp, Artificial
  CRISPR gRNA sequence
aatacccaaggcatacgata

SEQ ID NO: 548222 - DNA, 20 bp, Artificial
  CRISPR gRNA sequence
ggaaatgcaatttgttgtaa

SEQ ID NO: 548223 - DNA, 20 bp, Artificial
  CRISPR gRNA sequence
aatgcaatttgttgtaaaag

SEQ ID NO: 548224 - DNA, 20 bp, Artificial
  CRISPR gRNA sequence
caatttgttgtaaaagcaga

SEQ ID NO: 548225 - DNA, 20 bp, Artificial
  CRISPR gRNA sequence
agcagatagttgctttataa

SEQ ID NO: 548226 - DNA, 20 bp, Artificial
  CRISPR gRNA sequence
gcagatagttgctttataat

SEQ ID NO: 548227 - DNA, 20 bp, Artificial
  CRISPR gRNA sequence
ggaacaacaaaaaataaaac

SEQ ID NO: 548228 - DNA, 20 bp, Artificial
  CRISPR gRNA sequence
accagtgtgcttttgccttt

SEQ ID NO: 548229 - DNA, 20 bp, Artificial
  CRISPR gRNA sequence
gtgtgctgcatctaactgac

SEQ ID NO: 548230 - DNA, 20 bp, Artificial
  CRISPR gRNA sequence
tgtgctgcatctaactgaca

SEQ ID NO: 548231 - DNA, 20 bp, Artificial
  CRISPR gRNA sequence
gtgctgcatctaactgacaa

SEQ ID NO: 548232 - DNA, 20 bp, Artificial
  CRISPR gRNA sequence
tgctgcatctaactgacaag

SEQ ID NO: 548233 - DNA, 20 bp, Artificial
  CRISPR gRNA sequence
gctgcatctaactgacaagg

SEQ ID NO: 548234 - DNA, 20 bp, Artificial
  CRISPR gRNA sequence
gcatctaactgacaaggggg

SEQ ID NO: 548235 - DNA, 20 bp, Artificial
  CRISPR gRNA sequence
tctaactgacaagggggaag

SEQ ID NO: 548236 - DNA, 20 bp, Artificial
  CRISPR gRNA sequence
gggaagaagatgaccacata

SEQ ID NO: 548237 - DNA, 20 bp, Artificial
  CRISPR gRNA sequence
agaagatgaccacatataga

SEQ ID NO: 548238 - DNA, 20 bp, Artificial
  CRISPR gRNA sequence
aagatgaccacatatagaca

SEQ ID NO: 548239 - DNA, 20 bp, Artificial
  CRISPR gRNA sequence
tgaccacatatagacagagc

SEQ ID NO: 548240 - DNA, 20 bp, Artificial
  CRISPR gRNA sequence
cacatatagacagagcaagc

SEQ ID NO: 548241 - DNA, 20 bp, Artificial
  CRISPR gRNA sequence
aagcaagttgaaatcttgaa

SEQ ID NO: 548242 - DNA, 20 bp, Artificial
  CRISPR gRNA sequence
ttgaaatcttgaaaagtttt

SEQ ID NO: 548243 - DNA, 20 bp, Artificial
  CRISPR gRNA sequence
tgaaaagttttaagtgttcc

SEQ ID NO: 548244 - DNA, 20 bp, Artificial
  CRISPR gRNA sequence
aaaagttttaagtgttccaa

SEQ ID NO: 548245 - DNA, 20 bp, Artificial
  CRISPR gRNA sequence
tccaagagacaaaatacttg

SEQ ID NO: 548246 - DNA, 20 bp, Artificial
  CRISPR gRNA sequence
ccaagagacaaaatacttga

SEQ ID NO: 548247 - DNA, 20 bp, Artificial
  CRISPR gRNA sequence
acttgaaggaaataatttct

SEQ ID NO: 548248 - DNA, 20 bp, Artificial
  CRISPR gRNA sequence
gaaggaaataatttctgagt

SEQ ID NO: 548249 - DNA, 20 bp, Artificial
  CRISPR gRNA sequence
ttctgagtaagatccctcta

SEQ ID NO: 548250 - DNA, 20 bp, Artificial
  CRISPR gRNA sequence
gatccctctatagaattaca

SEQ ID NO: 548251 - DNA, 20 bp, Artificial
  CRISPR gRNA sequence
tagaattacatggaatattt

SEQ ID NO: 548252 - DNA, 20 bp, Artificial
  CRISPR gRNA sequence
agaattacatggaatatttt

SEQ ID NO: 548253 - DNA, 20 bp, Artificial
  CRISPR gRNA sequence
gaattacatggaatatttta

SEQ ID NO: 548254 - DNA, 20 bp, Artificial
  CRISPR gRNA sequence
aattacatggaatattttag

SEQ ID NO: 548255 - DNA, 20 bp, Artificial
  CRISPR gRNA sequence
aatattttaggggattttta

SEQ ID NO: 548256 - DNA, 20 bp, Artificial
  CRISPR gRNA sequence
atattttaggggatttttaa

SEQ ID NO: 548257 - DNA, 20 bp, Artificial
  CRISPR gRNA sequence
tttaactttatgtttgccat

SEQ ID NO: 548258 - DNA, 20 bp, Artificial
  CRISPR gRNA sequence
atgtttgccattagaatttg

SEQ ID NO: 548259 - DNA, 20 bp, Artificial
  CRISPR gRNA sequence
cattagaatttgaagacaca

SEQ ID NO: 548260 - DNA, 20 bp, Artificial
  CRISPR gRNA sequence
agtaaaattactcttactga

SEQ ID NO: 548261 - DNA, 20 bp, Artificial
  CRISPR gRNA sequence
aaattactcttactgaaagt

SEQ ID NO: 548262 - DNA, 20 bp, Artificial
  CRISPR gRNA sequence
aagattactttccctgtaaa

SEQ ID NO: 548263 - DNA, 20 bp, Artificial
  CRISPR gRNA sequence
tactttccctgtaaatagtc

SEQ ID NO: 548264 - DNA, 20 bp, Artificial
  CRISPR gRNA sequence
ccctgtaaatagtctggtaa

SEQ ID NO: 548265 - DNA, 20 bp, Artificial
  CRISPR gRNA sequence
atagtctggtaaaagatcat

SEQ ID NO: 548266 - DNA, 20 bp, Artificial
  CRISPR gRNA sequence
agtctggtaaaagatcataa

SEQ ID NO: 548267 - DNA, 20 bp, Artificial
  CRISPR gRNA sequence
gtctggtaaaagatcataag

SEQ ID NO: 548268 - DNA, 20 bp, Artificial
  CRISPR gRNA sequence
tcctcttattgatttgaaat

SEQ ID NO: 548269 - DNA, 20 bp, Artificial
  CRISPR gRNA sequence
ttcttttaattattaaataa

SEQ ID NO: 548270 - DNA, 20 bp, Artificial
  CRISPR gRNA sequence
tacattttcttccaaattga

SEQ ID NO: 548271 - DNA, 20 bp, Artificial
  CRISPR gRNA sequence
gatagttcacatatatacaa

SEQ ID NO: 548272 - DNA, 20 bp, Artificial
  CRISPR gRNA sequence
atatatacaacagattttga

SEQ ID NO: 548273 - DNA, 20 bp, Artificial
  CRISPR gRNA sequence
acaacagattttgaaagttt

SEQ ID NO: 548274 - DNA, 20 bp, Artificial
  CRISPR gRNA sequence
caacagattttgaaagtttg

SEQ ID NO: 548275 - DNA, 20 bp, Artificial
  CRISPR gRNA sequence
gtttgaggaatgttgcttga

SEQ ID NO: 548276 - DNA, 20 bp, Artificial
  CRISPR gRNA sequence
tttgaggaatgttgcttgat

SEQ ID NO: 548277 - DNA, 20 bp, Artificial
  CRISPR gRNA sequence
gaatgttgcttgataggtct

SEQ ID NO: 548278 - DNA, 20 bp, Artificial
  CRISPR gRNA sequence
aatgttgcttgataggtctt

SEQ ID NO: 548279 - DNA, 20 bp, Artificial
  CRISPR gRNA sequence
taggtcttaggtttaaatcc

SEQ ID NO: 548280 - DNA, 20 bp, Artificial
  CRISPR gRNA sequence
ggtcttaggtttaaatcctg

SEQ ID NO: 548281 - DNA, 20 bp, Artificial
  CRISPR gRNA sequence
cttaggtttaaatcctggag

SEQ ID NO: 548282 - DNA, 20 bp, Artificial
  CRISPR gRNA sequence
ctggagtagtgttgacatct

SEQ ID NO: 548283 - DNA, 20 bp, Artificial
  CRISPR gRNA sequence
tgacatctgagacatatgtc

SEQ ID NO: 548284 - DNA, 20 bp, Artificial
  CRISPR gRNA sequence
gacatctgagacatatgtct

SEQ ID NO: 548285 - DNA, 20 bp, Artificial
  CRISPR gRNA sequence
tatgtctgggcttctgaccc

SEQ ID NO: 548286 - DNA, 20 bp, Artificial
  CRISPR gRNA sequence
ggtttctgttaaccaaatat

SEQ ID NO: 548287 - DNA, 20 bp, Artificial
  CRISPR gRNA sequence
tttctgttaaccaaatattg

SEQ ID NO: 548288 - DNA, 20 bp, Artificial
  CRISPR gRNA sequence
ttctgttaaccaaatattgg

SEQ ID NO: 548289 - DNA, 20 bp, Artificial
  CRISPR gRNA sequence
tctccttttaaaatgcaaac

SEQ ID NO: 548290 - DNA, 20 bp, Artificial
  CRISPR gRNA sequence
ctccttttaaaatgcaaacc

SEQ ID NO: 548291 - DNA, 20 bp, Artificial
  CRISPR gRNA sequence
ccttttaaaatgcaaaccag

SEQ ID NO: 548292 - DNA, 20 bp, Artificial
  CRISPR gRNA sequence
gctgaacttaatgatcttaa

SEQ ID NO: 548293 - DNA, 20 bp, Artificial
  CRISPR gRNA sequence
atcttaatggttcttttgaa

SEQ ID NO: 548294 - DNA, 20 bp, Artificial
  CRISPR gRNA sequence
atggttcttttgaacagtaa

SEQ ID NO: 548295 - DNA, 20 bp, Artificial
  CRISPR gRNA sequence
tcttttgaacagtaacagtc

SEQ ID NO: 548296 - DNA, 20 bp, Artificial
  CRISPR gRNA sequence
cttttgaacagtaacagtct

SEQ ID NO: 548297 - DNA, 20 bp, Artificial
  CRISPR gRNA sequence
tctaggatctttttttttct

SEQ ID NO: 548298 - DNA, 20 bp, Artificial
  CRISPR gRNA sequence
gatttttgaatgcttttgtg

SEQ ID NO: 548299 - DNA, 20 bp, Artificial
  CRISPR gRNA sequence
tggaaccacatgcatcataa

SEQ ID NO: 548300 - DNA, 20 bp, Artificial
  CRISPR gRNA sequence
taatagatacaaatccatga

SEQ ID NO: 548301 - DNA, 20 bp, Artificial
  CRISPR gRNA sequence
acaaatccatgaaagtataa

SEQ ID NO: 548302 - DNA, 20 bp, Artificial
  CRISPR gRNA sequence
aaagtataacagttaaatac

SEQ ID NO: 548303 - DNA, 20 bp, Artificial
  CRISPR gRNA sequence
aatactagatcttacttttt

SEQ ID NO: 548304 - DNA, 20 bp, Artificial
  CRISPR gRNA sequence
atactagatcttactttttc

SEQ ID NO: 548305 - DNA, 20 bp, Artificial
  CRISPR gRNA sequence
taaactttccaatgctttat

SEQ ID NO: 548306 - DNA, 20 bp, Artificial
  CRISPR gRNA sequence
tttccaatgctttatcagtg

SEQ ID NO: 548307 - DNA, 20 bp, Artificial
  CRISPR gRNA sequence
gcaaactaactcacattgac

SEQ ID NO: 548308 - DNA, 20 bp, Artificial
  CRISPR gRNA sequence
ttgactagcctgctctcctt

SEQ ID NO: 548309 - DNA, 20 bp, Artificial
  CRISPR gRNA sequence
gctcctcaccactatcattt

SEQ ID NO: 548310 - DNA, 20 bp, Artificial
  CRISPR gRNA sequence
tcaccactatcattttagat

SEQ ID NO: 548311 - DNA, 20 bp, Artificial
  CRISPR gRNA sequence
cactatcattttagattggc

SEQ ID NO: 548312 - DNA, 20 bp, Artificial
  CRISPR gRNA sequence
atcattttagattggccaga

SEQ ID NO: 548313 - DNA, 20 bp, Artificial
  CRISPR gRNA sequence
acagttgttacttacctttt

SEQ ID NO: 548314 - DNA, 20 bp, Artificial
  CRISPR gRNA sequence
gttacttaccttttaagaat

SEQ ID NO: 548315 - DNA, 20 bp, Artificial
  CRISPR gRNA sequence
ttacttaccttttaagaatg

SEQ ID NO: 548316 - DNA, 20 bp, Artificial
  CRISPR gRNA sequence
acttaccttttaagaatgag

SEQ ID NO: 548317 - DNA, 20 bp, Artificial
  CRISPR gRNA sequence
accttttaagaatgaggaga

SEQ ID NO: 548318 - DNA, 20 bp, Artificial
  CRISPR gRNA sequence
ccttttaagaatgaggagac

SEQ ID NO: 548319 - DNA, 20 bp, Artificial
  CRISPR gRNA sequence
tttaagaatgaggagacagg

SEQ ID NO: 548320 - DNA, 20 bp, Artificial
  CRISPR gRNA sequence
agaatgaggagacaggtagc

SEQ ID NO: 548321 - DNA, 20 bp, Artificial
  CRISPR gRNA sequence
gaatgaggagacaggtagcc

SEQ ID NO: 548322 - DNA, 20 bp, Artificial
  CRISPR gRNA sequence
aggagacaggtagccgggtg

SEQ ID NO: 548323 - DNA, 20 bp, Artificial
  CRISPR gRNA sequence
agacaggtagccgggtgcgg

SEQ ID NO: 548324 - DNA, 20 bp, Artificial
  CRISPR gRNA sequence
cacctgtaatcccaacactt

SEQ ID NO: 548325 - DNA, 20 bp, Artificial
  CRISPR gRNA sequence
acctgtaatcccaacacttt

SEQ ID NO: 548326 - DNA, 20 bp, Artificial
  CRISPR gRNA sequence
ctgtaatcccaacactttgg

SEQ ID NO: 548327 - DNA, 20 bp, Artificial
  CRISPR gRNA sequence
tgtaatcccaacactttggg

SEQ ID NO: 548328 - DNA, 20 bp, Artificial
  CRISPR gRNA sequence
tcccaacactttgggaggct

SEQ ID NO: 548329 - DNA, 20 bp, Artificial
  CRISPR gRNA sequence
cccaacactttgggaggctg

SEQ ID NO: 548330 - DNA, 20 bp, Artificial
  CRISPR gRNA sequence
aacactttgggaggctgagg

SEQ ID NO: 548331 - DNA, 20 bp, Artificial
  CRISPR gRNA sequence
acactttgggaggctgaggc

SEQ ID NO: 548332 - DNA, 20 bp, Artificial
  CRISPR gRNA sequence
ctttgggaggctgaggcggg

SEQ ID NO: 548333 - DNA, 20 bp, Artificial
  CRISPR gRNA sequence
ggctgaggcgggtggatcac

SEQ ID NO: 548334 - DNA, 20 bp, Artificial
  CRISPR gRNA sequence
gctgaggcgggtggatcacg

SEQ ID NO: 548335 - DNA, 20 bp, Artificial
  CRISPR gRNA sequence
aggcgggtggatcacgaggt

SEQ ID NO: 548336 - DNA, 20 bp, Artificial
  CRISPR gRNA sequence
ggcgggtggatcacgaggtc

SEQ ID NO: 548337 - DNA, 20 bp, Artificial
  CRISPR gRNA sequence
cgggtggatcacgaggtcag

SEQ ID NO: 548338 - DNA, 20 bp, Artificial
  CRISPR gRNA sequence
gatcacgaggtcaggagatc

SEQ ID NO: 548339 - DNA, 20 bp, Artificial
  CRISPR gRNA sequence
tcaggagatcaagaccatcc

SEQ ID NO: 548340 - DNA, 20 bp, Artificial
  CRISPR gRNA sequence
caagaccatcctggctaaca

SEQ ID NO: 548341 - DNA, 20 bp, Artificial
  CRISPR gRNA sequence
gtactaaaaatacaaaaaat

SEQ ID NO: 548342 - DNA, 20 bp, Artificial
  CRISPR gRNA sequence
taaaaatacaaaaaattagt

SEQ ID NO: 548343 - DNA, 20 bp, Artificial
  CRISPR gRNA sequence
aaaaatacaaaaaattagtc

SEQ ID NO: 548344 - DNA, 20 bp, Artificial
  CRISPR gRNA sequence
aaaaaattagtcaggtgtgt

SEQ ID NO: 548345 - DNA, 20 bp, Artificial
  CRISPR gRNA sequence
aaattagtcaggtgtgttgg

SEQ ID NO: 548346 - DNA, 20 bp, Artificial
  CRISPR gRNA sequence
aattagtcaggtgtgttggt

SEQ ID NO: 548347 - DNA, 20 bp, Artificial
  CRISPR gRNA sequence
ggtgtgttggtgggcacctg

SEQ ID NO: 548348 - DNA, 20 bp, Artificial
  CRISPR gRNA sequence
ttggtgggcacctgtagtcc

SEQ ID NO: 548349 - DNA, 20 bp, Artificial
  CRISPR gRNA sequence
cacctgtagtcccagctact

SEQ ID NO: 548350 - DNA, 20 bp, Artificial
  CRISPR gRNA sequence
acctgtagtcccagctactt

SEQ ID NO: 548351 - DNA, 20 bp, Artificial
  CRISPR gRNA sequence
ctgtagtcccagctacttgg

SEQ ID NO: 548352 - DNA, 20 bp, Artificial
  CRISPR gRNA sequence
tgtagtcccagctacttggg

SEQ ID NO: 548353 - DNA, 20 bp, Artificial
  CRISPR gRNA sequence
tcccagctacttgggaggct

SEQ ID NO: 548354 - DNA, 20 bp, Artificial
  CRISPR gRNA sequence
cccagctacttgggaggctg

SEQ ID NO: 548355 - DNA, 20 bp, Artificial
  CRISPR gRNA sequence
agctacttgggaggctgagg

SEQ ID NO: 548356 - DNA, 20 bp, Artificial
  CRISPR gRNA sequence
gctacttgggaggctgaggc

SEQ ID NO: 548357 - DNA, 20 bp, Artificial
  CRISPR gRNA sequence
tacttgggaggctgaggcag

SEQ ID NO: 548358 - DNA, 20 bp, Artificial
  CRISPR gRNA sequence
gggaggctgaggcaggagaa

SEQ ID NO: 548359 - DNA, 20 bp, Artificial
  CRISPR gRNA sequence
gcaggagaatggcatgaacc

SEQ ID NO: 548360 - DNA, 20 bp, Artificial
  CRISPR gRNA sequence
caggagaatggcatgaaccc

SEQ ID NO: 548361 - DNA, 20 bp, Artificial
  CRISPR gRNA sequence
ggagaatggcatgaacccgg

SEQ ID NO: 548362 - DNA, 20 bp, Artificial
  CRISPR gRNA sequence
gagaatggcatgaacccggg

SEQ ID NO: 548363 - DNA, 20 bp, Artificial
  CRISPR gRNA sequence
aatggcatgaacccgggagg

SEQ ID NO: 548364 - DNA, 20 bp, Artificial
  CRISPR gRNA sequence
tggcatgaacccgggaggcg

SEQ ID NO: 548365 - DNA, 20 bp, Artificial
  CRISPR gRNA sequence
atgaacccgggaggcggagc

SEQ ID NO: 548366 - DNA, 20 bp, Artificial
  CRISPR gRNA sequence
aacccgggaggcggagctgg

SEQ ID NO: 548367 - DNA, 20 bp, Artificial
  CRISPR gRNA sequence
cgggaggcggagctggcagt

SEQ ID NO: 548368 - DNA, 20 bp, Artificial
  CRISPR gRNA sequence
ggcggagctggcagtgagct

SEQ ID NO: 548369 - DNA, 20 bp, Artificial
  CRISPR gRNA sequence
gagaccacaccactgcactc

SEQ ID NO: 548370 - DNA, 20 bp, Artificial
  CRISPR gRNA sequence
cacaccactgcactccagcc

SEQ ID NO: 548371 - DNA, 20 bp, Artificial
  CRISPR gRNA sequence
acaccactgcactccagcct

SEQ ID NO: 548372 - DNA, 20 bp, Artificial
  CRISPR gRNA sequence
ctgcactccagcctgggtga

SEQ ID NO: 548373 - DNA, 20 bp, Artificial
  CRISPR gRNA sequence
gcactccagcctgggtgaca

SEQ ID NO: 548374 - DNA, 20 bp, Artificial
  CRISPR gRNA sequence
tccagcctgggtgacagagt

SEQ ID NO: 548375 - DNA, 20 bp, Artificial
  CRISPR gRNA sequence
tccgtctcaaaaaaaaaaaa

SEQ ID NO: 548376 - DNA, 20 bp, Artificial
  CRISPR gRNA sequence
tcaaaaaaaaaaaaaagaat

SEQ ID NO: 548377 - DNA, 20 bp, Artificial
  CRISPR gRNA sequence
caaaaaaaaaaaaaagaatg

SEQ ID NO: 548378 - DNA, 20 bp, Artificial
  CRISPR gRNA sequence
aaaaaaaaaaaaagaatgag

SEQ ID NO: 548379 - DNA, 20 bp, Artificial
  CRISPR gRNA sequence
aaaaaaaaagaatgaggaga

SEQ ID NO: 548380 - DNA, 20 bp, Artificial
  CRISPR gRNA sequence
aaaaaaaagaatgaggagac

SEQ ID NO: 548381 - DNA, 20 bp, Artificial
  CRISPR gRNA sequence
aaaaaaagaatgaggagaca

SEQ ID NO: 548382 - DNA, 20 bp, Artificial
  CRISPR gRNA sequence
aatgaggagacagggtcaac

SEQ ID NO: 548383 - DNA, 20 bp, Artificial
  CRISPR gRNA sequence
atgaggagacagggtcaacc

SEQ ID NO: 548384 - DNA, 20 bp, Artificial
  CRISPR gRNA sequence
aggagacagggtcaaccagg

SEQ ID NO: 548385 - DNA, 20 bp, Artificial
  CRISPR gRNA sequence
ggagacagggtcaaccaggt

SEQ ID NO: 548386 - DNA, 20 bp, Artificial
  CRISPR gRNA sequence
gagacagggtcaaccaggtg

SEQ ID NO: 548387 - DNA, 20 bp, Artificial
  CRISPR gRNA sequence
accaggtggggtgacttgcc

SEQ ID NO: 548388 - DNA, 20 bp, Artificial
  CRISPR gRNA sequence
ccaggtggggtgacttgccc

SEQ ID NO: 548389 - DNA, 20 bp, Artificial
  CRISPR gRNA sequence
caggtggggtgacttgccca

SEQ ID NO: 548390 - DNA, 20 bp, Artificial
  CRISPR gRNA sequence
tgacttgcccagggtcactt

SEQ ID NO: 548391 - DNA, 20 bp, Artificial
  CRISPR gRNA sequence
gcccagggtcacttaagtat

SEQ ID NO: 548392 - DNA, 20 bp, Artificial
  CRISPR gRNA sequence
ccagggtcacttaagtattg

SEQ ID NO: 548393 - DNA, 20 bp, Artificial
  CRISPR gRNA sequence
ggtcacttaagtattggaga

SEQ ID NO: 548394 - DNA, 20 bp, Artificial
  CRISPR gRNA sequence
ttggagatagaattaaaatt

SEQ ID NO: 548395 - DNA, 20 bp, Artificial
  CRISPR gRNA sequence
tggagatagaattaaaattt

SEQ ID NO: 548396 - DNA, 20 bp, Artificial
  CRISPR gRNA sequence
aaatttaggtctttgaattc

SEQ ID NO: 548397 - DNA, 20 bp, Artificial
  CRISPR gRNA sequence
atttaggtctttgaattcca

SEQ ID NO: 548398 - DNA, 20 bp, Artificial
  CRISPR gRNA sequence
tcaaaataaatcaaatttta

SEQ ID NO: 548399 - DNA, 20 bp, Artificial
  CRISPR gRNA sequence
tttgatttattcatatgaat

SEQ ID NO: 548400 - DNA, 20 bp, Artificial
  CRISPR gRNA sequence
atttattcatatgaatgagc

SEQ ID NO: 548401 - DNA, 20 bp, Artificial
  CRISPR gRNA sequence
ttattcatatgaatgagcta

SEQ ID NO: 548402 - DNA, 20 bp, Artificial
  CRISPR gRNA sequence
ctagagaaacccatactata

SEQ ID NO: 548403 - DNA, 20 bp, Artificial
  CRISPR gRNA sequence
ccatactatatagatataca

SEQ ID NO: 548404 - DNA, 20 bp, Artificial
  CRISPR gRNA sequence
tactatatagatatacatag

SEQ ID NO: 548405 - DNA, 20 bp, Artificial
  CRISPR gRNA sequence
tagatatacatagtagatat

SEQ ID NO: 548406 - DNA, 20 bp, Artificial
  CRISPR gRNA sequence
gtttcttgtaacattttgtc

SEQ ID NO: 548407 - DNA, 20 bp, Artificial
  CRISPR gRNA sequence
tcttgtaacattttgtctag

SEQ ID NO: 548408 - DNA, 20 bp, Artificial
  CRISPR gRNA sequence
cttgtaacattttgtctagt

SEQ ID NO: 548409 - DNA, 20 bp, Artificial
  CRISPR gRNA sequence
tgtctagtaggacctttttg

SEQ ID NO: 548410 - DNA, 20 bp, Artificial
  CRISPR gRNA sequence
tttgtggtttgtcatcattt

SEQ ID NO: 548411 - DNA, 20 bp, Artificial
  CRISPR gRNA sequence
gtcataccgtcactgcaacc

SEQ ID NO: 548412 - DNA, 20 bp, Artificial
  CRISPR gRNA sequence
ccgtcactgcaacccagaaa

SEQ ID NO: 548413 - DNA, 20 bp, Artificial
  CRISPR gRNA sequence
cgtcactgcaacccagaaat

SEQ ID NO: 548414 - DNA, 20 bp, Artificial
  CRISPR gRNA sequence
gtcactgcaacccagaaatg

SEQ ID NO: 548415 - DNA, 20 bp, Artificial
  CRISPR gRNA sequence
gcaacccagaaatggggcga

SEQ ID NO: 548416 - DNA, 20 bp, Artificial
  CRISPR gRNA sequence
caacccagaaatggggcgat

SEQ ID NO: 548417 - DNA, 20 bp, Artificial
  CRISPR gRNA sequence
aacccagaaatggggcgatg

SEQ ID NO: 548418 - DNA, 20 bp, Artificial
  CRISPR gRNA sequence
ggggcgatggggttactaac

SEQ ID NO: 548419 - DNA, 20 bp, Artificial
  CRISPR gRNA sequence
aactagttaaacacaatcta

SEQ ID NO: 548420 - DNA, 20 bp, Artificial
  CRISPR gRNA sequence
actagttaaacacaatctaa

SEQ ID NO: 548421 - DNA, 20 bp, Artificial
  CRISPR gRNA sequence
tagttaaacacaatctaaag

SEQ ID NO: 548422 - DNA, 20 bp, Artificial
  CRISPR gRNA sequence
cacaatctaaaggagaattt

SEQ ID NO: 548423 - DNA, 20 bp, Artificial
  CRISPR gRNA sequence
caatctaaaggagaatttta

SEQ ID NO: 548424 - DNA, 20 bp, Artificial
  CRISPR gRNA sequence
ctaaaggagaattttagaga

SEQ ID NO: 548425 - DNA, 20 bp, Artificial
  CRISPR gRNA sequence
ggagaattttagagacagtt

SEQ ID NO: 548426 - DNA, 20 bp, Artificial
  CRISPR gRNA sequence
ttttagagacagttaagatt

SEQ ID NO: 548427 - DNA, 20 bp, Artificial
  CRISPR gRNA sequence
tttagagacagttaagattg

SEQ ID NO: 548428 - DNA, 20 bp, Artificial
  CRISPR gRNA sequence
gagacagttaagattgagga

SEQ ID NO: 548429 - DNA, 20 bp, Artificial
  CRISPR gRNA sequence
gacagttaagattgaggaca

SEQ ID NO: 548430 - DNA, 20 bp, Artificial
  CRISPR gRNA sequence
ttgtccaactcgtattgtac

SEQ ID NO: 548431 - DNA, 20 bp, Artificial
  CRISPR gRNA sequence
tgtccaactcgtattgtact

SEQ ID NO: 548432 - DNA, 20 bp, Artificial
  CRISPR gRNA sequence
gtccaactcgtattgtactg

SEQ ID NO: 548433 - DNA, 20 bp, Artificial
  CRISPR gRNA sequence
tccaactcgtattgtactgg

SEQ ID NO: 548434 - DNA, 20 bp, Artificial
  CRISPR gRNA sequence
gaatgaactaatacttactg

SEQ ID NO: 548435 - DNA, 20 bp, Artificial
  CRISPR gRNA sequence
aatgaactaatacttactga

SEQ ID NO: 548436 - DNA, 20 bp, Artificial
  CRISPR gRNA sequence
atttaatccacacaacaacc

SEQ ID NO: 548437 - DNA, 20 bp, Artificial
  CRISPR gRNA sequence
taatccacacaacaacccag

SEQ ID NO: 548438 - DNA, 20 bp, Artificial
  CRISPR gRNA sequence
cacacaacaacccagtggtg

SEQ ID NO: 548439 - DNA, 20 bp, Artificial
  CRISPR gRNA sequence
acacaacaacccagtggtgt

SEQ ID NO: 548440 - DNA, 20 bp, Artificial
  CRISPR gRNA sequence
cagtggtgtgggtatttata

SEQ ID NO: 548441 - DNA, 20 bp, Artificial
  CRISPR gRNA sequence
agtggtgtgggtatttataa

SEQ ID NO: 548442 - DNA, 20 bp, Artificial
  CRISPR gRNA sequence
tggtgtgggtatttataaag

SEQ ID NO: 548443 - DNA, 20 bp, Artificial
  CRISPR gRNA sequence
ggtgtgggtatttataaagg

SEQ ID NO: 548444 - DNA, 20 bp, Artificial
  CRISPR gRNA sequence
tatttataaaggaggaatct

SEQ ID NO: 548445 - DNA, 20 bp, Artificial
  CRISPR gRNA sequence
atttataaaggaggaatctg

SEQ ID NO: 548446 - DNA, 20 bp, Artificial
  CRISPR gRNA sequence
taaaggaggaatctgaggca

SEQ ID NO: 548447 - DNA, 20 bp, Artificial
  CRISPR gRNA sequence
ggaggaatctgaggcacagt

SEQ ID NO: 548448 - DNA, 20 bp, Artificial
  CRISPR gRNA sequence
gaggaatctgaggcacagtg

SEQ ID NO: 548449 - DNA, 20 bp, Artificial
  CRISPR gRNA sequence
accaaatatacacatttatt

SEQ ID NO: 548450 - DNA, 20 bp, Artificial
  CRISPR gRNA sequence
caaatatacacatttattaa

SEQ ID NO: 548451 - DNA, 20 bp, Artificial
  CRISPR gRNA sequence
atacacatttattaagagca

SEQ ID NO: 548452 - DNA, 20 bp, Artificial
  CRISPR gRNA sequence
acatttattaagagcaaagc

SEQ ID NO: 548453 - DNA, 20 bp, Artificial
  CRISPR gRNA sequence
catttattaagagcaaagcc

SEQ ID NO: 548454 - DNA, 20 bp, Artificial
  CRISPR gRNA sequence
tccaactccatctgaactca

SEQ ID NO: 548455 - DNA, 20 bp, Artificial
  CRISPR gRNA sequence
ctgtgtcttccccactgtac

SEQ ID NO: 548456 - DNA, 20 bp, Artificial
  CRISPR gRNA sequence
tgtgtcttccccactgtact

SEQ ID NO: 548457 - DNA, 20 bp, Artificial
  CRISPR gRNA sequence
gtcttccccactgtactggg

SEQ ID NO: 548458 - DNA, 20 bp, Artificial
  CRISPR gRNA sequence
cccactgtactgggaagtaa

SEQ ID NO: 548459 - DNA, 20 bp, Artificial
  CRISPR gRNA sequence
ctgtactgggaagtaaaagt

SEQ ID NO: 548460 - DNA, 20 bp, Artificial
  CRISPR gRNA sequence
tactgggaagtaaaagtaag

SEQ ID NO: 548461 - DNA, 20 bp, Artificial
  CRISPR gRNA sequence
gtaaaagtaagaagatgact

SEQ ID NO: 548462 - DNA, 20 bp, Artificial
  CRISPR gRNA sequence
aaaagtaagaagatgactca

SEQ ID NO: 548463 - DNA, 20 bp, Artificial
  CRISPR gRNA sequence
gtaagaagatgactcagaga

SEQ ID NO: 548464 - DNA, 20 bp, Artificial
  CRISPR gRNA sequence
aagaagatgactcagagatg

SEQ ID NO: 548465 - DNA, 20 bp, Artificial
  CRISPR gRNA sequence
agagatggagaattataatc

SEQ ID NO: 548466 - DNA, 20 bp, Artificial
  CRISPR gRNA sequence
gagaattataatctggaatt

SEQ ID NO: 548467 - DNA, 20 bp, Artificial
  CRISPR gRNA sequence
aatttggaatttacttccat

SEQ ID NO: 548468 - DNA, 20 bp, Artificial
  CRISPR gRNA sequence
ggttaaccgtttgaaaattg

SEQ ID NO: 548469 - DNA, 20 bp, Artificial
  CRISPR gRNA sequence
cgtttgaaaattgcagctcc

SEQ ID NO: 548470 - DNA, 20 bp, Artificial
  CRISPR gRNA sequence
gtttgaaaattgcagctcca

SEQ ID NO: 548471 - DNA, 20 bp, Artificial
  CRISPR gRNA sequence
aaattgcagctccaaggcat

SEQ ID NO: 548472 - DNA, 20 bp, Artificial
  CRISPR gRNA sequence
aattgcagctccaaggcatt

SEQ ID NO: 548473 - DNA, 20 bp, Artificial
  CRISPR gRNA sequence
ttgcagctccaaggcattgg

SEQ ID NO: 548474 - DNA, 20 bp, Artificial
  CRISPR gRNA sequence
agctccaaggcattgggaga

SEQ ID NO: 548475 - DNA, 20 bp, Artificial
  CRISPR gRNA sequence
ccaaggcattgggagatgga

SEQ ID NO: 548476 - DNA, 20 bp, Artificial
  CRISPR gRNA sequence
ggcattgggagatggaaaga

SEQ ID NO: 548477 - DNA, 20 bp, Artificial
  CRISPR gRNA sequence
ttgggagatggaaagaaagc

SEQ ID NO: 548478 - DNA, 20 bp, Artificial
  CRISPR gRNA sequence
gagatggaaagaaagctagt

SEQ ID NO: 548479 - DNA, 20 bp, Artificial
  CRISPR gRNA sequence
cctccttatctccttatctg

SEQ ID NO: 548480 - DNA, 20 bp, Artificial
  CRISPR gRNA sequence
cttatctccttatctgcggt

SEQ ID NO: 548481 - DNA, 20 bp, Artificial
  CRISPR gRNA sequence
tatctccttatctgcggtca

SEQ ID NO: 548482 - DNA, 20 bp, Artificial
  CRISPR gRNA sequence
ctccttatctgcggtcagag

SEQ ID NO: 548483 - DNA, 20 bp, Artificial
  CRISPR gRNA sequence
ttatctgcggtcagagtaga

SEQ ID NO: 548484 - DNA, 20 bp, Artificial
  CRISPR gRNA sequence
tgcggtcagagtagatagca

SEQ ID NO: 548485 - DNA, 20 bp, Artificial
  CRISPR gRNA sequence
cggtcagagtagatagcatg

SEQ ID NO: 548486 - DNA, 20 bp, Artificial
  CRISPR gRNA sequence
ggtcagagtagatagcatgg

SEQ ID NO: 548487 - DNA, 20 bp, Artificial
  CRISPR gRNA sequence
gaggttttatgcccatgcta

SEQ ID NO: 548488 - DNA, 20 bp, Artificial
  CRISPR gRNA sequence
atgcccatgctacagatgtt

SEQ ID NO: 548489 - DNA, 20 bp, Artificial
  CRISPR gRNA sequence
gcccatgctacagatgttca

SEQ ID NO: 548490 - DNA, 20 bp, Artificial
  CRISPR gRNA sequence
tacagatgttcagagatctc

SEQ ID NO: 548491 - DNA, 20 bp, Artificial
  CRISPR gRNA sequence
acagatgttcagagatctca

SEQ ID NO: 548492 - DNA, 20 bp, Artificial
  CRISPR gRNA sequence
atgttcagagatctcaaggt

SEQ ID NO: 548493 - DNA, 20 bp, Artificial
  CRISPR gRNA sequence
tcagagatctcaaggtcaga

SEQ ID NO: 548494 - DNA, 20 bp, Artificial
  CRISPR gRNA sequence
agatctcaaggtcagaaagc

SEQ ID NO: 548495 - DNA, 20 bp, Artificial
  CRISPR gRNA sequence
aaggtcagaaagctggttta

SEQ ID NO: 548496 - DNA, 20 bp, Artificial
  CRISPR gRNA sequence
gtcagaaagctggtttatgg

SEQ ID NO: 548497 - DNA, 20 bp, Artificial
  CRISPR gRNA sequence
tttatggcagcacgtgaata

SEQ ID NO: 548498 - DNA, 20 bp, Artificial
  CRISPR gRNA sequence
tggcagcacgtgaatataga

SEQ ID NO: 548499 - DNA, 20 bp, Artificial
  CRISPR gRNA sequence
tgaatatagacagacttata

SEQ ID NO: 548500 - DNA, 20 bp, Artificial
  CRISPR gRNA sequence
atagacagacttatacagat

SEQ ID NO: 548501 - DNA, 20 bp, Artificial
  CRISPR gRNA sequence
cttatacagattagaaaatt

SEQ ID NO: 548502 - DNA, 20 bp, Artificial
  CRISPR gRNA sequence
atacagattagaaaattgag

SEQ ID NO: 548503 - DNA, 20 bp, Artificial
  CRISPR gRNA sequence
gattagaaaattgagaagtt

SEQ ID NO: 548504 - DNA, 20 bp, Artificial
  CRISPR gRNA sequence
attagaaaattgagaagttg

SEQ ID NO: 548505 - DNA, 20 bp, Artificial
  CRISPR gRNA sequence
ttagaaaattgagaagttga

SEQ ID NO: 548506 - DNA, 20 bp, Artificial
  CRISPR gRNA sequence
gaaaattgagaagttgaggg

SEQ ID NO: 548507 - DNA, 20 bp, Artificial
  CRISPR gRNA sequence
aaaattgagaagttgagggc

SEQ ID NO: 548508 - DNA, 20 bp, Artificial
  CRISPR gRNA sequence
aattgagaagttgagggcag

SEQ ID NO: 548509 - DNA, 20 bp, Artificial
  CRISPR gRNA sequence
ttgagggcaggagaaaattc

SEQ ID NO: 548510 - DNA, 20 bp, Artificial
  CRISPR gRNA sequence
gggcaggagaaaattctgga

SEQ ID NO: 548511 - DNA, 20 bp, Artificial
  CRISPR gRNA sequence
caggagaaaattctggatag

SEQ ID NO: 548512 - DNA, 20 bp, Artificial
  CRISPR gRNA sequence
ggagaaaattctggatagaa

SEQ ID NO: 548513 - DNA, 20 bp, Artificial
  CRISPR gRNA sequence
attctggatagaagagaaca

SEQ ID NO: 548514 - DNA, 20 bp, Artificial
  CRISPR gRNA sequence
ttctggatagaagagaacat

SEQ ID NO: 548515 - DNA, 20 bp, Artificial
  CRISPR gRNA sequence
gatagaagagaacatgggat

SEQ ID NO: 548516 - DNA, 20 bp, Artificial
  CRISPR gRNA sequence
atagaagagaacatgggatt

SEQ ID NO: 548517 - DNA, 20 bp, Artificial
  CRISPR gRNA sequence
agaagagaacatgggattgg

SEQ ID NO: 548518 - DNA, 20 bp, Artificial
  CRISPR gRNA sequence
gagaacatgggattgggagc

SEQ ID NO: 548519 - DNA, 20 bp, Artificial
  CRISPR gRNA sequence
ggattgggagcaagaaaacc

SEQ ID NO: 548520 - DNA, 20 bp, Artificial
  CRISPR gRNA sequence
gattgggagcaagaaaacct

SEQ ID NO: 548521 - DNA, 20 bp, Artificial
  CRISPR gRNA sequence
gagcaagaaaacctaggtcc

SEQ ID NO: 548522 - DNA, 20 bp, Artificial
  CRISPR gRNA sequence
gacctgatttcattgcttac

SEQ ID NO: 548523 - DNA, 20 bp, Artificial
  CRISPR gRNA sequence
ctgatttcattgcttactgg

SEQ ID NO: 548524 - DNA, 20 bp, Artificial
  CRISPR gRNA sequence
gcttactggcagtgtgaatg

SEQ ID NO: 548525 - DNA, 20 bp, Artificial
  CRISPR gRNA sequence
cttactggcagtgtgaatgt

SEQ ID NO: 548526 - DNA, 20 bp, Artificial
  CRISPR gRNA sequence
ttactggcagtgtgaatgtg

SEQ ID NO: 548527 - DNA, 20 bp, Artificial
  CRISPR gRNA sequence
tactggcagtgtgaatgtgg

SEQ ID NO: 548528 - DNA, 20 bp, Artificial
  CRISPR gRNA sequence
gataataatacttactttac

SEQ ID NO: 548529 - DNA, 20 bp, Artificial
  CRISPR gRNA sequence
ataataatacttactttaca

SEQ ID NO: 548530 - DNA, 20 bp, Artificial
  CRISPR gRNA sequence
taataatacttactttacaa

SEQ ID NO: 548531 - DNA, 20 bp, Artificial
  CRISPR gRNA sequence
atacttactttacaagggct

SEQ ID NO: 548532 - DNA, 20 bp, Artificial
  CRISPR gRNA sequence
tacttactttacaagggctg

SEQ ID NO: 548533 - DNA, 20 bp, Artificial
  CRISPR gRNA sequence
gctgaggaaattaaataaaa

SEQ ID NO: 548534 - DNA, 20 bp, Artificial
  CRISPR gRNA sequence
aaattaaataaaatagcatg

SEQ ID NO: 548535 - DNA, 20 bp, Artificial
  CRISPR gRNA sequence
aattaaataaaatagcatgt

SEQ ID NO: 548536 - DNA, 20 bp, Artificial
  CRISPR gRNA sequence
aaataaaatagcatgtggga

SEQ ID NO: 548537 - DNA, 20 bp, Artificial
  CRISPR gRNA sequence
ataaaatagcatgtgggaaa

SEQ ID NO: 548538 - DNA, 20 bp, Artificial
  CRISPR gRNA sequence
catgtgggaaagagtattga

SEQ ID NO: 548539 - DNA, 20 bp, Artificial
  CRISPR gRNA sequence
tgggaaagagtattgatggt

SEQ ID NO: 548540 - DNA, 20 bp, Artificial
  CRISPR gRNA sequence
gttagtcactataaaactgc

SEQ ID NO: 548541 - DNA, 20 bp, Artificial
  CRISPR gRNA sequence
taaaactgctagttgttatt

SEQ ID NO: 548542 - DNA, 20 bp, Artificial
  CRISPR gRNA sequence
aaaactgctagttgttattc

SEQ ID NO: 548543 - DNA, 20 bp, Artificial
  CRISPR gRNA sequence
gctagttgttattcaggata

SEQ ID NO: 548544 - DNA, 20 bp, Artificial
  CRISPR gRNA sequence
ctagttgttattcaggatac

SEQ ID NO: 548545 - DNA, 20 bp, Artificial
  CRISPR gRNA sequence
gttgttattcaggatacagg

SEQ ID NO: 548546 - DNA, 20 bp, Artificial
  CRISPR gRNA sequence
tgttattcaggatacaggaa

SEQ ID NO: 548547 - DNA, 20 bp, Artificial
  CRISPR gRNA sequence
caggatacaggaagagtttc

SEQ ID NO: 548548 - DNA, 20 bp, Artificial
  CRISPR gRNA sequence
ggatacaggaagagtttcaa

SEQ ID NO: 548549 - DNA, 20 bp, Artificial
  CRISPR gRNA sequence
atacaggaagagtttcaaga

SEQ ID NO: 548550 - DNA, 20 bp, Artificial
  CRISPR gRNA sequence
tacaggaagagtttcaagag

SEQ ID NO: 548551 - DNA, 20 bp, Artificial
  CRISPR gRNA sequence
gagtttcaagagaggacatt

SEQ ID NO: 548552 - DNA, 20 bp, Artificial
  CRISPR gRNA sequence
atttggtataacattatata

SEQ ID NO: 548553 - DNA, 20 bp, Artificial
  CRISPR gRNA sequence
ataacattatatacagccaa

SEQ ID NO: 548554 - DNA, 20 bp, Artificial
  CRISPR gRNA sequence
ttatatacagccaatggttt

SEQ ID NO: 548555 - DNA, 20 bp, Artificial
  CRISPR gRNA sequence
tatatacagccaatggttta

SEQ ID NO: 548556 - DNA, 20 bp, Artificial
  CRISPR gRNA sequence
tatacagccaatggtttaag

SEQ ID NO: 548557 - DNA, 20 bp, Artificial
  CRISPR gRNA sequence
atacagccaatggtttaagg

SEQ ID NO: 548558 - DNA, 20 bp, Artificial
  CRISPR gRNA sequence
atggtttaaggaggacaatg

SEQ ID NO: 548559 - DNA, 20 bp, Artificial
  CRISPR gRNA sequence
gtttaaggaggacaatgtag

SEQ ID NO: 548560 - DNA, 20 bp, Artificial
  CRISPR gRNA sequence
ttaaggaggacaatgtagaa

SEQ ID NO: 548561 - DNA, 20 bp, Artificial
  CRISPR gRNA sequence
taaggaggacaatgtagaag

SEQ ID NO: 548562 - DNA, 20 bp, Artificial
  CRISPR gRNA sequence
ggacaatgtagaagaggttg

SEQ ID NO: 548563 - DNA, 20 bp, Artificial
  CRISPR gRNA sequence
tgtagaagaggttgtggatt

SEQ ID NO: 548564 - DNA, 20 bp, Artificial
  CRISPR gRNA sequence
gaggttgtggatttggcact

SEQ ID NO: 548565 - DNA, 20 bp, Artificial
  CRISPR gRNA sequence
aggttgtggatttggcactt

SEQ ID NO: 548566 - DNA, 20 bp, Artificial
  CRISPR gRNA sequence
gttgtggatttggcacttag

SEQ ID NO: 548567 - DNA, 20 bp, Artificial
  CRISPR gRNA sequence
ttgtggatttggcacttagg

SEQ ID NO: 548568 - DNA, 20 bp, Artificial
  CRISPR gRNA sequence
acttaggaggtcattgttga

SEQ ID NO: 548569 - DNA, 20 bp, Artificial
  CRISPR gRNA sequence
ttgttgacagaccttgtgaa

SEQ ID NO: 548570 - DNA, 20 bp, Artificial
  CRISPR gRNA sequence
gacagaccttgtgaatagat

SEQ ID NO: 548571 - DNA, 20 bp, Artificial
  CRISPR gRNA sequence
acagaccttgtgaatagatg

SEQ ID NO: 548572 - DNA, 20 bp, Artificial
  CRISPR gRNA sequence
cagaccttgtgaatagatga

SEQ ID NO: 548573 - DNA, 20 bp, Artificial
  CRISPR gRNA sequence
accttgtgaatagatgaggg

SEQ ID NO: 548574 - DNA, 20 bp, Artificial
  CRISPR gRNA sequence
ccttgtgaatagatgagggt

SEQ ID NO: 548575 - DNA, 20 bp, Artificial
  CRISPR gRNA sequence
gaatagatgagggtaggaac

SEQ ID NO: 548576 - DNA, 20 bp, Artificial
  CRISPR gRNA sequence
gagggtaggaaccagattcc

SEQ ID NO: 548577 - DNA, 20 bp, Artificial
  CRISPR gRNA sequence
agggtaggaaccagattcct

SEQ ID NO: 548578 - DNA, 20 bp, Artificial
  CRISPR gRNA sequence
gaaccagattcctgggcttt

SEQ ID NO: 548579 - DNA, 20 bp, Artificial
  CRISPR gRNA sequence
cagattcctgggctttaagt

SEQ ID NO: 548580 - DNA, 20 bp, Artificial
  CRISPR gRNA sequence
attcctgggctttaagtaag

SEQ ID NO: 548581 - DNA, 20 bp, Artificial
  CRISPR gRNA sequence
tcctgggctttaagtaagaa

SEQ ID NO: 548582 - DNA, 20 bp, Artificial
  CRISPR gRNA sequence
cctgggctttaagtaagaag

SEQ ID NO: 548583 - DNA, 20 bp, Artificial
  CRISPR gRNA sequence
ctgggctttaagtaagaaga

SEQ ID NO: 548584 - DNA, 20 bp, Artificial
  CRISPR gRNA sequence
tgggctttaagtaagaagag

SEQ ID NO: 548585 - DNA, 20 bp, Artificial
  CRISPR gRNA sequence
gctttaagtaagaagagggg

SEQ ID NO: 548586 - DNA, 20 bp, Artificial
  CRISPR gRNA sequence
taagaagaggggtagtccaa

SEQ ID NO: 548587 - DNA, 20 bp, Artificial
  CRISPR gRNA sequence
aagaagaggggtagtccaat

SEQ ID NO: 548588 - DNA, 20 bp, Artificial
  CRISPR gRNA sequence
agaggggtagtccaataggc

SEQ ID NO: 548589 - DNA, 20 bp, Artificial
  CRISPR gRNA sequence
caataggccagttatatatt

SEQ ID NO: 548590 - DNA, 20 bp, Artificial
  CRISPR gRNA sequence
agttatatatttggctgtga

SEQ ID NO: 548591 - DNA, 20 bp, Artificial
  CRISPR gRNA sequence
ttatatatttggctgtgaaa

SEQ ID NO: 548592 - DNA, 20 bp, Artificial
  CRISPR gRNA sequence
tatatatttggctgtgaaag

SEQ ID NO: 548593 - DNA, 20 bp, Artificial
  CRISPR gRNA sequence
gaaagaggaaaataaaatct

SEQ ID NO: 548594 - DNA, 20 bp, Artificial
  CRISPR gRNA sequence
aataaaatctgagtaccttt

SEQ ID NO: 548595 - DNA, 20 bp, Artificial
  CRISPR gRNA sequence
taaaatctgagtacctttga

SEQ ID NO: 548596 - DNA, 20 bp, Artificial
  CRISPR gRNA sequence
ctgagtacctttgagagtca

SEQ ID NO: 548597 - DNA, 20 bp, Artificial
  CRISPR gRNA sequence
tgagtacctttgagagtcaa

SEQ ID NO: 548598 - DNA, 20 bp, Artificial
  CRISPR gRNA sequence
tgagagtcaaaggctatttc

SEQ ID NO: 548599 - DNA, 20 bp, Artificial
  CRISPR gRNA sequence
gagagtcaaaggctatttcc

SEQ ID NO: 548600 - DNA, 20 bp, Artificial
  CRISPR gRNA sequence
tcaaaggctatttccaggta

SEQ ID NO: 548601 - DNA, 20 bp, Artificial
  CRISPR gRNA sequence
tatttccaggtaaagaaacc

SEQ ID NO: 548602 - DNA, 20 bp, Artificial
  CRISPR gRNA sequence
tgcacttcaccattctcttt

SEQ ID NO: 548603 - DNA, 20 bp, Artificial
  CRISPR gRNA sequence
attctcttttagataactgc

SEQ ID NO: 548604 - DNA, 20 bp, Artificial
  CRISPR gRNA sequence
ttctcttttagataactgct

SEQ ID NO: 548605 - DNA, 20 bp, Artificial
  CRISPR gRNA sequence
tcttttagataactgctggg

SEQ ID NO: 548606 - DNA, 20 bp, Artificial
  CRISPR gRNA sequence
tttagataactgctgggaag

SEQ ID NO: 548607 - DNA, 20 bp, Artificial
  CRISPR gRNA sequence
agataactgctgggaagaag

SEQ ID NO: 548608 - DNA, 20 bp, Artificial
  CRISPR gRNA sequence
gataactgctgggaagaagt

SEQ ID NO: 548609 - DNA, 20 bp, Artificial
  CRISPR gRNA sequence
taacaccctccacattgaca

SEQ ID NO: 548610 - DNA, 20 bp, Artificial
  CRISPR gRNA sequence
cattgacacagaactctaaa

SEQ ID NO: 548611 - DNA, 20 bp, Artificial
  CRISPR gRNA sequence
attgacacagaactctaaat

SEQ ID NO: 548612 - DNA, 20 bp, Artificial
  CRISPR gRNA sequence
tgacacagaactctaaatgg

SEQ ID NO: 548613 - DNA, 20 bp, Artificial
  CRISPR gRNA sequence
cagaactctaaatgggagcc

SEQ ID NO: 548614 - DNA, 20 bp, Artificial
  CRISPR gRNA sequence
agaactctaaatgggagcct

SEQ ID NO: 548615 - DNA, 20 bp, Artificial
  CRISPR gRNA sequence
gaactctaaatgggagccta

SEQ ID NO: 548616 - DNA, 20 bp, Artificial
  CRISPR gRNA sequence
tctaaatgggagcctaggga

SEQ ID NO: 548617 - DNA, 20 bp, Artificial
  CRISPR gRNA sequence
ctaaatgggagcctagggaa

SEQ ID NO: 548618 - DNA, 20 bp, Artificial
  CRISPR gRNA sequence
taaatgggagcctagggaaa

SEQ ID NO: 548619 - DNA, 20 bp, Artificial
  CRISPR gRNA sequence
gggaaagggcacattttttg

SEQ ID NO: 548620 - DNA, 20 bp, Artificial
  CRISPR gRNA sequence
ggaaagggcacattttttga

SEQ ID NO: 548621 - DNA, 20 bp, Artificial
  CRISPR gRNA sequence
gaaagggcacattttttgaa

SEQ ID NO: 548622 - DNA, 20 bp, Artificial
  CRISPR gRNA sequence
aaagggcacattttttgaag

SEQ ID NO: 548623 - DNA, 20 bp, Artificial
  CRISPR gRNA sequence
gggcacattttttgaagggg

SEQ ID NO: 548624 - DNA, 20 bp, Artificial
  CRISPR gRNA sequence
ggcacattttttgaaggggt

SEQ ID NO: 548625 - DNA, 20 bp, Artificial
  CRISPR gRNA sequence
cattttttgaaggggtaggc

SEQ ID NO: 548626 - DNA, 20 bp, Artificial
  CRISPR gRNA sequence
ttttttgaaggggtaggcaa

SEQ ID NO: 548627 - DNA, 20 bp, Artificial
  CRISPR gRNA sequence
tttttgaaggggtaggcaag

SEQ ID NO: 548628 - DNA, 20 bp, Artificial
  CRISPR gRNA sequence
gtaggcaagaggatattctc

SEQ ID NO: 548629 - DNA, 20 bp, Artificial
  CRISPR gRNA sequence
aggcaagaggatattctcta

SEQ ID NO: 548630 - DNA, 20 bp, Artificial
  CRISPR gRNA sequence
gaggatattctctagagtac

SEQ ID NO: 548631 - DNA, 20 bp, Artificial
  CRISPR gRNA sequence
ccaactgttgtacacattta

SEQ ID NO: 548632 - DNA, 20 bp, Artificial
  CRISPR gRNA sequence
gttgtacacatttatggacc

SEQ ID NO: 548633 - DNA, 20 bp, Artificial
  CRISPR gRNA sequence
tttatggaccaagaacataa

SEQ ID NO: 548634 - DNA, 20 bp, Artificial
  CRISPR gRNA sequence
aacataaaagaaacattgtt

SEQ ID NO: 548635 - DNA, 20 bp, Artificial
  CRISPR gRNA sequence
cattgttcagttccgacctg

SEQ ID NO: 548636 - DNA, 20 bp, Artificial
  CRISPR gRNA sequence
agttccgacctgaagttatg

SEQ ID NO: 548637 - DNA, 20 bp, Artificial
  CRISPR gRNA sequence
tgtagaacaaacattgttct

SEQ ID NO: 548638 - DNA, 20 bp, Artificial
  CRISPR gRNA sequence
aacattgttctgagttcaac

SEQ ID NO: 548639 - DNA, 20 bp, Artificial
  CRISPR gRNA sequence
actagatgatctttctttca

SEQ ID NO: 548640 - DNA, 20 bp, Artificial
  CRISPR gRNA sequence
atctttctttcatagctgtg

SEQ ID NO: 548641 - DNA, 20 bp, Artificial
  CRISPR gRNA sequence
tgtggacattatgttacctg

SEQ ID NO: 548642 - DNA, 20 bp, Artificial
  CRISPR gRNA sequence
gtggacattatgttacctgc

SEQ ID NO: 548643 - DNA, 20 bp, Artificial
  CRISPR gRNA sequence
tggacattatgttacctgca

SEQ ID NO: 548644 - DNA, 20 bp, Artificial
  CRISPR gRNA sequence
gacattatgttacctgcagg

SEQ ID NO: 548645 - DNA, 20 bp, Artificial
  CRISPR gRNA sequence
ttatgttacctgcagggagt

SEQ ID NO: 548646 - DNA, 20 bp, Artificial
  CRISPR gRNA sequence
ctgcagggagtaagtcactg

SEQ ID NO: 548647 - DNA, 20 bp, Artificial
  CRISPR gRNA sequence
tgcagggagtaagtcactga

SEQ ID NO: 548648 - DNA, 20 bp, Artificial
  CRISPR gRNA sequence
agggagtaagtcactgaagg

SEQ ID NO: 548649 - DNA, 20 bp, Artificial
  CRISPR gRNA sequence
ggagtaagtcactgaaggta

SEQ ID NO: 548650 - DNA, 20 bp, Artificial
  CRISPR gRNA sequence
caccctttgatcttactcct

SEQ ID NO: 548651 - DNA, 20 bp, Artificial
  CRISPR gRNA sequence
tgatcttactcctaagaaaa

SEQ ID NO: 548652 - DNA, 20 bp, Artificial
  CRISPR gRNA sequence
atcttactcctaagaaaaaa

SEQ ID NO: 548653 - DNA, 20 bp, Artificial
  CRISPR gRNA sequence
cttactcctaagaaaaaaga

SEQ ID NO: 548654 - DNA, 20 bp, Artificial
  CRISPR gRNA sequence
ctaagaaaaaagagagaaat

SEQ ID NO: 548655 - DNA, 20 bp, Artificial
  CRISPR gRNA sequence
gaaattggaaaaattcatca

SEQ ID NO: 548656 - DNA, 20 bp, Artificial
  CRISPR gRNA sequence
catagaaacacaaaaatatg

SEQ ID NO: 548657 - DNA, 20 bp, Artificial
  CRISPR gRNA sequence
aacacaaaaatatgcggaaa

SEQ ID NO: 548658 - DNA, 20 bp, Artificial
  CRISPR gRNA sequence
acacaaaaatatgcggaaat

SEQ ID NO: 548659 - DNA, 20 bp, Artificial
  CRISPR gRNA sequence
aaatatgcggaaataggaaa

SEQ ID NO: 548660 - DNA, 20 bp, Artificial
  CRISPR gRNA sequence
aatatgcggaaataggaaaa

SEQ ID NO: 548661 - DNA, 20 bp, Artificial
  CRISPR gRNA sequence
tatgcggaaataggaaaaag

SEQ ID NO: 548662 - DNA, 20 bp, Artificial
  CRISPR gRNA sequence
gcggaaataggaaaaaggag

SEQ ID NO: 548663 - DNA, 20 bp, Artificial
  CRISPR gRNA sequence
gaaataggaaaaaggagaag

SEQ ID NO: 548664 - DNA, 20 bp, Artificial
  CRISPR gRNA sequence
aaataggaaaaaggagaaga

SEQ ID NO: 548665 - DNA, 20 bp, Artificial
  CRISPR gRNA sequence
aggaaaaaggagaagaagga

SEQ ID NO: 548666 - DNA, 20 bp, Artificial
  CRISPR gRNA sequence
agaaggaaagaaatgcaaca

SEQ ID NO: 548667 - DNA, 20 bp, Artificial
  CRISPR gRNA sequence
gaaggaaagaaatgcaacat

SEQ ID NO: 548668 - DNA, 20 bp, Artificial
  CRISPR gRNA sequence
acataggaaataatattatg

SEQ ID NO: 548669 - DNA, 20 bp, Artificial
  CRISPR gRNA sequence
gaaataatattatgtagact

SEQ ID NO: 548670 - DNA, 20 bp, Artificial
  CRISPR gRNA sequence
atattatgtagactgagata

SEQ ID NO: 548671 - DNA, 20 bp, Artificial
  CRISPR gRNA sequence
agactgagataaagaatgtt

SEQ ID NO: 548672 - DNA, 20 bp, Artificial
  CRISPR gRNA sequence
atgttaagaatatttgaaca

SEQ ID NO: 548673 - DNA, 20 bp, Artificial
  CRISPR gRNA sequence
tatttgaacaaagtttgaac

SEQ ID NO: 548674 - DNA, 20 bp, Artificial
  CRISPR gRNA sequence
ttgaaccagatgaaatgtaa

SEQ ID NO: 548675 - DNA, 20 bp, Artificial
  CRISPR gRNA sequence
tgaaccagatgaaatgtaac

SEQ ID NO: 548676 - DNA, 20 bp, Artificial
  CRISPR gRNA sequence
accagatgaaatgtaacagg

SEQ ID NO: 548677 - DNA, 20 bp, Artificial
  CRISPR gRNA sequence
tgaaatgtaacaggcagaaa

SEQ ID NO: 548678 - DNA, 20 bp, Artificial
  CRISPR gRNA sequence
aatgtaacaggcagaaacag

SEQ ID NO: 548679 - DNA, 20 bp, Artificial
  CRISPR gRNA sequence
gtaacaggcagaaacagaag

SEQ ID NO: 548680 - DNA, 20 bp, Artificial
  CRISPR gRNA sequence
taacaggcagaaacagaagt

SEQ ID NO: 548681 - DNA, 20 bp, Artificial
  CRISPR gRNA sequence
acaggcagaaacagaagtag

SEQ ID NO: 548682 - DNA, 20 bp, Artificial
  CRISPR gRNA sequence
caggcagaaacagaagtagg

SEQ ID NO: 548683 - DNA, 20 bp, Artificial
  CRISPR gRNA sequence
aacagaagtaggaggatttt

SEQ ID NO: 548684 - DNA, 20 bp, Artificial
  CRISPR gRNA sequence
gaggatttttggactgattt

SEQ ID NO: 548685 - DNA, 20 bp, Artificial
  CRISPR gRNA sequence
atttttggactgatttaagt

SEQ ID NO: 548686 - DNA, 20 bp, Artificial
  CRISPR gRNA sequence
tgacttttatgactttccac

SEQ ID NO: 548687 - DNA, 20 bp, Artificial
  CRISPR gRNA sequence
gacttttatgactttccact

SEQ ID NO: 548688 - DNA, 20 bp, Artificial
  CRISPR gRNA sequence
ttttatgactttccactggg

SEQ ID NO: 548689 - DNA, 20 bp, Artificial
  CRISPR gRNA sequence
tgactttccactgggaagaa

SEQ ID NO: 548690 - DNA, 20 bp, Artificial
  CRISPR gRNA sequence
cactgggaagaatagtgatt

SEQ ID NO: 548691 - DNA, 20 bp, Artificial
  CRISPR gRNA sequence
tcactctgcttttaaaaatt

SEQ ID NO: 548692 - DNA, 20 bp, Artificial
  CRISPR gRNA sequence
tctgcttttaaaaattgaga

SEQ ID NO: 548693 - DNA, 20 bp, Artificial
  CRISPR gRNA sequence
ttgagaaagaacgctgcgtg

SEQ ID NO: 548694 - DNA, 20 bp, Artificial
  CRISPR gRNA sequence
agaaagaacgctgcgtgcag

SEQ ID NO: 548695 - DNA, 20 bp, Artificial
  CRISPR gRNA sequence
ctataatcccaacactttgt

SEQ ID NO: 548696 - DNA, 20 bp, Artificial
  CRISPR gRNA sequence
tataatcccaacactttgtg

SEQ ID NO: 548697 - DNA, 20 bp, Artificial
  CRISPR gRNA sequence
tcccaacactttgtgaggcc

SEQ ID NO: 548698 - DNA, 20 bp, Artificial
  CRISPR gRNA sequence
aacactttgtgaggccaaga

SEQ ID NO: 548699 - DNA, 20 bp, Artificial
  CRISPR gRNA sequence
acactttgtgaggccaagac

SEQ ID NO: 548700 - DNA, 20 bp, Artificial
  CRISPR gRNA sequence
actttgtgaggccaagacgg

SEQ ID NO: 548701 - DNA, 20 bp, Artificial
  CRISPR gRNA sequence
ctttgtgaggccaagacggg

SEQ ID NO: 548702 - DNA, 20 bp, Artificial
  CRISPR gRNA sequence
ccaagacgggaggattgctt

SEQ ID NO: 548703 - DNA, 20 bp, Artificial
  CRISPR gRNA sequence
caagacgggaggattgcttg

SEQ ID NO: 548704 - DNA, 20 bp, Artificial
  CRISPR gRNA sequence
cgggaggattgcttgaggct

SEQ ID NO: 548705 - DNA, 20 bp, Artificial
  CRISPR gRNA sequence
ggaggattgcttgaggctga

SEQ ID NO: 548706 - DNA, 20 bp, Artificial
  CRISPR gRNA sequence
ttgcttgaggctgagagttc

SEQ ID NO: 548707 - DNA, 20 bp, Artificial
  CRISPR gRNA sequence
tgaggctgagagttcgagac

SEQ ID NO: 548708 - DNA, 20 bp, Artificial
  CRISPR gRNA sequence
ctgagagttcgagaccagcc

SEQ ID NO: 548709 - DNA, 20 bp, Artificial
  CRISPR gRNA sequence
tgagagttcgagaccagcct

SEQ ID NO: 548710 - DNA, 20 bp, Artificial
  CRISPR gRNA sequence
cgagaccagcctgggcaaca

SEQ ID NO: 548711 - DNA, 20 bp, Artificial
  CRISPR gRNA sequence
gagaccagcctgggcaacat

SEQ ID NO: 548712 - DNA, 20 bp, Artificial
  CRISPR gRNA sequence
agaccagcctgggcaacata

SEQ ID NO: 548713 - DNA, 20 bp, Artificial
  CRISPR gRNA sequence
accagcctgggcaacatagg

SEQ ID NO: 548714 - DNA, 20 bp, Artificial
  CRISPR gRNA sequence
tatctctactaaaaattaaa

SEQ ID NO: 548715 - DNA, 20 bp, Artificial
  CRISPR gRNA sequence
ctaaaaattaaaaagttact

SEQ ID NO: 548716 - DNA, 20 bp, Artificial
  CRISPR gRNA sequence
taaaaattaaaaagttactg

SEQ ID NO: 548717 - DNA, 20 bp, Artificial
  CRISPR gRNA sequence
aaaaagttactgaggtgttg

SEQ ID NO: 548718 - DNA, 20 bp, Artificial
  CRISPR gRNA sequence
ggtgttgtggcatgtgtctg

SEQ ID NO: 548719 - DNA, 20 bp, Artificial
  CRISPR gRNA sequence
gtggcatgtgtctgtagtcc

SEQ ID NO: 548720 - DNA, 20 bp, Artificial
  CRISPR gRNA sequence
tgtctgtagtcctagctact

SEQ ID NO: 548721 - DNA, 20 bp, Artificial
  CRISPR gRNA sequence
gtctgtagtcctagctactt

SEQ ID NO: 548722 - DNA, 20 bp, Artificial
  CRISPR gRNA sequence
ctgtagtcctagctacttgg

SEQ ID NO: 548723 - DNA, 20 bp, Artificial
  CRISPR gRNA sequence
tcctagctacttgggagact

SEQ ID NO: 548724 - DNA, 20 bp, Artificial
  CRISPR gRNA sequence
cctagctacttgggagactg

SEQ ID NO: 548725 - DNA, 20 bp, Artificial
  CRISPR gRNA sequence
agctacttgggagactgagg

SEQ ID NO: 548726 - DNA, 20 bp, Artificial
  CRISPR gRNA sequence
gctacttgggagactgaggt

SEQ ID NO: 548727 - DNA, 20 bp, Artificial
  CRISPR gRNA sequence
tacttgggagactgaggtgg

SEQ ID NO: 548728 - DNA, 20 bp, Artificial
  CRISPR gRNA sequence
acttgggagactgaggtggg

SEQ ID NO: 548729 - DNA, 20 bp, Artificial
  CRISPR gRNA sequence
ctgaggtgggaggatcactt

SEQ ID NO: 548730 - DNA, 20 bp, Artificial
  CRISPR gRNA sequence
gtgggaggatcacttcagcc

SEQ ID NO: 548731 - DNA, 20 bp, Artificial
  CRISPR gRNA sequence
ggaggatcacttcagcctgg

SEQ ID NO: 548732 - DNA, 20 bp, Artificial
  CRISPR gRNA sequence
gcctggcagtttaaataaat

SEQ ID NO: 548733 - DNA, 20 bp, Artificial
  CRISPR gRNA sequence
gcagtttaaataaatcagat

SEQ ID NO: 548734 - DNA, 20 bp, Artificial
  CRISPR gRNA sequence
taattaataatcttccaaaa

SEQ ID NO: 548735 - DNA, 20 bp, Artificial
  CRISPR gRNA sequence
taataatcttccaaaacaga

SEQ ID NO: 548736 - DNA, 20 bp, Artificial
  CRISPR gRNA sequence
tcttccaaaacagaaagcac

SEQ ID NO: 548737 - DNA, 20 bp, Artificial
  CRISPR gRNA sequence
cttccaaaacagaaagcacc

SEQ ID NO: 548738 - DNA, 20 bp, Artificial
  CRISPR gRNA sequence
aaaacagaaagcaccaggtt

SEQ ID NO: 548739 - DNA, 20 bp, Artificial
  CRISPR gRNA sequence
cagaaagcaccaggttcaga

SEQ ID NO: 548740 - DNA, 20 bp, Artificial
  CRISPR gRNA sequence
agaaagcaccaggttcagat

SEQ ID NO: 548741 - DNA, 20 bp, Artificial
  CRISPR gRNA sequence
ccaggttcagatgggttcat

SEQ ID NO: 548742 - DNA, 20 bp, Artificial
  CRISPR gRNA sequence
ggttcattggtgaattctac

SEQ ID NO: 548743 - DNA, 20 bp, Artificial
  CRISPR gRNA sequence
gtgaattctaccagatattt

SEQ ID NO: 548744 - DNA, 20 bp, Artificial
  CRISPR gRNA sequence
tgaattctaccagatattta

SEQ ID NO: 548745 - DNA, 20 bp, Artificial
  CRISPR gRNA sequence
attctaccagatatttaagg

SEQ ID NO: 548746 - DNA, 20 bp, Artificial
  CRISPR gRNA sequence
taattctctataatctcttt

SEQ ID NO: 548747 - DNA, 20 bp, Artificial
  CRISPR gRNA sequence
ttctctataatctcttttag

SEQ ID NO: 548748 - DNA, 20 bp, Artificial
  CRISPR gRNA sequence
ctataatctcttttagaaga

SEQ ID NO: 548749 - DNA, 20 bp, Artificial
  CRISPR gRNA sequence
taatctcttttagaagatag

SEQ ID NO: 548750 - DNA, 20 bp, Artificial
  CRISPR gRNA sequence
tctcttttagaagatagaag

SEQ ID NO: 548751 - DNA, 20 bp, Artificial
  CRISPR gRNA sequence
tcttttagaagatagaagca

SEQ ID NO: 548752 - DNA, 20 bp, Artificial
  CRISPR gRNA sequence
cttttagaagatagaagcag

SEQ ID NO: 548753 - DNA, 20 bp, Artificial
  CRISPR gRNA sequence
ttttagaagatagaagcaga

SEQ ID NO: 548754 - DNA, 20 bp, Artificial
  CRISPR gRNA sequence
tactttccaattcattttat

SEQ ID NO: 548755 - DNA, 20 bp, Artificial
  CRISPR gRNA sequence
actttccaattcattttatg

SEQ ID NO: 548756 - DNA, 20 bp, Artificial
  CRISPR gRNA sequence
tccaattcattttatgaggc

SEQ ID NO: 548757 - DNA, 20 bp, Artificial
  CRISPR gRNA sequence
ttattcttgtgctaaaacca

SEQ ID NO: 548758 - DNA, 20 bp, Artificial
  CRISPR gRNA sequence
ctaaaaccaaagaacaatac

SEQ ID NO: 548759 - DNA, 20 bp, Artificial
  CRISPR gRNA sequence
accaaagaacaatacaagaa

SEQ ID NO: 548760 - DNA, 20 bp, Artificial
  CRISPR gRNA sequence
caatacaagaaaagaaaatt

SEQ ID NO: 548761 - DNA, 20 bp, Artificial
  CRISPR gRNA sequence
atttctcatgaacatacatg

SEQ ID NO: 548762 - DNA, 20 bp, Artificial
  CRISPR gRNA sequence
agaaaccttaaacaaaatat

SEQ ID NO: 548763 - DNA, 20 bp, Artificial
  CRISPR gRNA sequence
taaacaaaatattagcaaat

SEQ ID NO: 548764 - DNA, 20 bp, Artificial
  CRISPR gRNA sequence
tattagcaaattggatccaa

SEQ ID NO: 548765 - DNA, 20 bp, Artificial
  CRISPR gRNA sequence
aaattggatccaacagcata

SEQ ID NO: 548766 - DNA, 20 bp, Artificial
  CRISPR gRNA sequence
tggatccaacagcatataga

SEQ ID NO: 548767 - DNA, 20 bp, Artificial
  CRISPR gRNA sequence
aagaattatacatcatgact

SEQ ID NO: 548768 - DNA, 20 bp, Artificial
  CRISPR gRNA sequence
aattatacatcatgactaag

SEQ ID NO: 548769 - DNA, 20 bp, Artificial
  CRISPR gRNA sequence
tgactaagtggtatttatct

SEQ ID NO: 548770 - DNA, 20 bp, Artificial
  CRISPR gRNA sequence
gactaagtggtatttatctc

SEQ ID NO: 548771 - DNA, 20 bp, Artificial
  CRISPR gRNA sequence
ggtatttatctcaggtgtgc

SEQ ID NO: 548772 - DNA, 20 bp, Artificial
  CRISPR gRNA sequence
gtatttatctcaggtgtgca

SEQ ID NO: 548773 - DNA, 20 bp, Artificial
  CRISPR gRNA sequence
tttatctcaggtgtgcaagg

SEQ ID NO: 548774 - DNA, 20 bp, Artificial
  CRISPR gRNA sequence
ttatctcaggtgtgcaaggc

SEQ ID NO: 548775 - DNA, 20 bp, Artificial
  CRISPR gRNA sequence
aatgtaatccatcacattga

SEQ ID NO: 548776 - DNA, 20 bp, Artificial
  CRISPR gRNA sequence
atcacattgacagactatga

SEQ ID NO: 548777 - DNA, 20 bp, Artificial
  CRISPR gRNA sequence
aaatcacatgatcataccaa

SEQ ID NO: 548778 - DNA, 20 bp, Artificial
  CRISPR gRNA sequence
catgatcataccaatagata

SEQ ID NO: 548779 - DNA, 20 bp, Artificial
  CRISPR gRNA sequence
cataccaatagatacagaaa

SEQ ID NO: 548780 - DNA, 20 bp, Artificial
  CRISPR gRNA sequence
caatttatgataaaaactct

SEQ ID NO: 548781 - DNA, 20 bp, Artificial
  CRISPR gRNA sequence
gataaaaactctcagtaaac

SEQ ID NO: 548782 - DNA, 20 bp, Artificial
  CRISPR gRNA sequence
ataaaaactctcagtaaact

SEQ ID NO: 548783 - DNA, 20 bp, Artificial
  CRISPR gRNA sequence
aactctcagtaaactaggaa

SEQ ID NO: 548784 - DNA, 20 bp, Artificial
  CRISPR gRNA sequence
ctctcagtaaactaggaata

SEQ ID NO: 548785 - DNA, 20 bp, Artificial
  CRISPR gRNA sequence
tctcagtaaactaggaatag

SEQ ID NO: 548786 - DNA, 20 bp, Artificial
  CRISPR gRNA sequence
ctcagtaaactaggaataga

SEQ ID NO: 548787 - DNA, 20 bp, Artificial
  CRISPR gRNA sequence
tcagtaaactaggaatagag

SEQ ID NO: 548788 - DNA, 20 bp, Artificial
  CRISPR gRNA sequence
aatgcctacaaaaaaccctg

SEQ ID NO: 548789 - DNA, 20 bp, Artificial
  CRISPR gRNA sequence
gcagctaacatcatctgtaa

SEQ ID NO: 548790 - DNA, 20 bp, Artificial
  CRISPR gRNA sequence
ctaacatcatctgtaatggt

SEQ ID NO: 548791 - DNA, 20 bp, Artificial
  CRISPR gRNA sequence
ctgtaatggtgagaaacttg

SEQ ID NO: 548792 - DNA, 20 bp, Artificial
  CRISPR gRNA sequence
aaacttgaagctttccaact

SEQ ID NO: 548793 - DNA, 20 bp, Artificial
  CRISPR gRNA sequence
gaagctttccaactaagacc

SEQ ID NO: 548794 - DNA, 20 bp, Artificial
  CRISPR gRNA sequence
ttccaactaagaccaagaat

SEQ ID NO: 548795 - DNA, 20 bp, Artificial
  CRISPR gRNA sequence
tccaactaagaccaagaata

SEQ ID NO: 548796 - DNA, 20 bp, Artificial
  CRISPR gRNA sequence
ttcttctcaccactcctttt

SEQ ID NO: 548797 - DNA, 20 bp, Artificial
  CRISPR gRNA sequence
ccttttcagtattgtactat

SEQ ID NO: 548798 - DNA, 20 bp, Artificial
  CRISPR gRNA sequence
taagcactaactaatgccat

SEQ ID NO: 548799 - DNA, 20 bp, Artificial
  CRISPR gRNA sequence
actaactaatgccataagac

SEQ ID NO: 548800 - DNA, 20 bp, Artificial
  CRISPR gRNA sequence
ctaatgccataagacaagaa

SEQ ID NO: 548801 - DNA, 20 bp, Artificial
  CRISPR gRNA sequence
taatgccataagacaagaaa

SEQ ID NO: 548802 - DNA, 20 bp, Artificial
  CRISPR gRNA sequence
aagacaagaaaaggaaataa

SEQ ID NO: 548803 - DNA, 20 bp, Artificial
  CRISPR gRNA sequence
aaaaggaaataaaagttata

SEQ ID NO: 548804 - DNA, 20 bp, Artificial
  CRISPR gRNA sequence
gaaataaaagttatacagat

SEQ ID NO: 548805 - DNA, 20 bp, Artificial
  CRISPR gRNA sequence
ataaaagttatacagatgag

SEQ ID NO: 548806 - DNA, 20 bp, Artificial
  CRISPR gRNA sequence
aagttatacagatgagaaga

SEQ ID NO: 548807 - DNA, 20 bp, Artificial
  CRISPR gRNA sequence
tatacagatgagaagaaaga

SEQ ID NO: 548808 - DNA, 20 bp, Artificial
  CRISPR gRNA sequence
agaaagaaagaaaattgttt

SEQ ID NO: 548809 - DNA, 20 bp, Artificial
  CRISPR gRNA sequence
aagaaaattgttttagttct

SEQ ID NO: 548810 - DNA, 20 bp, Artificial
  CRISPR gRNA sequence
cgaattgaccaaaaacctcc

SEQ ID NO: 548811 - DNA, 20 bp, Artificial
  CRISPR gRNA sequence
ctggaactaataaaaaacta

SEQ ID NO: 548812 - DNA, 20 bp, Artificial
  CRISPR gRNA sequence
aaaaaactatagcacatttg

SEQ ID NO: 548813 - DNA, 20 bp, Artificial
  CRISPR gRNA sequence
aaaaactatagcacatttgt

SEQ ID NO: 548814 - DNA, 20 bp, Artificial
  CRISPR gRNA sequence
tagcacatttgtaggataca

SEQ ID NO: 548815 - DNA, 20 bp, Artificial
  CRISPR gRNA sequence
gatacaaagttaatatacaa

SEQ ID NO: 548816 - DNA, 20 bp, Artificial
  CRISPR gRNA sequence
agtcaatcacttttctataa

SEQ ID NO: 548817 - DNA, 20 bp, Artificial
  CRISPR gRNA sequence
tttctataacagcaatgaac

SEQ ID NO: 548818 - DNA, 20 bp, Artificial
  CRISPR gRNA sequence
ctataacagcaatgaacaag

SEQ ID NO: 548819 - DNA, 20 bp, Artificial
  CRISPR gRNA sequence
caatgaacaagtggaatttg

SEQ ID NO: 548820 - DNA, 20 bp, Artificial
  CRISPR gRNA sequence
aaacacaacaccatttacct

SEQ ID NO: 548821 - DNA, 20 bp, Artificial
  CRISPR gRNA sequence
caccccaaaaatgcaatact

SEQ ID NO: 548822 - DNA, 20 bp, Artificial
  CRISPR gRNA sequence
accccaaaaatgcaatactt

SEQ ID NO: 548823 - DNA, 20 bp, Artificial
  CRISPR gRNA sequence
tacaataacaaaatatgtcc

SEQ ID NO: 548824 - DNA, 20 bp, Artificial
  CRISPR gRNA sequence
aatatgtcccagatttatat

SEQ ID NO: 548825 - DNA, 20 bp, Artificial
  CRISPR gRNA sequence
aaaactgatgaacaaaatca

SEQ ID NO: 548826 - DNA, 20 bp, Artificial
  CRISPR gRNA sequence
actgatgaacaaaatcaaag

SEQ ID NO: 548827 - DNA, 20 bp, Artificial
  CRISPR gRNA sequence
tcaaagaagaactaaataaa

SEQ ID NO: 548828 - DNA, 20 bp, Artificial
  CRISPR gRNA sequence
aaagaagaactaaataaatg

SEQ ID NO: 548829 - DNA, 20 bp, Artificial
  CRISPR gRNA sequence
agaagaactaaataaatgga

SEQ ID NO: 548830 - DNA, 20 bp, Artificial
  CRISPR gRNA sequence
ggagagatattctatgttca

SEQ ID NO: 548831 - DNA, 20 bp, Artificial
  CRISPR gRNA sequence
agatattctatgttcataga

SEQ ID NO: 548832 - DNA, 20 bp, Artificial
  CRISPR gRNA sequence
gatattctatgttcatagat

SEQ ID NO: 548833 - DNA, 20 bp, Artificial
  CRISPR gRNA sequence
attctatgttcatagatagg

SEQ ID NO: 548834 - DNA, 20 bp, Artificial
  CRISPR gRNA sequence
taggaagactccttattgtg

SEQ ID NO: 548835 - DNA, 20 bp, Artificial
  CRISPR gRNA sequence
actccttattgtgaagatgt

SEQ ID NO: 548836 - DNA, 20 bp, Artificial
  CRISPR gRNA sequence
tccaatttactctataaatt

SEQ ID NO: 548837 - DNA, 20 bp, Artificial
  CRISPR gRNA sequence
tataaattcagtgcaatccc

SEQ ID NO: 548838 - DNA, 20 bp, Artificial
  CRISPR gRNA sequence
tgcaatcccaagcaaaatat

SEQ ID NO: 548839 - DNA, 20 bp, Artificial
  CRISPR gRNA sequence
aatcccaagcaaaatatcag

SEQ ID NO: 548840 - DNA, 20 bp, Artificial
  CRISPR gRNA sequence
aaaatatcagaagtcatttg

SEQ ID NO: 548841 - DNA, 20 bp, Artificial
  CRISPR gRNA sequence
cagaagtcatttgtggatat

SEQ ID NO: 548842 - DNA, 20 bp, Artificial
  CRISPR gRNA sequence
gatatcagcaaactgatttt

SEQ ID NO: 548843 - DNA, 20 bp, Artificial
  CRISPR gRNA sequence
atatcagcaaactgatttta

SEQ ID NO: 548844 - DNA, 20 bp, Artificial
  CRISPR gRNA sequence
aaactgattttaaggttaaa

SEQ ID NO: 548845 - DNA, 20 bp, Artificial
  CRISPR gRNA sequence
aactgattttaaggttaaat

SEQ ID NO: 548846 - DNA, 20 bp, Artificial
  CRISPR gRNA sequence
tgattttaaggttaaatggg

SEQ ID NO: 548847 - DNA, 20 bp, Artificial
  CRISPR gRNA sequence
gattttaaggttaaatgggc

SEQ ID NO: 548848 - DNA, 20 bp, Artificial
  CRISPR gRNA sequence
aaggttaaatgggcaggcaa

SEQ ID NO: 548849 - DNA, 20 bp, Artificial
  CRISPR gRNA sequence
taaatgggcaggcaaaagac

SEQ ID NO: 548850 - DNA, 20 bp, Artificial
  CRISPR gRNA sequence
gggcaggcaaaagaccagaa

SEQ ID NO: 548851 - DNA, 20 bp, Artificial
  CRISPR gRNA sequence
aggcaaaagaccagaatagc

SEQ ID NO: 548852 - DNA, 20 bp, Artificial
  CRISPR gRNA sequence
gaatagccagcaaaatattg

SEQ ID NO: 548853 - DNA, 20 bp, Artificial
  CRISPR gRNA sequence
aatagccagcaaaatattga

SEQ ID NO: 548854 - DNA, 20 bp, Artificial
  CRISPR gRNA sequence
tagccagcaaaatattgaag

SEQ ID NO: 548855 - DNA, 20 bp, Artificial
  CRISPR gRNA sequence
attgaaggagaacaaaattg

SEQ ID NO: 548856 - DNA, 20 bp, Artificial
  CRISPR gRNA sequence
ttgaaggagaacaaaattgt

SEQ ID NO: 548857 - DNA, 20 bp, Artificial
  CRISPR gRNA sequence
gactgatactactcaacttc

SEQ ID NO: 548858 - DNA, 20 bp, Artificial
  CRISPR gRNA sequence
caacttcaagacttactata

SEQ ID NO: 548859 - DNA, 20 bp, Artificial
  CRISPR gRNA sequence
caagacttactataaagcta

SEQ ID NO: 548860 - DNA, 20 bp, Artificial
  CRISPR gRNA sequence
gacttactataaagctacag

SEQ ID NO: 548861 - DNA, 20 bp, Artificial
  CRISPR gRNA sequence
taaagctacagtagtcaaca

SEQ ID NO: 548862 - DNA, 20 bp, Artificial
  CRISPR gRNA sequence
ctacagtagtcaacatagtg

SEQ ID NO: 548863 - DNA, 20 bp, Artificial
  CRISPR gRNA sequence
tagtcaacatagtgtggtac

SEQ ID NO: 548864 - DNA, 20 bp, Artificial
  CRISPR gRNA sequence
tcaacatagtgtggtactgg

SEQ ID NO: 548865 - DNA, 20 bp, Artificial
  CRISPR gRNA sequence
tggtactggtggaaaaataa

SEQ ID NO: 548866 - DNA, 20 bp, Artificial
  CRISPR gRNA sequence
gtggaaaaataaaagacaaa

SEQ ID NO: 548867 - DNA, 20 bp, Artificial
  CRISPR gRNA sequence
aaaataaaagacaaatagat

SEQ ID NO: 548868 - DNA, 20 bp, Artificial
  CRISPR gRNA sequence
agacaaatagatcagtgaat

SEQ ID NO: 548869 - DNA, 20 bp, Artificial
  CRISPR gRNA sequence
aatagatcagtgaatcggaa

SEQ ID NO: 548870 - DNA, 20 bp, Artificial
  CRISPR gRNA sequence
tagatcagtgaatcggaata

SEQ ID NO: 548871 - DNA, 20 bp, Artificial
  CRISPR gRNA sequence
gatcagtgaatcggaataga

SEQ ID NO: 548872 - DNA, 20 bp, Artificial
  CRISPR gRNA sequence
gtgaatcggaatagagagcc

SEQ ID NO: 548873 - DNA, 20 bp, Artificial
  CRISPR gRNA sequence
gaaataaaccaacataaata

SEQ ID NO: 548874 - DNA, 20 bp, Artificial
  CRISPR gRNA sequence
tggtcaactgatctttgaca

SEQ ID NO: 548875 - DNA, 20 bp, Artificial
  CRISPR gRNA sequence
ggtcaactgatctttgacaa

SEQ ID NO: 548876 - DNA, 20 bp, Artificial
  CRISPR gRNA sequence
tcaactgatctttgacaaag

SEQ ID NO: 548877 - DNA, 20 bp, Artificial
  CRISPR gRNA sequence
tgatctttgacaaaggagca

SEQ ID NO: 548878 - DNA, 20 bp, Artificial
  CRISPR gRNA sequence
gatctttgacaaaggagcaa

SEQ ID NO: 548879 - DNA, 20 bp, Artificial
  CRISPR gRNA sequence
aaggagcaaaggcaatacaa

SEQ ID NO: 548880 - DNA, 20 bp, Artificial
  CRISPR gRNA sequence
ggagcaaaggcaatacaatg

SEQ ID NO: 548881 - DNA, 20 bp, Artificial
  CRISPR gRNA sequence
aaaggcaatacaatggagca

SEQ ID NO: 548882 - DNA, 20 bp, Artificial
  CRISPR gRNA sequence
aagatgatcttttcaacaaa

SEQ ID NO: 548883 - DNA, 20 bp, Artificial
  CRISPR gRNA sequence
acaaatagtgctgtaacaac

SEQ ID NO: 548884 - DNA, 20 bp, Artificial
  CRISPR gRNA sequence
caaaaaaatgaatctaaaca

SEQ ID NO: 548885 - DNA, 20 bp, Artificial
  CRISPR gRNA sequence
tcacaaaattttactcaaaa

SEQ ID NO: 548886 - DNA, 20 bp, Artificial
  CRISPR gRNA sequence
attttactcaaaatggacca

SEQ ID NO: 548887 - DNA, 20 bp, Artificial
  CRISPR gRNA sequence
aatgtaaaatgcaaaaccat

SEQ ID NO: 548888 - DNA, 20 bp, Artificial
  CRISPR gRNA sequence
ccataagactcctaaaacat

SEQ ID NO: 548889 - DNA, 20 bp, Artificial
  CRISPR gRNA sequence
ataagactcctaaaacataa

SEQ ID NO: 548890 - DNA, 20 bp, Artificial
  CRISPR gRNA sequence
ctaaaacataagagaaaacc

SEQ ID NO: 548891 - DNA, 20 bp, Artificial
  CRISPR gRNA sequence
agagaaaacctagataactt

SEQ ID NO: 548892 - DNA, 20 bp, Artificial
  CRISPR gRNA sequence
ctttggatatgatgactttt

SEQ ID NO: 548893 - DNA, 20 bp, Artificial
  CRISPR gRNA sequence
actttttagatacaacacca

SEQ ID NO: 548894 - DNA, 20 bp, Artificial
  CRISPR gRNA sequence
accaaagacatgattcatga

SEQ ID NO: 548895 - DNA, 20 bp, Artificial
  CRISPR gRNA sequence
aagacatgattcatgaaaga

SEQ ID NO: 548896 - DNA, 20 bp, Artificial
  CRISPR gRNA sequence
tgattcatgaaagaaagaat

SEQ ID NO: 548897 - DNA, 20 bp, Artificial
  CRISPR gRNA sequence
tcatgaaagaaagaattggt

SEQ ID NO: 548898 - DNA, 20 bp, Artificial
  CRISPR gRNA sequence
ttaaaaacattgctctatga

SEQ ID NO: 548899 - DNA, 20 bp, Artificial
  CRISPR gRNA sequence
gctctatgaaagacaatttc

SEQ ID NO: 548900 - DNA, 20 bp, Artificial
  CRISPR gRNA sequence
tctatgaaagacaatttcaa

SEQ ID NO: 548901 - DNA, 20 bp, Artificial
  CRISPR gRNA sequence
aaagacaatttcaagagaat

SEQ ID NO: 548902 - DNA, 20 bp, Artificial
  CRISPR gRNA sequence
gacaatttcaagagaatgag

SEQ ID NO: 548903 - DNA, 20 bp, Artificial
  CRISPR gRNA sequence
tttcaagagaatgagaagcc

SEQ ID NO: 548904 - DNA, 20 bp, Artificial
  CRISPR gRNA sequence
gagaatgagaagccaagcca

SEQ ID NO: 548905 - DNA, 20 bp, Artificial
  CRISPR gRNA sequence
tgagaagccaagccacagac

SEQ ID NO: 548906 - DNA, 20 bp, Artificial
  CRISPR gRNA sequence
gagaagccaagccacagact

SEQ ID NO: 548907 - DNA, 20 bp, Artificial
  CRISPR gRNA sequence
gaagccaagccacagactgg

SEQ ID NO: 548908 - DNA, 20 bp, Artificial
  CRISPR gRNA sequence
ctgggagaaaatatttgcaa

SEQ ID NO: 548909 - DNA, 20 bp, Artificial
  CRISPR gRNA sequence
gcaaaagacacatctgataa

SEQ ID NO: 548910 - DNA, 20 bp, Artificial
  CRISPR gRNA sequence
aaaaacttttaaaactcaac

SEQ ID NO: 548911 - DNA, 20 bp, Artificial
  CRISPR gRNA sequence
aaacaacccaattaaaaaat

SEQ ID NO: 548912 - DNA, 20 bp, Artificial
  CRISPR gRNA sequence
cccaattaaaaaatgagtca

SEQ ID NO: 548913 - DNA, 20 bp, Artificial
  CRISPR gRNA sequence
atctcatcacacacttctcc

SEQ ID NO: 548914 - DNA, 20 bp, Artificial
  CRISPR gRNA sequence
tctcatcacacacttctcca

SEQ ID NO: 548915 - DNA, 20 bp, Artificial
  CRISPR gRNA sequence
catcacacacttctccaagg

SEQ ID NO: 548916 - DNA, 20 bp, Artificial
  CRISPR gRNA sequence
atcacacacttctccaagga

SEQ ID NO: 548917 - DNA, 20 bp, Artificial
  CRISPR gRNA sequence
acttctccaaggaaggtata

SEQ ID NO: 548918 - DNA, 20 bp, Artificial
  CRISPR gRNA sequence
ctccaaggaaggtatacaga

SEQ ID NO: 548919 - DNA, 20 bp, Artificial
  CRISPR gRNA sequence
gaaggtatacagatggcaaa

SEQ ID NO: 548920 - DNA, 20 bp, Artificial
  CRISPR gRNA sequence
aaggtatacagatggcaaat

SEQ ID NO: 548921 - DNA, 20 bp, Artificial
  CRISPR gRNA sequence
aggtatacagatggcaaata

SEQ ID NO: 548922 - DNA, 20 bp, Artificial
  CRISPR gRNA sequence
atggcaaatagggatataaa

SEQ ID NO: 548923 - DNA, 20 bp, Artificial
  CRISPR gRNA sequence
gggatataaaaagatactcc

SEQ ID NO: 548924 - DNA, 20 bp, Artificial
  CRISPR gRNA sequence
ggatataaaaagatactcct

SEQ ID NO: 548925 - DNA, 20 bp, Artificial
  CRISPR gRNA sequence
ataaaaagatactcctgggc

SEQ ID NO: 548926 - DNA, 20 bp, Artificial
  CRISPR gRNA sequence
taaaaagatactcctgggcc

SEQ ID NO: 548927 - DNA, 20 bp, Artificial
  CRISPR gRNA sequence
agatactcctgggccgggtg

SEQ ID NO: 548928 - DNA, 20 bp, Artificial
  CRISPR gRNA sequence
tactcctgggccgggtgcgg

SEQ ID NO: 548929 - DNA, 20 bp, Artificial
  CRISPR gRNA sequence
gtggctcacacctgtaatcc

SEQ ID NO: 548930 - DNA, 20 bp, Artificial
  CRISPR gRNA sequence
cacctgtaatcccagcactt

SEQ ID NO: 548931 - DNA, 20 bp, Artificial
  CRISPR gRNA sequence
acctgtaatcccagcacttt

SEQ ID NO: 548932 - DNA, 20 bp, Artificial
  CRISPR gRNA sequence
ctgtaatcccagcactttgg

SEQ ID NO: 548933 - DNA, 20 bp, Artificial
  CRISPR gRNA sequence
tgtaatcccagcactttggg

SEQ ID NO: 548934 - DNA, 20 bp, Artificial
  CRISPR gRNA sequence
tcccagcactttgggaggcc

SEQ ID NO: 548935 - DNA, 20 bp, Artificial
  CRISPR gRNA sequence
cccagcactttgggaggccg

SEQ ID NO: 548936 - DNA, 20 bp, Artificial
  CRISPR gRNA sequence
agcactttgggaggccgagg

SEQ ID NO: 548937 - DNA, 20 bp, Artificial
  CRISPR gRNA sequence
gcactttgggaggccgaggc

SEQ ID NO: 548938 - DNA, 20 bp, Artificial
  CRISPR gRNA sequence
ctttgggaggccgaggcagg

SEQ ID NO: 548939 - DNA, 20 bp, Artificial
  CRISPR gRNA sequence
ccgaggcaggcggatcacct

SEQ ID NO: 548940 - DNA, 20 bp, Artificial
  CRISPR gRNA sequence
cgaggcaggcggatcacctg

SEQ ID NO: 548941 - DNA, 20 bp, Artificial
  CRISPR gRNA sequence
gcaggcggatcacctgaggt

SEQ ID NO: 548942 - DNA, 20 bp, Artificial
  CRISPR gRNA sequence
caggcggatcacctgaggtc

SEQ ID NO: 548943 - DNA, 20 bp, Artificial
  CRISPR gRNA sequence
ggcggatcacctgaggtcag

SEQ ID NO: 548944 - DNA, 20 bp, Artificial
  CRISPR gRNA sequence
tcacctgaggtcaggagttc

SEQ ID NO: 548945 - DNA, 20 bp, Artificial
  CRISPR gRNA sequence
tgaggtcaggagttcaagac

SEQ ID NO: 548946 - DNA, 20 bp, Artificial
  CRISPR gRNA sequence
tcaggagttcaagaccagcc

SEQ ID NO: 548947 - DNA, 20 bp, Artificial
  CRISPR gRNA sequence
caagaccagcctggccaaca

SEQ ID NO: 548948 - DNA, 20 bp, Artificial
  CRISPR gRNA sequence
aagaccagcctggccaacat

SEQ ID NO: 548949 - DNA, 20 bp, Artificial
  CRISPR gRNA sequence
agaccagcctggccaacatg

SEQ ID NO: 548950 - DNA, 20 bp, Artificial
  CRISPR gRNA sequence
ttttgtaaaaatacaaaaat

SEQ ID NO: 548951 - DNA, 20 bp, Artificial
  CRISPR gRNA sequence
gtaaaaatacaaaaattagc

SEQ ID NO: 548952 - DNA, 20 bp, Artificial
  CRISPR gRNA sequence
taaaaatacaaaaattagct

SEQ ID NO: 548953 - DNA, 20 bp, Artificial
  CRISPR gRNA sequence
ctaggcatgtcctatgtcaa

SEQ ID NO: 548954 - DNA, 20 bp, Artificial
  CRISPR gRNA sequence
taggcatgtcctatgtcaac

SEQ ID NO: 548955 - DNA, 20 bp, Artificial
  CRISPR gRNA sequence
tgtcctatgtcaacaggcaa

SEQ ID NO: 548956 - DNA, 20 bp, Artificial
  CRISPR gRNA sequence
gtcctatgtcaacaggcaac

SEQ ID NO: 548957 - DNA, 20 bp, Artificial
  CRISPR gRNA sequence
tcctatgtcaacaggcaaca

SEQ ID NO: 548958 - DNA, 20 bp, Artificial
  CRISPR gRNA sequence
gtcaacaggcaacagggaaa

SEQ ID NO: 548959 - DNA, 20 bp, Artificial
  CRISPR gRNA sequence
gcaacagggaaatggaaact

SEQ ID NO: 548960 - DNA, 20 bp, Artificial
  CRISPR gRNA sequence
ccacttcacgcctatcacac

SEQ ID NO: 548961 - DNA, 20 bp, Artificial
  CRISPR gRNA sequence
ctatcacactggccaaaatc

SEQ ID NO: 548962 - DNA, 20 bp, Artificial
  CRISPR gRNA sequence
gccaaaatctagaacactga

SEQ ID NO: 548963 - DNA, 20 bp, Artificial
  CRISPR gRNA sequence
acactgacagcaccaaatgc

SEQ ID NO: 548964 - DNA, 20 bp, Artificial
  CRISPR gRNA sequence
tgacagcaccaaatgccagt

SEQ ID NO: 548965 - DNA, 20 bp, Artificial
  CRISPR gRNA sequence
gacagcaccaaatgccagtg

SEQ ID NO: 548966 - DNA, 20 bp, Artificial
  CRISPR gRNA sequence
accaaatgccagtgaggatg

SEQ ID NO: 548967 - DNA, 20 bp, Artificial
  CRISPR gRNA sequence
caaatgccagtgaggatgtg

SEQ ID NO: 548968 - DNA, 20 bp, Artificial
  CRISPR gRNA sequence
ggagcaactctcattcattg

SEQ ID NO: 548969 - DNA, 20 bp, Artificial
  CRISPR gRNA sequence
gagcaactctcattcattgc

SEQ ID NO: 548970 - DNA, 20 bp, Artificial
  CRISPR gRNA sequence
caactctcattcattgcagg

SEQ ID NO: 548971 - DNA, 20 bp, Artificial
  CRISPR gRNA sequence
aactctcattcattgcaggt

SEQ ID NO: 548972 - DNA, 20 bp, Artificial
  CRISPR gRNA sequence
ttgcaggtgggaatgcaaaa

SEQ ID NO: 548973 - DNA, 20 bp, Artificial
  CRISPR gRNA sequence
ggtgggaatgcaaaatggta

SEQ ID NO: 548974 - DNA, 20 bp, Artificial
  CRISPR gRNA sequence
gcaaaatggtacagccactt

SEQ ID NO: 548975 - DNA, 20 bp, Artificial
  CRISPR gRNA sequence
aaatggtacagccactttgg

SEQ ID NO: 548976 - DNA, 20 bp, Artificial
  CRISPR gRNA sequence
ggtacagccactttggaaga

SEQ ID NO: 548977 - DNA, 20 bp, Artificial
  CRISPR gRNA sequence
agccactttggaagacagtt

SEQ ID NO: 548978 - DNA, 20 bp, Artificial
  CRISPR gRNA sequence
cactttggaagacagtttgg

SEQ ID NO: 548979 - DNA, 20 bp, Artificial
  CRISPR gRNA sequence
tgcttcttgctatttacccg

SEQ ID NO: 548980 - DNA, 20 bp, Artificial
  CRISPR gRNA sequence
gcttcttgctatttacccga

SEQ ID NO: 548981 - DNA, 20 bp, Artificial
  CRISPR gRNA sequence
ttgacataaaaaccttcaca

SEQ ID NO: 548982 - DNA, 20 bp, Artificial
  CRISPR gRNA sequence
cataaaaaccttcacatgga

SEQ ID NO: 548983 - DNA, 20 bp, Artificial
  CRISPR gRNA sequence
aaccttcacatggatggtta

SEQ ID NO: 548984 - DNA, 20 bp, Artificial
  CRISPR gRNA sequence
tattaataattgtcaaaact

SEQ ID NO: 548985 - DNA, 20 bp, Artificial
  CRISPR gRNA sequence
taataattgtcaaaacttgg

SEQ ID NO: 548986 - DNA, 20 bp, Artificial
  CRISPR gRNA sequence
gtcaaaacttggaagcaacc

SEQ ID NO: 548987 - DNA, 20 bp, Artificial
  CRISPR gRNA sequence
gaagcaaccaagatgtcctt

SEQ ID NO: 548988 - DNA, 20 bp, Artificial
  CRISPR gRNA sequence
caaccaagatgtccttcagt

SEQ ID NO: 548989 - DNA, 20 bp, Artificial
  CRISPR gRNA sequence
gatgtccttcagtaagtgaa

SEQ ID NO: 548990 - DNA, 20 bp, Artificial
  CRISPR gRNA sequence
gtgaatggacaaataaactg

SEQ ID NO: 548991 - DNA, 20 bp, Artificial
  CRISPR gRNA sequence
caaataaactgtggtacata

SEQ ID NO: 548992 - DNA, 20 bp, Artificial
  CRISPR gRNA sequence
actgtggtacatacagacaa

SEQ ID NO: 548993 - DNA, 20 bp, Artificial
  CRISPR gRNA sequence
acagacaatagaatattatt

SEQ ID NO: 548994 - DNA, 20 bp, Artificial
  CRISPR gRNA sequence
gaatattattcagcactgaa

SEQ ID NO: 548995 - DNA, 20 bp, Artificial
  CRISPR gRNA sequence
cagcactgaaaagaactatc

SEQ ID NO: 548996 - DNA, 20 bp, Artificial
  CRISPR gRNA sequence
aagaactatcaagccatgaa

SEQ ID NO: 548997 - DNA, 20 bp, Artificial
  CRISPR gRNA sequence
tatcaagccatgaaaagaca

SEQ ID NO: 548998 - DNA, 20 bp, Artificial
  CRISPR gRNA sequence
tcaagccatgaaaagacatg

SEQ ID NO: 548999 - DNA, 20 bp, Artificial
  CRISPR gRNA sequence
caagccatgaaaagacatgg

SEQ ID NO: 549000 - DNA, 20 bp, Artificial
  CRISPR gRNA sequence
gaaacttaaatgcatattat

SEQ ID NO: 549001 - DNA, 20 bp, Artificial
  CRISPR gRNA sequence
taaatgcatattataagtca

SEQ ID NO: 549002 - DNA, 20 bp, Artificial
  CRISPR gRNA sequence
gtcaaagaatccaatctgaa

SEQ ID NO: 549003 - DNA, 20 bp, Artificial
  CRISPR gRNA sequence
tcaaagaatccaatctgaac

SEQ ID NO: 549004 - DNA, 20 bp, Artificial
  CRISPR gRNA sequence
attttacctatgtgacattc

SEQ ID NO: 549005 - DNA, 20 bp, Artificial
  CRISPR gRNA sequence
acctatgtgacattctggaa

SEQ ID NO: 549006 - DNA, 20 bp, Artificial
  CRISPR gRNA sequence
cctatgtgacattctggaaa

SEQ ID NO: 549007 - DNA, 20 bp, Artificial
  CRISPR gRNA sequence
ttctggaaaaggcaaaactg

SEQ ID NO: 549008 - DNA, 20 bp, Artificial
  CRISPR gRNA sequence
ctggaaaaggcaaaactgtg

SEQ ID NO: 549009 - DNA, 20 bp, Artificial
  CRISPR gRNA sequence
aaaactgtggagactgtaaa

SEQ ID NO: 549010 - DNA, 20 bp, Artificial
  CRISPR gRNA sequence
tgtggagactgtaaaaagat

SEQ ID NO: 549011 - DNA, 20 bp, Artificial
  CRISPR gRNA sequence
ggagactgtaaaaagattag

SEQ ID NO: 549012 - DNA, 20 bp, Artificial
  CRISPR gRNA sequence
actgtaaaaagattagtagt

SEQ ID NO: 549013 - DNA, 20 bp, Artificial
  CRISPR gRNA sequence
gtaaaaagattagtagttgg

SEQ ID NO: 549014 - DNA, 20 bp, Artificial
  CRISPR gRNA sequence
taaaaagattagtagttggc

SEQ ID NO: 549015 - DNA, 20 bp, Artificial
  CRISPR gRNA sequence
aaaaagattagtagttggca

SEQ ID NO: 549016 - DNA, 20 bp, Artificial
  CRISPR gRNA sequence
aaaagattagtagttggcag

SEQ ID NO: 549017 - DNA, 20 bp, Artificial
  CRISPR gRNA sequence
tagttggcaggggatatgaa

SEQ ID NO: 549018 - DNA, 20 bp, Artificial
  CRISPR gRNA sequence
agttggcaggggatatgaat

SEQ ID NO: 549019 - DNA, 20 bp, Artificial
  CRISPR gRNA sequence
tggcaggggatatgaatagg

SEQ ID NO: 549020 - DNA, 20 bp, Artificial
  CRISPR gRNA sequence
ggatatgaataggtggaaca

SEQ ID NO: 549021 - DNA, 20 bp, Artificial
  CRISPR gRNA sequence
atatgaataggtggaacaca

SEQ ID NO: 549022 - DNA, 20 bp, Artificial
  CRISPR gRNA sequence
tatgaataggtggaacacag

SEQ ID NO: 549023 - DNA, 20 bp, Artificial
  CRISPR gRNA sequence
tgaataggtggaacacagag

SEQ ID NO: 549024 - DNA, 20 bp, Artificial
  CRISPR gRNA sequence
aggtggaacacagaggagtt

SEQ ID NO: 549025 - DNA, 20 bp, Artificial
  CRISPR gRNA sequence
ggtggaacacagaggagttt

SEQ ID NO: 549026 - DNA, 20 bp, Artificial
  CRISPR gRNA sequence
gtggaacacagaggagtttg

SEQ ID NO: 549027 - DNA, 20 bp, Artificial
  CRISPR gRNA sequence
tggaacacagaggagtttgg

SEQ ID NO: 549028 - DNA, 20 bp, Artificial
  CRISPR gRNA sequence
aacacagaggagtttggggg

SEQ ID NO: 549029 - DNA, 20 bp, Artificial
  CRISPR gRNA sequence
tatacatttgtccaaaccca

SEQ ID NO: 549030 - DNA, 20 bp, Artificial
  CRISPR gRNA sequence
tacaactgaatgctaatgta

SEQ ID NO: 549031 - DNA, 20 bp, Artificial
  CRISPR gRNA sequence
ctgaatgctaatgtaaagtg

SEQ ID NO: 549032 - DNA, 20 bp, Artificial
  CRISPR gRNA sequence
ttttaatgataatgatgtat

SEQ ID NO: 549033 - DNA, 20 bp, Artificial
  CRISPR gRNA sequence
atgataatgatgtatcagaa

SEQ ID NO: 549034 - DNA, 20 bp, Artificial
  CRISPR gRNA sequence
ttctaaaaaatgtaccactc

SEQ ID NO: 549035 - DNA, 20 bp, Artificial
  CRISPR gRNA sequence
aaaaaatgtaccactctggt

SEQ ID NO: 549036 - DNA, 20 bp, Artificial
  CRISPR gRNA sequence
aaaaatgtaccactctggtg

SEQ ID NO: 549037 - DNA, 20 bp, Artificial
  CRISPR gRNA sequence
aaaatgtaccactctggtga

SEQ ID NO: 549038 - DNA, 20 bp, Artificial
  CRISPR gRNA sequence
ctggtgagggatattgataa

SEQ ID NO: 549039 - DNA, 20 bp, Artificial
  CRISPR gRNA sequence
tggtgagggatattgataat

SEQ ID NO: 549040 - DNA, 20 bp, Artificial
  CRISPR gRNA sequence
ggtgagggatattgataatg

SEQ ID NO: 549041 - DNA, 20 bp, Artificial
  CRISPR gRNA sequence
tgagggatattgataatggg

SEQ ID NO: 549042 - DNA, 20 bp, Artificial
  CRISPR gRNA sequence
gagggatattgataatgggg

SEQ ID NO: 549043 - DNA, 20 bp, Artificial
  CRISPR gRNA sequence
atggggaggctatgcatgtg

SEQ ID NO: 549044 - DNA, 20 bp, Artificial
  CRISPR gRNA sequence
tggggaggctatgcatgtgt

SEQ ID NO: 549045 - DNA, 20 bp, Artificial
  CRISPR gRNA sequence
ggggaggctatgcatgtgta

SEQ ID NO: 549046 - DNA, 20 bp, Artificial
  CRISPR gRNA sequence
gggaggctatgcatgtgtag

SEQ ID NO: 549047 - DNA, 20 bp, Artificial
  CRISPR gRNA sequence
aggctatgcatgtgtagggg

SEQ ID NO: 549048 - DNA, 20 bp, Artificial
  CRISPR gRNA sequence
ggctatgcatgtgtaggggc

SEQ ID NO: 549049 - DNA, 20 bp, Artificial
  CRISPR gRNA sequence
aactttctgtaacttctgct

SEQ ID NO: 549050 - DNA, 20 bp, Artificial
  CRISPR gRNA sequence
cctgaaactcaaaatattta

SEQ ID NO: 549051 - DNA, 20 bp, Artificial
  CRISPR gRNA sequence
aactcaaaatatttaaagcc

SEQ ID NO: 549052 - DNA, 20 bp, Artificial
  CRISPR gRNA sequence
aaaatatttaaagccaagtg

SEQ ID NO: 549053 - DNA, 20 bp, Artificial
  CRISPR gRNA sequence
ccaagtgaagctaacttact

SEQ ID NO: 549054 - DNA, 20 bp, Artificial
  CRISPR gRNA sequence
aacttactaagccatgaatc

SEQ ID NO: 549055 - DNA, 20 bp, Artificial
  CRISPR gRNA sequence
taagccatgaatcaagtttg

SEQ ID NO: 549056 - DNA, 20 bp, Artificial
  CRISPR gRNA sequence
gtttgtggaataaccccaaa

SEQ ID NO: 549057 - DNA, 20 bp, Artificial
  CRISPR gRNA sequence
ttgtggaataaccccaaata

SEQ ID NO: 549058 - DNA, 20 bp, Artificial
  CRISPR gRNA sequence
tgtggaataaccccaaatag

SEQ ID NO: 549059 - DNA, 20 bp, Artificial
  CRISPR gRNA sequence
ccaaatagaggaaccattcc

SEQ ID NO: 549060 - DNA, 20 bp, Artificial
  CRISPR gRNA sequence
ttccaagtgttttcaaaaca

SEQ ID NO: 549061 - DNA, 20 bp, Artificial
  CRISPR gRNA sequence
gttttcaaaacatagtaatt

SEQ ID NO: 549062 - DNA, 20 bp, Artificial
  CRISPR gRNA sequence
ttttcaaaacatagtaattt

SEQ ID NO: 549063 - DNA, 20 bp, Artificial
  CRISPR gRNA sequence
gtaatttgggtgcatatttc

SEQ ID NO: 549064 - DNA, 20 bp, Artificial
  CRISPR gRNA sequence
taatttgggtgcatatttca

SEQ ID NO: 549065 - DNA, 20 bp, Artificial
  CRISPR gRNA sequence
aatttgggtgcatatttcaa

SEQ ID NO: 549066 - DNA, 20 bp, Artificial
  CRISPR gRNA sequence
atttgggtgcatatttcaag

SEQ ID NO: 549067 - DNA, 20 bp, Artificial
  CRISPR gRNA sequence
atttcaaggggctgcattct

SEQ ID NO: 549068 - DNA, 20 bp, Artificial
  CRISPR gRNA sequence
tttcaaggggctgcattcta

SEQ ID NO: 549069 - DNA, 20 bp, Artificial
  CRISPR gRNA sequence
ggctgcattctaaggataaa

SEQ ID NO: 549070 - DNA, 20 bp, Artificial
  CRISPR gRNA sequence
taaggataaaaagaactata

SEQ ID NO: 549071 - DNA, 20 bp, Artificial
  CRISPR gRNA sequence
gaaaaaaattgtaatgtttt

SEQ ID NO: 549072 - DNA, 20 bp, Artificial
  CRISPR gRNA sequence
taatgttttaagtaattatg

SEQ ID NO: 549073 - DNA, 20 bp, Artificial
  CRISPR gRNA sequence
gttttaagtaattatgtagt

SEQ ID NO: 549074 - DNA, 20 bp, Artificial
  CRISPR gRNA sequence
ttaagtaattatgtagttag

SEQ ID NO: 549075 - DNA, 20 bp, Artificial
  CRISPR gRNA sequence
tatgtagttagcagtaatgc

SEQ ID NO: 549076 - DNA, 20 bp, Artificial
  CRISPR gRNA sequence
ttagcagtaatgctggtatt

SEQ ID NO: 549077 - DNA, 20 bp, Artificial
  CRISPR gRNA sequence
gctggtatttggttactgtt

SEQ ID NO: 549078 - DNA, 20 bp, Artificial
  CRISPR gRNA sequence
ttactgttgagtatgtattg

SEQ ID NO: 549079 - DNA, 20 bp, Artificial
  CRISPR gRNA sequence
tactgttgagtatgtattgc

SEQ ID NO: 549080 - DNA, 20 bp, Artificial
  CRISPR gRNA sequence
atattgttgttattgaatat

SEQ ID NO: 549081 - DNA, 20 bp, Artificial
  CRISPR gRNA sequence
tattgttgttattgaatatt

SEQ ID NO: 549082 - DNA, 20 bp, Artificial
  CRISPR gRNA sequence
ttattgaatattgggatgtt

SEQ ID NO: 549083 - DNA, 20 bp, Artificial
  CRISPR gRNA sequence
tattgggatgtttggcatga

SEQ ID NO: 549084 - DNA, 20 bp, Artificial
  CRISPR gRNA sequence
gggatgtttggcatgaaaga

SEQ ID NO: 549085 - DNA, 20 bp, Artificial
  CRISPR gRNA sequence
ggatgtttggcatgaaagaa

SEQ ID NO: 549086 - DNA, 20 bp, Artificial
  CRISPR gRNA sequence
atgtttggcatgaaagaaag

SEQ ID NO: 549087 - DNA, 20 bp, Artificial
  CRISPR gRNA sequence
ggcatgaaagaaaggagatt

SEQ ID NO: 549088 - DNA, 20 bp, Artificial
  CRISPR gRNA sequence
agattcagctgtaaattgat

SEQ ID NO: 549089 - DNA, 20 bp, Artificial
  CRISPR gRNA sequence
gattcagctgtaaattgatt

SEQ ID NO: 549090 - DNA, 20 bp, Artificial
  CRISPR gRNA sequence
agctgtaaattgattaggtt

SEQ ID NO: 549091 - DNA, 20 bp, Artificial
  CRISPR gRNA sequence
attaggttaagtaaacattg

SEQ ID NO: 549092 - DNA, 20 bp, Artificial
  CRISPR gRNA sequence
ttaagtaaacattgtagccc

SEQ ID NO: 549093 - DNA, 20 bp, Artificial
  CRISPR gRNA sequence
tgtagccctggatttattta

SEQ ID NO: 549094 - DNA, 20 bp, Artificial
  CRISPR gRNA sequence
gtagccctggatttatttaa

SEQ ID NO: 549095 - DNA, 20 bp, Artificial
  CRISPR gRNA sequence
atatgaaattgctgtttctc

SEQ ID NO: 549096 - DNA, 20 bp, Artificial
  CRISPR gRNA sequence
agtcaaaaaccattgaatct

SEQ ID NO: 549097 - DNA, 20 bp, Artificial
  CRISPR gRNA sequence
caaaaaccattgaatcttgg

SEQ ID NO: 549098 - DNA, 20 bp, Artificial
  CRISPR gRNA sequence
attgaatcttggcagcttaa

SEQ ID NO: 549099 - DNA, 20 bp, Artificial
  CRISPR gRNA sequence
ttgaatcttggcagcttaat

SEQ ID NO: 549100 - DNA, 20 bp, Artificial
  CRISPR gRNA sequence
tgaatcttggcagcttaata

SEQ ID NO: 549101 - DNA, 20 bp, Artificial
  CRISPR gRNA sequence
cttggcagcttaatagggtt

SEQ ID NO: 549102 - DNA, 20 bp, Artificial
  CRISPR gRNA sequence
aatagggttcagcataatgc

SEQ ID NO: 549103 - DNA, 20 bp, Artificial
  CRISPR gRNA sequence
cattaatgtattttgtctct

SEQ ID NO: 549104 - DNA, 20 bp, Artificial
  CRISPR gRNA sequence
ttagaaaattgtgtatttcc

SEQ ID NO: 549105 - DNA, 20 bp, Artificial
  CRISPR gRNA sequence
ttctgtccattgaaatgttc

SEQ ID NO: 549106 - DNA, 20 bp, Artificial
  CRISPR gRNA sequence
cattgaaatgttctagaaac

SEQ ID NO: 549107 - DNA, 20 bp, Artificial
  CRISPR gRNA sequence
ttgaaatgttctagaaacaa

SEQ ID NO: 549108 - DNA, 20 bp, Artificial
  CRISPR gRNA sequence
aatgttctagaaacaagagc

SEQ ID NO: 549109 - DNA, 20 bp, Artificial
  CRISPR gRNA sequence
agaaacaagagccagtcctg

SEQ ID NO: 549110 - DNA, 20 bp, Artificial
  CRISPR gRNA sequence
gtagcaatttgcatgcttct

SEQ ID NO: 549111 - DNA, 20 bp, Artificial
  CRISPR gRNA sequence
tttgcatgcttcttggttct

SEQ ID NO: 549112 - DNA, 20 bp, Artificial
  CRISPR gRNA sequence
tgcttcttggttcttggacc

SEQ ID NO: 549113 - DNA, 20 bp, Artificial
  CRISPR gRNA sequence
tggttcttggacccagattt

SEQ ID NO: 549114 - DNA, 20 bp, Artificial
  CRISPR gRNA sequence
tggacccagatttgagtgac

SEQ ID NO: 549115 - DNA, 20 bp, Artificial
  CRISPR gRNA sequence
tttgagtgaccagtgttacc

SEQ ID NO: 549116 - DNA, 20 bp, Artificial
  CRISPR gRNA sequence
ccagtgttacctggtgtgcc

SEQ ID NO: 549117 - DNA, 20 bp, Artificial
  CRISPR gRNA sequence
cctggtgtgcccagacttcc

SEQ ID NO: 549118 - DNA, 20 bp, Artificial
  CRISPR gRNA sequence
gtgcccagacttcccagttt

SEQ ID NO: 549119 - DNA, 20 bp, Artificial
  CRISPR gRNA sequence
agcacccgaatttcatatcc

SEQ ID NO: 549120 - DNA, 20 bp, Artificial
  CRISPR gRNA sequence
gcacccgaatttcatatccc

SEQ ID NO: 549121 - DNA, 20 bp, Artificial
  CRISPR gRNA sequence
tcatatcccaggaaactctt

SEQ ID NO: 549122 - DNA, 20 bp, Artificial
  CRISPR gRNA sequence
cccaggaaactcttcagttt

SEQ ID NO: 549123 - DNA, 20 bp, Artificial
  CRISPR gRNA sequence
ccaggaaactcttcagtttc

SEQ ID NO: 549124 - DNA, 20 bp, Artificial
  CRISPR gRNA sequence
ctcttcagtttcaggaaaac

SEQ ID NO: 549125 - DNA, 20 bp, Artificial
  CRISPR gRNA sequence
tcttcagtttcaggaaaacc

SEQ ID NO: 549126 - DNA, 20 bp, Artificial
  CRISPR gRNA sequence
ttcaggaaaaccaggatgat

SEQ ID NO: 549127 - DNA, 20 bp, Artificial
  CRISPR gRNA sequence
gatgattggccaccttcacc

SEQ ID NO: 549128 - DNA, 20 bp, Artificial
  CRISPR gRNA sequence
ggccaccttcacccagatta

SEQ ID NO: 549129 - DNA, 20 bp, Artificial
  CRISPR gRNA sequence
catttcccatgaaaatgaac

SEQ ID NO: 549130 - DNA, 20 bp, Artificial
  CRISPR gRNA sequence
atttcccatgaaaatgaact

SEQ ID NO: 549131 - DNA, 20 bp, Artificial
  CRISPR gRNA sequence
tttcccatgaaaatgaacta

SEQ ID NO: 549132 - DNA, 20 bp, Artificial
  CRISPR gRNA sequence
tgaaaatgaactagggcctt

SEQ ID NO: 549133 - DNA, 20 bp, Artificial
  CRISPR gRNA sequence
gaaaatgaactagggccttt

SEQ ID NO: 549134 - DNA, 20 bp, Artificial
  CRISPR gRNA sequence
atgaactagggcctttggga

SEQ ID NO: 549135 - DNA, 20 bp, Artificial
  CRISPR gRNA sequence
actagggcctttgggacagt

SEQ ID NO: 549136 - DNA, 20 bp, Artificial
  CRISPR gRNA sequence
cagttggctgattccatacc

SEQ ID NO: 549137 - DNA, 20 bp, Artificial
  CRISPR gRNA sequence
agttggctgattccatacct

SEQ ID NO: 549138 - DNA, 20 bp, Artificial
  CRISPR gRNA sequence
gttggctgattccatacctg

SEQ ID NO: 549139 - DNA, 20 bp, Artificial
  CRISPR gRNA sequence
ctgattccatacctggggca

SEQ ID NO: 549140 - DNA, 20 bp, Artificial
  CRISPR gRNA sequence
ggcatggaatgcattaaaat

SEQ ID NO: 549141 - DNA, 20 bp, Artificial
  CRISPR gRNA sequence
aatgcattaaaataagcctt

SEQ ID NO: 549142 - DNA, 20 bp, Artificial
  CRISPR gRNA sequence
ttgagtatcttattttacca

SEQ ID NO: 549143 - DNA, 20 bp, Artificial
  CRISPR gRNA sequence
atcttattttaccacagaac

SEQ ID NO: 549144 - DNA, 20 bp, Artificial
  CRISPR gRNA sequence
tattttaccacagaacaaga

SEQ ID NO: 549145 - DNA, 20 bp, Artificial
  CRISPR gRNA sequence
agaacaagaaagctatcaaa

SEQ ID NO: 549146 - DNA, 20 bp, Artificial
  CRISPR gRNA sequence
atcaaaaagacttaacatga

SEQ ID NO: 549147 - DNA, 20 bp, Artificial
  CRISPR gRNA sequence
acttaacatgatggtacgaa

SEQ ID NO: 549148 - DNA, 20 bp, Artificial
  CRISPR gRNA sequence
cttaacatgatggtacgaac

SEQ ID NO: 549149 - DNA, 20 bp, Artificial
  CRISPR gRNA sequence
atgatggtacgaacaggact

SEQ ID NO: 549150 - DNA, 20 bp, Artificial
  CRISPR gRNA sequence
tgatggtacgaacaggactc

SEQ ID NO: 549151 - DNA, 20 bp, Artificial
  CRISPR gRNA sequence
atggtacgaacaggactcag

SEQ ID NO: 549152 - DNA, 20 bp, Artificial
  CRISPR gRNA sequence
aggactcaggagccactctg

SEQ ID NO: 549153 - DNA, 20 bp, Artificial
  CRISPR gRNA sequence
gactcaggagccactctgaa

SEQ ID NO: 549154 - DNA, 20 bp, Artificial
  CRISPR gRNA sequence
actcaggagccactctgaag

SEQ ID NO: 549155 - DNA, 20 bp, Artificial
  CRISPR gRNA sequence
cactctgaagaggttccctc

SEQ ID NO: 549156 - DNA, 20 bp, Artificial
  CRISPR gRNA sequence
ggttccctctggccaaaaat

SEQ ID NO: 549157 - DNA, 20 bp, Artificial
  CRISPR gRNA sequence
ctggccaaaaataagacaat

SEQ ID NO: 549158 - DNA, 20 bp, Artificial
  CRISPR gRNA sequence
aagacaattggaacatcaat

SEQ ID NO: 549159 - DNA, 20 bp, Artificial
  CRISPR gRNA sequence
atcaataagaataacaactt

SEQ ID NO: 549160 - DNA, 20 bp, Artificial
  CRISPR gRNA sequence
aataagaataacaacttcag

SEQ ID NO: 549161 - DNA, 20 bp, Artificial
  CRISPR gRNA sequence
ttcagtagattgaaacacat

SEQ ID NO: 549162 - DNA, 20 bp, Artificial
  CRISPR gRNA sequence
tgaaacacatcagttgtgct

SEQ ID NO: 549163 - DNA, 20 bp, Artificial
  CRISPR gRNA sequence
aaacaaatttaaaaactcac

SEQ ID NO: 549164 - DNA, 20 bp, Artificial
  CRISPR gRNA sequence
aaaaactcactggtcatctc

SEQ ID NO: 549165 - DNA, 20 bp, Artificial
  CRISPR gRNA sequence
aaactcactggtcatctcta

SEQ ID NO: 549166 - DNA, 20 bp, Artificial
  CRISPR gRNA sequence
ggtcatctctagagaatgct

SEQ ID NO: 549167 - DNA, 20 bp, Artificial
  CRISPR gRNA sequence
gtcatctctagagaatgctt

SEQ ID NO: 549168 - DNA, 20 bp, Artificial
  CRISPR gRNA sequence
catctctagagaatgcttgg

SEQ ID NO: 549169 - DNA, 20 bp, Artificial
  CRISPR gRNA sequence
cattattttgaaaaacgata

SEQ ID NO: 549170 - DNA, 20 bp, Artificial
  CRISPR gRNA sequence
attttgaaaaacgataaaga

SEQ ID NO: 549171 - DNA, 20 bp, Artificial
  CRISPR gRNA sequence
tttgaaaaacgataaagaaa

SEQ ID NO: 549172 - DNA, 20 bp, Artificial
  CRISPR gRNA sequence
gaaaaacgataaagaaagag

SEQ ID NO: 549173 - DNA, 20 bp, Artificial
  CRISPR gRNA sequence
ttcctatataaattgaacct

SEQ ID NO: 549174 - DNA, 20 bp, Artificial
  CRISPR gRNA sequence
cctatataaattgaacctca

SEQ ID NO: 549175 - DNA, 20 bp, Artificial
  CRISPR gRNA sequence
agagtaaccacattgttgat

SEQ ID NO: 549176 - DNA, 20 bp, Artificial
  CRISPR gRNA sequence
gagtaaccacattgttgatg

SEQ ID NO: 549177 - DNA, 20 bp, Artificial
  CRISPR gRNA sequence
agtaaccacattgttgatga

SEQ ID NO: 549178 - DNA, 20 bp, Artificial
  CRISPR gRNA sequence
gtaaccacattgttgatgag

SEQ ID NO: 549179 - DNA, 20 bp, Artificial
  CRISPR gRNA sequence
accacattgttgatgagggg

SEQ ID NO: 549180 - DNA, 20 bp, Artificial
  CRISPR gRNA sequence
gggcagtttatctttatgtg

SEQ ID NO: 549181 - DNA, 20 bp, Artificial
  CRISPR gRNA sequence
ttatctttatgtgaagattg

SEQ ID NO: 549182 - DNA, 20 bp, Artificial
  CRISPR gRNA sequence
ctttatgtgaagattgtagt

SEQ ID NO: 549183 - DNA, 20 bp, Artificial
  CRISPR gRNA sequence
tgtgaagattgtagttagta

SEQ ID NO: 549184 - DNA, 20 bp, Artificial
  CRISPR gRNA sequence
gaagattgtagttagtaaag

SEQ ID NO: 549185 - DNA, 20 bp, Artificial
  CRISPR gRNA sequence
aagattgtagttagtaaaga

SEQ ID NO: 549186 - DNA, 20 bp, Artificial
  CRISPR gRNA sequence
agttagtaaagaaggaatga

SEQ ID NO: 549187 - DNA, 20 bp, Artificial
  CRISPR gRNA sequence
gcaaacccttgatgaactta

SEQ ID NO: 549188 - DNA, 20 bp, Artificial
  CRISPR gRNA sequence
ccttgatgaacttatggctc

SEQ ID NO: 549189 - DNA, 20 bp, Artificial
  CRISPR gRNA sequence
tggctctagacaatgatctt

SEQ ID NO: 549190 - DNA, 20 bp, Artificial
  CRISPR gRNA sequence
ctctagacaatgatcttcag

SEQ ID NO: 549191 - DNA, 20 bp, Artificial
  CRISPR gRNA sequence
agtggcactgacatcatgaa

SEQ ID NO: 549192 - DNA, 20 bp, Artificial
  CRISPR gRNA sequence
cactgacatcatgaaaagaa

SEQ ID NO: 549193 - DNA, 20 bp, Artificial
  CRISPR gRNA sequence
atcatgaaaagaaaagcaac

SEQ ID NO: 549194 - DNA, 20 bp, Artificial
  CRISPR gRNA sequence
tcatgaaaagaaaagcaacc

SEQ ID NO: 549195 - DNA, 20 bp, Artificial
  CRISPR gRNA sequence
ccaggcatcgtatgccacct

SEQ ID NO: 549196 - DNA, 20 bp, Artificial
  CRISPR gRNA sequence
caggcatcgtatgccaccta

SEQ ID NO: 549197 - DNA, 20 bp, Artificial
  CRISPR gRNA sequence
aggcatcgtatgccacctaa

SEQ ID NO: 549198 - DNA, 20 bp, Artificial
  CRISPR gRNA sequence
catcgtatgccacctaaggg

SEQ ID NO: 549199 - DNA, 20 bp, Artificial
  CRISPR gRNA sequence
ggaagtatacaaacactact

SEQ ID NO: 549200 - DNA, 20 bp, Artificial
  CRISPR gRNA sequence
gaagtatacaaacactactt

SEQ ID NO: 549201 - DNA, 20 bp, Artificial
  CRISPR gRNA sequence
aagtatacaaacactacttg

SEQ ID NO: 549202 - DNA, 20 bp, Artificial
  CRISPR gRNA sequence
gtatacaaacactacttggg

SEQ ID NO: 549203 - DNA, 20 bp, Artificial
  CRISPR gRNA sequence
acttggggagtattattgcc

SEQ ID NO: 549204 - DNA, 20 bp, Artificial
  CRISPR gRNA sequence
cttggggagtattattgcca

SEQ ID NO: 549205 - DNA, 20 bp, Artificial
  CRISPR gRNA sequence
atatctgaattttgctacta

SEQ ID NO: 549206 - DNA, 20 bp, Artificial
  CRISPR gRNA sequence
tctgaattttgctactaaag

SEQ ID NO: 549207 - DNA, 20 bp, Artificial
  CRISPR gRNA sequence
ctgaattttgctactaaaga

SEQ ID NO: 549208 - DNA, 20 bp, Artificial
  CRISPR gRNA sequence
tgaattttgctactaaagaa

SEQ ID NO: 549209 - DNA, 20 bp, Artificial
  CRISPR gRNA sequence
aaagaagggaaaatgatgtt

SEQ ID NO: 549210 - DNA, 20 bp, Artificial
  CRISPR gRNA sequence
aagaagggaaaatgatgttc

SEQ ID NO: 549211 - DNA, 20 bp, Artificial
  CRISPR gRNA sequence
agaagggaaaatgatgttcg

SEQ ID NO: 549212 - DNA, 20 bp, Artificial
  CRISPR gRNA sequence
gaagggaaaatgatgttcgg

SEQ ID NO: 549213 - DNA, 20 bp, Artificial
  CRISPR gRNA sequence
aaatgatgttcgggggcacc

SEQ ID NO: 549214 - DNA, 20 bp, Artificial
  CRISPR gRNA sequence
tgatgttcgggggcacctag

SEQ ID NO: 549215 - DNA, 20 bp, Artificial
  CRISPR gRNA sequence
cgggggcacctagcagtttc

SEQ ID NO: 549216 - DNA, 20 bp, Artificial
  CRISPR gRNA sequence
ggcacctagcagtttctggc

SEQ ID NO: 549217 - DNA, 20 bp, Artificial
  CRISPR gRNA sequence
gcacctagcagtttctggcc

SEQ ID NO: 549218 - DNA, 20 bp, Artificial
  CRISPR gRNA sequence
cacctagcagtttctggcca

SEQ ID NO: 549219 - DNA, 20 bp, Artificial
  CRISPR gRNA sequence
gtcttctcaaatctgaccaa

SEQ ID NO: 549220 - DNA, 20 bp, Artificial
  CRISPR gRNA sequence
tcttctcaaatctgaccaat

SEQ ID NO: 549221 - DNA, 20 bp, Artificial
  CRISPR gRNA sequence
cacacctgtgttcctaataa

SEQ ID NO: 549222 - DNA, 20 bp, Artificial
  CRISPR gRNA sequence
acacctgtgttcctaataaa

SEQ ID NO: 549223 - DNA, 20 bp, Artificial
  CRISPR gRNA sequence
ctgtgttcctaataaaagga

SEQ ID NO: 549224 - DNA, 20 bp, Artificial
  CRISPR gRNA sequence
atccatgtcacatttgttct

SEQ ID NO: 549225 - DNA, 20 bp, Artificial
  CRISPR gRNA sequence
gtgacccctccccaatcctt

SEQ ID NO: 549226 - DNA, 20 bp, Artificial
  CRISPR gRNA sequence
acccctccccaatcctttag

SEQ ID NO: 549227 - DNA, 20 bp, Artificial
  CRISPR gRNA sequence
tgcattgtgtactctgattt

SEQ ID NO: 549228 - DNA, 20 bp, Artificial
  CRISPR gRNA sequence
ctctgattttggattttcaa

SEQ ID NO: 549229 - DNA, 20 bp, Artificial
  CRISPR gRNA sequence
gattttggattttcaatagc

SEQ ID NO: 549230 - DNA, 20 bp, Artificial
  CRISPR gRNA sequence
ttggattttcaatagctgga

SEQ ID NO: 549231 - DNA, 20 bp, Artificial
  CRISPR gRNA sequence
ggattttcaatagctggata

SEQ ID NO: 549232 - DNA, 20 bp, Artificial
  CRISPR gRNA sequence
tttaccttgtgaacatacca

SEQ ID NO: 549233 - DNA, 20 bp, Artificial
  CRISPR gRNA sequence
ccacagttttttgtgaaaac

SEQ ID NO: 549234 - DNA, 20 bp, Artificial
  CRISPR gRNA sequence
cacagttttttgtgaaaaca

SEQ ID NO: 549235 - DNA, 20 bp, Artificial
  CRISPR gRNA sequence
cagttttttgtgaaaacaag

SEQ ID NO: 549236 - DNA, 20 bp, Artificial
  CRISPR gRNA sequence
gagctgctgtgaaaacaact

SEQ ID NO: 549237 - DNA, 20 bp, Artificial
  CRISPR gRNA sequence
agctgctgtgaaaacaactt

SEQ ID NO: 549238 - DNA, 20 bp, Artificial
  CRISPR gRNA sequence
cttaggttgtttttgcctta

SEQ ID NO: 549239 - DNA, 20 bp, Artificial
  CRISPR gRNA sequence
tttttgccttatggtatatt

SEQ ID NO: 549240 - DNA, 20 bp, Artificial
  CRISPR gRNA sequence
tgccttatggtatattaagt

SEQ ID NO: 549241 - DNA, 20 bp, Artificial
  CRISPR gRNA sequence
gccttatggtatattaagta

SEQ ID NO: 549242 - DNA, 20 bp, Artificial
  CRISPR gRNA sequence
tggtatattaagtaaggctg

SEQ ID NO: 549243 - DNA, 20 bp, Artificial
  CRISPR gRNA sequence
aatatctttgtgcctttttg

SEQ ID NO: 549244 - DNA, 20 bp, Artificial
  CRISPR gRNA sequence
atatctttgtgcctttttgc

SEQ ID NO: 549245 - DNA, 20 bp, Artificial
  CRISPR gRNA sequence
tatctttgtgcctttttgcg

SEQ ID NO: 549246 - DNA, 20 bp, Artificial
  CRISPR gRNA sequence
tctttgtgcctttttgcggg

SEQ ID NO: 549247 - DNA, 20 bp, Artificial
  CRISPR gRNA sequence
ttgtgcctttttgcggggag

SEQ ID NO: 549248 - DNA, 20 bp, Artificial
  CRISPR gRNA sequence
tgcctttttgcggggagtag

SEQ ID NO: 549249 - DNA, 20 bp, Artificial
  CRISPR gRNA sequence
gcctttttgcggggagtaga

SEQ ID NO: 549250 - DNA, 20 bp, Artificial
  CRISPR gRNA sequence
cctttttgcggggagtagaa

SEQ ID NO: 549251 - DNA, 20 bp, Artificial
  CRISPR gRNA sequence
cacatcattgatattttccc

SEQ ID NO: 549252 - DNA, 20 bp, Artificial
  CRISPR gRNA sequence
acatcattgatattttcccc

SEQ ID NO: 549253 - DNA, 20 bp, Artificial
  CRISPR gRNA sequence
ttttccccaggataacatct

SEQ ID NO: 549254 - DNA, 20 bp, Artificial
  CRISPR gRNA sequence
ccaggataacatcttagaaa

SEQ ID NO: 549255 - DNA, 20 bp, Artificial
  CRISPR gRNA sequence
acatcttagaaatggaattg

SEQ ID NO: 549256 - DNA, 20 bp, Artificial
  CRISPR gRNA sequence
atcttagaaatggaattgca

SEQ ID NO: 549257 - DNA, 20 bp, Artificial
  CRISPR gRNA sequence
aaatggaattgcagagtcac

SEQ ID NO: 549258 - DNA, 20 bp, Artificial
  CRISPR gRNA sequence
gcagagtcacaagatattaa

SEQ ID NO: 549259 - DNA, 20 bp, Artificial
  CRISPR gRNA sequence
agagtcacaagatattaata

SEQ ID NO: 549260 - DNA, 20 bp, Artificial
  CRISPR gRNA sequence
taccaataacatctactcaa

SEQ ID NO: 549261 - DNA, 20 bp, Artificial
  CRISPR gRNA sequence
accaataacatctactcaat

SEQ ID NO: 549262 - DNA, 20 bp, Artificial
  CRISPR gRNA sequence
tctactcaataggttaatga

SEQ ID NO: 549263 - DNA, 20 bp, Artificial
  CRISPR gRNA sequence
aggttaatgacagtatataa

SEQ ID NO: 549264 - DNA, 20 bp, Artificial
  CRISPR gRNA sequence
cttaaatgcaactaccctat

SEQ ID NO: 549265 - DNA, 20 bp, Artificial
  CRISPR gRNA sequence
atgcaactaccctatgagat

SEQ ID NO: 549266 - DNA, 20 bp, Artificial
  CRISPR gRNA sequence
tatgagataagtatatttat

SEQ ID NO: 549267 - DNA, 20 bp, Artificial
  CRISPR gRNA sequence
taagtatatttattagtctc

SEQ ID NO: 549268 - DNA, 20 bp, Artificial
  CRISPR gRNA sequence
atatttattagtctcgagta

SEQ ID NO: 549269 - DNA, 20 bp, Artificial
  CRISPR gRNA sequence
ctcgagtatagttaccctgt

SEQ ID NO: 549270 - DNA, 20 bp, Artificial
  CRISPR gRNA sequence
atagttaccctgtgagaaaa

SEQ ID NO: 549271 - DNA, 20 bp, Artificial
  CRISPR gRNA sequence
agttaccctgtgagaaaatg

SEQ ID NO: 549272 - DNA, 20 bp, Artificial
  CRISPR gRNA sequence
gttaccctgtgagaaaatgg

SEQ ID NO: 549273 - DNA, 20 bp, Artificial
  CRISPR gRNA sequence
tgtgagaaaatggaggcact

SEQ ID NO: 549274 - DNA, 20 bp, Artificial
  CRISPR gRNA sequence
tgagaaaatggaggcactga

SEQ ID NO: 549275 - DNA, 20 bp, Artificial
  CRISPR gRNA sequence
gagaaaatggaggcactgag

SEQ ID NO: 549276 - DNA, 20 bp, Artificial
  CRISPR gRNA sequence
aatggaggcactgagaggtt

SEQ ID NO: 549277 - DNA, 20 bp, Artificial
  CRISPR gRNA sequence
atggaggcactgagaggtta

SEQ ID NO: 549278 - DNA, 20 bp, Artificial
  CRISPR gRNA sequence
tgcccaacattgtaatgact

SEQ ID NO: 549279 - DNA, 20 bp, Artificial
  CRISPR gRNA sequence
caacattgtaatgacttagt

SEQ ID NO: 549280 - DNA, 20 bp, Artificial
  CRISPR gRNA sequence
gtaatgacttagtgagacta

SEQ ID NO: 549281 - DNA, 20 bp, Artificial
  CRISPR gRNA sequence
taatgacttagtgagactat

SEQ ID NO: 549282 - DNA, 20 bp, Artificial
  CRISPR gRNA sequence
gagactataggcacatgact

SEQ ID NO: 549283 - DNA, 20 bp, Artificial
  CRISPR gRNA sequence
acatgacttagtgcaatgtc

SEQ ID NO: 549284 - DNA, 20 bp, Artificial
  CRISPR gRNA sequence
gcttcatgataaatattttt

SEQ ID NO: 549285 - DNA, 20 bp, Artificial
  CRISPR gRNA sequence
cttcatgataaatattttta

SEQ ID NO: 549286 - DNA, 20 bp, Artificial
  CRISPR gRNA sequence
ggcttattatatacaactgc

SEQ ID NO: 549287 - DNA, 20 bp, Artificial
  CRISPR gRNA sequence
gccctaccaaacacaatgcc

SEQ ID NO: 549288 - DNA, 20 bp, Artificial
  CRISPR gRNA sequence
atgccaagttctgcttccac

SEQ ID NO: 549289 - DNA, 20 bp, Artificial
  CRISPR gRNA sequence
ccaagttctgcttccactgg

SEQ ID NO: 549290 - DNA, 20 bp, Artificial
  CRISPR gRNA sequence
tctgcttccactggcagtat

SEQ ID NO: 549291 - DNA, 20 bp, Artificial
  CRISPR gRNA sequence
cttccactggcagtatgaga

SEQ ID NO: 549292 - DNA, 20 bp, Artificial
  CRISPR gRNA sequence
cactggcagtatgagatggt

SEQ ID NO: 549293 - DNA, 20 bp, Artificial
  CRISPR gRNA sequence
atggtcagaaacaaaccttc

SEQ ID NO: 549294 - DNA, 20 bp, Artificial
  CRISPR gRNA sequence
gtcagaaacaaaccttctag

SEQ ID NO: 549295 - DNA, 20 bp, Artificial
  CRISPR gRNA sequence
gcttcttttattaaataaca

SEQ ID NO: 549296 - DNA, 20 bp, Artificial
  CRISPR gRNA sequence
cttcttttattaaataacac

SEQ ID NO: 549297 - DNA, 20 bp, Artificial
  CRISPR gRNA sequence
ttcttttattaaataacaca

SEQ ID NO: 549298 - DNA, 20 bp, Artificial
  CRISPR gRNA sequence
ttattaaataacacagggtc

SEQ ID NO: 549299 - DNA, 20 bp, Artificial
  CRISPR gRNA sequence
cacagggtctggaatgtatc

SEQ ID NO: 549300 - DNA, 20 bp, Artificial
  CRISPR gRNA sequence
tgtatcaagcttgtgcatat

SEQ ID NO: 549301 - DNA, 20 bp, Artificial
  CRISPR gRNA sequence
cttgtgcatataagtttgtt

SEQ ID NO: 549302 - DNA, 20 bp, Artificial
  CRISPR gRNA sequence
catataagtttgtttagaaa

SEQ ID NO: 549303 - DNA, 20 bp, Artificial
  CRISPR gRNA sequence
tcgaatcttgttattcatat

SEQ ID NO: 549304 - DNA, 20 bp, Artificial
  CRISPR gRNA sequence
tgttattcatattagttcta

SEQ ID NO: 549305 - DNA, 20 bp, Artificial
  CRISPR gRNA sequence
ttattcatattagttctaca

SEQ ID NO: 549306 - DNA, 20 bp, Artificial
  CRISPR gRNA sequence
catattagttctacagagtc

SEQ ID NO: 549307 - DNA, 20 bp, Artificial
  CRISPR gRNA sequence
gttctacagagtcaagttaa

SEQ ID NO: 549308 - DNA, 20 bp, Artificial
  CRISPR gRNA sequence
gagtcaagttaacagtgaaa

SEQ ID NO: 549309 - DNA, 20 bp, Artificial
  CRISPR gRNA sequence
caagttaacagtgaaatagc

SEQ ID NO: 549310 - DNA, 20 bp, Artificial
  CRISPR gRNA sequence
gttaacagtgaaatagcaag

SEQ ID NO: 549311 - DNA, 20 bp, Artificial
  CRISPR gRNA sequence
cagtgaaatagcaagtagtg

SEQ ID NO: 549312 - DNA, 20 bp, Artificial
  CRISPR gRNA sequence
aagtagtgaagtaatgttcc

SEQ ID NO: 549313 - DNA, 20 bp, Artificial
  CRISPR gRNA sequence
agtagtgaagtaatgttcct

SEQ ID NO: 549314 - DNA, 20 bp, Artificial
  CRISPR gRNA sequence
gtagtgaagtaatgttcctg

SEQ ID NO: 549315 - DNA, 20 bp, Artificial
  CRISPR gRNA sequence
tagtgaagtaatgttcctgg

SEQ ID NO: 549316 - DNA, 20 bp, Artificial
  CRISPR gRNA sequence
taatgttcctgggggaaata

SEQ ID NO: 549317 - DNA, 20 bp, Artificial
  CRISPR gRNA sequence
aatgttcctgggggaaatac

SEQ ID NO: 549318 - DNA, 20 bp, Artificial
  CRISPR gRNA sequence
atgttcctgggggaaataca

SEQ ID NO: 549319 - DNA, 20 bp, Artificial
  CRISPR gRNA sequence
tgttcctgggggaaatacag

SEQ ID NO: 549320 - DNA, 20 bp, Artificial
  CRISPR gRNA sequence
tcctgggggaaatacagggg

SEQ ID NO: 549321 - DNA, 20 bp, Artificial
  CRISPR gRNA sequence
cctgggggaaatacaggggt

SEQ ID NO: 549322 - DNA, 20 bp, Artificial
  CRISPR gRNA sequence
atacaggggtaggttcctgt

SEQ ID NO: 549323 - DNA, 20 bp, Artificial
  CRISPR gRNA sequence
ggtaggttcctgtgagcctc

SEQ ID NO: 549324 - DNA, 20 bp, Artificial
  CRISPR gRNA sequence
tcctgtgagcctctagtcat

SEQ ID NO: 549325 - DNA, 20 bp, Artificial
  CRISPR gRNA sequence
tttaaataaaccttaatata

SEQ ID NO: 549326 - DNA, 20 bp, Artificial
  CRISPR gRNA sequence
atttattgaccttgaactca

SEQ ID NO: 549327 - DNA, 20 bp, Artificial
  CRISPR gRNA sequence
gaccttgaactcatagccaa

SEQ ID NO: 549328 - DNA, 20 bp, Artificial
  CRISPR gRNA sequence
cagcactgtaactcatgcct

SEQ ID NO: 549329 - DNA, 20 bp, Artificial
  CRISPR gRNA sequence
ctgtaactcatgcctaagtg

SEQ ID NO: 549330 - DNA, 20 bp, Artificial
  CRISPR gRNA sequence
aatacacctattttctctgc

SEQ ID NO: 549331 - DNA, 20 bp, Artificial
  CRISPR gRNA sequence
atacacctattttctctgca

SEQ ID NO: 549332 - DNA, 20 bp, Artificial
  CRISPR gRNA sequence
tttctctgcaaggcacatcg

SEQ ID NO: 549333 - DNA, 20 bp, Artificial
  CRISPR gRNA sequence
catcgcagccttcttgcact

SEQ ID NO: 549334 - DNA, 20 bp, Artificial
  CRISPR gRNA sequence
atcgcagccttcttgcactt

SEQ ID NO: 549335 - DNA, 20 bp, Artificial
  CRISPR gRNA sequence
ttgcacttaggaactcttgt

SEQ ID NO: 549336 - DNA, 20 bp, Artificial
  CRISPR gRNA sequence
agcccttcaacactatactt

SEQ ID NO: 549337 - DNA, 20 bp, Artificial
  CRISPR gRNA sequence
gcccttcaacactatacttt

SEQ ID NO: 549338 - DNA, 20 bp, Artificial
  CRISPR gRNA sequence
tactttgggaccacttaaaa

SEQ ID NO: 549339 - DNA, 20 bp, Artificial
  CRISPR gRNA sequence
tagtgaaatcaccaacaaaa

SEQ ID NO: 549340 - DNA, 20 bp, Artificial
  CRISPR gRNA sequence
agcacaaaaatgcaaaatca

SEQ ID NO: 549341 - DNA, 20 bp, Artificial
  CRISPR gRNA sequence
tgcaaaatcatggcactaaa

SEQ ID NO: 549342 - DNA, 20 bp, Artificial
  CRISPR gRNA sequence
ggcactaaatagactgcaaa

SEQ ID NO: 549343 - DNA, 20 bp, Artificial
  CRISPR gRNA sequence
gcactaaatagactgcaaat

SEQ ID NO: 549344 - DNA, 20 bp, Artificial
  CRISPR gRNA sequence
gcaaataggacacttgttaa

SEQ ID NO: 549345 - DNA, 20 bp, Artificial
  CRISPR gRNA sequence
aggacacttgttaacagtgt

SEQ ID NO: 549346 - DNA, 20 bp, Artificial
  CRISPR gRNA sequence
acagtgtaagaacttgaaac

SEQ ID NO: 549347 - DNA, 20 bp, Artificial
  CRISPR gRNA sequence
gtgtaagaacttgaaacaag

SEQ ID NO: 549348 - DNA, 20 bp, Artificial
  CRISPR gRNA sequence
tgtaagaacttgaaacaaga

SEQ ID NO: 549349 - DNA, 20 bp, Artificial
  CRISPR gRNA sequence
aagaacttgaaacaagaagg

SEQ ID NO: 549350 - DNA, 20 bp, Artificial
  CRISPR gRNA sequence
gaacttgaaacaagaaggca

SEQ ID NO: 549351 - DNA, 20 bp, Artificial
  CRISPR gRNA sequence
ttacctttttccacctctgc

SEQ ID NO: 549352 - DNA, 20 bp, Artificial
  CRISPR gRNA sequence
tacctttttccacctctgct

SEQ ID NO: 549353 - DNA, 20 bp, Artificial
  CRISPR gRNA sequence
tctgctgggaatctgcttat

SEQ ID NO: 549354 - DNA, 20 bp, Artificial
  CRISPR gRNA sequence
ctgctgggaatctgcttatt

SEQ ID NO: 549355 - DNA, 20 bp, Artificial
  CRISPR gRNA sequence
tctgcttattgggtgactca

SEQ ID NO: 549356 - DNA, 20 bp, Artificial
  CRISPR gRNA sequence
tcatcactgttcttatgtct

SEQ ID NO: 549357 - DNA, 20 bp, Artificial
  CRISPR gRNA sequence
atgtctgagaatgactgctt

SEQ ID NO: 549358 - DNA, 20 bp, Artificial
  CRISPR gRNA sequence
tgtctgagaatgactgcttt

SEQ ID NO: 549359 - DNA, 20 bp, Artificial
  CRISPR gRNA sequence
ctgctttgggtattgatttg

SEQ ID NO: 549360 - DNA, 20 bp, Artificial
  CRISPR gRNA sequence
tgtggattacaaataaattt

SEQ ID NO: 549361 - DNA, 20 bp, Artificial
  CRISPR gRNA sequence
acaaataaatttcagtaaat

SEQ ID NO: 549362 - DNA, 20 bp, Artificial
  CRISPR gRNA sequence
tcagtaaataagcaaaccgc

SEQ ID NO: 549363 - DNA, 20 bp, Artificial
  CRISPR gRNA sequence
cagtaaataagcaaaccgca

SEQ ID NO: 549364 - DNA, 20 bp, Artificial
  CRISPR gRNA sequence
taaataagcaaaccgcaagg

SEQ ID NO: 549365 - DNA, 20 bp, Artificial
  CRISPR gRNA sequence
aggtggaatctgcaaataat

SEQ ID NO: 549366 - DNA, 20 bp, Artificial
  CRISPR gRNA sequence
ggtggaatctgcaaataatg

SEQ ID NO: 549367 - DNA, 20 bp, Artificial
  CRISPR gRNA sequence
taatgaggatccattttgat

SEQ ID NO: 549368 - DNA, 20 bp, Artificial
  CRISPR gRNA sequence
tccattttgatcagttcaac

SEQ ID NO: 549369 - DNA, 20 bp, Artificial
  CRISPR gRNA sequence
ttcttttcttttctttttta

SEQ ID NO: 549370 - DNA, 20 bp, Artificial
  CRISPR gRNA sequence
tcttttcttttcttttttat

SEQ ID NO: 549371 - DNA, 20 bp, Artificial
  CRISPR gRNA sequence
ttcttttttataggtcattc

SEQ ID NO: 549372 - DNA, 20 bp, Artificial
  CRISPR gRNA sequence
tttataggtcattcaagaca

SEQ ID NO: 549373 - DNA, 20 bp, Artificial
  CRISPR gRNA sequence
tgcacttatacccataccat

SEQ ID NO: 549374 - DNA, 20 bp, Artificial
  CRISPR gRNA sequence
acttatacccataccattag

SEQ ID NO: 549375 - DNA, 20 bp, Artificial
  CRISPR gRNA sequence
tgtattgtgctgtatatgaa

SEQ ID NO: 549376 - DNA, 20 bp, Artificial
  CRISPR gRNA sequence
gtatgctttttaaaacaaaa

SEQ ID NO: 549377 - DNA, 20 bp, Artificial
  CRISPR gRNA sequence
aaaacttgcattgttttcca

SEQ ID NO: 549378 - DNA, 20 bp, Artificial
  CRISPR gRNA sequence
aaacttgcattgttttccaa

SEQ ID NO: 549379 - DNA, 20 bp, Artificial
  CRISPR gRNA sequence
ttgcattgttttccaaaggt

SEQ ID NO: 549380 - DNA, 20 bp, Artificial
  CRISPR gRNA sequence
gttttccaaaggtcagaaaa

SEQ ID NO: 549381 - DNA, 20 bp, Artificial
  CRISPR gRNA sequence
caaaggtcagaaaatagttt

SEQ ID NO: 549382 - DNA, 20 bp, Artificial
  CRISPR gRNA sequence
aaaggtcagaaaatagttta

SEQ ID NO: 549383 - DNA, 20 bp, Artificial
  CRISPR gRNA sequence
atagtttaaggatgaaaata

SEQ ID NO: 549384 - DNA, 20 bp, Artificial
  CRISPR gRNA sequence
gaaaataaagtttgaaattt

SEQ ID NO: 549385 - DNA, 20 bp, Artificial
  CRISPR gRNA sequence
tgaaattttagacatttgaa

SEQ ID NO: 549386 - DNA, 20 bp, Artificial
  CRISPR gRNA sequence
acttttttgctttacgtgtg

SEQ ID NO: 549387 - DNA, 20 bp, Artificial
  CRISPR gRNA sequence
cttttttgctttacgtgtgt

SEQ ID NO: 549388 - DNA, 20 bp, Artificial
  CRISPR gRNA sequence
tttacgtgtgtgggactgct

SEQ ID NO: 549389 - DNA, 20 bp, Artificial
  CRISPR gRNA sequence
tgtgggactgctgagcatgc

SEQ ID NO: 549390 - DNA, 20 bp, Artificial
  CRISPR gRNA sequence
gtgggactgctgagcatgct

SEQ ID NO: 549391 - DNA, 20 bp, Artificial
  CRISPR gRNA sequence
gagcatgctaggttcctcca

SEQ ID NO: 549392 - DNA, 20 bp, Artificial
  CRISPR gRNA sequence
ccaaagatccacattatctc

SEQ ID NO: 549393 - DNA, 20 bp, Artificial
  CRISPR gRNA sequence
caaagatccacattatctca

SEQ ID NO: 549394 - DNA, 20 bp, Artificial
  CRISPR gRNA sequence
agatccacattatctcaagg

SEQ ID NO: 549395 - DNA, 20 bp, Artificial
  CRISPR gRNA sequence
ctcaaggtagaatgaatcct

SEQ ID NO: 549396 - DNA, 20 bp, Artificial
  CRISPR gRNA sequence
tcaaggtagaatgaatcctt

SEQ ID NO: 549397 - DNA, 20 bp, Artificial
  CRISPR gRNA sequence
tagaatgaatccttaggcca

SEQ ID NO: 549398 - DNA, 20 bp, Artificial
  CRISPR gRNA sequence
gaatgaatccttaggccaca

SEQ ID NO: 549399 - DNA, 20 bp, Artificial
  CRISPR gRNA sequence
atgaatccttaggccacaga

SEQ ID NO: 549400 - DNA, 20 bp, Artificial
  CRISPR gRNA sequence
ttaggccacagagagcttta

SEQ ID NO: 549401 - DNA, 20 bp, Artificial
  CRISPR gRNA sequence
taggccacagagagctttac

SEQ ID NO: 549402 - DNA, 20 bp, Artificial
  CRISPR gRNA sequence
cacagagagctttacaggcc

SEQ ID NO: 549403 - DNA, 20 bp, Artificial
  CRISPR gRNA sequence
acagagagctttacaggcct

SEQ ID NO: 549404 - DNA, 20 bp, Artificial
  CRISPR gRNA sequence
gctttacaggcctgggaaca

SEQ ID NO: 549405 - DNA, 20 bp, Artificial
  CRISPR gRNA sequence
acaggcctgggaacacagcc

SEQ ID NO: 549406 - DNA, 20 bp, Artificial
  CRISPR gRNA sequence
cacagcctggacctgttgca

SEQ ID NO: 549407 - DNA, 20 bp, Artificial
  CRISPR gRNA sequence
ctgtgatctgcttcaaaata

SEQ ID NO: 549408 - DNA, 20 bp, Artificial
  CRISPR gRNA sequence
tcaaaatatagttaaacttc

SEQ ID NO: 549409 - DNA, 20 bp, Artificial
  CRISPR gRNA sequence
tagttaaacttctggtctcc

SEQ ID NO: 549410 - DNA, 20 bp, Artificial
  CRISPR gRNA sequence
taaacttctggtctccaagt

SEQ ID NO: 549411 - DNA, 20 bp, Artificial
  CRISPR gRNA sequence
aacttctggtctccaagtca

SEQ ID NO: 549412 - DNA, 20 bp, Artificial
  CRISPR gRNA sequence
ctccaagtcagagtttgcta

SEQ ID NO: 549413 - DNA, 20 bp, Artificial
  CRISPR gRNA sequence
gagtttgctaaagacctctt

SEQ ID NO: 549414 - DNA, 20 bp, Artificial
  CRISPR gRNA sequence
agtttgctaaagacctcttt

SEQ ID NO: 549415 - DNA, 20 bp, Artificial
  CRISPR gRNA sequence
ttcatgtcatataacacgaa

SEQ ID NO: 549416 - DNA, 20 bp, Artificial
  CRISPR gRNA sequence
tcatgtcatataacacgaat

SEQ ID NO: 549417 - DNA, 20 bp, Artificial
  CRISPR gRNA sequence
catgtcatataacacgaatg

SEQ ID NO: 549418 - DNA, 20 bp, Artificial
  CRISPR gRNA sequence
tataacacgaatggggctcc

SEQ ID NO: 549419 - DNA, 20 bp, Artificial
  CRISPR gRNA sequence
ataacacgaatggggctccc

SEQ ID NO: 549420 - DNA, 20 bp, Artificial
  CRISPR gRNA sequence
acacgaatggggctcccagg

SEQ ID NO: 549421 - DNA, 20 bp, Artificial
  CRISPR gRNA sequence
cacgaatggggctcccaggt

SEQ ID NO: 549422 - DNA, 20 bp, Artificial
  CRISPR gRNA sequence
gaatggggctcccaggtagg

SEQ ID NO: 549423 - DNA, 20 bp, Artificial
  CRISPR gRNA sequence
aatggggctcccaggtagga

SEQ ID NO: 549424 - DNA, 20 bp, Artificial
  CRISPR gRNA sequence
atggggctcccaggtaggaa

SEQ ID NO: 549425 - DNA, 20 bp, Artificial
  CRISPR gRNA sequence
ggggctcccaggtaggaagg

SEQ ID NO: 549426 - DNA, 20 bp, Artificial
  CRISPR gRNA sequence
cccaggtaggaagggagttt

SEQ ID NO: 549427 - DNA, 20 bp, Artificial
  CRISPR gRNA sequence
gtaggaagggagttttggtt

SEQ ID NO: 549428 - DNA, 20 bp, Artificial
  CRISPR gRNA sequence
aagggagttttggttgagtt

SEQ ID NO: 549429 - DNA, 20 bp, Artificial
  CRISPR gRNA sequence
ttaagtgacttacgtaatac

SEQ ID NO: 549430 - DNA, 20 bp, Artificial
  CRISPR gRNA sequence
ttgtgcttgtattacttcct

SEQ ID NO: 549431 - DNA, 20 bp, Artificial
  CRISPR gRNA sequence
tattacttcctgagccttct

SEQ ID NO: 549432 - DNA, 20 bp, Artificial
  CRISPR gRNA sequence
cctgagccttctcagtcccc

SEQ ID NO: 549433 - DNA, 20 bp, Artificial
  CRISPR gRNA sequence
tctcagtcccctagcaatct

SEQ ID NO: 549434 - DNA, 20 bp, Artificial
  CRISPR gRNA sequence
ctcagtcccctagcaatctt

SEQ ID NO: 549435 - DNA, 20 bp, Artificial
  CRISPR gRNA sequence
agtcccctagcaatcttggg

SEQ ID NO: 549436 - DNA, 20 bp, Artificial
  CRISPR gRNA sequence
agcaatcttgggcagtcata

SEQ ID NO: 549437 - DNA, 20 bp, Artificial
  CRISPR gRNA sequence
tcttgggcagtcatacagct

SEQ ID NO: 549438 - DNA, 20 bp, Artificial
  CRISPR gRNA sequence
ttgggcagtcatacagcttg

SEQ ID NO: 549439 - DNA, 20 bp, Artificial
  CRISPR gRNA sequence
agcttggagaactgatgact

SEQ ID NO: 549440 - DNA, 20 bp, Artificial
  CRISPR gRNA sequence
cttggagaactgatgacttg

SEQ ID NO: 549441 - DNA, 20 bp, Artificial
  CRISPR gRNA sequence
tgacttggagaatttgttcc

SEQ ID NO: 549442 - DNA, 20 bp, Artificial
  CRISPR gRNA sequence
gttcccagcctgttcattcc

SEQ ID NO: 549443 - DNA, 20 bp, Artificial
  CRISPR gRNA sequence
gcctgttcattcctggtaat

SEQ ID NO: 549444 - DNA, 20 bp, Artificial
  CRISPR gRNA sequence
gtaatccctctcaaatccca

SEQ ID NO: 549445 - DNA, 20 bp, Artificial
  CRISPR gRNA sequence
taatccctctcaaatcccaa

SEQ ID NO: 549446 - DNA, 20 bp, Artificial
  CRISPR gRNA sequence
ccctctcaaatcccaaagga

SEQ ID NO: 549447 - DNA, 20 bp, Artificial
  CRISPR gRNA sequence
cctctcaaatcccaaaggac

SEQ ID NO: 549448 - DNA, 20 bp, Artificial
  CRISPR gRNA sequence
ctctcaaatcccaaaggaca

SEQ ID NO: 549449 - DNA, 20 bp, Artificial
  CRISPR gRNA sequence
ctcaaatcccaaaggacagg

SEQ ID NO: 549450 - DNA, 20 bp, Artificial
  CRISPR gRNA sequence
aaatcccaaaggacagggag

SEQ ID NO: 549451 - DNA, 20 bp, Artificial
  CRISPR gRNA sequence
aatcccaaaggacagggagc

SEQ ID NO: 549452 - DNA, 20 bp, Artificial
  CRISPR gRNA sequence
gggagcaggctgtaattctg

SEQ ID NO: 549453 - DNA, 20 bp, Artificial
  CRISPR gRNA sequence
gagcaggctgtaattctgaa

SEQ ID NO: 549454 - DNA, 20 bp, Artificial
  CRISPR gRNA sequence
caggctgtaattctgaagag

SEQ ID NO: 549455 - DNA, 20 bp, Artificial
  CRISPR gRNA sequence
agtggatattcttgatgcca

SEQ ID NO: 549456 - DNA, 20 bp, Artificial
  CRISPR gRNA sequence
ggatattcttgatgccacag

SEQ ID NO: 549457 - DNA, 20 bp, Artificial
  CRISPR gRNA sequence
tgccacagcagtttccatac

SEQ ID NO: 549458 - DNA, 20 bp, Artificial
  CRISPR gRNA sequence
tccataccagccttcaccaa

SEQ ID NO: 549459 - DNA, 20 bp, Artificial
  CRISPR gRNA sequence
ccataccagccttcaccaaa

SEQ ID NO: 549460 - DNA, 20 bp, Artificial
  CRISPR gRNA sequence
ttcaccaaaaggaaatatgc

SEQ ID NO: 549461 - DNA, 20 bp, Artificial
  CRISPR gRNA sequence
ccaaaaggaaatatgccaga

SEQ ID NO: 549462 - DNA, 20 bp, Artificial
  CRISPR gRNA sequence
caaaaggaaatatgccagac

SEQ ID NO: 549463 - DNA, 20 bp, Artificial
  CRISPR gRNA sequence
aaaaggaaatatgccagaca

SEQ ID NO: 549464 - DNA, 20 bp, Artificial
  CRISPR gRNA sequence
atgccagacagggaatgccg

SEQ ID NO: 549465 - DNA, 20 bp, Artificial
  CRISPR gRNA sequence
gccagacagggaatgccgaa

SEQ ID NO: 549466 - DNA, 20 bp, Artificial
  CRISPR gRNA sequence
ccgaagagtaaactttctac

SEQ ID NO: 549467 - DNA, 20 bp, Artificial
  CRISPR gRNA sequence
agtaaactttctacaagtga

SEQ ID NO: 549468 - DNA, 20 bp, Artificial
  CRISPR gRNA sequence
tttctacaagtgatagtatc

SEQ ID NO: 549469 - DNA, 20 bp, Artificial
  CRISPR gRNA sequence
ttctacaagtgatagtatct

SEQ ID NO: 549470 - DNA, 20 bp, Artificial
  CRISPR gRNA sequence
gatccattgtgtcatgaatc

SEQ ID NO: 549471 - DNA, 20 bp, Artificial
  CRISPR gRNA sequence
catgaatcaagtttataaac

SEQ ID NO: 549472 - DNA, 20 bp, Artificial
  CRISPR gRNA sequence
caagtttataaactagattt

SEQ ID NO: 549473 - DNA, 20 bp, Artificial
  CRISPR gRNA sequence
aaactagatttcagtttcct

SEQ ID NO: 549474 - DNA, 20 bp, Artificial
  CRISPR gRNA sequence
ttccttagacctgcactgtt

SEQ ID NO: 549475 - DNA, 20 bp, Artificial
  CRISPR gRNA sequence
tagacctgcactgtttagta

SEQ ID NO: 549476 - DNA, 20 bp, Artificial
  CRISPR gRNA sequence
acctgcactgtttagtatag

SEQ ID NO: 549477 - DNA, 20 bp, Artificial
  CRISPR gRNA sequence
tgtttagtatagtagccaat

SEQ ID NO: 549478 - DNA, 20 bp, Artificial
  CRISPR gRNA sequence
aatgaaataccattaaattt

SEQ ID NO: 549479 - DNA, 20 bp, Artificial
  CRISPR gRNA sequence
taaatttaagattcattcct

SEQ ID NO: 549480 - DNA, 20 bp, Artificial
  CRISPR gRNA sequence
agttacactaaccacctttc

SEQ ID NO: 549481 - DNA, 20 bp, Artificial
  CRISPR gRNA sequence
aagtgctcaatacctacatc

SEQ ID NO: 549482 - DNA, 20 bp, Artificial
  CRISPR gRNA sequence
gctcaatacctacatctggc

SEQ ID NO: 549483 - DNA, 20 bp, Artificial
  CRISPR gRNA sequence
caatacctacatctggctag

SEQ ID NO: 549484 - DNA, 20 bp, Artificial
  CRISPR gRNA sequence
ctggctagtggctaccatac

SEQ ID NO: 549485 - DNA, 20 bp, Artificial
  CRISPR gRNA sequence
ctagtggctaccatactgga

SEQ ID NO: 549486 - DNA, 20 bp, Artificial
  CRISPR gRNA sequence
ggctaccatactggatagcc

SEQ ID NO: 549487 - DNA, 20 bp, Artificial
  CRISPR gRNA sequence
ccatactggatagcccagat

SEQ ID NO: 549488 - DNA, 20 bp, Artificial
  CRISPR gRNA sequence
catactggatagcccagata

SEQ ID NO: 549489 - DNA, 20 bp, Artificial
  CRISPR gRNA sequence
aaggaataatcctatcattg

SEQ ID NO: 549490 - DNA, 20 bp, Artificial
  CRISPR gRNA sequence
aataatcctatcattgcaga

SEQ ID NO: 549491 - DNA, 20 bp, Artificial
  CRISPR gRNA sequence
atcattgcagaaagttttct

SEQ ID NO: 549492 - DNA, 20 bp, Artificial
  CRISPR gRNA sequence
ttgcagaaagttttcttggt

SEQ ID NO: 549493 - DNA, 20 bp, Artificial
  CRISPR gRNA sequence
gaaagttttcttggtcagtg

SEQ ID NO: 549494 - DNA, 20 bp, Artificial
  CRISPR gRNA sequence
tttcttggtcagtgcagaac

SEQ ID NO: 549495 - DNA, 20 bp, Artificial
  CRISPR gRNA sequence
actagactattttgcgatat

SEQ ID NO: 549496 - DNA, 20 bp, Artificial
  CRISPR gRNA sequence
tgataacattttcatattat

SEQ ID NO: 549497 - DNA, 20 bp, Artificial
  CRISPR gRNA sequence
taccatgaaaatccatccct

SEQ ID NO: 549498 - DNA, 20 bp, Artificial
  CRISPR gRNA sequence
gaaaatccatccctaagtaa

SEQ ID NO: 549499 - DNA, 20 bp, Artificial
  CRISPR gRNA sequence
atccctaagtaatagattat

SEQ ID NO: 549500 - DNA, 20 bp, Artificial
  CRISPR gRNA sequence
ctaagtaatagattatcagt

SEQ ID NO: 549501 - DNA, 20 bp, Artificial
  CRISPR gRNA sequence
tcagttgactctccactaaa

SEQ ID NO: 549502 - DNA, 20 bp, Artificial
  CRISPR gRNA sequence
ctaaacagtattataacgat

SEQ ID NO: 549503 - DNA, 20 bp, Artificial
  CRISPR gRNA sequence
agtattataacgatcagctg

SEQ ID NO: 549504 - DNA, 20 bp, Artificial
  CRISPR gRNA sequence
ttataacgatcagctgaaga

SEQ ID NO: 549505 - DNA, 20 bp, Artificial
  CRISPR gRNA sequence
gatcagctgaagaaagtttt

SEQ ID NO: 549506 - DNA, 20 bp, Artificial
  CRISPR gRNA sequence
gcccaatgcataaaatattt

SEQ ID NO: 549507 - DNA, 20 bp, Artificial
  CRISPR gRNA sequence
cccaatgcataaaatatttt

SEQ ID NO: 549508 - DNA, 20 bp, Artificial
  CRISPR gRNA sequence
caatgcataaaatattttgg

SEQ ID NO: 549509 - DNA, 20 bp, Artificial
  CRISPR gRNA sequence
aatctattttaatccccaaa

SEQ ID NO: 549510 - DNA, 20 bp, Artificial
  CRISPR gRNA sequence
ctattttaatccccaaatag

SEQ ID NO: 549511 - DNA, 20 bp, Artificial
  CRISPR gRNA sequence
atccccaaatagcagtataa

SEQ ID NO: 549512 - DNA, 20 bp, Artificial
  CRISPR gRNA sequence
atagttaatcatctcctgaa

SEQ ID NO: 549513 - DNA, 20 bp, Artificial
  CRISPR gRNA sequence
tagttaatcatctcctgaac

SEQ ID NO: 549514 - DNA, 20 bp, Artificial
  CRISPR gRNA sequence
taatcatctcctgaacaggt

SEQ ID NO: 549515 - DNA, 20 bp, Artificial
  CRISPR gRNA sequence
ctcctgaacaggttggttcc

SEQ ID NO: 549516 - DNA, 20 bp, Artificial
  CRISPR gRNA sequence
aaccaaaatcattttccact

SEQ ID NO: 549517 - DNA, 20 bp, Artificial
  CRISPR gRNA sequence
ttttccactcagtgttgttg

SEQ ID NO: 549518 - DNA, 20 bp, Artificial
  CRISPR gRNA sequence
gttgttgtagatctcaatta

SEQ ID NO: 549519 - DNA, 20 bp, Artificial
  CRISPR gRNA sequence
tctcaattaaagaactaacc

SEQ ID NO: 549520 - DNA, 20 bp, Artificial
  CRISPR gRNA sequence
ctcaattaaagaactaaccc

SEQ ID NO: 549521 - DNA, 20 bp, Artificial
  CRISPR gRNA sequence
aacccaggatacctgaacta

SEQ ID NO: 549522 - DNA, 20 bp, Artificial
  CRISPR gRNA sequence
cccaggatacctgaactaaa

SEQ ID NO: 549523 - DNA, 20 bp, Artificial
  CRISPR gRNA sequence
caggatacctgaactaaaga

SEQ ID NO: 549524 - DNA, 20 bp, Artificial
  CRISPR gRNA sequence
aggatacctgaactaaagag

SEQ ID NO: 549525 - DNA, 20 bp, Artificial
  CRISPR gRNA sequence
atacctgaactaaagagagg

SEQ ID NO: 549526 - DNA, 20 bp, Artificial
  CRISPR gRNA sequence
aactaaagagaggtggcact

SEQ ID NO: 549527 - DNA, 20 bp, Artificial
  CRISPR gRNA sequence
gaggtggcactgagtttcca

SEQ ID NO: 549528 - DNA, 20 bp, Artificial
  CRISPR gRNA sequence
ccatagaacttcaaaacaat

SEQ ID NO: 549529 - DNA, 20 bp, Artificial
  CRISPR gRNA sequence
tcacttaaaaaaaaaaaaaa

SEQ ID NO: 549530 - DNA, 20 bp, Artificial
  CRISPR gRNA sequence
aaaaaaagtcattcaatata

SEQ ID NO: 549531 - DNA, 20 bp, Artificial
  CRISPR gRNA sequence
tatacagaaaattactcccc

SEQ ID NO: 549532 - DNA, 20 bp, Artificial
  CRISPR gRNA sequence
cagaaaattactcccctggt

SEQ ID NO: 549533 - DNA, 20 bp, Artificial
  CRISPR gRNA sequence
actcccctggtcagtactgt

SEQ ID NO: 549534 - DNA, 20 bp, Artificial
  CRISPR gRNA sequence
ctggtcagtactgttagccc

SEQ ID NO: 549535 - DNA, 20 bp, Artificial
  CRISPR gRNA sequence
cttaaaaaaaaaaaacaatt

SEQ ID NO: 549536 - DNA, 20 bp, Artificial
  CRISPR gRNA sequence
taaaaaaaaaaaacaatttg

SEQ ID NO: 549537 - DNA, 20 bp, Artificial
  CRISPR gRNA sequence
aaaaaaaaaaaacaatttgg

SEQ ID NO: 549538 - DNA, 20 bp, Artificial
  CRISPR gRNA sequence
aaaaaaaacaatttggaggc

SEQ ID NO: 549539 - DNA, 20 bp, Artificial
  CRISPR gRNA sequence
aaaaaaacaatttggaggcc

SEQ ID NO: 549540 - DNA, 20 bp, Artificial
  CRISPR gRNA sequence
aacaatttggaggccaggca

SEQ ID NO: 549541 - DNA, 20 bp, Artificial
  CRISPR gRNA sequence
aatttggaggccaggcatgg

SEQ ID NO: 549542 - DNA, 20 bp, Artificial
  CRISPR gRNA sequence
gtggctcatgcctgtaatcc

SEQ ID NO: 549543 - DNA, 20 bp, Artificial
  CRISPR gRNA sequence
gcctgtaatcccagcacatt

SEQ ID NO: 549544 - DNA, 20 bp, Artificial
  CRISPR gRNA sequence
ctgtaatcccagcacattga

SEQ ID NO: 549545 - DNA, 20 bp, Artificial
  CRISPR gRNA sequence
tgtaatcccagcacattgag

SEQ ID NO: 549546 - DNA, 20 bp, Artificial
  CRISPR gRNA sequence
tcccagcacattgagaggtc

SEQ ID NO: 549547 - DNA, 20 bp, Artificial
  CRISPR gRNA sequence
tcgagttgtgtgcatcactt

SEQ ID NO: 549548 - DNA, 20 bp, Artificial
  CRISPR gRNA sequence
ttgtgtgcatcacttgagcc

SEQ ID NO: 549549 - DNA, 20 bp, Artificial
  CRISPR gRNA sequence
tgtgtgcatcacttgagccc

SEQ ID NO: 549550 - DNA, 20 bp, Artificial
  CRISPR gRNA sequence
tgtgcatcacttgagcccag

SEQ ID NO: 549551 - DNA, 20 bp, Artificial
  CRISPR gRNA sequence
tcacttgagcccaggagttt

SEQ ID NO: 549552 - DNA, 20 bp, Artificial
  CRISPR gRNA sequence
tgagcccaggagtttgagac

SEQ ID NO: 549553 - DNA, 20 bp, Artificial
  CRISPR gRNA sequence
ccaggagtttgagaccagcc

SEQ ID NO: 549554 - DNA, 20 bp, Artificial
  CRISPR gRNA sequence
tgagaccagcctggacaaca

SEQ ID NO: 549555 - DNA, 20 bp, Artificial
  CRISPR gRNA sequence
ctacaaaaaaatacaaaaat

SEQ ID NO: 549556 - DNA, 20 bp, Artificial
  CRISPR gRNA sequence
aaaaaaatacaaaaattagc

SEQ ID NO: 549557 - DNA, 20 bp, Artificial
  CRISPR gRNA sequence
aaaaaatacaaaaattagcc

SEQ ID NO: 549558 - DNA, 20 bp, Artificial
  CRISPR gRNA sequence
atacaaaaattagccaggca

SEQ ID NO: 549559 - DNA, 20 bp, Artificial
  CRISPR gRNA sequence
caaaaattagccaggcatgg

SEQ ID NO: 549560 - DNA, 20 bp, Artificial
  CRISPR gRNA sequence
ggcatggtggtgcatgcctg

SEQ ID NO: 549561 - DNA, 20 bp, Artificial
  CRISPR gRNA sequence
gtggtgcatgcctgtagtcc

SEQ ID NO: 549562 - DNA, 20 bp, Artificial
  CRISPR gRNA sequence
tgcctgtagtcccagctact

SEQ ID NO: 549563 - DNA, 20 bp, Artificial
  CRISPR gRNA sequence
gcctgtagtcccagctactc

SEQ ID NO: 549564 - DNA, 20 bp, Artificial
  CRISPR gRNA sequence
ctgtagtcccagctactcag

SEQ ID NO: 549565 - DNA, 20 bp, Artificial
  CRISPR gRNA sequence
tgtagtcccagctactcagg

SEQ ID NO: 549566 - DNA, 20 bp, Artificial
  CRISPR gRNA sequence
tcccagctactcaggaggct

SEQ ID NO: 549567 - DNA, 20 bp, Artificial
  CRISPR gRNA sequence
cccagctactcaggaggctg

SEQ ID NO: 549568 - DNA, 20 bp, Artificial
  CRISPR gRNA sequence
agctactcaggaggctgagg

SEQ ID NO: 549569 - DNA, 20 bp, Artificial
  CRISPR gRNA sequence
gctactcaggaggctgaggc

SEQ ID NO: 549570 - DNA, 20 bp, Artificial
  CRISPR gRNA sequence
tactcaggaggctgaggcgg

SEQ ID NO: 549571 - DNA, 20 bp, Artificial
  CRISPR gRNA sequence
actcaggaggctgaggcggg

SEQ ID NO: 549572 - DNA, 20 bp, Artificial
  CRISPR gRNA sequence
ctcaggaggctgaggcggga

SEQ ID NO: 549573 - DNA, 20 bp, Artificial
  CRISPR gRNA sequence
caggaggctgaggcgggagg

SEQ ID NO: 549574 - DNA, 20 bp, Artificial
  CRISPR gRNA sequence
aggaggctgaggcgggaggg

SEQ ID NO: 549575 - DNA, 20 bp, Artificial
  CRISPR gRNA sequence
aggctgaggcgggagggagg

SEQ ID NO: 549576 - DNA, 20 bp, Artificial
  CRISPR gRNA sequence
cgggagggaggcagatgttg

SEQ ID NO: 549577 - DNA, 20 bp, Artificial
  CRISPR gRNA sequence
agggaggcagatgttgcagt

SEQ ID NO: 549578 - DNA, 20 bp, Artificial
  CRISPR gRNA sequence
ggcagatgttgcagtgagct

SEQ ID NO: 549579 - DNA, 20 bp, Artificial
  CRISPR gRNA sequence
gagattgtgccactgcactc

SEQ ID NO: 549580 - DNA, 20 bp, Artificial
  CRISPR gRNA sequence
tgtgccactgcactccagcc

SEQ ID NO: 549581 - DNA, 20 bp, Artificial
  CRISPR gRNA sequence
gtgccactgcactccagcct

SEQ ID NO: 549582 - DNA, 20 bp, Artificial
  CRISPR gRNA sequence
ctgcactccagcctgggtga

SEQ ID NO: 549583 - DNA, 20 bp, Artificial
  CRISPR gRNA sequence
gcactccagcctgggtgatg

SEQ ID NO: 549584 - DNA, 20 bp, Artificial
  CRISPR gRNA sequence
tccagcctgggtgatggagt

SEQ ID NO: 549585 - DNA, 20 bp, Artificial
  CRISPR gRNA sequence
aacaaacaaacaaaaaaact

SEQ ID NO: 549586 - DNA, 20 bp, Artificial
  CRISPR gRNA sequence
aacaaacaaaaaaactcagc

SEQ ID NO: 549587 - DNA, 20 bp, Artificial
  CRISPR gRNA sequence
cagcaagcatctcaaccttt

SEQ ID NO: 549588 - DNA, 20 bp, Artificial
  CRISPR gRNA sequence
tcaacctttaagcaacctta

SEQ ID NO: 549589 - DNA, 20 bp, Artificial
  CRISPR gRNA sequence
gcaaccttaaagtcattaat

SEQ ID NO: 549590 - DNA, 20 bp, Artificial
  CRISPR gRNA sequence
caaccttaaagtcattaatt

SEQ ID NO: 549591 - DNA, 20 bp, Artificial
  CRISPR gRNA sequence
taaagtcattaattgggaaa

SEQ ID NO: 549592 - DNA, 20 bp, Artificial
  CRISPR gRNA sequence
gtcattaattgggaaatagt

SEQ ID NO: 549593 - DNA, 20 bp, Artificial
  CRISPR gRNA sequence
ttgggaaatagtgagatgtt

SEQ ID NO: 549594 - DNA, 20 bp, Artificial
  CRISPR gRNA sequence
aaatagtgagatgtttggca

SEQ ID NO: 549595 - DNA, 20 bp, Artificial
  CRISPR gRNA sequence
gatgtttggcatggaatctt

SEQ ID NO: 549596 - DNA, 20 bp, Artificial
  CRISPR gRNA sequence
gtttggcatggaatcttcag

SEQ ID NO: 549597 - DNA, 20 bp, Artificial
  CRISPR gRNA sequence
ttggcatggaatcttcagaa

SEQ ID NO: 549598 - DNA, 20 bp, Artificial
  CRISPR gRNA sequence
tggcatggaatcttcagaag

SEQ ID NO: 549599 - DNA, 20 bp, Artificial
  CRISPR gRNA sequence
atggaatcttcagaagagga

SEQ ID NO: 549600 - DNA, 20 bp, Artificial
  CRISPR gRNA sequence
ggaatcttcagaagaggaaa

SEQ ID NO: 549601 - DNA, 20 bp, Artificial
  CRISPR gRNA sequence
cagaagaggaaagagttgaa

SEQ ID NO: 549602 - DNA, 20 bp, Artificial
  CRISPR gRNA sequence
aggaaagagttgaatggaaa

SEQ ID NO: 549603 - DNA, 20 bp, Artificial
  CRISPR gRNA sequence
gagttgaatggaaacagctc

SEQ ID NO: 549604 - DNA, 20 bp, Artificial
  CRISPR gRNA sequence
tggaaacagctccagctgcc

SEQ ID NO: 549605 - DNA, 20 bp, Artificial
  CRISPR gRNA sequence
cagctccagctgcctagttg

SEQ ID NO: 549606 - DNA, 20 bp, Artificial
  CRISPR gRNA sequence
agctgcctagttgtagttga

SEQ ID NO: 549607 - DNA, 20 bp, Artificial
  CRISPR gRNA sequence
tagttgacagacaactttat

SEQ ID NO: 549608 - DNA, 20 bp, Artificial
  CRISPR gRNA sequence
acagacaactttataagctc

SEQ ID NO: 549609 - DNA, 20 bp, Artificial
  CRISPR gRNA sequence
tctagtcaaccctattgact

SEQ ID NO: 549610 - DNA, 20 bp, Artificial
  CRISPR gRNA sequence
tgactaagcttctgaaccac

SEQ ID NO: 549611 - DNA, 20 bp, Artificial
  CRISPR gRNA sequence
aagcttctgaaccactagca

SEQ ID NO: 549612 - DNA, 20 bp, Artificial
  CRISPR gRNA sequence
ctgaaccactagcatagttc

SEQ ID NO: 549613 - DNA, 20 bp, Artificial
  CRISPR gRNA sequence
tgaaccactagcatagttct

SEQ ID NO: 549614 - DNA, 20 bp, Artificial
  CRISPR gRNA sequence
gaaccactagcatagttcta

SEQ ID NO: 549615 - DNA, 20 bp, Artificial
  CRISPR gRNA sequence
cactagcatagttctagggt

SEQ ID NO: 549616 - DNA, 20 bp, Artificial
  CRISPR gRNA sequence
actagcatagttctagggtc

SEQ ID NO: 549617 - DNA, 20 bp, Artificial
  CRISPR gRNA sequence
agcatagttctagggtcagg

SEQ ID NO: 549618 - DNA, 20 bp, Artificial
  CRISPR gRNA sequence
ggtcaggcggatgcctactg

SEQ ID NO: 549619 - DNA, 20 bp, Artificial
  CRISPR gRNA sequence
gtcaggcggatgcctactgt

SEQ ID NO: 549620 - DNA, 20 bp, Artificial
  CRISPR gRNA sequence
aggcggatgcctactgtggg

SEQ ID NO: 549621 - DNA, 20 bp, Artificial
  CRISPR gRNA sequence
ggcggatgcctactgtgggc

SEQ ID NO: 549622 - DNA, 20 bp, Artificial
  CRISPR gRNA sequence
gatgcctactgtgggcagga

SEQ ID NO: 549623 - DNA, 20 bp, Artificial
  CRISPR gRNA sequence
gaaagtgatgcatgcatgtg

SEQ ID NO: 549624 - DNA, 20 bp, Artificial
  CRISPR gRNA sequence
aaagtgatgcatgcatgtgt

SEQ ID NO: 549625 - DNA, 20 bp, Artificial
  CRISPR gRNA sequence
agtgatgcatgcatgtgtgg

SEQ ID NO: 549626 - DNA, 20 bp, Artificial
  CRISPR gRNA sequence
gatgcatgcatgtgtgggag

SEQ ID NO: 549627 - DNA, 20 bp, Artificial
  CRISPR gRNA sequence
cagtgtcttaatgtctgaaa

SEQ ID NO: 549628 - DNA, 20 bp, Artificial
  CRISPR gRNA sequence
tgtcttaatgtctgaaatag

SEQ ID NO: 549629 - DNA, 20 bp, Artificial
  CRISPR gRNA sequence
atgtctgaaatagtagccat

SEQ ID NO: 549630 - DNA, 20 bp, Artificial
  CRISPR gRNA sequence
tagtagccatgagctacatg

SEQ ID NO: 549631 - DNA, 20 bp, Artificial
  CRISPR gRNA sequence
ccatgagctacatgtggcta

SEQ ID NO: 549632 - DNA, 20 bp, Artificial
  CRISPR gRNA sequence
atgagctacatgtggctatg

SEQ ID NO: 549633 - DNA, 20 bp, Artificial
  CRISPR gRNA sequence
gctatggagcacttgaaatg

SEQ ID NO: 549634 - DNA, 20 bp, Artificial
  CRISPR gRNA sequence
ctatggagcacttgaaatgt

SEQ ID NO: 549635 - DNA, 20 bp, Artificial
  CRISPR gRNA sequence
atggagcacttgaaatgtgg

SEQ ID NO: 549636 - DNA, 20 bp, Artificial
  CRISPR gRNA sequence
tccaaattatcatgtgctgt

SEQ ID NO: 549637 - DNA, 20 bp, Artificial
  CRISPR gRNA sequence
gtgtaaaataatatgtttct

SEQ ID NO: 549638 - DNA, 20 bp, Artificial
  CRISPR gRNA sequence
gtttctaagaccgtgtgtga

SEQ ID NO: 549639 - DNA, 20 bp, Artificial
  CRISPR gRNA sequence
cattaaaaaatgtttatatt

SEQ ID NO: 549640 - DNA, 20 bp, Artificial
  CRISPR gRNA sequence
tttttttttactttgtaatg

SEQ ID NO: 549641 - DNA, 20 bp, Artificial
  CRISPR gRNA sequence
aaaattttaaattacttatg

SEQ ID NO: 549642 - DNA, 20 bp, Artificial
  CRISPR gRNA sequence
ggcttgcattatatttctat

SEQ ID NO: 549643 - DNA, 20 bp, Artificial
  CRISPR gRNA sequence
tgcattatatttctattgga

SEQ ID NO: 549644 - DNA, 20 bp, Artificial
  CRISPR gRNA sequence
atatttctattggacagcac

SEQ ID NO: 549645 - DNA, 20 bp, Artificial
  CRISPR gRNA sequence
agcactggtccaaactattc

SEQ ID NO: 549646 - DNA, 20 bp, Artificial
  CRISPR gRNA sequence
tctagccttccctgcatctt

SEQ ID NO: 549647 - DNA, 20 bp, Artificial
  CRISPR gRNA sequence
gcatcttcagccttatgcac

SEQ ID NO: 549648 - DNA, 20 bp, Artificial
  CRISPR gRNA sequence
catcttcagccttatgcacg

SEQ ID NO: 549649 - DNA, 20 bp, Artificial
  CRISPR gRNA sequence
ccttatgcacgaggtaaaat

SEQ ID NO: 549650 - DNA, 20 bp, Artificial
  CRISPR gRNA sequence
aaaattagccattttgtcaa

SEQ ID NO: 549651 - DNA, 20 bp, Artificial
  CRISPR gRNA sequence
ttgtcaacagtttttgcatt

SEQ ID NO: 549652 - DNA, 20 bp, Artificial
  CRISPR gRNA sequence
ccaatttttgaacaactctt

SEQ ID NO: 549653 - DNA, 20 bp, Artificial
  CRISPR gRNA sequence
ttttgaacaactctttggac

SEQ ID NO: 549654 - DNA, 20 bp, Artificial
  CRISPR gRNA sequence
aactctttggaccagctctg

SEQ ID NO: 549655 - DNA, 20 bp, Artificial
  CRISPR gRNA sequence
tctgtagccgatttgattta

SEQ ID NO: 549656 - DNA, 20 bp, Artificial
  CRISPR gRNA sequence
ccgatttgatttaaagcata

SEQ ID NO: 549657 - DNA, 20 bp, Artificial
  CRISPR gRNA sequence
cgatttgatttaaagcatat

SEQ ID NO: 549658 - DNA, 20 bp, Artificial
  CRISPR gRNA sequence
ttgatttaaagcatatagga

SEQ ID NO: 549659 - DNA, 20 bp, Artificial
  CRISPR gRNA sequence
atttaaagcatataggatag

SEQ ID NO: 549660 - DNA, 20 bp, Artificial
  CRISPR gRNA sequence
tttaaagcatataggatagc

SEQ ID NO: 549661 - DNA, 20 bp, Artificial
  CRISPR gRNA sequence
tataggatagcaggaaatcc

SEQ ID NO: 549662 - DNA, 20 bp, Artificial
  CRISPR gRNA sequence
ataggatagcaggaaatccc

SEQ ID NO: 549663 - DNA, 20 bp, Artificial
  CRISPR gRNA sequence
taggatagcaggaaatccca

SEQ ID NO: 549664 - DNA, 20 bp, Artificial
  CRISPR gRNA sequence
agcaggaaatcccagggtga

SEQ ID NO: 549665 - DNA, 20 bp, Artificial
  CRISPR gRNA sequence
gcaggaaatcccagggtgat

SEQ ID NO: 549666 - DNA, 20 bp, Artificial
  CRISPR gRNA sequence
caggaaatcccagggtgatg

SEQ ID NO: 549667 - DNA, 20 bp, Artificial
  CRISPR gRNA sequence
atcccagggtgatggggctc

SEQ ID NO: 549668 - DNA, 20 bp, Artificial
  CRISPR gRNA sequence
agggtgatggggctctggct

SEQ ID NO: 549669 - DNA, 20 bp, Artificial
  CRISPR gRNA sequence
ctggcttagttttccatatt

SEQ ID NO: 549670 - DNA, 20 bp, Artificial
  CRISPR gRNA sequence
tggcttagttttccatattt

SEQ ID NO: 549671 - DNA, 20 bp, Artificial
  CRISPR gRNA sequence
ttccatatttaggcctctaa

SEQ ID NO: 549672 - DNA, 20 bp, Artificial
  CRISPR gRNA sequence
tccatatttaggcctctaat

SEQ ID NO: 549673 - DNA, 20 bp, Artificial
  CRISPR gRNA sequence
atatttaggcctctaatagg

SEQ ID NO: 549674 - DNA, 20 bp, Artificial
  CRISPR gRNA sequence
ttaggcctctaataggcagt

SEQ ID NO: 549675 - DNA, 20 bp, Artificial
  CRISPR gRNA sequence
cacatttcaccttttctttt

SEQ ID NO: 549676 - DNA, 20 bp, Artificial
  CRISPR gRNA sequence
ttcttttcagttctttaatt

SEQ ID NO: 549677 - DNA, 20 bp, Artificial
  CRISPR gRNA sequence
ttttcagttctttaattgag

SEQ ID NO: 549678 - DNA, 20 bp, Artificial
  CRISPR gRNA sequence
gaagacaatttcttcatttt

SEQ ID NO: 549679 - DNA, 20 bp, Artificial
  CRISPR gRNA sequence
aagacaatttcttcattttt

SEQ ID NO: 549680 - DNA, 20 bp, Artificial
  CRISPR gRNA sequence
ttaggtattctgaaatgtga

SEQ ID NO: 549681 - DNA, 20 bp, Artificial
  CRISPR gRNA sequence
tctgaaatgtgacagaaaac

SEQ ID NO: 549682 - DNA, 20 bp, Artificial
  CRISPR gRNA sequence
aaatgtgacagaaaaccaga

SEQ ID NO: 549683 - DNA, 20 bp, Artificial
  CRISPR gRNA sequence
acagaaaaccagacagaacc

SEQ ID NO: 549684 - DNA, 20 bp, Artificial
  CRISPR gRNA sequence
aaaaccagacagaaccaagt

SEQ ID NO: 549685 - DNA, 20 bp, Artificial
  CRISPR gRNA sequence
agaaccaagtaagtacactg

SEQ ID NO: 549686 - DNA, 20 bp, Artificial
  CRISPR gRNA sequence
gaaccaagtaagtacactgc

SEQ ID NO: 549687 - DNA, 20 bp, Artificial
  CRISPR gRNA sequence
gcaggctgtgcactctgtgc

SEQ ID NO: 549688 - DNA, 20 bp, Artificial
  CRISPR gRNA sequence
tgcactctgtgccagaacaa

SEQ ID NO: 549689 - DNA, 20 bp, Artificial
  CRISPR gRNA sequence
actctgtgccagaacaacag

SEQ ID NO: 549690 - DNA, 20 bp, Artificial
  CRISPR gRNA sequence
gaacaacagcagccctgctg

SEQ ID NO: 549691 - DNA, 20 bp, Artificial
  CRISPR gRNA sequence
tgctgtagatgcccattact

SEQ ID NO: 549692 - DNA, 20 bp, Artificial
  CRISPR gRNA sequence
gctgtagatgcccattactt

SEQ ID NO: 549693 - DNA, 20 bp, Artificial
  CRISPR gRNA sequence
gtagatgcccattacttggg

SEQ ID NO: 549694 - DNA, 20 bp, Artificial
  CRISPR gRNA sequence
atgcccattacttgggaagc

SEQ ID NO: 549695 - DNA, 20 bp, Artificial
  CRISPR gRNA sequence
gccagattgtactcatctgt

SEQ ID NO: 549696 - DNA, 20 bp, Artificial
  CRISPR gRNA sequence
catctgttggttgccttgta

SEQ ID NO: 549697 - DNA, 20 bp, Artificial
  CRISPR gRNA sequence
tggttgccttgtacagtaat

SEQ ID NO: 549698 - DNA, 20 bp, Artificial
  CRISPR gRNA sequence
ttgccttgtacagtaataag

SEQ ID NO: 549699 - DNA, 20 bp, Artificial
  CRISPR gRNA sequence
acagtaataagaagtaacat

SEQ ID NO: 549700 - DNA, 20 bp, Artificial
  CRISPR gRNA sequence
gtaataagaagtaacatcag

SEQ ID NO: 549701 - DNA, 20 bp, Artificial
  CRISPR gRNA sequence
atcagcagatatactaacca

SEQ ID NO: 549702 - DNA, 20 bp, Artificial
  CRISPR gRNA sequence
tatactaaccatagtgtatt

SEQ ID NO: 549703 - DNA, 20 bp, Artificial
  CRISPR gRNA sequence
ctgtgtgccatgcactgcac

SEQ ID NO: 549704 - DNA, 20 bp, Artificial
  CRISPR gRNA sequence
actctctgcatatcgtttcc

SEQ ID NO: 549705 - DNA, 20 bp, Artificial
  CRISPR gRNA sequence
tttcctggaaccctctcaat

SEQ ID NO: 549706 - DNA, 20 bp, Artificial
  CRISPR gRNA sequence
aaccctctcaatgagccttg

SEQ ID NO: 549707 - DNA, 20 bp, Artificial
  CRISPR gRNA sequence
accctctcaatgagccttgc

SEQ ID NO: 549708 - DNA, 20 bp, Artificial
  CRISPR gRNA sequence
cctctcaatgagccttgcag

SEQ ID NO: 549709 - DNA, 20 bp, Artificial
  CRISPR gRNA sequence
ctctcaatgagccttgcagg

SEQ ID NO: 549710 - DNA, 20 bp, Artificial
  CRISPR gRNA sequence
ctcaatgagccttgcaggag

SEQ ID NO: 549711 - DNA, 20 bp, Artificial
  CRISPR gRNA sequence
ggagtatcataccccttgct

SEQ ID NO: 549712 - DNA, 20 bp, Artificial
  CRISPR gRNA sequence
agtatcataccccttgctta

SEQ ID NO: 549713 - DNA, 20 bp, Artificial
  CRISPR gRNA sequence
tcataccccttgcttagaga

SEQ ID NO: 549714 - DNA, 20 bp, Artificial
  CRISPR gRNA sequence
tgcttagagacagcgcatat

SEQ ID NO: 549715 - DNA, 20 bp, Artificial
  CRISPR gRNA sequence
gacagcgcatatgagattca

SEQ ID NO: 549716 - DNA, 20 bp, Artificial
  CRISPR gRNA sequence
agcgcatatgagattcatag

SEQ ID NO: 549717 - DNA, 20 bp, Artificial
  CRISPR gRNA sequence
atatgagattcatagaagtc

SEQ ID NO: 549718 - DNA, 20 bp, Artificial
  CRISPR gRNA sequence
gagattcatagaagtcaagt

SEQ ID NO: 549719 - DNA, 20 bp, Artificial
  CRISPR gRNA sequence
agaagtcaagtgagatatca

SEQ ID NO: 549720 - DNA, 20 bp, Artificial
  CRISPR gRNA sequence
agatatcaaagtcacgttgc

SEQ ID NO: 549721 - DNA, 20 bp, Artificial
  CRISPR gRNA sequence
atcaaagtcacgttgctagt

SEQ ID NO: 549722 - DNA, 20 bp, Artificial
  CRISPR gRNA sequence
gtcacgttgctagtaagtga

SEQ ID NO: 549723 - DNA, 20 bp, Artificial
  CRISPR gRNA sequence
tcacgttgctagtaagtgat

SEQ ID NO: 549724 - DNA, 20 bp, Artificial
  CRISPR gRNA sequence
gttgctagtaagtgatgggc

SEQ ID NO: 549725 - DNA, 20 bp, Artificial
  CRISPR gRNA sequence
ttgctagtaagtgatgggct

SEQ ID NO: 549726 - DNA, 20 bp, Artificial
  CRISPR gRNA sequence
gatgggctgggatttaaatc

SEQ ID NO: 549727 - DNA, 20 bp, Artificial
  CRISPR gRNA sequence
atgggctgggatttaaatct

SEQ ID NO: 549728 - DNA, 20 bp, Artificial
  CRISPR gRNA sequence
gggatttaaatctaggtctt

SEQ ID NO: 549729 - DNA, 20 bp, Artificial
  CRISPR gRNA sequence
aatctaggtctttggactcc

SEQ ID NO: 549730 - DNA, 20 bp, Artificial
  CRISPR gRNA sequence
tctaggtctttggactccaa

SEQ ID NO: 549731 - DNA, 20 bp, Artificial
  CRISPR gRNA sequence
actccctccacctcccatcc

SEQ ID NO: 549732 - DNA, 20 bp, Artificial
  CRISPR gRNA sequence
tccacctcccatcccagaaa

SEQ ID NO: 549733 - DNA, 20 bp, Artificial
  CRISPR gRNA sequence
cctcccatcccagaaaaagt

SEQ ID NO: 549734 - DNA, 20 bp, Artificial
  CRISPR gRNA sequence
catcccagaaaaagttggat

SEQ ID NO: 549735 - DNA, 20 bp, Artificial
  CRISPR gRNA sequence
atcccagaaaaagttggatc

SEQ ID NO: 549736 - DNA, 20 bp, Artificial
  CRISPR gRNA sequence
tcccagaaaaagttggatca

SEQ ID NO: 549737 - DNA, 20 bp, Artificial
  CRISPR gRNA sequence
agaaaaagttggatcaggga

SEQ ID NO: 549738 - DNA, 20 bp, Artificial
  CRISPR gRNA sequence
gaaaaagttggatcagggat

SEQ ID NO: 549739 - DNA, 20 bp, Artificial
  CRISPR gRNA sequence
aaaaagttggatcagggata

SEQ ID NO: 549740 - DNA, 20 bp, Artificial
  CRISPR gRNA sequence
atcagggatagggttcactt

SEQ ID NO: 549741 - DNA, 20 bp, Artificial
  CRISPR gRNA sequence
tcagggatagggttcacttc

SEQ ID NO: 549742 - DNA, 20 bp, Artificial
  CRISPR gRNA sequence
agggatagggttcacttcag

SEQ ID NO: 549743 - DNA, 20 bp, Artificial
  CRISPR gRNA sequence
atagggttcacttcaggagc

SEQ ID NO: 549744 - DNA, 20 bp, Artificial
  CRISPR gRNA sequence
tagggttcacttcaggagcc

SEQ ID NO: 549745 - DNA, 20 bp, Artificial
  CRISPR gRNA sequence
agggttcacttcaggagcca

SEQ ID NO: 549746 - DNA, 20 bp, Artificial
  CRISPR gRNA sequence
ttcacttcaggagccagggt

SEQ ID NO: 549747 - DNA, 20 bp, Artificial
  CRISPR gRNA sequence
cacttcaggagccagggtca

SEQ ID NO: 549748 - DNA, 20 bp, Artificial
  CRISPR gRNA sequence
tcaggagccagggtcagagc

SEQ ID NO: 549749 - DNA, 20 bp, Artificial
  CRISPR gRNA sequence
caggagccagggtcagagct

SEQ ID NO: 549750 - DNA, 20 bp, Artificial
  CRISPR gRNA sequence
cagggtcagagctgggcctg

SEQ ID NO: 549751 - DNA, 20 bp, Artificial
  CRISPR gRNA sequence
gggcctgtagtcacatataa

SEQ ID NO: 549752 - DNA, 20 bp, Artificial
  CRISPR gRNA sequence
ctgtagtcacatataaaaga

SEQ ID NO: 549753 - DNA, 20 bp, Artificial
  CRISPR gRNA sequence
tgtagtcacatataaaagat

SEQ ID NO: 549754 - DNA, 20 bp, Artificial
  CRISPR gRNA sequence
agataggacacaaacacaat

SEQ ID NO: 549755 - DNA, 20 bp, Artificial
  CRISPR gRNA sequence
taggacacaaacacaattag

SEQ ID NO: 549756 - DNA, 20 bp, Artificial
  CRISPR gRNA sequence
gacacaaacacaattagcag

SEQ ID NO: 549757 - DNA, 20 bp, Artificial
  CRISPR gRNA sequence
aacacaattagcagcagtgt

SEQ ID NO: 549758 - DNA, 20 bp, Artificial
  CRISPR gRNA sequence
gttggtttaataaaccgccg

SEQ ID NO: 549759 - DNA, 20 bp, Artificial
  CRISPR gRNA sequence
ttggtttaataaaccgccgt

SEQ ID NO: 549760 - DNA, 20 bp, Artificial
  CRISPR gRNA sequence
tggtttaataaaccgccgta

SEQ ID NO: 549761 - DNA, 20 bp, Artificial
  CRISPR gRNA sequence
aaaccgccgtagggtgctcc

SEQ ID NO: 549762 - DNA, 20 bp, Artificial
  CRISPR gRNA sequence
accgccgtagggtgctccaa

SEQ ID NO: 549763 - DNA, 20 bp, Artificial
  CRISPR gRNA sequence
ccgccgtagggtgctccaag

SEQ ID NO: 549764 - DNA, 20 bp, Artificial
  CRISPR gRNA sequence
tgctccaagaggccccctcc

SEQ ID NO: 549765 - DNA, 20 bp, Artificial
  CRISPR gRNA sequence
tccaagaggccccctcctgg

SEQ ID NO: 549766 - DNA, 20 bp, Artificial
  CRISPR gRNA sequence
cccctcctggcagatcccac

SEQ ID NO: 549767 - DNA, 20 bp, Artificial
  CRISPR gRNA sequence
ctcctggcagatcccactgg

SEQ ID NO: 549768 - DNA, 20 bp, Artificial
  CRISPR gRNA sequence
tggcagatcccactggtggt

SEQ ID NO: 549769 - DNA, 20 bp, Artificial
  CRISPR gRNA sequence
ggcagatcccactggtggtc

SEQ ID NO: 549770 - DNA, 20 bp, Artificial
  CRISPR gRNA sequence
cagatcccactggtggtcag

SEQ ID NO: 549771 - DNA, 20 bp, Artificial
  CRISPR gRNA sequence
agatcccactggtggtcagg

SEQ ID NO: 549772 - DNA, 20 bp, Artificial
  CRISPR gRNA sequence
tcccactggtggtcaggagg

SEQ ID NO: 549773 - DNA, 20 bp, Artificial
  CRISPR gRNA sequence
ccactggtggtcaggaggca

SEQ ID NO: 549774 - DNA, 20 bp, Artificial
  CRISPR gRNA sequence
cactggtggtcaggaggcag

SEQ ID NO: 549775 - DNA, 20 bp, Artificial
  CRISPR gRNA sequence
tggtcaggaggcagaggcat

SEQ ID NO: 549776 - DNA, 20 bp, Artificial
  CRISPR gRNA sequence
caggaggcagaggcatgagc

SEQ ID NO: 549777 - DNA, 20 bp, Artificial
  CRISPR gRNA sequence
aggaggcagaggcatgagct

SEQ ID NO: 549778 - DNA, 20 bp, Artificial
  CRISPR gRNA sequence
agaggcatgagctgggtgtt

SEQ ID NO: 549779 - DNA, 20 bp, Artificial
  CRISPR gRNA sequence
gaggcatgagctgggtgttg

SEQ ID NO: 549780 - DNA, 20 bp, Artificial
  CRISPR gRNA sequence
aggcatgagctgggtgttga

SEQ ID NO: 549781 - DNA, 20 bp, Artificial
  CRISPR gRNA sequence
tgagctgggtgttgagggat

SEQ ID NO: 549782 - DNA, 20 bp, Artificial
  CRISPR gRNA sequence
gagctgggtgttgagggatg

SEQ ID NO: 549783 - DNA, 20 bp, Artificial
  CRISPR gRNA sequence
agctgggtgttgagggatga

SEQ ID NO: 549784 - DNA, 20 bp, Artificial
  CRISPR gRNA sequence
gctgggtgttgagggatgag

SEQ ID NO: 549785 - DNA, 20 bp, Artificial
  CRISPR gRNA sequence
gggtgttgagggatgagggg

SEQ ID NO: 549786 - DNA, 20 bp, Artificial
  CRISPR gRNA sequence
gtgttgagggatgaggggaa

SEQ ID NO: 549787 - DNA, 20 bp, Artificial
  CRISPR gRNA sequence
gagggatgaggggaagagtt

SEQ ID NO: 549788 - DNA, 20 bp, Artificial
  CRISPR gRNA sequence
agggatgaggggaagagtta

SEQ ID NO: 549789 - DNA, 20 bp, Artificial
  CRISPR gRNA sequence
tgaggggaagagttaaggcc

SEQ ID NO: 549790 - DNA, 20 bp, Artificial
  CRISPR gRNA sequence
ctctgcctcctgaccaccag

SEQ ID NO: 549791 - DNA, 20 bp, Artificial
  CRISPR gRNA sequence
atccctgatccaactttttc

SEQ ID NO: 549792 - DNA, 20 bp, Artificial
  CRISPR gRNA sequence
tttctgggatgggaggtgga

SEQ ID NO: 549793 - DNA, 20 bp, Artificial
  CRISPR gRNA sequence
gtggttaacagtataactct

SEQ ID NO: 549794 - DNA, 20 bp, Artificial
  CRISPR gRNA sequence
tgatatctcacttgacttct

SEQ ID NO: 549795 - DNA, 20 bp, Artificial
  CRISPR gRNA sequence
atatgcgctgtctctaagca

SEQ ID NO: 549796 - DNA, 20 bp, Artificial
  CRISPR gRNA sequence
cctcctgcaaggctcattga

SEQ ID NO: 549797 - DNA, 20 bp, Artificial
  CRISPR gRNA sequence
gttccaggaaacgatatgca

SEQ ID NO: 549798 - DNA, 20 bp, Artificial
  CRISPR gRNA sequence
ctgtacaaggcaaccaacag

SEQ ID NO: 549799 - DNA, 20 bp, Artificial
  CRISPR gRNA sequence
gggctgctgttgttctggca

SEQ ID NO: 549800 - DNA, 20 bp, Artificial
  CRISPR gRNA sequence
tctggttttctgtcacattt

SEQ ID NO: 549801 - DNA, 20 bp, Artificial
  CRISPR gRNA sequence
tgaaaagaaaaggtgaaatg

SEQ ID NO: 549802 - DNA, 20 bp, Artificial
  CRISPR gRNA sequence
aagccagagccccatcaccc

SEQ ID NO: 549803 - DNA, 20 bp, Artificial
  CRISPR gRNA sequence
tcggctacagagctggtcca

SEQ ID NO: 549804 - DNA, 20 bp, Artificial
  CRISPR gRNA sequence
gctgaagatgcagggaaggc

SEQ ID NO: 549805 - DNA, 20 bp, Artificial
  CRISPR gRNA sequence
tggttcagaagcttagtcaa

SEQ ID NO: 549806 - DNA, 20 bp, Artificial
  CRISPR gRNA sequence
cttaaaggttgagatgcttg

SEQ ID NO: 549807 - DNA, 20 bp, Artificial
  CRISPR gRNA sequence
tgtttgtttgttttttgaga

SEQ ID NO: 549808 - DNA, 20 bp, Artificial
  CRISPR gRNA sequence
tctcactccatcacccaggc

SEQ ID NO: 549809 - DNA, 20 bp, Artificial
  CRISPR gRNA sequence
ctccctcccgcctcagcctc

SEQ ID NO: 549810 - DNA, 20 bp, Artificial
  CRISPR gRNA sequence
aactcgacctctcaatgtgc

SEQ ID NO: 549811 - DNA, 20 bp, Artificial
  CRISPR gRNA sequence
gggctaacagtactgaccag

SEQ ID NO: 549812 - DNA, 20 bp, Artificial
  CRISPR gRNA sequence
ggggagtaattttctgtata

SEQ ID NO: 549813 - DNA, 20 bp, Artificial
  CRISPR gRNA sequence
ctctctttagttcaggtatc

SEQ ID NO: 549814 - DNA, 20 bp, Artificial
  CRISPR gRNA sequence
aattgagatctacaacaaca

SEQ ID NO: 549815 - DNA, 20 bp, Artificial
  CRISPR gRNA sequence
taactattatactgctattt

SEQ ID NO: 549816 - DNA, 20 bp, Artificial
  CRISPR gRNA sequence
cgttataatactgtttagtg

SEQ ID NO: 549817 - DNA, 20 bp, Artificial
  CRISPR gRNA sequence
tgactgataatctattactt

SEQ ID NO: 549818 - DNA, 20 bp, Artificial
  CRISPR gRNA sequence
tgataatctattacttaggg

SEQ ID NO: 549819 - DNA, 20 bp, Artificial
  CRISPR gRNA sequence
aagaaaactttctgcaatga

SEQ ID NO: 549820 - DNA, 20 bp, Artificial
  CRISPR gRNA sequence
aaaggtggttagtgtaactg

SEQ ID NO: 549821 - DNA, 20 bp, Artificial
  CRISPR gRNA sequence
gtggttagtgtaactgagga

SEQ ID NO: 549822 - DNA, 20 bp, Artificial
  CRISPR gRNA sequence
taaacttgattcatgacaca

SEQ ID NO: 549823 - DNA, 20 bp, Artificial
  CRISPR gRNA sequence
atggaaactgctgtggcatc

SEQ ID NO: 549824 - DNA, 20 bp, Artificial
  CRISPR gRNA sequence
catcaagaatatccactctt

SEQ ID NO: 549825 - DNA, 20 bp, Artificial
  CRISPR gRNA sequence
acagcctgctccctgtcctt

SEQ ID NO: 549826 - DNA, 20 bp, Artificial
  CRISPR gRNA sequence
cctgtcctttgggatttgag

SEQ ID NO: 549827 - DNA, 20 bp, Artificial
  CRISPR gRNA sequence
gagagggattactcattacc

SEQ ID NO: 549828 - DNA, 20 bp, Artificial
  CRISPR gRNA sequence
tgtaaagctctctgtggcct

SEQ ID NO: 549829 - DNA, 20 bp, Artificial
  CRISPR gRNA sequence
tcattctaccttgagataat

SEQ ID NO: 549830 - DNA, 20 bp, Artificial
  CRISPR gRNA sequence
ttgtaattactgctaatggt

SEQ ID NO: 549831 - DNA, 20 bp, Artificial
  CRISPR gRNA sequence
tataagtgcatatctgtgtc

SEQ ID NO: 549832 - DNA, 20 bp, Artificial
  CRISPR gRNA sequence
aactagttgaactgatcaaa

SEQ ID NO: 549833 - DNA, 20 bp, Artificial
  CRISPR gRNA sequence
taagaacagtgatgaaaact

SEQ ID NO: 549834 - DNA, 20 bp, Artificial
  CRISPR gRNA sequence
tatagtgttgaagggctgac

SEQ ID NO: 549835 - DNA, 20 bp, Artificial
  CRISPR gRNA sequence
tagataagcttcacttaggc

SEQ ID NO: 549836 - DNA, 20 bp, Artificial
  CRISPR gRNA sequence
gagttacagtgctgttggct

SEQ ID NO: 549837 - DNA, 20 bp, Artificial
  CRISPR gRNA sequence
cttgactctgtagaactaat

SEQ ID NO: 549838 - DNA, 20 bp, Artificial
  CRISPR gRNA sequence
tcagtgcctccattttctca

SEQ ID NO: 549839 - DNA, 20 bp, Artificial
  CRISPR gRNA sequence
taataaatatacttatctca

SEQ ID NO: 549840 - DNA, 20 bp, Artificial
  CRISPR gRNA sequence
tatatactgtcattaaccta

SEQ ID NO: 549841 - DNA, 20 bp, Artificial
  CRISPR gRNA sequence
agctattgaaaatccaaaat

SEQ ID NO: 549842 - DNA, 20 bp, Artificial
  CRISPR gRNA sequence
gagtacacaatgcactgcta

SEQ ID NO: 549843 - DNA, 20 bp, Artificial
  CRISPR gRNA sequence
gcactgctaaaggattgggg

SEQ ID NO: 549844 - DNA, 20 bp, Artificial
  CRISPR gRNA sequence
tcactaagaacaaatgtgac

SEQ ID NO: 549845 - DNA, 20 bp, Artificial
  CRISPR gRNA sequence
aggaggaagagagagagaaa

SEQ ID NO: 549846 - DNA, 20 bp, Artificial
  CRISPR gRNA sequence
ggaagagagagagaaaatga

SEQ ID NO: 549847 - DNA, 20 bp, Artificial
  CRISPR gRNA sequence
gagaaaatgaatgaataaat

SEQ ID NO: 549848 - DNA, 20 bp, Artificial
  CRISPR gRNA sequence
atgaatgaataaatgagaat

SEQ ID NO: 549849 - DNA, 20 bp, Artificial
  CRISPR gRNA sequence
tctagagccataagttcatc

SEQ ID NO: 549850 - DNA, 20 bp, Artificial
  CRISPR gRNA sequence
ctttatcgtttttcaaaata

SEQ ID NO: 549851 - DNA, 20 bp, Artificial
  CRISPR gRNA sequence
gcattctctagagatgacca

SEQ ID NO: 549852 - DNA, 20 bp, Artificial
  CRISPR gRNA sequence
ttggccagagggaacctctt

SEQ ID NO: 549853 - DNA, 20 bp, Artificial
  CRISPR gRNA sequence
gaacctcttcagagtggctc

SEQ ID NO: 549854 - DNA, 20 bp, Artificial
  CRISPR gRNA sequence
tgcattccatgccccaggta

SEQ ID NO: 549855 - DNA, 20 bp, Artificial
  CRISPR gRNA sequence
tgataattaggtaccataat

SEQ ID NO: 549856 - DNA, 20 bp, Artificial
  CRISPR gRNA sequence
tcctggttttcctgaaactg

SEQ ID NO: 549857 - DNA, 20 bp, Artificial
  CRISPR gRNA sequence
cctgaaactgaagagtttcc

SEQ ID NO: 549858 - DNA, 20 bp, Artificial
  CRISPR gRNA sequence
agtttcctgggatatgaaat

SEQ ID NO: 549859 - DNA, 20 bp, Artificial
  CRISPR gRNA sequence
gtaacactggtcactcaaat

SEQ ID NO: 549860 - DNA, 20 bp, Artificial
  CRISPR gRNA sequence
ctaagagacaaaatacatta

SEQ ID NO: 549861 - DNA, 20 bp, Artificial
  CRISPR gRNA sequence
ttaacctaatcaatttacag

SEQ ID NO: 549862 - DNA, 20 bp, Artificial
  CRISPR gRNA sequence
tttatagttctttttatcct

SEQ ID NO: 549863 - DNA, 20 bp, Artificial
  CRISPR gRNA sequence
tactatgttttgaaaacact

SEQ ID NO: 549864 - DNA, 20 bp, Artificial
  CRISPR gRNA sequence
cttggaatggttcctctatt

SEQ ID NO: 549865 - DNA, 20 bp, Artificial
  CRISPR gRNA sequence
ttcacttggctttaaatatt

SEQ ID NO: 549866 - DNA, 20 bp, Artificial
  CRISPR gRNA sequence
ccattatcaatatccctcac

SEQ ID NO: 549867 - DNA, 20 bp, Artificial
  CRISPR gRNA sequence
caccagagtggtacattttt

SEQ ID NO: 549868 - DNA, 20 bp, Artificial
  CRISPR gRNA sequence
agcattcagttgtacattct

SEQ ID NO: 549869 - DNA, 20 bp, Artificial
  CRISPR gRNA sequence
aacatcgttacagtatcata

SEQ ID NO: 549870 - DNA, 20 bp, Artificial
  CRISPR gRNA sequence
ctccacagttttgccttttc

SEQ ID NO: 549871 - DNA, 20 bp, Artificial
  CRISPR gRNA sequence
tagcatgtagcctgttcaga

SEQ ID NO: 549872 - DNA, 20 bp, Artificial
  CRISPR gRNA sequence
cttgatagttcttttcagtg

SEQ ID NO: 549873 - DNA, 20 bp, Artificial
  CRISPR gRNA sequence
aacataagtttttaatgcct

SEQ ID NO: 549874 - DNA, 20 bp, Artificial
  CRISPR gRNA sequence
caagaagcatgacagttgtg

SEQ ID NO: 549875 - DNA, 20 bp, Artificial
  CRISPR gRNA sequence
tgacagttgtgttgaatggt

SEQ ID NO: 549876 - DNA, 20 bp, Artificial
  CRISPR gRNA sequence
attttgcattcccacctgca

SEQ ID NO: 549877 - DNA, 20 bp, Artificial
  CRISPR gRNA sequence
cattcccacctgcaatgaat

SEQ ID NO: 549878 - DNA, 20 bp, Artificial
  CRISPR gRNA sequence
aaaatagaaaatagtagaaa

SEQ ID NO: 549879 - DNA, 20 bp, Artificial
  CRISPR gRNA sequence
gcctcggcctcccaaagtgc

SEQ ID NO: 549880 - DNA, 20 bp, Artificial
  CRISPR gRNA sequence
tgagccaccgcacccggccc

SEQ ID NO: 549881 - DNA, 20 bp, Artificial
  CRISPR gRNA sequence
atctttgactcattttttaa

SEQ ID NO: 549882 - DNA, 20 bp, Artificial
  CRISPR gRNA sequence
ggttgtttgtgtttttcttg

SEQ ID NO: 549883 - DNA, 20 bp, Artificial
  CRISPR gRNA sequence
ttaaaagttttttgtatatt

SEQ ID NO: 549884 - DNA, 20 bp, Artificial
  CRISPR gRNA sequence
gcttaccaattctttctttc

SEQ ID NO: 549885 - DNA, 20 bp, Artificial
  CRISPR gRNA sequence
taggttttctcttatgtttt

SEQ ID NO: 549886 - DNA, 20 bp, Artificial
  CRISPR gRNA sequence
atttagatctatggtccatt

SEQ ID NO: 549887 - DNA, 20 bp, Artificial
  CRISPR gRNA sequence
ttagattcatttttttgcat

SEQ ID NO: 549888 - DNA, 20 bp, Artificial
  CRISPR gRNA sequence
ctttatagtaagtcttgaag

SEQ ID NO: 549889 - DNA, 20 bp, Artificial
  CRISPR gRNA sequence
atgacttctgatattttgct

SEQ ID NO: 549890 - DNA, 20 bp, Artificial
  CRISPR gRNA sequence
atattttgcttgggattgca

SEQ ID NO: 549891 - DNA, 20 bp, Artificial
  CRISPR gRNA sequence
ttgggattgcactgaattta

SEQ ID NO: 549892 - DNA, 20 bp, Artificial
  CRISPR gRNA sequence
taactgacatcttcacaata

SEQ ID NO: 549893 - DNA, 20 bp, Artificial
  CRISPR gRNA sequence
agtcttcctatctatgaaca

SEQ ID NO: 549894 - DNA, 20 bp, Artificial
  CRISPR gRNA sequence
gtacctaagtattgcatttt

SEQ ID NO: 549895 - DNA, 20 bp, Artificial
  CRISPR gRNA sequence
gaggtttttggtcaattcgt

SEQ ID NO: 549896 - DNA, 20 bp, Artificial
  CRISPR gRNA sequence
cttatagtacaatactgaaa

SEQ ID NO: 549897 - DNA, 20 bp, Artificial
  CRISPR gRNA sequence
attacagatgatgttagctg

SEQ ID NO: 549898 - DNA, 20 bp, Artificial
  CRISPR gRNA sequence
ccctctattcctagtttact

SEQ ID NO: 549899 - DNA, 20 bp, Artificial
  CRISPR gRNA sequence
gtttttatcataaattgatg

SEQ ID NO: 549900 - DNA, 20 bp, Artificial
  CRISPR gRNA sequence
tttcatagtctgtcaatgtg

SEQ ID NO: 549901 - DNA, 20 bp, Artificial
  CRISPR gRNA sequence
ataattctttctatatgctg

SEQ ID NO: 549902 - DNA, 20 bp, Artificial
  CRISPR gRNA sequence
ttgttctttggttttagcac

SEQ ID NO: 549903 - DNA, 20 bp, Artificial
  CRISPR gRNA sequence
aataatgctggcctcataaa

SEQ ID NO: 549904 - DNA, 20 bp, Artificial
  CRISPR gRNA sequence
atcttctaaaagagattata

SEQ ID NO: 549905 - DNA, 20 bp, Artificial
  CRISPR gRNA sequence
tttcttccttaaatatctgg

SEQ ID NO: 549906 - DNA, 20 bp, Artificial
  CRISPR gRNA sequence
tttttaatttttagtagaga

SEQ ID NO: 549907 - DNA, 20 bp, Artificial
  CRISPR gRNA sequence
gtcttggcctcacaaagtgt

SEQ ID NO: 549908 - DNA, 20 bp, Artificial
  CRISPR gRNA sequence
tctttctcaatttttaaaag

SEQ ID NO: 549909 - DNA, 20 bp, Artificial
  CRISPR gRNA sequence
catatttttgtgtttctatg

SEQ ID NO: 549910 - DNA, 20 bp, Artificial
  CRISPR gRNA sequence
caatttctctcttttttctt

SEQ ID NO: 549911 - DNA, 20 bp, Artificial
  CRISPR gRNA sequence
ttttcttaggagtaagatca

SEQ ID NO: 549912 - DNA, 20 bp, Artificial
  CRISPR gRNA sequence
agttggaaactggtactcta

SEQ ID NO: 549913 - DNA, 20 bp, Artificial
  CRISPR gRNA sequence
cctttccctaggctcccatt

SEQ ID NO: 549914 - DNA, 20 bp, Artificial
  CRISPR gRNA sequence
tagagttctgtgtcaatgtg

SEQ ID NO: 549915 - DNA, 20 bp, Artificial
  CRISPR gRNA sequence
ttcccagcagttatctaaaa

SEQ ID NO: 549916 - DNA, 20 bp, Artificial
  CRISPR gRNA sequence
aaagagaatggtgaagtgca

SEQ ID NO: 549917 - DNA, 20 bp, Artificial
  CRISPR gRNA sequence
cctcttcttacttaaagccc

SEQ ID NO: 549918 - DNA, 20 bp, Artificial
  CRISPR gRNA sequence
cttgaaactcttcctgtatc

SEQ ID NO: 549919 - DNA, 20 bp, Artificial
  CRISPR gRNA sequence
atcccatgttctcttctatc

SEQ ID NO: 549920 - DNA, 20 bp, Artificial
  CRISPR gRNA sequence
cagattataattctccatct

SEQ ID NO: 549921 - DNA, 20 bp, Artificial
  CRISPR gRNA sequence
agtggggaagacacagtgct

SEQ ID NO: 549922 - DNA, 20 bp, Artificial
  CRISPR gRNA sequence
cacagtgctttgagttcaga

SEQ ID NO: 549923 - DNA, 20 bp, Artificial
  CRISPR gRNA sequence
tgctttgagttcagatggag

SEQ ID NO: 549924 - DNA, 20 bp, Artificial
  CRISPR gRNA sequence
ctttataaatacccacacca

SEQ ID NO: 549925 - DNA, 20 bp, Artificial
  CRISPR gRNA sequence
ccacaccactgggttgttgt

SEQ ID NO: 549926 - DNA, 20 bp, Artificial
  CRISPR gRNA sequence
catttatgtaaatcatttac

SEQ ID NO: 549927 - DNA, 20 bp, Artificial
  CRISPR gRNA sequence
gttcattcccccagtacaat

SEQ ID NO: 549928 - DNA, 20 bp, Artificial
  CRISPR gRNA sequence
gtaaccccatcgccccattt

SEQ ID NO: 549929 - DNA, 20 bp, Artificial
  CRISPR gRNA sequence
actatgtatatctatatagt

SEQ ID NO: 549930 - DNA, 20 bp, Artificial
  CRISPR gRNA sequence
ggtttctctagctcattcat

SEQ ID NO: 549931 - DNA, 20 bp, Artificial
  CRISPR gRNA sequence
gatttattttgaaacgtata

SEQ ID NO: 549932 - DNA, 20 bp, Artificial
  CRISPR gRNA sequence
ttttgaaacgtatagagagt

SEQ ID NO: 549933 - DNA, 20 bp, Artificial
  CRISPR gRNA sequence
ggtatcatacaaaaacactc

SEQ ID NO: 549934 - DNA, 20 bp, Artificial
  CRISPR gRNA sequence
tcttttttttttttttgaga

SEQ ID NO: 549935 - DNA, 20 bp, Artificial
  CRISPR gRNA sequence
tctcactctgtcacccaggc

SEQ ID NO: 549936 - DNA, 20 bp, Artificial
  CRISPR gRNA sequence
ctcactgccagctccgcctc

SEQ ID NO: 549937 - DNA, 20 bp, Artificial
  CRISPR gRNA sequence
ttttgtatttttagtacaga

SEQ ID NO: 549938 - DNA, 20 bp, Artificial
  CRISPR gRNA sequence
cggggtttcaccgtgttagc

SEQ ID NO: 549939 - DNA, 20 bp, Artificial
  CRISPR gRNA sequence
gcctcagcctcccaaagtgt

SEQ ID NO: 549940 - DNA, 20 bp, Artificial
  CRISPR gRNA sequence
gcaaatgaggcatttatttg

SEQ ID NO: 549941 - DNA, 20 bp, Artificial
  CRISPR gRNA sequence
aggagagcaggctagtcaat

SEQ ID NO: 549942 - DNA, 20 bp, Artificial
  CRISPR gRNA sequence
tatttaactgttatactttc

SEQ ID NO: 549943 - DNA, 20 bp, Artificial
  CRISPR gRNA sequence
aatatttggttaacagaaac

SEQ ID NO: 549944 - DNA, 20 bp, Artificial
  CRISPR gRNA sequence
ctcagatgtcaacactactc

SEQ ID NO: 549945 - DNA, 20 bp, Artificial
  CRISPR gRNA sequence
tttggaagaaaatgtaaaag

SEQ ID NO: 549946 - DNA, 20 bp, Artificial
  CRISPR gRNA sequence
caccattatttaataattaa

SEQ ID NO: 549947 - DNA, 20 bp, Artificial
  CRISPR gRNA sequence
acttatttcaaatcaataag

SEQ ID NO: 549948 - DNA, 20 bp, Artificial
  CRISPR gRNA sequence
aaagtaatcttactttcagt

SEQ ID NO: 549949 - DNA, 20 bp, Artificial
  CRISPR gRNA sequence
tattccatgtaattctatag

SEQ ID NO: 549950 - DNA, 20 bp, Artificial
  CRISPR gRNA sequence
gcatttccatatcgtatgcc

SEQ ID NO: 549951 - DNA, 20 bp, Artificial
  CRISPR gRNA sequence
attatgtaacactcaaaagg

SEQ ID NO: 549952 - DNA, 20 bp, Artificial
  CRISPR gRNA sequence
tcaaaaggtggaattaataa

SEQ ID NO: 549953 - DNA, 20 bp, Artificial
  CRISPR gRNA sequence
cttgtacaaacagtgctcct

SEQ ID NO: 549954 - DNA, 20 bp, Artificial
  CRISPR gRNA sequence
ctcctttgagtgacacctct

SEQ ID NO: 549955 - DNA, 20 bp, Artificial
  CRISPR gRNA sequence
tccgtgtttcataactttaa

SEQ ID NO: 549956 - DNA, 20 bp, Artificial
  CRISPR gRNA sequence
caccaaccaggaccttcaga

SEQ ID NO: 549957 - DNA, 20 bp, Artificial
  CRISPR gRNA sequence
aaccaggaccttcagacagg

SEQ ID NO: 549958 - DNA, 20 bp, Artificial
  CRISPR gRNA sequence
cccctcactggagaacactg

SEQ ID NO: 549959 - DNA, 20 bp, Artificial
  CRISPR gRNA sequence
catcttcctgctcaggtcac

SEQ ID NO: 549960 - DNA, 20 bp, Artificial
  CRISPR gRNA sequence
cgcagtcctcacaggcaaga

SEQ ID NO: 549961 - DNA, 20 bp, Artificial
  CRISPR gRNA sequence
tcaaaaagcaacatcctaag

SEQ ID NO: 549962 - DNA, 20 bp, Artificial
  CRISPR gRNA sequence
agattaagcagctgaaaaca

SEQ ID NO: 549963 - DNA, 20 bp, Artificial
  CRISPR gRNA sequence
taagcagctgaaaacagcga

SEQ ID NO: 549964 - DNA, 20 bp, Artificial
  CRISPR gRNA sequence
ggtttcttcaaatgaaagga

SEQ ID NO: 549965 - DNA, 20 bp, Artificial
  CRISPR gRNA sequence
aaagaattcagtccaactgc

SEQ ID NO: 549966 - DNA, 20 bp, Artificial
  CRISPR gRNA sequence
cccatcccaccccaccccaa

SEQ ID NO: 549967 - DNA, 20 bp, Artificial
  CRISPR gRNA sequence
tatggggccctcccgcaggg

SEQ ID NO: 549968 - DNA, 20 bp, Artificial
  CRISPR gRNA sequence
ctacaggcaccaaggctgca

SEQ ID NO: 549969 - DNA, 20 bp, Artificial
  CRISPR gRNA sequence
tgcacttgaaaacgattaga

SEQ ID NO: 549970 - DNA, 20 bp, Artificial
  CRISPR gRNA sequence
gatggagtaagcgctgtcga

SEQ ID NO: 549971 - DNA, 20 bp, Artificial
  CRISPR gRNA sequence
gaggcctcccgctacaggcc

SEQ ID NO: 549972 - DNA, 20 bp, Artificial
  CRISPR gRNA sequence
gcttgcattccgccggctgg

SEQ ID NO: 549973 - DNA, 20 bp, Artificial
  CRISPR gRNA sequence
cggctggctgggttccttgt

SEQ ID NO: 549974 - DNA, 20 bp, Artificial
  CRISPR gRNA sequence
tttcaaaatcagaggctaat

SEQ ID NO: 549975 - DNA, 20 bp, Artificial
  CRISPR gRNA sequence
atcagaggctaatacgaatt

SEQ ID NO: 549976 - DNA, 20 bp, Artificial
  CRISPR gRNA sequence
tccgtccccagatgctttca

SEQ ID NO: 549977 - DNA, 20 bp, Artificial
  CRISPR gRNA sequence
agaagttgaaaaatgactca

SEQ ID NO: 549978 - DNA, 20 bp, Artificial
  CRISPR gRNA sequence
ctcaggacctgcaaatgaaa

SEQ ID NO: 549979 - DNA, 20 bp, Artificial
  CRISPR gRNA sequence
cttgcaggtttttgtcagga

SEQ ID NO: 549980 - DNA, 20 bp, Artificial
  CRISPR gRNA sequence
ctgagttggcaaagcagtca

SEQ ID NO: 549981 - DNA, 20 bp, Artificial
  CRISPR gRNA sequence
tatgaaagacataggctgtc

SEQ ID NO: 549982 - DNA, 20 bp, Artificial
  CRISPR gRNA sequence
aagatggtaaaccagaactc

SEQ ID NO: 549983 - DNA, 20 bp, Artificial
  CRISPR gRNA sequence
ccagaactctggaattcctt

SEQ ID NO: 549984 - DNA, 20 bp, Artificial
  CRISPR gRNA sequence
tctatatgagcgcatctcac

SEQ ID NO: 549985 - DNA, 20 bp, Artificial
  CRISPR gRNA sequence
aaagtttcgatgtagctgga

SEQ ID NO: 549986 - DNA, 20 bp, Artificial
  CRISPR gRNA sequence
ctgtaaagctgccaaaactc

SEQ ID NO: 549987 - DNA, 20 bp, Artificial
  CRISPR gRNA sequence
gaaaaactgttatctgccat

SEQ ID NO: 549988 - DNA, 20 bp, Artificial
  CRISPR gRNA sequence
tgtctggtaaaccaagtccc

SEQ ID NO: 549989 - DNA, 20 bp, Artificial
  CRISPR gRNA sequence
ccaccttaaaaacgggaagc

SEQ ID NO: 549990 - DNA, 20 bp, Artificial
  CRISPR gRNA sequence
cgggaagcctgaatgctcct

SEQ ID NO: 549991 - DNA, 20 bp, Artificial
  CRISPR gRNA sequence
tccgggtgcgccgcggccct

SEQ ID NO: 549992 - DNA, 20 bp, Artificial
  CRISPR gRNA sequence
ggcggcagggcaggggcgca

SEQ ID NO: 549993 - DNA, 20 bp, Artificial
  CRISPR gRNA sequence
ggctttaagttattgtttga

SEQ ID NO: 549994 - DNA, 20 bp, Artificial
  CRISPR gRNA sequence
aagacaataaatgggagact

SEQ ID NO: 549995 - DNA, 20 bp, Artificial
  CRISPR gRNA sequence
ctcatattctctatttgccc

SEQ ID NO: 549996 - DNA, 20 bp, Artificial
  CRISPR gRNA sequence
ctatttacaattatattatt

SEQ ID NO: 549997 - DNA, 20 bp, Artificial
  CRISPR gRNA sequence
acctttttgtttgttaaact

SEQ ID NO: 549998 - DNA, 20 bp, Artificial
  CRISPR gRNA sequence
caatattataaagcagcatt

SEQ ID NO: 549999 - DNA, 20 bp, Artificial
  CRISPR gRNA sequence
ttggtttctcaccaggaaac

SEQ ID NO: 550000 - DNA, 20 bp, Artificial
  CRISPR gRNA sequence
acacaacttataggttgtat

SEQ ID NO: 550001 - DNA, 20 bp, Artificial
  CRISPR gRNA sequence
tatgaggattgatgtgaaga

SEQ ID NO: 550002 - DNA, 20 bp, Artificial
  CRISPR gRNA sequence
gaattaattaacatatgtat

SEQ ID NO: 550003 - DNA, 20 bp, Artificial
  CRISPR gRNA sequence
tgttagctttgtatctataa

SEQ ID NO: 550004 - DNA, 20 bp, Artificial
  CRISPR gRNA sequence
actttgggaggccgaggcgg

SEQ ID NO: 550005 - DNA, 20 bp, Artificial
  CRISPR gRNA sequence
tactcgggaggctgaggcag

SEQ ID NO: 550006 - DNA, 20 bp, Artificial
  CRISPR gRNA sequence
gttatttactcaccgctgct

SEQ ID NO: 550007 - DNA, 20 bp, Artificial
  CRISPR gRNA sequence
tgatgatgttgtattaaata

SEQ ID NO: 550008 - DNA, 20 bp, Artificial
  CRISPR gRNA sequence
gtattaaataatggattgct

SEQ ID NO: 550009 - DNA, 20 bp, Artificial
  CRISPR gRNA sequence
catcttaaaatatatactgg

SEQ ID NO: 550010 - DNA, 20 bp, Artificial
  CRISPR gRNA sequence
ttgctccataggacaatccc

SEQ ID NO: 550011 - DNA, 20 bp, Artificial
  CRISPR gRNA sequence
caacctccttacaagcttga

SEQ ID NO: 550012 - DNA, 20 bp, Artificial
  CRISPR gRNA sequence
ctccttgagcatcaaggagc

SEQ ID NO: 550013 - DNA, 20 bp, Artificial
  CRISPR gRNA sequence
atctacctgttcaaatttaa

SEQ ID NO: 550014 - DNA, 20 bp, Artificial
  CRISPR gRNA sequence
gaccctgatatggtttggct

SEQ ID NO: 550015 - DNA, 20 bp, Artificial
  CRISPR gRNA sequence
gtcctcacccaaatctcatc

SEQ ID NO: 550016 - DNA, 20 bp, Artificial
  CRISPR gRNA sequence
tgggaggtgattgtaccatg

SEQ ID NO: 550017 - DNA, 20 bp, Artificial
  CRISPR gRNA sequence
cccatgctattctagtgata

SEQ ID NO: 550018 - DNA, 20 bp, Artificial
  CRISPR gRNA sequence
tgctattctagtgatagaga

SEQ ID NO: 550019 - DNA, 20 bp, Artificial
  CRISPR gRNA sequence
ctccccagccatgtggaact

SEQ ID NO: 550020 - DNA, 20 bp, Artificial
  CRISPR gRNA sequence
caaaaaatctctgaagccaa

SEQ ID NO: 550021 - DNA, 20 bp, Artificial
  CRISPR gRNA sequence
gctgcaaatcctgacctgac

SEQ ID NO: 550022 - DNA, 20 bp, Artificial
  CRISPR gRNA sequence
gacctgacctgaattaacac

SEQ ID NO: 550023 - DNA, 20 bp, Artificial
  CRISPR gRNA sequence
acctgaattaacacaaggat

SEQ ID NO: 550024 - DNA, 20 bp, Artificial
  CRISPR gRNA sequence
actttgggaggctgaggcag

SEQ ID NO: 550025 - DNA, 20 bp, Artificial
  CRISPR gRNA sequence
caggaggatggcttgaggcc

SEQ ID NO: 550026 - DNA, 20 bp, Artificial
  CRISPR gRNA sequence
acttgcaactgcttgaacca

SEQ ID NO: 550027 - DNA, 20 bp, Artificial
  CRISPR gRNA sequence
ccaaggaatctgaagctaca

SEQ ID NO: 550028 - DNA, 20 bp, Artificial
  CRISPR gRNA sequence
gaccttgtctttaaatatat

SEQ ID NO: 550029 - DNA, 20 bp, Artificial
  CRISPR gRNA sequence
ttgttcctatgcttgaccca

SEQ ID NO: 550030 - DNA, 20 bp, Artificial
  CRISPR gRNA sequence
gggtgctccccataattaag

SEQ ID NO: 550031 - DNA, 20 bp, Artificial
  CRISPR gRNA sequence
ctaaggcagcatggacctac

SEQ ID NO: 550032 - DNA, 20 bp, Artificial
  CRISPR gRNA sequence
ggcagcatggacctacaagg

SEQ ID NO: 550033 - DNA, 20 bp, Artificial
  CRISPR gRNA sequence
aaggctaattactttgtcct

SEQ ID NO: 550034 - DNA, 20 bp, Artificial
  CRISPR gRNA sequence
aacaatggtcatggtagcac

SEQ ID NO: 550035 - DNA, 20 bp, Artificial
  CRISPR gRNA sequence
atttaggttcaccaagataa

SEQ ID NO: 550036 - DNA, 20 bp, Artificial
  CRISPR gRNA sequence
tcccccatcttctcctcctc

SEQ ID NO: 550037 - DNA, 20 bp, Artificial
  CRISPR gRNA sequence
cagcctgccttggtagaaac

SEQ ID NO: 550038 - DNA, 20 bp, Artificial
  CRISPR gRNA sequence
tttaatcatcttttaagcag

SEQ ID NO: 550039 - DNA, 20 bp, Artificial
  CRISPR gRNA sequence
ttttaagcagtggaatttct

SEQ ID NO: 550040 - DNA, 20 bp, Artificial
  CRISPR gRNA sequence
ttcagtggcaatccaatcca

SEQ ID NO: 550041 - DNA, 20 bp, Artificial
  CRISPR gRNA sequence
ttccaaggaacatgcatccc

SEQ ID NO: 550042 - DNA, 20 bp, Artificial
  CRISPR gRNA sequence
tctcaaattttaaggtgcct

SEQ ID NO: 550043 - DNA, 20 bp, Artificial
  CRISPR gRNA sequence
taaggtgcctaagaatcacc

SEQ ID NO: 550044 - DNA, 20 bp, Artificial
  CRISPR gRNA sequence
caggacagatggggagacag

SEQ ID NO: 550045 - DNA, 20 bp, Artificial
  CRISPR gRNA sequence
atggggagacagatggatag

SEQ ID NO: 550046 - DNA, 20 bp, Artificial
  CRISPR gRNA sequence
ggactcagaagcccagctgc

SEQ ID NO: 550047 - DNA, 20 bp, Artificial
  CRISPR gRNA sequence
tcagactgtaatgagattaa

SEQ ID NO: 550048 - DNA, 20 bp, Artificial
  CRISPR gRNA sequence
acacagataataatcaacat

SEQ ID NO: 550049 - DNA, 20 bp, Artificial
  CRISPR gRNA sequence
attaacatgtagtgcctgca

SEQ ID NO: 550050 - DNA, 20 bp, Artificial
  CRISPR gRNA sequence
agagcacacggccattggct

SEQ ID NO: 550051 - DNA, 20 bp, Artificial
  CRISPR gRNA sequence
caggaagccgaggctccccg

SEQ ID NO: 550052 - DNA, 20 bp, Artificial
  CRISPR gRNA sequence
agggtatgtgatatgatgag

SEQ ID NO: 550053 - DNA, 20 bp, Artificial
  CRISPR gRNA sequence
tgatatgatgagaagagtca

SEQ ID NO: 550054 - DNA, 20 bp, Artificial
  CRISPR gRNA sequence
gatgagaagagtcactgagt

SEQ ID NO: 550055 - DNA, 20 bp, Artificial
  CRISPR gRNA sequence
acagtccttttaggagctgg

SEQ ID NO: 550056 - DNA, 20 bp, Artificial
  CRISPR gRNA sequence
tcttattttcatctgtgaaa

SEQ ID NO: 550057 - DNA, 20 bp, Artificial
  CRISPR gRNA sequence
aggtcactgtaaaggtcaaa

SEQ ID NO: 550058 - DNA, 20 bp, Artificial
  CRISPR gRNA sequence
aaaggtcaaacagaatatga

SEQ ID NO: 550059 - DNA, 20 bp, Artificial
  CRISPR gRNA sequence
atatgactgagtgccacatg

SEQ ID NO: 550060 - DNA, 20 bp, Artificial
  CRISPR gRNA sequence
agaaaagaaaagaaaaaaaa

SEQ ID NO: 550061 - DNA, 20 bp, Artificial
  CRISPR gRNA sequence
aattagtcaatttataatta

SEQ ID NO: 550062 - DNA, 20 bp, Artificial
  CRISPR gRNA sequence
gtcaatttataattaatgaa

SEQ ID NO: 550063 - DNA, 20 bp, Artificial
  CRISPR gRNA sequence
ttcactgctgtgtaaaaaat

SEQ ID NO: 550064 - DNA, 20 bp, Artificial
  CRISPR gRNA sequence
agaaatatgtgtatattttc

SEQ ID NO: 550065 - DNA, 20 bp, Artificial
  CRISPR gRNA sequence
tagaaattttaaggggactt

SEQ ID NO: 550066 - DNA, 20 bp, Artificial
  CRISPR gRNA sequence
caatgtacacacagaaggaa

SEQ ID NO: 550067 - DNA, 20 bp, Artificial
  CRISPR gRNA sequence
cacagaaggaagtggatgcc

SEQ ID NO: 550068 - DNA, 20 bp, Artificial
  CRISPR gRNA sequence
tatcatgcagatgtgaaacc

SEQ ID NO: 550069 - DNA, 20 bp, Artificial
  CRISPR gRNA sequence
ttcttggaccctctatctac

SEQ ID NO: 550070 - DNA, 20 bp, Artificial
  CRISPR gRNA sequence
atacctttgctgaggtgcca

SEQ ID NO: 550071 - DNA, 20 bp, Artificial
  CRISPR gRNA sequence
tttagctagttattttgagg

SEQ ID NO: 550072 - DNA, 20 bp, Artificial
  CRISPR gRNA sequence
tcttggtctgtcacccagac

SEQ ID NO: 550073 - DNA, 20 bp, Artificial
  CRISPR gRNA sequence
gcctcagcctcctgggctca

SEQ ID NO: 550074 - DNA, 20 bp, Artificial
  CRISPR gRNA sequence
gatcctcccacctcagcctc

SEQ ID NO: 550075 - DNA, 20 bp, Artificial
  CRISPR gRNA sequence
ttattttatttttgtagaga

SEQ ID NO: 550076 - DNA, 20 bp, Artificial
  CRISPR gRNA sequence
tggagtcttgctatgttgcc

SEQ ID NO: 550077 - DNA, 20 bp, Artificial
  CRISPR gRNA sequence
tcctcagcctcacaaagtgc

SEQ ID NO: 550078 - DNA, 20 bp, Artificial
  CRISPR gRNA sequence
ttgagccacaatgcccggcc

SEQ ID NO: 550079 - DNA, 20 bp, Artificial
  CRISPR gRNA sequence
gagaaatttattcaaatgtt

SEQ ID NO: 550080 - DNA, 20 bp, Artificial
  CRISPR gRNA sequence
ttttcaaggaaatcttctaa

SEQ ID NO: 550081 - DNA, 20 bp, Artificial
  CRISPR gRNA sequence
gcaagctgtatttgtctaaa

SEQ ID NO: 550082 - DNA, 20 bp, Artificial
  CRISPR gRNA sequence
tttgtctaaatagagtccac

SEQ ID NO: 550083 - DNA, 20 bp, Artificial
  CRISPR gRNA sequence
tttacacattttagctttaa

SEQ ID NO: 550084 - DNA, 20 bp, Artificial
  CRISPR gRNA sequence
cattagaaagttccacacag

SEQ ID NO: 550085 - DNA, 20 bp, Artificial
  CRISPR gRNA sequence
gaaccaatacaacttcctgg

SEQ ID NO: 550086 - DNA, 20 bp, Artificial
  CRISPR gRNA sequence
caatacaacttcctggtaga

SEQ ID NO: 550087 - DNA, 20 bp, Artificial
  CRISPR gRNA sequence
tcaagaaaaagagaggtatc

SEQ ID NO: 550088 - DNA, 20 bp, Artificial
  CRISPR gRNA sequence
gtttcagactgaccagctga

SEQ ID NO: 550089 - DNA, 20 bp, Artificial
  CRISPR gRNA sequence
tatacacataaggagctcgg

SEQ ID NO: 550090 - DNA, 20 bp, Artificial
  CRISPR gRNA sequence
tgatatttaaagccctgaca

SEQ ID NO: 550091 - DNA, 20 bp, Artificial
  CRISPR gRNA sequence
actagcaaaagaagctgaaa

SEQ ID NO: 550092 - DNA, 20 bp, Artificial
  CRISPR gRNA sequence
actttgggaggccaaggcag

SEQ ID NO: 550093 - DNA, 20 bp, Artificial
  CRISPR gRNA sequence
caggtggatcacctgaggtc

SEQ ID NO: 550094 - DNA, 20 bp, Artificial
  CRISPR gRNA sequence
aggaaaaaagagaaagaaac

SEQ ID NO: 550095 - DNA, 20 bp, Artificial
  CRISPR gRNA sequence
aaaagagaaagaaacatgaa

SEQ ID NO: 550096 - DNA, 20 bp, Artificial
  CRISPR gRNA sequence
aacatgaatagggtggtatc

SEQ ID NO: 550097 - DNA, 20 bp, Artificial
  CRISPR gRNA sequence
tgaagacagtacttggagga

SEQ ID NO: 550098 - DNA, 20 bp, Artificial
  CRISPR gRNA sequence
tcaaaagctgctgagaagtc

SEQ ID NO: 550099 - DNA, 20 bp, Artificial
  CRISPR gRNA sequence
agtcaagaatgacatggact

SEQ ID NO: 550100 - DNA, 20 bp, Artificial
  CRISPR gRNA sequence
catggactgagaatgaacca

SEQ ID NO: 550101 - DNA, 20 bp, Artificial
  CRISPR gRNA sequence
ttattaacaaggaggtctag

SEQ ID NO: 550102 - DNA, 20 bp, Artificial
  CRISPR gRNA sequence
agtgcagatgaaagcctatt

SEQ ID NO: 550103 - DNA, 20 bp, Artificial
  CRISPR gRNA sequence
cagatgaaagcctatttgga

SEQ ID NO: 550104 - DNA, 20 bp, Artificial
  CRISPR gRNA sequence
ctatttggagtgggttaaaa

SEQ ID NO: 550105 - DNA, 20 bp, Artificial
  CRISPR gRNA sequence
gtgggttaaaagtgaatata

SEQ ID NO: 550106 - DNA, 20 bp, Artificial
  CRISPR gRNA sequence
taaaagtgaatataagggat

SEQ ID NO: 550107 - DNA, 20 bp, Artificial
  CRISPR gRNA sequence
aatataagggatcagaataa

SEQ ID NO: 550108 - DNA, 20 bp, Artificial
  CRISPR gRNA sequence
cagcaggtggtggtggctgg

SEQ ID NO: 550109 - DNA, 20 bp, Artificial
  CRISPR gRNA sequence
ggtggtggctggaggggtac

SEQ ID NO: 550110 - DNA, 20 bp, Artificial
  CRISPR gRNA sequence
gggggaaattctcatcagga

SEQ ID NO: 550111 - DNA, 20 bp, Artificial
  CRISPR gRNA sequence
gaaattctcatcaggagaga

SEQ ID NO: 550112 - DNA, 20 bp, Artificial
  CRISPR gRNA sequence
gagagagtgggtagaagcac

SEQ ID NO: 550113 - DNA, 20 bp, Artificial
  CRISPR gRNA sequence
ccgaggacggcaagaggagg

SEQ ID NO: 550114 - DNA, 20 bp, Artificial
  CRISPR gRNA sequence
cagggcctacaggctcaggt

SEQ ID NO: 550115 - DNA, 20 bp, Artificial
  CRISPR gRNA sequence
agaagcaaagccttcagctg

SEQ ID NO: 550116 - DNA, 20 bp, Artificial
  CRISPR gRNA sequence
agagaaaaagtaactgctag

SEQ ID NO: 550117 - DNA, 20 bp, Artificial
  CRISPR gRNA sequence
aaaaagtaactgctaggaga

SEQ ID NO: 550118 - DNA, 20 bp, Artificial
  CRISPR gRNA sequence
attaaaagtgcaggactttg

SEQ ID NO: 550119 - DNA, 20 bp, Artificial
  CRISPR gRNA sequence
gtgtatttttctgcaaccac

SEQ ID NO: 550120 - DNA, 20 bp, Artificial
  CRISPR gRNA sequence
caaccacatgggtgtgagca

SEQ ID NO: 550121 - DNA, 20 bp, Artificial
  CRISPR gRNA sequence
tctagctgtaatctggccat

SEQ ID NO: 550122 - DNA, 20 bp, Artificial
  CRISPR gRNA sequence
ctaagtgtgtctgcaacgga

SEQ ID NO: 550123 - DNA, 20 bp, Artificial
  CRISPR gRNA sequence
tctgcaacggactgagtcta

SEQ ID NO: 550124 - DNA, 20 bp, Artificial
  CRISPR gRNA sequence
gagtgacaacagcactcagg

SEQ ID NO: 550125 - DNA, 20 bp, Artificial
  CRISPR gRNA sequence
caaggacagggcatggtggt

SEQ ID NO: 550126 - DNA, 20 bp, Artificial
  CRISPR gRNA sequence
cacctgacattgaggtaatg

SEQ ID NO: 550127 - DNA, 20 bp, Artificial
  CRISPR gRNA sequence
atgagttctcggttacatcc

SEQ ID NO: 550128 - DNA, 20 bp, Artificial
  CRISPR gRNA sequence
ctcggttacatccatgggta

SEQ ID NO: 550129 - DNA, 20 bp, Artificial
  CRISPR gRNA sequence
gcgatcaaggacaatattga

SEQ ID NO: 550130 - DNA, 20 bp, Artificial
  CRISPR gRNA sequence
attgcaaccaccaagacacc

SEQ ID NO: 550131 - DNA, 20 bp, Artificial
  CRISPR gRNA sequence
aggggctttagagaccaggg

SEQ ID NO: 550132 - DNA, 20 bp, Artificial
  CRISPR gRNA sequence
agtttaaaatggtgcaggag

SEQ ID NO: 550133 - DNA, 20 bp, Artificial
  CRISPR gRNA sequence
ggagctgggtgtggtggctc

SEQ ID NO: 550134 - DNA, 20 bp, Artificial
  CRISPR gRNA sequence
cagcactttgggaggctgag

SEQ ID NO: 550135 - DNA, 20 bp, Artificial
  CRISPR gRNA sequence
actttgggaggctgaggcgg

SEQ ID NO: 550136 - DNA, 20 bp, Artificial
  CRISPR gRNA sequence
cgggtggatcacctgagctc

SEQ ID NO: 550137 - DNA, 20 bp, Artificial
  CRISPR gRNA sequence
ctgcactctggccttggtaa

SEQ ID NO: 550138 - DNA, 20 bp, Artificial
  CRISPR gRNA sequence
gtggggaagcaggaacttta

SEQ ID NO: 550139 - DNA, 20 bp, Artificial
  CRISPR gRNA sequence
acatctatcagtggagccca

SEQ ID NO: 550140 - DNA, 20 bp, Artificial
  CRISPR gRNA sequence
tagattctctcctcacccag

SEQ ID NO: 550141 - DNA, 20 bp, Artificial
  CRISPR gRNA sequence
ctcacccagaggaatgacaa

SEQ ID NO: 550142 - DNA, 20 bp, Artificial
  CRISPR gRNA sequence
attttaaacaaatcaactta

SEQ ID NO: 550143 - DNA, 20 bp, Artificial
  CRISPR gRNA sequence
ttttaaaagatgagaaagct

SEQ ID NO: 550144 - DNA, 20 bp, Artificial
  CRISPR gRNA sequence
agatgagaaagctctgaatt

SEQ ID NO: 550145 - DNA, 20 bp, Artificial
  CRISPR gRNA sequence
caggtagtacgggctgggct

SEQ ID NO: 550146 - DNA, 20 bp, Artificial
  CRISPR gRNA sequence
tacgggctgggctgggaata

SEQ ID NO: 550147 - DNA, 20 bp, Artificial
  CRISPR gRNA sequence
acataacgtgcaaatcactg

SEQ ID NO: 550148 - DNA, 20 bp, Artificial
  CRISPR gRNA sequence
aaggcagttaggccgcaggg

SEQ ID NO: 550149 - DNA, 20 bp, Artificial
  CRISPR gRNA sequence
taggccgcagggctgggtag

SEQ ID NO: 550150 - DNA, 20 bp, Artificial
  CRISPR gRNA sequence
ccgcagggctgggtaggtga

SEQ ID NO: 550151 - DNA, 20 bp, Artificial
  CRISPR gRNA sequence
gctgggtaggtgagtgggtg

SEQ ID NO: 550152 - DNA, 20 bp, Artificial
  CRISPR gRNA sequence
agcacccccaaaggaaggcc

SEQ ID NO: 550153 - DNA, 20 bp, Artificial
  CRISPR gRNA sequence
agaaagagcatggtgtgctt

SEQ ID NO: 550154 - DNA, 20 bp, Artificial
  CRISPR gRNA sequence
cacacgtgattcctaacagc

SEQ ID NO: 550155 - DNA, 20 bp, Artificial
  CRISPR gRNA sequence
cagctagaatgaggagggca

SEQ ID NO: 550156 - DNA, 20 bp, Artificial
  CRISPR gRNA sequence
gtgctaaagtaaggaacgct

SEQ ID NO: 550157 - DNA, 20 bp, Artificial
  CRISPR gRNA sequence
gtcagcaggctgactgtctt

SEQ ID NO: 550158 - DNA, 20 bp, Artificial
  CRISPR gRNA sequence
atggacaggacagaccagag

SEQ ID NO: 550159 - DNA, 20 bp, Artificial
  CRISPR gRNA sequence
atgctggagagagaagtcaa

SEQ ID NO: 550160 - DNA, 20 bp, Artificial
  CRISPR gRNA sequence
agtcaacaggattcagtgat

SEQ ID NO: 550161 - DNA, 20 bp, Artificial
  CRISPR gRNA sequence
cagtgatgagggtgggggaa

SEQ ID NO: 550162 - DNA, 20 bp, Artificial
  CRISPR gRNA sequence
caatggctgggaagcaagtc

SEQ ID NO: 550163 - DNA, 20 bp, Artificial
  CRISPR gRNA sequence
gtgatgaagattaagaactc

SEQ ID NO: 550164 - DNA, 20 bp, Artificial
  CRISPR gRNA sequence
gaagattaagaactcaggga

SEQ ID NO: 550165 - DNA, 20 bp, Artificial
  CRISPR gRNA sequence
ctcagggattgggtgcagtg

SEQ ID NO: 550166 - DNA, 20 bp, Artificial
  CRISPR gRNA sequence
atttattagaaccacaagat

SEQ ID NO: 550167 - DNA, 20 bp, Artificial
  CRISPR gRNA sequence
gatatttttgataccccaaa

SEQ ID NO: 550168 - DNA, 20 bp, Artificial
  CRISPR gRNA sequence
ttgttaagagagaacagcag

SEQ ID NO: 550169 - DNA, 20 bp, Artificial
  CRISPR gRNA sequence
attttgggaggccaaggtgg

SEQ ID NO: 550170 - DNA, 20 bp, Artificial
  CRISPR gRNA sequence
ggccaaggtggttggattgc

SEQ ID NO: 550171 - DNA, 20 bp, Artificial
  CRISPR gRNA sequence
tggttggattgcttgagttc

SEQ ID NO: 550172 - DNA, 20 bp, Artificial
  CRISPR gRNA sequence
ttcaggagttcaagaccaac

SEQ ID NO: 550173 - DNA, 20 bp, Artificial
  CRISPR gRNA sequence
cagctacttgggaggctgaa

SEQ ID NO: 550174 - DNA, 20 bp, Artificial
  CRISPR gRNA sequence
ttgtgccactgcactccagc

SEQ ID NO: 550175 - DNA, 20 bp, Artificial
  CRISPR gRNA sequence
agtttttgcctagtagcaat

SEQ ID NO: 550176 - DNA, 20 bp, Artificial
  CRISPR gRNA sequence
tacaggggaaatcaagaaca

SEQ ID NO: 550177 - DNA, 20 bp, Artificial
  CRISPR gRNA sequence
gcattatttcctccactcaa

SEQ ID NO: 550178 - DNA, 20 bp, Artificial
  CRISPR gRNA sequence
ggaaggcacaagaaaaagta

SEQ ID NO: 550179 - DNA, 20 bp, Artificial
  CRISPR gRNA sequence
aagaaaaagtacagaattca

SEQ ID NO: 550180 - DNA, 20 bp, Artificial
  CRISPR gRNA sequence
aagtacagaattcaaggggt

SEQ ID NO: 550181 - DNA, 20 bp, Artificial
  CRISPR gRNA sequence
ttataaatgtaaatgaaaca

SEQ ID NO: 550182 - DNA, 20 bp, Artificial
  CRISPR gRNA sequence
aaacaatgagtgatagaggg

SEQ ID NO: 550183 - DNA, 20 bp, Artificial
  CRISPR gRNA sequence
agagggcagggtggtggtga

SEQ ID NO: 550184 - DNA, 20 bp, Artificial
  CRISPR gRNA sequence
aacagtagaagaaagtagtc

SEQ ID NO: 550185 - DNA, 20 bp, Artificial
  CRISPR gRNA sequence
agctagtggtggagggaagt

SEQ ID NO: 550186 - DNA, 20 bp, Artificial
  CRISPR gRNA sequence
acagttgacccttgaacaac

SEQ ID NO: 550187 - DNA, 20 bp, Artificial
  CRISPR gRNA sequence
acaacatgggtttgagctgt

SEQ ID NO: 550188 - DNA, 20 bp, Artificial
  CRISPR gRNA sequence
ctgtgtgggtccacttacat

SEQ ID NO: 550189 - DNA, 20 bp, Artificial
  CRISPR gRNA sequence
tgctttaacgtgaagataat

SEQ ID NO: 550190 - DNA, 20 bp, Artificial
  CRISPR gRNA sequence
aacaggtgatgtttggttac

SEQ ID NO: 550191 - DNA, 20 bp, Artificial
  CRISPR gRNA sequence
ttttttttttttttagttat

SEQ ID NO: 550192 - DNA, 20 bp, Artificial
  CRISPR gRNA sequence
atatgtttggttttccattc

SEQ ID NO: 550193 - DNA, 20 bp, Artificial
  CRISPR gRNA sequence
cattcctgagttacttcact

SEQ ID NO: 550194 - DNA, 20 bp, Artificial
  CRISPR gRNA sequence
ccagttccatccaggttgct

SEQ ID NO: 550195 - DNA, 20 bp, Artificial
  CRISPR gRNA sequence
tttttttttttcttttgaga

SEQ ID NO: 550196 - DNA, 20 bp, Artificial
  CRISPR gRNA sequence
gtctcgctctgtccccaggc

SEQ ID NO: 550197 - DNA, 20 bp, Artificial
  CRISPR gRNA sequence
cattctcctgcctcagcctc

SEQ ID NO: 550198 - DNA, 20 bp, Artificial
  CRISPR gRNA sequence
ttttgtatttttagtaaaga

SEQ ID NO: 550199 - DNA, 20 bp, Artificial
  CRISPR gRNA sequence
cggggtttcaccatgttagc

SEQ ID NO: 550200 - DNA, 20 bp, Artificial
  CRISPR gRNA sequence
gccttggcctcccaaagtgc

SEQ ID NO: 550201 - DNA, 20 bp, Artificial
  CRISPR gRNA sequence
gattccatatttttgcaatt

SEQ ID NO: 550202 - DNA, 20 bp, Artificial
  CRISPR gRNA sequence
ataaaatgacttgttttcct

SEQ ID NO: 550203 - DNA, 20 bp, Artificial
  CRISPR gRNA sequence
tctgggtagatacccagtaa

SEQ ID NO: 550204 - DNA, 20 bp, Artificial
  CRISPR gRNA sequence
gatacccagtaatgggattg

SEQ ID NO: 550205 - DNA, 20 bp, Artificial
  CRISPR gRNA sequence
taaattacggccattcttgc

SEQ ID NO: 550206 - DNA, 20 bp, Artificial
  CRISPR gRNA sequence
gtccttggcccactttttga

SEQ ID NO: 550207 - DNA, 20 bp, Artificial
  CRISPR gRNA sequence
gtttgacttccttatagatt

SEQ ID NO: 550208 - DNA, 20 bp, Artificial
  CRISPR gRNA sequence
ctttgtcagatacatagttt

SEQ ID NO: 550209 - DNA, 20 bp, Artificial
  CRISPR gRNA sequence
tgaatattttctcccacttt

SEQ ID NO: 550210 - DNA, 20 bp, Artificial
  CRISPR gRNA sequence
tgtttttgttgcatttgttt

SEQ ID NO: 550211 - DNA, 20 bp, Artificial
  CRISPR gRNA sequence
ttgcctaagccaaagtctag

SEQ ID NO: 550212 - DNA, 20 bp, Artificial
  CRISPR gRNA sequence
gtttttctgatgttatcttc

SEQ ID NO: 550213 - DNA, 20 bp, Artificial
  CRISPR gRNA sequence
atttaagtttttgatccacc

SEQ ID NO: 550214 - DNA, 20 bp, Artificial
  CRISPR gRNA sequence
ttttatataaggtgaaagat

SEQ ID NO: 550215 - DNA, 20 bp, Artificial
  CRISPR gRNA sequence
tctctagcttaatttagtgt

SEQ ID NO: 550216 - DNA, 20 bp, Artificial
  CRISPR gRNA sequence
ctattagcagttaagttttt

SEQ ID NO: 550217 - DNA, 20 bp, Artificial
  CRISPR gRNA sequence
cagttaagtttttgggagtc

SEQ ID NO: 550218 - DNA, 20 bp, Artificial
  CRISPR gRNA sequence
cataaatttttgactgctca

SEQ ID NO: 550219 - DNA, 20 bp, Artificial
  CRISPR gRNA sequence
ccctaattgccatgttgttc

SEQ ID NO: 550220 - DNA, 20 bp, Artificial
  CRISPR gRNA sequence
aaaaatataaggcaatttta

SEQ ID NO: 550221 - DNA, 20 bp, Artificial
  CRISPR gRNA sequence
gaacagcgtggtcccacatt

SEQ ID NO: 550222 - DNA, 20 bp, Artificial
  CRISPR gRNA sequence
gcgtggtcccacattcagga

SEQ ID NO: 550223 - DNA, 20 bp, Artificial
  CRISPR gRNA sequence
agacaccgtcccttccttct

SEQ ID NO: 550224 - DNA, 20 bp, Artificial
  CRISPR gRNA sequence
tgacattctattaggggagg

SEQ ID NO: 550225 - DNA, 20 bp, Artificial
  CRISPR gRNA sequence
atttacttagggaactaaca

SEQ ID NO: 550226 - DNA, 20 bp, Artificial
  CRISPR gRNA sequence
tgaagtaaagaaagccatag

SEQ ID NO: 550227 - DNA, 20 bp, Artificial
  CRISPR gRNA sequence
agccatagaagagtttcaaa

SEQ ID NO: 550228 - DNA, 20 bp, Artificial
  CRISPR gRNA sequence
aaacaggatggggacaaaat

SEQ ID NO: 550229 - DNA, 20 bp, Artificial
  CRISPR gRNA sequence
tattttttcagtcctcttat

SEQ ID NO: 550230 - DNA, 20 bp, Artificial
  CRISPR gRNA sequence
tataatctacattaacaaat

SEQ ID NO: 550231 - DNA, 20 bp, Artificial
  CRISPR gRNA sequence
acaaacatgtatcacatata

SEQ ID NO: 550232 - DNA, 20 bp, Artificial
  CRISPR gRNA sequence
aggtatagcttgaagatacc

SEQ ID NO: 550233 - DNA, 20 bp, Artificial
  CRISPR gRNA sequence
aacagcaatcatgtaaatat

SEQ ID NO: 550234 - DNA, 20 bp, Artificial
  CRISPR gRNA sequence
gttgatggctgctgactgat

SEQ ID NO: 550235 - DNA, 20 bp, Artificial
  CRISPR gRNA sequence
tttcttaaaagaagacaatg

SEQ ID NO: 550236 - DNA, 20 bp, Artificial
  CRISPR gRNA sequence
aggcatccaatgctgtttga

SEQ ID NO: 550237 - DNA, 20 bp, Artificial
  CRISPR gRNA sequence
agtaaaactgctttcaaaat

SEQ ID NO: 550238 - DNA, 20 bp, Artificial
  CRISPR gRNA sequence
atgttcacagcatcttcacc

SEQ ID NO: 550239 - DNA, 20 bp, Artificial
  CRISPR gRNA sequence
tcatcatgagattgtggcaa

SEQ ID NO: 550240 - DNA, 20 bp, Artificial
  CRISPR gRNA sequence
cacccttcaaagtcatccat

SEQ ID NO: 550241 - DNA, 20 bp, Artificial
  CRISPR gRNA sequence
tcaaagtcatccatgaggat

SEQ ID NO: 550242 - DNA, 20 bp, Artificial
  CRISPR gRNA sequence
tgatattttgacctgacgat

SEQ ID NO: 550243 - DNA, 20 bp, Artificial
  CRISPR gRNA sequence
caaatattcttaatgacatc

SEQ ID NO: 550244 - DNA, 20 bp, Artificial
  CRISPR gRNA sequence
tcttaatgacatctagaatg

SEQ ID NO: 550245 - DNA, 20 bp, Artificial
  CRISPR gRNA sequence
actttgcccagattcatcag

SEQ ID NO: 550246 - DNA, 20 bp, Artificial
  CRISPR gRNA sequence
actccttgatccatgggctg

SEQ ID NO: 550247 - DNA, 20 bp, Artificial
  CRISPR gRNA sequence
cttgatccatgggctgcaga

SEQ ID NO: 550248 - DNA, 20 bp, Artificial
  CRISPR gRNA sequence
gtacatctccatcagagctc

SEQ ID NO: 550249 - DNA, 20 bp, Artificial
  CRISPR gRNA sequence
acaagcaataatatactgaa

SEQ ID NO: 550250 - DNA, 20 bp, Artificial
  CRISPR gRNA sequence
tccattttatagagcacaag

SEQ ID NO: 550251 - DNA, 20 bp, Artificial
  CRISPR gRNA sequence
ttaagggccctaaaaatttt

SEQ ID NO: 550252 - DNA, 20 bp, Artificial
  CRISPR gRNA sequence
tgcattagcccacacaacaa

SEQ ID NO: 550253 - DNA, 20 bp, Artificial
  CRISPR gRNA sequence
caccagtaatcttagatctt

SEQ ID NO: 550254 - DNA, 20 bp, Artificial
  CRISPR gRNA sequence
tcagccttcacagaactaaa

SEQ ID NO: 550255 - DNA, 20 bp, Artificial
  CRISPR gRNA sequence
ttcacagaactaaagagagt

SEQ ID NO: 550256 - DNA, 20 bp, Artificial
  CRISPR gRNA sequence
aagagagttagggtcttgct

SEQ ID NO: 550257 - DNA, 20 bp, Artificial
  CRISPR gRNA sequence
gtcttgctctggattaggct

SEQ ID NO: 550258 - DNA, 20 bp, Artificial
  CRISPR gRNA sequence
tggattaggctttggattaa

SEQ ID NO: 550259 - DNA, 20 bp, Artificial
  CRISPR gRNA sequence
ttccttcaagaacttttcct

SEQ ID NO: 550260 - DNA, 20 bp, Artificial
  CRISPR gRNA sequence
tttttttttttttcttcaga

SEQ ID NO: 550261 - DNA, 20 bp, Artificial
  CRISPR gRNA sequence
ttcattcttgtagcccagac

SEQ ID NO: 550262 - DNA, 20 bp, Artificial
  CRISPR gRNA sequence
gcctcagcctcccaaccagc

SEQ ID NO: 550263 - DNA, 20 bp, Artificial
  CRISPR gRNA sequence
ttttgtatttttagtagaga

SEQ ID NO: 550264 - DNA, 20 bp, Artificial
  CRISPR gRNA sequence
accttggcctcccaaagtgc

SEQ ID NO: 550265 - DNA, 20 bp, Artificial
  CRISPR gRNA sequence
tgagcacttagaagccattg

SEQ ID NO: 550266 - DNA, 20 bp, Artificial
  CRISPR gRNA sequence
gaaaaagcgttaaatattgt

SEQ ID NO: 550267 - DNA, 20 bp, Artificial
  CRISPR gRNA sequence
actgatggacttgcttaaag

SEQ ID NO: 550268 - DNA, 20 bp, Artificial
  CRISPR gRNA sequence
aataaaaggaggtgtgcctg

SEQ ID NO: 550269 - DNA, 20 bp, Artificial
  CRISPR gRNA sequence
ttatggtttcatatttatgt

SEQ ID NO: 550270 - DNA, 20 bp, Artificial
  CRISPR gRNA sequence
gtttcatatttatgtgggag

SEQ ID NO: 550271 - DNA, 20 bp, Artificial
  CRISPR gRNA sequence
tgtgggagtagagtggagct

SEQ ID NO: 550272 - DNA, 20 bp, Artificial
  CRISPR gRNA sequence
tacatctccatcagtaatgc

SEQ ID NO: 550273 - DNA, 20 bp, Artificial
  CRISPR gRNA sequence
tagtgacatttcattgatac

SEQ ID NO: 550274 - DNA, 20 bp, Artificial
  CRISPR gRNA sequence
catctcttctgcttgttgat

SEQ ID NO: 550275 - DNA, 20 bp, Artificial
  CRISPR gRNA sequence
tcaaatacagcctttgccta

SEQ ID NO: 550276 - DNA, 20 bp, Artificial
  CRISPR gRNA sequence
ttgcctattgaatttactaa

SEQ ID NO: 550277 - DNA, 20 bp, Artificial
  CRISPR gRNA sequence
tggtgtggaagactgatggg

SEQ ID NO: 550278 - DNA, 20 bp, Artificial
  CRISPR gRNA sequence
actagatgattgacagcata

SEQ ID NO: 550279 - DNA, 20 bp, Artificial
  CRISPR gRNA sequence
agaggaggtgccaggagggc

SEQ ID NO: 550280 - DNA, 20 bp, Artificial
  CRISPR gRNA sequence
gaggtgccaggagggccagg

SEQ ID NO: 550281 - DNA, 20 bp, Artificial
  CRISPR gRNA sequence
cagctcttacttcctcctag

SEQ ID NO: 550282 - DNA, 20 bp, Artificial
  CRISPR gRNA sequence
gtttgacactgttcagtgtg

SEQ ID NO: 550283 - DNA, 20 bp, Artificial
  CRISPR gRNA sequence
caggtctgggactcacagga

SEQ ID NO: 550284 - DNA, 20 bp, Artificial
  CRISPR gRNA sequence
acaggaaaggatacagattt

SEQ ID NO: 550285 - DNA, 20 bp, Artificial
  CRISPR gRNA sequence
agtagaagaaaggccaggag

SEQ ID NO: 550286 - DNA, 20 bp, Artificial
  CRISPR gRNA sequence
tggcatcataactccaagac

SEQ ID NO: 550287 - DNA, 20 bp, Artificial
  CRISPR gRNA sequence
gtcaacatgtggagacttga

SEQ ID NO: 550288 - DNA, 20 bp, Artificial
  CRISPR gRNA sequence
gaagaaaattcaaatgtaag

SEQ ID NO: 550289 - DNA, 20 bp, Artificial
  CRISPR gRNA sequence
taaaagaacctgtagtttca

SEQ ID NO: 550290 - DNA, 20 bp, Artificial
  CRISPR gRNA sequence
cctgtagtttcactgaatac

SEQ ID NO: 550291 - DNA, 20 bp, Artificial
  CRISPR gRNA sequence
gtttcactgaatactgggat

SEQ ID NO: 550292 - DNA, 20 bp, Artificial
  CRISPR gRNA sequence
ggatctgggtgatatttatt

SEQ ID NO: 550293 - DNA, 20 bp, Artificial
  CRISPR gRNA sequence
ggttattttaaaaaaggaaa

SEQ ID NO: 550294 - DNA, 20 bp, Artificial
  CRISPR gRNA sequence
gatattctccttttattatt

SEQ ID NO: 550295 - DNA, 20 bp, Artificial
  CRISPR gRNA sequence
aagttatagaaatatatatg

SEQ ID NO: 550296 - DNA, 20 bp, Artificial
  CRISPR gRNA sequence
actttggtaggccaaagtgg

SEQ ID NO: 550297 - DNA, 20 bp, Artificial
  CRISPR gRNA sequence
tggaaggatcacttgagccc

SEQ ID NO: 550298 - DNA, 20 bp, Artificial
  CRISPR gRNA sequence
tattttaactataaaaagac

SEQ ID NO: 550299 - DNA, 20 bp, Artificial
  CRISPR gRNA sequence
ctatgtaaattttttttaaa

SEQ ID NO: 550300 - DNA, 20 bp, Artificial
  CRISPR gRNA sequence
agaattattcaaccaagagg

SEQ ID NO: 550301 - DNA, 20 bp, Artificial
  CRISPR gRNA sequence
tctacctctactttgtgtgc

SEQ ID NO: 550302 - DNA, 20 bp, Artificial
  CRISPR gRNA sequence
aaaagaacaatagaagaaag

SEQ ID NO: 550303 - DNA, 20 bp, Artificial
  CRISPR gRNA sequence
gaacaatagaagaaagggga

SEQ ID NO: 550304 - DNA, 20 bp, Artificial
  CRISPR gRNA sequence
tttctcaaaggtcacaaacc

SEQ ID NO: 550305 - DNA, 20 bp, Artificial
  CRISPR gRNA sequence
aggtcacaaaccatggatga

SEQ ID NO: 550306 - DNA, 20 bp, Artificial
  CRISPR gRNA sequence
cacaaaccatggatgaacga

SEQ ID NO: 550307 - DNA, 20 bp, Artificial
  CRISPR gRNA sequence
aaccatggatgaacgaatga

SEQ ID NO: 550308 - DNA, 20 bp, Artificial
  CRISPR gRNA sequence
atggatgaacgaatgaatga

SEQ ID NO: 550309 - DNA, 20 bp, Artificial
  CRISPR gRNA sequence
atgaacgaatgaatgaatga

SEQ ID NO: 550310 - DNA, 20 bp, Artificial
  CRISPR gRNA sequence
acgaatgaatgaatgaatga

SEQ ID NO: 550311 - DNA, 20 bp, Artificial
  CRISPR gRNA sequence
gaatacacaaataggagcaa

SEQ ID NO: 550312 - DNA, 20 bp, Artificial
  CRISPR gRNA sequence
gcaaaggaatggtgtcaaca

SEQ ID NO: 550313 - DNA, 20 bp, Artificial
  CRISPR gRNA sequence
ttgttgctttgctgatacca

SEQ ID NO: 550314 - DNA, 20 bp, Artificial
  CRISPR gRNA sequence
agggacgctaataaccatgc

SEQ ID NO: 550315 - DNA, 20 bp, Artificial
  CRISPR gRNA sequence
ccatgccagagtgcagaaca

SEQ ID NO: 550316 - DNA, 20 bp, Artificial
  CRISPR gRNA sequence
attttgaagccagcaaggcc

SEQ ID NO: 550317 - DNA, 20 bp, Artificial
  CRISPR gRNA sequence
ataaaagattgttttcaggt

SEQ ID NO: 550318 - DNA, 20 bp, Artificial
  CRISPR gRNA sequence
tttcaggtttgaataaaatt

SEQ ID NO: 550319 - DNA, 20 bp, Artificial
  CRISPR gRNA sequence
tctttttacactggttgaca

SEQ ID NO: 550320 - DNA, 20 bp, Artificial
  CRISPR gRNA sequence
ttttctctctttttctttta

SEQ ID NO: 550321 - DNA, 20 bp, Artificial
  CRISPR gRNA sequence
catcaaggtattcacactgt

SEQ ID NO: 550322 - DNA, 20 bp, Artificial
  CRISPR gRNA sequence
attcacactgtctgaattaa

SEQ ID NO: 550323 - DNA, 20 bp, Artificial
  CRISPR gRNA sequence
aactgggtgagaactgggca

SEQ ID NO: 550324 - DNA, 20 bp, Artificial
  CRISPR gRNA sequence
gggtgagaactgggcatggg

SEQ ID NO: 550325 - DNA, 20 bp, Artificial
  CRISPR gRNA sequence
ttgaaggtttttttgttttg

SEQ ID NO: 550326 - DNA, 20 bp, Artificial
  CRISPR gRNA sequence
tttttttgttttgaagaatt

SEQ ID NO: 550327 - DNA, 20 bp, Artificial
  CRISPR gRNA sequence
ttttttttaaataaagatat

SEQ ID NO: 550328 - DNA, 20 bp, Artificial
  CRISPR gRNA sequence
cctaatcagcactacatgta

SEQ ID NO: 550329 - DNA, 20 bp, Artificial
  CRISPR gRNA sequence
aaatctggtcaccgttaact

SEQ ID NO: 550330 - DNA, 20 bp, Artificial
  CRISPR gRNA sequence
actttgggaggccaaggcag

SEQ ID NO: 550331 - DNA, 20 bp, Artificial
  CRISPR gRNA sequence
caggtggatcacttgaggtc

SEQ ID NO: 550332 - DNA, 20 bp, Artificial
  CRISPR gRNA sequence
tacatgggaggctgaggcag

SEQ ID NO: 550333 - DNA, 20 bp, Artificial
  CRISPR gRNA sequence
ctgtgccactgcactccagc

SEQ ID NO: 550334 - DNA, 20 bp, Artificial
  CRISPR gRNA sequence
aaaaaaaaaaaaaaaaaaat

SEQ ID NO: 550335 - DNA, 20 bp, Artificial
  CRISPR gRNA sequence
gaacctggacaatctgactg

SEQ ID NO: 550336 - DNA, 20 bp, Artificial
  CRISPR gRNA sequence
ttaaagatagtgacatgatg

SEQ ID NO: 550337 - DNA, 20 bp, Artificial
  CRISPR gRNA sequence
tgacatgatgcagggtttct

SEQ ID NO: 550338 - DNA, 20 bp, Artificial
  CRISPR gRNA sequence
ttgcaaatgagaaagtcaaa

SEQ ID NO: 550339 - DNA, 20 bp, Artificial
  CRISPR gRNA sequence
gctctgtggtttccaaatca

SEQ ID NO: 550340 - DNA, 20 bp, Artificial
  CRISPR gRNA sequence
aaaagaaaacgagcaaacaa

SEQ ID NO: 550341 - DNA, 20 bp, Artificial
  CRISPR gRNA sequence
gagataccagcgggccaagt

SEQ ID NO: 550342 - DNA, 20 bp, Artificial
  CRISPR gRNA sequence
actaattcaaatctgagctt

SEQ ID NO: 550343 - DNA, 20 bp, Artificial
  CRISPR gRNA sequence
ggactttcaataaatatctg

SEQ ID NO: 550344 - DNA, 20 bp, Artificial
  CRISPR gRNA sequence
tttcaataaatatctgttga

SEQ ID NO: 550345 - DNA, 20 bp, Artificial
  CRISPR gRNA sequence
caaaagataaggcttcctga

SEQ ID NO: 550346 - DNA, 20 bp, Artificial
  CRISPR gRNA sequence
attttaccaactaagtgtta

SEQ ID NO: 550347 - DNA, 20 bp, Artificial
  CRISPR gRNA sequence
agataaacttgtacccactc

SEQ ID NO: 550348 - DNA, 20 bp, Artificial
  CRISPR gRNA sequence
ttcctttttctttttggaga

SEQ ID NO: 550349 - DNA, 20 bp, Artificial
  CRISPR gRNA sequence
agacaagctaatcactcttc

SEQ ID NO: 550350 - DNA, 20 bp, Artificial
  CRISPR gRNA sequence
ctcttccgggatttgaagga

SEQ ID NO: 550351 - DNA, 20 bp, Artificial
  CRISPR gRNA sequence
atttgaaggaaagggttttc

SEQ ID NO: 550352 - DNA, 20 bp, Artificial
  CRISPR gRNA sequence
tcccttaaaagtttcagtac

SEQ ID NO: 550353 - DNA, 20 bp, Artificial
  CRISPR gRNA sequence
aagtttcagtacctgaatat

SEQ ID NO: 550354 - DNA, 20 bp, Artificial
  CRISPR gRNA sequence
atgaatattggtatttccct

SEQ ID NO: 550355 - DNA, 20 bp, Artificial
  CRISPR gRNA sequence
tcgtgcaagcccagagatag

SEQ ID NO: 550356 - DNA, 20 bp, Artificial
  CRISPR gRNA sequence
ttttgctcccaagtgagcag

SEQ ID NO: 550357 - DNA, 20 bp, Artificial
  CRISPR gRNA sequence
tgagcagatggatttctcat

SEQ ID NO: 550358 - DNA, 20 bp, Artificial
  CRISPR gRNA sequence
gatggatttctcatctggat

SEQ ID NO: 550359 - DNA, 20 bp, Artificial
  CRISPR gRNA sequence
ttgatgcctacttgcagtat

SEQ ID NO: 550360 - DNA, 20 bp, Artificial
  CRISPR gRNA sequence
tattagtcagtcccaatttt

SEQ ID NO: 550361 - DNA, 20 bp, Artificial
  CRISPR gRNA sequence
caggcatggagataataaag

SEQ ID NO: 550362 - DNA, 20 bp, Artificial
  CRISPR gRNA sequence
atttgttcatcaaatgttca

SEQ ID NO: 550363 - DNA, 20 bp, Artificial
  CRISPR gRNA sequence
cagacactgaaataagcagg

SEQ ID NO: 550364 - DNA, 20 bp, Artificial
  CRISPR gRNA sequence
agacaaaatcccagccctct

SEQ ID NO: 550365 - DNA, 20 bp, Artificial
  CRISPR gRNA sequence
aaaaagtaaatatcttttat

SEQ ID NO: 550366 - DNA, 20 bp, Artificial
  CRISPR gRNA sequence
tatcttttatttggatgatg

SEQ ID NO: 550367 - DNA, 20 bp, Artificial
  CRISPR gRNA sequence
tgctatagagaaaaataaag

SEQ ID NO: 550368 - DNA, 20 bp, Artificial
  CRISPR gRNA sequence
aaagcagagtgtgggggctg

SEQ ID NO: 550369 - DNA, 20 bp, Artificial
  CRISPR gRNA sequence
tgaggagtactggtaaggaa

SEQ ID NO: 550370 - DNA, 20 bp, Artificial
  CRISPR gRNA sequence
agtactggtaaggaaaggag

SEQ ID NO: 550371 - DNA, 20 bp, Artificial
  CRISPR gRNA sequence
gtcataagttggcatctgag

SEQ ID NO: 550372 - DNA, 20 bp, Artificial
  CRISPR gRNA sequence
ggagcgagcctaagaacatc

SEQ ID NO: 550373 - DNA, 20 bp, Artificial
  CRISPR gRNA sequence
agcctaagaacatctggggt

SEQ ID NO: 550374 - DNA, 20 bp, Artificial
  CRISPR gRNA sequence
atctggggtgagagtgagaa

SEQ ID NO: 550375 - DNA, 20 bp, Artificial
  CRISPR gRNA sequence
cagatgaagaaatggactga

SEQ ID NO: 550376 - DNA, 20 bp, Artificial
  CRISPR gRNA sequence
gcctcctcgataagttcatc

SEQ ID NO: 550377 - DNA, 20 bp, Artificial
  CRISPR gRNA sequence
agttcaaatggagatgtgtt

SEQ ID NO: 550378 - DNA, 20 bp, Artificial
  CRISPR gRNA sequence
tctgagtatcaaatacacac

SEQ ID NO: 550379 - DNA, 20 bp, Artificial
  CRISPR gRNA sequence
catgtcgaaatgaaaatatt

SEQ ID NO: 550380 - DNA, 20 bp, Artificial
  CRISPR gRNA sequence
ttgactgttctcaccttaga

SEQ ID NO: 550381 - DNA, 20 bp, Artificial
  CRISPR gRNA sequence
gagatccacagtatgcttta

SEQ ID NO: 550382 - DNA, 20 bp, Artificial
  CRISPR gRNA sequence
ttactagatcggttaaggct

SEQ ID NO: 550383 - DNA, 20 bp, Artificial
  CRISPR gRNA sequence
tcatttcactaaaattcctt

SEQ ID NO: 550384 - DNA, 20 bp, Artificial
  CRISPR gRNA sequence
atctgattttttattttttt

SEQ ID NO: 550385 - DNA, 20 bp, Artificial
  CRISPR gRNA sequence
gaagttgagatttgtcattg

SEQ ID NO: 550386 - DNA, 20 bp, Artificial
  CRISPR gRNA sequence
gatttgtcattgcagaattt

SEQ ID NO: 550387 - DNA, 20 bp, Artificial
  CRISPR gRNA sequence
tgtatttactaaagaaatgt

SEQ ID NO: 550388 - DNA, 20 bp, Artificial
  CRISPR gRNA sequence
taaaacaaaaaaacatagca

SEQ ID NO: 550389 - DNA, 20 bp, Artificial
  CRISPR gRNA sequence
aaaacatagcaacgaataca

SEQ ID NO: 550390 - DNA, 20 bp, Artificial
  CRISPR gRNA sequence
tgagtgaaacttgattagat

SEQ ID NO: 550391 - DNA, 20 bp, Artificial
  CRISPR gRNA sequence
cttgtgacaagtggggaaat

SEQ ID NO: 550392 - DNA, 20 bp, Artificial
  CRISPR gRNA sequence
acaagtggggaaatctgaat

SEQ ID NO: 550393 - DNA, 20 bp, Artificial
  CRISPR gRNA sequence
gtaaaagttaggtgatgtta

SEQ ID NO: 550394 - DNA, 20 bp, Artificial
  CRISPR gRNA sequence
gagattatgcaaaagtgtct

SEQ ID NO: 550395 - DNA, 20 bp, Artificial
  CRISPR gRNA sequence
aaagtgtctaggagtgaaat

SEQ ID NO: 550396 - DNA, 20 bp, Artificial
  CRISPR gRNA sequence
gagtgaaatgtgggtaccta

SEQ ID NO: 550397 - DNA, 20 bp, Artificial
  CRISPR gRNA sequence
ctatatttcccatgttttag

SEQ ID NO: 550398 - DNA, 20 bp, Artificial
  CRISPR gRNA sequence
cattggacaatgtatacatg

SEQ ID NO: 550399 - DNA, 20 bp, Artificial
  CRISPR gRNA sequence
catcttcaaaaagttgctta

SEQ ID NO: 550400 - DNA, 20 bp, Artificial
  CRISPR gRNA sequence
tgcttagtggatctcaggct

SEQ ID NO: 550401 - DNA, 20 bp, Artificial
  CRISPR gRNA sequence
ggatacaacagagcatataa

SEQ ID NO: 550402 - DNA, 20 bp, Artificial
  CRISPR gRNA sequence
ggaataggttctgattcaga

SEQ ID NO: 550403 - DNA, 20 bp, Artificial
  CRISPR gRNA sequence
acacacaacactattttaac

SEQ ID NO: 550404 - DNA, 20 bp, Artificial
  CRISPR gRNA sequence
tatgcagatagttggcaata

SEQ ID NO: 550405 - DNA, 20 bp, Artificial
  CRISPR gRNA sequence
ctgtaaaatgtcaacaacag

SEQ ID NO: 550406 - DNA, 20 bp, Artificial
  CRISPR gRNA sequence
ttttgctctgttacccaggc

SEQ ID NO: 550407 - DNA, 20 bp, Artificial
  CRISPR gRNA sequence
gccaggctcatctcagcctc

SEQ ID NO: 550408 - DNA, 20 bp, Artificial
  CRISPR gRNA sequence
tggctaactttttgtagaga

SEQ ID NO: 550409 - DNA, 20 bp, Artificial
  CRISPR gRNA sequence
taataatgacatacatgaga

SEQ ID NO: 550410 - DNA, 20 bp, Artificial
  CRISPR gRNA sequence
tggccctgcccttgacacac

SEQ ID NO: 550411 - DNA, 20 bp, Artificial
  CRISPR gRNA sequence
attacaattcaaggtgagat

SEQ ID NO: 550412 - DNA, 20 bp, Artificial
  CRISPR gRNA sequence
agttacttcctagatacaat

SEQ ID NO: 550413 - DNA, 20 bp, Artificial
  CRISPR gRNA sequence
atacaatgggggtacaggtg

SEQ ID NO: 550414 - DNA, 20 bp, Artificial
  CRISPR gRNA sequence
gctcttcccctgtggctttg

SEQ ID NO: 550415 - DNA, 20 bp, Artificial
  CRISPR gRNA sequence
gtacacggtgcaagctctcg

SEQ ID NO: 550416 - DNA, 20 bp, Artificial
  CRISPR gRNA sequence
tctcggtggatctaccattc

SEQ ID NO: 550417 - DNA, 20 bp, Artificial
  CRISPR gRNA sequence
atctaccattccggggtctg

SEQ ID NO: 550418 - DNA, 20 bp, Artificial
  CRISPR gRNA sequence
ccctagcagaggttctccat

SEQ ID NO: 550419 - DNA, 20 bp, Artificial
  CRISPR gRNA sequence
ttaccctctgaagcaacagc

SEQ ID NO: 550420 - DNA, 20 bp, Artificial
  CRISPR gRNA sequence
ctgcaaagagcaggggggcc

SEQ ID NO: 550421 - DNA, 20 bp, Artificial
  CRISPR gRNA sequence
tgcaaatttctgcagctggc

SEQ ID NO: 550422 - DNA, 20 bp, Artificial
  CRISPR gRNA sequence
cttgaatttttcctcagaaa

SEQ ID NO: 550423 - DNA, 20 bp, Artificial
  CRISPR gRNA sequence
atctttgtgaacatataaaa

SEQ ID NO: 550424 - DNA, 20 bp, Artificial
  CRISPR gRNA sequence
aacagcaaccaagccacctc

SEQ ID NO: 550425 - DNA, 20 bp, Artificial
  CRISPR gRNA sequence
tctctttgctaaaacatatt

SEQ ID NO: 550426 - DNA, 20 bp, Artificial
  CRISPR gRNA sequence
ccacatcttcctgtcttctt

SEQ ID NO: 550427 - DNA, 20 bp, Artificial
  CRISPR gRNA sequence
taataaagacatacccaaga

SEQ ID NO: 550428 - DNA, 20 bp, Artificial
  CRISPR gRNA sequence
gggaggccccacaatcatgg

SEQ ID NO: 550429 - DNA, 20 bp, Artificial
  CRISPR gRNA sequence
gcaagagagagcttgtgcag

SEQ ID NO: 550430 - DNA, 20 bp, Artificial
  CRISPR gRNA sequence
tagccctgcccttgacatat

SEQ ID NO: 550431 - DNA, 20 bp, Artificial
  CRISPR gRNA sequence
attacaattcaacgtaagat

SEQ ID NO: 550432 - DNA, 20 bp, Artificial
  CRISPR gRNA sequence
cacagagccaaaccatatca

SEQ ID NO: 550433 - DNA, 20 bp, Artificial
  CRISPR gRNA sequence
tggggtttcagcatgttgct

SEQ ID NO: 550434 - DNA, 20 bp, Artificial
  CRISPR gRNA sequence
ccacctcagcctctcagtgc

SEQ ID NO: 550435 - DNA, 20 bp, Artificial
  CRISPR gRNA sequence
tctcagccaagttcatactt

SEQ ID NO: 550436 - DNA, 20 bp, Artificial
  CRISPR gRNA sequence
cagactattcatccagcagc

SEQ ID NO: 550437 - DNA, 20 bp, Artificial
  CRISPR gRNA sequence
ggccctaaaaactttatcta

SEQ ID NO: 550438 - DNA, 20 bp, Artificial
  CRISPR gRNA sequence
taaacgcttgaagcctatct

SEQ ID NO: 550439 - DNA, 20 bp, Artificial
  CRISPR gRNA sequence
ttgaagcctatctcagggtc

SEQ ID NO: 550440 - DNA, 20 bp, Artificial
  CRISPR gRNA sequence
agggtcctgagtagtagacc

SEQ ID NO: 550441 - DNA, 20 bp, Artificial
  CRISPR gRNA sequence
ctatgtaatactaaccagca

SEQ ID NO: 550442 - DNA, 20 bp, Artificial
  CRISPR gRNA sequence
tactaaccagcagagggtag

SEQ ID NO: 550443 - DNA, 20 bp, Artificial
  CRISPR gRNA sequence
gggactgtacagctgtgaaa

SEQ ID NO: 550444 - DNA, 20 bp, Artificial
  CRISPR gRNA sequence
cagctgtgaaaaagaatgag

SEQ ID NO: 550445 - DNA, 20 bp, Artificial
  CRISPR gRNA sequence
tggatctctatgaagtgata

SEQ ID NO: 550446 - DNA, 20 bp, Artificial
  CRISPR gRNA sequence
atgagatacaaaaaaataca

SEQ ID NO: 550447 - DNA, 20 bp, Artificial
  CRISPR gRNA sequence
agagtgttaccttgtttaag

SEQ ID NO: 550448 - DNA, 20 bp, Artificial
  CRISPR gRNA sequence
gggtagttagaaaaaaaaaa

SEQ ID NO: 550449 - DNA, 20 bp, Artificial
  CRISPR gRNA sequence
tttgttttttttttttgaga

SEQ ID NO: 550450 - DNA, 20 bp, Artificial
  CRISPR gRNA sequence
tctcactccgtcacccaggc

SEQ ID NO: 550451 - DNA, 20 bp, Artificial
  CRISPR gRNA sequence
gcctcagcctcctaggtagc

SEQ ID NO: 550452 - DNA, 20 bp, Artificial
  CRISPR gRNA sequence
attttttgttttagtagaga

SEQ ID NO: 550453 - DNA, 20 bp, Artificial
  CRISPR gRNA sequence
cagggtttcactgcgttagc

SEQ ID NO: 550454 - DNA, 20 bp, Artificial
  CRISPR gRNA sequence
gccttggcctcccaaagtgc

SEQ ID NO: 550455 - DNA, 20 bp, Artificial
  CRISPR gRNA sequence
aaagtgctgggattacagtc

SEQ ID NO: 550456 - DNA, 20 bp, Artificial
  CRISPR gRNA sequence
catgagtcactgcacccggc

SEQ ID NO: 550457 - DNA, 20 bp, Artificial
  CRISPR gRNA sequence
ggccagaatccaagtaactt

SEQ ID NO: 550458 - DNA, 20 bp, Artificial
  CRISPR gRNA sequence
atatagtattgcatattcac

SEQ ID NO: 550459 - DNA, 20 bp, Artificial
  CRISPR gRNA sequence
tatacagatatttcttatta

SEQ ID NO: 550460 - DNA, 20 bp, Artificial
  CRISPR gRNA sequence
atatcttgaaaaactcattg

SEQ ID NO: 550461 - DNA, 20 bp, Artificial
  CRISPR gRNA sequence
atagcaactgtaaaatgatt

SEQ ID NO: 550462 - DNA, 20 bp, Artificial
  CRISPR gRNA sequence
tatactgatgctactaagaa

SEQ ID NO: 550463 - DNA, 20 bp, Artificial
  CRISPR gRNA sequence
aagaacagagttctcactgt

SEQ ID NO: 550464 - DNA, 20 bp, Artificial
  CRISPR gRNA sequence
attattagtgttagaagtat

SEQ ID NO: 550465 - DNA, 20 bp, Artificial
  CRISPR gRNA sequence
tgaggcaggaacactacaag

SEQ ID NO: 550466 - DNA, 20 bp, Artificial
  CRISPR gRNA sequence
gtgttcccacttgtcaaatg

SEQ ID NO: 550467 - DNA, 20 bp, Artificial
  CRISPR gRNA sequence
tggggttgccgagcatcaaa

SEQ ID NO: 550468 - DNA, 20 bp, Artificial
  CRISPR gRNA sequence
cgagcatcaaaatggatgac

SEQ ID NO: 550469 - DNA, 20 bp, Artificial
  CRISPR gRNA sequence
caggaatgccatatttaaaa

SEQ ID NO: 550470 - DNA, 20 bp, Artificial
  CRISPR gRNA sequence
ccatatttaaaaaagaatcc

SEQ ID NO: 550471 - DNA, 20 bp, Artificial
  CRISPR gRNA sequence
taaaataaaagaaaaaaagg

SEQ ID NO: 550472 - DNA, 20 bp, Artificial
  CRISPR gRNA sequence
agaaacagaagagaaaattg

SEQ ID NO: 550473 - DNA, 20 bp, Artificial
  CRISPR gRNA sequence
actttgggaaactgacttgg

SEQ ID NO: 550474 - DNA, 20 bp, Artificial
  CRISPR gRNA sequence
tgggaggattgcttgagccc

SEQ ID NO: 550475 - DNA, 20 bp, Artificial
  CRISPR gRNA sequence
ctatttggaaactgaggtgg

SEQ ID NO: 550476 - DNA, 20 bp, Artificial
  CRISPR gRNA sequence
aactgaggtgggaggatcgc

SEQ ID NO: 550477 - DNA, 20 bp, Artificial
  CRISPR gRNA sequence
ctatactctagcctgggcaa

SEQ ID NO: 550478 - DNA, 20 bp, Artificial
  CRISPR gRNA sequence
gggaggggaggggagagagg

SEQ ID NO: 550479 - DNA, 20 bp, Artificial
  CRISPR gRNA sequence
gggagggagaagaaagggac

SEQ ID NO: 550480 - DNA, 20 bp, Artificial
  CRISPR gRNA sequence
atttgaaaatattttagtgg

SEQ ID NO: 550481 - DNA, 20 bp, Artificial
  CRISPR gRNA sequence
acttcggtaggccaaggagg

SEQ ID NO: 550482 - DNA, 20 bp, Artificial
  CRISPR gRNA sequence
agggaggatcacttgagccc

SEQ ID NO: 550483 - DNA, 20 bp, Artificial
  CRISPR gRNA sequence
tactcagaaggctgaggtgg

SEQ ID NO: 550484 - DNA, 20 bp, Artificial
  CRISPR gRNA sequence
tgagcctcagaggtcgaggc

SEQ ID NO: 550485 - DNA, 20 bp, Artificial
  CRISPR gRNA sequence
tagcacccctgtactccagc

SEQ ID NO: 550486 - DNA, 20 bp, Artificial
  CRISPR gRNA sequence
aataaaatattttagtgata

SEQ ID NO: 550487 - DNA, 20 bp, Artificial
  CRISPR gRNA sequence
tagtgataatggattctggg

SEQ ID NO: 550488 - DNA, 20 bp, Artificial
  CRISPR gRNA sequence
gattctgggaagaatcacca

SEQ ID NO: 550489 - DNA, 20 bp, Artificial
  CRISPR gRNA sequence
accataggatactaaaacca

SEQ ID NO: 550490 - DNA, 20 bp, Artificial
  CRISPR gRNA sequence
aatgaacaatggctggagaa

SEQ ID NO: 550491 - DNA, 20 bp, Artificial
  CRISPR gRNA sequence
tatgaagtattcctgctaca

SEQ ID NO: 550492 - DNA, 20 bp, Artificial
  CRISPR gRNA sequence
ctgctacaaagagttacaac

SEQ ID NO: 550493 - DNA, 20 bp, Artificial
  CRISPR gRNA sequence
agcaacagttttaggttaaa

SEQ ID NO: 550494 - DNA, 20 bp, Artificial
  CRISPR gRNA sequence
atgtggtgcaggactggctt

SEQ ID NO: 550495 - DNA, 20 bp, Artificial
  CRISPR gRNA sequence
gatgattctgtgacttgttg

SEQ ID NO: 550496 - DNA, 20 bp, Artificial
  CRISPR gRNA sequence
ttcttatgagacatatgata

SEQ ID NO: 550497 - DNA, 20 bp, Artificial
  CRISPR gRNA sequence
gttcccagtaattctatgaa

SEQ ID NO: 550498 - DNA, 20 bp, Artificial
  CRISPR gRNA sequence
attattctcctttccctcat

SEQ ID NO: 550499 - DNA, 20 bp, Artificial
  CRISPR gRNA sequence
acaagttcatgactcaggtg

SEQ ID NO: 550500 - DNA, 20 bp, Artificial
  CRISPR gRNA sequence
actcaggtgaggagtggggc

SEQ ID NO: 550501 - DNA, 20 bp, Artificial
  CRISPR gRNA sequence
gcttccctaatgaggcaggc

SEQ ID NO: 550502 - DNA, 20 bp, Artificial
  CRISPR gRNA sequence
gcaggcttgggtccccaaaa

SEQ ID NO: 550503 - DNA, 20 bp, Artificial
  CRISPR gRNA sequence
agtttataaatacatgtttg

SEQ ID NO: 550504 - DNA, 20 bp, Artificial
  CRISPR gRNA sequence
tttgctgaatcaaatgactt

SEQ ID NO: 550505 - DNA, 20 bp, Artificial
  CRISPR gRNA sequence
ctgaatcaaatgacttctga

SEQ ID NO: 550506 - DNA, 20 bp, Artificial
  CRISPR gRNA sequence
aatgacttctgaatgaatac

SEQ ID NO: 550507 - DNA, 20 bp, Artificial
  CRISPR gRNA sequence
ggaggtggagcttgggcaaa

SEQ ID NO: 550508 - DNA, 20 bp, Artificial
  CRISPR gRNA sequence
agcagtgacccaaggtgcca

SEQ ID NO: 550509 - DNA, 20 bp, Artificial
  CRISPR gRNA sequence
agggaccagcttgcctggag

SEQ ID NO: 550510 - DNA, 20 bp, Artificial
  CRISPR gRNA sequence
ggagaagctctctcagctca

SEQ ID NO: 550511 - DNA, 20 bp, Artificial
  CRISPR gRNA sequence
tcatattctgtcacccaggc

SEQ ID NO: 550512 - DNA, 20 bp, Artificial
  CRISPR gRNA sequence
gattctcccacctcagcctt

SEQ ID NO: 550513 - DNA, 20 bp, Artificial
  CRISPR gRNA sequence
gcctcagcctcccaaagtgc

SEQ ID NO: 550514 - DNA, 20 bp, Artificial
  CRISPR gRNA sequence
acactgacttatctgatcgt

SEQ ID NO: 550515 - DNA, 20 bp, Artificial
  CRISPR gRNA sequence
atctgatcgtgcgggtactt

SEQ ID NO: 550516 - DNA, 20 bp, Artificial
  CRISPR gRNA sequence
acgggctggagggctggcag

SEQ ID NO: 550517 - DNA, 20 bp, Artificial
  CRISPR gRNA sequence
ggaggttactgctgtactcc

SEQ ID NO: 550518 - DNA, 20 bp, Artificial
  CRISPR gRNA sequence
ctgactggggccaatgtgtg

SEQ ID NO: 550519 - DNA, 20 bp, Artificial
  CRISPR gRNA sequence
ccaatgtgtggagggtgaag

SEQ ID NO: 550520 - DNA, 20 bp, Artificial
  CRISPR gRNA sequence
cttggctgacaacacacgga

SEQ ID NO: 550521 - DNA, 20 bp, Artificial
  CRISPR gRNA sequence
ccagttctgatactagtttt

SEQ ID NO: 550522 - DNA, 20 bp, Artificial
  CRISPR gRNA sequence
tgaggggaggaaaaaggagc

SEQ ID NO: 550523 - DNA, 20 bp, Artificial
  CRISPR gRNA sequence
gagcaggagtcgcaccactt

SEQ ID NO: 550524 - DNA, 20 bp, Artificial
  CRISPR gRNA sequence
tcctgaaaaggctcccacgg

SEQ ID NO: 550525 - DNA, 20 bp, Artificial
  CRISPR gRNA sequence
gcccggcgcgtccacccagc

SEQ ID NO: 550526 - DNA, 20 bp, Artificial
  CRISPR gRNA sequence
ctcgtcgggccggcctctgc

SEQ ID NO: 550527 - DNA, 20 bp, Artificial
  CRISPR gRNA sequence
cgaggccagaggcgcgcccg

SEQ ID NO: 550528 - DNA, 20 bp, Artificial
  CRISPR gRNA sequence
aagacaaacgcggcgccgcg

SEQ ID NO: 550529 - DNA, 20 bp, Artificial
  CRISPR gRNA sequence
agcgacgcggggcgggccct

SEQ ID NO: 550530 - DNA, 20 bp, Artificial
  CRISPR gRNA sequence
ctgcctgctgcactgctttg

SEQ ID NO: 550531 - DNA, 20 bp, Artificial
  CRISPR gRNA sequence
caggggccccgcgccggccg

SEQ ID NO: 550532 - DNA, 20 bp, Artificial
  CRISPR gRNA sequence
ggtactgggcagcacccagg

SEQ ID NO: 550533 - DNA, 20 bp, Artificial
  CRISPR gRNA sequence
gaggcggttgccgatcagag

SEQ ID NO: 550534 - DNA, 20 bp, Artificial
  CRISPR gRNA sequence
ccgatcagagacgggtgggg

SEQ ID NO: 550535 - DNA, 20 bp, Artificial
  CRISPR gRNA sequence
ttcatcgccagtgtccctca

SEQ ID NO: 550536 - DNA, 20 bp, Artificial
  CRISPR gRNA sequence
gcccgggacggggagcgggc

SEQ ID NO: 550537 - DNA, 20 bp, Artificial
  CRISPR gRNA sequence
tatcagcagagaggactttt

SEQ ID NO: 550538 - DNA, 20 bp, Artificial
  CRISPR gRNA sequence
gaatcgccccacagcgagga

SEQ ID NO: 550539 - DNA, 20 bp, Artificial
  CRISPR gRNA sequence
agtcggcagcggcctcacgt

SEQ ID NO: 550540 - DNA, 20 bp, Artificial
  CRISPR gRNA sequence
tcaggccatagcaaaacccc

SEQ ID NO: 550541 - DNA, 20 bp, Artificial
  CRISPR gRNA sequence
agtacagcagtaacctccca

SEQ ID NO: 550542 - DNA, 20 bp, Artificial
  CRISPR gRNA sequence
agcgagttcaactgtacttg

SEQ ID NO: 550543 - DNA, 20 bp, Artificial
  CRISPR gRNA sequence
atggaagacagccaaggggg

SEQ ID NO: 550544 - DNA, 20 bp, Artificial
  CRISPR gRNA sequence
actttgggaggctgaggcag

SEQ ID NO: 550545 - DNA, 20 bp, Artificial
  CRISPR gRNA sequence
caggtggatcacttgaggcc

SEQ ID NO: 550546 - DNA, 20 bp, Artificial
  CRISPR gRNA sequence
tactcggaaggctgaggtgg

SEQ ID NO: 550547 - DNA, 20 bp, Artificial
  CRISPR gRNA sequence
ggctgaggtgggagaatcac

SEQ ID NO: 550548 - DNA, 20 bp, Artificial
  CRISPR gRNA sequence
tcacctgagtcccggaggca

SEQ ID NO: 550549 - DNA, 20 bp, Artificial
  CRISPR gRNA sequence
ttgtgccactgaactccagc

SEQ ID NO: 550550 - DNA, 20 bp, Artificial
  CRISPR gRNA sequence
ctgaactccagcctgggtga

SEQ ID NO: 550551 - DNA, 20 bp, Artificial
  CRISPR gRNA sequence
aaaaaaaaaaggtgagctgt

SEQ ID NO: 550552 - DNA, 20 bp, Artificial
  CRISPR gRNA sequence
gaagcagtcttcatgggagg

SEQ ID NO: 550553 - DNA, 20 bp, Artificial
  CRISPR gRNA sequence
gataatgtgggaaaagattg

SEQ ID NO: 550554 - DNA, 20 bp, Artificial
  CRISPR gRNA sequence
gattgctgagtgtcccctta

SEQ ID NO: 550555 - DNA, 20 bp, Artificial
  CRISPR gRNA sequence
tgagtgtccccttagggagt

SEQ ID NO: 550556 - DNA, 20 bp, Artificial
  CRISPR gRNA sequence
agagcttctcctgggcctta

SEQ ID NO: 550557 - DNA, 20 bp, Artificial
  CRISPR gRNA sequence
aggaccatgcgcctgggaag

SEQ ID NO: 550558 - DNA, 20 bp, Artificial
  CRISPR gRNA sequence
agaggaaggctgcagtcagg

SEQ ID NO: 550559 - DNA, 20 bp, Artificial
  CRISPR gRNA sequence
aggcagggaggccagaaggc

SEQ ID NO: 550560 - DNA, 20 bp, Artificial
  CRISPR gRNA sequence
acagggcccaaatagctctg

SEQ ID NO: 550561 - DNA, 20 bp, Artificial
  CRISPR gRNA sequence
tagctctggggagttcatgt

SEQ ID NO: 550562 - DNA, 20 bp, Artificial
  CRISPR gRNA sequence
ggaaaagaagagatacaaac

SEQ ID NO: 550563 - DNA, 20 bp, Artificial
  CRISPR gRNA sequence
gagatacaaacagggattaa

SEQ ID NO: 550564 - DNA, 20 bp, Artificial
  CRISPR gRNA sequence
tacaaacagggattaattga

SEQ ID NO: 550565 - DNA, 20 bp, Artificial
  CRISPR gRNA sequence
acagggattaattgaatgga

SEQ ID NO: 550566 - DNA, 20 bp, Artificial
  CRISPR gRNA sequence
gtccctcattccctggcacc

SEQ ID NO: 550567 - DNA, 20 bp, Artificial
  CRISPR gRNA sequence
gccttaaactaaagacaaga

SEQ ID NO: 550568 - DNA, 20 bp, Artificial
  CRISPR gRNA sequence
taaactaaagacaagactga

SEQ ID NO: 550569 - DNA, 20 bp, Artificial
  CRISPR gRNA sequence
gtgattaacagcatcagctc

SEQ ID NO: 550570 - DNA, 20 bp, Artificial
  CRISPR gRNA sequence
ctggggtcagatgcctagct

SEQ ID NO: 550571 - DNA, 20 bp, Artificial
  CRISPR gRNA sequence
atcctggccccactcctcac

SEQ ID NO: 550572 - DNA, 20 bp, Artificial
  CRISPR gRNA sequence
cacctgagtcatgaacttgt

SEQ ID NO: 550573 - DNA, 20 bp, Artificial
  CRISPR gRNA sequence
tcagtaccttcacttttgaa

SEQ ID NO: 550574 - DNA, 20 bp, Artificial
  CRISPR gRNA sequence
accactcacatgagggaaag

SEQ ID NO: 550575 - DNA, 20 bp, Artificial
  CRISPR gRNA sequence
agaataataaacccacttca

SEQ ID NO: 550576 - DNA, 20 bp, Artificial
  CRISPR gRNA sequence
agtcatgcaataaatattta

SEQ ID NO: 550577 - DNA, 20 bp, Artificial
  CRISPR gRNA sequence
taagcactgcacaatggacg

SEQ ID NO: 550578 - DNA, 20 bp, Artificial
  CRISPR gRNA sequence
gggagagagacagtaagtaa

SEQ ID NO: 550579 - DNA, 20 bp, Artificial
  CRISPR gRNA sequence
gtaagtaaatgagtaaaaac

SEQ ID NO: 550580 - DNA, 20 bp, Artificial
  CRISPR gRNA sequence
aatgagtaaaaacatggatg

SEQ ID NO: 550581 - DNA, 20 bp, Artificial
  CRISPR gRNA sequence
aaacatttactagtacagag

SEQ ID NO: 550582 - DNA, 20 bp, Artificial
  CRISPR gRNA sequence
gagatgagtaaagcaaagaa

SEQ ID NO: 550583 - DNA, 20 bp, Artificial
  CRISPR gRNA sequence
aagtcgttaatacttcagtt

SEQ ID NO: 550584 - DNA, 20 bp, Artificial
  CRISPR gRNA sequence
aacatttgcgtactttctcc

SEQ ID NO: 550585 - DNA, 20 bp, Artificial
  CRISPR gRNA sequence
ttatttttgccaaaccattt

SEQ ID NO: 550586 - DNA, 20 bp, Artificial
  CRISPR gRNA sequence
gagcattctccaacaagtca

SEQ ID NO: 550587 - DNA, 20 bp, Artificial
  CRISPR gRNA sequence
tgtctgggctagttgcttta

SEQ ID NO: 550588 - DNA, 20 bp, Artificial
  CRISPR gRNA sequence
ttgctttaccgaatgtccct

SEQ ID NO: 550589 - DNA, 20 bp, Artificial
  CRISPR gRNA sequence
taccgaatgtccctttggat

SEQ ID NO: 550590 - DNA, 20 bp, Artificial
  CRISPR gRNA sequence
tggttgtaactctttgtagc

SEQ ID NO: 550591 - DNA, 20 bp, Artificial
  CRISPR gRNA sequence
aggaatacttcatagctatg

SEQ ID NO: 550592 - DNA, 20 bp, Artificial
  CRISPR gRNA sequence
tgttaagtgatgttttgagg

SEQ ID NO: 550593 - DNA, 20 bp, Artificial
  CRISPR gRNA sequence
aagtgatgttttgaggttga

SEQ ID NO: 550594 - DNA, 20 bp, Artificial
  CRISPR gRNA sequence
tatcctatggtgattcttcc

SEQ ID NO: 550595 - DNA, 20 bp, Artificial
  CRISPR gRNA sequence
ttttattttattttttgaga

SEQ ID NO: 550596 - DNA, 20 bp, Artificial
  CRISPR gRNA sequence
tctcactgtgtcacccaggc

SEQ ID NO: 550597 - DNA, 20 bp, Artificial
  CRISPR gRNA sequence
tgtcacccaggctggagtac

SEQ ID NO: 550598 - DNA, 20 bp, Artificial
  CRISPR gRNA sequence
aattctgccacctcagcctt

SEQ ID NO: 550599 - DNA, 20 bp, Artificial
  CRISPR gRNA sequence
ttttttagtttttgtagaaa

SEQ ID NO: 550600 - DNA, 20 bp, Artificial
  CRISPR gRNA sequence
tccttggcctaccgaagtgt

SEQ ID NO: 550601 - DNA, 20 bp, Artificial
  CRISPR gRNA sequence
tctcactctgttgcccaggc

SEQ ID NO: 550602 - DNA, 20 bp, Artificial
  CRISPR gRNA sequence
ttttgtattttttatagaga

SEQ ID NO: 550603 - DNA, 20 bp, Artificial
  CRISPR gRNA sequence
aagtcagtttcccaaagtgt

SEQ ID NO: 550604 - DNA, 20 bp, Artificial
  CRISPR gRNA sequence
ttagtttacattgttcagta

SEQ ID NO: 550605 - DNA, 20 bp, Artificial
  CRISPR gRNA sequence
ttagaaggttatgtggactc

SEQ ID NO: 550606 - DNA, 20 bp, Artificial
  CRISPR gRNA sequence
gtgggaacaccttcaagctt

SEQ ID NO: 550607 - DNA, 20 bp, Artificial
  CRISPR gRNA sequence
tagtgttcctgcctcagcct

SEQ ID NO: 550608 - DNA, 20 bp, Artificial
  CRISPR gRNA sequence
tggtatttagaaatcaagtt

SEQ ID NO: 550609 - DNA, 20 bp, Artificial
  CRISPR gRNA sequence
caaagtgtgcccacaggtac

SEQ ID NO: 550610 - DNA, 20 bp, Artificial
  CRISPR gRNA sequence
cagttttcaaagttaagaaa

SEQ ID NO: 550611 - DNA, 20 bp, Artificial
  CRISPR gRNA sequence
aatagagtttttacaaagtc

SEQ ID NO: 550612 - DNA, 20 bp, Artificial
  CRISPR gRNA sequence
taagatttttcaactctaca

SEQ ID NO: 550613 - DNA, 20 bp, Artificial
  CRISPR gRNA sequence
agaaatatctgtatatccca

SEQ ID NO: 550614 - DNA, 20 bp, Artificial
  CRISPR gRNA sequence
atactatattcaaaagttac

SEQ ID NO: 550615 - DNA, 20 bp, Artificial
  CRISPR gRNA sequence
aaaagttacttggattctgg

SEQ ID NO: 550616 - DNA, 20 bp, Artificial
  CRISPR gRNA sequence
actttgggaggccaaggcgg

SEQ ID NO: 550617 - DNA, 20 bp, Artificial
  CRISPR gRNA sequence
tacctaggaggctgaggcag

SEQ ID NO: 550618 - DNA, 20 bp, Artificial
  CRISPR gRNA sequence
ttacaacactgcactccagc

SEQ ID NO: 550619 - DNA, 20 bp, Artificial
  CRISPR gRNA sequence
ctgcactccagcctgggtga

SEQ ID NO: 550620 - DNA, 20 bp, Artificial
  CRISPR gRNA sequence
acaaaacaaaaaaaagttat

SEQ ID NO: 550621 - DNA, 20 bp, Artificial
  CRISPR gRNA sequence
cacagctgtacagtccctca

SEQ ID NO: 550622 - DNA, 20 bp, Artificial
  CRISPR gRNA sequence
tattacatagtgtggtcagg

SEQ ID NO: 550623 - DNA, 20 bp, Artificial
  CRISPR gRNA sequence
gtcagggagggtctctttaa

SEQ ID NO: 550624 - DNA, 20 bp, Artificial
  CRISPR gRNA sequence
taggccacaaggctatctgg

SEQ ID NO: 550625 - DNA, 20 bp, Artificial
  CRISPR gRNA sequence
tcaagcgtttaagaaacttc

SEQ ID NO: 550626 - DNA, 20 bp, Artificial
  CRISPR gRNA sequence
tcaaggataccattgtggtg

SEQ ID NO: 550627 - DNA, 20 bp, Artificial
  CRISPR gRNA sequence
aatgaagttataaaagtagt

SEQ ID NO: 550628 - DNA, 20 bp, Artificial
  CRISPR gRNA sequence
agttataaaagtagtcaggg

SEQ ID NO: 550629 - DNA, 20 bp, Artificial
  CRISPR gRNA sequence
tcagtgactggaaagttttg

SEQ ID NO: 550630 - DNA, 20 bp, Artificial
  CRISPR gRNA sequence
agttttgaaggattttgaac

SEQ ID NO: 550631 - DNA, 20 bp, Artificial
  CRISPR gRNA sequence
aggagtgaaattatgatgac

SEQ ID NO: 550632 - DNA, 20 bp, Artificial
  CRISPR gRNA sequence
atgatgacttggatgtttaa

SEQ ID NO: 550633 - DNA, 20 bp, Artificial
  CRISPR gRNA sequence
taaaagaattattctggctg

SEQ ID NO: 550634 - DNA, 20 bp, Artificial
  CRISPR gRNA sequence
agaattattctggctgctgg

SEQ ID NO: 550635 - DNA, 20 bp, Artificial
  CRISPR gRNA sequence
ctgcaggggcaatgcaggaa

SEQ ID NO: 550636 - DNA, 20 bp, Artificial
  CRISPR gRNA sequence
aatgcaggaaaggaatcact

SEQ ID NO: 550637 - DNA, 20 bp, Artificial
  CRISPR gRNA sequence
tcactgggggtgggagatat

SEQ ID NO: 550638 - DNA, 20 bp, Artificial
  CRISPR gRNA sequence
tgttttgaaggtggagctgg

SEQ ID NO: 550639 - DNA, 20 bp, Artificial
  CRISPR gRNA sequence
ttggtgtgggcttgcattag

SEQ ID NO: 550640 - DNA, 20 bp, Artificial
  CRISPR gRNA sequence
ttgcattagtggaatgacat

SEQ ID NO: 550641 - DNA, 20 bp, Artificial
  CRISPR gRNA sequence
gaatgacatgtggatagggc

SEQ ID NO: 550642 - DNA, 20 bp, Artificial
  CRISPR gRNA sequence
tcaaaagtatgaacttggct

SEQ ID NO: 550643 - DNA, 20 bp, Artificial
  CRISPR gRNA sequence
tgggcagatcttttgagccc

SEQ ID NO: 550644 - DNA, 20 bp, Artificial
  CRISPR gRNA sequence
gttcccacccaaatcttacg

SEQ ID NO: 550645 - DNA, 20 bp, Artificial
  CRISPR gRNA sequence
gcagggctaggtggagataa

SEQ ID NO: 550646 - DNA, 20 bp, Artificial
  CRISPR gRNA sequence
ccccatactgttctcagata

SEQ ID NO: 550647 - DNA, 20 bp, Artificial
  CRISPR gRNA sequence
tatttgatgattttataaat

SEQ ID NO: 550648 - DNA, 20 bp, Artificial
  CRISPR gRNA sequence
ctccctggccaggtggaact

SEQ ID NO: 550649 - DNA, 20 bp, Artificial
  CRISPR gRNA sequence
cctttataaattacccagtc

SEQ ID NO: 550650 - DNA, 20 bp, Artificial
  CRISPR gRNA sequence
tatgtctttattagcagcat

SEQ ID NO: 550651 - DNA, 20 bp, Artificial
  CRISPR gRNA sequence
actaatatagtaaattggta

SEQ ID NO: 550652 - DNA, 20 bp, Artificial
  CRISPR gRNA sequence
atgtggaagcaactttggaa

SEQ ID NO: 550653 - DNA, 20 bp, Artificial
  CRISPR gRNA sequence
tttggaactgggtaacaggc

SEQ ID NO: 550654 - DNA, 20 bp, Artificial
  CRISPR gRNA sequence
actgggtaacaggcagggat

SEQ ID NO: 550655 - DNA, 20 bp, Artificial
  CRISPR gRNA sequence
tggaacttcctagagacttg

SEQ ID NO: 550656 - DNA, 20 bp, Artificial
  CRISPR gRNA sequence
gaggaacaattgttgggaac

SEQ ID NO: 550657 - DNA, 20 bp, Artificial
  CRISPR gRNA sequence
atgttcacaaagatgtggtt

SEQ ID NO: 550658 - DNA, 20 bp, Artificial
  CRISPR gRNA sequence
gaattggaacttatgtttaa

SEQ ID NO: 550659 - DNA, 20 bp, Artificial
  CRISPR gRNA sequence
ccactcaggctgttgcttca

SEQ ID NO: 550660 - DNA, 20 bp, Artificial
  CRISPR gRNA sequence
ttacatgtggtgttgggcct

SEQ ID NO: 550661 - DNA, 20 bp, Artificial
  CRISPR gRNA sequence
cctgtggatgcacagaagtc

SEQ ID NO: 550662 - DNA, 20 bp, Artificial
  CRISPR gRNA sequence
gaacctctgcctagatttca

SEQ ID NO: 550663 - DNA, 20 bp, Artificial
  CRISPR gRNA sequence
cagaggatgtatggaaatgc

SEQ ID NO: 550664 - DNA, 20 bp, Artificial
  CRISPR gRNA sequence
tccaggcagaagtttgctgc

SEQ ID NO: 550665 - DNA, 20 bp, Artificial
  CRISPR gRNA sequence
ggcagtgtggaagggaaatg

SEQ ID NO: 550666 - DNA, 20 bp, Artificial
  CRISPR gRNA sequence
gtggagttggagcccccaca

SEQ ID NO: 550667 - DNA, 20 bp, Artificial
  CRISPR gRNA sequence
ggccatcatccaccagaccc

SEQ ID NO: 550668 - DNA, 20 bp, Artificial
  CRISPR gRNA sequence
cagctcatgaaagcagccag

SEQ ID NO: 550669 - DNA, 20 bp, Artificial
  CRISPR gRNA sequence
gagcccatctcttgcgtcac

SEQ ID NO: 550670 - DNA, 20 bp, Artificial
  CRISPR gRNA sequence
cgtcacctggatgtgaggca

SEQ ID NO: 550671 - DNA, 20 bp, Artificial
  CRISPR gRNA sequence
taaggtttaagactgcccta

SEQ ID NO: 550672 - DNA, 20 bp, Artificial
  CRISPR gRNA sequence
tttggacaatttctcccatt

SEQ ID NO: 550673 - DNA, 20 bp, Artificial
  CRISPR gRNA sequence
gacaatttctcccatttgga

SEQ ID NO: 550674 - DNA, 20 bp, Artificial
  CRISPR gRNA sequence
gccttatctccgatgagact

SEQ ID NO: 550675 - DNA, 20 bp, Artificial
  CRISPR gRNA sequence
gagactttggatttagactt

SEQ ID NO: 550676 - DNA, 20 bp, Artificial
  CRISPR gRNA sequence
ttagacttttggattaatgc

SEQ ID NO: 550677 - DNA, 20 bp, Artificial
  CRISPR gRNA sequence
acatgagatttgggaggggc

SEQ ID NO: 550678 - DNA, 20 bp, Artificial
  CRISPR gRNA sequence
agatttgggaggggccgggg

SEQ ID NO: 550679 - DNA, 20 bp, Artificial
  CRISPR gRNA sequence
gtccccacccaaatctcacc

SEQ ID NO: 550680 - DNA, 20 bp, Artificial
  CRISPR gRNA sequence
gcagggccaggtggagataa

SEQ ID NO: 550681 - DNA, 20 bp, Artificial
  CRISPR gRNA sequence
tctatactgttcttgtgata

SEQ ID NO: 550682 - DNA, 20 bp, Artificial
  CRISPR gRNA sequence
gatctgatggtttcataaag

SEQ ID NO: 550683 - DNA, 20 bp, Artificial
  CRISPR gRNA sequence
ttccctggccatgtggaact

SEQ ID NO: 550684 - DNA, 20 bp, Artificial
  CRISPR gRNA sequence
tatgtcattattagcagtgc

SEQ ID NO: 550685 - DNA, 20 bp, Artificial
  CRISPR gRNA sequence
gagatgagcctggcaattgc

SEQ ID NO: 550686 - DNA, 20 bp, Artificial
  CRISPR gRNA sequence
cctggcaattgcttgagtct

SEQ ID NO: 550687 - DNA, 20 bp, Artificial
  CRISPR gRNA sequence
tgacacaactgcattccagc

SEQ ID NO: 550688 - DNA, 20 bp, Artificial
  CRISPR gRNA sequence
aggaactattttattattaa

SEQ ID NO: 550689 - DNA, 20 bp, Artificial
  CRISPR gRNA sequence
ttttttaatagtaaagattg

SEQ ID NO: 550690 - DNA, 20 bp, Artificial
  CRISPR gRNA sequence
gacttgttcatgtgctttgc

SEQ ID NO: 550691 - DNA, 20 bp, Artificial
  CRISPR gRNA sequence
aactaggcccagtgttataa

SEQ ID NO: 550692 - DNA, 20 bp, Artificial
  CRISPR gRNA sequence
ttcacacagcaaataagtgg

SEQ ID NO: 550693 - DNA, 20 bp, Artificial
  CRISPR gRNA sequence
aacttgaactttgattctct

SEQ ID NO: 550694 - DNA, 20 bp, Artificial
  CRISPR gRNA sequence
cactaagcaactttttgaag

SEQ ID NO: 550695 - DNA, 20 bp, Artificial
  CRISPR gRNA sequence
tatcataatttgtaatggtg

SEQ ID NO: 550696 - DNA, 20 bp, Artificial
  CRISPR gRNA sequence
aggggtgcttctttgggaca

SEQ ID NO: 550697 - DNA, 20 bp, Artificial
  CRISPR gRNA sequence
cagatttccccacttgtcac

SEQ ID NO: 550698 - DNA, 20 bp, Artificial
  CRISPR gRNA sequence
agtgtcttttgttaaaaaac

SEQ ID NO: 550699 - DNA, 20 bp, Artificial
  CRISPR gRNA sequence
cctctttttaagaaccagat

SEQ ID NO: 550700 - DNA, 20 bp, Artificial
  CRISPR gRNA sequence
ctttagtaaatacaggcttt

SEQ ID NO: 550701 - DNA, 20 bp, Artificial
  CRISPR gRNA sequence
cttttttgaagctttacttg

SEQ ID NO: 550702 - DNA, 20 bp, Artificial
  CRISPR gRNA sequence
acaaatctcaacttccatct

SEQ ID NO: 550703 - DNA, 20 bp, Artificial
  CRISPR gRNA sequence
ctcagggttgtaagtgaaac

SEQ ID NO: 550704 - DNA, 20 bp, Artificial
  CRISPR gRNA sequence
tttctcagataagttcaggt

SEQ ID NO: 550705 - DNA, 20 bp, Artificial
  CRISPR gRNA sequence
atgtctgttgagattagtgc

SEQ ID NO: 550706 - DNA, 20 bp, Artificial
  CRISPR gRNA sequence
ccattgtaaactacttgcaa

SEQ ID NO: 550707 - DNA, 20 bp, Artificial
  CRISPR gRNA sequence
tagagtttcccaacgatgaa

SEQ ID NO: 550708 - DNA, 20 bp, Artificial
  CRISPR gRNA sequence
ctgagtatctagaaaataac

SEQ ID NO: 550709 - DNA, 20 bp, Artificial
  CRISPR gRNA sequence
gaaaataacaaggattctca

SEQ ID NO: 550710 - DNA, 20 bp, Artificial
  CRISPR gRNA sequence
cagtactgtattgaaatacc

SEQ ID NO: 550711 - DNA, 20 bp, Artificial
  CRISPR gRNA sequence
ataccttgaatcagactttg

SEQ ID NO: 550712 - DNA, 20 bp, Artificial
  CRISPR gRNA sequence
cttattccctaaagcatact

SEQ ID NO: 550713 - DNA, 20 bp, Artificial
  CRISPR gRNA sequence
aatgtggcctttgagaaagg

SEQ ID NO: 550714 - DNA, 20 bp, Artificial
  CRISPR gRNA sequence
gcctttgagaaaggtgggat

SEQ ID NO: 550715 - DNA, 20 bp, Artificial
  CRISPR gRNA sequence
tgtagctggtagctactttg

SEQ ID NO: 550716 - DNA, 20 bp, Artificial
  CRISPR gRNA sequence
aataggttaagtgcaagaac

SEQ ID NO: 550717 - DNA, 20 bp, Artificial
  CRISPR gRNA sequence
ttgctctggccttggggacc

SEQ ID NO: 550718 - DNA, 20 bp, Artificial
  CRISPR gRNA sequence
gtcactaactgggaccggct

SEQ ID NO: 550719 - DNA, 20 bp, Artificial
  CRISPR gRNA sequence
taactgggaccggctaaggg

SEQ ID NO: 550720 - DNA, 20 bp, Artificial
  CRISPR gRNA sequence
ggaatcgatcaggaaaaaag

SEQ ID NO: 550721 - DNA, 20 bp, Artificial
  CRISPR gRNA sequence
ccagctctgccccttgctag

SEQ ID NO: 550722 - DNA, 20 bp, Artificial
  CRISPR gRNA sequence
ctctgccccttgctagctga

SEQ ID NO: 550723 - DNA, 20 bp, Artificial
  CRISPR gRNA sequence
tcatctgtagcctggtgctt

SEQ ID NO: 550724 - DNA, 20 bp, Artificial
  CRISPR gRNA sequence
aaaatagactccaagagggc

SEQ ID NO: 550725 - DNA, 20 bp, Artificial
  CRISPR gRNA sequence
aacatttgatgaacaaataa

SEQ ID NO: 550726 - DNA, 20 bp, Artificial
  CRISPR gRNA sequence
atgaataataagaactacct

SEQ ID NO: 550727 - DNA, 20 bp, Artificial
  CRISPR gRNA sequence
taataagaactacctcagag

SEQ ID NO: 550728 - DNA, 20 bp, Artificial
  CRISPR gRNA sequence
aactacctcagagttgagtt

SEQ ID NO: 550729 - DNA, 20 bp, Artificial
  CRISPR gRNA sequence
agagttgagttgaggattaa

SEQ ID NO: 550730 - DNA, 20 bp, Artificial
  CRISPR gRNA sequence
tgtcacatagtaagcctgca

SEQ ID NO: 550731 - DNA, 20 bp, Artificial
  CRISPR gRNA sequence
ctgagctggcctagggctcc

SEQ ID NO: 550732 - DNA, 20 bp, Artificial
  CRISPR gRNA sequence
ggacttgctaagagctaggc

SEQ ID NO: 550733 - DNA, 20 bp, Artificial
  CRISPR gRNA sequence
cacaactgtatgaaacttga

SEQ ID NO: 550734 - DNA, 20 bp, Artificial
  CRISPR gRNA sequence
aaattgggactgactaatat

SEQ ID NO: 550735 - DNA, 20 bp, Artificial
  CRISPR gRNA sequence
tcaatactataaatgcatat

SEQ ID NO: 550736 - DNA, 20 bp, Artificial
  CRISPR gRNA sequence
gggcttgcacgaggctttaa

SEQ ID NO: 550737 - DNA, 20 bp, Artificial
  CRISPR gRNA sequence
tcaggtactgaaacttttaa

SEQ ID NO: 550738 - DNA, 20 bp, Artificial
  CRISPR gRNA sequence
ccctttccttcaaatcccgg

SEQ ID NO: 550739 - DNA, 20 bp, Artificial
  CRISPR gRNA sequence
acttcagaaggcccagggag

SEQ ID NO: 550740 - DNA, 20 bp, Artificial
  CRISPR gRNA sequence
gaggaggatcacttgagccc

SEQ ID NO: 550741 - DNA, 20 bp, Artificial
  CRISPR gRNA sequence
tacttgggaggctgaggcag

SEQ ID NO: 550742 - DNA, 20 bp, Artificial
  CRISPR gRNA sequence
ttgcaccactgcacaccaac

SEQ ID NO: 550743 - DNA, 20 bp, Artificial
  CRISPR gRNA sequence
ctgcacaccaacctgggtga

SEQ ID NO: 550744 - DNA, 20 bp, Artificial
  CRISPR gRNA sequence
tttgattggggctgacatcc

SEQ ID NO: 550745 - DNA, 20 bp, Artificial
  CRISPR gRNA sequence
attggggctgacatccatga

SEQ ID NO: 550746 - DNA, 20 bp, Artificial
  CRISPR gRNA sequence
catctcaaaagggacagctg

SEQ ID NO: 550747 - DNA, 20 bp, Artificial
  CRISPR gRNA sequence
cagaaagtggggctgaaaaa

SEQ ID NO: 550748 - DNA, 20 bp, Artificial
  CRISPR gRNA sequence
agccaggttccacagcaatt

SEQ ID NO: 550749 - DNA, 20 bp, Artificial
  CRISPR gRNA sequence
atttgggatttcacaaagcc

SEQ ID NO: 550750 - DNA, 20 bp, Artificial
  CRISPR gRNA sequence
atttcacaaagcccagggtt

SEQ ID NO: 550751 - DNA, 20 bp, Artificial
  CRISPR gRNA sequence
agtccatatgccagacatat

SEQ ID NO: 550752 - DNA, 20 bp, Artificial
  CRISPR gRNA sequence
cctgatagggctagcctggc

SEQ ID NO: 550753 - DNA, 20 bp, Artificial
  CRISPR gRNA sequence
ggttacccctaagctcagat

SEQ ID NO: 550754 - DNA, 20 bp, Artificial
  CRISPR gRNA sequence
agttgccaactttcaagaac

SEQ ID NO: 550755 - DNA, 20 bp, Artificial
  CRISPR gRNA sequence
caggaattttcacacaaaat

SEQ ID NO: 550756 - DNA, 20 bp, Artificial
  CRISPR gRNA sequence
ggcccgctggtatctcctct

SEQ ID NO: 550757 - DNA, 20 bp, Artificial
  CRISPR gRNA sequence
gctggtatctcctctgtggg

SEQ ID NO: 550758 - DNA, 20 bp, Artificial
  CRISPR gRNA sequence
ctggctttttcttccttgac

SEQ ID NO: 550759 - DNA, 20 bp, Artificial
  CRISPR gRNA sequence
aaaccttcttaatatgtttt

SEQ ID NO: 550760 - DNA, 20 bp, Artificial
  CRISPR gRNA sequence
ttttttttttttttctgaga

SEQ ID NO: 550761 - DNA, 20 bp, Artificial
  CRISPR gRNA sequence
tcttgctctgtcacccaggc

SEQ ID NO: 550762 - DNA, 20 bp, Artificial
  CRISPR gRNA sequence
gccactgcaacctccacctc

SEQ ID NO: 550763 - DNA, 20 bp, Artificial
  CRISPR gRNA sequence
gcctcagcctcccatgtaac

SEQ ID NO: 550764 - DNA, 20 bp, Artificial
  CRISPR gRNA sequence
ccatgtaactgggattacag

SEQ ID NO: 550765 - DNA, 20 bp, Artificial
  CRISPR gRNA sequence
ttttgtatttttagtagaga

SEQ ID NO: 550766 - DNA, 20 bp, Artificial
  CRISPR gRNA sequence
gccttggcctcccaaagtgc

SEQ ID NO: 550767 - DNA, 20 bp, Artificial
  CRISPR gRNA sequence
atgagccactgctcccagtg

SEQ ID NO: 550768 - DNA, 20 bp, Artificial
  CRISPR gRNA sequence
aaaaaaaagtaccagtcaat

SEQ ID NO: 550769 - DNA, 20 bp, Artificial
  CRISPR gRNA sequence
gtcaatctgaatctcaggcc

SEQ ID NO: 550770 - DNA, 20 bp, Artificial
  CRISPR gRNA sequence
ccctgagtaataatttgcag

SEQ ID NO: 550771 - DNA, 20 bp, Artificial
  CRISPR gRNA sequence
tttgcagaggaatttgtgct

SEQ ID NO: 550772 - DNA, 20 bp, Artificial
  CRISPR gRNA sequence
aggaatttgtgctgggggtt

SEQ ID NO: 550773 - DNA, 20 bp, Artificial
  CRISPR gRNA sequence
agattttctaaataagaaat

SEQ ID NO: 550774 - DNA, 20 bp, Artificial
  CRISPR gRNA sequence
ggatacttcatctataaaac

SEQ ID NO: 550775 - DNA, 20 bp, Artificial
  CRISPR gRNA sequence
gttttgtagaaacactgcaa

SEQ ID NO: 550776 - DNA, 20 bp, Artificial
  CRISPR gRNA sequence
acccagttaattcagacagt

SEQ ID NO: 550777 - DNA, 20 bp, Artificial
  CRISPR gRNA sequence
tctagtgtggggaggccttt

SEQ ID NO: 550778 - DNA, 20 bp, Artificial
  CRISPR gRNA sequence
ttaacaactcctcctcttgg

SEQ ID NO: 550779 - DNA, 20 bp, Artificial
  CRISPR gRNA sequence
ttttaatattataatagtaa

SEQ ID NO: 550780 - DNA, 20 bp, Artificial
  CRISPR gRNA sequence
aacaaccactgttaatcatt

SEQ ID NO: 550781 - DNA, 20 bp, Artificial
  CRISPR gRNA sequence
agtctaaaaaaagagcaagt

SEQ ID NO: 550782 - DNA, 20 bp, Artificial
  CRISPR gRNA sequence
tatatattttttggtagaga

SEQ ID NO: 550783 - DNA, 20 bp, Artificial
  CRISPR gRNA sequence
actttggcctaccaaagtgc

SEQ ID NO: 550784 - DNA, 20 bp, Artificial
  CRISPR gRNA sequence
tctttattgtttttaaaaag

SEQ ID NO: 550785 - DNA, 20 bp, Artificial
  CRISPR gRNA sequence
caaattcccaataataaaag

SEQ ID NO: 550786 - DNA, 20 bp, Artificial
  CRISPR gRNA sequence
ctagtatagataactttaaa

SEQ ID NO: 550787 - DNA, 20 bp, Artificial
  CRISPR gRNA sequence
ttgttttatttgttaacatc

SEQ ID NO: 550788 - DNA, 20 bp, Artificial
  CRISPR gRNA sequence
gtgtttaattctgcttacat

SEQ ID NO: 550789 - DNA, 20 bp, Artificial
  CRISPR gRNA sequence
ttccatctttttcctactat

SEQ ID NO: 550790 - DNA, 20 bp, Artificial
  CRISPR gRNA sequence
ccacatgttgactcttgtct

SEQ ID NO: 550791 - DNA, 20 bp, Artificial
  CRISPR gRNA sequence
ccaaatctgtatcctttcct

SEQ ID NO: 550792 - DNA, 20 bp, Artificial
  CRISPR gRNA sequence
cagctactgggcatctttgc

SEQ ID NO: 550793 - DNA, 20 bp, Artificial
  CRISPR gRNA sequence
cagtctgaaattgctgtctg

SEQ ID NO: 550794 - DNA, 20 bp, Artificial
  CRISPR gRNA sequence
aacaatctaatacaaaaaaa

SEQ ID NO: 550795 - DNA, 20 bp, Artificial
  CRISPR gRNA sequence
aaaaattacctaatgctgtc

SEQ ID NO: 550796 - DNA, 20 bp, Artificial
  CRISPR gRNA sequence
aatacatcaggacatatgta

SEQ ID NO: 550797 - DNA, 20 bp, Artificial
  CRISPR gRNA sequence
tagacaaagctagccacaaa

SEQ ID NO: 550798 - DNA, 20 bp, Artificial
  CRISPR gRNA sequence
aaaaggagtgttcatcagtg

SEQ ID NO: 550799 - DNA, 20 bp, Artificial
  CRISPR gRNA sequence
attatggttccctcatgctc

SEQ ID NO: 550800 - DNA, 20 bp, Artificial
  CRISPR gRNA sequence
aatattatgtagttattaaa

SEQ ID NO: 550801 - DNA, 20 bp, Artificial
  CRISPR gRNA sequence
atgacatattaatggaaagg

SEQ ID NO: 550802 - DNA, 20 bp, Artificial
  CRISPR gRNA sequence
gcataagaccatttttatta

SEQ ID NO: 550803 - DNA, 20 bp, Artificial
  CRISPR gRNA sequence
tgttactgttgtcattgttt

SEQ ID NO: 550804 - DNA, 20 bp, Artificial
  CRISPR gRNA sequence
ctaagtgctcaagtgaaaag

SEQ ID NO: 550805 - DNA, 20 bp, Artificial
  CRISPR gRNA sequence
cagcactttgggaggccaag

SEQ ID NO: 550806 - DNA, 20 bp, Artificial
  CRISPR gRNA sequence
actttgggaggccaaggtgg

SEQ ID NO: 550807 - DNA, 20 bp, Artificial
  CRISPR gRNA sequence
actaaaaatacaaaaattag

SEQ ID NO: 550808 - DNA, 20 bp, Artificial
  CRISPR gRNA sequence
tggttgggaggctgaggcag

SEQ ID NO: 550809 - DNA, 20 bp, Artificial
  CRISPR gRNA sequence
tgcactccagtctgggctac

SEQ ID NO: 550810 - DNA, 20 bp, Artificial
  CRISPR gRNA sequence
aaactaggccttttatgcca

SEQ ID NO: 550811 - DNA, 20 bp, Artificial
  CRISPR gRNA sequence
gccaaagagttagtgaagtt

SEQ ID NO: 550812 - DNA, 20 bp, Artificial
  CRISPR gRNA sequence
ttattgcagatggagaaagt

SEQ ID NO: 550813 - DNA, 20 bp, Artificial
  CRISPR gRNA sequence
aagatctaagattactggtg

SEQ ID NO: 550814 - DNA, 20 bp, Artificial
  CRISPR gRNA sequence
tgaaaatttttagggccctt

SEQ ID NO: 550815 - DNA, 20 bp, Artificial
  CRISPR gRNA sequence
ctataaaatggaacaacagg

SEQ ID NO: 550816 - DNA, 20 bp, Artificial
  CRISPR gRNA sequence
tctgtttacagcatggttta

SEQ ID NO: 550817 - DNA, 20 bp, Artificial
  CRISPR gRNA sequence
tgatggagatgtacaaggag

SEQ ID NO: 550818 - DNA, 20 bp, Artificial
  CRISPR gRNA sequence
caacatccattctgcagccc

SEQ ID NO: 550819 - DNA, 20 bp, Artificial
  CRISPR gRNA sequence
attctgcagcccatggatca

SEQ ID NO: 550820 - DNA, 20 bp, Artificial
  CRISPR gRNA sequence
cctttgaagtcttattatgt

SEQ ID NO: 550821 - DNA, 20 bp, Artificial
  CRISPR gRNA sequence
catagataattattcttctg

SEQ ID NO: 550822 - DNA, 20 bp, Artificial
  CRISPR gRNA sequence
gtaaattgacaaccttctga

SEQ ID NO: 550823 - DNA, 20 bp, Artificial
  CRISPR gRNA sequence
tcagcattctagatgtcatt

SEQ ID NO: 550824 - DNA, 20 bp, Artificial
  CRISPR gRNA sequence
atcaaaatatcaacattaac

SEQ ID NO: 550825 - DNA, 20 bp, Artificial
  CRISPR gRNA sequence
caacattaacaggagtttgg

SEQ ID NO: 550826 - DNA, 20 bp, Artificial
  CRISPR gRNA sequence
gtcaaaatatcaatattaac

SEQ ID NO: 550827 - DNA, 20 bp, Artificial
  CRISPR gRNA sequence
caatattaacaggagtttgg

SEQ ID NO: 550828 - DNA, 20 bp, Artificial
  CRISPR gRNA sequence
agaatttgattccgatcctc

SEQ ID NO: 550829 - DNA, 20 bp, Artificial
  CRISPR gRNA sequence
gatcctcatggatgactttg

SEQ ID NO: 550830 - DNA, 20 bp, Artificial
  CRISPR gRNA sequence
aagaaaaatagaagtggagc

SEQ ID NO: 550831 - DNA, 20 bp, Artificial
  CRISPR gRNA sequence
tgatgaaaattgagccaatg

SEQ ID NO: 550832 - DNA, 20 bp, Artificial
  CRISPR gRNA sequence
ccaatgaggagttgcttctt

SEQ ID NO: 550833 - DNA, 20 bp, Artificial
  CRISPR gRNA sequence
acattgtttaaatgacaaca

SEQ ID NO: 550834 - DNA, 20 bp, Artificial
  CRISPR gRNA sequence
ttaaatgacaacaaagggtt

SEQ ID NO: 550835 - DNA, 20 bp, Artificial
  CRISPR gRNA sequence
tttagttgataaagcagcag

SEQ ID NO: 550836 - DNA, 20 bp, Artificial
  CRISPR gRNA sequence
attttgaaagcagttttact

SEQ ID NO: 550837 - DNA, 20 bp, Artificial
  CRISPR gRNA sequence
taaaattctatcaaacagca

SEQ ID NO: 550838 - DNA, 20 bp, Artificial
  CRISPR gRNA sequence
gagaaatattttgtgaaagg

SEQ ID NO: 550839 - DNA, 20 bp, Artificial
  CRISPR gRNA sequence
tatagaactggagattgtta

SEQ ID NO: 550840 - DNA, 20 bp, Artificial
  CRISPR gRNA sequence
ggagattgttatggggttaa

SEQ ID NO: 550841 - DNA, 20 bp, Artificial
  CRISPR gRNA sequence
attgttatggggttaagaga

SEQ ID NO: 550842 - DNA, 20 bp, Artificial
  CRISPR gRNA sequence
taaaatacattttttaaaga

SEQ ID NO: 550843 - DNA, 20 bp, Artificial
  CRISPR gRNA sequence
ggctttctttacttcaatac

SEQ ID NO: 550844 - DNA, 20 bp, Artificial
  CRISPR gRNA sequence
gtaaattctgcctcccctaa

SEQ ID NO: 550845 - DNA, 20 bp, Artificial
  CRISPR gRNA sequence
acggtgtctgtcttgttctc

SEQ ID NO: 550846 - DNA, 20 bp, Artificial
  CRISPR gRNA sequence
ttgttctcaaggatcttata

SEQ ID NO: 550847 - DNA, 20 bp, Artificial
  CRISPR gRNA sequence
ttatatagaatagatgccca

SEQ ID NO: 550848 - DNA, 20 bp, Artificial
  CRISPR gRNA sequence
agatgcccaatgaatatttc

SEQ ID NO: 550849 - DNA, 20 bp, Artificial
  CRISPR gRNA sequence
gcccaatgaatatttcctga

SEQ ID NO: 550850 - DNA, 20 bp, Artificial
  CRISPR gRNA sequence
aatgaatatttcctgagtga

SEQ ID NO: 550851 - DNA, 20 bp, Artificial
  CRISPR gRNA sequence
tttcctgagtgaatgaataa

SEQ ID NO: 550852 - DNA, 20 bp, Artificial
  CRISPR gRNA sequence
atgaataaatgaatcccatc

SEQ ID NO: 550853 - DNA, 20 bp, Artificial
  CRISPR gRNA sequence
ttctgaaagggcactgacca

SEQ ID NO: 550854 - DNA, 20 bp, Artificial
  CRISPR gRNA sequence
cctgctttcctacctgtaaa

SEQ ID NO: 550855 - DNA, 20 bp, Artificial
  CRISPR gRNA sequence
tactgcaggtagacatggag

SEQ ID NO: 550856 - DNA, 20 bp, Artificial
  CRISPR gRNA sequence
agacatggagagggataaaa

SEQ ID NO: 550857 - DNA, 20 bp, Artificial
  CRISPR gRNA sequence
atgtgaacatataaccagca

SEQ ID NO: 550858 - DNA, 20 bp, Artificial
  CRISPR gRNA sequence
tgtcacttcaccagtgaaat

SEQ ID NO: 550859 - DNA, 20 bp, Artificial
  CRISPR gRNA sequence
taatttgactaaataatttt

SEQ ID NO: 550860 - DNA, 20 bp, Artificial
  CRISPR gRNA sequence
aggaaaagcataaggtgtag

SEQ ID NO: 550861 - DNA, 20 bp, Artificial
  CRISPR gRNA sequence
taaggtgtagaagaatgaaa

SEQ ID NO: 550862 - DNA, 20 bp, Artificial
  CRISPR gRNA sequence
tatataaaaatcaactcaag

SEQ ID NO: 550863 - DNA, 20 bp, Artificial
  CRISPR gRNA sequence
acagcaatataaacaatcag

SEQ ID NO: 550864 - DNA, 20 bp, Artificial
  CRISPR gRNA sequence
tctgacaaaggaccaatatc

SEQ ID NO: 550865 - DNA, 20 bp, Artificial
  CRISPR gRNA sequence
tcaaaaagtgggccaaggac

SEQ ID NO: 550866 - DNA, 20 bp, Artificial
  CRISPR gRNA sequence
tgaatagacagttctcaaag

SEQ ID NO: 550867 - DNA, 20 bp, Artificial
  CRISPR gRNA sequence
caataccaccttactcctgc

SEQ ID NO: 550868 - DNA, 20 bp, Artificial
  CRISPR gRNA sequence
aaaaaataatagatgttggc

SEQ ID NO: 550869 - DNA, 20 bp, Artificial
  CRISPR gRNA sequence
aacacctgtacactgctggt

SEQ ID NO: 550870 - DNA, 20 bp, Artificial
  CRISPR gRNA sequence
ttgatccagcaatcccatta

SEQ ID NO: 550871 - DNA, 20 bp, Artificial
  CRISPR gRNA sequence
aactcgcaattgcaaaaata

SEQ ID NO: 550872 - DNA, 20 bp, Artificial
  CRISPR gRNA sequence
gcataaatgcccatcaatca

SEQ ID NO: 550873 - DNA, 20 bp, Artificial
  CRISPR gRNA sequence
aaatgcccatcaatcaatga

SEQ ID NO: 550874 - DNA, 20 bp, Artificial
  CRISPR gRNA sequence
tgtgggagatatatatatat

SEQ ID NO: 550875 - DNA, 20 bp, Artificial
  CRISPR gRNA sequence
tactcaggaggctgaggcag

SEQ ID NO: 550876 - DNA, 20 bp, Artificial
  CRISPR gRNA sequence
ataatggcattcacagcaac

SEQ ID NO: 550877 - DNA, 20 bp, Artificial
  CRISPR gRNA sequence
tattctaagtgaagtaactc

SEQ ID NO: 550878 - DNA, 20 bp, Artificial
  CRISPR gRNA sequence
aagtgggagctaagctatgt

SEQ ID NO: 550879 - DNA, 20 bp, Artificial
  CRISPR gRNA sequence
aactttggggacttgtggag

SEQ ID NO: 550880 - DNA, 20 bp, Artificial
  CRISPR gRNA sequence
tggggacttgtggagaaggg

SEQ ID NO: 550881 - DNA, 20 bp, Artificial
  CRISPR gRNA sequence
cttgtggagaagggtgggat

SEQ ID NO: 550882 - DNA, 20 bp, Artificial
  CRISPR gRNA sequence
agaagggtgggatggggatg

SEQ ID NO: 550883 - DNA, 20 bp, Artificial
  CRISPR gRNA sequence
gagggataaaagactacaca

SEQ ID NO: 550884 - DNA, 20 bp, Artificial
  CRISPR gRNA sequence
acactgggtacagtgtacac

SEQ ID NO: 550885 - DNA, 20 bp, Artificial
  CRISPR gRNA sequence
aatatacttactaagtgaaa

SEQ ID NO: 550886 - DNA, 20 bp, Artificial
  CRISPR gRNA sequence
aaagcaggctaagtgggagg

SEQ ID NO: 550887 - DNA, 20 bp, Artificial
  CRISPR gRNA sequence
ggggttggtcttgctatctc

SEQ ID NO: 550888 - DNA, 20 bp, Artificial
  CRISPR gRNA sequence
agctcaaacccatgttgttc

SEQ ID NO: 550889 - DNA, 20 bp, Artificial
  CRISPR gRNA sequence
tcttctactgttctcaagcc

SEQ ID NO: 550890 - DNA, 20 bp, Artificial
  CRISPR gRNA sequence
aaaagacatcttcatgccgc

SEQ ID NO: 550891 - DNA, 20 bp, Artificial
  CRISPR gRNA sequence
tttacatttataagacattt

SEQ ID NO: 550892 - DNA, 20 bp, Artificial
  CRISPR gRNA sequence
gtgtggtagactctcacccc

SEQ ID NO: 550893 - DNA, 20 bp, Artificial
  CRISPR gRNA sequence
gtgccttcccacatactctg

SEQ ID NO: 550894 - DNA, 20 bp, Artificial
  CRISPR gRNA sequence
gttccccttaattaagggag

SEQ ID NO: 550895 - DNA, 20 bp, Artificial
  CRISPR gRNA sequence
aagtccttgtagataaacaa

SEQ ID NO: 550896 - DNA, 20 bp, Artificial
  CRISPR gRNA sequence
tcatgctctgtcacccaggc

SEQ ID NO: 550897 - DNA, 20 bp, Artificial
  CRISPR gRNA sequence
ttttgtacttttcgtaaaga

SEQ ID NO: 550898 - DNA, 20 bp, Artificial
  CRISPR gRNA sequence
agatgcatttaaacccactt

SEQ ID NO: 550899 - DNA, 20 bp, Artificial
  CRISPR gRNA sequence
cccaccactgcacccaatcc

SEQ ID NO: 550900 - DNA, 20 bp, Artificial
  CRISPR gRNA sequence
cacttcccccaccctcatca

SEQ ID NO: 550901 - DNA, 20 bp, Artificial
  CRISPR gRNA sequence
acttctctctccagcatctc

SEQ ID NO: 550902 - DNA, 20 bp, Artificial
  CRISPR gRNA sequence
ttctgtggcttcctctccat

SEQ ID NO: 550903 - DNA, 20 bp, Artificial
  CRISPR gRNA sequence
ccctcctcattctagctgtt

SEQ ID NO: 550904 - DNA, 20 bp, Artificial
  CRISPR gRNA sequence
tccattcagggccttccttt

SEQ ID NO: 550905 - DNA, 20 bp, Artificial
  CRISPR gRNA sequence
tggcagatggttggtgctcc

SEQ ID NO: 550906 - DNA, 20 bp, Artificial
  CRISPR gRNA sequence
tggttggtgctccatgaatg

SEQ ID NO: 550907 - DNA, 20 bp, Artificial
  CRISPR gRNA sequence
atgaatgtcgggtccatttc

SEQ ID NO: 550908 - DNA, 20 bp, Artificial
  CRISPR gRNA sequence
caggtcccagttttctatta

SEQ ID NO: 550909 - DNA, 20 bp, Artificial
  CRISPR gRNA sequence
cttagcacaaaaagtacctg

SEQ ID NO: 550910 - DNA, 20 bp, Artificial
  CRISPR gRNA sequence
aaatatatggtgttgtgtat

SEQ ID NO: 550911 - DNA, 20 bp, Artificial
  CRISPR gRNA sequence
aggtcctatggaaaaaacaa

SEQ ID NO: 550912 - DNA, 20 bp, Artificial
  CRISPR gRNA sequence
agttgcagaactggaaaatt

SEQ ID NO: 550913 - DNA, 20 bp, Artificial
  CRISPR gRNA sequence
gctttctcatcttttaaaaa

SEQ ID NO: 550914 - DNA, 20 bp, Artificial
  CRISPR gRNA sequence
cttaacatcatcagatgaag

SEQ ID NO: 550915 - DNA, 20 bp, Artificial
  CRISPR gRNA sequence
agatgaagatgagtatgaaa

SEQ ID NO: 550916 - DNA, 20 bp, Artificial
  CRISPR gRNA sequence
gttctttctttatgtgcttg

SEQ ID NO: 550917 - DNA, 20 bp, Artificial
  CRISPR gRNA sequence
aaattaatggtctatgagaa

SEQ ID NO: 550918 - DNA, 20 bp, Artificial
  CRISPR gRNA sequence
aattagatgttacctgttgt

SEQ ID NO: 550919 - DNA, 20 bp, Artificial
  CRISPR gRNA sequence
tcaattcctttgtcattcct

SEQ ID NO: 550920 - DNA, 20 bp, Artificial
  CRISPR gRNA sequence
gtcattcctctgggtgagga

SEQ ID NO: 550921 - DNA, 20 bp, Artificial
  CRISPR gRNA sequence
acagtatcagttgtcttact

SEQ ID NO: 550922 - DNA, 20 bp, Artificial
  CRISPR gRNA sequence
ttaatttatttattttgaga

SEQ ID NO: 550923 - DNA, 20 bp, Artificial
  CRISPR gRNA sequence
tctcactctgttaccaaggc

SEQ ID NO: 550924 - DNA, 20 bp, Artificial
  CRISPR gRNA sequence
gcctcagcctcccaaagtgc

SEQ ID NO: 550925 - DNA, 20 bp, Artificial
  CRISPR gRNA sequence
tccttgatcgcctctcctgt

SEQ ID NO: 550926 - DNA, 20 bp, Artificial
  CRISPR gRNA sequence
ctctacgttacccactaccc

SEQ ID NO: 550927 - DNA, 20 bp, Artificial
  CRISPR gRNA sequence
tgctgccctccctactcagc

SEQ ID NO: 550928 - DNA, 20 bp, Artificial
  CRISPR gRNA sequence
actttttctctcctcaaatc

SEQ ID NO: 550929 - DNA, 20 bp, Artificial
  CRISPR gRNA sequence
ttgcttcttatttcactaag

SEQ ID NO: 550930 - DNA, 20 bp, Artificial
  CRISPR gRNA sequence
gccctgctttctctcctgat

SEQ ID NO: 550931 - DNA, 20 bp, Artificial
  CRISPR gRNA sequence
tcctgatatgaatggacttt

SEQ ID NO: 550932 - DNA, 20 bp, Artificial
  CRISPR gRNA sequence
ttaaactttccacgtgtgcc

SEQ ID NO: 550933 - DNA, 20 bp, Artificial
  CRISPR gRNA sequence
cacctcctcttgccgtcctc

SEQ ID NO: 550934 - DNA, 20 bp, Artificial
  CRISPR gRNA sequence
tctacccactctctcctgat

SEQ ID NO: 550935 - DNA, 20 bp, Artificial
  CRISPR gRNA sequence
tactgtcttcacttgacatc

SEQ ID NO: 550936 - DNA, 20 bp, Artificial
  CRISPR gRNA sequence
tttctcttttttccttgaga

SEQ ID NO: 550937 - DNA, 20 bp, Artificial
  CRISPR gRNA sequence
ttcgcccttgttgcccaggc

SEQ ID NO: 550938 - DNA, 20 bp, Artificial
  CRISPR gRNA sequence
ctcactgcaacctatgcctc

SEQ ID NO: 550939 - DNA, 20 bp, Artificial
  CRISPR gRNA sequence
cctatgcctcccgggttcaa

SEQ ID NO: 550940 - DNA, 20 bp, Artificial
  CRISPR gRNA sequence
ttttgtatttttagtagaga

SEQ ID NO: 550941 - DNA, 20 bp, Artificial
  CRISPR gRNA sequence
gccttggcctcccaaagtgt

SEQ ID NO: 550942 - DNA, 20 bp, Artificial
  CRISPR gRNA sequence
tctgtctgcgttcatagcca

SEQ ID NO: 550943 - DNA, 20 bp, Artificial
  CRISPR gRNA sequence
acagatctagagctctagcc

SEQ ID NO: 550944 - DNA, 20 bp, Artificial
  CRISPR gRNA sequence
tcagctggtcagtctgaaac

SEQ ID NO: 550945 - DNA, 20 bp, Artificial
  CRISPR gRNA sequence
ccttgatacctctctttttc

SEQ ID NO: 550946 - DNA, 20 bp, Artificial
  CRISPR gRNA sequence
ggaagttgtattggttctac

SEQ ID NO: 550947 - DNA, 20 bp, Artificial
  CRISPR gRNA sequence
agaagatttccttgaaaaag

SEQ ID NO: 550948 - DNA, 20 bp, Artificial
  CRISPR gRNA sequence
atctttgaaacatggacatt

SEQ ID NO: 550949 - DNA, 20 bp, Artificial
  CRISPR gRNA sequence
tagatagggccaacaaacaa

SEQ ID NO: 550950 - DNA, 20 bp, Artificial
  CRISPR gRNA sequence
agggccaacaaacaagagga

SEQ ID NO: 550951 - DNA, 20 bp, Artificial
  CRISPR gRNA sequence
aacaaacaagaggattgagt

SEQ ID NO: 550952 - DNA, 20 bp, Artificial
  CRISPR gRNA sequence
cattttaagagcccttttta

SEQ ID NO: 550953 - DNA, 20 bp, Artificial
  CRISPR gRNA sequence
gtaaaactaattcaaaacat

SEQ ID NO: 550954 - DNA, 20 bp, Artificial
  CRISPR gRNA sequence
actttgtgaggctgaggagg

SEQ ID NO: 550955 - DNA, 20 bp, Artificial
  CRISPR gRNA sequence
tactcaagaggctgaggtgg

SEQ ID NO: 550956 - DNA, 20 bp, Artificial
  CRISPR gRNA sequence
ttgcacctctgcactccagt

SEQ ID NO: 550957 - DNA, 20 bp, Artificial
  CRISPR gRNA sequence
ggttttgttagtcagaccaa

SEQ ID NO: 550958 - DNA, 20 bp, Artificial
  CRISPR gRNA sequence
agaccttaggaagcctgcag

SEQ ID NO: 550959 - DNA, 20 bp, Artificial
  CRISPR gRNA sequence
aggagtaaagtacaggggag

SEQ ID NO: 550960 - DNA, 20 bp, Artificial
  CRISPR gRNA sequence
aggcagtgatattgatagta

SEQ ID NO: 550961 - DNA, 20 bp, Artificial
  CRISPR gRNA sequence
gggacttaaagtcctggttt

SEQ ID NO: 550962 - DNA, 20 bp, Artificial
  CRISPR gRNA sequence
tgtgatggtgcatacttatg

SEQ ID NO: 550963 - DNA, 20 bp, Artificial
  CRISPR gRNA sequence
tactatcatccaggtagata

SEQ ID NO: 550964 - DNA, 20 bp, Artificial
  CRISPR gRNA sequence
ggtagatagagggtccaaga

SEQ ID NO: 550965 - DNA, 20 bp, Artificial
  CRISPR gRNA sequence
agtgagcatattttggacag

SEQ ID NO: 550966 - DNA, 20 bp, Artificial
  CRISPR gRNA sequence
gatgatgatttttatgtaag

SEQ ID NO: 550967 - DNA, 20 bp, Artificial
  CRISPR gRNA sequence
ctgccctgtccttaactggg

SEQ ID NO: 550968 - DNA, 20 bp, Artificial
  CRISPR gRNA sequence
ctgcttaaagtagaggtata

SEQ ID NO: 550969 - DNA, 20 bp, Artificial
  CRISPR gRNA sequence
aaaggcttgcacacttttag

SEQ ID NO: 550970 - DNA, 20 bp, Artificial
  CRISPR gRNA sequence
cttgcacacttttagatgag

SEQ ID NO: 550971 - DNA, 20 bp, Artificial
  CRISPR gRNA sequence
aagagcttctacctagtcaa

SEQ ID NO: 550972 - DNA, 20 bp, Artificial
  CRISPR gRNA sequence
agatgaaaataagacagttt

SEQ ID NO: 550973 - DNA, 20 bp, Artificial
  CRISPR gRNA sequence
ctgtaagtagaacaagagac

SEQ ID NO: 550974 - DNA, 20 bp, Artificial
  CRISPR gRNA sequence
aagtagaacaagagacctgg

SEQ ID NO: 550975 - DNA, 20 bp, Artificial
  CRISPR gRNA sequence
tccggggagcctcggcttcc

SEQ ID NO: 550976 - DNA, 20 bp, Artificial
  CRISPR gRNA sequence
ttaatctcattacagtctga

SEQ ID NO: 550977 - DNA, 20 bp, Artificial
  CRISPR gRNA sequence
atggctcttagtcatgaagc

SEQ ID NO: 550978 - DNA, 20 bp, Artificial
  CRISPR gRNA sequence
gcactcaggcagctgggctt

SEQ ID NO: 550979 - DNA, 20 bp, Artificial
  CRISPR gRNA sequence
actgtacctctttggagata

SEQ ID NO: 550980 - DNA, 20 bp, Artificial
  CRISPR gRNA sequence
tctttggagatagcgggtag

SEQ ID NO: 550981 - DNA, 20 bp, Artificial
  CRISPR gRNA sequence
tttatttgaagactgtctct

SEQ ID NO: 550982 - DNA, 20 bp, Artificial
  CRISPR gRNA sequence
tcatgtgctgtggttgaaag

SEQ ID NO: 550983 - DNA, 20 bp, Artificial
  CRISPR gRNA sequence
tctgttcagttcagaaagtg

SEQ ID NO: 550984 - DNA, 20 bp, Artificial
  CRISPR gRNA sequence
gcagagctagatcaatacat

SEQ ID NO: 550985 - DNA, 20 bp, Artificial
  CRISPR gRNA sequence
ccacatacatcagaagcacc

SEQ ID NO: 550986 - DNA, 20 bp, Artificial
  CRISPR gRNA sequence
cacctgggatggtggggctc

SEQ ID NO: 550987 - DNA, 20 bp, Artificial
  CRISPR gRNA sequence
aggcatttttgaactattct

SEQ ID NO: 550988 - DNA, 20 bp, Artificial
  CRISPR gRNA sequence
aagtcccctgagggctgcta

SEQ ID NO: 550989 - DNA, 20 bp, Artificial
  CRISPR gRNA sequence
ccctgagggctgctatgggg

SEQ ID NO: 550990 - DNA, 20 bp, Artificial
  CRISPR gRNA sequence
agggctctaggctttcaatt

SEQ ID NO: 550991 - DNA, 20 bp, Artificial
  CRISPR gRNA sequence
ctagagcaacttcttatcca

SEQ ID NO: 550992 - DNA, 20 bp, Artificial
  CRISPR gRNA sequence
gcaacttcttatccattgga

SEQ ID NO: 550993 - DNA, 20 bp, Artificial
  CRISPR gRNA sequence
ctggtttctaccaaggcagg

SEQ ID NO: 550994 - DNA, 20 bp, Artificial
  CRISPR gRNA sequence
ctttatttaactgagcgaga

SEQ ID NO: 550995 - DNA, 20 bp, Artificial
  CRISPR gRNA sequence
cctcttatgattaattgctg

SEQ ID NO: 550996 - DNA, 20 bp, Artificial
  CRISPR gRNA sequence
gctgagacgcaagaaggcat

SEQ ID NO: 550997 - DNA, 20 bp, Artificial
  CRISPR gRNA sequence
cttttaaagggcaacaatgg

SEQ ID NO: 550998 - DNA, 20 bp, Artificial
  CRISPR gRNA sequence
taggaggcacttcctagaag

SEQ ID NO: 550999 - DNA, 20 bp, Artificial
  CRISPR gRNA sequence
gcacttcctagaagaagggt

SEQ ID NO: 551000 - DNA, 20 bp, Artificial
  CRISPR gRNA sequence
tccacctttcacaaaatgta

SEQ ID NO: 551001 - DNA, 20 bp, Artificial
  CRISPR gRNA sequence
ctttcctttcacaaaatgct

SEQ ID NO: 551002 - DNA, 20 bp, Artificial
  CRISPR gRNA sequence
gctttgagtcagacgtgtta

SEQ ID NO: 551003 - DNA, 20 bp, Artificial
  CRISPR gRNA sequence
ttaattatggggagcaccct

SEQ ID NO: 551004 - DNA, 20 bp, Artificial
  CRISPR gRNA sequence
gcccactgtgtgtagtgagc

SEQ ID NO: 551005 - DNA, 20 bp, Artificial
  CRISPR gRNA sequence
ctttaaactttttataaaga

SEQ ID NO: 551006 - DNA, 20 bp, Artificial
  CRISPR gRNA sequence
cctcagcctcccaaagtgct

SEQ ID NO: 551007 - DNA, 20 bp, Artificial
  CRISPR gRNA sequence
cactgtgtcctgccaagcac

SEQ ID NO: 551008 - DNA, 20 bp, Artificial
  CRISPR gRNA sequence
atttttgtggtgaaacgata

SEQ ID NO: 551009 - DNA, 20 bp, Artificial
  CRISPR gRNA sequence
aacgataatgaatatttgaa

SEQ ID NO: 551010 - DNA, 20 bp, Artificial
  CRISPR gRNA sequence
tgtgttaattcaggtcaggt

SEQ ID NO: 551011 - DNA, 20 bp, Artificial
  CRISPR gRNA sequence
cttcagagattttttgattt

SEQ ID NO: 551012 - DNA, 20 bp, Artificial
  CRISPR gRNA sequence
gattttttgatttaagaatt

SEQ ID NO: 551013 - DNA, 20 bp, Artificial
  CRISPR gRNA sequence
tgatttaagaattgaggata

SEQ ID NO: 551014 - DNA, 20 bp, Artificial
  CRISPR gRNA sequence
ctataaagaactacctgaaa

SEQ ID NO: 551015 - DNA, 20 bp, Artificial
  CRISPR gRNA sequence
gagaactcactctctatcac

SEQ ID NO: 551016 - DNA, 20 bp, Artificial
  CRISPR gRNA sequence
aggtccctctctcgacacat

SEQ ID NO: 551017 - DNA, 20 bp, Artificial
  CRISPR gRNA sequence
attacaattcaagatgagat

SEQ ID NO: 551018 - DNA, 20 bp, Artificial
  CRISPR gRNA sequence
gacccagagccaaaccatat

SEQ ID NO: 551019 - DNA, 20 bp, Artificial
  CRISPR gRNA sequence
gagccaaaccatatcagggt

SEQ ID NO: 551020 - DNA, 20 bp, Artificial
  CRISPR gRNA sequence
agatctgacctagcaaaaga

SEQ ID NO: 551021 - DNA, 20 bp, Artificial
  CRISPR gRNA sequence
ttctcgctccttgatgctca

SEQ ID NO: 551022 - DNA, 20 bp, Artificial
  CRISPR gRNA sequence
aaatattatacttttttttc

SEQ ID NO: 551023 - DNA, 20 bp, Artificial
  CRISPR gRNA sequence
gaggacttataatgtactca

SEQ ID NO: 551024 - DNA, 20 bp, Artificial
  CRISPR gRNA sequence
aacctgtatcccaagcagcg

SEQ ID NO: 551025 - DNA, 20 bp, Artificial
  CRISPR gRNA sequence
ttttttttttttttttgaga

SEQ ID NO: 551026 - DNA, 20 bp, Artificial
  CRISPR gRNA sequence
tctcgctctgtcgcccaggc

SEQ ID NO: 551027 - DNA, 20 bp, Artificial
  CRISPR gRNA sequence
ctcactgcaagctccgcctc

SEQ ID NO: 551028 - DNA, 20 bp, Artificial
  CRISPR gRNA sequence
cattctcctgcctcagcctc

SEQ ID NO: 551029 - DNA, 20 bp, Artificial
  CRISPR gRNA sequence
ttttgtatttttagtagaga

SEQ ID NO: 551030 - DNA, 20 bp, Artificial
  CRISPR gRNA sequence
cggggtttcaccgtgttagc

SEQ ID NO: 551031 - DNA, 20 bp, Artificial
  CRISPR gRNA sequence
gcctcggcctcccaaagtgc

SEQ ID NO: 551032 - DNA, 20 bp, Artificial
  CRISPR gRNA sequence
tggtgagaaaccaacagaga

SEQ ID NO: 551033 - DNA, 20 bp, Artificial
  CRISPR gRNA sequence
gtaagtggcagaacctggct

SEQ ID NO: 551034 - DNA, 20 bp, Artificial
  CRISPR gRNA sequence
aaatagtaaatactattatt

SEQ ID NO: 551035 - DNA, 20 bp, Artificial
  CRISPR gRNA sequence
atataattgtaaatagtgaa

SEQ ID NO: 551036 - DNA, 20 bp, Artificial
  CRISPR gRNA sequence
acaggattccagggcaaata

SEQ ID NO: 551037 - DNA, 20 bp, Artificial
  CRISPR gRNA sequence
ttccagggcaaatagagaat

SEQ ID NO: 551038 - DNA, 20 bp, Artificial
  CRISPR gRNA sequence
agaatatgagtctctagggc

SEQ ID NO: 551039 - DNA, 20 bp, Artificial
  CRISPR gRNA sequence
gtctctagggctgggataag

SEQ ID NO: 551040 - DNA, 20 bp, Artificial
  CRISPR gRNA sequence
ggctgggataaggtgagtct

SEQ ID NO: 551041 - DNA, 20 bp, Artificial
  CRISPR gRNA sequence
atacaagaaatatatgaaac

SEQ ID NO: 551042 - DNA, 20 bp, Artificial
  CRISPR gRNA sequence
tatattattttcagacaaag

SEQ ID NO: 551043 - DNA, 20 bp, Artificial
  CRISPR gRNA sequence
gaaaaagtagacgtcctcgt

SEQ ID NO: 551044 - DNA, 20 bp, Artificial
  CRISPR gRNA sequence
cggaggaggcgtagagggcg

SEQ ID NO: 551045 - DNA, 20 bp, Artificial
  CRISPR gRNA sequence
gacctctttattagatgttt

SEQ ID NO: 551046 - DNA, 20 bp, Artificial
  CRISPR gRNA sequence
tttattagatgtttaggaat

SEQ ID NO: 551047 - DNA, 20 bp, Artificial
  CRISPR gRNA sequence
atggtcatcgtgagcatctg

SEQ ID NO: 551048 - DNA, 20 bp, Artificial
  CRISPR gRNA sequence
tggggtcaggctgggctaac

SEQ ID NO: 551049 - DNA, 20 bp, Artificial
  CRISPR gRNA sequence
tgtgctccccgaggactggc

SEQ ID NO: 551050 - DNA, 20 bp, Artificial
  CRISPR gRNA sequence
ggacttggtttaccagacaa

SEQ ID NO: 551051 - DNA, 20 bp, Artificial
  CRISPR gRNA sequence
gcagataacagtttttcaga

SEQ ID NO: 551052 - DNA, 20 bp, Artificial
  CRISPR gRNA sequence
caagtaagacggaaaagctc

SEQ ID NO: 551053 - DNA, 20 bp, Artificial
  CRISPR gRNA sequence
agctcacggatcaggtgatg

SEQ ID NO: 551054 - DNA, 20 bp, Artificial
  CRISPR gRNA sequence
gatcaggtgatgcagaatcc

SEQ ID NO: 551055 - DNA, 20 bp, Artificial
  CRISPR gRNA sequence
ttacctaaagcagtaaaaag

SEQ ID NO: 551056 - DNA, 20 bp, Artificial
  CRISPR gRNA sequence
gcctctctttgacgagagaa

SEQ ID NO: 551057 - DNA, 20 bp, Artificial
  CRISPR gRNA sequence
tgttgaaccaacatctgata

SEQ ID NO: 551058 - DNA, 20 bp, Artificial
  CRISPR gRNA sequence
accaacatctgatatggaat

SEQ ID NO: 551059 - DNA, 20 bp, Artificial
  CRISPR gRNA sequence
gctgaagagccaaatcccaa

SEQ ID NO: 551060 - DNA, 20 bp, Artificial
  CRISPR gRNA sequence
gccaaatcccaaaggaattc

SEQ ID NO: 551061 - DNA, 20 bp, Artificial
  CRISPR gRNA sequence
tagaaatgtagatatgctaa

SEQ ID NO: 551062 - DNA, 20 bp, Artificial
  CRISPR gRNA sequence
tatgctaagtgaattagtcc

SEQ ID NO: 551063 - DNA, 20 bp, Artificial
  CRISPR gRNA sequence
aaccaatcttgaaatacctg

SEQ ID NO: 551064 - DNA, 20 bp, Artificial
  CRISPR gRNA sequence
cagcctatgtctttcatatt

SEQ ID NO: 551065 - DNA, 20 bp, Artificial
  CRISPR gRNA sequence
tcctgagatcatggactgcg

SEQ ID NO: 551066 - DNA, 20 bp, Artificial
  CRISPR gRNA sequence
ctattgactggaagaaagga

SEQ ID NO: 551067 - DNA, 20 bp, Artificial
  CRISPR gRNA sequence
tcaagaaaaagcagaagcgt

SEQ ID NO: 551068 - DNA, 20 bp, Artificial
  CRISPR gRNA sequence
aattaccaaacaagtatcca

SEQ ID NO: 551069 - DNA, 20 bp, Artificial
  CRISPR gRNA sequence
actgaaagcatctggggacg

SEQ ID NO: 551070 - DNA, 20 bp, Artificial
  CRISPR gRNA sequence
catctggggacggagaatca

SEQ ID NO: 551071 - DNA, 20 bp, Artificial
  CRISPR gRNA sequence
agaatcactggataaagatt

SEQ ID NO: 551072 - DNA, 20 bp, Artificial
  CRISPR gRNA sequence
acttcgctggggaggcctta

SEQ ID NO: 551073 - DNA, 20 bp, Artificial
  CRISPR gRNA sequence
cgaaggtgaagaagaagagg

SEQ ID NO: 551074 - DNA, 20 bp, Artificial
  CRISPR gRNA sequence
gtgatgaggagggagaagat

SEQ ID NO: 551075 - DNA, 20 bp, Artificial
  CRISPR gRNA sequence
caaggaacccagccagccgg

SEQ ID NO: 551076 - DNA, 20 bp, Artificial
  CRISPR gRNA sequence
gagggccccatagaccccat

SEQ ID NO: 551077 - DNA, 20 bp, Artificial
  CRISPR gRNA sequence
ccccatagaccccattgggg

SEQ ID NO: 551078 - DNA, 20 bp, Artificial
  CRISPR gRNA sequence
tagaccccattggggtgggg

SEQ ID NO: 551079 - DNA, 20 bp, Artificial
  CRISPR gRNA sequence
cccattggggtggggtggga

SEQ ID NO: 551080 - DNA, 20 bp, Artificial
  CRISPR gRNA sequence
ggggtggggtgggatggggt

SEQ ID NO: 551081 - DNA, 20 bp, Artificial
  CRISPR gRNA sequence
aggtctggtgatgaggttcc

SEQ ID NO: 551082 - DNA, 20 bp, Artificial
  CRISPR gRNA sequence
ctaccactcctgcagttgga

SEQ ID NO: 551083 - DNA, 20 bp, Artificial
  CRISPR gRNA sequence
gttttcagctgcttaatctg

SEQ ID NO: 551084 - DNA, 20 bp, Artificial
  CRISPR gRNA sequence
atcatctcagaagggccgtg

SEQ ID NO: 551085 - DNA, 20 bp, Artificial
  CRISPR gRNA sequence
gagtagggccgtattctcct

SEQ ID NO: 551086 - DNA, 20 bp, Artificial
  CRISPR gRNA sequence
gctttttgatcttctttttt

SEQ ID NO: 551087 - DNA, 20 bp, Artificial
  CRISPR gRNA sequence
ttgatcttcttttttaaggg

SEQ ID NO: 551088 - DNA, 20 bp, Artificial
  CRISPR gRNA sequence
ttcttttttaagggttgggt

SEQ ID NO: 551089 - DNA, 20 bp, Artificial
  CRISPR gRNA sequence
cagctcaggcgagagctgcc

SEQ ID NO: 551090 - DNA, 20 bp, Artificial
  CRISPR gRNA sequence
cacaggcaccgccctgctgc

SEQ ID NO: 551091 - DNA, 20 bp, Artificial
  CRISPR gRNA sequence
caccgccctgctgccggagt

SEQ ID NO: 551092 - DNA, 20 bp, Artificial
  CRISPR gRNA sequence
gtgtgaccggttggtggctg

SEQ ID NO: 551093 - DNA, 20 bp, Artificial
  CRISPR gRNA sequence
accggttggtggctggtgag

SEQ ID NO: 551094 - DNA, 20 bp, Artificial
  CRISPR gRNA sequence
ctggtgagtggggtttccaa

SEQ ID NO: 551095 - DNA, 20 bp, Artificial
  CRISPR gRNA sequence
gacagcgctctgtggcagcc

SEQ ID NO: 551096 - DNA, 20 bp, Artificial
  CRISPR gRNA sequence
ccgcgctgaccaggcctgta

SEQ ID NO: 551097 - DNA, 20 bp, Artificial
  CRISPR gRNA sequence
accttagaacacatttataa

SEQ ID NO: 551098 - DNA, 20 bp, Artificial
  CRISPR gRNA sequence
ttcaatttgtacataatagt

SEQ ID NO: 551099 - DNA, 20 bp, Artificial
  CRISPR gRNA sequence
aaaaaaaagaaaaagtgcaa

SEQ ID NO: 551100 - DNA, 20 bp, Artificial
  CRISPR gRNA sequence
tcctttattaattccacctt

SEQ ID NO: 551101 - DNA, 20 bp, Artificial
  CRISPR gRNA sequence
atacttgaaggaaataattt

SEQ ID NO: 551102 - DNA, 20 bp, Artificial
  CRISPR gRNA sequence
ttctgagtaagatccctcta

SEQ ID NO: 551103 - DNA, 20 bp, Artificial
  CRISPR gRNA sequence
gatccctctatagaattaca

SEQ ID NO: 551104 - DNA, 20 bp, Artificial
  CRISPR gRNA sequence
gaattacatggaatatttta

SEQ ID NO: 551105 - DNA, 20 bp, Artificial
  CRISPR gRNA sequence
tttaactttatgtttgccat

SEQ ID NO: 551106 - DNA, 20 bp, Artificial
  CRISPR gRNA sequence
gtctggtaaaagatcataag

SEQ ID NO: 551107 - DNA, 20 bp, Artificial
  CRISPR gRNA sequence
caacagattttgaaagtttg

SEQ ID NO: 551108 - DNA, 20 bp, Artificial
  CRISPR gRNA sequence
taggtcttaggtttaaatcc

SEQ ID NO: 551109 - DNA, 20 bp, Artificial
  CRISPR gRNA sequence
tcttttgaacagtaacagtc

SEQ ID NO: 551110 - DNA, 20 bp, Artificial
  CRISPR gRNA sequence
ttttttttctgagatgattt

SEQ ID NO: 551111 - DNA, 20 bp, Artificial
  CRISPR gRNA sequence
acagttgttacttacctttt

SEQ ID NO: 551112 - DNA, 20 bp, Artificial
  CRISPR gRNA sequence
aagaatgaggagacaggtag

SEQ ID NO: 551113 - DNA, 20 bp, Artificial
  CRISPR gRNA sequence
caacactttgggaggctgag

SEQ ID NO: 551114 - DNA, 20 bp, Artificial
  CRISPR gRNA sequence
actttgggaggctgaggcgg

SEQ ID NO: 551115 - DNA, 20 bp, Artificial
  CRISPR gRNA sequence
tacttgggaggctgaggcag

SEQ ID NO: 551116 - DNA, 20 bp, Artificial
  CRISPR gRNA sequence
ccacaccactgcactccagc

SEQ ID NO: 551117 - DNA, 20 bp, Artificial
  CRISPR gRNA sequence
ctgcactccagcctgggtga

SEQ ID NO: 551118 - DNA, 20 bp, Artificial
  CRISPR gRNA sequence
tccgtctcaaaaaaaaaaaa

SEQ ID NO: 551119 - DNA, 20 bp, Artificial
  CRISPR gRNA sequence
aaaaaaaaagaatgaggaga

SEQ ID NO: 551120 - DNA, 20 bp, Artificial
  CRISPR gRNA sequence
aggagacagggtcaaccagg

SEQ ID NO: 551121 - DNA, 20 bp, Artificial
  CRISPR gRNA sequence
accaggtggggtgacttgcc

SEQ ID NO: 551122 - DNA, 20 bp, Artificial
  CRISPR gRNA sequence
ggtcacttaagtattggaga

SEQ ID NO: 551123 - DNA, 20 bp, Artificial
  CRISPR gRNA sequence
tagaattaaaatttaggtct

SEQ ID NO: 551124 - DNA, 20 bp, Artificial
  CRISPR gRNA sequence
aaatttaggtctttgaattc

SEQ ID NO: 551125 - DNA, 20 bp, Artificial
  CRISPR gRNA sequence
gttttctttgatttattcat

SEQ ID NO: 551126 - DNA, 20 bp, Artificial
  CRISPR gRNA sequence
gcaacccagaaatggggcga

SEQ ID NO: 551127 - DNA, 20 bp, Artificial
  CRISPR gRNA sequence
tagttaaacacaatctaaag

SEQ ID NO: 551128 - DNA, 20 bp, Artificial
  CRISPR gRNA sequence
gagacagttaagattgagga

SEQ ID NO: 551129 - DNA, 20 bp, Artificial
  CRISPR gRNA sequence
tccaactcgtattgtactgg

SEQ ID NO: 551130 - DNA, 20 bp, Artificial
  CRISPR gRNA sequence
ccacacaacaacccagtggt

SEQ ID NO: 551131 - DNA, 20 bp, Artificial
  CRISPR gRNA sequence
ggtgtgggtatttataaagg

SEQ ID NO: 551132 - DNA, 20 bp, Artificial
  CRISPR gRNA sequence
acatttattaagagcaaagc

SEQ ID NO: 551133 - DNA, 20 bp, Artificial
  CRISPR gRNA sequence
aagaagatgactcagagatg

SEQ ID NO: 551134 - DNA, 20 bp, Artificial
  CRISPR gRNA sequence
agagatggagaattataatc

SEQ ID NO: 551135 - DNA, 20 bp, Artificial
  CRISPR gRNA sequence
gagaattataatctggaatt

SEQ ID NO: 551136 - DNA, 20 bp, Artificial
  CRISPR gRNA sequence
cttatctccttatctgcggt

SEQ ID NO: 551137 - DNA, 20 bp, Artificial
  CRISPR gRNA sequence
aagctggtttatggcagcac

SEQ ID NO: 551138 - DNA, 20 bp, Artificial
  CRISPR gRNA sequence
gttgagggcaggagaaaatt

SEQ ID NO: 551139 - DNA, 20 bp, Artificial
  CRISPR gRNA sequence
attctggatagaagagaaca

SEQ ID NO: 551140 - DNA, 20 bp, Artificial
  CRISPR gRNA sequence
tttcattgcttactggcagt

SEQ ID NO: 551141 - DNA, 20 bp, Artificial
  CRISPR gRNA sequence
ttactggcagtgtgaatgtg

SEQ ID NO: 551142 - DNA, 20 bp, Artificial
  CRISPR gRNA sequence
aaataaaatagcatgtggga

SEQ ID NO: 551143 - DNA, 20 bp, Artificial
  CRISPR gRNA sequence
taaaactgctagttgttatt

SEQ ID NO: 551144 - DNA, 20 bp, Artificial
  CRISPR gRNA sequence
gttgttattcaggatacagg

SEQ ID NO: 551145 - DNA, 20 bp, Artificial
  CRISPR gRNA sequence
aggacaatgtagaagaggtt

SEQ ID NO: 551146 - DNA, 20 bp, Artificial
  CRISPR gRNA sequence
ggtcattgttgacagacctt

SEQ ID NO: 551147 - DNA, 20 bp, Artificial
  CRISPR gRNA sequence
gacagaccttgtgaatagat

SEQ ID NO: 551148 - DNA, 20 bp, Artificial
  CRISPR gRNA sequence
cctgggctttaagtaagaag

SEQ ID NO: 551149 - DNA, 20 bp, Artificial
  CRISPR gRNA sequence
gtgaaagaggaaaataaaat

SEQ ID NO: 551150 - DNA, 20 bp, Artificial
  CRISPR gRNA sequence
aataaaatctgagtaccttt

SEQ ID NO: 551151 - DNA, 20 bp, Artificial
  CRISPR gRNA sequence
agataactgctgggaagaag

SEQ ID NO: 551152 - DNA, 20 bp, Artificial
  CRISPR gRNA sequence
ggaaagggcacattttttga

SEQ ID NO: 551153 - DNA, 20 bp, Artificial
  CRISPR gRNA sequence
ttttttgaaggggtaggcaa

SEQ ID NO: 551154 - DNA, 20 bp, Artificial
  CRISPR gRNA sequence
gtaggcaagaggatattctc

SEQ ID NO: 551155 - DNA, 20 bp, Artificial
  CRISPR gRNA sequence
tatgtagaacaaacattgtt

SEQ ID NO: 551156 - DNA, 20 bp, Artificial
  CRISPR gRNA sequence
tggacattatgttacctgca

SEQ ID NO: 551157 - DNA, 20 bp, Artificial
  CRISPR gRNA sequence
atattatgtagactgagata

SEQ ID NO: 551158 - DNA, 20 bp, Artificial
  CRISPR gRNA sequence
agactgagataaagaatgtt

SEQ ID NO: 551159 - DNA, 20 bp, Artificial
  CRISPR gRNA sequence
acaggcagaaacagaagtag

SEQ ID NO: 551160 - DNA, 20 bp, Artificial
  CRISPR gRNA sequence
ttttatgactttccactggg

SEQ ID NO: 551161 - DNA, 20 bp, Artificial
  CRISPR gRNA sequence
cactgggaagaatagtgatt

SEQ ID NO: 551162 - DNA, 20 bp, Artificial
  CRISPR gRNA sequence
actttgtgaggccaagacgg

SEQ ID NO: 551163 - DNA, 20 bp, Artificial
  CRISPR gRNA sequence
cgggaggattgcttgaggct

SEQ ID NO: 551164 - DNA, 20 bp, Artificial
  CRISPR gRNA sequence
tacttgggagactgaggtgg

SEQ ID NO: 551165 - DNA, 20 bp, Artificial
  CRISPR gRNA sequence
acagaaagcaccaggttcag

SEQ ID NO: 551166 - DNA, 20 bp, Artificial
  CRISPR gRNA sequence
aggttcagatgggttcattg

SEQ ID NO: 551167 - DNA, 20 bp, Artificial
  CRISPR gRNA sequence
ttaaacaaaatattagcaaa

SEQ ID NO: 551168 - DNA, 20 bp, Artificial
  CRISPR gRNA sequence
tggatccaacagcatataga

SEQ ID NO: 551169 - DNA, 20 bp, Artificial
  CRISPR gRNA sequence
ataaaaactctcagtaaact

SEQ ID NO: 551170 - DNA, 20 bp, Artificial
  CRISPR gRNA sequence
gaagctttccaactaagacc

SEQ ID NO: 551171 - DNA, 20 bp, Artificial
  CRISPR gRNA sequence
tgttttagttctcagatgac

SEQ ID NO: 551172 - DNA, 20 bp, Artificial
  CRISPR gRNA sequence
tatctatgtatacaatccaa

SEQ ID NO: 551173 - DNA, 20 bp, Artificial
  CRISPR gRNA sequence
aaaaaactatagcacatttg

SEQ ID NO: 551174 - DNA, 20 bp, Artificial
  CRISPR gRNA sequence
ctataacagcaatgaacaag

SEQ ID NO: 551175 - DNA, 20 bp, Artificial
  CRISPR gRNA sequence
caaaatatcagaagtcattt

SEQ ID NO: 551176 - DNA, 20 bp, Artificial
  CRISPR gRNA sequence
taaatgggcaggcaaaagac

SEQ ID NO: 551177 - DNA, 20 bp, Artificial
  CRISPR gRNA sequence
aataaaagacaaatagatca

SEQ ID NO: 551178 - DNA, 20 bp, Artificial
  CRISPR gRNA sequence
agacaaatagatcagtgaat

SEQ ID NO: 551179 - DNA, 20 bp, Artificial
  CRISPR gRNA sequence
ggacatccacatgcaaaaaa

SEQ ID NO: 551180 - DNA, 20 bp, Artificial
  CRISPR gRNA sequence
aagagaaaacctagataact

SEQ ID NO: 551181 - DNA, 20 bp, Artificial
  CRISPR gRNA sequence
aagacatgattcatgaaaga

SEQ ID NO: 551182 - DNA, 20 bp, Artificial
  CRISPR gRNA sequence
tctatgaaagacaatttcaa

SEQ ID NO: 551183 - DNA, 20 bp, Artificial
  CRISPR gRNA sequence
acaaacaacccaattaaaaa

SEQ ID NO: 551184 - DNA, 20 bp, Artificial
  CRISPR gRNA sequence
aaggtatacagatggcaaat

SEQ ID NO: 551185 - DNA, 20 bp, Artificial
  CRISPR gRNA sequence
tataaaaagatactcctggg

SEQ ID NO: 551186 - DNA, 20 bp, Artificial
  CRISPR gRNA sequence
actttgggaggccgaggcag

SEQ ID NO: 551187 - DNA, 20 bp, Artificial
  CRISPR gRNA sequence
caggcggatcacctgaggtc

SEQ ID NO: 551188 - DNA, 20 bp, Artificial
  CRISPR gRNA sequence
tgacagcaccaaatgccagt

SEQ ID NO: 551189 - DNA, 20 bp, Artificial
  CRISPR gRNA sequence
aactctcattcattgcaggt

SEQ ID NO: 551190 - DNA, 20 bp, Artificial
  CRISPR gRNA sequence
gttgacataaaaaccttcac

SEQ ID NO: 551191 - DNA, 20 bp, Artificial
  CRISPR gRNA sequence
accaagatgtccttcagtaa

SEQ ID NO: 551192 - DNA, 20 bp, Artificial
  CRISPR gRNA sequence
actgtggtacatacagacaa

SEQ ID NO: 551193 - DNA, 20 bp, Artificial
  CRISPR gRNA sequence
taaatgcatattataagtca

SEQ ID NO: 551194 - DNA, 20 bp, Artificial
  CRISPR gRNA sequence
aaaaagattagtagttggca

SEQ ID NO: 551195 - DNA, 20 bp, Artificial
  CRISPR gRNA sequence
attagtagttggcaggggat

SEQ ID NO: 551196 - DNA, 20 bp, Artificial
  CRISPR gRNA sequence
tatgaataggtggaacacag

SEQ ID NO: 551197 - DNA, 20 bp, Artificial
  CRISPR gRNA sequence
tatacatttgtccaaaccca

SEQ ID NO: 551198 - DNA, 20 bp, Artificial
  CRISPR gRNA sequence
caaacccacagaatgtacaa

SEQ ID NO: 551199 - DNA, 20 bp, Artificial
  CRISPR gRNA sequence
actgaatgctaatgtaaagt

SEQ ID NO: 551200 - DNA, 20 bp, Artificial
  CRISPR gRNA sequence
ttttaatgataatgatgtat

SEQ ID NO: 551201 - DNA, 20 bp, Artificial
  CRISPR gRNA sequence
aaaaatgtaccactctggtg

SEQ ID NO: 551202 - DNA, 20 bp, Artificial
  CRISPR gRNA sequence
aggctatgcatgtgtagggg

SEQ ID NO: 551203 - DNA, 20 bp, Artificial
  CRISPR gRNA sequence
tgaagctaacttactaagcc

SEQ ID NO: 551204 - DNA, 20 bp, Artificial
  CRISPR gRNA sequence
taagccatgaatcaagtttg

SEQ ID NO: 551205 - DNA, 20 bp, Artificial
  CRISPR gRNA sequence
tgttttcaaaacatagtaat

SEQ ID NO: 551206 - DNA, 20 bp, Artificial
  CRISPR gRNA sequence
atttcaaggggctgcattct

SEQ ID NO: 551207 - DNA, 20 bp, Artificial
  CRISPR gRNA sequence
atgctggtatttggttactg

SEQ ID NO: 551208 - DNA, 20 bp, Artificial
  CRISPR gRNA sequence
tgtattgcaggaaaatgcaa

SEQ ID NO: 551209 - DNA, 20 bp, Artificial
  CRISPR gRNA sequence
gaatatttatattgttgtta

SEQ ID NO: 551210 - DNA, 20 bp, Artificial
  CRISPR gRNA sequence
atattgttgttattgaatat

SEQ ID NO: 551211 - DNA, 20 bp, Artificial
  CRISPR gRNA sequence
gttaagtaaacattgtagcc

SEQ ID NO: 551212 - DNA, 20 bp, Artificial
  CRISPR gRNA sequence
gtttctctagtcaaaaacca

SEQ ID NO: 551213 - DNA, 20 bp, Artificial
  CRISPR gRNA sequence
attgaatcttggcagcttaa

SEQ ID NO: 551214 - DNA, 20 bp, Artificial
  CRISPR gRNA sequence
cttggttcttggacccagat

SEQ ID NO: 551215 - DNA, 20 bp, Artificial
  CRISPR gRNA sequence
agacttcccagtttcagcac

SEQ ID NO: 551216 - DNA, 20 bp, Artificial
  CRISPR gRNA sequence
ctcttcagtttcaggaaaac

SEQ ID NO: 551217 - DNA, 20 bp, Artificial
  CRISPR gRNA sequence
ctgattccatacctggggca

SEQ ID NO: 551218 - DNA, 20 bp, Artificial
  CRISPR gRNA sequence
ggaatgcattaaaataagcc

SEQ ID NO: 551219 - DNA, 20 bp, Artificial
  CRISPR gRNA sequence
aagacaattggaacatcaat

SEQ ID NO: 551220 - DNA, 20 bp, Artificial
  CRISPR gRNA sequence
aaactcactggtcatctcta

SEQ ID NO: 551221 - DNA, 20 bp, Artificial
  CRISPR gRNA sequence
gaaaaacgataaagaaagag

SEQ ID NO: 551222 - DNA, 20 bp, Artificial
  CRISPR gRNA sequence
ttcctatataaattgaacct

SEQ ID NO: 551223 - DNA, 20 bp, Artificial
  CRISPR gRNA sequence
aagattgtagttagtaaaga

SEQ ID NO: 551224 - DNA, 20 bp, Artificial
  CRISPR gRNA sequence
aagtatacaaacactacttg

SEQ ID NO: 551225 - DNA, 20 bp, Artificial
  CRISPR gRNA sequence
cttggggagtattattgcca

SEQ ID NO: 551226 - DNA, 20 bp, Artificial
  CRISPR gRNA sequence
gtattattgccaaggaatat

SEQ ID NO: 551227 - DNA, 20 bp, Artificial
  CRISPR gRNA sequence
ggcacctagcagtttctggc

SEQ ID NO: 551228 - DNA, 20 bp, Artificial
  CRISPR gRNA sequence
gtgcattgtgtactctgatt

SEQ ID NO: 551229 - DNA, 20 bp, Artificial
  CRISPR gRNA sequence
tgattttggattttcaatag

SEQ ID NO: 551230 - DNA, 20 bp, Artificial
  CRISPR gRNA sequence
ttggattttcaatagctgga

SEQ ID NO: 551231 - DNA, 20 bp, Artificial
  CRISPR gRNA sequence
tatctttgtgcctttttgcg

SEQ ID NO: 551232 - DNA, 20 bp, Artificial
  CRISPR gRNA sequence
cacatcattgatattttccc

SEQ ID NO: 551233 - DNA, 20 bp, Artificial
  CRISPR gRNA sequence
ccaggataacatcttagaaa

SEQ ID NO: 551234 - DNA, 20 bp, Artificial
  CRISPR gRNA sequence
acatcttagaaatggaattg

SEQ ID NO: 551235 - DNA, 20 bp, Artificial
  CRISPR gRNA sequence
gataagtatatttattagtc

SEQ ID NO: 551236 - DNA, 20 bp, Artificial
  CRISPR gRNA sequence
ggcttattatatacaactgc

SEQ ID NO: 551237 - DNA, 20 bp, Artificial
  CRISPR gRNA sequence
gcttcttttattaaataaca

SEQ ID NO: 551238 - DNA, 20 bp, Artificial
  CRISPR gRNA sequence
ttattaaataacacagggtc

SEQ ID NO: 551239 - DNA, 20 bp, Artificial
  CRISPR gRNA sequence
ataagtttgtttagaaatag

SEQ ID NO: 551240 - DNA, 20 bp, Artificial
  CRISPR gRNA sequence
tgttattcatattagttcta

SEQ ID NO: 551241 - DNA, 20 bp, Artificial
  CRISPR gRNA sequence
aatgttcctgggggaaatac

SEQ ID NO: 551242 - DNA, 20 bp, Artificial
  CRISPR gRNA sequence
tacctttttccacctctgct

SEQ ID NO: 551243 - DNA, 20 bp, Artificial
  CRISPR gRNA sequence
ctctgctgggaatctgctta

SEQ ID NO: 551244 - DNA, 20 bp, Artificial
  CRISPR gRNA sequence
tcatcactgttcttatgtct

SEQ ID NO: 551245 - DNA, 20 bp, Artificial
  CRISPR gRNA sequence
tatgtctgagaatgactgct

SEQ ID NO: 551246 - DNA, 20 bp, Artificial
  CRISPR gRNA sequence
actgctttgggtattgattt

SEQ ID NO: 551247 - DNA, 20 bp, Artificial
  CRISPR gRNA sequence
taaataagcaaaccgcaagg

SEQ ID NO: 551248 - DNA, 20 bp, Artificial
  CRISPR gRNA sequence
aggtggaatctgcaaataat

SEQ ID NO: 551249 - DNA, 20 bp, Artificial
  CRISPR gRNA sequence
attttgatcagttcaactag

SEQ ID NO: 551250 - DNA, 20 bp, Artificial
  CRISPR gRNA sequence
caacatgtattgtgctgtat

SEQ ID NO: 551251 - DNA, 20 bp, Artificial
  CRISPR gRNA sequence
caaaggtcagaaaatagttt

SEQ ID NO: 551252 - DNA, 20 bp, Artificial
  CRISPR gRNA sequence
agatccacattatctcaagg

SEQ ID NO: 551253 - DNA, 20 bp, Artificial
  CRISPR gRNA sequence
ccacattatctcaaggtaga

SEQ ID NO: 551254 - DNA, 20 bp, Artificial
  CRISPR gRNA sequence
taaacttctggtctccaagt

SEQ ID NO: 551255 - DNA, 20 bp, Artificial
  CRISPR gRNA sequence
taattttcatgtcatataac

SEQ ID NO: 551256 - DNA, 20 bp, Artificial
  CRISPR gRNA sequence
atggggctcccaggtaggaa

SEQ ID NO: 551257 - DNA, 20 bp, Artificial
  CRISPR gRNA sequence
aggtaggaagggagttttgg

SEQ ID NO: 551258 - DNA, 20 bp, Artificial
  CRISPR gRNA sequence
cttggagaactgatgacttg

SEQ ID NO: 551259 - DNA, 20 bp, Artificial
  CRISPR gRNA sequence
cagcctgttcattcctggta

SEQ ID NO: 551260 - DNA, 20 bp, Artificial
  CRISPR gRNA sequence
gggagcaggctgtaattctg

SEQ ID NO: 551261 - DNA, 20 bp, Artificial
  CRISPR gRNA sequence
gcaggctgtaattctgaaga

SEQ ID NO: 551262 - DNA, 20 bp, Artificial
  CRISPR gRNA sequence
aaaaggaaatatgccagaca

SEQ ID NO: 551263 - DNA, 20 bp, Artificial
  CRISPR gRNA sequence
atgccagacagggaatgccg

SEQ ID NO: 551264 - DNA, 20 bp, Artificial
  CRISPR gRNA sequence
tttctacaagtgatagtatc

SEQ ID NO: 551265 - DNA, 20 bp, Artificial
  CRISPR gRNA sequence
tatctaggatccattgtgtc

SEQ ID NO: 551266 - DNA, 20 bp, Artificial
  CRISPR gRNA sequence
tctggctagtggctaccata

SEQ ID NO: 551267 - DNA, 20 bp, Artificial
  CRISPR gRNA sequence
catactggatagcccagata

SEQ ID NO: 551268 - DNA, 20 bp, Artificial
  CRISPR gRNA sequence
tctcaattaaagaactaacc

SEQ ID NO: 551269 - DNA, 20 bp, Artificial
  CRISPR gRNA sequence
tgaactaaagagaggtggca

SEQ ID NO: 551270 - DNA, 20 bp, Artificial
  CRISPR gRNA sequence
aatcccagcacattgagagg

SEQ ID NO: 551271 - DNA, 20 bp, Artificial
  CRISPR gRNA sequence
tgtgtgcatcacttgagccc

SEQ ID NO: 551272 - DNA, 20 bp, Artificial
  CRISPR gRNA sequence
ttgtgccactgcactccagc

SEQ ID NO: 551273 - DNA, 20 bp, Artificial
  CRISPR gRNA sequence
ctgcactccagcctgggtga

SEQ ID NO: 551274 - DNA, 20 bp, Artificial
  CRISPR gRNA sequence
aaatagtgagatgtttggca

SEQ ID NO: 551275 - DNA, 20 bp, Artificial
  CRISPR gRNA sequence
atggaatcttcagaagagga

SEQ ID NO: 551276 - DNA, 20 bp, Artificial
  CRISPR gRNA sequence
atcttcagaagaggaaagag

SEQ ID NO: 551277 - DNA, 20 bp, Artificial
  CRISPR gRNA sequence
ctgaaccactagcatagttc

SEQ ID NO: 551278 - DNA, 20 bp, Artificial
  CRISPR gRNA sequence
tagcatagttctagggtcag

SEQ ID NO: 551279 - DNA, 20 bp, Artificial
  CRISPR gRNA sequence
ctatggagcacttgaaatgt

SEQ ID NO: 551280 - DNA, 20 bp, Artificial
  CRISPR gRNA sequence
agtccaaattatcatgtgct

SEQ ID NO: 551281 - DNA, 20 bp, Artificial
  CRISPR gRNA sequence
gtttctaagaccgtgtgtga

SEQ ID NO: 551282 - DNA, 20 bp, Artificial
  CRISPR gRNA sequence
ctcattaaaaaatgtttata

SEQ ID NO: 551283 - DNA, 20 bp, Artificial
  CRISPR gRNA sequence
atttttttttactttgtaat

SEQ ID NO: 551284 - DNA, 20 bp, Artificial
  CRISPR gRNA sequence
ccgatttgatttaaagcata

SEQ ID NO: 551285 - DNA, 20 bp, Artificial
  CRISPR gRNA sequence
tataggatagcaggaaatcc

SEQ ID NO: 551286 - DNA, 20 bp, Artificial
  CRISPR gRNA sequence
ctctcaatgagccttgcagg

SEQ ID NO: 551287 - DNA, 20 bp, Artificial
  CRISPR gRNA sequence
gttgctagtaagtgatgggc

SEQ ID NO: 551288 - DNA, 20 bp, Artificial
  CRISPR gRNA sequence
aatctaggtctttggactcc

SEQ ID NO: 551289 - DNA, 20 bp, Artificial
  CRISPR gRNA sequence
acctcccatcccagaaaaag

SEQ ID NO: 551290 - DNA, 20 bp, Artificial
  CRISPR gRNA sequence
atcccagaaaaagttggatc

SEQ ID NO: 551291 - DNA, 20 bp, Artificial
  CRISPR gRNA sequence
agaaaaagttggatcaggga

SEQ ID NO: 551292 - DNA, 20 bp, Artificial
  CRISPR gRNA sequence
atagggttcacttcaggagc

SEQ ID NO: 551293 - DNA, 20 bp, Artificial
  CRISPR gRNA sequence
gttggtttaataaaccgccg

SEQ ID NO: 551294 - DNA, 20 bp, Artificial
  CRISPR gRNA sequence
tcaggaggcagaggcatgag

SEQ ID NO: 551295 - DNA, 20 bp, Artificial
  CRISPR gRNA sequence
gaggcatgagctgggtgttg

SEQ ID NO: 551296 - DNA, 20 bp, Artificial
  CRISPR gRNA sequence
gggtgttgagggatgagggg

SEQ ID NO: 551297 - DNA, 20 bp, Artificial
  CRISPR gRNA sequence
ggcctcttggagcaccctac

SEQ ID NO: 551298 - DNA, 20 bp, Artificial
  CRISPR gRNA sequence
taaaccaacactgctgctaa

SEQ ID NO: 551299 - DNA, 20 bp, Artificial
  CRISPR gRNA sequence
taactcttggagtccaaaga

SEQ ID NO: 551300 - DNA, 20 bp, Artificial
  CRISPR gRNA sequence
caaccaacagatgagtacaa

SEQ ID NO: 551301 - DNA, 20 bp, Artificial
  CRISPR gRNA sequence
agtgtacttacttggttctg

SEQ ID NO: 551302 - DNA, 20 bp, Artificial
  CRISPR gRNA sequence
taagccagagccccatcacc

SEQ ID NO: 551303 - DNA, 20 bp, Artificial
  CRISPR gRNA sequence
ctgggatttcctgctatcct

SEQ ID NO: 551304 - DNA, 20 bp, Artificial
  CRISPR gRNA sequence
gaagatgcagggaaggctag

SEQ ID NO: 551305 - DNA, 20 bp, Artificial
  CRISPR gRNA sequence
tagaactatgctagtggttc

SEQ ID NO: 551306 - DNA, 20 bp, Artificial
  CRISPR gRNA sequence
gcttagtcaatagggttgac

SEQ ID NO: 551307 - DNA, 20 bp, Artificial
  CRISPR gRNA sequence
aactacaactaggcagctgg

SEQ ID NO: 551308 - DNA, 20 bp, Artificial
  CRISPR gRNA sequence
cattcaactctttcctcttc

SEQ ID NO: 551309 - DNA, 20 bp, Artificial
  CRISPR gRNA sequence
ttcccaattaatgactttaa

SEQ ID NO: 551310 - DNA, 20 bp, Artificial
  CRISPR gRNA sequence
ttaaggttgcttaaaggttg

SEQ ID NO: 551311 - DNA, 20 bp, Artificial
  CRISPR gRNA sequence
cttaaaggttgagatgcttg

SEQ ID NO: 551312 - DNA, 20 bp, Artificial
  CRISPR gRNA sequence
ttgagatgcttgctgagttt

SEQ ID NO: 551313 - DNA, 20 bp, Artificial
  CRISPR gRNA sequence
gatgcttgctgagttttttt

SEQ ID NO: 551314 - DNA, 20 bp, Artificial
  CRISPR gRNA sequence
cttgctgagtttttttgttt

SEQ ID NO: 551315 - DNA, 20 bp, Artificial
  CRISPR gRNA sequence
tttgtatttttttgtagaga

SEQ ID NO: 551316 - DNA, 20 bp, Artificial
  CRISPR gRNA sequence
caactcgacctctcaatgtg

SEQ ID NO: 551317 - DNA, 20 bp, Artificial
  CRISPR gRNA sequence
gccaccatgcctggcctcca

SEQ ID NO: 551318 - DNA, 20 bp, Artificial
  CRISPR gRNA sequence
tttttttaagaacaaatttt

SEQ ID NO: 551319 - DNA, 20 bp, Artificial
  CRISPR gRNA sequence
ttttttaagtgaaatcaacc

SEQ ID NO: 551320 - DNA, 20 bp, Artificial
  CRISPR gRNA sequence
ctacaacaacactgagtgga

SEQ ID NO: 551321 - DNA, 20 bp, Artificial
  CRISPR gRNA sequence
aacactgagtggaaaatgat

SEQ ID NO: 551322 - DNA, 20 bp, Artificial
  CRISPR gRNA sequence
tgggaaccaacctgttcagg

SEQ ID NO: 551323 - DNA, 20 bp, Artificial
  CRISPR gRNA sequence
ttaactattatactgctatt

SEQ ID NO: 551324 - DNA, 20 bp, Artificial
  CRISPR gRNA sequence
tactgctatttggggattaa

SEQ ID NO: 551325 - DNA, 20 bp, Artificial
  CRISPR gRNA sequence
tcttcagctgatcgttataa

SEQ ID NO: 551326 - DNA, 20 bp, Artificial
  CRISPR gRNA sequence
ctgataatctattacttagg

SEQ ID NO: 551327 - DNA, 20 bp, Artificial
  CRISPR gRNA sequence
caagaaaactttctgcaatg

SEQ ID NO: 551328 - DNA, 20 bp, Artificial
  CRISPR gRNA sequence
caggtctaaggaaactgaaa

SEQ ID NO: 551329 - DNA, 20 bp, Artificial
  CRISPR gRNA sequence
aactgaaatctagtttataa

SEQ ID NO: 551330 - DNA, 20 bp, Artificial
  CRISPR gRNA sequence
cctagatactatcacttgta

SEQ ID NO: 551331 - DNA, 20 bp, Artificial
  CRISPR gRNA sequence
tacagcctgctccctgtcct

SEQ ID NO: 551332 - DNA, 20 bp, Artificial
  CRISPR gRNA sequence
ccctgtcctttgggatttga

SEQ ID NO: 551333 - DNA, 20 bp, Artificial
  CRISPR gRNA sequence
tctccaagctgtatgactgc

SEQ ID NO: 551334 - DNA, 20 bp, Artificial
  CRISPR gRNA sequence
caaactctgacttggagacc

SEQ ID NO: 551335 - DNA, 20 bp, Artificial
  CRISPR gRNA sequence
ctgtaaagctctctgtggcc

SEQ ID NO: 551336 - DNA, 20 bp, Artificial
  CRISPR gRNA sequence
gtcccacacacgtaaagcaa

SEQ ID NO: 551337 - DNA, 20 bp, Artificial
  CRISPR gRNA sequence
cacacgtaaagcaaaaaagt

SEQ ID NO: 551338 - DNA, 20 bp, Artificial
  CRISPR gRNA sequence
tctgacctttggaaaacaat

SEQ ID NO: 551339 - DNA, 20 bp, Artificial
  CRISPR gRNA sequence
caatgcaagttttcaaacta

SEQ ID NO: 551340 - DNA, 20 bp, Artificial
  CRISPR gRNA sequence
caaaatggatcctcattatt

SEQ ID NO: 551341 - DNA, 20 bp, Artificial
  CRISPR gRNA sequence
attatttgcagattccacct

SEQ ID NO: 551342 - DNA, 20 bp, Artificial
  CRISPR gRNA sequence
tttgcagattccaccttgcg

SEQ ID NO: 551343 - DNA, 20 bp, Artificial
  CRISPR gRNA sequence
aaactttgagtcacccaata

SEQ ID NO: 551344 - DNA, 20 bp, Artificial
  CRISPR gRNA sequence
aaaaaggtaaagctctgcct

SEQ ID NO: 551345 - DNA, 20 bp, Artificial
  CRISPR gRNA sequence
tatttgcagtctatttagtg

SEQ ID NO: 551346 - DNA, 20 bp, Artificial
  CRISPR gRNA sequence
agtgccatgattttgcattt

SEQ ID NO: 551347 - DNA, 20 bp, Artificial
  CRISPR gRNA sequence
gcatttttgtgcttttttgt

SEQ ID NO: 551348 - DNA, 20 bp, Artificial
  CRISPR gRNA sequence
agagaaaataggtgtattag

SEQ ID NO: 551349 - DNA, 20 bp, Artificial
  CRISPR gRNA sequence
aataaatcaacactatatat

SEQ ID NO: 551350 - DNA, 20 bp, Artificial
  CRISPR gRNA sequence
ctgtagaactaatatgaata

SEQ ID NO: 551351 - DNA, 20 bp, Artificial
  CRISPR gRNA sequence
ttctaaacaaacttatatgc

SEQ ID NO: 551352 - DNA, 20 bp, Artificial
  CRISPR gRNA sequence
aagaagcaagtgttccacta

SEQ ID NO: 551353 - DNA, 20 bp, Artificial
  CRISPR gRNA sequence
agcaagtgttccactagaag

SEQ ID NO: 551354 - DNA, 20 bp, Artificial
  CRISPR gRNA sequence
agtggaagcagaacttggca

SEQ ID NO: 551355 - DNA, 20 bp, Artificial
  CRISPR gRNA sequence
cataaggcaaaaacaaccta

SEQ ID NO: 551356 - DNA, 20 bp, Artificial
  CRISPR gRNA sequence
aagttgttttcacagcagct

SEQ ID NO: 551357 - DNA, 20 bp, Artificial
  CRISPR gRNA sequence
agagtacacaatgcactgct

SEQ ID NO: 551358 - DNA, 20 bp, Artificial
  CRISPR gRNA sequence
aaataggcagtcacctattg

SEQ ID NO: 551359 - DNA, 20 bp, Artificial
  CRISPR gRNA sequence
tggcaataatactccccaag

SEQ ID NO: 551360 - DNA, 20 bp, Artificial
  CRISPR gRNA sequence
ttaggtggcatacgatgcct

SEQ ID NO: 551361 - DNA, 20 bp, Artificial
  CRISPR gRNA sequence
tctagagccataagttcatc

SEQ ID NO: 551362 - DNA, 20 bp, Artificial
  CRISPR gRNA sequence
agttcatcaagggtttgcaa

SEQ ID NO: 551363 - DNA, 20 bp, Artificial
  CRISPR gRNA sequence
atttatataggaaaagcagc

SEQ ID NO: 551364 - DNA, 20 bp, Artificial
  CRISPR gRNA sequence
atttgattcttctctttctt

SEQ ID NO: 551365 - DNA, 20 bp, Artificial
  CRISPR gRNA sequence
gcattctctagagatgacca

SEQ ID NO: 551366 - DNA, 20 bp, Artificial
  CRISPR gRNA sequence
gatgaccagtgagtttttaa

SEQ ID NO: 551367 - DNA, 20 bp, Artificial
  CRISPR gRNA sequence
gcatgaactgagcacaactg

SEQ ID NO: 551368 - DNA, 20 bp, Artificial
  CRISPR gRNA sequence
ccatcatgttaagtcttttt

SEQ ID NO: 551369 - DNA, 20 bp, Artificial
  CRISPR gRNA sequence
ctgtggtaaaataagatact

SEQ ID NO: 551370 - DNA, 20 bp, Artificial
  CRISPR gRNA sequence
gggtgaaggtggccaatcat

SEQ ID NO: 551371 - DNA, 20 bp, Artificial
  CRISPR gRNA sequence
tcctggttttcctgaaactg

SEQ ID NO: 551372 - DNA, 20 bp, Artificial
  CRISPR gRNA sequence
caaattgctacaggactggc

SEQ ID NO: 551373 - DNA, 20 bp, Artificial
  CRISPR gRNA sequence
tgctgaaccctattaagctg

SEQ ID NO: 551374 - DNA, 20 bp, Artificial
  CRISPR gRNA sequence
ctattaagctgccaagattc

SEQ ID NO: 551375 - DNA, 20 bp, Artificial
  CRISPR gRNA sequence
tttaaataaatccagggcta

SEQ ID NO: 551376 - DNA, 20 bp, Artificial
  CRISPR gRNA sequence
tgaaatatgcacccaaatta

SEQ ID NO: 551377 - DNA, 20 bp, Artificial
  CRISPR gRNA sequence
tatttggggttattccacaa

SEQ ID NO: 551378 - DNA, 20 bp, Artificial
  CRISPR gRNA sequence
gttattccacaaacttgatt

SEQ ID NO: 551379 - DNA, 20 bp, Artificial
  CRISPR gRNA sequence
cttgattcatggcttagtaa

SEQ ID NO: 551380 - DNA, 20 bp, Artificial
  CRISPR gRNA sequence
ggcttagtaagttagcttca

SEQ ID NO: 551381 - DNA, 20 bp, Artificial
  CRISPR gRNA sequence
ttcacttggctttaaatatt

SEQ ID NO: 551382 - DNA, 20 bp, Artificial
  CRISPR gRNA sequence
aaaactgagcagaagttaca

SEQ ID NO: 551383 - DNA, 20 bp, Artificial
  CRISPR gRNA sequence
agcattcagttgtacattct

SEQ ID NO: 551384 - DNA, 20 bp, Artificial
  CRISPR gRNA sequence
actaatctttttacagtctc

SEQ ID NO: 551385 - DNA, 20 bp, Artificial
  CRISPR gRNA sequence
tttgcatagcatgtagcctg

SEQ ID NO: 551386 - DNA, 20 bp, Artificial
  CRISPR gRNA sequence
atagcatgtagcctgttcag

SEQ ID NO: 551387 - DNA, 20 bp, Artificial
  CRISPR gRNA sequence
ctttgacttataatatgcat

SEQ ID NO: 551388 - DNA, 20 bp, Artificial
  CRISPR gRNA sequence
aagtttcctccatgtctttt

SEQ ID NO: 551389 - DNA, 20 bp, Artificial
  CRISPR gRNA sequence
attctattgtctgtatgtac

SEQ ID NO: 551390 - DNA, 20 bp, Artificial
  CRISPR gRNA sequence
cacttactgaaggacatctt

SEQ ID NO: 551391 - DNA, 20 bp, Artificial
  CRISPR gRNA sequence
gaaggacatcttggttgctt

SEQ ID NO: 551392 - DNA, 20 bp, Artificial
  CRISPR gRNA sequence
gatgctataaccatccatgt

SEQ ID NO: 551393 - DNA, 20 bp, Artificial
  CRISPR gRNA sequence
gtgaaggtttttatgtcaac

SEQ ID NO: 551394 - DNA, 20 bp, Artificial
  CRISPR gRNA sequence
tgttgaatggtaagagtaca

SEQ ID NO: 551395 - DNA, 20 bp, Artificial
  CRISPR gRNA sequence
gcatttggtgctgtcagtgt

SEQ ID NO: 551396 - DNA, 20 bp, Artificial
  CRISPR gRNA sequence
aagtggtatttcattgttgt

SEQ ID NO: 551397 - DNA, 20 bp, Artificial
  CRISPR gRNA sequence
aaaatagaaaatagtagaaa

SEQ ID NO: 551398 - DNA, 20 bp, Artificial
  CRISPR gRNA sequence
tgcctcggcctcccaaagtg

SEQ ID NO: 551399 - DNA, 20 bp, Artificial
  CRISPR gRNA sequence
tttgactcattttttaattg

SEQ ID NO: 551400 - DNA, 20 bp, Artificial
  CRISPR gRNA sequence
tcattttttaattgggttgt

SEQ ID NO: 551401 - DNA, 20 bp, Artificial
  CRISPR gRNA sequence
ggttgtttgtgtttttcttg

SEQ ID NO: 551402 - DNA, 20 bp, Artificial
  CRISPR gRNA sequence
tgtttttcttgttgagtttt

SEQ ID NO: 551403 - DNA, 20 bp, Artificial
  CRISPR gRNA sequence
gcaaatattttctcccagtc

SEQ ID NO: 551404 - DNA, 20 bp, Artificial
  CRISPR gRNA sequence
tattttctcccagtctgtgg

SEQ ID NO: 551405 - DNA, 20 bp, Artificial
  CRISPR gRNA sequence
tgaaattgtctttcatagag

SEQ ID NO: 551406 - DNA, 20 bp, Artificial
  CRISPR gRNA sequence
tgtttttaattttaatgaag

SEQ ID NO: 551407 - DNA, 20 bp, Artificial
  CRISPR gRNA sequence
gtcatcatatccaaagttat

SEQ ID NO: 551408 - DNA, 20 bp, Artificial
  CRISPR gRNA sequence
aaagttatctaggttttctc

SEQ ID NO: 551409 - DNA, 20 bp, Artificial
  CRISPR gRNA sequence
ctcttatgttttaggagtct

SEQ ID NO: 551410 - DNA, 20 bp, Artificial
  CRISPR gRNA sequence
ttttgtgaagggcataaggt

SEQ ID NO: 551411 - DNA, 20 bp, Artificial
  CRISPR gRNA sequence
tgaagggcataaggtctgtg

SEQ ID NO: 551412 - DNA, 20 bp, Artificial
  CRISPR gRNA sequence
gatcagttgaccatatttat

SEQ ID NO: 551413 - DNA, 20 bp, Artificial
  CRISPR gRNA sequence
gtttatttctgggctctcta

SEQ ID NO: 551414 - DNA, 20 bp, Artificial
  CRISPR gRNA sequence
taccacactatgttgactac

SEQ ID NO: 551415 - DNA, 20 bp, Artificial
  CRISPR gRNA sequence
cctgcccatttaaccttaaa

SEQ ID NO: 551416 - DNA, 20 bp, Artificial
  CRISPR gRNA sequence
tccacaaatgacttctgata

SEQ ID NO: 551417 - DNA, 20 bp, Artificial
  CRISPR gRNA sequence
aatgacttctgatattttgc

SEQ ID NO: 551418 - DNA, 20 bp, Artificial
  CRISPR gRNA sequence
tctccatttatttagttctt

SEQ ID NO: 551419 - DNA, 20 bp, Artificial
  CRISPR gRNA sequence
gttcttctttgattttgttc

SEQ ID NO: 551420 - DNA, 20 bp, Artificial
  CRISPR gRNA sequence
ttgattttgttcatcagttt

SEQ ID NO: 551421 - DNA, 20 bp, Artificial
  CRISPR gRNA sequence
gggtgctaaggtaaatggtg

SEQ ID NO: 551422 - DNA, 20 bp, Artificial
  CRISPR gRNA sequence
tgttcattgctgttatagaa

SEQ ID NO: 551423 - DNA, 20 bp, Artificial
  CRISPR gRNA sequence
tttgtatcctacaaatgtgc

SEQ ID NO: 551424 - DNA, 20 bp, Artificial
  CRISPR gRNA sequence
atagttttttattagttcca

SEQ ID NO: 551425 - DNA, 20 bp, Artificial
  CRISPR gRNA sequence
ttccaggaggtttttggtca

SEQ ID NO: 551426 - DNA, 20 bp, Artificial
  CRISPR gRNA sequence
ggaggtttttggtcaattcg

SEQ ID NO: 551427 - DNA, 20 bp, Artificial
  CRISPR gRNA sequence
tcttgtcttatggcattagt

SEQ ID NO: 551428 - DNA, 20 bp, Artificial
  CRISPR gRNA sequence
cttattcttggtcttagttg

SEQ ID NO: 551429 - DNA, 20 bp, Artificial
  CRISPR gRNA sequence
ttggtcttagttggaaagct

SEQ ID NO: 551430 - DNA, 20 bp, Artificial
  CRISPR gRNA sequence
attacagatgatgttagctg

SEQ ID NO: 551431 - DNA, 20 bp, Artificial
  CRISPR gRNA sequence
ggcatttgttaacaagttga

SEQ ID NO: 551432 - DNA, 20 bp, Artificial
  CRISPR gRNA sequence
gaaaaagtttcccctctatt

SEQ ID NO: 551433 - DNA, 20 bp, Artificial
  CRISPR gRNA sequence
ccctctattcctagtttact

SEQ ID NO: 551434 - DNA, 20 bp, Artificial
  CRISPR gRNA sequence
agtttttatcataaattgat

SEQ ID NO: 551435 - DNA, 20 bp, Artificial
  CRISPR gRNA sequence
aattgatgttggattttgtc

SEQ ID NO: 551436 - DNA, 20 bp, Artificial
  CRISPR gRNA sequence
ctgtatctattggtatgatc

SEQ ID NO: 551437 - DNA, 20 bp, Artificial
  CRISPR gRNA sequence
ctttcatagtctgtcaatgt

SEQ ID NO: 551438 - DNA, 20 bp, Artificial
  CRISPR gRNA sequence
tcaatgtgatggattacatt

SEQ ID NO: 551439 - DNA, 20 bp, Artificial
  CRISPR gRNA sequence
ttggatccaatttgctaata

SEQ ID NO: 551440 - DNA, 20 bp, Artificial
  CRISPR gRNA sequence
caatttgctaatattttgtt

SEQ ID NO: 551441 - DNA, 20 bp, Artificial
  CRISPR gRNA sequence
tttcttttcttgtattgttc

SEQ ID NO: 551442 - DNA, 20 bp, Artificial
  CRISPR gRNA sequence
aatgaattggaaagtatgcc

SEQ ID NO: 551443 - DNA, 20 bp, Artificial
  CRISPR gRNA sequence
cctctgcttctatcttctaa

SEQ ID NO: 551444 - DNA, 20 bp, Artificial
  CRISPR gRNA sequence
ccaatgaacccatctgaacc

SEQ ID NO: 551445 - DNA, 20 bp, Artificial
  CRISPR gRNA sequence
acccatctgaacctggtgct

SEQ ID NO: 551446 - DNA, 20 bp, Artificial
  CRISPR gRNA sequence
aacctggtgctttctgtttt

SEQ ID NO: 551447 - DNA, 20 bp, Artificial
  CRISPR gRNA sequence
tggaagattattaattactg

SEQ ID NO: 551448 - DNA, 20 bp, Artificial
  CRISPR gRNA sequence
cgtcttggcctcacaaagtg

SEQ ID NO: 551449 - DNA, 20 bp, Artificial
  CRISPR gRNA sequence
cagtccaaaaatcctcctac

SEQ ID NO: 551450 - DNA, 20 bp, Artificial
  CRISPR gRNA sequence
tttcctatttccgcatattt

SEQ ID NO: 551451 - DNA, 20 bp, Artificial
  CRISPR gRNA sequence
ttcttaggagtaagatcaaa

SEQ ID NO: 551452 - DNA, 20 bp, Artificial
  CRISPR gRNA sequence
tcatctagttgaactcagaa

SEQ ID NO: 551453 - DNA, 20 bp, Artificial
  CRISPR gRNA sequence
aacttcaggtcggaactgaa

SEQ ID NO: 551454 - DNA, 20 bp, Artificial
  CRISPR gRNA sequence
aaagagaatggtgaagtgca

SEQ ID NO: 551455 - DNA, 20 bp, Artificial
  CRISPR gRNA sequence
gcctttgactctcaaaggta

SEQ ID NO: 551456 - DNA, 20 bp, Artificial
  CRISPR gRNA sequence
ctgtatcctgaataacaact

SEQ ID NO: 551457 - DNA, 20 bp, Artificial
  CRISPR gRNA sequence
aatgaaatcaggtctaggac

SEQ ID NO: 551458 - DNA, 20 bp, Artificial
  CRISPR gRNA sequence
atattcacgtgctgccataa

SEQ ID NO: 551459 - DNA, 20 bp, Artificial
  CRISPR gRNA sequence
aaggcaagaaataattgctc

SEQ ID NO: 551460 - DNA, 20 bp, Artificial
  CRISPR gRNA sequence
aatggaagtaaattccaaat

SEQ ID NO: 551461 - DNA, 20 bp, Artificial
  CRISPR gRNA sequence
ccagtacagtggggaagaca

SEQ ID NO: 551462 - DNA, 20 bp, Artificial
  CRISPR gRNA sequence
gatggagttggatgtcaaat

SEQ ID NO: 551463 - DNA, 20 bp, Artificial
  CRISPR gRNA sequence
gttatttaacctcactgtgc

SEQ ID NO: 551464 - DNA, 20 bp, Artificial
  CRISPR gRNA sequence
cccacaccactgggttgttg

SEQ ID NO: 551465 - DNA, 20 bp, Artificial
  CRISPR gRNA sequence
catttatgtaaatcatttac

SEQ ID NO: 551466 - DNA, 20 bp, Artificial
  CRISPR gRNA sequence
aactgtctctaaaattctcc

SEQ ID NO: 551467 - DNA, 20 bp, Artificial
  CRISPR gRNA sequence
ctctaaaattctcctttaga

SEQ ID NO: 551468 - DNA, 20 bp, Artificial
  CRISPR gRNA sequence
actatgtatatctatatagt

SEQ ID NO: 551469 - DNA, 20 bp, Artificial
  CRISPR gRNA sequence
aaatcaaagaaaactttaaa

SEQ ID NO: 551470 - DNA, 20 bp, Artificial
  CRISPR gRNA sequence
ttttgtatttttagtacaga

SEQ ID NO: 551471 - DNA, 20 bp, Artificial
  CRISPR gRNA sequence
cgcctcagcctcccaaagtg

SEQ ID NO: 551472 - DNA, 20 bp, Artificial
  CRISPR gRNA sequence
gcaaatgaggcatttatttg

SEQ ID NO: 551473 - DNA, 20 bp, Artificial
  CRISPR gRNA sequence
gagcaggctagtcaatgtga

SEQ ID NO: 551474 - DNA, 20 bp, Artificial
  CRISPR gRNA sequence
aggctagtcaatgtgagtta

SEQ ID NO: 551475 - DNA, 20 bp, Artificial
  CRISPR gRNA sequence
gcttcactgataaagcattg

SEQ ID NO: 551476 - DNA, 20 bp, Artificial
  CRISPR gRNA sequence
gtatttaactgttatacttt

SEQ ID NO: 551477 - DNA, 20 bp, Artificial
  CRISPR gRNA sequence
taagatcattaagttcagct

SEQ ID NO: 551478 - DNA, 20 bp, Artificial
  CRISPR gRNA sequence
tctcagatgtcaacactact

SEQ ID NO: 551479 - DNA, 20 bp, Artificial
  CRISPR gRNA sequence
ggcaaacataaagttaaaca

SEQ ID NO: 551480 - DNA, 20 bp, Artificial
  CRISPR gRNA sequence
cttggaacacttaaaacttt

SEQ ID NO: 551481 - DNA, 20 bp, Artificial
  CRISPR gRNA sequence
taaaacttttcaagatttca

SEQ ID NO: 551482 - DNA, 20 bp, Artificial
  CRISPR gRNA sequence
ataccaaaaggcaaaagcac

SEQ ID NO: 551483 - DNA, 20 bp, Artificial
  CRISPR gRNA sequence
gttcccattataaagcaact

SEQ ID NO: 551484 - DNA, 20 bp, Artificial
  CRISPR gRNA sequence
aaaaggtggaattaataaag

SEQ ID NO: 551485 - DNA, 20 bp, Artificial
  CRISPR gRNA sequence
ttaataaaggaatgtttgct

SEQ ID NO: 551486 - DNA, 20 bp, Artificial
  CRISPR gRNA sequence
ttaactattttaactttgca

SEQ ID NO: 551487 - DNA, 20 bp, Artificial
  CRISPR gRNA sequence
ctcctttgagtgacacctct

SEQ ID NO: 551488 - DNA, 20 bp, Artificial
  CRISPR gRNA sequence
gcactttttcttttttttct

SEQ ID NO: 551489 - DNA, 20 bp, Artificial
  CRISPR gRNA sequence
tcagccctggtggcaggaag

SEQ ID NO: 551490 - DNA, 20 bp, Artificial
  CRISPR gRNA sequence
tactctacacggcccttctg

SEQ ID NO: 551491 - DNA, 20 bp, Artificial
  CRISPR gRNA sequence
gtgatgcaggctgcacactc

SEQ ID NO: 551492 - DNA, 20 bp, Artificial
  CRISPR gRNA sequence
taagcagctgaaaacagcga

SEQ ID NO: 551493 - DNA, 20 bp, Artificial
  CRISPR gRNA sequence
agtgaaaatcatgcacttga

SEQ ID NO: 551494 - DNA, 20 bp, Artificial
  CRISPR gRNA sequence
agatggagtaagcgctgtcg

SEQ ID NO: 551495 - DNA, 20 bp, Artificial
  CRISPR gRNA sequence
cgcccacctccacttcctac

SEQ ID NO: 551496 - DNA, 20 bp, Artificial
  CRISPR gRNA sequence
ccggctggctgggttccttg

SEQ ID NO: 551497 - DNA, 20 bp, Artificial
  CRISPR gRNA sequence
acgaattcagaatctttatc

SEQ ID NO: 551498 - DNA, 20 bp, Artificial
  CRISPR gRNA sequence
tccagtgattctccgtcccc

SEQ ID NO: 551499 - DNA, 20 bp, Artificial
  CRISPR gRNA sequence
ctccgtccccagatgctttc

SEQ ID NO: 551500 - DNA, 20 bp, Artificial
  CRISPR gRNA sequence
tgaaaaatgactcattggat

SEQ ID NO: 551501 - DNA, 20 bp, Artificial
  CRISPR gRNA sequence
ttctaacagtgcctggaccc

SEQ ID NO: 551502 - DNA, 20 bp, Artificial
  CRISPR gRNA sequence
cagtgcctggacccttacgc

SEQ ID NO: 551503 - DNA, 20 bp, Artificial
  CRISPR gRNA sequence
ttacgcttctgctttttctt

SEQ ID NO: 551504 - DNA, 20 bp, Artificial
  CRISPR gRNA sequence
aagggatcagccttatctgg

SEQ ID NO: 551505 - DNA, 20 bp, Artificial
  CRISPR gRNA sequence
tctggttctgatttcatctt

SEQ ID NO: 551506 - DNA, 20 bp, Artificial
  CRISPR gRNA sequence
tttaatatcctgcaggtatt

SEQ ID NO: 551507 - DNA, 20 bp, Artificial
  CRISPR gRNA sequence
accagaactctggaattcct

SEQ ID NO: 551508 - DNA, 20 bp, Artificial
  CRISPR gRNA sequence
tttggctcttcagctgttgc

SEQ ID NO: 551509 - DNA, 20 bp, Artificial
  CRISPR gRNA sequence
tcttcattttcacggtgcca

SEQ ID NO: 551510 - DNA, 20 bp, Artificial
  CRISPR gRNA sequence
tcatgaacttcttcatagaa

SEQ ID NO: 551511 - DNA, 20 bp, Artificial
  CRISPR gRNA sequence
tatgagcgcatctcacctga

SEQ ID NO: 551512 - DNA, 20 bp, Artificial
  CRISPR gRNA sequence
aatgcattaattcttctttt

SEQ ID NO: 551513 - DNA, 20 bp, Artificial
  CRISPR gRNA sequence
cttctttttactgctttagg

SEQ ID NO: 551514 - DNA, 20 bp, Artificial
  CRISPR gRNA sequence
cctgtaaagctgccaaaact

SEQ ID NO: 551515 - DNA, 20 bp, Artificial
  CRISPR gRNA sequence
gattctgcatcacctgatcc

SEQ ID NO: 551516 - DNA, 20 bp, Artificial
  CRISPR gRNA sequence
tccgtcttacttgcattttt

SEQ ID NO: 551517 - DNA, 20 bp, Artificial
  CRISPR gRNA sequence
aaaactgttatctgccatct

SEQ ID NO: 551518 - DNA, 20 bp, Artificial
  CRISPR gRNA sequence
gcggggctggctgggctagc

SEQ ID NO: 551519 - DNA, 20 bp, Artificial
  CRISPR gRNA sequence
ctttcctttcccaaaagtga

SEQ ID NO: 551520 - DNA, 20 bp, Artificial
  CRISPR gRNA sequence
tctgaaaataatataacttt

SEQ ID NO: 551521 - DNA, 20 bp, Artificial
  CRISPR gRNA sequence
taactttaatggctttaagt

SEQ ID NO: 551522 - DNA, 20 bp, Artificial
  CRISPR gRNA sequence
aatggctcaccagttaaaat

SEQ ID NO: 551523 - DNA, 20 bp, Artificial
  CRISPR gRNA sequence
tgtatttgctaatttccctt

SEQ ID NO: 551524 - DNA, 20 bp, Artificial
  CRISPR gRNA sequence
taatttcccttatctgtttc

SEQ ID NO: 551525 - DNA, 20 bp, Artificial
  CRISPR gRNA sequence
cactttcaagtcactgacct

SEQ ID NO: 551526 - DNA, 20 bp, Artificial
  CRISPR gRNA sequence
cattagaaaatcatagccaa

SEQ ID NO: 551527 - DNA, 20 bp, Artificial
  CRISPR gRNA sequence
acaacttaaactctctctct

SEQ ID NO: 551528 - DNA, 20 bp, Artificial
  CRISPR gRNA sequence
tacacaacttataggttgta

SEQ ID NO: 551529 - DNA, 20 bp, Artificial
  CRISPR gRNA sequence
aggttgtatgaggattgatg

SEQ ID NO: 551530 - DNA, 20 bp, Artificial
  CRISPR gRNA sequence
cacagaaagtgctaaataat

SEQ ID NO: 551531 - DNA, 20 bp, Artificial
  CRISPR gRNA sequence
tgttagctttgtatctataa

SEQ ID NO: 551532 - DNA, 20 bp, Artificial
  CRISPR gRNA sequence
aatggcgtgaacccaggagg

SEQ ID NO: 551533 - DNA, 20 bp, Artificial
  CRISPR gRNA sequence
aaaaaaaaaaaaaaattgta

SEQ ID NO: 551534 - DNA, 20 bp, Artificial
  CRISPR gRNA sequence
acatttagttatttactcac

SEQ ID NO: 551535 - DNA, 20 bp, Artificial
  CRISPR gRNA sequence
gcttgggatacaggttgtca

SEQ ID NO: 551536 - DNA, 20 bp, Artificial
  CRISPR gRNA sequence
ttgatgatgttgtattaaat

SEQ ID NO: 551537 - DNA, 20 bp, Artificial
  CRISPR gRNA sequence
taaaatatatactggttgag

SEQ ID NO: 551538 - DNA, 20 bp, Artificial
  CRISPR gRNA sequence
tggtatcatgcattggactt

SEQ ID NO: 551539 - DNA, 20 bp, Artificial
  CRISPR gRNA sequence
gaagagctcgcaacctcctt

SEQ ID NO: 551540 - DNA, 20 bp, Artificial
  CRISPR gRNA sequence
agaataaattcagaccctga

SEQ ID NO: 551541 - DNA, 20 bp, Artificial
  CRISPR gRNA sequence
cgagagagggacctggtggg

SEQ ID NO: 551542 - DNA, 20 bp, Artificial
  CRISPR gRNA sequence
gaggtgattgtaccatgggg

SEQ ID NO: 551543 - DNA, 20 bp, Artificial
  CRISPR gRNA sequence
agtgagttctcatgacatct

SEQ ID NO: 551544 - DNA, 20 bp, Artificial
  CRISPR gRNA sequence
ctcctgctgccttgtgaaaa

SEQ ID NO: 551545 - DNA, 20 bp, Artificial
  CRISPR gRNA sequence
tgctgccttgtgaaaaaagt

SEQ ID NO: 551546 - DNA, 20 bp, Artificial
  CRISPR gRNA sequence
tgcttctccttcgccttctg

SEQ ID NO: 551547 - DNA, 20 bp, Artificial
  CRISPR gRNA sequence
cttcgccttctgccatgatt

SEQ ID NO: 551548 - DNA, 20 bp, Artificial
  CRISPR gRNA sequence
cctcttttctttataaatta

SEQ ID NO: 551549 - DNA, 20 bp, Artificial
  CRISPR gRNA sequence
tcttcgcaagttggtagcaa

SEQ ID NO: 551550 - DNA, 20 bp, Artificial
  CRISPR gRNA sequence
tgacctgacctgaattaaca

SEQ ID NO: 551551 - DNA, 20 bp, Artificial
  CRISPR gRNA sequence
cactcacttcaaatattcat

SEQ ID NO: 551552 - DNA, 20 bp, Artificial
  CRISPR gRNA sequence
gtttcaccacaaaaatattc

SEQ ID NO: 551553 - DNA, 20 bp, Artificial
  CRISPR gRNA sequence
ttgggaggctgaggcaggag

SEQ ID NO: 551554 - DNA, 20 bp, Artificial
  CRISPR gRNA sequence
agcaagaccctgtctttata

SEQ ID NO: 551555 - DNA, 20 bp, Artificial
  CRISPR gRNA sequence
ccctgtctttataaaaagtt

SEQ ID NO: 551556 - DNA, 20 bp, Artificial
  CRISPR gRNA sequence
ctgtagtctcagctacttgc

SEQ ID NO: 551557 - DNA, 20 bp, Artificial
  CRISPR gRNA sequence
agctcactacacacagtggg

SEQ ID NO: 551558 - DNA, 20 bp, Artificial
  CRISPR gRNA sequence
aatgaagtaaatacttgttc

SEQ ID NO: 551559 - DNA, 20 bp, Artificial
  CRISPR gRNA sequence
gtgctccccataattaagtg

SEQ ID NO: 551560 - DNA, 20 bp, Artificial
  CRISPR gRNA sequence
tactatgttgtcatttaaaa

SEQ ID NO: 551561 - DNA, 20 bp, Artificial
  CRISPR gRNA sequence
tgatgttttctaagacaagt

SEQ ID NO: 551562 - DNA, 20 bp, Artificial
  CRISPR gRNA sequence
cactgacttccctttctact

SEQ ID NO: 551563 - DNA, 20 bp, Artificial
  CRISPR gRNA sequence
tccctttctacttggggctt

SEQ ID NO: 551564 - DNA, 20 bp, Artificial
  CRISPR gRNA sequence
tacttggggcttcctagttt

SEQ ID NO: 551565 - DNA, 20 bp, Artificial
  CRISPR gRNA sequence
acaagtccttacatacttcc

SEQ ID NO: 551566 - DNA, 20 bp, Artificial
  CRISPR gRNA sequence
catttctcaggggcagaaaa

SEQ ID NO: 551567 - DNA, 20 bp, Artificial
  CRISPR gRNA sequence
aggtgcctaagaatcaccaa

SEQ ID NO: 551568 - DNA, 20 bp, Artificial
  CRISPR gRNA sequence
ccaagggtgcttgttaaaaa

SEQ ID NO: 551569 - DNA, 20 bp, Artificial
  CRISPR gRNA sequence
ttcctgagccccaccatccc

SEQ ID NO: 551570 - DNA, 20 bp, Artificial
  CRISPR gRNA sequence
aggtgcttctgatgtatgtg

SEQ ID NO: 551571 - DNA, 20 bp, Artificial
  CRISPR gRNA sequence
atgtggcctgtttgttctgt

SEQ ID NO: 551572 - DNA, 20 bp, Artificial
  CRISPR gRNA sequence
gggagacagatggatagaag

SEQ ID NO: 551573 - DNA, 20 bp, Artificial
  CRISPR gRNA sequence
atctccaaagaggtacagta

SEQ ID NO: 551574 - DNA, 20 bp, Artificial
  CRISPR gRNA sequence
ccagctgcctgagtgcatat

SEQ ID NO: 551575 - DNA, 20 bp, Artificial
  CRISPR gRNA sequence
ttacttaaatcaccttgtgt

SEQ ID NO: 551576 - DNA, 20 bp, Artificial
  CRISPR gRNA sequence
acttactctatcagactgta

SEQ ID NO: 551577 - DNA, 20 bp, Artificial
  CRISPR gRNA sequence
agagcacacggccattggct

SEQ ID NO: 551578 - DNA, 20 bp, Artificial
  CRISPR gRNA sequence
gagtcactgagtaggagttg

SEQ ID NO: 551579 - DNA, 20 bp, Artificial
  CRISPR gRNA sequence
acagtccttttaggagctgg

SEQ ID NO: 551580 - DNA, 20 bp, Artificial
  CRISPR gRNA sequence
atatgactgagtgccacatg

SEQ ID NO: 551581 - DNA, 20 bp, Artificial
  CRISPR gRNA sequence
cctttctgcagcacctagat

SEQ ID NO: 551582 - DNA, 20 bp, Artificial
  CRISPR gRNA sequence
ctattaggtctggtgtctct

SEQ ID NO: 551583 - DNA, 20 bp, Artificial
  CRISPR gRNA sequence
cctctatctacctggatgat

SEQ ID NO: 551584 - DNA, 20 bp, Artificial
  CRISPR gRNA sequence
cccctgtactttactcctct

SEQ ID NO: 551585 - DNA, 20 bp, Artificial
  CRISPR gRNA sequence
cctaggatggtcttgaacta

SEQ ID NO: 551586 - DNA, 20 bp, Artificial
  CRISPR gRNA sequence
ctcctcagcctcacaaagtg

SEQ ID NO: 551587 - DNA, 20 bp, Artificial
  CRISPR gRNA sequence
aattattttaaaacagttca

SEQ ID NO: 551588 - DNA, 20 bp, Artificial
  CRISPR gRNA sequence
ttaagaggagaaatttattc

SEQ ID NO: 551589 - DNA, 20 bp, Artificial
  CRISPR gRNA sequence
aatttattcaaatgttttga

SEQ ID NO: 551590 - DNA, 20 bp, Artificial
  CRISPR gRNA sequence
tctaaattctgactcaatcc

SEQ ID NO: 551591 - DNA, 20 bp, Artificial
  CRISPR gRNA sequence
aattatcagatccccaatgt

SEQ ID NO: 551592 - DNA, 20 bp, Artificial
  CRISPR gRNA sequence
gatccccaatgtccatgttt

SEQ ID NO: 551593 - DNA, 20 bp, Artificial
  CRISPR gRNA sequence
agacctcacatagccttgca

SEQ ID NO: 551594 - DNA, 20 bp, Artificial
  CRISPR gRNA sequence
ttgcaagtcgctttacacat

SEQ ID NO: 551595 - DNA, 20 bp, Artificial
  CRISPR gRNA sequence
gatgagtgacatgatctgac

SEQ ID NO: 551596 - DNA, 20 bp, Artificial
  CRISPR gRNA sequence
agaggtatcaaggatgacat

SEQ ID NO: 551597 - DNA, 20 bp, Artificial
  CRISPR gRNA sequence
gctgccattaaccaaaaggg

SEQ ID NO: 551598 - DNA, 20 bp, Artificial
  CRISPR gRNA sequence
aaaagatttggggaggagca

SEQ ID NO: 551599 - DNA, 20 bp, Artificial
  CRISPR gRNA sequence
caggttttaaggggaagata

SEQ ID NO: 551600 - DNA, 20 bp, Artificial
  CRISPR gRNA sequence
gacagaaaaggaaagagacc

SEQ ID NO: 551601 - DNA, 20 bp, Artificial
  CRISPR gRNA sequence
gagacctaaggcttaagcct

SEQ ID NO: 551602 - DNA, 20 bp, Artificial
  CRISPR gRNA sequence
actgttcaggaggctgaggc

SEQ ID NO: 551603 - DNA, 20 bp, Artificial
  CRISPR gRNA sequence
acatggactgagaatgaacc

SEQ ID NO: 551604 - DNA, 20 bp, Artificial
  CRISPR gRNA sequence
ttattaacaaggaggtctag

SEQ ID NO: 551605 - DNA, 20 bp, Artificial
  CRISPR gRNA sequence
gaatatggacaacttcttca

SEQ ID NO: 551606 - DNA, 20 bp, Artificial
  CRISPR gRNA sequence
gaggggtacagggatcatga

SEQ ID NO: 551607 - DNA, 20 bp, Artificial
  CRISPR gRNA sequence
tgggatccagggcacacgtg

SEQ ID NO: 551608 - DNA, 20 bp, Artificial
  CRISPR gRNA sequence
taggaaggtaggcaggtggt

SEQ ID NO: 551609 - DNA, 20 bp, Artificial
  CRISPR gRNA sequence
gagagcttgtggaaattgcc

SEQ ID NO: 551610 - DNA, 20 bp, Artificial
  CRISPR gRNA sequence
gcttgtggaaattgccctct

SEQ ID NO: 551611 - DNA, 20 bp, Artificial
  CRISPR gRNA sequence
cagtctagagaaggaggtat

SEQ ID NO: 551612 - DNA, 20 bp, Artificial
  CRISPR gRNA sequence
aataccaacttaattgaggt

SEQ ID NO: 551613 - DNA, 20 bp, Artificial
  CRISPR gRNA sequence
atacaagactgcaacacaaa

SEQ ID NO: 551614 - DNA, 20 bp, Artificial
  CRISPR gRNA sequence
ggagaaatgtgtcccctctc

SEQ ID NO: 551615 - DNA, 20 bp, Artificial
  CRISPR gRNA sequence
atgtgtcccctctctctagt

SEQ ID NO: 551616 - DNA, 20 bp, Artificial
  CRISPR gRNA sequence
cgggtggatcacctgagctc

SEQ ID NO: 551617 - DNA, 20 bp, Artificial
  CRISPR gRNA sequence
gaggcagaggttgcagtcag

SEQ ID NO: 551618 - DNA, 20 bp, Artificial
  CRISPR gRNA sequence
atactgttctccccaccttg

SEQ ID NO: 551619 - DNA, 20 bp, Artificial
  CRISPR gRNA sequence
ttcatggtatcagtaatatt

SEQ ID NO: 551620 - DNA, 20 bp, Artificial
  CRISPR gRNA sequence
ccagttctgcaactttatcc

SEQ ID NO: 551621 - DNA, 20 bp, Artificial
  CRISPR gRNA sequence
taggacctcttttaaaggca

SEQ ID NO: 551622 - DNA, 20 bp, Artificial
  CRISPR gRNA sequence
acaaaatacaggaagtaaga

SEQ ID NO: 551623 - DNA, 20 bp, Artificial
  CRISPR gRNA sequence
taagaacatgtttgaccatg

SEQ ID NO: 551624 - DNA, 20 bp, Artificial
  CRISPR gRNA sequence
ctgaatggagaaagagcatg

SEQ ID NO: 551625 - DNA, 20 bp, Artificial
  CRISPR gRNA sequence
tggtgtgcttgaggatacac

SEQ ID NO: 551626 - DNA, 20 bp, Artificial
  CRISPR gRNA sequence
gtgctaaagtaaggaacgct

SEQ ID NO: 551627 - DNA, 20 bp, Artificial
  CRISPR gRNA sequence
taatggagaggaagccacag

SEQ ID NO: 551628 - DNA, 20 bp, Artificial
  CRISPR gRNA sequence
ggacaggacagaccagagca

SEQ ID NO: 551629 - DNA, 20 bp, Artificial
  CRISPR gRNA sequence
gatgctggagagagaagtca

SEQ ID NO: 551630 - DNA, 20 bp, Artificial
  CRISPR gRNA sequence
gaagcaagtcgagggtgtga

SEQ ID NO: 551631 - DNA, 20 bp, Artificial
  CRISPR gRNA sequence
tgtgatgaagattaagaact

SEQ ID NO: 551632 - DNA, 20 bp, Artificial
  CRISPR gRNA sequence
gtaacagcacagaaactgac

SEQ ID NO: 551633 - DNA, 20 bp, Artificial
  CRISPR gRNA sequence
gttaaacatttattagaacc

SEQ ID NO: 551634 - DNA, 20 bp, Artificial
  CRISPR gRNA sequence
gatatttttgataccccaaa

SEQ ID NO: 551635 - DNA, 20 bp, Artificial
  CRISPR gRNA sequence
cattttgggaggccaaggtg

SEQ ID NO: 551636 - DNA, 20 bp, Artificial
  CRISPR gRNA sequence
ttgggaggccaaggtggttg

SEQ ID NO: 551637 - DNA, 20 bp, Artificial
  CRISPR gRNA sequence
ccagctacttgggaggctga

SEQ ID NO: 551638 - DNA, 20 bp, Artificial
  CRISPR gRNA sequence
gattacttgaagccatgagg

SEQ ID NO: 551639 - DNA, 20 bp, Artificial
  CRISPR gRNA sequence
gaggcagagattgcagtcag

SEQ ID NO: 551640 - DNA, 20 bp, Artificial
  CRISPR gRNA sequence
aagagcaattaaaatttgac

SEQ ID NO: 551641 - DNA, 20 bp, Artificial
  CRISPR gRNA sequence
ataagaagcaaatatcaccc

SEQ ID NO: 551642 - DNA, 20 bp, Artificial
  CRISPR gRNA sequence
aaaacacaccagcatctttc

SEQ ID NO: 551643 - DNA, 20 bp, Artificial
  CRISPR gRNA sequence
ccagcatctttccattgctt

SEQ ID NO: 551644 - DNA, 20 bp, Artificial
  CRISPR gRNA sequence
ccagggagagctgatgtatc

SEQ ID NO: 551645 - DNA, 20 bp, Artificial
  CRISPR gRNA sequence
acagttgacccttgaacaac

SEQ ID NO: 551646 - DNA, 20 bp, Artificial
  CRISPR gRNA sequence
gctgtgtgggtccacttaca

SEQ ID NO: 551647 - DNA, 20 bp, Artificial
  CRISPR gRNA sequence
ccaacccctcctcccactta

SEQ ID NO: 551648 - DNA, 20 bp, Artificial
  CRISPR gRNA sequence
tagtaagtatattttcttcc

SEQ ID NO: 551649 - DNA, 20 bp, Artificial
  CRISPR gRNA sequence
ttttttattactattatctc

SEQ ID NO: 551650 - DNA, 20 bp, Artificial
  CRISPR gRNA sequence
aatagttttgggggaacagg

SEQ ID NO: 551651 - DNA, 20 bp, Artificial
  CRISPR gRNA sequence
ggtgatgtttggttacatgg

SEQ ID NO: 551652 - DNA, 20 bp, Artificial
  CRISPR gRNA sequence
ttttttttttagttatttgg

SEQ ID NO: 551653 - DNA, 20 bp, Artificial
  CRISPR gRNA sequence
tagttatttgggtgtgattt

SEQ ID NO: 551654 - DNA, 20 bp, Artificial
  CRISPR gRNA sequence
agttcactgtatcattctta

SEQ ID NO: 551655 - DNA, 20 bp, Artificial
  CRISPR gRNA sequence
tcccacttgtaagttagaac

SEQ ID NO: 551656 - DNA, 20 bp, Artificial
  CRISPR gRNA sequence
cttgtaagttagaacatatg

SEQ ID NO: 551657 - DNA, 20 bp, Artificial
  CRISPR gRNA sequence
ttttgtatttttagtaaaga

SEQ ID NO: 551658 - DNA, 20 bp, Artificial
  CRISPR gRNA sequence
cgccttggcctcccaaagtg

SEQ ID NO: 551659 - DNA, 20 bp, Artificial
  CRISPR gRNA sequence
ccacattttctttatccact

SEQ ID NO: 551660 - DNA, 20 bp, Artificial
  CRISPR gRNA sequence
cattgattgatgggcattta

SEQ ID NO: 551661 - DNA, 20 bp, Artificial
  CRISPR gRNA sequence
gttgtctttttcataaaatg

SEQ ID NO: 551662 - DNA, 20 bp, Artificial
  CRISPR gRNA sequence
ctctgggtagatacccagta

SEQ ID NO: 551663 - DNA, 20 bp, Artificial
  CRISPR gRNA sequence
caaatggtagttctactttt

SEQ ID NO: 551664 - DNA, 20 bp, Artificial
  CRISPR gRNA sequence
gaaatctccatagtggttgt

SEQ ID NO: 551665 - DNA, 20 bp, Artificial
  CRISPR gRNA sequence
ccatgccaacatctattatt

SEQ ID NO: 551666 - DNA, 20 bp, Artificial
  CRISPR gRNA sequence
ggagtaaggtggtattgcat

SEQ ID NO: 551667 - DNA, 20 bp, Artificial
  CRISPR gRNA sequence
gtaatgttgagcattttttc

SEQ ID NO: 551668 - DNA, 20 bp, Artificial
  CRISPR gRNA sequence
tgtccttggcccactttttg

SEQ ID NO: 551669 - DNA, 20 bp, Artificial
  CRISPR gRNA sequence
cttggcccactttttgatgg

SEQ ID NO: 551670 - DNA, 20 bp, Artificial
  CRISPR gRNA sequence
gcccactttttgatgggatt

SEQ ID NO: 551671 - DNA, 20 bp, Artificial
  CRISPR gRNA sequence
gggattgtttgcttttttct

SEQ ID NO: 551672 - DNA, 20 bp, Artificial
  CRISPR gRNA sequence
tgtttgcttttttcttgctg

SEQ ID NO: 551673 - DNA, 20 bp, Artificial
  CRISPR gRNA sequence
gctgatttgtttgacttcct

SEQ ID NO: 551674 - DNA, 20 bp, Artificial
  CRISPR gRNA sequence
tattggtcctttgtcagata

SEQ ID NO: 551675 - DNA, 20 bp, Artificial
  CRISPR gRNA sequence
tttctcccactttgtgggtt

SEQ ID NO: 551676 - DNA, 20 bp, Artificial
  CRISPR gRNA sequence
tgtgggttgtgtgtttactc

SEQ ID NO: 551677 - DNA, 20 bp, Artificial
  CRISPR gRNA sequence
ggttgtgtgtttactctgct

SEQ ID NO: 551678 - DNA, 20 bp, Artificial
  CRISPR gRNA sequence
gattgtttatattgctgtac

SEQ ID NO: 551679 - DNA, 20 bp, Artificial
  CRISPR gRNA sequence
tttaagccccatctatttat

SEQ ID NO: 551680 - DNA, 20 bp, Artificial
  CRISPR gRNA sequence
tttatctttgtttttgttgc

SEQ ID NO: 551681 - DNA, 20 bp, Artificial
  CRISPR gRNA sequence
ttgcctaagccaaagtctag

SEQ ID NO: 551682 - DNA, 20 bp, Artificial
  CRISPR gRNA sequence
atgttatcttctagaatttt

SEQ ID NO: 551683 - DNA, 20 bp, Artificial
  CRISPR gRNA sequence
gaatttttatggcttcaggt

SEQ ID NO: 551684 - DNA, 20 bp, Artificial
  CRISPR gRNA sequence
tatggcttcaggtcttagat

SEQ ID NO: 551685 - DNA, 20 bp, Artificial
  CRISPR gRNA sequence
taagtttttgatccaccttg

SEQ ID NO: 551686 - DNA, 20 bp, Artificial
  CRISPR gRNA sequence
tataaggtgaaagatgagga

SEQ ID NO: 551687 - DNA, 20 bp, Artificial
  CRISPR gRNA sequence
cagtttcattcttctacacc

SEQ ID NO: 551688 - DNA, 20 bp, Artificial
  CRISPR gRNA sequence
tttcctaataagttcttttc

SEQ ID NO: 551689 - DNA, 20 bp, Artificial
  CRISPR gRNA sequence
catataacatagaaaatatg

SEQ ID NO: 551690 - DNA, 20 bp, Artificial
  CRISPR gRNA sequence
tgtgttgtttatgttattgg

SEQ ID NO: 551691 - DNA, 20 bp, Artificial
  CRISPR gRNA sequence
ttctggtaggctattagcag

SEQ ID NO: 551692 - DNA, 20 bp, Artificial
  CRISPR gRNA sequence
aaatataaggcaattttatt

SEQ ID NO: 551693 - DNA, 20 bp, Artificial
  CRISPR gRNA sequence
accttgctccatgtctctca

SEQ ID NO: 551694 - DNA, 20 bp, Artificial
  CRISPR gRNA sequence
agcgtggtcccacattcagg

SEQ ID NO: 551695 - DNA, 20 bp, Artificial
  CRISPR gRNA sequence
tgaagtaaagaaagccatag

SEQ ID NO: 551696 - DNA, 20 bp, Artificial
  CRISPR gRNA sequence
atataatggatacacacagg

SEQ ID NO: 551697 - DNA, 20 bp, Artificial
  CRISPR gRNA sequence
aggtatagcttgaagatacc

SEQ ID NO: 551698 - DNA, 20 bp, Artificial
  CRISPR gRNA sequence
aaagtgtgtcacacaaattt

SEQ ID NO: 551699 - DNA, 20 bp, Artificial
  CRISPR gRNA sequence
tttcccagggcatataaatg

SEQ ID NO: 551700 - DNA, 20 bp, Artificial
  CRISPR gRNA sequence
tttcttaaaagaagacaatg

SEQ ID NO: 551701 - DNA, 20 bp, Artificial
  CRISPR gRNA sequence
tatttctcagaggcatccaa

SEQ ID NO: 551702 - DNA, 20 bp, Artificial
  CRISPR gRNA sequence
tagaattttactcacagtaa

SEQ ID NO: 551703 - DNA, 20 bp, Artificial
  CRISPR gRNA sequence
taaattttctcaaatcctgc

SEQ ID NO: 551704 - DNA, 20 bp, Artificial
  CRISPR gRNA sequence
tcattggctcaattttcatc

SEQ ID NO: 551705 - DNA, 20 bp, Artificial
  CRISPR gRNA sequence
ttaatattgatattttgacc

SEQ ID NO: 551706 - DNA, 20 bp, Artificial
  CRISPR gRNA sequence
aaggttgtcaatttactttg

SEQ ID NO: 551707 - DNA, 20 bp, Artificial
  CRISPR gRNA sequence
acatctccatcagagctctt

SEQ ID NO: 551708 - DNA, 20 bp, Artificial
  CRISPR gRNA sequence
ctaagcagtaagtattaaca

SEQ ID NO: 551709 - DNA, 20 bp, Artificial
  CRISPR gRNA sequence
attttatagagcacaagcag

SEQ ID NO: 551710 - DNA, 20 bp, Artificial
  CRISPR gRNA sequence
tttcagagtggtaaatgagc

SEQ ID NO: 551711 - DNA, 20 bp, Artificial
  CRISPR gRNA sequence
ggcatcttcttccagtagaa

SEQ ID NO: 551712 - DNA, 20 bp, Artificial
  CRISPR gRNA sequence
ttttgtctacattgaaaatc

SEQ ID NO: 551713 - DNA, 20 bp, Artificial
  CRISPR gRNA sequence
agatcttctggataatttct

SEQ ID NO: 551714 - DNA, 20 bp, Artificial
  CRISPR gRNA sequence
gcagcttctacatcaacact

SEQ ID NO: 551715 - DNA, 20 bp, Artificial
  CRISPR gRNA sequence
caacacttgctgctttactt

SEQ ID NO: 551716 - DNA, 20 bp, Artificial
  CRISPR gRNA sequence
tcacagttttatgttatgga

SEQ ID NO: 551717 - DNA, 20 bp, Artificial
  CRISPR gRNA sequence
gatctcatgaactaacctct

SEQ ID NO: 551718 - DNA, 20 bp, Artificial
  CRISPR gRNA sequence
atagcttcaaacttttctcc

SEQ ID NO: 551719 - DNA, 20 bp, Artificial
  CRISPR gRNA sequence
aaagagagttagggtcttgc

SEQ ID NO: 551720 - DNA, 20 bp, Artificial
  CRISPR gRNA sequence
agttagggtcttgctctgga

SEQ ID NO: 551721 - DNA, 20 bp, Artificial
  CRISPR gRNA sequence
ggtcttgctctggattaggc

SEQ ID NO: 551722 - DNA, 20 bp, Artificial
  CRISPR gRNA sequence
tggattaagggaatgttgta

SEQ ID NO: 551723 - DNA, 20 bp, Artificial
  CRISPR gRNA sequence
actttctccatctgcaataa

SEQ ID NO: 551724 - DNA, 20 bp, Artificial
  CRISPR gRNA sequence
taactctttggcataaaagg

SEQ ID NO: 551725 - DNA, 20 bp, Artificial
  CRISPR gRNA sequence
aggcctagttttcagcccat

SEQ ID NO: 551726 - DNA, 20 bp, Artificial
  CRISPR gRNA sequence
tttttttttttttcttcaga

SEQ ID NO: 551727 - DNA, 20 bp, Artificial
  CRISPR gRNA sequence
aacatctgcctttcaggttc

SEQ ID NO: 551728 - DNA, 20 bp, Artificial
  CRISPR gRNA sequence
tgcctcagcctcccaaccag

SEQ ID NO: 551729 - DNA, 20 bp, Artificial
  CRISPR gRNA sequence
ttttgtatttttagtagaga

SEQ ID NO: 551730 - DNA, 20 bp, Artificial
  CRISPR gRNA sequence
caccttggcctcccaaagtg

SEQ ID NO: 551731 - DNA, 20 bp, Artificial
  CRISPR gRNA sequence
caccacgcccggccacctgt

SEQ ID NO: 551732 - DNA, 20 bp, Artificial
  CRISPR gRNA sequence
cttttcacatgccttcctca

SEQ ID NO: 551733 - DNA, 20 bp, Artificial
  CRISPR gRNA sequence
cctcactaagcttaatcatt

SEQ ID NO: 551734 - DNA, 20 bp, Artificial
  CRISPR gRNA sequence
ataaagttaggcactgatgg

SEQ ID NO: 551735 - DNA, 20 bp, Artificial
  CRISPR gRNA sequence
caataaaaggaggtgtgcct

SEQ ID NO: 551736 - DNA, 20 bp, Artificial
  CRISPR gRNA sequence
tgatgaacactccttttgtg

SEQ ID NO: 551737 - DNA, 20 bp, Artificial
  CRISPR gRNA sequence
tacatatgtcctgatgtatt

SEQ ID NO: 551738 - DNA, 20 bp, Artificial
  CRISPR gRNA sequence
agttgctacatcaaaaggta

SEQ ID NO: 551739 - DNA, 20 bp, Artificial
  CRISPR gRNA sequence
tattttaatagaagttgctg

SEQ ID NO: 551740 - DNA, 20 bp, Artificial
  CRISPR gRNA sequence
agcattaggtaatttttttt

SEQ ID NO: 551741 - DNA, 20 bp, Artificial
  CRISPR gRNA sequence
tttaaaaatttaagcatctc

SEQ ID NO: 551742 - DNA, 20 bp, Artificial
  CRISPR gRNA sequence
atttaagcatctcttctgct

SEQ ID NO: 551743 - DNA, 20 bp, Artificial
  CRISPR gRNA sequence
gcatctcttctgcttgttga

SEQ ID NO: 551744 - DNA, 20 bp, Artificial
  CRISPR gRNA sequence
ttcacatcctctttttttgt

SEQ ID NO: 551745 - DNA, 20 bp, Artificial
  CRISPR gRNA sequence
catcctctttttttgtatta

SEQ ID NO: 551746 - DNA, 20 bp, Artificial
  CRISPR gRNA sequence
ctctttttttgtattagatt

SEQ ID NO: 551747 - DNA, 20 bp, Artificial
  CRISPR gRNA sequence
attgtttgtttttttcttct

SEQ ID NO: 551748 - DNA, 20 bp, Artificial
  CRISPR gRNA sequence
ttatatatttttatctgtat

SEQ ID NO: 551749 - DNA, 20 bp, Artificial
  CRISPR gRNA sequence
ctaaatgaatatcttccata

SEQ ID NO: 551750 - DNA, 20 bp, Artificial
  CRISPR gRNA sequence
tctatatttttacataatga

SEQ ID NO: 551751 - DNA, 20 bp, Artificial
  CRISPR gRNA sequence
gaggtaaaactgggagaact

SEQ ID NO: 551752 - DNA, 20 bp, Artificial
  CRISPR gRNA sequence
actaagactggcctggaaca

SEQ ID NO: 551753 - DNA, 20 bp, Artificial
  CRISPR gRNA sequence
ctggcctggaacatcatgct

SEQ ID NO: 551754 - DNA, 20 bp, Artificial
  CRISPR gRNA sequence
ctgggactcacaggaaagga

SEQ ID NO: 551755 - DNA, 20 bp, Artificial
  CRISPR gRNA sequence
gagcgtatgaagtgggaaaa

SEQ ID NO: 551756 - DNA, 20 bp, Artificial
  CRISPR gRNA sequence
tgggaaaaggcagcttggac

SEQ ID NO: 551757 - DNA, 20 bp, Artificial
  CRISPR gRNA sequence
ggcagcttggacctgtgctt

SEQ ID NO: 551758 - DNA, 20 bp, Artificial
  CRISPR gRNA sequence
aacacatgcatacaatttat

SEQ ID NO: 551759 - DNA, 20 bp, Artificial
  CRISPR gRNA sequence
gcttatgctctaaaagaacc

SEQ ID NO: 551760 - DNA, 20 bp, Artificial
  CRISPR gRNA sequence
taaacaatttagtattatgc

SEQ ID NO: 551761 - DNA, 20 bp, Artificial
  CRISPR gRNA sequence
tggaaggatcacttgagccc

SEQ ID NO: 551762 - DNA, 20 bp, Artificial
  CRISPR gRNA sequence
agactggaaagagacaccct

SEQ ID NO: 551763 - DNA, 20 bp, Artificial
  CRISPR gRNA sequence
caccctaaatgattaacagt

SEQ ID NO: 551764 - DNA, 20 bp, Artificial
  CRISPR gRNA sequence
taaagtaaccacggttactt

SEQ ID NO: 551765 - DNA, 20 bp, Artificial
  CRISPR gRNA sequence
ctttagagattgtggtgatg

SEQ ID NO: 551766 - DNA, 20 bp, Artificial
  CRISPR gRNA sequence
gaacaatagaagaaagggga

SEQ ID NO: 551767 - DNA, 20 bp, Artificial
  CRISPR gRNA sequence
gcaaaggaatggtgtcaaca

SEQ ID NO: 551768 - DNA, 20 bp, Artificial
  CRISPR gRNA sequence
aatggtgtcaacagtgagtt

SEQ ID NO: 551769 - DNA, 20 bp, Artificial
  CRISPR gRNA sequence
agagtgcagaacagagagtg

SEQ ID NO: 551770 - DNA, 20 bp, Artificial
  CRISPR gRNA sequence
gaaatcataatgcccaccat

SEQ ID NO: 551771 - DNA, 20 bp, Artificial
  CRISPR gRNA sequence
tcataatgcccaccataaaa

SEQ ID NO: 551772 - DNA, 20 bp, Artificial
  CRISPR gRNA sequence
cccaccataaaagattgttt

SEQ ID NO: 551773 - DNA, 20 bp, Artificial
  CRISPR gRNA sequence
tttacactggttgacatgga

SEQ ID NO: 551774 - DNA, 20 bp, Artificial
  CRISPR gRNA sequence
ttgacatggaataggctttc

SEQ ID NO: 551775 - DNA, 20 bp, Artificial
  CRISPR gRNA sequence
gggtgagaactgggcatggg

SEQ ID NO: 551776 - DNA, 20 bp, Artificial
  CRISPR gRNA sequence
ctgggcatggggtgagtttt

SEQ ID NO: 551777 - DNA, 20 bp, Artificial
  CRISPR gRNA sequence
attttatcagtgatcgccta

SEQ ID NO: 551778 - DNA, 20 bp, Artificial
  CRISPR gRNA sequence
atgctagccagataattttt

SEQ ID NO: 551779 - DNA, 20 bp, Artificial
  CRISPR gRNA sequence
cagataatttttgaaggttt

SEQ ID NO: 551780 - DNA, 20 bp, Artificial
  CRISPR gRNA sequence
tgatctcaaatattctgttg

SEQ ID NO: 551781 - DNA, 20 bp, Artificial
  CRISPR gRNA sequence
cctgaagttgtaactggaac

SEQ ID NO: 551782 - DNA, 20 bp, Artificial
  CRISPR gRNA sequence
caagttttatagatgaagta

SEQ ID NO: 551783 - DNA, 20 bp, Artificial
  CRISPR gRNA sequence
tgcaaattattactcagggc

SEQ ID NO: 551784 - DNA, 20 bp, Artificial
  CRISPR gRNA sequence
ttattactcagggcctgaga

SEQ ID NO: 551785 - DNA, 20 bp, Artificial
  CRISPR gRNA sequence
atgggaggctgaggcaggag

SEQ ID NO: 551786 - DNA, 20 bp, Artificial
  CRISPR gRNA sequence
gaatcctaaaaacatattaa

SEQ ID NO: 551787 - DNA, 20 bp, Artificial
  CRISPR gRNA sequence
caacaatgttaagtaatgaa

SEQ ID NO: 551788 - DNA, 20 bp, Artificial
  CRISPR gRNA sequence
gcagaatcagtgctcttaac

SEQ ID NO: 551789 - DNA, 20 bp, Artificial
  CRISPR gRNA sequence
ctcttaaccattgtttctta

SEQ ID NO: 551790 - DNA, 20 bp, Artificial
  CRISPR gRNA sequence
ttaaagatagtgacatgatg

SEQ ID NO: 551791 - DNA, 20 bp, Artificial
  CRISPR gRNA sequence
acaggtgaggcactaagctc

SEQ ID NO: 551792 - DNA, 20 bp, Artificial
  CRISPR gRNA sequence
agttggcaactaattcaaat

SEQ ID NO: 551793 - DNA, 20 bp, Artificial
  CRISPR gRNA sequence
caggacaaggacaaaggtgt

SEQ ID NO: 551794 - DNA, 20 bp, Artificial
  CRISPR gRNA sequence
tctgttgaatgaattaacta

SEQ ID NO: 551795 - DNA, 20 bp, Artificial
  CRISPR gRNA sequence
cttaaatgtagttcaaaaga

SEQ ID NO: 551796 - DNA, 20 bp, Artificial
  CRISPR gRNA sequence
tttgacagtcaccccaaacc

SEQ ID NO: 551797 - DNA, 20 bp, Artificial
  CRISPR gRNA sequence
tcgtaaggagagatggagaa

SEQ ID NO: 551798 - DNA, 20 bp, Artificial
  CRISPR gRNA sequence
gatggagaaagaagtttaac

SEQ ID NO: 551799 - DNA, 20 bp, Artificial
  CRISPR gRNA sequence
tcatatacaaccaaaacaga

SEQ ID NO: 551800 - DNA, 20 bp, Artificial
  CRISPR gRNA sequence
cccttttgagatgttccctc

SEQ ID NO: 551801 - DNA, 20 bp, Artificial
  CRISPR gRNA sequence
gatgttccctctcaagttta

SEQ ID NO: 551802 - DNA, 20 bp, Artificial
  CRISPR gRNA sequence
atcaaacttaacagcctcgc

SEQ ID NO: 551803 - DNA, 20 bp, Artificial
  CRISPR gRNA sequence
gtggtgcaatcgtggctcac

SEQ ID NO: 551804 - DNA, 20 bp, Artificial
  CRISPR gRNA sequence
tccctgggccttctgaagtg

SEQ ID NO: 551805 - DNA, 20 bp, Artificial
  CRISPR gRNA sequence
gagacaagctaatcactctt

SEQ ID NO: 551806 - DNA, 20 bp, Artificial
  CRISPR gRNA sequence
ctcttccgggatttgaagga

SEQ ID NO: 551807 - DNA, 20 bp, Artificial
  CRISPR gRNA sequence
atttgaaggaaagggttttc

SEQ ID NO: 551808 - DNA, 20 bp, Artificial
  CRISPR gRNA sequence
attttaaggctcacactgcc

SEQ ID NO: 551809 - DNA, 20 bp, Artificial
  CRISPR gRNA sequence
gaaaaaagaaaaattccctt

SEQ ID NO: 551810 - DNA, 20 bp, Artificial
  CRISPR gRNA sequence
ctgaatataagacatcataa

SEQ ID NO: 551811 - DNA, 20 bp, Artificial
  CRISPR gRNA sequence
tttttgctcccaagtgagca

SEQ ID NO: 551812 - DNA, 20 bp, Artificial
  CRISPR gRNA sequence
gccttgtccctctcacttct

SEQ ID NO: 551813 - DNA, 20 bp, Artificial
  CRISPR gRNA sequence
cccaattttgggggtagaaa

SEQ ID NO: 551814 - DNA, 20 bp, Artificial
  CRISPR gRNA sequence
gagataataaagaggagtag

SEQ ID NO: 551815 - DNA, 20 bp, Artificial
  CRISPR gRNA sequence
taataaagaggagtagcact

SEQ ID NO: 551816 - DNA, 20 bp, Artificial
  CRISPR gRNA sequence
cactgtttgttttaactcaa

SEQ ID NO: 551817 - DNA, 20 bp, Artificial
  CRISPR gRNA sequence
atttaacagtagcagcagca

SEQ ID NO: 551818 - DNA, 20 bp, Artificial
  CRISPR gRNA sequence
cagcagcacgaagattcact

SEQ ID NO: 551819 - DNA, 20 bp, Artificial
  CRISPR gRNA sequence
tgacaagcacttgttccaag

SEQ ID NO: 551820 - DNA, 20 bp, Artificial
  CRISPR gRNA sequence
gaacacgcctatcaaagtaa

SEQ ID NO: 551821 - DNA, 20 bp, Artificial
  CRISPR gRNA sequence
acttggttgatagagaaggt

SEQ ID NO: 551822 - DNA, 20 bp, Artificial
  CRISPR gRNA sequence
ggccattcctcttttttcct

SEQ ID NO: 551823 - DNA, 20 bp, Artificial
  CRISPR gRNA sequence
cttctcttatttccttaaga

SEQ ID NO: 551824 - DNA, 20 bp, Artificial
  CRISPR gRNA sequence
atttccttaagacagagatt

SEQ ID NO: 551825 - DNA, 20 bp, Artificial
  CRISPR gRNA sequence
ctgatttcagccacaccacc

SEQ ID NO: 551826 - DNA, 20 bp, Artificial
  CRISPR gRNA sequence
tccttctaatatgatgctaa

SEQ ID NO: 551827 - DNA, 20 bp, Artificial
  CRISPR gRNA sequence
aacctatttcttctttctca

SEQ ID NO: 551828 - DNA, 20 bp, Artificial
  CRISPR gRNA sequence
aggttagtgcaaaagtaatt

SEQ ID NO: 551829 - DNA, 20 bp, Artificial
  CRISPR gRNA sequence
ttgagagcacttctttagcc

SEQ ID NO: 551830 - DNA, 20 bp, Artificial
  CRISPR gRNA sequence
ggatacagctgagatccaca

SEQ ID NO: 551831 - DNA, 20 bp, Artificial
  CRISPR gRNA sequence
actagatcggttaaggctgt

SEQ ID NO: 551832 - DNA, 20 bp, Artificial
  CRISPR gRNA sequence
ttttaaatctattctccaaa

SEQ ID NO: 551833 - DNA, 20 bp, Artificial
  CRISPR gRNA sequence
cgttgggaaactctattgca

SEQ ID NO: 551834 - DNA, 20 bp, Artificial
  CRISPR gRNA sequence
gtttacaatggcacagcctc

SEQ ID NO: 551835 - DNA, 20 bp, Artificial
  CRISPR gRNA sequence
gcctcattagtttcttatta

SEQ ID NO: 551836 - DNA, 20 bp, Artificial
  CRISPR gRNA sequence
tctccaaagaggaactgcta

SEQ ID NO: 551837 - DNA, 20 bp, Artificial
  CRISPR gRNA sequence
gaaaagagaaacggctgcat

SEQ ID NO: 551838 - DNA, 20 bp, Artificial
  CRISPR gRNA sequence
ttacaaccctgagatggaag

SEQ ID NO: 551839 - DNA, 20 bp, Artificial
  CRISPR gRNA sequence
ccttctggtcacccctcaag

SEQ ID NO: 551840 - DNA, 20 bp, Artificial
  CRISPR gRNA sequence
cccctcaagtaaagcttcaa

SEQ ID NO: 551841 - DNA, 20 bp, Artificial
  CRISPR gRNA sequence
agaaaacttacacatataag

SEQ ID NO: 551842 - DNA, 20 bp, Artificial
  CRISPR gRNA sequence
catataagggctgatttatg

SEQ ID NO: 551843 - DNA, 20 bp, Artificial
  CRISPR gRNA sequence
caacgaatacaatgagtgaa

SEQ ID NO: 551844 - DNA, 20 bp, Artificial
  CRISPR gRNA sequence
tgagtgaaacttgattagat

SEQ ID NO: 551845 - DNA, 20 bp, Artificial
  CRISPR gRNA sequence
ggtaaaagttaggtgatgtt

SEQ ID NO: 551846 - DNA, 20 bp, Artificial
  CRISPR gRNA sequence
ttatagatgttatgatgtta

SEQ ID NO: 551847 - DNA, 20 bp, Artificial
  CRISPR gRNA sequence
attgtgctgacctatatttc

SEQ ID NO: 551848 - DNA, 20 bp, Artificial
  CRISPR gRNA sequence
agtagtactcatcttcaaaa

SEQ ID NO: 551849 - DNA, 20 bp, Artificial
  CRISPR gRNA sequence
agagcatataaaggaatagg

SEQ ID NO: 551850 - DNA, 20 bp, Artificial
  CRISPR gRNA sequence
ggacacattactgaacctac

SEQ ID NO: 551851 - DNA, 20 bp, Artificial
  CRISPR gRNA sequence
cactctgttataacactggg

SEQ ID NO: 551852 - DNA, 20 bp, Artificial
  CRISPR gRNA sequence
aacacacaacactattttaa

SEQ ID NO: 551853 - DNA, 20 bp, Artificial
  CRISPR gRNA sequence
aaatacattgtcatctaatg

SEQ ID NO: 551854 - DNA, 20 bp, Artificial
  CRISPR gRNA sequence
cagtatagaggaaactgccc

SEQ ID NO: 551855 - DNA, 20 bp, Artificial
  CRISPR gRNA sequence
ctggccctgcccttgacaca

SEQ ID NO: 551856 - DNA, 20 bp, Artificial
  CRISPR gRNA sequence
ggggattattacaattcaag

SEQ ID NO: 551857 - DNA, 20 bp, Artificial
  CRISPR gRNA sequence
accttgggcagctcttcccc

SEQ ID NO: 551858 - DNA, 20 bp, Artificial
  CRISPR gRNA sequence
cagggtacagccatcctcct

SEQ ID NO: 551859 - DNA, 20 bp, Artificial
  CRISPR gRNA sequence
atgagctggcattaagtgtc

SEQ ID NO: 551860 - DNA, 20 bp, Artificial
  CRISPR gRNA sequence
caacaccacatgtaagccac

SEQ ID NO: 551861 - DNA, 20 bp, Artificial
  CRISPR gRNA sequence
aacagctggcatgcagggct

SEQ ID NO: 551862 - DNA, 20 bp, Artificial
  CRISPR gRNA sequence
gtgataggaggggctgccat

SEQ ID NO: 551863 - DNA, 20 bp, Artificial
  CRISPR gRNA sequence
agacattttccccattgtct

SEQ ID NO: 551864 - DNA, 20 bp, Artificial
  CRISPR gRNA sequence
acttaatgcaaatttctgca

SEQ ID NO: 551865 - DNA, 20 bp, Artificial
  CRISPR gRNA sequence
cttgaatttttcctcagaaa

SEQ ID NO: 551866 - DNA, 20 bp, Artificial
  CRISPR gRNA sequence
ctttgtgaacatataaaact

SEQ ID NO: 551867 - DNA, 20 bp, Artificial
  CRISPR gRNA sequence
cagcaaccaagccacctctt

SEQ ID NO: 551868 - DNA, 20 bp, Artificial
  CRISPR gRNA sequence
aagccacctcttgaatgctt

SEQ ID NO: 551869 - DNA, 20 bp, Artificial
  CRISPR gRNA sequence
tgcctgttacccagttccaa

SEQ ID NO: 551870 - DNA, 20 bp, Artificial
  CRISPR gRNA sequence
ttacatggcagtaggcaaga

SEQ ID NO: 551871 - DNA, 20 bp, Artificial
  CRISPR gRNA sequence
cagtatgggggaaactgccc

SEQ ID NO: 551872 - DNA, 20 bp, Artificial
  CRISPR gRNA sequence
ctagccctgcccttgacata

SEQ ID NO: 551873 - DNA, 20 bp, Artificial
  CRISPR gRNA sequence
ggggattattacaattcaac

SEQ ID NO: 551874 - DNA, 20 bp, Artificial
  CRISPR gRNA sequence
cacagagccaaaccatatca

SEQ ID NO: 551875 - DNA, 20 bp, Artificial
  CRISPR gRNA sequence
catatcatggggtttcagca

SEQ ID NO: 551876 - DNA, 20 bp, Artificial
  CRISPR gRNA sequence
cccacctcagcctctcagtg

SEQ ID NO: 551877 - DNA, 20 bp, Artificial
  CRISPR gRNA sequence
atccagatatctcccacccc

SEQ ID NO: 551878 - DNA, 20 bp, Artificial
  CRISPR gRNA sequence
ctccaccacaatggtatcct

SEQ ID NO: 551879 - DNA, 20 bp, Artificial
  CRISPR gRNA sequence
tggtatccttgaagtttctt

SEQ ID NO: 551880 - DNA, 20 bp, Artificial
  CRISPR gRNA sequence
gatctctatgaagtgatagg

SEQ ID NO: 551881 - DNA, 20 bp, Artificial
  CRISPR gRNA sequence
aaaaaatacatagagtgtta

SEQ ID NO: 551882 - DNA, 20 bp, Artificial
  CRISPR gRNA sequence
aaagaatccaaataactttt

SEQ ID NO: 551883 - DNA, 20 bp, Artificial
  CRISPR gRNA sequence
atccaaataacttttttttg

SEQ ID NO: 551884 - DNA, 20 bp, Artificial
  CRISPR gRNA sequence
aataacttttttttgttttg

SEQ ID NO: 551885 - DNA, 20 bp, Artificial
  CRISPR gRNA sequence
ttttttgttttgttttgttt

SEQ ID NO: 551886 - DNA, 20 bp, Artificial
  CRISPR gRNA sequence
gccaccatgcccagctaatt

SEQ ID NO: 551887 - DNA, 20 bp, Artificial
  CRISPR gRNA sequence
attttttgttttagtagaga

SEQ ID NO: 551888 - DNA, 20 bp, Artificial
  CRISPR gRNA sequence
cgccttggcctcccaaagtg

SEQ ID NO: 551889 - DNA, 20 bp, Artificial
  CRISPR gRNA sequence
gaaatctttaactgtattta

SEQ ID NO: 551890 - DNA, 20 bp, Artificial
  CRISPR gRNA sequence
ttagtaagtttgtagttggt

SEQ ID NO: 551891 - DNA, 20 bp, Artificial
  CRISPR gRNA sequence
agattggtatagcaactgta

SEQ ID NO: 551892 - DNA, 20 bp, Artificial
  CRISPR gRNA sequence
atagcaactgtaaaatgatt

SEQ ID NO: 551893 - DNA, 20 bp, Artificial
  CRISPR gRNA sequence
taaaatgatttggggtttaa

SEQ ID NO: 551894 - DNA, 20 bp, Artificial
  CRISPR gRNA sequence
agaggcagaagaactaagca

SEQ ID NO: 551895 - DNA, 20 bp, Artificial
  CRISPR gRNA sequence
gggcacactttgcacccaga

SEQ ID NO: 551896 - DNA, 20 bp, Artificial
  CRISPR gRNA sequence
ctaaaagaaaccagggaacc

SEQ ID NO: 551897 - DNA, 20 bp, Artificial
  CRISPR gRNA sequence
ttctgtgccagaaagtaagg

SEQ ID NO: 551898 - DNA, 20 bp, Artificial
  CRISPR gRNA sequence
caaacagagcaaaaggactc

SEQ ID NO: 551899 - DNA, 20 bp, Artificial
  CRISPR gRNA sequence
cactttgggaaactgacttg

SEQ ID NO: 551900 - DNA, 20 bp, Artificial
  CRISPR gRNA sequence
ttgggaaactgacttgggag

SEQ ID NO: 551901 - DNA, 20 bp, Artificial
  CRISPR gRNA sequence
tttggaaactgaggtgggag

SEQ ID NO: 551902 - DNA, 20 bp, Artificial
  CRISPR gRNA sequence
agggaggatcacttgagccc

SEQ ID NO: 551903 - DNA, 20 bp, Artificial
  CRISPR gRNA sequence
gtctgggcaacatagggaaa

SEQ ID NO: 551904 - DNA, 20 bp, Artificial
  CRISPR gRNA sequence
tcagaaggctgaggtggcag

SEQ ID NO: 551905 - DNA, 20 bp, Artificial
  CRISPR gRNA sequence
aaataaaatattttagtgat

SEQ ID NO: 551906 - DNA, 20 bp, Artificial
  CRISPR gRNA sequence
aaaaaaaaaaaaaaaaaagc

SEQ ID NO: 551907 - DNA, 20 bp, Artificial
  CRISPR gRNA sequence
ggttaaagggggttaaaaag

SEQ ID NO: 551908 - DNA, 20 bp, Artificial
  CRISPR gRNA sequence
aatgaagtatgtggtgcagg

SEQ ID NO: 551909 - DNA, 20 bp, Artificial
  CRISPR gRNA sequence
tattgtatcaatgccacatt

SEQ ID NO: 551910 - DNA, 20 bp, Artificial
  CRISPR gRNA sequence
aatgccacatttccagatta

SEQ ID NO: 551911 - DNA, 20 bp, Artificial
  CRISPR gRNA sequence
catgagatctgaaactctca

SEQ ID NO: 551912 - DNA, 20 bp, Artificial
  CRISPR gRNA sequence
aaactaatgtgacagttaac

SEQ ID NO: 551913 - DNA, 20 bp, Artificial
  CRISPR gRNA sequence
tactaattttgcaactgtcc

SEQ ID NO: 551914 - DNA, 20 bp, Artificial
  CRISPR gRNA sequence
acgacttccatcaccccttt

SEQ ID NO: 551915 - DNA, 20 bp, Artificial
  CRISPR gRNA sequence
ttactcatctctgtactagt

SEQ ID NO: 551916 - DNA, 20 bp, Artificial
  CRISPR gRNA sequence
actttatcaccatccagcat

SEQ ID NO: 551917 - DNA, 20 bp, Artificial
  CRISPR gRNA sequence
tctctctccctcactataag

SEQ ID NO: 551918 - DNA, 20 bp, Artificial
  CRISPR gRNA sequence
cacaaaggcagggaactgtg

SEQ ID NO: 551919 - DNA, 20 bp, Artificial
  CRISPR gRNA sequence
tgtatcccccgtccattgtg

SEQ ID NO: 551920 - DNA, 20 bp, Artificial
  CRISPR gRNA sequence
gttcccagtaattctatgaa

SEQ ID NO: 551921 - DNA, 20 bp, Artificial
  CRISPR gRNA sequence
atgctgttaatcactgcatt

SEQ ID NO: 551922 - DNA, 20 bp, Artificial
  CRISPR gRNA sequence
tttgcagcttccctaatgag

SEQ ID NO: 551923 - DNA, 20 bp, Artificial
  CRISPR gRNA sequence
tatacccattcagtcttgtc

SEQ ID NO: 551924 - DNA, 20 bp, Artificial
  CRISPR gRNA sequence
ttagtttaaggcctatgcag

SEQ ID NO: 551925 - DNA, 20 bp, Artificial
  CRISPR gRNA sequence
atgcagagcagtttataaat

SEQ ID NO: 551926 - DNA, 20 bp, Artificial
  CRISPR gRNA sequence
ttcaaataatctgttggagg

SEQ ID NO: 551927 - DNA, 20 bp, Artificial
  CRISPR gRNA sequence
ggaggtggagcttgggcaaa

SEQ ID NO: 551928 - DNA, 20 bp, Artificial
  CRISPR gRNA sequence
aaggtgccagggaatgaggg

SEQ ID NO: 551929 - DNA, 20 bp, Artificial
  CRISPR gRNA sequence
accccatccattcaattaat

SEQ ID NO: 551930 - DNA, 20 bp, Artificial
  CRISPR gRNA sequence
cagccttcctctttgttgct

SEQ ID NO: 551931 - DNA, 20 bp, Artificial
  CRISPR gRNA sequence
aatatcctccctcccatgaa

SEQ ID NO: 551932 - DNA, 20 bp, Artificial
  CRISPR gRNA sequence
aagactgcttcacaaaagac

SEQ ID NO: 551933 - DNA, 20 bp, Artificial
  CRISPR gRNA sequence
atcctctgcctccgggactc

SEQ ID NO: 551934 - DNA, 20 bp, Artificial
  CRISPR gRNA sequence
accgtgttggccctgctggt

SEQ ID NO: 551935 - DNA, 20 bp, Artificial
  CRISPR gRNA sequence
ggaggttactgctgtactcc

SEQ ID NO: 551936 - DNA, 20 bp, Artificial
  CRISPR gRNA sequence
aggatggaaccagttctgat

SEQ ID NO: 551937 - DNA, 20 bp, Artificial
  CRISPR gRNA sequence
accagttctgatactagttt

SEQ ID NO: 551938 - DNA, 20 bp, Artificial
  CRISPR gRNA sequence
caacgtgaggccgctgccga

SEQ ID NO: 551939 - DNA, 20 bp, Artificial
  CRISPR gRNA sequence
cctacccgctcctcgctgtg

SEQ ID NO: 551940 - DNA, 20 bp, Artificial
  CRISPR gRNA sequence
gccggcgcggggcccctggg

SEQ ID NO: 551941 - DNA, 20 bp, Artificial
  CRISPR gRNA sequence
ctcccccaccctccgcggcg

SEQ ID NO: 551942 - DNA, 20 bp, Artificial
  CRISPR gRNA sequence
ccgcggcgccgcgtttgtct

SEQ ID NO: 551943 - DNA, 20 bp, Artificial
  CRISPR gRNA sequence
cttctggccgaccgcgtagg

SEQ ID NO: 551944 - DNA, 20 bp, Artificial
  CRISPR gRNA sequence
taggcggtgcttgaacttag

SEQ ID NO: 551945 - DNA, 20 bp, Artificial
  CRISPR gRNA sequence
tcagcgtggtctgcctgctg

SEQ ID NO: 551946 - DNA, 20 bp, Artificial
  CRISPR gRNA sequence
tccagtgaccaagttccttc

SEQ ID NO: 551947 - DNA, 20 bp, Artificial
  CRISPR gRNA sequence
gcttccccagtaacgtcgct

SEQ ID NO: 551948 - DNA, 20 bp, Artificial
  CRISPR gRNA sequence
cagtcggcagcggcctcacg

SEQ ID NO: 551949 - DNA, 20 bp, Artificial
  CRISPR gRNA sequence
gccagccctccagcccgtcc

SEQ ID NO: 551950 - DNA, 20 bp, Artificial
  CRISPR gRNA sequence
aagaggcctgggctgggcgt

SEQ ID NO: 551951 - DNA, 20 bp, Artificial
  CRISPR gRNA sequence
gaggcagaggatgcagtgag

SEQ ID NO: 551952 - DNA, 20 bp, Artificial
  CRISPR gRNA sequence
tggacatgtgataatgtggg

SEQ ID NO: 551953 - DNA, 20 bp, Artificial
  CRISPR gRNA sequence
ctgagtgtccccttagggag

SEQ ID NO: 551954 - DNA, 20 bp, Artificial
  CRISPR gRNA sequence
gtctggattctctgagctga

SEQ ID NO: 551955 - DNA, 20 bp, Artificial
  CRISPR gRNA sequence
gggaaaagaagagatacaaa

SEQ ID NO: 551956 - DNA, 20 bp, Artificial
  CRISPR gRNA sequence
gttctcccttccactgcaaa

SEQ ID NO: 551957 - DNA, 20 bp, Artificial
  CRISPR gRNA sequence
tttgcccaagctccacctcc

SEQ ID NO: 551958 - DNA, 20 bp, Artificial
  CRISPR gRNA sequence
catgtattcattcagaagtc

SEQ ID NO: 551959 - DNA, 20 bp, Artificial
  CRISPR gRNA sequence
cattagggaagctgcaaatg

SEQ ID NO: 551960 - DNA, 20 bp, Artificial
  CRISPR gRNA sequence
atcagctctggggtcagatg

SEQ ID NO: 551961 - DNA, 20 bp, Artificial
  CRISPR gRNA sequence
gtgatggaagtcgttaatac

SEQ ID NO: 551962 - DNA, 20 bp, Artificial
  CRISPR gRNA sequence
aagtcgttaatacttcagtt

SEQ ID NO: 551963 - DNA, 20 bp, Artificial
  CRISPR gRNA sequence
aatcaccagttaactgtcac

SEQ ID NO: 551964 - DNA, 20 bp, Artificial
  CRISPR gRNA sequence
ttatttttgccaaaccattt

SEQ ID NO: 551965 - DNA, 20 bp, Artificial
  CRISPR gRNA sequence
gaaatgtggcattgatacaa

SEQ ID NO: 551966 - DNA, 20 bp, Artificial
  CRISPR gRNA sequence
aaccccctttaacctaaaac

SEQ ID NO: 551967 - DNA, 20 bp, Artificial
  CRISPR gRNA sequence
atttttgaagtgtctgggct

SEQ ID NO: 551968 - DNA, 20 bp, Artificial
  CRISPR gRNA sequence
ttaccgaatgtccctttgga

SEQ ID NO: 551969 - DNA, 20 bp, Artificial
  CRISPR gRNA sequence
tgtccctttggatgtggatt

SEQ ID NO: 551970 - DNA, 20 bp, Artificial
  CRISPR gRNA sequence
cctttggatgtggattgcct

SEQ ID NO: 551971 - DNA, 20 bp, Artificial
  CRISPR gRNA sequence
tgcctgcttgtttcctcatg

SEQ ID NO: 551972 - DNA, 20 bp, Artificial
  CRISPR gRNA sequence
tgtcacatcaggaagatgtg

SEQ ID NO: 551973 - DNA, 20 bp, Artificial
  CRISPR gRNA sequence
actttgacatttggttaaag

SEQ ID NO: 551974 - DNA, 20 bp, Artificial
  CRISPR gRNA sequence
atttggttaaagtgaagttt

SEQ ID NO: 551975 - DNA, 20 bp, Artificial
  CRISPR gRNA sequence
gtaataaatgatgtgttaag

SEQ ID NO: 551976 - DNA, 20 bp, Artificial
  CRISPR gRNA sequence
tctccagccattgttcattc

SEQ ID NO: 551977 - DNA, 20 bp, Artificial
  CRISPR gRNA sequence
tcagtggttttagtatccta

SEQ ID NO: 551978 - DNA, 20 bp, Artificial
  CRISPR gRNA sequence
aggactacaggtgcatgcca

SEQ ID NO: 551979 - DNA, 20 bp, Artificial
  CRISPR gRNA sequence
ccatgcttggctaatttttt

SEQ ID NO: 551980 - DNA, 20 bp, Artificial
  CRISPR gRNA sequence
ttttttagtttttgtagaaa

SEQ ID NO: 551981 - DNA, 20 bp, Artificial
  CRISPR gRNA sequence
ctccttggcctaccgaagtg

SEQ ID NO: 551982 - DNA, 20 bp, Artificial
  CRISPR gRNA sequence
ttcccttcccttctttcctt

SEQ ID NO: 551983 - DNA, 20 bp, Artificial
  CRISPR gRNA sequence
gactcaagcgatcctcccac

SEQ ID NO: 551984 - DNA, 20 bp, Artificial
  CRISPR gRNA sequence
ttttgtattttttatagaga

SEQ ID NO: 551985 - DNA, 20 bp, Artificial
  CRISPR gRNA sequence
ggctcaagcaatcctcccaa

SEQ ID NO: 551986 - DNA, 20 bp, Artificial
  CRISPR gRNA sequence
caagtcagtttcccaaagtg

SEQ ID NO: 551987 - DNA, 20 bp, Artificial
  CRISPR gRNA sequence
agccacccagcaattttctc

SEQ ID NO: 551988 - DNA, 20 bp, Artificial
  CRISPR gRNA sequence
ttctctctatatatatattt

SEQ ID NO: 551989 - DNA, 20 bp, Artificial
  CRISPR gRNA sequence
gtttacattgttcagtaatg

SEQ ID NO: 551990 - DNA, 20 bp, Artificial
  CRISPR gRNA sequence
tttagaaggttatgtggact

SEQ ID NO: 551991 - DNA, 20 bp, Artificial
  CRISPR gRNA sequence
tttgacaagtgggaacacct

SEQ ID NO: 551992 - DNA, 20 bp, Artificial
  CRISPR gRNA sequence
caagcttcagagtccttttg

SEQ ID NO: 551993 - DNA, 20 bp, Artificial
  CRISPR gRNA sequence
agtccttttgctctgtttgt

SEQ ID NO: 551994 - DNA, 20 bp, Artificial
  CRISPR gRNA sequence
cttttgctctgtttgttcct

SEQ ID NO: 551995 - DNA, 20 bp, Artificial
  CRISPR gRNA sequence
gccttcgaatcattaggttc

SEQ ID NO: 551996 - DNA, 20 bp, Artificial
  CRISPR gRNA sequence
gtgcccacaggtaccagagt

SEQ ID NO: 551997 - DNA, 20 bp, Artificial
  CRISPR gRNA sequence
agtcattgcttctcagcctt

SEQ ID NO: 551998 - DNA, 20 bp, Artificial
  CRISPR gRNA sequence
cagttttcaaagttaagaaa

SEQ ID NO: 551999 - DNA, 20 bp, Artificial
  CRISPR gRNA sequence
acttctaacactaataatct

SEQ ID NO: 552000 - DNA, 20 bp, Artificial
  CRISPR gRNA sequence
acaaacttactaaatacagt

SEQ ID NO: 552001 - DNA, 20 bp, Artificial
  CRISPR gRNA sequence
caacttagcaatggttcgac

SEQ ID NO: 552002 - DNA, 20 bp, Artificial
  CRISPR gRNA sequence
taagatttttcaactctaca

SEQ ID NO: 552003 - DNA, 20 bp, Artificial
  CRISPR gRNA sequence
aatactatattcaaaagtta

SEQ ID NO: 552004 - DNA, 20 bp, Artificial
  CRISPR gRNA sequence
ggcgggcggatcacaaggtc

SEQ ID NO: 552005 - DNA, 20 bp, Artificial
  CRISPR gRNA sequence
gaggcagagactgcagtgag

SEQ ID NO: 552006 - DNA, 20 bp, Artificial
  CRISPR gRNA sequence
aacaaaacaaaaaaaagtta

SEQ ID NO: 552007 - DNA, 20 bp, Artificial
  CRISPR gRNA sequence
ctactactcaggaccctgag

SEQ ID NO: 552008 - DNA, 20 bp, Artificial
  CRISPR gRNA sequence
aggaccctgagataggcttc

SEQ ID NO: 552009 - DNA, 20 bp, Artificial
  CRISPR gRNA sequence
tcagggttggatcctgtaga

SEQ ID NO: 552010 - DNA, 20 bp, Artificial
  CRISPR gRNA sequence
ccttttaaatattttggcct

SEQ ID NO: 552011 - DNA, 20 bp, Artificial
  CRISPR gRNA sequence
ctttttgctttcagtgactg

SEQ ID NO: 552012 - DNA, 20 bp, Artificial
  CRISPR gRNA sequence
ttcagtgactggaaagtttt

SEQ ID NO: 552013 - DNA, 20 bp, Artificial
  CRISPR gRNA sequence
gagtgaaattatgatgactt

SEQ ID NO: 552014 - DNA, 20 bp, Artificial
  CRISPR gRNA sequence
tgggggtgggagatatctgg

SEQ ID NO: 552015 - DNA, 20 bp, Artificial
  CRISPR gRNA sequence
gtgttttgaaggtggagctg

SEQ ID NO: 552016 - DNA, 20 bp, Artificial
  CRISPR gRNA sequence
tggagctggcaggatttggt

SEQ ID NO: 552017 - DNA, 20 bp, Artificial
  CRISPR gRNA sequence
aacatgctgaaaccccatga

SEQ ID NO: 552018 - DNA, 20 bp, Artificial
  CRISPR gRNA sequence
ggagataattgaatcataag

SEQ ID NO: 552019 - DNA, 20 bp, Artificial
  CRISPR gRNA sequence
tgaataagtctcacaatatt

SEQ ID NO: 552020 - DNA, 20 bp, Artificial
  CRISPR gRNA sequence
atatttgatgattttataaa

SEQ ID NO: 552021 - DNA, 20 bp, Artificial
  CRISPR gRNA sequence
tacttctcctttgcattctg

SEQ ID NO: 552022 - DNA, 20 bp, Artificial
  CRISPR gRNA sequence
ctttggaactgggtaacagg

SEQ ID NO: 552023 - DNA, 20 bp, Artificial
  CRISPR gRNA sequence
gggtaacaggcagggattgg

SEQ ID NO: 552024 - DNA, 20 bp, Artificial
  CRISPR gRNA sequence
aagaagacaggaagatgtgg

SEQ ID NO: 552025 - DNA, 20 bp, Artificial
  CRISPR gRNA sequence
aacttcctagagacttgttg

SEQ ID NO: 552026 - DNA, 20 bp, Artificial
  CRISPR gRNA sequence
tggaataaaggtgactctta

SEQ ID NO: 552027 - DNA, 20 bp, Artificial
  CRISPR gRNA sequence
aagcagcaaagcattcaaga

SEQ ID NO: 552028 - DNA, 20 bp, Artificial
  CRISPR gRNA sequence
cttggttgctgttaaaagca

SEQ ID NO: 552029 - DNA, 20 bp, Artificial
  CRISPR gRNA sequence
gttttatatgttcacaaaga

SEQ ID NO: 552030 - DNA, 20 bp, Artificial
  CRISPR gRNA sequence
atgtggtttggaattggaac

SEQ ID NO: 552031 - DNA, 20 bp, Artificial
  CRISPR gRNA sequence
ctggaggccttggagggaaa

SEQ ID NO: 552032 - DNA, 20 bp, Artificial
  CRISPR gRNA sequence
aacatggagccctgcatgcc

SEQ ID NO: 552033 - DNA, 20 bp, Artificial
  CRISPR gRNA sequence
ggccaacataccactcaggc

SEQ ID NO: 552034 - DNA, 20 bp, Artificial
  CRISPR gRNA sequence
tgcttcagagggtaagcctt

SEQ ID NO: 552035 - DNA, 20 bp, Artificial
  CRISPR gRNA sequence
gatgcacagaagtcaagaat

SEQ ID NO: 552036 - DNA, 20 bp, Artificial
  CRISPR gRNA sequence
ttgaggtttgagaacctctg

SEQ ID NO: 552037 - DNA, 20 bp, Artificial
  CRISPR gRNA sequence
aaatgcctggatgtccaggc

SEQ ID NO: 552038 - DNA, 20 bp, Artificial
  CRISPR gRNA sequence
cccggaatggtagatccacc

SEQ ID NO: 552039 - DNA, 20 bp, Artificial
  CRISPR gRNA sequence
aggagatcattttggaactt

SEQ ID NO: 552040 - DNA, 20 bp, Artificial
  CRISPR gRNA sequence
ttaaggtttaagactgccct

SEQ ID NO: 552041 - DNA, 20 bp, Artificial
  CRISPR gRNA sequence
ttgcatggggcctgtagccc

SEQ ID NO: 552042 - DNA, 20 bp, Artificial
  CRISPR gRNA sequence
ctaggaagtaactaacttgc

SEQ ID NO: 552043 - DNA, 20 bp, Artificial
  CRISPR gRNA sequence
tgccttatctccgatgagac

SEQ ID NO: 552044 - DNA, 20 bp, Artificial
  CRISPR gRNA sequence
tgagactttggatttagact

SEQ ID NO: 552045 - DNA, 20 bp, Artificial
  CRISPR gRNA sequence
tggattaatgctggaataag

SEQ ID NO: 552046 - DNA, 20 bp, Artificial
  CRISPR gRNA sequence
ggactgttggaagggcatta

SEQ ID NO: 552047 - DNA, 20 bp, Artificial
  CRISPR gRNA sequence
gtgttttgaaatgtgaggac

SEQ ID NO: 552048 - DNA, 20 bp, Artificial
  CRISPR gRNA sequence
gaggggccggggtggaatga

SEQ ID NO: 552049 - DNA, 20 bp, Artificial
  CRISPR gRNA sequence
ggagataattgaatcatgag

SEQ ID NO: 552050 - DNA, 20 bp, Artificial
  CRISPR gRNA sequence
gaataagtctcacaagatct

SEQ ID NO: 552051 - DNA, 20 bp, Artificial
  CRISPR gRNA sequence
ctgccaccattaagacatga

SEQ ID NO: 552052 - DNA, 20 bp, Artificial
  CRISPR gRNA sequence
tgcttctcctttgccttctg

SEQ ID NO: 552053 - DNA, 20 bp, Artificial
  CRISPR gRNA sequence
tttgccttctgccatgattg

SEQ ID NO: 552054 - DNA, 20 bp, Artificial
  CRISPR gRNA sequence
gaggctgagatgagcctggc

SEQ ID NO: 552055 - DNA, 20 bp, Artificial
  CRISPR gRNA sequence
tattgccaactatctgcata

SEQ ID NO: 552056 - DNA, 20 bp, Artificial
  CRISPR gRNA sequence
ttaaaattttccttatattg

SEQ ID NO: 552057 - DNA, 20 bp, Artificial
  CRISPR gRNA sequence
gatctgtttttttttaatag

SEQ ID NO: 552058 - DNA, 20 bp, Artificial
  CRISPR gRNA sequence
ttattatgtgagacttgttc

SEQ ID NO: 552059 - DNA, 20 bp, Artificial
  CRISPR gRNA sequence
ggagttgagacttagacagt

SEQ ID NO: 552060 - DNA, 20 bp, Artificial
  CRISPR gRNA sequence
tacctgctctgtgccaggag

SEQ ID NO: 552061 - DNA, 20 bp, Artificial
  CRISPR gRNA sequence
ctctgtgccaggagctatgc

SEQ ID NO: 552062 - DNA, 20 bp, Artificial
  CRISPR gRNA sequence
ggagctatgcttcagatttg

SEQ ID NO: 552063 - DNA, 20 bp, Artificial
  CRISPR gRNA sequence
atgtttttatttaattgtca

SEQ ID NO: 552064 - DNA, 20 bp, Artificial
  CRISPR gRNA sequence
gggaacatttaataggagaa

SEQ ID NO: 552065 - DNA, 20 bp, Artificial
  CRISPR gRNA sequence
agtggcagagtgaacttgaa

SEQ ID NO: 552066 - DNA, 20 bp, Artificial
  CRISPR gRNA sequence
aactttttgaagatgagtac

SEQ ID NO: 552067 - DNA, 20 bp, Artificial
  CRISPR gRNA sequence
tcataatttgtaatggtgag

SEQ ID NO: 552068 - DNA, 20 bp, Artificial
  CRISPR gRNA sequence
tcacctaacttttacccgta

SEQ ID NO: 552069 - DNA, 20 bp, Artificial
  CRISPR gRNA sequence
gttaaaaaacccggatctaa

SEQ ID NO: 552070 - DNA, 20 bp, Artificial
  CRISPR gRNA sequence
ttcactcattgtattcgttg

SEQ ID NO: 552071 - DNA, 20 bp, Artificial
  CRISPR gRNA sequence
ttgtattcgttgctatgttt

SEQ ID NO: 552072 - DNA, 20 bp, Artificial
  CRISPR gRNA sequence
aattttgatgggcatctttc

SEQ ID NO: 552073 - DNA, 20 bp, Artificial
  CRISPR gRNA sequence
cttagaacctctttttaaga

SEQ ID NO: 552074 - DNA, 20 bp, Artificial
  CRISPR gRNA sequence
ctaacatttctttagtaaat

SEQ ID NO: 552075 - DNA, 20 bp, Artificial
  CRISPR gRNA sequence
tacaggctttgagggtaggt

SEQ ID NO: 552076 - DNA, 20 bp, Artificial
  CRISPR gRNA sequence
ttgagggtaggtattggttt

SEQ ID NO: 552077 - DNA, 20 bp, Artificial
  CRISPR gRNA sequence
ataaatcagcccttatatgt

SEQ ID NO: 552078 - DNA, 20 bp, Artificial
  CRISPR gRNA sequence
tatgtgtaagttttctgcct

SEQ ID NO: 552079 - DNA, 20 bp, Artificial
  CRISPR gRNA sequence
tgccttttggtttcttctca

SEQ ID NO: 552080 - DNA, 20 bp, Artificial
  CRISPR gRNA sequence
tgctgtttctgcacaagtgc

SEQ ID NO: 552081 - DNA, 20 bp, Artificial
  CRISPR gRNA sequence
cacaagtgcctaagcttttt

SEQ ID NO: 552082 - DNA, 20 bp, Artificial
  CRISPR gRNA sequence
ctttacttgaggggtgacca

SEQ ID NO: 552083 - DNA, 20 bp, Artificial
  CRISPR gRNA sequence
tgtaagtgaaaccaggatgc

SEQ ID NO: 552084 - DNA, 20 bp, Artificial
  CRISPR gRNA sequence
ttctcttttctcagataagt

SEQ ID NO: 552085 - DNA, 20 bp, Artificial
  CRISPR gRNA sequence
tgcccatcagcctccaagga

SEQ ID NO: 552086 - DNA, 20 bp, Artificial
  CRISPR gRNA sequence
actttataggttctagtgaa

SEQ ID NO: 552087 - DNA, 20 bp, Artificial
  CRISPR gRNA sequence
aatgttccccaaaatgtctg

SEQ ID NO: 552088 - DNA, 20 bp, Artificial
  CRISPR gRNA sequence
ttccactgggctgaccagtc

SEQ ID NO: 552089 - DNA, 20 bp, Artificial
  CRISPR gRNA sequence
gttaaaaattagaagaaaat

SEQ ID NO: 552090 - DNA, 20 bp, Artificial
  CRISPR gRNA sequence
cattcagaaaaaaataaaaa

SEQ ID NO: 552091 - DNA, 20 bp, Artificial
  CRISPR gRNA sequence
ccattgtaaactacttgcaa

SEQ ID NO: 552092 - DNA, 20 bp, Artificial
  CRISPR gRNA sequence
actgagtatctagaaaataa

SEQ ID NO: 552093 - DNA, 20 bp, Artificial
  CRISPR gRNA sequence
ccttgaatcagactttggag

SEQ ID NO: 552094 - DNA, 20 bp, Artificial
  CRISPR gRNA sequence
taggttggtgcaaaagttat

SEQ ID NO: 552095 - DNA, 20 bp, Artificial
  CRISPR gRNA sequence
tactacaaaaaaatattaac

SEQ ID NO: 552096 - DNA, 20 bp, Artificial
  CRISPR gRNA sequence
ccactttttaataccaggtc

SEQ ID NO: 552097 - DNA, 20 bp, Artificial
  CRISPR gRNA sequence
ttgtagctggtagctacttt

SEQ ID NO: 552098 - DNA, 20 bp, Artificial
  CRISPR gRNA sequence
agaaggaaagtacagaaaga

SEQ ID NO: 552099 - DNA, 20 bp, Artificial
  CRISPR gRNA sequence
cttgatgaacttatcgagga

SEQ ID NO: 552100 - DNA, 20 bp, Artificial
  CRISPR gRNA sequence
ttgctctggccttggggacc

SEQ ID NO: 552101 - DNA, 20 bp, Artificial
  CRISPR gRNA sequence
accgttgggagacaggtggc

SEQ ID NO: 552102 - DNA, 20 bp, Artificial
  CRISPR gRNA sequence
ccatttcttcatctgtagcc

SEQ ID NO: 552103 - DNA, 20 bp, Artificial
  CRISPR gRNA sequence
agatgttcttaggctcgctc

SEQ ID NO: 552104 - DNA, 20 bp, Artificial
  CRISPR gRNA sequence
agtactcctcagcccccaca

SEQ ID NO: 552105 - DNA, 20 bp, Artificial
  CRISPR gRNA sequence
aaaaatagactccaagaggg

SEQ ID NO: 552106 - DNA, 20 bp, Artificial
  CRISPR gRNA sequence
tccaagagggctgggatttt

SEQ ID NO: 552107 - DNA, 20 bp, Artificial
  CRISPR gRNA sequence
tttgttcattgctatatcct

SEQ ID NO: 552108 - DNA, 20 bp, Artificial
  CRISPR gRNA sequence
gaactacctcagagttgagt

SEQ ID NO: 552109 - DNA, 20 bp, Artificial
  CRISPR gRNA sequence
acacaaacagctcttggaac

SEQ ID NO: 552110 - DNA, 20 bp, Artificial
  CRISPR gRNA sequence
gctgagctggcctagggctc

SEQ ID NO: 552111 - DNA, 20 bp, Artificial
  CRISPR gRNA sequence
aagagtcacaactgtatgaa

SEQ ID NO: 552112 - DNA, 20 bp, Artificial
  CRISPR gRNA sequence
attactagcctagacatttt

SEQ ID NO: 552113 - DNA, 20 bp, Artificial
  CRISPR gRNA sequence
tatgggtgtgtagatagaga

SEQ ID NO: 552114 - DNA, 20 bp, Artificial
  CRISPR gRNA sequence
tgtagatagagatgttgctt

SEQ ID NO: 552115 - DNA, 20 bp, Artificial
  CRISPR gRNA sequence
gccccaagaccctgctatct

SEQ ID NO: 552116 - DNA, 20 bp, Artificial
  CRISPR gRNA sequence
ctgctatctctgggcttgca

SEQ ID NO: 552117 - DNA, 20 bp, Artificial
  CRISPR gRNA sequence
agagaagtatcttaaaatta

SEQ ID NO: 552118 - DNA, 20 bp, Artificial
  CRISPR gRNA sequence
ctttccttcaaatcccggaa

SEQ ID NO: 552119 - DNA, 20 bp, Artificial
  CRISPR gRNA sequence
cttcaaatcccggaagagtg

SEQ ID NO: 552120 - DNA, 20 bp, Artificial
  CRISPR gRNA sequence
cattggctgggcatggtggc

SEQ ID NO: 552121 - DNA, 20 bp, Artificial
  CRISPR gRNA sequence
gaggaggatcacttgagccc

SEQ ID NO: 552122 - DNA, 20 bp, Artificial
  CRISPR gRNA sequence
gcctgagcaacatagtgaga

SEQ ID NO: 552123 - DNA, 20 bp, Artificial
  CRISPR gRNA sequence
gaggttgaagctacagtgag

SEQ ID NO: 552124 - DNA, 20 bp, Artificial
  CRISPR gRNA sequence
ctcaaaccatagcgaggctg

SEQ ID NO: 552125 - DNA, 20 bp, Artificial
  CRISPR gRNA sequence
aaccatagcgaggctgttaa

SEQ ID NO: 552126 - DNA, 20 bp, Artificial
  CRISPR gRNA sequence
gctgacatccatgagtgggt

SEQ ID NO: 552127 - DNA, 20 bp, Artificial
  CRISPR gRNA sequence
ggagcccgcaggtcctccca

SEQ ID NO: 552128 - DNA, 20 bp, Artificial
  CRISPR gRNA sequence
aagtggggctgaaaaactga

SEQ ID NO: 552129 - DNA, 20 bp, Artificial
  CRISPR gRNA sequence
cagccaggttccacagcaat

SEQ ID NO: 552130 - DNA, 20 bp, Artificial
  CRISPR gRNA sequence
atttgggatttcacaaagcc

SEQ ID NO: 552131 - DNA, 20 bp, Artificial
  CRISPR gRNA sequence
tggctggggttacccctaag

SEQ ID NO: 552132 - DNA, 20 bp, Artificial
  CRISPR gRNA sequence
tttcacacaaaatgtgaata

SEQ ID NO: 552133 - DNA, 20 bp, Artificial
  CRISPR gRNA sequence
ggaacctggcaatggtgggc

SEQ ID NO: 552134 - DNA, 20 bp, Artificial
  CRISPR gRNA sequence
ggcaggagctgaggcacagc

SEQ ID NO: 552135 - DNA, 20 bp, Artificial
  CRISPR gRNA sequence
taatgcgtcatttgccacag

SEQ ID NO: 552136 - DNA, 20 bp, Artificial
  CRISPR gRNA sequence
gttctgtttctttgtgactc

SEQ ID NO: 552137 - DNA, 20 bp, Artificial
  CRISPR gRNA sequence
tctttgtgactcctttgttt

SEQ ID NO: 552138 - DNA, 20 bp, Artificial
  CRISPR gRNA sequence
ttgtttgctcgttttctttt

SEQ ID NO: 552139 - DNA, 20 bp, Artificial
  CRISPR gRNA sequence
tttctttttattgtttctgg

SEQ ID NO: 552140 - DNA, 20 bp, Artificial
  CRISPR gRNA sequence
ccctcttcagctctagcatt

SEQ ID NO: 552141 - DNA, 20 bp, Artificial
  CRISPR gRNA sequence
attcgatgatttggaaacca

SEQ ID NO: 552142 - DNA, 20 bp, Artificial
  CRISPR gRNA sequence
cagagcttagtgcctcacct

SEQ ID NO: 552143 - DNA, 20 bp, Artificial
  CRISPR gRNA sequence
cctcacctgtaggtttggag

SEQ ID NO: 552144 - DNA, 20 bp, Artificial
  CRISPR gRNA sequence
aggtttggaggtgtgcttaa

SEQ ID NO: 552145 - DNA, 20 bp, Artificial
  CRISPR gRNA sequence
tctgctgttccaatgctgtc

SEQ ID NO: 552146 - DNA, 20 bp, Artificial
  CRISPR gRNA sequence
taagaaacaatggttaagag

SEQ ID NO: 552147 - DNA, 20 bp, Artificial
  CRISPR gRNA sequence
ttaagagcactgattctgca

SEQ ID NO: 552148 - DNA, 20 bp, Artificial
  CRISPR gRNA sequence
tcagattgtccaggttcaaa

SEQ ID NO: 552149 - DNA, 20 bp, Artificial
  CRISPR gRNA sequence
attacttaacattgttgtgc

SEQ ID NO: 552150 - DNA, 20 bp, Artificial
  CRISPR gRNA sequence
ttagaaataaaaccttctta

SEQ ID NO: 552151 - DNA, 20 bp, Artificial
  CRISPR gRNA sequence
aaaaccttcttaatatgttt

SEQ ID NO: 552152 - DNA, 20 bp, Artificial
  CRISPR gRNA sequence
ttcttaatatgtttttagga

SEQ ID NO: 552153 - DNA, 20 bp, Artificial
  CRISPR gRNA sequence
aacctccacctcccgggttc

SEQ ID NO: 552154 - DNA, 20 bp, Artificial
  CRISPR gRNA sequence
tgcctcagcctcccatgtaa

SEQ ID NO: 552155 - DNA, 20 bp, Artificial
  CRISPR gRNA sequence
ttttgtatttttagtagaga

SEQ ID NO: 552156 - DNA, 20 bp, Artificial
  CRISPR gRNA sequence
tgccttggcctcccaaagtg

SEQ ID NO: 552157 - DNA, 20 bp, Artificial
  CRISPR gRNA sequence
agagccagggccatacaagt

SEQ ID NO: 552158 - DNA, 20 bp, Artificial
  CRISPR gRNA sequence
ttaacccatagttaacggtg

SEQ ID NO: 552159 - DNA, 20 bp, Artificial
  CRISPR gRNA sequence
aactattaaaattgaggtgt

SEQ ID NO: 552160 - DNA, 20 bp, Artificial
  CRISPR gRNA sequence
aacagaatatttgagatcag

SEQ ID NO: 552161 - DNA, 20 bp, Artificial
  CRISPR gRNA sequence
tgatcactctatacatgtag

SEQ ID NO: 552162 - DNA, 20 bp, Artificial
  CRISPR gRNA sequence
ttttccctccctccatctct

SEQ ID NO: 552163 - DNA, 20 bp, Artificial
  CRISPR gRNA sequence
acaatcttttatggtgggca

SEQ ID NO: 552164 - DNA, 20 bp, Artificial
  CRISPR gRNA sequence
gggagttcaccctgggcctt

SEQ ID NO: 552165 - DNA, 20 bp, Artificial
  CRISPR gRNA sequence
cattcattcattcgttcatc

SEQ ID NO: 552166 - DNA, 20 bp, Artificial
  CRISPR gRNA sequence
cacacaaagtagaggtagat

SEQ ID NO: 552167 - DNA, 20 bp, Artificial
  CRISPR gRNA sequence
ttctatttaaaaaaaattta

SEQ ID NO: 552168 - DNA, 20 bp, Artificial
  CRISPR gRNA sequence
gccaccacatctggcctctt

SEQ ID NO: 552169 - DNA, 20 bp, Artificial
  CRISPR gRNA sequence
ccaataataaaaggagaata

SEQ ID NO: 552170 - DNA, 20 bp, Artificial
  CRISPR gRNA sequence
taagccatggcataatacta

SEQ ID NO: 552171 - DNA, 20 bp, Artificial
  CRISPR gRNA sequence
ctaaattgtttaactattag

SEQ ID NO: 552172 - DNA, 20 bp, Artificial
  CRISPR gRNA sequence
tctctttatgtaggttatac

SEQ ID NO: 552173 - DNA, 20 bp, Artificial
  CRISPR gRNA sequence
agcaaaaataaattgtatgc

SEQ ID NO: 552174 - DNA, 20 bp, Artificial
  CRISPR gRNA sequence
gtatgcatgtgtttttgtat

SEQ ID NO: 552175 - DNA, 20 bp, Artificial
  CRISPR gRNA sequence
gtttttgtatgtgtgtttaa

SEQ ID NO: 552176 - DNA, 20 bp, Artificial
  CRISPR gRNA sequence
tctctctcagtctccttagc

SEQ ID NO: 552177 - DNA, 20 bp, Artificial
  CRISPR gRNA sequence
gccagtgttttcccctctag

SEQ ID NO: 552178 - DNA, 20 bp, Artificial
  CRISPR gRNA sequence
acttagcagctactgggcat

SEQ ID NO: 552179 - DNA, 20 bp, Artificial
  CRISPR gRNA sequence
ggccagtcttagtcttcctg

SEQ ID NO: 552180 - DNA, 20 bp, Artificial
  CRISPR gRNA sequence
cacctaggaggaagtaagag

SEQ ID NO: 552181 - DNA, 20 bp, Artificial
  CRISPR gRNA sequence
gctgtcaatcatctagttct

SEQ ID NO: 552182 - DNA, 20 bp, Artificial
  CRISPR gRNA sequence
tccaaatcaacaagcagaag

SEQ ID NO: 552183 - DNA, 20 bp, Artificial
  CRISPR gRNA sequence
agtgttcatcagtggtggat

SEQ ID NO: 552184 - DNA, 20 bp, Artificial
  CRISPR gRNA sequence
gaataaagtatagctatacc

SEQ ID NO: 552185 - DNA, 20 bp, Artificial
  CRISPR gRNA sequence
agctataccagttgatttca

SEQ ID NO: 552186 - DNA, 20 bp, Artificial
  CRISPR gRNA sequence
tttattgcacttcacagata

SEQ ID NO: 552187 - DNA, 20 bp, Artificial
  CRISPR gRNA sequence
aaattgaaggttcgtgacaa

SEQ ID NO: 552188 - DNA, 20 bp, Artificial
  CRISPR gRNA sequence
aagtccatcagtgcctaact

SEQ ID NO: 552189 - DNA, 20 bp, Artificial
  CRISPR gRNA sequence
ttagtaattcccacaatatt

SEQ ID NO: 552190 - DNA, 20 bp, Artificial
  CRISPR gRNA sequence
atctttgatgttactgttgt

SEQ ID NO: 552191 - DNA, 20 bp, Artificial
  CRISPR gRNA sequence
ggccaatttaataaccctgc

SEQ ID NO: 552192 - DNA, 20 bp, Artificial
  CRISPR gRNA sequence
cactttaaattaaaaactag

SEQ ID NO: 552193 - DNA, 20 bp, Artificial
  CRISPR gRNA sequence
aaattaaaaactagaaatga

SEQ ID NO: 552194 - DNA, 20 bp, Artificial
  CRISPR gRNA sequence
tgggtggatcacctgaggtc

SEQ ID NO: 552195 - DNA, 20 bp, Artificial
  CRISPR gRNA sequence
ttgggaggctgaggcaggag

SEQ ID NO: 552196 - DNA, 20 bp, Artificial
  CRISPR gRNA sequence
aggtgagaaagctgcaggag

SEQ ID NO: 552197 - DNA, 20 bp, Artificial
  CRISPR gRNA sequence
caagaaattatccagaagat

SEQ ID NO: 552198 - DNA, 20 bp, Artificial
  CRISPR gRNA sequence
tggtgcaggatacatgaaac

SEQ ID NO: 552199 - DNA, 20 bp, Artificial
  CRISPR gRNA sequence
ctagacaggagaagtcaact

SEQ ID NO: 552200 - DNA, 20 bp, Artificial
  CRISPR gRNA sequence
taagaattaggctaaatcta

SEQ ID NO: 552201 - DNA, 20 bp, Artificial
  CRISPR gRNA sequence
aacaggctggatgacagcac

SEQ ID NO: 552202 - DNA, 20 bp, Artificial
  CRISPR gRNA sequence
gacagcacatctgtttacag

SEQ ID NO: 552203 - DNA, 20 bp, Artificial
  CRISPR gRNA sequence
gtaagcccactgttaatact

SEQ ID NO: 552204 - DNA, 20 bp, Artificial
  CRISPR gRNA sequence
aatacttactgcttagaaaa

SEQ ID NO: 552205 - DNA, 20 bp, Artificial
  CRISPR gRNA sequence
aaagattcatttcagtatat

SEQ ID NO: 552206 - DNA, 20 bp, Artificial
  CRISPR gRNA sequence
gagatgtacaaggagatgag

SEQ ID NO: 552207 - DNA, 20 bp, Artificial
  CRISPR gRNA sequence
caaggagatgagtgttgttt

SEQ ID NO: 552208 - DNA, 20 bp, Artificial
  CRISPR gRNA sequence
agtaaattgacaaccttctg

SEQ ID NO: 552209 - DNA, 20 bp, Artificial
  CRISPR gRNA sequence
atcaaaatatcaacattaac

SEQ ID NO: 552210 - DNA, 20 bp, Artificial
  CRISPR gRNA sequence
attaacaggagtttggaaga

SEQ ID NO: 552211 - DNA, 20 bp, Artificial
  CRISPR gRNA sequence
gtcaaaatatcaatattaac

SEQ ID NO: 552212 - DNA, 20 bp, Artificial
  CRISPR gRNA sequence
attaacaggagtttggaaga

SEQ ID NO: 552213 - DNA, 20 bp, Artificial
  CRISPR gRNA sequence
tgaaaattgagccaatgagg

SEQ ID NO: 552214 - DNA, 20 bp, Artificial
  CRISPR gRNA sequence
tcttatggatgagcaaagaa

SEQ ID NO: 552215 - DNA, 20 bp, Artificial
  CRISPR gRNA sequence
cctggtgaagatgctgtgaa

SEQ ID NO: 552216 - DNA, 20 bp, Artificial
  CRISPR gRNA sequence
atttagttgataaagcagca

SEQ ID NO: 552217 - DNA, 20 bp, Artificial
  CRISPR gRNA sequence
aaatttactctaattttgaa

SEQ ID NO: 552218 - DNA, 20 bp, Artificial
  CRISPR gRNA sequence
ttaggacttgctgaaggctc

SEQ ID NO: 552219 - DNA, 20 bp, Artificial
  CRISPR gRNA sequence
gaaggctcaaatgattgtta

SEQ ID NO: 552220 - DNA, 20 bp, Artificial
  CRISPR gRNA sequence
tttttaattaaatatgtaca

SEQ ID NO: 552221 - DNA, 20 bp, Artificial
  CRISPR gRNA sequence
cacactttactctgatattt

SEQ ID NO: 552222 - DNA, 20 bp, Artificial
  CRISPR gRNA sequence
gtgtatccattatatgtgat

SEQ ID NO: 552223 - DNA, 20 bp, Artificial
  CRISPR gRNA sequence
gaaaaatattgaaagatgta

SEQ ID NO: 552224 - DNA, 20 bp, Artificial
  CRISPR gRNA sequence
gatgtattctgatttgttaa

SEQ ID NO: 552225 - DNA, 20 bp, Artificial
  CRISPR gRNA sequence
gttaatgtagattatagaac

SEQ ID NO: 552226 - DNA, 20 bp, Artificial
  CRISPR gRNA sequence
gactgaaaaaatacttatat

SEQ ID NO: 552227 - DNA, 20 bp, Artificial
  CRISPR gRNA sequence
tgtatgtgtctatgtataat

SEQ ID NO: 552228 - DNA, 20 bp, Artificial
  CRISPR gRNA sequence
ttactcttattttgtcccca

SEQ ID NO: 552229 - DNA, 20 bp, Artificial
  CRISPR gRNA sequence
catcctgtttgaaactcttc

SEQ ID NO: 552230 - DNA, 20 bp, Artificial
  CRISPR gRNA sequence
tctttacttcaatactagaa

SEQ ID NO: 552231 - DNA, 20 bp, Artificial
  CRISPR gRNA sequence
tacttcaatactagaattgt

SEQ ID NO: 552232 - DNA, 20 bp, Artificial
  CRISPR gRNA sequence
tgatgccttgcaagggctgg

SEQ ID NO: 552233 - DNA, 20 bp, Artificial
  CRISPR gRNA sequence
ggctgtgcttgtgtatgcag

SEQ ID NO: 552234 - DNA, 20 bp, Artificial
  CRISPR gRNA sequence
tacttttctcatgccattgc

SEQ ID NO: 552235 - DNA, 20 bp, Artificial
  CRISPR gRNA sequence
ctctcctgggcatagttaac

SEQ ID NO: 552236 - DNA, 20 bp, Artificial
  CRISPR gRNA sequence
taaatgttcttattgacacc

SEQ ID NO: 552237 - DNA, 20 bp, Artificial
  CRISPR gRNA sequence
aaggtgatatgcctcttgga

SEQ ID NO: 552238 - DNA, 20 bp, Artificial
  CRISPR gRNA sequence
taatttgactaaataatttt

SEQ ID NO: 552239 - DNA, 20 bp, Artificial
  CRISPR gRNA sequence
tcagaaaaactcttctagac

SEQ ID NO: 552240 - DNA, 20 bp, Artificial
  CRISPR gRNA sequence
caaaaacaaagataaataga

SEQ ID NO: 552241 - DNA, 20 bp, Artificial
  CRISPR gRNA sequence
aatagatggggcttaaatta

SEQ ID NO: 552242 - DNA, 20 bp, Artificial
  CRISPR gRNA sequence
gtaaactagtacaaccacta

SEQ ID NO: 552243 - DNA, 20 bp, Artificial
  CRISPR gRNA sequence
ttgttcaagggtcaactgta

SEQ ID NO: 552244 - DNA, 20 bp, Artificial
  CRISPR gRNA sequence
tcttcatgccgccagggtat

SEQ ID NO: 552245 - DNA, 20 bp, Artificial
  CRISPR gRNA sequence
ccaccctgccctctatcact

SEQ ID NO: 552246 - DNA, 20 bp, Artificial
  CRISPR gRNA sequence
tttacatttataagacattt

SEQ ID NO: 552247 - DNA, 20 bp, Artificial
  CRISPR gRNA sequence
aaagcaatggaaagatgctg

SEQ ID NO: 552248 - DNA, 20 bp, Artificial
  CRISPR gRNA sequence
tagataaacaaatgggtgat

SEQ ID NO: 552249 - DNA, 20 bp, Artificial
  CRISPR gRNA sequence
tacaactggtcattcagtgt

SEQ ID NO: 552250 - DNA, 20 bp, Artificial
  CRISPR gRNA sequence
taatgttaacttaaaatagc

SEQ ID NO: 552251 - DNA, 20 bp, Artificial
  CRISPR gRNA sequence
aacttaaaatagctgcagtt

SEQ ID NO: 552252 - DNA, 20 bp, Artificial
  CRISPR gRNA sequence
taaaatagctgcagtttttt

SEQ ID NO: 552253 - DNA, 20 bp, Artificial
  CRISPR gRNA sequence
gctgactgcaatctctgcct

SEQ ID NO: 552254 - DNA, 20 bp, Artificial
  CRISPR gRNA sequence
ttttgtacttttcgtaaaga

SEQ ID NO: 552255 - DNA, 20 bp, Artificial
  CRISPR gRNA sequence
cccaatcttgtggttctaat

SEQ ID NO: 552256 - DNA, 20 bp, Artificial
  CRISPR gRNA sequence
ggttctgatgtgaagcatta

SEQ ID NO: 552257 - DNA, 20 bp, Artificial
  CRISPR gRNA sequence
taatcttcatcacaccctcg

SEQ ID NO: 552258 - DNA, 20 bp, Artificial
  CRISPR gRNA sequence
ccctcgacttgcttcccagc

SEQ ID NO: 552259 - DNA, 20 bp, Artificial
  CRISPR gRNA sequence
ctccagcatctcctgagtct

SEQ ID NO: 552260 - DNA, 20 bp, Artificial
  CRISPR gRNA sequence
agtcttgttaaaaacctttc

SEQ ID NO: 552261 - DNA, 20 bp, Artificial
  CRISPR gRNA sequence
tcagggccttcctttggggg

SEQ ID NO: 552262 - DNA, 20 bp, Artificial
  CRISPR gRNA sequence
cctaactgccttttatcctt

SEQ ID NO: 552263 - DNA, 20 bp, Artificial
  CRISPR gRNA sequence
catgaatgtcgggtccattt

SEQ ID NO: 552264 - DNA, 20 bp, Artificial
  CRISPR gRNA sequence
tttcttggatttatgcaggt

SEQ ID NO: 552265 - DNA, 20 bp, Artificial
  CRISPR gRNA sequence
tacttcctgtattttgtgtc

SEQ ID NO: 552266 - DNA, 20 bp, Artificial
  CRISPR gRNA sequence
gtattttgtgtcagcagttt

SEQ ID NO: 552267 - DNA, 20 bp, Artificial
  CRISPR gRNA sequence
aatttctgccaccaaagtca

SEQ ID NO: 552268 - DNA, 20 bp, Artificial
  CRISPR gRNA sequence
aaccaatttttttttctctc

SEQ ID NO: 552269 - DNA, 20 bp, Artificial
  CRISPR gRNA sequence
tttctctcctaggtttcatc

SEQ ID NO: 552270 - DNA, 20 bp, Artificial
  CRISPR gRNA sequence
gaactggaaaattctgaatt

SEQ ID NO: 552271 - DNA, 20 bp, Artificial
  CRISPR gRNA sequence
gctttctcatcttttaaaaa

SEQ ID NO: 552272 - DNA, 20 bp, Artificial
  CRISPR gRNA sequence
taccatgaagttctttcttt

SEQ ID NO: 552273 - DNA, 20 bp, Artificial
  CRISPR gRNA sequence
tgcttggtgagtattccata

SEQ ID NO: 552274 - DNA, 20 bp, Artificial
  CRISPR gRNA sequence
ggtgagtattccataagttg

SEQ ID NO: 552275 - DNA, 20 bp, Artificial
  CRISPR gRNA sequence
ggcaaatttccattttttta

SEQ ID NO: 552276 - DNA, 20 bp, Artificial
  CRISPR gRNA sequence
aattagatgttacctgttgt

SEQ ID NO: 552277 - DNA, 20 bp, Artificial
  CRISPR gRNA sequence
agtatcagttgtcttactag

SEQ ID NO: 552278 - DNA, 20 bp, Artificial
  CRISPR gRNA sequence
aaagagatgtagtgacagca

SEQ ID NO: 552279 - DNA, 20 bp, Artificial
  CRISPR gRNA sequence
tagatgttactctataaagt

SEQ ID NO: 552280 - DNA, 20 bp, Artificial
  CRISPR gRNA sequence
tcctgcttccccacacagcg

SEQ ID NO: 552281 - DNA, 20 bp, Artificial
  CRISPR gRNA sequence
gcttccccacacagcgggga

SEQ ID NO: 552282 - DNA, 20 bp, Artificial
  CRISPR gRNA sequence
acctctgcctcccaggttca

SEQ ID NO: 552283 - DNA, 20 bp, Artificial
  CRISPR gRNA sequence
tttttgtattttagtagaga

SEQ ID NO: 552284 - DNA, 20 bp, Artificial
  CRISPR gRNA sequence
cgcctcagcctcccaaagtg

SEQ ID NO: 552285 - DNA, 20 bp, Artificial
  CRISPR gRNA sequence
gagagaggggacacatttct

SEQ ID NO: 552286 - DNA, 20 bp, Artificial
  CRISPR gRNA sequence
taggcccctgcctcacatgc

SEQ ID NO: 552287 - DNA, 20 bp, Artificial
  CRISPR gRNA sequence
tttaaggcctgcctcatttt

SEQ ID NO: 552288 - DNA, 20 bp, Artificial
  CRISPR gRNA sequence
ctcagtccgttgcagacaca

SEQ ID NO: 552289 - DNA, 20 bp, Artificial
  CRISPR gRNA sequence
cttagcttccttgctccttt

SEQ ID NO: 552290 - DNA, 20 bp, Artificial
  CRISPR gRNA sequence
tggcttgtcatactcgcatg

SEQ ID NO: 552291 - DNA, 20 bp, Artificial
  CRISPR gRNA sequence
actcgcatggccagattaca

SEQ ID NO: 552292 - DNA, 20 bp, Artificial
  CRISPR gRNA sequence
gattacagctagattaagtc

SEQ ID NO: 552293 - DNA, 20 bp, Artificial
  CRISPR gRNA sequence
tctagactgactcttcagct

SEQ ID NO: 552294 - DNA, 20 bp, Artificial
  CRISPR gRNA sequence
actgactcttcagctgaagg

SEQ ID NO: 552295 - DNA, 20 bp, Artificial
  CRISPR gRNA sequence
cccatacctgagcctgtagg

SEQ ID NO: 552296 - DNA, 20 bp, Artificial
  CRISPR gRNA sequence
cgtcctcgggaatatcaccc

SEQ ID NO: 552297 - DNA, 20 bp, Artificial
  CRISPR gRNA sequence
tcacttttaacccactccaa

SEQ ID NO: 552298 - DNA, 20 bp, Artificial
  CRISPR gRNA sequence
catgtcattcttgacttctc

SEQ ID NO: 552299 - DNA, 20 bp, Artificial
  CRISPR gRNA sequence
catccaggataccaccctat

SEQ ID NO: 552300 - DNA, 20 bp, Artificial
  CRISPR gRNA sequence
tttctcttttttccttgaga

SEQ ID NO: 552301 - DNA, 20 bp, Artificial
  CRISPR gRNA sequence
tgcctcagcctcctgaacag

SEQ ID NO: 552302 - DNA, 20 bp, Artificial
  CRISPR gRNA sequence
ttttgtatttttagtagaga

SEQ ID NO: 552303 - DNA, 20 bp, Artificial
  CRISPR gRNA sequence
tgccttggcctcccaaagtg

SEQ ID NO: 552304 - DNA, 20 bp, Artificial
  CRISPR gRNA sequence
tacaggtgtgagccactgtg

SEQ ID NO: 552305 - DNA, 20 bp, Artificial
  CRISPR gRNA sequence
taacacactgactattcctt

SEQ ID NO: 552306 - DNA, 20 bp, Artificial
  CRISPR gRNA sequence
attccttttcagcttctttt

SEQ ID NO: 552307 - DNA, 20 bp, Artificial
  CRISPR gRNA sequence
tcagcttcttttgctagttt

SEQ ID NO: 552308 - DNA, 20 bp, Artificial
  CRISPR gRNA sequence
cctcttaacactggaaacat

SEQ ID NO: 552309 - DNA, 20 bp, Artificial
  CRISPR gRNA sequence
tgggtgagctcatcccatgt

SEQ ID NO: 552310 - DNA, 20 bp, Artificial
  CRISPR gRNA sequence
gtggactctatttagacaaa

SEQ ID NO: 552311 - DNA, 20 bp, Artificial
  CRISPR gRNA sequence
agatgtcaaagtatcctctt

SEQ ID NO: 552312 - DNA, 20 bp, Artificial
  CRISPR gRNA sequence
atagatagggccaacaaaca

SEQ ID NO: 552313 - DNA, 20 bp, Artificial
  CRISPR gRNA sequence
cattttaagagcccttttta

SEQ ID NO: 552314 - DNA, 20 bp, Artificial
  CRISPR gRNA sequence
ttctcctcttaaacttgatg

SEQ ID NO: 552315 - DNA, 20 bp, Artificial
  CRISPR gRNA sequence
ttgtgaggctgaggagggag

SEQ ID NO: 552316 - DNA, 20 bp, Artificial
  CRISPR gRNA sequence
gaggctgaggctgcagtgag

SEQ ID NO: 552317 - DNA, 20 bp, Artificial
  CRISPR gRNA sequence
ctatggcacctcagcaaagg

SEQ ID NO: 552318 - DNA, 20 bp, Artificial
  CRISPR gRNA sequence
aggagtaaagtacaggggag

SEQ ID NO: 552319 - DNA, 20 bp, Artificial
  CRISPR gRNA sequence
ttgagtgtgggacttaaagt

SEQ ID NO: 552320 - DNA, 20 bp, Artificial
  CRISPR gRNA sequence
cctggtttgagagtctggac

SEQ ID NO: 552321 - DNA, 20 bp, Artificial
  CRISPR gRNA sequence
acttgataaaatacattttt

SEQ ID NO: 552322 - DNA, 20 bp, Artificial
  CRISPR gRNA sequence
atgtgatggtgcatacttat

SEQ ID NO: 552323 - DNA, 20 bp, Artificial
  CRISPR gRNA sequence
caagaaagagtctgcaagat

SEQ ID NO: 552324 - DNA, 20 bp, Artificial
  CRISPR gRNA sequence
taaaaagacataagatgact

SEQ ID NO: 552325 - DNA, 20 bp, Artificial
  CRISPR gRNA sequence
ggtttcacatctgcatgata

SEQ ID NO: 552326 - DNA, 20 bp, Artificial
  CRISPR gRNA sequence
ttccttgaggtaatgttaac

SEQ ID NO: 552327 - DNA, 20 bp, Artificial
  CRISPR gRNA sequence
cagtgagcatattttggaca

SEQ ID NO: 552328 - DNA, 20 bp, Artificial
  CRISPR gRNA sequence
cttctgtgtgtacattgaga

SEQ ID NO: 552329 - DNA, 20 bp, Artificial
  CRISPR gRNA sequence
ccccttaaaatttctacttc

SEQ ID NO: 552330 - DNA, 20 bp, Artificial
  CRISPR gRNA sequence
gaccttcatcacatctcaga

SEQ ID NO: 552331 - DNA, 20 bp, Artificial
  CRISPR gRNA sequence
actgccctgtccttaactgg

SEQ ID NO: 552332 - DNA, 20 bp, Artificial
  CRISPR gRNA sequence
aggaagtaggcacatttctt

SEQ ID NO: 552333 - DNA, 20 bp, Artificial
  CRISPR gRNA sequence
cacatttcttgccagtttaa

SEQ ID NO: 552334 - DNA, 20 bp, Artificial
  CRISPR gRNA sequence
cacgggcagcaagaaaatat

SEQ ID NO: 552335 - DNA, 20 bp, Artificial
  CRISPR gRNA sequence
ctgtgatctaggtgctgcag

SEQ ID NO: 552336 - DNA, 20 bp, Artificial
  CRISPR gRNA sequence
tgtgtaatgagatagccaga

SEQ ID NO: 552337 - DNA, 20 bp, Artificial
  CRISPR gRNA sequence
aagataatactaacacttct

SEQ ID NO: 552338 - DNA, 20 bp, Artificial
  CRISPR gRNA sequence
cccctgaaattactttcata

SEQ ID NO: 552339 - DNA, 20 bp, Artificial
  CRISPR gRNA sequence
gcatgtggcactcagtcata

SEQ ID NO: 552340 - DNA, 20 bp, Artificial
  CRISPR gRNA sequence
cctttcacagatgaaaataa

SEQ ID NO: 552341 - DNA, 20 bp, Artificial
  CRISPR gRNA sequence
gaaaataagacagtttagga

SEQ ID NO: 552342 - DNA, 20 bp, Artificial
  CRISPR gRNA sequence
gtagaacaagagacctggat

SEQ ID NO: 552343 - DNA, 20 bp, Artificial
  CRISPR gRNA sequence
gtcacacagcaggccaaggc

SEQ ID NO: 552344 - DNA, 20 bp, Artificial
  CRISPR gRNA sequence
tcacataccctccggggagc

SEQ ID NO: 552345 - DNA, 20 bp, Artificial
  CRISPR gRNA sequence
gcactacatgttaattcata

SEQ ID NO: 552346 - DNA, 20 bp, Artificial
  CRISPR gRNA sequence
gaggaggaaacctagacaca

SEQ ID NO: 552347 - DNA, 20 bp, Artificial
  CRISPR gRNA sequence
tgggatatgcactcaggcag

SEQ ID NO: 552348 - DNA, 20 bp, Artificial
  CRISPR gRNA sequence
ctgtctccccatctgtcctg

SEQ ID NO: 552349 - DNA, 20 bp, Artificial
  CRISPR gRNA sequence
gtatttttaacaagcaccct

SEQ ID NO: 552350 - DNA, 20 bp, Artificial
  CRISPR gRNA sequence
taggcaccttaaaatttgag

SEQ ID NO: 552351 - DNA, 20 bp, Artificial
  CRISPR gRNA sequence
ggaccatttctaaggaggta

SEQ ID NO: 552352 - DNA, 20 bp, Artificial
  CRISPR gRNA sequence
atttctaaggaggtagaaag

SEQ ID NO: 552353 - DNA, 20 bp, Artificial
  CRISPR gRNA sequence
gaagttaggagagcagggct

SEQ ID NO: 552354 - DNA, 20 bp, Artificial
  CRISPR gRNA sequence
actagagcaacttcttatcc

SEQ ID NO: 552355 - DNA, 20 bp, Artificial
  CRISPR gRNA sequence
agcaacttcttatccattgg

SEQ ID NO: 552356 - DNA, 20 bp, Artificial
  CRISPR gRNA sequence
ccattggattggattgccac

SEQ ID NO: 552357 - DNA, 20 bp, Artificial
  CRISPR gRNA sequence
gatttaattctgagaaattc

SEQ ID NO: 552358 - DNA, 20 bp, Artificial
  CRISPR gRNA sequence
gagaaattccactgcttaaa

SEQ ID NO: 552359 - DNA, 20 bp, Artificial
  CRISPR gRNA sequence
gtatgtaaggacttgtgtga

SEQ ID NO: 552360 - DNA, 20 bp, Artificial
  CRISPR gRNA sequence
aagggaagtcagtgtgtgac

SEQ ID NO: 552361 - DNA, 20 bp, Artificial
  CRISPR gRNA sequence
gagaagatgggggaaccatt

SEQ ID NO: 552362 - DNA, 20 bp, Artificial
  CRISPR gRNA sequence
accattaaatgcttttattt

SEQ ID NO: 552363 - DNA, 20 bp, Artificial
  CRISPR gRNA sequence
acttaaatgctctttttagt

SEQ ID NO: 552364 - DNA, 20 bp, Artificial
  CRISPR gRNA sequence
tgaccattgttgtatattac

SEQ ID NO: 552365 - DNA, 20 bp, Artificial
  CRISPR gRNA sequence
tgtatattacatatgttttt

SEQ ID NO: 552366 - DNA, 20 bp, Artificial
  CRISPR gRNA sequence
tgcatgtttcctcaggcctc

SEQ ID NO: 552367 - DNA, 20 bp, Artificial
  CRISPR gRNA sequence
taggacaaagtaattagcct

SEQ ID NO: 552368 - DNA, 20 bp, Artificial
  CRISPR gRNA sequence
ttatggactttcctttcaca

SEQ ID NO: 552369 - DNA, 20 bp, Artificial
  CRISPR gRNA sequence
ctggcacaattataactcac

SEQ ID NO: 552370 - DNA, 20 bp, Artificial
  CRISPR gRNA sequence
caattataactcactgtagc

SEQ ID NO: 552371 - DNA, 20 bp, Artificial
  CRISPR gRNA sequence
ttgtgttaattcaggtcagg

SEQ ID NO: 552372 - DNA, 20 bp, Artificial
  CRISPR gRNA sequence
tcaggtcaggatttgcagct

SEQ ID NO: 552373 - DNA, 20 bp, Artificial
  CRISPR gRNA sequence
taccaacttgcgaagactct

SEQ ID NO: 552374 - DNA, 20 bp, Artificial
  CRISPR gRNA sequence
tgcgaagactcttttggctt

SEQ ID NO: 552375 - DNA, 20 bp, Artificial
  CRISPR gRNA sequence
ctcttttggcttcagagatt

SEQ ID NO: 552376 - DNA, 20 bp, Artificial
  CRISPR gRNA sequence
ttgatttaagaattgaggat

SEQ ID NO: 552377 - DNA, 20 bp, Artificial
  CRISPR gRNA sequence
gggatttggggcctgtattg

SEQ ID NO: 552378 - DNA, 20 bp, Artificial
  CRISPR gRNA sequence
ctgggtaatttataaagaaa

SEQ ID NO: 552379 - DNA, 20 bp, Artificial
  CRISPR gRNA sequence
catgggaattacaattcaag

SEQ ID NO: 552380 - DNA, 20 bp, Artificial
  CRISPR gRNA sequence
ttctcgctccttgatgctca

SEQ ID NO: 552381 - DNA, 20 bp, Artificial
  CRISPR gRNA sequence
gagtttgtctgctcatcctt

SEQ ID NO: 552382 - DNA, 20 bp, Artificial
  CRISPR gRNA sequence
cgaggacttataatgtactc

SEQ ID NO: 552383 - DNA, 20 bp, Artificial
  CRISPR gRNA sequence
taaataactaaatgtgtcat

SEQ ID NO: 552384 - DNA, 20 bp, Artificial
  CRISPR gRNA sequence
ttttgtatttttagtagaga

SEQ ID NO: 552385 - DNA, 20 bp, Artificial
  CRISPR gRNA sequence
cgcctcggcctcccaaagtg

SEQ ID NO: 552386 - DNA, 20 bp, Artificial
  CRISPR gRNA sequence
agttgtgtactagtacttat

SEQ ID NO: 552387 - DNA, 20 bp, Artificial
  CRISPR gRNA sequence
tggtgagaaaccaacagaga

SEQ ID NO: 552388 - DNA, 20 bp, Artificial
  CRISPR gRNA sequence
accaacagagagagagttta

SEQ ID NO: 552389 - DNA, 20 bp, Artificial
  CRISPR gRNA sequence
acagctagtaagtggcagaa

SEQ ID NO: 552390 - DNA, 20 bp, Artificial
  CRISPR gRNA sequence
ggctatctggctctagagcc

SEQ ID NO: 552391 - DNA, 20 bp, Artificial
  CRISPR gRNA sequence
atggttttaactattcacaa

SEQ ID NO: 552392 - DNA, 20 bp, Artificial
  CRISPR gRNA sequence
actacaggaacatgcatttg

SEQ ID NO: 552393 - DNA, 20 bp, Artificial
  CRISPR gRNA sequence
atcatgacaatctgtcttgg

SEQ ID NO: 552394 - DNA, 20 bp, Artificial
  CRISPR gRNA sequence
tcttggctatgattttctaa

SEQ ID NO: 552395 - DNA, 20 bp, Artificial
  CRISPR gRNA sequence
ttacatttgtaatttttatt

SEQ ID NO: 552396 - DNA, 20 bp, Artificial
  CRISPR gRNA sequence
tctgttttttacattatatc

SEQ ID NO: 552397 - DNA, 20 bp, Artificial
  CRISPR gRNA sequence
aaaaaggtcagtgacttgaa

SEQ ID NO: 552398 - DNA, 20 bp, Artificial
  CRISPR gRNA sequence
aatataattgtaaatagtga

SEQ ID NO: 552399 - DNA, 20 bp, Artificial
  CRISPR gRNA sequence
aatacaagaaatatatgaaa

SEQ ID NO: 552400 - DNA, 20 bp, Artificial
  CRISPR gRNA sequence
cagcgccgccgcggcgggcc

SEQ ID NO: 552401 - DNA, 20 bp, Artificial
  CRISPR gRNA sequence
gcccactgccctgaaggtca

SEQ ID NO: 552402 - DNA, 20 bp, Artificial
  CRISPR gRNA sequence
tcgctttgttctgcgctgcg

SEQ ID NO: 552403 - DNA, 20 bp, Artificial
  CRISPR gRNA sequence
cggcgcacccggaggagcat

SEQ ID NO: 552404 - DNA, 20 bp, Artificial
  CRISPR gRNA sequence
cccggaggagcattcaggct

SEQ ID NO: 552405 - DNA, 20 bp, Artificial
  CRISPR gRNA sequence
acgtccaggacctctttatt

SEQ ID NO: 552406 - DNA, 20 bp, Artificial
  CRISPR gRNA sequence
tttattagatgtttaggaat

SEQ ID NO: 552407 - DNA, 20 bp, Artificial
  CRISPR gRNA sequence
tggggtcaggctgggctaac

SEQ ID NO: 552408 - DNA, 20 bp, Artificial
  CRISPR gRNA sequence
tcaggctgggctaactgggg

SEQ ID NO: 552409 - DNA, 20 bp, Artificial
  CRISPR gRNA sequence
ggctaactggggttttgatt

SEQ ID NO: 552410 - DNA, 20 bp, Artificial
  CRISPR gRNA sequence
tagcctagttactcacggga

SEQ ID NO: 552411 - DNA, 20 bp, Artificial
  CRISPR gRNA sequence
aaaacattcagatggcagat

SEQ ID NO: 552412 - DNA, 20 bp, Artificial
  CRISPR gRNA sequence
agtttttcagatggggttcc

SEQ ID NO: 552413 - DNA, 20 bp, Artificial
  CRISPR gRNA sequence
gatcaggtgatgcagaatcc

SEQ ID NO: 552414 - DNA, 20 bp, Artificial
  CRISPR gRNA sequence
atgcagaatcctggagtttt

SEQ ID NO: 552415 - DNA, 20 bp, Artificial
  CRISPR gRNA sequence
tcccaaaggaattccagagt

SEQ ID NO: 552416 - DNA, 20 bp, Artificial
  CRISPR gRNA sequence
atacctgcaggatattaaag

SEQ ID NO: 552417 - DNA, 20 bp, Artificial
  CRISPR gRNA sequence
agttccactttcaacccaat

SEQ ID NO: 552418 - DNA, 20 bp, Artificial
  CRISPR gRNA sequence
ggggacggagaatcactgga

SEQ ID NO: 552419 - DNA, 20 bp, Artificial
  CRISPR gRNA sequence
gattctgaattcgtattagc

SEQ ID NO: 552420 - DNA, 20 bp, Artificial
  CRISPR gRNA sequence
atgcggcacaatcccgtcga

SEQ ID NO: 552421 - DNA, 20 bp, Artificial
  CRISPR gRNA sequence
cgacagcgcttactccatct

SEQ ID NO: 552422 - DNA, 20 bp, Artificial
  CRISPR gRNA sequence
ccatctaatcgttttcaagt

SEQ ID NO: 552423 - DNA, 20 bp, Artificial
  CRISPR gRNA sequence
cttttcctttttccttatta

SEQ ID NO: 552424 - DNA, 20 bp, Artificial
  CRISPR gRNA sequence
tgaaatgcatttcagaaata

SEQ ID NO: 552425 - DNA, 20 bp, Artificial
  CRISPR gRNA sequence
ttcatttgaagaaacccact

SEQ ID NO: 552426 - DNA, 20 bp, Artificial
  CRISPR gRNA sequence
gaaacccactcgctgttttc

SEQ ID NO: 552427 - DNA, 20 bp, Artificial
  CRISPR gRNA sequence
gggccgtattctccttagga

SEQ ID NO: 552428 - DNA, 20 bp, Artificial
  CRISPR gRNA sequence
caagggctgtgcggaagaaa

SEQ ID NO: 552429 - DNA, 20 bp, Artificial
  CRISPR gRNA sequence
gcaccgccctgctgccggag

SEQ ID NO: 552430 - DNA, 20 bp, Artificial
  CRISPR gRNA sequence
aggggctgggctgggaagtc

SEQ ID NO: 552431 - DNA, 20 bp, Artificial
  CRISPR gRNA sequence
ttgagcatatgagcgtcaag

SEQ ID NO: 552432 - DNA, 20 bp, Artificial
  CRISPR gRNA sequence
accggttggtggctggtgag

SEQ ID NO: 552433 - DNA, 20 bp, Artificial
  CRISPR gRNA sequence
aacacatttataactgaata

SEQ ID NO: 552434 - DNA, 20 bp, Artificial
  CRISPR gRNA sequence
atgagtcccaatttataact

SEQ ID NO: 552435 - DNA, 20 bp, Artificial
  CRISPR gRNA sequence
tcccaatttataactgatag

SEQ ID NO: 552436 - DNA, 20 bp, Artificial
  CRISPR gRNA sequence
agaggtgtcactcaaaggag

SEQ ID NO: 552437 - DNA, 20 bp, Artificial
  CRISPR gRNA sequence
gtacaagtcacacaattgca

SEQ ID NO: 552438 - DNA, 20 bp, Artificial
  CRISPR gRNA sequence
gagctgcaaagttaaaatag

SEQ ID NO: 552439 - DNA, 20 bp, Artificial
  CRISPR gRNA sequence
aatttgttgtaaaagcagat

SEQ ID NO: 552440 - DNA, 20 bp, Artificial
  CRISPR gRNA sequence
aacaacaaaaaataaaacca

SEQ ID NO: 552441 - DNA, 20 bp, Artificial
  CRISPR gRNA sequence
gcaagcaagttgaaatcttg

SEQ ID NO: 552442 - DNA, 20 bp, Artificial
  CRISPR gRNA sequence
agaattacatggaatatttt

SEQ ID NO: 552443 - DNA, 20 bp, Artificial
  CRISPR gRNA sequence
gaatattttaggggattttt

SEQ ID NO: 552444 - DNA, 20 bp, Artificial
  CRISPR gRNA sequence
ggttttgcccttgcaaaact

SEQ ID NO: 552445 - DNA, 20 bp, Artificial
  CRISPR gRNA sequence
gcaaaactttatgtttaact

SEQ ID NO: 552446 - DNA, 20 bp, Artificial
  CRISPR gRNA sequence
taaaattactcttactgaaa

SEQ ID NO: 552447 - DNA, 20 bp, Artificial
  CRISPR gRNA sequence
aagaggaatgatattcctct

SEQ ID NO: 552448 - DNA, 20 bp, Artificial
  CRISPR gRNA sequence
ttcttttaattattaaataa

SEQ ID NO: 552449 - DNA, 20 bp, Artificial
  CRISPR gRNA sequence
ttgatagttcacatatatac

SEQ ID NO: 552450 - DNA, 20 bp, Artificial
  CRISPR gRNA sequence
acatatatacaacagatttt

SEQ ID NO: 552451 - DNA, 20 bp, Artificial
  CRISPR gRNA sequence
gattttgaaagtttgaggaa

SEQ ID NO: 552452 - DNA, 20 bp, Artificial
  CRISPR gRNA sequence
ggaatgttgcttgataggtc

SEQ ID NO: 552453 - DNA, 20 bp, Artificial
  CRISPR gRNA sequence
ttgacatctgagacatatgt

SEQ ID NO: 552454 - DNA, 20 bp, Artificial
  CRISPR gRNA sequence
catatgtctgggcttctgac

SEQ ID NO: 552455 - DNA, 20 bp, Artificial
  CRISPR gRNA sequence
ctaggatctttttttttctg

SEQ ID NO: 552456 - DNA, 20 bp, Artificial
  CRISPR gRNA sequence
ttttttctgagatgattttt

SEQ ID NO: 552457 - DNA, 20 bp, Artificial
  CRISPR gRNA sequence
aaatactagatcttactttt

SEQ ID NO: 552458 - DNA, 20 bp, Artificial
  CRISPR gRNA sequence
ctagatcttactttttcagg

SEQ ID NO: 552459 - DNA, 20 bp, Artificial
  CRISPR gRNA sequence
gatttctcatctaaactttc

SEQ ID NO: 552460 - DNA, 20 bp, Artificial
  CRISPR gRNA sequence
ttgctcctcaccactatcat

SEQ ID NO: 552461 - DNA, 20 bp, Artificial
  CRISPR gRNA sequence
actccagcctgggtgacaga

SEQ ID NO: 552462 - DNA, 20 bp, Artificial
  CRISPR gRNA sequence
atttaggtctttgaattcca

SEQ ID NO: 552463 - DNA, 20 bp, Artificial
  CRISPR gRNA sequence
tgataccatcctgactctct

SEQ ID NO: 552464 - DNA, 20 bp, Artificial
  CRISPR gRNA sequence
tttcaaaataaatcaaattt

SEQ ID NO: 552465 - DNA, 20 bp, Artificial
  CRISPR gRNA sequence
aaatcaaattttaaagtttt

SEQ ID NO: 552466 - DNA, 20 bp, Artificial
  CRISPR gRNA sequence
taattttttacctcattatc

SEQ ID NO: 552467 - DNA, 20 bp, Artificial
  CRISPR gRNA sequence
tttgtctagtaggacctttt

SEQ ID NO: 552468 - DNA, 20 bp, Artificial
  CRISPR gRNA sequence
aaggagaattttagagacag

SEQ ID NO: 552469 - DNA, 20 bp, Artificial
  CRISPR gRNA sequence
gctccacaacaaactcctgt

SEQ ID NO: 552470 - DNA, 20 bp, Artificial
  CRISPR gRNA sequence
cacatttattaagagcaaag

SEQ ID NO: 552471 - DNA, 20 bp, Artificial
  CRISPR gRNA sequence
ggaatttacttccattggtt

SEQ ID NO: 552472 - DNA, 20 bp, Artificial
  CRISPR gRNA sequence
gcggtcagagtagatagcat

SEQ ID NO: 552473 - DNA, 20 bp, Artificial
  CRISPR gRNA sequence
agagatctcaaggtcagaaa

SEQ ID NO: 552474 - DNA, 20 bp, Artificial
  CRISPR gRNA sequence
cgtgaatatagacagactta

SEQ ID NO: 552475 - DNA, 20 bp, Artificial
  CRISPR gRNA sequence
aattctggatagaagagaac

SEQ ID NO: 552476 - DNA, 20 bp, Artificial
  CRISPR gRNA sequence
caagaaaacctaggtcctag

SEQ ID NO: 552477 - DNA, 20 bp, Artificial
  CRISPR gRNA sequence
ctaggtcctagacctgattt

SEQ ID NO: 552478 - DNA, 20 bp, Artificial
  CRISPR gRNA sequence
gttgttattcaggatacagg

SEQ ID NO: 552479 - DNA, 20 bp, Artificial
  CRISPR gRNA sequence
gtataacattatatacagcc

SEQ ID NO: 552480 - DNA, 20 bp, Artificial
  CRISPR gRNA sequence
gaggacaatgtagaagaggt

SEQ ID NO: 552481 - DNA, 20 bp, Artificial
  CRISPR gRNA sequence
gtgaatagatgagggtagga

SEQ ID NO: 552482 - DNA, 20 bp, Artificial
  CRISPR gRNA sequence
tgagggtaggaaccagattc

SEQ ID NO: 552483 - DNA, 20 bp, Artificial
  CRISPR gRNA sequence
ataactgctgggaagaagta

SEQ ID NO: 552484 - DNA, 20 bp, Artificial
  CRISPR gRNA sequence
aagaggatattctctagagt

SEQ ID NO: 552485 - DNA, 20 bp, Artificial
  CRISPR gRNA sequence
gaatgttaagaatatttgaa

SEQ ID NO: 552486 - DNA, 20 bp, Artificial
  CRISPR gRNA sequence
aacaggcagaaacagaagta

SEQ ID NO: 552487 - DNA, 20 bp, Artificial
  CRISPR gRNA sequence
cagaagtaggaggatttttg

SEQ ID NO: 552488 - DNA, 20 bp, Artificial
  CRISPR gRNA sequence
tgactttccactgggaagaa

SEQ ID NO: 552489 - DNA, 20 bp, Artificial
  CRISPR gRNA sequence
atagtgattaagaatgttca

SEQ ID NO: 552490 - DNA, 20 bp, Artificial
  CRISPR gRNA sequence
tgagaaagaacgctgcgtgc

SEQ ID NO: 552491 - DNA, 20 bp, Artificial
  CRISPR gRNA sequence
cactttgtgaggccaagacg

SEQ ID NO: 552492 - DNA, 20 bp, Artificial
  CRISPR gRNA sequence
ttgtgaggccaagacgggag

SEQ ID NO: 552493 - DNA, 20 bp, Artificial
  CRISPR gRNA sequence
tgggaggatcacttcagcct

SEQ ID NO: 552494 - DNA, 20 bp, Artificial
  CRISPR gRNA sequence
atctgtaatggtgagaaact

SEQ ID NO: 552495 - DNA, 20 bp, Artificial
  CRISPR gRNA sequence
agatgagaagaaagaaagaa

SEQ ID NO: 552496 - DNA, 20 bp, Artificial
  CRISPR gRNA sequence
agcaatgaacaagtggaatt

SEQ ID NO: 552497 - DNA, 20 bp, Artificial
  CRISPR gRNA sequence
ggtacaataacaaaatatgt

SEQ ID NO: 552498 - DNA, 20 bp, Artificial
  CRISPR gRNA sequence
gtcatttgtggatatcagca

SEQ ID NO: 552499 - DNA, 20 bp, Artificial
  CRISPR gRNA sequence
ttttagatacaacaccaaag

SEQ ID NO: 552500 - DNA, 20 bp, Artificial
  CRISPR gRNA sequence
atggtacagccactttggaa

SEQ ID NO: 552501 - DNA, 20 bp, Artificial
  CRISPR gRNA sequence
gccactttggaagacagttt

SEQ ID NO: 552502 - DNA, 20 bp, Artificial
  CRISPR gRNA sequence
cttaccattcaacacaactg

SEQ ID NO: 552503 - DNA, 20 bp, Artificial
  CRISPR gRNA sequence
gcaaaactgtggagactgta

SEQ ID NO: 552504 - DNA, 20 bp, Artificial
  CRISPR gRNA sequence
tatgaataggtggaacacag

SEQ ID NO: 552505 - DNA, 20 bp, Artificial
  CRISPR gRNA sequence
aactgaatgctaatgtaaag

SEQ ID NO: 552506 - DNA, 20 bp, Artificial
  CRISPR gRNA sequence
taatgataatgatgtatcag

SEQ ID NO: 552507 - DNA, 20 bp, Artificial
  CRISPR gRNA sequence
caaactttctgtaacttctg

SEQ ID NO: 552508 - DNA, 20 bp, Artificial
  CRISPR gRNA sequence
ctaacttactaagccatgaa

SEQ ID NO: 552509 - DNA, 20 bp, Artificial
  CRISPR gRNA sequence
ccaaatagaggaaccattcc

SEQ ID NO: 552510 - DNA, 20 bp, Artificial
  CRISPR gRNA sequence
aactataaagaaaaaaattg

SEQ ID NO: 552511 - DNA, 20 bp, Artificial
  CRISPR gRNA sequence
attgttgttattgaatattg

SEQ ID NO: 552512 - DNA, 20 bp, Artificial
  CRISPR gRNA sequence
ggatgtttggcatgaaagaa

SEQ ID NO: 552513 - DNA, 20 bp, Artificial
  CRISPR gRNA sequence
agaaaggagattcagctgta

SEQ ID NO: 552514 - DNA, 20 bp, Artificial
  CRISPR gRNA sequence
ggttaagtaaacattgtagc

SEQ ID NO: 552515 - DNA, 20 bp, Artificial
  CRISPR gRNA sequence
taatttgaaccatatgaaat

SEQ ID NO: 552516 - DNA, 20 bp, Artificial
  CRISPR gRNA sequence
gtcaaaaaccattgaatctt

SEQ ID NO: 552517 - DNA, 20 bp, Artificial
  CRISPR gRNA sequence
agccagtcctgtagcaattt

SEQ ID NO: 552518 - DNA, 20 bp, Artificial
  CRISPR gRNA sequence
catgcttcttggttcttgga

SEQ ID NO: 552519 - DNA, 20 bp, Artificial
  CRISPR gRNA sequence
tacctggtgtgcccagactt

SEQ ID NO: 552520 - DNA, 20 bp, Artificial
  CRISPR gRNA sequence
tttcatatcccaggaaactc

SEQ ID NO: 552521 - DNA, 20 bp, Artificial
  CRISPR gRNA sequence
cttcagtttcaggaaaacca

SEQ ID NO: 552522 - DNA, 20 bp, Artificial
  CRISPR gRNA sequence
aggatgattggccaccttca

SEQ ID NO: 552523 - DNA, 20 bp, Artificial
  CRISPR gRNA sequence
ctagggcctttgggacagtt

SEQ ID NO: 552524 - DNA, 20 bp, Artificial
  CRISPR gRNA sequence
tcaataagaataacaacttc

SEQ ID NO: 552525 - DNA, 20 bp, Artificial
  CRISPR gRNA sequence
actcactggtcatctctaga

SEQ ID NO: 552526 - DNA, 20 bp, Artificial
  CRISPR gRNA sequence
aaagaaagagaagaatcaaa

SEQ ID NO: 552527 - DNA, 20 bp, Artificial
  CRISPR gRNA sequence
taaccacattgttgatgagg

SEQ ID NO: 552528 - DNA, 20 bp, Artificial
  CRISPR gRNA sequence
aggggcagtttatctttatg

SEQ ID NO: 552529 - DNA, 20 bp, Artificial
  CRISPR gRNA sequence
aatgatgttcgggggcacct

SEQ ID NO: 552530 - DNA, 20 bp, Artificial
  CRISPR gRNA sequence
ctttagcagtgcattgtgta

SEQ ID NO: 552531 - DNA, 20 bp, Artificial
  CRISPR gRNA sequence
agtgcattgtgtactctgat

SEQ ID NO: 552532 - DNA, 20 bp, Artificial
  CRISPR gRNA sequence
ttggattttcaatagctgga

SEQ ID NO: 552533 - DNA, 20 bp, Artificial
  CRISPR gRNA sequence
agtttaccttgtgaacatac

SEQ ID NO: 552534 - DNA, 20 bp, Artificial
  CRISPR gRNA sequence
gctgctgtgaaaacaactta

SEQ ID NO: 552535 - DNA, 20 bp, Artificial
  CRISPR gRNA sequence
catgacttagtgcaatgtct

SEQ ID NO: 552536 - DNA, 20 bp, Artificial
  CRISPR gRNA sequence
tgcttcatgataaatatttt

SEQ ID NO: 552537 - DNA, 20 bp, Artificial
  CRISPR gRNA sequence
ctaccaaacacaatgccaag

SEQ ID NO: 552538 - DNA, 20 bp, Artificial
  CRISPR gRNA sequence
aacaaaccttctagtggaac

SEQ ID NO: 552539 - DNA, 20 bp, Artificial
  CRISPR gRNA sequence
aacacagggtctggaatgta

SEQ ID NO: 552540 - DNA, 20 bp, Artificial
  CRISPR gRNA sequence
aatgtatcaagcttgtgcat

SEQ ID NO: 552541 - DNA, 20 bp, Artificial
  CRISPR gRNA sequence
tatcaagcttgtgcatataa

SEQ ID NO: 552542 - DNA, 20 bp, Artificial
  CRISPR gRNA sequence
gttcctgtgagcctctagtc

SEQ ID NO: 552543 - DNA, 20 bp, Artificial
  CRISPR gRNA sequence
tcataagatttttgttaatg

SEQ ID NO: 552544 - DNA, 20 bp, Artificial
  CRISPR gRNA sequence
tgttaatgatctgtttataa

SEQ ID NO: 552545 - DNA, 20 bp, Artificial
  CRISPR gRNA sequence
taaccttgttttatgtgtgt

SEQ ID NO: 552546 - DNA, 20 bp, Artificial
  CRISPR gRNA sequence
aaataaaccttaatatatag

SEQ ID NO: 552547 - DNA, 20 bp, Artificial
  CRISPR gRNA sequence
cactgtaactcatgcctaag

SEQ ID NO: 552548 - DNA, 20 bp, Artificial
  CRISPR gRNA sequence
aagaacttgaaacaagaagg

SEQ ID NO: 552549 - DNA, 20 bp, Artificial
  CRISPR gRNA sequence
tttttccacctctgctggga

SEQ ID NO: 552550 - DNA, 20 bp, Artificial
  CRISPR gRNA sequence
aatctgcttattgggtgact

SEQ ID NO: 552551 - DNA, 20 bp, Artificial
  CRISPR gRNA sequence
ctgttcttatgtctgagaat

SEQ ID NO: 552552 - DNA, 20 bp, Artificial
  CRISPR gRNA sequence
ctgagaatgactgctttggg

SEQ ID NO: 552553 - DNA, 20 bp, Artificial
  CRISPR gRNA sequence
gactgctttgggtattgatt

SEQ ID NO: 552554 - DNA, 20 bp, Artificial
  CRISPR gRNA sequence
gtgctgtatatgaatggtat

SEQ ID NO: 552555 - DNA, 20 bp, Artificial
  CRISPR gRNA sequence
atgtatgctttttaaaacaa

SEQ ID NO: 552556 - DNA, 20 bp, Artificial
  CRISPR gRNA sequence
caaaatagtttgaaaacttg

SEQ ID NO: 552557 - DNA, 20 bp, Artificial
  CRISPR gRNA sequence
ttgttttccaaaggtcagaa

SEQ ID NO: 552558 - DNA, 20 bp, Artificial
  CRISPR gRNA sequence
aaatagtttaaggatgaaaa

SEQ ID NO: 552559 - DNA, 20 bp, Artificial
  CRISPR gRNA sequence
ttgaaaagaaacaaaaactt

SEQ ID NO: 552560 - DNA, 20 bp, Artificial
  CRISPR gRNA sequence
gaatgaatccttaggccaca

SEQ ID NO: 552561 - DNA, 20 bp, Artificial
  CRISPR gRNA sequence
atagcctccttttacctgtg

SEQ ID NO: 552562 - DNA, 20 bp, Artificial
  CRISPR gRNA sequence
taaacttctggtctccaagt

SEQ ID NO: 552563 - DNA, 20 bp, Artificial
  CRISPR gRNA sequence
atggggctcccaggtaggaa

SEQ ID NO: 552564 - DNA, 20 bp, Artificial
  CRISPR gRNA sequence
gacttacgtaatacaagtaa

SEQ ID NO: 552565 - DNA, 20 bp, Artificial
  CRISPR gRNA sequence
ctagcaatcttgggcagtca

SEQ ID NO: 552566 - DNA, 20 bp, Artificial
  CRISPR gRNA sequence
gtggatattcttgatgccac

SEQ ID NO: 552567 - DNA, 20 bp, Artificial
  CRISPR gRNA sequence
aggatccattgtgtcatgaa

SEQ ID NO: 552568 - DNA, 20 bp, Artificial
  CRISPR gRNA sequence
gtcatgaatcaagtttataa

SEQ ID NO: 552569 - DNA, 20 bp, Artificial
  CRISPR gRNA sequence
atcaagtttataaactagat

SEQ ID NO: 552570 - DNA, 20 bp, Artificial
  CRISPR gRNA sequence
tttcagtttccttagacctg

SEQ ID NO: 552571 - DNA, 20 bp, Artificial
  CRISPR gRNA sequence
tatagtagccaattagccac

SEQ ID NO: 552572 - DNA, 20 bp, Artificial
  CRISPR gRNA sequence
aaaatgaaataccattaaat

SEQ ID NO: 552573 - DNA, 20 bp, Artificial
  CRISPR gRNA sequence
ggaataatcctatcattgca

SEQ ID NO: 552574 - DNA, 20 bp, Artificial
  CRISPR gRNA sequence
atgaaaatccatccctaagt

SEQ ID NO: 552575 - DNA, 20 bp, Artificial
  CRISPR gRNA sequence
tattataacgatcagctgaa

SEQ ID NO: 552576 - DNA, 20 bp, Artificial
  CRISPR gRNA sequence
tgaactaaagagaggtggca

SEQ ID NO: 552577 - DNA, 20 bp, Artificial
  CRISPR gRNA sequence
catagaacttcaaaacaatt

SEQ ID NO: 552578 - DNA, 20 bp, Artificial
  CRISPR gRNA sequence
tgtgtgcatcacttgagccc

SEQ ID NO: 552579 - DNA, 20 bp, Artificial
  CRISPR gRNA sequence
gaggcagatgttgcagtgag

SEQ ID NO: 552580 - DNA, 20 bp, Artificial
  CRISPR gRNA sequence
tcattaattgggaaatagtg

SEQ ID NO: 552581 - DNA, 20 bp, Artificial
  CRISPR gRNA sequence
gctctagtcaaccctattga

SEQ ID NO: 552582 - DNA, 20 bp, Artificial
  CRISPR gRNA sequence
tgtgctgtgagtgtaaaata

SEQ ID NO: 552583 - DNA, 20 bp, Artificial
  CRISPR gRNA sequence
atataaaatatctcattaaa

SEQ ID NO: 552584 - DNA, 20 bp, Artificial
  CRISPR gRNA sequence
caaaaattttaaattactta

SEQ ID NO: 552585 - DNA, 20 bp, Artificial
  CRISPR gRNA sequence
gtaaaattagccattttgtc

SEQ ID NO: 552586 - DNA, 20 bp, Artificial
  CRISPR gRNA sequence
ttttgtcaacagtttttgca

SEQ ID NO: 552587 - DNA, 20 bp, Artificial
  CRISPR gRNA sequence
actctttggaccagctctgt

SEQ ID NO: 552588 - DNA, 20 bp, Artificial
  CRISPR gRNA sequence
ttggaccagctctgtagccg

SEQ ID NO: 552589 - DNA, 20 bp, Artificial
  CRISPR gRNA sequence
aaatcccagggtgatggggc

SEQ ID NO: 552590 - DNA, 20 bp, Artificial
  CRISPR gRNA sequence
ccagggtgatggggctctgg

SEQ ID NO: 552591 - DNA, 20 bp, Artificial
  CRISPR gRNA sequence
agatgcccattacttgggaa

SEQ ID NO: 552592 - DNA, 20 bp, Artificial
  CRISPR gRNA sequence
tgcactagccactctctgca

SEQ ID NO: 552593 - DNA, 20 bp, Artificial
  CRISPR gRNA sequence
tgcaggaggagtatcatacc

SEQ ID NO: 552594 - DNA, 20 bp, Artificial
  CRISPR gRNA sequence
cttgcttagagacagcgcat

SEQ ID NO: 552595 - DNA, 20 bp, Artificial
  CRISPR gRNA sequence
cgttgctagtaagtgatggg

SEQ ID NO: 552596 - DNA, 20 bp, Artificial
  CRISPR gRNA sequence
caaacacaattagcagcagt

SEQ ID NO: 552597 - DNA, 20 bp, Artificial
  CRISPR gRNA sequence
gtctggttttctgtcacatt

SEQ ID NO: 552598 - DNA, 20 bp, Artificial
  CRISPR gRNA sequence
atttcagaatacctaaaaat

SEQ ID NO: 552599 - DNA, 20 bp, Artificial
  CRISPR gRNA sequence
cttctcaattaaagaactga

SEQ ID NO: 552600 - DNA, 20 bp, Artificial
  CRISPR gRNA sequence
caaaaattggtcagaacatg

SEQ ID NO: 552601 - DNA, 20 bp, Artificial
  CRISPR gRNA sequence
ggctgaagatgcagggaagg

SEQ ID NO: 552602 - DNA, 20 bp, Artificial
  CRISPR gRNA sequence
gtttggaccagtgctgtcca

SEQ ID NO: 552603 - DNA, 20 bp, Artificial
  CRISPR gRNA sequence
atattctttcacacacggtc

SEQ ID NO: 552604 - DNA, 20 bp, Artificial
  CRISPR gRNA sequence
tagtctagttctgcactgac

SEQ ID NO: 552605 - DNA, 20 bp, Artificial
  CRISPR gRNA sequence
gatcctagatactatcactt

SEQ ID NO: 552606 - DNA, 20 bp, Artificial
  CRISPR gRNA sequence
tatggaaactgctgtggcat

SEQ ID NO: 552607 - DNA, 20 bp, Artificial
  CRISPR gRNA sequence
gcatcaagaatatccactct

SEQ ID NO: 552608 - DNA, 20 bp, Artificial
  CRISPR gRNA sequence
tgtcttgaatgacctataaa

SEQ ID NO: 552609 - DNA, 20 bp, Artificial
  CRISPR gRNA sequence
tgaatgacctataaaaaaga

SEQ ID NO: 552610 - DNA, 20 bp, Artificial
  CRISPR gRNA sequence
gacctataaaaaagaaaaga

SEQ ID NO: 552611 - DNA, 20 bp, Artificial
  CRISPR gRNA sequence
aaggctgcgatgtgccttgc

SEQ ID NO: 552612 - DNA, 20 bp, Artificial
  CRISPR gRNA sequence
aagggagaggaggaagagag

SEQ ID NO: 552613 - DNA, 20 bp, Artificial
  CRISPR gRNA sequence
agagaaaatgaatgaataaa

SEQ ID NO: 552614 - DNA, 20 bp, Artificial
  CRISPR gRNA sequence
cagatttgagaagaccctgg

SEQ ID NO: 552615 - DNA, 20 bp, Artificial
  CRISPR gRNA sequence
agattcaatggtttttgact

SEQ ID NO: 552616 - DNA, 20 bp, Artificial
  CRISPR gRNA sequence
ctttatagttctttttatcc

SEQ ID NO: 552617 - DNA, 20 bp, Artificial
  CRISPR gRNA sequence
aacaaaactgagcagaagtt

SEQ ID NO: 552618 - DNA, 20 bp, Artificial
  CRISPR gRNA sequence
tcaccagagtggtacatttt

SEQ ID NO: 552619 - DNA, 20 bp, Artificial
  CRISPR gRNA sequence
tctccacagttttgcctttt

SEQ ID NO: 552620 - DNA, 20 bp, Artificial
  CRISPR gRNA sequence
taagagtacatacagttttg

SEQ ID NO: 552621 - DNA, 20 bp, Artificial
  CRISPR gRNA sequence
aatttttgtatttttacaaa

SEQ ID NO: 552622 - DNA, 20 bp, Artificial
  CRISPR gRNA sequence
tttttacaaaatagaaaata

SEQ ID NO: 552623 - DNA, 20 bp, Artificial
  CRISPR gRNA sequence
gagtcttcctatctatgaac

SEQ ID NO: 552624 - DNA, 20 bp, Artificial
  CRISPR gRNA sequence
tccacttgttcattgctgtt

SEQ ID NO: 552625 - DNA, 20 bp, Artificial
  CRISPR gRNA sequence
ggtttctacatgtatgttca

SEQ ID NO: 552626 - DNA, 20 bp, Artificial
  CRISPR gRNA sequence
attgttctttggttttagca

SEQ ID NO: 552627 - DNA, 20 bp, Artificial
  CRISPR gRNA sequence
tatcttctaaaagagattat

SEQ ID NO: 552628 - DNA, 20 bp, Artificial
  CRISPR gRNA sequence
atttcttccttaaatatctg

SEQ ID NO: 552629 - DNA, 20 bp, Artificial
  CRISPR gRNA sequence
ataatgtccacacagctatg

SEQ ID NO: 552630 - DNA, 20 bp, Artificial
  CRISPR gRNA sequence
cagttggaaactggtactct

SEQ ID NO: 552631 - DNA, 20 bp, Artificial
  CRISPR gRNA sequence
cttcccagcagttatctaaa

SEQ ID NO: 552632 - DNA, 20 bp, Artificial
  CRISPR gRNA sequence
aatcccatgttctcttctat

SEQ ID NO: 552633 - DNA, 20 bp, Artificial
  CRISPR gRNA sequence
gtaggagcatgacacaaagg

SEQ ID NO: 552634 - DNA, 20 bp, Artificial
  CRISPR gRNA sequence
tcctactagacaaaatgtta

SEQ ID NO: 552635 - DNA, 20 bp, Artificial
  CRISPR gRNA sequence
ctcattcatatgaataaatc

SEQ ID NO: 552636 - DNA, 20 bp, Artificial
  CRISPR gRNA sequence
aaagcattggaaagtttaga

SEQ ID NO: 552637 - DNA, 20 bp, Artificial
  CRISPR gRNA sequence
aaaagcattcaaaaatcatc

SEQ ID NO: 552638 - DNA, 20 bp, Artificial
  CRISPR gRNA sequence
ggtcctccaatatttggtta

SEQ ID NO: 552639 - DNA, 20 bp, Artificial
  CRISPR gRNA sequence
atatgtgaactatcaatttg

SEQ ID NO: 552640 - DNA, 20 bp, Artificial
  CRISPR gRNA sequence
tcaccattatttaataatta

SEQ ID NO: 552641 - DNA, 20 bp, Artificial
  CRISPR gRNA sequence
attctatagagggatcttac

SEQ ID NO: 552642 - DNA, 20 bp, Artificial
  CRISPR gRNA sequence
ctccgtgtttcataacttta

SEQ ID NO: 552643 - DNA, 20 bp, Artificial
  CRISPR gRNA sequence
gggcccagcaatgggactac

SEQ ID NO: 552644 - DNA, 20 bp, Artificial
  CRISPR gRNA sequence
gctcaggtcaccagggtggt

SEQ ID NO: 552645 - DNA, 20 bp, Artificial
  CRISPR gRNA sequence
atcaaaaagcaacatcctaa

SEQ ID NO: 552646 - DNA, 20 bp, Artificial
  CRISPR gRNA sequence
gggtttcttcaaatgaaagg

SEQ ID NO: 552647 - DNA, 20 bp, Artificial
  CRISPR gRNA sequence
aatcagaggctaatacgaat

SEQ ID NO: 552648 - DNA, 20 bp, Artificial
  CRISPR gRNA sequence
aagacataggctgtccaggg

SEQ ID NO: 552649 - DNA, 20 bp, Artificial
  CRISPR gRNA sequence
aagttattgtttgaaagggt

SEQ ID NO: 552650 - DNA, 20 bp, Artificial
  CRISPR gRNA sequence
aaagacaataaatgggagac

SEQ ID NO: 552651 - DNA, 20 bp, Artificial
  CRISPR gRNA sequence
tatctgtttcagctgcttgt

SEQ ID NO: 552652 - DNA, 20 bp, Artificial
  CRISPR gRNA sequence
taaataatactaaaacaaca

SEQ ID NO: 552653 - DNA, 20 bp, Artificial
  CRISPR gRNA sequence
tgaattaattaacatatgta

SEQ ID NO: 552654 - DNA, 20 bp, Artificial
  CRISPR gRNA sequence
gtattagaatggtgctcaac

SEQ ID NO: 552655 - DNA, 20 bp, Artificial
  CRISPR gRNA sequence
ctactcgggaggctgaggca

SEQ ID NO: 552656 - DNA, 20 bp, Artificial
  CRISPR gRNA sequence
aaaaaagtataatatttagt

SEQ ID NO: 552657 - DNA, 20 bp, Artificial
  CRISPR gRNA sequence
actccttgagcatcaaggag

SEQ ID NO: 552658 - DNA, 20 bp, Artificial
  CRISPR gRNA sequence
gatctacctgttcaaattta

SEQ ID NO: 552659 - DNA, 20 bp, Artificial
  CRISPR gRNA sequence
aaagtacccagcctgccttg

SEQ ID NO: 552660 - DNA, 20 bp, Artificial
  CRISPR gRNA sequence
cttttaagcagtggaatttc

SEQ ID NO: 552661 - DNA, 20 bp, Artificial
  CRISPR gRNA sequence
cttccaaggaacatgcatcc

SEQ ID NO: 552662 - DNA, 20 bp, Artificial
  CRISPR gRNA sequence
aggctgggcatttctcaggg

SEQ ID NO: 552663 - DNA, 20 bp, Artificial
  CRISPR gRNA sequence
aaaccaagctttctacctcc

SEQ ID NO: 552664 - DNA, 20 bp, Artificial
  CRISPR gRNA sequence
ttctcaaattttaaggtgcc

SEQ ID NO: 552665 - DNA, 20 bp, Artificial
  CRISPR gRNA sequence
tttaggagctggaagagttt

SEQ ID NO: 552666 - DNA, 20 bp, Artificial
  CRISPR gRNA sequence
aggtctcttgttctacttac

SEQ ID NO: 552667 - DNA, 20 bp, Artificial
  CRISPR gRNA sequence
caggtcactgtaaaggtcaa

SEQ ID NO: 552668 - DNA, 20 bp, Artificial
  CRISPR gRNA sequence
ccacatgcagggtttgtaaa

SEQ ID NO: 552669 - DNA, 20 bp, Artificial
  CRISPR gRNA sequence
tgcagggtttgtaaaaaaga

SEQ ID NO: 552670 - DNA, 20 bp, Artificial
  CRISPR gRNA sequence
ggtttgtaaaaaagaaaaga

SEQ ID NO: 552671 - DNA, 20 bp, Artificial
  CRISPR gRNA sequence
gtaaaaaagaaaagaaaaga

SEQ ID NO: 552672 - DNA, 20 bp, Artificial
  CRISPR gRNA sequence
aaagaaaagaaaagaaaaga

SEQ ID NO: 552673 - DNA, 20 bp, Artificial
  CRISPR gRNA sequence
aagaaaagaaaagaaaaaaa

SEQ ID NO: 552674 - DNA, 20 bp, Artificial
  CRISPR gRNA sequence
tttaagcagcattaaactgg

SEQ ID NO: 552675 - DNA, 20 bp, Artificial
  CRISPR gRNA sequence
gttcactgctgtgtaaaaaa

SEQ ID NO: 552676 - DNA, 20 bp, Artificial
  CRISPR gRNA sequence
cacatatctgatgacatttt

SEQ ID NO: 552677 - DNA, 20 bp, Artificial
  CRISPR gRNA sequence
aggactaataaacctcagaa

SEQ ID NO: 552678 - DNA, 20 bp, Artificial
  CRISPR gRNA sequence
catacctttgctgaggtgcc

SEQ ID NO: 552679 - DNA, 20 bp, Artificial
  CRISPR gRNA sequence
cttgagccacaatgcccggc

SEQ ID NO: 552680 - DNA, 20 bp, Artificial
  CRISPR gRNA sequence
acagttcatcaagtttaaga

SEQ ID NO: 552681 - DNA, 20 bp, Artificial
  CRISPR gRNA sequence
aacagagttagatggggcca

SEQ ID NO: 552682 - DNA, 20 bp, Artificial
  CRISPR gRNA sequence
ggtagagtgaatgtggtatt

SEQ ID NO: 552683 - DNA, 20 bp, Artificial
  CRISPR gRNA sequence
cccactggctatgaacgcag

SEQ ID NO: 552684 - DNA, 20 bp, Artificial
  CRISPR gRNA sequence
gaaaaggaatagtcagtgtg

SEQ ID NO: 552685 - DNA, 20 bp, Artificial
  CRISPR gRNA sequence
aggaatagtcagtgtgttag

SEQ ID NO: 552686 - DNA, 20 bp, Artificial
  CRISPR gRNA sequence
aaccccctctcaaggaaaaa

SEQ ID NO: 552687 - DNA, 20 bp, Artificial
  CRISPR gRNA sequence
ccctctcaaggaaaaaagag

SEQ ID NO: 552688 - DNA, 20 bp, Artificial
  CRISPR gRNA sequence
gtcaaaagctgctgagaagt

SEQ ID NO: 552689 - DNA, 20 bp, Artificial
  CRISPR gRNA sequence
aagtcaagaatgacatggac

SEQ ID NO: 552690 - DNA, 20 bp, Artificial
  CRISPR gRNA sequence
ttaaaagtgaatataaggga

SEQ ID NO: 552691 - DNA, 20 bp, Artificial
  CRISPR gRNA sequence
ctggaggggtacagggatca

SEQ ID NO: 552692 - DNA, 20 bp, Artificial
  CRISPR gRNA sequence
gtttaacttcaggtgagaac

SEQ ID NO: 552693 - DNA, 20 bp, Artificial
  CRISPR gRNA sequence
gaaagtccattcatatcagg

SEQ ID NO: 552694 - DNA, 20 bp, Artificial
  CRISPR gRNA sequence
gaggtattcaagatttgagg

SEQ ID NO: 552695 - DNA, 20 bp, Artificial
  CRISPR gRNA sequence
cttaattgaggtaagtgatt

SEQ ID NO: 552696 - DNA, 20 bp, Artificial
  CRISPR gRNA sequence
gcaaccacatgggtgtgagc

SEQ ID NO: 552697 - DNA, 20 bp, Artificial
  CRISPR gRNA sequence
ggcgatcaaggacaatattg

SEQ ID NO: 552698 - DNA, 20 bp, Artificial
  CRISPR gRNA sequence
ccaccaagacaccaggaatg

SEQ ID NO: 552699 - DNA, 20 bp, Artificial
  CRISPR gRNA sequence
gaggcaggccttaaaatgac

SEQ ID NO: 552700 - DNA, 20 bp, Artificial
  CRISPR gRNA sequence
ggagtgtcagtgagaagcag

SEQ ID NO: 552701 - DNA, 20 bp, Artificial
  CRISPR gRNA sequence
aagtagctagctcctctata

SEQ ID NO: 552702 - DNA, 20 bp, Artificial
  CRISPR gRNA sequence
agctcctctataccagaaaa

SEQ ID NO: 552703 - DNA, 20 bp, Artificial
  CRISPR gRNA sequence
ggaatactcaccaagcacat

SEQ ID NO: 552704 - DNA, 20 bp, Artificial
  CRISPR gRNA sequence
taaaccctatttttaaaaga

SEQ ID NO: 552705 - DNA, 20 bp, Artificial
  CRISPR gRNA sequence
aagatgagaaagctctgaat

SEQ ID NO: 552706 - DNA, 20 bp, Artificial
  CRISPR gRNA sequence
aacagctgatgaaacctagg

SEQ ID NO: 552707 - DNA, 20 bp, Artificial
  CRISPR gRNA sequence
aggagagaaaaaaaaattgg

SEQ ID NO: 552708 - DNA, 20 bp, Artificial
  CRISPR gRNA sequence
aaaacaacatgactttggtg

SEQ ID NO: 552709 - DNA, 20 bp, Artificial
  CRISPR gRNA sequence
catgtggagcttactcttta

SEQ ID NO: 552710 - DNA, 20 bp, Artificial
  CRISPR gRNA sequence
aactgggacctgcataaatc

SEQ ID NO: 552711 - DNA, 20 bp, Artificial
  CRISPR gRNA sequence
cccaaaggaaggccctgaat

SEQ ID NO: 552712 - DNA, 20 bp, Artificial
  CRISPR gRNA sequence
acacacgtgattcctaacag

SEQ ID NO: 552713 - DNA, 20 bp, Artificial
  CRISPR gRNA sequence
atcctaatggagaggaagcc

SEQ ID NO: 552714 - DNA, 20 bp, Artificial
  CRISPR gRNA sequence
agaggcatcattaactgaga

SEQ ID NO: 552715 - DNA, 20 bp, Artificial
  CRISPR gRNA sequence
agggaacatctagtaacagc

SEQ ID NO: 552716 - DNA, 20 bp, Artificial
  CRISPR gRNA sequence
acagagtatgtgggaaggca

SEQ ID NO: 552717 - DNA, 20 bp, Artificial
  CRISPR gRNA sequence
gggaaggcacaagaaaaagt

SEQ ID NO: 552718 - DNA, 20 bp, Artificial
  CRISPR gRNA sequence
tcctgggcttgagaacagta

SEQ ID NO: 552719 - DNA, 20 bp, Artificial
  CRISPR gRNA sequence
tggtggagggaagtgagggt

SEQ ID NO: 552720 - DNA, 20 bp, Artificial
  CRISPR gRNA sequence
aaaggggagactgcagctca

SEQ ID NO: 552721 - DNA, 20 bp, Artificial
  CRISPR gRNA sequence
ccattcctgagttacttcac

SEQ ID NO: 552722 - DNA, 20 bp, Artificial
  CRISPR gRNA sequence
tagttctacttttagttgct

SEQ ID NO: 552723 - DNA, 20 bp, Artificial
  CRISPR gRNA sequence
agtttttctgatgttatctt

SEQ ID NO: 552724 - DNA, 20 bp, Artificial
  CRISPR gRNA sequence
ttctctagcttaatttagtg

SEQ ID NO: 552725 - DNA, 20 bp, Artificial
  CRISPR gRNA sequence
caacatgcaatgcatataac

SEQ ID NO: 552726 - DNA, 20 bp, Artificial
  CRISPR gRNA sequence
tcaactataattttgaacta

SEQ ID NO: 552727 - DNA, 20 bp, Artificial
  CRISPR gRNA sequence
ctggtgaagtgacaagacac

SEQ ID NO: 552728 - DNA, 20 bp, Artificial
  CRISPR gRNA sequence
ttgacattctattaggggag

SEQ ID NO: 552729 - DNA, 20 bp, Artificial
  CRISPR gRNA sequence
ttgaagcaggagcaatggca

SEQ ID NO: 552730 - DNA, 20 bp, Artificial
  CRISPR gRNA sequence
cacaattctagtattgaagt

SEQ ID NO: 552731 - DNA, 20 bp, Artificial
  CRISPR gRNA sequence
ctataatctacattaacaaa

SEQ ID NO: 552732 - DNA, 20 bp, Artificial
  CRISPR gRNA sequence
gaggcatccaatgctgtttg

SEQ ID NO: 552733 - DNA, 20 bp, Artificial
  CRISPR gRNA sequence
caggagtatagatgccatct

SEQ ID NO: 552734 - DNA, 20 bp, Artificial
  CRISPR gRNA sequence
acaaatattcttaatgacat

SEQ ID NO: 552735 - DNA, 20 bp, Artificial
  CRISPR gRNA sequence
tactttgcccagattcatca

SEQ ID NO: 552736 - DNA, 20 bp, Artificial
  CRISPR gRNA sequence
tactccttgatccatgggct

SEQ ID NO: 552737 - DNA, 20 bp, Artificial
  CRISPR gRNA sequence
ttccattttatagagcacaa

SEQ ID NO: 552738 - DNA, 20 bp, Artificial
  CRISPR gRNA sequence
gacaagggaggccaggagaa

SEQ ID NO: 552739 - DNA, 20 bp, Artificial
  CRISPR gRNA sequence
ttgatttggatttctttttc

SEQ ID NO: 552740 - DNA, 20 bp, Artificial
  CRISPR gRNA sequence
tgggttgtggtgtctttccc

SEQ ID NO: 552741 - DNA, 20 bp, Artificial
  CRISPR gRNA sequence
tgagagagacctgggaagta

SEQ ID NO: 552742 - DNA, 20 bp, Artificial
  CRISPR gRNA sequence
cagatagtaggaaaaagatg

SEQ ID NO: 552743 - DNA, 20 bp, Artificial
  CRISPR gRNA sequence
ggaagaaaattcaaatgtaa

SEQ ID NO: 552744 - DNA, 20 bp, Artificial
  CRISPR gRNA sequence
aatattaaaaataaaaagtt

SEQ ID NO: 552745 - DNA, 20 bp, Artificial
  CRISPR gRNA sequence
aaagttatagaaatatatat

SEQ ID NO: 552746 - DNA, 20 bp, Artificial
  CRISPR gRNA sequence
actatgtaaattttttttaa

SEQ ID NO: 552747 - DNA, 20 bp, Artificial
  CRISPR gRNA sequence
taatgaacaaaagaacaata

SEQ ID NO: 552748 - DNA, 20 bp, Artificial
  CRISPR gRNA sequence
ttgctgataccactgagtgg

SEQ ID NO: 552749 - DNA, 20 bp, Artificial
  CRISPR gRNA sequence
tagatctcctcagctgtgaa

SEQ ID NO: 552750 - DNA, 20 bp, Artificial
  CRISPR gRNA sequence
tttgaaggtttttttgtttt

SEQ ID NO: 552751 - DNA, 20 bp, Artificial
  CRISPR gRNA sequence
gaagtatcctgatttcttat

SEQ ID NO: 552752 - DNA, 20 bp, Artificial
  CRISPR gRNA sequence
ttacatgggaggctgaggca

SEQ ID NO: 552753 - DNA, 20 bp, Artificial
  CRISPR gRNA sequence
tgacagagcaagactccatc

SEQ ID NO: 552754 - DNA, 20 bp, Artificial
  CRISPR gRNA sequence
aaaaaaaaaaaaaaaaaaaa

SEQ ID NO: 552755 - DNA, 20 bp, Artificial
  CRISPR gRNA sequence
tgaacctggacaatctgact

SEQ ID NO: 552756 - DNA, 20 bp, Artificial
  CRISPR gRNA sequence
ggaacagcagatgttgcaaa

SEQ ID NO: 552757 - DNA, 20 bp, Artificial
  CRISPR gRNA sequence
agagcaagactccagtcaag

SEQ ID NO: 552758 - DNA, 20 bp, Artificial
  CRISPR gRNA sequence
tcaaggaagaaaaagccaga

SEQ ID NO: 552759 - DNA, 20 bp, Artificial
  CRISPR gRNA sequence
agccagaccagaaacaataa

SEQ ID NO: 552760 - DNA, 20 bp, Artificial
  CRISPR gRNA sequence
cgagcaaacaaaggagtcac

SEQ ID NO: 552761 - DNA, 20 bp, Artificial
  CRISPR gRNA sequence
tcaaaagataaggcttcctg

SEQ ID NO: 552762 - DNA, 20 bp, Artificial
  CRISPR gRNA sequence
aggacttcgtaaggagagat

SEQ ID NO: 552763 - DNA, 20 bp, Artificial
  CRISPR gRNA sequence
agctaatttttatatttttt

SEQ ID NO: 552764 - DNA, 20 bp, Artificial
  CRISPR gRNA sequence
gggttttcttgagtttgttc

SEQ ID NO: 552765 - DNA, 20 bp, Artificial
  CRISPR gRNA sequence
tttgaccaaaaaaaaaaaaa

SEQ ID NO: 552766 - DNA, 20 bp, Artificial
  CRISPR gRNA sequence
accaaaaaaaaaaaaaaaag

SEQ ID NO: 552767 - DNA, 20 bp, Artificial
  CRISPR gRNA sequence
aaaaaaaaaaaagaaagaaa

SEQ ID NO: 552768 - DNA, 20 bp, Artificial
  CRISPR gRNA sequence
agtcagtcccaattttgggg

SEQ ID NO: 552769 - DNA, 20 bp, Artificial
  CRISPR gRNA sequence
tggatgatgttaagtgctat

SEQ ID NO: 552770 - DNA, 20 bp, Artificial
  CRISPR gRNA sequence
agttggcatctgagcagagt

SEQ ID NO: 552771 - DNA, 20 bp, Artificial
  CRISPR gRNA sequence
aagaacatctggggtgagag

SEQ ID NO: 552772 - DNA, 20 bp, Artificial
  CRISPR gRNA sequence
cgaagcaccaggctacagat

SEQ ID NO: 552773 - DNA, 20 bp, Artificial
  CRISPR gRNA sequence
tgcctcctcgataagttcat

SEQ ID NO: 552774 - DNA, 20 bp, Artificial
  CRISPR gRNA sequence
ttctgagtatcaaatacaca

SEQ ID NO: 552775 - DNA, 20 bp, Artificial
  CRISPR gRNA sequence
atcatttcactaaaattcct

SEQ ID NO: 552776 - DNA, 20 bp, Artificial
  CRISPR gRNA sequence
ctaatttttaactggcatag

SEQ ID NO: 552777 - DNA, 20 bp, Artificial
  CRISPR gRNA sequence
tggcataggaagaaaatgtt

SEQ ID NO: 552778 - DNA, 20 bp, Artificial
  CRISPR gRNA sequence
tattcaaacctgaacttatc

SEQ ID NO: 552779 - DNA, 20 bp, Artificial
  CRISPR gRNA sequence
acctgaacttatctgagaaa

SEQ ID NO: 552780 - DNA, 20 bp, Artificial
  CRISPR gRNA sequence
ggaagttgagatttgtcatt

SEQ ID NO: 552781 - DNA, 20 bp, Artificial
  CRISPR gRNA sequence
aaaaaagcttaggcacttgt

SEQ ID NO: 552782 - DNA, 20 bp, Artificial
  CRISPR gRNA sequence
cttgtgcagaaacagcatga

SEQ ID NO: 552783 - DNA, 20 bp, Artificial
  CRISPR gRNA sequence
gcatgagaagaaaccaaaag

SEQ ID NO: 552784 - DNA, 20 bp, Artificial
  CRISPR gRNA sequence
caaagtttctacttttaaac

SEQ ID NO: 552785 - DNA, 20 bp, Artificial
  CRISPR gRNA sequence
cctcaaagcctgtatttact

SEQ ID NO: 552786 - DNA, 20 bp, Artificial
  CRISPR gRNA sequence
ggagtgaaatgtgggtacct

SEQ ID NO: 552787 - DNA, 20 bp, Artificial
  CRISPR gRNA sequence
cctatatttcccatgtttta

SEQ ID NO: 552788 - DNA, 20 bp, Artificial
  CRISPR gRNA sequence
caatgtatacatgttggata

SEQ ID NO: 552789 - DNA, 20 bp, Artificial
  CRISPR gRNA sequence
aggaataggttctgattcag

SEQ ID NO: 552790 - DNA, 20 bp, Artificial
  CRISPR gRNA sequence
aatgtgagataatttcaaat

SEQ ID NO: 552791 - DNA, 20 bp, Artificial
  CRISPR gRNA sequence
tctgtaaaatgtcaacaaca

SEQ ID NO: 552792 - DNA, 20 bp, Artificial
  CRISPR gRNA sequence
aaatatatccattccaaatg

SEQ ID NO: 552793 - DNA, 20 bp, Artificial
  CRISPR gRNA sequence
cagctggcttgaatttttcc

SEQ ID NO: 552794 - DNA, 20 bp, Artificial
  CRISPR gRNA sequence
cctcttgaatgctttgctgc

SEQ ID NO: 552795 - DNA, 20 bp, Artificial
  CRISPR gRNA sequence
agggaggccccacaatcatg

SEQ ID NO: 552796 - DNA, 20 bp, Artificial
  CRISPR gRNA sequence
acagactattcatccagcag

SEQ ID NO: 552797 - DNA, 20 bp, Artificial
  CRISPR gRNA sequence
agggactgtacagctgtgaa

SEQ ID NO: 552798 - DNA, 20 bp, Artificial
  CRISPR gRNA sequence
accttgtttaagaagggtag

SEQ ID NO: 552799 - DNA, 20 bp, Artificial
  CRISPR gRNA sequence
agggtagttagaaaaaaaaa

SEQ ID NO: 552800 - DNA, 20 bp, Artificial
  CRISPR gRNA sequence
tcatgagtcactgcacccgg

SEQ ID NO: 552801 - DNA, 20 bp, Artificial
  CRISPR gRNA sequence
tgaaaaataaaaggaactgt

SEQ ID NO: 552802 - DNA, 20 bp, Artificial
  CRISPR gRNA sequence
ctaaataccatctctcacta

SEQ ID NO: 552803 - DNA, 20 bp, Artificial
  CRISPR gRNA sequence
gtccagaacatctttctgtg

SEQ ID NO: 552804 - DNA, 20 bp, Artificial
  CRISPR gRNA sequence
acaggaatgccatatttaaa

SEQ ID NO: 552805 - DNA, 20 bp, Artificial
  CRISPR gRNA sequence
ccacataaccttctaaaata

SEQ ID NO: 552806 - DNA, 20 bp, Artificial
  CRISPR gRNA sequence
actaataaatatatatatag

SEQ ID NO: 552807 - DNA, 20 bp, Artificial
  CRISPR gRNA sequence
tatatatagagagaaacaga

SEQ ID NO: 552808 - DNA, 20 bp, Artificial
  CRISPR gRNA sequence
cagagtgagactgtgtctca

SEQ ID NO: 552809 - DNA, 20 bp, Artificial
  CRISPR gRNA sequence
agactgtgtctcaaaagaaa

SEQ ID NO: 552810 - DNA, 20 bp, Artificial
  CRISPR gRNA sequence
ggaaggaagggagggaggga

SEQ ID NO: 552811 - DNA, 20 bp, Artificial
  CRISPR gRNA sequence
agaaagggacaagggtgggg

SEQ ID NO: 552812 - DNA, 20 bp, Artificial
  CRISPR gRNA sequence
ctactcagaaggctgaggtg

SEQ ID NO: 552813 - DNA, 20 bp, Artificial
  CRISPR gRNA sequence
ttagtgataatggattctgg

SEQ ID NO: 552814 - DNA, 20 bp, Artificial
  CRISPR gRNA sequence
taaaatggtgcctctacaat

SEQ ID NO: 552815 - DNA, 20 bp, Artificial
  CRISPR gRNA sequence
cctgctacaaagagttacaa

SEQ ID NO: 552816 - DNA, 20 bp, Artificial
  CRISPR gRNA sequence
tgatgattctgtgacttgtt

SEQ ID NO: 552817 - DNA, 20 bp, Artificial
  CRISPR gRNA sequence
gttcttatgagacatatgat

SEQ ID NO: 552818 - DNA, 20 bp, Artificial
  CRISPR gRNA sequence
taacagatggcaaaaataac

SEQ ID NO: 552819 - DNA, 20 bp, Artificial
  CRISPR gRNA sequence
acagttaactggtgattcaa

SEQ ID NO: 552820 - DNA, 20 bp, Artificial
  CRISPR gRNA sequence
aggagaagctctctcagctc

SEQ ID NO: 552821 - DNA, 20 bp, Artificial
  CRISPR gRNA sequence
ccgtgggagccttttcagga

SEQ ID NO: 552822 - DNA, 20 bp, Artificial
  CRISPR gRNA sequence
gtatcagcagagaggacttt

SEQ ID NO: 552823 - DNA, 20 bp, Artificial
  CRISPR gRNA sequence
ctactcggaaggctgaggtg

SEQ ID NO: 552824 - DNA, 20 bp, Artificial
  CRISPR gRNA sequence
actgaactccagcctgggtg

SEQ ID NO: 552825 - DNA, 20 bp, Artificial
  CRISPR gRNA sequence
caggaccatgcgcctgggaa

SEQ ID NO: 552826 - DNA, 20 bp, Artificial
  CRISPR gRNA sequence
taccactcacatgagggaaa

SEQ ID NO: 552827 - DNA, 20 bp, Artificial
  CRISPR gRNA sequence
gagaataataaacccacttc

SEQ ID NO: 552828 - DNA, 20 bp, Artificial
  CRISPR gRNA sequence
agtacagagatgagtaaagc

SEQ ID NO: 552829 - DNA, 20 bp, Artificial
  CRISPR gRNA sequence
agagcattctccaacaagtc

SEQ ID NO: 552830 - DNA, 20 bp, Artificial
  CRISPR gRNA sequence
gtatcctatggtgattcttc

SEQ ID NO: 552831 - DNA, 20 bp, Artificial
  CRISPR gRNA sequence
ctaatttttttttagttttt

SEQ ID NO: 552832 - DNA, 20 bp, Artificial
  CRISPR gRNA sequence
acacttccttactttctggc

SEQ ID NO: 552833 - DNA, 20 bp, Artificial
  CRISPR gRNA sequence
cttttagtgagagatggtat

SEQ ID NO: 552834 - DNA, 20 bp, Artificial
  CRISPR gRNA sequence
gccttgtcagttttcaaagt

SEQ ID NO: 552835 - DNA, 20 bp, Artificial
  CRISPR gRNA sequence
ttcaagatataactccataa

SEQ ID NO: 552836 - DNA, 20 bp, Artificial
  CRISPR gRNA sequence
ctacctaggaggctgaggca

SEQ ID NO: 552837 - DNA, 20 bp, Artificial
  CRISPR gRNA sequence
tgagataggcttcaagcgtt

SEQ ID NO: 552838 - DNA, 20 bp, Artificial
  CRISPR gRNA sequence
taccattgtggtggagagtg

SEQ ID NO: 552839 - DNA, 20 bp, Artificial
  CRISPR gRNA sequence
tatgatgacttggatgttta

SEQ ID NO: 552840 - DNA, 20 bp, Artificial
  CRISPR gRNA sequence
ggatgaatagtctgtagagg

SEQ ID NO: 552841 - DNA, 20 bp, Artificial
  CRISPR gRNA sequence
gtatgtctttattagcagca

SEQ ID NO: 552842 - DNA, 20 bp, Artificial
  CRISPR gRNA sequence
tacgtggaactttgaacttg

SEQ ID NO: 552843 - DNA, 20 bp, Artificial
  CRISPR gRNA sequence
attatttagggcatctggtg

SEQ ID NO: 552844 - DNA, 20 bp, Artificial
  CRISPR gRNA sequence
atttgcagcccaatgatgca

SEQ ID NO: 552845 - DNA, 20 bp, Artificial
  CRISPR gRNA sequence
cagcccaatgatgcaataga

SEQ ID NO: 552846 - DNA, 20 bp, Artificial
  CRISPR gRNA sequence
aggaaaaattcaagccagct

SEQ ID NO: 552847 - DNA, 20 bp, Artificial
  CRISPR gRNA sequence
gaaaatgtctccagggcata

SEQ ID NO: 552848 - DNA, 20 bp, Artificial
  CRISPR gRNA sequence
gcctgtggatgcacagaagt

SEQ ID NO: 552849 - DNA, 20 bp, Artificial
  CRISPR gRNA sequence
gtatgtcattattagcagtg

SEQ ID NO: 552850 - DNA, 20 bp, Artificial
  CRISPR gRNA sequence
gaggggtgcttctttgggac

SEQ ID NO: 552851 - DNA, 20 bp, Artificial
  CRISPR gRNA sequence
attggtttctctgtttaaaa

SEQ ID NO: 552852 - DNA, 20 bp, Artificial
  CRISPR gRNA sequence
ataagatacagagactgtcc

SEQ ID NO: 552853 - DNA, 20 bp, Artificial
  CRISPR gRNA sequence
cctatgccagttaaaaatta

SEQ ID NO: 552854 - DNA, 20 bp, Artificial
  CRISPR gRNA sequence
ttgaagtttaacatacacat

SEQ ID NO: 552855 - DNA, 20 bp, Artificial
  CRISPR gRNA sequence
aaaataaaaaatcagattaa

SEQ ID NO: 552856 - DNA, 20 bp, Artificial
  CRISPR gRNA sequence
cccaacgatgaactgagtat

SEQ ID NO: 552857 - DNA, 20 bp, Artificial
  CRISPR gRNA sequence
aataccttgaatcagacttt

SEQ ID NO: 552858 - DNA, 20 bp, Artificial
  CRISPR gRNA sequence
tcaaagacaaatgtggcctt

SEQ ID NO: 552859 - DNA, 20 bp, Artificial
  CRISPR gRNA sequence
aggtctaaagggaaacatct

SEQ ID NO: 552860 - DNA, 20 bp, Artificial
  CRISPR gRNA sequence
aagggaaacatcttgagaaa

SEQ ID NO: 552861 - DNA, 20 bp, Artificial
  CRISPR gRNA sequence
aaataggttaagtgcaagaa

SEQ ID NO: 552862 - DNA, 20 bp, Artificial
  CRISPR gRNA sequence
catcatattagaaggaaagt

SEQ ID NO: 552863 - DNA, 20 bp, Artificial
  CRISPR gRNA sequence
tactttgataggcgtgttct

SEQ ID NO: 552864 - DNA, 20 bp, Artificial
  CRISPR gRNA sequence
aaaattgggactgactaata

SEQ ID NO: 552865 - DNA, 20 bp, Artificial
  CRISPR gRNA sequence
ctcagtgacccatatccaga

SEQ ID NO: 552866 - DNA, 20 bp, Artificial
  CRISPR gRNA sequence
tttatttctaagaacaaact

SEQ ID NO: 552867 - DNA, 20 bp, Artificial
  CRISPR gRNA sequence
actgcacaccaacctgggtg

SEQ ID NO: 552868 - DNA, 20 bp, Artificial
  CRISPR gRNA sequence
gaatgagaccctgtctccaa

SEQ ID NO: 552869 - DNA, 20 bp, Artificial
  CRISPR gRNA sequence
aaggagggagagagagaggg

SEQ ID NO: 552870 - DNA, 20 bp, Artificial
  CRISPR gRNA sequence
ggagagagagagggaaagaa

SEQ ID NO: 552871 - DNA, 20 bp, Artificial
  CRISPR gRNA sequence
ggaaagaaagagaaaaataa

SEQ ID NO: 552872 - DNA, 20 bp, Artificial
  CRISPR gRNA sequence
agaaagagaaaaataaaaag

SEQ ID NO: 552873 - DNA, 20 bp, Artificial
  CRISPR gRNA sequence
gagaaaaataaaaagaaaga

SEQ ID NO: 552874 - DNA, 20 bp, Artificial
  CRISPR gRNA sequence
aaaataaaaagaaagaaaag

SEQ ID NO: 552875 - DNA, 20 bp, Artificial
  CRISPR gRNA sequence
catcttgctttggtgatgag

SEQ ID NO: 552876 - DNA, 20 bp, Artificial
  CRISPR gRNA sequence
gctgtctatagattgtatcc

SEQ ID NO: 552877 - DNA, 20 bp, Artificial
  CRISPR gRNA sequence
atgccatgtagcaagctaaa

SEQ ID NO: 552878 - DNA, 20 bp, Artificial
  CRISPR gRNA sequence
tcacctgcaaaataataagg

SEQ ID NO: 552879 - DNA, 20 bp, Artificial
  CRISPR gRNA sequence
cggtgaccagattttctaaa

SEQ ID NO: 552880 - DNA, 20 bp, Artificial
  CRISPR gRNA sequence
aattgaggtgttgatgtttt

SEQ ID NO: 552881 - DNA, 20 bp, Artificial
  CRISPR gRNA sequence
tgttttgtagaaacactgca

SEQ ID NO: 552882 - DNA, 20 bp, Artificial
  CRISPR gRNA sequence
tcaaaaattatctggctagc

SEQ ID NO: 552883 - DNA, 20 bp, Artificial
  CRISPR gRNA sequence
gatgttgacctaactcatta

SEQ ID NO: 552884 - DNA, 20 bp, Artificial
  CRISPR gRNA sequence
taactcattaaaagaaaaag

SEQ ID NO: 552885 - DNA, 20 bp, Artificial
  CRISPR gRNA sequence
catccatggtttgtgacctt

SEQ ID NO: 552886 - DNA, 20 bp, Artificial
  CRISPR gRNA sequence
ttctattgttcttttgttca

SEQ ID NO: 552887 - DNA, 20 bp, Artificial
  CRISPR gRNA sequence
gtgttggccttggaagtgca

SEQ ID NO: 552888 - DNA, 20 bp, Artificial
  CRISPR gRNA sequence
cagtctaaaaaaagagcaag

SEQ ID NO: 552889 - DNA, 20 bp, Artificial
  CRISPR gRNA sequence
cactttggcctaccaaagtg

SEQ ID NO: 552890 - DNA, 20 bp, Artificial
  CRISPR gRNA sequence
taactttttatttttaatat

SEQ ID NO: 552891 - DNA, 20 bp, Artificial
  CRISPR gRNA sequence
ccaaattcccaataataaaa

SEQ ID NO: 552892 - DNA, 20 bp, Artificial
  CRISPR gRNA sequence
aatggcctccattggagcca

SEQ ID NO: 552893 - DNA, 20 bp, Artificial
  CRISPR gRNA sequence
atcagtcttccacaccatag

SEQ ID NO: 552894 - DNA, 20 bp, Artificial
  CRISPR gRNA sequence
cactttcattatgtaaaaat

SEQ ID NO: 552895 - DNA, 20 bp, Artificial
  CRISPR gRNA sequence
aaggagcctttaaactttga

SEQ ID NO: 552896 - DNA, 20 bp, Artificial
  CRISPR gRNA sequence
aggatgtgaaaagacatttc

SEQ ID NO: 552897 - DNA, 20 bp, Artificial
  CRISPR gRNA sequence
tgaaaagacatttctcagaa

SEQ ID NO: 552898 - DNA, 20 bp, Artificial
  CRISPR gRNA sequence
gaatattatgtagttattaa

SEQ ID NO: 552899 - DNA, 20 bp, Artificial
  CRISPR gRNA sequence
tgcataagaccatttttatt

SEQ ID NO: 552900 - DNA, 20 bp, Artificial
  CRISPR gRNA sequence
ctctcactttaaattaaaaa

SEQ ID NO: 552901 - DNA, 20 bp, Artificial
  CRISPR gRNA sequence
ctggttgggaggctgaggca

SEQ ID NO: 552902 - DNA, 20 bp, Artificial
  CRISPR gRNA sequence
ttgcactccagtctgggcta

SEQ ID NO: 552903 - DNA, 20 bp, Artificial
  CRISPR gRNA sequence
acaagaatgaaactctgtct

SEQ ID NO: 552904 - DNA, 20 bp, Artificial
  CRISPR gRNA sequence
gtctgaagaaaaaaaaaaaa

SEQ ID NO: 552905 - DNA, 20 bp, Artificial
  CRISPR gRNA sequence
gaagaaaaaaaaaaaaaaag

SEQ ID NO: 552906 - DNA, 20 bp, Artificial
  CRISPR gRNA sequence
aaaaaaaaaaaaaaagaaag

SEQ ID NO: 552907 - DNA, 20 bp, Artificial
  CRISPR gRNA sequence
tacttcagtgaacacataaa

SEQ ID NO: 552908 - DNA, 20 bp, Artificial
  CRISPR gRNA sequence
gaaacagcgttattgcagat

SEQ ID NO: 552909 - DNA, 20 bp, Artificial
  CRISPR gRNA sequence
tctgtgaaggctgagagagg

SEQ ID NO: 552910 - DNA, 20 bp, Artificial
  CRISPR gRNA sequence
agagaggtgagaaagctgca

SEQ ID NO: 552911 - DNA, 20 bp, Artificial
  CRISPR gRNA sequence
gttagttcatgagatcttag

SEQ ID NO: 552912 - DNA, 20 bp, Artificial
  CRISPR gRNA sequence
aagtgttgatgtagaagctg

SEQ ID NO: 552913 - DNA, 20 bp, Artificial
  CRISPR gRNA sequence
ctgaaaatttttagggccct

SEQ ID NO: 552914 - DNA, 20 bp, Artificial
  CRISPR gRNA sequence
ccactgttaatacttactgc

SEQ ID NO: 552915 - DNA, 20 bp, Artificial
  CRISPR gRNA sequence
ttcagcattctagatgtcat

SEQ ID NO: 552916 - DNA, 20 bp, Artificial
  CRISPR gRNA sequence
tcaacattaacaggagtttg

SEQ ID NO: 552917 - DNA, 20 bp, Artificial
  CRISPR gRNA sequence
tcaatattaacaggagtttg

SEQ ID NO: 552918 - DNA, 20 bp, Artificial
  CRISPR gRNA sequence
actttgaagggtggaaatag

SEQ ID NO: 552919 - DNA, 20 bp, Artificial
  CRISPR gRNA sequence
gttgcttcttatggatgagc

SEQ ID NO: 552920 - DNA, 20 bp, Artificial
  CRISPR gRNA sequence
gataaagcagcagcaggatt

SEQ ID NO: 552921 - DNA, 20 bp, Artificial
  CRISPR gRNA sequence
caaacagcattggatgcctc

SEQ ID NO: 552922 - DNA, 20 bp, Artificial
  CRISPR gRNA sequence
aactcatcattgtcttcttt

SEQ ID NO: 552923 - DNA, 20 bp, Artificial
  CRISPR gRNA sequence
catttatatgccctgggaaa

SEQ ID NO: 552924 - DNA, 20 bp, Artificial
  CRISPR gRNA sequence
tgtatctatttgactatatg

SEQ ID NO: 552925 - DNA, 20 bp, Artificial
  CRISPR gRNA sequence
tgttttaaaatacatttttt

SEQ ID NO: 552926 - DNA, 20 bp, Artificial
  CRISPR gRNA sequence
tggctttctttacttcaata

SEQ ID NO: 552927 - DNA, 20 bp, Artificial
  CRISPR gRNA sequence
tgtaaattctgcctccccta

SEQ ID NO: 552928 - DNA, 20 bp, Artificial
  CRISPR gRNA sequence
cttgttctcaaggatcttat

SEQ ID NO: 552929 - DNA, 20 bp, Artificial
  CRISPR gRNA sequence
ttcttacactaaattaagct

SEQ ID NO: 552930 - DNA, 20 bp, Artificial
  CRISPR gRNA sequence
taggaaaagcataaggtgta

SEQ ID NO: 552931 - DNA, 20 bp, Artificial
  CRISPR gRNA sequence
aaaaattctagaagataaca

SEQ ID NO: 552932 - DNA, 20 bp, Artificial
  CRISPR gRNA sequence
aacacacaacccacaaagtg

SEQ ID NO: 552933 - DNA, 20 bp, Artificial
  CRISPR gRNA sequence
atctgacaaaggaccaatat

SEQ ID NO: 552934 - DNA, 20 bp, Artificial
  CRISPR gRNA sequence
aaggaagtcaaacaaatcag

SEQ ID NO: 552935 - DNA, 20 bp, Artificial
  CRISPR gRNA sequence
gcaataccaccttactcctg

SEQ ID NO: 552936 - DNA, 20 bp, Artificial
  CRISPR gRNA sequence
ccatcaatcaatgagtggat

SEQ ID NO: 552937 - DNA, 20 bp, Artificial
  CRISPR gRNA sequence
ctactcaggaggctgaggca

SEQ ID NO: 552938 - DNA, 20 bp, Artificial
  CRISPR gRNA sequence
cagagcgagactctgtctca

SEQ ID NO: 552939 - DNA, 20 bp, Artificial
  CRISPR gRNA sequence
caagtgggagctaagctatg

SEQ ID NO: 552940 - DNA, 20 bp, Artificial
  CRISPR gRNA sequence
cacactgggtacagtgtaca

SEQ ID NO: 552941 - DNA, 20 bp, Artificial
  CRISPR gRNA sequence
gtacagtgtacaccagaatc

SEQ ID NO: 552942 - DNA, 20 bp, Artificial
  CRISPR gRNA sequence
tagtaataaaaaaatttaaa

SEQ ID NO: 552943 - DNA, 20 bp, Artificial
  CRISPR gRNA sequence
aaaagaaaaaaaagcataag

SEQ ID NO: 552944 - DNA, 20 bp, Artificial
  CRISPR gRNA sequence
tctcagggatggcagaggcg

SEQ ID NO: 552945 - DNA, 20 bp, Artificial
  CRISPR gRNA sequence
tagcacaaattaatggtcta

SEQ ID NO: 552946 - DNA, 20 bp, Artificial
  CRISPR gRNA sequence
caaattaatggtctatgaga

SEQ ID NO: 552947 - DNA, 20 bp, Artificial
  CRISPR gRNA sequence
tgtcattcctctgggtgagg

SEQ ID NO: 552948 - DNA, 20 bp, Artificial
  CRISPR gRNA sequence
gtgctcacacccatgtggtt

SEQ ID NO: 552949 - DNA, 20 bp, Artificial
  CRISPR gRNA sequence
tttgcttcttatttcactaa

SEQ ID NO: 552950 - DNA, 20 bp, Artificial
  CRISPR gRNA sequence
ttctacccactctctcctga

SEQ ID NO: 552951 - DNA, 20 bp, Artificial
  CRISPR gRNA sequence
ccacctgctgtcttcacttt

SEQ ID NO: 552952 - DNA, 20 bp, Artificial
  CRISPR gRNA sequence
aggaagttgtattggttcta

SEQ ID NO: 552953 - DNA, 20 bp, Artificial
  CRISPR gRNA sequence
tagaagatttccttgaaaaa

SEQ ID NO: 552954 - DNA, 20 bp, Artificial
  CRISPR gRNA sequence
caacaaacaagaggattgag

SEQ ID NO: 552955 - DNA, 20 bp, Artificial
  CRISPR gRNA sequence
atccaggtagatagagggtc

SEQ ID NO: 552956 - DNA, 20 bp, Artificial
  CRISPR gRNA sequence
atactatttttttttttttt

SEQ ID NO: 552957 - DNA, 20 bp, Artificial
  CRISPR gRNA sequence
agatgatgatttttatgtaa

SEQ ID NO: 552958 - DNA, 20 bp, Artificial
  CRISPR gRNA sequence
aaaatgtcatcagatatgtg

SEQ ID NO: 552959 - DNA, 20 bp, Artificial
  CRISPR gRNA sequence
gtggtaagtcccacgggcag

SEQ ID NO: 552960 - DNA, 20 bp, Artificial
  CRISPR gRNA sequence
agaaggaaaagatctgaggt

SEQ ID NO: 552961 - DNA, 20 bp, Artificial
  CRISPR gRNA sequence
gaaactgtgatctaggtgct

SEQ ID NO: 552962 - DNA, 20 bp, Artificial
  CRISPR gRNA sequence
actgttgtgtaatgagatag

SEQ ID NO: 552963 - DNA, 20 bp, Artificial
  CRISPR gRNA sequence
ctctttggagatagcgggta

SEQ ID NO: 552964 - DNA, 20 bp, Artificial
  CRISPR gRNA sequence
atgatgcacctctgttcagt

SEQ ID NO: 552965 - DNA, 20 bp, Artificial
  CRISPR gRNA sequence
ggcagagctagatcaataca

SEQ ID NO: 552966 - DNA, 20 bp, Artificial
  CRISPR gRNA sequence
ttcttaggcaccttaaaatt

SEQ ID NO: 552967 - DNA, 20 bp, Artificial
  CRISPR gRNA sequence
aaaggaccatttctaaggag

SEQ ID NO: 552968 - DNA, 20 bp, Artificial
  CRISPR gRNA sequence
aaagcttggttttctgcccc

SEQ ID NO: 552969 - DNA, 20 bp, Artificial
  CRISPR gRNA sequence
tgccactgaagatttaattc

SEQ ID NO: 552970 - DNA, 20 bp, Artificial
  CRISPR gRNA sequence
gattaaaagtctttttaatt

SEQ ID NO: 552971 - DNA, 20 bp, Artificial
  CRISPR gRNA sequence
taaaaactaggaagccccaa

SEQ ID NO: 552972 - DNA, 20 bp, Artificial
  CRISPR gRNA sequence
agcataagcattaacttgtc

SEQ ID NO: 552973 - DNA, 20 bp, Artificial
  CRISPR gRNA sequence
gcttttaaagggcaacaatg

SEQ ID NO: 552974 - DNA, 20 bp, Artificial
  CRISPR gRNA sequence
taatgaatatttgaagtgag

SEQ ID NO: 552975 - DNA, 20 bp, Artificial
  CRISPR gRNA sequence
gcttcagagattttttgatt

SEQ ID NO: 552976 - DNA, 20 bp, Artificial
  CRISPR gRNA sequence
cctgaaactgggtaatttat

SEQ ID NO: 552977 - DNA, 20 bp, Artificial
  CRISPR gRNA sequence
tgagaactcactctctatca

SEQ ID NO: 552978 - DNA, 20 bp, Artificial
  CRISPR gRNA sequence
caggtagatctgacctagca

SEQ ID NO: 552979 - DNA, 20 bp, Artificial
  CRISPR gRNA sequence
tagatctgacctagcaaaag

SEQ ID NO: 552980 - DNA, 20 bp, Artificial
  CRISPR gRNA sequence
ccaacaagttacaattttta

SEQ ID NO: 552981 - DNA, 20 bp, Artificial
  CRISPR gRNA sequence
tacttatccctgtttcctgg

SEQ ID NO: 552982 - DNA, 20 bp, Artificial
  CRISPR gRNA sequence
aaaatagtaaatactattat

SEQ ID NO: 552983 - DNA, 20 bp, Artificial
  CRISPR gRNA sequence
aacaggattccagggcaaat

SEQ ID NO: 552984 - DNA, 20 bp, Artificial
  CRISPR gRNA sequence
ataagggaaattagcaaata

SEQ ID NO: 552985 - DNA, 20 bp, Artificial
  CRISPR gRNA sequence
gggaaaggaaagacattttt

SEQ ID NO: 552986 - DNA, 20 bp, Artificial
  CRISPR gRNA sequence
acgagggcatgtctgatggg

SEQ ID NO: 552987 - DNA, 20 bp, Artificial
  CRISPR gRNA sequence
aagctcacggatcaggtgat

SEQ ID NO: 552988 - DNA, 20 bp, Artificial
  CRISPR gRNA sequence
tttacctaaagcagtaaaaa

SEQ ID NO: 552989 - DNA, 20 bp, Artificial
  CRISPR gRNA sequence
tgaagaagttcatgacttgg

SEQ ID NO: 552990 - DNA, 20 bp, Artificial
  CRISPR gRNA sequence
agcctctctttgacgagaga

SEQ ID NO: 552991 - DNA, 20 bp, Artificial
  CRISPR gRNA sequence
aaccaacatctgatatggaa

SEQ ID NO: 552992 - DNA, 20 bp, Artificial
  CRISPR gRNA sequence
caccgtgaaaatgaagagga

SEQ ID NO: 552993 - DNA, 20 bp, Artificial
  CRISPR gRNA sequence
ggaaaaataaagtagtcata

SEQ ID NO: 552994 - DNA, 20 bp, Artificial
  CRISPR gRNA sequence
agagttctggtttaccatct

SEQ ID NO: 552995 - DNA, 20 bp, Artificial
  CRISPR gRNA sequence
gatgggtgtactattgactg

SEQ ID NO: 552996 - DNA, 20 bp, Artificial
  CRISPR gRNA sequence
actattgactggaagaaagg

SEQ ID NO: 552997 - DNA, 20 bp, Artificial
  CRISPR gRNA sequence
aatgttactgtcaaaaccat

SEQ ID NO: 552998 - DNA, 20 bp, Artificial
  CRISPR gRNA sequence
cactgaaagcatctggggac

SEQ ID NO: 552999 - DNA, 20 bp, Artificial
  CRISPR gRNA sequence
agtggcaactgaaatgcatt

SEQ ID NO: 553000 - DNA, 20 bp, Artificial
  CRISPR gRNA sequence
tgaattctttcctttcattt

SEQ ID NO: 553001 - DNA, 20 bp, Artificial
  CRISPR gRNA sequence
gcaggagcaagggctgtgcg

SEQ ID NO: 553002 - DNA, 20 bp, Artificial
  CRISPR gRNA sequence
tttcaatttgtacataatag

SEQ ID NO: 553003 - DNA, 20 bp, Artificial
  CRISPR gRNA sequence
ctattaaagttatgaaacac

SEQ ID NO: 553004 - DNA, 20 bp, Artificial
  CRISPR gRNA sequence
ttatgaaacacggagaaaaa

SEQ ID NO: 553005 - DNA, 20 bp, Artificial
  CRISPR gRNA sequence
tagatttgatttttgaagac

SEQ ID NO: 553006 - DNA, 20 bp, Artificial
  CRISPR gRNA sequence
tttctgagtaagatccctct

SEQ ID NO: 553007 - DNA, 20 bp, Artificial
  CRISPR gRNA sequence
gtttaactttatgtttgcca

SEQ ID NO: 553008 - DNA, 20 bp, Artificial
  CRISPR gRNA sequence
gacagttgttacttaccttt

SEQ ID NO: 553009 - DNA, 20 bp, Artificial
  CRISPR gRNA sequence
ctacttgggaggctgaggca

SEQ ID NO: 553010 - DNA, 20 bp, Artificial
  CRISPR gRNA sequence
ttccgtctcaaaaaaaaaaa

SEQ ID NO: 553011 - DNA, 20 bp, Artificial
  CRISPR gRNA sequence
gggtcacttaagtattggag

SEQ ID NO: 553012 - DNA, 20 bp, Artificial
  CRISPR gRNA sequence
tttattcatatgaatgagct

SEQ ID NO: 553013 - DNA, 20 bp, Artificial
  CRISPR gRNA sequence
tgtcataccgtcactgcaac

SEQ ID NO: 553014 - DNA, 20 bp, Artificial
  CRISPR gRNA sequence
ctagttaaacacaatctaaa

SEQ ID NO: 553015 - DNA, 20 bp, Artificial
  CRISPR gRNA sequence
taagaagatgactcagagat

SEQ ID NO: 553016 - DNA, 20 bp, Artificial
  CRISPR gRNA sequence
tccaaggcattgggagatgg

SEQ ID NO: 553017 - DNA, 20 bp, Artificial
  CRISPR gRNA sequence
gatgttcagagatctcaagg

SEQ ID NO: 553018 - DNA, 20 bp, Artificial
  CRISPR gRNA sequence
tatagacagacttatacaga

SEQ ID NO: 553019 - DNA, 20 bp, Artificial
  CRISPR gRNA sequence
aaattgagaagttgagggca

SEQ ID NO: 553020 - DNA, 20 bp, Artificial
  CRISPR gRNA sequence
agagaacatgggattgggag

SEQ ID NO: 553021 - DNA, 20 bp, Artificial
  CRISPR gRNA sequence
gtcaaaggctatttccaggt

SEQ ID NO: 553022 - DNA, 20 bp, Artificial
  CRISPR gRNA sequence
atttatggaccaagaacata

SEQ ID NO: 553023 - DNA, 20 bp, Artificial
  CRISPR gRNA sequence
acaccctttgatcttactcc

SEQ ID NO: 553024 - DNA, 20 bp, Artificial
  CRISPR gRNA sequence
tcttactcctaagaaaaaag

SEQ ID NO: 553025 - DNA, 20 bp, Artificial
  CRISPR gRNA sequence
agaaattggaaaaattcatc

SEQ ID NO: 553026 - DNA, 20 bp, Artificial
  CRISPR gRNA sequence
taggaaaaaggagaagaagg

SEQ ID NO: 553027 - DNA, 20 bp, Artificial
  CRISPR gRNA sequence
aatattatgtagactgagat

SEQ ID NO: 553028 - DNA, 20 bp, Artificial
  CRISPR gRNA sequence
tagactgagataaagaatgt

SEQ ID NO: 553029 - DNA, 20 bp, Artificial
  CRISPR gRNA sequence
aaccagatgaaatgtaacag

SEQ ID NO: 553030 - DNA, 20 bp, Artificial
  CRISPR gRNA sequence
cttttatgactttccactgg

SEQ ID NO: 553031 - DNA, 20 bp, Artificial
  CRISPR gRNA sequence
ccactgggaagaatagtgat

SEQ ID NO: 553032 - DNA, 20 bp, Artificial
  CRISPR gRNA sequence
ttcactctgcttttaaaaat

SEQ ID NO: 553033 - DNA, 20 bp, Artificial
  CRISPR gRNA sequence
gtaattaataatcttccaaa

SEQ ID NO: 553034 - DNA, 20 bp, Artificial
  CRISPR gRNA sequence
aattctaccagatatttaag

SEQ ID NO: 553035 - DNA, 20 bp, Artificial
  CRISPR gRNA sequence
gctaaaaccaaagaacaata

SEQ ID NO: 553036 - DNA, 20 bp, Artificial
  CRISPR gRNA sequence
aaccaaagaacaatacaaga

SEQ ID NO: 553037 - DNA, 20 bp, Artificial
  CRISPR gRNA sequence
tatttctcatgaacatacat

SEQ ID NO: 553038 - DNA, 20 bp, Artificial
  CRISPR gRNA sequence
caaattggatccaacagcat

SEQ ID NO: 553039 - DNA, 20 bp, Artificial
  CRISPR gRNA sequence
ttggatccaacagcatatag

SEQ ID NO: 553040 - DNA, 20 bp, Artificial
  CRISPR gRNA sequence
catcacattgacagactatg

SEQ ID NO: 553041 - DNA, 20 bp, Artificial
  CRISPR gRNA sequence
acatgatcataccaatagat

SEQ ID NO: 553042 - DNA, 20 bp, Artificial
  CRISPR gRNA sequence
gctaacatcatctgtaatgg

SEQ ID NO: 553043 - DNA, 20 bp, Artificial
  CRISPR gRNA sequence
tgaagctttccaactaagac

SEQ ID NO: 553044 - DNA, 20 bp, Artificial
  CRISPR gRNA sequence
cactaactaatgccataaga

SEQ ID NO: 553045 - DNA, 20 bp, Artificial
  CRISPR gRNA sequence
aataaaagttatacagatga

SEQ ID NO: 553046 - DNA, 20 bp, Artificial
  CRISPR gRNA sequence
aaagttatacagatgagaag

SEQ ID NO: 553047 - DNA, 20 bp, Artificial
  CRISPR gRNA sequence
ttatacagatgagaagaaag

SEQ ID NO: 553048 - DNA, 20 bp, Artificial
  CRISPR gRNA sequence
aaatatgtcccagatttata

SEQ ID NO: 553049 - DNA, 20 bp, Artificial
  CRISPR gRNA sequence
ttaaatgggcaggcaaaaga

SEQ ID NO: 553050 - DNA, 20 bp, Artificial
  CRISPR gRNA sequence
agtgaatcggaatagagagc

SEQ ID NO: 553051 - DNA, 20 bp, Artificial
  CRISPR gRNA sequence
cataagactcctaaaacata

SEQ ID NO: 553052 - DNA, 20 bp, Artificial
  CRISPR gRNA sequence
caccaaagacatgattcatg

SEQ ID NO: 553053 - DNA, 20 bp, Artificial
  CRISPR gRNA sequence
aaagacatgattcatgaaag

SEQ ID NO: 553054 - DNA, 20 bp, Artificial
  CRISPR gRNA sequence
ctctatgaaagacaatttca

SEQ ID NO: 553055 - DNA, 20 bp, Artificial
  CRISPR gRNA sequence
agaagccaagccacagactg

SEQ ID NO: 553056 - DNA, 20 bp, Artificial
  CRISPR gRNA sequence
aaaaaacttttaaaactcaa

SEQ ID NO: 553057 - DNA, 20 bp, Artificial
  CRISPR gRNA sequence
aactgtggtacatacagaca

SEQ ID NO: 553058 - DNA, 20 bp, Artificial
  CRISPR gRNA sequence
ttaaatgcatattataagtc

SEQ ID NO: 553059 - DNA, 20 bp, Artificial
  CRISPR gRNA sequence
ttatacatttgtccaaaccc

SEQ ID NO: 553060 - DNA, 20 bp, Artificial
  CRISPR gRNA sequence
tttttaatgataatgatgta

SEQ ID NO: 553061 - DNA, 20 bp, Artificial
  CRISPR gRNA sequence
ctaaggataaaaagaactat

SEQ ID NO: 553062 - DNA, 20 bp, Artificial
  CRISPR gRNA sequence
atattgggatgtttggcatg

SEQ ID NO: 553063 - DNA, 20 bp, Artificial
  CRISPR gRNA sequence
ccattaatgtattttgtctc

SEQ ID NO: 553064 - DNA, 20 bp, Artificial
  CRISPR gRNA sequence
gttctgtccattgaaatgtt

SEQ ID NO: 553065 - DNA, 20 bp, Artificial
  CRISPR gRNA sequence
tatcttattttaccacagaa

SEQ ID NO: 553066 - DNA, 20 bp, Artificial
  CRISPR gRNA sequence
taagacaattggaacatcaa

SEQ ID NO: 553067 - DNA, 20 bp, Artificial
  CRISPR gRNA sequence
aaaactcactggtcatctct

SEQ ID NO: 553068 - DNA, 20 bp, Artificial
  CRISPR gRNA sequence
tcattattttgaaaaacgat

SEQ ID NO: 553069 - DNA, 20 bp, Artificial
  CRISPR gRNA sequence
tgaaaaacgataaagaaaga

SEQ ID NO: 553070 - DNA, 20 bp, Artificial
  CRISPR gRNA sequence
cagtggcactgacatcatga

SEQ ID NO: 553071 - DNA, 20 bp, Artificial
  CRISPR gRNA sequence
attttccccaggataacatc

SEQ ID NO: 553072 - DNA, 20 bp, Artificial
  CRISPR gRNA sequence
tctcgagtatagttaccctg

SEQ ID NO: 553073 - DNA, 20 bp, Artificial
  CRISPR gRNA sequence
aggcttattatatacaactg

SEQ ID NO: 553074 - DNA, 20 bp, Artificial
  CRISPR gRNA sequence
ccactggcagtatgagatgg

SEQ ID NO: 553075 - DNA, 20 bp, Artificial
  CRISPR gRNA sequence
gcttgtgcatataagtttgt

SEQ ID NO: 553076 - DNA, 20 bp, Artificial
  CRISPR gRNA sequence
ttcatcactgttcttatgtc

SEQ ID NO: 553077 - DNA, 20 bp, Artificial
  CRISPR gRNA sequence
cttgcattgttttccaaagg

SEQ ID NO: 553078 - DNA, 20 bp, Artificial
  CRISPR gRNA sequence
ttgaaattttagacatttga

SEQ ID NO: 553079 - DNA, 20 bp, Artificial
  CRISPR gRNA sequence
aagatccacattatctcaag

SEQ ID NO: 553080 - DNA, 20 bp, Artificial
  CRISPR gRNA sequence
gcttggagaactgatgactt

SEQ ID NO: 553081 - DNA, 20 bp, Artificial
  CRISPR gRNA sequence
taaggaataatcctatcatt

SEQ ID NO: 553082 - DNA, 20 bp, Artificial
  CRISPR gRNA sequence
cagtattataacgatcagct

SEQ ID NO: 553083 - DNA, 20 bp, Artificial
  CRISPR gRNA sequence
tctcctgaacaggttggttc

SEQ ID NO: 553084 - DNA, 20 bp, Artificial
  CRISPR gRNA sequence
aaaaaaaagtcattcaatat

SEQ ID NO: 553085 - DNA, 20 bp, Artificial
  CRISPR gRNA sequence
tgtttctaagaccgtgtgtg

SEQ ID NO: 553086 - DNA, 20 bp, Artificial
  CRISPR gRNA sequence
tttaggtattctgaaatgtg

SEQ ID NO: 553087 - DNA, 20 bp, Artificial
  CRISPR gRNA sequence
cactccctccacctcccatc

SEQ ID NO: 553088 - DNA, 20 bp, Artificial
  CRISPR gRNA sequence
ctattagaggcctaaatatg

SEQ ID NO: 553089 - DNA, 20 bp, Artificial
  CRISPR gRNA sequence
aaattggtcagaacatgata

SEQ ID NO: 553090 - DNA, 20 bp, Artificial
  CRISPR gRNA sequence
catgatagaaaaccaaatgc

SEQ ID NO: 553091 - DNA, 20 bp, Artificial
  CRISPR gRNA sequence
ttatgcattgggcaatagct

SEQ ID NO: 553092 - DNA, 20 bp, Artificial
  CRISPR gRNA sequence
tctagttctgcactgaccaa

SEQ ID NO: 553093 - DNA, 20 bp, Artificial
  CRISPR gRNA sequence
cgtaagtcacttaactcaac

SEQ ID NO: 553094 - DNA, 20 bp, Artificial
  CRISPR gRNA sequence
aaactattttctgacctttg

SEQ ID NO: 553095 - DNA, 20 bp, Artificial
  CRISPR gRNA sequence
tcagacataagaacagtgat

SEQ ID NO: 553096 - DNA, 20 bp, Artificial
  CRISPR gRNA sequence
tatttaaacagagacacaca

SEQ ID NO: 553097 - DNA, 20 bp, Artificial
  CRISPR gRNA sequence
tacttaatataccataaggc

SEQ ID NO: 553098 - DNA, 20 bp, Artificial
  CRISPR gRNA sequence
agcagctccttgttttcaca

SEQ ID NO: 553099 - DNA, 20 bp, Artificial
  CRISPR gRNA sequence
ctgctaactacataattact

SEQ ID NO: 553100 - DNA, 20 bp, Artificial
  CRISPR gRNA sequence
cacccaaattactatgtttt

SEQ ID NO: 553101 - DNA, 20 bp, Artificial
  CRISPR gRNA sequence
tttgagtttcaggttcacaa

SEQ ID NO: 553102 - DNA, 20 bp, Artificial
  CRISPR gRNA sequence
tattcatgtcatctgagaac

SEQ ID NO: 553103 - DNA, 20 bp, Artificial
  CRISPR gRNA sequence
gaacatctgtagcatgggca

SEQ ID NO: 553104 - DNA, 20 bp, Artificial
  CRISPR gRNA sequence
attcatatgaataaatcaaa

SEQ ID NO: 553105 - DNA, 20 bp, Artificial
  CRISPR gRNA sequence
gagtcaggatggtatcatac

SEQ ID NO: 553106 - DNA, 20 bp, Artificial
  CRISPR gRNA sequence
ggaaagtttagatgagaaat

SEQ ID NO: 553107 - DNA, 20 bp, Artificial
  CRISPR gRNA sequence
aacataaagttttgcaaggg

SEQ ID NO: 553108 - DNA, 20 bp, Artificial
  CRISPR gRNA sequence
attttgtctcttggaacact

SEQ ID NO: 553109 - DNA, 20 bp, Artificial
  CRISPR gRNA sequence
ttaactttgcagctcgtttt

SEQ ID NO: 553110 - DNA, 20 bp, Artificial
  CRISPR gRNA sequence
ctaactattatgtacaaatt

SEQ ID NO: 553111 - DNA, 20 bp, Artificial
  CRISPR gRNA sequence
actcagcagattaagcagct

SEQ ID NO: 553112 - DNA, 20 bp, Artificial
  CRISPR gRNA sequence
aggctgcagagggtattgga

SEQ ID NO: 553113 - DNA, 20 bp, Artificial
  CRISPR gRNA sequence
aaagtgaaaatcatgcactt

SEQ ID NO: 553114 - DNA, 20 bp, Artificial
  CRISPR gRNA sequence
acataggctgtccagggtca

SEQ ID NO: 553115 - DNA, 20 bp, Artificial
  CRISPR gRNA sequence
agtcgctcctgtaaagctgc

SEQ ID NO: 553116 - DNA, 20 bp, Artificial
  CRISPR gRNA sequence
atctgaaggaaccccatctg

SEQ ID NO: 553117 - DNA, 20 bp, Artificial
  CRISPR gRNA sequence
gtccacacgaaacttacaat

SEQ ID NO: 553118 - DNA, 20 bp, Artificial
  CRISPR gRNA sequence
cgatgaccatcgccctacgg

SEQ ID NO: 553119 - DNA, 20 bp, Artificial
  CRISPR gRNA sequence
gtcctggacgtctccacctt

SEQ ID NO: 553120 - DNA, 20 bp, Artificial
  CRISPR gRNA sequence
taaactggggatataatgta

SEQ ID NO: 553121 - DNA, 20 bp, Artificial
  CRISPR gRNA sequence
attacaaatgtaaataatac

SEQ ID NO: 553122 - DNA, 20 bp, Artificial
  CRISPR gRNA sequence
aaagcagcattgtgaatagt

SEQ ID NO: 553123 - DNA, 20 bp, Artificial
  CRISPR gRNA sequence
gtagttctttatagcagtgt

SEQ ID NO: 553124 - DNA, 20 bp, Artificial
  CRISPR gRNA sequence
agaggcctgaggaaacatgc

SEQ ID NO: 553125 - DNA, 20 bp, Artificial
  CRISPR gRNA sequence
ctgggcatttctcaggggca

SEQ ID NO: 553126 - DNA, 20 bp, Artificial
  CRISPR gRNA sequence
agaaaagaaaagaaaagaaa

SEQ ID NO: 553127 - DNA, 20 bp, Artificial
  CRISPR gRNA sequence
ctagaagattaccaggttac

SEQ ID NO: 553128 - DNA, 20 bp, Artificial
  CRISPR gRNA sequence
atcttatgtctttttacaac

SEQ ID NO: 553129 - DNA, 20 bp, Artificial
  CRISPR gRNA sequence
caatatcactgcctcctgat

SEQ ID NO: 553130 - DNA, 20 bp, Artificial
  CRISPR gRNA sequence
tatccagttggtctgactaa

SEQ ID NO: 553131 - DNA, 20 bp, Artificial
  CRISPR gRNA sequence
tagaatattttaaattattt

SEQ ID NO: 553132 - DNA, 20 bp, Artificial
  CRISPR gRNA sequence
aaataaaatggtgcaggagg

SEQ ID NO: 553133 - DNA, 20 bp, Artificial
  CRISPR gRNA sequence
gctgtcactacatctctttc

SEQ ID NO: 553134 - DNA, 20 bp, Artificial
  CRISPR gRNA sequence
tcctctataccagaaaagga

SEQ ID NO: 553135 - DNA, 20 bp, Artificial
  CRISPR gRNA sequence
attaatttgtgctagtctct

SEQ ID NO: 553136 - DNA, 20 bp, Artificial
  CRISPR gRNA sequence
aacaccatatatttgttggg

SEQ ID NO: 553137 - DNA, 20 bp, Artificial
  CRISPR gRNA sequence
agaaaaaaaaattggttaga

SEQ ID NO: 553138 - DNA, 20 bp, Artificial
  CRISPR gRNA sequence
gtggagcttactctttaata

SEQ ID NO: 553139 - DNA, 20 bp, Artificial
  CRISPR gRNA sequence
cctgtctcaacaaacaaaca

SEQ ID NO: 553140 - DNA, 20 bp, Artificial
  CRISPR gRNA sequence
aattaaggggaactgccctc

SEQ ID NO: 553141 - DNA, 20 bp, Artificial
  CRISPR gRNA sequence
tttctttaaaaaatgtattt

SEQ ID NO: 553142 - DNA, 20 bp, Artificial
  CRISPR gRNA sequence
catacaactttacactaatg

SEQ ID NO: 553143 - DNA, 20 bp, Artificial
  CRISPR gRNA sequence
tgttcaatagcattatgtct

SEQ ID NO: 553144 - DNA, 20 bp, Artificial
  CRISPR gRNA sequence
aatactttattgctgaaaaa

SEQ ID NO: 553145 - DNA, 20 bp, Artificial
  CRISPR gRNA sequence
tgatagaattttactcacag

SEQ ID NO: 553146 - DNA, 20 bp, Artificial
  CRISPR gRNA sequence
gatgttgtattagcaagcat

SEQ ID NO: 553147 - DNA, 20 bp, Artificial
  CRISPR gRNA sequence
acgcatggttcttggcatcc

SEQ ID NO: 553148 - DNA, 20 bp, Artificial
  CRISPR gRNA sequence
actaaaatgtaacagagaga

SEQ ID NO: 553149 - DNA, 20 bp, Artificial
  CRISPR gRNA sequence
ttcaagagacattagggagg

SEQ ID NO: 553150 - DNA, 20 bp, Artificial
  CRISPR gRNA sequence
tttaaagcttggctagaggg

SEQ ID NO: 553151 - DNA, 20 bp, Artificial
  CRISPR gRNA sequence
gcagaattaaacacacatac

SEQ ID NO: 553152 - DNA, 20 bp, Artificial
  CRISPR gRNA sequence
ttattcaggatgttaacaaa

SEQ ID NO: 553153 - DNA, 20 bp, Artificial
  CRISPR gRNA sequence
tgcagaatattcctcttttt

SEQ ID NO: 553154 - DNA, 20 bp, Artificial
  CRISPR gRNA sequence
tcctattactattataatat

SEQ ID NO: 553155 - DNA, 20 bp, Artificial
  CRISPR gRNA sequence
gagttgttaagaactgtctc

SEQ ID NO: 553156 - DNA, 20 bp, Artificial
  CRISPR gRNA sequence
tatagagtgatcacatatct

SEQ ID NO: 553157 - DNA, 20 bp, Artificial
  CRISPR gRNA sequence
attctgttgcagtgtttcta

SEQ ID NO: 553158 - DNA, 20 bp, Artificial
  CRISPR gRNA sequence
aaaaaaaaaatcagaatcct

SEQ ID NO: 553159 - DNA, 20 bp, Artificial
  CRISPR gRNA sequence
cagaccagaaacaataaaaa

SEQ ID NO: 553160 - DNA, 20 bp, Artificial
  CRISPR gRNA sequence
caggagccctcatatacaac

SEQ ID NO: 553161 - DNA, 20 bp, Artificial
  CRISPR gRNA sequence
aggcaggatatagcaatgaa

SEQ ID NO: 553162 - DNA, 20 bp, Artificial
  CRISPR gRNA sequence
tgccattaaaaaaaaatagc

SEQ ID NO: 553163 - DNA, 20 bp, Artificial
  CRISPR gRNA sequence
taagggtctgtgtccttaag

SEQ ID NO: 553164 - DNA, 20 bp, Artificial
  CRISPR gRNA sequence
tgagaagaaaccaaaaggca

SEQ ID NO: 553165 - DNA, 20 bp, Artificial
  CRISPR gRNA sequence
aagaggttctaagactattt

SEQ ID NO: 553166 - DNA, 20 bp, Artificial
  CRISPR gRNA sequence
tgaaagatgcccatcaaaat

SEQ ID NO: 553167 - DNA, 20 bp, Artificial
  CRISPR gRNA sequence
gcccatcaaaattaaaacaa

SEQ ID NO: 553168 - DNA, 20 bp, Artificial
  CRISPR gRNA sequence
aatcagtgtgacaattaaat

SEQ ID NO: 553169 - DNA, 20 bp, Artificial
  CRISPR gRNA sequence
ggattatctttgctaaataa

SEQ ID NO: 553170 - DNA, 20 bp, Artificial
  CRISPR gRNA sequence
aacaatctttactattaaaa

SEQ ID NO: 553171 - DNA, 20 bp, Artificial
  CRISPR gRNA sequence
aatctcatgtcctcacattt

SEQ ID NO: 553172 - DNA, 20 bp, Artificial
  CRISPR gRNA sequence
tccaaatgggagaaattgtc

SEQ ID NO: 553173 - DNA, 20 bp, Artificial
  CRISPR gRNA sequence
cttttagccatggctggagc

SEQ ID NO: 553174 - DNA, 20 bp, Artificial
  CRISPR gRNA sequence
accacatctttgtgaacata

SEQ ID NO: 553175 - DNA, 20 bp, Artificial
  CRISPR gRNA sequence
aatgctgccagtctctttgc

SEQ ID NO: 553176 - DNA, 20 bp, Artificial
  CRISPR gRNA sequence
aatcctgccagctccacctt

SEQ ID NO: 553177 - DNA, 20 bp, Artificial
  CRISPR gRNA sequence
cactcctgttcaaaatcctt

SEQ ID NO: 553178 - DNA, 20 bp, Artificial
  CRISPR gRNA sequence
caaaatatttaaaaggccct

SEQ ID NO: 553179 - DNA, 20 bp, Artificial
  CRISPR gRNA sequence
tattatggagttatatcttg

SEQ ID NO: 553180 - DNA, 20 bp, Artificial
  CRISPR gRNA sequence
gggtgaactcctgactttgt

SEQ ID NO: 553181 - DNA, 20 bp, Artificial
  CRISPR gRNA sequence
aaactctatttcttaacttt

SEQ ID NO: 553182 - DNA, 20 bp, Artificial
  CRISPR gRNA sequence
gaccagcctgggcaacatgg

SEQ ID NO: 553183 - DNA, 20 bp, Artificial
  CRISPR gRNA sequence
tagggaaaccctgtttctac

SEQ ID NO: 553184 - DNA, 20 bp, Artificial
  CRISPR gRNA sequence
gaagaatcaccataggatac

SEQ ID NO: 553185 - DNA, 20 bp, Artificial
  CRISPR gRNA sequence
acaggatattcactcaacct

SEQ ID NO: 553186 - DNA, 20 bp, Artificial
  CRISPR gRNA sequence
cagatggcaaaaataacaaa

SEQ ID NO: 553187 - DNA, 20 bp, Artificial
  CRISPR gRNA sequence
aattgttctaaaatttcaaa

SEQ ID NO: 553188 - DNA, 20 bp, Artificial
  CRISPR gRNA sequence
ttttcctcccctcaaatcct

SEQ ID NO: 553189 - DNA, 20 bp, Artificial
  CRISPR gRNA sequence
tggccccagtcaggccatag

SEQ ID NO: 553190 - DNA, 20 bp, Artificial
  CRISPR gRNA sequence
gagacagtaagtaaatgagt

SEQ ID NO: 553191 - DNA, 20 bp, Artificial
  CRISPR gRNA sequence
ctttttaaccccctttaacc

SEQ ID NO: 553192 - DNA, 20 bp, Artificial
  CRISPR gRNA sequence
cagtgaaaccctgtctctac

SEQ ID NO: 553193 - DNA, 20 bp, Artificial
  CRISPR gRNA sequence
gagactctgtctcaaaaaaa

SEQ ID NO: 553194 - DNA, 20 bp, Artificial
  CRISPR gRNA sequence
gtctcaaaaaaaaaaaacaa

SEQ ID NO: 553195 - DNA, 20 bp, Artificial
  CRISPR gRNA sequence
aaaaaaaaaaaacaaaaaaa

SEQ ID NO: 553196 - DNA, 20 bp, Artificial
  CRISPR gRNA sequence
aaaaaaacaaaaaaacaaaa

SEQ ID NO: 553197 - DNA, 20 bp, Artificial
  CRISPR gRNA sequence
ccaatgatgcaatagaaaag

SEQ ID NO: 553198 - DNA, 20 bp, Artificial
  CRISPR gRNA sequence
agtgttgtgtgttcctatag

SEQ ID NO: 553199 - DNA, 20 bp, Artificial
  CRISPR gRNA sequence
attgtccaatgaaattctgc

SEQ ID NO: 553200 - DNA, 20 bp, Artificial
  CRISPR gRNA sequence
cacaagagtgtcttttgtta

SEQ ID NO: 553201 - DNA, 20 bp, Artificial
  CRISPR gRNA sequence
ctgtccctagaaaaggaggg

SEQ ID NO: 553202 - DNA, 20 bp, Artificial
  CRISPR gRNA sequence
agactttggagaatagattt

SEQ ID NO: 553203 - DNA, 20 bp, Artificial
  CRISPR gRNA sequence
tgctatttttttttaatggc

SEQ ID NO: 553204 - DNA, 20 bp, Artificial
  CRISPR gRNA sequence
tgtatgaaacttgattgagt

SEQ ID NO: 553205 - DNA, 20 bp, Artificial
  CRISPR gRNA sequence
atttctaagaacaaactcaa

SEQ ID NO: 553206 - DNA, 20 bp, Artificial
  CRISPR gRNA sequence
tgaggcagaaagtggggctg

SEQ ID NO: 553207 - DNA, 20 bp, Artificial
  CRISPR gRNA sequence
agacatatggggatacagcc

SEQ ID NO: 553208 - DNA, 20 bp, Artificial
  CRISPR gRNA sequence
caaaataataaggttagaaa

SEQ ID NO: 553209 - DNA, 20 bp, Artificial
  CRISPR gRNA sequence
aaatcaggatacttcatcta

SEQ ID NO: 553210 - DNA, 20 bp, Artificial
  CRISPR gRNA sequence
aaaaaaaattcaaaattctt

SEQ ID NO: 553211 - DNA, 20 bp, Artificial
  CRISPR gRNA sequence
ttcaaaattcttcaaaacaa

SEQ ID NO: 553212 - DNA, 20 bp, Artificial
  CRISPR gRNA sequence
tctctttgcttttaaacagc

SEQ ID NO: 553213 - DNA, 20 bp, Artificial
  CRISPR gRNA sequence
ctcattaaaagaaaaagaga

SEQ ID NO: 553214 - DNA, 20 bp, Artificial
  CRISPR gRNA sequence
tctcaattttattcaaacct

SEQ ID NO: 553215 - DNA, 20 bp, Artificial
  CRISPR gRNA sequence
atggtttgtgacctttgaga

SEQ ID NO: 553216 - DNA, 20 bp, Artificial
  CRISPR gRNA sequence
aaagtaaccgtggttacttt

SEQ ID NO: 553217 - DNA, 20 bp, Artificial
  CRISPR gRNA sequence
ggcaaaggctgtatttgaaa

SEQ ID NO: 553218 - DNA, 20 bp, Artificial
  CRISPR gRNA sequence
cctttaaactttgagaagaa

SEQ ID NO: 553219 - DNA, 20 bp, Artificial
  CRISPR gRNA sequence
actgtctctcactttaaatt

SEQ ID NO: 553220 - DNA, 20 bp, Artificial
  CRISPR gRNA sequence
aaaaaaagccacgatgggct

SEQ ID NO: 553221 - DNA, 20 bp, Artificial
  CRISPR gRNA sequence
agaaagccatctccataaca

SEQ ID NO: 553222 - DNA, 20 bp, Artificial
  CRISPR gRNA sequence
caacagattttcaatgtaga

SEQ ID NO: 553223 - DNA, 20 bp, Artificial
  CRISPR gRNA sequence
ggaagggtccattgatgcag

SEQ ID NO: 553224 - DNA, 20 bp, Artificial
  CRISPR gRNA sequence
atgtataactcttgactccc

SEQ ID NO: 553225 - DNA, 20 bp, Artificial
  CRISPR gRNA sequence
aaatcaactcaaggtggatc

SEQ ID NO: 553226 - DNA, 20 bp, Artificial
  CRISPR gRNA sequence
attctagaagataacatcag

SEQ ID NO: 553227 - DNA, 20 bp, Artificial
  CRISPR gRNA sequence
aaggtcatgaccaagaaccc

SEQ ID NO: 553228 - DNA, 20 bp, Artificial
  CRISPR gRNA sequence
aacccaaaaacaaatgcaac

SEQ ID NO: 553229 - DNA, 20 bp, Artificial
  CRISPR gRNA sequence
tactgggtatctacccagag

SEQ ID NO: 553230 - DNA, 20 bp, Artificial
  CRISPR gRNA sequence
agtgaagtaactcaggaatg

SEQ ID NO: 553231 - DNA, 20 bp, Artificial
  CRISPR gRNA sequence
caaataactaaaaaaaaaaa

SEQ ID NO: 553232 - DNA, 20 bp, Artificial
  CRISPR gRNA sequence
ccaaacatcacctgttcccc

SEQ ID NO: 553233 - DNA, 20 bp, Artificial
  CRISPR gRNA sequence
taccctaattgctactaggc

SEQ ID NO: 553234 - DNA, 20 bp, Artificial
  CRISPR gRNA sequence
tatgttaggccagtcttgtt

SEQ ID NO: 553235 - DNA, 20 bp, Artificial
  CRISPR gRNA sequence
tttaaaagaggtcctatgga

SEQ ID NO: 553236 - DNA, 20 bp, Artificial
  CRISPR gRNA sequence
gcatacatatatactgtcat

SEQ ID NO: 553237 - DNA, 20 bp, Artificial
  CRISPR gRNA sequence
tttcatctgcactgctatgc

SEQ ID NO: 553238 - DNA, 20 bp, Artificial
  CRISPR gRNA sequence
taagctcattatcttcccct

SEQ ID NO: 553239 - DNA, 20 bp, Artificial
  CRISPR gRNA sequence
ttctaccagaatgatctttt

SEQ ID NO: 553240 - DNA, 20 bp, Artificial
  CRISPR gRNA sequence
agccctttttatagagtttg

SEQ ID NO: 553241 - DNA, 20 bp, Artificial
  CRISPR gRNA sequence
tagagtttgtaaaactaatt

SEQ ID NO: 553242 - DNA, 20 bp, Artificial
  CRISPR gRNA sequence
gacctggatggatgctttct

SEQ ID NO: 553243 - DNA, 20 bp, Artificial
  CRISPR gRNA sequence
gtgtgagctagattaaactt

SEQ ID NO: 553244 - DNA, 20 bp, Artificial
  CRISPR gRNA sequence
ataagcattaacttgtctta

SEQ ID NO: 553245 - DNA, 20 bp, Artificial
  CRISPR gRNA sequence
aggttcacaattttgaaatg

SEQ ID NO: 553246 - DNA, 20 bp, Artificial
  CRISPR gRNA sequence
ggtttaccagacaaggggat

SEQ ID NO: 553247 - DNA, 20 bp, Artificial
  CRISPR gRNA sequence
tttgccaactcagtcctgac

SEQ ID NO: 553248 - DNA, 20 bp, Artificial
  CRISPR gRNA sequence
aaaggaaagaatgttactgt

SEQ ID NO: 553249 - DNA, 20 bp, Artificial
  CRISPR gRNA sequence
acacaattgcaagaagtttt

SEQ ID NO: 553250 - DNA, 20 bp, Artificial
  CRISPR gRNA sequence
ataatgggaacaacaaaaaa

SEQ ID NO: 553251 - DNA, 20 bp, Artificial
  CRISPR gRNA sequence
ttttaaaggttttgcccttg

SEQ ID NO: 553252 - DNA, 20 bp, Artificial
  CRISPR gRNA sequence
gaacatgggattgggagcaa

SEQ ID NO: 553253 - DNA, 20 bp, Artificial
  CRISPR gRNA sequence
gtattgatggttagtcacta

SEQ ID NO: 553254 - DNA, 20 bp, Artificial
  CRISPR gRNA sequence
cactgaaggtagagcctcaa

SEQ ID NO: 553255 - DNA, 20 bp, Artificial
  CRISPR gRNA sequence
atcagtaattaataatcttc

SEQ ID NO: 553256 - DNA, 20 bp, Artificial
  CRISPR gRNA sequence
ggccagcattattcttgtgc

SEQ ID NO: 553257 - DNA, 20 bp, Artificial
  CRISPR gRNA sequence
atccaacatcaatttatgat

SEQ ID NO: 553258 - DNA, 20 bp, Artificial
  CRISPR gRNA sequence
cttgttaacaaatgcctaca

SEQ ID NO: 553259 - DNA, 20 bp, Artificial
  CRISPR gRNA sequence
acaatccaaacgaattgacc

SEQ ID NO: 553260 - DNA, 20 bp, Artificial
  CRISPR gRNA sequence
aaaacctcctggaactaata

SEQ ID NO: 553261 - DNA, 20 bp, Artificial
  CRISPR gRNA sequence
aacaagtggaatttgaagtt

SEQ ID NO: 553262 - DNA, 20 bp, Artificial
  CRISPR gRNA sequence
gatttatatgagaaaatcaa

SEQ ID NO: 553263 - DNA, 20 bp, Artificial
  CRISPR gRNA sequence
atagatctaaatgtaaaatg

SEQ ID NO: 553264 - DNA, 20 bp, Artificial
  CRISPR gRNA sequence
atgcaaaaccataagactcc

SEQ ID NO: 553265 - DNA, 20 bp, Artificial
  CRISPR gRNA sequence
aagactcctaaaacataaga

SEQ ID NO: 553266 - DNA, 20 bp, Artificial
  CRISPR gRNA sequence
agctgtacttcattaaaatt

SEQ ID NO: 553267 - DNA, 20 bp, Artificial
  CRISPR gRNA sequence
actgttatccaaaatataca

SEQ ID NO: 553268 - DNA, 20 bp, Artificial
  CRISPR gRNA sequence
caaaatatacaaaaaacttt

SEQ ID NO: 553269 - DNA, 20 bp, Artificial
  CRISPR gRNA sequence
aacttttaaaactcaacaag

SEQ ID NO: 553270 - DNA, 20 bp, Artificial
  CRISPR gRNA sequence
gacagtttggcagtttctta

SEQ ID NO: 553271 - DNA, 20 bp, Artificial
  CRISPR gRNA sequence
gctatttacccgaaggcatt

SEQ ID NO: 553272 - DNA, 20 bp, Artificial
  CRISPR gRNA sequence
ttaaaaacttatgttgacat

SEQ ID NO: 553273 - DNA, 20 bp, Artificial
  CRISPR gRNA sequence
gcatctttattaataattgt

SEQ ID NO: 553274 - DNA, 20 bp, Artificial
  CRISPR gRNA sequence
atgtgacattctggaaaagg

SEQ ID NO: 553275 - DNA, 20 bp, Artificial
  CRISPR gRNA sequence
ggaaccattccaagtgtttt

SEQ ID NO: 553276 - DNA, 20 bp, Artificial
  CRISPR gRNA sequence
aaattgctgtttctctagtc

SEQ ID NO: 553277 - DNA, 20 bp, Artificial
  CRISPR gRNA sequence
aggaaactcttcagtttcag

SEQ ID NO: 553278 - DNA, 20 bp, Artificial
  CRISPR gRNA sequence
tcatgcgttcataatgtact

SEQ ID NO: 553279 - DNA, 20 bp, Artificial
  CRISPR gRNA sequence
aatgtactaaaaacaaattt

SEQ ID NO: 553280 - DNA, 20 bp, Artificial
  CRISPR gRNA sequence
ggagctaactcattattttg

SEQ ID NO: 553281 - DNA, 20 bp, Artificial
  CRISPR gRNA sequence
aacataccacagttttttgt

SEQ ID NO: 553282 - DNA, 20 bp, Artificial
  CRISPR gRNA sequence
tgaaaacaaggagctgctgt

SEQ ID NO: 553283 - DNA, 20 bp, Artificial
  CRISPR gRNA sequence
tgaatggtatgtatgctttt

SEQ ID NO: 553284 - DNA, 20 bp, Artificial
  CRISPR gRNA sequence
tttttaaaacaaaatagttt

SEQ ID NO: 553285 - DNA, 20 bp, Artificial
  CRISPR gRNA sequence
ttagacatttgaaaagaaac

SEQ ID NO: 553286 - DNA, 20 bp, Artificial
  CRISPR gRNA sequence
actgagtttccatagaactt

SEQ ID NO: 553287 - DNA, 20 bp, Artificial
  CRISPR gRNA sequence
aaaatttgttcttaaaaaaa

SEQ ID NO: 553288 - DNA, 20 bp, Artificial
  CRISPR gRNA sequence
tggagtgagaccctgtctca

SEQ ID NO: 553289 - DNA, 20 bp, Artificial
  CRISPR gRNA sequence
ctcaaaaaacaaacaaacaa

SEQ ID NO: 553290 - DNA, 20 bp, Artificial
  CRISPR gRNA sequence
aggtattctgaaatgtgaca

SEQ ID NO: 553291 - DNA, 20 bp, Artificial
  CRISPR gRNA sequence
ggccttaactcttcccctca

SEQ ID NO: 553292 - DNA, 20 bp, Artificial
  CRISPR gRNA sequence
aactcttcccctcatccctc

SEQ ID NO: 553293 - DNA, 20 bp, Artificial
  CRISPR gRNA sequence
actcttcccctcatccctca

SEQ ID NO: 553294 - DNA, 20 bp, Artificial
  CRISPR gRNA sequence
ttcccctcatccctcaacac

SEQ ID NO: 553295 - DNA, 20 bp, Artificial
  CRISPR gRNA sequence
cccctcatccctcaacaccc

SEQ ID NO: 553296 - DNA, 20 bp, Artificial
  CRISPR gRNA sequence
ccctcatccctcaacaccca

SEQ ID NO: 553297 - DNA, 20 bp, Artificial
  CRISPR gRNA sequence
atccctcaacacccagctca

SEQ ID NO: 553298 - DNA, 20 bp, Artificial
  CRISPR gRNA sequence
aacacccagctcatgcctct

SEQ ID NO: 553299 - DNA, 20 bp, Artificial
  CRISPR gRNA sequence
atgcctctgcctcctgacca

SEQ ID NO: 553300 - DNA, 20 bp, Artificial
  CRISPR gRNA sequence
tgcctcctgaccaccagtgg

SEQ ID NO: 553301 - DNA, 20 bp, Artificial
  CRISPR gRNA sequence
cctcctgaccaccagtggga

SEQ ID NO: 553302 - DNA, 20 bp, Artificial
  CRISPR gRNA sequence
ctgaccaccagtgggatctg

SEQ ID NO: 553303 - DNA, 20 bp, Artificial
  CRISPR gRNA sequence
accaccagtgggatctgcca

SEQ ID NO: 553304 - DNA, 20 bp, Artificial
  CRISPR gRNA sequence
ccaggagggggcctcttgga

SEQ ID NO: 553305 - DNA, 20 bp, Artificial
  CRISPR gRNA sequence
ttggagcaccctacggcggt

SEQ ID NO: 553306 - DNA, 20 bp, Artificial
  CRISPR gRNA sequence
ggagcaccctacggcggttt

SEQ ID NO: 553307 - DNA, 20 bp, Artificial
  CRISPR gRNA sequence
gagcaccctacggcggttta

SEQ ID NO: 553308 - DNA, 20 bp, Artificial
  CRISPR gRNA sequence
cggcggtttattaaaccaac

SEQ ID NO: 553309 - DNA, 20 bp, Artificial
  CRISPR gRNA sequence
attaaaccaacactgctgct

SEQ ID NO: 553310 - DNA, 20 bp, Artificial
  CRISPR gRNA sequence
ttaaaccaacactgctgcta

SEQ ID NO: 553311 - DNA, 20 bp, Artificial
  CRISPR gRNA sequence
aaccaacactgctgctaatt

SEQ ID NO: 553312 - DNA, 20 bp, Artificial
  CRISPR gRNA sequence
ctgctaattgtgtttgtgtc

SEQ ID NO: 553313 - DNA, 20 bp, Artificial
  CRISPR gRNA sequence
ctaattgtgtttgtgtccta

SEQ ID NO: 553314 - DNA, 20 bp, Artificial
  CRISPR gRNA sequence
attgtgtttgtgtcctatct

SEQ ID NO: 553315 - DNA, 20 bp, Artificial
  CRISPR gRNA sequence
tgtttgtgtcctatctttta

SEQ ID NO: 553316 - DNA, 20 bp, Artificial
  CRISPR gRNA sequence
gtgtcctatcttttatatgt

SEQ ID NO: 553317 - DNA, 20 bp, Artificial
  CRISPR gRNA sequence
tgtcctatcttttatatgtg

SEQ ID NO: 553318 - DNA, 20 bp, Artificial
  CRISPR gRNA sequence
tcttttatatgtgactacag

SEQ ID NO: 553319 - DNA, 20 bp, Artificial
  CRISPR gRNA sequence
ttatatgtgactacaggccc

SEQ ID NO: 553320 - DNA, 20 bp, Artificial
  CRISPR gRNA sequence
tatatgtgactacaggccca

SEQ ID NO: 553321 - DNA, 20 bp, Artificial
  CRISPR gRNA sequence
atatgtgactacaggcccag

SEQ ID NO: 553322 - DNA, 20 bp, Artificial
  CRISPR gRNA sequence
tatgtgactacaggcccagc

SEQ ID NO: 553323 - DNA, 20 bp, Artificial
  CRISPR gRNA sequence
caggcccagctctgaccctg

SEQ ID NO: 553324 - DNA, 20 bp, Artificial
  CRISPR gRNA sequence
tgaccctggctcctgaagtg

SEQ ID NO: 553325 - DNA, 20 bp, Artificial
  CRISPR gRNA sequence
accctggctcctgaagtgaa

SEQ ID NO: 553326 - DNA, 20 bp, Artificial
  CRISPR gRNA sequence
gctcctgaagtgaaccctat

SEQ ID NO: 553327 - DNA, 20 bp, Artificial
  CRISPR gRNA sequence
ctgaagtgaaccctatccct

SEQ ID NO: 553328 - DNA, 20 bp, Artificial
  CRISPR gRNA sequence
aagtgaaccctatccctgat

SEQ ID NO: 553329 - DNA, 20 bp, Artificial
  CRISPR gRNA sequence
tccctgatccaactttttct

SEQ ID NO: 553330 - DNA, 20 bp, Artificial
  CRISPR gRNA sequence
atccaactttttctgggatg

SEQ ID NO: 553331 - DNA, 20 bp, Artificial
  CRISPR gRNA sequence
tttctgggatgggaggtgga

SEQ ID NO: 553332 - DNA, 20 bp, Artificial
  CRISPR gRNA sequence
ttctgggatgggaggtggag

SEQ ID NO: 553333 - DNA, 20 bp, Artificial
  CRISPR gRNA sequence
tctgggatgggaggtggagg

SEQ ID NO: 553334 - DNA, 20 bp, Artificial
  CRISPR gRNA sequence
ctgggatgggaggtggaggg

SEQ ID NO: 553335 - DNA, 20 bp, Artificial
  CRISPR gRNA sequence
tgggatgggaggtggaggga

SEQ ID NO: 553336 - DNA, 20 bp, Artificial
  CRISPR gRNA sequence
ggatgggaggtggagggagt

SEQ ID NO: 553337 - DNA, 20 bp, Artificial
  CRISPR gRNA sequence
tagtggttaacagtataact

SEQ ID NO: 553338 - DNA, 20 bp, Artificial
  CRISPR gRNA sequence
acagtataactcttggagtc

SEQ ID NO: 553339 - DNA, 20 bp, Artificial
  CRISPR gRNA sequence
ttggagtccaaagacctaga

SEQ ID NO: 553340 - DNA, 20 bp, Artificial
  CRISPR gRNA sequence
ggagtccaaagacctagatt

SEQ ID NO: 553341 - DNA, 20 bp, Artificial
  CRISPR gRNA sequence
gagtccaaagacctagattt

SEQ ID NO: 553342 - DNA, 20 bp, Artificial
  CRISPR gRNA sequence
gatttaaatcccagcccatc

SEQ ID NO: 553343 - DNA, 20 bp, Artificial
  CRISPR gRNA sequence
aaatcccagcccatcactta

SEQ ID NO: 553344 - DNA, 20 bp, Artificial
  CRISPR gRNA sequence
aatcccagcccatcacttac

SEQ ID NO: 553345 - DNA, 20 bp, Artificial
  CRISPR gRNA sequence
actagcaacgtgactttgat

SEQ ID NO: 553346 - DNA, 20 bp, Artificial
  CRISPR gRNA sequence
ctagcaacgtgactttgata

SEQ ID NO: 553347 - DNA, 20 bp, Artificial
  CRISPR gRNA sequence
gcaacgtgactttgatatct

SEQ ID NO: 553348 - DNA, 20 bp, Artificial
  CRISPR gRNA sequence
tgatatctcacttgacttct

SEQ ID NO: 553349 - DNA, 20 bp, Artificial
  CRISPR gRNA sequence
gatatctcacttgacttcta

SEQ ID NO: 553350 - DNA, 20 bp, Artificial
  CRISPR gRNA sequence
atatctcacttgacttctat

SEQ ID NO: 553351 - DNA, 20 bp, Artificial
  CRISPR gRNA sequence
acttgacttctatgaatctc

SEQ ID NO: 553352 - DNA, 20 bp, Artificial
  CRISPR gRNA sequence
gacttctatgaatctcatat

SEQ ID NO: 553353 - DNA, 20 bp, Artificial
  CRISPR gRNA sequence
acttctatgaatctcatatg

SEQ ID NO: 553354 - DNA, 20 bp, Artificial
  CRISPR gRNA sequence
ctatgaatctcatatgcgct

SEQ ID NO: 553355 - DNA, 20 bp, Artificial
  CRISPR gRNA sequence
tatgaatctcatatgcgctg

SEQ ID NO: 553356 - DNA, 20 bp, Artificial
  CRISPR gRNA sequence
tgaatctcatatgcgctgtc

SEQ ID NO: 553357 - DNA, 20 bp, Artificial
  CRISPR gRNA sequence
atatgcgctgtctctaagca

SEQ ID NO: 553358 - DNA, 20 bp, Artificial
  CRISPR gRNA sequence
tctctaagcaaggggtatga

SEQ ID NO: 553359 - DNA, 20 bp, Artificial
  CRISPR gRNA sequence
taagcaaggggtatgatact

SEQ ID NO: 553360 - DNA, 20 bp, Artificial
  CRISPR gRNA sequence
agcaaggggtatgatactcc

SEQ ID NO: 553361 - DNA, 20 bp, Artificial
  CRISPR gRNA sequence
ctcctgcaaggctcattgag

SEQ ID NO: 553362 - DNA, 20 bp, Artificial
  CRISPR gRNA sequence
ctgcaaggctcattgagagg

SEQ ID NO: 553363 - DNA, 20 bp, Artificial
  CRISPR gRNA sequence
caaggctcattgagagggtt

SEQ ID NO: 553364 - DNA, 20 bp, Artificial
  CRISPR gRNA sequence
attgagagggttccaggaaa

SEQ ID NO: 553365 - DNA, 20 bp, Artificial
  CRISPR gRNA sequence
agagggttccaggaaacgat

SEQ ID NO: 553366 - DNA, 20 bp, Artificial
  CRISPR gRNA sequence
caggaaacgatatgcagaga

SEQ ID NO: 553367 - DNA, 20 bp, Artificial
  CRISPR gRNA sequence
gtgcagtgcatggcacacag

SEQ ID NO: 553368 - DNA, 20 bp, Artificial
  CRISPR gRNA sequence
gtacttaatacactatggtt

SEQ ID NO: 553369 - DNA, 20 bp, Artificial
  CRISPR gRNA sequence
aatacactatggttagtata

SEQ ID NO: 553370 - DNA, 20 bp, Artificial
  CRISPR gRNA sequence
atacactatggttagtatat

SEQ ID NO: 553371 - DNA, 20 bp, Artificial
  CRISPR gRNA sequence
tggttagtatatctgctgat

SEQ ID NO: 553372 - DNA, 20 bp, Artificial
  CRISPR gRNA sequence
gtatatctgctgatgttact

SEQ ID NO: 553373 - DNA, 20 bp, Artificial
  CRISPR gRNA sequence
ctgatgttacttcttattac

SEQ ID NO: 553374 - DNA, 20 bp, Artificial
  CRISPR gRNA sequence
atgttacttcttattactgt

SEQ ID NO: 553375 - DNA, 20 bp, Artificial
  CRISPR gRNA sequence
cttcttattactgtacaagg

SEQ ID NO: 553376 - DNA, 20 bp, Artificial
  CRISPR gRNA sequence
cttattactgtacaaggcaa

SEQ ID NO: 553377 - DNA, 20 bp, Artificial
  CRISPR gRNA sequence
ttattactgtacaaggcaac

SEQ ID NO: 553378 - DNA, 20 bp, Artificial
  CRISPR gRNA sequence
attactgtacaaggcaacca

SEQ ID NO: 553379 - DNA, 20 bp, Artificial
  CRISPR gRNA sequence
ttactgtacaaggcaaccaa

SEQ ID NO: 553380 - DNA, 20 bp, Artificial
  CRISPR gRNA sequence
ctgtacaaggcaaccaacag

SEQ ID NO: 553381 - DNA, 20 bp, Artificial
  CRISPR gRNA sequence
tacaaggcaaccaacagatg

SEQ ID NO: 553382 - DNA, 20 bp, Artificial
  CRISPR gRNA sequence
gcttcccaagtaatgggcat

SEQ ID NO: 553383 - DNA, 20 bp, Artificial
  CRISPR gRNA sequence
cccaagtaatgggcatctac

SEQ ID NO: 553384 - DNA, 20 bp, Artificial
  CRISPR gRNA sequence
ccaagtaatgggcatctaca

SEQ ID NO: 553385 - DNA, 20 bp, Artificial
  CRISPR gRNA sequence
cagcagggctgctgttgttc

SEQ ID NO: 553386 - DNA, 20 bp, Artificial
  CRISPR gRNA sequence
ctgttgttctggcacagagt

SEQ ID NO: 553387 - DNA, 20 bp, Artificial
  CRISPR gRNA sequence
ttgttctggcacagagtgca

SEQ ID NO: 553388 - DNA, 20 bp, Artificial
  CRISPR gRNA sequence
ttctggcacagagtgcacag

SEQ ID NO: 553389 - DNA, 20 bp, Artificial
  CRISPR gRNA sequence
tggcacagagtgcacagcct

SEQ ID NO: 553390 - DNA, 20 bp, Artificial
  CRISPR gRNA sequence
gcacagagtgcacagcctgc

SEQ ID NO: 553391 - DNA, 20 bp, Artificial
  CRISPR gRNA sequence
cagtgtacttacttggttct

SEQ ID NO: 553392 - DNA, 20 bp, Artificial
  CRISPR gRNA sequence
acttggttctgtctggtttt

SEQ ID NO: 553393 - DNA, 20 bp, Artificial
  CRISPR gRNA sequence
cttggttctgtctggttttc

SEQ ID NO: 553394 - DNA, 20 bp, Artificial
  CRISPR gRNA sequence
ggttctgtctggttttctgt

SEQ ID NO: 553395 - DNA, 20 bp, Artificial
  CRISPR gRNA sequence
gttctgtctggttttctgtc

SEQ ID NO: 553396 - DNA, 20 bp, Artificial
  CRISPR gRNA sequence
tgtctggttttctgtcacat

SEQ ID NO: 553397 - DNA, 20 bp, Artificial
  CRISPR gRNA sequence
tctggttttctgtcacattt

SEQ ID NO: 553398 - DNA, 20 bp, Artificial
  CRISPR gRNA sequence
gttttctgtcacatttcaga

SEQ ID NO: 553399 - DNA, 20 bp, Artificial
  CRISPR gRNA sequence
tctgtcacatttcagaatac

SEQ ID NO: 553400 - DNA, 20 bp, Artificial
  CRISPR gRNA sequence
ctgtcacatttcagaatacc

SEQ ID NO: 553401 - DNA, 20 bp, Artificial
  CRISPR gRNA sequence
tgtcacatttcagaatacct

SEQ ID NO: 553402 - DNA, 20 bp, Artificial
  CRISPR gRNA sequence
tcacatttcagaatacctaa

SEQ ID NO: 553403 - DNA, 20 bp, Artificial
  CRISPR gRNA sequence
cagaatacctaaaaatgaag

SEQ ID NO: 553404 - DNA, 20 bp, Artificial
  CRISPR gRNA sequence
agaatacctaaaaatgaaga

SEQ ID NO: 553405 - DNA, 20 bp, Artificial
  CRISPR gRNA sequence
aaaatgaagaaattgtcttc

SEQ ID NO: 553406 - DNA, 20 bp, Artificial
  CRISPR gRNA sequence
tcttctcaattaaagaactg

SEQ ID NO: 553407 - DNA, 20 bp, Artificial
  CRISPR gRNA sequence
ctcaattaaagaactgaaaa

SEQ ID NO: 553408 - DNA, 20 bp, Artificial
  CRISPR gRNA sequence
tcaattaaagaactgaaaag

SEQ ID NO: 553409 - DNA, 20 bp, Artificial
  CRISPR gRNA sequence
aattaaagaactgaaaagaa

SEQ ID NO: 553410 - DNA, 20 bp, Artificial
  CRISPR gRNA sequence
aagaactgaaaagaaaaggt

SEQ ID NO: 553411 - DNA, 20 bp, Artificial
  CRISPR gRNA sequence
aaaagaaaaggtgaaatgtg

SEQ ID NO: 553412 - DNA, 20 bp, Artificial
  CRISPR gRNA sequence
ctgactgcctattagaggcc

SEQ ID NO: 553413 - DNA, 20 bp, Artificial
  CRISPR gRNA sequence
actgcctattagaggcctaa

SEQ ID NO: 553414 - DNA, 20 bp, Artificial
  CRISPR gRNA sequence
cctattagaggcctaaatat

SEQ ID NO: 553415 - DNA, 20 bp, Artificial
  CRISPR gRNA sequence
ttagaggcctaaatatggaa

SEQ ID NO: 553416 - DNA, 20 bp, Artificial
  CRISPR gRNA sequence
gaggcctaaatatggaaaac

SEQ ID NO: 553417 - DNA, 20 bp, Artificial
  CRISPR gRNA sequence
aatatggaaaactaagccag

SEQ ID NO: 553418 - DNA, 20 bp, Artificial
  CRISPR gRNA sequence
agccagagccccatcaccct

SEQ ID NO: 553419 - DNA, 20 bp, Artificial
  CRISPR gRNA sequence
ggatttcctgctatcctata

SEQ ID NO: 553420 - DNA, 20 bp, Artificial
  CRISPR gRNA sequence
cctgctatcctatatgcttt

SEQ ID NO: 553421 - DNA, 20 bp, Artificial
  CRISPR gRNA sequence
ctgctatcctatatgcttta

SEQ ID NO: 553422 - DNA, 20 bp, Artificial
  CRISPR gRNA sequence
ctatcctatatgctttaaat

SEQ ID NO: 553423 - DNA, 20 bp, Artificial
  CRISPR gRNA sequence
tcctatatgctttaaatcaa

SEQ ID NO: 553424 - DNA, 20 bp, Artificial
  CRISPR gRNA sequence
tatgctttaaatcaaatcgg

SEQ ID NO: 553425 - DNA, 20 bp, Artificial
  CRISPR gRNA sequence
taaatcaaatcggctacaga

SEQ ID NO: 553426 - DNA, 20 bp, Artificial
  CRISPR gRNA sequence
aaatcaaatcggctacagag

SEQ ID NO: 553427 - DNA, 20 bp, Artificial
  CRISPR gRNA sequence
aatcaaatcggctacagagc

SEQ ID NO: 553428 - DNA, 20 bp, Artificial
  CRISPR gRNA sequence
cagagctggtccaaagagtt

SEQ ID NO: 553429 - DNA, 20 bp, Artificial
  CRISPR gRNA sequence
gtccaaagagttgttcaaaa

SEQ ID NO: 553430 - DNA, 20 bp, Artificial
  CRISPR gRNA sequence
ttcaaaaattggtcagaaca

SEQ ID NO: 553431 - DNA, 20 bp, Artificial
  CRISPR gRNA sequence
aaaaattggtcagaacatga

SEQ ID NO: 553432 - DNA, 20 bp, Artificial
  CRISPR gRNA sequence
gtcagaacatgatagaaaac

SEQ ID NO: 553433 - DNA, 20 bp, Artificial
  CRISPR gRNA sequence
ttgacaaaatggctaatttt

SEQ ID NO: 553434 - DNA, 20 bp, Artificial
  CRISPR gRNA sequence
acaaaatggctaattttacc

SEQ ID NO: 553435 - DNA, 20 bp, Artificial
  CRISPR gRNA sequence
attttacctcgtgcataagg

SEQ ID NO: 553436 - DNA, 20 bp, Artificial
  CRISPR gRNA sequence
tacctcgtgcataaggctga

SEQ ID NO: 553437 - DNA, 20 bp, Artificial
  CRISPR gRNA sequence
acctcgtgcataaggctgaa

SEQ ID NO: 553438 - DNA, 20 bp, Artificial
  CRISPR gRNA sequence
cctcgtgcataaggctgaag

SEQ ID NO: 553439 - DNA, 20 bp, Artificial
  CRISPR gRNA sequence
gtgcataaggctgaagatgc

SEQ ID NO: 553440 - DNA, 20 bp, Artificial
  CRISPR gRNA sequence
aagatgcagggaaggctaga

SEQ ID NO: 553441 - DNA, 20 bp, Artificial
  CRISPR gRNA sequence
gaatagtttggaccagtgct

SEQ ID NO: 553442 - DNA, 20 bp, Artificial
  CRISPR gRNA sequence
ggaccagtgctgtccaatag

SEQ ID NO: 553443 - DNA, 20 bp, Artificial
  CRISPR gRNA sequence
gaccagtgctgtccaataga

SEQ ID NO: 553444 - DNA, 20 bp, Artificial
  CRISPR gRNA sequence
tccaatagaaatataatgca

SEQ ID NO: 553445 - DNA, 20 bp, Artificial
  CRISPR gRNA sequence
aaaatttttggtatccacat

SEQ ID NO: 553446 - DNA, 20 bp, Artificial
  CRISPR gRNA sequence
aaatttttggtatccacatt

SEQ ID NO: 553447 - DNA, 20 bp, Artificial
  CRISPR gRNA sequence
ttggtatccacattacaaag

SEQ ID NO: 553448 - DNA, 20 bp, Artificial
  CRISPR gRNA sequence
tggtatccacattacaaagt

SEQ ID NO: 553449 - DNA, 20 bp, Artificial
  CRISPR gRNA sequence
ggtatccacattacaaagta

SEQ ID NO: 553450 - DNA, 20 bp, Artificial
  CRISPR gRNA sequence
gtatccacattacaaagtaa

SEQ ID NO: 553451 - DNA, 20 bp, Artificial
  CRISPR gRNA sequence
caaagtaaaaaaaaatgtaa

SEQ ID NO: 553452 - DNA, 20 bp, Artificial
  CRISPR gRNA sequence
taatattttatttaacacaa

SEQ ID NO: 553453 - DNA, 20 bp, Artificial
  CRISPR gRNA sequence
aatattttatttaacacaat

SEQ ID NO: 553454 - DNA, 20 bp, Artificial
  CRISPR gRNA sequence
atattttatttaacacaatg

SEQ ID NO: 553455 - DNA, 20 bp, Artificial
  CRISPR gRNA sequence
tatttaacacaatgtgtcac

SEQ ID NO: 553456 - DNA, 20 bp, Artificial
  CRISPR gRNA sequence
atttaacacaatgtgtcaca

SEQ ID NO: 553457 - DNA, 20 bp, Artificial
  CRISPR gRNA sequence
tttaacacaatgtgtcacaa

SEQ ID NO: 553458 - DNA, 20 bp, Artificial
  CRISPR gRNA sequence
aacacaatgtgtcacaaata

SEQ ID NO: 553459 - DNA, 20 bp, Artificial
  CRISPR gRNA sequence
acacaatgtgtcacaaatat

SEQ ID NO: 553460 - DNA, 20 bp, Artificial
  CRISPR gRNA sequence
tttcaacatgtactcaatat

SEQ ID NO: 553461 - DNA, 20 bp, Artificial
  CRISPR gRNA sequence
caacatgtactcaatataaa

SEQ ID NO: 553462 - DNA, 20 bp, Artificial
  CRISPR gRNA sequence
aacatgtactcaatataaac

SEQ ID NO: 553463 - DNA, 20 bp, Artificial
  CRISPR gRNA sequence
aatataaacattttttaatg

SEQ ID NO: 553464 - DNA, 20 bp, Artificial
  CRISPR gRNA sequence
tttaatgagatattttatat

SEQ ID NO: 553465 - DNA, 20 bp, Artificial
  CRISPR gRNA sequence
ttaatgagatattttatatt

SEQ ID NO: 553466 - DNA, 20 bp, Artificial
  CRISPR gRNA sequence
taatgagatattttatattc

SEQ ID NO: 553467 - DNA, 20 bp, Artificial
  CRISPR gRNA sequence
aatgagatattttatattct

SEQ ID NO: 553468 - DNA, 20 bp, Artificial
  CRISPR gRNA sequence
atgagatattttatattctt

SEQ ID NO: 553469 - DNA, 20 bp, Artificial
  CRISPR gRNA sequence
tatattctttcacacacggt

SEQ ID NO: 553470 - DNA, 20 bp, Artificial
  CRISPR gRNA sequence
atattctttcacacacggtc

SEQ ID NO: 553471 - DNA, 20 bp, Artificial
  CRISPR gRNA sequence
tattctttcacacacggtct

SEQ ID NO: 553472 - DNA, 20 bp, Artificial
  CRISPR gRNA sequence
tttcacacacggtcttagaa

SEQ ID NO: 553473 - DNA, 20 bp, Artificial
  CRISPR gRNA sequence
tcacacacggtcttagaaac

SEQ ID NO: 553474 - DNA, 20 bp, Artificial
  CRISPR gRNA sequence
cacacacggtcttagaaaca

SEQ ID NO: 553475 - DNA, 20 bp, Artificial
  CRISPR gRNA sequence
acacacggtcttagaaacat

SEQ ID NO: 553476 - DNA, 20 bp, Artificial
  CRISPR gRNA sequence
agaaacatattattttacac

SEQ ID NO: 553477 - DNA, 20 bp, Artificial
  CRISPR gRNA sequence
gaaacatattattttacact

SEQ ID NO: 553478 - DNA, 20 bp, Artificial
  CRISPR gRNA sequence
ttttacactcacagcacatg

SEQ ID NO: 553479 - DNA, 20 bp, Artificial
  CRISPR gRNA sequence
tacactcacagcacatgata

SEQ ID NO: 553480 - DNA, 20 bp, Artificial
  CRISPR gRNA sequence
acactcacagcacatgataa

SEQ ID NO: 553481 - DNA, 20 bp, Artificial
  CRISPR gRNA sequence
cactcacagcacatgataat

SEQ ID NO: 553482 - DNA, 20 bp, Artificial
  CRISPR gRNA sequence
acagcacatgataatttgga

SEQ ID NO: 553483 - DNA, 20 bp, Artificial
  CRISPR gRNA sequence
ggactcccacatttcaagtg

SEQ ID NO: 553484 - DNA, 20 bp, Artificial
  CRISPR gRNA sequence
gactcccacatttcaagtgc

SEQ ID NO: 553485 - DNA, 20 bp, Artificial
  CRISPR gRNA sequence
ccacatttcaagtgctccat

SEQ ID NO: 553486 - DNA, 20 bp, Artificial
  CRISPR gRNA sequence
caagtgctccatagccacat

SEQ ID NO: 553487 - DNA, 20 bp, Artificial
  CRISPR gRNA sequence
aagtgctccatagccacatg

SEQ ID NO: 553488 - DNA, 20 bp, Artificial
  CRISPR gRNA sequence
catagccacatgtagctcat

SEQ ID NO: 553489 - DNA, 20 bp, Artificial
  CRISPR gRNA sequence
atggctactatttcagacat

SEQ ID NO: 553490 - DNA, 20 bp, Artificial
  CRISPR gRNA sequence
ctatttcagacattaagaca

SEQ ID NO: 553491 - DNA, 20 bp, Artificial
  CRISPR gRNA sequence
tttcagacattaagacactg

SEQ ID NO: 553492 - DNA, 20 bp, Artificial
  CRISPR gRNA sequence
cagacattaagacactgctc

SEQ ID NO: 553493 - DNA, 20 bp, Artificial
  CRISPR gRNA sequence
agacattaagacactgctcc

SEQ ID NO: 553494 - DNA, 20 bp, Artificial
  CRISPR gRNA sequence
agacactgctcccacacatg

SEQ ID NO: 553495 - DNA, 20 bp, Artificial
  CRISPR gRNA sequence
ctcccacacatgcatgcatc

SEQ ID NO: 553496 - DNA, 20 bp, Artificial
  CRISPR gRNA sequence
ccacacatgcatgcatcact

SEQ ID NO: 553497 - DNA, 20 bp, Artificial
  CRISPR gRNA sequence
tcctgcccacagtaggcatc

SEQ ID NO: 553498 - DNA, 20 bp, Artificial
  CRISPR gRNA sequence
cctgcccacagtaggcatcc

SEQ ID NO: 553499 - DNA, 20 bp, Artificial
  CRISPR gRNA sequence
ctgcccacagtaggcatccg

SEQ ID NO: 553500 - DNA, 20 bp, Artificial
  CRISPR gRNA sequence
cccacagtaggcatccgcct

SEQ ID NO: 553501 - DNA, 20 bp, Artificial
  CRISPR gRNA sequence
accctagaactatgctagtg

SEQ ID NO: 553502 - DNA, 20 bp, Artificial
  CRISPR gRNA sequence
gaactatgctagtggttcag

SEQ ID NO: 553503 - DNA, 20 bp, Artificial
  CRISPR gRNA sequence
tgctagtggttcagaagctt

SEQ ID NO: 553504 - DNA, 20 bp, Artificial
  CRISPR gRNA sequence
gtggttcagaagcttagtca

SEQ ID NO: 553505 - DNA, 20 bp, Artificial
  CRISPR gRNA sequence
agaagcttagtcaatagggt

SEQ ID NO: 553506 - DNA, 20 bp, Artificial
  CRISPR gRNA sequence
agtcaatagggttgactaga

SEQ ID NO: 553507 - DNA, 20 bp, Artificial
  CRISPR gRNA sequence
gtcaatagggttgactagag

SEQ ID NO: 553508 - DNA, 20 bp, Artificial
  CRISPR gRNA sequence
actagagcttataaagttgt

SEQ ID NO: 553509 - DNA, 20 bp, Artificial
  CRISPR gRNA sequence
gagcttataaagttgtctgt

SEQ ID NO: 553510 - DNA, 20 bp, Artificial
  CRISPR gRNA sequence
ataaagttgtctgtcaacta

SEQ ID NO: 553511 - DNA, 20 bp, Artificial
  CRISPR gRNA sequence
taaagttgtctgtcaactac

SEQ ID NO: 553512 - DNA, 20 bp, Artificial
  CRISPR gRNA sequence
tctgtcaactacaactaggc

SEQ ID NO: 553513 - DNA, 20 bp, Artificial
  CRISPR gRNA sequence
tcaactacaactaggcagct

SEQ ID NO: 553514 - DNA, 20 bp, Artificial
  CRISPR gRNA sequence
caactaggcagctggagctg

SEQ ID NO: 553515 - DNA, 20 bp, Artificial
  CRISPR gRNA sequence
ggcagctggagctgtttcca

SEQ ID NO: 553516 - DNA, 20 bp, Artificial
  CRISPR gRNA sequence
gagctgtttccattcaactc

SEQ ID NO: 553517 - DNA, 20 bp, Artificial
  CRISPR gRNA sequence
tttccattcaactctttcct

SEQ ID NO: 553518 - DNA, 20 bp, Artificial
  CRISPR gRNA sequence
ccattcaactctttcctctt

SEQ ID NO: 553519 - DNA, 20 bp, Artificial
  CRISPR gRNA sequence
cattcaactctttcctcttc

SEQ ID NO: 553520 - DNA, 20 bp, Artificial
  CRISPR gRNA sequence
aactctttcctcttctgaag

SEQ ID NO: 553521 - DNA, 20 bp, Artificial
  CRISPR gRNA sequence
tttcctcttctgaagattcc

SEQ ID NO: 553522 - DNA, 20 bp, Artificial
  CRISPR gRNA sequence
tcctcttctgaagattccat

SEQ ID NO: 553523 - DNA, 20 bp, Artificial
  CRISPR gRNA sequence
cctcttctgaagattccatg

SEQ ID NO: 553524 - DNA, 20 bp, Artificial
  CRISPR gRNA sequence
ctcttctgaagattccatgc

SEQ ID NO: 553525 - DNA, 20 bp, Artificial
  CRISPR gRNA sequence
ttctgaagattccatgccaa

SEQ ID NO: 553526 - DNA, 20 bp, Artificial
  CRISPR gRNA sequence
ctgaagattccatgccaaac

SEQ ID NO: 553527 - DNA, 20 bp, Artificial
  CRISPR gRNA sequence
tgaagattccatgccaaaca

SEQ ID NO: 553528 - DNA, 20 bp, Artificial
  CRISPR gRNA sequence
aagattccatgccaaacatc

SEQ ID NO: 553529 - DNA, 20 bp, Artificial
  CRISPR gRNA sequence
catgccaaacatctcactat

SEQ ID NO: 553530 - DNA, 20 bp, Artificial
  CRISPR gRNA sequence
actatttcccaattaatgac

SEQ ID NO: 553531 - DNA, 20 bp, Artificial
  CRISPR gRNA sequence
tttcccaattaatgacttta

SEQ ID NO: 553532 - DNA, 20 bp, Artificial
  CRISPR gRNA sequence
cccaattaatgactttaagg

SEQ ID NO: 553533 - DNA, 20 bp, Artificial
  CRISPR gRNA sequence
ccaattaatgactttaaggt

SEQ ID NO: 553534 - DNA, 20 bp, Artificial
  CRISPR gRNA sequence
atgactttaaggttgcttaa

SEQ ID NO: 553535 - DNA, 20 bp, Artificial
  CRISPR gRNA sequence
taaggttgcttaaaggttga

SEQ ID NO: 553536 - DNA, 20 bp, Artificial
  CRISPR gRNA sequence
aaggttgcttaaaggttgag

SEQ ID NO: 553537 - DNA, 20 bp, Artificial
  CRISPR gRNA sequence
aggttgcttaaaggttgaga

SEQ ID NO: 553538 - DNA, 20 bp, Artificial
  CRISPR gRNA sequence
cttaaaggttgagatgcttg

SEQ ID NO: 553539 - DNA, 20 bp, Artificial
  CRISPR gRNA sequence
aaaggttgagatgcttgctg

SEQ ID NO: 553540 - DNA, 20 bp, Artificial
  CRISPR gRNA sequence
aaggttgagatgcttgctga

SEQ ID NO: 553541 - DNA, 20 bp, Artificial
  CRISPR gRNA sequence
agatgcttgctgagtttttt

SEQ ID NO: 553542 - DNA, 20 bp, Artificial
  CRISPR gRNA sequence
gctgagtttttttgtttgtt

SEQ ID NO: 553543 - DNA, 20 bp, Artificial
  CRISPR gRNA sequence
ctgagtttttttgtttgttt

SEQ ID NO: 553544 - DNA, 20 bp, Artificial
  CRISPR gRNA sequence
agtttttttgtttgtttgtt

SEQ ID NO: 553545 - DNA, 20 bp, Artificial
  CRISPR gRNA sequence
ttttgtttgtttgttttttg

SEQ ID NO: 553546 - DNA, 20 bp, Artificial
  CRISPR gRNA sequence
tttgtttgtttgttttttga

SEQ ID NO: 553547 - DNA, 20 bp, Artificial
  CRISPR gRNA sequence
ttgtttgtttgttttttgag

SEQ ID NO: 553548 - DNA, 20 bp, Artificial
  CRISPR gRNA sequence
tgtttgtttgttttttgaga

SEQ ID NO: 553549 - DNA, 20 bp, Artificial
  CRISPR gRNA sequence
gtttgtttgttttttgagac

SEQ ID NO: 553550 - DNA, 20 bp, Artificial
  CRISPR gRNA sequence
tttgtttgttttttgagaca

SEQ ID NO: 553551 - DNA, 20 bp, Artificial
  CRISPR gRNA sequence
gtttgttttttgagacaggg

SEQ ID NO: 553552 - DNA, 20 bp, Artificial
  CRISPR gRNA sequence
tttgttttttgagacagggt

SEQ ID NO: 553553 - DNA, 20 bp, Artificial
  CRISPR gRNA sequence
gttttttgagacagggtctc

SEQ ID NO: 553554 - DNA, 20 bp, Artificial
  CRISPR gRNA sequence
ttttttgagacagggtctca

SEQ ID NO: 553555 - DNA, 20 bp, Artificial
  CRISPR gRNA sequence
tttgagacagggtctcactc

SEQ ID NO: 553556 - DNA, 20 bp, Artificial
  CRISPR gRNA sequence
ttgagacagggtctcactcc

SEQ ID NO: 553557 - DNA, 20 bp, Artificial
  CRISPR gRNA sequence
tgagacagggtctcactcca

SEQ ID NO: 553558 - DNA, 20 bp, Artificial
  CRISPR gRNA sequence
gagacagggtctcactccat

SEQ ID NO: 553559 - DNA, 20 bp, Artificial
  CRISPR gRNA sequence
agacagggtctcactccatc

SEQ ID NO: 553560 - DNA, 20 bp, Artificial
  CRISPR gRNA sequence
actccatcacccaggctgga

SEQ ID NO: 553561 - DNA, 20 bp, Artificial
  CRISPR gRNA sequence
catcacccaggctggagtgc

SEQ ID NO: 553562 - DNA, 20 bp, Artificial
  CRISPR gRNA sequence
gagtgcagtggcacaatctc

SEQ ID NO: 553563 - DNA, 20 bp, Artificial
  CRISPR gRNA sequence
agctcactgcaacatctgcc

SEQ ID NO: 553564 - DNA, 20 bp, Artificial
  CRISPR gRNA sequence
actgcaacatctgcctccct

SEQ ID NO: 553565 - DNA, 20 bp, Artificial
  CRISPR gRNA sequence
caacatctgcctccctcccg

SEQ ID NO: 553566 - DNA, 20 bp, Artificial
  CRISPR gRNA sequence
cctccctcccgcctcagcct

SEQ ID NO: 553567 - DNA, 20 bp, Artificial
  CRISPR gRNA sequence
cctcccgcctcagcctcctg

SEQ ID NO: 553568 - DNA, 20 bp, Artificial
  CRISPR gRNA sequence
ccgcctcagcctcctgagta

SEQ ID NO: 553569 - DNA, 20 bp, Artificial
  CRISPR gRNA sequence
agcctcctgagtagctggga

SEQ ID NO: 553570 - DNA, 20 bp, Artificial
  CRISPR gRNA sequence
ctgagtagctgggactacag

SEQ ID NO: 553571 - DNA, 20 bp, Artificial
  CRISPR gRNA sequence
agtagctgggactacaggca

SEQ ID NO: 553572 - DNA, 20 bp, Artificial
  CRISPR gRNA sequence
ggactacaggcatgcaccac

SEQ ID NO: 553573 - DNA, 20 bp, Artificial
  CRISPR gRNA sequence
caggcatgcaccaccatgcc

SEQ ID NO: 553574 - DNA, 20 bp, Artificial
  CRISPR gRNA sequence
gctaatttttgtattttttt

SEQ ID NO: 553575 - DNA, 20 bp, Artificial
  CRISPR gRNA sequence
atttttgtatttttttgtag

SEQ ID NO: 553576 - DNA, 20 bp, Artificial
  CRISPR gRNA sequence
ttgtatttttttgtagagat

SEQ ID NO: 553577 - DNA, 20 bp, Artificial
  CRISPR gRNA sequence
tgtatttttttgtagagata

SEQ ID NO: 553578 - DNA, 20 bp, Artificial
  CRISPR gRNA sequence
gtatttttttgtagagatag

SEQ ID NO: 553579 - DNA, 20 bp, Artificial
  CRISPR gRNA sequence
tatttttttgtagagatagt

SEQ ID NO: 553580 - DNA, 20 bp, Artificial
  CRISPR gRNA sequence
ttttgtagagatagtgtttc

SEQ ID NO: 553581 - DNA, 20 bp, Artificial
  CRISPR gRNA sequence
tttgtagagatagtgtttca

SEQ ID NO: 553582 - DNA, 20 bp, Artificial
  CRISPR gRNA sequence
ttgtagagatagtgtttcac

SEQ ID NO: 553583 - DNA, 20 bp, Artificial
  CRISPR gRNA sequence
tgtagagatagtgtttcacc

SEQ ID NO: 553584 - DNA, 20 bp, Artificial
  CRISPR gRNA sequence
gtagagatagtgtttcacca

SEQ ID NO: 553585 - DNA, 20 bp, Artificial
  CRISPR gRNA sequence
tagagatagtgtttcaccat

SEQ ID NO: 553586 - DNA, 20 bp, Artificial
  CRISPR gRNA sequence
caccatgttgtccaggctgg

SEQ ID NO: 553587 - DNA, 20 bp, Artificial
  CRISPR gRNA sequence
accatgttgtccaggctggt

SEQ ID NO: 553588 - DNA, 20 bp, Artificial
  CRISPR gRNA sequence
tccaggctggtctcaaactc

SEQ ID NO: 553589 - DNA, 20 bp, Artificial
  CRISPR gRNA sequence
gtctcaaactcctgggctca

SEQ ID NO: 553590 - DNA, 20 bp, Artificial
  CRISPR gRNA sequence
aaactcctgggctcaagtga

SEQ ID NO: 553591 - DNA, 20 bp, Artificial
  CRISPR gRNA sequence
ctgggctcaagtgatgcaca

SEQ ID NO: 553592 - DNA, 20 bp, Artificial
  CRISPR gRNA sequence
ggctcaagtgatgcacacaa

SEQ ID NO: 553593 - DNA, 20 bp, Artificial
  CRISPR gRNA sequence
aagtgatgcacacaactcga

SEQ ID NO: 553594 - DNA, 20 bp, Artificial
  CRISPR gRNA sequence
gacctctcaatgtgctggga

SEQ ID NO: 553595 - DNA, 20 bp, Artificial
  CRISPR gRNA sequence
tcaatgtgctgggattacag

SEQ ID NO: 553596 - DNA, 20 bp, Artificial
  CRISPR gRNA sequence
aatgtgctgggattacaggc

SEQ ID NO: 553597 - DNA, 20 bp, Artificial
  CRISPR gRNA sequence
ggattacaggcatgagccac

SEQ ID NO: 553598 - DNA, 20 bp, Artificial
  CRISPR gRNA sequence
caggcatgagccaccatgcc

SEQ ID NO: 553599 - DNA, 20 bp, Artificial
  CRISPR gRNA sequence
gcctccaaattgtttttttt

SEQ ID NO: 553600 - DNA, 20 bp, Artificial
  CRISPR gRNA sequence
caaattgtttttttttttta

SEQ ID NO: 553601 - DNA, 20 bp, Artificial
  CRISPR gRNA sequence
ttttttttttttaagaacaa

SEQ ID NO: 553602 - DNA, 20 bp, Artificial
  CRISPR gRNA sequence
tttttttttaagaacaaatt

SEQ ID NO: 553603 - DNA, 20 bp, Artificial
  CRISPR gRNA sequence
ttttttttaagaacaaattt

SEQ ID NO: 553604 - DNA, 20 bp, Artificial
  CRISPR gRNA sequence
tttttttaagaacaaatttt

SEQ ID NO: 553605 - DNA, 20 bp, Artificial
  CRISPR gRNA sequence
ttttttaagaacaaattttt

SEQ ID NO: 553606 - DNA, 20 bp, Artificial
  CRISPR gRNA sequence
tttttaagaacaaatttttt

SEQ ID NO: 553607 - DNA, 20 bp, Artificial
  CRISPR gRNA sequence
ttttaagaacaaattttttc

SEQ ID NO: 553608 - DNA, 20 bp, Artificial
  CRISPR gRNA sequence
tttaagaacaaattttttca

SEQ ID NO: 553609 - DNA, 20 bp, Artificial
  CRISPR gRNA sequence
ttaagaacaaattttttcag

SEQ ID NO: 553610 - DNA, 20 bp, Artificial
  CRISPR gRNA sequence
taagaacaaattttttcaga

SEQ ID NO: 553611 - DNA, 20 bp, Artificial
  CRISPR gRNA sequence
aagaacaaattttttcagat

SEQ ID NO: 553612 - DNA, 20 bp, Artificial
  CRISPR gRNA sequence
agaacaaattttttcagatt

SEQ ID NO: 553613 - DNA, 20 bp, Artificial
  CRISPR gRNA sequence
tttcagattatctggggcta

SEQ ID NO: 553614 - DNA, 20 bp, Artificial
  CRISPR gRNA sequence
ttcagattatctggggctaa

SEQ ID NO: 553615 - DNA, 20 bp, Artificial
  CRISPR gRNA sequence
tcagattatctggggctaac

SEQ ID NO: 553616 - DNA, 20 bp, Artificial
  CRISPR gRNA sequence
cagattatctggggctaaca

SEQ ID NO: 553617 - DNA, 20 bp, Artificial
  CRISPR gRNA sequence
agattatctggggctaacag

SEQ ID NO: 553618 - DNA, 20 bp, Artificial
  CRISPR gRNA sequence
tctggggctaacagtactga

SEQ ID NO: 553619 - DNA, 20 bp, Artificial
  CRISPR gRNA sequence
gggctaacagtactgaccag

SEQ ID NO: 553620 - DNA, 20 bp, Artificial
  CRISPR gRNA sequence
acagtactgaccaggggagt

SEQ ID NO: 553621 - DNA, 20 bp, Artificial
  CRISPR gRNA sequence
accaggggagtaattttctg

SEQ ID NO: 553622 - DNA, 20 bp, Artificial
  CRISPR gRNA sequence
tctgtatattgaatgacttt

SEQ ID NO: 553623 - DNA, 20 bp, Artificial
  CRISPR gRNA sequence
ctgtatattgaatgactttt

SEQ ID NO: 553624 - DNA, 20 bp, Artificial
  CRISPR gRNA sequence
tgtatattgaatgacttttt

SEQ ID NO: 553625 - DNA, 20 bp, Artificial
  CRISPR gRNA sequence
tatattgaatgacttttttt

SEQ ID NO: 553626 - DNA, 20 bp, Artificial
  CRISPR gRNA sequence
aatgactttttttttttttt

SEQ ID NO: 553627 - DNA, 20 bp, Artificial
  CRISPR gRNA sequence
ttttttttttttttaagtga

SEQ ID NO: 553628 - DNA, 20 bp, Artificial
  CRISPR gRNA sequence
tttttttttttttaagtgaa

SEQ ID NO: 553629 - DNA, 20 bp, Artificial
  CRISPR gRNA sequence
ttttttttttttaagtgaaa

SEQ ID NO: 553630 - DNA, 20 bp, Artificial
  CRISPR gRNA sequence
tttttttttttaagtgaaat

SEQ ID NO: 553631 - DNA, 20 bp, Artificial
  CRISPR gRNA sequence
ttttttttttaagtgaaatc

SEQ ID NO: 553632 - DNA, 20 bp, Artificial
  CRISPR gRNA sequence
tttttttttaagtgaaatca

SEQ ID NO: 553633 - DNA, 20 bp, Artificial
  CRISPR gRNA sequence
ttttttttaagtgaaatcaa

SEQ ID NO: 553634 - DNA, 20 bp, Artificial
  CRISPR gRNA sequence
tttttttaagtgaaatcaac

SEQ ID NO: 553635 - DNA, 20 bp, Artificial
  CRISPR gRNA sequence
ttttttaagtgaaatcaacc

SEQ ID NO: 553636 - DNA, 20 bp, Artificial
  CRISPR gRNA sequence
tttttaagtgaaatcaacca

SEQ ID NO: 553637 - DNA, 20 bp, Artificial
  CRISPR gRNA sequence
ttttaagtgaaatcaaccaa

SEQ ID NO: 553638 - DNA, 20 bp, Artificial
  CRISPR gRNA sequence
tttaagtgaaatcaaccaat

SEQ ID NO: 553639 - DNA, 20 bp, Artificial
  CRISPR gRNA sequence
ttaagtgaaatcaaccaatt

SEQ ID NO: 553640 - DNA, 20 bp, Artificial
  CRISPR gRNA sequence
taagtgaaatcaaccaattg

SEQ ID NO: 553641 - DNA, 20 bp, Artificial
  CRISPR gRNA sequence
aagtgaaatcaaccaattgt

SEQ ID NO: 553642 - DNA, 20 bp, Artificial
  CRISPR gRNA sequence
agtgaaatcaaccaattgtt

SEQ ID NO: 553643 - DNA, 20 bp, Artificial
  CRISPR gRNA sequence
ttttgaagttctatggaaac

SEQ ID NO: 553644 - DNA, 20 bp, Artificial
  CRISPR gRNA sequence
tgaagttctatggaaactca

SEQ ID NO: 553645 - DNA, 20 bp, Artificial
  CRISPR gRNA sequence
gaagttctatggaaactcag

SEQ ID NO: 553646 - DNA, 20 bp, Artificial
  CRISPR gRNA sequence
aagttctatggaaactcagt

SEQ ID NO: 553647 - DNA, 20 bp, Artificial
  CRISPR gRNA sequence
tatggaaactcagtgccacc

SEQ ID NO: 553648 - DNA, 20 bp, Artificial
  CRISPR gRNA sequence
tggaaactcagtgccacctc

SEQ ID NO: 553649 - DNA, 20 bp, Artificial
  CRISPR gRNA sequence
agtgccacctctctttagtt

SEQ ID NO: 553650 - DNA, 20 bp, Artificial
  CRISPR gRNA sequence
tctttagttcaggtatcctg

SEQ ID NO: 553651 - DNA, 20 bp, Artificial
  CRISPR gRNA sequence
tttagttcaggtatcctggg

SEQ ID NO: 553652 - DNA, 20 bp, Artificial
  CRISPR gRNA sequence
tagttcaggtatcctgggtt

SEQ ID NO: 553653 - DNA, 20 bp, Artificial
  CRISPR gRNA sequence
agttcaggtatcctgggtta

SEQ ID NO: 553654 - DNA, 20 bp, Artificial
  CRISPR gRNA sequence
gttcaggtatcctgggttag

SEQ ID NO: 553655 - DNA, 20 bp, Artificial
  CRISPR gRNA sequence
aggtatcctgggttagttct

SEQ ID NO: 553656 - DNA, 20 bp, Artificial
  CRISPR gRNA sequence
ggttagttctttaattgaga

SEQ ID NO: 553657 - DNA, 20 bp, Artificial
  CRISPR gRNA sequence
gttctttaattgagatctac

SEQ ID NO: 553658 - DNA, 20 bp, Artificial
  CRISPR gRNA sequence
tttaattgagatctacaaca

SEQ ID NO: 553659 - DNA, 20 bp, Artificial
  CRISPR gRNA sequence
taattgagatctacaacaac

SEQ ID NO: 553660 - DNA, 20 bp, Artificial
  CRISPR gRNA sequence
aattgagatctacaacaaca

SEQ ID NO: 553661 - DNA, 20 bp, Artificial
  CRISPR gRNA sequence
attgagatctacaacaacac

SEQ ID NO: 553662 - DNA, 20 bp, Artificial
  CRISPR gRNA sequence
agatctacaacaacactgag

SEQ ID NO: 553663 - DNA, 20 bp, Artificial
  CRISPR gRNA sequence
caacaacactgagtggaaaa

SEQ ID NO: 553664 - DNA, 20 bp, Artificial
  CRISPR gRNA sequence
agtggaaaatgattttggtt

SEQ ID NO: 553665 - DNA, 20 bp, Artificial
  CRISPR gRNA sequence
tggtttctgggaaccaacct

SEQ ID NO: 553666 - DNA, 20 bp, Artificial
  CRISPR gRNA sequence
ggtttctgggaaccaacctg

SEQ ID NO: 553667 - DNA, 20 bp, Artificial
  CRISPR gRNA sequence
gtttctgggaaccaacctgt

SEQ ID NO: 553668 - DNA, 20 bp, Artificial
  CRISPR gRNA sequence
ctgggaaccaacctgttcag

SEQ ID NO: 553669 - DNA, 20 bp, Artificial
  CRISPR gRNA sequence
tgggaaccaacctgttcagg

SEQ ID NO: 553670 - DNA, 20 bp, Artificial
  CRISPR gRNA sequence
ggaaccaacctgttcaggag

SEQ ID NO: 553671 - DNA, 20 bp, Artificial
  CRISPR gRNA sequence
ttcaggagatgattaactat

SEQ ID NO: 553672 - DNA, 20 bp, Artificial
  CRISPR gRNA sequence
aggagatgattaactattat

SEQ ID NO: 553673 - DNA, 20 bp, Artificial
  CRISPR gRNA sequence
actattatactgctatttgg

SEQ ID NO: 553674 - DNA, 20 bp, Artificial
  CRISPR gRNA sequence
ttatactgctatttggggat

SEQ ID NO: 553675 - DNA, 20 bp, Artificial
  CRISPR gRNA sequence
tactgctatttggggattaa

SEQ ID NO: 553676 - DNA, 20 bp, Artificial
  CRISPR gRNA sequence
ctatttggggattaaaatag

SEQ ID NO: 553677 - DNA, 20 bp, Artificial
  CRISPR gRNA sequence
tttggggattaaaatagatt

SEQ ID NO: 553678 - DNA, 20 bp, Artificial
  CRISPR gRNA sequence
ggggattaaaatagattttt

SEQ ID NO: 553679 - DNA, 20 bp, Artificial
  CRISPR gRNA sequence
gggattaaaatagattttta

SEQ ID NO: 553680 - DNA, 20 bp, Artificial
  CRISPR gRNA sequence
aaatagatttttaaaaaatt

SEQ ID NO: 553681 - DNA, 20 bp, Artificial
  CRISPR gRNA sequence
ttaaaaaatttgagctccca

SEQ ID NO: 553682 - DNA, 20 bp, Artificial
  CRISPR gRNA sequence
taaaaaatttgagctcccaa

SEQ ID NO: 553683 - DNA, 20 bp, Artificial
  CRISPR gRNA sequence
aaaaaatttgagctcccaaa

SEQ ID NO: 553684 - DNA, 20 bp, Artificial
  CRISPR gRNA sequence
aaaaatttgagctcccaaaa

SEQ ID NO: 553685 - DNA, 20 bp, Artificial
  CRISPR gRNA sequence
gagctcccaaaatattttat

SEQ ID NO: 553686 - DNA, 20 bp, Artificial
  CRISPR gRNA sequence
agctcccaaaatattttatg

SEQ ID NO: 553687 - DNA, 20 bp, Artificial
  CRISPR gRNA sequence
ccaaaatattttatgcattg

SEQ ID NO: 553688 - DNA, 20 bp, Artificial
  CRISPR gRNA sequence
tatgcattgggcaatagctg

SEQ ID NO: 553689 - DNA, 20 bp, Artificial
  CRISPR gRNA sequence
atgcattgggcaatagctga

SEQ ID NO: 553690 - DNA, 20 bp, Artificial
  CRISPR gRNA sequence
tgcattgggcaatagctgaa

SEQ ID NO: 553691 - DNA, 20 bp, Artificial
  CRISPR gRNA sequence
ggcaatagctgaaaactttc

SEQ ID NO: 553692 - DNA, 20 bp, Artificial
  CRISPR gRNA sequence
aaaactttcttcagctgatc

SEQ ID NO: 553693 - DNA, 20 bp, Artificial
  CRISPR gRNA sequence
tcttcagctgatcgttataa

SEQ ID NO: 553694 - DNA, 20 bp, Artificial
  CRISPR gRNA sequence
cttcagctgatcgttataat

SEQ ID NO: 553695 - DNA, 20 bp, Artificial
  CRISPR gRNA sequence
ttcagctgatcgttataata

SEQ ID NO: 553696 - DNA, 20 bp, Artificial
  CRISPR gRNA sequence
cagctgatcgttataatact

SEQ ID NO: 553697 - DNA, 20 bp, Artificial
  CRISPR gRNA sequence
agctgatcgttataatactg

SEQ ID NO: 553698 - DNA, 20 bp, Artificial
  CRISPR gRNA sequence
atcgttataatactgtttag

SEQ ID NO: 553699 - DNA, 20 bp, Artificial
  CRISPR gRNA sequence
taatactgtttagtggagag

SEQ ID NO: 553700 - DNA, 20 bp, Artificial
  CRISPR gRNA sequence
tttagtggagagtcaactga

SEQ ID NO: 553701 - DNA, 20 bp, Artificial
  CRISPR gRNA sequence
agtggagagtcaactgactg

SEQ ID NO: 553702 - DNA, 20 bp, Artificial
  CRISPR gRNA sequence
gtggagagtcaactgactga

SEQ ID NO: 553703 - DNA, 20 bp, Artificial
  CRISPR gRNA sequence
actgataatctattacttag

SEQ ID NO: 553704 - DNA, 20 bp, Artificial
  CRISPR gRNA sequence
ataatctattacttagggat

SEQ ID NO: 553705 - DNA, 20 bp, Artificial
  CRISPR gRNA sequence
ttacttagggatggattttc

SEQ ID NO: 553706 - DNA, 20 bp, Artificial
  CRISPR gRNA sequence
cttagggatggattttcatg

SEQ ID NO: 553707 - DNA, 20 bp, Artificial
  CRISPR gRNA sequence
agggatggattttcatggta

SEQ ID NO: 553708 - DNA, 20 bp, Artificial
  CRISPR gRNA sequence
gggatggattttcatggtat

SEQ ID NO: 553709 - DNA, 20 bp, Artificial
  CRISPR gRNA sequence
tcatggtatttacaacttat

SEQ ID NO: 553710 - DNA, 20 bp, Artificial
  CRISPR gRNA sequence
catggtatttacaacttata

SEQ ID NO: 553711 - DNA, 20 bp, Artificial
  CRISPR gRNA sequence
atggtatttacaacttataa

SEQ ID NO: 553712 - DNA, 20 bp, Artificial
  CRISPR gRNA sequence
acaacttataatatgaaaat

SEQ ID NO: 553713 - DNA, 20 bp, Artificial
  CRISPR gRNA sequence
caacttataatatgaaaatg

SEQ ID NO: 553714 - DNA, 20 bp, Artificial
  CRISPR gRNA sequence
ataatatgaaaatgttatca

SEQ ID NO: 553715 - DNA, 20 bp, Artificial
  CRISPR gRNA sequence
taatatgaaaatgttatcat

SEQ ID NO: 553716 - DNA, 20 bp, Artificial
  CRISPR gRNA sequence
tcatcaggaaattatattta

SEQ ID NO: 553717 - DNA, 20 bp, Artificial
  CRISPR gRNA sequence
tatttagcactgatatcgca

SEQ ID NO: 553718 - DNA, 20 bp, Artificial
  CRISPR gRNA sequence
agcactgatatcgcaaaata

SEQ ID NO: 553719 - DNA, 20 bp, Artificial
  CRISPR gRNA sequence
gcactgatatcgcaaaatag

SEQ ID NO: 553720 - DNA, 20 bp, Artificial
  CRISPR gRNA sequence
atatcgcaaaatagtctagt

SEQ ID NO: 553721 - DNA, 20 bp, Artificial
  CRISPR gRNA sequence
gttctgcactgaccaagaaa

SEQ ID NO: 553722 - DNA, 20 bp, Artificial
  CRISPR gRNA sequence
tgcactgaccaagaaaactt

SEQ ID NO: 553723 - DNA, 20 bp, Artificial
  CRISPR gRNA sequence
cactgaccaagaaaactttc

SEQ ID NO: 553724 - DNA, 20 bp, Artificial
  CRISPR gRNA sequence
accaagaaaactttctgcaa

SEQ ID NO: 553725 - DNA, 20 bp, Artificial
  CRISPR gRNA sequence
tctgcaatgataggattatt

SEQ ID NO: 553726 - DNA, 20 bp, Artificial
  CRISPR gRNA sequence
ctgcaatgataggattattc

SEQ ID NO: 553727 - DNA, 20 bp, Artificial
  CRISPR gRNA sequence
tgcaatgataggattattcc

SEQ ID NO: 553728 - DNA, 20 bp, Artificial
  CRISPR gRNA sequence
caatgataggattattcctt

SEQ ID NO: 553729 - DNA, 20 bp, Artificial
  CRISPR gRNA sequence
ttccttatctgggctatcca

SEQ ID NO: 553730 - DNA, 20 bp, Artificial
  CRISPR gRNA sequence
cttatctgggctatccagta

SEQ ID NO: 553731 - DNA, 20 bp, Artificial
  CRISPR gRNA sequence
atctgggctatccagtatgg

SEQ ID NO: 553732 - DNA, 20 bp, Artificial
  CRISPR gRNA sequence
tctgggctatccagtatggt

SEQ ID NO: 553733 - DNA, 20 bp, Artificial
  CRISPR gRNA sequence
ggctatccagtatggtagcc

SEQ ID NO: 553734 - DNA, 20 bp, Artificial
  CRISPR gRNA sequence
tccagtatggtagccactag

SEQ ID NO: 553735 - DNA, 20 bp, Artificial
  CRISPR gRNA sequence
gccagatgtaggtattgagc

SEQ ID NO: 553736 - DNA, 20 bp, Artificial
  CRISPR gRNA sequence
agcacttgaaaggtggttag

SEQ ID NO: 553737 - DNA, 20 bp, Artificial
  CRISPR gRNA sequence
gaaaggtggttagtgtaact

SEQ ID NO: 553738 - DNA, 20 bp, Artificial
  CRISPR gRNA sequence
aaaggtggttagtgtaactg

SEQ ID NO: 553739 - DNA, 20 bp, Artificial
  CRISPR gRNA sequence
gtgtaactgaggaatgaatc

SEQ ID NO: 553740 - DNA, 20 bp, Artificial
  CRISPR gRNA sequence
aggaatgaatcttaaattta

SEQ ID NO: 553741 - DNA, 20 bp, Artificial
  CRISPR gRNA sequence
aaatttaatggtatttcatt

SEQ ID NO: 553742 - DNA, 20 bp, Artificial
  CRISPR gRNA sequence
aatttaatggtatttcattt

SEQ ID NO: 553743 - DNA, 20 bp, Artificial
  CRISPR gRNA sequence
aatggtatttcattttaaat

SEQ ID NO: 553744 - DNA, 20 bp, Artificial
  CRISPR gRNA sequence
atggtatttcattttaaatg

SEQ ID NO: 553745 - DNA, 20 bp, Artificial
  CRISPR gRNA sequence
cattttaaatgatatattta

SEQ ID NO: 553746 - DNA, 20 bp, Artificial
  CRISPR gRNA sequence
attttaaatgatatatttaa

SEQ ID NO: 553747 - DNA, 20 bp, Artificial
  CRISPR gRNA sequence
taaatgatatatttaaataa

SEQ ID NO: 553748 - DNA, 20 bp, Artificial
  CRISPR gRNA sequence
aaatgatatatttaaataat

SEQ ID NO: 553749 - DNA, 20 bp, Artificial
  CRISPR gRNA sequence
aatgatatatttaaataatc

SEQ ID NO: 553750 - DNA, 20 bp, Artificial
  CRISPR gRNA sequence
aaataatcatatgtggctaa

SEQ ID NO: 553751 - DNA, 20 bp, Artificial
  CRISPR gRNA sequence
aataatcatatgtggctaat

SEQ ID NO: 553752 - DNA, 20 bp, Artificial
  CRISPR gRNA sequence
attggctactatactaaaca

SEQ ID NO: 553753 - DNA, 20 bp, Artificial
  CRISPR gRNA sequence
gctactatactaaacagtgc

SEQ ID NO: 553754 - DNA, 20 bp, Artificial
  CRISPR gRNA sequence
ctatactaaacagtgcaggt

SEQ ID NO: 553755 - DNA, 20 bp, Artificial
  CRISPR gRNA sequence
tactaaacagtgcaggtcta

SEQ ID NO: 553756 - DNA, 20 bp, Artificial
  CRISPR gRNA sequence
aacagtgcaggtctaaggaa

SEQ ID NO: 553757 - DNA, 20 bp, Artificial
  CRISPR gRNA sequence
aggaaactgaaatctagttt

SEQ ID NO: 553758 - DNA, 20 bp, Artificial
  CRISPR gRNA sequence
aaatctagtttataaacttg

SEQ ID NO: 553759 - DNA, 20 bp, Artificial
  CRISPR gRNA sequence
gtttataaacttgattcatg

SEQ ID NO: 553760 - DNA, 20 bp, Artificial
  CRISPR gRNA sequence
ataaacttgattcatgacac

SEQ ID NO: 553761 - DNA, 20 bp, Artificial
  CRISPR gRNA sequence
taaacttgattcatgacaca

SEQ ID NO: 553762 - DNA, 20 bp, Artificial
  CRISPR gRNA sequence
gattcatgacacaatggatc

SEQ ID NO: 553763 - DNA, 20 bp, Artificial
  CRISPR gRNA sequence
attcatgacacaatggatcc

SEQ ID NO: 553764 - DNA, 20 bp, Artificial
  CRISPR gRNA sequence
atgacacaatggatcctaga

SEQ ID NO: 553765 - DNA, 20 bp, Artificial
  CRISPR gRNA sequence
gatactatcacttgtagaaa

SEQ ID NO: 553766 - DNA, 20 bp, Artificial
  CRISPR gRNA sequence
tcacttgtagaaagtttact

SEQ ID NO: 553767 - DNA, 20 bp, Artificial
  CRISPR gRNA sequence
gtagaaagtttactcttcgg

SEQ ID NO: 553768 - DNA, 20 bp, Artificial
  CRISPR gRNA sequence
tagaaagtttactcttcggc

SEQ ID NO: 553769 - DNA, 20 bp, Artificial
  CRISPR gRNA sequence
actcttcggcattccctgtc

SEQ ID NO: 553770 - DNA, 20 bp, Artificial
  CRISPR gRNA sequence
ctcttcggcattccctgtct

SEQ ID NO: 553771 - DNA, 20 bp, Artificial
  CRISPR gRNA sequence
ttcggcattccctgtctggc

SEQ ID NO: 553772 - DNA, 20 bp, Artificial
  CRISPR gRNA sequence
cggcattccctgtctggcat

SEQ ID NO: 553773 - DNA, 20 bp, Artificial
  CRISPR gRNA sequence
ggcattccctgtctggcata

SEQ ID NO: 553774 - DNA, 20 bp, Artificial
  CRISPR gRNA sequence
cctgtctggcatatttcctt

SEQ ID NO: 553775 - DNA, 20 bp, Artificial
  CRISPR gRNA sequence
tctggcatatttccttttgg

SEQ ID NO: 553776 - DNA, 20 bp, Artificial
  CRISPR gRNA sequence
gcatatttccttttggtgaa

SEQ ID NO: 553777 - DNA, 20 bp, Artificial
  CRISPR gRNA sequence
ccttttggtgaaggctggta

SEQ ID NO: 553778 - DNA, 20 bp, Artificial
  CRISPR gRNA sequence
cttttggtgaaggctggtat

SEQ ID NO: 553779 - DNA, 20 bp, Artificial
  CRISPR gRNA sequence
ttggtgaaggctggtatgga

SEQ ID NO: 553780 - DNA, 20 bp, Artificial
  CRISPR gRNA sequence
tggtgaaggctggtatggaa

SEQ ID NO: 553781 - DNA, 20 bp, Artificial
  CRISPR gRNA sequence
ggtgaaggctggtatggaaa

SEQ ID NO: 553782 - DNA, 20 bp, Artificial
  CRISPR gRNA sequence
gtgaaggctggtatggaaac

SEQ ID NO: 553783 - DNA, 20 bp, Artificial
  CRISPR gRNA sequence
gtatggaaactgctgtggca

SEQ ID NO: 553784 - DNA, 20 bp, Artificial
  CRISPR gRNA sequence
ctgtggcatcaagaatatcc

SEQ ID NO: 553785 - DNA, 20 bp, Artificial
  CRISPR gRNA sequence
tggcatcaagaatatccact

SEQ ID NO: 553786 - DNA, 20 bp, Artificial
  CRISPR gRNA sequence
ttcagaattacagcctgctc

SEQ ID NO: 553787 - DNA, 20 bp, Artificial
  CRISPR gRNA sequence
cagaattacagcctgctccc

SEQ ID NO: 553788 - DNA, 20 bp, Artificial
  CRISPR gRNA sequence
agaattacagcctgctccct

SEQ ID NO: 553789 - DNA, 20 bp, Artificial
  CRISPR gRNA sequence
cagcctgctccctgtccttt

SEQ ID NO: 553790 - DNA, 20 bp, Artificial
  CRISPR gRNA sequence
ctccctgtcctttgggattt

SEQ ID NO: 553791 - DNA, 20 bp, Artificial
  CRISPR gRNA sequence
cctgtcctttgggatttgag

SEQ ID NO: 553792 - DNA, 20 bp, Artificial
  CRISPR gRNA sequence
tcctttgggatttgagaggg

SEQ ID NO: 553793 - DNA, 20 bp, Artificial
  CRISPR gRNA sequence
tgggatttgagagggattac

SEQ ID NO: 553794 - DNA, 20 bp, Artificial
  CRISPR gRNA sequence
gggatttgagagggattact

SEQ ID NO: 553795 - DNA, 20 bp, Artificial
  CRISPR gRNA sequence
ggatttgagagggattactc

SEQ ID NO: 553796 - DNA, 20 bp, Artificial
  CRISPR gRNA sequence
gagagggattactcattacc

SEQ ID NO: 553797 - DNA, 20 bp, Artificial
  CRISPR gRNA sequence
agagggattactcattacca

SEQ ID NO: 553798 - DNA, 20 bp, Artificial
  CRISPR gRNA sequence
ctcattaccaggaatgaaca

SEQ ID NO: 553799 - DNA, 20 bp, Artificial
  CRISPR gRNA sequence
attaccaggaatgaacaggc

SEQ ID NO: 553800 - DNA, 20 bp, Artificial
  CRISPR gRNA sequence
ccaggaatgaacaggctggg

SEQ ID NO: 553801 - DNA, 20 bp, Artificial
  CRISPR gRNA sequence
ggaacaaattctccaagtca

SEQ ID NO: 553802 - DNA, 20 bp, Artificial
  CRISPR gRNA sequence
tccaagtcatcagttctcca

SEQ ID NO: 553803 - DNA, 20 bp, Artificial
  CRISPR gRNA sequence
caagtcatcagttctccaag

SEQ ID NO: 553804 - DNA, 20 bp, Artificial
  CRISPR gRNA sequence
tccaagctgtatgactgccc

SEQ ID NO: 553805 - DNA, 20 bp, Artificial
  CRISPR gRNA sequence
caagctgtatgactgcccaa

SEQ ID NO: 553806 - DNA, 20 bp, Artificial
  CRISPR gRNA sequence
tatgactgcccaagattgct

SEQ ID NO: 553807 - DNA, 20 bp, Artificial
  CRISPR gRNA sequence
cccaagattgctaggggact

SEQ ID NO: 553808 - DNA, 20 bp, Artificial
  CRISPR gRNA sequence
ctaggggactgagaaggctc

SEQ ID NO: 553809 - DNA, 20 bp, Artificial
  CRISPR gRNA sequence
ggggactgagaaggctcagg

SEQ ID NO: 553810 - DNA, 20 bp, Artificial
  CRISPR gRNA sequence
agaaggctcaggaagtaata

SEQ ID NO: 553811 - DNA, 20 bp, Artificial
  CRISPR gRNA sequence
aggaagtaatacaagcacaa

SEQ ID NO: 553812 - DNA, 20 bp, Artificial
  CRISPR gRNA sequence
cttgtattacgtaagtcact

SEQ ID NO: 553813 - DNA, 20 bp, Artificial
  CRISPR gRNA sequence
gtattacgtaagtcacttaa

SEQ ID NO: 553814 - DNA, 20 bp, Artificial
  CRISPR gRNA sequence
tattacgtaagtcacttaac

SEQ ID NO: 553815 - DNA, 20 bp, Artificial
  CRISPR gRNA sequence
cgtaagtcacttaactcaac

SEQ ID NO: 553816 - DNA, 20 bp, Artificial
  CRISPR gRNA sequence
aactcaaccaaaactccctt

SEQ ID NO: 553817 - DNA, 20 bp, Artificial
  CRISPR gRNA sequence
actcaaccaaaactcccttc

SEQ ID NO: 553818 - DNA, 20 bp, Artificial
  CRISPR gRNA sequence
aaccaaaactcccttcctac

SEQ ID NO: 553819 - DNA, 20 bp, Artificial
  CRISPR gRNA sequence
ccttcctacctgggagcccc

SEQ ID NO: 553820 - DNA, 20 bp, Artificial
  CRISPR gRNA sequence
cctacctgggagccccattc

SEQ ID NO: 553821 - DNA, 20 bp, Artificial
  CRISPR gRNA sequence
ctacctgggagccccattcg

SEQ ID NO: 553822 - DNA, 20 bp, Artificial
  CRISPR gRNA sequence
cctgggagccccattcgtgt

SEQ ID NO: 553823 - DNA, 20 bp, Artificial
  CRISPR gRNA sequence
ggagccccattcgtgttata

SEQ ID NO: 553824 - DNA, 20 bp, Artificial
  CRISPR gRNA sequence
gtgttatatgacatgaaaat

SEQ ID NO: 553825 - DNA, 20 bp, Artificial
  CRISPR gRNA sequence
tatgacatgaaaattacaga

SEQ ID NO: 553826 - DNA, 20 bp, Artificial
  CRISPR gRNA sequence
cagaggtggcagcctaaaga

SEQ ID NO: 553827 - DNA, 20 bp, Artificial
  CRISPR gRNA sequence
aagaggtctttagcaaactc

SEQ ID NO: 553828 - DNA, 20 bp, Artificial
  CRISPR gRNA sequence
tagcaaactctgacttggag

SEQ ID NO: 553829 - DNA, 20 bp, Artificial
  CRISPR gRNA sequence
agcaaactctgacttggaga

SEQ ID NO: 553830 - DNA, 20 bp, Artificial
  CRISPR gRNA sequence
gcaaactctgacttggagac

SEQ ID NO: 553831 - DNA, 20 bp, Artificial
  CRISPR gRNA sequence
tgacttggagaccagaagtt

SEQ ID NO: 553832 - DNA, 20 bp, Artificial
  CRISPR gRNA sequence
acttggagaccagaagttta

SEQ ID NO: 553833 - DNA, 20 bp, Artificial
  CRISPR gRNA sequence
ggagaccagaagtttaacta

SEQ ID NO: 553834 - DNA, 20 bp, Artificial
  CRISPR gRNA sequence
gagaccagaagtttaactat

SEQ ID NO: 553835 - DNA, 20 bp, Artificial
  CRISPR gRNA sequence
aactatattttgaagcagat

SEQ ID NO: 553836 - DNA, 20 bp, Artificial
  CRISPR gRNA sequence
actatattttgaagcagatc

SEQ ID NO: 553837 - DNA, 20 bp, Artificial
  CRISPR gRNA sequence
tattttgaagcagatcacag

SEQ ID NO: 553838 - DNA, 20 bp, Artificial
  CRISPR gRNA sequence
tgaagcagatcacaggtaaa

SEQ ID NO: 553839 - DNA, 20 bp, Artificial
  CRISPR gRNA sequence
gaagcagatcacaggtaaaa

SEQ ID NO: 553840 - DNA, 20 bp, Artificial
  CRISPR gRNA sequence
aagcagatcacaggtaaaag

SEQ ID NO: 553841 - DNA, 20 bp, Artificial
  CRISPR gRNA sequence
tgcaacaggtccaggctgtg

SEQ ID NO: 553842 - DNA, 20 bp, Artificial
  CRISPR gRNA sequence
tgttcccaggcctgtaaagc

SEQ ID NO: 553843 - DNA, 20 bp, Artificial
  CRISPR gRNA sequence
ccaggcctgtaaagctctct

SEQ ID NO: 553844 - DNA, 20 bp, Artificial
  CRISPR gRNA sequence
taaagctctctgtggcctaa

SEQ ID NO: 553845 - DNA, 20 bp, Artificial
  CRISPR gRNA sequence
tctgtggcctaaggattcat

SEQ ID NO: 553846 - DNA, 20 bp, Artificial
  CRISPR gRNA sequence
tgtggcctaaggattcattc

SEQ ID NO: 553847 - DNA, 20 bp, Artificial
  CRISPR gRNA sequence
tggcctaaggattcattcta

SEQ ID NO: 553848 - DNA, 20 bp, Artificial
  CRISPR gRNA sequence
aggattcattctaccttgag

SEQ ID NO: 553849 - DNA, 20 bp, Artificial
  CRISPR gRNA sequence
attctaccttgagataatgt

SEQ ID NO: 553850 - DNA, 20 bp, Artificial
  CRISPR gRNA sequence
taccttgagataatgtggat

SEQ ID NO: 553851 - DNA, 20 bp, Artificial
  CRISPR gRNA sequence
ccttgagataatgtggatct

SEQ ID NO: 553852 - DNA, 20 bp, Artificial
  CRISPR gRNA sequence
gagataatgtggatctttgg

SEQ ID NO: 553853 - DNA, 20 bp, Artificial
  CRISPR gRNA sequence
agataatgtggatctttgga

SEQ ID NO: 553854 - DNA, 20 bp, Artificial
  CRISPR gRNA sequence
tggaggaacctagcatgctc

SEQ ID NO: 553855 - DNA, 20 bp, Artificial
  CRISPR gRNA sequence
ggaggaacctagcatgctca

SEQ ID NO: 553856 - DNA, 20 bp, Artificial
  CRISPR gRNA sequence
gaggaacctagcatgctcag

SEQ ID NO: 553857 - DNA, 20 bp, Artificial
  CRISPR gRNA sequence
gcatgctcagcagtcccaca

SEQ ID NO: 553858 - DNA, 20 bp, Artificial
  CRISPR gRNA sequence
agcagtcccacacacgtaaa

SEQ ID NO: 553859 - DNA, 20 bp, Artificial
  CRISPR gRNA sequence
ttgtttcttttcaaatgtct

SEQ ID NO: 553860 - DNA, 20 bp, Artificial
  CRISPR gRNA sequence
tgtttcttttcaaatgtcta

SEQ ID NO: 553861 - DNA, 20 bp, Artificial
  CRISPR gRNA sequence
gtttcttttcaaatgtctaa

SEQ ID NO: 553862 - DNA, 20 bp, Artificial
  CRISPR gRNA sequence
tttcttttcaaatgtctaaa

SEQ ID NO: 553863 - DNA, 20 bp, Artificial
  CRISPR gRNA sequence
cttttcaaatgtctaaaatt

SEQ ID NO: 553864 - DNA, 20 bp, Artificial
  CRISPR gRNA sequence
ttttcaaatgtctaaaattt

SEQ ID NO: 553865 - DNA, 20 bp, Artificial
  CRISPR gRNA sequence
ttcaaatgtctaaaatttca

SEQ ID NO: 553866 - DNA, 20 bp, Artificial
  CRISPR gRNA sequence
tcaaatgtctaaaatttcaa

SEQ ID NO: 553867 - DNA, 20 bp, Artificial
  CRISPR gRNA sequence
caaatgtctaaaatttcaaa

SEQ ID NO: 553868 - DNA, 20 bp, Artificial
  CRISPR gRNA sequence
aaatgtctaaaatttcaaac

SEQ ID NO: 553869 - DNA, 20 bp, Artificial
  CRISPR gRNA sequence
aaatttcaaactttattttc

SEQ ID NO: 553870 - DNA, 20 bp, Artificial
  CRISPR gRNA sequence
caaactttattttcatcctt

SEQ ID NO: 553871 - DNA, 20 bp, Artificial
  CRISPR gRNA sequence
aaactttattttcatcctta

SEQ ID NO: 553872 - DNA, 20 bp, Artificial
  CRISPR gRNA sequence
tattttcatccttaaactat

SEQ ID NO: 553873 - DNA, 20 bp, Artificial
  CRISPR gRNA sequence
attttcatccttaaactatt

SEQ ID NO: 553874 - DNA, 20 bp, Artificial
  CRISPR gRNA sequence
ttttcatccttaaactattt

SEQ ID NO: 553875 - DNA, 20 bp, Artificial
  CRISPR gRNA sequence
tcatccttaaactattttct

SEQ ID NO: 553876 - DNA, 20 bp, Artificial
  CRISPR gRNA sequence
catccttaaactattttctg

SEQ ID NO: 553877 - DNA, 20 bp, Artificial
  CRISPR gRNA sequence
atccttaaactattttctga

SEQ ID NO: 553878 - DNA, 20 bp, Artificial
  CRISPR gRNA sequence
aaactattttctgacctttg

SEQ ID NO: 553879 - DNA, 20 bp, Artificial
  CRISPR gRNA sequence
aactattttctgacctttgg

SEQ ID NO: 553880 - DNA, 20 bp, Artificial
  CRISPR gRNA sequence
ttttctgacctttggaaaac

SEQ ID NO: 553881 - DNA, 20 bp, Artificial
  CRISPR gRNA sequence
tctgacctttggaaaacaat

SEQ ID NO: 553882 - DNA, 20 bp, Artificial
  CRISPR gRNA sequence
ctgacctttggaaaacaatg

SEQ ID NO: 553883 - DNA, 20 bp, Artificial
  CRISPR gRNA sequence
tgacctttggaaaacaatgc

SEQ ID NO: 553884 - DNA, 20 bp, Artificial
  CRISPR gRNA sequence
acctttggaaaacaatgcaa

SEQ ID NO: 553885 - DNA, 20 bp, Artificial
  CRISPR gRNA sequence
tggaaaacaatgcaagtttt

SEQ ID NO: 553886 - DNA, 20 bp, Artificial
  CRISPR gRNA sequence
ggaaaacaatgcaagttttc

SEQ ID NO: 553887 - DNA, 20 bp, Artificial
  CRISPR gRNA sequence
gaaaacaatgcaagttttca

SEQ ID NO: 553888 - DNA, 20 bp, Artificial
  CRISPR gRNA sequence
tcaaactattttgttttaaa

SEQ ID NO: 553889 - DNA, 20 bp, Artificial
  CRISPR gRNA sequence
caaactattttgttttaaaa

SEQ ID NO: 553890 - DNA, 20 bp, Artificial
  CRISPR gRNA sequence
aaactattttgttttaaaaa

SEQ ID NO: 553891 - DNA, 20 bp, Artificial
  CRISPR gRNA sequence
ttttgttttaaaaagcatac

SEQ ID NO: 553892 - DNA, 20 bp, Artificial
  CRISPR gRNA sequence
tgttttaaaaagcatacata

SEQ ID NO: 553893 - DNA, 20 bp, Artificial
  CRISPR gRNA sequence
gttttaaaaagcatacatac

SEQ ID NO: 553894 - DNA, 20 bp, Artificial
  CRISPR gRNA sequence
ttttaaaaagcatacatacc

SEQ ID NO: 553895 - DNA, 20 bp, Artificial
  CRISPR gRNA sequence
taaaaagcatacataccatt

SEQ ID NO: 553896 - DNA, 20 bp, Artificial
  CRISPR gRNA sequence
aaaaagcatacataccattc

SEQ ID NO: 553897 - DNA, 20 bp, Artificial
  CRISPR gRNA sequence
aaaagcatacataccattca

SEQ ID NO: 553898 - DNA, 20 bp, Artificial
  CRISPR gRNA sequence
atatacagcacaatacatgt

SEQ ID NO: 553899 - DNA, 20 bp, Artificial
  CRISPR gRNA sequence
taattactgctaatggtatg

SEQ ID NO: 553900 - DNA, 20 bp, Artificial
  CRISPR gRNA sequence
ctgctaatggtatgggtata

SEQ ID NO: 553901 - DNA, 20 bp, Artificial
  CRISPR gRNA sequence
ctaatggtatgggtataagt

SEQ ID NO: 553902 - DNA, 20 bp, Artificial
  CRISPR gRNA sequence
atggtatgggtataagtgca

SEQ ID NO: 553903 - DNA, 20 bp, Artificial
  CRISPR gRNA sequence
tgtcttgaatgacctataaa

SEQ ID NO: 553904 - DNA, 20 bp, Artificial
  CRISPR gRNA sequence
gaatgacctataaaaaagaa

SEQ ID NO: 553905 - DNA, 20 bp, Artificial
  CRISPR gRNA sequence
aatgacctataaaaaagaaa

SEQ ID NO: 553906 - DNA, 20 bp, Artificial
  CRISPR gRNA sequence
taaaaaagaaaagaaaagaa

SEQ ID NO: 553907 - DNA, 20 bp, Artificial
  CRISPR gRNA sequence
aactagttgaactgatcaaa

SEQ ID NO: 553908 - DNA, 20 bp, Artificial
  CRISPR gRNA sequence
gttgaactgatcaaaatgga

SEQ ID NO: 553909 - DNA, 20 bp, Artificial
  CRISPR gRNA sequence
aactgatcaaaatggatcct

SEQ ID NO: 553910 - DNA, 20 bp, Artificial
  CRISPR gRNA sequence
atcaaaatggatcctcatta

SEQ ID NO: 553911 - DNA, 20 bp, Artificial
  CRISPR gRNA sequence
attatttgcagattccacct

SEQ ID NO: 553912 - DNA, 20 bp, Artificial
  CRISPR gRNA sequence
tttgcagattccaccttgcg

SEQ ID NO: 553913 - DNA, 20 bp, Artificial
  CRISPR gRNA sequence
gcagattccaccttgcggtt

SEQ ID NO: 553914 - DNA, 20 bp, Artificial
  CRISPR gRNA sequence
cagattccaccttgcggttt

SEQ ID NO: 553915 - DNA, 20 bp, Artificial
  CRISPR gRNA sequence
caccttgcggtttgcttatt

SEQ ID NO: 553916 - DNA, 20 bp, Artificial
  CRISPR gRNA sequence
gcggtttgcttatttactga

SEQ ID NO: 553917 - DNA, 20 bp, Artificial
  CRISPR gRNA sequence
cggtttgcttatttactgaa

SEQ ID NO: 553918 - DNA, 20 bp, Artificial
  CRISPR gRNA sequence
gcttatttactgaaatttat

SEQ ID NO: 553919 - DNA, 20 bp, Artificial
  CRISPR gRNA sequence
cttatttactgaaatttatt

SEQ ID NO: 553920 - DNA, 20 bp, Artificial
  CRISPR gRNA sequence
atttactgaaatttatttgt

SEQ ID NO: 553921 - DNA, 20 bp, Artificial
  CRISPR gRNA sequence
tttactgaaatttatttgta

SEQ ID NO: 553922 - DNA, 20 bp, Artificial
  CRISPR gRNA sequence
actgaaatttatttgtaatc

SEQ ID NO: 553923 - DNA, 20 bp, Artificial
  CRISPR gRNA sequence
ctgaaatttatttgtaatcc

SEQ ID NO: 553924 - DNA, 20 bp, Artificial
  CRISPR gRNA sequence
aaatttatttgtaatccaca

SEQ ID NO: 553925 - DNA, 20 bp, Artificial
  CRISPR gRNA sequence
atttgtaatccacaaatcaa

SEQ ID NO: 553926 - DNA, 20 bp, Artificial
  CRISPR gRNA sequence
tttgtaatccacaaatcaat

SEQ ID NO: 553927 - DNA, 20 bp, Artificial
  CRISPR gRNA sequence
gtaatccacaaatcaatacc

SEQ ID NO: 553928 - DNA, 20 bp, Artificial
  CRISPR gRNA sequence
taatccacaaatcaataccc

SEQ ID NO: 553929 - DNA, 20 bp, Artificial
  CRISPR gRNA sequence
tcagacataagaacagtgat

SEQ ID NO: 553930 - DNA, 20 bp, Artificial
  CRISPR gRNA sequence
agacataagaacagtgatga

SEQ ID NO: 553931 - DNA, 20 bp, Artificial
  CRISPR gRNA sequence
tgagtcacccaataagcaga

SEQ ID NO: 553932 - DNA, 20 bp, Artificial
  CRISPR gRNA sequence
gagtcacccaataagcagat

SEQ ID NO: 553933 - DNA, 20 bp, Artificial
  CRISPR gRNA sequence
agtcacccaataagcagatt

SEQ ID NO: 553934 - DNA, 20 bp, Artificial
  CRISPR gRNA sequence
ccagcagaggtggaaaaagg

SEQ ID NO: 553935 - DNA, 20 bp, Artificial
  CRISPR gRNA sequence
tgccttcttgtttcaagttc

SEQ ID NO: 553936 - DNA, 20 bp, Artificial
  CRISPR gRNA sequence
ccttcttgtttcaagttctt

SEQ ID NO: 553937 - DNA, 20 bp, Artificial
  CRISPR gRNA sequence
cttgtttcaagttcttacac

SEQ ID NO: 553938 - DNA, 20 bp, Artificial
  CRISPR gRNA sequence
ttgtttcaagttcttacact

SEQ ID NO: 553939 - DNA, 20 bp, Artificial
  CRISPR gRNA sequence
gtttcaagttcttacactgt

SEQ ID NO: 553940 - DNA, 20 bp, Artificial
  CRISPR gRNA sequence
tttcaagttcttacactgtt

SEQ ID NO: 553941 - DNA, 20 bp, Artificial
  CRISPR gRNA sequence
caagttcttacactgttaac

SEQ ID NO: 553942 - DNA, 20 bp, Artificial
  CRISPR gRNA sequence
aagttcttacactgttaaca

SEQ ID NO: 553943 - DNA, 20 bp, Artificial
  CRISPR gRNA sequence
ttacactgttaacaagtgtc

SEQ ID NO: 553944 - DNA, 20 bp, Artificial
  CRISPR gRNA sequence
acactgttaacaagtgtcct

SEQ ID NO: 553945 - DNA, 20 bp, Artificial
  CRISPR gRNA sequence
cactgttaacaagtgtccta

SEQ ID NO: 553946 - DNA, 20 bp, Artificial
  CRISPR gRNA sequence
ttaacaagtgtcctatttgc

SEQ ID NO: 553947 - DNA, 20 bp, Artificial
  CRISPR gRNA sequence
acaagtgtcctatttgcagt

SEQ ID NO: 553948 - DNA, 20 bp, Artificial
  CRISPR gRNA sequence
tttgcagtctatttagtgcc

SEQ ID NO: 553949 - DNA, 20 bp, Artificial
  CRISPR gRNA sequence
gcagtctatttagtgccatg

SEQ ID NO: 553950 - DNA, 20 bp, Artificial
  CRISPR gRNA sequence
cagtctatttagtgccatga

SEQ ID NO: 553951 - DNA, 20 bp, Artificial
  CRISPR gRNA sequence
tttagtgccatgattttgca

SEQ ID NO: 553952 - DNA, 20 bp, Artificial
  CRISPR gRNA sequence
agtgccatgattttgcattt

SEQ ID NO: 553953 - DNA, 20 bp, Artificial
  CRISPR gRNA sequence
gtgccatgattttgcatttt

SEQ ID NO: 553954 - DNA, 20 bp, Artificial
  CRISPR gRNA sequence
tgcatttttgtgcttttttg

SEQ ID NO: 553955 - DNA, 20 bp, Artificial
  CRISPR gRNA sequence
gcatttttgtgcttttttgt

SEQ ID NO: 553956 - DNA, 20 bp, Artificial
  CRISPR gRNA sequence
catttttgtgcttttttgtt

SEQ ID NO: 553957 - DNA, 20 bp, Artificial
  CRISPR gRNA sequence
ttgtgcttttttgttggtga

SEQ ID NO: 553958 - DNA, 20 bp, Artificial
  CRISPR gRNA sequence
tgtgcttttttgttggtgat

SEQ ID NO: 553959 - DNA, 20 bp, Artificial
  CRISPR gRNA sequence
gtgcttttttgttggtgatt

SEQ ID NO: 553960 - DNA, 20 bp, Artificial
  CRISPR gRNA sequence
tgcttttttgttggtgattt

SEQ ID NO: 553961 - DNA, 20 bp, Artificial
  CRISPR gRNA sequence
ttttgttggtgatttcacta

SEQ ID NO: 553962 - DNA, 20 bp, Artificial
  CRISPR gRNA sequence
tttgttggtgatttcactat

SEQ ID NO: 553963 - DNA, 20 bp, Artificial
  CRISPR gRNA sequence
ttgttggtgatttcactatt

SEQ ID NO: 553964 - DNA, 20 bp, Artificial
  CRISPR gRNA sequence
tgttggtgatttcactattt

SEQ ID NO: 553965 - DNA, 20 bp, Artificial
  CRISPR gRNA sequence
gttggtgatttcactatttt

SEQ ID NO: 553966 - DNA, 20 bp, Artificial
  CRISPR gRNA sequence
ttggtgatttcactatttta

SEQ ID NO: 553967 - DNA, 20 bp, Artificial
  CRISPR gRNA sequence
gtgatttcactattttaagt

SEQ ID NO: 553968 - DNA, 20 bp, Artificial
  CRISPR gRNA sequence
cactattttaagtggtccca

SEQ ID NO: 553969 - DNA, 20 bp, Artificial
  CRISPR gRNA sequence
actattttaagtggtcccaa

SEQ ID NO: 553970 - DNA, 20 bp, Artificial
  CRISPR gRNA sequence
ttttaagtggtcccaaagta

SEQ ID NO: 553971 - DNA, 20 bp, Artificial
  CRISPR gRNA sequence
taagtggtcccaaagtatag

SEQ ID NO: 553972 - DNA, 20 bp, Artificial
  CRISPR gRNA sequence
aagtggtcccaaagtatagt

SEQ ID NO: 553973 - DNA, 20 bp, Artificial
  CRISPR gRNA sequence
agtggtcccaaagtatagtg

SEQ ID NO: 553974 - DNA, 20 bp, Artificial
  CRISPR gRNA sequence
aagggctgacaagagttcct

SEQ ID NO: 553975 - DNA, 20 bp, Artificial
  CRISPR gRNA sequence
acaagagttcctaagtgcaa

SEQ ID NO: 553976 - DNA, 20 bp, Artificial
  CRISPR gRNA sequence
ctaagtgcaagaaggctgcg

SEQ ID NO: 553977 - DNA, 20 bp, Artificial
  CRISPR gRNA sequence
agtgcaagaaggctgcgatg

SEQ ID NO: 553978 - DNA, 20 bp, Artificial
  CRISPR gRNA sequence
cgatgtgccttgcagagaaa

SEQ ID NO: 553979 - DNA, 20 bp, Artificial
  CRISPR gRNA sequence
gcagagaaaataggtgtatt

SEQ ID NO: 553980 - DNA, 20 bp, Artificial
  CRISPR gRNA sequence
cagagaaaataggtgtatta

SEQ ID NO: 553981 - DNA, 20 bp, Artificial
  CRISPR gRNA sequence
gataagcttcacttaggcat

SEQ ID NO: 553982 - DNA, 20 bp, Artificial
  CRISPR gRNA sequence
cacttaggcatgagttacag

SEQ ID NO: 553983 - DNA, 20 bp, Artificial
  CRISPR gRNA sequence
acttaggcatgagttacagt

SEQ ID NO: 553984 - DNA, 20 bp, Artificial
  CRISPR gRNA sequence
aggcatgagttacagtgctg

SEQ ID NO: 553985 - DNA, 20 bp, Artificial
  CRISPR gRNA sequence
ggcatgagttacagtgctgt

SEQ ID NO: 553986 - DNA, 20 bp, Artificial
  CRISPR gRNA sequence
cagtgctgttggctatgagt

SEQ ID NO: 553987 - DNA, 20 bp, Artificial
  CRISPR gRNA sequence
ttggctatgagttcaaggtc

SEQ ID NO: 553988 - DNA, 20 bp, Artificial
  CRISPR gRNA sequence
gctatgagttcaaggtcaat

SEQ ID NO: 553989 - DNA, 20 bp, Artificial
  CRISPR gRNA sequence
tgagttcaaggtcaataaat

SEQ ID NO: 553990 - DNA, 20 bp, Artificial
  CRISPR gRNA sequence
aaggtcaataaatcaacact

SEQ ID NO: 553991 - DNA, 20 bp, Artificial
  CRISPR gRNA sequence
tatattaaggtttatttaaa

SEQ ID NO: 553992 - DNA, 20 bp, Artificial
  CRISPR gRNA sequence
aggtttatttaaacagagac

SEQ ID NO: 553993 - DNA, 20 bp, Artificial
  CRISPR gRNA sequence
atttaaacagagacacacat

SEQ ID NO: 553994 - DNA, 20 bp, Artificial
  CRISPR gRNA sequence
tttaaacagagacacacata

SEQ ID NO: 553995 - DNA, 20 bp, Artificial
  CRISPR gRNA sequence
aaacagagacacacataaaa

SEQ ID NO: 553996 - DNA, 20 bp, Artificial
  CRISPR gRNA sequence
aacagagacacacataaaac

SEQ ID NO: 553997 - DNA, 20 bp, Artificial
  CRISPR gRNA sequence
taaacagatcattaacaaaa

SEQ ID NO: 553998 - DNA, 20 bp, Artificial
  CRISPR gRNA sequence
acaaaaatcttatgactaga

SEQ ID NO: 553999 - DNA, 20 bp, Artificial
  CRISPR gRNA sequence
atgactagaggctcacagga

SEQ ID NO: 554000 - DNA, 20 bp, Artificial
  CRISPR gRNA sequence
tgactagaggctcacaggaa

SEQ ID NO: 554001 - DNA, 20 bp, Artificial
  CRISPR gRNA sequence
gaggctcacaggaacctacc

SEQ ID NO: 554002 - DNA, 20 bp, Artificial
  CRISPR gRNA sequence
acaggaacctacccctgtat

SEQ ID NO: 554003 - DNA, 20 bp, Artificial
  CRISPR gRNA sequence
cccctgtatttcccccagga

SEQ ID NO: 554004 - DNA, 20 bp, Artificial
  CRISPR gRNA sequence
tatttcccccaggaacatta

SEQ ID NO: 554005 - DNA, 20 bp, Artificial
  CRISPR gRNA sequence
cccccaggaacattacttca

SEQ ID NO: 554006 - DNA, 20 bp, Artificial
  CRISPR gRNA sequence
ccccaggaacattacttcac

SEQ ID NO: 554007 - DNA, 20 bp, Artificial
  CRISPR gRNA sequence
cttcactacttgctatttca

SEQ ID NO: 554008 - DNA, 20 bp, Artificial
  CRISPR gRNA sequence
cactacttgctatttcactg

SEQ ID NO: 554009 - DNA, 20 bp, Artificial
  CRISPR gRNA sequence
actacttgctatttcactgt

SEQ ID NO: 554010 - DNA, 20 bp, Artificial
  CRISPR gRNA sequence
cttgctatttcactgttaac

SEQ ID NO: 554011 - DNA, 20 bp, Artificial
  CRISPR gRNA sequence
gctatttcactgttaacttg

SEQ ID NO: 554012 - DNA, 20 bp, Artificial
  CRISPR gRNA sequence
ctatttcactgttaacttga

SEQ ID NO: 554013 - DNA, 20 bp, Artificial
  CRISPR gRNA sequence
tttcactgttaacttgactc

SEQ ID NO: 554014 - DNA, 20 bp, Artificial
  CRISPR gRNA sequence
cactgttaacttgactctgt

SEQ ID NO: 554015 - DNA, 20 bp, Artificial
  CRISPR gRNA sequence
actgttaacttgactctgta

SEQ ID NO: 554016 - DNA, 20 bp, Artificial
  CRISPR gRNA sequence
ttaacttgactctgtagaac

SEQ ID NO: 554017 - DNA, 20 bp, Artificial
  CRISPR gRNA sequence
acttgactctgtagaactaa

SEQ ID NO: 554018 - DNA, 20 bp, Artificial
  CRISPR gRNA sequence
gactctgtagaactaatatg

SEQ ID NO: 554019 - DNA, 20 bp, Artificial
  CRISPR gRNA sequence
actctgtagaactaatatga

SEQ ID NO: 554020 - DNA, 20 bp, Artificial
  CRISPR gRNA sequence
tgtagaactaatatgaataa

SEQ ID NO: 554021 - DNA, 20 bp, Artificial
  CRISPR gRNA sequence
tagaactaatatgaataaca

SEQ ID NO: 554022 - DNA, 20 bp, Artificial
  CRISPR gRNA sequence
atatgaataacaagattcga

SEQ ID NO: 554023 - DNA, 20 bp, Artificial
  CRISPR gRNA sequence
gactatttctaaacaaactt

SEQ ID NO: 554024 - DNA, 20 bp, Artificial
  CRISPR gRNA sequence
tttctaaacaaacttatatg

SEQ ID NO: 554025 - DNA, 20 bp, Artificial
  CRISPR gRNA sequence
ctaaacaaacttatatgcac

SEQ ID NO: 554026 - DNA, 20 bp, Artificial
  CRISPR gRNA sequence
taaacaaacttatatgcaca

SEQ ID NO: 554027 - DNA, 20 bp, Artificial
  CRISPR gRNA sequence
aacaaacttatatgcacaag

SEQ ID NO: 554028 - DNA, 20 bp, Artificial
  CRISPR gRNA sequence
atatgcacaagcttgataca

SEQ ID NO: 554029 - DNA, 20 bp, Artificial
  CRISPR gRNA sequence
tatgcacaagcttgatacat

SEQ ID NO: 554030 - DNA, 20 bp, Artificial
  CRISPR gRNA sequence
gatacattccagaccctgtg

SEQ ID NO: 554031 - DNA, 20 bp, Artificial
  CRISPR gRNA sequence
atacattccagaccctgtgt

SEQ ID NO: 554032 - DNA, 20 bp, Artificial
  CRISPR gRNA sequence
cagaccctgtgttatttaat

SEQ ID NO: 554033 - DNA, 20 bp, Artificial
  CRISPR gRNA sequence
tgttatttaataaaagaagc

SEQ ID NO: 554034 - DNA, 20 bp, Artificial
  CRISPR gRNA sequence
tttaataaaagaagcaagtg

SEQ ID NO: 554035 - DNA, 20 bp, Artificial
  CRISPR gRNA sequence
aataaaagaagcaagtgttc

SEQ ID NO: 554036 - DNA, 20 bp, Artificial
  CRISPR gRNA sequence
ataaaagaagcaagtgttcc

SEQ ID NO: 554037 - DNA, 20 bp, Artificial
  CRISPR gRNA sequence
cactagaaggtttgtttctg

SEQ ID NO: 554038 - DNA, 20 bp, Artificial
  CRISPR gRNA sequence
gaaggtttgtttctgaccat

SEQ ID NO: 554039 - DNA, 20 bp, Artificial
  CRISPR gRNA sequence
gtttctgaccatctcatact

SEQ ID NO: 554040 - DNA, 20 bp, Artificial
  CRISPR gRNA sequence
tttctgaccatctcatactg

SEQ ID NO: 554041 - DNA, 20 bp, Artificial
  CRISPR gRNA sequence
ctgaccatctcatactgcca

SEQ ID NO: 554042 - DNA, 20 bp, Artificial
  CRISPR gRNA sequence
tgaccatctcatactgccag

SEQ ID NO: 554043 - DNA, 20 bp, Artificial
  CRISPR gRNA sequence
accatctcatactgccagtg

SEQ ID NO: 554044 - DNA, 20 bp, Artificial
  CRISPR gRNA sequence
atactgccagtggaagcaga

SEQ ID NO: 554045 - DNA, 20 bp, Artificial
  CRISPR gRNA sequence
ccagtggaagcagaacttgg

SEQ ID NO: 554046 - DNA, 20 bp, Artificial
  CRISPR gRNA sequence
ggcattgtgtttggtagggc

SEQ ID NO: 554047 - DNA, 20 bp, Artificial
  CRISPR gRNA sequence
gcattgtgtttggtagggca

SEQ ID NO: 554048 - DNA, 20 bp, Artificial
  CRISPR gRNA sequence
tgtttggtagggcaattctg

SEQ ID NO: 554049 - DNA, 20 bp, Artificial
  CRISPR gRNA sequence
ggtagggcaattctggcagt

SEQ ID NO: 554050 - DNA, 20 bp, Artificial
  CRISPR gRNA sequence
gtagggcaattctggcagtt

SEQ ID NO: 554051 - DNA, 20 bp, Artificial
  CRISPR gRNA sequence
tggcagttgtatataataag

SEQ ID NO: 554052 - DNA, 20 bp, Artificial
  CRISPR gRNA sequence
gcagttgtatataataagcc

SEQ ID NO: 554053 - DNA, 20 bp, Artificial
  CRISPR gRNA sequence
tatataataagccttaaaaa

SEQ ID NO: 554054 - DNA, 20 bp, Artificial
  CRISPR gRNA sequence
aaaaatatttatcatgaagc

SEQ ID NO: 554055 - DNA, 20 bp, Artificial
  CRISPR gRNA sequence
aaaatatttatcatgaagca

SEQ ID NO: 554056 - DNA, 20 bp, Artificial
  CRISPR gRNA sequence
atcatgaagcatctagacat

SEQ ID NO: 554057 - DNA, 20 bp, Artificial
  CRISPR gRNA sequence
tcatgaagcatctagacatt

SEQ ID NO: 554058 - DNA, 20 bp, Artificial
  CRISPR gRNA sequence
gacattgcactaagtcatgt

SEQ ID NO: 554059 - DNA, 20 bp, Artificial
  CRISPR gRNA sequence
cactaagtcatgtgcctata

SEQ ID NO: 554060 - DNA, 20 bp, Artificial
  CRISPR gRNA sequence
agtcatgtgcctatagtctc

SEQ ID NO: 554061 - DNA, 20 bp, Artificial
  CRISPR gRNA sequence
tagtctcactaagtcattac

SEQ ID NO: 554062 - DNA, 20 bp, Artificial
  CRISPR gRNA sequence
actaagtcattacaatgttg

SEQ ID NO: 554063 - DNA, 20 bp, Artificial
  CRISPR gRNA sequence
agtcattacaatgttgggca

SEQ ID NO: 554064 - DNA, 20 bp, Artificial
  CRISPR gRNA sequence
caatgttgggcaagtgcctt

SEQ ID NO: 554065 - DNA, 20 bp, Artificial
  CRISPR gRNA sequence
ggcaagtgccttaacctctc

SEQ ID NO: 554066 - DNA, 20 bp, Artificial
  CRISPR gRNA sequence
aacctctcagtgcctccatt

SEQ ID NO: 554067 - DNA, 20 bp, Artificial
  CRISPR gRNA sequence
acctctcagtgcctccattt

SEQ ID NO: 554068 - DNA, 20 bp, Artificial
  CRISPR gRNA sequence
tcagtgcctccattttctca

SEQ ID NO: 554069 - DNA, 20 bp, Artificial
  CRISPR gRNA sequence
agtgcctccattttctcaca

SEQ ID NO: 554070 - DNA, 20 bp, Artificial
  CRISPR gRNA sequence
cattttctcacagggtaact

SEQ ID NO: 554071 - DNA, 20 bp, Artificial
  CRISPR gRNA sequence
tctcacagggtaactatact

SEQ ID NO: 554072 - DNA, 20 bp, Artificial
  CRISPR gRNA sequence
ctcacagggtaactatactc

SEQ ID NO: 554073 - DNA, 20 bp, Artificial
  CRISPR gRNA sequence
tcacagggtaactatactcg

SEQ ID NO: 554074 - DNA, 20 bp, Artificial
  CRISPR gRNA sequence
acagggtaactatactcgag

SEQ ID NO: 554075 - DNA, 20 bp, Artificial
  CRISPR gRNA sequence
tactcgagactaataaatat

SEQ ID NO: 554076 - DNA, 20 bp, Artificial
  CRISPR gRNA sequence
gagactaataaatatactta

SEQ ID NO: 554077 - DNA, 20 bp, Artificial
  CRISPR gRNA sequence
ataaatatacttatctcata

SEQ ID NO: 554078 - DNA, 20 bp, Artificial
  CRISPR gRNA sequence
atctcatagggtagttgcat

SEQ ID NO: 554079 - DNA, 20 bp, Artificial
  CRISPR gRNA sequence
tctcatagggtagttgcatt

SEQ ID NO: 554080 - DNA, 20 bp, Artificial
  CRISPR gRNA sequence
atagggtagttgcatttaag

SEQ ID NO: 554081 - DNA, 20 bp, Artificial
  CRISPR gRNA sequence
catttaagaacagctgttat

SEQ ID NO: 554082 - DNA, 20 bp, Artificial
  CRISPR gRNA sequence
aagaacagctgttatatact

SEQ ID NO: 554083 - DNA, 20 bp, Artificial
  CRISPR gRNA sequence
agaacagctgttatatactg

SEQ ID NO: 554084 - DNA, 20 bp, Artificial
  CRISPR gRNA sequence
ttatatactgtcattaacct

SEQ ID NO: 554085 - DNA, 20 bp, Artificial
  CRISPR gRNA sequence
tatactgtcattaacctatt

SEQ ID NO: 554086 - DNA, 20 bp, Artificial
  CRISPR gRNA sequence
tcattaacctattgagtaga

SEQ ID NO: 554087 - DNA, 20 bp, Artificial
  CRISPR gRNA sequence
acctattgagtagatgttat

SEQ ID NO: 554088 - DNA, 20 bp, Artificial
  CRISPR gRNA sequence
ttgagtagatgttattggta

SEQ ID NO: 554089 - DNA, 20 bp, Artificial
  CRISPR gRNA sequence
agtagatgttattggtatct

SEQ ID NO: 554090 - DNA, 20 bp, Artificial
  CRISPR gRNA sequence
ttggtatctctattaatatc

SEQ ID NO: 554091 - DNA, 20 bp, Artificial
  CRISPR gRNA sequence
gtatctctattaatatcttg

SEQ ID NO: 554092 - DNA, 20 bp, Artificial
  CRISPR gRNA sequence
tattaatatcttgtgactct

SEQ ID NO: 554093 - DNA, 20 bp, Artificial
  CRISPR gRNA sequence
ttaatatcttgtgactctgc

SEQ ID NO: 554094 - DNA, 20 bp, Artificial
  CRISPR gRNA sequence
atatcttgtgactctgcaat

SEQ ID NO: 554095 - DNA, 20 bp, Artificial
  CRISPR gRNA sequence
gtgactctgcaattccattt

SEQ ID NO: 554096 - DNA, 20 bp, Artificial
  CRISPR gRNA sequence
tgactctgcaattccatttc

SEQ ID NO: 554097 - DNA, 20 bp, Artificial
  CRISPR gRNA sequence
tgcaattccatttctaagat

SEQ ID NO: 554098 - DNA, 20 bp, Artificial
  CRISPR gRNA sequence
caattccatttctaagatgt

SEQ ID NO: 554099 - DNA, 20 bp, Artificial
  CRISPR gRNA sequence
catttctaagatgttatcct

SEQ ID NO: 554100 - DNA, 20 bp, Artificial
  CRISPR gRNA sequence
ctaagatgttatcctgggga

SEQ ID NO: 554101 - DNA, 20 bp, Artificial
  CRISPR gRNA sequence
taagatgttatcctggggaa

SEQ ID NO: 554102 - DNA, 20 bp, Artificial
  CRISPR gRNA sequence
agatgttatcctggggaaaa

SEQ ID NO: 554103 - DNA, 20 bp, Artificial
  CRISPR gRNA sequence
tcctggggaaaatatcaatg

SEQ ID NO: 554104 - DNA, 20 bp, Artificial
  CRISPR gRNA sequence
gggaaaatatcaatgatgtg

SEQ ID NO: 554105 - DNA, 20 bp, Artificial
  CRISPR gRNA sequence
ctactccccgcaaaaaggca

SEQ ID NO: 554106 - DNA, 20 bp, Artificial
  CRISPR gRNA sequence
tactccccgcaaaaaggcac

SEQ ID NO: 554107 - DNA, 20 bp, Artificial
  CRISPR gRNA sequence
ctccccgcaaaaaggcacaa

SEQ ID NO: 554108 - DNA, 20 bp, Artificial
  CRISPR gRNA sequence
cccgcaaaaaggcacaaaga

SEQ ID NO: 554109 - DNA, 20 bp, Artificial
  CRISPR gRNA sequence
actgcagccttacttaatat

SEQ ID NO: 554110 - DNA, 20 bp, Artificial
  CRISPR gRNA sequence
ctgcagccttacttaatata

SEQ ID NO: 554111 - DNA, 20 bp, Artificial
  CRISPR gRNA sequence
cagccttacttaatatacca

SEQ ID NO: 554112 - DNA, 20 bp, Artificial
  CRISPR gRNA sequence
acttaatataccataaggca

SEQ ID NO: 554113 - DNA, 20 bp, Artificial
  CRISPR gRNA sequence
cttaatataccataaggcaa

SEQ ID NO: 554114 - DNA, 20 bp, Artificial
  CRISPR gRNA sequence
aatataccataaggcaaaaa

SEQ ID NO: 554115 - DNA, 20 bp, Artificial
  CRISPR gRNA sequence
atataccataaggcaaaaac

SEQ ID NO: 554116 - DNA, 20 bp, Artificial
  CRISPR gRNA sequence
agttgttttcacagcagctc

SEQ ID NO: 554117 - DNA, 20 bp, Artificial
  CRISPR gRNA sequence
ttttcacagcagctccttgt

SEQ ID NO: 554118 - DNA, 20 bp, Artificial
  CRISPR gRNA sequence
tcacagcagctccttgtttt

SEQ ID NO: 554119 - DNA, 20 bp, Artificial
  CRISPR gRNA sequence
cacagcagctccttgttttc

SEQ ID NO: 554120 - DNA, 20 bp, Artificial
  CRISPR gRNA sequence
acagcagctccttgttttca

SEQ ID NO: 554121 - DNA, 20 bp, Artificial
  CRISPR gRNA sequence
cttgttttcacaaaaaactg

SEQ ID NO: 554122 - DNA, 20 bp, Artificial
  CRISPR gRNA sequence
gttttcacaaaaaactgtgg

SEQ ID NO: 554123 - DNA, 20 bp, Artificial
  CRISPR gRNA sequence
ttttcacaaaaaactgtggt

SEQ ID NO: 554124 - DNA, 20 bp, Artificial
  CRISPR gRNA sequence
tcacaaaaaactgtggtatg

SEQ ID NO: 554125 - DNA, 20 bp, Artificial
  CRISPR gRNA sequence
cacaaaaaactgtggtatgt

SEQ ID NO: 554126 - DNA, 20 bp, Artificial
  CRISPR gRNA sequence
acaaaaaactgtggtatgtt

SEQ ID NO: 554127 - DNA, 20 bp, Artificial
  CRISPR gRNA sequence
tggtatgttcacaaggtaaa

SEQ ID NO: 554128 - DNA, 20 bp, Artificial
  CRISPR gRNA sequence
acaaggtaaactctatccag

SEQ ID NO: 554129 - DNA, 20 bp, Artificial
  CRISPR gRNA sequence
tatccagctattgaaaatcc

SEQ ID NO: 554130 - DNA, 20 bp, Artificial
  CRISPR gRNA sequence
tccagctattgaaaatccaa

SEQ ID NO: 554131 - DNA, 20 bp, Artificial
  CRISPR gRNA sequence
ttgaaaatccaaaatcagag

SEQ ID NO: 554132 - DNA, 20 bp, Artificial
  CRISPR gRNA sequence
aaaatccaaaatcagagtac

SEQ ID NO: 554133 - DNA, 20 bp, Artificial
  CRISPR gRNA sequence
ctaaaggattggggaggggt

SEQ ID NO: 554134 - DNA, 20 bp, Artificial
  CRISPR gRNA sequence
aaggattggggaggggtcac

SEQ ID NO: 554135 - DNA, 20 bp, Artificial
  CRISPR gRNA sequence
gggaggggtcactaagaaca

SEQ ID NO: 554136 - DNA, 20 bp, Artificial
  CRISPR gRNA sequence
agaacaaatgtgacatggat

SEQ ID NO: 554137 - DNA, 20 bp, Artificial
  CRISPR gRNA sequence
tccttttattaggaacacag

SEQ ID NO: 554138 - DNA, 20 bp, Artificial
  CRISPR gRNA sequence
ccttttattaggaacacagg

SEQ ID NO: 554139 - DNA, 20 bp, Artificial
  CRISPR gRNA sequence
cttttattaggaacacaggt

SEQ ID NO: 554140 - DNA, 20 bp, Artificial
  CRISPR gRNA sequence
ttattaggaacacaggtgtg

SEQ ID NO: 554141 - DNA, 20 bp, Artificial
  CRISPR gRNA sequence
tattaggaacacaggtgtgt

SEQ ID NO: 554142 - DNA, 20 bp, Artificial
  CRISPR gRNA sequence
attaggaacacaggtgtgtt

SEQ ID NO: 554143 - DNA, 20 bp, Artificial
  CRISPR gRNA sequence
ttaggaacacaggtgtgttg

SEQ ID NO: 554144 - DNA, 20 bp, Artificial
  CRISPR gRNA sequence
ggaacacaggtgtgttggag

SEQ ID NO: 554145 - DNA, 20 bp, Artificial
  CRISPR gRNA sequence
gagcaaataggcagtcacct

SEQ ID NO: 554146 - DNA, 20 bp, Artificial
  CRISPR gRNA sequence
ttggtcagatttgagaagac

SEQ ID NO: 554147 - DNA, 20 bp, Artificial
  CRISPR gRNA sequence
gtcagatttgagaagaccct

SEQ ID NO: 554148 - DNA, 20 bp, Artificial
  CRISPR gRNA sequence
gagaagaccctggccagaaa

SEQ ID NO: 554149 - DNA, 20 bp, Artificial
  CRISPR gRNA sequence
agaagaccctggccagaaac

SEQ ID NO: 554150 - DNA, 20 bp, Artificial
  CRISPR gRNA sequence
gccagaaactgctaggtgcc

SEQ ID NO: 554151 - DNA, 20 bp, Artificial
  CRISPR gRNA sequence
ctaggtgcccccgaacatca

SEQ ID NO: 554152 - DNA, 20 bp, Artificial
  CRISPR gRNA sequence
ggtgcccccgaacatcattt

SEQ ID NO: 554153 - DNA, 20 bp, Artificial
  CRISPR gRNA sequence
tcccttctttagtagcaaaa

SEQ ID NO: 554154 - DNA, 20 bp, Artificial
  CRISPR gRNA sequence
cccttctttagtagcaaaat

SEQ ID NO: 554155 - DNA, 20 bp, Artificial
  CRISPR gRNA sequence
ccttctttagtagcaaaatt

SEQ ID NO: 554156 - DNA, 20 bp, Artificial
  CRISPR gRNA sequence
ctttagtagcaaaattcaga

SEQ ID NO: 554157 - DNA, 20 bp, Artificial
  CRISPR gRNA sequence
tttagtagcaaaattcagat

SEQ ID NO: 554158 - DNA, 20 bp, Artificial
  CRISPR gRNA sequence
tagtagcaaaattcagatat

SEQ ID NO: 554159 - DNA, 20 bp, Artificial
  CRISPR gRNA sequence
agtagcaaaattcagatatt

SEQ ID NO: 554160 - DNA, 20 bp, Artificial
  CRISPR gRNA sequence
gtagcaaaattcagatattc

SEQ ID NO: 554161 - DNA, 20 bp, Artificial
  CRISPR gRNA sequence
agatattccttggcaataat

SEQ ID NO: 554162 - DNA, 20 bp, Artificial
  CRISPR gRNA sequence
cttggcaataatactcccca

SEQ ID NO: 554163 - DNA, 20 bp, Artificial
  CRISPR gRNA sequence
ggcaataatactccccaagt

SEQ ID NO: 554164 - DNA, 20 bp, Artificial
  CRISPR gRNA sequence
gcaataatactccccaagta

SEQ ID NO: 554165 - DNA, 20 bp, Artificial
  CRISPR gRNA sequence
cccaagtagtgtttgtatac

SEQ ID NO: 554166 - DNA, 20 bp, Artificial
  CRISPR gRNA sequence
gtatacttcccttaggtggc

SEQ ID NO: 554167 - DNA, 20 bp, Artificial
  CRISPR gRNA sequence
tatacttcccttaggtggca

SEQ ID NO: 554168 - DNA, 20 bp, Artificial
  CRISPR gRNA sequence
cccttaggtggcatacgatg

SEQ ID NO: 554169 - DNA, 20 bp, Artificial
  CRISPR gRNA sequence
ccttaggtggcatacgatgc

SEQ ID NO: 554170 - DNA, 20 bp, Artificial
  CRISPR gRNA sequence
aggtggcatacgatgcctgg

SEQ ID NO: 554171 - DNA, 20 bp, Artificial
  CRISPR gRNA sequence
ggtggcatacgatgcctggt

SEQ ID NO: 554172 - DNA, 20 bp, Artificial
  CRISPR gRNA sequence
gttgcttttcttttcatgat

SEQ ID NO: 554173 - DNA, 20 bp, Artificial
  CRISPR gRNA sequence
cttttcttttcatgatgtca

SEQ ID NO: 554174 - DNA, 20 bp, Artificial
  CRISPR gRNA sequence
ttcttttcatgatgtcagtg

SEQ ID NO: 554175 - DNA, 20 bp, Artificial
  CRISPR gRNA sequence
tcttttcatgatgtcagtgc

SEQ ID NO: 554176 - DNA, 20 bp, Artificial
  CRISPR gRNA sequence
cttttcatgatgtcagtgcc

SEQ ID NO: 554177 - DNA, 20 bp, Artificial
  CRISPR gRNA sequence
ttttcatgatgtcagtgcca

SEQ ID NO: 554178 - DNA, 20 bp, Artificial
  CRISPR gRNA sequence
ttcatgatgtcagtgccact

SEQ ID NO: 554179 - DNA, 20 bp, Artificial
  CRISPR gRNA sequence
tcatgatgtcagtgccactg

SEQ ID NO: 554180 - DNA, 20 bp, Artificial
  CRISPR gRNA sequence
catgatgtcagtgccactga

SEQ ID NO: 554181 - DNA, 20 bp, Artificial
  CRISPR gRNA sequence
atgatgtcagtgccactgaa

SEQ ID NO: 554182 - DNA, 20 bp, Artificial
  CRISPR gRNA sequence
aagatcattgtctagagcca

SEQ ID NO: 554183 - DNA, 20 bp, Artificial
  CRISPR gRNA sequence
tctagagccataagttcatc

SEQ ID NO: 554184 - DNA, 20 bp, Artificial
  CRISPR gRNA sequence
gagccataagttcatcaagg

SEQ ID NO: 554185 - DNA, 20 bp, Artificial
  CRISPR gRNA sequence
atcaagggtttgcaaagtgg

SEQ ID NO: 554186 - DNA, 20 bp, Artificial
  CRISPR gRNA sequence
gcaaagtggtttagtctatc

SEQ ID NO: 554187 - DNA, 20 bp, Artificial
  CRISPR gRNA sequence
caaagtggtttagtctatca

SEQ ID NO: 554188 - DNA, 20 bp, Artificial
  CRISPR gRNA sequence
agtctatcattccttcttta

SEQ ID NO: 554189 - DNA, 20 bp, Artificial
  CRISPR gRNA sequence
gtctatcattccttctttac

SEQ ID NO: 554190 - DNA, 20 bp, Artificial
  CRISPR gRNA sequence
tcattccttctttactaact

SEQ ID NO: 554191 - DNA, 20 bp, Artificial
  CRISPR gRNA sequence
cttctttactaactacaatc

SEQ ID NO: 554192 - DNA, 20 bp, Artificial
  CRISPR gRNA sequence
ctttactaactacaatcttc

SEQ ID NO: 554193 - DNA, 20 bp, Artificial
  CRISPR gRNA sequence
tttactaactacaatcttca

SEQ ID NO: 554194 - DNA, 20 bp, Artificial
  CRISPR gRNA sequence
tactaactacaatcttcaca

SEQ ID NO: 554195 - DNA, 20 bp, Artificial
  CRISPR gRNA sequence
actaactacaatcttcacat

SEQ ID NO: 554196 - DNA, 20 bp, Artificial
  CRISPR gRNA sequence
ctaactacaatcttcacata

SEQ ID NO: 554197 - DNA, 20 bp, Artificial
  CRISPR gRNA sequence
actacaatcttcacataaag

SEQ ID NO: 554198 - DNA, 20 bp, Artificial
  CRISPR gRNA sequence
caatcttcacataaagataa

SEQ ID NO: 554199 - DNA, 20 bp, Artificial
  CRISPR gRNA sequence
cacataaagataaactgccc

SEQ ID NO: 554200 - DNA, 20 bp, Artificial
  CRISPR gRNA sequence
acataaagataaactgcccc

SEQ ID NO: 554201 - DNA, 20 bp, Artificial
  CRISPR gRNA sequence
cccctcatcaacaatgtggt

SEQ ID NO: 554202 - DNA, 20 bp, Artificial
  CRISPR gRNA sequence
atcaacaatgtggttactct

SEQ ID NO: 554203 - DNA, 20 bp, Artificial
  CRISPR gRNA sequence
ctctgaggttcaatttatat

SEQ ID NO: 554204 - DNA, 20 bp, Artificial
  CRISPR gRNA sequence
tgaggttcaatttatatagg

SEQ ID NO: 554205 - DNA, 20 bp, Artificial
  CRISPR gRNA sequence
aggttcaatttatataggaa

SEQ ID NO: 554206 - DNA, 20 bp, Artificial
  CRISPR gRNA sequence
aatttatataggaaaagcag

SEQ ID NO: 554207 - DNA, 20 bp, Artificial
  CRISPR gRNA sequence
atataggaaaagcagcattt

SEQ ID NO: 554208 - DNA, 20 bp, Artificial
  CRISPR gRNA sequence
tataggaaaagcagcatttg

SEQ ID NO: 554209 - DNA, 20 bp, Artificial
  CRISPR gRNA sequence
gattcttctctttctttatc

SEQ ID NO: 554210 - DNA, 20 bp, Artificial
  CRISPR gRNA sequence
attcttctctttctttatcg

SEQ ID NO: 554211 - DNA, 20 bp, Artificial
  CRISPR gRNA sequence
ttctctttctttatcgtttt

SEQ ID NO: 554212 - DNA, 20 bp, Artificial
  CRISPR gRNA sequence
ctctttctttatcgtttttc

SEQ ID NO: 554213 - DNA, 20 bp, Artificial
  CRISPR gRNA sequence
tctttctttatcgtttttca

SEQ ID NO: 554214 - DNA, 20 bp, Artificial
  CRISPR gRNA sequence
tttctttatcgtttttcaaa

SEQ ID NO: 554215 - DNA, 20 bp, Artificial
  CRISPR gRNA sequence
tctttatcgtttttcaaaat

SEQ ID NO: 554216 - DNA, 20 bp, Artificial
  CRISPR gRNA sequence
ctttatcgtttttcaaaata

SEQ ID NO: 554217 - DNA, 20 bp, Artificial
  CRISPR gRNA sequence
tttatcgtttttcaaaataa

SEQ ID NO: 554218 - DNA, 20 bp, Artificial
  CRISPR gRNA sequence
tatcgtttttcaaaataatg

SEQ ID NO: 554219 - DNA, 20 bp, Artificial
  CRISPR gRNA sequence
atcgtttttcaaaataatga

SEQ ID NO: 554220 - DNA, 20 bp, Artificial
  CRISPR gRNA sequence
tcgtttttcaaaataatgag

SEQ ID NO: 554221 - DNA, 20 bp, Artificial
  CRISPR gRNA sequence
ttcaaaataatgagttagct

SEQ ID NO: 554222 - DNA, 20 bp, Artificial
  CRISPR gRNA sequence
tcaaaataatgagttagctc

SEQ ID NO: 554223 - DNA, 20 bp, Artificial
  CRISPR gRNA sequence
caaaataatgagttagctcc

SEQ ID NO: 554224 - DNA, 20 bp, Artificial
  CRISPR gRNA sequence
aaaataatgagttagctccc

SEQ ID NO: 554225 - DNA, 20 bp, Artificial
  CRISPR gRNA sequence
gctcccaagcattctctaga

SEQ ID NO: 554226 - DNA, 20 bp, Artificial
  CRISPR gRNA sequence
ccaagcattctctagagatg

SEQ ID NO: 554227 - DNA, 20 bp, Artificial
  CRISPR gRNA sequence
tctagagatgaccagtgagt

SEQ ID NO: 554228 - DNA, 20 bp, Artificial
  CRISPR gRNA sequence
tagagatgaccagtgagttt

SEQ ID NO: 554229 - DNA, 20 bp, Artificial
  CRISPR gRNA sequence
gagatgaccagtgagttttt

SEQ ID NO: 554230 - DNA, 20 bp, Artificial
  CRISPR gRNA sequence
ttaaatttgtttttagtaca

SEQ ID NO: 554231 - DNA, 20 bp, Artificial
  CRISPR gRNA sequence
taaatttgtttttagtacat

SEQ ID NO: 554232 - DNA, 20 bp, Artificial
  CRISPR gRNA sequence
aaatttgtttttagtacatt

SEQ ID NO: 554233 - DNA, 20 bp, Artificial
  CRISPR gRNA sequence
aatttgtttttagtacatta

SEQ ID NO: 554234 - DNA, 20 bp, Artificial
  CRISPR gRNA sequence
gtttttagtacattatgaac

SEQ ID NO: 554235 - DNA, 20 bp, Artificial
  CRISPR gRNA sequence
tttttagtacattatgaacg

SEQ ID NO: 554236 - DNA, 20 bp, Artificial
  CRISPR gRNA sequence
ttagtacattatgaacgcat

SEQ ID NO: 554237 - DNA, 20 bp, Artificial
  CRISPR gRNA sequence
tagtacattatgaacgcatg

SEQ ID NO: 554238 - DNA, 20 bp, Artificial
  CRISPR gRNA sequence
agtacattatgaacgcatga

SEQ ID NO: 554239 - DNA, 20 bp, Artificial
  CRISPR gRNA sequence
gtacattatgaacgcatgaa

SEQ ID NO: 554240 - DNA, 20 bp, Artificial
  CRISPR gRNA sequence
tgaacgcatgaactgagcac

SEQ ID NO: 554241 - DNA, 20 bp, Artificial
  CRISPR gRNA sequence
agcacaactgatgtgtttca

SEQ ID NO: 554242 - DNA, 20 bp, Artificial
  CRISPR gRNA sequence
atgtgtttcaatctactgaa

SEQ ID NO: 554243 - DNA, 20 bp, Artificial
  CRISPR gRNA sequence
caatctactgaagttgttat

SEQ ID NO: 554244 - DNA, 20 bp, Artificial
  CRISPR gRNA sequence
aatctactgaagttgttatt

SEQ ID NO: 554245 - DNA, 20 bp, Artificial
  CRISPR gRNA sequence
ctgaagttgttattcttatt

SEQ ID NO: 554246 - DNA, 20 bp, Artificial
  CRISPR gRNA sequence
aagttgttattcttattgat

SEQ ID NO: 554247 - DNA, 20 bp, Artificial
  CRISPR gRNA sequence
ttattcttattgatgttcca

SEQ ID NO: 554248 - DNA, 20 bp, Artificial
  CRISPR gRNA sequence
ttcttattgatgttccaatt

SEQ ID NO: 554249 - DNA, 20 bp, Artificial
  CRISPR gRNA sequence
ttattgatgttccaattgtc

SEQ ID NO: 554250 - DNA, 20 bp, Artificial
  CRISPR gRNA sequence
attgatgttccaattgtctt

SEQ ID NO: 554251 - DNA, 20 bp, Artificial
  CRISPR gRNA sequence
ttgatgttccaattgtctta

SEQ ID NO: 554252 - DNA, 20 bp, Artificial
  CRISPR gRNA sequence
atgttccaattgtcttattt

SEQ ID NO: 554253 - DNA, 20 bp, Artificial
  CRISPR gRNA sequence
caattgtcttatttttggcc

SEQ ID NO: 554254 - DNA, 20 bp, Artificial
  CRISPR gRNA sequence
tcttatttttggccagaggg

SEQ ID NO: 554255 - DNA, 20 bp, Artificial
  CRISPR gRNA sequence
atttttggccagagggaacc

SEQ ID NO: 554256 - DNA, 20 bp, Artificial
  CRISPR gRNA sequence
tttttggccagagggaacct

SEQ ID NO: 554257 - DNA, 20 bp, Artificial
  CRISPR gRNA sequence
ttggccagagggaacctctt

SEQ ID NO: 554258 - DNA, 20 bp, Artificial
  CRISPR gRNA sequence
tggccagagggaacctcttc

SEQ ID NO: 554259 - DNA, 20 bp, Artificial
  CRISPR gRNA sequence
ggccagagggaacctcttca

SEQ ID NO: 554260 - DNA, 20 bp, Artificial
  CRISPR gRNA sequence
gccagagggaacctcttcag

SEQ ID NO: 554261 - DNA, 20 bp, Artificial
  CRISPR gRNA sequence
ttcagagtggctcctgagtc

SEQ ID NO: 554262 - DNA, 20 bp, Artificial
  CRISPR gRNA sequence
cagagtggctcctgagtcct

SEQ ID NO: 554263 - DNA, 20 bp, Artificial
  CRISPR gRNA sequence
agagtggctcctgagtcctg

SEQ ID NO: 554264 - DNA, 20 bp, Artificial
  CRISPR gRNA sequence
ctgagtcctgttcgtaccat

SEQ ID NO: 554265 - DNA, 20 bp, Artificial
  CRISPR gRNA sequence
agtcctgttcgtaccatcat

SEQ ID NO: 554266 - DNA, 20 bp, Artificial
  CRISPR gRNA sequence
ttcgtaccatcatgttaagt

SEQ ID NO: 554267 - DNA, 20 bp, Artificial
  CRISPR gRNA sequence
gtaccatcatgttaagtctt

SEQ ID NO: 554268 - DNA, 20 bp, Artificial
  CRISPR gRNA sequence
agtctttttgatagctttct

SEQ ID NO: 554269 - DNA, 20 bp, Artificial
  CRISPR gRNA sequence
tttgatagctttcttgttct

SEQ ID NO: 554270 - DNA, 20 bp, Artificial
  CRISPR gRNA sequence
ttgatagctttcttgttctg

SEQ ID NO: 554271 - DNA, 20 bp, Artificial
  CRISPR gRNA sequence
tgatagctttcttgttctgt

SEQ ID NO: 554272 - DNA, 20 bp, Artificial
  CRISPR gRNA sequence
gatagctttcttgttctgtg

SEQ ID NO: 554273 - DNA, 20 bp, Artificial
  CRISPR gRNA sequence
atagctttcttgttctgtgg

SEQ ID NO: 554274 - DNA, 20 bp, Artificial
  CRISPR gRNA sequence
tcttgttctgtggtaaaata

SEQ ID NO: 554275 - DNA, 20 bp, Artificial
  CRISPR gRNA sequence
cttgttctgtggtaaaataa

SEQ ID NO: 554276 - DNA, 20 bp, Artificial
  CRISPR gRNA sequence
ttgttctgtggtaaaataag

SEQ ID NO: 554277 - DNA, 20 bp, Artificial
  CRISPR gRNA sequence
gttctgtggtaaaataagat

SEQ ID NO: 554278 - DNA, 20 bp, Artificial
  CRISPR gRNA sequence
ttctgtggtaaaataagata

SEQ ID NO: 554279 - DNA, 20 bp, Artificial
  CRISPR gRNA sequence
tgtggtaaaataagatactc

SEQ ID NO: 554280 - DNA, 20 bp, Artificial
  CRISPR gRNA sequence
tggtaaaataagatactcaa

SEQ ID NO: 554281 - DNA, 20 bp, Artificial
  CRISPR gRNA sequence
aaggcttattttaatgcatt

SEQ ID NO: 554282 - DNA, 20 bp, Artificial
  CRISPR gRNA sequence
attttaatgcattccatgcc

SEQ ID NO: 554283 - DNA, 20 bp, Artificial
  CRISPR gRNA sequence
ttttaatgcattccatgccc

SEQ ID NO: 554284 - DNA, 20 bp, Artificial
  CRISPR gRNA sequence
taatgcattccatgccccag

SEQ ID NO: 554285 - DNA, 20 bp, Artificial
  CRISPR gRNA sequence
aatgcattccatgccccagg

SEQ ID NO: 554286 - DNA, 20 bp, Artificial
  CRISPR gRNA sequence
atgcattccatgccccaggt

SEQ ID NO: 554287 - DNA, 20 bp, Artificial
  CRISPR gRNA sequence
catgccccaggtatggaatc

SEQ ID NO: 554288 - DNA, 20 bp, Artificial
  CRISPR gRNA sequence
tcccaaaggccctagttcat

SEQ ID NO: 554289 - DNA, 20 bp, Artificial
  CRISPR gRNA sequence
gttcattttcatgggaaatg

SEQ ID NO: 554290 - DNA, 20 bp, Artificial
  CRISPR gRNA sequence
attttcatgggaaatgataa

SEQ ID NO: 554291 - DNA, 20 bp, Artificial
  CRISPR gRNA sequence
tcatgggaaatgataattag

SEQ ID NO: 554292 - DNA, 20 bp, Artificial
  CRISPR gRNA sequence
catgggaaatgataattagg

SEQ ID NO: 554293 - DNA, 20 bp, Artificial
  CRISPR gRNA sequence
atgggaaatgataattaggt

SEQ ID NO: 554294 - DNA, 20 bp, Artificial
  CRISPR gRNA sequence
ggtaccataatctgggtgaa

SEQ ID NO: 554295 - DNA, 20 bp, Artificial
  CRISPR gRNA sequence
ggtgaaggtggccaatcatc

SEQ ID NO: 554296 - DNA, 20 bp, Artificial
  CRISPR gRNA sequence
gttttcctgaaactgaagag

SEQ ID NO: 554297 - DNA, 20 bp, Artificial
  CRISPR gRNA sequence
tcctgaaactgaagagtttc

SEQ ID NO: 554298 - DNA, 20 bp, Artificial
  CRISPR gRNA sequence
cctgaaactgaagagtttcc

SEQ ID NO: 554299 - DNA, 20 bp, Artificial
  CRISPR gRNA sequence
ctgaaactgaagagtttcct

SEQ ID NO: 554300 - DNA, 20 bp, Artificial
  CRISPR gRNA sequence
aaactgaagagtttcctggg

SEQ ID NO: 554301 - DNA, 20 bp, Artificial
  CRISPR gRNA sequence
aagagtttcctgggatatga

SEQ ID NO: 554302 - DNA, 20 bp, Artificial
  CRISPR gRNA sequence
cctgggatatgaaattcggg

SEQ ID NO: 554303 - DNA, 20 bp, Artificial
  CRISPR gRNA sequence
ctgggatatgaaattcgggt

SEQ ID NO: 554304 - DNA, 20 bp, Artificial
  CRISPR gRNA sequence
ggatatgaaattcgggtgct

SEQ ID NO: 554305 - DNA, 20 bp, Artificial
  CRISPR gRNA sequence
gggtgctgaaactgggaagt

SEQ ID NO: 554306 - DNA, 20 bp, Artificial
  CRISPR gRNA sequence
aaactgggaagtctgggcac

SEQ ID NO: 554307 - DNA, 20 bp, Artificial
  CRISPR gRNA sequence
ggaagtctgggcacaccagg

SEQ ID NO: 554308 - DNA, 20 bp, Artificial
  CRISPR gRNA sequence
ggcacaccaggtaacactgg

SEQ ID NO: 554309 - DNA, 20 bp, Artificial
  CRISPR gRNA sequence
gtcactcaaatctgggtcca

SEQ ID NO: 554310 - DNA, 20 bp, Artificial
  CRISPR gRNA sequence
aaatctgggtccaagaacca

SEQ ID NO: 554311 - DNA, 20 bp, Artificial
  CRISPR gRNA sequence
ggtccaagaaccaagaagca

SEQ ID NO: 554312 - DNA, 20 bp, Artificial
  CRISPR gRNA sequence
ctacaggactggctcttgtt

SEQ ID NO: 554313 - DNA, 20 bp, Artificial
  CRISPR gRNA sequence
caggactggctcttgtttct

SEQ ID NO: 554314 - DNA, 20 bp, Artificial
  CRISPR gRNA sequence
gctcttgtttctagaacatt

SEQ ID NO: 554315 - DNA, 20 bp, Artificial
  CRISPR gRNA sequence
ttgtttctagaacatttcaa

SEQ ID NO: 554316 - DNA, 20 bp, Artificial
  CRISPR gRNA sequence
gtttctagaacatttcaatg

SEQ ID NO: 554317 - DNA, 20 bp, Artificial
  CRISPR gRNA sequence
tttctagaacatttcaatgg

SEQ ID NO: 554318 - DNA, 20 bp, Artificial
  CRISPR gRNA sequence
ctagaacatttcaatggaca

SEQ ID NO: 554319 - DNA, 20 bp, Artificial
  CRISPR gRNA sequence
tagaacatttcaatggacag

SEQ ID NO: 554320 - DNA, 20 bp, Artificial
  CRISPR gRNA sequence
gaacatttcaatggacagaa

SEQ ID NO: 554321 - DNA, 20 bp, Artificial
  CRISPR gRNA sequence
caatggacagaaccaggaaa

SEQ ID NO: 554322 - DNA, 20 bp, Artificial
  CRISPR gRNA sequence
aatggacagaaccaggaaat

SEQ ID NO: 554323 - DNA, 20 bp, Artificial
  CRISPR gRNA sequence
tctaagagacaaaatacatt

SEQ ID NO: 554324 - DNA, 20 bp, Artificial
  CRISPR gRNA sequence
ctaagagacaaaatacatta

SEQ ID NO: 554325 - DNA, 20 bp, Artificial
  CRISPR gRNA sequence
taagagacaaaatacattaa

SEQ ID NO: 554326 - DNA, 20 bp, Artificial
  CRISPR gRNA sequence
agagacaaaatacattaatg

SEQ ID NO: 554327 - DNA, 20 bp, Artificial
  CRISPR gRNA sequence
atgggtcatgctggcattat

SEQ ID NO: 554328 - DNA, 20 bp, Artificial
  CRISPR gRNA sequence
gcattatgctgaaccctatt

SEQ ID NO: 554329 - DNA, 20 bp, Artificial
  CRISPR gRNA sequence
tgctgaaccctattaagctg

SEQ ID NO: 554330 - DNA, 20 bp, Artificial
  CRISPR gRNA sequence
aaccctattaagctgccaag

SEQ ID NO: 554331 - DNA, 20 bp, Artificial
  CRISPR gRNA sequence
ttaagctgccaagattcaat

SEQ ID NO: 554332 - DNA, 20 bp, Artificial
  CRISPR gRNA sequence
agctgccaagattcaatggt

SEQ ID NO: 554333 - DNA, 20 bp, Artificial
  CRISPR gRNA sequence
ccaagattcaatggtttttg

SEQ ID NO: 554334 - DNA, 20 bp, Artificial
  CRISPR gRNA sequence
aatggtttttgactagagaa

SEQ ID NO: 554335 - DNA, 20 bp, Artificial
  CRISPR gRNA sequence
ttgactagagaaacagcaat

SEQ ID NO: 554336 - DNA, 20 bp, Artificial
  CRISPR gRNA sequence
tgactagagaaacagcaatt

SEQ ID NO: 554337 - DNA, 20 bp, Artificial
  CRISPR gRNA sequence
gactagagaaacagcaattt

SEQ ID NO: 554338 - DNA, 20 bp, Artificial
  CRISPR gRNA sequence
actagagaaacagcaatttc

SEQ ID NO: 554339 - DNA, 20 bp, Artificial
  CRISPR gRNA sequence
gagaaacagcaatttcatat

SEQ ID NO: 554340 - DNA, 20 bp, Artificial
  CRISPR gRNA sequence
catatggttcaaattaatac

SEQ ID NO: 554341 - DNA, 20 bp, Artificial
  CRISPR gRNA sequence
atatggttcaaattaatacc

SEQ ID NO: 554342 - DNA, 20 bp, Artificial
  CRISPR gRNA sequence
aaattaatacctttaaataa

SEQ ID NO: 554343 - DNA, 20 bp, Artificial
  CRISPR gRNA sequence
atacctttaaataaatccag

SEQ ID NO: 554344 - DNA, 20 bp, Artificial
  CRISPR gRNA sequence
taaataaatccagggctaca

SEQ ID NO: 554345 - DNA, 20 bp, Artificial
  CRISPR gRNA sequence
aaataaatccagggctacaa

SEQ ID NO: 554346 - DNA, 20 bp, Artificial
  CRISPR gRNA sequence
aataaatccagggctacaat

SEQ ID NO: 554347 - DNA, 20 bp, Artificial
  CRISPR gRNA sequence
caatgtttacttaacctaat

SEQ ID NO: 554348 - DNA, 20 bp, Artificial
  CRISPR gRNA sequence
acttaacctaatcaatttac

SEQ ID NO: 554349 - DNA, 20 bp, Artificial
  CRISPR gRNA sequence
cttaacctaatcaatttaca

SEQ ID NO: 554350 - DNA, 20 bp, Artificial
  CRISPR gRNA sequence
aacctaatcaatttacagct

SEQ ID NO: 554351 - DNA, 20 bp, Artificial
  CRISPR gRNA sequence
acctaatcaatttacagctg

SEQ ID NO: 554352 - DNA, 20 bp, Artificial
  CRISPR gRNA sequence
atcaatttacagctgaatct

SEQ ID NO: 554353 - DNA, 20 bp, Artificial
  CRISPR gRNA sequence
acagctgaatctcctttctt

SEQ ID NO: 554354 - DNA, 20 bp, Artificial
  CRISPR gRNA sequence
cagctgaatctcctttcttt

SEQ ID NO: 554355 - DNA, 20 bp, Artificial
  CRISPR gRNA sequence
aatctcctttctttcatgcc

SEQ ID NO: 554356 - DNA, 20 bp, Artificial
  CRISPR gRNA sequence
ctttctttcatgccaaacat

SEQ ID NO: 554357 - DNA, 20 bp, Artificial
  CRISPR gRNA sequence
tctttcatgccaaacatccc

SEQ ID NO: 554358 - DNA, 20 bp, Artificial
  CRISPR gRNA sequence
ctttcatgccaaacatccca

SEQ ID NO: 554359 - DNA, 20 bp, Artificial
  CRISPR gRNA sequence
tttcatgccaaacatcccaa

SEQ ID NO: 554360 - DNA, 20 bp, Artificial
  CRISPR gRNA sequence
tcatgccaaacatcccaata

SEQ ID NO: 554361 - DNA, 20 bp, Artificial
  CRISPR gRNA sequence
catgccaaacatcccaatat

SEQ ID NO: 554362 - DNA, 20 bp, Artificial
  CRISPR gRNA sequence
atgccaaacatcccaatatt

SEQ ID NO: 554363 - DNA, 20 bp, Artificial
  CRISPR gRNA sequence
aataacaacaatataaatat

SEQ ID NO: 554364 - DNA, 20 bp, Artificial
  CRISPR gRNA sequence
atttgcattttcctgcaata

SEQ ID NO: 554365 - DNA, 20 bp, Artificial
  CRISPR gRNA sequence
gcattttcctgcaatacata

SEQ ID NO: 554366 - DNA, 20 bp, Artificial
  CRISPR gRNA sequence
cattttcctgcaatacatac

SEQ ID NO: 554367 - DNA, 20 bp, Artificial
  CRISPR gRNA sequence
tcctgcaatacatactcaac

SEQ ID NO: 554368 - DNA, 20 bp, Artificial
  CRISPR gRNA sequence
cctgcaatacatactcaaca

SEQ ID NO: 554369 - DNA, 20 bp, Artificial
  CRISPR gRNA sequence
ctgcaatacatactcaacag

SEQ ID NO: 554370 - DNA, 20 bp, Artificial
  CRISPR gRNA sequence
caatacatactcaacagtaa

SEQ ID NO: 554371 - DNA, 20 bp, Artificial
  CRISPR gRNA sequence
aacagtaaccaaataccagc

SEQ ID NO: 554372 - DNA, 20 bp, Artificial
  CRISPR gRNA sequence
ctgctaactacataattact

SEQ ID NO: 554373 - DNA, 20 bp, Artificial
  CRISPR gRNA sequence
ctaactacataattacttaa

SEQ ID NO: 554374 - DNA, 20 bp, Artificial
  CRISPR gRNA sequence
actacataattacttaaaac

SEQ ID NO: 554375 - DNA, 20 bp, Artificial
  CRISPR gRNA sequence
cataattacttaaaacatta

SEQ ID NO: 554376 - DNA, 20 bp, Artificial
  CRISPR gRNA sequence
cttaaaacattacaattttt

SEQ ID NO: 554377 - DNA, 20 bp, Artificial
  CRISPR gRNA sequence
aaaacattacaatttttttc

SEQ ID NO: 554378 - DNA, 20 bp, Artificial
  CRISPR gRNA sequence
aaacattacaatttttttct

SEQ ID NO: 554379 - DNA, 20 bp, Artificial
  CRISPR gRNA sequence
caatttttttctttatagtt

SEQ ID NO: 554380 - DNA, 20 bp, Artificial
  CRISPR gRNA sequence
ttttctttatagttcttttt

SEQ ID NO: 554381 - DNA, 20 bp, Artificial
  CRISPR gRNA sequence
tttctttatagttcttttta

SEQ ID NO: 554382 - DNA, 20 bp, Artificial
  CRISPR gRNA sequence
ttctttatagttctttttat

SEQ ID NO: 554383 - DNA, 20 bp, Artificial
  CRISPR gRNA sequence
tctttatagttctttttatc

SEQ ID NO: 554384 - DNA, 20 bp, Artificial
  CRISPR gRNA sequence
ctttatagttctttttatcc

SEQ ID NO: 554385 - DNA, 20 bp, Artificial
  CRISPR gRNA sequence
tttatagttctttttatcct

SEQ ID NO: 554386 - DNA, 20 bp, Artificial
  CRISPR gRNA sequence
tatagttctttttatcctta

SEQ ID NO: 554387 - DNA, 20 bp, Artificial
  CRISPR gRNA sequence
atagttctttttatccttag

SEQ ID NO: 554388 - DNA, 20 bp, Artificial
  CRISPR gRNA sequence
tagttctttttatccttaga

SEQ ID NO: 554389 - DNA, 20 bp, Artificial
  CRISPR gRNA sequence
tttttatccttagaatgcag

SEQ ID NO: 554390 - DNA, 20 bp, Artificial
  CRISPR gRNA sequence
tttatccttagaatgcagcc

SEQ ID NO: 554391 - DNA, 20 bp, Artificial
  CRISPR gRNA sequence
ttatccttagaatgcagccc

SEQ ID NO: 554392 - DNA, 20 bp, Artificial
  CRISPR gRNA sequence
tatccttagaatgcagcccc

SEQ ID NO: 554393 - DNA, 20 bp, Artificial
  CRISPR gRNA sequence
atccttagaatgcagcccct

SEQ ID NO: 554394 - DNA, 20 bp, Artificial
  CRISPR gRNA sequence
tccttagaatgcagcccctt

SEQ ID NO: 554395 - DNA, 20 bp, Artificial
  CRISPR gRNA sequence
agaatgcagccccttgaaat

SEQ ID NO: 554396 - DNA, 20 bp, Artificial
  CRISPR gRNA sequence
gaatgcagccccttgaaata

SEQ ID NO: 554397 - DNA, 20 bp, Artificial
  CRISPR gRNA sequence
gaaatatgcacccaaattac

SEQ ID NO: 554398 - DNA, 20 bp, Artificial
  CRISPR gRNA sequence
aaatatgcacccaaattact

SEQ ID NO: 554399 - DNA, 20 bp, Artificial
  CRISPR gRNA sequence
ctatgttttgaaaacacttg

SEQ ID NO: 554400 - DNA, 20 bp, Artificial
  CRISPR gRNA sequence
tgttttgaaaacacttggaa

SEQ ID NO: 554401 - DNA, 20 bp, Artificial
  CRISPR gRNA sequence
tgaaaacacttggaatggtt

SEQ ID NO: 554402 - DNA, 20 bp, Artificial
  CRISPR gRNA sequence
gaaaacacttggaatggttc

SEQ ID NO: 554403 - DNA, 20 bp, Artificial
  CRISPR gRNA sequence
aaaacacttggaatggttcc

SEQ ID NO: 554404 - DNA, 20 bp, Artificial
  CRISPR gRNA sequence
ggaatggttcctctatttgg

SEQ ID NO: 554405 - DNA, 20 bp, Artificial
  CRISPR gRNA sequence
gaatggttcctctatttggg

SEQ ID NO: 554406 - DNA, 20 bp, Artificial
  CRISPR gRNA sequence
ctctatttggggttattcca

SEQ ID NO: 554407 - DNA, 20 bp, Artificial
  CRISPR gRNA sequence
tatttggggttattccacaa

SEQ ID NO: 554408 - DNA, 20 bp, Artificial
  CRISPR gRNA sequence
tttggggttattccacaaac

SEQ ID NO: 554409 - DNA, 20 bp, Artificial
  CRISPR gRNA sequence
ggggttattccacaaacttg

SEQ ID NO: 554410 - DNA, 20 bp, Artificial
  CRISPR gRNA sequence
gggttattccacaaacttga

SEQ ID NO: 554411 - DNA, 20 bp, Artificial
  CRISPR gRNA sequence
ttccacaaacttgattcatg

SEQ ID NO: 554412 - DNA, 20 bp, Artificial
  CRISPR gRNA sequence
cacaaacttgattcatggct

SEQ ID NO: 554413 - DNA, 20 bp, Artificial
  CRISPR gRNA sequence
gattcatggcttagtaagtt

SEQ ID NO: 554414 - DNA, 20 bp, Artificial
  CRISPR gRNA sequence
attcatggcttagtaagtta

SEQ ID NO: 554415 - DNA, 20 bp, Artificial
  CRISPR gRNA sequence
atggcttagtaagttagctt

SEQ ID NO: 554416 - DNA, 20 bp, Artificial
  CRISPR gRNA sequence
agtaagttagcttcacttgg

SEQ ID NO: 554417 - DNA, 20 bp, Artificial
  CRISPR gRNA sequence
gtaagttagcttcacttggc

SEQ ID NO: 554418 - DNA, 20 bp, Artificial
  CRISPR gRNA sequence
gcttcacttggctttaaata

SEQ ID NO: 554419 - DNA, 20 bp, Artificial
  CRISPR gRNA sequence
cacttggctttaaatatttt

SEQ ID NO: 554420 - DNA, 20 bp, Artificial
  CRISPR gRNA sequence
acttggctttaaatattttg

SEQ ID NO: 554421 - DNA, 20 bp, Artificial
  CRISPR gRNA sequence
ggctttaaatattttgagtt

SEQ ID NO: 554422 - DNA, 20 bp, Artificial
  CRISPR gRNA sequence
gctttaaatattttgagttt

SEQ ID NO: 554423 - DNA, 20 bp, Artificial
  CRISPR gRNA sequence
taaatattttgagtttcagg

SEQ ID NO: 554424 - DNA, 20 bp, Artificial
  CRISPR gRNA sequence
aaatattttgagtttcaggt

SEQ ID NO: 554425 - DNA, 20 bp, Artificial
  CRISPR gRNA sequence
aatattttgagtttcaggtt

SEQ ID NO: 554426 - DNA, 20 bp, Artificial
  CRISPR gRNA sequence
tgagtttcaggttcacaaca

SEQ ID NO: 554427 - DNA, 20 bp, Artificial
  CRISPR gRNA sequence
gagtttcaggttcacaacaa

SEQ ID NO: 554428 - DNA, 20 bp, Artificial
  CRISPR gRNA sequence
agtttcaggttcacaacaaa

SEQ ID NO: 554429 - DNA, 20 bp, Artificial
  CRISPR gRNA sequence
caggttcacaacaaaactga

SEQ ID NO: 554430 - DNA, 20 bp, Artificial
  CRISPR gRNA sequence
aggttcacaacaaaactgag

SEQ ID NO: 554431 - DNA, 20 bp, Artificial
  CRISPR gRNA sequence
acaacaaaactgagcagaag

SEQ ID NO: 554432 - DNA, 20 bp, Artificial
  CRISPR gRNA sequence
agcagaagttacagaaagtt

SEQ ID NO: 554433 - DNA, 20 bp, Artificial
  CRISPR gRNA sequence
cagaaagtttgtacatacat

SEQ ID NO: 554434 - DNA, 20 bp, Artificial
  CRISPR gRNA sequence
gtacatacatcctgccccta

SEQ ID NO: 554435 - DNA, 20 bp, Artificial
  CRISPR gRNA sequence
tacatacatcctgcccctac

SEQ ID NO: 554436 - DNA, 20 bp, Artificial
  CRISPR gRNA sequence
cccctacacatgcatagcct

SEQ ID NO: 554437 - DNA, 20 bp, Artificial
  CRISPR gRNA sequence
cacatgcatagcctccccat

SEQ ID NO: 554438 - DNA, 20 bp, Artificial
  CRISPR gRNA sequence
cccattatcaatatccctca

SEQ ID NO: 554439 - DNA, 20 bp, Artificial
  CRISPR gRNA sequence
tcaatatccctcaccagagt

SEQ ID NO: 554440 - DNA, 20 bp, Artificial
  CRISPR gRNA sequence
accagagtggtacatttttt

SEQ ID NO: 554441 - DNA, 20 bp, Artificial
  CRISPR gRNA sequence
tttagaattaatgaaaccat

SEQ ID NO: 554442 - DNA, 20 bp, Artificial
  CRISPR gRNA sequence
ttagaattaatgaaaccatt

SEQ ID NO: 554443 - DNA, 20 bp, Artificial
  CRISPR gRNA sequence
tagaattaatgaaaccattc

SEQ ID NO: 554444 - DNA, 20 bp, Artificial
  CRISPR gRNA sequence
agaattaatgaaaccattct

SEQ ID NO: 554445 - DNA, 20 bp, Artificial
  CRISPR gRNA sequence
gaattaatgaaaccattctg

SEQ ID NO: 554446 - DNA, 20 bp, Artificial
  CRISPR gRNA sequence
atgaaaccattctgatacat

SEQ ID NO: 554447 - DNA, 20 bp, Artificial
  CRISPR gRNA sequence
tgatacatcattatcattaa

SEQ ID NO: 554448 - DNA, 20 bp, Artificial
  CRISPR gRNA sequence
atacatcattatcattaaaa

SEQ ID NO: 554449 - DNA, 20 bp, Artificial
  CRISPR gRNA sequence
tcattaaaaaatccacactt

SEQ ID NO: 554450 - DNA, 20 bp, Artificial
  CRISPR gRNA sequence
aaaaatccacactttacatt

SEQ ID NO: 554451 - DNA, 20 bp, Artificial
  CRISPR gRNA sequence
tacattagcattcagttgta

SEQ ID NO: 554452 - DNA, 20 bp, Artificial
  CRISPR gRNA sequence
acattagcattcagttgtac

SEQ ID NO: 554453 - DNA, 20 bp, Artificial
  CRISPR gRNA sequence
cattagcattcagttgtaca

SEQ ID NO: 554454 - DNA, 20 bp, Artificial
  CRISPR gRNA sequence
gcattcagttgtacattctg

SEQ ID NO: 554455 - DNA, 20 bp, Artificial
  CRISPR gRNA sequence
agttgtacattctgtgggtt

SEQ ID NO: 554456 - DNA, 20 bp, Artificial
  CRISPR gRNA sequence
tacattctgtgggtttggac

SEQ ID NO: 554457 - DNA, 20 bp, Artificial
  CRISPR gRNA sequence
tgtgggtttggacaaatgta

SEQ ID NO: 554458 - DNA, 20 bp, Artificial
  CRISPR gRNA sequence
tgggtttggacaaatgtata

SEQ ID NO: 554459 - DNA, 20 bp, Artificial
  CRISPR gRNA sequence
ggacaaatgtataataacat

SEQ ID NO: 554460 - DNA, 20 bp, Artificial
  CRISPR gRNA sequence
gacaaatgtataataacatc

SEQ ID NO: 554461 - DNA, 20 bp, Artificial
  CRISPR gRNA sequence
cagtatcatacagagtattt

SEQ ID NO: 554462 - DNA, 20 bp, Artificial
  CRISPR gRNA sequence
tcactgcccccaaactcctc

SEQ ID NO: 554463 - DNA, 20 bp, Artificial
  CRISPR gRNA sequence
cactgcccccaaactcctct

SEQ ID NO: 554464 - DNA, 20 bp, Artificial
  CRISPR gRNA sequence
actgcccccaaactcctctg

SEQ ID NO: 554465 - DNA, 20 bp, Artificial
  CRISPR gRNA sequence
cccccaaactcctctgtgtt

SEQ ID NO: 554466 - DNA, 20 bp, Artificial
  CRISPR gRNA sequence
ctctgtgttccacctattca

SEQ ID NO: 554467 - DNA, 20 bp, Artificial
  CRISPR gRNA sequence
tgtgttccacctattcatat

SEQ ID NO: 554468 - DNA, 20 bp, Artificial
  CRISPR gRNA sequence
tgttccacctattcatatcc

SEQ ID NO: 554469 - DNA, 20 bp, Artificial
  CRISPR gRNA sequence
cacctattcatatcccctgc

SEQ ID NO: 554470 - DNA, 20 bp, Artificial
  CRISPR gRNA sequence
ttcatatcccctgccaacta

SEQ ID NO: 554471 - DNA, 20 bp, Artificial
  CRISPR gRNA sequence
atatcccctgccaactacta

SEQ ID NO: 554472 - DNA, 20 bp, Artificial
  CRISPR gRNA sequence
ccaactactaatctttttac

SEQ ID NO: 554473 - DNA, 20 bp, Artificial
  CRISPR gRNA sequence
ctaatctttttacagtctcc

SEQ ID NO: 554474 - DNA, 20 bp, Artificial
  CRISPR gRNA sequence
atctttttacagtctccaca

SEQ ID NO: 554475 - DNA, 20 bp, Artificial
  CRISPR gRNA sequence
tttacagtctccacagtttt

SEQ ID NO: 554476 - DNA, 20 bp, Artificial
  CRISPR gRNA sequence
ttacagtctccacagttttg

SEQ ID NO: 554477 - DNA, 20 bp, Artificial
  CRISPR gRNA sequence
tacagtctccacagttttgc

SEQ ID NO: 554478 - DNA, 20 bp, Artificial
  CRISPR gRNA sequence
acagtctccacagttttgcc

SEQ ID NO: 554479 - DNA, 20 bp, Artificial
  CRISPR gRNA sequence
cagtctccacagttttgcct

SEQ ID NO: 554480 - DNA, 20 bp, Artificial
  CRISPR gRNA sequence
cacagttttgccttttccag

SEQ ID NO: 554481 - DNA, 20 bp, Artificial
  CRISPR gRNA sequence
tgccttttccagaatgtcac

SEQ ID NO: 554482 - DNA, 20 bp, Artificial
  CRISPR gRNA sequence
gccttttccagaatgtcaca

SEQ ID NO: 554483 - DNA, 20 bp, Artificial
  CRISPR gRNA sequence
ccttttccagaatgtcacat

SEQ ID NO: 554484 - DNA, 20 bp, Artificial
  CRISPR gRNA sequence
ttccagaatgtcacataggt

SEQ ID NO: 554485 - DNA, 20 bp, Artificial
  CRISPR gRNA sequence
tccagaatgtcacataggta

SEQ ID NO: 554486 - DNA, 20 bp, Artificial
  CRISPR gRNA sequence
ccagaatgtcacataggtaa

SEQ ID NO: 554487 - DNA, 20 bp, Artificial
  CRISPR gRNA sequence
cagaatgtcacataggtaaa

SEQ ID NO: 554488 - DNA, 20 bp, Artificial
  CRISPR gRNA sequence
gcatagcatgtagcctgttc

SEQ ID NO: 554489 - DNA, 20 bp, Artificial
  CRISPR gRNA sequence
catagcatgtagcctgttca

SEQ ID NO: 554490 - DNA, 20 bp, Artificial
  CRISPR gRNA sequence
ttcagattggattctttgac

SEQ ID NO: 554491 - DNA, 20 bp, Artificial
  CRISPR gRNA sequence
agattggattctttgactta

SEQ ID NO: 554492 - DNA, 20 bp, Artificial
  CRISPR gRNA sequence
gattctttgacttataatat

SEQ ID NO: 554493 - DNA, 20 bp, Artificial
  CRISPR gRNA sequence
tttgacttataatatgcatt

SEQ ID NO: 554494 - DNA, 20 bp, Artificial
  CRISPR gRNA sequence
tgacttataatatgcattta

SEQ ID NO: 554495 - DNA, 20 bp, Artificial
  CRISPR gRNA sequence
gacttataatatgcatttaa

SEQ ID NO: 554496 - DNA, 20 bp, Artificial
  CRISPR gRNA sequence
acttataatatgcatttaag

SEQ ID NO: 554497 - DNA, 20 bp, Artificial
  CRISPR gRNA sequence
ataatatgcatttaagtttc

SEQ ID NO: 554498 - DNA, 20 bp, Artificial
  CRISPR gRNA sequence
taatatgcatttaagtttcc

SEQ ID NO: 554499 - DNA, 20 bp, Artificial
  CRISPR gRNA sequence
aagtttcctccatgtctttt

SEQ ID NO: 554500 - DNA, 20 bp, Artificial
  CRISPR gRNA sequence
agtttcctccatgtcttttc

SEQ ID NO: 554501 - DNA, 20 bp, Artificial
  CRISPR gRNA sequence
cctccatgtcttttcatggc

SEQ ID NO: 554502 - DNA, 20 bp, Artificial
  CRISPR gRNA sequence
ctccatgtcttttcatggct

SEQ ID NO: 554503 - DNA, 20 bp, Artificial
  CRISPR gRNA sequence
catgtcttttcatggcttga

SEQ ID NO: 554504 - DNA, 20 bp, Artificial
  CRISPR gRNA sequence
ttcatggcttgatagttctt

SEQ ID NO: 554505 - DNA, 20 bp, Artificial
  CRISPR gRNA sequence
tcatggcttgatagttcttt

SEQ ID NO: 554506 - DNA, 20 bp, Artificial
  CRISPR gRNA sequence
catggcttgatagttctttt

SEQ ID NO: 554507 - DNA, 20 bp, Artificial
  CRISPR gRNA sequence
atggcttgatagttcttttc

SEQ ID NO: 554508 - DNA, 20 bp, Artificial
  CRISPR gRNA sequence
gatagttcttttcagtgctg

SEQ ID NO: 554509 - DNA, 20 bp, Artificial
  CRISPR gRNA sequence
atagttcttttcagtgctga

SEQ ID NO: 554510 - DNA, 20 bp, Artificial
  CRISPR gRNA sequence
ttttcagtgctgaataatat

SEQ ID NO: 554511 - DNA, 20 bp, Artificial
  CRISPR gRNA sequence
ttcagtgctgaataatattc

SEQ ID NO: 554512 - DNA, 20 bp, Artificial
  CRISPR gRNA sequence
tcagtgctgaataatattct

SEQ ID NO: 554513 - DNA, 20 bp, Artificial
  CRISPR gRNA sequence
cagtgctgaataatattcta

SEQ ID NO: 554514 - DNA, 20 bp, Artificial
  CRISPR gRNA sequence
agtgctgaataatattctat

SEQ ID NO: 554515 - DNA, 20 bp, Artificial
  CRISPR gRNA sequence
aataatattctattgtctgt

SEQ ID NO: 554516 - DNA, 20 bp, Artificial
  CRISPR gRNA sequence
tattgtctgtatgtaccaca

SEQ ID NO: 554517 - DNA, 20 bp, Artificial
  CRISPR gRNA sequence
ttgtctgtatgtaccacagt

SEQ ID NO: 554518 - DNA, 20 bp, Artificial
  CRISPR gRNA sequence
tctgtatgtaccacagttta

SEQ ID NO: 554519 - DNA, 20 bp, Artificial
  CRISPR gRNA sequence
tatgtaccacagtttatttg

SEQ ID NO: 554520 - DNA, 20 bp, Artificial
  CRISPR gRNA sequence
atttgtccattcacttactg

SEQ ID NO: 554521 - DNA, 20 bp, Artificial
  CRISPR gRNA sequence
tttgtccattcacttactga

SEQ ID NO: 554522 - DNA, 20 bp, Artificial
  CRISPR gRNA sequence
gtccattcacttactgaagg

SEQ ID NO: 554523 - DNA, 20 bp, Artificial
  CRISPR gRNA sequence
tccattcacttactgaagga

SEQ ID NO: 554524 - DNA, 20 bp, Artificial
  CRISPR gRNA sequence
acttactgaaggacatcttg

SEQ ID NO: 554525 - DNA, 20 bp, Artificial
  CRISPR gRNA sequence
actgaaggacatcttggttg

SEQ ID NO: 554526 - DNA, 20 bp, Artificial
  CRISPR gRNA sequence
ctgaaggacatcttggttgc

SEQ ID NO: 554527 - DNA, 20 bp, Artificial
  CRISPR gRNA sequence
aaggacatcttggttgcttc

SEQ ID NO: 554528 - DNA, 20 bp, Artificial
  CRISPR gRNA sequence
ggttgcttccaagttttgac

SEQ ID NO: 554529 - DNA, 20 bp, Artificial
  CRISPR gRNA sequence
gttgcttccaagttttgaca

SEQ ID NO: 554530 - DNA, 20 bp, Artificial
  CRISPR gRNA sequence
cttccaagttttgacaatta

SEQ ID NO: 554531 - DNA, 20 bp, Artificial
  CRISPR gRNA sequence
ccaagttttgacaattatta

SEQ ID NO: 554532 - DNA, 20 bp, Artificial
  CRISPR gRNA sequence
caagttttgacaattattaa

SEQ ID NO: 554533 - DNA, 20 bp, Artificial
  CRISPR gRNA sequence
tgacaattattaataaagat

SEQ ID NO: 554534 - DNA, 20 bp, Artificial
  CRISPR gRNA sequence
gacaattattaataaagatg

SEQ ID NO: 554535 - DNA, 20 bp, Artificial
  CRISPR gRNA sequence
acaattattaataaagatgc

SEQ ID NO: 554536 - DNA, 20 bp, Artificial
  CRISPR gRNA sequence
ttaataaagatgctataacc

SEQ ID NO: 554537 - DNA, 20 bp, Artificial
  CRISPR gRNA sequence
ataaagatgctataaccatc

SEQ ID NO: 554538 - DNA, 20 bp, Artificial
  CRISPR gRNA sequence
taaccatccatgtgaaggtt

SEQ ID NO: 554539 - DNA, 20 bp, Artificial
  CRISPR gRNA sequence
ttatgtcaacataagttttt

SEQ ID NO: 554540 - DNA, 20 bp, Artificial
  CRISPR gRNA sequence
tatgtcaacataagttttta

SEQ ID NO: 554541 - DNA, 20 bp, Artificial
  CRISPR gRNA sequence
atgtcaacataagtttttaa

SEQ ID NO: 554542 - DNA, 20 bp, Artificial
  CRISPR gRNA sequence
tgtcaacataagtttttaat

SEQ ID NO: 554543 - DNA, 20 bp, Artificial
  CRISPR gRNA sequence
ttaatgccttcgggtaaata

SEQ ID NO: 554544 - DNA, 20 bp, Artificial
  CRISPR gRNA sequence
taatgccttcgggtaaatag

SEQ ID NO: 554545 - DNA, 20 bp, Artificial
  CRISPR gRNA sequence
aatgccttcgggtaaatagc

SEQ ID NO: 554546 - DNA, 20 bp, Artificial
  CRISPR gRNA sequence
atgccttcgggtaaatagca

SEQ ID NO: 554547 - DNA, 20 bp, Artificial
  CRISPR gRNA sequence
cgggtaaatagcaagaagca

SEQ ID NO: 554548 - DNA, 20 bp, Artificial
  CRISPR gRNA sequence
gggtaaatagcaagaagcat

SEQ ID NO: 554549 - DNA, 20 bp, Artificial
  CRISPR gRNA sequence
tgttgaatggtaagagtaca

SEQ ID NO: 554550 - DNA, 20 bp, Artificial
  CRISPR gRNA sequence
aatggtaagagtacatacag

SEQ ID NO: 554551 - DNA, 20 bp, Artificial
  CRISPR gRNA sequence
tgtaagaaactgccaaactg

SEQ ID NO: 554552 - DNA, 20 bp, Artificial
  CRISPR gRNA sequence
gtaagaaactgccaaactgt

SEQ ID NO: 554553 - DNA, 20 bp, Artificial
  CRISPR gRNA sequence
taagaaactgccaaactgtc

SEQ ID NO: 554554 - DNA, 20 bp, Artificial
  CRISPR gRNA sequence
ccaaactgtcttccaaagtg

SEQ ID NO: 554555 - DNA, 20 bp, Artificial
  CRISPR gRNA sequence
tcttccaaagtggctgtacc

SEQ ID NO: 554556 - DNA, 20 bp, Artificial
  CRISPR gRNA sequence
ccaaagtggctgtaccattt

SEQ ID NO: 554557 - DNA, 20 bp, Artificial
  CRISPR gRNA sequence
caaagtggctgtaccatttt

SEQ ID NO: 554558 - DNA, 20 bp, Artificial
  CRISPR gRNA sequence
taccattttgcattcccacc

SEQ ID NO: 554559 - DNA, 20 bp, Artificial
  CRISPR gRNA sequence
tgcattcccacctgcaatga

SEQ ID NO: 554560 - DNA, 20 bp, Artificial
  CRISPR gRNA sequence
gcattcccacctgcaatgaa

SEQ ID NO: 554561 - DNA, 20 bp, Artificial
  CRISPR gRNA sequence
cattcccacctgcaatgaat

SEQ ID NO: 554562 - DNA, 20 bp, Artificial
  CRISPR gRNA sequence
ccacctgcaatgaatgagag

SEQ ID NO: 554563 - DNA, 20 bp, Artificial
  CRISPR gRNA sequence
caatgaatgagagttgctcc

SEQ ID NO: 554564 - DNA, 20 bp, Artificial
  CRISPR gRNA sequence
ctccacatcctcactggcat

SEQ ID NO: 554565 - DNA, 20 bp, Artificial
  CRISPR gRNA sequence
cacatcctcactggcatttg

SEQ ID NO: 554566 - DNA, 20 bp, Artificial
  CRISPR gRNA sequence
actggcatttggtgctgtca

SEQ ID NO: 554567 - DNA, 20 bp, Artificial
  CRISPR gRNA sequence
gcatttggtgctgtcagtgt

SEQ ID NO: 554568 - DNA, 20 bp, Artificial
  CRISPR gRNA sequence
ggtgctgtcagtgttctaga

SEQ ID NO: 554569 - DNA, 20 bp, Artificial
  CRISPR gRNA sequence
gtgctgtcagtgttctagat

SEQ ID NO: 554570 - DNA, 20 bp, Artificial
  CRISPR gRNA sequence
tcagtgttctagattttggc

SEQ ID NO: 554571 - DNA, 20 bp, Artificial
  CRISPR gRNA sequence
tagattttggccagtgtgat

SEQ ID NO: 554572 - DNA, 20 bp, Artificial
  CRISPR gRNA sequence
gattttggccagtgtgatag

SEQ ID NO: 554573 - DNA, 20 bp, Artificial
  CRISPR gRNA sequence
tggccagtgtgataggcgtg

SEQ ID NO: 554574 - DNA, 20 bp, Artificial
  CRISPR gRNA sequence
ggccagtgtgataggcgtga

SEQ ID NO: 554575 - DNA, 20 bp, Artificial
  CRISPR gRNA sequence
gccagtgtgataggcgtgaa

SEQ ID NO: 554576 - DNA, 20 bp, Artificial
  CRISPR gRNA sequence
cattgttgtcttagtttcca

SEQ ID NO: 554577 - DNA, 20 bp, Artificial
  CRISPR gRNA sequence
attgttgtcttagtttccat

SEQ ID NO: 554578 - DNA, 20 bp, Artificial
  CRISPR gRNA sequence
ttgtcttagtttccatttcc

SEQ ID NO: 554579 - DNA, 20 bp, Artificial
  CRISPR gRNA sequence
tcttagtttccatttccctg

SEQ ID NO: 554580 - DNA, 20 bp, Artificial
  CRISPR gRNA sequence
agtttccatttccctgttgc

SEQ ID NO: 554581 - DNA, 20 bp, Artificial
  CRISPR gRNA sequence
gtttccatttccctgttgcc

SEQ ID NO: 554582 - DNA, 20 bp, Artificial
  CRISPR gRNA sequence
ccatttccctgttgcctgtt

SEQ ID NO: 554583 - DNA, 20 bp, Artificial
  CRISPR gRNA sequence
catttccctgttgcctgttg

SEQ ID NO: 554584 - DNA, 20 bp, Artificial
  CRISPR gRNA sequence
ccctgttgcctgttgacata

SEQ ID NO: 554585 - DNA, 20 bp, Artificial
  CRISPR gRNA sequence
cctgttgcctgttgacatag

SEQ ID NO: 554586 - DNA, 20 bp, Artificial
  CRISPR gRNA sequence
ttgcctgttgacataggaca

SEQ ID NO: 554587 - DNA, 20 bp, Artificial
  CRISPR gRNA sequence
cctgttgacataggacatgc

SEQ ID NO: 554588 - DNA, 20 bp, Artificial
  CRISPR gRNA sequence
ttgacataggacatgcctag

SEQ ID NO: 554589 - DNA, 20 bp, Artificial
  CRISPR gRNA sequence
acataggacatgcctagcta

SEQ ID NO: 554590 - DNA, 20 bp, Artificial
  CRISPR gRNA sequence
gctaatttttgtatttttac

SEQ ID NO: 554591 - DNA, 20 bp, Artificial
  CRISPR gRNA sequence
atttttgtatttttacaaaa

SEQ ID NO: 554592 - DNA, 20 bp, Artificial
  CRISPR gRNA sequence
ttgtatttttacaaaataga

SEQ ID NO: 554593 - DNA, 20 bp, Artificial
  CRISPR gRNA sequence
tgtatttttacaaaatagaa

SEQ ID NO: 554594 - DNA, 20 bp, Artificial
  CRISPR gRNA sequence
gtatttttacaaaatagaaa

SEQ ID NO: 554595 - DNA, 20 bp, Artificial
  CRISPR gRNA sequence
tatttttacaaaatagaaaa

SEQ ID NO: 554596 - DNA, 20 bp, Artificial
  CRISPR gRNA sequence
ttacaaaatagaaaatagta

SEQ ID NO: 554597 - DNA, 20 bp, Artificial
  CRISPR gRNA sequence
tacaaaatagaaaatagtag

SEQ ID NO: 554598 - DNA, 20 bp, Artificial
  CRISPR gRNA sequence
acaaaatagaaaatagtaga

SEQ ID NO: 554599 - DNA, 20 bp, Artificial
  CRISPR gRNA sequence
caaaatagaaaatagtagaa

SEQ ID NO: 554600 - DNA, 20 bp, Artificial
  CRISPR gRNA sequence
ccccatgttggccaggctgg

SEQ ID NO: 554601 - DNA, 20 bp, Artificial
  CRISPR gRNA sequence
cccatgttggccaggctggt

SEQ ID NO: 554602 - DNA, 20 bp, Artificial
  CRISPR gRNA sequence
gccaggctggtcttgaactc

SEQ ID NO: 554603 - DNA, 20 bp, Artificial
  CRISPR gRNA sequence
gtcttgaactcctgacctca

SEQ ID NO: 554604 - DNA, 20 bp, Artificial
  CRISPR gRNA sequence
gaactcctgacctcaggtga

SEQ ID NO: 554605 - DNA, 20 bp, Artificial
  CRISPR gRNA sequence
aactcctgacctcaggtgat

SEQ ID NO: 554606 - DNA, 20 bp, Artificial
  CRISPR gRNA sequence
ctgacctcaggtgatccgcc

SEQ ID NO: 554607 - DNA, 20 bp, Artificial
  CRISPR gRNA sequence
acctcaggtgatccgcctgc

SEQ ID NO: 554608 - DNA, 20 bp, Artificial
  CRISPR gRNA sequence
aggtgatccgcctgcctcgg

SEQ ID NO: 554609 - DNA, 20 bp, Artificial
  CRISPR gRNA sequence
cctcggcctcccaaagtgct

SEQ ID NO: 554610 - DNA, 20 bp, Artificial
  CRISPR gRNA sequence
ggcctcccaaagtgctggga

SEQ ID NO: 554611 - DNA, 20 bp, Artificial
  CRISPR gRNA sequence
ccaaagtgctgggattacag

SEQ ID NO: 554612 - DNA, 20 bp, Artificial
  CRISPR gRNA sequence
ggattacaggtgtgagccac

SEQ ID NO: 554613 - DNA, 20 bp, Artificial
  CRISPR gRNA sequence
caggtgtgagccaccgcacc

SEQ ID NO: 554614 - DNA, 20 bp, Artificial
  CRISPR gRNA sequence
tttatatccctatttgccat

SEQ ID NO: 554615 - DNA, 20 bp, Artificial
  CRISPR gRNA sequence
ttatatccctatttgccatc

SEQ ID NO: 554616 - DNA, 20 bp, Artificial
  CRISPR gRNA sequence
tatatccctatttgccatct

SEQ ID NO: 554617 - DNA, 20 bp, Artificial
  CRISPR gRNA sequence
atatccctatttgccatctg

SEQ ID NO: 554618 - DNA, 20 bp, Artificial
  CRISPR gRNA sequence
tatccctatttgccatctgt

SEQ ID NO: 554619 - DNA, 20 bp, Artificial
  CRISPR gRNA sequence
tttgccatctgtataccttc

SEQ ID NO: 554620 - DNA, 20 bp, Artificial
  CRISPR gRNA sequence
gccatctgtataccttcctt

SEQ ID NO: 554621 - DNA, 20 bp, Artificial
  CRISPR gRNA sequence
ccatctgtataccttccttg

SEQ ID NO: 554622 - DNA, 20 bp, Artificial
  CRISPR gRNA sequence
tataccttccttggagaagt

SEQ ID NO: 554623 - DNA, 20 bp, Artificial
  CRISPR gRNA sequence
ccttggagaagtgtgtgatg

SEQ ID NO: 554624 - DNA, 20 bp, Artificial
  CRISPR gRNA sequence
cttggagaagtgtgtgatga

SEQ ID NO: 554625 - DNA, 20 bp, Artificial
  CRISPR gRNA sequence
ggagaagtgtgtgatgagat

SEQ ID NO: 554626 - DNA, 20 bp, Artificial
  CRISPR gRNA sequence
gagaagtgtgtgatgagatc

SEQ ID NO: 554627 - DNA, 20 bp, Artificial
  CRISPR gRNA sequence
tgactcattttttaattggg

SEQ ID NO: 554628 - DNA, 20 bp, Artificial
  CRISPR gRNA sequence
gactcattttttaattgggt

SEQ ID NO: 554629 - DNA, 20 bp, Artificial
  CRISPR gRNA sequence
actcattttttaattgggtt

SEQ ID NO: 554630 - DNA, 20 bp, Artificial
  CRISPR gRNA sequence
attttttaattgggttgttt

SEQ ID NO: 554631 - DNA, 20 bp, Artificial
  CRISPR gRNA sequence
tttaattgggttgtttgtgt

SEQ ID NO: 554632 - DNA, 20 bp, Artificial
  CRISPR gRNA sequence
ttaattgggttgtttgtgtt

SEQ ID NO: 554633 - DNA, 20 bp, Artificial
  CRISPR gRNA sequence
taattgggttgtttgtgttt

SEQ ID NO: 554634 - DNA, 20 bp, Artificial
  CRISPR gRNA sequence
aattgggttgtttgtgtttt

SEQ ID NO: 554635 - DNA, 20 bp, Artificial
  CRISPR gRNA sequence
attgggttgtttgtgttttt

SEQ ID NO: 554636 - DNA, 20 bp, Artificial
  CRISPR gRNA sequence
ggttgtttgtgtttttcttg

SEQ ID NO: 554637 - DNA, 20 bp, Artificial
  CRISPR gRNA sequence
tttgtgtttttcttgttgag

SEQ ID NO: 554638 - DNA, 20 bp, Artificial
  CRISPR gRNA sequence
gtgtttttcttgttgagttt

SEQ ID NO: 554639 - DNA, 20 bp, Artificial
  CRISPR gRNA sequence
tgtttttcttgttgagtttt

SEQ ID NO: 554640 - DNA, 20 bp, Artificial
  CRISPR gRNA sequence
ttcttgttgagttttaaaag

SEQ ID NO: 554641 - DNA, 20 bp, Artificial
  CRISPR gRNA sequence
tcttgttgagttttaaaagt

SEQ ID NO: 554642 - DNA, 20 bp, Artificial
  CRISPR gRNA sequence
cttgttgagttttaaaagtt

SEQ ID NO: 554643 - DNA, 20 bp, Artificial
  CRISPR gRNA sequence
ttgttgagttttaaaagttt

SEQ ID NO: 554644 - DNA, 20 bp, Artificial
  CRISPR gRNA sequence
gttgagttttaaaagttttt

SEQ ID NO: 554645 - DNA, 20 bp, Artificial
  CRISPR gRNA sequence
ttgagttttaaaagtttttt

SEQ ID NO: 554646 - DNA, 20 bp, Artificial
  CRISPR gRNA sequence
agttttaaaagttttttgta

SEQ ID NO: 554647 - DNA, 20 bp, Artificial
  CRISPR gRNA sequence
taaaagttttttgtatattt

SEQ ID NO: 554648 - DNA, 20 bp, Artificial
  CRISPR gRNA sequence
aaaagttttttgtatatttt

SEQ ID NO: 554649 - DNA, 20 bp, Artificial
  CRISPR gRNA sequence
aaagttttttgtatattttg

SEQ ID NO: 554650 - DNA, 20 bp, Artificial
  CRISPR gRNA sequence
tttgtatattttggataaca

SEQ ID NO: 554651 - DNA, 20 bp, Artificial
  CRISPR gRNA sequence
ttgtatattttggataacag

SEQ ID NO: 554652 - DNA, 20 bp, Artificial
  CRISPR gRNA sequence
tgtatattttggataacagt

SEQ ID NO: 554653 - DNA, 20 bp, Artificial
  CRISPR gRNA sequence
gtatattttggataacagtc

SEQ ID NO: 554654 - DNA, 20 bp, Artificial
  CRISPR gRNA sequence
tatattttggataacagtct

SEQ ID NO: 554655 - DNA, 20 bp, Artificial
  CRISPR gRNA sequence
tggataacagtcttttatca

SEQ ID NO: 554656 - DNA, 20 bp, Artificial
  CRISPR gRNA sequence
ggataacagtcttttatcag

SEQ ID NO: 554657 - DNA, 20 bp, Artificial
  CRISPR gRNA sequence
gataacagtcttttatcaga

SEQ ID NO: 554658 - DNA, 20 bp, Artificial
  CRISPR gRNA sequence
ttatcagatgtgtcttttgc

SEQ ID NO: 554659 - DNA, 20 bp, Artificial
  CRISPR gRNA sequence
tatcagatgtgtcttttgca

SEQ ID NO: 554660 - DNA, 20 bp, Artificial
  CRISPR gRNA sequence
atcagatgtgtcttttgcaa

SEQ ID NO: 554661 - DNA, 20 bp, Artificial
  CRISPR gRNA sequence
tcagatgtgtcttttgcaaa

SEQ ID NO: 554662 - DNA, 20 bp, Artificial
  CRISPR gRNA sequence
ttgcaaatattttctcccag

SEQ ID NO: 554663 - DNA, 20 bp, Artificial
  CRISPR gRNA sequence
tgcaaatattttctcccagt

SEQ ID NO: 554664 - DNA, 20 bp, Artificial
  CRISPR gRNA sequence
gcaaatattttctcccagtc

SEQ ID NO: 554665 - DNA, 20 bp, Artificial
  CRISPR gRNA sequence
caaatattttctcccagtct

SEQ ID NO: 554666 - DNA, 20 bp, Artificial
  CRISPR gRNA sequence
tctcccagtctgtggcttgg

SEQ ID NO: 554667 - DNA, 20 bp, Artificial
  CRISPR gRNA sequence
ctcccagtctgtggcttggc

SEQ ID NO: 554668 - DNA, 20 bp, Artificial
  CRISPR gRNA sequence
tcccagtctgtggcttggct

SEQ ID NO: 554669 - DNA, 20 bp, Artificial
  CRISPR gRNA sequence
ccagtctgtggcttggcttc

SEQ ID NO: 554670 - DNA, 20 bp, Artificial
  CRISPR gRNA sequence
tggcttggcttctcattctc

SEQ ID NO: 554671 - DNA, 20 bp, Artificial
  CRISPR gRNA sequence
ggcttctcattctcttgaaa

SEQ ID NO: 554672 - DNA, 20 bp, Artificial
  CRISPR gRNA sequence
gcttctcattctcttgaaat

SEQ ID NO: 554673 - DNA, 20 bp, Artificial
  CRISPR gRNA sequence
ctcattctcttgaaattgtc

SEQ ID NO: 554674 - DNA, 20 bp, Artificial
  CRISPR gRNA sequence
tcattctcttgaaattgtct

SEQ ID NO: 554675 - DNA, 20 bp, Artificial
  CRISPR gRNA sequence
attctcttgaaattgtcttt

SEQ ID NO: 554676 - DNA, 20 bp, Artificial
  CRISPR gRNA sequence
tcttgaaattgtctttcata

SEQ ID NO: 554677 - DNA, 20 bp, Artificial
  CRISPR gRNA sequence
ttgaaattgtctttcataga

SEQ ID NO: 554678 - DNA, 20 bp, Artificial
  CRISPR gRNA sequence
gaaattgtctttcatagagc

SEQ ID NO: 554679 - DNA, 20 bp, Artificial
  CRISPR gRNA sequence
aaattgtctttcatagagca

SEQ ID NO: 554680 - DNA, 20 bp, Artificial
  CRISPR gRNA sequence
tctttcatagagcaatgttt

SEQ ID NO: 554681 - DNA, 20 bp, Artificial
  CRISPR gRNA sequence
tcatagagcaatgtttttaa

SEQ ID NO: 554682 - DNA, 20 bp, Artificial
  CRISPR gRNA sequence
catagagcaatgtttttaat

SEQ ID NO: 554683 - DNA, 20 bp, Artificial
  CRISPR gRNA sequence
atagagcaatgtttttaatt

SEQ ID NO: 554684 - DNA, 20 bp, Artificial
  CRISPR gRNA sequence
ttaattttaatgaagtacag

SEQ ID NO: 554685 - DNA, 20 bp, Artificial
  CRISPR gRNA sequence
taattttaatgaagtacagc

SEQ ID NO: 554686 - DNA, 20 bp, Artificial
  CRISPR gRNA sequence
aattttaatgaagtacagct

SEQ ID NO: 554687 - DNA, 20 bp, Artificial
  CRISPR gRNA sequence
attttaatgaagtacagctt

SEQ ID NO: 554688 - DNA, 20 bp, Artificial
  CRISPR gRNA sequence
taatgaagtacagcttacca

SEQ ID NO: 554689 - DNA, 20 bp, Artificial
  CRISPR gRNA sequence
aatgaagtacagcttaccaa

SEQ ID NO: 554690 - DNA, 20 bp, Artificial
  CRISPR gRNA sequence
atgaagtacagcttaccaat

SEQ ID NO: 554691 - DNA, 20 bp, Artificial
  CRISPR gRNA sequence
accaattctttctttcatga

SEQ ID NO: 554692 - DNA, 20 bp, Artificial
  CRISPR gRNA sequence
ccaattctttctttcatgaa

SEQ ID NO: 554693 - DNA, 20 bp, Artificial
  CRISPR gRNA sequence
tttctttcatgaatcatgtc

SEQ ID NO: 554694 - DNA, 20 bp, Artificial
  CRISPR gRNA sequence
tctttcatgaatcatgtctt

SEQ ID NO: 554695 - DNA, 20 bp, Artificial
  CRISPR gRNA sequence
ctttcatgaatcatgtcttt

SEQ ID NO: 554696 - DNA, 20 bp, Artificial
  CRISPR gRNA sequence
tttcatgaatcatgtctttg

SEQ ID NO: 554697 - DNA, 20 bp, Artificial
  CRISPR gRNA sequence
tcatgaatcatgtctttggt

SEQ ID NO: 554698 - DNA, 20 bp, Artificial
  CRISPR gRNA sequence
catgaatcatgtctttggtg

SEQ ID NO: 554699 - DNA, 20 bp, Artificial
  CRISPR gRNA sequence
atgaatcatgtctttggtgt

SEQ ID NO: 554700 - DNA, 20 bp, Artificial
  CRISPR gRNA sequence
tggtgttgtatctaaaaagt

SEQ ID NO: 554701 - DNA, 20 bp, Artificial
  CRISPR gRNA sequence
ggtgttgtatctaaaaagtc

SEQ ID NO: 554702 - DNA, 20 bp, Artificial
  CRISPR gRNA sequence
gtgttgtatctaaaaagtca

SEQ ID NO: 554703 - DNA, 20 bp, Artificial
  CRISPR gRNA sequence
tatctaaaaagtcatcatat

SEQ ID NO: 554704 - DNA, 20 bp, Artificial
  CRISPR gRNA sequence
aaaagtcatcatatccaaag

SEQ ID NO: 554705 - DNA, 20 bp, Artificial
  CRISPR gRNA sequence
tctaggttttctcttatgtt

SEQ ID NO: 554706 - DNA, 20 bp, Artificial
  CRISPR gRNA sequence
ggttttctcttatgttttag

SEQ ID NO: 554707 - DNA, 20 bp, Artificial
  CRISPR gRNA sequence
tctcttatgttttaggagtc

SEQ ID NO: 554708 - DNA, 20 bp, Artificial
  CRISPR gRNA sequence
ctcttatgttttaggagtct

SEQ ID NO: 554709 - DNA, 20 bp, Artificial
  CRISPR gRNA sequence
tcttatgttttaggagtctt

SEQ ID NO: 554710 - DNA, 20 bp, Artificial
  CRISPR gRNA sequence
ttatgttttaggagtcttat

SEQ ID NO: 554711 - DNA, 20 bp, Artificial
  CRISPR gRNA sequence
atgttttaggagtcttatgg

SEQ ID NO: 554712 - DNA, 20 bp, Artificial
  CRISPR gRNA sequence
tgttttaggagtcttatggt

SEQ ID NO: 554713 - DNA, 20 bp, Artificial
  CRISPR gRNA sequence
taggagtcttatggttttgc

SEQ ID NO: 554714 - DNA, 20 bp, Artificial
  CRISPR gRNA sequence
aggagtcttatggttttgca

SEQ ID NO: 554715 - DNA, 20 bp, Artificial
  CRISPR gRNA sequence
ggagtcttatggttttgcat

SEQ ID NO: 554716 - DNA, 20 bp, Artificial
  CRISPR gRNA sequence
atggttttgcattttacatt

SEQ ID NO: 554717 - DNA, 20 bp, Artificial
  CRISPR gRNA sequence
tggttttgcattttacattt

SEQ ID NO: 554718 - DNA, 20 bp, Artificial
  CRISPR gRNA sequence
tgcattttacatttagatct

SEQ ID NO: 554719 - DNA, 20 bp, Artificial
  CRISPR gRNA sequence
gcattttacatttagatcta

SEQ ID NO: 554720 - DNA, 20 bp, Artificial
  CRISPR gRNA sequence
cattttacatttagatctat

SEQ ID NO: 554721 - DNA, 20 bp, Artificial
  CRISPR gRNA sequence
tacatttagatctatggtcc

SEQ ID NO: 554722 - DNA, 20 bp, Artificial
  CRISPR gRNA sequence
acatttagatctatggtcca

SEQ ID NO: 554723 - DNA, 20 bp, Artificial
  CRISPR gRNA sequence
catttagatctatggtccat

SEQ ID NO: 554724 - DNA, 20 bp, Artificial
  CRISPR gRNA sequence
agatctatggtccattttga

SEQ ID NO: 554725 - DNA, 20 bp, Artificial
  CRISPR gRNA sequence
gatctatggtccattttgag

SEQ ID NO: 554726 - DNA, 20 bp, Artificial
  CRISPR gRNA sequence
tggtccattttgagtaaaat

SEQ ID NO: 554727 - DNA, 20 bp, Artificial
  CRISPR gRNA sequence
tgagtaaaattttgtgaagg

SEQ ID NO: 554728 - DNA, 20 bp, Artificial
  CRISPR gRNA sequence
gagtaaaattttgtgaaggg

SEQ ID NO: 554729 - DNA, 20 bp, Artificial
  CRISPR gRNA sequence
agtaaaattttgtgaagggc

SEQ ID NO: 554730 - DNA, 20 bp, Artificial
  CRISPR gRNA sequence
tgtgaagggcataaggtctg

SEQ ID NO: 554731 - DNA, 20 bp, Artificial
  CRISPR gRNA sequence
gtgaagggcataaggtctgt

SEQ ID NO: 554732 - DNA, 20 bp, Artificial
  CRISPR gRNA sequence
tgaagggcataaggtctgtg

SEQ ID NO: 554733 - DNA, 20 bp, Artificial
  CRISPR gRNA sequence
tgtttagattcatttttttg

SEQ ID NO: 554734 - DNA, 20 bp, Artificial
  CRISPR gRNA sequence
agattcatttttttgcatgt

SEQ ID NO: 554735 - DNA, 20 bp, Artificial
  CRISPR gRNA sequence
gattcatttttttgcatgtg

SEQ ID NO: 554736 - DNA, 20 bp, Artificial
  CRISPR gRNA sequence
atttttttgcatgtggatgt

SEQ ID NO: 554737 - DNA, 20 bp, Artificial
  CRISPR gRNA sequence
ttttgcatgtggatgtccag

SEQ ID NO: 554738 - DNA, 20 bp, Artificial
  CRISPR gRNA sequence
tttgcatgtggatgtccagt

SEQ ID NO: 554739 - DNA, 20 bp, Artificial
  CRISPR gRNA sequence
ttgcatgtggatgtccagtt

SEQ ID NO: 554740 - DNA, 20 bp, Artificial
  CRISPR gRNA sequence
tgcatgtggatgtccagttg

SEQ ID NO: 554741 - DNA, 20 bp, Artificial
  CRISPR gRNA sequence
gcatgtggatgtccagttgt

SEQ ID NO: 554742 - DNA, 20 bp, Artificial
  CRISPR gRNA sequence
catgtggatgtccagttgtt

SEQ ID NO: 554743 - DNA, 20 bp, Artificial
  CRISPR gRNA sequence
ttacagcactatttgttgaa

SEQ ID NO: 554744 - DNA, 20 bp, Artificial
  CRISPR gRNA sequence
cagcactatttgttgaaaag

SEQ ID NO: 554745 - DNA, 20 bp, Artificial
  CRISPR gRNA sequence
tttgttgaaaagatcatctt

SEQ ID NO: 554746 - DNA, 20 bp, Artificial
  CRISPR gRNA sequence
gttgaaaagatcatctttgc

SEQ ID NO: 554747 - DNA, 20 bp, Artificial
  CRISPR gRNA sequence
ttgaaaagatcatctttgct

SEQ ID NO: 554748 - DNA, 20 bp, Artificial
  CRISPR gRNA sequence
aaaagatcatctttgctcca

SEQ ID NO: 554749 - DNA, 20 bp, Artificial
  CRISPR gRNA sequence
tgctccattgtattgccttt

SEQ ID NO: 554750 - DNA, 20 bp, Artificial
  CRISPR gRNA sequence
gctccattgtattgcctttg

SEQ ID NO: 554751 - DNA, 20 bp, Artificial
  CRISPR gRNA sequence
ctccattgtattgcctttgc

SEQ ID NO: 554752 - DNA, 20 bp, Artificial
  CRISPR gRNA sequence
cattgtattgcctttgctcc

SEQ ID NO: 554753 - DNA, 20 bp, Artificial
  CRISPR gRNA sequence
tattgcctttgctcctttgt

SEQ ID NO: 554754 - DNA, 20 bp, Artificial
  CRISPR gRNA sequence
cctttgctcctttgtcaaag

SEQ ID NO: 554755 - DNA, 20 bp, Artificial
  CRISPR gRNA sequence
tgctcctttgtcaaagatca

SEQ ID NO: 554756 - DNA, 20 bp, Artificial
  CRISPR gRNA sequence
gctcctttgtcaaagatcag

SEQ ID NO: 554757 - DNA, 20 bp, Artificial
  CRISPR gRNA sequence
ctcctttgtcaaagatcagt

SEQ ID NO: 554758 - DNA, 20 bp, Artificial
  CRISPR gRNA sequence
ctttgtcaaagatcagttga

SEQ ID NO: 554759 - DNA, 20 bp, Artificial
  CRISPR gRNA sequence
tgtcaaagatcagttgacca

SEQ ID NO: 554760 - DNA, 20 bp, Artificial
  CRISPR gRNA sequence
gtcaaagatcagttgaccat

SEQ ID NO: 554761 - DNA, 20 bp, Artificial
  CRISPR gRNA sequence
tcaaagatcagttgaccata

SEQ ID NO: 554762 - DNA, 20 bp, Artificial
  CRISPR gRNA sequence
accatatttatgttggttta

SEQ ID NO: 554763 - DNA, 20 bp, Artificial
  CRISPR gRNA sequence
atgttggtttatttctgggc

SEQ ID NO: 554764 - DNA, 20 bp, Artificial
  CRISPR gRNA sequence
tgttggtttatttctgggct

SEQ ID NO: 554765 - DNA, 20 bp, Artificial
  CRISPR gRNA sequence
gtttatttctgggctctcta

SEQ ID NO: 554766 - DNA, 20 bp, Artificial
  CRISPR gRNA sequence
atttctgggctctctattcc

SEQ ID NO: 554767 - DNA, 20 bp, Artificial
  CRISPR gRNA sequence
tttctgggctctctattccg

SEQ ID NO: 554768 - DNA, 20 bp, Artificial
  CRISPR gRNA sequence
ctgggctctctattccgatt

SEQ ID NO: 554769 - DNA, 20 bp, Artificial
  CRISPR gRNA sequence
tgggctctctattccgattc

SEQ ID NO: 554770 - DNA, 20 bp, Artificial
  CRISPR gRNA sequence
ggctctctattccgattcac

SEQ ID NO: 554771 - DNA, 20 bp, Artificial
  CRISPR gRNA sequence
tctattccgattcactgatc

SEQ ID NO: 554772 - DNA, 20 bp, Artificial
  CRISPR gRNA sequence
tattccgattcactgatcta

SEQ ID NO: 554773 - DNA, 20 bp, Artificial
  CRISPR gRNA sequence
ttccgattcactgatctatt

SEQ ID NO: 554774 - DNA, 20 bp, Artificial
  CRISPR gRNA sequence
cgattcactgatctatttgt

SEQ ID NO: 554775 - DNA, 20 bp, Artificial
  CRISPR gRNA sequence
actgatctatttgtctttta

SEQ ID NO: 554776 - DNA, 20 bp, Artificial
  CRISPR gRNA sequence
atctatttgtcttttatttt

SEQ ID NO: 554777 - DNA, 20 bp, Artificial
  CRISPR gRNA sequence
tttgtcttttatttttccac

SEQ ID NO: 554778 - DNA, 20 bp, Artificial
  CRISPR gRNA sequence
gtcttttatttttccaccag

SEQ ID NO: 554779 - DNA, 20 bp, Artificial
  CRISPR gRNA sequence
tcttttatttttccaccagt

SEQ ID NO: 554780 - DNA, 20 bp, Artificial
  CRISPR gRNA sequence
ttatttttccaccagtacca

SEQ ID NO: 554781 - DNA, 20 bp, Artificial
  CRISPR gRNA sequence
tatttttccaccagtaccac

SEQ ID NO: 554782 - DNA, 20 bp, Artificial
  CRISPR gRNA sequence
atttttccaccagtaccaca

SEQ ID NO: 554783 - DNA, 20 bp, Artificial
  CRISPR gRNA sequence
tttttccaccagtaccacac

SEQ ID NO: 554784 - DNA, 20 bp, Artificial
  CRISPR gRNA sequence
ttccaccagtaccacactat

SEQ ID NO: 554785 - DNA, 20 bp, Artificial
  CRISPR gRNA sequence
tccaccagtaccacactatg

SEQ ID NO: 554786 - DNA, 20 bp, Artificial
  CRISPR gRNA sequence
ccaccagtaccacactatgt

SEQ ID NO: 554787 - DNA, 20 bp, Artificial
  CRISPR gRNA sequence
caccagtaccacactatgtt

SEQ ID NO: 554788 - DNA, 20 bp, Artificial
  CRISPR gRNA sequence
tgttgactactgtagcttta

SEQ ID NO: 554789 - DNA, 20 bp, Artificial
  CRISPR gRNA sequence
actactgtagctttatagta

SEQ ID NO: 554790 - DNA, 20 bp, Artificial
  CRISPR gRNA sequence
ctgtagctttatagtaagtc

SEQ ID NO: 554791 - DNA, 20 bp, Artificial
  CRISPR gRNA sequence
tagctttatagtaagtcttg

SEQ ID NO: 554792 - DNA, 20 bp, Artificial
  CRISPR gRNA sequence
tatagtaagtcttgaagttg

SEQ ID NO: 554793 - DNA, 20 bp, Artificial
  CRISPR gRNA sequence
atagtaagtcttgaagttga

SEQ ID NO: 554794 - DNA, 20 bp, Artificial
  CRISPR gRNA sequence
tagtaagtcttgaagttgag

SEQ ID NO: 554795 - DNA, 20 bp, Artificial
  CRISPR gRNA sequence
gaagttgagtagtatcagtc

SEQ ID NO: 554796 - DNA, 20 bp, Artificial
  CRISPR gRNA sequence
aagttgagtagtatcagtcc

SEQ ID NO: 554797 - DNA, 20 bp, Artificial
  CRISPR gRNA sequence
agtagtatcagtcctacaat

SEQ ID NO: 554798 - DNA, 20 bp, Artificial
  CRISPR gRNA sequence
caattttgttctccttcaat

SEQ ID NO: 554799 - DNA, 20 bp, Artificial
  CRISPR gRNA sequence
tgttctccttcaatattttg

SEQ ID NO: 554800 - DNA, 20 bp, Artificial
  CRISPR gRNA sequence
gttctccttcaatattttgc

SEQ ID NO: 554801 - DNA, 20 bp, Artificial
  CRISPR gRNA sequence
ttctccttcaatattttgct

SEQ ID NO: 554802 - DNA, 20 bp, Artificial
  CRISPR gRNA sequence
tccttcaatattttgctggc

SEQ ID NO: 554803 - DNA, 20 bp, Artificial
  CRISPR gRNA sequence
cttcaatattttgctggcta

SEQ ID NO: 554804 - DNA, 20 bp, Artificial
  CRISPR gRNA sequence
caatattttgctggctattc

SEQ ID NO: 554805 - DNA, 20 bp, Artificial
  CRISPR gRNA sequence
aatattttgctggctattct

SEQ ID NO: 554806 - DNA, 20 bp, Artificial
  CRISPR gRNA sequence
tgctggctattctggtcttt

SEQ ID NO: 554807 - DNA, 20 bp, Artificial
  CRISPR gRNA sequence
gctggctattctggtctttt

SEQ ID NO: 554808 - DNA, 20 bp, Artificial
  CRISPR gRNA sequence
ctggctattctggtcttttg

SEQ ID NO: 554809 - DNA, 20 bp, Artificial
  CRISPR gRNA sequence
gctattctggtcttttgcct

SEQ ID NO: 554810 - DNA, 20 bp, Artificial
  CRISPR gRNA sequence
ttctggtcttttgcctgccc

SEQ ID NO: 554811 - DNA, 20 bp, Artificial
  CRISPR gRNA sequence
tggtcttttgcctgcccatt

SEQ ID NO: 554812 - DNA, 20 bp, Artificial
  CRISPR gRNA sequence
gtcttttgcctgcccattta

SEQ ID NO: 554813 - DNA, 20 bp, Artificial
  CRISPR gRNA sequence
ttgcctgcccatttaacctt

SEQ ID NO: 554814 - DNA, 20 bp, Artificial
  CRISPR gRNA sequence
tgcctgcccatttaacctta

SEQ ID NO: 554815 - DNA, 20 bp, Artificial
  CRISPR gRNA sequence
gcctgcccatttaaccttaa

SEQ ID NO: 554816 - DNA, 20 bp, Artificial
  CRISPR gRNA sequence
cctgcccatttaaccttaaa

SEQ ID NO: 554817 - DNA, 20 bp, Artificial
  CRISPR gRNA sequence
cccatttaaccttaaaatca

SEQ ID NO: 554818 - DNA, 20 bp, Artificial
  CRISPR gRNA sequence
aaccttaaaatcagtttgct

SEQ ID NO: 554819 - DNA, 20 bp, Artificial
  CRISPR gRNA sequence
accttaaaatcagtttgctg

SEQ ID NO: 554820 - DNA, 20 bp, Artificial
  CRISPR gRNA sequence
aaaatcagtttgctgatatc

SEQ ID NO: 554821 - DNA, 20 bp, Artificial
  CRISPR gRNA sequence
aaatcagtttgctgatatcc

SEQ ID NO: 554822 - DNA, 20 bp, Artificial
  CRISPR gRNA sequence
gctgatatccacaaatgact

SEQ ID NO: 554823 - DNA, 20 bp, Artificial
  CRISPR gRNA sequence
ctgatatccacaaatgactt

SEQ ID NO: 554824 - DNA, 20 bp, Artificial
  CRISPR gRNA sequence
atatccacaaatgacttctg

SEQ ID NO: 554825 - DNA, 20 bp, Artificial
  CRISPR gRNA sequence
ctgatattttgcttgggatt

SEQ ID NO: 554826 - DNA, 20 bp, Artificial
  CRISPR gRNA sequence
tgatattttgcttgggattg

SEQ ID NO: 554827 - DNA, 20 bp, Artificial
  CRISPR gRNA sequence
atattttgcttgggattgca

SEQ ID NO: 554828 - DNA, 20 bp, Artificial
  CRISPR gRNA sequence
tgcttgggattgcactgaat

SEQ ID NO: 554829 - DNA, 20 bp, Artificial
  CRISPR gRNA sequence
gcttgggattgcactgaatt

SEQ ID NO: 554830 - DNA, 20 bp, Artificial
  CRISPR gRNA sequence
cttgggattgcactgaattt

SEQ ID NO: 554831 - DNA, 20 bp, Artificial
  CRISPR gRNA sequence
gggattgcactgaatttata

SEQ ID NO: 554832 - DNA, 20 bp, Artificial
  CRISPR gRNA sequence
ggattgcactgaatttatag

SEQ ID NO: 554833 - DNA, 20 bp, Artificial
  CRISPR gRNA sequence
cactgaatttatagagtaaa

SEQ ID NO: 554834 - DNA, 20 bp, Artificial
  CRISPR gRNA sequence
aatttatagagtaaattgga

SEQ ID NO: 554835 - DNA, 20 bp, Artificial
  CRISPR gRNA sequence
atagagtaaattggaaataa

SEQ ID NO: 554836 - DNA, 20 bp, Artificial
  CRISPR gRNA sequence
tagagtaaattggaaataac

SEQ ID NO: 554837 - DNA, 20 bp, Artificial
  CRISPR gRNA sequence
gaaataactgacatcttcac

SEQ ID NO: 554838 - DNA, 20 bp, Artificial
  CRISPR gRNA sequence
acatcttcacaataaggagt

SEQ ID NO: 554839 - DNA, 20 bp, Artificial
  CRISPR gRNA sequence
cacaataaggagtcttccta

SEQ ID NO: 554840 - DNA, 20 bp, Artificial
  CRISPR gRNA sequence
acaataaggagtcttcctat

SEQ ID NO: 554841 - DNA, 20 bp, Artificial
  CRISPR gRNA sequence
cctatctatgaacatagaat

SEQ ID NO: 554842 - DNA, 20 bp, Artificial
  CRISPR gRNA sequence
ctatctatgaacatagaata

SEQ ID NO: 554843 - DNA, 20 bp, Artificial
  CRISPR gRNA sequence
tctatgaacatagaatatct

SEQ ID NO: 554844 - DNA, 20 bp, Artificial
  CRISPR gRNA sequence
tgaacatagaatatctctcc

SEQ ID NO: 554845 - DNA, 20 bp, Artificial
  CRISPR gRNA sequence
tccatttatttagttcttct

SEQ ID NO: 554846 - DNA, 20 bp, Artificial
  CRISPR gRNA sequence
catttatttagttcttcttt

SEQ ID NO: 554847 - DNA, 20 bp, Artificial
  CRISPR gRNA sequence
atttagttcttctttgattt

SEQ ID NO: 554848 - DNA, 20 bp, Artificial
  CRISPR gRNA sequence
tttagttcttctttgatttt

SEQ ID NO: 554849 - DNA, 20 bp, Artificial
  CRISPR gRNA sequence
agttcttctttgattttgtt

SEQ ID NO: 554850 - DNA, 20 bp, Artificial
  CRISPR gRNA sequence
gttcttctttgattttgttc

SEQ ID NO: 554851 - DNA, 20 bp, Artificial
  CRISPR gRNA sequence
ttctttgattttgttcatca

SEQ ID NO: 554852 - DNA, 20 bp, Artificial
  CRISPR gRNA sequence
ctttgattttgttcatcagt

SEQ ID NO: 554853 - DNA, 20 bp, Artificial
  CRISPR gRNA sequence
tttgattttgttcatcagtt

SEQ ID NO: 554854 - DNA, 20 bp, Artificial
  CRISPR gRNA sequence
tgattttgttcatcagtttt

SEQ ID NO: 554855 - DNA, 20 bp, Artificial
  CRISPR gRNA sequence
gattttgttcatcagttttg

SEQ ID NO: 554856 - DNA, 20 bp, Artificial
  CRISPR gRNA sequence
attttgttcatcagttttgt

SEQ ID NO: 554857 - DNA, 20 bp, Artificial
  CRISPR gRNA sequence
tgttcatcagttttgttgat

SEQ ID NO: 554858 - DNA, 20 bp, Artificial
  CRISPR gRNA sequence
gttcatcagttttgttgatt

SEQ ID NO: 554859 - DNA, 20 bp, Artificial
  CRISPR gRNA sequence
ttcatcagttttgttgattt

SEQ ID NO: 554860 - DNA, 20 bp, Artificial
  CRISPR gRNA sequence
atcagttttgttgattttct

SEQ ID NO: 554861 - DNA, 20 bp, Artificial
  CRISPR gRNA sequence
tgttgattttctcatataaa

SEQ ID NO: 554862 - DNA, 20 bp, Artificial
  CRISPR gRNA sequence
gttgattttctcatataaat

SEQ ID NO: 554863 - DNA, 20 bp, Artificial
  CRISPR gRNA sequence
ttgattttctcatataaatc

SEQ ID NO: 554864 - DNA, 20 bp, Artificial
  CRISPR gRNA sequence
attttctcatataaatctgg

SEQ ID NO: 554865 - DNA, 20 bp, Artificial
  CRISPR gRNA sequence
tctcatataaatctgggaca

SEQ ID NO: 554866 - DNA, 20 bp, Artificial
  CRISPR gRNA sequence
ctcatataaatctgggacat

SEQ ID NO: 554867 - DNA, 20 bp, Artificial
  CRISPR gRNA sequence
tcatataaatctgggacata

SEQ ID NO: 554868 - DNA, 20 bp, Artificial
  CRISPR gRNA sequence
atataaatctgggacatatt

SEQ ID NO: 554869 - DNA, 20 bp, Artificial
  CRISPR gRNA sequence
ggacatattttgttattgta

SEQ ID NO: 554870 - DNA, 20 bp, Artificial
  CRISPR gRNA sequence
tgttattgtacctaagtatt

SEQ ID NO: 554871 - DNA, 20 bp, Artificial
  CRISPR gRNA sequence
gttattgtacctaagtattg

SEQ ID NO: 554872 - DNA, 20 bp, Artificial
  CRISPR gRNA sequence
ttattgtacctaagtattgc

SEQ ID NO: 554873 - DNA, 20 bp, Artificial
  CRISPR gRNA sequence
ttgtacctaagtattgcatt

SEQ ID NO: 554874 - DNA, 20 bp, Artificial
  CRISPR gRNA sequence
tacctaagtattgcattttt

SEQ ID NO: 554875 - DNA, 20 bp, Artificial
  CRISPR gRNA sequence
agtattgcatttttggggtg

SEQ ID NO: 554876 - DNA, 20 bp, Artificial
  CRISPR gRNA sequence
catttttggggtgctaaggt

SEQ ID NO: 554877 - DNA, 20 bp, Artificial
  CRISPR gRNA sequence
ttggggtgctaaggtaaatg

SEQ ID NO: 554878 - DNA, 20 bp, Artificial
  CRISPR gRNA sequence
tggggtgctaaggtaaatgg

SEQ ID NO: 554879 - DNA, 20 bp, Artificial
  CRISPR gRNA sequence
ggggtgctaaggtaaatggt

SEQ ID NO: 554880 - DNA, 20 bp, Artificial
  CRISPR gRNA sequence
gggtgctaaggtaaatggtg

SEQ ID NO: 554881 - DNA, 20 bp, Artificial
  CRISPR gRNA sequence
aggtaaatggtgttgtgttt

SEQ ID NO: 554882 - DNA, 20 bp, Artificial
  CRISPR gRNA sequence
tgttttaaacttcaaattcc

SEQ ID NO: 554883 - DNA, 20 bp, Artificial
  CRISPR gRNA sequence
taaacttcaaattccacttg

SEQ ID NO: 554884 - DNA, 20 bp, Artificial
  CRISPR gRNA sequence
aaacttcaaattccacttgt

SEQ ID NO: 554885 - DNA, 20 bp, Artificial
  CRISPR gRNA sequence
aacttcaaattccacttgtt

SEQ ID NO: 554886 - DNA, 20 bp, Artificial
  CRISPR gRNA sequence
caaattccacttgttcattg

SEQ ID NO: 554887 - DNA, 20 bp, Artificial
  CRISPR gRNA sequence
aaattccacttgttcattgc

SEQ ID NO: 554888 - DNA, 20 bp, Artificial
  CRISPR gRNA sequence
cacttgttcattgctgttat

SEQ ID NO: 554889 - DNA, 20 bp, Artificial
  CRISPR gRNA sequence
gttcattgctgttatagaaa

SEQ ID NO: 554890 - DNA, 20 bp, Artificial
  CRISPR gRNA sequence
ttcattgctgttatagaaaa

SEQ ID NO: 554891 - DNA, 20 bp, Artificial
  CRISPR gRNA sequence
attgctgttatagaaaagtg

SEQ ID NO: 554892 - DNA, 20 bp, Artificial
  CRISPR gRNA sequence
ctgttatagaaaagtgattg

SEQ ID NO: 554893 - DNA, 20 bp, Artificial
  CRISPR gRNA sequence
ttatagaaaagtgattgact

SEQ ID NO: 554894 - DNA, 20 bp, Artificial
  CRISPR gRNA sequence
tagaaaagtgattgactttt

SEQ ID NO: 554895 - DNA, 20 bp, Artificial
  CRISPR gRNA sequence
acttttgtatattaactttg

SEQ ID NO: 554896 - DNA, 20 bp, Artificial
  CRISPR gRNA sequence
ttgtatattaactttgtatc

SEQ ID NO: 554897 - DNA, 20 bp, Artificial
  CRISPR gRNA sequence
tgtatattaactttgtatcc

SEQ ID NO: 554898 - DNA, 20 bp, Artificial
  CRISPR gRNA sequence
gtatattaactttgtatcct

SEQ ID NO: 554899 - DNA, 20 bp, Artificial
  CRISPR gRNA sequence
tatattaactttgtatccta

SEQ ID NO: 554900 - DNA, 20 bp, Artificial
  CRISPR gRNA sequence
actttgtatcctacaaatgt

SEQ ID NO: 554901 - DNA, 20 bp, Artificial
  CRISPR gRNA sequence
tgtatcctacaaatgtgcta

SEQ ID NO: 554902 - DNA, 20 bp, Artificial
  CRISPR gRNA sequence
gtatcctacaaatgtgctat

SEQ ID NO: 554903 - DNA, 20 bp, Artificial
  CRISPR gRNA sequence
tatcctacaaatgtgctata

SEQ ID NO: 554904 - DNA, 20 bp, Artificial
  CRISPR gRNA sequence
caaatgtgctatagtttttt

SEQ ID NO: 554905 - DNA, 20 bp, Artificial
  CRISPR gRNA sequence
tagttttttattagttccag

SEQ ID NO: 554906 - DNA, 20 bp, Artificial
  CRISPR gRNA sequence
tttattagttccaggaggtt

SEQ ID NO: 554907 - DNA, 20 bp, Artificial
  CRISPR gRNA sequence
ttattagttccaggaggttt

SEQ ID NO: 554908 - DNA, 20 bp, Artificial
  CRISPR gRNA sequence
tattagttccaggaggtttt

SEQ ID NO: 554909 - DNA, 20 bp, Artificial
  CRISPR gRNA sequence
attagttccaggaggttttt

SEQ ID NO: 554910 - DNA, 20 bp, Artificial
  CRISPR gRNA sequence
ttagttccaggaggtttttg

SEQ ID NO: 554911 - DNA, 20 bp, Artificial
  CRISPR gRNA sequence
gttccaggaggtttttggtc

SEQ ID NO: 554912 - DNA, 20 bp, Artificial
  CRISPR gRNA sequence
caggaggtttttggtcaatt

SEQ ID NO: 554913 - DNA, 20 bp, Artificial
  CRISPR gRNA sequence
ttggtcaattcgtttggatt

SEQ ID NO: 554914 - DNA, 20 bp, Artificial
  CRISPR gRNA sequence
tggtcaattcgtttggattg

SEQ ID NO: 554915 - DNA, 20 bp, Artificial
  CRISPR gRNA sequence
ggtcaattcgtttggattgt

SEQ ID NO: 554916 - DNA, 20 bp, Artificial
  CRISPR gRNA sequence
gtcaattcgtttggattgta

SEQ ID NO: 554917 - DNA, 20 bp, Artificial
  CRISPR gRNA sequence
gtttggattgtatacataga

SEQ ID NO: 554918 - DNA, 20 bp, Artificial
  CRISPR gRNA sequence
ggattgtatacatagatatt

SEQ ID NO: 554919 - DNA, 20 bp, Artificial
  CRISPR gRNA sequence
gattgtatacatagatattc

SEQ ID NO: 554920 - DNA, 20 bp, Artificial
  CRISPR gRNA sequence
tatacatagatattcatgtc

SEQ ID NO: 554921 - DNA, 20 bp, Artificial
  CRISPR gRNA sequence
atgtcatctgagaactaaaa

SEQ ID NO: 554922 - DNA, 20 bp, Artificial
  CRISPR gRNA sequence
agaactaaaacaattttctt

SEQ ID NO: 554923 - DNA, 20 bp, Artificial
  CRISPR gRNA sequence
aaacaattttctttctttct

SEQ ID NO: 554924 - DNA, 20 bp, Artificial
  CRISPR gRNA sequence
tctttctttcttctcatctg

SEQ ID NO: 554925 - DNA, 20 bp, Artificial
  CRISPR gRNA sequence
ctttctttcttctcatctgt

SEQ ID NO: 554926 - DNA, 20 bp, Artificial
  CRISPR gRNA sequence
tttctttcttctcatctgta

SEQ ID NO: 554927 - DNA, 20 bp, Artificial
  CRISPR gRNA sequence
tctttcttctcatctgtata

SEQ ID NO: 554928 - DNA, 20 bp, Artificial
  CRISPR gRNA sequence
ctttcttctcatctgtataa

SEQ ID NO: 554929 - DNA, 20 bp, Artificial
  CRISPR gRNA sequence
tttcttctcatctgtataac

SEQ ID NO: 554930 - DNA, 20 bp, Artificial
  CRISPR gRNA sequence
tcttctcatctgtataactt

SEQ ID NO: 554931 - DNA, 20 bp, Artificial
  CRISPR gRNA sequence
cttctcatctgtataacttt

SEQ ID NO: 554932 - DNA, 20 bp, Artificial
  CRISPR gRNA sequence
ttctcatctgtataactttt

SEQ ID NO: 554933 - DNA, 20 bp, Artificial
  CRISPR gRNA sequence
ctcatctgtataacttttat

SEQ ID NO: 554934 - DNA, 20 bp, Artificial
  CRISPR gRNA sequence
tcatctgtataacttttatt

SEQ ID NO: 554935 - DNA, 20 bp, Artificial
  CRISPR gRNA sequence
atctgtataacttttatttc

SEQ ID NO: 554936 - DNA, 20 bp, Artificial
  CRISPR gRNA sequence
tataacttttatttcctttt

SEQ ID NO: 554937 - DNA, 20 bp, Artificial
  CRISPR gRNA sequence
ttatttccttttcttgtctt

SEQ ID NO: 554938 - DNA, 20 bp, Artificial
  CRISPR gRNA sequence
tatttccttttcttgtctta

SEQ ID NO: 554939 - DNA, 20 bp, Artificial
  CRISPR gRNA sequence
atttccttttcttgtcttat

SEQ ID NO: 554940 - DNA, 20 bp, Artificial
  CRISPR gRNA sequence
tttccttttcttgtcttatg

SEQ ID NO: 554941 - DNA, 20 bp, Artificial
  CRISPR gRNA sequence
ccttttcttgtcttatggca

SEQ ID NO: 554942 - DNA, 20 bp, Artificial
  CRISPR gRNA sequence
cttttcttgtcttatggcat

SEQ ID NO: 554943 - DNA, 20 bp, Artificial
  CRISPR gRNA sequence
ttcttgtcttatggcattag

SEQ ID NO: 554944 - DNA, 20 bp, Artificial
  CRISPR gRNA sequence
tcttgtcttatggcattagt

SEQ ID NO: 554945 - DNA, 20 bp, Artificial
  CRISPR gRNA sequence
cttgtcttatggcattagtt

SEQ ID NO: 554946 - DNA, 20 bp, Artificial
  CRISPR gRNA sequence
ttgtcttatggcattagtta

SEQ ID NO: 554947 - DNA, 20 bp, Artificial
  CRISPR gRNA sequence
gtcttatggcattagttagt

SEQ ID NO: 554948 - DNA, 20 bp, Artificial
  CRISPR gRNA sequence
tcttatggcattagttagtg

SEQ ID NO: 554949 - DNA, 20 bp, Artificial
  CRISPR gRNA sequence
atggcattagttagtgctta

SEQ ID NO: 554950 - DNA, 20 bp, Artificial
  CRISPR gRNA sequence
tggcattagttagtgcttat

SEQ ID NO: 554951 - DNA, 20 bp, Artificial
  CRISPR gRNA sequence
gttagtgcttatagtacaat

SEQ ID NO: 554952 - DNA, 20 bp, Artificial
  CRISPR gRNA sequence
gtgcttatagtacaatactg

SEQ ID NO: 554953 - DNA, 20 bp, Artificial
  CRISPR gRNA sequence
atagtacaatactgaaaagg

SEQ ID NO: 554954 - DNA, 20 bp, Artificial
  CRISPR gRNA sequence
tagtacaatactgaaaagga

SEQ ID NO: 554955 - DNA, 20 bp, Artificial
  CRISPR gRNA sequence
aaaaggagtggtgagaagaa

SEQ ID NO: 554956 - DNA, 20 bp, Artificial
  CRISPR gRNA sequence
tttccttattcttggtctta

SEQ ID NO: 554957 - DNA, 20 bp, Artificial
  CRISPR gRNA sequence
ccttattcttggtcttagtt

SEQ ID NO: 554958 - DNA, 20 bp, Artificial
  CRISPR gRNA sequence
cttattcttggtcttagttg

SEQ ID NO: 554959 - DNA, 20 bp, Artificial
  CRISPR gRNA sequence
attcttggtcttagttggaa

SEQ ID NO: 554960 - DNA, 20 bp, Artificial
  CRISPR gRNA sequence
ttcttggtcttagttggaaa

SEQ ID NO: 554961 - DNA, 20 bp, Artificial
  CRISPR gRNA sequence
ttggtcttagttggaaagct

SEQ ID NO: 554962 - DNA, 20 bp, Artificial
  CRISPR gRNA sequence
ggtcttagttggaaagcttc

SEQ ID NO: 554963 - DNA, 20 bp, Artificial
  CRISPR gRNA sequence
gtcttagttggaaagcttca

SEQ ID NO: 554964 - DNA, 20 bp, Artificial
  CRISPR gRNA sequence
agttggaaagcttcaagttt

SEQ ID NO: 554965 - DNA, 20 bp, Artificial
  CRISPR gRNA sequence
gttggaaagcttcaagtttc

SEQ ID NO: 554966 - DNA, 20 bp, Artificial
  CRISPR gRNA sequence
gaaagcttcaagtttctcac

SEQ ID NO: 554967 - DNA, 20 bp, Artificial
  CRISPR gRNA sequence
caagtttctcaccattacag

SEQ ID NO: 554968 - DNA, 20 bp, Artificial
  CRISPR gRNA sequence
aagtttctcaccattacaga

SEQ ID NO: 554969 - DNA, 20 bp, Artificial
  CRISPR gRNA sequence
ctcaccattacagatgatgt

SEQ ID NO: 554970 - DNA, 20 bp, Artificial
  CRISPR gRNA sequence
tcaccattacagatgatgtt

SEQ ID NO: 554971 - DNA, 20 bp, Artificial
  CRISPR gRNA sequence
accattacagatgatgttag

SEQ ID NO: 554972 - DNA, 20 bp, Artificial
  CRISPR gRNA sequence
cagatgatgttagctgcagg

SEQ ID NO: 554973 - DNA, 20 bp, Artificial
  CRISPR gRNA sequence
gctgcagggttttttgtagg

SEQ ID NO: 554974 - DNA, 20 bp, Artificial
  CRISPR gRNA sequence
cagggttttttgtaggcatt

SEQ ID NO: 554975 - DNA, 20 bp, Artificial
  CRISPR gRNA sequence
tttgtaggcatttgttaaca

SEQ ID NO: 554976 - DNA, 20 bp, Artificial
  CRISPR gRNA sequence
ttgtaggcatttgttaacaa

SEQ ID NO: 554977 - DNA, 20 bp, Artificial
  CRISPR gRNA sequence
tgtaggcatttgttaacaag

SEQ ID NO: 554978 - DNA, 20 bp, Artificial
  CRISPR gRNA sequence
gtaggcatttgttaacaagt

SEQ ID NO: 554979 - DNA, 20 bp, Artificial
  CRISPR gRNA sequence
taggcatttgttaacaagtt

SEQ ID NO: 554980 - DNA, 20 bp, Artificial
  CRISPR gRNA sequence
gttaacaagttgaaaaagtt

SEQ ID NO: 554981 - DNA, 20 bp, Artificial
  CRISPR gRNA sequence
ttaacaagttgaaaaagttt

SEQ ID NO: 554982 - DNA, 20 bp, Artificial
  CRISPR gRNA sequence
acaagttgaaaaagtttccc

SEQ ID NO: 554983 - DNA, 20 bp, Artificial
  CRISPR gRNA sequence
aaaaagtttcccctctattc

SEQ ID NO: 554984 - DNA, 20 bp, Artificial
  CRISPR gRNA sequence
cccctctattcctagtttac

SEQ ID NO: 554985 - DNA, 20 bp, Artificial
  CRISPR gRNA sequence
ccctctattcctagtttact

SEQ ID NO: 554986 - DNA, 20 bp, Artificial
  CRISPR gRNA sequence
tattcctagtttactgagag

SEQ ID NO: 554987 - DNA, 20 bp, Artificial
  CRISPR gRNA sequence
ttcctagtttactgagagtt

SEQ ID NO: 554988 - DNA, 20 bp, Artificial
  CRISPR gRNA sequence
ctagtttactgagagttttt

SEQ ID NO: 554989 - DNA, 20 bp, Artificial
  CRISPR gRNA sequence
gtttactgagagtttttatc

SEQ ID NO: 554990 - DNA, 20 bp, Artificial
  CRISPR gRNA sequence
actgagagtttttatcataa

SEQ ID NO: 554991 - DNA, 20 bp, Artificial
  CRISPR gRNA sequence
ctgagagtttttatcataaa

SEQ ID NO: 554992 - DNA, 20 bp, Artificial
  CRISPR gRNA sequence
agagtttttatcataaattg

SEQ ID NO: 554993 - DNA, 20 bp, Artificial
  CRISPR gRNA sequence
ttatcataaattgatgttgg

SEQ ID NO: 554994 - DNA, 20 bp, Artificial
  CRISPR gRNA sequence
tatcataaattgatgttgga

SEQ ID NO: 554995 - DNA, 20 bp, Artificial
  CRISPR gRNA sequence
atcataaattgatgttggat

SEQ ID NO: 554996 - DNA, 20 bp, Artificial
  CRISPR gRNA sequence
tcataaattgatgttggatt

SEQ ID NO: 554997 - DNA, 20 bp, Artificial
  CRISPR gRNA sequence
atgttggattttgtcaaatg

SEQ ID NO: 554998 - DNA, 20 bp, Artificial
  CRISPR gRNA sequence
gattttgtcaaatgcttttt

SEQ ID NO: 554999 - DNA, 20 bp, Artificial
  CRISPR gRNA sequence
tgtcaaatgctttttctgta

SEQ ID NO: 555000 - DNA, 20 bp, Artificial
  CRISPR gRNA sequence
gtcaaatgctttttctgtat

SEQ ID NO: 555001 - DNA, 20 bp, Artificial
  CRISPR gRNA sequence
tcaaatgctttttctgtatc

SEQ ID NO: 555002 - DNA, 20 bp, Artificial
  CRISPR gRNA sequence
tttctgtatctattggtatg

SEQ ID NO: 555003 - DNA, 20 bp, Artificial
  CRISPR gRNA sequence
ttctgtatctattggtatga

SEQ ID NO: 555004 - DNA, 20 bp, Artificial
  CRISPR gRNA sequence
tctgtatctattggtatgat

SEQ ID NO: 555005 - DNA, 20 bp, Artificial
  CRISPR gRNA sequence
ctgtatctattggtatgatc

SEQ ID NO: 555006 - DNA, 20 bp, Artificial
  CRISPR gRNA sequence
tgtatctattggtatgatca

SEQ ID NO: 555007 - DNA, 20 bp, Artificial
  CRISPR gRNA sequence
tatctattggtatgatcatg

SEQ ID NO: 555008 - DNA, 20 bp, Artificial
  CRISPR gRNA sequence
ttggtatgatcatgtgattt

SEQ ID NO: 555009 - DNA, 20 bp, Artificial
  CRISPR gRNA sequence
gtatgatcatgtgatttttc

SEQ ID NO: 555010 - DNA, 20 bp, Artificial
  CRISPR gRNA sequence
ttctttcatagtctgtcaat

SEQ ID NO: 555011 - DNA, 20 bp, Artificial
  CRISPR gRNA sequence
tctttcatagtctgtcaatg

SEQ ID NO: 555012 - DNA, 20 bp, Artificial
  CRISPR gRNA sequence
ctttcatagtctgtcaatgt

SEQ ID NO: 555013 - DNA, 20 bp, Artificial
  CRISPR gRNA sequence
tttcatagtctgtcaatgtg

SEQ ID NO: 555014 - DNA, 20 bp, Artificial
  CRISPR gRNA sequence
tcatagtctgtcaatgtgat

SEQ ID NO: 555015 - DNA, 20 bp, Artificial
  CRISPR gRNA sequence
catagtctgtcaatgtgatg

SEQ ID NO: 555016 - DNA, 20 bp, Artificial
  CRISPR gRNA sequence
atagtctgtcaatgtgatgg

SEQ ID NO: 555017 - DNA, 20 bp, Artificial
  CRISPR gRNA sequence
tcaatgtgatggattacatt

SEQ ID NO: 555018 - DNA, 20 bp, Artificial
  CRISPR gRNA sequence
cattaattgattttcatatg

SEQ ID NO: 555019 - DNA, 20 bp, Artificial
  CRISPR gRNA sequence
attgattttcatatgttgaa

SEQ ID NO: 555020 - DNA, 20 bp, Artificial
  CRISPR gRNA sequence
attttcatatgttgaacctg

SEQ ID NO: 555021 - DNA, 20 bp, Artificial
  CRISPR gRNA sequence
tcatatgttgaacctgcctt

SEQ ID NO: 555022 - DNA, 20 bp, Artificial
  CRISPR gRNA sequence
catatgttgaacctgccttg

SEQ ID NO: 555023 - DNA, 20 bp, Artificial
  CRISPR gRNA sequence
atatgttgaacctgccttgc

SEQ ID NO: 555024 - DNA, 20 bp, Artificial
  CRISPR gRNA sequence
aacctgccttgcacacctga

SEQ ID NO: 555025 - DNA, 20 bp, Artificial
  CRISPR gRNA sequence
ccttgcacacctgagataaa

SEQ ID NO: 555026 - DNA, 20 bp, Artificial
  CRISPR gRNA sequence
gcacacctgagataaatacc

SEQ ID NO: 555027 - DNA, 20 bp, Artificial
  CRISPR gRNA sequence
cacacctgagataaatacca

SEQ ID NO: 555028 - DNA, 20 bp, Artificial
  CRISPR gRNA sequence
agataaataccacttagtca

SEQ ID NO: 555029 - DNA, 20 bp, Artificial
  CRISPR gRNA sequence
agtcatgatgtataattctt

SEQ ID NO: 555030 - DNA, 20 bp, Artificial
  CRISPR gRNA sequence
gtcatgatgtataattcttt

SEQ ID NO: 555031 - DNA, 20 bp, Artificial
  CRISPR gRNA sequence
tttctatatgctgttggatc

SEQ ID NO: 555032 - DNA, 20 bp, Artificial
  CRISPR gRNA sequence
tctatatgctgttggatcca

SEQ ID NO: 555033 - DNA, 20 bp, Artificial
  CRISPR gRNA sequence
ctatatgctgttggatccaa

SEQ ID NO: 555034 - DNA, 20 bp, Artificial
  CRISPR gRNA sequence
tatatgctgttggatccaat

SEQ ID NO: 555035 - DNA, 20 bp, Artificial
  CRISPR gRNA sequence
tatgctgttggatccaattt

SEQ ID NO: 555036 - DNA, 20 bp, Artificial
  CRISPR gRNA sequence
ttggatccaatttgctaata

SEQ ID NO: 555037 - DNA, 20 bp, Artificial
  CRISPR gRNA sequence
gatccaatttgctaatattt

SEQ ID NO: 555038 - DNA, 20 bp, Artificial
  CRISPR gRNA sequence
gctaatattttgtttaaggt

SEQ ID NO: 555039 - DNA, 20 bp, Artificial
  CRISPR gRNA sequence
ctaatattttgtttaaggtt

SEQ ID NO: 555040 - DNA, 20 bp, Artificial
  CRISPR gRNA sequence
atattttgtttaaggtttct

SEQ ID NO: 555041 - DNA, 20 bp, Artificial
  CRISPR gRNA sequence
tgtttaaggtttctacatgt

SEQ ID NO: 555042 - DNA, 20 bp, Artificial
  CRISPR gRNA sequence
gtttaaggtttctacatgta

SEQ ID NO: 555043 - DNA, 20 bp, Artificial
  CRISPR gRNA sequence
tttaaggtttctacatgtat

SEQ ID NO: 555044 - DNA, 20 bp, Artificial
  CRISPR gRNA sequence
aaggtttctacatgtatgtt

SEQ ID NO: 555045 - DNA, 20 bp, Artificial
  CRISPR gRNA sequence
aggtttctacatgtatgttc

SEQ ID NO: 555046 - DNA, 20 bp, Artificial
  CRISPR gRNA sequence
ctacatgtatgttcatgaga

SEQ ID NO: 555047 - DNA, 20 bp, Artificial
  CRISPR gRNA sequence
tacatgtatgttcatgagaa

SEQ ID NO: 555048 - DNA, 20 bp, Artificial
  CRISPR gRNA sequence
catgtatgttcatgagaaat

SEQ ID NO: 555049 - DNA, 20 bp, Artificial
  CRISPR gRNA sequence
atgagaaatatttgtcttaa

SEQ ID NO: 555050 - DNA, 20 bp, Artificial
  CRISPR gRNA sequence
gtcttaattttcttttcttg

SEQ ID NO: 555051 - DNA, 20 bp, Artificial
  CRISPR gRNA sequence
tcttaattttcttttcttgt

SEQ ID NO: 555052 - DNA, 20 bp, Artificial
  CRISPR gRNA sequence
aattttcttttcttgtattg

SEQ ID NO: 555053 - DNA, 20 bp, Artificial
  CRISPR gRNA sequence
attttcttttcttgtattgt

SEQ ID NO: 555054 - DNA, 20 bp, Artificial
  CRISPR gRNA sequence
tcttttcttgtattgttctt

SEQ ID NO: 555055 - DNA, 20 bp, Artificial
  CRISPR gRNA sequence
cttttcttgtattgttcttt

SEQ ID NO: 555056 - DNA, 20 bp, Artificial
  CRISPR gRNA sequence
ttttcttgtattgttctttg

SEQ ID NO: 555057 - DNA, 20 bp, Artificial
  CRISPR gRNA sequence
ttcttgtattgttctttggt

SEQ ID NO: 555058 - DNA, 20 bp, Artificial
  CRISPR gRNA sequence
tcttgtattgttctttggtt

SEQ ID NO: 555059 - DNA, 20 bp, Artificial
  CRISPR gRNA sequence
cttgtattgttctttggttt

SEQ ID NO: 555060 - DNA, 20 bp, Artificial
  CRISPR gRNA sequence
ttgtattgttctttggtttt

SEQ ID NO: 555061 - DNA, 20 bp, Artificial
  CRISPR gRNA sequence
gtattgttctttggttttag

SEQ ID NO: 555062 - DNA, 20 bp, Artificial
  CRISPR gRNA sequence
tattgttctttggttttagc

SEQ ID NO: 555063 - DNA, 20 bp, Artificial
  CRISPR gRNA sequence
ttctttggttttagcacaag

SEQ ID NO: 555064 - DNA, 20 bp, Artificial
  CRISPR gRNA sequence
tttggttttagcacaagaat

SEQ ID NO: 555065 - DNA, 20 bp, Artificial
  CRISPR gRNA sequence
tggttttagcacaagaataa

SEQ ID NO: 555066 - DNA, 20 bp, Artificial
  CRISPR gRNA sequence
ggttttagcacaagaataat

SEQ ID NO: 555067 - DNA, 20 bp, Artificial
  CRISPR gRNA sequence
gttttagcacaagaataatg

SEQ ID NO: 555068 - DNA, 20 bp, Artificial
  CRISPR gRNA sequence
tagcacaagaataatgctgg

SEQ ID NO: 555069 - DNA, 20 bp, Artificial
  CRISPR gRNA sequence
agcacaagaataatgctggc

SEQ ID NO: 555070 - DNA, 20 bp, Artificial
  CRISPR gRNA sequence
gcacaagaataatgctggcc

SEQ ID NO: 555071 - DNA, 20 bp, Artificial
  CRISPR gRNA sequence
gcctcataaaatgaattgga

SEQ ID NO: 555072 - DNA, 20 bp, Artificial
  CRISPR gRNA sequence
ataaaatgaattggaaagta

SEQ ID NO: 555073 - DNA, 20 bp, Artificial
  CRISPR gRNA sequence
gaaagtatgccctctgcttc

SEQ ID NO: 555074 - DNA, 20 bp, Artificial
  CRISPR gRNA sequence
tgcttctatcttctaaaaga

SEQ ID NO: 555075 - DNA, 20 bp, Artificial
  CRISPR gRNA sequence
cttctatcttctaaaagaga

SEQ ID NO: 555076 - DNA, 20 bp, Artificial
  CRISPR gRNA sequence
ctatcttctaaaagagatta

SEQ ID NO: 555077 - DNA, 20 bp, Artificial
  CRISPR gRNA sequence
tatcttctaaaagagattat

SEQ ID NO: 555078 - DNA, 20 bp, Artificial
  CRISPR gRNA sequence
tcttctaaaagagattatag

SEQ ID NO: 555079 - DNA, 20 bp, Artificial
  CRISPR gRNA sequence
ctaaaagagattatagagaa

SEQ ID NO: 555080 - DNA, 20 bp, Artificial
  CRISPR gRNA sequence
taaaagagattatagagaat

SEQ ID NO: 555081 - DNA, 20 bp, Artificial
  CRISPR gRNA sequence
aaagagattatagagaatta

SEQ ID NO: 555082 - DNA, 20 bp, Artificial
  CRISPR gRNA sequence
tagagaattagtatttcttc

SEQ ID NO: 555083 - DNA, 20 bp, Artificial
  CRISPR gRNA sequence
gtatttcttccttaaatatc

SEQ ID NO: 555084 - DNA, 20 bp, Artificial
  CRISPR gRNA sequence
cttccttaaatatctggtag

SEQ ID NO: 555085 - DNA, 20 bp, Artificial
  CRISPR gRNA sequence
ttccttaaatatctggtaga

SEQ ID NO: 555086 - DNA, 20 bp, Artificial
  CRISPR gRNA sequence
ccttaaatatctggtagaat

SEQ ID NO: 555087 - DNA, 20 bp, Artificial
  CRISPR gRNA sequence
cttaaatatctggtagaatt

SEQ ID NO: 555088 - DNA, 20 bp, Artificial
  CRISPR gRNA sequence
aaatatctggtagaattcac

SEQ ID NO: 555089 - DNA, 20 bp, Artificial
  CRISPR gRNA sequence
aatatctggtagaattcacc

SEQ ID NO: 555090 - DNA, 20 bp, Artificial
  CRISPR gRNA sequence
gtagaattcaccaatgaacc

SEQ ID NO: 555091 - DNA, 20 bp, Artificial
  CRISPR gRNA sequence
accaatgaacccatctgaac

SEQ ID NO: 555092 - DNA, 20 bp, Artificial
  CRISPR gRNA sequence
aacctggtgctttctgtttt

SEQ ID NO: 555093 - DNA, 20 bp, Artificial
  CRISPR gRNA sequence
gtgctttctgttttggaaga

SEQ ID NO: 555094 - DNA, 20 bp, Artificial
  CRISPR gRNA sequence
tctgttttggaagattatta

SEQ ID NO: 555095 - DNA, 20 bp, Artificial
  CRISPR gRNA sequence
ctgttttggaagattattaa

SEQ ID NO: 555096 - DNA, 20 bp, Artificial
  CRISPR gRNA sequence
tgttttggaagattattaat

SEQ ID NO: 555097 - DNA, 20 bp, Artificial
  CRISPR gRNA sequence
ttttggaagattattaatta

SEQ ID NO: 555098 - DNA, 20 bp, Artificial
  CRISPR gRNA sequence
tggaagattattaattactg

SEQ ID NO: 555099 - DNA, 20 bp, Artificial
  CRISPR gRNA sequence
ggaagattattaattactga

SEQ ID NO: 555100 - DNA, 20 bp, Artificial
  CRISPR gRNA sequence
gaagattattaattactgat

SEQ ID NO: 555101 - DNA, 20 bp, Artificial
  CRISPR gRNA sequence
ttaattactgatctgattta

SEQ ID NO: 555102 - DNA, 20 bp, Artificial
  CRISPR gRNA sequence
attactgatctgatttattt

SEQ ID NO: 555103 - DNA, 20 bp, Artificial
  CRISPR gRNA sequence
ctgatctgatttatttaaac

SEQ ID NO: 555104 - DNA, 20 bp, Artificial
  CRISPR gRNA sequence
atctgatttatttaaactgc

SEQ ID NO: 555105 - DNA, 20 bp, Artificial
  CRISPR gRNA sequence
atttatttaaactgccaggc

SEQ ID NO: 555106 - DNA, 20 bp, Artificial
  CRISPR gRNA sequence
atttaaactgccaggctgaa

SEQ ID NO: 555107 - DNA, 20 bp, Artificial
  CRISPR gRNA sequence
tttaaactgccaggctgaag

SEQ ID NO: 555108 - DNA, 20 bp, Artificial
  CRISPR gRNA sequence
aaactgccaggctgaagtga

SEQ ID NO: 555109 - DNA, 20 bp, Artificial
  CRISPR gRNA sequence
aactgccaggctgaagtgat

SEQ ID NO: 555110 - DNA, 20 bp, Artificial
  CRISPR gRNA sequence
ccaggctgaagtgatcctcc

SEQ ID NO: 555111 - DNA, 20 bp, Artificial
  CRISPR gRNA sequence
aagtgatcctcccacctcag

SEQ ID NO: 555112 - DNA, 20 bp, Artificial
  CRISPR gRNA sequence
ccacctcagtctcccaagta

SEQ ID NO: 555113 - DNA, 20 bp, Artificial
  CRISPR gRNA sequence
agtctcccaagtagctagga

SEQ ID NO: 555114 - DNA, 20 bp, Artificial
  CRISPR gRNA sequence
ccaagtagctaggactacag

SEQ ID NO: 555115 - DNA, 20 bp, Artificial
  CRISPR gRNA sequence
ggactacagacacatgccac

SEQ ID NO: 555116 - DNA, 20 bp, Artificial
  CRISPR gRNA sequence
cagacacatgccacaacacc

SEQ ID NO: 555117 - DNA, 20 bp, Artificial
  CRISPR gRNA sequence
agtaactttttaatttttag

SEQ ID NO: 555118 - DNA, 20 bp, Artificial
  CRISPR gRNA sequence
tttaatttttagtagagata

SEQ ID NO: 555119 - DNA, 20 bp, Artificial
  CRISPR gRNA sequence
ttaatttttagtagagatag

SEQ ID NO: 555120 - DNA, 20 bp, Artificial
  CRISPR gRNA sequence
taatttttagtagagatagg

SEQ ID NO: 555121 - DNA, 20 bp, Artificial
  CRISPR gRNA sequence
aatttttagtagagataggg

SEQ ID NO: 555122 - DNA, 20 bp, Artificial
  CRISPR gRNA sequence
atttttagtagagatagggt

SEQ ID NO: 555123 - DNA, 20 bp, Artificial
  CRISPR gRNA sequence
ttagtagagatagggtctcc

SEQ ID NO: 555124 - DNA, 20 bp, Artificial
  CRISPR gRNA sequence
tagtagagatagggtctccc

SEQ ID NO: 555125 - DNA, 20 bp, Artificial
  CRISPR gRNA sequence
agtagagatagggtctccct

SEQ ID NO: 555126 - DNA, 20 bp, Artificial
  CRISPR gRNA sequence
gtagagatagggtctcccta

SEQ ID NO: 555127 - DNA, 20 bp, Artificial
  CRISPR gRNA sequence
cctatgttgcccaggctggt

SEQ ID NO: 555128 - DNA, 20 bp, Artificial
  CRISPR gRNA sequence
tgttgcccaggctggtctcg

SEQ ID NO: 555129 - DNA, 20 bp, Artificial
  CRISPR gRNA sequence
cccaggctggtctcgaactc

SEQ ID NO: 555130 - DNA, 20 bp, Artificial
  CRISPR gRNA sequence
gtctcgaactctcagcctca

SEQ ID NO: 555131 - DNA, 20 bp, Artificial
  CRISPR gRNA sequence
gaactctcagcctcaagcaa

SEQ ID NO: 555132 - DNA, 20 bp, Artificial
  CRISPR gRNA sequence
tcagcctcaagcaatcctcc

SEQ ID NO: 555133 - DNA, 20 bp, Artificial
  CRISPR gRNA sequence
agcctcaagcaatcctcccg

SEQ ID NO: 555134 - DNA, 20 bp, Artificial
  CRISPR gRNA sequence
aagcaatcctcccgtcttgg

SEQ ID NO: 555135 - DNA, 20 bp, Artificial
  CRISPR gRNA sequence
ccgtcttggcctcacaaagt

SEQ ID NO: 555136 - DNA, 20 bp, Artificial
  CRISPR gRNA sequence
ggcctcacaaagtgttggga

SEQ ID NO: 555137 - DNA, 20 bp, Artificial
  CRISPR gRNA sequence
gcctcacaaagtgttgggat

SEQ ID NO: 555138 - DNA, 20 bp, Artificial
  CRISPR gRNA sequence
acaaagtgttgggattatag

SEQ ID NO: 555139 - DNA, 20 bp, Artificial
  CRISPR gRNA sequence
ggattataggcataagccac

SEQ ID NO: 555140 - DNA, 20 bp, Artificial
  CRISPR gRNA sequence
taggcataagccactgcacg

SEQ ID NO: 555141 - DNA, 20 bp, Artificial
  CRISPR gRNA sequence
cacgcagcgttctttctcaa

SEQ ID NO: 555142 - DNA, 20 bp, Artificial
  CRISPR gRNA sequence
tttctcaatttttaaaagca

SEQ ID NO: 555143 - DNA, 20 bp, Artificial
  CRISPR gRNA sequence
tctcaatttttaaaagcaga

SEQ ID NO: 555144 - DNA, 20 bp, Artificial
  CRISPR gRNA sequence
ctcaatttttaaaagcagag

SEQ ID NO: 555145 - DNA, 20 bp, Artificial
  CRISPR gRNA sequence
tcaatttttaaaagcagagt

SEQ ID NO: 555146 - DNA, 20 bp, Artificial
  CRISPR gRNA sequence
aatttttaaaagcagagtga

SEQ ID NO: 555147 - DNA, 20 bp, Artificial
  CRISPR gRNA sequence
ttaaaagcagagtgaacatt

SEQ ID NO: 555148 - DNA, 20 bp, Artificial
  CRISPR gRNA sequence
taaaagcagagtgaacattc

SEQ ID NO: 555149 - DNA, 20 bp, Artificial
  CRISPR gRNA sequence
aaaagcagagtgaacattct

SEQ ID NO: 555150 - DNA, 20 bp, Artificial
  CRISPR gRNA sequence
aaagcagagtgaacattctt

SEQ ID NO: 555151 - DNA, 20 bp, Artificial
  CRISPR gRNA sequence
ttaatcactattcttcccag

SEQ ID NO: 555152 - DNA, 20 bp, Artificial
  CRISPR gRNA sequence
aatcactattcttcccagtg

SEQ ID NO: 555153 - DNA, 20 bp, Artificial
  CRISPR gRNA sequence
atcactattcttcccagtgg

SEQ ID NO: 555154 - DNA, 20 bp, Artificial
  CRISPR gRNA sequence
ttcttcccagtggaaagtca

SEQ ID NO: 555155 - DNA, 20 bp, Artificial
  CRISPR gRNA sequence
ttcccagtggaaagtcataa

SEQ ID NO: 555156 - DNA, 20 bp, Artificial
  CRISPR gRNA sequence
cccagtggaaagtcataaaa

SEQ ID NO: 555157 - DNA, 20 bp, Artificial
  CRISPR gRNA sequence
ccagtggaaagtcataaaag

SEQ ID NO: 555158 - DNA, 20 bp, Artificial
  CRISPR gRNA sequence
aaatcagtccaaaaatcctc

SEQ ID NO: 555159 - DNA, 20 bp, Artificial
  CRISPR gRNA sequence
aatcagtccaaaaatcctcc

SEQ ID NO: 555160 - DNA, 20 bp, Artificial
  CRISPR gRNA sequence
ctacttctgtttctgcctgt

SEQ ID NO: 555161 - DNA, 20 bp, Artificial
  CRISPR gRNA sequence
cttctgtttctgcctgttac

SEQ ID NO: 555162 - DNA, 20 bp, Artificial
  CRISPR gRNA sequence
ctgtttctgcctgttacatt

SEQ ID NO: 555163 - DNA, 20 bp, Artificial
  CRISPR gRNA sequence
tgtttctgcctgttacattt

SEQ ID NO: 555164 - DNA, 20 bp, Artificial
  CRISPR gRNA sequence
tttctgcctgttacatttca

SEQ ID NO: 555165 - DNA, 20 bp, Artificial
  CRISPR gRNA sequence
ctgcctgttacatttcatct

SEQ ID NO: 555166 - DNA, 20 bp, Artificial
  CRISPR gRNA sequence
tgcctgttacatttcatctg

SEQ ID NO: 555167 - DNA, 20 bp, Artificial
  CRISPR gRNA sequence
cctgttacatttcatctggt

SEQ ID NO: 555168 - DNA, 20 bp, Artificial
  CRISPR gRNA sequence
ttacatttcatctggttcaa

SEQ ID NO: 555169 - DNA, 20 bp, Artificial
  CRISPR gRNA sequence
catttcatctggttcaaact

SEQ ID NO: 555170 - DNA, 20 bp, Artificial
  CRISPR gRNA sequence
catctggttcaaactttgtt

SEQ ID NO: 555171 - DNA, 20 bp, Artificial
  CRISPR gRNA sequence
atctggttcaaactttgttc

SEQ ID NO: 555172 - DNA, 20 bp, Artificial
  CRISPR gRNA sequence
gttcaaactttgttcaaata

SEQ ID NO: 555173 - DNA, 20 bp, Artificial
  CRISPR gRNA sequence
aaactttgttcaaatattct

SEQ ID NO: 555174 - DNA, 20 bp, Artificial
  CRISPR gRNA sequence
tgttcaaatattcttaacat

SEQ ID NO: 555175 - DNA, 20 bp, Artificial
  CRISPR gRNA sequence
gttcaaatattcttaacatt

SEQ ID NO: 555176 - DNA, 20 bp, Artificial
  CRISPR gRNA sequence
ttcaaatattcttaacattc

SEQ ID NO: 555177 - DNA, 20 bp, Artificial
  CRISPR gRNA sequence
aaatattcttaacattcttt

SEQ ID NO: 555178 - DNA, 20 bp, Artificial
  CRISPR gRNA sequence
ttaacattctttatctcagt

SEQ ID NO: 555179 - DNA, 20 bp, Artificial
  CRISPR gRNA sequence
aacattctttatctcagtct

SEQ ID NO: 555180 - DNA, 20 bp, Artificial
  CRISPR gRNA sequence
acattctttatctcagtcta

SEQ ID NO: 555181 - DNA, 20 bp, Artificial
  CRISPR gRNA sequence
tttatctcagtctacataat

SEQ ID NO: 555182 - DNA, 20 bp, Artificial
  CRISPR gRNA sequence
tatctcagtctacataatat

SEQ ID NO: 555183 - DNA, 20 bp, Artificial
  CRISPR gRNA sequence
atctcagtctacataatatt

SEQ ID NO: 555184 - DNA, 20 bp, Artificial
  CRISPR gRNA sequence
tctcagtctacataatatta

SEQ ID NO: 555185 - DNA, 20 bp, Artificial
  CRISPR gRNA sequence
agtctacataatattatttc

SEQ ID NO: 555186 - DNA, 20 bp, Artificial
  CRISPR gRNA sequence
cataatattatttcctatgt

SEQ ID NO: 555187 - DNA, 20 bp, Artificial
  CRISPR gRNA sequence
tttcctatgttgcatttctt

SEQ ID NO: 555188 - DNA, 20 bp, Artificial
  CRISPR gRNA sequence
cctatgttgcatttctttcc

SEQ ID NO: 555189 - DNA, 20 bp, Artificial
  CRISPR gRNA sequence
ctatgttgcatttctttcct

SEQ ID NO: 555190 - DNA, 20 bp, Artificial
  CRISPR gRNA sequence
tgttgcatttctttccttct

SEQ ID NO: 555191 - DNA, 20 bp, Artificial
  CRISPR gRNA sequence
catttctttccttcttctcc

SEQ ID NO: 555192 - DNA, 20 bp, Artificial
  CRISPR gRNA sequence
ctttccttcttctccttttt

SEQ ID NO: 555193 - DNA, 20 bp, Artificial
  CRISPR gRNA sequence
tttccttcttctcctttttc

SEQ ID NO: 555194 - DNA, 20 bp, Artificial
  CRISPR gRNA sequence
tccttcttctcctttttcct

SEQ ID NO: 555195 - DNA, 20 bp, Artificial
  CRISPR gRNA sequence
ccttcttctcctttttccta

SEQ ID NO: 555196 - DNA, 20 bp, Artificial
  CRISPR gRNA sequence
cttcttctcctttttcctat

SEQ ID NO: 555197 - DNA, 20 bp, Artificial
  CRISPR gRNA sequence
cttctcctttttcctatttc

SEQ ID NO: 555198 - DNA, 20 bp, Artificial
  CRISPR gRNA sequence
ttctcctttttcctatttcc

SEQ ID NO: 555199 - DNA, 20 bp, Artificial
  CRISPR gRNA sequence
ctcctttttcctatttccgc

SEQ ID NO: 555200 - DNA, 20 bp, Artificial
  CRISPR gRNA sequence
tcctttttcctatttccgca

SEQ ID NO: 555201 - DNA, 20 bp, Artificial
  CRISPR gRNA sequence
ctttttcctatttccgcata

SEQ ID NO: 555202 - DNA, 20 bp, Artificial
  CRISPR gRNA sequence
tttcctatttccgcatattt

SEQ ID NO: 555203 - DNA, 20 bp, Artificial
  CRISPR gRNA sequence
ttcctatttccgcatatttt

SEQ ID NO: 555204 - DNA, 20 bp, Artificial
  CRISPR gRNA sequence
tcctatttccgcatattttt

SEQ ID NO: 555205 - DNA, 20 bp, Artificial
  CRISPR gRNA sequence
cctatttccgcatatttttg

SEQ ID NO: 555206 - DNA, 20 bp, Artificial
  CRISPR gRNA sequence
ctatttccgcatatttttgt

SEQ ID NO: 555207 - DNA, 20 bp, Artificial
  CRISPR gRNA sequence
tttccgcatatttttgtgtt

SEQ ID NO: 555208 - DNA, 20 bp, Artificial
  CRISPR gRNA sequence
ccgcatatttttgtgtttct

SEQ ID NO: 555209 - DNA, 20 bp, Artificial
  CRISPR gRNA sequence
cgcatatttttgtgtttcta

SEQ ID NO: 555210 - DNA, 20 bp, Artificial
  CRISPR gRNA sequence
ttgtgtttctatgatgaatt

SEQ ID NO: 555211 - DNA, 20 bp, Artificial
  CRISPR gRNA sequence
tgtgtttctatgatgaattt

SEQ ID NO: 555212 - DNA, 20 bp, Artificial
  CRISPR gRNA sequence
gtgtttctatgatgaatttt

SEQ ID NO: 555213 - DNA, 20 bp, Artificial
  CRISPR gRNA sequence
tgtttctatgatgaattttt

SEQ ID NO: 555214 - DNA, 20 bp, Artificial
  CRISPR gRNA sequence
ctatgatgaatttttccaat

SEQ ID NO: 555215 - DNA, 20 bp, Artificial
  CRISPR gRNA sequence
tatgatgaatttttccaatt

SEQ ID NO: 555216 - DNA, 20 bp, Artificial
  CRISPR gRNA sequence
tgatgaatttttccaatttc

SEQ ID NO: 555217 - DNA, 20 bp, Artificial
  CRISPR gRNA sequence
ttccaatttctctctttttt

SEQ ID NO: 555218 - DNA, 20 bp, Artificial
  CRISPR gRNA sequence
tccaatttctctcttttttc

SEQ ID NO: 555219 - DNA, 20 bp, Artificial
  CRISPR gRNA sequence
ccaatttctctcttttttct

SEQ ID NO: 555220 - DNA, 20 bp, Artificial
  CRISPR gRNA sequence
caatttctctcttttttctt

SEQ ID NO: 555221 - DNA, 20 bp, Artificial
  CRISPR gRNA sequence
ctctcttttttcttaggagt

SEQ ID NO: 555222 - DNA, 20 bp, Artificial
  CRISPR gRNA sequence
tctcttttttcttaggagta

SEQ ID NO: 555223 - DNA, 20 bp, Artificial
  CRISPR gRNA sequence
tcttttttcttaggagtaag

SEQ ID NO: 555224 - DNA, 20 bp, Artificial
  CRISPR gRNA sequence
ttttttcttaggagtaagat

SEQ ID NO: 555225 - DNA, 20 bp, Artificial
  CRISPR gRNA sequence
ttttcttaggagtaagatca

SEQ ID NO: 555226 - DNA, 20 bp, Artificial
  CRISPR gRNA sequence
tttcttaggagtaagatcaa

SEQ ID NO: 555227 - DNA, 20 bp, Artificial
  CRISPR gRNA sequence
ttcttaggagtaagatcaaa

SEQ ID NO: 555228 - DNA, 20 bp, Artificial
  CRISPR gRNA sequence
tcttaggagtaagatcaaag

SEQ ID NO: 555229 - DNA, 20 bp, Artificial
  CRISPR gRNA sequence
cttaggagtaagatcaaagg

SEQ ID NO: 555230 - DNA, 20 bp, Artificial
  CRISPR gRNA sequence
ttaggagtaagatcaaaggg

SEQ ID NO: 555231 - DNA, 20 bp, Artificial
  CRISPR gRNA sequence
aggagtaagatcaaagggtg

SEQ ID NO: 555232 - DNA, 20 bp, Artificial
  CRISPR gRNA sequence
ggagtaagatcaaagggtgt

SEQ ID NO: 555233 - DNA, 20 bp, Artificial
  CRISPR gRNA sequence
ttttgaggctctaccttcag

SEQ ID NO: 555234 - DNA, 20 bp, Artificial
  CRISPR gRNA sequence
tttgaggctctaccttcagt

SEQ ID NO: 555235 - DNA, 20 bp, Artificial
  CRISPR gRNA sequence
ttgaggctctaccttcagtg

SEQ ID NO: 555236 - DNA, 20 bp, Artificial
  CRISPR gRNA sequence
tgaggctctaccttcagtga

SEQ ID NO: 555237 - DNA, 20 bp, Artificial
  CRISPR gRNA sequence
gaggctctaccttcagtgac

SEQ ID NO: 555238 - DNA, 20 bp, Artificial
  CRISPR gRNA sequence
aggctctaccttcagtgact

SEQ ID NO: 555239 - DNA, 20 bp, Artificial
  CRISPR gRNA sequence
taccttcagtgacttactcc

SEQ ID NO: 555240 - DNA, 20 bp, Artificial
  CRISPR gRNA sequence
ccttcagtgacttactccct

SEQ ID NO: 555241 - DNA, 20 bp, Artificial
  CRISPR gRNA sequence
cagtgacttactccctgcag

SEQ ID NO: 555242 - DNA, 20 bp, Artificial
  CRISPR gRNA sequence
agtgacttactccctgcagg

SEQ ID NO: 555243 - DNA, 20 bp, Artificial
  CRISPR gRNA sequence
actccctgcaggtaacataa

SEQ ID NO: 555244 - DNA, 20 bp, Artificial
  CRISPR gRNA sequence
ctccctgcaggtaacataat

SEQ ID NO: 555245 - DNA, 20 bp, Artificial
  CRISPR gRNA sequence
cctgcaggtaacataatgtc

SEQ ID NO: 555246 - DNA, 20 bp, Artificial
  CRISPR gRNA sequence
caggtaacataatgtccaca

SEQ ID NO: 555247 - DNA, 20 bp, Artificial
  CRISPR gRNA sequence
tgaaagaaagatcatctagt

SEQ ID NO: 555248 - DNA, 20 bp, Artificial
  CRISPR gRNA sequence
gttgaactcagaacaatgtt

SEQ ID NO: 555249 - DNA, 20 bp, Artificial
  CRISPR gRNA sequence
aactcagaacaatgtttgtt

SEQ ID NO: 555250 - DNA, 20 bp, Artificial
  CRISPR gRNA sequence
agaacaatgtttgttctaca

SEQ ID NO: 555251 - DNA, 20 bp, Artificial
  CRISPR gRNA sequence
gttctacataacttcaggtc

SEQ ID NO: 555252 - DNA, 20 bp, Artificial
  CRISPR gRNA sequence
ttctacataacttcaggtcg

SEQ ID NO: 555253 - DNA, 20 bp, Artificial
  CRISPR gRNA sequence
tacataacttcaggtcggaa

SEQ ID NO: 555254 - DNA, 20 bp, Artificial
  CRISPR gRNA sequence
cataacttcaggtcggaact

SEQ ID NO: 555255 - DNA, 20 bp, Artificial
  CRISPR gRNA sequence
caggtcggaactgaacaatg

SEQ ID NO: 555256 - DNA, 20 bp, Artificial
  CRISPR gRNA sequence
aggtcggaactgaacaatgt

SEQ ID NO: 555257 - DNA, 20 bp, Artificial
  CRISPR gRNA sequence
aacaatgtttcttttatgtt

SEQ ID NO: 555258 - DNA, 20 bp, Artificial
  CRISPR gRNA sequence
cttttatgttcttggtccat

SEQ ID NO: 555259 - DNA, 20 bp, Artificial
  CRISPR gRNA sequence
ttttatgttcttggtccata

SEQ ID NO: 555260 - DNA, 20 bp, Artificial
  CRISPR gRNA sequence
ttatgttcttggtccataaa

SEQ ID NO: 555261 - DNA, 20 bp, Artificial
  CRISPR gRNA sequence
tatgttcttggtccataaat

SEQ ID NO: 555262 - DNA, 20 bp, Artificial
  CRISPR gRNA sequence
atgttcttggtccataaatg

SEQ ID NO: 555263 - DNA, 20 bp, Artificial
  CRISPR gRNA sequence
tgttcttggtccataaatgt

SEQ ID NO: 555264 - DNA, 20 bp, Artificial
  CRISPR gRNA sequence
ttggtccataaatgtgtaca

SEQ ID NO: 555265 - DNA, 20 bp, Artificial
  CRISPR gRNA sequence
ggtccataaatgtgtacaac

SEQ ID NO: 555266 - DNA, 20 bp, Artificial
  CRISPR gRNA sequence
gtccataaatgtgtacaaca

SEQ ID NO: 555267 - DNA, 20 bp, Artificial
  CRISPR gRNA sequence
gaaactggtactctagagaa

SEQ ID NO: 555268 - DNA, 20 bp, Artificial
  CRISPR gRNA sequence
gtactctagagaatatcctc

SEQ ID NO: 555269 - DNA, 20 bp, Artificial
  CRISPR gRNA sequence
tagagaatatcctcttgcct

SEQ ID NO: 555270 - DNA, 20 bp, Artificial
  CRISPR gRNA sequence
gagaatatcctcttgcctac

SEQ ID NO: 555271 - DNA, 20 bp, Artificial
  CRISPR gRNA sequence
ttgcctaccccttcaaaaaa

SEQ ID NO: 555272 - DNA, 20 bp, Artificial
  CRISPR gRNA sequence
gcctaccccttcaaaaaatg

SEQ ID NO: 555273 - DNA, 20 bp, Artificial
  CRISPR gRNA sequence
cctaccccttcaaaaaatgt

SEQ ID NO: 555274 - DNA, 20 bp, Artificial
  CRISPR gRNA sequence
ccccttcaaaaaatgtgccc

SEQ ID NO: 555275 - DNA, 20 bp, Artificial
  CRISPR gRNA sequence
caaaaaatgtgccctttccc

SEQ ID NO: 555276 - DNA, 20 bp, Artificial
  CRISPR gRNA sequence
aaaaaatgtgccctttccct

SEQ ID NO: 555277 - DNA, 20 bp, Artificial
  CRISPR gRNA sequence
tccctaggctcccatttaga

SEQ ID NO: 555278 - DNA, 20 bp, Artificial
  CRISPR gRNA sequence
ccctaggctcccatttagag

SEQ ID NO: 555279 - DNA, 20 bp, Artificial
  CRISPR gRNA sequence
cctaggctcccatttagagt

SEQ ID NO: 555280 - DNA, 20 bp, Artificial
  CRISPR gRNA sequence
ggctcccatttagagttctg

SEQ ID NO: 555281 - DNA, 20 bp, Artificial
  CRISPR gRNA sequence
ccatttagagttctgtgtca

SEQ ID NO: 555282 - DNA, 20 bp, Artificial
  CRISPR gRNA sequence
agagttctgtgtcaatgtgg

SEQ ID NO: 555283 - DNA, 20 bp, Artificial
  CRISPR gRNA sequence
gagttctgtgtcaatgtgga

SEQ ID NO: 555284 - DNA, 20 bp, Artificial
  CRISPR gRNA sequence
tgtgtcaatgtggagggtgt

SEQ ID NO: 555285 - DNA, 20 bp, Artificial
  CRISPR gRNA sequence
tgtcaatgtggagggtgtta

SEQ ID NO: 555286 - DNA, 20 bp, Artificial
  CRISPR gRNA sequence
caatcatcctacttcttccc

SEQ ID NO: 555287 - DNA, 20 bp, Artificial
  CRISPR gRNA sequence
cttcttcccagcagttatct

SEQ ID NO: 555288 - DNA, 20 bp, Artificial
  CRISPR gRNA sequence
cttcccagcagttatctaaa

SEQ ID NO: 555289 - DNA, 20 bp, Artificial
  CRISPR gRNA sequence
ttcccagcagttatctaaaa

SEQ ID NO: 555290 - DNA, 20 bp, Artificial
  CRISPR gRNA sequence
cccagcagttatctaaaaga

SEQ ID NO: 555291 - DNA, 20 bp, Artificial
  CRISPR gRNA sequence
ccagcagttatctaaaagag

SEQ ID NO: 555292 - DNA, 20 bp, Artificial
  CRISPR gRNA sequence
tctaaaagagaatggtgaag

SEQ ID NO: 555293 - DNA, 20 bp, Artificial
  CRISPR gRNA sequence
aaagagaatggtgaagtgca

SEQ ID NO: 555294 - DNA, 20 bp, Artificial
  CRISPR gRNA sequence
ggtttctttacctggaaata

SEQ ID NO: 555295 - DNA, 20 bp, Artificial
  CRISPR gRNA sequence
ctttacctggaaatagcctt

SEQ ID NO: 555296 - DNA, 20 bp, Artificial
  CRISPR gRNA sequence
tttacctggaaatagccttt

SEQ ID NO: 555297 - DNA, 20 bp, Artificial
  CRISPR gRNA sequence
tacctggaaatagcctttga

SEQ ID NO: 555298 - DNA, 20 bp, Artificial
  CRISPR gRNA sequence
acctggaaatagcctttgac

SEQ ID NO: 555299 - DNA, 20 bp, Artificial
  CRISPR gRNA sequence
cctggaaatagcctttgact

SEQ ID NO: 555300 - DNA, 20 bp, Artificial
  CRISPR gRNA sequence
gaaatagcctttgactctca

SEQ ID NO: 555301 - DNA, 20 bp, Artificial
  CRISPR gRNA sequence
tgactctcaaaggtactcag

SEQ ID NO: 555302 - DNA, 20 bp, Artificial
  CRISPR gRNA sequence
gactctcaaaggtactcaga

SEQ ID NO: 555303 - DNA, 20 bp, Artificial
  CRISPR gRNA sequence
actctcaaaggtactcagat

SEQ ID NO: 555304 - DNA, 20 bp, Artificial
  CRISPR gRNA sequence
tcaaaggtactcagatttta

SEQ ID NO: 555305 - DNA, 20 bp, Artificial
  CRISPR gRNA sequence
aaaggtactcagattttatt

SEQ ID NO: 555306 - DNA, 20 bp, Artificial
  CRISPR gRNA sequence
agattttattttcctctttc

SEQ ID NO: 555307 - DNA, 20 bp, Artificial
  CRISPR gRNA sequence
tattttcctctttcacagcc

SEQ ID NO: 555308 - DNA, 20 bp, Artificial
  CRISPR gRNA sequence
attttcctctttcacagcca

SEQ ID NO: 555309 - DNA, 20 bp, Artificial
  CRISPR gRNA sequence
ttttcctctttcacagccaa

SEQ ID NO: 555310 - DNA, 20 bp, Artificial
  CRISPR gRNA sequence
tcctctttcacagccaaata

SEQ ID NO: 555311 - DNA, 20 bp, Artificial
  CRISPR gRNA sequence
cctctttcacagccaaatat

SEQ ID NO: 555312 - DNA, 20 bp, Artificial
  CRISPR gRNA sequence
ctctttcacagccaaatata

SEQ ID NO: 555313 - DNA, 20 bp, Artificial
  CRISPR gRNA sequence
tttcacagccaaatatataa

SEQ ID NO: 555314 - DNA, 20 bp, Artificial
  CRISPR gRNA sequence
tcacagccaaatatataact

SEQ ID NO: 555315 - DNA, 20 bp, Artificial
  CRISPR gRNA sequence
cacagccaaatatataactg

SEQ ID NO: 555316 - DNA, 20 bp, Artificial
  CRISPR gRNA sequence
acagccaaatatataactgg

SEQ ID NO: 555317 - DNA, 20 bp, Artificial
  CRISPR gRNA sequence
gcctattggactacccctct

SEQ ID NO: 555318 - DNA, 20 bp, Artificial
  CRISPR gRNA sequence
ttggactacccctcttctta

SEQ ID NO: 555319 - DNA, 20 bp, Artificial
  CRISPR gRNA sequence
gactacccctcttcttactt

SEQ ID NO: 555320 - DNA, 20 bp, Artificial
  CRISPR gRNA sequence
cccctcttcttacttaaagc

SEQ ID NO: 555321 - DNA, 20 bp, Artificial
  CRISPR gRNA sequence
ttcttacttaaagcccagga

SEQ ID NO: 555322 - DNA, 20 bp, Artificial
  CRISPR gRNA sequence
cttacttaaagcccaggaat

SEQ ID NO: 555323 - DNA, 20 bp, Artificial
  CRISPR gRNA sequence
ttacttaaagcccaggaatc

SEQ ID NO: 555324 - DNA, 20 bp, Artificial
  CRISPR gRNA sequence
acttaaagcccaggaatctg

SEQ ID NO: 555325 - DNA, 20 bp, Artificial
  CRISPR gRNA sequence
cttaaagcccaggaatctgg

SEQ ID NO: 555326 - DNA, 20 bp, Artificial
  CRISPR gRNA sequence
aaagcccaggaatctggttc

SEQ ID NO: 555327 - DNA, 20 bp, Artificial
  CRISPR gRNA sequence
aagcccaggaatctggttcc

SEQ ID NO: 555328 - DNA, 20 bp, Artificial
  CRISPR gRNA sequence
gttcctaccctcatctattc

SEQ ID NO: 555329 - DNA, 20 bp, Artificial
  CRISPR gRNA sequence
ctaccctcatctattcacaa

SEQ ID NO: 555330 - DNA, 20 bp, Artificial
  CRISPR gRNA sequence
ccctcatctattcacaaggt

SEQ ID NO: 555331 - DNA, 20 bp, Artificial
  CRISPR gRNA sequence
atctattcacaaggtctgtc

SEQ ID NO: 555332 - DNA, 20 bp, Artificial
  CRISPR gRNA sequence
ttcacaaggtctgtcaacaa

SEQ ID NO: 555333 - DNA, 20 bp, Artificial
  CRISPR gRNA sequence
acaaggtctgtcaacaatga

SEQ ID NO: 555334 - DNA, 20 bp, Artificial
  CRISPR gRNA sequence
tcaacaatgacctcctaagt

SEQ ID NO: 555335 - DNA, 20 bp, Artificial
  CRISPR gRNA sequence
ctaagtgccaaatccacaac

SEQ ID NO: 555336 - DNA, 20 bp, Artificial
  CRISPR gRNA sequence
agtgccaaatccacaacctc

SEQ ID NO: 555337 - DNA, 20 bp, Artificial
  CRISPR gRNA sequence
ttctacattgtcctccttaa

SEQ ID NO: 555338 - DNA, 20 bp, Artificial
  CRISPR gRNA sequence
ctacattgtcctccttaaac

SEQ ID NO: 555339 - DNA, 20 bp, Artificial
  CRISPR gRNA sequence
tacattgtcctccttaaacc

SEQ ID NO: 555340 - DNA, 20 bp, Artificial
  CRISPR gRNA sequence
cattgtcctccttaaaccat

SEQ ID NO: 555341 - DNA, 20 bp, Artificial
  CRISPR gRNA sequence
tcctccttaaaccattggct

SEQ ID NO: 555342 - DNA, 20 bp, Artificial
  CRISPR gRNA sequence
cttaaaccattggctgtata

SEQ ID NO: 555343 - DNA, 20 bp, Artificial
  CRISPR gRNA sequence
aaaccattggctgtatataa

SEQ ID NO: 555344 - DNA, 20 bp, Artificial
  CRISPR gRNA sequence
aaccattggctgtatataat

SEQ ID NO: 555345 - DNA, 20 bp, Artificial
  CRISPR gRNA sequence
gctgtatataatgttatacc

SEQ ID NO: 555346 - DNA, 20 bp, Artificial
  CRISPR gRNA sequence
tatataatgttataccaaat

SEQ ID NO: 555347 - DNA, 20 bp, Artificial
  CRISPR gRNA sequence
taccaaatgtcctctcttga

SEQ ID NO: 555348 - DNA, 20 bp, Artificial
  CRISPR gRNA sequence
tcttgaaactcttcctgtat

SEQ ID NO: 555349 - DNA, 20 bp, Artificial
  CRISPR gRNA sequence
ttgaaactcttcctgtatcc

SEQ ID NO: 555350 - DNA, 20 bp, Artificial
  CRISPR gRNA sequence
gaaactcttcctgtatcctg

SEQ ID NO: 555351 - DNA, 20 bp, Artificial
  CRISPR gRNA sequence
aaactcttcctgtatcctga

SEQ ID NO: 555352 - DNA, 20 bp, Artificial
  CRISPR gRNA sequence
ttcctgtatcctgaataaca

SEQ ID NO: 555353 - DNA, 20 bp, Artificial
  CRISPR gRNA sequence
cctgtatcctgaataacaac

SEQ ID NO: 555354 - DNA, 20 bp, Artificial
  CRISPR gRNA sequence
ctgtatcctgaataacaact

SEQ ID NO: 555355 - DNA, 20 bp, Artificial
  CRISPR gRNA sequence
tatcctgaataacaactagc

SEQ ID NO: 555356 - DNA, 20 bp, Artificial
  CRISPR gRNA sequence
aataacaactagcagtttta

SEQ ID NO: 555357 - DNA, 20 bp, Artificial
  CRISPR gRNA sequence
gcagttttatagtgactaac

SEQ ID NO: 555358 - DNA, 20 bp, Artificial
  CRISPR gRNA sequence
tatagtgactaaccatcaat

SEQ ID NO: 555359 - DNA, 20 bp, Artificial
  CRISPR gRNA sequence
atagtgactaaccatcaata

SEQ ID NO: 555360 - DNA, 20 bp, Artificial
  CRISPR gRNA sequence
tagtgactaaccatcaatac

SEQ ID NO: 555361 - DNA, 20 bp, Artificial
  CRISPR gRNA sequence
accatcaatactctttccca

SEQ ID NO: 555362 - DNA, 20 bp, Artificial
  CRISPR gRNA sequence
tttcccacatgctattttat

SEQ ID NO: 555363 - DNA, 20 bp, Artificial
  CRISPR gRNA sequence
tcccacatgctattttattt

SEQ ID NO: 555364 - DNA, 20 bp, Artificial
  CRISPR gRNA sequence
cccacatgctattttattta

SEQ ID NO: 555365 - DNA, 20 bp, Artificial
  CRISPR gRNA sequence
ccacatgctattttatttaa

SEQ ID NO: 555366 - DNA, 20 bp, Artificial
  CRISPR gRNA sequence
ttttatttaatttcctcagc

SEQ ID NO: 555367 - DNA, 20 bp, Artificial
  CRISPR gRNA sequence
tatttaatttcctcagccct

SEQ ID NO: 555368 - DNA, 20 bp, Artificial
  CRISPR gRNA sequence
atttaatttcctcagccctt

SEQ ID NO: 555369 - DNA, 20 bp, Artificial
  CRISPR gRNA sequence
tttaatttcctcagcccttg

SEQ ID NO: 555370 - DNA, 20 bp, Artificial
  CRISPR gRNA sequence
aatttcctcagcccttgtaa

SEQ ID NO: 555371 - DNA, 20 bp, Artificial
  CRISPR gRNA sequence
atttcctcagcccttgtaaa

SEQ ID NO: 555372 - DNA, 20 bp, Artificial
  CRISPR gRNA sequence
cctcagcccttgtaaagtaa

SEQ ID NO: 555373 - DNA, 20 bp, Artificial
  CRISPR gRNA sequence
ctcagcccttgtaaagtaag

SEQ ID NO: 555374 - DNA, 20 bp, Artificial
  CRISPR gRNA sequence
agcccttgtaaagtaagtat

SEQ ID NO: 555375 - DNA, 20 bp, Artificial
  CRISPR gRNA sequence
gtaaagtaagtattattatc

SEQ ID NO: 555376 - DNA, 20 bp, Artificial
  CRISPR gRNA sequence
taaagtaagtattattatcc

SEQ ID NO: 555377 - DNA, 20 bp, Artificial
  CRISPR gRNA sequence
ttatcccccacattcacact

SEQ ID NO: 555378 - DNA, 20 bp, Artificial
  CRISPR gRNA sequence
tcccccacattcacactgcc

SEQ ID NO: 555379 - DNA, 20 bp, Artificial
  CRISPR gRNA sequence
acactgccagtaagcaatga

SEQ ID NO: 555380 - DNA, 20 bp, Artificial
  CRISPR gRNA sequence
ccagtaagcaatgaaatcag

SEQ ID NO: 555381 - DNA, 20 bp, Artificial
  CRISPR gRNA sequence
ggacctaggttttcttgctc

SEQ ID NO: 555382 - DNA, 20 bp, Artificial
  CRISPR gRNA sequence
ggttttcttgctcccaatcc

SEQ ID NO: 555383 - DNA, 20 bp, Artificial
  CRISPR gRNA sequence
tcttgctcccaatcccatgt

SEQ ID NO: 555384 - DNA, 20 bp, Artificial
  CRISPR gRNA sequence
cttgctcccaatcccatgtt

SEQ ID NO: 555385 - DNA, 20 bp, Artificial
  CRISPR gRNA sequence
ttgctcccaatcccatgttc

SEQ ID NO: 555386 - DNA, 20 bp, Artificial
  CRISPR gRNA sequence
gctcccaatcccatgttctc

SEQ ID NO: 555387 - DNA, 20 bp, Artificial
  CRISPR gRNA sequence
ctcccaatcccatgttctct

SEQ ID NO: 555388 - DNA, 20 bp, Artificial
  CRISPR gRNA sequence
ccaatcccatgttctcttct

SEQ ID NO: 555389 - DNA, 20 bp, Artificial
  CRISPR gRNA sequence
tcttctatccagaattttct

SEQ ID NO: 555390 - DNA, 20 bp, Artificial
  CRISPR gRNA sequence
ttctatccagaattttctcc

SEQ ID NO: 555391 - DNA, 20 bp, Artificial
  CRISPR gRNA sequence
ctatccagaattttctcctg

SEQ ID NO: 555392 - DNA, 20 bp, Artificial
  CRISPR gRNA sequence
tatccagaattttctcctgc

SEQ ID NO: 555393 - DNA, 20 bp, Artificial
  CRISPR gRNA sequence
tccagaattttctcctgccc

SEQ ID NO: 555394 - DNA, 20 bp, Artificial
  CRISPR gRNA sequence
tctcctgccctcaacttctc

SEQ ID NO: 555395 - DNA, 20 bp, Artificial
  CRISPR gRNA sequence
ctcctgccctcaacttctca

SEQ ID NO: 555396 - DNA, 20 bp, Artificial
  CRISPR gRNA sequence
tcctgccctcaacttctcaa

SEQ ID NO: 555397 - DNA, 20 bp, Artificial
  CRISPR gRNA sequence
ctgccctcaacttctcaatt

SEQ ID NO: 555398 - DNA, 20 bp, Artificial
  CRISPR gRNA sequence
ccctcaacttctcaattttc

SEQ ID NO: 555399 - DNA, 20 bp, Artificial
  CRISPR gRNA sequence
aacttctcaattttctaatc

SEQ ID NO: 555400 - DNA, 20 bp, Artificial
  CRISPR gRNA sequence
ctcaattttctaatctgtat

SEQ ID NO: 555401 - DNA, 20 bp, Artificial
  CRISPR gRNA sequence
tcaattttctaatctgtata

SEQ ID NO: 555402 - DNA, 20 bp, Artificial
  CRISPR gRNA sequence
aattttctaatctgtataag

SEQ ID NO: 555403 - DNA, 20 bp, Artificial
  CRISPR gRNA sequence
tctaatctgtataagtctgt

SEQ ID NO: 555404 - DNA, 20 bp, Artificial
  CRISPR gRNA sequence
ctaatctgtataagtctgtc

SEQ ID NO: 555405 - DNA, 20 bp, Artificial
  CRISPR gRNA sequence
taatctgtataagtctgtct

SEQ ID NO: 555406 - DNA, 20 bp, Artificial
  CRISPR gRNA sequence
atctgtataagtctgtctat

SEQ ID NO: 555407 - DNA, 20 bp, Artificial
  CRISPR gRNA sequence
tataagtctgtctatattca

SEQ ID NO: 555408 - DNA, 20 bp, Artificial
  CRISPR gRNA sequence
tctatattcacgtgctgcca

SEQ ID NO: 555409 - DNA, 20 bp, Artificial
  CRISPR gRNA sequence
tattcacgtgctgccataaa

SEQ ID NO: 555410 - DNA, 20 bp, Artificial
  CRISPR gRNA sequence
acgtgctgccataaaccagc

SEQ ID NO: 555411 - DNA, 20 bp, Artificial
  CRISPR gRNA sequence
ccataaaccagctttctgac

SEQ ID NO: 555412 - DNA, 20 bp, Artificial
  CRISPR gRNA sequence
tctgaccttgagatctctga

SEQ ID NO: 555413 - DNA, 20 bp, Artificial
  CRISPR gRNA sequence
ctgaccttgagatctctgaa

SEQ ID NO: 555414 - DNA, 20 bp, Artificial
  CRISPR gRNA sequence
tgaccttgagatctctgaac

SEQ ID NO: 555415 - DNA, 20 bp, Artificial
  CRISPR gRNA sequence
accttgagatctctgaacat

SEQ ID NO: 555416 - DNA, 20 bp, Artificial
  CRISPR gRNA sequence
gagatctctgaacatctgta

SEQ ID NO: 555417 - DNA, 20 bp, Artificial
  CRISPR gRNA sequence
agatctctgaacatctgtag

SEQ ID NO: 555418 - DNA, 20 bp, Artificial
  CRISPR gRNA sequence
tgaacatctgtagcatgggc

SEQ ID NO: 555419 - DNA, 20 bp, Artificial
  CRISPR gRNA sequence
aacatctgtagcatgggcat

SEQ ID NO: 555420 - DNA, 20 bp, Artificial
  CRISPR gRNA sequence
tagcatgggcataaaacctc

SEQ ID NO: 555421 - DNA, 20 bp, Artificial
  CRISPR gRNA sequence
catgctatctactctgaccg

SEQ ID NO: 555422 - DNA, 20 bp, Artificial
  CRISPR gRNA sequence
tctactctgaccgcagataa

SEQ ID NO: 555423 - DNA, 20 bp, Artificial
  CRISPR gRNA sequence
ctctgaccgcagataaggag

SEQ ID NO: 555424 - DNA, 20 bp, Artificial
  CRISPR gRNA sequence
tgaccgcagataaggagata

SEQ ID NO: 555425 - DNA, 20 bp, Artificial
  CRISPR gRNA sequence
accgcagataaggagataag

SEQ ID NO: 555426 - DNA, 20 bp, Artificial
  CRISPR gRNA sequence
ctcactagctttctttccat

SEQ ID NO: 555427 - DNA, 20 bp, Artificial
  CRISPR gRNA sequence
actagctttctttccatctc

SEQ ID NO: 555428 - DNA, 20 bp, Artificial
  CRISPR gRNA sequence
gctttctttccatctcccaa

SEQ ID NO: 555429 - DNA, 20 bp, Artificial
  CRISPR gRNA sequence
tctttccatctcccaatgcc

SEQ ID NO: 555430 - DNA, 20 bp, Artificial
  CRISPR gRNA sequence
ctttccatctcccaatgcct

SEQ ID NO: 555431 - DNA, 20 bp, Artificial
  CRISPR gRNA sequence
tttccatctcccaatgcctt

SEQ ID NO: 555432 - DNA, 20 bp, Artificial
  CRISPR gRNA sequence
tccatctcccaatgccttgg

SEQ ID NO: 555433 - DNA, 20 bp, Artificial
  CRISPR gRNA sequence
ccatctcccaatgccttgga

SEQ ID NO: 555434 - DNA, 20 bp, Artificial
  CRISPR gRNA sequence
catctcccaatgccttggag

SEQ ID NO: 555435 - DNA, 20 bp, Artificial
  CRISPR gRNA sequence
ccaatgccttggagctgcaa

SEQ ID NO: 555436 - DNA, 20 bp, Artificial
  CRISPR gRNA sequence
ggagctgcaattttcaaacg

SEQ ID NO: 555437 - DNA, 20 bp, Artificial
  CRISPR gRNA sequence
gagctgcaattttcaaacgg

SEQ ID NO: 555438 - DNA, 20 bp, Artificial
  CRISPR gRNA sequence
caattttcaaacggttaacc

SEQ ID NO: 555439 - DNA, 20 bp, Artificial
  CRISPR gRNA sequence
tcaaacggttaaccaatgga

SEQ ID NO: 555440 - DNA, 20 bp, Artificial
  CRISPR gRNA sequence
caaacggttaaccaatggaa

SEQ ID NO: 555441 - DNA, 20 bp, Artificial
  CRISPR gRNA sequence
aaacggttaaccaatggaag

SEQ ID NO: 555442 - DNA, 20 bp, Artificial
  CRISPR gRNA sequence
accaatggaagtaaattcca

SEQ ID NO: 555443 - DNA, 20 bp, Artificial
  CRISPR gRNA sequence
caaattccagattataattc

SEQ ID NO: 555444 - DNA, 20 bp, Artificial
  CRISPR gRNA sequence
cagattataattctccatct

SEQ ID NO: 555445 - DNA, 20 bp, Artificial
  CRISPR gRNA sequence
taattctccatctctgagtc

SEQ ID NO: 555446 - DNA, 20 bp, Artificial
  CRISPR gRNA sequence
tccatctctgagtcatcttc

SEQ ID NO: 555447 - DNA, 20 bp, Artificial
  CRISPR gRNA sequence
catctctgagtcatcttctt

SEQ ID NO: 555448 - DNA, 20 bp, Artificial
  CRISPR gRNA sequence
tgagtcatcttcttactttt

SEQ ID NO: 555449 - DNA, 20 bp, Artificial
  CRISPR gRNA sequence
agtcatcttcttacttttac

SEQ ID NO: 555450 - DNA, 20 bp, Artificial
  CRISPR gRNA sequence
cttacttttacttcccagta

SEQ ID NO: 555451 - DNA, 20 bp, Artificial
  CRISPR gRNA sequence
ttacttttacttcccagtac

SEQ ID NO: 555452 - DNA, 20 bp, Artificial
  CRISPR gRNA sequence
acttttacttcccagtacag

SEQ ID NO: 555453 - DNA, 20 bp, Artificial
  CRISPR gRNA sequence
cttttacttcccagtacagt

SEQ ID NO: 555454 - DNA, 20 bp, Artificial
  CRISPR gRNA sequence
ttacttcccagtacagtggg

SEQ ID NO: 555455 - DNA, 20 bp, Artificial
  CRISPR gRNA sequence
tacttcccagtacagtgggg

SEQ ID NO: 555456 - DNA, 20 bp, Artificial
  CRISPR gRNA sequence
acttcccagtacagtgggga

SEQ ID NO: 555457 - DNA, 20 bp, Artificial
  CRISPR gRNA sequence
cttcccagtacagtggggaa

SEQ ID NO: 555458 - DNA, 20 bp, Artificial
  CRISPR gRNA sequence
cccagtacagtggggaagac

SEQ ID NO: 555459 - DNA, 20 bp, Artificial
  CRISPR gRNA sequence
ccagtacagtggggaagaca

SEQ ID NO: 555460 - DNA, 20 bp, Artificial
  CRISPR gRNA sequence
tgagttcagatggagttgga

SEQ ID NO: 555461 - DNA, 20 bp, Artificial
  CRISPR gRNA sequence
gagttcagatggagttggat

SEQ ID NO: 555462 - DNA, 20 bp, Artificial
  CRISPR gRNA sequence
agttcagatggagttggatg

SEQ ID NO: 555463 - DNA, 20 bp, Artificial
  CRISPR gRNA sequence
agatggagttggatgtcaaa

SEQ ID NO: 555464 - DNA, 20 bp, Artificial
  CRISPR gRNA sequence
gatgtcaaatcctggctttg

SEQ ID NO: 555465 - DNA, 20 bp, Artificial
  CRISPR gRNA sequence
gctttgctcttaataaatgt

SEQ ID NO: 555466 - DNA, 20 bp, Artificial
  CRISPR gRNA sequence
tgctcttaataaatgtgtat

SEQ ID NO: 555467 - DNA, 20 bp, Artificial
  CRISPR gRNA sequence
gctcttaataaatgtgtata

SEQ ID NO: 555468 - DNA, 20 bp, Artificial
  CRISPR gRNA sequence
ctcttaataaatgtgtatat

SEQ ID NO: 555469 - DNA, 20 bp, Artificial
  CRISPR gRNA sequence
ttaataaatgtgtatatttg

SEQ ID NO: 555470 - DNA, 20 bp, Artificial
  CRISPR gRNA sequence
aataaatgtgtatatttggt

SEQ ID NO: 555471 - DNA, 20 bp, Artificial
  CRISPR gRNA sequence
ataaatgtgtatatttggtc

SEQ ID NO: 555472 - DNA, 20 bp, Artificial
  CRISPR gRNA sequence
ggtcaagttatttaacctca

SEQ ID NO: 555473 - DNA, 20 bp, Artificial
  CRISPR gRNA sequence
gtcaagttatttaacctcac

SEQ ID NO: 555474 - DNA, 20 bp, Artificial
  CRISPR gRNA sequence
tttaacctcactgtgcctca

SEQ ID NO: 555475 - DNA, 20 bp, Artificial
  CRISPR gRNA sequence
aacctcactgtgcctcagat

SEQ ID NO: 555476 - DNA, 20 bp, Artificial
  CRISPR gRNA sequence
acctcactgtgcctcagatt

SEQ ID NO: 555477 - DNA, 20 bp, Artificial
  CRISPR gRNA sequence
actgtgcctcagattcctcc

SEQ ID NO: 555478 - DNA, 20 bp, Artificial
  CRISPR gRNA sequence
tgcctcagattcctccttta

SEQ ID NO: 555479 - DNA, 20 bp, Artificial
  CRISPR gRNA sequence
agattcctcctttataaata

SEQ ID NO: 555480 - DNA, 20 bp, Artificial
  CRISPR gRNA sequence
ctcctttataaatacccaca

SEQ ID NO: 555481 - DNA, 20 bp, Artificial
  CRISPR gRNA sequence
ctttataaatacccacacca

SEQ ID NO: 555482 - DNA, 20 bp, Artificial
  CRISPR gRNA sequence
tataaatacccacaccactg

SEQ ID NO: 555483 - DNA, 20 bp, Artificial
  CRISPR gRNA sequence
ataaatacccacaccactgg

SEQ ID NO: 555484 - DNA, 20 bp, Artificial
  CRISPR gRNA sequence
taaatacccacaccactggg

SEQ ID NO: 555485 - DNA, 20 bp, Artificial
  CRISPR gRNA sequence
ggttgttgtgtggattaaat

SEQ ID NO: 555486 - DNA, 20 bp, Artificial
  CRISPR gRNA sequence
ttgtgtggattaaatgtgac

SEQ ID NO: 555487 - DNA, 20 bp, Artificial
  CRISPR gRNA sequence
tgtggattaaatgtgacaca

SEQ ID NO: 555488 - DNA, 20 bp, Artificial
  CRISPR gRNA sequence
aatgtgacacatttatgtaa

SEQ ID NO: 555489 - DNA, 20 bp, Artificial
  CRISPR gRNA sequence
atgtaaatcatttacaggag

SEQ ID NO: 555490 - DNA, 20 bp, Artificial
  CRISPR gRNA sequence
tgtaaatcatttacaggagt

SEQ ID NO: 555491 - DNA, 20 bp, Artificial
  CRISPR gRNA sequence
acaggagtttgttgtggagc

SEQ ID NO: 555492 - DNA, 20 bp, Artificial
  CRISPR gRNA sequence
caggagtttgttgtggagca

SEQ ID NO: 555493 - DNA, 20 bp, Artificial
  CRISPR gRNA sequence
gttgtggagcaggccttcag

SEQ ID NO: 555494 - DNA, 20 bp, Artificial
  CRISPR gRNA sequence
ttgtggagcaggccttcagt

SEQ ID NO: 555495 - DNA, 20 bp, Artificial
  CRISPR gRNA sequence
tggagcaggccttcagtaag

SEQ ID NO: 555496 - DNA, 20 bp, Artificial
  CRISPR gRNA sequence
cagtaagtattagttcattc

SEQ ID NO: 555497 - DNA, 20 bp, Artificial
  CRISPR gRNA sequence
agtaagtattagttcattcc

SEQ ID NO: 555498 - DNA, 20 bp, Artificial
  CRISPR gRNA sequence
gttcattcccccagtacaat

SEQ ID NO: 555499 - DNA, 20 bp, Artificial
  CRISPR gRNA sequence
attcccccagtacaatacga

SEQ ID NO: 555500 - DNA, 20 bp, Artificial
  CRISPR gRNA sequence
ccccagtacaatacgagttg

SEQ ID NO: 555501 - DNA, 20 bp, Artificial
  CRISPR gRNA sequence
gacaagaactctgtcctcaa

SEQ ID NO: 555502 - DNA, 20 bp, Artificial
  CRISPR gRNA sequence
tgtcctcaatcttaactgtc

SEQ ID NO: 555503 - DNA, 20 bp, Artificial
  CRISPR gRNA sequence
tcctcaatcttaactgtctc

SEQ ID NO: 555504 - DNA, 20 bp, Artificial
  CRISPR gRNA sequence
aatcttaactgtctctaaaa

SEQ ID NO: 555505 - DNA, 20 bp, Artificial
  CRISPR gRNA sequence
aactgtctctaaaattctcc

SEQ ID NO: 555506 - DNA, 20 bp, Artificial
  CRISPR gRNA sequence
actgtctctaaaattctcct

SEQ ID NO: 555507 - DNA, 20 bp, Artificial
  CRISPR gRNA sequence
tctctaaaattctcctttag

SEQ ID NO: 555508 - DNA, 20 bp, Artificial
  CRISPR gRNA sequence
taaaattctcctttagattg

SEQ ID NO: 555509 - DNA, 20 bp, Artificial
  CRISPR gRNA sequence
aaattctcctttagattgtg

SEQ ID NO: 555510 - DNA, 20 bp, Artificial
  CRISPR gRNA sequence
tcctttagattgtgtttaac

SEQ ID NO: 555511 - DNA, 20 bp, Artificial
  CRISPR gRNA sequence
ctttagattgtgtttaacta

SEQ ID NO: 555512 - DNA, 20 bp, Artificial
  CRISPR gRNA sequence
tagattgtgtttaactagtt

SEQ ID NO: 555513 - DNA, 20 bp, Artificial
  CRISPR gRNA sequence
agattgtgtttaactagtta

SEQ ID NO: 555514 - DNA, 20 bp, Artificial
  CRISPR gRNA sequence
gattgtgtttaactagttag

SEQ ID NO: 555515 - DNA, 20 bp, Artificial
  CRISPR gRNA sequence
tgtttaactagttagtaacc

SEQ ID NO: 555516 - DNA, 20 bp, Artificial
  CRISPR gRNA sequence
aactagttagtaaccccatc

SEQ ID NO: 555517 - DNA, 20 bp, Artificial
  CRISPR gRNA sequence
actagttagtaaccccatcg

SEQ ID NO: 555518 - DNA, 20 bp, Artificial
  CRISPR gRNA sequence
gttagtaaccccatcgcccc

SEQ ID NO: 555519 - DNA, 20 bp, Artificial
  CRISPR gRNA sequence
gtaaccccatcgccccattt

SEQ ID NO: 555520 - DNA, 20 bp, Artificial
  CRISPR gRNA sequence
ctgggttgcagtgacggtat

SEQ ID NO: 555521 - DNA, 20 bp, Artificial
  CRISPR gRNA sequence
tgggttgcagtgacggtatg

SEQ ID NO: 555522 - DNA, 20 bp, Artificial
  CRISPR gRNA sequence
ggttgcagtgacggtatgac

SEQ ID NO: 555523 - DNA, 20 bp, Artificial
  CRISPR gRNA sequence
cagtgacggtatgacagtag

SEQ ID NO: 555524 - DNA, 20 bp, Artificial
  CRISPR gRNA sequence
aaatgatgacaaaccacaaa

SEQ ID NO: 555525 - DNA, 20 bp, Artificial
  CRISPR gRNA sequence
ctagacaaaatgttacaaga

SEQ ID NO: 555526 - DNA, 20 bp, Artificial
  CRISPR gRNA sequence
gacaaaatgttacaagaaac

SEQ ID NO: 555527 - DNA, 20 bp, Artificial
  CRISPR gRNA sequence
caagaaacatgagataatga

SEQ ID NO: 555528 - DNA, 20 bp, Artificial
  CRISPR gRNA sequence
agttacatttgaccaatatc

SEQ ID NO: 555529 - DNA, 20 bp, Artificial
  CRISPR gRNA sequence
catttgaccaatatctacta

SEQ ID NO: 555530 - DNA, 20 bp, Artificial
  CRISPR gRNA sequence
gaccaatatctactatgtat

SEQ ID NO: 555531 - DNA, 20 bp, Artificial
  CRISPR gRNA sequence
accaatatctactatgtata

SEQ ID NO: 555532 - DNA, 20 bp, Artificial
  CRISPR gRNA sequence
ctatgtatatctatatagta

SEQ ID NO: 555533 - DNA, 20 bp, Artificial
  CRISPR gRNA sequence
tgtatatctatatagtatgg

SEQ ID NO: 555534 - DNA, 20 bp, Artificial
  CRISPR gRNA sequence
tatagtatgggtttctctag

SEQ ID NO: 555535 - DNA, 20 bp, Artificial
  CRISPR gRNA sequence
ctctagctcattcatatgaa

SEQ ID NO: 555536 - DNA, 20 bp, Artificial
  CRISPR gRNA sequence
tctagctcattcatatgaat

SEQ ID NO: 555537 - DNA, 20 bp, Artificial
  CRISPR gRNA sequence
tagctcattcatatgaataa

SEQ ID NO: 555538 - DNA, 20 bp, Artificial
  CRISPR gRNA sequence
gctcattcatatgaataaat

SEQ ID NO: 555539 - DNA, 20 bp, Artificial
  CRISPR gRNA sequence
attcatatgaataaatcaaa

SEQ ID NO: 555540 - DNA, 20 bp, Artificial
  CRISPR gRNA sequence
atatgaataaatcaaagaaa

SEQ ID NO: 555541 - DNA, 20 bp, Artificial
  CRISPR gRNA sequence
taaaatttgatttattttga

SEQ ID NO: 555542 - DNA, 20 bp, Artificial
  CRISPR gRNA sequence
aaaatttgatttattttgaa

SEQ ID NO: 555543 - DNA, 20 bp, Artificial
  CRISPR gRNA sequence
aaatttgatttattttgaaa

SEQ ID NO: 555544 - DNA, 20 bp, Artificial
  CRISPR gRNA sequence
gatttattttgaaacgtata

SEQ ID NO: 555545 - DNA, 20 bp, Artificial
  CRISPR gRNA sequence
atttattttgaaacgtatag

SEQ ID NO: 555546 - DNA, 20 bp, Artificial
  CRISPR gRNA sequence
attttgaaacgtatagagag

SEQ ID NO: 555547 - DNA, 20 bp, Artificial
  CRISPR gRNA sequence
ttttgaaacgtatagagagt

SEQ ID NO: 555548 - DNA, 20 bp, Artificial
  CRISPR gRNA sequence
tgaaacgtatagagagtcag

SEQ ID NO: 555549 - DNA, 20 bp, Artificial
  CRISPR gRNA sequence
gaaacgtatagagagtcagg

SEQ ID NO: 555550 - DNA, 20 bp, Artificial
  CRISPR gRNA sequence
aaacgtatagagagtcagga

SEQ ID NO: 555551 - DNA, 20 bp, Artificial
  CRISPR gRNA sequence
tggaattcaaagacctaaat

SEQ ID NO: 555552 - DNA, 20 bp, Artificial
  CRISPR gRNA sequence
gaattcaaagacctaaattt

SEQ ID NO: 555553 - DNA, 20 bp, Artificial
  CRISPR gRNA sequence
aaagacctaaattttaattc

SEQ ID NO: 555554 - DNA, 20 bp, Artificial
  CRISPR gRNA sequence
aattttaattctatctccaa

SEQ ID NO: 555555 - DNA, 20 bp, Artificial
  CRISPR gRNA sequence
taattctatctccaatactt

SEQ ID NO: 555556 - DNA, 20 bp, Artificial
  CRISPR gRNA sequence
aattctatctccaatactta

SEQ ID NO: 555557 - DNA, 20 bp, Artificial
  CRISPR gRNA sequence
attctatctccaatacttaa

SEQ ID NO: 555558 - DNA, 20 bp, Artificial
  CRISPR gRNA sequence
tatctccaatacttaagtga

SEQ ID NO: 555559 - DNA, 20 bp, Artificial
  CRISPR gRNA sequence
tctccaatacttaagtgacc

SEQ ID NO: 555560 - DNA, 20 bp, Artificial
  CRISPR gRNA sequence
caatacttaagtgaccctgg

SEQ ID NO: 555561 - DNA, 20 bp, Artificial
  CRISPR gRNA sequence
aagtgaccctgggcaagtca

SEQ ID NO: 555562 - DNA, 20 bp, Artificial
  CRISPR gRNA sequence
agtgaccctgggcaagtcac

SEQ ID NO: 555563 - DNA, 20 bp, Artificial
  CRISPR gRNA sequence
ggcaagtcaccccacctggt

SEQ ID NO: 555564 - DNA, 20 bp, Artificial
  CRISPR gRNA sequence
gttgaccctgtctcctcatt

SEQ ID NO: 555565 - DNA, 20 bp, Artificial
  CRISPR gRNA sequence
accctgtctcctcattcttt

SEQ ID NO: 555566 - DNA, 20 bp, Artificial
  CRISPR gRNA sequence
tctcctcattcttttttttt

SEQ ID NO: 555567 - DNA, 20 bp, Artificial
  CRISPR gRNA sequence
ctcattcttttttttttttt

SEQ ID NO: 555568 - DNA, 20 bp, Artificial
  CRISPR gRNA sequence
attcttttttttttttttga

SEQ ID NO: 555569 - DNA, 20 bp, Artificial
  CRISPR gRNA sequence
ttttttttttttttgagacg

SEQ ID NO: 555570 - DNA, 20 bp, Artificial
  CRISPR gRNA sequence
ttttttttttttgagacgga

SEQ ID NO: 555571 - DNA, 20 bp, Artificial
  CRISPR gRNA sequence
tttttttttttgagacggaa

SEQ ID NO: 555572 - DNA, 20 bp, Artificial
  CRISPR gRNA sequence
ttttttttttgagacggaat

SEQ ID NO: 555573 - DNA, 20 bp, Artificial
  CRISPR gRNA sequence
tttttttttgagacggaatc

SEQ ID NO: 555574 - DNA, 20 bp, Artificial
  CRISPR gRNA sequence
ttttttttgagacggaatct

SEQ ID NO: 555575 - DNA, 20 bp, Artificial
  CRISPR gRNA sequence
tttttttgagacggaatctc

SEQ ID NO: 555576 - DNA, 20 bp, Artificial
  CRISPR gRNA sequence
ttttttgagacggaatctca

SEQ ID NO: 555577 - DNA, 20 bp, Artificial
  CRISPR gRNA sequence
tttttgagacggaatctcac

SEQ ID NO: 555578 - DNA, 20 bp, Artificial
  CRISPR gRNA sequence
ttttgagacggaatctcact

SEQ ID NO: 555579 - DNA, 20 bp, Artificial
  CRISPR gRNA sequence
tttgagacggaatctcactc

SEQ ID NO: 555580 - DNA, 20 bp, Artificial
  CRISPR gRNA sequence
ttgagacggaatctcactct

SEQ ID NO: 555581 - DNA, 20 bp, Artificial
  CRISPR gRNA sequence
tgagacggaatctcactctg

SEQ ID NO: 555582 - DNA, 20 bp, Artificial
  CRISPR gRNA sequence
gagacggaatctcactctgt

SEQ ID NO: 555583 - DNA, 20 bp, Artificial
  CRISPR gRNA sequence
agacggaatctcactctgtc

SEQ ID NO: 555584 - DNA, 20 bp, Artificial
  CRISPR gRNA sequence
actctgtcacccaggctgga

SEQ ID NO: 555585 - DNA, 20 bp, Artificial
  CRISPR gRNA sequence
tgtcacccaggctggagtgc

SEQ ID NO: 555586 - DNA, 20 bp, Artificial
  CRISPR gRNA sequence
tcacccaggctggagtgcag

SEQ ID NO: 555587 - DNA, 20 bp, Artificial
  CRISPR gRNA sequence
gagtgcagtggtgtggtctc

SEQ ID NO: 555588 - DNA, 20 bp, Artificial
  CRISPR gRNA sequence
agctcactgccagctccgcc

SEQ ID NO: 555589 - DNA, 20 bp, Artificial
  CRISPR gRNA sequence
actgccagctccgcctcccg

SEQ ID NO: 555590 - DNA, 20 bp, Artificial
  CRISPR gRNA sequence
ccagctccgcctcccgggtt

SEQ ID NO: 555591 - DNA, 20 bp, Artificial
  CRISPR gRNA sequence
cgcctcccgggttcatgcca

SEQ ID NO: 555592 - DNA, 20 bp, Artificial
  CRISPR gRNA sequence
ccgggttcatgccattctcc

SEQ ID NO: 555593 - DNA, 20 bp, Artificial
  CRISPR gRNA sequence
atgccattctcctgcctcag

SEQ ID NO: 555594 - DNA, 20 bp, Artificial
  CRISPR gRNA sequence
tcctgcctcagcctcccaag

SEQ ID NO: 555595 - DNA, 20 bp, Artificial
  CRISPR gRNA sequence
ctgcctcagcctcccaagta

SEQ ID NO: 555596 - DNA, 20 bp, Artificial
  CRISPR gRNA sequence
cctcagcctcccaagtagct

SEQ ID NO: 555597 - DNA, 20 bp, Artificial
  CRISPR gRNA sequence
agcctcccaagtagctggga

SEQ ID NO: 555598 - DNA, 20 bp, Artificial
  CRISPR gRNA sequence
ccaagtagctgggactacag

SEQ ID NO: 555599 - DNA, 20 bp, Artificial
  CRISPR gRNA sequence
ggactacaggtgcccaccaa

SEQ ID NO: 555600 - DNA, 20 bp, Artificial
  CRISPR gRNA sequence
caggtgcccaccaacacacc

SEQ ID NO: 555601 - DNA, 20 bp, Artificial
  CRISPR gRNA sequence
actaattttttgtattttta

SEQ ID NO: 555602 - DNA, 20 bp, Artificial
  CRISPR gRNA sequence
attttttgtatttttagtac

SEQ ID NO: 555603 - DNA, 20 bp, Artificial
  CRISPR gRNA sequence
tttgtatttttagtacagac

SEQ ID NO: 555604 - DNA, 20 bp, Artificial
  CRISPR gRNA sequence
ttgtatttttagtacagacg

SEQ ID NO: 555605 - DNA, 20 bp, Artificial
  CRISPR gRNA sequence
tgtatttttagtacagacgg

SEQ ID NO: 555606 - DNA, 20 bp, Artificial
  CRISPR gRNA sequence
gtatttttagtacagacggg

SEQ ID NO: 555607 - DNA, 20 bp, Artificial
  CRISPR gRNA sequence
tatttttagtacagacgggg

SEQ ID NO: 555608 - DNA, 20 bp, Artificial
  CRISPR gRNA sequence
ttagtacagacggggtttca

SEQ ID NO: 555609 - DNA, 20 bp, Artificial
  CRISPR gRNA sequence
tagtacagacggggtttcac

SEQ ID NO: 555610 - DNA, 20 bp, Artificial
  CRISPR gRNA sequence
agtacagacggggtttcacc

SEQ ID NO: 555611 - DNA, 20 bp, Artificial
  CRISPR gRNA sequence
gtacagacggggtttcaccg

SEQ ID NO: 555612 - DNA, 20 bp, Artificial
  CRISPR gRNA sequence
caccgtgttagccaggatgg

SEQ ID NO: 555613 - DNA, 20 bp, Artificial
  CRISPR gRNA sequence
accgtgttagccaggatggt

SEQ ID NO: 555614 - DNA, 20 bp, Artificial
  CRISPR gRNA sequence
gccaggatggtcttgatctc

SEQ ID NO: 555615 - DNA, 20 bp, Artificial
  CRISPR gRNA sequence
gatctcctgacctcgtgatc

SEQ ID NO: 555616 - DNA, 20 bp, Artificial
  CRISPR gRNA sequence
atctcctgacctcgtgatcc

SEQ ID NO: 555617 - DNA, 20 bp, Artificial
  CRISPR gRNA sequence
ctgacctcgtgatccacccg

SEQ ID NO: 555618 - DNA, 20 bp, Artificial
  CRISPR gRNA sequence
acctcgtgatccacccgcct

SEQ ID NO: 555619 - DNA, 20 bp, Artificial
  CRISPR gRNA sequence
gtgatccacccgcctcagcc

SEQ ID NO: 555620 - DNA, 20 bp, Artificial
  CRISPR gRNA sequence
agcctcccaaagtgttggga

SEQ ID NO: 555621 - DNA, 20 bp, Artificial
  CRISPR gRNA sequence
ccaaagtgttgggattacag

SEQ ID NO: 555622 - DNA, 20 bp, Artificial
  CRISPR gRNA sequence
ggattacaggtgtgagccac

SEQ ID NO: 555623 - DNA, 20 bp, Artificial
  CRISPR gRNA sequence
caggtgtgagccaccgcacc

SEQ ID NO: 555624 - DNA, 20 bp, Artificial
  CRISPR gRNA sequence
cctgtctcctcattcttaaa

SEQ ID NO: 555625 - DNA, 20 bp, Artificial
  CRISPR gRNA sequence
tctcctcattcttaaaaggt

SEQ ID NO: 555626 - DNA, 20 bp, Artificial
  CRISPR gRNA sequence
ctcattcttaaaaggtaagt

SEQ ID NO: 555627 - DNA, 20 bp, Artificial
  CRISPR gRNA sequence
attcttaaaaggtaagtaac

SEQ ID NO: 555628 - DNA, 20 bp, Artificial
  CRISPR gRNA sequence
ttaaaaggtaagtaacaact

SEQ ID NO: 555629 - DNA, 20 bp, Artificial
  CRISPR gRNA sequence
aaaaggtaagtaacaactgt

SEQ ID NO: 555630 - DNA, 20 bp, Artificial
  CRISPR gRNA sequence
aaaggtaagtaacaactgtc

SEQ ID NO: 555631 - DNA, 20 bp, Artificial
  CRISPR gRNA sequence
tctggccaatctaaaatgat

SEQ ID NO: 555632 - DNA, 20 bp, Artificial
  CRISPR gRNA sequence
gccaatctaaaatgatagtg

SEQ ID NO: 555633 - DNA, 20 bp, Artificial
  CRISPR gRNA sequence
aaatgatagtggtgaggagc

SEQ ID NO: 555634 - DNA, 20 bp, Artificial
  CRISPR gRNA sequence
atttgaagggtttgctaaag

SEQ ID NO: 555635 - DNA, 20 bp, Artificial
  CRISPR gRNA sequence
tttgaagggtttgctaaagg

SEQ ID NO: 555636 - DNA, 20 bp, Artificial
  CRISPR gRNA sequence
gaagggtttgctaaaggaga

SEQ ID NO: 555637 - DNA, 20 bp, Artificial
  CRISPR gRNA sequence
aagggtttgctaaaggagag

SEQ ID NO: 555638 - DNA, 20 bp, Artificial
  CRISPR gRNA sequence
gctaaaggagagcaggctag

SEQ ID NO: 555639 - DNA, 20 bp, Artificial
  CRISPR gRNA sequence
ctaaaggagagcaggctagt

SEQ ID NO: 555640 - DNA, 20 bp, Artificial
  CRISPR gRNA sequence
aaggagagcaggctagtcaa

SEQ ID NO: 555641 - DNA, 20 bp, Artificial
  CRISPR gRNA sequence
gtcaatgtgagttagtttgc

SEQ ID NO: 555642 - DNA, 20 bp, Artificial
  CRISPR gRNA sequence
gtttgcttcactgataaagc

SEQ ID NO: 555643 - DNA, 20 bp, Artificial
  CRISPR gRNA sequence
gcttcactgataaagcattg

SEQ ID NO: 555644 - DNA, 20 bp, Artificial
  CRISPR gRNA sequence
cttcactgataaagcattgg

SEQ ID NO: 555645 - DNA, 20 bp, Artificial
  CRISPR gRNA sequence
cactgataaagcattggaaa

SEQ ID NO: 555646 - DNA, 20 bp, Artificial
  CRISPR gRNA sequence
actgataaagcattggaaag

SEQ ID NO: 555647 - DNA, 20 bp, Artificial
  CRISPR gRNA sequence
ataaagcattggaaagttta

SEQ ID NO: 555648 - DNA, 20 bp, Artificial
  CRISPR gRNA sequence
gaaagtttagatgagaaatc

SEQ ID NO: 555649 - DNA, 20 bp, Artificial
  CRISPR gRNA sequence
agatgagaaatcaaaacctg

SEQ ID NO: 555650 - DNA, 20 bp, Artificial
  CRISPR gRNA sequence
gatgagaaatcaaaacctga

SEQ ID NO: 555651 - DNA, 20 bp, Artificial
  CRISPR gRNA sequence
aaaaagtaagatctagtatt

SEQ ID NO: 555652 - DNA, 20 bp, Artificial
  CRISPR gRNA sequence
gtatttaactgttatacttt

SEQ ID NO: 555653 - DNA, 20 bp, Artificial
  CRISPR gRNA sequence
aactgttatactttcatgga

SEQ ID NO: 555654 - DNA, 20 bp, Artificial
  CRISPR gRNA sequence
actgttatactttcatggat

SEQ ID NO: 555655 - DNA, 20 bp, Artificial
  CRISPR gRNA sequence
ttatactttcatggatttgt

SEQ ID NO: 555656 - DNA, 20 bp, Artificial
  CRISPR gRNA sequence
tactttcatggatttgtatc

SEQ ID NO: 555657 - DNA, 20 bp, Artificial
  CRISPR gRNA sequence
tcatggatttgtatctatta

SEQ ID NO: 555658 - DNA, 20 bp, Artificial
  CRISPR gRNA sequence
catggatttgtatctattat

SEQ ID NO: 555659 - DNA, 20 bp, Artificial
  CRISPR gRNA sequence
atggatttgtatctattatg

SEQ ID NO: 555660 - DNA, 20 bp, Artificial
  CRISPR gRNA sequence
gtatctattatgatgcatgt

SEQ ID NO: 555661 - DNA, 20 bp, Artificial
  CRISPR gRNA sequence
tatctattatgatgcatgtg

SEQ ID NO: 555662 - DNA, 20 bp, Artificial
  CRISPR gRNA sequence
ttatgatgcatgtggttcca

SEQ ID NO: 555663 - DNA, 20 bp, Artificial
  CRISPR gRNA sequence
tgatgcatgtggttccacac

SEQ ID NO: 555664 - DNA, 20 bp, Artificial
  CRISPR gRNA sequence
cacacaaaagcattcaaaaa

SEQ ID NO: 555665 - DNA, 20 bp, Artificial
  CRISPR gRNA sequence
aaaaatcatctcagaaaaaa

SEQ ID NO: 555666 - DNA, 20 bp, Artificial
  CRISPR gRNA sequence
agaaaaaaaaagatcctaga

SEQ ID NO: 555667 - DNA, 20 bp, Artificial
  CRISPR gRNA sequence
gactgttactgttcaaaaga

SEQ ID NO: 555668 - DNA, 20 bp, Artificial
  CRISPR gRNA sequence
ttactgttcaaaagaaccat

SEQ ID NO: 555669 - DNA, 20 bp, Artificial
  CRISPR gRNA sequence
ctgttcaaaagaaccattaa

SEQ ID NO: 555670 - DNA, 20 bp, Artificial
  CRISPR gRNA sequence
ttcaaaagaaccattaagat

SEQ ID NO: 555671 - DNA, 20 bp, Artificial
  CRISPR gRNA sequence
aaaagaaccattaagatcat

SEQ ID NO: 555672 - DNA, 20 bp, Artificial
  CRISPR gRNA sequence
agatcattaagttcagctcc

SEQ ID NO: 555673 - DNA, 20 bp, Artificial
  CRISPR gRNA sequence
agttcagctcctggtttgca

SEQ ID NO: 555674 - DNA, 20 bp, Artificial
  CRISPR gRNA sequence
agctcctggtttgcatttta

SEQ ID NO: 555675 - DNA, 20 bp, Artificial
  CRISPR gRNA sequence
ctggtttgcattttaaaagg

SEQ ID NO: 555676 - DNA, 20 bp, Artificial
  CRISPR gRNA sequence
gtttgcattttaaaaggaga

SEQ ID NO: 555677 - DNA, 20 bp, Artificial
  CRISPR gRNA sequence
gcattttaaaaggagaaggt

SEQ ID NO: 555678 - DNA, 20 bp, Artificial
  CRISPR gRNA sequence
cattttaaaaggagaaggtc

SEQ ID NO: 555679 - DNA, 20 bp, Artificial
  CRISPR gRNA sequence
taaaaggagaaggtcctcca

SEQ ID NO: 555680 - DNA, 20 bp, Artificial
  CRISPR gRNA sequence
aaaaggagaaggtcctccaa

SEQ ID NO: 555681 - DNA, 20 bp, Artificial
  CRISPR gRNA sequence
aaaggagaaggtcctccaat

SEQ ID NO: 555682 - DNA, 20 bp, Artificial
  CRISPR gRNA sequence
caatatttggttaacagaaa

SEQ ID NO: 555683 - DNA, 20 bp, Artificial
  CRISPR gRNA sequence
ggttaacagaaaccagggtc

SEQ ID NO: 555684 - DNA, 20 bp, Artificial
  CRISPR gRNA sequence
gttaacagaaaccagggtca

SEQ ID NO: 555685 - DNA, 20 bp, Artificial
  CRISPR gRNA sequence
acagaaaccagggtcagaag

SEQ ID NO: 555686 - DNA, 20 bp, Artificial
  CRISPR gRNA sequence
agatgtcaacactactccag

SEQ ID NO: 555687 - DNA, 20 bp, Artificial
  CRISPR gRNA sequence
ctccaggatttaaacctaag

SEQ ID NO: 555688 - DNA, 20 bp, Artificial
  CRISPR gRNA sequence
caggatttaaacctaagacc

SEQ ID NO: 555689 - DNA, 20 bp, Artificial
  CRISPR gRNA sequence
aaacctaagacctatcaagc

SEQ ID NO: 555690 - DNA, 20 bp, Artificial
  CRISPR gRNA sequence
aacctaagacctatcaagca

SEQ ID NO: 555691 - DNA, 20 bp, Artificial
  CRISPR gRNA sequence
agacctatcaagcaacattc

SEQ ID NO: 555692 - DNA, 20 bp, Artificial
  CRISPR gRNA sequence
tcaagcaacattcctcaaac

SEQ ID NO: 555693 - DNA, 20 bp, Artificial
  CRISPR gRNA sequence
ctcaaactttcaaaatctgt

SEQ ID NO: 555694 - DNA, 20 bp, Artificial
  CRISPR gRNA sequence
aaactttcaaaatctgttgt

SEQ ID NO: 555695 - DNA, 20 bp, Artificial
  CRISPR gRNA sequence
tcaaaatctgttgtatatat

SEQ ID NO: 555696 - DNA, 20 bp, Artificial
  CRISPR gRNA sequence
caaaatctgttgtatatatg

SEQ ID NO: 555697 - DNA, 20 bp, Artificial
  CRISPR gRNA sequence
aaaatctgttgtatatatgt

SEQ ID NO: 555698 - DNA, 20 bp, Artificial
  CRISPR gRNA sequence
ttgtatatatgtgaactatc

SEQ ID NO: 555699 - DNA, 20 bp, Artificial
  CRISPR gRNA sequence
tatatatgtgaactatcaat

SEQ ID NO: 555700 - DNA, 20 bp, Artificial
  CRISPR gRNA sequence
tcaatttggaagaaaatgta

SEQ ID NO: 555701 - DNA, 20 bp, Artificial
  CRISPR gRNA sequence
ggaagaaaatgtaaaagaag

SEQ ID NO: 555702 - DNA, 20 bp, Artificial
  CRISPR gRNA sequence
gaagaaaatgtaaaagaagg

SEQ ID NO: 555703 - DNA, 20 bp, Artificial
  CRISPR gRNA sequence
tttaataattaaaagaattt

SEQ ID NO: 555704 - DNA, 20 bp, Artificial
  CRISPR gRNA sequence
aataattaaaagaatttttt

SEQ ID NO: 555705 - DNA, 20 bp, Artificial
  CRISPR gRNA sequence
ataattaaaagaattttttc

SEQ ID NO: 555706 - DNA, 20 bp, Artificial
  CRISPR gRNA sequence
aaagaattttttcaaattaa

SEQ ID NO: 555707 - DNA, 20 bp, Artificial
  CRISPR gRNA sequence
tttcaaattaatagtactta

SEQ ID NO: 555708 - DNA, 20 bp, Artificial
  CRISPR gRNA sequence
ttcaaattaatagtacttat

SEQ ID NO: 555709 - DNA, 20 bp, Artificial
  CRISPR gRNA sequence
tcaaattaatagtacttatt

SEQ ID NO: 555710 - DNA, 20 bp, Artificial
  CRISPR gRNA sequence
caaattaatagtacttattt

SEQ ID NO: 555711 - DNA, 20 bp, Artificial
  CRISPR gRNA sequence
aaattaatagtacttatttc

SEQ ID NO: 555712 - DNA, 20 bp, Artificial
  CRISPR gRNA sequence
atagtacttatttcaaatca

SEQ ID NO: 555713 - DNA, 20 bp, Artificial
  CRISPR gRNA sequence
atttcaaatcaataagagga

SEQ ID NO: 555714 - DNA, 20 bp, Artificial
  CRISPR gRNA sequence
tttcaaatcaataagaggaa

SEQ ID NO: 555715 - DNA, 20 bp, Artificial
  CRISPR gRNA sequence
caaatcaataagaggaatat

SEQ ID NO: 555716 - DNA, 20 bp, Artificial
  CRISPR gRNA sequence
aaatcaataagaggaatatc

SEQ ID NO: 555717 - DNA, 20 bp, Artificial
  CRISPR gRNA sequence
ctcttatgatcttttaccag

SEQ ID NO: 555718 - DNA, 20 bp, Artificial
  CRISPR gRNA sequence
ttatgatcttttaccagact

SEQ ID NO: 555719 - DNA, 20 bp, Artificial
  CRISPR gRNA sequence
atgatcttttaccagactat

SEQ ID NO: 555720 - DNA, 20 bp, Artificial
  CRISPR gRNA sequence
tgatcttttaccagactatt

SEQ ID NO: 555721 - DNA, 20 bp, Artificial
  CRISPR gRNA sequence
ttaccagactatttacaggg

SEQ ID NO: 555722 - DNA, 20 bp, Artificial
  CRISPR gRNA sequence
taccagactatttacaggga

SEQ ID NO: 555723 - DNA, 20 bp, Artificial
  CRISPR gRNA sequence
accagactatttacagggaa

SEQ ID NO: 555724 - DNA, 20 bp, Artificial
  CRISPR gRNA sequence
ccagactatttacagggaaa

SEQ ID NO: 555725 - DNA, 20 bp, Artificial
  CRISPR gRNA sequence
tttacagggaaagtaatctt

SEQ ID NO: 555726 - DNA, 20 bp, Artificial
  CRISPR gRNA sequence
acagggaaagtaatcttact

SEQ ID NO: 555727 - DNA, 20 bp, Artificial
  CRISPR gRNA sequence
cagggaaagtaatcttactt

SEQ ID NO: 555728 - DNA, 20 bp, Artificial
  CRISPR gRNA sequence
actttcagtaagagtaattt

SEQ ID NO: 555729 - DNA, 20 bp, Artificial
  CRISPR gRNA sequence
ctttcagtaagagtaatttt

SEQ ID NO: 555730 - DNA, 20 bp, Artificial
  CRISPR gRNA sequence
tcagtaagagtaattttact

SEQ ID NO: 555731 - DNA, 20 bp, Artificial
  CRISPR gRNA sequence
cagtaagagtaattttactt

SEQ ID NO: 555732 - DNA, 20 bp, Artificial
  CRISPR gRNA sequence
agtaagagtaattttacttt

SEQ ID NO: 555733 - DNA, 20 bp, Artificial
  CRISPR gRNA sequence
tactttgtgtcttcaaattc

SEQ ID NO: 555734 - DNA, 20 bp, Artificial
  CRISPR gRNA sequence
actttgtgtcttcaaattct

SEQ ID NO: 555735 - DNA, 20 bp, Artificial
  CRISPR gRNA sequence
ctttgtgtcttcaaattcta

SEQ ID NO: 555736 - DNA, 20 bp, Artificial
  CRISPR gRNA sequence
tgtgtcttcaaattctaatg

SEQ ID NO: 555737 - DNA, 20 bp, Artificial
  CRISPR gRNA sequence
gtgtcttcaaattctaatgg

SEQ ID NO: 555738 - DNA, 20 bp, Artificial
  CRISPR gRNA sequence
tgtcttcaaattctaatggc

SEQ ID NO: 555739 - DNA, 20 bp, Artificial
  CRISPR gRNA sequence
caaattctaatggcaaacat

SEQ ID NO: 555740 - DNA, 20 bp, Artificial
  CRISPR gRNA sequence
aaattctaatggcaaacata

SEQ ID NO: 555741 - DNA, 20 bp, Artificial
  CRISPR gRNA sequence
taatggcaaacataaagtta

SEQ ID NO: 555742 - DNA, 20 bp, Artificial
  CRISPR gRNA sequence
atggcaaacataaagttaaa

SEQ ID NO: 555743 - DNA, 20 bp, Artificial
  CRISPR gRNA sequence
aacataaagttttgcaaggg

SEQ ID NO: 555744 - DNA, 20 bp, Artificial
  CRISPR gRNA sequence
tgcaagggcaaaacctttaa

SEQ ID NO: 555745 - DNA, 20 bp, Artificial
  CRISPR gRNA sequence
gcaagggcaaaacctttaaa

SEQ ID NO: 555746 - DNA, 20 bp, Artificial
  CRISPR gRNA sequence
caagggcaaaacctttaaaa

SEQ ID NO: 555747 - DNA, 20 bp, Artificial
  CRISPR gRNA sequence
taaaaatcccctaaaatatt

SEQ ID NO: 555748 - DNA, 20 bp, Artificial
  CRISPR gRNA sequence
aaaaatcccctaaaatattc

SEQ ID NO: 555749 - DNA, 20 bp, Artificial
  CRISPR gRNA sequence
aaaatcccctaaaatattcc

SEQ ID NO: 555750 - DNA, 20 bp, Artificial
  CRISPR gRNA sequence
aaatattccatgtaattcta

SEQ ID NO: 555751 - DNA, 20 bp, Artificial
  CRISPR gRNA sequence
catgtaattctatagaggga

SEQ ID NO: 555752 - DNA, 20 bp, Artificial
  CRISPR gRNA sequence
tatagagggatcttactcag

SEQ ID NO: 555753 - DNA, 20 bp, Artificial
  CRISPR gRNA sequence
tagagggatcttactcagaa

SEQ ID NO: 555754 - DNA, 20 bp, Artificial
  CRISPR gRNA sequence
actcagaaattatttccttc

SEQ ID NO: 555755 - DNA, 20 bp, Artificial
  CRISPR gRNA sequence
ctcagaaattatttccttca

SEQ ID NO: 555756 - DNA, 20 bp, Artificial
  CRISPR gRNA sequence
agaaattatttccttcaagt

SEQ ID NO: 555757 - DNA, 20 bp, Artificial
  CRISPR gRNA sequence
tttccttcaagtattttgtc

SEQ ID NO: 555758 - DNA, 20 bp, Artificial
  CRISPR gRNA sequence
ccttcaagtattttgtctct

SEQ ID NO: 555759 - DNA, 20 bp, Artificial
  CRISPR gRNA sequence
cttcaagtattttgtctctt

SEQ ID NO: 555760 - DNA, 20 bp, Artificial
  CRISPR gRNA sequence
caagtattttgtctcttgga

SEQ ID NO: 555761 - DNA, 20 bp, Artificial
  CRISPR gRNA sequence
aagtattttgtctcttggaa

SEQ ID NO: 555762 - DNA, 20 bp, Artificial
  CRISPR gRNA sequence
tgtctcttggaacacttaaa

SEQ ID NO: 555763 - DNA, 20 bp, Artificial
  CRISPR gRNA sequence
gtctcttggaacacttaaaa

SEQ ID NO: 555764 - DNA, 20 bp, Artificial
  CRISPR gRNA sequence
tctcttggaacacttaaaac

SEQ ID NO: 555765 - DNA, 20 bp, Artificial
  CRISPR gRNA sequence
ttggaacacttaaaactttt

SEQ ID NO: 555766 - DNA, 20 bp, Artificial
  CRISPR gRNA sequence
ggaacacttaaaacttttca

SEQ ID NO: 555767 - DNA, 20 bp, Artificial
  CRISPR gRNA sequence
gaacacttaaaacttttcaa

SEQ ID NO: 555768 - DNA, 20 bp, Artificial
  CRISPR gRNA sequence
aaaacttttcaagatttcaa

SEQ ID NO: 555769 - DNA, 20 bp, Artificial
  CRISPR gRNA sequence
aaacttttcaagatttcaac

SEQ ID NO: 555770 - DNA, 20 bp, Artificial
  CRISPR gRNA sequence
ttcaagatttcaacttgctt

SEQ ID NO: 555771 - DNA, 20 bp, Artificial
  CRISPR gRNA sequence
tcaagatttcaacttgcttg

SEQ ID NO: 555772 - DNA, 20 bp, Artificial
  CRISPR gRNA sequence
caagatttcaacttgcttgc

SEQ ID NO: 555773 - DNA, 20 bp, Artificial
  CRISPR gRNA sequence
aagatttcaacttgcttgct

SEQ ID NO: 555774 - DNA, 20 bp, Artificial
  CRISPR gRNA sequence
caacttgcttgctctgtcta

SEQ ID NO: 555775 - DNA, 20 bp, Artificial
  CRISPR gRNA sequence
aacttgcttgctctgtctat

SEQ ID NO: 555776 - DNA, 20 bp, Artificial
  CRISPR gRNA sequence
gcttgctctgtctatatgtg

SEQ ID NO: 555777 - DNA, 20 bp, Artificial
  CRISPR gRNA sequence
cttgctctgtctatatgtgg

SEQ ID NO: 555778 - DNA, 20 bp, Artificial
  CRISPR gRNA sequence
gctctgtctatatgtggtca

SEQ ID NO: 555779 - DNA, 20 bp, Artificial
  CRISPR gRNA sequence
ctctgtctatatgtggtcat

SEQ ID NO: 555780 - DNA, 20 bp, Artificial
  CRISPR gRNA sequence
tgtctatatgtggtcatctt

SEQ ID NO: 555781 - DNA, 20 bp, Artificial
  CRISPR gRNA sequence
tctatatgtggtcatcttct

SEQ ID NO: 555782 - DNA, 20 bp, Artificial
  CRISPR gRNA sequence
tatgtggtcatcttcttccc

SEQ ID NO: 555783 - DNA, 20 bp, Artificial
  CRISPR gRNA sequence
cttcccccttgtcagttaga

SEQ ID NO: 555784 - DNA, 20 bp, Artificial
  CRISPR gRNA sequence
ttcccccttgtcagttagat

SEQ ID NO: 555785 - DNA, 20 bp, Artificial
  CRISPR gRNA sequence
cccccttgtcagttagatgc

SEQ ID NO: 555786 - DNA, 20 bp, Artificial
  CRISPR gRNA sequence
ccccttgtcagttagatgca

SEQ ID NO: 555787 - DNA, 20 bp, Artificial
  CRISPR gRNA sequence
gtcagttagatgcagcacac

SEQ ID NO: 555788 - DNA, 20 bp, Artificial
  CRISPR gRNA sequence
tcagttagatgcagcacaca

SEQ ID NO: 555789 - DNA, 20 bp, Artificial
  CRISPR gRNA sequence
gatgcagcacacatatacca

SEQ ID NO: 555790 - DNA, 20 bp, Artificial
  CRISPR gRNA sequence
gttttattttttgttgttcc

SEQ ID NO: 555791 - DNA, 20 bp, Artificial
  CRISPR gRNA sequence
tattttttgttgttcccatt

SEQ ID NO: 555792 - DNA, 20 bp, Artificial
  CRISPR gRNA sequence
attttttgttgttcccatta

SEQ ID NO: 555793 - DNA, 20 bp, Artificial
  CRISPR gRNA sequence
ttttttgttgttcccattat

SEQ ID NO: 555794 - DNA, 20 bp, Artificial
  CRISPR gRNA sequence
tttgttgttcccattataaa

SEQ ID NO: 555795 - DNA, 20 bp, Artificial
  CRISPR gRNA sequence
ttgttgttcccattataaag

SEQ ID NO: 555796 - DNA, 20 bp, Artificial
  CRISPR gRNA sequence
tgttgttcccattataaagc

SEQ ID NO: 555797 - DNA, 20 bp, Artificial
  CRISPR gRNA sequence
gttgttcccattataaagca

SEQ ID NO: 555798 - DNA, 20 bp, Artificial
  CRISPR gRNA sequence
ttgttcccattataaagcaa

SEQ ID NO: 555799 - DNA, 20 bp, Artificial
  CRISPR gRNA sequence
ttcccattataaagcaacta

SEQ ID NO: 555800 - DNA, 20 bp, Artificial
  CRISPR gRNA sequence
ccattataaagcaactatct

SEQ ID NO: 555801 - DNA, 20 bp, Artificial
  CRISPR gRNA sequence
taaagcaactatctgctttt

SEQ ID NO: 555802 - DNA, 20 bp, Artificial
  CRISPR gRNA sequence
tctgcttttacaacaaattg

SEQ ID NO: 555803 - DNA, 20 bp, Artificial
  CRISPR gRNA sequence
cttttacaacaaattgcatt

SEQ ID NO: 555804 - DNA, 20 bp, Artificial
  CRISPR gRNA sequence
ttacaacaaattgcatttcc

SEQ ID NO: 555805 - DNA, 20 bp, Artificial
  CRISPR gRNA sequence
tacaacaaattgcatttcca

SEQ ID NO: 555806 - DNA, 20 bp, Artificial
  CRISPR gRNA sequence
acaacaaattgcatttccat

SEQ ID NO: 555807 - DNA, 20 bp, Artificial
  CRISPR gRNA sequence
caacaaattgcatttccata

SEQ ID NO: 555808 - DNA, 20 bp, Artificial
  CRISPR gRNA sequence
catttccatatcgtatgcct

SEQ ID NO: 555809 - DNA, 20 bp, Artificial
  CRISPR gRNA sequence
ccatatcgtatgccttgggt

SEQ ID NO: 555810 - DNA, 20 bp, Artificial
  CRISPR gRNA sequence
catatcgtatgccttgggta

SEQ ID NO: 555811 - DNA, 20 bp, Artificial
  CRISPR gRNA sequence
gggtattatgtaacactcaa

SEQ ID NO: 555812 - DNA, 20 bp, Artificial
  CRISPR gRNA sequence
ggtattatgtaacactcaaa

SEQ ID NO: 555813 - DNA, 20 bp, Artificial
  CRISPR gRNA sequence
tgtaacactcaaaaggtgga

SEQ ID NO: 555814 - DNA, 20 bp, Artificial
  CRISPR gRNA sequence
aaaaggtggaattaataaag

SEQ ID NO: 555815 - DNA, 20 bp, Artificial
  CRISPR gRNA sequence
ataaaggaatgtttgctcca

SEQ ID NO: 555816 - DNA, 20 bp, Artificial
  CRISPR gRNA sequence
gctccaagcttaactatttt

SEQ ID NO: 555817 - DNA, 20 bp, Artificial
  CRISPR gRNA sequence
ctccaagcttaactatttta

SEQ ID NO: 555818 - DNA, 20 bp, Artificial
  CRISPR gRNA sequence
caagcttaactattttaact

SEQ ID NO: 555819 - DNA, 20 bp, Artificial
  CRISPR gRNA sequence
aactattttaactttgcagc

SEQ ID NO: 555820 - DNA, 20 bp, Artificial
  CRISPR gRNA sequence
actattttaactttgcagct

SEQ ID NO: 555821 - DNA, 20 bp, Artificial
  CRISPR gRNA sequence
ttttaactttgcagctcgtt

SEQ ID NO: 555822 - DNA, 20 bp, Artificial
  CRISPR gRNA sequence
taactttgcagctcgtttta

SEQ ID NO: 555823 - DNA, 20 bp, Artificial
  CRISPR gRNA sequence
aactttgcagctcgttttaa

SEQ ID NO: 555824 - DNA, 20 bp, Artificial
  CRISPR gRNA sequence
actttgcagctcgttttaaa

SEQ ID NO: 555825 - DNA, 20 bp, Artificial
  CRISPR gRNA sequence
tgcagctcgttttaaaaact

SEQ ID NO: 555826 - DNA, 20 bp, Artificial
  CRISPR gRNA sequence
gcagctcgttttaaaaactt

SEQ ID NO: 555827 - DNA, 20 bp, Artificial
  CRISPR gRNA sequence
cagctcgttttaaaaacttc

SEQ ID NO: 555828 - DNA, 20 bp, Artificial
  CRISPR gRNA sequence
gttttaaaaacttcttgcaa

SEQ ID NO: 555829 - DNA, 20 bp, Artificial
  CRISPR gRNA sequence
taaaaacttcttgcaattgt

SEQ ID NO: 555830 - DNA, 20 bp, Artificial
  CRISPR gRNA sequence
aaaaacttcttgcaattgtg

SEQ ID NO: 555831 - DNA, 20 bp, Artificial
  CRISPR gRNA sequence
aaaacttcttgcaattgtgt

SEQ ID NO: 555832 - DNA, 20 bp, Artificial
  CRISPR gRNA sequence
cttgcaattgtgtgacttgt

SEQ ID NO: 555833 - DNA, 20 bp, Artificial
  CRISPR gRNA sequence
ttgcaattgtgtgacttgta

SEQ ID NO: 555834 - DNA, 20 bp, Artificial
  CRISPR gRNA sequence
gcaattgtgtgacttgtaca

SEQ ID NO: 555835 - DNA, 20 bp, Artificial
  CRISPR gRNA sequence
caattgtgtgacttgtacaa

SEQ ID NO: 555836 - DNA, 20 bp, Artificial
  CRISPR gRNA sequence
tgtgacttgtacaaacagtg

SEQ ID NO: 555837 - DNA, 20 bp, Artificial
  CRISPR gRNA sequence
gtacaaacagtgctcctttg

SEQ ID NO: 555838 - DNA, 20 bp, Artificial
  CRISPR gRNA sequence
tacaaacagtgctcctttga

SEQ ID NO: 555839 - DNA, 20 bp, Artificial
  CRISPR gRNA sequence
ctttgagtgacacctctgtg

SEQ ID NO: 555840 - DNA, 20 bp, Artificial
  CRISPR gRNA sequence
tgagtgacacctctgtgggt

SEQ ID NO: 555841 - DNA, 20 bp, Artificial
  CRISPR gRNA sequence
gagtgacacctctgtgggtt

SEQ ID NO: 555842 - DNA, 20 bp, Artificial
  CRISPR gRNA sequence
agtgacacctctgtgggttt

SEQ ID NO: 555843 - DNA, 20 bp, Artificial
  CRISPR gRNA sequence
tgtgggtttgatcttttctc

SEQ ID NO: 555844 - DNA, 20 bp, Artificial
  CRISPR gRNA sequence
tgggtttgatcttttctctg

SEQ ID NO: 555845 - DNA, 20 bp, Artificial
  CRISPR gRNA sequence
gatcttttctctgtcttcaa

SEQ ID NO: 555846 - DNA, 20 bp, Artificial
  CRISPR gRNA sequence
atcttttctctgtcttcaaa

SEQ ID NO: 555847 - DNA, 20 bp, Artificial
  CRISPR gRNA sequence
ttctctgtcttcaaaaatca

SEQ ID NO: 555848 - DNA, 20 bp, Artificial
  CRISPR gRNA sequence
tctctgtcttcaaaaatcaa

SEQ ID NO: 555849 - DNA, 20 bp, Artificial
  CRISPR gRNA sequence
ctctgtcttcaaaaatcaaa

SEQ ID NO: 555850 - DNA, 20 bp, Artificial
  CRISPR gRNA sequence
tctgtcttcaaaaatcaaat

SEQ ID NO: 555851 - DNA, 20 bp, Artificial
  CRISPR gRNA sequence
tgtcttcaaaaatcaaatct

SEQ ID NO: 555852 - DNA, 20 bp, Artificial
  CRISPR gRNA sequence
tcttcaaaaatcaaatctat

SEQ ID NO: 555853 - DNA, 20 bp, Artificial
  CRISPR gRNA sequence
caaaaatcaaatctatcagt

SEQ ID NO: 555854 - DNA, 20 bp, Artificial
  CRISPR gRNA sequence
aaaaatcaaatctatcagtt

SEQ ID NO: 555855 - DNA, 20 bp, Artificial
  CRISPR gRNA sequence
tcagttataaattgggactc

SEQ ID NO: 555856 - DNA, 20 bp, Artificial
  CRISPR gRNA sequence
taaattgggactcatttgca

SEQ ID NO: 555857 - DNA, 20 bp, Artificial
  CRISPR gRNA sequence
ggactcatttgcactttttc

SEQ ID NO: 555858 - DNA, 20 bp, Artificial
  CRISPR gRNA sequence
atttgcactttttctttttt

SEQ ID NO: 555859 - DNA, 20 bp, Artificial
  CRISPR gRNA sequence
gcactttttcttttttttct

SEQ ID NO: 555860 - DNA, 20 bp, Artificial
  CRISPR gRNA sequence
cactttttcttttttttctc

SEQ ID NO: 555861 - DNA, 20 bp, Artificial
  CRISPR gRNA sequence
tttcttttttttctccgtgt

SEQ ID NO: 555862 - DNA, 20 bp, Artificial
  CRISPR gRNA sequence
ttcttttttttctccgtgtt

SEQ ID NO: 555863 - DNA, 20 bp, Artificial
  CRISPR gRNA sequence
tcttttttttctccgtgttt

SEQ ID NO: 555864 - DNA, 20 bp, Artificial
  CRISPR gRNA sequence
cttttttttctccgtgtttc

SEQ ID NO: 555865 - DNA, 20 bp, Artificial
  CRISPR gRNA sequence
ttttttttctccgtgtttca

SEQ ID NO: 555866 - DNA, 20 bp, Artificial
  CRISPR gRNA sequence
ttttttctccgtgtttcata

SEQ ID NO: 555867 - DNA, 20 bp, Artificial
  CRISPR gRNA sequence
tttttctccgtgtttcataa

SEQ ID NO: 555868 - DNA, 20 bp, Artificial
  CRISPR gRNA sequence
ttttctccgtgtttcataac

SEQ ID NO: 555869 - DNA, 20 bp, Artificial
  CRISPR gRNA sequence
tttctccgtgtttcataact

SEQ ID NO: 555870 - DNA, 20 bp, Artificial
  CRISPR gRNA sequence
ttctccgtgtttcataactt

SEQ ID NO: 555871 - DNA, 20 bp, Artificial
  CRISPR gRNA sequence
tctccgtgtttcataacttt

SEQ ID NO: 555872 - DNA, 20 bp, Artificial
  CRISPR gRNA sequence
ctccgtgtttcataacttta

SEQ ID NO: 555873 - DNA, 20 bp, Artificial
  CRISPR gRNA sequence
tccgtgtttcataactttaa

SEQ ID NO: 555874 - DNA, 20 bp, Artificial
  CRISPR gRNA sequence
cgtgtttcataactttaata

SEQ ID NO: 555875 - DNA, 20 bp, Artificial
  CRISPR gRNA sequence
cataactttaatagaatatt

SEQ ID NO: 555876 - DNA, 20 bp, Artificial
  CRISPR gRNA sequence
ataactttaatagaatattc

SEQ ID NO: 555877 - DNA, 20 bp, Artificial
  CRISPR gRNA sequence
taatagaatattctaactat

SEQ ID NO: 555878 - DNA, 20 bp, Artificial
  CRISPR gRNA sequence
aatagaatattctaactatt

SEQ ID NO: 555879 - DNA, 20 bp, Artificial
  CRISPR gRNA sequence
atagaatattctaactatta

SEQ ID NO: 555880 - DNA, 20 bp, Artificial
  CRISPR gRNA sequence
taactattatgtacaaattg

SEQ ID NO: 555881 - DNA, 20 bp, Artificial
  CRISPR gRNA sequence
actattatgtacaaattgaa

SEQ ID NO: 555882 - DNA, 20 bp, Artificial
  CRISPR gRNA sequence
ttatgtacaaattgaaaaca

SEQ ID NO: 555883 - DNA, 20 bp, Artificial
  CRISPR gRNA sequence
tgtacaaattgaaaacactg

SEQ ID NO: 555884 - DNA, 20 bp, Artificial
  CRISPR gRNA sequence
aaaacactgtattcagttat

SEQ ID NO: 555885 - DNA, 20 bp, Artificial
  CRISPR gRNA sequence
tattcagttataaatgtgtt

SEQ ID NO: 555886 - DNA, 20 bp, Artificial
  CRISPR gRNA sequence
agttataaatgtgttctaag

SEQ ID NO: 555887 - DNA, 20 bp, Artificial
  CRISPR gRNA sequence
taaatgtgttctaaggttag

SEQ ID NO: 555888 - DNA, 20 bp, Artificial
  CRISPR gRNA sequence
taaggttaggctgagcactc

SEQ ID NO: 555889 - DNA, 20 bp, Artificial
  CRISPR gRNA sequence
aggttaggctgagcactctc

SEQ ID NO: 555890 - DNA, 20 bp, Artificial
  CRISPR gRNA sequence
ggctgagcactctctacagg

SEQ ID NO: 555891 - DNA, 20 bp, Artificial
  CRISPR gRNA sequence
agcactctctacaggcctgg

SEQ ID NO: 555892 - DNA, 20 bp, Artificial
  CRISPR gRNA sequence
tctacaggcctggtcagcgc

SEQ ID NO: 555893 - DNA, 20 bp, Artificial
  CRISPR gRNA sequence
tacaggcctggtcagcgcgg

SEQ ID NO: 555894 - DNA, 20 bp, Artificial
  CRISPR gRNA sequence
caggcctggtcagcgcggac

SEQ ID NO: 555895 - DNA, 20 bp, Artificial
  CRISPR gRNA sequence
gtcagcgcggacaaggccat

SEQ ID NO: 555896 - DNA, 20 bp, Artificial
  CRISPR gRNA sequence
ccacagagcgctgtcaccca

SEQ ID NO: 555897 - DNA, 20 bp, Artificial
  CRISPR gRNA sequence
tcacccacttggaaacccca

SEQ ID NO: 555898 - DNA, 20 bp, Artificial
  CRISPR gRNA sequence
ggaaaccccactcaccagcc

SEQ ID NO: 555899 - DNA, 20 bp, Artificial
  CRISPR gRNA sequence
gaaaccccactcaccagcca

SEQ ID NO: 555900 - DNA, 20 bp, Artificial
  CRISPR gRNA sequence
accagccaccaaccggtcac

SEQ ID NO: 555901 - DNA, 20 bp, Artificial
  CRISPR gRNA sequence
cagacaggatgaatggtggg

SEQ ID NO: 555902 - DNA, 20 bp, Artificial
  CRISPR gRNA sequence
agacaggatgaatggtgggg

SEQ ID NO: 555903 - DNA, 20 bp, Artificial
  CRISPR gRNA sequence
ctgagaaagcaggacttgac

SEQ ID NO: 555904 - DNA, 20 bp, Artificial
  CRISPR gRNA sequence
agaaagcaggacttgacgct

SEQ ID NO: 555905 - DNA, 20 bp, Artificial
  CRISPR gRNA sequence
gacgctcatatgctcaaatg

SEQ ID NO: 555906 - DNA, 20 bp, Artificial
  CRISPR gRNA sequence
acgctcatatgctcaaatga

SEQ ID NO: 555907 - DNA, 20 bp, Artificial
  CRISPR gRNA sequence
atatgctcaaatgaaacgca

SEQ ID NO: 555908 - DNA, 20 bp, Artificial
  CRISPR gRNA sequence
aaatgaaacgcaggacttcc

SEQ ID NO: 555909 - DNA, 20 bp, Artificial
  CRISPR gRNA sequence
cccagcccagcccctcactg

SEQ ID NO: 555910 - DNA, 20 bp, Artificial
  CRISPR gRNA sequence
ccagcccagcccctcactgg

SEQ ID NO: 555911 - DNA, 20 bp, Artificial
  CRISPR gRNA sequence
actggagaacactgccgaat

SEQ ID NO: 555912 - DNA, 20 bp, Artificial
  CRISPR gRNA sequence
gagaacactgccgaatccca

SEQ ID NO: 555913 - DNA, 20 bp, Artificial
  CRISPR gRNA sequence
ccgaatcccaactccggcag

SEQ ID NO: 555914 - DNA, 20 bp, Artificial
  CRISPR gRNA sequence
cggcagcagggcggtgcctg

SEQ ID NO: 555915 - DNA, 20 bp, Artificial
  CRISPR gRNA sequence
tgtcacgaggacaggctcgc

SEQ ID NO: 555916 - DNA, 20 bp, Artificial
  CRISPR gRNA sequence
gcgtcttcagccctggtggc

SEQ ID NO: 555917 - DNA, 20 bp, Artificial
  CRISPR gRNA sequence
cagccctggtggcaggaagc

SEQ ID NO: 555918 - DNA, 20 bp, Artificial
  CRISPR gRNA sequence
agccctggtggcaggaagca

SEQ ID NO: 555919 - DNA, 20 bp, Artificial
  CRISPR gRNA sequence
gtggcaggaagcagtgtttc

SEQ ID NO: 555920 - DNA, 20 bp, Artificial
  CRISPR gRNA sequence
cttccgcacagcccttgctc

SEQ ID NO: 555921 - DNA, 20 bp, Artificial
  CRISPR gRNA sequence
ttccgcacagcccttgctcc

SEQ ID NO: 555922 - DNA, 20 bp, Artificial
  CRISPR gRNA sequence
ccgcacagcccttgctcctg

SEQ ID NO: 555923 - DNA, 20 bp, Artificial
  CRISPR gRNA sequence
cgcacagcccttgctcctgc

SEQ ID NO: 555924 - DNA, 20 bp, Artificial
  CRISPR gRNA sequence
gctcctgctaggaagtggca

SEQ ID NO: 555925 - DNA, 20 bp, Artificial
  CRISPR gRNA sequence
ctcctgctaggaagtggcac

SEQ ID NO: 555926 - DNA, 20 bp, Artificial
  CRISPR gRNA sequence
ctgctaggaagtggcacatc

SEQ ID NO: 555927 - DNA, 20 bp, Artificial
  CRISPR gRNA sequence
ctaggaagtggcacatcttc

SEQ ID NO: 555928 - DNA, 20 bp, Artificial
  CRISPR gRNA sequence
ggaagtggcacatcttcctg

SEQ ID NO: 555929 - DNA, 20 bp, Artificial
  CRISPR gRNA sequence
cctgctcaggtcaccagggt

SEQ ID NO: 555930 - DNA, 20 bp, Artificial
  CRISPR gRNA sequence
ctgctcaggtcaccagggtg

SEQ ID NO: 555931 - DNA, 20 bp, Artificial
  CRISPR gRNA sequence
ctcaggtcaccagggtggtt

SEQ ID NO: 555932 - DNA, 20 bp, Artificial
  CRISPR gRNA sequence
aggtcaccagggtggttcag

SEQ ID NO: 555933 - DNA, 20 bp, Artificial
  CRISPR gRNA sequence
agaaatggcaaggacgagcg

SEQ ID NO: 555934 - DNA, 20 bp, Artificial
  CRISPR gRNA sequence
acaggcaagaagggataaat

SEQ ID NO: 555935 - DNA, 20 bp, Artificial
  CRISPR gRNA sequence
tcgcctgagctggtgtgcca

SEQ ID NO: 555936 - DNA, 20 bp, Artificial
  CRISPR gRNA sequence
gcctgagctggtgtgccaca

SEQ ID NO: 555937 - DNA, 20 bp, Artificial
  CRISPR gRNA sequence
agctggtgtgccacaaccct

SEQ ID NO: 555938 - DNA, 20 bp, Artificial
  CRISPR gRNA sequence
gtgtgccacaaccctgaccc

SEQ ID NO: 555939 - DNA, 20 bp, Artificial
  CRISPR gRNA sequence
acccaacccttaaaaaagaa

SEQ ID NO: 555940 - DNA, 20 bp, Artificial
  CRISPR gRNA sequence
aaaaaagaagatcaaaaagc

SEQ ID NO: 555941 - DNA, 20 bp, Artificial
  CRISPR gRNA sequence
aaaaagaagatcaaaaagca

SEQ ID NO: 555942 - DNA, 20 bp, Artificial
  CRISPR gRNA sequence
aggagaatacggccctactc

SEQ ID NO: 555943 - DNA, 20 bp, Artificial
  CRISPR gRNA sequence
ctctacacggcccttctgag

SEQ ID NO: 555944 - DNA, 20 bp, Artificial
  CRISPR gRNA sequence
tacacggcccttctgagatg

SEQ ID NO: 555945 - DNA, 20 bp, Artificial
  CRISPR gRNA sequence
cacggcccttctgagatgat

SEQ ID NO: 555946 - DNA, 20 bp, Artificial
  CRISPR gRNA sequence
ctgagatgattagcatacag

SEQ ID NO: 555947 - DNA, 20 bp, Artificial
  CRISPR gRNA sequence
tgagatgattagcatacagc

SEQ ID NO: 555948 - DNA, 20 bp, Artificial
  CRISPR gRNA sequence
agatgattagcatacagcag

SEQ ID NO: 555949 - DNA, 20 bp, Artificial
  CRISPR gRNA sequence
gcatacagcaggtgatgcag

SEQ ID NO: 555950 - DNA, 20 bp, Artificial
  CRISPR gRNA sequence
cacactcagcagattaagca

SEQ ID NO: 555951 - DNA, 20 bp, Artificial
  CRISPR gRNA sequence
agcagattaagcagctgaaa

SEQ ID NO: 555952 - DNA, 20 bp, Artificial
  CRISPR gRNA sequence
agcagctgaaaacagcgagt

SEQ ID NO: 555953 - DNA, 20 bp, Artificial
  CRISPR gRNA sequence
aaaacagcgagtgggtttct

SEQ ID NO: 555954 - DNA, 20 bp, Artificial
  CRISPR gRNA sequence
cttcaaatgaaaggaaagaa

SEQ ID NO: 555955 - DNA, 20 bp, Artificial
  CRISPR gRNA sequence
ttcaaatgaaaggaaagaat

SEQ ID NO: 555956 - DNA, 20 bp, Artificial
  CRISPR gRNA sequence
caaatgaaaggaaagaattc

SEQ ID NO: 555957 - DNA, 20 bp, Artificial
  CRISPR gRNA sequence
aaatgaaaggaaagaattca

SEQ ID NO: 555958 - DNA, 20 bp, Artificial
  CRISPR gRNA sequence
agtccaactgcaggagtggt

SEQ ID NO: 555959 - DNA, 20 bp, Artificial
  CRISPR gRNA sequence
caggagtggtaggagaggtt

SEQ ID NO: 555960 - DNA, 20 bp, Artificial
  CRISPR gRNA sequence
tagatccctggaacctcatc

SEQ ID NO: 555961 - DNA, 20 bp, Artificial
  CRISPR gRNA sequence
gatccctggaacctcatcac

SEQ ID NO: 555962 - DNA, 20 bp, Artificial
  CRISPR gRNA sequence
gaacctcatcaccagacctc

SEQ ID NO: 555963 - DNA, 20 bp, Artificial
  CRISPR gRNA sequence
atcaccagacctcggccctt

SEQ ID NO: 555964 - DNA, 20 bp, Artificial
  CRISPR gRNA sequence
ggcccttttagccaagtgat

SEQ ID NO: 555965 - DNA, 20 bp, Artificial
  CRISPR gRNA sequence
ttagccaagtgatccccacc

SEQ ID NO: 555966 - DNA, 20 bp, Artificial
  CRISPR gRNA sequence
tagccaagtgatccccaccc

SEQ ID NO: 555967 - DNA, 20 bp, Artificial
  CRISPR gRNA sequence
agccaagtgatccccacccc

SEQ ID NO: 555968 - DNA, 20 bp, Artificial
  CRISPR gRNA sequence
gccaagtgatccccacccca

SEQ ID NO: 555969 - DNA, 20 bp, Artificial
  CRISPR gRNA sequence
tggggccctcccgcagggaa

SEQ ID NO: 555970 - DNA, 20 bp, Artificial
  CRISPR gRNA sequence
ccgcagggaagggtccaggc

SEQ ID NO: 555971 - DNA, 20 bp, Artificial
  CRISPR gRNA sequence
caggcaccaaggctgcagag

SEQ ID NO: 555972 - DNA, 20 bp, Artificial
  CRISPR gRNA sequence
cagagggtattggacaaaac

SEQ ID NO: 555973 - DNA, 20 bp, Artificial
  CRISPR gRNA sequence
gacaaaacctcctatttctg

SEQ ID NO: 555974 - DNA, 20 bp, Artificial
  CRISPR gRNA sequence
ctatttctgaaatgcatttc

SEQ ID NO: 555975 - DNA, 20 bp, Artificial
  CRISPR gRNA sequence
tttctgaaatgcatttcagt

SEQ ID NO: 555976 - DNA, 20 bp, Artificial
  CRISPR gRNA sequence
ctgaaatgcatttcagttgc

SEQ ID NO: 555977 - DNA, 20 bp, Artificial
  CRISPR gRNA sequence
tgaaatgcatttcagttgcc

SEQ ID NO: 555978 - DNA, 20 bp, Artificial
  CRISPR gRNA sequence
aaatgcatttcagttgccac

SEQ ID NO: 555979 - DNA, 20 bp, Artificial
  CRISPR gRNA sequence
cagttgccactgtacacatt

SEQ ID NO: 555980 - DNA, 20 bp, Artificial
  CRISPR gRNA sequence
agttgccactgtacacatta

SEQ ID NO: 555981 - DNA, 20 bp, Artificial
  CRISPR gRNA sequence
ccactgtacacattaagcaa

SEQ ID NO: 555982 - DNA, 20 bp, Artificial
  CRISPR gRNA sequence
tacacattaagcaaaataat

SEQ ID NO: 555983 - DNA, 20 bp, Artificial
  CRISPR gRNA sequence
agcaaaataataaggaaaaa

SEQ ID NO: 555984 - DNA, 20 bp, Artificial
  CRISPR gRNA sequence
gaaaacgattagatggagta

SEQ ID NO: 555985 - DNA, 20 bp, Artificial
  CRISPR gRNA sequence
aaaacgattagatggagtaa

SEQ ID NO: 555986 - DNA, 20 bp, Artificial
  CRISPR gRNA sequence
gatggagtaagcgctgtcga

SEQ ID NO: 555987 - DNA, 20 bp, Artificial
  CRISPR gRNA sequence
tcgacgggattgtgccgcat

SEQ ID NO: 555988 - DNA, 20 bp, Artificial
  CRISPR gRNA sequence
tgccgcatgcggcaaagact

SEQ ID NO: 555989 - DNA, 20 bp, Artificial
  CRISPR gRNA sequence
aggcctcccgctacaggccc

SEQ ID NO: 555990 - DNA, 20 bp, Artificial
  CRISPR gRNA sequence
ccgctacaggcccggagtcg

SEQ ID NO: 555991 - DNA, 20 bp, Artificial
  CRISPR gRNA sequence
caggcccggagtcgcgacag

SEQ ID NO: 555992 - DNA, 20 bp, Artificial
  CRISPR gRNA sequence
ccaggcgcccacctccactt

SEQ ID NO: 555993 - DNA, 20 bp, Artificial
  CRISPR gRNA sequence
cacttcctactgctgcttgc

SEQ ID NO: 555994 - DNA, 20 bp, Artificial
  CRISPR gRNA sequence
cctactgctgcttgcattcc

SEQ ID NO: 555995 - DNA, 20 bp, Artificial
  CRISPR gRNA sequence
ctactgctgcttgcattccg

SEQ ID NO: 555996 - DNA, 20 bp, Artificial
  CRISPR gRNA sequence
ctgctgcttgcattccgccg

SEQ ID NO: 555997 - DNA, 20 bp, Artificial
  CRISPR gRNA sequence
ctgcttgcattccgccggct

SEQ ID NO: 555998 - DNA, 20 bp, Artificial
  CRISPR gRNA sequence
cttgcattccgccggctggc

SEQ ID NO: 555999 - DNA, 20 bp, Artificial
  CRISPR gRNA sequence
gcattccgccggctggctgg

SEQ ID NO: 556000 - DNA, 20 bp, Artificial
  CRISPR gRNA sequence
cattccgccggctggctggg

SEQ ID NO: 556001 - DNA, 20 bp, Artificial
  CRISPR gRNA sequence
cgccggctggctgggttcct

SEQ ID NO: 556002 - DNA, 20 bp, Artificial
  CRISPR gRNA sequence
gctgggttccttgttgggat

SEQ ID NO: 556003 - DNA, 20 bp, Artificial
  CRISPR gRNA sequence
ggttccttgttgggattaat

SEQ ID NO: 556004 - DNA, 20 bp, Artificial
  CRISPR gRNA sequence
cttgttgggattaatttcca

SEQ ID NO: 556005 - DNA, 20 bp, Artificial
  CRISPR gRNA sequence
gttgggattaatttccacct

SEQ ID NO: 556006 - DNA, 20 bp, Artificial
  CRISPR gRNA sequence
ttgggattaatttccacctc

SEQ ID NO: 556007 - DNA, 20 bp, Artificial
  CRISPR gRNA sequence
ggattaatttccacctcatc

SEQ ID NO: 556008 - DNA, 20 bp, Artificial
  CRISPR gRNA sequence
atttccacctcatcctcatc

SEQ ID NO: 556009 - DNA, 20 bp, Artificial
  CRISPR gRNA sequence
ccacctcatcctcatcttct

SEQ ID NO: 556010 - DNA, 20 bp, Artificial
  CRISPR gRNA sequence
cacctcatcctcatcttctc

SEQ ID NO: 556011 - DNA, 20 bp, Artificial
  CRISPR gRNA sequence
atcctcatcttctccctcct

SEQ ID NO: 556012 - DNA, 20 bp, Artificial
  CRISPR gRNA sequence
atcttctccctcctcatcac

SEQ ID NO: 556013 - DNA, 20 bp, Artificial
  CRISPR gRNA sequence
ctccctcctcatcaccttct

SEQ ID NO: 556014 - DNA, 20 bp, Artificial
  CRISPR gRNA sequence
tccctcctcatcaccttcta

SEQ ID NO: 556015 - DNA, 20 bp, Artificial
  CRISPR gRNA sequence
cctcctcatcaccttctaat

SEQ ID NO: 556016 - DNA, 20 bp, Artificial
  CRISPR gRNA sequence
ctcatcaccttctaattcgt

SEQ ID NO: 556017 - DNA, 20 bp, Artificial
  CRISPR gRNA sequence
atcaccttctaattcgtcct

SEQ ID NO: 556018 - DNA, 20 bp, Artificial
  CRISPR gRNA sequence
ctaattcgtcctcttcttct

SEQ ID NO: 556019 - DNA, 20 bp, Artificial
  CRISPR gRNA sequence
taattcgtcctcttcttctt

SEQ ID NO: 556020 - DNA, 20 bp, Artificial
  CRISPR gRNA sequence
attcgtcctcttcttcttca

SEQ ID NO: 556021 - DNA, 20 bp, Artificial
  CRISPR gRNA sequence
gtcctcttcttcttcacctt

SEQ ID NO: 556022 - DNA, 20 bp, Artificial
  CRISPR gRNA sequence
ttcttcttcaccttcgtcaa

SEQ ID NO: 556023 - DNA, 20 bp, Artificial
  CRISPR gRNA sequence
cttcttcaccttcgtcaaaa

SEQ ID NO: 556024 - DNA, 20 bp, Artificial
  CRISPR gRNA sequence
ttcttcaccttcgtcaaaat

SEQ ID NO: 556025 - DNA, 20 bp, Artificial
  CRISPR gRNA sequence
cttcaccttcgtcaaaattg

SEQ ID NO: 556026 - DNA, 20 bp, Artificial
  CRISPR gRNA sequence
ttcaccttcgtcaaaattgt

SEQ ID NO: 556027 - DNA, 20 bp, Artificial
  CRISPR gRNA sequence
caccttcgtcaaaattgtca

SEQ ID NO: 556028 - DNA, 20 bp, Artificial
  CRISPR gRNA sequence
accttcgtcaaaattgtcat

SEQ ID NO: 556029 - DNA, 20 bp, Artificial
  CRISPR gRNA sequence
cgtcaaaattgtcatcatcc

SEQ ID NO: 556030 - DNA, 20 bp, Artificial
  CRISPR gRNA sequence
gtcaaaattgtcatcatcct

SEQ ID NO: 556031 - DNA, 20 bp, Artificial
  CRISPR gRNA sequence
tcatcatcctttaaggcctc

SEQ ID NO: 556032 - DNA, 20 bp, Artificial
  CRISPR gRNA sequence
taaggcctccccagcgaagt

SEQ ID NO: 556033 - DNA, 20 bp, Artificial
  CRISPR gRNA sequence
aaggcctccccagcgaagta

SEQ ID NO: 556034 - DNA, 20 bp, Artificial
  CRISPR gRNA sequence
aggcctccccagcgaagtac

SEQ ID NO: 556035 - DNA, 20 bp, Artificial
  CRISPR gRNA sequence
cccagcgaagtacagcacag

SEQ ID NO: 556036 - DNA, 20 bp, Artificial
  CRISPR gRNA sequence
tggtccgctcacggaaaaag

SEQ ID NO: 556037 - DNA, 20 bp, Artificial
  CRISPR gRNA sequence
acggaaaaagtgtccaattt

SEQ ID NO: 556038 - DNA, 20 bp, Artificial
  CRISPR gRNA sequence
caaaatcagaggctaatacg

SEQ ID NO: 556039 - DNA, 20 bp, Artificial
  CRISPR gRNA sequence
aaaatcagaggctaatacga

SEQ ID NO: 556040 - DNA, 20 bp, Artificial
  CRISPR gRNA sequence
atacgaattcagaatcttta

SEQ ID NO: 556041 - DNA, 20 bp, Artificial
  CRISPR gRNA sequence
agaatctttatccagtgatt

SEQ ID NO: 556042 - DNA, 20 bp, Artificial
  CRISPR gRNA sequence
tatccagtgattctccgtcc

SEQ ID NO: 556043 - DNA, 20 bp, Artificial
  CRISPR gRNA sequence
atccagtgattctccgtccc

SEQ ID NO: 556044 - DNA, 20 bp, Artificial
  CRISPR gRNA sequence
tccagtgattctccgtcccc

SEQ ID NO: 556045 - DNA, 20 bp, Artificial
  CRISPR gRNA sequence
tccgtccccagatgctttca

SEQ ID NO: 556046 - DNA, 20 bp, Artificial
  CRISPR gRNA sequence
cgtccccagatgctttcagt

SEQ ID NO: 556047 - DNA, 20 bp, Artificial
  CRISPR gRNA sequence
tcagtggattgaagaagttg

SEQ ID NO: 556048 - DNA, 20 bp, Artificial
  CRISPR gRNA sequence
cagtggattgaagaagttga

SEQ ID NO: 556049 - DNA, 20 bp, Artificial
  CRISPR gRNA sequence
agtggattgaagaagttgaa

SEQ ID NO: 556050 - DNA, 20 bp, Artificial
  CRISPR gRNA sequence
aagaagttgaaaaatgactc

SEQ ID NO: 556051 - DNA, 20 bp, Artificial
  CRISPR gRNA sequence
aaaaatgactcattggatac

SEQ ID NO: 556052 - DNA, 20 bp, Artificial
  CRISPR gRNA sequence
attggatacttgtttggtaa

SEQ ID NO: 556053 - DNA, 20 bp, Artificial
  CRISPR gRNA sequence
gatacttgtttggtaattgt

SEQ ID NO: 556054 - DNA, 20 bp, Artificial
  CRISPR gRNA sequence
gtttggtaattgttctaaca

SEQ ID NO: 556055 - DNA, 20 bp, Artificial
  CRISPR gRNA sequence
tttggtaattgttctaacag

SEQ ID NO: 556056 - DNA, 20 bp, Artificial
  CRISPR gRNA sequence
ggtaattgttctaacagtgc

SEQ ID NO: 556057 - DNA, 20 bp, Artificial
  CRISPR gRNA sequence
gtaattgttctaacagtgcc

SEQ ID NO: 556058 - DNA, 20 bp, Artificial
  CRISPR gRNA sequence
ttctaacagtgcctggaccc

SEQ ID NO: 556059 - DNA, 20 bp, Artificial
  CRISPR gRNA sequence
taacagtgcctggaccctta

SEQ ID NO: 556060 - DNA, 20 bp, Artificial
  CRISPR gRNA sequence
acagtgcctggacccttacg

SEQ ID NO: 556061 - DNA, 20 bp, Artificial
  CRISPR gRNA sequence
gacccttacgcttctgcttt

SEQ ID NO: 556062 - DNA, 20 bp, Artificial
  CRISPR gRNA sequence
acgcttctgctttttcttga

SEQ ID NO: 556063 - DNA, 20 bp, Artificial
  CRISPR gRNA sequence
cgcttctgctttttcttgat

SEQ ID NO: 556064 - DNA, 20 bp, Artificial
  CRISPR gRNA sequence
ctgctttttcttgatggttt

SEQ ID NO: 556065 - DNA, 20 bp, Artificial
  CRISPR gRNA sequence
tgctttttcttgatggtttt

SEQ ID NO: 556066 - DNA, 20 bp, Artificial
  CRISPR gRNA sequence
ctttttcttgatggttttga

SEQ ID NO: 556067 - DNA, 20 bp, Artificial
  CRISPR gRNA sequence
tttcttgatggttttgacag

SEQ ID NO: 556068 - DNA, 20 bp, Artificial
  CRISPR gRNA sequence
ttcttgatggttttgacagt

SEQ ID NO: 556069 - DNA, 20 bp, Artificial
  CRISPR gRNA sequence
tcttgatggttttgacagta

SEQ ID NO: 556070 - DNA, 20 bp, Artificial
  CRISPR gRNA sequence
cttgatggttttgacagtaa

SEQ ID NO: 556071 - DNA, 20 bp, Artificial
  CRISPR gRNA sequence
ttgatggttttgacagtaac

SEQ ID NO: 556072 - DNA, 20 bp, Artificial
  CRISPR gRNA sequence
gatggttttgacagtaacat

SEQ ID NO: 556073 - DNA, 20 bp, Artificial
  CRISPR gRNA sequence
atggttttgacagtaacatt

SEQ ID NO: 556074 - DNA, 20 bp, Artificial
  CRISPR gRNA sequence
tgacagtaacattctttcct

SEQ ID NO: 556075 - DNA, 20 bp, Artificial
  CRISPR gRNA sequence
gacagtaacattctttcctt

SEQ ID NO: 556076 - DNA, 20 bp, Artificial
  CRISPR gRNA sequence
acagtaacattctttccttt

SEQ ID NO: 556077 - DNA, 20 bp, Artificial
  CRISPR gRNA sequence
tttcctttcttccagtcaat

SEQ ID NO: 556078 - DNA, 20 bp, Artificial
  CRISPR gRNA sequence
tcctttcttccagtcaatag

SEQ ID NO: 556079 - DNA, 20 bp, Artificial
  CRISPR gRNA sequence
cctttcttccagtcaatagt

SEQ ID NO: 556080 - DNA, 20 bp, Artificial
  CRISPR gRNA sequence
ctttcttccagtcaatagta

SEQ ID NO: 556081 - DNA, 20 bp, Artificial
  CRISPR gRNA sequence
tcttccagtcaatagtacac

SEQ ID NO: 556082 - DNA, 20 bp, Artificial
  CRISPR gRNA sequence
cttccagtcaatagtacacc

SEQ ID NO: 556083 - DNA, 20 bp, Artificial
  CRISPR gRNA sequence
ttccagtcaatagtacaccc

SEQ ID NO: 556084 - DNA, 20 bp, Artificial
  CRISPR gRNA sequence
ccagtcaatagtacacccat

SEQ ID NO: 556085 - DNA, 20 bp, Artificial
  CRISPR gRNA sequence
cagtcaatagtacacccatc

SEQ ID NO: 556086 - DNA, 20 bp, Artificial
  CRISPR gRNA sequence
aggacctgcaaatgaaaagg

SEQ ID NO: 556087 - DNA, 20 bp, Artificial
  CRISPR gRNA sequence
caaatgaaaagggatcagcc

SEQ ID NO: 556088 - DNA, 20 bp, Artificial
  CRISPR gRNA sequence
atctggttctgatttcatct

SEQ ID NO: 556089 - DNA, 20 bp, Artificial
  CRISPR gRNA sequence
tctggttctgatttcatctt

SEQ ID NO: 556090 - DNA, 20 bp, Artificial
  CRISPR gRNA sequence
gttctgatttcatcttgcag

SEQ ID NO: 556091 - DNA, 20 bp, Artificial
  CRISPR gRNA sequence
tgatttcatcttgcaggttt

SEQ ID NO: 556092 - DNA, 20 bp, Artificial
  CRISPR gRNA sequence
atttcatcttgcaggttttt

SEQ ID NO: 556093 - DNA, 20 bp, Artificial
  CRISPR gRNA sequence
catcttgcaggtttttgtca

SEQ ID NO: 556094 - DNA, 20 bp, Artificial
  CRISPR gRNA sequence
atcttgcaggtttttgtcag

SEQ ID NO: 556095 - DNA, 20 bp, Artificial
  CRISPR gRNA sequence
gcaggtttttgtcaggactg

SEQ ID NO: 556096 - DNA, 20 bp, Artificial
  CRISPR gRNA sequence
caggtttttgtcaggactga

SEQ ID NO: 556097 - DNA, 20 bp, Artificial
  CRISPR gRNA sequence
ttgtcaggactgagttggca

SEQ ID NO: 556098 - DNA, 20 bp, Artificial
  CRISPR gRNA sequence
tgtcaggactgagttggcaa

SEQ ID NO: 556099 - DNA, 20 bp, Artificial
  CRISPR gRNA sequence
gtcaggactgagttggcaaa

SEQ ID NO: 556100 - DNA, 20 bp, Artificial
  CRISPR gRNA sequence
tcaggactgagttggcaaag

SEQ ID NO: 556101 - DNA, 20 bp, Artificial
  CRISPR gRNA sequence
agttggcaaagcagtcattg

SEQ ID NO: 556102 - DNA, 20 bp, Artificial
  CRISPR gRNA sequence
gcaaagcagtcattgggttg

SEQ ID NO: 556103 - DNA, 20 bp, Artificial
  CRISPR gRNA sequence
ggttgaaagtggaactctta

SEQ ID NO: 556104 - DNA, 20 bp, Artificial
  CRISPR gRNA sequence
aaagtggaactcttaatatg

SEQ ID NO: 556105 - DNA, 20 bp, Artificial
  CRISPR gRNA sequence
ttaatatgaaagacataggc

SEQ ID NO: 556106 - DNA, 20 bp, Artificial
  CRISPR gRNA sequence
aatatgaaagacataggctg

SEQ ID NO: 556107 - DNA, 20 bp, Artificial
  CRISPR gRNA sequence
atatgaaagacataggctgt

SEQ ID NO: 556108 - DNA, 20 bp, Artificial
  CRISPR gRNA sequence
tccagggtcagaaaacttca

SEQ ID NO: 556109 - DNA, 20 bp, Artificial
  CRISPR gRNA sequence
cactttaatatcctgcaggt

SEQ ID NO: 556110 - DNA, 20 bp, Artificial
  CRISPR gRNA sequence
actttaatatcctgcaggta

SEQ ID NO: 556111 - DNA, 20 bp, Artificial
  CRISPR gRNA sequence
taatatcctgcaggtatttc

SEQ ID NO: 556112 - DNA, 20 bp, Artificial
  CRISPR gRNA sequence
aatatcctgcaggtatttca

SEQ ID NO: 556113 - DNA, 20 bp, Artificial
  CRISPR gRNA sequence
atatcctgcaggtatttcaa

SEQ ID NO: 556114 - DNA, 20 bp, Artificial
  CRISPR gRNA sequence
caggtatttcaagattggtt

SEQ ID NO: 556115 - DNA, 20 bp, Artificial
  CRISPR gRNA sequence
caagattggttcatcatatt

SEQ ID NO: 556116 - DNA, 20 bp, Artificial
  CRISPR gRNA sequence
aagattggttcatcatattc

SEQ ID NO: 556117 - DNA, 20 bp, Artificial
  CRISPR gRNA sequence
gttcatcatattcctggact

SEQ ID NO: 556118 - DNA, 20 bp, Artificial
  CRISPR gRNA sequence
atcatattcctggactaatt

SEQ ID NO: 556119 - DNA, 20 bp, Artificial
  CRISPR gRNA sequence
ctggactaattcacttagca

SEQ ID NO: 556120 - DNA, 20 bp, Artificial
  CRISPR gRNA sequence
gactaattcacttagcatat

SEQ ID NO: 556121 - DNA, 20 bp, Artificial
  CRISPR gRNA sequence
attcacttagcatatctaca

SEQ ID NO: 556122 - DNA, 20 bp, Artificial
  CRISPR gRNA sequence
acttagcatatctacatttc

SEQ ID NO: 556123 - DNA, 20 bp, Artificial
  CRISPR gRNA sequence
agcatatctacatttctaaa

SEQ ID NO: 556124 - DNA, 20 bp, Artificial
  CRISPR gRNA sequence
gcatatctacatttctaaag

SEQ ID NO: 556125 - DNA, 20 bp, Artificial
  CRISPR gRNA sequence
catttctaaagatggtaaac

SEQ ID NO: 556126 - DNA, 20 bp, Artificial
  CRISPR gRNA sequence
ctaaagatggtaaaccagaa

SEQ ID NO: 556127 - DNA, 20 bp, Artificial
  CRISPR gRNA sequence
taaagatggtaaaccagaac

SEQ ID NO: 556128 - DNA, 20 bp, Artificial
  CRISPR gRNA sequence
aagatggtaaaccagaactc

SEQ ID NO: 556129 - DNA, 20 bp, Artificial
  CRISPR gRNA sequence
tggaattcctttgggatttg

SEQ ID NO: 556130 - DNA, 20 bp, Artificial
  CRISPR gRNA sequence
gaattcctttgggatttggc

SEQ ID NO: 556131 - DNA, 20 bp, Artificial
  CRISPR gRNA sequence
ctttgggatttggctcttca

SEQ ID NO: 556132 - DNA, 20 bp, Artificial
  CRISPR gRNA sequence
tgggatttggctcttcagct

SEQ ID NO: 556133 - DNA, 20 bp, Artificial
  CRISPR gRNA sequence
gggatttggctcttcagctg

SEQ ID NO: 556134 - DNA, 20 bp, Artificial
  CRISPR gRNA sequence
ggatttggctcttcagctgt

SEQ ID NO: 556135 - DNA, 20 bp, Artificial
  CRISPR gRNA sequence
ggctcttcagctgttgctgc

SEQ ID NO: 556136 - DNA, 20 bp, Artificial
  CRISPR gRNA sequence
gctcttcagctgttgctgct

SEQ ID NO: 556137 - DNA, 20 bp, Artificial
  CRISPR gRNA sequence
ttcagctgttgctgctgctt

SEQ ID NO: 556138 - DNA, 20 bp, Artificial
  CRISPR gRNA sequence
cagctgttgctgctgctttt

SEQ ID NO: 556139 - DNA, 20 bp, Artificial
  CRISPR gRNA sequence
agctgttgctgctgcttttt

SEQ ID NO: 556140 - DNA, 20 bp, Artificial
  CRISPR gRNA sequence
ttgctgctgctttttctgtt

SEQ ID NO: 556141 - DNA, 20 bp, Artificial
  CRISPR gRNA sequence
ctgctgctttttctgttatg

SEQ ID NO: 556142 - DNA, 20 bp, Artificial
  CRISPR gRNA sequence
ctgctttttctgttatgact

SEQ ID NO: 556143 - DNA, 20 bp, Artificial
  CRISPR gRNA sequence
ctttttctgttatgactact

SEQ ID NO: 556144 - DNA, 20 bp, Artificial
  CRISPR gRNA sequence
tttctgttatgactacttta

SEQ ID NO: 556145 - DNA, 20 bp, Artificial
  CRISPR gRNA sequence
ttctgttatgactactttat

SEQ ID NO: 556146 - DNA, 20 bp, Artificial
  CRISPR gRNA sequence
tctgttatgactactttatt

SEQ ID NO: 556147 - DNA, 20 bp, Artificial
  CRISPR gRNA sequence
ctgttatgactactttattt

SEQ ID NO: 556148 - DNA, 20 bp, Artificial
  CRISPR gRNA sequence
tgttatgactactttatttt

SEQ ID NO: 556149 - DNA, 20 bp, Artificial
  CRISPR gRNA sequence
ttatgactactttatttttc

SEQ ID NO: 556150 - DNA, 20 bp, Artificial
  CRISPR gRNA sequence
tgactactttatttttcctg

SEQ ID NO: 556151 - DNA, 20 bp, Artificial
  CRISPR gRNA sequence
ctttatttttcctgtctcca

SEQ ID NO: 556152 - DNA, 20 bp, Artificial
  CRISPR gRNA sequence
tatttttcctgtctccagcc

SEQ ID NO: 556153 - DNA, 20 bp, Artificial
  CRISPR gRNA sequence
atttttcctgtctccagcca

SEQ ID NO: 556154 - DNA, 20 bp, Artificial
  CRISPR gRNA sequence
tttttcctgtctccagccaa

SEQ ID NO: 556155 - DNA, 20 bp, Artificial
  CRISPR gRNA sequence
ttcctgtctccagccaattt

SEQ ID NO: 556156 - DNA, 20 bp, Artificial
  CRISPR gRNA sequence
tcctgtctccagccaatttc

SEQ ID NO: 556157 - DNA, 20 bp, Artificial
  CRISPR gRNA sequence
cctgtctccagccaatttct

SEQ ID NO: 556158 - DNA, 20 bp, Artificial
  CRISPR gRNA sequence
ctgtctccagccaatttctc

SEQ ID NO: 556159 - DNA, 20 bp, Artificial
  CRISPR gRNA sequence
tctccagccaatttctcctc

SEQ ID NO: 556160 - DNA, 20 bp, Artificial
  CRISPR gRNA sequence
cagccaatttctcctcctct

SEQ ID NO: 556161 - DNA, 20 bp, Artificial
  CRISPR gRNA sequence
ctcctcctcttcattttcac

SEQ ID NO: 556162 - DNA, 20 bp, Artificial
  CRISPR gRNA sequence
tcctcctcttcattttcacg

SEQ ID NO: 556163 - DNA, 20 bp, Artificial
  CRISPR gRNA sequence
ctcctcttcattttcacggt

SEQ ID NO: 556164 - DNA, 20 bp, Artificial
  CRISPR gRNA sequence
ctcttcattttcacggtgcc

SEQ ID NO: 556165 - DNA, 20 bp, Artificial
  CRISPR gRNA sequence
ttcattttcacggtgccatt

SEQ ID NO: 556166 - DNA, 20 bp, Artificial
  CRISPR gRNA sequence
cattttcacggtgccattct

SEQ ID NO: 556167 - DNA, 20 bp, Artificial
  CRISPR gRNA sequence
attttcacggtgccattctg

SEQ ID NO: 556168 - DNA, 20 bp, Artificial
  CRISPR gRNA sequence
tcacggtgccattctgattc

SEQ ID NO: 556169 - DNA, 20 bp, Artificial
  CRISPR gRNA sequence
cacggtgccattctgattcc

SEQ ID NO: 556170 - DNA, 20 bp, Artificial
  CRISPR gRNA sequence
acggtgccattctgattcca

SEQ ID NO: 556171 - DNA, 20 bp, Artificial
  CRISPR gRNA sequence
tgattccatatcagatgttg

SEQ ID NO: 556172 - DNA, 20 bp, Artificial
  CRISPR gRNA sequence
attccatatcagatgttggt

SEQ ID NO: 556173 - DNA, 20 bp, Artificial
  CRISPR gRNA sequence
catatcagatgttggttcaa

SEQ ID NO: 556174 - DNA, 20 bp, Artificial
  CRISPR gRNA sequence
gttcaacatcaccggtgata

SEQ ID NO: 556175 - DNA, 20 bp, Artificial
  CRISPR gRNA sequence
aacatcaccggtgataaatt

SEQ ID NO: 556176 - DNA, 20 bp, Artificial
  CRISPR gRNA sequence
tcttctctcgtcaaagagag

SEQ ID NO: 556177 - DNA, 20 bp, Artificial
  CRISPR gRNA sequence
ttctctcgtcaaagagaggc

SEQ ID NO: 556178 - DNA, 20 bp, Artificial
  CRISPR gRNA sequence
ctctcgtcaaagagaggctg

SEQ ID NO: 556179 - DNA, 20 bp, Artificial
  CRISPR gRNA sequence
tctcgtcaaagagaggctgg

SEQ ID NO: 556180 - DNA, 20 bp, Artificial
  CRISPR gRNA sequence
tcgtcaaagagaggctggta

SEQ ID NO: 556181 - DNA, 20 bp, Artificial
  CRISPR gRNA sequence
gtcaaagagaggctggtata

SEQ ID NO: 556182 - DNA, 20 bp, Artificial
  CRISPR gRNA sequence
gtataatgctgcatattttc

SEQ ID NO: 556183 - DNA, 20 bp, Artificial
  CRISPR gRNA sequence
catattttctttccaagtca

SEQ ID NO: 556184 - DNA, 20 bp, Artificial
  CRISPR gRNA sequence
tctttccaagtcatgaactt

SEQ ID NO: 556185 - DNA, 20 bp, Artificial
  CRISPR gRNA sequence
ctttccaagtcatgaacttc

SEQ ID NO: 556186 - DNA, 20 bp, Artificial
  CRISPR gRNA sequence
tttccaagtcatgaacttct

SEQ ID NO: 556187 - DNA, 20 bp, Artificial
  CRISPR gRNA sequence
tccaagtcatgaacttcttc

SEQ ID NO: 556188 - DNA, 20 bp, Artificial
  CRISPR gRNA sequence
ccaagtcatgaacttcttca

SEQ ID NO: 556189 - DNA, 20 bp, Artificial
  CRISPR gRNA sequence
caagtcatgaacttcttcat

SEQ ID NO: 556190 - DNA, 20 bp, Artificial
  CRISPR gRNA sequence
cttcatagaacttggcttct

SEQ ID NO: 556191 - DNA, 20 bp, Artificial
  CRISPR gRNA sequence
ttcatagaacttggcttcta

SEQ ID NO: 556192 - DNA, 20 bp, Artificial
  CRISPR gRNA sequence
catagaacttggcttctata

SEQ ID NO: 556193 - DNA, 20 bp, Artificial
  CRISPR gRNA sequence
atagaacttggcttctatat

SEQ ID NO: 556194 - DNA, 20 bp, Artificial
  CRISPR gRNA sequence
ggcttctatatgagcgcatc

SEQ ID NO: 556195 - DNA, 20 bp, Artificial
  CRISPR gRNA sequence
gcttctatatgagcgcatct

SEQ ID NO: 556196 - DNA, 20 bp, Artificial
  CRISPR gRNA sequence
ctatatgagcgcatctcacc

SEQ ID NO: 556197 - DNA, 20 bp, Artificial
  CRISPR gRNA sequence
tatatgagcgcatctcacct

SEQ ID NO: 556198 - DNA, 20 bp, Artificial
  CRISPR gRNA sequence
tatgagcgcatctcacctga

SEQ ID NO: 556199 - DNA, 20 bp, Artificial
  CRISPR gRNA sequence
acctgaatttgtttcaatgc

SEQ ID NO: 556200 - DNA, 20 bp, Artificial
  CRISPR gRNA sequence
aatttgtttcaatgcattaa

SEQ ID NO: 556201 - DNA, 20 bp, Artificial
  CRISPR gRNA sequence
gtttcaatgcattaattctt

SEQ ID NO: 556202 - DNA, 20 bp, Artificial
  CRISPR gRNA sequence
tttcaatgcattaattcttc

SEQ ID NO: 556203 - DNA, 20 bp, Artificial
  CRISPR gRNA sequence
caatgcattaattcttcttt

SEQ ID NO: 556204 - DNA, 20 bp, Artificial
  CRISPR gRNA sequence
aatgcattaattcttctttt

SEQ ID NO: 556205 - DNA, 20 bp, Artificial
  CRISPR gRNA sequence
attcttctttttactgcttt

SEQ ID NO: 556206 - DNA, 20 bp, Artificial
  CRISPR gRNA sequence
ttctttttactgctttaggt

SEQ ID NO: 556207 - DNA, 20 bp, Artificial
  CRISPR gRNA sequence
ctttttactgctttaggtaa

SEQ ID NO: 556208 - DNA, 20 bp, Artificial
  CRISPR gRNA sequence
tttttactgctttaggtaaa

SEQ ID NO: 556209 - DNA, 20 bp, Artificial
  CRISPR gRNA sequence
tttactgctttaggtaaagt

SEQ ID NO: 556210 - DNA, 20 bp, Artificial
  CRISPR gRNA sequence
ttactgctttaggtaaagtt

SEQ ID NO: 556211 - DNA, 20 bp, Artificial
  CRISPR gRNA sequence
tactgctttaggtaaagttt

SEQ ID NO: 556212 - DNA, 20 bp, Artificial
  CRISPR gRNA sequence
actgctttaggtaaagtttc

SEQ ID NO: 556213 - DNA, 20 bp, Artificial
  CRISPR gRNA sequence
ctgctttaggtaaagtttcg

SEQ ID NO: 556214 - DNA, 20 bp, Artificial
  CRISPR gRNA sequence
ctttaggtaaagtttcgatg

SEQ ID NO: 556215 - DNA, 20 bp, Artificial
  CRISPR gRNA sequence
taggtaaagtttcgatgtag

SEQ ID NO: 556216 - DNA, 20 bp, Artificial
  CRISPR gRNA sequence
aggtaaagtttcgatgtagc

SEQ ID NO: 556217 - DNA, 20 bp, Artificial
  CRISPR gRNA sequence
ggtaaagtttcgatgtagct

SEQ ID NO: 556218 - DNA, 20 bp, Artificial
  CRISPR gRNA sequence
cgatgtagctggaaggggtg

SEQ ID NO: 556219 - DNA, 20 bp, Artificial
  CRISPR gRNA sequence
gatgtagctggaaggggtgt

SEQ ID NO: 556220 - DNA, 20 bp, Artificial
  CRISPR gRNA sequence
gaaggggtgtgaggggcatt

SEQ ID NO: 556221 - DNA, 20 bp, Artificial
  CRISPR gRNA sequence
tcaagtcgctcctgtaaagc

SEQ ID NO: 556222 - DNA, 20 bp, Artificial
  CRISPR gRNA sequence
ctgtaaagctgccaaaactc

SEQ ID NO: 556223 - DNA, 20 bp, Artificial
  CRISPR gRNA sequence
taaagctgccaaaactccag

SEQ ID NO: 556224 - DNA, 20 bp, Artificial
  CRISPR gRNA sequence
ccaaaactccaggattctgc

SEQ ID NO: 556225 - DNA, 20 bp, Artificial
  CRISPR gRNA sequence
caggattctgcatcacctga

SEQ ID NO: 556226 - DNA, 20 bp, Artificial
  CRISPR gRNA sequence
tgcatcacctgatccgtgag

SEQ ID NO: 556227 - DNA, 20 bp, Artificial
  CRISPR gRNA sequence
catcacctgatccgtgagct

SEQ ID NO: 556228 - DNA, 20 bp, Artificial
  CRISPR gRNA sequence
atccgtgagcttttccgtct

SEQ ID NO: 556229 - DNA, 20 bp, Artificial
  CRISPR gRNA sequence
ttccgtcttacttgcatttt

SEQ ID NO: 556230 - DNA, 20 bp, Artificial
  CRISPR gRNA sequence
tccgtcttacttgcattttt

SEQ ID NO: 556231 - DNA, 20 bp, Artificial
  CRISPR gRNA sequence
ccgtcttacttgcattttta

SEQ ID NO: 556232 - DNA, 20 bp, Artificial
  CRISPR gRNA sequence
cgtcttacttgcatttttag

SEQ ID NO: 556233 - DNA, 20 bp, Artificial
  CRISPR gRNA sequence
acttgcatttttagcagctt

SEQ ID NO: 556234 - DNA, 20 bp, Artificial
  CRISPR gRNA sequence
cttgcatttttagcagcttc

SEQ ID NO: 556235 - DNA, 20 bp, Artificial
  CRISPR gRNA sequence
gcatttttagcagcttccac

SEQ ID NO: 556236 - DNA, 20 bp, Artificial
  CRISPR gRNA sequence
catttttagcagcttccacg

SEQ ID NO: 556237 - DNA, 20 bp, Artificial
  CRISPR gRNA sequence
ttagcagcttccacgaaatc

SEQ ID NO: 556238 - DNA, 20 bp, Artificial
  CRISPR gRNA sequence
tagcagcttccacgaaatct

SEQ ID NO: 556239 - DNA, 20 bp, Artificial
  CRISPR gRNA sequence
agcagcttccacgaaatctg

SEQ ID NO: 556240 - DNA, 20 bp, Artificial
  CRISPR gRNA sequence
gcagcttccacgaaatctga

SEQ ID NO: 556241 - DNA, 20 bp, Artificial
  CRISPR gRNA sequence
ccacgaaatctgaaggaacc

SEQ ID NO: 556242 - DNA, 20 bp, Artificial
  CRISPR gRNA sequence
cacgaaatctgaaggaaccc

SEQ ID NO: 556243 - DNA, 20 bp, Artificial
  CRISPR gRNA sequence
aaggaaccccatctgaaaaa

SEQ ID NO: 556244 - DNA, 20 bp, Artificial
  CRISPR gRNA sequence
aaaaactgttatctgccatc

SEQ ID NO: 556245 - DNA, 20 bp, Artificial
  CRISPR gRNA sequence
ttatctgccatctgaatgtt

SEQ ID NO: 556246 - DNA, 20 bp, Artificial
  CRISPR gRNA sequence
tctgccatctgaatgttttt

SEQ ID NO: 556247 - DNA, 20 bp, Artificial
  CRISPR gRNA sequence
ccatctgaatgtttttatcc

SEQ ID NO: 556248 - DNA, 20 bp, Artificial
  CRISPR gRNA sequence
aatgtttttatccccttgtc

SEQ ID NO: 556249 - DNA, 20 bp, Artificial
  CRISPR gRNA sequence
ttatccccttgtctggtaaa

SEQ ID NO: 556250 - DNA, 20 bp, Artificial
  CRISPR gRNA sequence
tatccccttgtctggtaaac

SEQ ID NO: 556251 - DNA, 20 bp, Artificial
  CRISPR gRNA sequence
atccccttgtctggtaaacc

SEQ ID NO: 556252 - DNA, 20 bp, Artificial
  CRISPR gRNA sequence
tccccttgtctggtaaacca

SEQ ID NO: 556253 - DNA, 20 bp, Artificial
  CRISPR gRNA sequence
gtctggtaaaccaagtcccg

SEQ ID NO: 556254 - DNA, 20 bp, Artificial
  CRISPR gRNA sequence
tctggtaaaccaagtcccgt

SEQ ID NO: 556255 - DNA, 20 bp, Artificial
  CRISPR gRNA sequence
gtaaaccaagtcccgtgagt

SEQ ID NO: 556256 - DNA, 20 bp, Artificial
  CRISPR gRNA sequence
ggctaaggcactcaggccag

SEQ ID NO: 556257 - DNA, 20 bp, Artificial
  CRISPR gRNA sequence
aggcactcaggccagtcctc

SEQ ID NO: 556258 - DNA, 20 bp, Artificial
  CRISPR gRNA sequence
aggccagtcctcggggagca

SEQ ID NO: 556259 - DNA, 20 bp, Artificial
  CRISPR gRNA sequence
ggggagcacacgccgcccat

SEQ ID NO: 556260 - DNA, 20 bp, Artificial
  CRISPR gRNA sequence
gctcgcaccgcacagctccc

SEQ ID NO: 556261 - DNA, 20 bp, Artificial
  CRISPR gRNA sequence
gcaccgcacagctcccaaca

SEQ ID NO: 556262 - DNA, 20 bp, Artificial
  CRISPR gRNA sequence
ccaacagctgagatgcaatg

SEQ ID NO: 556263 - DNA, 20 bp, Artificial
  CRISPR gRNA sequence
agatgcaatgccaaggactt

SEQ ID NO: 556264 - DNA, 20 bp, Artificial
  CRISPR gRNA sequence
tcttccccatcagacatgcc

SEQ ID NO: 556265 - DNA, 20 bp, Artificial
  CRISPR gRNA sequence
cttccccatcagacatgccc

SEQ ID NO: 556266 - DNA, 20 bp, Artificial
  CRISPR gRNA sequence
ttccccatcagacatgccct

SEQ ID NO: 556267 - DNA, 20 bp, Artificial
  CRISPR gRNA sequence
ccccatcagacatgccctcg

SEQ ID NO: 556268 - DNA, 20 bp, Artificial
  CRISPR gRNA sequence
cccatcagacatgccctcgt

SEQ ID NO: 556269 - DNA, 20 bp, Artificial
  CRISPR gRNA sequence
gtccacacgaaacttacaat

SEQ ID NO: 556270 - DNA, 20 bp, Artificial
  CRISPR gRNA sequence
acaatcaaaaccccagttag

SEQ ID NO: 556271 - DNA, 20 bp, Artificial
  CRISPR gRNA sequence
caatcaaaaccccagttagc

SEQ ID NO: 556272 - DNA, 20 bp, Artificial
  CRISPR gRNA sequence
gcccagcctgaccccacaga

SEQ ID NO: 556273 - DNA, 20 bp, Artificial
  CRISPR gRNA sequence
accccacagatgctcacgat

SEQ ID NO: 556274 - DNA, 20 bp, Artificial
  CRISPR gRNA sequence
acgatgaccatcgccctacg

SEQ ID NO: 556275 - DNA, 20 bp, Artificial
  CRISPR gRNA sequence
cggaaaaactcaaattccta

SEQ ID NO: 556276 - DNA, 20 bp, Artificial
  CRISPR gRNA sequence
aaattcctaaacatctaata

SEQ ID NO: 556277 - DNA, 20 bp, Artificial
  CRISPR gRNA sequence
ctaaacatctaataaagagg

SEQ ID NO: 556278 - DNA, 20 bp, Artificial
  CRISPR gRNA sequence
aacatctaataaagaggtcc

SEQ ID NO: 556279 - DNA, 20 bp, Artificial
  CRISPR gRNA sequence
ataaagaggtcctggacgtc

SEQ ID NO: 556280 - DNA, 20 bp, Artificial
  CRISPR gRNA sequence
gacgtctccaccttaaaaac

SEQ ID NO: 556281 - DNA, 20 bp, Artificial
  CRISPR gRNA sequence
caccttaaaaacgggaagcc

SEQ ID NO: 556282 - DNA, 20 bp, Artificial
  CRISPR gRNA sequence
aaaaacgggaagcctgaatg

SEQ ID NO: 556283 - DNA, 20 bp, Artificial
  CRISPR gRNA sequence
aaaacgggaagcctgaatgc

SEQ ID NO: 556284 - DNA, 20 bp, Artificial
  CRISPR gRNA sequence
aatgctcctccgggtgcgcc

SEQ ID NO: 556285 - DNA, 20 bp, Artificial
  CRISPR gRNA sequence
ctccgggtgcgccgcggccc

SEQ ID NO: 556286 - DNA, 20 bp, Artificial
  CRISPR gRNA sequence
cgggtgcgccgcggccctcc

SEQ ID NO: 556287 - DNA, 20 bp, Artificial
  CRISPR gRNA sequence
cgggtacgcggggctggctg

SEQ ID NO: 556288 - DNA, 20 bp, Artificial
  CRISPR gRNA sequence
gctgggctagcgggagattt

SEQ ID NO: 556289 - DNA, 20 bp, Artificial
  CRISPR gRNA sequence
ggctagcgggagatttgagc

SEQ ID NO: 556290 - DNA, 20 bp, Artificial
  CRISPR gRNA sequence
gcgggagatttgagctgcca

SEQ ID NO: 556291 - DNA, 20 bp, Artificial
  CRISPR gRNA sequence
gagctgccagcccccactcg

SEQ ID NO: 556292 - DNA, 20 bp, Artificial
  CRISPR gRNA sequence
agctgccagcccccactcgc

SEQ ID NO: 556293 - DNA, 20 bp, Artificial
  CRISPR gRNA sequence
ccagcccccactcgccgccc

SEQ ID NO: 556294 - DNA, 20 bp, Artificial
  CRISPR gRNA sequence
gccgccctctacgcctcctc

SEQ ID NO: 556295 - DNA, 20 bp, Artificial
  CRISPR gRNA sequence
tacgcctcctccgctgggcc

SEQ ID NO: 556296 - DNA, 20 bp, Artificial
  CRISPR gRNA sequence
cgcctcctccgctgggccgc

SEQ ID NO: 556297 - DNA, 20 bp, Artificial
  CRISPR gRNA sequence
ctccgctgggccgccggcga

SEQ ID NO: 556298 - DNA, 20 bp, Artificial
  CRISPR gRNA sequence
cgctgggccgccggcgagga

SEQ ID NO: 556299 - DNA, 20 bp, Artificial
  CRISPR gRNA sequence
ggccgccggcgaggaagccg

SEQ ID NO: 556300 - DNA, 20 bp, Artificial
  CRISPR gRNA sequence
gaccttcagggcagtgggcg

SEQ ID NO: 556301 - DNA, 20 bp, Artificial
  CRISPR gRNA sequence
accttcagggcagtgggcgg

SEQ ID NO: 556302 - DNA, 20 bp, Artificial
  CRISPR gRNA sequence
cagggcagtgggcggcaggg

SEQ ID NO: 556303 - DNA, 20 bp, Artificial
  CRISPR gRNA sequence
agggcagtgggcggcagggc

SEQ ID NO: 556304 - DNA, 20 bp, Artificial
  CRISPR gRNA sequence
ggaggggccgctccaggccc

SEQ ID NO: 556305 - DNA, 20 bp, Artificial
  CRISPR gRNA sequence
caggccccaagccccaggcc

SEQ ID NO: 556306 - DNA, 20 bp, Artificial
  CRISPR gRNA sequence
cccaccctgacgaggacgtc

SEQ ID NO: 556307 - DNA, 20 bp, Artificial
  CRISPR gRNA sequence
acgaggacgtctactttttc

SEQ ID NO: 556308 - DNA, 20 bp, Artificial
  CRISPR gRNA sequence
ctttttcttgaaaaatgtct

SEQ ID NO: 556309 - DNA, 20 bp, Artificial
  CRISPR gRNA sequence
tttcttgaaaaatgtctttc

SEQ ID NO: 556310 - DNA, 20 bp, Artificial
  CRISPR gRNA sequence
ttcttgaaaaatgtctttcc

SEQ ID NO: 556311 - DNA, 20 bp, Artificial
  CRISPR gRNA sequence
tcttgaaaaatgtctttcct

SEQ ID NO: 556312 - DNA, 20 bp, Artificial
  CRISPR gRNA sequence
cttgaaaaatgtctttcctt

SEQ ID NO: 556313 - DNA, 20 bp, Artificial
  CRISPR gRNA sequence
ttgaaaaatgtctttccttt

SEQ ID NO: 556314 - DNA, 20 bp, Artificial
  CRISPR gRNA sequence
gaaaaatgtctttcctttcc

SEQ ID NO: 556315 - DNA, 20 bp, Artificial
  CRISPR gRNA sequence
aaaaatgtctttcctttccc

SEQ ID NO: 556316 - DNA, 20 bp, Artificial
  CRISPR gRNA sequence
tcctttcccaaaagtgactc

SEQ ID NO: 556317 - DNA, 20 bp, Artificial
  CRISPR gRNA sequence
cctttcccaaaagtgactct

SEQ ID NO: 556318 - DNA, 20 bp, Artificial
  CRISPR gRNA sequence
ctttcccaaaagtgactctg

SEQ ID NO: 556319 - DNA, 20 bp, Artificial
  CRISPR gRNA sequence
tcccaaaagtgactctgctt

SEQ ID NO: 556320 - DNA, 20 bp, Artificial
  CRISPR gRNA sequence
cccaaaagtgactctgcttt

SEQ ID NO: 556321 - DNA, 20 bp, Artificial
  CRISPR gRNA sequence
ccaaaagtgactctgctttg

SEQ ID NO: 556322 - DNA, 20 bp, Artificial
  CRISPR gRNA sequence
tgctttgtctgaaaataata

SEQ ID NO: 556323 - DNA, 20 bp, Artificial
  CRISPR gRNA sequence
ctttgtctgaaaataatata

SEQ ID NO: 556324 - DNA, 20 bp, Artificial
  CRISPR gRNA sequence
tgtctgaaaataatataact

SEQ ID NO: 556325 - DNA, 20 bp, Artificial
  CRISPR gRNA sequence
gtctgaaaataatataactt

SEQ ID NO: 556326 - DNA, 20 bp, Artificial
  CRISPR gRNA sequence
tctgaaaataatataacttt

SEQ ID NO: 556327 - DNA, 20 bp, Artificial
  CRISPR gRNA sequence
aaaataatataactttaatg

SEQ ID NO: 556328 - DNA, 20 bp, Artificial
  CRISPR gRNA sequence
taatggctttaagttattgt

SEQ ID NO: 556329 - DNA, 20 bp, Artificial
  CRISPR gRNA sequence
aatggctttaagttattgtt

SEQ ID NO: 556330 - DNA, 20 bp, Artificial
  CRISPR gRNA sequence
atggctttaagttattgttt

SEQ ID NO: 556331 - DNA, 20 bp, Artificial
  CRISPR gRNA sequence
taagttattgtttgaaaggg

SEQ ID NO: 556332 - DNA, 20 bp, Artificial
  CRISPR gRNA sequence
aagttattgtttgaaagggt

SEQ ID NO: 556333 - DNA, 20 bp, Artificial
  CRISPR gRNA sequence
agttattgtttgaaagggtt

SEQ ID NO: 556334 - DNA, 20 bp, Artificial
  CRISPR gRNA sequence
ttgtttgaaagggttcagaa

SEQ ID NO: 556335 - DNA, 20 bp, Artificial
  CRISPR gRNA sequence
tttgaaagggttcagaaaag

SEQ ID NO: 556336 - DNA, 20 bp, Artificial
  CRISPR gRNA sequence
gaaagggttcagaaaagaca

SEQ ID NO: 556337 - DNA, 20 bp, Artificial
  CRISPR gRNA sequence
aaagggttcagaaaagacaa

SEQ ID NO: 556338 - DNA, 20 bp, Artificial
  CRISPR gRNA sequence
agaaaagacaataaatggga

SEQ ID NO: 556339 - DNA, 20 bp, Artificial
  CRISPR gRNA sequence
agaatggctcaccagttaaa

SEQ ID NO: 556340 - DNA, 20 bp, Artificial
  CRISPR gRNA sequence
gaatggctcaccagttaaaa

SEQ ID NO: 556341 - DNA, 20 bp, Artificial
  CRISPR gRNA sequence
accagttaaaatccaagttt

SEQ ID NO: 556342 - DNA, 20 bp, Artificial
  CRISPR gRNA sequence
aaatccaagtttcatatatt

SEQ ID NO: 556343 - DNA, 20 bp, Artificial
  CRISPR gRNA sequence
catatatttcttgtatttgc

SEQ ID NO: 556344 - DNA, 20 bp, Artificial
  CRISPR gRNA sequence
atatatttcttgtatttgct

SEQ ID NO: 556345 - DNA, 20 bp, Artificial
  CRISPR gRNA sequence
cttgtatttgctaatttccc

SEQ ID NO: 556346 - DNA, 20 bp, Artificial
  CRISPR gRNA sequence
ttgtatttgctaatttccct

SEQ ID NO: 556347 - DNA, 20 bp, Artificial
  CRISPR gRNA sequence
gtatttgctaatttccctta

SEQ ID NO: 556348 - DNA, 20 bp, Artificial
  CRISPR gRNA sequence
tatttgctaatttcccttat

SEQ ID NO: 556349 - DNA, 20 bp, Artificial
  CRISPR gRNA sequence
gctaatttcccttatctgtt

SEQ ID NO: 556350 - DNA, 20 bp, Artificial
  CRISPR gRNA sequence
ctaatttcccttatctgttt

SEQ ID NO: 556351 - DNA, 20 bp, Artificial
  CRISPR gRNA sequence
atttcccttatctgtttcag

SEQ ID NO: 556352 - DNA, 20 bp, Artificial
  CRISPR gRNA sequence
cccttatctgtttcagctgc

SEQ ID NO: 556353 - DNA, 20 bp, Artificial
  CRISPR gRNA sequence
ccttatctgtttcagctgct

SEQ ID NO: 556354 - DNA, 20 bp, Artificial
  CRISPR gRNA sequence
atctgtttcagctgcttgtt

SEQ ID NO: 556355 - DNA, 20 bp, Artificial
  CRISPR gRNA sequence
tctgtttcagctgcttgttc

SEQ ID NO: 556356 - DNA, 20 bp, Artificial
  CRISPR gRNA sequence
tttcagctgcttgttcagaa

SEQ ID NO: 556357 - DNA, 20 bp, Artificial
  CRISPR gRNA sequence
cagctgcttgttcagaaaaa

SEQ ID NO: 556358 - DNA, 20 bp, Artificial
  CRISPR gRNA sequence
agctgcttgttcagaaaaat

SEQ ID NO: 556359 - DNA, 20 bp, Artificial
  CRISPR gRNA sequence
cttgttcagaaaaatttcat

SEQ ID NO: 556360 - DNA, 20 bp, Artificial
  CRISPR gRNA sequence
gttcagaaaaatttcattca

SEQ ID NO: 556361 - DNA, 20 bp, Artificial
  CRISPR gRNA sequence
ttcagaaaaatttcattcat

SEQ ID NO: 556362 - DNA, 20 bp, Artificial
  CRISPR gRNA sequence
agaaaaatttcattcataga

SEQ ID NO: 556363 - DNA, 20 bp, Artificial
  CRISPR gRNA sequence
cattcatagactcaccttat

SEQ ID NO: 556364 - DNA, 20 bp, Artificial
  CRISPR gRNA sequence
attcatagactcaccttatc

SEQ ID NO: 556365 - DNA, 20 bp, Artificial
  CRISPR gRNA sequence
atagactcaccttatcccag

SEQ ID NO: 556366 - DNA, 20 bp, Artificial
  CRISPR gRNA sequence
accttatcccagccctagag

SEQ ID NO: 556367 - DNA, 20 bp, Artificial
  CRISPR gRNA sequence
atcccagccctagagactca

SEQ ID NO: 556368 - DNA, 20 bp, Artificial
  CRISPR gRNA sequence
tcccagccctagagactcat

SEQ ID NO: 556369 - DNA, 20 bp, Artificial
  CRISPR gRNA sequence
gagactcatattctctattt

SEQ ID NO: 556370 - DNA, 20 bp, Artificial
  CRISPR gRNA sequence
atattctctatttgccctgg

SEQ ID NO: 556371 - DNA, 20 bp, Artificial
  CRISPR gRNA sequence
tctatttgccctggaatcct

SEQ ID NO: 556372 - DNA, 20 bp, Artificial
  CRISPR gRNA sequence
tatttgccctggaatcctgt

SEQ ID NO: 556373 - DNA, 20 bp, Artificial
  CRISPR gRNA sequence
tttgccctggaatcctgttc

SEQ ID NO: 556374 - DNA, 20 bp, Artificial
  CRISPR gRNA sequence
gccctggaatcctgttcact

SEQ ID NO: 556375 - DNA, 20 bp, Artificial
  CRISPR gRNA sequence
ccctggaatcctgttcacta

SEQ ID NO: 556376 - DNA, 20 bp, Artificial
  CRISPR gRNA sequence
gaatcctgttcactatttac

SEQ ID NO: 556377 - DNA, 20 bp, Artificial
  CRISPR gRNA sequence
ttcactatttacaattatat

SEQ ID NO: 556378 - DNA, 20 bp, Artificial
  CRISPR gRNA sequence
actatttacaattatattat

SEQ ID NO: 556379 - DNA, 20 bp, Artificial
  CRISPR gRNA sequence
tttacaattatattattctg

SEQ ID NO: 556380 - DNA, 20 bp, Artificial
  CRISPR gRNA sequence
acaattatattattctgaat

SEQ ID NO: 556381 - DNA, 20 bp, Artificial
  CRISPR gRNA sequence
caattatattattctgaata

SEQ ID NO: 556382 - DNA, 20 bp, Artificial
  CRISPR gRNA sequence
tattattctgaataatagta

SEQ ID NO: 556383 - DNA, 20 bp, Artificial
  CRISPR gRNA sequence
ttctgaataatagtatttac

SEQ ID NO: 556384 - DNA, 20 bp, Artificial
  CRISPR gRNA sequence
tgaataatagtatttactat

SEQ ID NO: 556385 - DNA, 20 bp, Artificial
  CRISPR gRNA sequence
aataatagtatttactattt

SEQ ID NO: 556386 - DNA, 20 bp, Artificial
  CRISPR gRNA sequence
actattttcgtctcttttat

SEQ ID NO: 556387 - DNA, 20 bp, Artificial
  CRISPR gRNA sequence
ctattttcgtctcttttata

SEQ ID NO: 556388 - DNA, 20 bp, Artificial
  CRISPR gRNA sequence
ttttcgtctcttttatattt

SEQ ID NO: 556389 - DNA, 20 bp, Artificial
  CRISPR gRNA sequence
tcgtctcttttatattttaa

SEQ ID NO: 556390 - DNA, 20 bp, Artificial
  CRISPR gRNA sequence
cgtctcttttatattttaat

SEQ ID NO: 556391 - DNA, 20 bp, Artificial
  CRISPR gRNA sequence
gtctcttttatattttaata

SEQ ID NO: 556392 - DNA, 20 bp, Artificial
  CRISPR gRNA sequence
ttttatattttaataaacca

SEQ ID NO: 556393 - DNA, 20 bp, Artificial
  CRISPR gRNA sequence
ttatattttaataaaccact

SEQ ID NO: 556394 - DNA, 20 bp, Artificial
  CRISPR gRNA sequence
tatattttaataaaccactt

SEQ ID NO: 556395 - DNA, 20 bp, Artificial
  CRISPR gRNA sequence
atattttaataaaccacttt

SEQ ID NO: 556396 - DNA, 20 bp, Artificial
  CRISPR gRNA sequence
tattttaataaaccactttc

SEQ ID NO: 556397 - DNA, 20 bp, Artificial
  CRISPR gRNA sequence
taataaaccactttcaagtc

SEQ ID NO: 556398 - DNA, 20 bp, Artificial
  CRISPR gRNA sequence
aataaaccactttcaagtca

SEQ ID NO: 556399 - DNA, 20 bp, Artificial
  CRISPR gRNA sequence
ataaaccactttcaagtcac

SEQ ID NO: 556400 - DNA, 20 bp, Artificial
  CRISPR gRNA sequence
tcaagtcactgacctttttg

SEQ ID NO: 556401 - DNA, 20 bp, Artificial
  CRISPR gRNA sequence
caagtcactgacctttttgt

SEQ ID NO: 556402 - DNA, 20 bp, Artificial
  CRISPR gRNA sequence
aagtcactgacctttttgtt

SEQ ID NO: 556403 - DNA, 20 bp, Artificial
  CRISPR gRNA sequence
acctttttgtttgttaaact

SEQ ID NO: 556404 - DNA, 20 bp, Artificial
  CRISPR gRNA sequence
tttgtttgttaaactgggga

SEQ ID NO: 556405 - DNA, 20 bp, Artificial
  CRISPR gRNA sequence
ttgtttgttaaactggggat

SEQ ID NO: 556406 - DNA, 20 bp, Artificial
  CRISPR gRNA sequence
tgtttgttaaactggggata

SEQ ID NO: 556407 - DNA, 20 bp, Artificial
  CRISPR gRNA sequence
gtttgttaaactggggatat

SEQ ID NO: 556408 - DNA, 20 bp, Artificial
  CRISPR gRNA sequence
tttgttaaactggggatata

SEQ ID NO: 556409 - DNA, 20 bp, Artificial
  CRISPR gRNA sequence
gttaaactggggatataatg

SEQ ID NO: 556410 - DNA, 20 bp, Artificial
  CRISPR gRNA sequence
ttaaactggggatataatgt

SEQ ID NO: 556411 - DNA, 20 bp, Artificial
  CRISPR gRNA sequence
aactggggatataatgtaaa

SEQ ID NO: 556412 - DNA, 20 bp, Artificial
  CRISPR gRNA sequence
gggatataatgtaaaaaaca

SEQ ID NO: 556413 - DNA, 20 bp, Artificial
  CRISPR gRNA sequence
caaatgtaaataatactaaa

SEQ ID NO: 556414 - DNA, 20 bp, Artificial
  CRISPR gRNA sequence
aaacaacattagaaaatcat

SEQ ID NO: 556415 - DNA, 20 bp, Artificial
  CRISPR gRNA sequence
gaaaatcatagccaagacag

SEQ ID NO: 556416 - DNA, 20 bp, Artificial
  CRISPR gRNA sequence
tcatgatattaacttagtgt

SEQ ID NO: 556417 - DNA, 20 bp, Artificial
  CRISPR gRNA sequence
acttagtgttaggcctaagg

SEQ ID NO: 556418 - DNA, 20 bp, Artificial
  CRISPR gRNA sequence
agtgttaggcctaaggaaac

SEQ ID NO: 556419 - DNA, 20 bp, Artificial
  CRISPR gRNA sequence
gtgttaggcctaaggaaaca

SEQ ID NO: 556420 - DNA, 20 bp, Artificial
  CRISPR gRNA sequence
ggcctaaggaaacatatcaa

SEQ ID NO: 556421 - DNA, 20 bp, Artificial
  CRISPR gRNA sequence
aggaaacatatcaaatgcat

SEQ ID NO: 556422 - DNA, 20 bp, Artificial
  CRISPR gRNA sequence
ctgtagtagatatgtaacct

SEQ ID NO: 556423 - DNA, 20 bp, Artificial
  CRISPR gRNA sequence
tagtagatatgtaacctttc

SEQ ID NO: 556424 - DNA, 20 bp, Artificial
  CRISPR gRNA sequence
tcagaacataatgatattat

SEQ ID NO: 556425 - DNA, 20 bp, Artificial
  CRISPR gRNA sequence
cagaacataatgatattata

SEQ ID NO: 556426 - DNA, 20 bp, Artificial
  CRISPR gRNA sequence
agaacataatgatattataa

SEQ ID NO: 556427 - DNA, 20 bp, Artificial
  CRISPR gRNA sequence
taacaatattataaagcagc

SEQ ID NO: 556428 - DNA, 20 bp, Artificial
  CRISPR gRNA sequence
taaagcagcattgtgaatag

SEQ ID NO: 556429 - DNA, 20 bp, Artificial
  CRISPR gRNA sequence
tgaatagttaaaaccatggg

SEQ ID NO: 556430 - DNA, 20 bp, Artificial
  CRISPR gRNA sequence
aaaccatgggctctagagcc

SEQ ID NO: 556431 - DNA, 20 bp, Artificial
  CRISPR gRNA sequence
tagagccagatagcctctac

SEQ ID NO: 556432 - DNA, 20 bp, Artificial
  CRISPR gRNA sequence
gagccagatagcctctactc

SEQ ID NO: 556433 - DNA, 20 bp, Artificial
  CRISPR gRNA sequence
tactcaaagccaggttctgc

SEQ ID NO: 556434 - DNA, 20 bp, Artificial
  CRISPR gRNA sequence
ctcaaagccaggttctgcca

SEQ ID NO: 556435 - DNA, 20 bp, Artificial
  CRISPR gRNA sequence
aaagccaggttctgccactt

SEQ ID NO: 556436 - DNA, 20 bp, Artificial
  CRISPR gRNA sequence
tgccacttactagctgttac

SEQ ID NO: 556437 - DNA, 20 bp, Artificial
  CRISPR gRNA sequence
ccacttactagctgttacct

SEQ ID NO: 556438 - DNA, 20 bp, Artificial
  CRISPR gRNA sequence
actagctgttaccttgagca

SEQ ID NO: 556439 - DNA, 20 bp, Artificial
  CRISPR gRNA sequence
ctagctgttaccttgagcaa

SEQ ID NO: 556440 - DNA, 20 bp, Artificial
  CRISPR gRNA sequence
gctgttaccttgagcaaaca

SEQ ID NO: 556441 - DNA, 20 bp, Artificial
  CRISPR gRNA sequence
ttaccttgagcaaacaactt

SEQ ID NO: 556442 - DNA, 20 bp, Artificial
  CRISPR gRNA sequence
ccttgagcaaacaacttaaa

SEQ ID NO: 556443 - DNA, 20 bp, Artificial
  CRISPR gRNA sequence
gagcaaacaacttaaactct

SEQ ID NO: 556444 - DNA, 20 bp, Artificial
  CRISPR gRNA sequence
agcaaacaacttaaactctc

SEQ ID NO: 556445 - DNA, 20 bp, Artificial
  CRISPR gRNA sequence
aaactctctctctgttggtt

SEQ ID NO: 556446 - DNA, 20 bp, Artificial
  CRISPR gRNA sequence
aactctctctctgttggttt

SEQ ID NO: 556447 - DNA, 20 bp, Artificial
  CRISPR gRNA sequence
tctctctgttggtttctcac

SEQ ID NO: 556448 - DNA, 20 bp, Artificial
  CRISPR gRNA sequence
tctctgttggtttctcacca

SEQ ID NO: 556449 - DNA, 20 bp, Artificial
  CRISPR gRNA sequence
tctgttggtttctcaccagg

SEQ ID NO: 556450 - DNA, 20 bp, Artificial
  CRISPR gRNA sequence
tgttggtttctcaccaggaa

SEQ ID NO: 556451 - DNA, 20 bp, Artificial
  CRISPR gRNA sequence
ttggtttctcaccaggaaac

SEQ ID NO: 556452 - DNA, 20 bp, Artificial
  CRISPR gRNA sequence
gtttctcaccaggaaacagg

SEQ ID NO: 556453 - DNA, 20 bp, Artificial
  CRISPR gRNA sequence
ctcaccaggaaacagggata

SEQ ID NO: 556454 - DNA, 20 bp, Artificial
  CRISPR gRNA sequence
tcaccaggaaacagggataa

SEQ ID NO: 556455 - DNA, 20 bp, Artificial
  CRISPR gRNA sequence
accaggaaacagggataagt

SEQ ID NO: 556456 - DNA, 20 bp, Artificial
  CRISPR gRNA sequence
gtacacaacttataggttgt

SEQ ID NO: 556457 - DNA, 20 bp, Artificial
  CRISPR gRNA sequence
ataggttgtatgaggattga

SEQ ID NO: 556458 - DNA, 20 bp, Artificial
  CRISPR gRNA sequence
taggttgtatgaggattgat

SEQ ID NO: 556459 - DNA, 20 bp, Artificial
  CRISPR gRNA sequence
tatgaggattgatgtgaaga

SEQ ID NO: 556460 - DNA, 20 bp, Artificial
  CRISPR gRNA sequence
atgtgaagattgaattaatt

SEQ ID NO: 556461 - DNA, 20 bp, Artificial
  CRISPR gRNA sequence
aattaattaacatatgtatt

SEQ ID NO: 556462 - DNA, 20 bp, Artificial
  CRISPR gRNA sequence
attaacatatgtattagaat

SEQ ID NO: 556463 - DNA, 20 bp, Artificial
  CRISPR gRNA sequence
acatatgtattagaatggtg

SEQ ID NO: 556464 - DNA, 20 bp, Artificial
  CRISPR gRNA sequence
gaatggtgctcaacacagaa

SEQ ID NO: 556465 - DNA, 20 bp, Artificial
  CRISPR gRNA sequence
aacacagaaagtgctaaata

SEQ ID NO: 556466 - DNA, 20 bp, Artificial
  CRISPR gRNA sequence
aataatgttagctttgtatc

SEQ ID NO: 556467 - DNA, 20 bp, Artificial
  CRISPR gRNA sequence
gctttgtatctataatgggg

SEQ ID NO: 556468 - DNA, 20 bp, Artificial
  CRISPR gRNA sequence
tgtatctataatggggtttc

SEQ ID NO: 556469 - DNA, 20 bp, Artificial
  CRISPR gRNA sequence
gtatctataatggggtttct

SEQ ID NO: 556470 - DNA, 20 bp, Artificial
  CRISPR gRNA sequence
tatctataatggggtttctg

SEQ ID NO: 556471 - DNA, 20 bp, Artificial
  CRISPR gRNA sequence
taatggggtttctgttaaaa

SEQ ID NO: 556472 - DNA, 20 bp, Artificial
  CRISPR gRNA sequence
ctgttaaaaattgtaacttg

SEQ ID NO: 556473 - DNA, 20 bp, Artificial
  CRISPR gRNA sequence
tgttaaaaattgtaacttgt

SEQ ID NO: 556474 - DNA, 20 bp, Artificial
  CRISPR gRNA sequence
ttaaaaattgtaacttgttg

SEQ ID NO: 556475 - DNA, 20 bp, Artificial
  CRISPR gRNA sequence
aaaattgtaacttgttggcc

SEQ ID NO: 556476 - DNA, 20 bp, Artificial
  CRISPR gRNA sequence
taacttgttggccgggcgcg

SEQ ID NO: 556477 - DNA, 20 bp, Artificial
  CRISPR gRNA sequence
gttggccgggcgcggtggct

SEQ ID NO: 556478 - DNA, 20 bp, Artificial
  CRISPR gRNA sequence
ttggccgggcgcggtggctc

SEQ ID NO: 556479 - DNA, 20 bp, Artificial
  CRISPR gRNA sequence
gccgggcgcggtggctcacg

SEQ ID NO: 556480 - DNA, 20 bp, Artificial
  CRISPR gRNA sequence
acgcctgtaatcccagcact

SEQ ID NO: 556481 - DNA, 20 bp, Artificial
  CRISPR gRNA sequence
taatcccagcactttgggag

SEQ ID NO: 556482 - DNA, 20 bp, Artificial
  CRISPR gRNA sequence
tgggaggccgaggcgggcgg

SEQ ID NO: 556483 - DNA, 20 bp, Artificial
  CRISPR gRNA sequence
gggaggccgaggcgggcgga

SEQ ID NO: 556484 - DNA, 20 bp, Artificial
  CRISPR gRNA sequence
ggaggccgaggcgggcggat

SEQ ID NO: 556485 - DNA, 20 bp, Artificial
  CRISPR gRNA sequence
gctaacacggtgaaaccccg

SEQ ID NO: 556486 - DNA, 20 bp, Artificial
  CRISPR gRNA sequence
acacggtgaaaccccgtctc

SEQ ID NO: 556487 - DNA, 20 bp, Artificial
  CRISPR gRNA sequence
tactaaaaatacaaaaaatt

SEQ ID NO: 556488 - DNA, 20 bp, Artificial
  CRISPR gRNA sequence
ctaaaaatacaaaaaattag

SEQ ID NO: 556489 - DNA, 20 bp, Artificial
  CRISPR gRNA sequence
aaaatacaaaaaattagccg

SEQ ID NO: 556490 - DNA, 20 bp, Artificial
  CRISPR gRNA sequence
gccgggcgtggtggcgggcg

SEQ ID NO: 556491 - DNA, 20 bp, Artificial
  CRISPR gRNA sequence
tagtcccagctactcgggag

SEQ ID NO: 556492 - DNA, 20 bp, Artificial
  CRISPR gRNA sequence
ctcgggaggctgaggcagga

SEQ ID NO: 556493 - DNA, 20 bp, Artificial
  CRISPR gRNA sequence
gggaggctgaggcaggagaa

SEQ ID NO: 556494 - DNA, 20 bp, Artificial
  CRISPR gRNA sequence
aggcaggagaatggcgtgaa

SEQ ID NO: 556495 - DNA, 20 bp, Artificial
  CRISPR gRNA sequence
gcagtgagccgagatcgcgc

SEQ ID NO: 556496 - DNA, 20 bp, Artificial
  CRISPR gRNA sequence
cagtgagccgagatcgcgcc

SEQ ID NO: 556497 - DNA, 20 bp, Artificial
  CRISPR gRNA sequence
cactccagcctgggcgacag

SEQ ID NO: 556498 - DNA, 20 bp, Artificial
  CRISPR gRNA sequence
cagcctgggcgacagagcga

SEQ ID NO: 556499 - DNA, 20 bp, Artificial
  CRISPR gRNA sequence
ggcgacagagcgagactctg

SEQ ID NO: 556500 - DNA, 20 bp, Artificial
  CRISPR gRNA sequence
tgtctcaaaaaaaaaaaaaa

SEQ ID NO: 556501 - DNA, 20 bp, Artificial
  CRISPR gRNA sequence
tctcaaaaaaaaaaaaaaaa

SEQ ID NO: 556502 - DNA, 20 bp, Artificial
  CRISPR gRNA sequence
aaaaaaaaaaaaaaaaaaaa

SEQ ID NO: 556503 - DNA, 20 bp, Artificial
  CRISPR gRNA sequence
taacttgttttacatttcaa

SEQ ID NO: 556504 - DNA, 20 bp, Artificial
  CRISPR gRNA sequence
gttttacatttcaaaattgt

SEQ ID NO: 556505 - DNA, 20 bp, Artificial
  CRISPR gRNA sequence
ttttacatttcaaaattgtg

SEQ ID NO: 556506 - DNA, 20 bp, Artificial
  CRISPR gRNA sequence
tacatttcaaaattgtgaac

SEQ ID NO: 556507 - DNA, 20 bp, Artificial
  CRISPR gRNA sequence
acatttcaaaattgtgaacc

SEQ ID NO: 556508 - DNA, 20 bp, Artificial
  CRISPR gRNA sequence
catttcaaaattgtgaacct

SEQ ID NO: 556509 - DNA, 20 bp, Artificial
  CRISPR gRNA sequence
caaaattgtgaaccttgtgt

SEQ ID NO: 556510 - DNA, 20 bp, Artificial
  CRISPR gRNA sequence
aaaattgtgaaccttgtgtt

SEQ ID NO: 556511 - DNA, 20 bp, Artificial
  CRISPR gRNA sequence
tgaaccttgtgttagtcacc

SEQ ID NO: 556512 - DNA, 20 bp, Artificial
  CRISPR gRNA sequence
gtgttagtcaccacatctgt

SEQ ID NO: 556513 - DNA, 20 bp, Artificial
  CRISPR gRNA sequence
tgttagtcaccacatctgtg

SEQ ID NO: 556514 - DNA, 20 bp, Artificial
  CRISPR gRNA sequence
gtcaccacatctgtggtctg

SEQ ID NO: 556515 - DNA, 20 bp, Artificial
  CRISPR gRNA sequence
tggtctgaaagcctccatga

SEQ ID NO: 556516 - DNA, 20 bp, Artificial
  CRISPR gRNA sequence
aaagcctccatgacacattt

SEQ ID NO: 556517 - DNA, 20 bp, Artificial
  CRISPR gRNA sequence
catgacacatttagttattt

SEQ ID NO: 556518 - DNA, 20 bp, Artificial
  CRISPR gRNA sequence
agttatttactcaccgctgc

SEQ ID NO: 556519 - DNA, 20 bp, Artificial
  CRISPR gRNA sequence
gttatttactcaccgctgct

SEQ ID NO: 556520 - DNA, 20 bp, Artificial
  CRISPR gRNA sequence
tttactcaccgctgcttggg

SEQ ID NO: 556521 - DNA, 20 bp, Artificial
  CRISPR gRNA sequence
actcaccgctgcttgggata

SEQ ID NO: 556522 - DNA, 20 bp, Artificial
  CRISPR gRNA sequence
ctcaccgctgcttgggatac

SEQ ID NO: 556523 - DNA, 20 bp, Artificial
  CRISPR gRNA sequence
accgctgcttgggatacagg

SEQ ID NO: 556524 - DNA, 20 bp, Artificial
  CRISPR gRNA sequence
cttgggatacaggttgtcaa

SEQ ID NO: 556525 - DNA, 20 bp, Artificial
  CRISPR gRNA sequence
gggatacaggttgtcaaaat

SEQ ID NO: 556526 - DNA, 20 bp, Artificial
  CRISPR gRNA sequence
ggatacaggttgtcaaaatg

SEQ ID NO: 556527 - DNA, 20 bp, Artificial
  CRISPR gRNA sequence
tcaaaatgattgatgatgtt

SEQ ID NO: 556528 - DNA, 20 bp, Artificial
  CRISPR gRNA sequence
atgatgttgtattaaataat

SEQ ID NO: 556529 - DNA, 20 bp, Artificial
  CRISPR gRNA sequence
tattaaataatggattgcta

SEQ ID NO: 556530 - DNA, 20 bp, Artificial
  CRISPR gRNA sequence
aataatggattgctaagagt

SEQ ID NO: 556531 - DNA, 20 bp, Artificial
  CRISPR gRNA sequence
ctaagagtacactgtatttt

SEQ ID NO: 556532 - DNA, 20 bp, Artificial
  CRISPR gRNA sequence
agagtacactgtattttttg

SEQ ID NO: 556533 - DNA, 20 bp, Artificial
  CRISPR gRNA sequence
tattttttgtggaagatcat

SEQ ID NO: 556534 - DNA, 20 bp, Artificial
  CRISPR gRNA sequence
tttgtggaagatcattttcc

SEQ ID NO: 556535 - DNA, 20 bp, Artificial
  CRISPR gRNA sequence
ttgtggaagatcattttcca

SEQ ID NO: 556536 - DNA, 20 bp, Artificial
  CRISPR gRNA sequence
tgtggaagatcattttccat

SEQ ID NO: 556537 - DNA, 20 bp, Artificial
  CRISPR gRNA sequence
gtggaagatcattttccatc

SEQ ID NO: 556538 - DNA, 20 bp, Artificial
  CRISPR gRNA sequence
tggaagatcattttccatct

SEQ ID NO: 556539 - DNA, 20 bp, Artificial
  CRISPR gRNA sequence
tccatcttaaaatatatact

SEQ ID NO: 556540 - DNA, 20 bp, Artificial
  CRISPR gRNA sequence
ccatcttaaaatatatactg

SEQ ID NO: 556541 - DNA, 20 bp, Artificial
  CRISPR gRNA sequence
catcttaaaatatatactgg

SEQ ID NO: 556542 - DNA, 20 bp, Artificial
  CRISPR gRNA sequence
aaaatatatactggttgagt

SEQ ID NO: 556543 - DNA, 20 bp, Artificial
  CRISPR gRNA sequence
aaatatatactggttgagtt

SEQ ID NO: 556544 - DNA, 20 bp, Artificial
  CRISPR gRNA sequence
gttgagttacgtttacattg

SEQ ID NO: 556545 - DNA, 20 bp, Artificial
  CRISPR gRNA sequence
agttacgtttacattgctcc

SEQ ID NO: 556546 - DNA, 20 bp, Artificial
  CRISPR gRNA sequence
cgtttacattgctccatagg

SEQ ID NO: 556547 - DNA, 20 bp, Artificial
  CRISPR gRNA sequence
acattgctccataggacaat

SEQ ID NO: 556548 - DNA, 20 bp, Artificial
  CRISPR gRNA sequence
cattgctccataggacaatc

SEQ ID NO: 556549 - DNA, 20 bp, Artificial
  CRISPR gRNA sequence
ctccataggacaatcccatg

SEQ ID NO: 556550 - DNA, 20 bp, Artificial
  CRISPR gRNA sequence
cataggacaatcccatgagt

SEQ ID NO: 556551 - DNA, 20 bp, Artificial
  CRISPR gRNA sequence
taagtcctcgatggctgttg

SEQ ID NO: 556552 - DNA, 20 bp, Artificial
  CRISPR gRNA sequence
gatggctgttgtaatgctct

SEQ ID NO: 556553 - DNA, 20 bp, Artificial
  CRISPR gRNA sequence
ttgtaatgctctggtatcat

SEQ ID NO: 556554 - DNA, 20 bp, Artificial
  CRISPR gRNA sequence
taatgctctggtatcatgca

SEQ ID NO: 556555 - DNA, 20 bp, Artificial
  CRISPR gRNA sequence
tggtatcatgcattggactt

SEQ ID NO: 556556 - DNA, 20 bp, Artificial
  CRISPR gRNA sequence
gtatcatgcattggacttca

SEQ ID NO: 556557 - DNA, 20 bp, Artificial
  CRISPR gRNA sequence
gacttcaatgcttccattag

SEQ ID NO: 556558 - DNA, 20 bp, Artificial
  CRISPR gRNA sequence
caatgcttccattagtcaat

SEQ ID NO: 556559 - DNA, 20 bp, Artificial
  CRISPR gRNA sequence
aatgcttccattagtcaatg

SEQ ID NO: 556560 - DNA, 20 bp, Artificial
  CRISPR gRNA sequence
ccattagtcaatgcacaagt

SEQ ID NO: 556561 - DNA, 20 bp, Artificial
  CRISPR gRNA sequence
cattagtcaatgcacaagtt

SEQ ID NO: 556562 - DNA, 20 bp, Artificial
  CRISPR gRNA sequence
gtcaatgcacaagttagtgt

SEQ ID NO: 556563 - DNA, 20 bp, Artificial
  CRISPR gRNA sequence
gtgtgggagatggaagagac

SEQ ID NO: 556564 - DNA, 20 bp, Artificial
  CRISPR gRNA sequence
tggaaaaaaaagtataatat

SEQ ID NO: 556565 - DNA, 20 bp, Artificial
  CRISPR gRNA sequence
gaaaaaaaagtataatattt

SEQ ID NO: 556566 - DNA, 20 bp, Artificial
  CRISPR gRNA sequence
agtacagaaaatagtaatat

SEQ ID NO: 556567 - DNA, 20 bp, Artificial
  CRISPR gRNA sequence
gtacagaaaatagtaatatt

SEQ ID NO: 556568 - DNA, 20 bp, Artificial
  CRISPR gRNA sequence
agacttatcatctgcaaatt

SEQ ID NO: 556569 - DNA, 20 bp, Artificial
  CRISPR gRNA sequence
gacttatcatctgcaaattt

SEQ ID NO: 556570 - DNA, 20 bp, Artificial
  CRISPR gRNA sequence
atcatctgcaaatttatgaa

SEQ ID NO: 556571 - DNA, 20 bp, Artificial
  CRISPR gRNA sequence
tcatctgcaaatttatgaag

SEQ ID NO: 556572 - DNA, 20 bp, Artificial
  CRISPR gRNA sequence
caaatttatgaagagctcgc

SEQ ID NO: 556573 - DNA, 20 bp, Artificial
  CRISPR gRNA sequence
atgaagagctcgcaacctcc

SEQ ID NO: 556574 - DNA, 20 bp, Artificial
  CRISPR gRNA sequence
tgaagagctcgcaacctcct

SEQ ID NO: 556575 - DNA, 20 bp, Artificial
  CRISPR gRNA sequence
gcaacctccttacaagcttg

SEQ ID NO: 556576 - DNA, 20 bp, Artificial
  CRISPR gRNA sequence
cttacaagcttgaaaggatg

SEQ ID NO: 556577 - DNA, 20 bp, Artificial
  CRISPR gRNA sequence
acaagcttgaaaggatgagc

SEQ ID NO: 556578 - DNA, 20 bp, Artificial
  CRISPR gRNA sequence
caagcttgaaaggatgagca

SEQ ID NO: 556579 - DNA, 20 bp, Artificial
  CRISPR gRNA sequence
gaaaggatgagcagacaaac

SEQ ID NO: 556580 - DNA, 20 bp, Artificial
  CRISPR gRNA sequence
aaaggatgagcagacaaact

SEQ ID NO: 556581 - DNA, 20 bp, Artificial
  CRISPR gRNA sequence
cttgagcatcaaggagcgag

SEQ ID NO: 556582 - DNA, 20 bp, Artificial
  CRISPR gRNA sequence
gagcatcaaggagcgagaat

SEQ ID NO: 556583 - DNA, 20 bp, Artificial
  CRISPR gRNA sequence
agcatcaaggagcgagaatt

SEQ ID NO: 556584 - DNA, 20 bp, Artificial
  CRISPR gRNA sequence
tttcttttgctaggtcagat

SEQ ID NO: 556585 - DNA, 20 bp, Artificial
  CRISPR gRNA sequence
tcttttgctaggtcagatct

SEQ ID NO: 556586 - DNA, 20 bp, Artificial
  CRISPR gRNA sequence
cttttgctaggtcagatcta

SEQ ID NO: 556587 - DNA, 20 bp, Artificial
  CRISPR gRNA sequence
ttttgctaggtcagatctac

SEQ ID NO: 556588 - DNA, 20 bp, Artificial
  CRISPR gRNA sequence
ttgctaggtcagatctacct

SEQ ID NO: 556589 - DNA, 20 bp, Artificial
  CRISPR gRNA sequence
tgctaggtcagatctacctg

SEQ ID NO: 556590 - DNA, 20 bp, Artificial
  CRISPR gRNA sequence
gctaggtcagatctacctgt

SEQ ID NO: 556591 - DNA, 20 bp, Artificial
  CRISPR gRNA sequence
ctaggtcagatctacctgtt

SEQ ID NO: 556592 - DNA, 20 bp, Artificial
  CRISPR gRNA sequence
ggtcagatctacctgttcaa

SEQ ID NO: 556593 - DNA, 20 bp, Artificial
  CRISPR gRNA sequence
cctgttcaaatttaacagaa

SEQ ID NO: 556594 - DNA, 20 bp, Artificial
  CRISPR gRNA sequence
ttcaaatttaacagaataaa

SEQ ID NO: 556595 - DNA, 20 bp, Artificial
  CRISPR gRNA sequence
aaatttaacagaataaattc

SEQ ID NO: 556596 - DNA, 20 bp, Artificial
  CRISPR gRNA sequence
aacagaataaattcagaccc

SEQ ID NO: 556597 - DNA, 20 bp, Artificial
  CRISPR gRNA sequence
acagaataaattcagaccct

SEQ ID NO: 556598 - DNA, 20 bp, Artificial
  CRISPR gRNA sequence
agaccctgatatggtttggc

SEQ ID NO: 556599 - DNA, 20 bp, Artificial
  CRISPR gRNA sequence
atatggtttggctctgggtc

SEQ ID NO: 556600 - DNA, 20 bp, Artificial
  CRISPR gRNA sequence
ggctctgggtcctcacccaa

SEQ ID NO: 556601 - DNA, 20 bp, Artificial
  CRISPR gRNA sequence
gctctgggtcctcacccaaa

SEQ ID NO: 556602 - DNA, 20 bp, Artificial
  CRISPR gRNA sequence
tgggtcctcacccaaatctc

SEQ ID NO: 556603 - DNA, 20 bp, Artificial
  CRISPR gRNA sequence
ggtcctcacccaaatctcat

SEQ ID NO: 556604 - DNA, 20 bp, Artificial
  CRISPR gRNA sequence
acccaaatctcatcttgaat

SEQ ID NO: 556605 - DNA, 20 bp, Artificial
  CRISPR gRNA sequence
atcttgaattgtaattccca

SEQ ID NO: 556606 - DNA, 20 bp, Artificial
  CRISPR gRNA sequence
gaattgtaattcccatgtgt

SEQ ID NO: 556607 - DNA, 20 bp, Artificial
  CRISPR gRNA sequence
aattgtaattcccatgtgtc

SEQ ID NO: 556608 - DNA, 20 bp, Artificial
  CRISPR gRNA sequence
taattcccatgtgtcgagag

SEQ ID NO: 556609 - DNA, 20 bp, Artificial
  CRISPR gRNA sequence
ccatgtgtcgagagagggac

SEQ ID NO: 556610 - DNA, 20 bp, Artificial
  CRISPR gRNA sequence
gtgggaggtgattgtaccat

SEQ ID NO: 556611 - DNA, 20 bp, Artificial
  CRISPR gRNA sequence
taccatgggggatggtttcc

SEQ ID NO: 556612 - DNA, 20 bp, Artificial
  CRISPR gRNA sequence
ccccatgctattctagtgat

SEQ ID NO: 556613 - DNA, 20 bp, Artificial
  CRISPR gRNA sequence
cccatgctattctagtgata

SEQ ID NO: 556614 - DNA, 20 bp, Artificial
  CRISPR gRNA sequence
ttctagtgatagagagtgag

SEQ ID NO: 556615 - DNA, 20 bp, Artificial
  CRISPR gRNA sequence
tagtgatagagagtgagttc

SEQ ID NO: 556616 - DNA, 20 bp, Artificial
  CRISPR gRNA sequence
gtgatagagagtgagttctc

SEQ ID NO: 556617 - DNA, 20 bp, Artificial
  CRISPR gRNA sequence
tcatgacatctgttggttta

SEQ ID NO: 556618 - DNA, 20 bp, Artificial
  CRISPR gRNA sequence
atgacatctgttggtttaaa

SEQ ID NO: 556619 - DNA, 20 bp, Artificial
  CRISPR gRNA sequence
ttggtttaaaagtgtgtggc

SEQ ID NO: 556620 - DNA, 20 bp, Artificial
  CRISPR gRNA sequence
gtttaaaagtgtgtggcagt

SEQ ID NO: 556621 - DNA, 20 bp, Artificial
  CRISPR gRNA sequence
aaaagtgtgtggcagttctc

SEQ ID NO: 556622 - DNA, 20 bp, Artificial
  CRISPR gRNA sequence
aaagtgtgtggcagttctct

SEQ ID NO: 556623 - DNA, 20 bp, Artificial
  CRISPR gRNA sequence
tctctctctcctgctgcctt

SEQ ID NO: 556624 - DNA, 20 bp, Artificial
  CRISPR gRNA sequence
tctctctcctgctgccttgt

SEQ ID NO: 556625 - DNA, 20 bp, Artificial
  CRISPR gRNA sequence
tctctcctgctgccttgtga

SEQ ID NO: 556626 - DNA, 20 bp, Artificial
  CRISPR gRNA sequence
tctcctgctgccttgtgaaa

SEQ ID NO: 556627 - DNA, 20 bp, Artificial
  CRISPR gRNA sequence
tcctgctgccttgtgaaaaa

SEQ ID NO: 556628 - DNA, 20 bp, Artificial
  CRISPR gRNA sequence
ctgctgccttgtgaaaaaag

SEQ ID NO: 556629 - DNA, 20 bp, Artificial
  CRISPR gRNA sequence
ctgccttgtgaaaaaagtgc

SEQ ID NO: 556630 - DNA, 20 bp, Artificial
  CRISPR gRNA sequence
ccttgtgaaaaaagtgcttg

SEQ ID NO: 556631 - DNA, 20 bp, Artificial
  CRISPR gRNA sequence
gtgaaaaaagtgcttgcttc

SEQ ID NO: 556632 - DNA, 20 bp, Artificial
  CRISPR gRNA sequence
tgaaaaaagtgcttgcttct

SEQ ID NO: 556633 - DNA, 20 bp, Artificial
  CRISPR gRNA sequence
gcttctccttcgccttctgc

SEQ ID NO: 556634 - DNA, 20 bp, Artificial
  CRISPR gRNA sequence
cttctccttcgccttctgcc

SEQ ID NO: 556635 - DNA, 20 bp, Artificial
  CRISPR gRNA sequence
ctccttcgccttctgccatg

SEQ ID NO: 556636 - DNA, 20 bp, Artificial
  CRISPR gRNA sequence
tccttcgccttctgccatga

SEQ ID NO: 556637 - DNA, 20 bp, Artificial
  CRISPR gRNA sequence
cttcgccttctgccatgatt

SEQ ID NO: 556638 - DNA, 20 bp, Artificial
  CRISPR gRNA sequence
cgccttctgccatgattgta

SEQ ID NO: 556639 - DNA, 20 bp, Artificial
  CRISPR gRNA sequence
gccttctgccatgattgtaa

SEQ ID NO: 556640 - DNA, 20 bp, Artificial
  CRISPR gRNA sequence
ctgccatgattgtaagtttc

SEQ ID NO: 556641 - DNA, 20 bp, Artificial
  CRISPR gRNA sequence
tgccatgattgtaagtttcc

SEQ ID NO: 556642 - DNA, 20 bp, Artificial
  CRISPR gRNA sequence
ccatgattgtaagtttcccg

SEQ ID NO: 556643 - DNA, 20 bp, Artificial
  CRISPR gRNA sequence
taagtttcccgaggcctccc

SEQ ID NO: 556644 - DNA, 20 bp, Artificial
  CRISPR gRNA sequence
cccgaggcctccccagccat

SEQ ID NO: 556645 - DNA, 20 bp, Artificial
  CRISPR gRNA sequence
ccgaggcctccccagccatg

SEQ ID NO: 556646 - DNA, 20 bp, Artificial
  CRISPR gRNA sequence
cccagccatgtggaactgtg

SEQ ID NO: 556647 - DNA, 20 bp, Artificial
  CRISPR gRNA sequence
tgagtcaattaaacctcttt

SEQ ID NO: 556648 - DNA, 20 bp, Artificial
  CRISPR gRNA sequence
aacctcttttctttataaat

SEQ ID NO: 556649 - DNA, 20 bp, Artificial
  CRISPR gRNA sequence
ttttctttataaattaccca

SEQ ID NO: 556650 - DNA, 20 bp, Artificial
  CRISPR gRNA sequence
ttctttataaattacccagt

SEQ ID NO: 556651 - DNA, 20 bp, Artificial
  CRISPR gRNA sequence
tctttataaattacccagtt

SEQ ID NO: 556652 - DNA, 20 bp, Artificial
  CRISPR gRNA sequence
ctttataaattacccagttt

SEQ ID NO: 556653 - DNA, 20 bp, Artificial
  CRISPR gRNA sequence
tttataaattacccagtttc

SEQ ID NO: 556654 - DNA, 20 bp, Artificial
  CRISPR gRNA sequence
tataaattacccagtttcag

SEQ ID NO: 556655 - DNA, 20 bp, Artificial
  CRISPR gRNA sequence
ataaattacccagtttcagg

SEQ ID NO: 556656 - DNA, 20 bp, Artificial
  CRISPR gRNA sequence
taaattacccagtttcaggt

SEQ ID NO: 556657 - DNA, 20 bp, Artificial
  CRISPR gRNA sequence
cccagtttcaggtagttctt

SEQ ID NO: 556658 - DNA, 20 bp, Artificial
  CRISPR gRNA sequence
caggtagttctttatagcag

SEQ ID NO: 556659 - DNA, 20 bp, Artificial
  CRISPR gRNA sequence
aggtagttctttatagcagt

SEQ ID NO: 556660 - DNA, 20 bp, Artificial
  CRISPR gRNA sequence
tttatagcagtgtgaaaaca

SEQ ID NO: 556661 - DNA, 20 bp, Artificial
  CRISPR gRNA sequence
tatagcagtgtgaaaacaga

SEQ ID NO: 556662 - DNA, 20 bp, Artificial
  CRISPR gRNA sequence
atagcagtgtgaaaacagac

SEQ ID NO: 556663 - DNA, 20 bp, Artificial
  CRISPR gRNA sequence
tagcagtgtgaaaacagacc

SEQ ID NO: 556664 - DNA, 20 bp, Artificial
  CRISPR gRNA sequence
atcctcaattcttaaatcaa

SEQ ID NO: 556665 - DNA, 20 bp, Artificial
  CRISPR gRNA sequence
tcctcaattcttaaatcaaa

SEQ ID NO: 556666 - DNA, 20 bp, Artificial
  CRISPR gRNA sequence
aattcttaaatcaaaaaatc

SEQ ID NO: 556667 - DNA, 20 bp, Artificial
  CRISPR gRNA sequence
ttaaatcaaaaaatctctga

SEQ ID NO: 556668 - DNA, 20 bp, Artificial
  CRISPR gRNA sequence
aaatcaaaaaatctctgaag

SEQ ID NO: 556669 - DNA, 20 bp, Artificial
  CRISPR gRNA sequence
aatcaaaaaatctctgaagc

SEQ ID NO: 556670 - DNA, 20 bp, Artificial
  CRISPR gRNA sequence
tgaagccaaaagagtcttcg

SEQ ID NO: 556671 - DNA, 20 bp, Artificial
  CRISPR gRNA sequence
aagccaaaagagtcttcgca

SEQ ID NO: 556672 - DNA, 20 bp, Artificial
  CRISPR gRNA sequence
cgcaagttggtagcaaaatc

SEQ ID NO: 556673 - DNA, 20 bp, Artificial
  CRISPR gRNA sequence
gcaagttggtagcaaaatcg

SEQ ID NO: 556674 - DNA, 20 bp, Artificial
  CRISPR gRNA sequence
gtagcaaaatcgtttagctg

SEQ ID NO: 556675 - DNA, 20 bp, Artificial
  CRISPR gRNA sequence
agctgcaaatcctgacctga

SEQ ID NO: 556676 - DNA, 20 bp, Artificial
  CRISPR gRNA sequence
gctgcaaatcctgacctgac

SEQ ID NO: 556677 - DNA, 20 bp, Artificial
  CRISPR gRNA sequence
caaatcctgacctgacctga

SEQ ID NO: 556678 - DNA, 20 bp, Artificial
  CRISPR gRNA sequence
acctgacctgaattaacaca

SEQ ID NO: 556679 - DNA, 20 bp, Artificial
  CRISPR gRNA sequence
acctgaattaacacaaggat

SEQ ID NO: 556680 - DNA, 20 bp, Artificial
  CRISPR gRNA sequence
aattaacacaaggatttgag

SEQ ID NO: 556681 - DNA, 20 bp, Artificial
  CRISPR gRNA sequence
acacaaggatttgagtcttt

SEQ ID NO: 556682 - DNA, 20 bp, Artificial
  CRISPR gRNA sequence
gagtctttctcactcacttc

SEQ ID NO: 556683 - DNA, 20 bp, Artificial
  CRISPR gRNA sequence
agtctttctcactcacttca

SEQ ID NO: 556684 - DNA, 20 bp, Artificial
  CRISPR gRNA sequence
tctcactcacttcaaatatt

SEQ ID NO: 556685 - DNA, 20 bp, Artificial
  CRISPR gRNA sequence
ctcactcacttcaaatattc

SEQ ID NO: 556686 - DNA, 20 bp, Artificial
  CRISPR gRNA sequence
tcactcacttcaaatattca

SEQ ID NO: 556687 - DNA, 20 bp, Artificial
  CRISPR gRNA sequence
actcacttcaaatattcatt

SEQ ID NO: 556688 - DNA, 20 bp, Artificial
  CRISPR gRNA sequence
acttcaaatattcattatcg

SEQ ID NO: 556689 - DNA, 20 bp, Artificial
  CRISPR gRNA sequence
caaatattcattatcgtttc

SEQ ID NO: 556690 - DNA, 20 bp, Artificial
  CRISPR gRNA sequence
aaatattcattatcgtttca

SEQ ID NO: 556691 - DNA, 20 bp, Artificial
  CRISPR gRNA sequence
attatcgtttcaccacaaaa

SEQ ID NO: 556692 - DNA, 20 bp, Artificial
  CRISPR gRNA sequence
tcgtttcaccacaaaaatat

SEQ ID NO: 556693 - DNA, 20 bp, Artificial
  CRISPR gRNA sequence
caccacaaaaatattcctgt

SEQ ID NO: 556694 - DNA, 20 bp, Artificial
  CRISPR gRNA sequence
accacaaaaatattcctgtg

SEQ ID NO: 556695 - DNA, 20 bp, Artificial
  CRISPR gRNA sequence
ctgtgcttggcaggacacag

SEQ ID NO: 556696 - DNA, 20 bp, Artificial
  CRISPR gRNA sequence
tgcttggcaggacacagtgg

SEQ ID NO: 556697 - DNA, 20 bp, Artificial
  CRISPR gRNA sequence
ggcaggacacagtggctcat

SEQ ID NO: 556698 - DNA, 20 bp, Artificial
  CRISPR gRNA sequence
gcaggacacagtggctcatg

SEQ ID NO: 556699 - DNA, 20 bp, Artificial
  CRISPR gRNA sequence
atggctatactcccagcact

SEQ ID NO: 556700 - DNA, 20 bp, Artificial
  CRISPR gRNA sequence
tactcccagcactttgggag

SEQ ID NO: 556701 - DNA, 20 bp, Artificial
  CRISPR gRNA sequence
ccagcactttgggaggctga

SEQ ID NO: 556702 - DNA, 20 bp, Artificial
  CRISPR gRNA sequence
tgggaggctgaggcaggagg

SEQ ID NO: 556703 - DNA, 20 bp, Artificial
  CRISPR gRNA sequence
gggaggctgaggcaggagga

SEQ ID NO: 556704 - DNA, 20 bp, Artificial
  CRISPR gRNA sequence
ggaggctgaggcaggaggat

SEQ ID NO: 556705 - DNA, 20 bp, Artificial
  CRISPR gRNA sequence
aggcaggaggatggcttgag

SEQ ID NO: 556706 - DNA, 20 bp, Artificial
  CRISPR gRNA sequence
gaggccaggagttcaagacc

SEQ ID NO: 556707 - DNA, 20 bp, Artificial
  CRISPR gRNA sequence
aggccaggagttcaagacca

SEQ ID NO: 556708 - DNA, 20 bp, Artificial
  CRISPR gRNA sequence
aagaccagcctgggcaacat

SEQ ID NO: 556709 - DNA, 20 bp, Artificial
  CRISPR gRNA sequence
ggcaacatagcaagaccctg

SEQ ID NO: 556710 - DNA, 20 bp, Artificial
  CRISPR gRNA sequence
tctttataaaaagtttaaag

SEQ ID NO: 556711 - DNA, 20 bp, Artificial
  CRISPR gRNA sequence
tataaaaagtttaaagatta

SEQ ID NO: 556712 - DNA, 20 bp, Artificial
  CRISPR gRNA sequence
ataaaaagtttaaagattag

SEQ ID NO: 556713 - DNA, 20 bp, Artificial
  CRISPR gRNA sequence
taaaaagtttaaagattagc

SEQ ID NO: 556714 - DNA, 20 bp, Artificial
  CRISPR gRNA sequence
aaagattagccagccatgat

SEQ ID NO: 556715 - DNA, 20 bp, Artificial
  CRISPR gRNA sequence
aagattagccagccatgatg

SEQ ID NO: 556716 - DNA, 20 bp, Artificial
  CRISPR gRNA sequence
gccagccatgatggctcctg

SEQ ID NO: 556717 - DNA, 20 bp, Artificial
  CRISPR gRNA sequence
ctgcctgtagtctcagctac

SEQ ID NO: 556718 - DNA, 20 bp, Artificial
  CRISPR gRNA sequence
cctgtagtctcagctacttg

SEQ ID NO: 556719 - DNA, 20 bp, Artificial
  CRISPR gRNA sequence
tagtctcagctacttgcaac

SEQ ID NO: 556720 - DNA, 20 bp, Artificial
  CRISPR gRNA sequence
agctacttgcaactgcttga

SEQ ID NO: 556721 - DNA, 20 bp, Artificial
  CRISPR gRNA sequence
cttgcaactgcttgaaccaa

SEQ ID NO: 556722 - DNA, 20 bp, Artificial
  CRISPR gRNA sequence
gcaactgcttgaaccaagga

SEQ ID NO: 556723 - DNA, 20 bp, Artificial
  CRISPR gRNA sequence
caactgcttgaaccaaggaa

SEQ ID NO: 556724 - DNA, 20 bp, Artificial
  CRISPR gRNA sequence
cttgaaccaaggaatctgaa

SEQ ID NO: 556725 - DNA, 20 bp, Artificial
  CRISPR gRNA sequence
gaaccaaggaatctgaagct

SEQ ID NO: 556726 - DNA, 20 bp, Artificial
  CRISPR gRNA sequence
aaccaaggaatctgaagcta

SEQ ID NO: 556727 - DNA, 20 bp, Artificial
  CRISPR gRNA sequence
aagctacagtgagttataat

SEQ ID NO: 556728 - DNA, 20 bp, Artificial
  CRISPR gRNA sequence
cagtgagttataattgtgcc

SEQ ID NO: 556729 - DNA, 20 bp, Artificial
  CRISPR gRNA sequence
taattgtgccagtgcactct

SEQ ID NO: 556730 - DNA, 20 bp, Artificial
  CRISPR gRNA sequence
tgccagtgcactctagctca

SEQ ID NO: 556731 - DNA, 20 bp, Artificial
  CRISPR gRNA sequence
tagctcactacacacagtgg

SEQ ID NO: 556732 - DNA, 20 bp, Artificial
  CRISPR gRNA sequence
gctcactacacacagtgggc

SEQ ID NO: 556733 - DNA, 20 bp, Artificial
  CRISPR gRNA sequence
actacacacagtgggctatg

SEQ ID NO: 556734 - DNA, 20 bp, Artificial
  CRISPR gRNA sequence
cacacagtgggctatgattg

SEQ ID NO: 556735 - DNA, 20 bp, Artificial
  CRISPR gRNA sequence
tgattgcatcagactgagac

SEQ ID NO: 556736 - DNA, 20 bp, Artificial
  CRISPR gRNA sequence
catcagactgagaccttgtc

SEQ ID NO: 556737 - DNA, 20 bp, Artificial
  CRISPR gRNA sequence
agaccttgtctttaaatata

SEQ ID NO: 556738 - DNA, 20 bp, Artificial
  CRISPR gRNA sequence
gtctttaaatatataggaat

SEQ ID NO: 556739 - DNA, 20 bp, Artificial
  CRISPR gRNA sequence
tctttaaatatataggaatg

SEQ ID NO: 556740 - DNA, 20 bp, Artificial
  CRISPR gRNA sequence
taaatatataggaatgaagt

SEQ ID NO: 556741 - DNA, 20 bp, Artificial
  CRISPR gRNA sequence
aaatatataggaatgaagta

SEQ ID NO: 556742 - DNA, 20 bp, Artificial
  CRISPR gRNA sequence
aatatataggaatgaagtaa

SEQ ID NO: 556743 - DNA, 20 bp, Artificial
  CRISPR gRNA sequence
gttcctatgcttgacccata

SEQ ID NO: 556744 - DNA, 20 bp, Artificial
  CRISPR gRNA sequence
ttcctatgcttgacccatag

SEQ ID NO: 556745 - DNA, 20 bp, Artificial
  CRISPR gRNA sequence
ctatgcttgacccatagggt

SEQ ID NO: 556746 - DNA, 20 bp, Artificial
  CRISPR gRNA sequence
tgcttgacccatagggtgct

SEQ ID NO: 556747 - DNA, 20 bp, Artificial
  CRISPR gRNA sequence
gacccatagggtgctcccca

SEQ ID NO: 556748 - DNA, 20 bp, Artificial
  CRISPR gRNA sequence
acccatagggtgctccccat

SEQ ID NO: 556749 - DNA, 20 bp, Artificial
  CRISPR gRNA sequence
cccataattaagtggggtgc

SEQ ID NO: 556750 - DNA, 20 bp, Artificial
  CRISPR gRNA sequence
agtggggtgcttaatatgca

SEQ ID NO: 556751 - DNA, 20 bp, Artificial
  CRISPR gRNA sequence
aatatgcagaggaaatactt

SEQ ID NO: 556752 - DNA, 20 bp, Artificial
  CRISPR gRNA sequence
atatgcagaggaaatacttt

SEQ ID NO: 556753 - DNA, 20 bp, Artificial
  CRISPR gRNA sequence
tgtattacctttccaaaatg

SEQ ID NO: 556754 - DNA, 20 bp, Artificial
  CRISPR gRNA sequence
gtattacctttccaaaatgt

SEQ ID NO: 556755 - DNA, 20 bp, Artificial
  CRISPR gRNA sequence
tattacctttccaaaatgta

SEQ ID NO: 556756 - DNA, 20 bp, Artificial
  CRISPR gRNA sequence
cctttccaaaatgtaaaaaa

SEQ ID NO: 556757 - DNA, 20 bp, Artificial
  CRISPR gRNA sequence
tccaaaatgtaaaaaaaaat

SEQ ID NO: 556758 - DNA, 20 bp, Artificial
  CRISPR gRNA sequence
ccaaaatgtaaaaaaaaatt

SEQ ID NO: 556759 - DNA, 20 bp, Artificial
  CRISPR gRNA sequence
caaaatgtaaaaaaaaattt

SEQ ID NO: 556760 - DNA, 20 bp, Artificial
  CRISPR gRNA sequence
taattccataacacgtctga

SEQ ID NO: 556761 - DNA, 20 bp, Artificial
  CRISPR gRNA sequence
aattccataacacgtctgac

SEQ ID NO: 556762 - DNA, 20 bp, Artificial
  CRISPR gRNA sequence
attccataacacgtctgact

SEQ ID NO: 556763 - DNA, 20 bp, Artificial
  CRISPR gRNA sequence
cataacacgtctgactcaaa

SEQ ID NO: 556764 - DNA, 20 bp, Artificial
  CRISPR gRNA sequence
actcaaagcattttgtgaaa

SEQ ID NO: 556765 - DNA, 20 bp, Artificial
  CRISPR gRNA sequence
aaagcattttgtgaaaggaa

SEQ ID NO: 556766 - DNA, 20 bp, Artificial
  CRISPR gRNA sequence
tgtgaaaggaaagtccataa

SEQ ID NO: 556767 - DNA, 20 bp, Artificial
  CRISPR gRNA sequence
gtgaaaggaaagtccataat

SEQ ID NO: 556768 - DNA, 20 bp, Artificial
  CRISPR gRNA sequence
tgaaaggaaagtccataata

SEQ ID NO: 556769 - DNA, 20 bp, Artificial
  CRISPR gRNA sequence
actcaatacattttgtgaaa

SEQ ID NO: 556770 - DNA, 20 bp, Artificial
  CRISPR gRNA sequence
aatacattttgtgaaaggtg

SEQ ID NO: 556771 - DNA, 20 bp, Artificial
  CRISPR gRNA sequence
tgtgaaaggtggagctacac

SEQ ID NO: 556772 - DNA, 20 bp, Artificial
  CRISPR gRNA sequence
gtgaaaggtggagctacaca

SEQ ID NO: 556773 - DNA, 20 bp, Artificial
  CRISPR gRNA sequence
tgaaaggtggagctacacag

SEQ ID NO: 556774 - DNA, 20 bp, Artificial
  CRISPR gRNA sequence
cacagagccttgtcgggccc

SEQ ID NO: 556775 - DNA, 20 bp, Artificial
  CRISPR gRNA sequence
gtcgggccctgcctattggt

SEQ ID NO: 556776 - DNA, 20 bp, Artificial
  CRISPR gRNA sequence
tcgggccctgcctattggtt

SEQ ID NO: 556777 - DNA, 20 bp, Artificial
  CRISPR gRNA sequence
cctattggttgggctggacc

SEQ ID NO: 556778 - DNA, 20 bp, Artificial
  CRISPR gRNA sequence
ttggttgggctggacctgtt

SEQ ID NO: 556779 - DNA, 20 bp, Artificial
  CRISPR gRNA sequence
gttgggctggacctgttaat

SEQ ID NO: 556780 - DNA, 20 bp, Artificial
  CRISPR gRNA sequence
ggctggacctgttaataggc

SEQ ID NO: 556781 - DNA, 20 bp, Artificial
  CRISPR gRNA sequence
gacctgttaataggcagtgc

SEQ ID NO: 556782 - DNA, 20 bp, Artificial
  CRISPR gRNA sequence
ttaataggcagtgcagggag

SEQ ID NO: 556783 - DNA, 20 bp, Artificial
  CRISPR gRNA sequence
ataggcagtgcagggagcag

SEQ ID NO: 556784 - DNA, 20 bp, Artificial
  CRISPR gRNA sequence
cctgtccagaggcctcactc

SEQ ID NO: 556785 - DNA, 20 bp, Artificial
  CRISPR gRNA sequence
tccagaggcctcactcccac

SEQ ID NO: 556786 - DNA, 20 bp, Artificial
  CRISPR gRNA sequence
actcccacccttcttctagg

SEQ ID NO: 556787 - DNA, 20 bp, Artificial
  CRISPR gRNA sequence
ccacccttcttctaggaagt

SEQ ID NO: 556788 - DNA, 20 bp, Artificial
  CRISPR gRNA sequence
cttctaggaagtgcctccta

SEQ ID NO: 556789 - DNA, 20 bp, Artificial
  CRISPR gRNA sequence
ttctaggaagtgcctcctat

SEQ ID NO: 556790 - DNA, 20 bp, Artificial
  CRISPR gRNA sequence
ctaggaagtgcctcctattg

SEQ ID NO: 556791 - DNA, 20 bp, Artificial
  CRISPR gRNA sequence
taggaagtgcctcctattgg

SEQ ID NO: 556792 - DNA, 20 bp, Artificial
  CRISPR gRNA sequence
ggaagtgcctcctattggct

SEQ ID NO: 556793 - DNA, 20 bp, Artificial
  CRISPR gRNA sequence
ctattggctaaggcagcatg

SEQ ID NO: 556794 - DNA, 20 bp, Artificial
  CRISPR gRNA sequence
ttggctaaggcagcatggac

SEQ ID NO: 556795 - DNA, 20 bp, Artificial
  CRISPR gRNA sequence
gctaaggcagcatggaccta

SEQ ID NO: 556796 - DNA, 20 bp, Artificial
  CRISPR gRNA sequence
aggcagcatggacctacaag

SEQ ID NO: 556797 - DNA, 20 bp, Artificial
  CRISPR gRNA sequence
caaggatgagttaagacact

SEQ ID NO: 556798 - DNA, 20 bp, Artificial
  CRISPR gRNA sequence
agacactaacatgtcacatt

SEQ ID NO: 556799 - DNA, 20 bp, Artificial
  CRISPR gRNA sequence
acatgtcacattctgccatt

SEQ ID NO: 556800 - DNA, 20 bp, Artificial
  CRISPR gRNA sequence
tgccattgttgccctttaaa

SEQ ID NO: 556801 - DNA, 20 bp, Artificial
  CRISPR gRNA sequence
ccattgttgccctttaaaag

SEQ ID NO: 556802 - DNA, 20 bp, Artificial
  CRISPR gRNA sequence
ttgccctttaaaagcctcaa

SEQ ID NO: 556803 - DNA, 20 bp, Artificial
  CRISPR gRNA sequence
ccctttaaaagcctcaaggc

SEQ ID NO: 556804 - DNA, 20 bp, Artificial
  CRISPR gRNA sequence
taaaagcctcaaggctaatt

SEQ ID NO: 556805 - DNA, 20 bp, Artificial
  CRISPR gRNA sequence
aaaagcctcaaggctaatta

SEQ ID NO: 556806 - DNA, 20 bp, Artificial
  CRISPR gRNA sequence
aaagcctcaaggctaattac

SEQ ID NO: 556807 - DNA, 20 bp, Artificial
  CRISPR gRNA sequence
aaggctaattactttgtcct

SEQ ID NO: 556808 - DNA, 20 bp, Artificial
  CRISPR gRNA sequence
attactttgtcctatgagtc

SEQ ID NO: 556809 - DNA, 20 bp, Artificial
  CRISPR gRNA sequence
ctttgtcctatgagtcattt

SEQ ID NO: 556810 - DNA, 20 bp, Artificial
  CRISPR gRNA sequence
tgtcctatgagtcatttatt

SEQ ID NO: 556811 - DNA, 20 bp, Artificial
  CRISPR gRNA sequence
gtcctatgagtcatttattt

SEQ ID NO: 556812 - DNA, 20 bp, Artificial
  CRISPR gRNA sequence
tcctatgagtcatttatttg

SEQ ID NO: 556813 - DNA, 20 bp, Artificial
  CRISPR gRNA sequence
tgagtcatttatttgttaat

SEQ ID NO: 556814 - DNA, 20 bp, Artificial
  CRISPR gRNA sequence
atttgttaattcatatgcct

SEQ ID NO: 556815 - DNA, 20 bp, Artificial
  CRISPR gRNA sequence
tttgttaattcatatgcctt

SEQ ID NO: 556816 - DNA, 20 bp, Artificial
  CRISPR gRNA sequence
gttaattcatatgccttctt

SEQ ID NO: 556817 - DNA, 20 bp, Artificial
  CRISPR gRNA sequence
ttaattcatatgccttcttg

SEQ ID NO: 556818 - DNA, 20 bp, Artificial
  CRISPR gRNA sequence
attcatatgccttcttgcgt

SEQ ID NO: 556819 - DNA, 20 bp, Artificial
  CRISPR gRNA sequence
atatgccttcttgcgtctca

SEQ ID NO: 556820 - DNA, 20 bp, Artificial
  CRISPR gRNA sequence
cttgcgtctcagctaccctc

SEQ ID NO: 556821 - DNA, 20 bp, Artificial
  CRISPR gRNA sequence
ttgcgtctcagctaccctcc

SEQ ID NO: 556822 - DNA, 20 bp, Artificial
  CRISPR gRNA sequence
gcgtctcagctaccctccag

SEQ ID NO: 556823 - DNA, 20 bp, Artificial
  CRISPR gRNA sequence
cgtctcagctaccctccagc

SEQ ID NO: 556824 - DNA, 20 bp, Artificial
  CRISPR gRNA sequence
agctaccctccagcaattaa

SEQ ID NO: 556825 - DNA, 20 bp, Artificial
  CRISPR gRNA sequence
ccctccagcaattaatcata

SEQ ID NO: 556826 - DNA, 20 bp, Artificial
  CRISPR gRNA sequence
cagcaattaatcataagagg

SEQ ID NO: 556827 - DNA, 20 bp, Artificial
  CRISPR gRNA sequence
atcataagaggcctgaggaa

SEQ ID NO: 556828 - DNA, 20 bp, Artificial
  CRISPR gRNA sequence
aggaaacatgcaaaaacata

SEQ ID NO: 556829 - DNA, 20 bp, Artificial
  CRISPR gRNA sequence
ggataataaagtattgatac

SEQ ID NO: 556830 - DNA, 20 bp, Artificial
  CRISPR gRNA sequence
atacattataaacgtctact

SEQ ID NO: 556831 - DNA, 20 bp, Artificial
  CRISPR gRNA sequence
taaacgtctactaaaaagag

SEQ ID NO: 556832 - DNA, 20 bp, Artificial
  CRISPR gRNA sequence
ctaaaaagagcatttaagta

SEQ ID NO: 556833 - DNA, 20 bp, Artificial
  CRISPR gRNA sequence
aaaagagcatttaagtaaat

SEQ ID NO: 556834 - DNA, 20 bp, Artificial
  CRISPR gRNA sequence
aagtaaatttaggttcacca

SEQ ID NO: 556835 - DNA, 20 bp, Artificial
  CRISPR gRNA sequence
agtaaatttaggttcaccaa

SEQ ID NO: 556836 - DNA, 20 bp, Artificial
  CRISPR gRNA sequence
aggttcaccaagataatgga

SEQ ID NO: 556837 - DNA, 20 bp, Artificial
  CRISPR gRNA sequence
ggttcaccaagataatggaa

SEQ ID NO: 556838 - DNA, 20 bp, Artificial
  CRISPR gRNA sequence
accaagataatggaatacta

SEQ ID NO: 556839 - DNA, 20 bp, Artificial
  CRISPR gRNA sequence
tgttgtcatttaaaatgatg

SEQ ID NO: 556840 - DNA, 20 bp, Artificial
  CRISPR gRNA sequence
tcatttaaaatgatgttttc

SEQ ID NO: 556841 - DNA, 20 bp, Artificial
  CRISPR gRNA sequence
aaaatgatgttttctaagac

SEQ ID NO: 556842 - DNA, 20 bp, Artificial
  CRISPR gRNA sequence
aaatgatgttttctaagaca

SEQ ID NO: 556843 - DNA, 20 bp, Artificial
  CRISPR gRNA sequence
tctaagacaagttaatgctt

SEQ ID NO: 556844 - DNA, 20 bp, Artificial
  CRISPR gRNA sequence
ctaagacaagttaatgctta

SEQ ID NO: 556845 - DNA, 20 bp, Artificial
  CRISPR gRNA sequence
taagacaagttaatgcttat

SEQ ID NO: 556846 - DNA, 20 bp, Artificial
  CRISPR gRNA sequence
agacaagttaatgcttatgc

SEQ ID NO: 556847 - DNA, 20 bp, Artificial
  CRISPR gRNA sequence
atgcttatgctccaattata

SEQ ID NO: 556848 - DNA, 20 bp, Artificial
  CRISPR gRNA sequence
atgctccaattataatctga

SEQ ID NO: 556849 - DNA, 20 bp, Artificial
  CRISPR gRNA sequence
tgctccaattataatctgaa

SEQ ID NO: 556850 - DNA, 20 bp, Artificial
  CRISPR gRNA sequence
caattataatctgaaaaata

SEQ ID NO: 556851 - DNA, 20 bp, Artificial
  CRISPR gRNA sequence
taatctgaaaaataaaagca

SEQ ID NO: 556852 - DNA, 20 bp, Artificial
  CRISPR gRNA sequence
aaaaataaaagcatttaatg

SEQ ID NO: 556853 - DNA, 20 bp, Artificial
  CRISPR gRNA sequence
aatggttcccccatcttctc

SEQ ID NO: 556854 - DNA, 20 bp, Artificial
  CRISPR gRNA sequence
atggttcccccatcttctcc

SEQ ID NO: 556855 - DNA, 20 bp, Artificial
  CRISPR gRNA sequence
ccccatcttctcctcctcct

SEQ ID NO: 556856 - DNA, 20 bp, Artificial
  CRISPR gRNA sequence
ctcctcctcctgaattcctt

SEQ ID NO: 556857 - DNA, 20 bp, Artificial
  CRISPR gRNA sequence
tcctcctcctgaattccttc

SEQ ID NO: 556858 - DNA, 20 bp, Artificial
  CRISPR gRNA sequence
ctcctcctgaattccttctc

SEQ ID NO: 556859 - DNA, 20 bp, Artificial
  CRISPR gRNA sequence
ctcctgaattccttctcgct

SEQ ID NO: 556860 - DNA, 20 bp, Artificial
  CRISPR gRNA sequence
ctgaattccttctcgctcag

SEQ ID NO: 556861 - DNA, 20 bp, Artificial
  CRISPR gRNA sequence
aattccttctcgctcagtta

SEQ ID NO: 556862 - DNA, 20 bp, Artificial
  CRISPR gRNA sequence
cttctcgctcagttaaataa

SEQ ID NO: 556863 - DNA, 20 bp, Artificial
  CRISPR gRNA sequence
ctcgctcagttaaataaagt

SEQ ID NO: 556864 - DNA, 20 bp, Artificial
  CRISPR gRNA sequence
tcgctcagttaaataaagta

SEQ ID NO: 556865 - DNA, 20 bp, Artificial
  CRISPR gRNA sequence
gctcagttaaataaagtacc

SEQ ID NO: 556866 - DNA, 20 bp, Artificial
  CRISPR gRNA sequence
agttaaataaagtacccagc

SEQ ID NO: 556867 - DNA, 20 bp, Artificial
  CRISPR gRNA sequence
aataaagtacccagcctgcc

SEQ ID NO: 556868 - DNA, 20 bp, Artificial
  CRISPR gRNA sequence
ccttggtagaaaccagagtc

SEQ ID NO: 556869 - DNA, 20 bp, Artificial
  CRISPR gRNA sequence
ggtagaaaccagagtcacac

SEQ ID NO: 556870 - DNA, 20 bp, Artificial
  CRISPR gRNA sequence
gtagaaaccagagtcacaca

SEQ ID NO: 556871 - DNA, 20 bp, Artificial
  CRISPR gRNA sequence
acttccctttctacttgggg

SEQ ID NO: 556872 - DNA, 20 bp, Artificial
  CRISPR gRNA sequence
ccctttctacttggggcttc

SEQ ID NO: 556873 - DNA, 20 bp, Artificial
  CRISPR gRNA sequence
cctttctacttggggcttcc

SEQ ID NO: 556874 - DNA, 20 bp, Artificial
  CRISPR gRNA sequence
tctacttggggcttcctagt

SEQ ID NO: 556875 - DNA, 20 bp, Artificial
  CRISPR gRNA sequence
ctacttggggcttcctagtt

SEQ ID NO: 556876 - DNA, 20 bp, Artificial
  CRISPR gRNA sequence
tacttggggcttcctagttt

SEQ ID NO: 556877 - DNA, 20 bp, Artificial
  CRISPR gRNA sequence
cttggggcttcctagttttt

SEQ ID NO: 556878 - DNA, 20 bp, Artificial
  CRISPR gRNA sequence
ggggcttcctagtttttaag

SEQ ID NO: 556879 - DNA, 20 bp, Artificial
  CRISPR gRNA sequence
gggcttcctagtttttaagt

SEQ ID NO: 556880 - DNA, 20 bp, Artificial
  CRISPR gRNA sequence
cctagtttttaagtttaatc

SEQ ID NO: 556881 - DNA, 20 bp, Artificial
  CRISPR gRNA sequence
ctagtttttaagtttaatct

SEQ ID NO: 556882 - DNA, 20 bp, Artificial
  CRISPR gRNA sequence
gtttttaagtttaatctagc

SEQ ID NO: 556883 - DNA, 20 bp, Artificial
  CRISPR gRNA sequence
ttaagtttaatctagctcac

SEQ ID NO: 556884 - DNA, 20 bp, Artificial
  CRISPR gRNA sequence
taagtttaatctagctcaca

SEQ ID NO: 556885 - DNA, 20 bp, Artificial
  CRISPR gRNA sequence
aagtttaatctagctcacac

SEQ ID NO: 556886 - DNA, 20 bp, Artificial
  CRISPR gRNA sequence
agtttaatctagctcacaca

SEQ ID NO: 556887 - DNA, 20 bp, Artificial
  CRISPR gRNA sequence
aatctagctcacacaagtcc

SEQ ID NO: 556888 - DNA, 20 bp, Artificial
  CRISPR gRNA sequence
atctagctcacacaagtcct

SEQ ID NO: 556889 - DNA, 20 bp, Artificial
  CRISPR gRNA sequence
gctcacacaagtccttacat

SEQ ID NO: 556890 - DNA, 20 bp, Artificial
  CRISPR gRNA sequence
acacaagtccttacatactt

SEQ ID NO: 556891 - DNA, 20 bp, Artificial
  CRISPR gRNA sequence
acatacttccttaagatttt

SEQ ID NO: 556892 - DNA, 20 bp, Artificial
  CRISPR gRNA sequence
catacttccttaagattttc

SEQ ID NO: 556893 - DNA, 20 bp, Artificial
  CRISPR gRNA sequence
ccttaagattttctttaatt

SEQ ID NO: 556894 - DNA, 20 bp, Artificial
  CRISPR gRNA sequence
cttaagattttctttaatta

SEQ ID NO: 556895 - DNA, 20 bp, Artificial
  CRISPR gRNA sequence
aagattttctttaattaaaa

SEQ ID NO: 556896 - DNA, 20 bp, Artificial
  CRISPR gRNA sequence
agattttctttaattaaaaa

SEQ ID NO: 556897 - DNA, 20 bp, Artificial
  CRISPR gRNA sequence
tctttaattaaaaagacttt

SEQ ID NO: 556898 - DNA, 20 bp, Artificial
  CRISPR gRNA sequence
ctttaattaaaaagactttt

SEQ ID NO: 556899 - DNA, 20 bp, Artificial
  CRISPR gRNA sequence
tttaattaaaaagactttta

SEQ ID NO: 556900 - DNA, 20 bp, Artificial
  CRISPR gRNA sequence
taattaaaaagacttttaat

SEQ ID NO: 556901 - DNA, 20 bp, Artificial
  CRISPR gRNA sequence
aattaaaaagacttttaatc

SEQ ID NO: 556902 - DNA, 20 bp, Artificial
  CRISPR gRNA sequence
attaaaaagacttttaatca

SEQ ID NO: 556903 - DNA, 20 bp, Artificial
  CRISPR gRNA sequence
aaaagacttttaatcatctt

SEQ ID NO: 556904 - DNA, 20 bp, Artificial
  CRISPR gRNA sequence
ttaatcatcttttaagcagt

SEQ ID NO: 556905 - DNA, 20 bp, Artificial
  CRISPR gRNA sequence
taatcatcttttaagcagtg

SEQ ID NO: 556906 - DNA, 20 bp, Artificial
  CRISPR gRNA sequence
aatcatcttttaagcagtgg

SEQ ID NO: 556907 - DNA, 20 bp, Artificial
  CRISPR gRNA sequence
atcatcttttaagcagtgga

SEQ ID NO: 556908 - DNA, 20 bp, Artificial
  CRISPR gRNA sequence
ttaagcagtggaatttctca

SEQ ID NO: 556909 - DNA, 20 bp, Artificial
  CRISPR gRNA sequence
taagcagtggaatttctcag

SEQ ID NO: 556910 - DNA, 20 bp, Artificial
  CRISPR gRNA sequence
aagcagtggaatttctcaga

SEQ ID NO: 556911 - DNA, 20 bp, Artificial
  CRISPR gRNA sequence
agcagtggaatttctcagaa

SEQ ID NO: 556912 - DNA, 20 bp, Artificial
  CRISPR gRNA sequence
ctcagaattaaatcttcagt

SEQ ID NO: 556913 - DNA, 20 bp, Artificial
  CRISPR gRNA sequence
tcagaattaaatcttcagtg

SEQ ID NO: 556914 - DNA, 20 bp, Artificial
  CRISPR gRNA sequence
agaattaaatcttcagtggc

SEQ ID NO: 556915 - DNA, 20 bp, Artificial
  CRISPR gRNA sequence
aatcttcagtggcaatccaa

SEQ ID NO: 556916 - DNA, 20 bp, Artificial
  CRISPR gRNA sequence
cagtggcaatccaatccaat

SEQ ID NO: 556917 - DNA, 20 bp, Artificial
  CRISPR gRNA sequence
agtggcaatccaatccaatg

SEQ ID NO: 556918 - DNA, 20 bp, Artificial
  CRISPR gRNA sequence
ctctagttgactcaaaattg

SEQ ID NO: 556919 - DNA, 20 bp, Artificial
  CRISPR gRNA sequence
tagttgactcaaaattgaaa

SEQ ID NO: 556920 - DNA, 20 bp, Artificial
  CRISPR gRNA sequence
gttgactcaaaattgaaagc

SEQ ID NO: 556921 - DNA, 20 bp, Artificial
  CRISPR gRNA sequence
actcaaaattgaaagcctag

SEQ ID NO: 556922 - DNA, 20 bp, Artificial
  CRISPR gRNA sequence
aaaattgaaagcctagagcc

SEQ ID NO: 556923 - DNA, 20 bp, Artificial
  CRISPR gRNA sequence
aaagcctagagccctgctct

SEQ ID NO: 556924 - DNA, 20 bp, Artificial
  CRISPR gRNA sequence
gagccctgctctcctaactt

SEQ ID NO: 556925 - DNA, 20 bp, Artificial
  CRISPR gRNA sequence
ctctcctaacttcctctggt

SEQ ID NO: 556926 - DNA, 20 bp, Artificial
  CRISPR gRNA sequence
tcctaacttcctctggtccc

SEQ ID NO: 556927 - DNA, 20 bp, Artificial
  CRISPR gRNA sequence
ctaacttcctctggtccctt

SEQ ID NO: 556928 - DNA, 20 bp, Artificial
  CRISPR gRNA sequence
acttcctctggtcccttttg

SEQ ID NO: 556929 - DNA, 20 bp, Artificial
  CRISPR gRNA sequence
cctctggtcccttttgccca

SEQ ID NO: 556930 - DNA, 20 bp, Artificial
  CRISPR gRNA sequence
ctctggtcccttttgcccac

SEQ ID NO: 556931 - DNA, 20 bp, Artificial
  CRISPR gRNA sequence
tggtcccttttgcccacccc

SEQ ID NO: 556932 - DNA, 20 bp, Artificial
  CRISPR gRNA sequence
gtcccttttgcccaccccac

SEQ ID NO: 556933 - DNA, 20 bp, Artificial
  CRISPR gRNA sequence
ttgcccaccccaccccatag

SEQ ID NO: 556934 - DNA, 20 bp, Artificial
  CRISPR gRNA sequence
tgcccaccccaccccatagc

SEQ ID NO: 556935 - DNA, 20 bp, Artificial
  CRISPR gRNA sequence
gcccaccccaccccatagca

SEQ ID NO: 556936 - DNA, 20 bp, Artificial
  CRISPR gRNA sequence
cccaccccaccccatagcag

SEQ ID NO: 556937 - DNA, 20 bp, Artificial
  CRISPR gRNA sequence
aggggacttccaaggaacat

SEQ ID NO: 556938 - DNA, 20 bp, Artificial
  CRISPR gRNA sequence
ccaaggaacatgcatcccca

SEQ ID NO: 556939 - DNA, 20 bp, Artificial
  CRISPR gRNA sequence
caaggaacatgcatccccag

SEQ ID NO: 556940 - DNA, 20 bp, Artificial
  CRISPR gRNA sequence
aaaaatgcctgttctcagta

SEQ ID NO: 556941 - DNA, 20 bp, Artificial
  CRISPR gRNA sequence
ttctcagtatttcatatact

SEQ ID NO: 556942 - DNA, 20 bp, Artificial
  CRISPR gRNA sequence
tcagtatttcatatacttat

SEQ ID NO: 556943 - DNA, 20 bp, Artificial
  CRISPR gRNA sequence
agtatttcatatacttatgc

SEQ ID NO: 556944 - DNA, 20 bp, Artificial
  CRISPR gRNA sequence
catatacttatgcctgcctc

SEQ ID NO: 556945 - DNA, 20 bp, Artificial
  CRISPR gRNA sequence
atatacttatgcctgcctct

SEQ ID NO: 556946 - DNA, 20 bp, Artificial
  CRISPR gRNA sequence
atgcctgcctctgtaactag

SEQ ID NO: 556947 - DNA, 20 bp, Artificial
  CRISPR gRNA sequence
tgcctgcctctgtaactagg

SEQ ID NO: 556948 - DNA, 20 bp, Artificial
  CRISPR gRNA sequence
cctctgtaactaggctgggc

SEQ ID NO: 556949 - DNA, 20 bp, Artificial
  CRISPR gRNA sequence
tgtaactaggctgggcattt

SEQ ID NO: 556950 - DNA, 20 bp, Artificial
  CRISPR gRNA sequence
taactaggctgggcatttct

SEQ ID NO: 556951 - DNA, 20 bp, Artificial
  CRISPR gRNA sequence
ggctgggcatttctcagggg

SEQ ID NO: 556952 - DNA, 20 bp, Artificial
  CRISPR gRNA sequence
ggcatttctcaggggcagaa

SEQ ID NO: 556953 - DNA, 20 bp, Artificial
  CRISPR gRNA sequence
ctcaggggcagaaaaccaag

SEQ ID NO: 556954 - DNA, 20 bp, Artificial
  CRISPR gRNA sequence
tcaggggcagaaaaccaagc

SEQ ID NO: 556955 - DNA, 20 bp, Artificial
  CRISPR gRNA sequence
aggggcagaaaaccaagctt

SEQ ID NO: 556956 - DNA, 20 bp, Artificial
  CRISPR gRNA sequence
tctacctccttagaaatggt

SEQ ID NO: 556957 - DNA, 20 bp, Artificial
  CRISPR gRNA sequence
ctacctccttagaaatggtc

SEQ ID NO: 556958 - DNA, 20 bp, Artificial
  CRISPR gRNA sequence
tacctccttagaaatggtcc

SEQ ID NO: 556959 - DNA, 20 bp, Artificial
  CRISPR gRNA sequence
cctccttagaaatggtcctt

SEQ ID NO: 556960 - DNA, 20 bp, Artificial
  CRISPR gRNA sequence
cttagaaatggtcctttgaa

SEQ ID NO: 556961 - DNA, 20 bp, Artificial
  CRISPR gRNA sequence
agaaatggtcctttgaagca

SEQ ID NO: 556962 - DNA, 20 bp, Artificial
  CRISPR gRNA sequence
gaaatggtcctttgaagcat

SEQ ID NO: 556963 - DNA, 20 bp, Artificial
  CRISPR gRNA sequence
tgaagcatttctcaaatttt

SEQ ID NO: 556964 - DNA, 20 bp, Artificial
  CRISPR gRNA sequence
gaagcatttctcaaatttta

SEQ ID NO: 556965 - DNA, 20 bp, Artificial
  CRISPR gRNA sequence
aagcatttctcaaattttaa

SEQ ID NO: 556966 - DNA, 20 bp, Artificial
  CRISPR gRNA sequence
ctcaaattttaaggtgccta

SEQ ID NO: 556967 - DNA, 20 bp, Artificial
  CRISPR gRNA sequence
tcaaattttaaggtgcctaa

SEQ ID NO: 556968 - DNA, 20 bp, Artificial
  CRISPR gRNA sequence
aaattttaaggtgcctaaga

SEQ ID NO: 556969 - DNA, 20 bp, Artificial
  CRISPR gRNA sequence
taaggtgcctaagaatcacc

SEQ ID NO: 556970 - DNA, 20 bp, Artificial
  CRISPR gRNA sequence
aaggtgcctaagaatcacca

SEQ ID NO: 556971 - DNA, 20 bp, Artificial
  CRISPR gRNA sequence
aggtgcctaagaatcaccaa

SEQ ID NO: 556972 - DNA, 20 bp, Artificial
  CRISPR gRNA sequence
agaatcaccaagggtgcttg

SEQ ID NO: 556973 - DNA, 20 bp, Artificial
  CRISPR gRNA sequence
gttaaaaatacagattcctg

SEQ ID NO: 556974 - DNA, 20 bp, Artificial
  CRISPR gRNA sequence
ttaaaaatacagattcctga

SEQ ID NO: 556975 - DNA, 20 bp, Artificial
  CRISPR gRNA sequence
aaaatacagattcctgagcc

SEQ ID NO: 556976 - DNA, 20 bp, Artificial
  CRISPR gRNA sequence
ctgagccccaccatcccagg

SEQ ID NO: 556977 - DNA, 20 bp, Artificial
  CRISPR gRNA sequence
agccccaccatcccaggtgc

SEQ ID NO: 556978 - DNA, 20 bp, Artificial
  CRISPR gRNA sequence
ctgatgtatgtggcctgttt

SEQ ID NO: 556979 - DNA, 20 bp, Artificial
  CRISPR gRNA sequence
tgatgtatgtggcctgtttg

SEQ ID NO: 556980 - DNA, 20 bp, Artificial
  CRISPR gRNA sequence
atgtatgtggcctgtttgtt

SEQ ID NO: 556981 - DNA, 20 bp, Artificial
  CRISPR gRNA sequence
tttgttctgttgcagattct

SEQ ID NO: 556982 - DNA, 20 bp, Artificial
  CRISPR gRNA sequence
gttctgttgcagattctaat

SEQ ID NO: 556983 - DNA, 20 bp, Artificial
  CRISPR gRNA sequence
ttctgttgcagattctaatg

SEQ ID NO: 556984 - DNA, 20 bp, Artificial
  CRISPR gRNA sequence
tgttgcagattctaatgtat

SEQ ID NO: 556985 - DNA, 20 bp, Artificial
  CRISPR gRNA sequence
ttgcagattctaatgtattg

SEQ ID NO: 556986 - DNA, 20 bp, Artificial
  CRISPR gRNA sequence
cagattctaatgtattgatc

SEQ ID NO: 556987 - DNA, 20 bp, Artificial
  CRISPR gRNA sequence
taatgtattgatctagctct

SEQ ID NO: 556988 - DNA, 20 bp, Artificial
  CRISPR gRNA sequence
atgtattgatctagctctgc

SEQ ID NO: 556989 - DNA, 20 bp, Artificial
  CRISPR gRNA sequence
atctagctctgccaatgtct

SEQ ID NO: 556990 - DNA, 20 bp, Artificial
  CRISPR gRNA sequence
gctctgccaatgtctagtct

SEQ ID NO: 556991 - DNA, 20 bp, Artificial
  CRISPR gRNA sequence
tgccaatgtctagtctttca

SEQ ID NO: 556992 - DNA, 20 bp, Artificial
  CRISPR gRNA sequence
ccaatgtctagtctttcatc

SEQ ID NO: 556993 - DNA, 20 bp, Artificial
  CRISPR gRNA sequence
gtctttcatccagcactttc

SEQ ID NO: 556994 - DNA, 20 bp, Artificial
  CRISPR gRNA sequence
tcatccagcactttctgaac

SEQ ID NO: 556995 - DNA, 20 bp, Artificial
  CRISPR gRNA sequence
catccagcactttctgaact

SEQ ID NO: 556996 - DNA, 20 bp, Artificial
  CRISPR gRNA sequence
atccagcactttctgaactg

SEQ ID NO: 556997 - DNA, 20 bp, Artificial
  CRISPR gRNA sequence
tctgaactgaacagaggtgc

SEQ ID NO: 556998 - DNA, 20 bp, Artificial
  CRISPR gRNA sequence
ctgaactgaacagaggtgca

SEQ ID NO: 556999 - DNA, 20 bp, Artificial
  CRISPR gRNA sequence
tgaactgaacagaggtgcat

SEQ ID NO: 557000 - DNA, 20 bp, Artificial
  CRISPR gRNA sequence
aactgaacagaggtgcatca

SEQ ID NO: 557001 - DNA, 20 bp, Artificial
  CRISPR gRNA sequence
aacagaggtgcatcatcagc

SEQ ID NO: 557002 - DNA, 20 bp, Artificial
  CRISPR gRNA sequence
tgtatctttggagggcaaag

SEQ ID NO: 557003 - DNA, 20 bp, Artificial
  CRISPR gRNA sequence
tggagggcaaagactaggta

SEQ ID NO: 557004 - DNA, 20 bp, Artificial
  CRISPR gRNA sequence
ggagggcaaagactaggtat

SEQ ID NO: 557005 - DNA, 20 bp, Artificial
  CRISPR gRNA sequence
gagggcaaagactaggtatg

SEQ ID NO: 557006 - DNA, 20 bp, Artificial
  CRISPR gRNA sequence
ggtatgactcacctttcaac

SEQ ID NO: 557007 - DNA, 20 bp, Artificial
  CRISPR gRNA sequence
acctttcaaccacagcacat

SEQ ID NO: 557008 - DNA, 20 bp, Artificial
  CRISPR gRNA sequence
tcaaccacagcacatgacat

SEQ ID NO: 557009 - DNA, 20 bp, Artificial
  CRISPR gRNA sequence
caaccacagcacatgacata

SEQ ID NO: 557010 - DNA, 20 bp, Artificial
  CRISPR gRNA sequence
aaccacagcacatgacataa

SEQ ID NO: 557011 - DNA, 20 bp, Artificial
  CRISPR gRNA sequence
ctcacaagcagtacaggaca

SEQ ID NO: 557012 - DNA, 20 bp, Artificial
  CRISPR gRNA sequence
acaagcagtacaggacagat

SEQ ID NO: 557013 - DNA, 20 bp, Artificial
  CRISPR gRNA sequence
agagagacagtcttcaaata

SEQ ID NO: 557014 - DNA, 20 bp, Artificial
  CRISPR gRNA sequence
caaataaaatgtaaattctt

SEQ ID NO: 557015 - DNA, 20 bp, Artificial
  CRISPR gRNA sequence
aaataaaatgtaaattcttc

SEQ ID NO: 557016 - DNA, 20 bp, Artificial
  CRISPR gRNA sequence
ttctacccgctatctccaaa

SEQ ID NO: 557017 - DNA, 20 bp, Artificial
  CRISPR gRNA sequence
ctacccgctatctccaaaga

SEQ ID NO: 557018 - DNA, 20 bp, Artificial
  CRISPR gRNA sequence
tacccgctatctccaaagag

SEQ ID NO: 557019 - DNA, 20 bp, Artificial
  CRISPR gRNA sequence
cccgctatctccaaagaggt

SEQ ID NO: 557020 - DNA, 20 bp, Artificial
  CRISPR gRNA sequence
tctccaaagaggtacagtat

SEQ ID NO: 557021 - DNA, 20 bp, Artificial
  CRISPR gRNA sequence
caaagaggtacagtatggtg

SEQ ID NO: 557022 - DNA, 20 bp, Artificial
  CRISPR gRNA sequence
agcatggactcagaagccca

SEQ ID NO: 557023 - DNA, 20 bp, Artificial
  CRISPR gRNA sequence
gcatggactcagaagcccag

SEQ ID NO: 557024 - DNA, 20 bp, Artificial
  CRISPR gRNA sequence
agaagcccagctgcctgagt

SEQ ID NO: 557025 - DNA, 20 bp, Artificial
  CRISPR gRNA sequence
cctgagtgcatatcccagct

SEQ ID NO: 557026 - DNA, 20 bp, Artificial
  CRISPR gRNA sequence
agtgcatatcccagcttcat

SEQ ID NO: 557027 - DNA, 20 bp, Artificial
  CRISPR gRNA sequence
catgactaagagccatttga

SEQ ID NO: 557028 - DNA, 20 bp, Artificial
  CRISPR gRNA sequence
atgactaagagccatttgac

SEQ ID NO: 557029 - DNA, 20 bp, Artificial
  CRISPR gRNA sequence
agagccatttgacattgggc

SEQ ID NO: 557030 - DNA, 20 bp, Artificial
  CRISPR gRNA sequence
gacattgggcaagttactta

SEQ ID NO: 557031 - DNA, 20 bp, Artificial
  CRISPR gRNA sequence
acattgggcaagttacttaa

SEQ ID NO: 557032 - DNA, 20 bp, Artificial
  CRISPR gRNA sequence
ggcaagttacttaaatcacc

SEQ ID NO: 557033 - DNA, 20 bp, Artificial
  CRISPR gRNA sequence
cttaaatcaccttgtgtcta

SEQ ID NO: 557034 - DNA, 20 bp, Artificial
  CRISPR gRNA sequence
aaatcaccttgtgtctaggt

SEQ ID NO: 557035 - DNA, 20 bp, Artificial
  CRISPR gRNA sequence
aatcaccttgtgtctaggtt

SEQ ID NO: 557036 - DNA, 20 bp, Artificial
  CRISPR gRNA sequence
gtgtctaggtttcctcctct

SEQ ID NO: 557037 - DNA, 20 bp, Artificial
  CRISPR gRNA sequence
tgtctaggtttcctcctctc

SEQ ID NO: 557038 - DNA, 20 bp, Artificial
  CRISPR gRNA sequence
ggtttcctcctctctacaat

SEQ ID NO: 557039 - DNA, 20 bp, Artificial
  CRISPR gRNA sequence
cctcctctctacaataagga

SEQ ID NO: 557040 - DNA, 20 bp, Artificial
  CRISPR gRNA sequence
ctcctctctacaataaggac

SEQ ID NO: 557041 - DNA, 20 bp, Artificial
  CRISPR gRNA sequence
ctctctacaataaggacaca

SEQ ID NO: 557042 - DNA, 20 bp, Artificial
  CRISPR gRNA sequence
tctacaataaggacacaaat

SEQ ID NO: 557043 - DNA, 20 bp, Artificial
  CRISPR gRNA sequence
tacaataaggacacaaatag

SEQ ID NO: 557044 - DNA, 20 bp, Artificial
  CRISPR gRNA sequence
caataaggacacaaatagta

SEQ ID NO: 557045 - DNA, 20 bp, Artificial
  CRISPR gRNA sequence
actctatcagactgtaatga

SEQ ID NO: 557046 - DNA, 20 bp, Artificial
  CRISPR gRNA sequence
ctctatcagactgtaatgag

SEQ ID NO: 557047 - DNA, 20 bp, Artificial
  CRISPR gRNA sequence
tatcagactgtaatgagatt

SEQ ID NO: 557048 - DNA, 20 bp, Artificial
  CRISPR gRNA sequence
tcagactgtaatgagattaa

SEQ ID NO: 557049 - DNA, 20 bp, Artificial
  CRISPR gRNA sequence
taatgagattaaatgagtta

SEQ ID NO: 557050 - DNA, 20 bp, Artificial
  CRISPR gRNA sequence
aatgagttaacacagataat

SEQ ID NO: 557051 - DNA, 20 bp, Artificial
  CRISPR gRNA sequence
acacagataataatcaacat

SEQ ID NO: 557052 - DNA, 20 bp, Artificial
  CRISPR gRNA sequence
acatgtagtgcctgcacaga

SEQ ID NO: 557053 - DNA, 20 bp, Artificial
  CRISPR gRNA sequence
cacagagtaagtacttaaca

SEQ ID NO: 557054 - DNA, 20 bp, Artificial
  CRISPR gRNA sequence
aacaaatgctagctgtaata

SEQ ID NO: 557055 - DNA, 20 bp, Artificial
  CRISPR gRNA sequence
acaaatgctagctgtaatag

SEQ ID NO: 557056 - DNA, 20 bp, Artificial
  CRISPR gRNA sequence
gctgtaatagagcacacggc

SEQ ID NO: 557057 - DNA, 20 bp, Artificial
  CRISPR gRNA sequence
taatagagcacacggccatt

SEQ ID NO: 557058 - DNA, 20 bp, Artificial
  CRISPR gRNA sequence
gctgtgagtttccaactcca

SEQ ID NO: 557059 - DNA, 20 bp, Artificial
  CRISPR gRNA sequence
tgagtttccaactccaggaa

SEQ ID NO: 557060 - DNA, 20 bp, Artificial
  CRISPR gRNA sequence
ccaactccaggaagccgagg

SEQ ID NO: 557061 - DNA, 20 bp, Artificial
  CRISPR gRNA sequence
caactccaggaagccgaggc

SEQ ID NO: 557062 - DNA, 20 bp, Artificial
  CRISPR gRNA sequence
caggaagccgaggctccccg

SEQ ID NO: 557063 - DNA, 20 bp, Artificial
  CRISPR gRNA sequence
cccggagggtatgtgatatg

SEQ ID NO: 557064 - DNA, 20 bp, Artificial
  CRISPR gRNA sequence
agtaggagttgggaggtttg

SEQ ID NO: 557065 - DNA, 20 bp, Artificial
  CRISPR gRNA sequence
ggaggtttgatcaagcctta

SEQ ID NO: 557066 - DNA, 20 bp, Artificial
  CRISPR gRNA sequence
gatcaagccttagccttggc

SEQ ID NO: 557067 - DNA, 20 bp, Artificial
  CRISPR gRNA sequence
atcaagccttagccttggcc

SEQ ID NO: 557068 - DNA, 20 bp, Artificial
  CRISPR gRNA sequence
agccttggcctgctgtgtga

SEQ ID NO: 557069 - DNA, 20 bp, Artificial
  CRISPR gRNA sequence
gccttggcctgctgtgtgac

SEQ ID NO: 557070 - DNA, 20 bp, Artificial
  CRISPR gRNA sequence
ggcctgctgtgtgacctggg

SEQ ID NO: 557071 - DNA, 20 bp, Artificial
  CRISPR gRNA sequence
gcctgctgtgtgacctgggg

SEQ ID NO: 557072 - DNA, 20 bp, Artificial
  CRISPR gRNA sequence
ctgtgtgacctggggccaca

SEQ ID NO: 557073 - DNA, 20 bp, Artificial
  CRISPR gRNA sequence
tgtgacctggggccacagtc

SEQ ID NO: 557074 - DNA, 20 bp, Artificial
  CRISPR gRNA sequence
gggccacagtccttttagga

SEQ ID NO: 557075 - DNA, 20 bp, Artificial
  CRISPR gRNA sequence
ttaggagctggaagagtttt

SEQ ID NO: 557076 - DNA, 20 bp, Artificial
  CRISPR gRNA sequence
taggagctggaagagtttta

SEQ ID NO: 557077 - DNA, 20 bp, Artificial
  CRISPR gRNA sequence
aggagctggaagagttttaa

SEQ ID NO: 557078 - DNA, 20 bp, Artificial
  CRISPR gRNA sequence
ggagctggaagagttttaag

SEQ ID NO: 557079 - DNA, 20 bp, Artificial
  CRISPR gRNA sequence
gaagagttttaagaaagcat

SEQ ID NO: 557080 - DNA, 20 bp, Artificial
  CRISPR gRNA sequence
taagaaagcatccatccagg

SEQ ID NO: 557081 - DNA, 20 bp, Artificial
  CRISPR gRNA sequence
aagaaagcatccatccaggt

SEQ ID NO: 557082 - DNA, 20 bp, Artificial
  CRISPR gRNA sequence
agaaagcatccatccaggtc

SEQ ID NO: 557083 - DNA, 20 bp, Artificial
  CRISPR gRNA sequence
ttgttctacttacagagaaa

SEQ ID NO: 557084 - DNA, 20 bp, Artificial
  CRISPR gRNA sequence
gttctacttacagagaaacg

SEQ ID NO: 557085 - DNA, 20 bp, Artificial
  CRISPR gRNA sequence
ttctacttacagagaaacgg

SEQ ID NO: 557086 - DNA, 20 bp, Artificial
  CRISPR gRNA sequence
tacttacagagaaacggact

SEQ ID NO: 557087 - DNA, 20 bp, Artificial
  CRISPR gRNA sequence
cttacagagaaacggactcc

SEQ ID NO: 557088 - DNA, 20 bp, Artificial
  CRISPR gRNA sequence
acagagaaacggactcctaa

SEQ ID NO: 557089 - DNA, 20 bp, Artificial
  CRISPR gRNA sequence
cagagaaacggactcctaaa

SEQ ID NO: 557090 - DNA, 20 bp, Artificial
  CRISPR gRNA sequence
ctaaactgtcttattttcat

SEQ ID NO: 557091 - DNA, 20 bp, Artificial
  CRISPR gRNA sequence
aactgtcttattttcatctg

SEQ ID NO: 557092 - DNA, 20 bp, Artificial
  CRISPR gRNA sequence
tcttattttcatctgtgaaa

SEQ ID NO: 557093 - DNA, 20 bp, Artificial
  CRISPR gRNA sequence
attttcatctgtgaaaggga

SEQ ID NO: 557094 - DNA, 20 bp, Artificial
  CRISPR gRNA sequence
ttttcatctgtgaaagggaa

SEQ ID NO: 557095 - DNA, 20 bp, Artificial
  CRISPR gRNA sequence
tcatctgtgaaagggaatgc

SEQ ID NO: 557096 - DNA, 20 bp, Artificial
  CRISPR gRNA sequence
catctgtgaaagggaatgct

SEQ ID NO: 557097 - DNA, 20 bp, Artificial
  CRISPR gRNA sequence
atctgtgaaagggaatgctg

SEQ ID NO: 557098 - DNA, 20 bp, Artificial
  CRISPR gRNA sequence
tgaaagggaatgctgtatca

SEQ ID NO: 557099 - DNA, 20 bp, Artificial
  CRISPR gRNA sequence
tatcaggtcactgtaaaggt

SEQ ID NO: 557100 - DNA, 20 bp, Artificial
  CRISPR gRNA sequence
taaaggtcaaacagaatatg

SEQ ID NO: 557101 - DNA, 20 bp, Artificial
  CRISPR gRNA sequence
agtgccacatgcagggtttg

SEQ ID NO: 557102 - DNA, 20 bp, Artificial
  CRISPR gRNA sequence
gtaaaaaagaaaagaaaaga

SEQ ID NO: 557103 - DNA, 20 bp, Artificial
  CRISPR gRNA sequence
taaaaaagaaaagaaaagaa

SEQ ID NO: 557104 - DNA, 20 bp, Artificial
  CRISPR gRNA sequence
caggggaaacatgaagaagt

SEQ ID NO: 557105 - DNA, 20 bp, Artificial
  CRISPR gRNA sequence
aggggaaacatgaagaagtg

SEQ ID NO: 557106 - DNA, 20 bp, Artificial
  CRISPR gRNA sequence
gtattatcttctaagttgct

SEQ ID NO: 557107 - DNA, 20 bp, Artificial
  CRISPR gRNA sequence
tcttctaagttgctagaact

SEQ ID NO: 557108 - DNA, 20 bp, Artificial
  CRISPR gRNA sequence
ctaagttgctagaactccct

SEQ ID NO: 557109 - DNA, 20 bp, Artificial
  CRISPR gRNA sequence
taagttgctagaactccctt

SEQ ID NO: 557110 - DNA, 20 bp, Artificial
  CRISPR gRNA sequence
agttgctagaactcccttga

SEQ ID NO: 557111 - DNA, 20 bp, Artificial
  CRISPR gRNA sequence
ctagaactcccttgactagg

SEQ ID NO: 557112 - DNA, 20 bp, Artificial
  CRISPR gRNA sequence
gaactcccttgactaggtag

SEQ ID NO: 557113 - DNA, 20 bp, Artificial
  CRISPR gRNA sequence
ccttgactaggtagaagctc

SEQ ID NO: 557114 - DNA, 20 bp, Artificial
  CRISPR gRNA sequence
gactaggtagaagctctttc

SEQ ID NO: 557115 - DNA, 20 bp, Artificial
  CRISPR gRNA sequence
actaggtagaagctctttct

SEQ ID NO: 557116 - DNA, 20 bp, Artificial
  CRISPR gRNA sequence
ggtagaagctctttctggct

SEQ ID NO: 557117 - DNA, 20 bp, Artificial
  CRISPR gRNA sequence
tttctggctatctcattaca

SEQ ID NO: 557118 - DNA, 20 bp, Artificial
  CRISPR gRNA sequence
tctggctatctcattacaca

SEQ ID NO: 557119 - DNA, 20 bp, Artificial
  CRISPR gRNA sequence
ctggctatctcattacacaa

SEQ ID NO: 557120 - DNA, 20 bp, Artificial
  CRISPR gRNA sequence
tggctatctcattacacaac

SEQ ID NO: 557121 - DNA, 20 bp, Artificial
  CRISPR gRNA sequence
gctatctcattacacaacag

SEQ ID NO: 557122 - DNA, 20 bp, Artificial
  CRISPR gRNA sequence
tctcattacacaacagttgc

SEQ ID NO: 557123 - DNA, 20 bp, Artificial
  CRISPR gRNA sequence
attacacaacagttgccaga

SEQ ID NO: 557124 - DNA, 20 bp, Artificial
  CRISPR gRNA sequence
cacaacagttgccagatggc

SEQ ID NO: 557125 - DNA, 20 bp, Artificial
  CRISPR gRNA sequence
ccagatggcaaaggtagaag

SEQ ID NO: 557126 - DNA, 20 bp, Artificial
  CRISPR gRNA sequence
tccaactcatctaaaagtgt

SEQ ID NO: 557127 - DNA, 20 bp, Artificial
  CRISPR gRNA sequence
atctaaaagtgtgcaagcct

SEQ ID NO: 557128 - DNA, 20 bp, Artificial
  CRISPR gRNA sequence
aaagtgtgcaagcctttctg

SEQ ID NO: 557129 - DNA, 20 bp, Artificial
  CRISPR gRNA sequence
tctgcagcacctagatcaca

SEQ ID NO: 557130 - DNA, 20 bp, Artificial
  CRISPR gRNA sequence
ctgcagcacctagatcacag

SEQ ID NO: 557131 - DNA, 20 bp, Artificial
  CRISPR gRNA sequence
tgcagcacctagatcacagt

SEQ ID NO: 557132 - DNA, 20 bp, Artificial
  CRISPR gRNA sequence
cagcacctagatcacagttt

SEQ ID NO: 557133 - DNA, 20 bp, Artificial
  CRISPR gRNA sequence
gatcacagtttctacacctc

SEQ ID NO: 557134 - DNA, 20 bp, Artificial
  CRISPR gRNA sequence
ctacacctcagatcttttcc

SEQ ID NO: 557135 - DNA, 20 bp, Artificial
  CRISPR gRNA sequence
tacacctcagatcttttcct

SEQ ID NO: 557136 - DNA, 20 bp, Artificial
  CRISPR gRNA sequence
cacctcagatcttttccttc

SEQ ID NO: 557137 - DNA, 20 bp, Artificial
  CRISPR gRNA sequence
agatcttttccttctataaa

SEQ ID NO: 557138 - DNA, 20 bp, Artificial
  CRISPR gRNA sequence
ttccttctataaatctttca

SEQ ID NO: 557139 - DNA, 20 bp, Artificial
  CRISPR gRNA sequence
tccttctataaatctttcat

SEQ ID NO: 557140 - DNA, 20 bp, Artificial
  CRISPR gRNA sequence
ccttctataaatctttcata

SEQ ID NO: 557141 - DNA, 20 bp, Artificial
  CRISPR gRNA sequence
cttctataaatctttcatat

SEQ ID NO: 557142 - DNA, 20 bp, Artificial
  CRISPR gRNA sequence
ctataaatctttcatatttt

SEQ ID NO: 557143 - DNA, 20 bp, Artificial
  CRISPR gRNA sequence
tataaatctttcatattttc

SEQ ID NO: 557144 - DNA, 20 bp, Artificial
  CRISPR gRNA sequence
taaatctttcatattttctt

SEQ ID NO: 557145 - DNA, 20 bp, Artificial
  CRISPR gRNA sequence
tcatattttcttgctgcccg

SEQ ID NO: 557146 - DNA, 20 bp, Artificial
  CRISPR gRNA sequence
catattttcttgctgcccgt

SEQ ID NO: 557147 - DNA, 20 bp, Artificial
  CRISPR gRNA sequence
atattttcttgctgcccgtg

SEQ ID NO: 557148 - DNA, 20 bp, Artificial
  CRISPR gRNA sequence
tcttgctgcccgtgggactt

SEQ ID NO: 557149 - DNA, 20 bp, Artificial
  CRISPR gRNA sequence
cttgctgcccgtgggactta

SEQ ID NO: 557150 - DNA, 20 bp, Artificial
  CRISPR gRNA sequence
ttgctgcccgtgggacttac

SEQ ID NO: 557151 - DNA, 20 bp, Artificial
  CRISPR gRNA sequence
gctgcccgtgggacttacca

SEQ ID NO: 557152 - DNA, 20 bp, Artificial
  CRISPR gRNA sequence
ctgcccgtgggacttaccac

SEQ ID NO: 557153 - DNA, 20 bp, Artificial
  CRISPR gRNA sequence
cccgtgggacttaccacagc

SEQ ID NO: 557154 - DNA, 20 bp, Artificial
  CRISPR gRNA sequence
accacagctgtatctaacaa

SEQ ID NO: 557155 - DNA, 20 bp, Artificial
  CRISPR gRNA sequence
ccacagctgtatctaacaaa

SEQ ID NO: 557156 - DNA, 20 bp, Artificial
  CRISPR gRNA sequence
tatctaacaaatattcgtta

SEQ ID NO: 557157 - DNA, 20 bp, Artificial
  CRISPR gRNA sequence
acaaatattcgttatacctc

SEQ ID NO: 557158 - DNA, 20 bp, Artificial
  CRISPR gRNA sequence
gttatacctctactttaagc

SEQ ID NO: 557159 - DNA, 20 bp, Artificial
  CRISPR gRNA sequence
tacctctactttaagcagca

SEQ ID NO: 557160 - DNA, 20 bp, Artificial
  CRISPR gRNA sequence
tactttaagcagcattaaac

SEQ ID NO: 557161 - DNA, 20 bp, Artificial
  CRISPR gRNA sequence
ctttaagcagcattaaactg

SEQ ID NO: 557162 - DNA, 20 bp, Artificial
  CRISPR gRNA sequence
taagcagcattaaactggca

SEQ ID NO: 557163 - DNA, 20 bp, Artificial
  CRISPR gRNA sequence
aagcagcattaaactggcaa

SEQ ID NO: 557164 - DNA, 20 bp, Artificial
  CRISPR gRNA sequence
agcagcattaaactggcaag

SEQ ID NO: 557165 - DNA, 20 bp, Artificial
  CRISPR gRNA sequence
aactggcaagaaatgtgcct

SEQ ID NO: 557166 - DNA, 20 bp, Artificial
  CRISPR gRNA sequence
gcaagaaatgtgcctacttc

SEQ ID NO: 557167 - DNA, 20 bp, Artificial
  CRISPR gRNA sequence
cttcctccctaagacaatta

SEQ ID NO: 557168 - DNA, 20 bp, Artificial
  CRISPR gRNA sequence
cctccctaagacaattagtc

SEQ ID NO: 557169 - DNA, 20 bp, Artificial
  CRISPR gRNA sequence
ctccctaagacaattagtca

SEQ ID NO: 557170 - DNA, 20 bp, Artificial
  CRISPR gRNA sequence
cctaagacaattagtcaatt

SEQ ID NO: 557171 - DNA, 20 bp, Artificial
  CRISPR gRNA sequence
agacaattagtcaatttata

SEQ ID NO: 557172 - DNA, 20 bp, Artificial
  CRISPR gRNA sequence
gtcaatttataattaatgaa

SEQ ID NO: 557173 - DNA, 20 bp, Artificial
  CRISPR gRNA sequence
ataattaatgaattgagttc

SEQ ID NO: 557174 - DNA, 20 bp, Artificial
  CRISPR gRNA sequence
taattaatgaattgagttca

SEQ ID NO: 557175 - DNA, 20 bp, Artificial
  CRISPR gRNA sequence
atgaattgagttcactgctg

SEQ ID NO: 557176 - DNA, 20 bp, Artificial
  CRISPR gRNA sequence
agttcactgctgtgtaaaaa

SEQ ID NO: 557177 - DNA, 20 bp, Artificial
  CRISPR gRNA sequence
actgctgtgtaaaaaatgag

SEQ ID NO: 557178 - DNA, 20 bp, Artificial
  CRISPR gRNA sequence
ctgtgtaaaaaatgagaatt

SEQ ID NO: 557179 - DNA, 20 bp, Artificial
  CRISPR gRNA sequence
tgtaaaaaatgagaatttct

SEQ ID NO: 557180 - DNA, 20 bp, Artificial
  CRISPR gRNA sequence
cttacacatatctgatgaca

SEQ ID NO: 557181 - DNA, 20 bp, Artificial
  CRISPR gRNA sequence
ttacacatatctgatgacat

SEQ ID NO: 557182 - DNA, 20 bp, Artificial
  CRISPR gRNA sequence
acacatatctgatgacattt

SEQ ID NO: 557183 - DNA, 20 bp, Artificial
  CRISPR gRNA sequence
cacatatctgatgacatttt

SEQ ID NO: 557184 - DNA, 20 bp, Artificial
  CRISPR gRNA sequence
atgacattttatagaaatat

SEQ ID NO: 557185 - DNA, 20 bp, Artificial
  CRISPR gRNA sequence
tatagaaatatgtgtatatt

SEQ ID NO: 557186 - DNA, 20 bp, Artificial
  CRISPR gRNA sequence
atagaaatatgtgtatattt

SEQ ID NO: 557187 - DNA, 20 bp, Artificial
  CRISPR gRNA sequence
tagaaatatgtgtatatttt

SEQ ID NO: 557188 - DNA, 20 bp, Artificial
  CRISPR gRNA sequence
tcacgaattttagtaaaggt

SEQ ID NO: 557189 - DNA, 20 bp, Artificial
  CRISPR gRNA sequence
cacgaattttagtaaaggtc

SEQ ID NO: 557190 - DNA, 20 bp, Artificial
  CRISPR gRNA sequence
acgaattttagtaaaggtca

SEQ ID NO: 557191 - DNA, 20 bp, Artificial
  CRISPR gRNA sequence
tagtaaaggtcaagtatcaa

SEQ ID NO: 557192 - DNA, 20 bp, Artificial
  CRISPR gRNA sequence
agtaaaggtcaagtatcaat

SEQ ID NO: 557193 - DNA, 20 bp, Artificial
  CRISPR gRNA sequence
gtaaaggtcaagtatcaatc

SEQ ID NO: 557194 - DNA, 20 bp, Artificial
  CRISPR gRNA sequence
aggacagggcagttaattct

SEQ ID NO: 557195 - DNA, 20 bp, Artificial
  CRISPR gRNA sequence
attctacttacataaaaatc

SEQ ID NO: 557196 - DNA, 20 bp, Artificial
  CRISPR gRNA sequence
tacttacataaaaatcatca

SEQ ID NO: 557197 - DNA, 20 bp, Artificial
  CRISPR gRNA sequence
cttacataaaaatcatcatc

SEQ ID NO: 557198 - DNA, 20 bp, Artificial
  CRISPR gRNA sequence
acataaaaatcatcatctga

SEQ ID NO: 557199 - DNA, 20 bp, Artificial
  CRISPR gRNA sequence
cataaaaatcatcatctgag

SEQ ID NO: 557200 - DNA, 20 bp, Artificial
  CRISPR gRNA sequence
agatgtgatgaaggtccata

SEQ ID NO: 557201 - DNA, 20 bp, Artificial
  CRISPR gRNA sequence
ataaacctcagaagtagaaa

SEQ ID NO: 557202 - DNA, 20 bp, Artificial
  CRISPR gRNA sequence
agaagtagaaattttaaggg

SEQ ID NO: 557203 - DNA, 20 bp, Artificial
  CRISPR gRNA sequence
taaggggacttttgggtatg

SEQ ID NO: 557204 - DNA, 20 bp, Artificial
  CRISPR gRNA sequence
aaggggacttttgggtatgg

SEQ ID NO: 557205 - DNA, 20 bp, Artificial
  CRISPR gRNA sequence
aggggacttttgggtatgga

SEQ ID NO: 557206 - DNA, 20 bp, Artificial
  CRISPR gRNA sequence
ttgggtatggaggaaagcca

SEQ ID NO: 557207 - DNA, 20 bp, Artificial
  CRISPR gRNA sequence
tgggtatggaggaaagccag

SEQ ID NO: 557208 - DNA, 20 bp, Artificial
  CRISPR gRNA sequence
gggtatggaggaaagccaga

SEQ ID NO: 557209 - DNA, 20 bp, Artificial
  CRISPR gRNA sequence
ggtatggaggaaagccagat

SEQ ID NO: 557210 - DNA, 20 bp, Artificial
  CRISPR gRNA sequence
aatgtacacacagaaggaag

SEQ ID NO: 557211 - DNA, 20 bp, Artificial
  CRISPR gRNA sequence
aatttaggaagtgccaggaa

SEQ ID NO: 557212 - DNA, 20 bp, Artificial
  CRISPR gRNA sequence
aggaagtgccaggaaatccc

SEQ ID NO: 557213 - DNA, 20 bp, Artificial
  CRISPR gRNA sequence
ggaagtgccaggaaatcccc

SEQ ID NO: 557214 - DNA, 20 bp, Artificial
  CRISPR gRNA sequence
tccaaaatatgctcactgga

SEQ ID NO: 557215 - DNA, 20 bp, Artificial
  CRISPR gRNA sequence
actggaagtctcctattagg

SEQ ID NO: 557216 - DNA, 20 bp, Artificial
  CRISPR gRNA sequence
gaagtctcctattaggtctg

SEQ ID NO: 557217 - DNA, 20 bp, Artificial
  CRISPR gRNA sequence
ctattaggtctggtgtctct

SEQ ID NO: 557218 - DNA, 20 bp, Artificial
  CRISPR gRNA sequence
ttaggtctggtgtctctaga

SEQ ID NO: 557219 - DNA, 20 bp, Artificial
  CRISPR gRNA sequence
ggtctggtgtctctagaaga

SEQ ID NO: 557220 - DNA, 20 bp, Artificial
  CRISPR gRNA sequence
gtgtctctagaagattacca

SEQ ID NO: 557221 - DNA, 20 bp, Artificial
  CRISPR gRNA sequence
tagaagattaccaggttact

SEQ ID NO: 557222 - DNA, 20 bp, Artificial
  CRISPR gRNA sequence
gaagattaccaggttactaa

SEQ ID NO: 557223 - DNA, 20 bp, Artificial
  CRISPR gRNA sequence
ccaggttactaaaacaagtg

SEQ ID NO: 557224 - DNA, 20 bp, Artificial
  CRISPR gRNA sequence
ctaaaacaagtgttaacatt

SEQ ID NO: 557225 - DNA, 20 bp, Artificial
  CRISPR gRNA sequence
aaacaagtgttaacattacc

SEQ ID NO: 557226 - DNA, 20 bp, Artificial
  CRISPR gRNA sequence
acattacctcaaggaagtat

SEQ ID NO: 557227 - DNA, 20 bp, Artificial
  CRISPR gRNA sequence
cctcaaggaagtatgacttc

SEQ ID NO: 557228 - DNA, 20 bp, Artificial
  CRISPR gRNA sequence
aaggaagtatgacttcctct

SEQ ID NO: 557229 - DNA, 20 bp, Artificial
  CRISPR gRNA sequence
cctcttttcttaaaaaaaaa

SEQ ID NO: 557230 - DNA, 20 bp, Artificial
  CRISPR gRNA sequence
ctcttttcttaaaaaaaaaa

SEQ ID NO: 557231 - DNA, 20 bp, Artificial
  CRISPR gRNA sequence
ttttcttaaaaaaaaaaaaa

SEQ ID NO: 557232 - DNA, 20 bp, Artificial
  CRISPR gRNA sequence
ttcttaaaaaaaaaaaaaaa

SEQ ID NO: 557233 - DNA, 20 bp, Artificial
  CRISPR gRNA sequence
tcttaaaaaaaaaaaaaaat

SEQ ID NO: 557234 - DNA, 20 bp, Artificial
  CRISPR gRNA sequence
cttaaaaaaaaaaaaaaata

SEQ ID NO: 557235 - DNA, 20 bp, Artificial
  CRISPR gRNA sequence
ttaaaaaaaaaaaaaaatag

SEQ ID NO: 557236 - DNA, 20 bp, Artificial
  CRISPR gRNA sequence
aaaaaaaaaaaaaaatagta

SEQ ID NO: 557237 - DNA, 20 bp, Artificial
  CRISPR gRNA sequence
aaaaaaaaaaaaaatagtat

SEQ ID NO: 557238 - DNA, 20 bp, Artificial
  CRISPR gRNA sequence
tatcatgcagatgtgaaacc

SEQ ID NO: 557239 - DNA, 20 bp, Artificial
  CRISPR gRNA sequence
atcatgcagatgtgaaacct

SEQ ID NO: 557240 - DNA, 20 bp, Artificial
  CRISPR gRNA sequence
tcatgcagatgtgaaaccta

SEQ ID NO: 557241 - DNA, 20 bp, Artificial
  CRISPR gRNA sequence
gagtcatcttatgtcttttt

SEQ ID NO: 557242 - DNA, 20 bp, Artificial
  CRISPR gRNA sequence
atgtctttttacaaccaaaa

SEQ ID NO: 557243 - DNA, 20 bp, Artificial
  CRISPR gRNA sequence
tgtctttttacaaccaaaac

SEQ ID NO: 557244 - DNA, 20 bp, Artificial
  CRISPR gRNA sequence
tttacaaccaaaacctacat

SEQ ID NO: 557245 - DNA, 20 bp, Artificial
  CRISPR gRNA sequence
ttacaaccaaaacctacatc

SEQ ID NO: 557246 - DNA, 20 bp, Artificial
  CRISPR gRNA sequence
tacaaccaaaacctacatct

SEQ ID NO: 557247 - DNA, 20 bp, Artificial
  CRISPR gRNA sequence
acaaccaaaacctacatctt

SEQ ID NO: 557248 - DNA, 20 bp, Artificial
  CRISPR gRNA sequence
caaccaaaacctacatcttg

SEQ ID NO: 557249 - DNA, 20 bp, Artificial
  CRISPR gRNA sequence
catcttgcagactctttctt

SEQ ID NO: 557250 - DNA, 20 bp, Artificial
  CRISPR gRNA sequence
gcagactctttcttggaccc

SEQ ID NO: 557251 - DNA, 20 bp, Artificial
  CRISPR gRNA sequence
cagactctttcttggaccct

SEQ ID NO: 557252 - DNA, 20 bp, Artificial
  CRISPR gRNA sequence
tttcttggaccctctatcta

SEQ ID NO: 557253 - DNA, 20 bp, Artificial
  CRISPR gRNA sequence
tcttggaccctctatctacc

SEQ ID NO: 557254 - DNA, 20 bp, Artificial
  CRISPR gRNA sequence
cttggaccctctatctacct

SEQ ID NO: 557255 - DNA, 20 bp, Artificial
  CRISPR gRNA sequence
ttggaccctctatctacctg

SEQ ID NO: 557256 - DNA, 20 bp, Artificial
  CRISPR gRNA sequence
ggaccctctatctacctgga

SEQ ID NO: 557257 - DNA, 20 bp, Artificial
  CRISPR gRNA sequence
gaccctctatctacctggat

SEQ ID NO: 557258 - DNA, 20 bp, Artificial
  CRISPR gRNA sequence
tatctacctggatgatagta

SEQ ID NO: 557259 - DNA, 20 bp, Artificial
  CRISPR gRNA sequence
tctacctggatgatagtagc

SEQ ID NO: 557260 - DNA, 20 bp, Artificial
  CRISPR gRNA sequence
cctggatgatagtagcttct

SEQ ID NO: 557261 - DNA, 20 bp, Artificial
  CRISPR gRNA sequence
gatgatagtagcttctaact

SEQ ID NO: 557262 - DNA, 20 bp, Artificial
  CRISPR gRNA sequence
ctaacttgacatctcctctc

SEQ ID NO: 557263 - DNA, 20 bp, Artificial
  CRISPR gRNA sequence
taacttgacatctcctctct

SEQ ID NO: 557264 - DNA, 20 bp, Artificial
  CRISPR gRNA sequence
acttgacatctcctctcttt

SEQ ID NO: 557265 - DNA, 20 bp, Artificial
  CRISPR gRNA sequence
gacatctcctctctttaatc

SEQ ID NO: 557266 - DNA, 20 bp, Artificial
  CRISPR gRNA sequence
acatctcctctctttaatcc

SEQ ID NO: 557267 - DNA, 20 bp, Artificial
  CRISPR gRNA sequence
ctctctttaatccatcataa

SEQ ID NO: 557268 - DNA, 20 bp, Artificial
  CRISPR gRNA sequence
tctttaatccatcataagta

SEQ ID NO: 557269 - DNA, 20 bp, Artificial
  CRISPR gRNA sequence
tttaatccatcataagtatg

SEQ ID NO: 557270 - DNA, 20 bp, Artificial
  CRISPR gRNA sequence
taatccatcataagtatgca

SEQ ID NO: 557271 - DNA, 20 bp, Artificial
  CRISPR gRNA sequence
aatccatcataagtatgcac

SEQ ID NO: 557272 - DNA, 20 bp, Artificial
  CRISPR gRNA sequence
atccatcataagtatgcacc

SEQ ID NO: 557273 - DNA, 20 bp, Artificial
  CRISPR gRNA sequence
atcttccaaaaatgtatttt

SEQ ID NO: 557274 - DNA, 20 bp, Artificial
  CRISPR gRNA sequence
ccaaaaatgtattttatcaa

SEQ ID NO: 557275 - DNA, 20 bp, Artificial
  CRISPR gRNA sequence
caaaaatgtattttatcaag

SEQ ID NO: 557276 - DNA, 20 bp, Artificial
  CRISPR gRNA sequence
tatcaagtcacttccttgct

SEQ ID NO: 557277 - DNA, 20 bp, Artificial
  CRISPR gRNA sequence
atcaagtcacttccttgctc

SEQ ID NO: 557278 - DNA, 20 bp, Artificial
  CRISPR gRNA sequence
tcaagtcacttccttgctcc

SEQ ID NO: 557279 - DNA, 20 bp, Artificial
  CRISPR gRNA sequence
ccttgctccagtataggaca

SEQ ID NO: 557280 - DNA, 20 bp, Artificial
  CRISPR gRNA sequence
cttgctccagtataggacac

SEQ ID NO: 557281 - DNA, 20 bp, Artificial
  CRISPR gRNA sequence
gctccagtataggacacaat

SEQ ID NO: 557282 - DNA, 20 bp, Artificial
  CRISPR gRNA sequence
ctccagtataggacacaatg

SEQ ID NO: 557283 - DNA, 20 bp, Artificial
  CRISPR gRNA sequence
cagtataggacacaatggct

SEQ ID NO: 557284 - DNA, 20 bp, Artificial
  CRISPR gRNA sequence
cccactgctacaagctgatg

SEQ ID NO: 557285 - DNA, 20 bp, Artificial
  CRISPR gRNA sequence
ctacaagctgatgtccagac

SEQ ID NO: 557286 - DNA, 20 bp, Artificial
  CRISPR gRNA sequence
caagctgatgtccagactct

SEQ ID NO: 557287 - DNA, 20 bp, Artificial
  CRISPR gRNA sequence
atgtccagactctcaaacca

SEQ ID NO: 557288 - DNA, 20 bp, Artificial
  CRISPR gRNA sequence
tcaaaccaggactttaagtc

SEQ ID NO: 557289 - DNA, 20 bp, Artificial
  CRISPR gRNA sequence
aaaccaggactttaagtccc

SEQ ID NO: 557290 - DNA, 20 bp, Artificial
  CRISPR gRNA sequence
taagtcccacactcaatact

SEQ ID NO: 557291 - DNA, 20 bp, Artificial
  CRISPR gRNA sequence
aagtcccacactcaatacta

SEQ ID NO: 557292 - DNA, 20 bp, Artificial
  CRISPR gRNA sequence
agtcccacactcaatactat

SEQ ID NO: 557293 - DNA, 20 bp, Artificial
  CRISPR gRNA sequence
aatactatcaatatcactgc

SEQ ID NO: 557294 - DNA, 20 bp, Artificial
  CRISPR gRNA sequence
tcaatatcactgcctcctga

SEQ ID NO: 557295 - DNA, 20 bp, Artificial
  CRISPR gRNA sequence
cctcctgatcaaaactcacc

SEQ ID NO: 557296 - DNA, 20 bp, Artificial
  CRISPR gRNA sequence
ctgatcaaaactcacctccc

SEQ ID NO: 557297 - DNA, 20 bp, Artificial
  CRISPR gRNA sequence
atcaaaactcacctcccctg

SEQ ID NO: 557298 - DNA, 20 bp, Artificial
  CRISPR gRNA sequence
acctcccctgtactttactc

SEQ ID NO: 557299 - DNA, 20 bp, Artificial
  CRISPR gRNA sequence
ccctgtactttactcctctg

SEQ ID NO: 557300 - DNA, 20 bp, Artificial
  CRISPR gRNA sequence
tactttactcctctgcaggc

SEQ ID NO: 557301 - DNA, 20 bp, Artificial
  CRISPR gRNA sequence
tactcctctgcaggcttcct

SEQ ID NO: 557302 - DNA, 20 bp, Artificial
  CRISPR gRNA sequence
actcctctgcaggcttccta

SEQ ID NO: 557303 - DNA, 20 bp, Artificial
  CRISPR gRNA sequence
ctcctctgcaggcttcctaa

SEQ ID NO: 557304 - DNA, 20 bp, Artificial
  CRISPR gRNA sequence
ctctgcaggcttcctaaggt

SEQ ID NO: 557305 - DNA, 20 bp, Artificial
  CRISPR gRNA sequence
tgcaggcttcctaaggtcta

SEQ ID NO: 557306 - DNA, 20 bp, Artificial
  CRISPR gRNA sequence
caggcttcctaaggtctatc

SEQ ID NO: 557307 - DNA, 20 bp, Artificial
  CRISPR gRNA sequence
cctaaggtctatccagttgg

SEQ ID NO: 557308 - DNA, 20 bp, Artificial
  CRISPR gRNA sequence
ctaaggtctatccagttggt

SEQ ID NO: 557309 - DNA, 20 bp, Artificial
  CRISPR gRNA sequence
aggtctatccagttggtctg

SEQ ID NO: 557310 - DNA, 20 bp, Artificial
  CRISPR gRNA sequence
tccagttggtctgactaaca

SEQ ID NO: 557311 - DNA, 20 bp, Artificial
  CRISPR gRNA sequence
gtctgactaacaaaaccata

SEQ ID NO: 557312 - DNA, 20 bp, Artificial
  CRISPR gRNA sequence
actaacaaaaccataccttt

SEQ ID NO: 557313 - DNA, 20 bp, Artificial
  CRISPR gRNA sequence
acaaaaccatacctttgctg

SEQ ID NO: 557314 - DNA, 20 bp, Artificial
  CRISPR gRNA sequence
tgctgaggtgccatagaata

SEQ ID NO: 557315 - DNA, 20 bp, Artificial
  CRISPR gRNA sequence
gctgaggtgccatagaatat

SEQ ID NO: 557316 - DNA, 20 bp, Artificial
  CRISPR gRNA sequence
ctgaggtgccatagaatatt

SEQ ID NO: 557317 - DNA, 20 bp, Artificial
  CRISPR gRNA sequence
aggtgccatagaatatttta

SEQ ID NO: 557318 - DNA, 20 bp, Artificial
  CRISPR gRNA sequence
tatttaattaatttatttag

SEQ ID NO: 557319 - DNA, 20 bp, Artificial
  CRISPR gRNA sequence
atttaattaatttatttagc

SEQ ID NO: 557320 - DNA, 20 bp, Artificial
  CRISPR gRNA sequence
tttaattaatttatttagct

SEQ ID NO: 557321 - DNA, 20 bp, Artificial
  CRISPR gRNA sequence
aattaatttatttagctagt

SEQ ID NO: 557322 - DNA, 20 bp, Artificial
  CRISPR gRNA sequence
attaatttatttagctagtt

SEQ ID NO: 557323 - DNA, 20 bp, Artificial
  CRISPR gRNA sequence
atttatttagctagttattt

SEQ ID NO: 557324 - DNA, 20 bp, Artificial
  CRISPR gRNA sequence
atttagctagttattttgag

SEQ ID NO: 557325 - DNA, 20 bp, Artificial
  CRISPR gRNA sequence
tttagctagttattttgagg

SEQ ID NO: 557326 - DNA, 20 bp, Artificial
  CRISPR gRNA sequence
agctagttattttgaggcag

SEQ ID NO: 557327 - DNA, 20 bp, Artificial
  CRISPR gRNA sequence
gctagttattttgaggcagg

SEQ ID NO: 557328 - DNA, 20 bp, Artificial
  CRISPR gRNA sequence
gttattttgaggcagggtct

SEQ ID NO: 557329 - DNA, 20 bp, Artificial
  CRISPR gRNA sequence
ttttgaggcagggtcttggt

SEQ ID NO: 557330 - DNA, 20 bp, Artificial
  CRISPR gRNA sequence
tgaggcagggtcttggtctg

SEQ ID NO: 557331 - DNA, 20 bp, Artificial
  CRISPR gRNA sequence
gaggcagggtcttggtctgt

SEQ ID NO: 557332 - DNA, 20 bp, Artificial
  CRISPR gRNA sequence
aggcagggtcttggtctgtc

SEQ ID NO: 557333 - DNA, 20 bp, Artificial
  CRISPR gRNA sequence
ggtctgtcacccagactgga

SEQ ID NO: 557334 - DNA, 20 bp, Artificial
  CRISPR gRNA sequence
gtctgtcacccagactggag

SEQ ID NO: 557335 - DNA, 20 bp, Artificial
  CRISPR gRNA sequence
tcacccagactggagtgcag

SEQ ID NO: 557336 - DNA, 20 bp, Artificial
  CRISPR gRNA sequence
gagtgcagaggtgcaatcat

SEQ ID NO: 557337 - DNA, 20 bp, Artificial
  CRISPR gRNA sequence
actgcagcctcagcctcctg

SEQ ID NO: 557338 - DNA, 20 bp, Artificial
  CRISPR gRNA sequence
cagcctcagcctcctgggct

SEQ ID NO: 557339 - DNA, 20 bp, Artificial
  CRISPR gRNA sequence
agcctcctgggctcaaggga

SEQ ID NO: 557340 - DNA, 20 bp, Artificial
  CRISPR gRNA sequence
ctgggctcaagggatcctcc

SEQ ID NO: 557341 - DNA, 20 bp, Artificial
  CRISPR gRNA sequence
ggctcaagggatcctcccac

SEQ ID NO: 557342 - DNA, 20 bp, Artificial
  CRISPR gRNA sequence
aagggatcctcccacctcag

SEQ ID NO: 557343 - DNA, 20 bp, Artificial
  CRISPR gRNA sequence
ccacctcagcctcttgagta

SEQ ID NO: 557344 - DNA, 20 bp, Artificial
  CRISPR gRNA sequence
agcctcttgagtagctggga

SEQ ID NO: 557345 - DNA, 20 bp, Artificial
  CRISPR gRNA sequence
ttgagtagctgggactacag

SEQ ID NO: 557346 - DNA, 20 bp, Artificial
  CRISPR gRNA sequence
gagtagctgggactacaggc

SEQ ID NO: 557347 - DNA, 20 bp, Artificial
  CRISPR gRNA sequence
agtagctgggactacaggca

SEQ ID NO: 557348 - DNA, 20 bp, Artificial
  CRISPR gRNA sequence
ggactacaggcatgcaccac

SEQ ID NO: 557349 - DNA, 20 bp, Artificial
  CRISPR gRNA sequence
caggcatgcaccaccatgcc

SEQ ID NO: 557350 - DNA, 20 bp, Artificial
  CRISPR gRNA sequence
gttaattattttatttttgt

SEQ ID NO: 557351 - DNA, 20 bp, Artificial
  CRISPR gRNA sequence
attattttatttttgtagag

SEQ ID NO: 557352 - DNA, 20 bp, Artificial
  CRISPR gRNA sequence
ttttatttttgtagagatgg

SEQ ID NO: 557353 - DNA, 20 bp, Artificial
  CRISPR gRNA sequence
tatttttgtagagatggagt

SEQ ID NO: 557354 - DNA, 20 bp, Artificial
  CRISPR gRNA sequence
atttttgtagagatggagtc

SEQ ID NO: 557355 - DNA, 20 bp, Artificial
  CRISPR gRNA sequence
tttttgtagagatggagtct

SEQ ID NO: 557356 - DNA, 20 bp, Artificial
  CRISPR gRNA sequence
ttgtagagatggagtcttgc

SEQ ID NO: 557357 - DNA, 20 bp, Artificial
  CRISPR gRNA sequence
tgtagagatggagtcttgct

SEQ ID NO: 557358 - DNA, 20 bp, Artificial
  CRISPR gRNA sequence
gtagagatggagtcttgcta

SEQ ID NO: 557359 - DNA, 20 bp, Artificial
  CRISPR gRNA sequence
tagagatggagtcttgctat

SEQ ID NO: 557360 - DNA, 20 bp, Artificial
  CRISPR gRNA sequence
gctatgttgcctaggatggt

SEQ ID NO: 557361 - DNA, 20 bp, Artificial
  CRISPR gRNA sequence
ctatgttgcctaggatggtc

SEQ ID NO: 557362 - DNA, 20 bp, Artificial
  CRISPR gRNA sequence
tgttgcctaggatggtcttg

SEQ ID NO: 557363 - DNA, 20 bp, Artificial
  CRISPR gRNA sequence
cctaggatggtcttgaacta

SEQ ID NO: 557364 - DNA, 20 bp, Artificial
  CRISPR gRNA sequence
ggatggtcttgaactactgg

SEQ ID NO: 557365 - DNA, 20 bp, Artificial
  CRISPR gRNA sequence
gaactactgggcttaagcaa

SEQ ID NO: 557366 - DNA, 20 bp, Artificial
  CRISPR gRNA sequence
aactactgggcttaagcaac

SEQ ID NO: 557367 - DNA, 20 bp, Artificial
  CRISPR gRNA sequence
ctgggcttaagcaaccctcc

SEQ ID NO: 557368 - DNA, 20 bp, Artificial
  CRISPR gRNA sequence
ggcttaagcaaccctccctc

SEQ ID NO: 557369 - DNA, 20 bp, Artificial
  CRISPR gRNA sequence
aagcaaccctccctcctcag

SEQ ID NO: 557370 - DNA, 20 bp, Artificial
  CRISPR gRNA sequence
agcaaccctccctcctcagc

SEQ ID NO: 557371 - DNA, 20 bp, Artificial
  CRISPR gRNA sequence
cctcctcagcctcacaaagt

SEQ ID NO: 557372 - DNA, 20 bp, Artificial
  CRISPR gRNA sequence
ctcagcctcacaaagtgctg

SEQ ID NO: 557373 - DNA, 20 bp, Artificial
  CRISPR gRNA sequence
agcctcacaaagtgctggga

SEQ ID NO: 557374 - DNA, 20 bp, Artificial
  CRISPR gRNA sequence
acaaagtgctgggattatag

SEQ ID NO: 557375 - DNA, 20 bp, Artificial
  CRISPR gRNA sequence
ggattatagccttgagccac

SEQ ID NO: 557376 - DNA, 20 bp, Artificial
  CRISPR gRNA sequence
tagccttgagccacaatgcc

SEQ ID NO: 557377 - DNA, 20 bp, Artificial
  CRISPR gRNA sequence
gagccacaatgcccggccta

SEQ ID NO: 557378 - DNA, 20 bp, Artificial
  CRISPR gRNA sequence
agccacaatgcccggcctag

SEQ ID NO: 557379 - DNA, 20 bp, Artificial
  CRISPR gRNA sequence
gaatattttaaattatttta

SEQ ID NO: 557380 - DNA, 20 bp, Artificial
  CRISPR gRNA sequence
taaattattttaaaacagtt

SEQ ID NO: 557381 - DNA, 20 bp, Artificial
  CRISPR gRNA sequence
aaattattttaaaacagttc

SEQ ID NO: 557382 - DNA, 20 bp, Artificial
  CRISPR gRNA sequence
aattattttaaaacagttca

SEQ ID NO: 557383 - DNA, 20 bp, Artificial
  CRISPR gRNA sequence
ttttaaaacagttcatcaag

SEQ ID NO: 557384 - DNA, 20 bp, Artificial
  CRISPR gRNA sequence
taaaacagttcatcaagttt

SEQ ID NO: 557385 - DNA, 20 bp, Artificial
  CRISPR gRNA sequence
aaaacagttcatcaagttta

SEQ ID NO: 557386 - DNA, 20 bp, Artificial
  CRISPR gRNA sequence
aaacagttcatcaagtttaa

SEQ ID NO: 557387 - DNA, 20 bp, Artificial
  CRISPR gRNA sequence
atcaagtttaagaggagaaa

SEQ ID NO: 557388 - DNA, 20 bp, Artificial
  CRISPR gRNA sequence
aagaggagaaatttattcaa

SEQ ID NO: 557389 - DNA, 20 bp, Artificial
  CRISPR gRNA sequence
agaggagaaatttattcaaa

SEQ ID NO: 557390 - DNA, 20 bp, Artificial
  CRISPR gRNA sequence
attcaaatgttttgaattag

SEQ ID NO: 557391 - DNA, 20 bp, Artificial
  CRISPR gRNA sequence
ttcaaatgttttgaattagt

SEQ ID NO: 557392 - DNA, 20 bp, Artificial
  CRISPR gRNA sequence
aaatgttttgaattagtttt

SEQ ID NO: 557393 - DNA, 20 bp, Artificial
  CRISPR gRNA sequence
tgaattagttttacaaactc

SEQ ID NO: 557394 - DNA, 20 bp, Artificial
  CRISPR gRNA sequence
gaattagttttacaaactct

SEQ ID NO: 557395 - DNA, 20 bp, Artificial
  CRISPR gRNA sequence
aattagttttacaaactcta

SEQ ID NO: 557396 - DNA, 20 bp, Artificial
  CRISPR gRNA sequence
gttttacaaactctataaaa

SEQ ID NO: 557397 - DNA, 20 bp, Artificial
  CRISPR gRNA sequence
tacaaactctataaaaaggg

SEQ ID NO: 557398 - DNA, 20 bp, Artificial
  CRISPR gRNA sequence
acaaactctataaaaagggc

SEQ ID NO: 557399 - DNA, 20 bp, Artificial
  CRISPR gRNA sequence
caaactctataaaaagggct

SEQ ID NO: 557400 - DNA, 20 bp, Artificial
  CRISPR gRNA sequence
tataaaaagggctcttaaaa

SEQ ID NO: 557401 - DNA, 20 bp, Artificial
  CRISPR gRNA sequence
taaaaagggctcttaaaatg

SEQ ID NO: 557402 - DNA, 20 bp, Artificial
  CRISPR gRNA sequence
ttaaaatgtgtgatctaaat

SEQ ID NO: 557403 - DNA, 20 bp, Artificial
  CRISPR gRNA sequence
aaaatgtgtgatctaaattc

SEQ ID NO: 557404 - DNA, 20 bp, Artificial
  CRISPR gRNA sequence
aaatgtgtgatctaaattct

SEQ ID NO: 557405 - DNA, 20 bp, Artificial
  CRISPR gRNA sequence
aattctgactcaatcctctt

SEQ ID NO: 557406 - DNA, 20 bp, Artificial
  CRISPR gRNA sequence
tgactcaatcctcttgtttg

SEQ ID NO: 557407 - DNA, 20 bp, Artificial
  CRISPR gRNA sequence
actcaatcctcttgtttgtt

SEQ ID NO: 557408 - DNA, 20 bp, Artificial
  CRISPR gRNA sequence
aatcctcttgtttgttggcc

SEQ ID NO: 557409 - DNA, 20 bp, Artificial
  CRISPR gRNA sequence
ttgtttgttggccctatcta

SEQ ID NO: 557410 - DNA, 20 bp, Artificial
  CRISPR gRNA sequence
gtttgttggccctatctata

SEQ ID NO: 557411 - DNA, 20 bp, Artificial
  CRISPR gRNA sequence
tttgttggccctatctataa

SEQ ID NO: 557412 - DNA, 20 bp, Artificial
  CRISPR gRNA sequence
gttggccctatctataaatt

SEQ ID NO: 557413 - DNA, 20 bp, Artificial
  CRISPR gRNA sequence
ttggccctatctataaatta

SEQ ID NO: 557414 - DNA, 20 bp, Artificial
  CRISPR gRNA sequence
gccctatctataaattatca

SEQ ID NO: 557415 - DNA, 20 bp, Artificial
  CRISPR gRNA sequence
tctataaattatcagatccc

SEQ ID NO: 557416 - DNA, 20 bp, Artificial
  CRISPR gRNA sequence
taaattatcagatccccaat

SEQ ID NO: 557417 - DNA, 20 bp, Artificial
  CRISPR gRNA sequence
tcagatccccaatgtccatg

SEQ ID NO: 557418 - DNA, 20 bp, Artificial
  CRISPR gRNA sequence
caaagattctactttttcaa

SEQ ID NO: 557419 - DNA, 20 bp, Artificial
  CRISPR gRNA sequence
aaagattctactttttcaag

SEQ ID NO: 557420 - DNA, 20 bp, Artificial
  CRISPR gRNA sequence
tactttttcaaggaaatctt

SEQ ID NO: 557421 - DNA, 20 bp, Artificial
  CRISPR gRNA sequence
ctttttcaaggaaatcttct

SEQ ID NO: 557422 - DNA, 20 bp, Artificial
  CRISPR gRNA sequence
tttcaaggaaatcttctaag

SEQ ID NO: 557423 - DNA, 20 bp, Artificial
  CRISPR gRNA sequence
ttcaaggaaatcttctaaga

SEQ ID NO: 557424 - DNA, 20 bp, Artificial
  CRISPR gRNA sequence
tcaaggaaatcttctaagag

SEQ ID NO: 557425 - DNA, 20 bp, Artificial
  CRISPR gRNA sequence
caaggaaatcttctaagagg

SEQ ID NO: 557426 - DNA, 20 bp, Artificial
  CRISPR gRNA sequence
aaggaaatcttctaagagga

SEQ ID NO: 557427 - DNA, 20 bp, Artificial
  CRISPR gRNA sequence
ctaagaggatactttgacat

SEQ ID NO: 557428 - DNA, 20 bp, Artificial
  CRISPR gRNA sequence
taagaggatactttgacatc

SEQ ID NO: 557429 - DNA, 20 bp, Artificial
  CRISPR gRNA sequence
agaggatactttgacatctt

SEQ ID NO: 557430 - DNA, 20 bp, Artificial
  CRISPR gRNA sequence
tgacatcttagcaagctgta

SEQ ID NO: 557431 - DNA, 20 bp, Artificial
  CRISPR gRNA sequence
gacatcttagcaagctgtat

SEQ ID NO: 557432 - DNA, 20 bp, Artificial
  CRISPR gRNA sequence
acatcttagcaagctgtatt

SEQ ID NO: 557433 - DNA, 20 bp, Artificial
  CRISPR gRNA sequence
agcaagctgtatttgtctaa

SEQ ID NO: 557434 - DNA, 20 bp, Artificial
  CRISPR gRNA sequence
gcaagctgtatttgtctaaa

SEQ ID NO: 557435 - DNA, 20 bp, Artificial
  CRISPR gRNA sequence
tatttgtctaaatagagtcc

SEQ ID NO: 557436 - DNA, 20 bp, Artificial
  CRISPR gRNA sequence
gtctaaatagagtccacagg

SEQ ID NO: 557437 - DNA, 20 bp, Artificial
  CRISPR gRNA sequence
tctaaatagagtccacaggg

SEQ ID NO: 557438 - DNA, 20 bp, Artificial
  CRISPR gRNA sequence
aatagagtccacaggggtca

SEQ ID NO: 557439 - DNA, 20 bp, Artificial
  CRISPR gRNA sequence
acatagccttgcaagtcgct

SEQ ID NO: 557440 - DNA, 20 bp, Artificial
  CRISPR gRNA sequence
gcaagtcgctttacacattt

SEQ ID NO: 557441 - DNA, 20 bp, Artificial
  CRISPR gRNA sequence
caagtcgctttacacatttt

SEQ ID NO: 557442 - DNA, 20 bp, Artificial
  CRISPR gRNA sequence
tacacattttagctttaaca

SEQ ID NO: 557443 - DNA, 20 bp, Artificial
  CRISPR gRNA sequence
acacattttagctttaacag

SEQ ID NO: 557444 - DNA, 20 bp, Artificial
  CRISPR gRNA sequence
cacattttagctttaacaga

SEQ ID NO: 557445 - DNA, 20 bp, Artificial
  CRISPR gRNA sequence
tagctttaacagagttagat

SEQ ID NO: 557446 - DNA, 20 bp, Artificial
  CRISPR gRNA sequence
agctttaacagagttagatg

SEQ ID NO: 557447 - DNA, 20 bp, Artificial
  CRISPR gRNA sequence
gctttaacagagttagatgg

SEQ ID NO: 557448 - DNA, 20 bp, Artificial
  CRISPR gRNA sequence
taacagagttagatggggcc

SEQ ID NO: 557449 - DNA, 20 bp, Artificial
  CRISPR gRNA sequence
aacagagttagatggggcca

SEQ ID NO: 557450 - DNA, 20 bp, Artificial
  CRISPR gRNA sequence
acagagttagatggggccat

SEQ ID NO: 557451 - DNA, 20 bp, Artificial
  CRISPR gRNA sequence
gatggggccattagaaagtt

SEQ ID NO: 557452 - DNA, 20 bp, Artificial
  CRISPR gRNA sequence
gaaagttccacacagatgag

SEQ ID NO: 557453 - DNA, 20 bp, Artificial
  CRISPR gRNA sequence
cacacagatgagtgacatga

SEQ ID NO: 557454 - DNA, 20 bp, Artificial
  CRISPR gRNA sequence
acttctgttttaaaaagatc

SEQ ID NO: 557455 - DNA, 20 bp, Artificial
  CRISPR gRNA sequence
ctgttttaaaaagatcattc

SEQ ID NO: 557456 - DNA, 20 bp, Artificial
  CRISPR gRNA sequence
tgttttaaaaagatcattct

SEQ ID NO: 557457 - DNA, 20 bp, Artificial
  CRISPR gRNA sequence
ttttaaaaagatcattctgg

SEQ ID NO: 557458 - DNA, 20 bp, Artificial
  CRISPR gRNA sequence
taaaaagatcattctggtag

SEQ ID NO: 557459 - DNA, 20 bp, Artificial
  CRISPR gRNA sequence
aaaaagatcattctggtaga

SEQ ID NO: 557460 - DNA, 20 bp, Artificial
  CRISPR gRNA sequence
aaaagatcattctggtagaa

SEQ ID NO: 557461 - DNA, 20 bp, Artificial
  CRISPR gRNA sequence
tggtagaaccaatacaactt

SEQ ID NO: 557462 - DNA, 20 bp, Artificial
  CRISPR gRNA sequence
gtagaaccaatacaacttcc

SEQ ID NO: 557463 - DNA, 20 bp, Artificial
  CRISPR gRNA sequence
cctggtagagtgaatgtggt

SEQ ID NO: 557464 - DNA, 20 bp, Artificial
  CRISPR gRNA sequence
ctggtagagtgaatgtggta

SEQ ID NO: 557465 - DNA, 20 bp, Artificial
  CRISPR gRNA sequence
gtagagtgaatgtggtattc

SEQ ID NO: 557466 - DNA, 20 bp, Artificial
  CRISPR gRNA sequence
aagaaaaagagaggtatcaa

SEQ ID NO: 557467 - DNA, 20 bp, Artificial
  CRISPR gRNA sequence
cagactgaccagctgaaagg

SEQ ID NO: 557468 - DNA, 20 bp, Artificial
  CRISPR gRNA sequence
agactgaccagctgaaagga

SEQ ID NO: 557469 - DNA, 20 bp, Artificial
  CRISPR gRNA sequence
accagctgaaaggatggggc

SEQ ID NO: 557470 - DNA, 20 bp, Artificial
  CRISPR gRNA sequence
aaaggatggggctgccatta

SEQ ID NO: 557471 - DNA, 20 bp, Artificial
  CRISPR gRNA sequence
ccattaaccaaaagggaaaa

SEQ ID NO: 557472 - DNA, 20 bp, Artificial
  CRISPR gRNA sequence
accaaaagggaaaagatttg

SEQ ID NO: 557473 - DNA, 20 bp, Artificial
  CRISPR gRNA sequence
ggggaggagcagcaggtttt

SEQ ID NO: 557474 - DNA, 20 bp, Artificial
  CRISPR gRNA sequence
gggaggagcagcaggtttta

SEQ ID NO: 557475 - DNA, 20 bp, Artificial
  CRISPR gRNA sequence
taaggggaagataatgagct

SEQ ID NO: 557476 - DNA, 20 bp, Artificial
  CRISPR gRNA sequence
aaggggaagataatgagctt

SEQ ID NO: 557477 - DNA, 20 bp, Artificial
  CRISPR gRNA sequence
aggggaagataatgagctta

SEQ ID NO: 557478 - DNA, 20 bp, Artificial
  CRISPR gRNA sequence
acttttggacttgtgatatt

SEQ ID NO: 557479 - DNA, 20 bp, Artificial
  CRISPR gRNA sequence
cttttggacttgtgatattt

SEQ ID NO: 557480 - DNA, 20 bp, Artificial
  CRISPR gRNA sequence
ttggacttgtgatatttgaa

SEQ ID NO: 557481 - DNA, 20 bp, Artificial
  CRISPR gRNA sequence
tggacttgtgatatttgaaa

SEQ ID NO: 557482 - DNA, 20 bp, Artificial
  CRISPR gRNA sequence
ggacttgtgatatttgaaag

SEQ ID NO: 557483 - DNA, 20 bp, Artificial
  CRISPR gRNA sequence
gacttgtgatatttgaaagg

SEQ ID NO: 557484 - DNA, 20 bp, Artificial
  CRISPR gRNA sequence
gtgatatttgaaaggccaat

SEQ ID NO: 557485 - DNA, 20 bp, Artificial
  CRISPR gRNA sequence
tgatatttgaaaggccaatt

SEQ ID NO: 557486 - DNA, 20 bp, Artificial
  CRISPR gRNA sequence
gaaaggccaattagatgtct

SEQ ID NO: 557487 - DNA, 20 bp, Artificial
  CRISPR gRNA sequence
aaaggccaattagatgtctg

SEQ ID NO: 557488 - DNA, 20 bp, Artificial
  CRISPR gRNA sequence
gatgtctgactggagaggta

SEQ ID NO: 557489 - DNA, 20 bp, Artificial
  CRISPR gRNA sequence
actggagaggtacactgggc

SEQ ID NO: 557490 - DNA, 20 bp, Artificial
  CRISPR gRNA sequence
gagaggtacactgggcagtc

SEQ ID NO: 557491 - DNA, 20 bp, Artificial
  CRISPR gRNA sequence
ggcagtcaggtatacacata

SEQ ID NO: 557492 - DNA, 20 bp, Artificial
  CRISPR gRNA sequence
ggcggggtactctgggctag

SEQ ID NO: 557493 - DNA, 20 bp, Artificial
  CRISPR gRNA sequence
tgggctagagctctagatct

SEQ ID NO: 557494 - DNA, 20 bp, Artificial
  CRISPR gRNA sequence
ggctagagctctagatctgt

SEQ ID NO: 557495 - DNA, 20 bp, Artificial
  CRISPR gRNA sequence
gagctctagatctgtacatt

SEQ ID NO: 557496 - DNA, 20 bp, Artificial
  CRISPR gRNA sequence
tagatctgtacattattagc

SEQ ID NO: 557497 - DNA, 20 bp, Artificial
  CRISPR gRNA sequence
gatctgtacattattagcat

SEQ ID NO: 557498 - DNA, 20 bp, Artificial
  CRISPR gRNA sequence
tacattattagcattgagat

SEQ ID NO: 557499 - DNA, 20 bp, Artificial
  CRISPR gRNA sequence
ttagcattgagatgatattt

SEQ ID NO: 557500 - DNA, 20 bp, Artificial
  CRISPR gRNA sequence
gcattgagatgatatttaaa

SEQ ID NO: 557501 - DNA, 20 bp, Artificial
  CRISPR gRNA sequence
agatgatatttaaagccctg

SEQ ID NO: 557502 - DNA, 20 bp, Artificial
  CRISPR gRNA sequence
aaagccctgacatgggatga

SEQ ID NO: 557503 - DNA, 20 bp, Artificial
  CRISPR gRNA sequence
aagccctgacatgggatgag

SEQ ID NO: 557504 - DNA, 20 bp, Artificial
  CRISPR gRNA sequence
acatgggatgagctcaccca

SEQ ID NO: 557505 - DNA, 20 bp, Artificial
  CRISPR gRNA sequence
acccactggctatgaacgca

SEQ ID NO: 557506 - DNA, 20 bp, Artificial
  CRISPR gRNA sequence
gctatgaacgcagacagaaa

SEQ ID NO: 557507 - DNA, 20 bp, Artificial
  CRISPR gRNA sequence
tgaacgcagacagaaaagga

SEQ ID NO: 557508 - DNA, 20 bp, Artificial
  CRISPR gRNA sequence
aggcttaagccttgatgttt

SEQ ID NO: 557509 - DNA, 20 bp, Artificial
  CRISPR gRNA sequence
aagccttgatgtttccagtg

SEQ ID NO: 557510 - DNA, 20 bp, Artificial
  CRISPR gRNA sequence
agccttgatgtttccagtgt

SEQ ID NO: 557511 - DNA, 20 bp, Artificial
  CRISPR gRNA sequence
gatgtttccagtgttaagag

SEQ ID NO: 557512 - DNA, 20 bp, Artificial
  CRISPR gRNA sequence
atgtttccagtgttaagagg

SEQ ID NO: 557513 - DNA, 20 bp, Artificial
  CRISPR gRNA sequence
ccagtgttaagaggttgggg

SEQ ID NO: 557514 - DNA, 20 bp, Artificial
  CRISPR gRNA sequence
cagtgttaagaggttgggga

SEQ ID NO: 557515 - DNA, 20 bp, Artificial
  CRISPR gRNA sequence
agaggttggggaaacaagga

SEQ ID NO: 557516 - DNA, 20 bp, Artificial
  CRISPR gRNA sequence
gggaaacaaggaaactagca

SEQ ID NO: 557517 - DNA, 20 bp, Artificial
  CRISPR gRNA sequence
gcaaaagaagctgaaaagga

SEQ ID NO: 557518 - DNA, 20 bp, Artificial
  CRISPR gRNA sequence
aaaaggaatagtcagtgtgt

SEQ ID NO: 557519 - DNA, 20 bp, Artificial
  CRISPR gRNA sequence
gaaagaaatgtgaagccagg

SEQ ID NO: 557520 - DNA, 20 bp, Artificial
  CRISPR gRNA sequence
acacctgtaatcccaacact

SEQ ID NO: 557521 - DNA, 20 bp, Artificial
  CRISPR gRNA sequence
taatcccaacactttgggag

SEQ ID NO: 557522 - DNA, 20 bp, Artificial
  CRISPR gRNA sequence
tgggaggccaaggcaggtgg

SEQ ID NO: 557523 - DNA, 20 bp, Artificial
  CRISPR gRNA sequence
gggaggccaaggcaggtgga

SEQ ID NO: 557524 - DNA, 20 bp, Artificial
  CRISPR gRNA sequence
ggaggccaaggcaggtggat

SEQ ID NO: 557525 - DNA, 20 bp, Artificial
  CRISPR gRNA sequence
aggtcaggagttcaagacca

SEQ ID NO: 557526 - DNA, 20 bp, Artificial
  CRISPR gRNA sequence
aagaccagcctgaccaacat

SEQ ID NO: 557527 - DNA, 20 bp, Artificial
  CRISPR gRNA sequence
accaacatggtgaaacccca

SEQ ID NO: 557528 - DNA, 20 bp, Artificial
  CRISPR gRNA sequence
tactaaaaatacaaaattag

SEQ ID NO: 557529 - DNA, 20 bp, Artificial
  CRISPR gRNA sequence
ctaaaaatacaaaattagcc

SEQ ID NO: 557530 - DNA, 20 bp, Artificial
  CRISPR gRNA sequence
aaaatacaaaattagccagg

SEQ ID NO: 557531 - DNA, 20 bp, Artificial
  CRISPR gRNA sequence
gccaggcatggtggtgcatg

SEQ ID NO: 557532 - DNA, 20 bp, Artificial
  CRISPR gRNA sequence
taatctcaactgttcaggag

SEQ ID NO: 557533 - DNA, 20 bp, Artificial
  CRISPR gRNA sequence
aactgttcaggaggctgagg

SEQ ID NO: 557534 - DNA, 20 bp, Artificial
  CRISPR gRNA sequence
ttcaggaggctgaggcagaa

SEQ ID NO: 557535 - DNA, 20 bp, Artificial
  CRISPR gRNA sequence
aggaggctgaggcagaagat

SEQ ID NO: 557536 - DNA, 20 bp, Artificial
  CRISPR gRNA sequence
aggcagaagattcacttgaa

SEQ ID NO: 557537 - DNA, 20 bp, Artificial
  CRISPR gRNA sequence
acttgaacccgggaggcata

SEQ ID NO: 557538 - DNA, 20 bp, Artificial
  CRISPR gRNA sequence
gaacccgggaggcataggtt

SEQ ID NO: 557539 - DNA, 20 bp, Artificial
  CRISPR gRNA sequence
aacccgggaggcataggttg

SEQ ID NO: 557540 - DNA, 20 bp, Artificial
  CRISPR gRNA sequence
cagtgagctgagatcgcgcc

SEQ ID NO: 557541 - DNA, 20 bp, Artificial
  CRISPR gRNA sequence
agatcgcgccattgcattcc

SEQ ID NO: 557542 - DNA, 20 bp, Artificial
  CRISPR gRNA sequence
cattccagcctgggcaacaa

SEQ ID NO: 557543 - DNA, 20 bp, Artificial
  CRISPR gRNA sequence
cagcctgggcaacaagggcg

SEQ ID NO: 557544 - DNA, 20 bp, Artificial
  CRISPR gRNA sequence
ggcaacaagggcgaaacccc

SEQ ID NO: 557545 - DNA, 20 bp, Artificial
  CRISPR gRNA sequence
tcaaggaaaaaagagaaaga

SEQ ID NO: 557546 - DNA, 20 bp, Artificial
  CRISPR gRNA sequence
aaggaaaaaagagaaagaaa

SEQ ID NO: 557547 - DNA, 20 bp, Artificial
  CRISPR gRNA sequence
gatgtcaagtgaagacagta

SEQ ID NO: 557548 - DNA, 20 bp, Artificial
  CRISPR gRNA sequence
ggaggagggagtgatcagct

SEQ ID NO: 557549 - DNA, 20 bp, Artificial
  CRISPR gRNA sequence
gaggagggagtgatcagcta

SEQ ID NO: 557550 - DNA, 20 bp, Artificial
  CRISPR gRNA sequence
tgtcaaaagctgctgagaag

SEQ ID NO: 557551 - DNA, 20 bp, Artificial
  CRISPR gRNA sequence
ctgagaagtcaagaatgaca

SEQ ID NO: 557552 - DNA, 20 bp, Artificial
  CRISPR gRNA sequence
agaagtcaagaatgacatgg

SEQ ID NO: 557553 - DNA, 20 bp, Artificial
  CRISPR gRNA sequence
agaatgaaccactggattta

SEQ ID NO: 557554 - DNA, 20 bp, Artificial
  CRISPR gRNA sequence
gatttattaacaaggaggtc

SEQ ID NO: 557555 - DNA, 20 bp, Artificial
  CRISPR gRNA sequence
attaacaaggaggtctagag

SEQ ID NO: 557556 - DNA, 20 bp, Artificial
  CRISPR gRNA sequence
ttaacaaggaggtctagagg

SEQ ID NO: 557557 - DNA, 20 bp, Artificial
  CRISPR gRNA sequence
acaaggaggtctagaggagt

SEQ ID NO: 557558 - DNA, 20 bp, Artificial
  CRISPR gRNA sequence
gaggagttttggcatagcag

SEQ ID NO: 557559 - DNA, 20 bp, Artificial
  CRISPR gRNA sequence
tggcatagcagtgcagatga

SEQ ID NO: 557560 - DNA, 20 bp, Artificial
  CRISPR gRNA sequence
ggcatagcagtgcagatgaa

SEQ ID NO: 557561 - DNA, 20 bp, Artificial
  CRISPR gRNA sequence
gcatagcagtgcagatgaaa

SEQ ID NO: 557562 - DNA, 20 bp, Artificial
  CRISPR gRNA sequence
tttggagtgggttaaaagtg

SEQ ID NO: 557563 - DNA, 20 bp, Artificial
  CRISPR gRNA sequence
ggagtgggttaaaagtgaat

SEQ ID NO: 557564 - DNA, 20 bp, Artificial
  CRISPR gRNA sequence
gagtgggttaaaagtgaata

SEQ ID NO: 557565 - DNA, 20 bp, Artificial
  CRISPR gRNA sequence
aaagtgaatataagggatca

SEQ ID NO: 557566 - DNA, 20 bp, Artificial
  CRISPR gRNA sequence
cttcaaggagattttctata

SEQ ID NO: 557567 - DNA, 20 bp, Artificial
  CRISPR gRNA sequence
ttcaaggagattttctataa

SEQ ID NO: 557568 - DNA, 20 bp, Artificial
  CRISPR gRNA sequence
caaggagattttctataaag

SEQ ID NO: 557569 - DNA, 20 bp, Artificial
  CRISPR gRNA sequence
aaggagattttctataaagt

SEQ ID NO: 557570 - DNA, 20 bp, Artificial
  CRISPR gRNA sequence
tctataaagtgaagacagca

SEQ ID NO: 557571 - DNA, 20 bp, Artificial
  CRISPR gRNA sequence
ctataaagtgaagacagcag

SEQ ID NO: 557572 - DNA, 20 bp, Artificial
  CRISPR gRNA sequence
tataaagtgaagacagcagg

SEQ ID NO: 557573 - DNA, 20 bp, Artificial
  CRISPR gRNA sequence
taaagtgaagacagcaggtg

SEQ ID NO: 557574 - DNA, 20 bp, Artificial
  CRISPR gRNA sequence
gaggggtacagggatcatga

SEQ ID NO: 557575 - DNA, 20 bp, Artificial
  CRISPR gRNA sequence
taatgacagtatatatgtat

SEQ ID NO: 557576 - DNA, 20 bp, Artificial
  CRISPR gRNA sequence
aatgacagtatatatgtatg

SEQ ID NO: 557577 - DNA, 20 bp, Artificial
  CRISPR gRNA sequence
atgacagtatatatgtatgc

SEQ ID NO: 557578 - DNA, 20 bp, Artificial
  CRISPR gRNA sequence
aaaatgaaccatcaacttat

SEQ ID NO: 557579 - DNA, 20 bp, Artificial
  CRISPR gRNA sequence
aaatgaaccatcaacttatg

SEQ ID NO: 557580 - DNA, 20 bp, Artificial
  CRISPR gRNA sequence
atgggggaaattctcatcag

SEQ ID NO: 557581 - DNA, 20 bp, Artificial
  CRISPR gRNA sequence
tgggggaaattctcatcagg

SEQ ID NO: 557582 - DNA, 20 bp, Artificial
  CRISPR gRNA sequence
tcatcaggagagagtgggta

SEQ ID NO: 557583 - DNA, 20 bp, Artificial
  CRISPR gRNA sequence
atcaggagagagtgggtaga

SEQ ID NO: 557584 - DNA, 20 bp, Artificial
  CRISPR gRNA sequence
gggtgatattcccgaggacg

SEQ ID NO: 557585 - DNA, 20 bp, Artificial
  CRISPR gRNA sequence
ccgaggacggcaagaggagg

SEQ ID NO: 557586 - DNA, 20 bp, Artificial
  CRISPR gRNA sequence
aacttcaggtgagaactcag

SEQ ID NO: 557587 - DNA, 20 bp, Artificial
  CRISPR gRNA sequence
acttcaggtgagaactcaga

SEQ ID NO: 557588 - DNA, 20 bp, Artificial
  CRISPR gRNA sequence
caggtgagaactcagaaagt

SEQ ID NO: 557589 - DNA, 20 bp, Artificial
  CRISPR gRNA sequence
aggtgagaactcagaaagtc

SEQ ID NO: 557590 - DNA, 20 bp, Artificial
  CRISPR gRNA sequence
agaaagtccattcatatcag

SEQ ID NO: 557591 - DNA, 20 bp, Artificial
  CRISPR gRNA sequence
atatcaggagagaaagcagg

SEQ ID NO: 557592 - DNA, 20 bp, Artificial
  CRISPR gRNA sequence
caggctcaggtatgggtagg

SEQ ID NO: 557593 - DNA, 20 bp, Artificial
  CRISPR gRNA sequence
aggtatgggtaggaaggtag

SEQ ID NO: 557594 - DNA, 20 bp, Artificial
  CRISPR gRNA sequence
gtggaaattgccctctgatt

SEQ ID NO: 557595 - DNA, 20 bp, Artificial
  CRISPR gRNA sequence
tggaaattgccctctgattg

SEQ ID NO: 557596 - DNA, 20 bp, Artificial
  CRISPR gRNA sequence
ccctctgattgcttattctc

SEQ ID NO: 557597 - DNA, 20 bp, Artificial
  CRISPR gRNA sequence
tgattgcttattctccttag

SEQ ID NO: 557598 - DNA, 20 bp, Artificial
  CRISPR gRNA sequence
attgcttattctccttagtg

SEQ ID NO: 557599 - DNA, 20 bp, Artificial
  CRISPR gRNA sequence
cttattctccttagtgaaat

SEQ ID NO: 557600 - DNA, 20 bp, Artificial
  CRISPR gRNA sequence
attctccttagtgaaataag

SEQ ID NO: 557601 - DNA, 20 bp, Artificial
  CRISPR gRNA sequence
ttctccttagtgaaataaga

SEQ ID NO: 557602 - DNA, 20 bp, Artificial
  CRISPR gRNA sequence
tccttagtgaaataagaagc

SEQ ID NO: 557603 - DNA, 20 bp, Artificial
  CRISPR gRNA sequence
cttagtgaaataagaagcaa

SEQ ID NO: 557604 - DNA, 20 bp, Artificial
  CRISPR gRNA sequence
agtgaaataagaagcaaagc

SEQ ID NO: 557605 - DNA, 20 bp, Artificial
  CRISPR gRNA sequence
gtgaaataagaagcaaagcc

SEQ ID NO: 557606 - DNA, 20 bp, Artificial
  CRISPR gRNA sequence
cagctgaagagtcagtctag

SEQ ID NO: 557607 - DNA, 20 bp, Artificial
  CRISPR gRNA sequence
agctgaagagtcagtctaga

SEQ ID NO: 557608 - DNA, 20 bp, Artificial
  CRISPR gRNA sequence
aagagtcagtctagagaagg

SEQ ID NO: 557609 - DNA, 20 bp, Artificial
  CRISPR gRNA sequence
gagaaggaggtattcaagat

SEQ ID NO: 557610 - DNA, 20 bp, Artificial
  CRISPR gRNA sequence
aagatttgaggagagaaaaa

SEQ ID NO: 557611 - DNA, 20 bp, Artificial
  CRISPR gRNA sequence
gaggagagaaaaagtaactg

SEQ ID NO: 557612 - DNA, 20 bp, Artificial
  CRISPR gRNA sequence
aggagagaaaaagtaactgc

SEQ ID NO: 557613 - DNA, 20 bp, Artificial
  CRISPR gRNA sequence
ctaggagagtgggtaagtga

SEQ ID NO: 557614 - DNA, 20 bp, Artificial
  CRISPR gRNA sequence
ggagagtgggtaagtgaaca

SEQ ID NO: 557615 - DNA, 20 bp, Artificial
  CRISPR gRNA sequence
ggaaataccaacttaattga

SEQ ID NO: 557616 - DNA, 20 bp, Artificial
  CRISPR gRNA sequence
aattgaggtaagtgattaga

SEQ ID NO: 557617 - DNA, 20 bp, Artificial
  CRISPR gRNA sequence
attgaggtaagtgattagag

SEQ ID NO: 557618 - DNA, 20 bp, Artificial
  CRISPR gRNA sequence
aggtaagtgattagagaaat

SEQ ID NO: 557619 - DNA, 20 bp, Artificial
  CRISPR gRNA sequence
gagaaattaaaagtgcagga

SEQ ID NO: 557620 - DNA, 20 bp, Artificial
  CRISPR gRNA sequence
aaagtgcaggactttgtagg

SEQ ID NO: 557621 - DNA, 20 bp, Artificial
  CRISPR gRNA sequence
tgtagggtggtgtatttttc

SEQ ID NO: 557622 - DNA, 20 bp, Artificial
  CRISPR gRNA sequence
gtagggtggtgtatttttct

SEQ ID NO: 557623 - DNA, 20 bp, Artificial
  CRISPR gRNA sequence
tagggtggtgtatttttctg

SEQ ID NO: 557624 - DNA, 20 bp, Artificial
  CRISPR gRNA sequence
ttctgcaaccacatgggtgt

SEQ ID NO: 557625 - DNA, 20 bp, Artificial
  CRISPR gRNA sequence
tctgcaaccacatgggtgtg

SEQ ID NO: 557626 - DNA, 20 bp, Artificial
  CRISPR gRNA sequence
ctgcaaccacatgggtgtga

SEQ ID NO: 557627 - DNA, 20 bp, Artificial
  CRISPR gRNA sequence
tgcaaccacatgggtgtgag

SEQ ID NO: 557628 - DNA, 20 bp, Artificial
  CRISPR gRNA sequence
caaccacatgggtgtgagca

SEQ ID NO: 557629 - DNA, 20 bp, Artificial
  CRISPR gRNA sequence
aatctagctgtaatctggcc

SEQ ID NO: 557630 - DNA, 20 bp, Artificial
  CRISPR gRNA sequence
atctagctgtaatctggcca

SEQ ID NO: 557631 - DNA, 20 bp, Artificial
  CRISPR gRNA sequence
gctgtaatctggccatgcga

SEQ ID NO: 557632 - DNA, 20 bp, Artificial
  CRISPR gRNA sequence
taatctggccatgcgagtat

SEQ ID NO: 557633 - DNA, 20 bp, Artificial
  CRISPR gRNA sequence
gccatgcgagtatgacaagc

SEQ ID NO: 557634 - DNA, 20 bp, Artificial
  CRISPR gRNA sequence
agtgtgtctgcaacggactg

SEQ ID NO: 557635 - DNA, 20 bp, Artificial
  CRISPR gRNA sequence
caacggactgagtctagtga

SEQ ID NO: 557636 - DNA, 20 bp, Artificial
  CRISPR gRNA sequence
agtctagtgagtgacaacag

SEQ ID NO: 557637 - DNA, 20 bp, Artificial
  CRISPR gRNA sequence
gtgagtgacaacagcactca

SEQ ID NO: 557638 - DNA, 20 bp, Artificial
  CRISPR gRNA sequence
aggctgagtagggagggcag

SEQ ID NO: 557639 - DNA, 20 bp, Artificial
  CRISPR gRNA sequence
agtagggagggcagcaggga

SEQ ID NO: 557640 - DNA, 20 bp, Artificial
  CRISPR gRNA sequence
tcagcatcagcatcatcaag

SEQ ID NO: 557641 - DNA, 20 bp, Artificial
  CRISPR gRNA sequence
acattgaggtaatgatgagt

SEQ ID NO: 557642 - DNA, 20 bp, Artificial
  CRISPR gRNA sequence
aggtaatgatgagttctcgg

SEQ ID NO: 557643 - DNA, 20 bp, Artificial
  CRISPR gRNA sequence
tcggttacatccatgggtag

SEQ ID NO: 557644 - DNA, 20 bp, Artificial
  CRISPR gRNA sequence
ggttacatccatgggtagtg

SEQ ID NO: 557645 - DNA, 20 bp, Artificial
  CRISPR gRNA sequence
catccatgggtagtgggtaa

SEQ ID NO: 557646 - DNA, 20 bp, Artificial
  CRISPR gRNA sequence
acaggagaggcgatcaagga

SEQ ID NO: 557647 - DNA, 20 bp, Artificial
  CRISPR gRNA sequence
caggagaggcgatcaaggac

SEQ ID NO: 557648 - DNA, 20 bp, Artificial
  CRISPR gRNA sequence
aaagaattttaatttaaata

SEQ ID NO: 557649 - DNA, 20 bp, Artificial
  CRISPR gRNA sequence
taatttaaatattgcaacca

SEQ ID NO: 557650 - DNA, 20 bp, Artificial
  CRISPR gRNA sequence
aatttaaatattgcaaccac

SEQ ID NO: 557651 - DNA, 20 bp, Artificial
  CRISPR gRNA sequence
atttaaatattgcaaccacc

SEQ ID NO: 557652 - DNA, 20 bp, Artificial
  CRISPR gRNA sequence
aaatattgcaaccaccaaga

SEQ ID NO: 557653 - DNA, 20 bp, Artificial
  CRISPR gRNA sequence
aatattgcaaccaccaagac

SEQ ID NO: 557654 - DNA, 20 bp, Artificial
  CRISPR gRNA sequence
caaccaccaagacaccagga

SEQ ID NO: 557655 - DNA, 20 bp, Artificial
  CRISPR gRNA sequence
aaaatgaccaagaaacactg

SEQ ID NO: 557656 - DNA, 20 bp, Artificial
  CRISPR gRNA sequence
aaatgaccaagaaacactgg

SEQ ID NO: 557657 - DNA, 20 bp, Artificial
  CRISPR gRNA sequence
gcatgtgaggcaggggccta

SEQ ID NO: 557658 - DNA, 20 bp, Artificial
  CRISPR gRNA sequence
tacaagactgcaacacaaaa

SEQ ID NO: 557659 - DNA, 20 bp, Artificial
  CRISPR gRNA sequence
caacacaaaaggggctttag

SEQ ID NO: 557660 - DNA, 20 bp, Artificial
  CRISPR gRNA sequence
tagagaccagggaggagtgt

SEQ ID NO: 557661 - DNA, 20 bp, Artificial
  CRISPR gRNA sequence
agagaccagggaggagtgtc

SEQ ID NO: 557662 - DNA, 20 bp, Artificial
  CRISPR gRNA sequence
gagaccagggaggagtgtca

SEQ ID NO: 557663 - DNA, 20 bp, Artificial
  CRISPR gRNA sequence
tctctagtttcagtttaaaa

SEQ ID NO: 557664 - DNA, 20 bp, Artificial
  CRISPR gRNA sequence
tctagtttcagtttaaaatg

SEQ ID NO: 557665 - DNA, 20 bp, Artificial
  CRISPR gRNA sequence
tagtttcagtttaaaatggt

SEQ ID NO: 557666 - DNA, 20 bp, Artificial
  CRISPR gRNA sequence
gtttcagtttaaaatggtgc

SEQ ID NO: 557667 - DNA, 20 bp, Artificial
  CRISPR gRNA sequence
cagtttaaaatggtgcagga

SEQ ID NO: 557668 - DNA, 20 bp, Artificial
  CRISPR gRNA sequence
agtttaaaatggtgcaggag

SEQ ID NO: 557669 - DNA, 20 bp, Artificial
  CRISPR gRNA sequence
aaaatggtgcaggagctggg

SEQ ID NO: 557670 - DNA, 20 bp, Artificial
  CRISPR gRNA sequence
aaatggtgcaggagctgggt

SEQ ID NO: 557671 - DNA, 20 bp, Artificial
  CRISPR gRNA sequence
ggtgtggtggctcatgagtg

SEQ ID NO: 557672 - DNA, 20 bp, Artificial
  CRISPR gRNA sequence
atgagtgtaatcccagcact

SEQ ID NO: 557673 - DNA, 20 bp, Artificial
  CRISPR gRNA sequence
tgggaggctgaggcgggtgg

SEQ ID NO: 557674 - DNA, 20 bp, Artificial
  CRISPR gRNA sequence
gggaggctgaggcgggtgga

SEQ ID NO: 557675 - DNA, 20 bp, Artificial
  CRISPR gRNA sequence
ggaggctgaggcgggtggat

SEQ ID NO: 557676 - DNA, 20 bp, Artificial
  CRISPR gRNA sequence
aggcgggtggatcacctgag

SEQ ID NO: 557677 - DNA, 20 bp, Artificial
  CRISPR gRNA sequence
agctcaggagtttgagacca

SEQ ID NO: 557678 - DNA, 20 bp, Artificial
  CRISPR gRNA sequence
aggagtttgagaccagcctg

SEQ ID NO: 557679 - DNA, 20 bp, Artificial
  CRISPR gRNA sequence
gagaccagcctggccaacac

SEQ ID NO: 557680 - DNA, 20 bp, Artificial
  CRISPR gRNA sequence
agaccagcctggccaacaca

SEQ ID NO: 557681 - DNA, 20 bp, Artificial
  CRISPR gRNA sequence
gccaacacagtgaaacacca

SEQ ID NO: 557682 - DNA, 20 bp, Artificial
  CRISPR gRNA sequence
tactaaaatacaaaaattag

SEQ ID NO: 557683 - DNA, 20 bp, Artificial
  CRISPR gRNA sequence
ctaaaatacaaaaattagct

SEQ ID NO: 557684 - DNA, 20 bp, Artificial
  CRISPR gRNA sequence
aaatacaaaaattagctggg

SEQ ID NO: 557685 - DNA, 20 bp, Artificial
  CRISPR gRNA sequence
gctgggcatggtggtgcggg

SEQ ID NO: 557686 - DNA, 20 bp, Artificial
  CRISPR gRNA sequence
ggcatggtggtgcgggcctg

SEQ ID NO: 557687 - DNA, 20 bp, Artificial
  CRISPR gRNA sequence
tagtcccagctacttgggag

SEQ ID NO: 557688 - DNA, 20 bp, Artificial
  CRISPR gRNA sequence
cttgggaggctgagacagta

SEQ ID NO: 557689 - DNA, 20 bp, Artificial
  CRISPR gRNA sequence
gggaggctgagacagtaaaa

SEQ ID NO: 557690 - DNA, 20 bp, Artificial
  CRISPR gRNA sequence
ggaggctgagacagtaaaat

SEQ ID NO: 557691 - DNA, 20 bp, Artificial
  CRISPR gRNA sequence
agacagtaaaatcactttga

SEQ ID NO: 557692 - DNA, 20 bp, Artificial
  CRISPR gRNA sequence
tgaacctgggaggcagaggt

SEQ ID NO: 557693 - DNA, 20 bp, Artificial
  CRISPR gRNA sequence
gaacctgggaggcagaggtt

SEQ ID NO: 557694 - DNA, 20 bp, Artificial
  CRISPR gRNA sequence
aacctgggaggcagaggttg

SEQ ID NO: 557695 - DNA, 20 bp, Artificial
  CRISPR gRNA sequence
ggaggcagaggttgcagtca

SEQ ID NO: 557696 - DNA, 20 bp, Artificial
  CRISPR gRNA sequence
cagtcagccaagattgtgcc

SEQ ID NO: 557697 - DNA, 20 bp, Artificial
  CRISPR gRNA sequence
tgccactgcactctggcctt

SEQ ID NO: 557698 - DNA, 20 bp, Artificial
  CRISPR gRNA sequence
cactctggccttggtaacag

SEQ ID NO: 557699 - DNA, 20 bp, Artificial
  CRISPR gRNA sequence
tggccttggtaacagagtga

SEQ ID NO: 557700 - DNA, 20 bp, Artificial
  CRISPR gRNA sequence
gccttggtaacagagtgaga

SEQ ID NO: 557701 - DNA, 20 bp, Artificial
  CRISPR gRNA sequence
ggtaacagagtgagactcct

SEQ ID NO: 557702 - DNA, 20 bp, Artificial
  CRISPR gRNA sequence
gtaacagagtgagactcctt

SEQ ID NO: 557703 - DNA, 20 bp, Artificial
  CRISPR gRNA sequence
cttctcaaaataaataaatt

SEQ ID NO: 557704 - DNA, 20 bp, Artificial
  CRISPR gRNA sequence
ctcaaaataaataaattaat

SEQ ID NO: 557705 - DNA, 20 bp, Artificial
  CRISPR gRNA sequence
tcaaaataaataaattaatt

SEQ ID NO: 557706 - DNA, 20 bp, Artificial
  CRISPR gRNA sequence
aaaataaataaattaattaa

SEQ ID NO: 557707 - DNA, 20 bp, Artificial
  CRISPR gRNA sequence
attaaataaaatggtgcagg

SEQ ID NO: 557708 - DNA, 20 bp, Artificial
  CRISPR gRNA sequence
aataaaatggtgcaggagga

SEQ ID NO: 557709 - DNA, 20 bp, Artificial
  CRISPR gRNA sequence
cccgctgtgtggggaagcag

SEQ ID NO: 557710 - DNA, 20 bp, Artificial
  CRISPR gRNA sequence
tgtggggaagcaggaacttt

SEQ ID NO: 557711 - DNA, 20 bp, Artificial
  CRISPR gRNA sequence
tatagagtaacatctatcag

SEQ ID NO: 557712 - DNA, 20 bp, Artificial
  CRISPR gRNA sequence
atagagtaacatctatcagt

SEQ ID NO: 557713 - DNA, 20 bp, Artificial
  CRISPR gRNA sequence
tagagtaacatctatcagtg

SEQ ID NO: 557714 - DNA, 20 bp, Artificial
  CRISPR gRNA sequence
tcagtggagcccaaagagtt

SEQ ID NO: 557715 - DNA, 20 bp, Artificial
  CRISPR gRNA sequence
taagctaactgctgtcacta

SEQ ID NO: 557716 - DNA, 20 bp, Artificial
  CRISPR gRNA sequence
agctaactgctgtcactaca

SEQ ID NO: 557717 - DNA, 20 bp, Artificial
  CRISPR gRNA sequence
actgctgtcactacatctct

SEQ ID NO: 557718 - DNA, 20 bp, Artificial
  CRISPR gRNA sequence
ctgtcactacatctctttcc

SEQ ID NO: 557719 - DNA, 20 bp, Artificial
  CRISPR gRNA sequence
tcactacatctctttccaaa

SEQ ID NO: 557720 - DNA, 20 bp, Artificial
  CRISPR gRNA sequence
catctctttccaaaacattc

SEQ ID NO: 557721 - DNA, 20 bp, Artificial
  CRISPR gRNA sequence
tttccaaaacattcctagta

SEQ ID NO: 557722 - DNA, 20 bp, Artificial
  CRISPR gRNA sequence
tccaaaacattcctagtaag

SEQ ID NO: 557723 - DNA, 20 bp, Artificial
  CRISPR gRNA sequence
ccaaaacattcctagtaaga

SEQ ID NO: 557724 - DNA, 20 bp, Artificial
  CRISPR gRNA sequence
caaaacattcctagtaagac

SEQ ID NO: 557725 - DNA, 20 bp, Artificial
  CRISPR gRNA sequence
ctagtaagacaactgatact

SEQ ID NO: 557726 - DNA, 20 bp, Artificial
  CRISPR gRNA sequence
gtaagacaactgatactgtt

SEQ ID NO: 557727 - DNA, 20 bp, Artificial
  CRISPR gRNA sequence
atactgttctccccaccttg

SEQ ID NO: 557728 - DNA, 20 bp, Artificial
  CRISPR gRNA sequence
ttctccccaccttggttaga

SEQ ID NO: 557729 - DNA, 20 bp, Artificial
  CRISPR gRNA sequence
tccccaccttggttagattc

SEQ ID NO: 557730 - DNA, 20 bp, Artificial
  CRISPR gRNA sequence
cccaccttggttagattctc

SEQ ID NO: 557731 - DNA, 20 bp, Artificial
  CRISPR gRNA sequence
ggttagattctctcctcacc

SEQ ID NO: 557732 - DNA, 20 bp, Artificial
  CRISPR gRNA sequence
gttagattctctcctcaccc

SEQ ID NO: 557733 - DNA, 20 bp, Artificial
  CRISPR gRNA sequence
gattctctcctcacccagag

SEQ ID NO: 557734 - DNA, 20 bp, Artificial
  CRISPR gRNA sequence
tctcctcacccagaggaatg

SEQ ID NO: 557735 - DNA, 20 bp, Artificial
  CRISPR gRNA sequence
tcctcacccagaggaatgac

SEQ ID NO: 557736 - DNA, 20 bp, Artificial
  CRISPR gRNA sequence
ctcacccagaggaatgacaa

SEQ ID NO: 557737 - DNA, 20 bp, Artificial
  CRISPR gRNA sequence
acccagaggaatgacaaagg

SEQ ID NO: 557738 - DNA, 20 bp, Artificial
  CRISPR gRNA sequence
aaagtagctagctcctctat

SEQ ID NO: 557739 - DNA, 20 bp, Artificial
  CRISPR gRNA sequence
gctcctctataccagaaaag

SEQ ID NO: 557740 - DNA, 20 bp, Artificial
  CRISPR gRNA sequence
ctctataccagaaaaggaga

SEQ ID NO: 557741 - DNA, 20 bp, Artificial
  CRISPR gRNA sequence
tataccagaaaaggagaaaa

SEQ ID NO: 557742 - DNA, 20 bp, Artificial
  CRISPR gRNA sequence
taccagaaaaggagaaaacc

SEQ ID NO: 557743 - DNA, 20 bp, Artificial
  CRISPR gRNA sequence
acaacaggtaacatctaatt

SEQ ID NO: 557744 - DNA, 20 bp, Artificial
  CRISPR gRNA sequence
attcttttctcatagaccat

SEQ ID NO: 557745 - DNA, 20 bp, Artificial
  CRISPR gRNA sequence
ttttctcatagaccattaat

SEQ ID NO: 557746 - DNA, 20 bp, Artificial
  CRISPR gRNA sequence
ttctcatagaccattaattt

SEQ ID NO: 557747 - DNA, 20 bp, Artificial
  CRISPR gRNA sequence
tctcatagaccattaatttg

SEQ ID NO: 557748 - DNA, 20 bp, Artificial
  CRISPR gRNA sequence
ctcatagaccattaatttgt

SEQ ID NO: 557749 - DNA, 20 bp, Artificial
  CRISPR gRNA sequence
tcatagaccattaatttgtg

SEQ ID NO: 557750 - DNA, 20 bp, Artificial
  CRISPR gRNA sequence
atagaccattaatttgtgct

SEQ ID NO: 557751 - DNA, 20 bp, Artificial
  CRISPR gRNA sequence
atttgtgctagtctctgaaa

SEQ ID NO: 557752 - DNA, 20 bp, Artificial
  CRISPR gRNA sequence
gtgctagtctctgaaaacag

SEQ ID NO: 557753 - DNA, 20 bp, Artificial
  CRISPR gRNA sequence
tgctagtctctgaaaacaga

SEQ ID NO: 557754 - DNA, 20 bp, Artificial
  CRISPR gRNA sequence
gtctctgaaaacagactaaa

SEQ ID NO: 557755 - DNA, 20 bp, Artificial
  CRISPR gRNA sequence
tgaaaacagactaaaaaaat

SEQ ID NO: 557756 - DNA, 20 bp, Artificial
  CRISPR gRNA sequence
aaaacagactaaaaaaatgg

SEQ ID NO: 557757 - DNA, 20 bp, Artificial
  CRISPR gRNA sequence
aaaaaatggaaatttgccat

SEQ ID NO: 557758 - DNA, 20 bp, Artificial
  CRISPR gRNA sequence
gccattttaaacaaatcaac

SEQ ID NO: 557759 - DNA, 20 bp, Artificial
  CRISPR gRNA sequence
ccattttaaacaaatcaact

SEQ ID NO: 557760 - DNA, 20 bp, Artificial
  CRISPR gRNA sequence
taaacaaatcaacttatgga

SEQ ID NO: 557761 - DNA, 20 bp, Artificial
  CRISPR gRNA sequence
aaacaaatcaacttatggaa

SEQ ID NO: 557762 - DNA, 20 bp, Artificial
  CRISPR gRNA sequence
aacaaatcaacttatggaat

SEQ ID NO: 557763 - DNA, 20 bp, Artificial
  CRISPR gRNA sequence
atggaatactcaccaagcac

SEQ ID NO: 557764 - DNA, 20 bp, Artificial
  CRISPR gRNA sequence
tggaatactcaccaagcaca

SEQ ID NO: 557765 - DNA, 20 bp, Artificial
  CRISPR gRNA sequence
accaagcacataaagaaaga

SEQ ID NO: 557766 - DNA, 20 bp, Artificial
  CRISPR gRNA sequence
catggtatcagtaatatttg

SEQ ID NO: 557767 - DNA, 20 bp, Artificial
  CRISPR gRNA sequence
atggtatcagtaatatttgg

SEQ ID NO: 557768 - DNA, 20 bp, Artificial
  CRISPR gRNA sequence
ggcgattccatttcatactc

SEQ ID NO: 557769 - DNA, 20 bp, Artificial
  CRISPR gRNA sequence
gcgattccatttcatactca

SEQ ID NO: 557770 - DNA, 20 bp, Artificial
  CRISPR gRNA sequence
catttcatactcatcttcat

SEQ ID NO: 557771 - DNA, 20 bp, Artificial
  CRISPR gRNA sequence
catactcatcttcatctgat

SEQ ID NO: 557772 - DNA, 20 bp, Artificial
  CRISPR gRNA sequence
atactcatcttcatctgatg

SEQ ID NO: 557773 - DNA, 20 bp, Artificial
  CRISPR gRNA sequence
atcttcatctgatgatgtta

SEQ ID NO: 557774 - DNA, 20 bp, Artificial
  CRISPR gRNA sequence
catctgatgatgttaagttg

SEQ ID NO: 557775 - DNA, 20 bp, Artificial
  CRISPR gRNA sequence
atctgatgatgttaagttgt

SEQ ID NO: 557776 - DNA, 20 bp, Artificial
  CRISPR gRNA sequence
atgatgttaagttgtagata

SEQ ID NO: 557777 - DNA, 20 bp, Artificial
  CRISPR gRNA sequence
agttgtagatagtgaggcta

SEQ ID NO: 557778 - DNA, 20 bp, Artificial
  CRISPR gRNA sequence
tagatagtgaggctacctga

SEQ ID NO: 557779 - DNA, 20 bp, Artificial
  CRISPR gRNA sequence
cctgacacagtgtctaaata

SEQ ID NO: 557780 - DNA, 20 bp, Artificial
  CRISPR gRNA sequence
acacagtgtctaaataaacc

SEQ ID NO: 557781 - DNA, 20 bp, Artificial
  CRISPR gRNA sequence
aataaaccctatttttaaaa

SEQ ID NO: 557782 - DNA, 20 bp, Artificial
  CRISPR gRNA sequence
tttttaaaagatgagaaagc

SEQ ID NO: 557783 - DNA, 20 bp, Artificial
  CRISPR gRNA sequence
ttaaaagatgagaaagctct

SEQ ID NO: 557784 - DNA, 20 bp, Artificial
  CRISPR gRNA sequence
taaaagatgagaaagctctg

SEQ ID NO: 557785 - DNA, 20 bp, Artificial
  CRISPR gRNA sequence
aaaagatgagaaagctctga

SEQ ID NO: 557786 - DNA, 20 bp, Artificial
  CRISPR gRNA sequence
aaagatgagaaagctctgaa

SEQ ID NO: 557787 - DNA, 20 bp, Artificial
  CRISPR gRNA sequence
tgaattcagaattttccagt

SEQ ID NO: 557788 - DNA, 20 bp, Artificial
  CRISPR gRNA sequence
aattcagaattttccagttc

SEQ ID NO: 557789 - DNA, 20 bp, Artificial
  CRISPR gRNA sequence
agaattttccagttctgcaa

SEQ ID NO: 557790 - DNA, 20 bp, Artificial
  CRISPR gRNA sequence
tccagttctgcaactttatc

SEQ ID NO: 557791 - DNA, 20 bp, Artificial
  CRISPR gRNA sequence
ccagttctgcaactttatcc

SEQ ID NO: 557792 - DNA, 20 bp, Artificial
  CRISPR gRNA sequence
cagttctgcaactttatcct

SEQ ID NO: 557793 - DNA, 20 bp, Artificial
  CRISPR gRNA sequence
tgcaactttatccttttgtt

SEQ ID NO: 557794 - DNA, 20 bp, Artificial
  CRISPR gRNA sequence
caactttatccttttgtttt

SEQ ID NO: 557795 - DNA, 20 bp, Artificial
  CRISPR gRNA sequence
tatccttttgttttttccat

SEQ ID NO: 557796 - DNA, 20 bp, Artificial
  CRISPR gRNA sequence
atccttttgttttttccata

SEQ ID NO: 557797 - DNA, 20 bp, Artificial
  CRISPR gRNA sequence
tccttttgttttttccatag

SEQ ID NO: 557798 - DNA, 20 bp, Artificial
  CRISPR gRNA sequence
ttgttttttccataggacct

SEQ ID NO: 557799 - DNA, 20 bp, Artificial
  CRISPR gRNA sequence
tgttttttccataggacctc

SEQ ID NO: 557800 - DNA, 20 bp, Artificial
  CRISPR gRNA sequence
gttttttccataggacctct

SEQ ID NO: 557801 - DNA, 20 bp, Artificial
  CRISPR gRNA sequence
ttttttccataggacctctt

SEQ ID NO: 557802 - DNA, 20 bp, Artificial
  CRISPR gRNA sequence
tttccataggacctctttta

SEQ ID NO: 557803 - DNA, 20 bp, Artificial
  CRISPR gRNA sequence
ttccataggacctcttttaa

SEQ ID NO: 557804 - DNA, 20 bp, Artificial
  CRISPR gRNA sequence
tccataggacctcttttaaa

SEQ ID NO: 557805 - DNA, 20 bp, Artificial
  CRISPR gRNA sequence
ccataggacctcttttaaag

SEQ ID NO: 557806 - DNA, 20 bp, Artificial
  CRISPR gRNA sequence
cataggacctcttttaaagg

SEQ ID NO: 557807 - DNA, 20 bp, Artificial
  CRISPR gRNA sequence
ttttaaaggcacattgcttg

SEQ ID NO: 557808 - DNA, 20 bp, Artificial
  CRISPR gRNA sequence
ttaaaggcacattgcttggt

SEQ ID NO: 557809 - DNA, 20 bp, Artificial
  CRISPR gRNA sequence
taaaggcacattgcttggta

SEQ ID NO: 557810 - DNA, 20 bp, Artificial
  CRISPR gRNA sequence
aaaggcacattgcttggtac

SEQ ID NO: 557811 - DNA, 20 bp, Artificial
  CRISPR gRNA sequence
aaggcacattgcttggtaca

SEQ ID NO: 557812 - DNA, 20 bp, Artificial
  CRISPR gRNA sequence
cttggtacatggaaagttac

SEQ ID NO: 557813 - DNA, 20 bp, Artificial
  CRISPR gRNA sequence
ggtacatggaaagttacatt

SEQ ID NO: 557814 - DNA, 20 bp, Artificial
  CRISPR gRNA sequence
gtacatggaaagttacattc

SEQ ID NO: 557815 - DNA, 20 bp, Artificial
  CRISPR gRNA sequence
cattcccatacacaacacca

SEQ ID NO: 557816 - DNA, 20 bp, Artificial
  CRISPR gRNA sequence
ccatacacaacaccatatat

SEQ ID NO: 557817 - DNA, 20 bp, Artificial
  CRISPR gRNA sequence
gttgggaaaaacagctgatg

SEQ ID NO: 557818 - DNA, 20 bp, Artificial
  CRISPR gRNA sequence
ttgggaaaaacagctgatga

SEQ ID NO: 557819 - DNA, 20 bp, Artificial
  CRISPR gRNA sequence
ggaaaaacagctgatgaaac

SEQ ID NO: 557820 - DNA, 20 bp, Artificial
  CRISPR gRNA sequence
atgaaacctaggagagaaaa

SEQ ID NO: 557821 - DNA, 20 bp, Artificial
  CRISPR gRNA sequence
ggagagaaaaaaaaattggt

SEQ ID NO: 557822 - DNA, 20 bp, Artificial
  CRISPR gRNA sequence
gttagaaaaaacaacatgac

SEQ ID NO: 557823 - DNA, 20 bp, Artificial
  CRISPR gRNA sequence
gaaaaaacaacatgactttg

SEQ ID NO: 557824 - DNA, 20 bp, Artificial
  CRISPR gRNA sequence
tggtggcagaaattattcat

SEQ ID NO: 557825 - DNA, 20 bp, Artificial
  CRISPR gRNA sequence
ggtggcagaaattattcatc

SEQ ID NO: 557826 - DNA, 20 bp, Artificial
  CRISPR gRNA sequence
gtggcagaaattattcatca

SEQ ID NO: 557827 - DNA, 20 bp, Artificial
  CRISPR gRNA sequence
ttcatcaggtactttttgtg

SEQ ID NO: 557828 - DNA, 20 bp, Artificial
  CRISPR gRNA sequence
atcaggtactttttgtgcta

SEQ ID NO: 557829 - DNA, 20 bp, Artificial
  CRISPR gRNA sequence
tttgtgctaagctgacaaac

SEQ ID NO: 557830 - DNA, 20 bp, Artificial
  CRISPR gRNA sequence
ttgtgctaagctgacaaact

SEQ ID NO: 557831 - DNA, 20 bp, Artificial
  CRISPR gRNA sequence
tgtgctaagctgacaaactg

SEQ ID NO: 557832 - DNA, 20 bp, Artificial
  CRISPR gRNA sequence
gtgctaagctgacaaactgc

SEQ ID NO: 557833 - DNA, 20 bp, Artificial
  CRISPR gRNA sequence
tgctaagctgacaaactgct

SEQ ID NO: 557834 - DNA, 20 bp, Artificial
  CRISPR gRNA sequence
agctgacaaactgctgacac

SEQ ID NO: 557835 - DNA, 20 bp, Artificial
  CRISPR gRNA sequence
acaaactgctgacacaaaat

SEQ ID NO: 557836 - DNA, 20 bp, Artificial
  CRISPR gRNA sequence
ctgacacaaaatacaggaag

SEQ ID NO: 557837 - DNA, 20 bp, Artificial
  CRISPR gRNA sequence
acacaaaatacaggaagtaa

SEQ ID NO: 557838 - DNA, 20 bp, Artificial
  CRISPR gRNA sequence
gaccatgtggagcttactct

SEQ ID NO: 557839 - DNA, 20 bp, Artificial
  CRISPR gRNA sequence
accatgtggagcttactctt

SEQ ID NO: 557840 - DNA, 20 bp, Artificial
  CRISPR gRNA sequence
actctttaatagaaaactgg

SEQ ID NO: 557841 - DNA, 20 bp, Artificial
  CRISPR gRNA sequence
ctctttaatagaaaactggg

SEQ ID NO: 557842 - DNA, 20 bp, Artificial
  CRISPR gRNA sequence
tttaatagaaaactgggacc

SEQ ID NO: 557843 - DNA, 20 bp, Artificial
  CRISPR gRNA sequence
taatagaaaactgggacctg

SEQ ID NO: 557844 - DNA, 20 bp, Artificial
  CRISPR gRNA sequence
aatagaaaactgggacctgc

SEQ ID NO: 557845 - DNA, 20 bp, Artificial
  CRISPR gRNA sequence
atagaaaactgggacctgca

SEQ ID NO: 557846 - DNA, 20 bp, Artificial
  CRISPR gRNA sequence
ggacctgcataaatccaaga

SEQ ID NO: 557847 - DNA, 20 bp, Artificial
  CRISPR gRNA sequence
cataaatccaagaaatggac

SEQ ID NO: 557848 - DNA, 20 bp, Artificial
  CRISPR gRNA sequence
atggagcaccaaccatctgc

SEQ ID NO: 557849 - DNA, 20 bp, Artificial
  CRISPR gRNA sequence
ccaggtagtacgggctgggc

SEQ ID NO: 557850 - DNA, 20 bp, Artificial
  CRISPR gRNA sequence
ggctgggaatatggggttgt

SEQ ID NO: 557851 - DNA, 20 bp, Artificial
  CRISPR gRNA sequence
ggaatatggggttgttccag

SEQ ID NO: 557852 - DNA, 20 bp, Artificial
  CRISPR gRNA sequence
ttccaggccctccaggagcc

SEQ ID NO: 557853 - DNA, 20 bp, Artificial
  CRISPR gRNA sequence
caggccctccaggagcctca

SEQ ID NO: 557854 - DNA, 20 bp, Artificial
  CRISPR gRNA sequence
caggagcctcacgtgtggag

SEQ ID NO: 557855 - DNA, 20 bp, Artificial
  CRISPR gRNA sequence
acgtgtggagaagacaggga

SEQ ID NO: 557856 - DNA, 20 bp, Artificial
  CRISPR gRNA sequence
tacatcaggggctgcatgag

SEQ ID NO: 557857 - DNA, 20 bp, Artificial
  CRISPR gRNA sequence
catcaggggctgcatgaggg

SEQ ID NO: 557858 - DNA, 20 bp, Artificial
  CRISPR gRNA sequence
catgaggggagctgcctggt

SEQ ID NO: 557859 - DNA, 20 bp, Artificial
  CRISPR gRNA sequence
cctggtctagggcctcccca

SEQ ID NO: 557860 - DNA, 20 bp, Artificial
  CRISPR gRNA sequence
gtctagggcctccccaagga

SEQ ID NO: 557861 - DNA, 20 bp, Artificial
  CRISPR gRNA sequence
gggcctccccaaggaagtca

SEQ ID NO: 557862 - DNA, 20 bp, Artificial
  CRISPR gRNA sequence
cccaaggaagtcatgctgga

SEQ ID NO: 557863 - DNA, 20 bp, Artificial
  CRISPR gRNA sequence
gaactgacataacgtgcaaa

SEQ ID NO: 557864 - DNA, 20 bp, Artificial
  CRISPR gRNA sequence
acataacgtgcaaatcactg

SEQ ID NO: 557865 - DNA, 20 bp, Artificial
  CRISPR gRNA sequence
aaggataaaaggcagttagg

SEQ ID NO: 557866 - DNA, 20 bp, Artificial
  CRISPR gRNA sequence
ggccgcagggctgggtaggt

SEQ ID NO: 557867 - DNA, 20 bp, Artificial
  CRISPR gRNA sequence
ggtaggtgagtgggtgggga

SEQ ID NO: 557868 - DNA, 20 bp, Artificial
  CRISPR gRNA sequence
aatggagaaagagcatggtg

SEQ ID NO: 557869 - DNA, 20 bp, Artificial
  CRISPR gRNA sequence
gaggatacacacgtgattcc

SEQ ID NO: 557870 - DNA, 20 bp, Artificial
  CRISPR gRNA sequence
aggatacacacgtgattcct

SEQ ID NO: 557871 - DNA, 20 bp, Artificial
  CRISPR gRNA sequence
ctaacagctagaatgaggag

SEQ ID NO: 557872 - DNA, 20 bp, Artificial
  CRISPR gRNA sequence
acagctagaatgaggagggc

SEQ ID NO: 557873 - DNA, 20 bp, Artificial
  CRISPR gRNA sequence
gaatgaggagggcaaggggt

SEQ ID NO: 557874 - DNA, 20 bp, Artificial
  CRISPR gRNA sequence
gtggggaacaagacagacaa

SEQ ID NO: 557875 - DNA, 20 bp, Artificial
  CRISPR gRNA sequence
tgtgtgctaaagtaaggaac

SEQ ID NO: 557876 - DNA, 20 bp, Artificial
  CRISPR gRNA sequence
aagtaaggaacgctaagggt

SEQ ID NO: 557877 - DNA, 20 bp, Artificial
  CRISPR gRNA sequence
agggtttggactgatcctaa

SEQ ID NO: 557878 - DNA, 20 bp, Artificial
  CRISPR gRNA sequence
ggactgatcctaatggagag

SEQ ID NO: 557879 - DNA, 20 bp, Artificial
  CRISPR gRNA sequence
gactgatcctaatggagagg

SEQ ID NO: 557880 - DNA, 20 bp, Artificial
  CRISPR gRNA sequence
atcctaatggagaggaagcc

SEQ ID NO: 557881 - DNA, 20 bp, Artificial
  CRISPR gRNA sequence
atggagaggaagccacagaa

SEQ ID NO: 557882 - DNA, 20 bp, Artificial
  CRISPR gRNA sequence
ttaacaagactggcctaaca

SEQ ID NO: 557883 - DNA, 20 bp, Artificial
  CRISPR gRNA sequence
taacaagactggcctaacat

SEQ ID NO: 557884 - DNA, 20 bp, Artificial
  CRISPR gRNA sequence
aacaagactggcctaacata

SEQ ID NO: 557885 - DNA, 20 bp, Artificial
  CRISPR gRNA sequence
acaagactggcctaacataa

SEQ ID NO: 557886 - DNA, 20 bp, Artificial
  CRISPR gRNA sequence
gcctaacataatttaagtgt

SEQ ID NO: 557887 - DNA, 20 bp, Artificial
  CRISPR gRNA sequence
acataatttaagtgtcagca

SEQ ID NO: 557888 - DNA, 20 bp, Artificial
  CRISPR gRNA sequence
aagtgtcagcaggctgactg

SEQ ID NO: 557889 - DNA, 20 bp, Artificial
  CRISPR gRNA sequence
agtgtcagcaggctgactgt

SEQ ID NO: 557890 - DNA, 20 bp, Artificial
  CRISPR gRNA sequence
actgtctttagagtagagag

SEQ ID NO: 557891 - DNA, 20 bp, Artificial
  CRISPR gRNA sequence
tctttagagtagagagcggc

SEQ ID NO: 557892 - DNA, 20 bp, Artificial
  CRISPR gRNA sequence
tagagtagagagcggctgac

SEQ ID NO: 557893 - DNA, 20 bp, Artificial
  CRISPR gRNA sequence
agagtagagagcggctgaca

SEQ ID NO: 557894 - DNA, 20 bp, Artificial
  CRISPR gRNA sequence
gagtagagagcggctgacag

SEQ ID NO: 557895 - DNA, 20 bp, Artificial
  CRISPR gRNA sequence
acaggggccagcacagaggc

SEQ ID NO: 557896 - DNA, 20 bp, Artificial
  CRISPR gRNA sequence
taatgaaagtcaatgctgta

SEQ ID NO: 557897 - DNA, 20 bp, Artificial
  CRISPR gRNA sequence
tagcaatgaagtccatggac

SEQ ID NO: 557898 - DNA, 20 bp, Artificial
  CRISPR gRNA sequence
gtagtggggacagacaagcg

SEQ ID NO: 557899 - DNA, 20 bp, Artificial
  CRISPR gRNA sequence
tagtggggacagacaagcgg

SEQ ID NO: 557900 - DNA, 20 bp, Artificial
  CRISPR gRNA sequence
aggagatgctggagagagaa

SEQ ID NO: 557901 - DNA, 20 bp, Artificial
  CRISPR gRNA sequence
gagagagaagtcaacaggat

SEQ ID NO: 557902 - DNA, 20 bp, Artificial
  CRISPR gRNA sequence
agtgatgagggtgggggaag

SEQ ID NO: 557903 - DNA, 20 bp, Artificial
  CRISPR gRNA sequence
tcaggtctccttggctgact

SEQ ID NO: 557904 - DNA, 20 bp, Artificial
  CRISPR gRNA sequence
cttggctgactgagaggcat

SEQ ID NO: 557905 - DNA, 20 bp, Artificial
  CRISPR gRNA sequence
ggctgactgagaggcatcat

SEQ ID NO: 557906 - DNA, 20 bp, Artificial
  CRISPR gRNA sequence
gctgactgagaggcatcatt

SEQ ID NO: 557907 - DNA, 20 bp, Artificial
  CRISPR gRNA sequence
actgagaggcatcattaact

SEQ ID NO: 557908 - DNA, 20 bp, Artificial
  CRISPR gRNA sequence
agaggcatcattaactgaga

SEQ ID NO: 557909 - DNA, 20 bp, Artificial
  CRISPR gRNA sequence
actgagatcagaaacaatgg

SEQ ID NO: 557910 - DNA, 20 bp, Artificial
  CRISPR gRNA sequence
agatcagaaacaatggctgg

SEQ ID NO: 557911 - DNA, 20 bp, Artificial
  CRISPR gRNA sequence
ggaagcaagtcgagggtgtg

SEQ ID NO: 557912 - DNA, 20 bp, Artificial
  CRISPR gRNA sequence
agaactcagggattgggtgc

SEQ ID NO: 557913 - DNA, 20 bp, Artificial
  CRISPR gRNA sequence
agggattgggtgcagtggtg

SEQ ID NO: 557914 - DNA, 20 bp, Artificial
  CRISPR gRNA sequence
ggtgcagtggtgggttggag

SEQ ID NO: 557915 - DNA, 20 bp, Artificial
  CRISPR gRNA sequence
gagccaggtccacctgccct

SEQ ID NO: 557916 - DNA, 20 bp, Artificial
  CRISPR gRNA sequence
ccctcatgagccaattgtta

SEQ ID NO: 557917 - DNA, 20 bp, Artificial
  CRISPR gRNA sequence
atgagccaattgttagcatc

SEQ ID NO: 557918 - DNA, 20 bp, Artificial
  CRISPR gRNA sequence
ttagcatctctgcccagccc

SEQ ID NO: 557919 - DNA, 20 bp, Artificial
  CRISPR gRNA sequence
gcatctctgcccagccctat

SEQ ID NO: 557920 - DNA, 20 bp, Artificial
  CRISPR gRNA sequence
tgcccagccctattagggaa

SEQ ID NO: 557921 - DNA, 20 bp, Artificial
  CRISPR gRNA sequence
cccagccctattagggaaca

SEQ ID NO: 557922 - DNA, 20 bp, Artificial
  CRISPR gRNA sequence
ttagggaacatctagtaaca

SEQ ID NO: 557923 - DNA, 20 bp, Artificial
  CRISPR gRNA sequence
gggaacatctagtaacagca

SEQ ID NO: 557924 - DNA, 20 bp, Artificial
  CRISPR gRNA sequence
gtaacagcacagaaactgac

SEQ ID NO: 557925 - DNA, 20 bp, Artificial
  CRISPR gRNA sequence
actaatgcttcacatcagaa

SEQ ID NO: 557926 - DNA, 20 bp, Artificial
  CRISPR gRNA sequence
atgcttcacatcagaacctc

SEQ ID NO: 557927 - DNA, 20 bp, Artificial
  CRISPR gRNA sequence
cacatcagaacctccatacc

SEQ ID NO: 557928 - DNA, 20 bp, Artificial
  CRISPR gRNA sequence
acatcagaacctccatacca

SEQ ID NO: 557929 - DNA, 20 bp, Artificial
  CRISPR gRNA sequence
cataccaacctagttgttaa

SEQ ID NO: 557930 - DNA, 20 bp, Artificial
  CRISPR gRNA sequence
gttgttaaacatttattaga

SEQ ID NO: 557931 - DNA, 20 bp, Artificial
  CRISPR gRNA sequence
ttaaacatttattagaacca

SEQ ID NO: 557932 - DNA, 20 bp, Artificial
  CRISPR gRNA sequence
aacatttattagaaccacaa

SEQ ID NO: 557933 - DNA, 20 bp, Artificial
  CRISPR gRNA sequence
attagaaccacaagattggg

SEQ ID NO: 557934 - DNA, 20 bp, Artificial
  CRISPR gRNA sequence
ttagaaccacaagattggga

SEQ ID NO: 557935 - DNA, 20 bp, Artificial
  CRISPR gRNA sequence
gaaccacaagattgggatat

SEQ ID NO: 557936 - DNA, 20 bp, Artificial
  CRISPR gRNA sequence
ggatatttttgataccccaa

SEQ ID NO: 557937 - DNA, 20 bp, Artificial
  CRISPR gRNA sequence
ttgataccccaaagtgggtt

SEQ ID NO: 557938 - DNA, 20 bp, Artificial
  CRISPR gRNA sequence
tgataccccaaagtgggttt

SEQ ID NO: 557939 - DNA, 20 bp, Artificial
  CRISPR gRNA sequence
gataccccaaagtgggttta

SEQ ID NO: 557940 - DNA, 20 bp, Artificial
  CRISPR gRNA sequence
ataccccaaagtgggtttaa

SEQ ID NO: 557941 - DNA, 20 bp, Artificial
  CRISPR gRNA sequence
aaatgcatcttgctctagga

SEQ ID NO: 557942 - DNA, 20 bp, Artificial
  CRISPR gRNA sequence
aatgcatcttgctctaggac

SEQ ID NO: 557943 - DNA, 20 bp, Artificial
  CRISPR gRNA sequence
gctctaggacttgtctcttg

SEQ ID NO: 557944 - DNA, 20 bp, Artificial
  CRISPR gRNA sequence
ctctaggacttgtctcttgt

SEQ ID NO: 557945 - DNA, 20 bp, Artificial
  CRISPR gRNA sequence
taggacttgtctcttgttaa

SEQ ID NO: 557946 - DNA, 20 bp, Artificial
  CRISPR gRNA sequence
ggacttgtctcttgttaaga

SEQ ID NO: 557947 - DNA, 20 bp, Artificial
  CRISPR gRNA sequence
gtctcttgttaagagagaac

SEQ ID NO: 557948 - DNA, 20 bp, Artificial
  CRISPR gRNA sequence
tctcttgttaagagagaaca

SEQ ID NO: 557949 - DNA, 20 bp, Artificial
  CRISPR gRNA sequence
ttgttaagagagaacagcag

SEQ ID NO: 557950 - DNA, 20 bp, Artificial
  CRISPR gRNA sequence
gttaagagagaacagcagct

SEQ ID NO: 557951 - DNA, 20 bp, Artificial
  CRISPR gRNA sequence
ttaagagagaacagcagctg

SEQ ID NO: 557952 - DNA, 20 bp, Artificial
  CRISPR gRNA sequence
agagagaacagcagctgggt

SEQ ID NO: 557953 - DNA, 20 bp, Artificial
  CRISPR gRNA sequence
ggtcctgtggttcatgcctg

SEQ ID NO: 557954 - DNA, 20 bp, Artificial
  CRISPR gRNA sequence
tggttcatgcctgtaagtcc

SEQ ID NO: 557955 - DNA, 20 bp, Artificial
  CRISPR gRNA sequence
atgcctgtaagtccagcatt

SEQ ID NO: 557956 - DNA, 20 bp, Artificial
  CRISPR gRNA sequence
taagtccagcattttgggag

SEQ ID NO: 557957 - DNA, 20 bp, Artificial
  CRISPR gRNA sequence
tgggaggccaaggtggttgg

SEQ ID NO: 557958 - DNA, 20 bp, Artificial
  CRISPR gRNA sequence
gggaggccaaggtggttgga

SEQ ID NO: 557959 - DNA, 20 bp, Artificial
  CRISPR gRNA sequence
ggaggccaaggtggttggat

SEQ ID NO: 557960 - DNA, 20 bp, Artificial
  CRISPR gRNA sequence
gattgcttgagttcaggagt

SEQ ID NO: 557961 - DNA, 20 bp, Artificial
  CRISPR gRNA sequence
cttgagttcaggagttcaag

SEQ ID NO: 557962 - DNA, 20 bp, Artificial
  CRISPR gRNA sequence
gagttcaggagttcaagacc

SEQ ID NO: 557963 - DNA, 20 bp, Artificial
  CRISPR gRNA sequence
agttcaggagttcaagacca

SEQ ID NO: 557964 - DNA, 20 bp, Artificial
  CRISPR gRNA sequence
aggagttcaagaccaacctg

SEQ ID NO: 557965 - DNA, 20 bp, Artificial
  CRISPR gRNA sequence
aagaccaacctgggtaaaat

SEQ ID NO: 557966 - DNA, 20 bp, Artificial
  CRISPR gRNA sequence
ggtaaaatggcgaaacccca

SEQ ID NO: 557967 - DNA, 20 bp, Artificial
  CRISPR gRNA sequence
tacgaaaagtacaaaaaatt

SEQ ID NO: 557968 - DNA, 20 bp, Artificial
  CRISPR gRNA sequence
acgaaaagtacaaaaaatta

SEQ ID NO: 557969 - DNA, 20 bp, Artificial
  CRISPR gRNA sequence
cgaaaagtacaaaaaattag

SEQ ID NO: 557970 - DNA, 20 bp, Artificial
  CRISPR gRNA sequence
gctgggcatggcacacacct

SEQ ID NO: 557971 - DNA, 20 bp, Artificial
  CRISPR gRNA sequence
ggcatggcacacacctgtgg

SEQ ID NO: 557972 - DNA, 20 bp, Artificial
  CRISPR gRNA sequence
tggtccccagctacttggga

SEQ ID NO: 557973 - DNA, 20 bp, Artificial
  CRISPR gRNA sequence
cttgggaggctgaagaggat

SEQ ID NO: 557974 - DNA, 20 bp, Artificial
  CRISPR gRNA sequence
gggaggctgaagaggattac

SEQ ID NO: 557975 - DNA, 20 bp, Artificial
  CRISPR gRNA sequence
ggaggctgaagaggattact

SEQ ID NO: 557976 - DNA, 20 bp, Artificial
  CRISPR gRNA sequence
aagaggattacttgaagcca

SEQ ID NO: 557977 - DNA, 20 bp, Artificial
  CRISPR gRNA sequence
cttgaagccatgaggcagag

SEQ ID NO: 557978 - DNA, 20 bp, Artificial
  CRISPR gRNA sequence
gaagccatgaggcagagatt

SEQ ID NO: 557979 - DNA, 20 bp, Artificial
  CRISPR gRNA sequence
aagccatgaggcagagattg

SEQ ID NO: 557980 - DNA, 20 bp, Artificial
  CRISPR gRNA sequence
cagtcagccatgattgtgcc

SEQ ID NO: 557981 - DNA, 20 bp, Artificial
  CRISPR gRNA sequence
tgccactgcactccagcctg

SEQ ID NO: 557982 - DNA, 20 bp, Artificial
  CRISPR gRNA sequence
cactccagcctgggtgacag

SEQ ID NO: 557983 - DNA, 20 bp, Artificial
  CRISPR gRNA sequence
cagcctgggtgacagagcat

SEQ ID NO: 557984 - DNA, 20 bp, Artificial
  CRISPR gRNA sequence
ggtgacagagcatgacctgt

SEQ ID NO: 557985 - DNA, 20 bp, Artificial
  CRISPR gRNA sequence
tctcaacaaacaaacaaaaa

SEQ ID NO: 557986 - DNA, 20 bp, Artificial
  CRISPR gRNA sequence
aacaaacaaacaaaaaactg

SEQ ID NO: 557987 - DNA, 20 bp, Artificial
  CRISPR gRNA sequence
cagctattttaagttaacat

SEQ ID NO: 557988 - DNA, 20 bp, Artificial
  CRISPR gRNA sequence
ttttaagttaacattaaaga

SEQ ID NO: 557989 - DNA, 20 bp, Artificial
  CRISPR gRNA sequence
taagttaacattaaagagca

SEQ ID NO: 557990 - DNA, 20 bp, Artificial
  CRISPR gRNA sequence
aagttaacattaaagagcaa

SEQ ID NO: 557991 - DNA, 20 bp, Artificial
  CRISPR gRNA sequence
agttaacattaaagagcaat

SEQ ID NO: 557992 - DNA, 20 bp, Artificial
  CRISPR gRNA sequence
acattaaagagcaattaaaa

SEQ ID NO: 557993 - DNA, 20 bp, Artificial
  CRISPR gRNA sequence
aagagcaattaaaatttgac

SEQ ID NO: 557994 - DNA, 20 bp, Artificial
  CRISPR gRNA sequence
aaatttgactgaagtttttg

SEQ ID NO: 557995 - DNA, 20 bp, Artificial
  CRISPR gRNA sequence
gactgaagtttttgcctagt

SEQ ID NO: 557996 - DNA, 20 bp, Artificial
  CRISPR gRNA sequence
actgaagtttttgcctagta

SEQ ID NO: 557997 - DNA, 20 bp, Artificial
  CRISPR gRNA sequence
aagtttttgcctagtagcaa

SEQ ID NO: 557998 - DNA, 20 bp, Artificial
  CRISPR gRNA sequence
ttgcctagtagcaattaggg

SEQ ID NO: 557999 - DNA, 20 bp, Artificial
  CRISPR gRNA sequence
tgcctagtagcaattagggt

SEQ ID NO: 558000 - DNA, 20 bp, Artificial
  CRISPR gRNA sequence
gcctagtagcaattagggta

SEQ ID NO: 558001 - DNA, 20 bp, Artificial
  CRISPR gRNA sequence
cctagtagcaattagggtaa

SEQ ID NO: 558002 - DNA, 20 bp, Artificial
  CRISPR gRNA sequence
gtagcaattagggtaattga

SEQ ID NO: 558003 - DNA, 20 bp, Artificial
  CRISPR gRNA sequence
gggtaattgaaataatacag

SEQ ID NO: 558004 - DNA, 20 bp, Artificial
  CRISPR gRNA sequence
aaataatacaggggaaatca

SEQ ID NO: 558005 - DNA, 20 bp, Artificial
  CRISPR gRNA sequence
aatgaccagttgtagacaac

SEQ ID NO: 558006 - DNA, 20 bp, Artificial
  CRISPR gRNA sequence
tagacaactgtgttagtaat

SEQ ID NO: 558007 - DNA, 20 bp, Artificial
  CRISPR gRNA sequence
tgttagtaatttcagataag

SEQ ID NO: 558008 - DNA, 20 bp, Artificial
  CRISPR gRNA sequence
gtaatttcagataagaagca

SEQ ID NO: 558009 - DNA, 20 bp, Artificial
  CRISPR gRNA sequence
cagataagaagcaaatatca

SEQ ID NO: 558010 - DNA, 20 bp, Artificial
  CRISPR gRNA sequence
agataagaagcaaatatcac

SEQ ID NO: 558011 - DNA, 20 bp, Artificial
  CRISPR gRNA sequence
gtttatctacaaggactttt

SEQ ID NO: 558012 - DNA, 20 bp, Artificial
  CRISPR gRNA sequence
tttatctacaaggacttttt

SEQ ID NO: 558013 - DNA, 20 bp, Artificial
  CRISPR gRNA sequence
atctacaaggactttttaga

SEQ ID NO: 558014 - DNA, 20 bp, Artificial
  CRISPR gRNA sequence
tctacaaggactttttagaa

SEQ ID NO: 558015 - DNA, 20 bp, Artificial
  CRISPR gRNA sequence
caaggactttttagaaccca

SEQ ID NO: 558016 - DNA, 20 bp, Artificial
  CRISPR gRNA sequence
tttagaacccatctccctta

SEQ ID NO: 558017 - DNA, 20 bp, Artificial
  CRISPR gRNA sequence
ttagaacccatctcccttaa

SEQ ID NO: 558018 - DNA, 20 bp, Artificial
  CRISPR gRNA sequence
tagaacccatctcccttaat

SEQ ID NO: 558019 - DNA, 20 bp, Artificial
  CRISPR gRNA sequence
agaacccatctcccttaatt

SEQ ID NO: 558020 - DNA, 20 bp, Artificial
  CRISPR gRNA sequence
gaacccatctcccttaatta

SEQ ID NO: 558021 - DNA, 20 bp, Artificial
  CRISPR gRNA sequence
ccttaattaaggggaactgc

SEQ ID NO: 558022 - DNA, 20 bp, Artificial
  CRISPR gRNA sequence
aattaaggggaactgccctc

SEQ ID NO: 558023 - DNA, 20 bp, Artificial
  CRISPR gRNA sequence
attaaggggaactgccctca

SEQ ID NO: 558024 - DNA, 20 bp, Artificial
  CRISPR gRNA sequence
aggggaactgccctcaaaaa

SEQ ID NO: 558025 - DNA, 20 bp, Artificial
  CRISPR gRNA sequence
ccctcaaaaacacaccagca

SEQ ID NO: 558026 - DNA, 20 bp, Artificial
  CRISPR gRNA sequence
aaaaacacaccagcatcttt

SEQ ID NO: 558027 - DNA, 20 bp, Artificial
  CRISPR gRNA sequence
tccattgctttgccgattat

SEQ ID NO: 558028 - DNA, 20 bp, Artificial
  CRISPR gRNA sequence
ccattgctttgccgattatg

SEQ ID NO: 558029 - DNA, 20 bp, Artificial
  CRISPR gRNA sequence
cattgctttgccgattatgc

SEQ ID NO: 558030 - DNA, 20 bp, Artificial
  CRISPR gRNA sequence
ctttgccgattatgcattat

SEQ ID NO: 558031 - DNA, 20 bp, Artificial
  CRISPR gRNA sequence
tgccgattatgcattatttc

SEQ ID NO: 558032 - DNA, 20 bp, Artificial
  CRISPR gRNA sequence
gccgattatgcattatttcc

SEQ ID NO: 558033 - DNA, 20 bp, Artificial
  CRISPR gRNA sequence
ccgattatgcattatttcct

SEQ ID NO: 558034 - DNA, 20 bp, Artificial
  CRISPR gRNA sequence
tgcattatttcctccactca

SEQ ID NO: 558035 - DNA, 20 bp, Artificial
  CRISPR gRNA sequence
tttcctccactcaacagagt

SEQ ID NO: 558036 - DNA, 20 bp, Artificial
  CRISPR gRNA sequence
cctccactcaacagagtatg

SEQ ID NO: 558037 - DNA, 20 bp, Artificial
  CRISPR gRNA sequence
ctccactcaacagagtatgt

SEQ ID NO: 558038 - DNA, 20 bp, Artificial
  CRISPR gRNA sequence
cactcaacagagtatgtggg

SEQ ID NO: 558039 - DNA, 20 bp, Artificial
  CRISPR gRNA sequence
aacagagtatgtgggaaggc

SEQ ID NO: 558040 - DNA, 20 bp, Artificial
  CRISPR gRNA sequence
aaggggtgagagtctaccac

SEQ ID NO: 558041 - DNA, 20 bp, Artificial
  CRISPR gRNA sequence
ccacacacaatagtggaaac

SEQ ID NO: 558042 - DNA, 20 bp, Artificial
  CRISPR gRNA sequence
aaaaatgtcttataaatgta

SEQ ID NO: 558043 - DNA, 20 bp, Artificial
  CRISPR gRNA sequence
ataaatgtaaatgaaacaat

SEQ ID NO: 558044 - DNA, 20 bp, Artificial
  CRISPR gRNA sequence
taaatgtaaatgaaacaatg

SEQ ID NO: 558045 - DNA, 20 bp, Artificial
  CRISPR gRNA sequence
ccataccctggcggcatgaa

SEQ ID NO: 558046 - DNA, 20 bp, Artificial
  CRISPR gRNA sequence
gcggcatgaagatgtctttt

SEQ ID NO: 558047 - DNA, 20 bp, Artificial
  CRISPR gRNA sequence
ttgtctttcccagggagagc

SEQ ID NO: 558048 - DNA, 20 bp, Artificial
  CRISPR gRNA sequence
tgtctttcccagggagagct

SEQ ID NO: 558049 - DNA, 20 bp, Artificial
  CRISPR gRNA sequence
gtctttcccagggagagctg

SEQ ID NO: 558050 - DNA, 20 bp, Artificial
  CRISPR gRNA sequence
tctttcccagggagagctga

SEQ ID NO: 558051 - DNA, 20 bp, Artificial
  CRISPR gRNA sequence
tcccagggagagctgatgta

SEQ ID NO: 558052 - DNA, 20 bp, Artificial
  CRISPR gRNA sequence
cccagggagagctgatgtat

SEQ ID NO: 558053 - DNA, 20 bp, Artificial
  CRISPR gRNA sequence
ccagggagagctgatgtatc

SEQ ID NO: 558054 - DNA, 20 bp, Artificial
  CRISPR gRNA sequence
atgtatcctgggcttgagaa

SEQ ID NO: 558055 - DNA, 20 bp, Artificial
  CRISPR gRNA sequence
ggcttgagaacagtagaaga

SEQ ID NO: 558056 - DNA, 20 bp, Artificial
  CRISPR gRNA sequence
gagaacagtagaagaaagta

SEQ ID NO: 558057 - DNA, 20 bp, Artificial
  CRISPR gRNA sequence
agaacagtagaagaaagtag

SEQ ID NO: 558058 - DNA, 20 bp, Artificial
  CRISPR gRNA sequence
gtggtggagggaagtgaggg

SEQ ID NO: 558059 - DNA, 20 bp, Artificial
  CRISPR gRNA sequence
cagctcagaagaaatcaaag

SEQ ID NO: 558060 - DNA, 20 bp, Artificial
  CRISPR gRNA sequence
agaagaaatcaaagtacagt

SEQ ID NO: 558061 - DNA, 20 bp, Artificial
  CRISPR gRNA sequence
acccttgaacaacatgggtt

SEQ ID NO: 558062 - DNA, 20 bp, Artificial
  CRISPR gRNA sequence
gaacaacatgggtttgagct

SEQ ID NO: 558063 - DNA, 20 bp, Artificial
  CRISPR gRNA sequence
aacaacatgggtttgagctg

SEQ ID NO: 558064 - DNA, 20 bp, Artificial
  CRISPR gRNA sequence
gagctgtgtgggtccactta

SEQ ID NO: 558065 - DNA, 20 bp, Artificial
  CRISPR gRNA sequence
agctgtgtgggtccacttac

SEQ ID NO: 558066 - DNA, 20 bp, Artificial
  CRISPR gRNA sequence
tgtgggtccacttacatgtg

SEQ ID NO: 558067 - DNA, 20 bp, Artificial
  CRISPR gRNA sequence
acatgtggattttcttccgc

SEQ ID NO: 558068 - DNA, 20 bp, Artificial
  CRISPR gRNA sequence
catgtggattttcttccgcc

SEQ ID NO: 558069 - DNA, 20 bp, Artificial
  CRISPR gRNA sequence
tcttccgcctctgccatccc

SEQ ID NO: 558070 - DNA, 20 bp, Artificial
  CRISPR gRNA sequence
cttccgcctctgccatccct

SEQ ID NO: 558071 - DNA, 20 bp, Artificial
  CRISPR gRNA sequence
ttccgcctctgccatccctg

SEQ ID NO: 558072 - DNA, 20 bp, Artificial
  CRISPR gRNA sequence
ccgcctctgccatccctgag

SEQ ID NO: 558073 - DNA, 20 bp, Artificial
  CRISPR gRNA sequence
cgcctctgccatccctgaga

SEQ ID NO: 558074 - DNA, 20 bp, Artificial
  CRISPR gRNA sequence
tgccatccctgagatagcaa

SEQ ID NO: 558075 - DNA, 20 bp, Artificial
  CRISPR gRNA sequence
ccatccctgagatagcaaga

SEQ ID NO: 558076 - DNA, 20 bp, Artificial
  CRISPR gRNA sequence
agatagcaagaccaacccct

SEQ ID NO: 558077 - DNA, 20 bp, Artificial
  CRISPR gRNA sequence
ctcccacttagcctgcttta

SEQ ID NO: 558078 - DNA, 20 bp, Artificial
  CRISPR gRNA sequence
ccacttagcctgctttaacg

SEQ ID NO: 558079 - DNA, 20 bp, Artificial
  CRISPR gRNA sequence
agcctgctttaacgtgaaga

SEQ ID NO: 558080 - DNA, 20 bp, Artificial
  CRISPR gRNA sequence
gcctgctttaacgtgaagat

SEQ ID NO: 558081 - DNA, 20 bp, Artificial
  CRISPR gRNA sequence
ctttaacgtgaagataatga

SEQ ID NO: 558082 - DNA, 20 bp, Artificial
  CRISPR gRNA sequence
taacgtgaagataatgagga

SEQ ID NO: 558083 - DNA, 20 bp, Artificial
  CRISPR gRNA sequence
aacgtgaagataatgaggat

SEQ ID NO: 558084 - DNA, 20 bp, Artificial
  CRISPR gRNA sequence
acgtgaagataatgaggatg

SEQ ID NO: 558085 - DNA, 20 bp, Artificial
  CRISPR gRNA sequence
tgatgatccactttcactta

SEQ ID NO: 558086 - DNA, 20 bp, Artificial
  CRISPR gRNA sequence
gatgatccactttcacttag

SEQ ID NO: 558087 - DNA, 20 bp, Artificial
  CRISPR gRNA sequence
atgatccactttcacttagt

SEQ ID NO: 558088 - DNA, 20 bp, Artificial
  CRISPR gRNA sequence
tcacttagtaagtatatttt

SEQ ID NO: 558089 - DNA, 20 bp, Artificial
  CRISPR gRNA sequence
cacttagtaagtatattttc

SEQ ID NO: 558090 - DNA, 20 bp, Artificial
  CRISPR gRNA sequence
acttagtaagtatattttct

SEQ ID NO: 558091 - DNA, 20 bp, Artificial
  CRISPR gRNA sequence
agtaagtatattttcttcct

SEQ ID NO: 558092 - DNA, 20 bp, Artificial
  CRISPR gRNA sequence
gtaagtatattttcttcctt

SEQ ID NO: 558093 - DNA, 20 bp, Artificial
  CRISPR gRNA sequence
tcttccttatgctttttttt

SEQ ID NO: 558094 - DNA, 20 bp, Artificial
  CRISPR gRNA sequence
cttccttatgcttttttttc

SEQ ID NO: 558095 - DNA, 20 bp, Artificial
  CRISPR gRNA sequence
ttccttatgcttttttttct

SEQ ID NO: 558096 - DNA, 20 bp, Artificial
  CRISPR gRNA sequence
ccttatgcttttttttcttt

SEQ ID NO: 558097 - DNA, 20 bp, Artificial
  CRISPR gRNA sequence
cttatgcttttttttctttt

SEQ ID NO: 558098 - DNA, 20 bp, Artificial
  CRISPR gRNA sequence
atgcttttttttctttttta

SEQ ID NO: 558099 - DNA, 20 bp, Artificial
  CRISPR gRNA sequence
tgcttttttttcttttttaa

SEQ ID NO: 558100 - DNA, 20 bp, Artificial
  CRISPR gRNA sequence
ttttttcttttttaaatttt

SEQ ID NO: 558101 - DNA, 20 bp, Artificial
  CRISPR gRNA sequence
tttttcttttttaaattttt

SEQ ID NO: 558102 - DNA, 20 bp, Artificial
  CRISPR gRNA sequence
ttttcttttttaaatttttt

SEQ ID NO: 558103 - DNA, 20 bp, Artificial
  CRISPR gRNA sequence
tttcttttttaaattttttt

SEQ ID NO: 558104 - DNA, 20 bp, Artificial
  CRISPR gRNA sequence
ttcttttttaaattttttta

SEQ ID NO: 558105 - DNA, 20 bp, Artificial
  CRISPR gRNA sequence
tcttttttaaatttttttat

SEQ ID NO: 558106 - DNA, 20 bp, Artificial
  CRISPR gRNA sequence
cttttttaaatttttttatt

SEQ ID NO: 558107 - DNA, 20 bp, Artificial
  CRISPR gRNA sequence
ttttttaaatttttttatta

SEQ ID NO: 558108 - DNA, 20 bp, Artificial
  CRISPR gRNA sequence
ttttaaatttttttattact

SEQ ID NO: 558109 - DNA, 20 bp, Artificial
  CRISPR gRNA sequence
tttaaatttttttattacta

SEQ ID NO: 558110 - DNA, 20 bp, Artificial
  CRISPR gRNA sequence
ttaaatttttttattactat

SEQ ID NO: 558111 - DNA, 20 bp, Artificial
  CRISPR gRNA sequence
taaatttttttattactatt

SEQ ID NO: 558112 - DNA, 20 bp, Artificial
  CRISPR gRNA sequence
aaatttttttattactatta

SEQ ID NO: 558113 - DNA, 20 bp, Artificial
  CRISPR gRNA sequence
aatttttttattactattat

SEQ ID NO: 558114 - DNA, 20 bp, Artificial
  CRISPR gRNA sequence
ttttattactattatctcaa

SEQ ID NO: 558115 - DNA, 20 bp, Artificial
  CRISPR gRNA sequence
tttattactattatctcaat

SEQ ID NO: 558116 - DNA, 20 bp, Artificial
  CRISPR gRNA sequence
ttattactattatctcaata

SEQ ID NO: 558117 - DNA, 20 bp, Artificial
  CRISPR gRNA sequence
tattactattatctcaatag

SEQ ID NO: 558118 - DNA, 20 bp, Artificial
  CRISPR gRNA sequence
attactattatctcaatagt

SEQ ID NO: 558119 - DNA, 20 bp, Artificial
  CRISPR gRNA sequence
ttactattatctcaatagtt

SEQ ID NO: 558120 - DNA, 20 bp, Artificial
  CRISPR gRNA sequence
ctattatctcaatagttttg

SEQ ID NO: 558121 - DNA, 20 bp, Artificial
  CRISPR gRNA sequence
ttatctcaatagttttgggg

SEQ ID NO: 558122 - DNA, 20 bp, Artificial
  CRISPR gRNA sequence
tctcaatagttttgggggaa

SEQ ID NO: 558123 - DNA, 20 bp, Artificial
  CRISPR gRNA sequence
aatagttttgggggaacagg

SEQ ID NO: 558124 - DNA, 20 bp, Artificial
  CRISPR gRNA sequence
tgggggaacaggtgatgttt

SEQ ID NO: 558125 - DNA, 20 bp, Artificial
  CRISPR gRNA sequence
gggggaacaggtgatgtttg

SEQ ID NO: 558126 - DNA, 20 bp, Artificial
  CRISPR gRNA sequence
ggggaacaggtgatgtttgg

SEQ ID NO: 558127 - DNA, 20 bp, Artificial
  CRISPR gRNA sequence
ggttacatggataagttttt

SEQ ID NO: 558128 - DNA, 20 bp, Artificial
  CRISPR gRNA sequence
gttacatggataagtttttt

SEQ ID NO: 558129 - DNA, 20 bp, Artificial
  CRISPR gRNA sequence
catggataagtttttttttt

SEQ ID NO: 558130 - DNA, 20 bp, Artificial
  CRISPR gRNA sequence
tttttttttttttagttatt

SEQ ID NO: 558131 - DNA, 20 bp, Artificial
  CRISPR gRNA sequence
ttttttttttttagttattt

SEQ ID NO: 558132 - DNA, 20 bp, Artificial
  CRISPR gRNA sequence
tttttttttttagttatttg

SEQ ID NO: 558133 - DNA, 20 bp, Artificial
  CRISPR gRNA sequence
ttttttttttagttatttgg

SEQ ID NO: 558134 - DNA, 20 bp, Artificial
  CRISPR gRNA sequence
tttttttttagttatttggg

SEQ ID NO: 558135 - DNA, 20 bp, Artificial
  CRISPR gRNA sequence
ttttttttagttatttgggt

SEQ ID NO: 558136 - DNA, 20 bp, Artificial
  CRISPR gRNA sequence
tttttttagttatttgggtg

SEQ ID NO: 558137 - DNA, 20 bp, Artificial
  CRISPR gRNA sequence
ttttttagttatttgggtgt

SEQ ID NO: 558138 - DNA, 20 bp, Artificial
  CRISPR gRNA sequence
tttttagttatttgggtgtg

SEQ ID NO: 558139 - DNA, 20 bp, Artificial
  CRISPR gRNA sequence
ttttagttatttgggtgtga

SEQ ID NO: 558140 - DNA, 20 bp, Artificial
  CRISPR gRNA sequence
tttagttatttgggtgtgat

SEQ ID NO: 558141 - DNA, 20 bp, Artificial
  CRISPR gRNA sequence
ttagttatttgggtgtgatt

SEQ ID NO: 558142 - DNA, 20 bp, Artificial
  CRISPR gRNA sequence
tagttatttgggtgtgattt

SEQ ID NO: 558143 - DNA, 20 bp, Artificial
  CRISPR gRNA sequence
agttatttgggtgtgatttc

SEQ ID NO: 558144 - DNA, 20 bp, Artificial
  CRISPR gRNA sequence
gttatttgggtgtgatttct

SEQ ID NO: 558145 - DNA, 20 bp, Artificial
  CRISPR gRNA sequence
tttgggtgtgatttctgaga

SEQ ID NO: 558146 - DNA, 20 bp, Artificial
  CRISPR gRNA sequence
gggtgtgatttctgagattc

SEQ ID NO: 558147 - DNA, 20 bp, Artificial
  CRISPR gRNA sequence
ggtgtgatttctgagattct

SEQ ID NO: 558148 - DNA, 20 bp, Artificial
  CRISPR gRNA sequence
ctgagattctggtgtacact

SEQ ID NO: 558149 - DNA, 20 bp, Artificial
  CRISPR gRNA sequence
tgagattctggtgtacactg

SEQ ID NO: 558150 - DNA, 20 bp, Artificial
  CRISPR gRNA sequence
agattctggtgtacactgta

SEQ ID NO: 558151 - DNA, 20 bp, Artificial
  CRISPR gRNA sequence
tggtgtacactgtacccagt

SEQ ID NO: 558152 - DNA, 20 bp, Artificial
  CRISPR gRNA sequence
gtgtacactgtacccagtgt

SEQ ID NO: 558153 - DNA, 20 bp, Artificial
  CRISPR gRNA sequence
tacccagtgtgtagtctttt

SEQ ID NO: 558154 - DNA, 20 bp, Artificial
  CRISPR gRNA sequence
ttatccctcatccccatccc

SEQ ID NO: 558155 - DNA, 20 bp, Artificial
  CRISPR gRNA sequence
tatccctcatccccatccca

SEQ ID NO: 558156 - DNA, 20 bp, Artificial
  CRISPR gRNA sequence
atccctcatccccatcccac

SEQ ID NO: 558157 - DNA, 20 bp, Artificial
  CRISPR gRNA sequence
tccctcatccccatcccacc

SEQ ID NO: 558158 - DNA, 20 bp, Artificial
  CRISPR gRNA sequence
atccccatcccacccttctc

SEQ ID NO: 558159 - DNA, 20 bp, Artificial
  CRISPR gRNA sequence
ctccacaagtccccaaagtt

SEQ ID NO: 558160 - DNA, 20 bp, Artificial
  CRISPR gRNA sequence
tccacaagtccccaaagttc

SEQ ID NO: 558161 - DNA, 20 bp, Artificial
  CRISPR gRNA sequence
cacaagtccccaaagttcac

SEQ ID NO: 558162 - DNA, 20 bp, Artificial
  CRISPR gRNA sequence
actgtatcattcttacatag

SEQ ID NO: 558163 - DNA, 20 bp, Artificial
  CRISPR gRNA sequence
tatcattcttacatagctta

SEQ ID NO: 558164 - DNA, 20 bp, Artificial
  CRISPR gRNA sequence
ttacatagcttagctcccac

SEQ ID NO: 558165 - DNA, 20 bp, Artificial
  CRISPR gRNA sequence
acatagcttagctcccactt

SEQ ID NO: 558166 - DNA, 20 bp, Artificial
  CRISPR gRNA sequence
catagcttagctcccacttg

SEQ ID NO: 558167 - DNA, 20 bp, Artificial
  CRISPR gRNA sequence
agctcccacttgtaagttag

SEQ ID NO: 558168 - DNA, 20 bp, Artificial
  CRISPR gRNA sequence
gctcccacttgtaagttaga

SEQ ID NO: 558169 - DNA, 20 bp, Artificial
  CRISPR gRNA sequence
ccacttgtaagttagaacat

SEQ ID NO: 558170 - DNA, 20 bp, Artificial
  CRISPR gRNA sequence
gtaagttagaacatatgttt

SEQ ID NO: 558171 - DNA, 20 bp, Artificial
  CRISPR gRNA sequence
taagttagaacatatgtttg

SEQ ID NO: 558172 - DNA, 20 bp, Artificial
  CRISPR gRNA sequence
gaacatatgtttggttttcc

SEQ ID NO: 558173 - DNA, 20 bp, Artificial
  CRISPR gRNA sequence
ggttttccattcctgagtta

SEQ ID NO: 558174 - DNA, 20 bp, Artificial
  CRISPR gRNA sequence
gttttccattcctgagttac

SEQ ID NO: 558175 - DNA, 20 bp, Artificial
  CRISPR gRNA sequence
tccattcctgagttacttca

SEQ ID NO: 558176 - DNA, 20 bp, Artificial
  CRISPR gRNA sequence
ccattcctgagttacttcac

SEQ ID NO: 558177 - DNA, 20 bp, Artificial
  CRISPR gRNA sequence
cattcctgagttacttcact

SEQ ID NO: 558178 - DNA, 20 bp, Artificial
  CRISPR gRNA sequence
ctgagttacttcacttagaa

SEQ ID NO: 558179 - DNA, 20 bp, Artificial
  CRISPR gRNA sequence
agttacttcacttagaataa

SEQ ID NO: 558180 - DNA, 20 bp, Artificial
  CRISPR gRNA sequence
cttcacttagaataatggtc

SEQ ID NO: 558181 - DNA, 20 bp, Artificial
  CRISPR gRNA sequence
cacttagaataatggtctcc

SEQ ID NO: 558182 - DNA, 20 bp, Artificial
  CRISPR gRNA sequence
acttagaataatggtctcca

SEQ ID NO: 558183 - DNA, 20 bp, Artificial
  CRISPR gRNA sequence
agaataatggtctccagttc

SEQ ID NO: 558184 - DNA, 20 bp, Artificial
  CRISPR gRNA sequence
gaataatggtctccagttcc

SEQ ID NO: 558185 - DNA, 20 bp, Artificial
  CRISPR gRNA sequence
cagttccatccaggttgctg

SEQ ID NO: 558186 - DNA, 20 bp, Artificial
  CRISPR gRNA sequence
catccaggttgctgtgaatg

SEQ ID NO: 558187 - DNA, 20 bp, Artificial
  CRISPR gRNA sequence
ctgtgaatgccattattttg

SEQ ID NO: 558188 - DNA, 20 bp, Artificial
  CRISPR gRNA sequence
tgaatgccattattttgttc

SEQ ID NO: 558189 - DNA, 20 bp, Artificial
  CRISPR gRNA sequence
ttttgttctttttttttttt

SEQ ID NO: 558190 - DNA, 20 bp, Artificial
  CRISPR gRNA sequence
tgttcttttttttttttttt

SEQ ID NO: 558191 - DNA, 20 bp, Artificial
  CRISPR gRNA sequence
gttctttttttttttttttt

SEQ ID NO: 558192 - DNA, 20 bp, Artificial
  CRISPR gRNA sequence
ttcttttttttttttttttc

SEQ ID NO: 558193 - DNA, 20 bp, Artificial
  CRISPR gRNA sequence
ttttttttttttttttcttt

SEQ ID NO: 558194 - DNA, 20 bp, Artificial
  CRISPR gRNA sequence
ttttttttttttttcttttg

SEQ ID NO: 558195 - DNA, 20 bp, Artificial
  CRISPR gRNA sequence
tttttttttttttcttttga

SEQ ID NO: 558196 - DNA, 20 bp, Artificial
  CRISPR gRNA sequence
ttttttttttttcttttgag

SEQ ID NO: 558197 - DNA, 20 bp, Artificial
  CRISPR gRNA sequence
tttttttttttcttttgaga

SEQ ID NO: 558198 - DNA, 20 bp, Artificial
  CRISPR gRNA sequence
ttttttttttcttttgagac

SEQ ID NO: 558199 - DNA, 20 bp, Artificial
  CRISPR gRNA sequence
tttttttttcttttgagaca

SEQ ID NO: 558200 - DNA, 20 bp, Artificial
  CRISPR gRNA sequence
ttttttttcttttgagacag

SEQ ID NO: 558201 - DNA, 20 bp, Artificial
  CRISPR gRNA sequence
tttttttcttttgagacaga

SEQ ID NO: 558202 - DNA, 20 bp, Artificial
  CRISPR gRNA sequence
ttttttcttttgagacagag

SEQ ID NO: 558203 - DNA, 20 bp, Artificial
  CRISPR gRNA sequence
tttttcttttgagacagagt

SEQ ID NO: 558204 - DNA, 20 bp, Artificial
  CRISPR gRNA sequence
ttttcttttgagacagagtc

SEQ ID NO: 558205 - DNA, 20 bp, Artificial
  CRISPR gRNA sequence
tttcttttgagacagagtct

SEQ ID NO: 558206 - DNA, 20 bp, Artificial
  CRISPR gRNA sequence
ttcttttgagacagagtctc

SEQ ID NO: 558207 - DNA, 20 bp, Artificial
  CRISPR gRNA sequence
tcttttgagacagagtctcg

SEQ ID NO: 558208 - DNA, 20 bp, Artificial
  CRISPR gRNA sequence
cttttgagacagagtctcgc

SEQ ID NO: 558209 - DNA, 20 bp, Artificial
  CRISPR gRNA sequence
ttttgagacagagtctcgct

SEQ ID NO: 558210 - DNA, 20 bp, Artificial
  CRISPR gRNA sequence
ttgagacagagtctcgctct

SEQ ID NO: 558211 - DNA, 20 bp, Artificial
  CRISPR gRNA sequence
tgagacagagtctcgctctg

SEQ ID NO: 558212 - DNA, 20 bp, Artificial
  CRISPR gRNA sequence
gagacagagtctcgctctgt

SEQ ID NO: 558213 - DNA, 20 bp, Artificial
  CRISPR gRNA sequence
agacagagtctcgctctgtc

SEQ ID NO: 558214 - DNA, 20 bp, Artificial
  CRISPR gRNA sequence
gctctgtccccaggctggag

SEQ ID NO: 558215 - DNA, 20 bp, Artificial
  CRISPR gRNA sequence
tgtccccaggctggagtgca

SEQ ID NO: 558216 - DNA, 20 bp, Artificial
  CRISPR gRNA sequence
tccccaggctggagtgcagt

SEQ ID NO: 558217 - DNA, 20 bp, Artificial
  CRISPR gRNA sequence
gagtgcagtggcgtgatctc

SEQ ID NO: 558218 - DNA, 20 bp, Artificial
  CRISPR gRNA sequence
ggctcactaaaagttccacc

SEQ ID NO: 558219 - DNA, 20 bp, Artificial
  CRISPR gRNA sequence
actaaaagttccacctccca

SEQ ID NO: 558220 - DNA, 20 bp, Artificial
  CRISPR gRNA sequence
aaagttccacctcccaggct

SEQ ID NO: 558221 - DNA, 20 bp, Artificial
  CRISPR gRNA sequence
cacctcccaggctcacgcca

SEQ ID NO: 558222 - DNA, 20 bp, Artificial
  CRISPR gRNA sequence
ccaggctcacgccattctcc

SEQ ID NO: 558223 - DNA, 20 bp, Artificial
  CRISPR gRNA sequence
acgccattctcctgcctcag

SEQ ID NO: 558224 - DNA, 20 bp, Artificial
  CRISPR gRNA sequence
tcctgcctcagcctcctgag

SEQ ID NO: 558225 - DNA, 20 bp, Artificial
  CRISPR gRNA sequence
ctgcctcagcctcctgagta

SEQ ID NO: 558226 - DNA, 20 bp, Artificial
  CRISPR gRNA sequence
cctcagcctcctgagtagct

SEQ ID NO: 558227 - DNA, 20 bp, Artificial
  CRISPR gRNA sequence
agcctcctgagtagctggga

SEQ ID NO: 558228 - DNA, 20 bp, Artificial
  CRISPR gRNA sequence
ctgagtagctgggactacag

SEQ ID NO: 558229 - DNA, 20 bp, Artificial
  CRISPR gRNA sequence
agtagctgggactacaggcg

SEQ ID NO: 558230 - DNA, 20 bp, Artificial
  CRISPR gRNA sequence
ggactacaggcgcccaccac

SEQ ID NO: 558231 - DNA, 20 bp, Artificial
  CRISPR gRNA sequence
caggcgcccaccaccatgcc

SEQ ID NO: 558232 - DNA, 20 bp, Artificial
  CRISPR gRNA sequence
attttttttttgtattttta

SEQ ID NO: 558233 - DNA, 20 bp, Artificial
  CRISPR gRNA sequence
tttttttgtatttttagtaa

SEQ ID NO: 558234 - DNA, 20 bp, Artificial
  CRISPR gRNA sequence
ttttttgtatttttagtaaa

SEQ ID NO: 558235 - DNA, 20 bp, Artificial
  CRISPR gRNA sequence
tttttgtatttttagtaaag

SEQ ID NO: 558236 - DNA, 20 bp, Artificial
  CRISPR gRNA sequence
ttttgtatttttagtaaaga

SEQ ID NO: 558237 - DNA, 20 bp, Artificial
  CRISPR gRNA sequence
tttgtatttttagtaaagac

SEQ ID NO: 558238 - DNA, 20 bp, Artificial
  CRISPR gRNA sequence
ttgtatttttagtaaagacg

SEQ ID NO: 558239 - DNA, 20 bp, Artificial
  CRISPR gRNA sequence
tgtatttttagtaaagacgg

SEQ ID NO: 558240 - DNA, 20 bp, Artificial
  CRISPR gRNA sequence
gtatttttagtaaagacggg

SEQ ID NO: 558241 - DNA, 20 bp, Artificial
  CRISPR gRNA sequence
tatttttagtaaagacgggg

SEQ ID NO: 558242 - DNA, 20 bp, Artificial
  CRISPR gRNA sequence
ttagtaaagacggggtttca

SEQ ID NO: 558243 - DNA, 20 bp, Artificial
  CRISPR gRNA sequence
tagtaaagacggggtttcac

SEQ ID NO: 558244 - DNA, 20 bp, Artificial
  CRISPR gRNA sequence
agtaaagacggggtttcacc

SEQ ID NO: 558245 - DNA, 20 bp, Artificial
  CRISPR gRNA sequence
gtaaagacggggtttcacca

SEQ ID NO: 558246 - DNA, 20 bp, Artificial
  CRISPR gRNA sequence
caccatgttagccaggatgg

SEQ ID NO: 558247 - DNA, 20 bp, Artificial
  CRISPR gRNA sequence
accatgttagccaggatggt

SEQ ID NO: 558248 - DNA, 20 bp, Artificial
  CRISPR gRNA sequence
gccaggatggtctcgatctc

SEQ ID NO: 558249 - DNA, 20 bp, Artificial
  CRISPR gRNA sequence
gatctcctgacctcgtgatc

SEQ ID NO: 558250 - DNA, 20 bp, Artificial
  CRISPR gRNA sequence
ctgacctcgtgatctgcccg

SEQ ID NO: 558251 - DNA, 20 bp, Artificial
  CRISPR gRNA sequence
acctcgtgatctgcccgcct

SEQ ID NO: 558252 - DNA, 20 bp, Artificial
  CRISPR gRNA sequence
gtgatctgcccgccttggcc

SEQ ID NO: 558253 - DNA, 20 bp, Artificial
  CRISPR gRNA sequence
cccgccttggcctcccaaag

SEQ ID NO: 558254 - DNA, 20 bp, Artificial
  CRISPR gRNA sequence
ggcctcccaaagtgctggga

SEQ ID NO: 558255 - DNA, 20 bp, Artificial
  CRISPR gRNA sequence
gcctcccaaagtgctgggat

SEQ ID NO: 558256 - DNA, 20 bp, Artificial
  CRISPR gRNA sequence
ccaaagtgctgggattacag

SEQ ID NO: 558257 - DNA, 20 bp, Artificial
  CRISPR gRNA sequence
ggattacagacacgagccac

SEQ ID NO: 558258 - DNA, 20 bp, Artificial
  CRISPR gRNA sequence
cagacacgagccaccgcgcc

SEQ ID NO: 558259 - DNA, 20 bp, Artificial
  CRISPR gRNA sequence
gcctattatgttccttttta

SEQ ID NO: 558260 - DNA, 20 bp, Artificial
  CRISPR gRNA sequence
ttatgttcctttttatggca

SEQ ID NO: 558261 - DNA, 20 bp, Artificial
  CRISPR gRNA sequence
tgttcctttttatggcatat

SEQ ID NO: 558262 - DNA, 20 bp, Artificial
  CRISPR gRNA sequence
ctttttatggcatattcata

SEQ ID NO: 558263 - DNA, 20 bp, Artificial
  CRISPR gRNA sequence
tttatggcatattcatatat

SEQ ID NO: 558264 - DNA, 20 bp, Artificial
  CRISPR gRNA sequence
ttatggcatattcatatata

SEQ ID NO: 558265 - DNA, 20 bp, Artificial
  CRISPR gRNA sequence
tatggcatattcatatatat

SEQ ID NO: 558266 - DNA, 20 bp, Artificial
  CRISPR gRNA sequence
atggcatattcatatatata

SEQ ID NO: 558267 - DNA, 20 bp, Artificial
  CRISPR gRNA sequence
tggcatattcatatatatat

SEQ ID NO: 558268 - DNA, 20 bp, Artificial
  CRISPR gRNA sequence
atatatatatatatctccca

SEQ ID NO: 558269 - DNA, 20 bp, Artificial
  CRISPR gRNA sequence
ccacattttctttatccact

SEQ ID NO: 558270 - DNA, 20 bp, Artificial
  CRISPR gRNA sequence
tctttatccactcattgatt

SEQ ID NO: 558271 - DNA, 20 bp, Artificial
  CRISPR gRNA sequence
ctttatccactcattgattg

SEQ ID NO: 558272 - DNA, 20 bp, Artificial
  CRISPR gRNA sequence
tttatccactcattgattga

SEQ ID NO: 558273 - DNA, 20 bp, Artificial
  CRISPR gRNA sequence
tatccactcattgattgatg

SEQ ID NO: 558274 - DNA, 20 bp, Artificial
  CRISPR gRNA sequence
atccactcattgattgatgg

SEQ ID NO: 558275 - DNA, 20 bp, Artificial
  CRISPR gRNA sequence
tccactcattgattgatggg

SEQ ID NO: 558276 - DNA, 20 bp, Artificial
  CRISPR gRNA sequence
attgattgatgggcatttat

SEQ ID NO: 558277 - DNA, 20 bp, Artificial
  CRISPR gRNA sequence
attgatgggcatttatgctg

SEQ ID NO: 558278 - DNA, 20 bp, Artificial
  CRISPR gRNA sequence
atgggcatttatgctgattc

SEQ ID NO: 558279 - DNA, 20 bp, Artificial
  CRISPR gRNA sequence
atgctgattccatatttttg

SEQ ID NO: 558280 - DNA, 20 bp, Artificial
  CRISPR gRNA sequence
tgctgattccatatttttgc

SEQ ID NO: 558281 - DNA, 20 bp, Artificial
  CRISPR gRNA sequence
attccatatttttgcaattg

SEQ ID NO: 558282 - DNA, 20 bp, Artificial
  CRISPR gRNA sequence
catatttttgcaattgcgag

SEQ ID NO: 558283 - DNA, 20 bp, Artificial
  CRISPR gRNA sequence
ttgcaattgcgagttgtgcc

SEQ ID NO: 558284 - DNA, 20 bp, Artificial
  CRISPR gRNA sequence
tgcaattgcgagttgtgcca

SEQ ID NO: 558285 - DNA, 20 bp, Artificial
  CRISPR gRNA sequence
gcaattgcgagttgtgccac

SEQ ID NO: 558286 - DNA, 20 bp, Artificial
  CRISPR gRNA sequence
caattgcgagttgtgccact

SEQ ID NO: 558287 - DNA, 20 bp, Artificial
  CRISPR gRNA sequence
cgagttgtgccactataaag

SEQ ID NO: 558288 - DNA, 20 bp, Artificial
  CRISPR gRNA sequence
tgccactataaagatgttgt

SEQ ID NO: 558289 - DNA, 20 bp, Artificial
  CRISPR gRNA sequence
taaagatgttgtgtgcaaca

SEQ ID NO: 558290 - DNA, 20 bp, Artificial
  CRISPR gRNA sequence
tgtgcaacatgttgtgtgtt

SEQ ID NO: 558291 - DNA, 20 bp, Artificial
  CRISPR gRNA sequence
tgtgttgtctttttcataaa

SEQ ID NO: 558292 - DNA, 20 bp, Artificial
  CRISPR gRNA sequence
tctttttcataaaatgactt

SEQ ID NO: 558293 - DNA, 20 bp, Artificial
  CRISPR gRNA sequence
tttcataaaatgacttgttt

SEQ ID NO: 558294 - DNA, 20 bp, Artificial
  CRISPR gRNA sequence
ttcataaaatgacttgtttt

SEQ ID NO: 558295 - DNA, 20 bp, Artificial
  CRISPR gRNA sequence
tcataaaatgacttgttttc

SEQ ID NO: 558296 - DNA, 20 bp, Artificial
  CRISPR gRNA sequence
cataaaatgacttgttttcc

SEQ ID NO: 558297 - DNA, 20 bp, Artificial
  CRISPR gRNA sequence
ataaaatgacttgttttcct

SEQ ID NO: 558298 - DNA, 20 bp, Artificial
  CRISPR gRNA sequence
gttttcctctgggtagatac

SEQ ID NO: 558299 - DNA, 20 bp, Artificial
  CRISPR gRNA sequence
ttttcctctgggtagatacc

SEQ ID NO: 558300 - DNA, 20 bp, Artificial
  CRISPR gRNA sequence
tcctctgggtagatacccag

SEQ ID NO: 558301 - DNA, 20 bp, Artificial
  CRISPR gRNA sequence
cctctgggtagatacccagt

SEQ ID NO: 558302 - DNA, 20 bp, Artificial
  CRISPR gRNA sequence
ctctgggtagatacccagta

SEQ ID NO: 558303 - DNA, 20 bp, Artificial
  CRISPR gRNA sequence
tgggtagatacccagtaatg

SEQ ID NO: 558304 - DNA, 20 bp, Artificial
  CRISPR gRNA sequence
ggtagatacccagtaatggg

SEQ ID NO: 558305 - DNA, 20 bp, Artificial
  CRISPR gRNA sequence
ctggatcaaatggtagttct

SEQ ID NO: 558306 - DNA, 20 bp, Artificial
  CRISPR gRNA sequence
gatcaaatggtagttctact

SEQ ID NO: 558307 - DNA, 20 bp, Artificial
  CRISPR gRNA sequence
tacttttagttgcttaagaa

SEQ ID NO: 558308 - DNA, 20 bp, Artificial
  CRISPR gRNA sequence
cttttagttgcttaagaaat

SEQ ID NO: 558309 - DNA, 20 bp, Artificial
  CRISPR gRNA sequence
ttagttgcttaagaaatctc

SEQ ID NO: 558310 - DNA, 20 bp, Artificial
  CRISPR gRNA sequence
tagttgcttaagaaatctcc

SEQ ID NO: 558311 - DNA, 20 bp, Artificial
  CRISPR gRNA sequence
agttgcttaagaaatctcca

SEQ ID NO: 558312 - DNA, 20 bp, Artificial
  CRISPR gRNA sequence
gttgcttaagaaatctccat

SEQ ID NO: 558313 - DNA, 20 bp, Artificial
  CRISPR gRNA sequence
cttaagaaatctccatagtg

SEQ ID NO: 558314 - DNA, 20 bp, Artificial
  CRISPR gRNA sequence
aagaaatctccatagtggtt

SEQ ID NO: 558315 - DNA, 20 bp, Artificial
  CRISPR gRNA sequence
agaaatctccatagtggttg

SEQ ID NO: 558316 - DNA, 20 bp, Artificial
  CRISPR gRNA sequence
catagtggttgtactagttt

SEQ ID NO: 558317 - DNA, 20 bp, Artificial
  CRISPR gRNA sequence
tactagtttacattcccacc

SEQ ID NO: 558318 - DNA, 20 bp, Artificial
  CRISPR gRNA sequence
gtttacattcccaccagcag

SEQ ID NO: 558319 - DNA, 20 bp, Artificial
  CRISPR gRNA sequence
acattcccaccagcagtgta

SEQ ID NO: 558320 - DNA, 20 bp, Artificial
  CRISPR gRNA sequence
cattcccaccagcagtgtac

SEQ ID NO: 558321 - DNA, 20 bp, Artificial
  CRISPR gRNA sequence
ccaccagcagtgtacaggtg

SEQ ID NO: 558322 - DNA, 20 bp, Artificial
  CRISPR gRNA sequence
ccttttcccaccacacccat

SEQ ID NO: 558323 - DNA, 20 bp, Artificial
  CRISPR gRNA sequence
ttcccaccacacccatgcca

SEQ ID NO: 558324 - DNA, 20 bp, Artificial
  CRISPR gRNA sequence
tcccaccacacccatgccaa

SEQ ID NO: 558325 - DNA, 20 bp, Artificial
  CRISPR gRNA sequence
cccaccacacccatgccaac

SEQ ID NO: 558326 - DNA, 20 bp, Artificial
  CRISPR gRNA sequence
ccaccacacccatgccaaca

SEQ ID NO: 558327 - DNA, 20 bp, Artificial
  CRISPR gRNA sequence
ttattttttgatttttaaat

SEQ ID NO: 558328 - DNA, 20 bp, Artificial
  CRISPR gRNA sequence
ttttttgatttttaaattac

SEQ ID NO: 558329 - DNA, 20 bp, Artificial
  CRISPR gRNA sequence
tttgatttttaaattacggc

SEQ ID NO: 558330 - DNA, 20 bp, Artificial
  CRISPR gRNA sequence
ttgatttttaaattacggcc

SEQ ID NO: 558331 - DNA, 20 bp, Artificial
  CRISPR gRNA sequence
tgatttttaaattacggcca

SEQ ID NO: 558332 - DNA, 20 bp, Artificial
  CRISPR gRNA sequence
gatttttaaattacggccat

SEQ ID NO: 558333 - DNA, 20 bp, Artificial
  CRISPR gRNA sequence
atttttaaattacggccatt

SEQ ID NO: 558334 - DNA, 20 bp, Artificial
  CRISPR gRNA sequence
ttaaattacggccattcttg

SEQ ID NO: 558335 - DNA, 20 bp, Artificial
  CRISPR gRNA sequence
taaattacggccattcttgc

SEQ ID NO: 558336 - DNA, 20 bp, Artificial
  CRISPR gRNA sequence
aaattacggccattcttgca

SEQ ID NO: 558337 - DNA, 20 bp, Artificial
  CRISPR gRNA sequence
aattacggccattcttgcag

SEQ ID NO: 558338 - DNA, 20 bp, Artificial
  CRISPR gRNA sequence
cggccattcttgcaggagta

SEQ ID NO: 558339 - DNA, 20 bp, Artificial
  CRISPR gRNA sequence
ttgcaggagtaaggtggtat

SEQ ID NO: 558340 - DNA, 20 bp, Artificial
  CRISPR gRNA sequence
gcaggagtaaggtggtattg

SEQ ID NO: 558341 - DNA, 20 bp, Artificial
  CRISPR gRNA sequence
caggagtaaggtggtattgc

SEQ ID NO: 558342 - DNA, 20 bp, Artificial
  CRISPR gRNA sequence
cattgtggtttcaatttgca

SEQ ID NO: 558343 - DNA, 20 bp, Artificial
  CRISPR gRNA sequence
tggtttcaatttgcatttcc

SEQ ID NO: 558344 - DNA, 20 bp, Artificial
  CRISPR gRNA sequence
caatttgcatttccctgata

SEQ ID NO: 558345 - DNA, 20 bp, Artificial
  CRISPR gRNA sequence
aatttgcatttccctgataa

SEQ ID NO: 558346 - DNA, 20 bp, Artificial
  CRISPR gRNA sequence
gcatttccctgataattagt

SEQ ID NO: 558347 - DNA, 20 bp, Artificial
  CRISPR gRNA sequence
catttccctgataattagta

SEQ ID NO: 558348 - DNA, 20 bp, Artificial
  CRISPR gRNA sequence
ccctgataattagtaatgtt

SEQ ID NO: 558349 - DNA, 20 bp, Artificial
  CRISPR gRNA sequence
cctgataattagtaatgttg

SEQ ID NO: 558350 - DNA, 20 bp, Artificial
  CRISPR gRNA sequence
ataattagtaatgttgagca

SEQ ID NO: 558351 - DNA, 20 bp, Artificial
  CRISPR gRNA sequence
gtaatgttgagcattttttc

SEQ ID NO: 558352 - DNA, 20 bp, Artificial
  CRISPR gRNA sequence
agcattttttcatatgtttg

SEQ ID NO: 558353 - DNA, 20 bp, Artificial
  CRISPR gRNA sequence
tttcatatgtttgttggcca

SEQ ID NO: 558354 - DNA, 20 bp, Artificial
  CRISPR gRNA sequence
ttcatatgtttgttggccat

SEQ ID NO: 558355 - DNA, 20 bp, Artificial
  CRISPR gRNA sequence
tcatatgtttgttggccatt

SEQ ID NO: 558356 - DNA, 20 bp, Artificial
  CRISPR gRNA sequence
catatgtttgttggccattt

SEQ ID NO: 558357 - DNA, 20 bp, Artificial
  CRISPR gRNA sequence
atatgtttgttggccatttg

SEQ ID NO: 558358 - DNA, 20 bp, Artificial
  CRISPR gRNA sequence
gttggccatttgtatatcct

SEQ ID NO: 558359 - DNA, 20 bp, Artificial
  CRISPR gRNA sequence
ttggccatttgtatatcctc

SEQ ID NO: 558360 - DNA, 20 bp, Artificial
  CRISPR gRNA sequence
gccatttgtatatcctcctt

SEQ ID NO: 558361 - DNA, 20 bp, Artificial
  CRISPR gRNA sequence
gtatatcctcctttgagaac

SEQ ID NO: 558362 - DNA, 20 bp, Artificial
  CRISPR gRNA sequence
tatatcctcctttgagaact

SEQ ID NO: 558363 - DNA, 20 bp, Artificial
  CRISPR gRNA sequence
ctttgagaactgtctattca

SEQ ID NO: 558364 - DNA, 20 bp, Artificial
  CRISPR gRNA sequence
tgagaactgtctattcatgt

SEQ ID NO: 558365 - DNA, 20 bp, Artificial
  CRISPR gRNA sequence
gagaactgtctattcatgtc

SEQ ID NO: 558366 - DNA, 20 bp, Artificial
  CRISPR gRNA sequence
agaactgtctattcatgtcc

SEQ ID NO: 558367 - DNA, 20 bp, Artificial
  CRISPR gRNA sequence
tctattcatgtccttggccc

SEQ ID NO: 558368 - DNA, 20 bp, Artificial
  CRISPR gRNA sequence
ttcatgtccttggcccactt

SEQ ID NO: 558369 - DNA, 20 bp, Artificial
  CRISPR gRNA sequence
atgtccttggcccacttttt

SEQ ID NO: 558370 - DNA, 20 bp, Artificial
  CRISPR gRNA sequence
ggcccactttttgatgggat

SEQ ID NO: 558371 - DNA, 20 bp, Artificial
  CRISPR gRNA sequence
gcccactttttgatgggatt

SEQ ID NO: 558372 - DNA, 20 bp, Artificial
  CRISPR gRNA sequence
tttgatgggattgtttgctt

SEQ ID NO: 558373 - DNA, 20 bp, Artificial
  CRISPR gRNA sequence
ttgatgggattgtttgcttt

SEQ ID NO: 558374 - DNA, 20 bp, Artificial
  CRISPR gRNA sequence
tgatgggattgtttgctttt

SEQ ID NO: 558375 - DNA, 20 bp, Artificial
  CRISPR gRNA sequence
gatgggattgtttgcttttt

SEQ ID NO: 558376 - DNA, 20 bp, Artificial
  CRISPR gRNA sequence
atgggattgtttgctttttt

SEQ ID NO: 558377 - DNA, 20 bp, Artificial
  CRISPR gRNA sequence
tttgcttttttcttgctgat

SEQ ID NO: 558378 - DNA, 20 bp, Artificial
  CRISPR gRNA sequence
gcttttttcttgctgatttg

SEQ ID NO: 558379 - DNA, 20 bp, Artificial
  CRISPR gRNA sequence
cttttttcttgctgatttgt

SEQ ID NO: 558380 - DNA, 20 bp, Artificial
  CRISPR gRNA sequence
ttttcttgctgatttgtttg

SEQ ID NO: 558381 - DNA, 20 bp, Artificial
  CRISPR gRNA sequence
tttcttgctgatttgtttga

SEQ ID NO: 558382 - DNA, 20 bp, Artificial
  CRISPR gRNA sequence
ttcttgctgatttgtttgac

SEQ ID NO: 558383 - DNA, 20 bp, Artificial
  CRISPR gRNA sequence
tcttgctgatttgtttgact

SEQ ID NO: 558384 - DNA, 20 bp, Artificial
  CRISPR gRNA sequence
cttgctgatttgtttgactt

SEQ ID NO: 558385 - DNA, 20 bp, Artificial
  CRISPR gRNA sequence
ttgctgatttgtttgacttc

SEQ ID NO: 558386 - DNA, 20 bp, Artificial
  CRISPR gRNA sequence
gctgatttgtttgacttcct

SEQ ID NO: 558387 - DNA, 20 bp, Artificial
  CRISPR gRNA sequence
ctgatttgtttgacttcctt

SEQ ID NO: 558388 - DNA, 20 bp, Artificial
  CRISPR gRNA sequence
atttgtttgacttccttata

SEQ ID NO: 558389 - DNA, 20 bp, Artificial
  CRISPR gRNA sequence
gtttgacttccttatagatt

SEQ ID NO: 558390 - DNA, 20 bp, Artificial
  CRISPR gRNA sequence
tttgacttccttatagattc

SEQ ID NO: 558391 - DNA, 20 bp, Artificial
  CRISPR gRNA sequence
gacttccttatagattctgg

SEQ ID NO: 558392 - DNA, 20 bp, Artificial
  CRISPR gRNA sequence
acttccttatagattctgga

SEQ ID NO: 558393 - DNA, 20 bp, Artificial
  CRISPR gRNA sequence
ccttatagattctggatatt

SEQ ID NO: 558394 - DNA, 20 bp, Artificial
  CRISPR gRNA sequence
cttatagattctggatattg

SEQ ID NO: 558395 - DNA, 20 bp, Artificial
  CRISPR gRNA sequence
atagattctggatattggtc

SEQ ID NO: 558396 - DNA, 20 bp, Artificial
  CRISPR gRNA sequence
tagattctggatattggtcc

SEQ ID NO: 558397 - DNA, 20 bp, Artificial
  CRISPR gRNA sequence
tggatattggtcctttgtca

SEQ ID NO: 558398 - DNA, 20 bp, Artificial
  CRISPR gRNA sequence
gatattggtcctttgtcaga

SEQ ID NO: 558399 - DNA, 20 bp, Artificial
  CRISPR gRNA sequence
gtcctttgtcagatacatag

SEQ ID NO: 558400 - DNA, 20 bp, Artificial
  CRISPR gRNA sequence
tgtcagatacatagtttgtg

SEQ ID NO: 558401 - DNA, 20 bp, Artificial
  CRISPR gRNA sequence
gtcagatacatagtttgtga

SEQ ID NO: 558402 - DNA, 20 bp, Artificial
  CRISPR gRNA sequence
tcagatacatagtttgtgaa

SEQ ID NO: 558403 - DNA, 20 bp, Artificial
  CRISPR gRNA sequence
gtgaatattttctcccactt

SEQ ID NO: 558404 - DNA, 20 bp, Artificial
  CRISPR gRNA sequence
tgaatattttctcccacttt

SEQ ID NO: 558405 - DNA, 20 bp, Artificial
  CRISPR gRNA sequence
tctcccactttgtgggttgt

SEQ ID NO: 558406 - DNA, 20 bp, Artificial
  CRISPR gRNA sequence
ctcccactttgtgggttgtg

SEQ ID NO: 558407 - DNA, 20 bp, Artificial
  CRISPR gRNA sequence
tcccactttgtgggttgtgt

SEQ ID NO: 558408 - DNA, 20 bp, Artificial
  CRISPR gRNA sequence
ccactttgtgggttgtgtgt

SEQ ID NO: 558409 - DNA, 20 bp, Artificial
  CRISPR gRNA sequence
tgtgggttgtgtgtttactc

SEQ ID NO: 558410 - DNA, 20 bp, Artificial
  CRISPR gRNA sequence
gtgggttgtgtgtttactct

SEQ ID NO: 558411 - DNA, 20 bp, Artificial
  CRISPR gRNA sequence
tgggttgtgtgtttactctg

SEQ ID NO: 558412 - DNA, 20 bp, Artificial
  CRISPR gRNA sequence
tgtgtttactctgctgattg

SEQ ID NO: 558413 - DNA, 20 bp, Artificial
  CRISPR gRNA sequence
actctgctgattgtttatat

SEQ ID NO: 558414 - DNA, 20 bp, Artificial
  CRISPR gRNA sequence
ctctgctgattgtttatatt

SEQ ID NO: 558415 - DNA, 20 bp, Artificial
  CRISPR gRNA sequence
tgctgattgtttatattgct

SEQ ID NO: 558416 - DNA, 20 bp, Artificial
  CRISPR gRNA sequence
ctgattgtttatattgctgt

SEQ ID NO: 558417 - DNA, 20 bp, Artificial
  CRISPR gRNA sequence
attgtttatattgctgtaca

SEQ ID NO: 558418 - DNA, 20 bp, Artificial
  CRISPR gRNA sequence
tttatattgctgtacagaag

SEQ ID NO: 558419 - DNA, 20 bp, Artificial
  CRISPR gRNA sequence
atattgctgtacagaagctt

SEQ ID NO: 558420 - DNA, 20 bp, Artificial
  CRISPR gRNA sequence
tattgctgtacagaagcttt

SEQ ID NO: 558421 - DNA, 20 bp, Artificial
  CRISPR gRNA sequence
ctgtacagaagctttttaat

SEQ ID NO: 558422 - DNA, 20 bp, Artificial
  CRISPR gRNA sequence
tacagaagctttttaattta

SEQ ID NO: 558423 - DNA, 20 bp, Artificial
  CRISPR gRNA sequence
tttaatttaagccccatcta

SEQ ID NO: 558424 - DNA, 20 bp, Artificial
  CRISPR gRNA sequence
ttaatttaagccccatctat

SEQ ID NO: 558425 - DNA, 20 bp, Artificial
  CRISPR gRNA sequence
taatttaagccccatctatt

SEQ ID NO: 558426 - DNA, 20 bp, Artificial
  CRISPR gRNA sequence
aatttaagccccatctattt

SEQ ID NO: 558427 - DNA, 20 bp, Artificial
  CRISPR gRNA sequence
atttaagccccatctattta

SEQ ID NO: 558428 - DNA, 20 bp, Artificial
  CRISPR gRNA sequence
aagccccatctatttatctt

SEQ ID NO: 558429 - DNA, 20 bp, Artificial
  CRISPR gRNA sequence
agccccatctatttatcttt

SEQ ID NO: 558430 - DNA, 20 bp, Artificial
  CRISPR gRNA sequence
tttatctttgtttttgttgc

SEQ ID NO: 558431 - DNA, 20 bp, Artificial
  CRISPR gRNA sequence
atctttgtttttgttgcatt

SEQ ID NO: 558432 - DNA, 20 bp, Artificial
  CRISPR gRNA sequence
tctttgtttttgttgcattt

SEQ ID NO: 558433 - DNA, 20 bp, Artificial
  CRISPR gRNA sequence
tgtttttgttgcatttgttt

SEQ ID NO: 558434 - DNA, 20 bp, Artificial
  CRISPR gRNA sequence
gtttttgttgcatttgtttt

SEQ ID NO: 558435 - DNA, 20 bp, Artificial
  CRISPR gRNA sequence
tttttgttgcatttgttttt

SEQ ID NO: 558436 - DNA, 20 bp, Artificial
  CRISPR gRNA sequence
ttgttgcatttgtttttggg

SEQ ID NO: 558437 - DNA, 20 bp, Artificial
  CRISPR gRNA sequence
tgttgcatttgtttttgggt

SEQ ID NO: 558438 - DNA, 20 bp, Artificial
  CRISPR gRNA sequence
gttgcatttgtttttgggtt

SEQ ID NO: 558439 - DNA, 20 bp, Artificial
  CRISPR gRNA sequence
ttgcatttgtttttgggttc

SEQ ID NO: 558440 - DNA, 20 bp, Artificial
  CRISPR gRNA sequence
catttgtttttgggttcttg

SEQ ID NO: 558441 - DNA, 20 bp, Artificial
  CRISPR gRNA sequence
gtttttgggttcttggtcat

SEQ ID NO: 558442 - DNA, 20 bp, Artificial
  CRISPR gRNA sequence
tttttgggttcttggtcatg

SEQ ID NO: 558443 - DNA, 20 bp, Artificial
  CRISPR gRNA sequence
ttgggttcttggtcatgacc

SEQ ID NO: 558444 - DNA, 20 bp, Artificial
  CRISPR gRNA sequence
tgggttcttggtcatgacct

SEQ ID NO: 558445 - DNA, 20 bp, Artificial
  CRISPR gRNA sequence
gggttcttggtcatgacctt

SEQ ID NO: 558446 - DNA, 20 bp, Artificial
  CRISPR gRNA sequence
ggttcttggtcatgaccttt

SEQ ID NO: 558447 - DNA, 20 bp, Artificial
  CRISPR gRNA sequence
ttggtcatgaccttttgcct

SEQ ID NO: 558448 - DNA, 20 bp, Artificial
  CRISPR gRNA sequence
ggtcatgaccttttgcctaa

SEQ ID NO: 558449 - DNA, 20 bp, Artificial
  CRISPR gRNA sequence
gtcatgaccttttgcctaag

SEQ ID NO: 558450 - DNA, 20 bp, Artificial
  CRISPR gRNA sequence
ttgcctaagccaaagtctag

SEQ ID NO: 558451 - DNA, 20 bp, Artificial
  CRISPR gRNA sequence
tgcctaagccaaagtctaga

SEQ ID NO: 558452 - DNA, 20 bp, Artificial
  CRISPR gRNA sequence
gcctaagccaaagtctagaa

SEQ ID NO: 558453 - DNA, 20 bp, Artificial
  CRISPR gRNA sequence
cctaagccaaagtctagaag

SEQ ID NO: 558454 - DNA, 20 bp, Artificial
  CRISPR gRNA sequence
agccaaagtctagaagagtt

SEQ ID NO: 558455 - DNA, 20 bp, Artificial
  CRISPR gRNA sequence
gaagagtttttctgatgtta

SEQ ID NO: 558456 - DNA, 20 bp, Artificial
  CRISPR gRNA sequence
ttctgatgttatcttctaga

SEQ ID NO: 558457 - DNA, 20 bp, Artificial
  CRISPR gRNA sequence
tctgatgttatcttctagaa

SEQ ID NO: 558458 - DNA, 20 bp, Artificial
  CRISPR gRNA sequence
ctgatgttatcttctagaat

SEQ ID NO: 558459 - DNA, 20 bp, Artificial
  CRISPR gRNA sequence
tgatgttatcttctagaatt

SEQ ID NO: 558460 - DNA, 20 bp, Artificial
  CRISPR gRNA sequence
atgttatcttctagaatttt

SEQ ID NO: 558461 - DNA, 20 bp, Artificial
  CRISPR gRNA sequence
tcttctagaatttttatggc

SEQ ID NO: 558462 - DNA, 20 bp, Artificial
  CRISPR gRNA sequence
ctagaatttttatggcttca

SEQ ID NO: 558463 - DNA, 20 bp, Artificial
  CRISPR gRNA sequence
tagaatttttatggcttcag

SEQ ID NO: 558464 - DNA, 20 bp, Artificial
  CRISPR gRNA sequence
gaatttttatggcttcaggt

SEQ ID NO: 558465 - DNA, 20 bp, Artificial
  CRISPR gRNA sequence
ttatggcttcaggtcttaga

SEQ ID NO: 558466 - DNA, 20 bp, Artificial
  CRISPR gRNA sequence
tatggcttcaggtcttagat

SEQ ID NO: 558467 - DNA, 20 bp, Artificial
  CRISPR gRNA sequence
atggcttcaggtcttagatt

SEQ ID NO: 558468 - DNA, 20 bp, Artificial
  CRISPR gRNA sequence
tggcttcaggtcttagattt

SEQ ID NO: 558469 - DNA, 20 bp, Artificial
  CRISPR gRNA sequence
caggtcttagatttaagttt

SEQ ID NO: 558470 - DNA, 20 bp, Artificial
  CRISPR gRNA sequence
aggtcttagatttaagtttt

SEQ ID NO: 558471 - DNA, 20 bp, Artificial
  CRISPR gRNA sequence
agatttaagtttttgatcca

SEQ ID NO: 558472 - DNA, 20 bp, Artificial
  CRISPR gRNA sequence
gatttaagtttttgatccac

SEQ ID NO: 558473 - DNA, 20 bp, Artificial
  CRISPR gRNA sequence
aagtttttgatccaccttga

SEQ ID NO: 558474 - DNA, 20 bp, Artificial
  CRISPR gRNA sequence
agtttttgatccaccttgag

SEQ ID NO: 558475 - DNA, 20 bp, Artificial
  CRISPR gRNA sequence
ttgatccaccttgagttgat

SEQ ID NO: 558476 - DNA, 20 bp, Artificial
  CRISPR gRNA sequence
tgatccaccttgagttgatt

SEQ ID NO: 558477 - DNA, 20 bp, Artificial
  CRISPR gRNA sequence
gatccaccttgagttgattt

SEQ ID NO: 558478 - DNA, 20 bp, Artificial
  CRISPR gRNA sequence
atccaccttgagttgatttt

SEQ ID NO: 558479 - DNA, 20 bp, Artificial
  CRISPR gRNA sequence
gagttgatttttatataagg

SEQ ID NO: 558480 - DNA, 20 bp, Artificial
  CRISPR gRNA sequence
agttgatttttatataaggt

SEQ ID NO: 558481 - DNA, 20 bp, Artificial
  CRISPR gRNA sequence
atttttatataaggtgaaag

SEQ ID NO: 558482 - DNA, 20 bp, Artificial
  CRISPR gRNA sequence
ttatataaggtgaaagatga

SEQ ID NO: 558483 - DNA, 20 bp, Artificial
  CRISPR gRNA sequence
tatataaggtgaaagatgag

SEQ ID NO: 558484 - DNA, 20 bp, Artificial
  CRISPR gRNA sequence
atataaggtgaaagatgagg

SEQ ID NO: 558485 - DNA, 20 bp, Artificial
  CRISPR gRNA sequence
tataaggtgaaagatgagga

SEQ ID NO: 558486 - DNA, 20 bp, Artificial
  CRISPR gRNA sequence
cattcttctacaccttatgc

SEQ ID NO: 558487 - DNA, 20 bp, Artificial
  CRISPR gRNA sequence
attcttctacaccttatgct

SEQ ID NO: 558488 - DNA, 20 bp, Artificial
  CRISPR gRNA sequence
ttctacaccttatgcttttc

SEQ ID NO: 558489 - DNA, 20 bp, Artificial
  CRISPR gRNA sequence
ctacaccttatgcttttcct

SEQ ID NO: 558490 - DNA, 20 bp, Artificial
  CRISPR gRNA sequence
tacaccttatgcttttccta

SEQ ID NO: 558491 - DNA, 20 bp, Artificial
  CRISPR gRNA sequence
caccttatgcttttcctaat

SEQ ID NO: 558492 - DNA, 20 bp, Artificial
  CRISPR gRNA sequence
atgcttttcctaataagttc

SEQ ID NO: 558493 - DNA, 20 bp, Artificial
  CRISPR gRNA sequence
tgcttttcctaataagttct

SEQ ID NO: 558494 - DNA, 20 bp, Artificial
  CRISPR gRNA sequence
ttcctaataagttcttttct

SEQ ID NO: 558495 - DNA, 20 bp, Artificial
  CRISPR gRNA sequence
tcctaataagttcttttctc

SEQ ID NO: 558496 - DNA, 20 bp, Artificial
  CRISPR gRNA sequence
cctaataagttcttttctct

SEQ ID NO: 558497 - DNA, 20 bp, Artificial
  CRISPR gRNA sequence
ctaataagttcttttctcta

SEQ ID NO: 558498 - DNA, 20 bp, Artificial
  CRISPR gRNA sequence
ataagttcttttctctagct

SEQ ID NO: 558499 - DNA, 20 bp, Artificial
  CRISPR gRNA sequence
ttttctctagcttaatttag

SEQ ID NO: 558500 - DNA, 20 bp, Artificial
  CRISPR gRNA sequence
ttctctagcttaatttagtg

SEQ ID NO: 558501 - DNA, 20 bp, Artificial
  CRISPR gRNA sequence
tctctagcttaatttagtgt

SEQ ID NO: 558502 - DNA, 20 bp, Artificial
  CRISPR gRNA sequence
ctctagcttaatttagtgta

SEQ ID NO: 558503 - DNA, 20 bp, Artificial
  CRISPR gRNA sequence
tctagcttaatttagtgtaa

SEQ ID NO: 558504 - DNA, 20 bp, Artificial
  CRISPR gRNA sequence
tagcttaatttagtgtaaga

SEQ ID NO: 558505 - DNA, 20 bp, Artificial
  CRISPR gRNA sequence
gcttaatttagtgtaagaat

SEQ ID NO: 558506 - DNA, 20 bp, Artificial
  CRISPR gRNA sequence
aatttagtgtaagaatacaa

SEQ ID NO: 558507 - DNA, 20 bp, Artificial
  CRISPR gRNA sequence
atttagtgtaagaatacaac

SEQ ID NO: 558508 - DNA, 20 bp, Artificial
  CRISPR gRNA sequence
agtgtaagaatacaacatgc

SEQ ID NO: 558509 - DNA, 20 bp, Artificial
  CRISPR gRNA sequence
gtgtaagaatacaacatgca

SEQ ID NO: 558510 - DNA, 20 bp, Artificial
  CRISPR gRNA sequence
tttatgttattggtaaggct

SEQ ID NO: 558511 - DNA, 20 bp, Artificial
  CRISPR gRNA sequence
atgttattggtaaggcttct

SEQ ID NO: 558512 - DNA, 20 bp, Artificial
  CRISPR gRNA sequence
tgttattggtaaggcttctg

SEQ ID NO: 558513 - DNA, 20 bp, Artificial
  CRISPR gRNA sequence
ttggtaaggcttctggtagg

SEQ ID NO: 558514 - DNA, 20 bp, Artificial
  CRISPR gRNA sequence
gtaaggcttctggtaggcta

SEQ ID NO: 558515 - DNA, 20 bp, Artificial
  CRISPR gRNA sequence
ctggtaggctattagcagtt

SEQ ID NO: 558516 - DNA, 20 bp, Artificial
  CRISPR gRNA sequence
tggtaggctattagcagtta

SEQ ID NO: 558517 - DNA, 20 bp, Artificial
  CRISPR gRNA sequence
gtaggctattagcagttaag

SEQ ID NO: 558518 - DNA, 20 bp, Artificial
  CRISPR gRNA sequence
ttagcagttaagtttttggg

SEQ ID NO: 558519 - DNA, 20 bp, Artificial
  CRISPR gRNA sequence
gcagttaagtttttgggagt

SEQ ID NO: 558520 - DNA, 20 bp, Artificial
  CRISPR gRNA sequence
agtttttgggagtcaagagt

SEQ ID NO: 558521 - DNA, 20 bp, Artificial
  CRISPR gRNA sequence
ttgggagtcaagagttatac

SEQ ID NO: 558522 - DNA, 20 bp, Artificial
  CRISPR gRNA sequence
tgggagtcaagagttataca

SEQ ID NO: 558523 - DNA, 20 bp, Artificial
  CRISPR gRNA sequence
gggagtcaagagttatacat

SEQ ID NO: 558524 - DNA, 20 bp, Artificial
  CRISPR gRNA sequence
ggagtcaagagttatacata

SEQ ID NO: 558525 - DNA, 20 bp, Artificial
  CRISPR gRNA sequence
tacataaatttttgactgct

SEQ ID NO: 558526 - DNA, 20 bp, Artificial
  CRISPR gRNA sequence
ttgactgctcaaggggttgg

SEQ ID NO: 558527 - DNA, 20 bp, Artificial
  CRISPR gRNA sequence
tgactgctcaaggggttggt

SEQ ID NO: 558528 - DNA, 20 bp, Artificial
  CRISPR gRNA sequence
gactgctcaaggggttggtg

SEQ ID NO: 558529 - DNA, 20 bp, Artificial
  CRISPR gRNA sequence
actgctcaaggggttggtgc

SEQ ID NO: 558530 - DNA, 20 bp, Artificial
  CRISPR gRNA sequence
ctcaaggggttggtgcccct

SEQ ID NO: 558531 - DNA, 20 bp, Artificial
  CRISPR gRNA sequence
aaggggttggtgcccctaat

SEQ ID NO: 558532 - DNA, 20 bp, Artificial
  CRISPR gRNA sequence
gtgcccctaattgccatgtt

SEQ ID NO: 558533 - DNA, 20 bp, Artificial
  CRISPR gRNA sequence
attgccatgttgttcaaggg

SEQ ID NO: 558534 - DNA, 20 bp, Artificial
  CRISPR gRNA sequence
ccatgttgttcaagggtcaa

SEQ ID NO: 558535 - DNA, 20 bp, Artificial
  CRISPR gRNA sequence
ttcaagggtcaactataatt

SEQ ID NO: 558536 - DNA, 20 bp, Artificial
  CRISPR gRNA sequence
aagggtcaactataattttg

SEQ ID NO: 558537 - DNA, 20 bp, Artificial
  CRISPR gRNA sequence
taattttgaactagaagaaa

SEQ ID NO: 558538 - DNA, 20 bp, Artificial
  CRISPR gRNA sequence
tgaactagaagaaactctaa

SEQ ID NO: 558539 - DNA, 20 bp, Artificial
  CRISPR gRNA sequence
gaactagaagaaactctaaa

SEQ ID NO: 558540 - DNA, 20 bp, Artificial
  CRISPR gRNA sequence
aactagaagaaactctaaaa

SEQ ID NO: 558541 - DNA, 20 bp, Artificial
  CRISPR gRNA sequence
gaagaaactctaaaaattat

SEQ ID NO: 558542 - DNA, 20 bp, Artificial
  CRISPR gRNA sequence
taaaaattatttagtcaaat

SEQ ID NO: 558543 - DNA, 20 bp, Artificial
  CRISPR gRNA sequence
aaaattatttagtcaaatta

SEQ ID NO: 558544 - DNA, 20 bp, Artificial
  CRISPR gRNA sequence
tttagtcaaattactcccat

SEQ ID NO: 558545 - DNA, 20 bp, Artificial
  CRISPR gRNA sequence
agtcaaattactcccatttc

SEQ ID NO: 558546 - DNA, 20 bp, Artificial
  CRISPR gRNA sequence
gtcaaattactcccatttca

SEQ ID NO: 558547 - DNA, 20 bp, Artificial
  CRISPR gRNA sequence
ctcccatttcactggtgaag

SEQ ID NO: 558548 - DNA, 20 bp, Artificial
  CRISPR gRNA sequence
ccatttcactggtgaagtga

SEQ ID NO: 558549 - DNA, 20 bp, Artificial
  CRISPR gRNA sequence
cactggtgaagtgacaagac

SEQ ID NO: 558550 - DNA, 20 bp, Artificial
  CRISPR gRNA sequence
actggtgaagtgacaagaca

SEQ ID NO: 558551 - DNA, 20 bp, Artificial
  CRISPR gRNA sequence
gtgaagtgacaagacaccaa

SEQ ID NO: 558552 - DNA, 20 bp, Artificial
  CRISPR gRNA sequence
tattgaatgcttactctctg

SEQ ID NO: 558553 - DNA, 20 bp, Artificial
  CRISPR gRNA sequence
attgaatgcttactctctgc

SEQ ID NO: 558554 - DNA, 20 bp, Artificial
  CRISPR gRNA sequence
ttgaatgcttactctctgct

SEQ ID NO: 558555 - DNA, 20 bp, Artificial
  CRISPR gRNA sequence
aatgcttactctctgctggt

SEQ ID NO: 558556 - DNA, 20 bp, Artificial
  CRISPR gRNA sequence
actctctgctggttatatgt

SEQ ID NO: 558557 - DNA, 20 bp, Artificial
  CRISPR gRNA sequence
ctctctgctggttatatgtt

SEQ ID NO: 558558 - DNA, 20 bp, Artificial
  CRISPR gRNA sequence
tctgctggttatatgttcac

SEQ ID NO: 558559 - DNA, 20 bp, Artificial
  CRISPR gRNA sequence
tgctggttatatgttcacat

SEQ ID NO: 558560 - DNA, 20 bp, Artificial
  CRISPR gRNA sequence
ctggttatatgttcacattg

SEQ ID NO: 558561 - DNA, 20 bp, Artificial
  CRISPR gRNA sequence
gttatatgttcacattgtct

SEQ ID NO: 558562 - DNA, 20 bp, Artificial
  CRISPR gRNA sequence
tatgttcacattgtcttgta

SEQ ID NO: 558563 - DNA, 20 bp, Artificial
  CRISPR gRNA sequence
acattgtcttgtattccttt

SEQ ID NO: 558564 - DNA, 20 bp, Artificial
  CRISPR gRNA sequence
tcttgtattcctttttatcc

SEQ ID NO: 558565 - DNA, 20 bp, Artificial
  CRISPR gRNA sequence
gtattcctttttatccctct

SEQ ID NO: 558566 - DNA, 20 bp, Artificial
  CRISPR gRNA sequence
tattcctttttatccctctc

SEQ ID NO: 558567 - DNA, 20 bp, Artificial
  CRISPR gRNA sequence
ctttttatccctctccatgt

SEQ ID NO: 558568 - DNA, 20 bp, Artificial
  CRISPR gRNA sequence
tttatccctctccatgtcta

SEQ ID NO: 558569 - DNA, 20 bp, Artificial
  CRISPR gRNA sequence
ttatccctctccatgtctac

SEQ ID NO: 558570 - DNA, 20 bp, Artificial
  CRISPR gRNA sequence
tatccctctccatgtctacc

SEQ ID NO: 558571 - DNA, 20 bp, Artificial
  CRISPR gRNA sequence
atccctctccatgtctacct

SEQ ID NO: 558572 - DNA, 20 bp, Artificial
  CRISPR gRNA sequence
tccctctccatgtctacctg

SEQ ID NO: 558573 - DNA, 20 bp, Artificial
  CRISPR gRNA sequence
tccatgtctacctgcagtag

SEQ ID NO: 558574 - DNA, 20 bp, Artificial
  CRISPR gRNA sequence
catgtctacctgcagtaggt

SEQ ID NO: 558575 - DNA, 20 bp, Artificial
  CRISPR gRNA sequence
cctgcagtaggtgttattaa

SEQ ID NO: 558576 - DNA, 20 bp, Artificial
  CRISPR gRNA sequence
cagtaggtgttattaacccc

SEQ ID NO: 558577 - DNA, 20 bp, Artificial
  CRISPR gRNA sequence
ttaaccccatttacaggtag

SEQ ID NO: 558578 - DNA, 20 bp, Artificial
  CRISPR gRNA sequence
accccatttacaggtaggaa

SEQ ID NO: 558579 - DNA, 20 bp, Artificial
  CRISPR gRNA sequence
acaggtaggaaagcaggctc

SEQ ID NO: 558580 - DNA, 20 bp, Artificial
  CRISPR gRNA sequence
caggtaggaaagcaggctcc

SEQ ID NO: 558581 - DNA, 20 bp, Artificial
  CRISPR gRNA sequence
caagaggcatatcaccttgc

SEQ ID NO: 558582 - DNA, 20 bp, Artificial
  CRISPR gRNA sequence
gctccatgtctctcagcaag

SEQ ID NO: 558583 - DNA, 20 bp, Artificial
  CRISPR gRNA sequence
ctccatgtctctcagcaagt

SEQ ID NO: 558584 - DNA, 20 bp, Artificial
  CRISPR gRNA sequence
catgtctctcagcaagttta

SEQ ID NO: 558585 - DNA, 20 bp, Artificial
  CRISPR gRNA sequence
tcagcaagtttatggcggca

SEQ ID NO: 558586 - DNA, 20 bp, Artificial
  CRISPR gRNA sequence
agcaagtttatggcggcaca

SEQ ID NO: 558587 - DNA, 20 bp, Artificial
  CRISPR gRNA sequence
atggcggcacaatgaccaga

SEQ ID NO: 558588 - DNA, 20 bp, Artificial
  CRISPR gRNA sequence
tggcggcacaatgaccagaa

SEQ ID NO: 558589 - DNA, 20 bp, Artificial
  CRISPR gRNA sequence
tctgactccttggtcagtgc

SEQ ID NO: 558590 - DNA, 20 bp, Artificial
  CRISPR gRNA sequence
actccttggtcagtgccctt

SEQ ID NO: 558591 - DNA, 20 bp, Artificial
  CRISPR gRNA sequence
cttggtcagtgccctttcag

SEQ ID NO: 558592 - DNA, 20 bp, Artificial
  CRISPR gRNA sequence
ggtcagtgccctttcagaac

SEQ ID NO: 558593 - DNA, 20 bp, Artificial
  CRISPR gRNA sequence
gtcagtgccctttcagaaca

SEQ ID NO: 558594 - DNA, 20 bp, Artificial
  CRISPR gRNA sequence
tcagaacagcgtggtcccac

SEQ ID NO: 558595 - DNA, 20 bp, Artificial
  CRISPR gRNA sequence
cagaacagcgtggtcccaca

SEQ ID NO: 558596 - DNA, 20 bp, Artificial
  CRISPR gRNA sequence
agaacagcgtggtcccacat

SEQ ID NO: 558597 - DNA, 20 bp, Artificial
  CRISPR gRNA sequence
aggatgggattcatttattc

SEQ ID NO: 558598 - DNA, 20 bp, Artificial
  CRISPR gRNA sequence
atttattcattcactcagga

SEQ ID NO: 558599 - DNA, 20 bp, Artificial
  CRISPR gRNA sequence
attcattcactcaggaaata

SEQ ID NO: 558600 - DNA, 20 bp, Artificial
  CRISPR gRNA sequence
ttcattcactcaggaaatat

SEQ ID NO: 558601 - DNA, 20 bp, Artificial
  CRISPR gRNA sequence
attcactcaggaaatattca

SEQ ID NO: 558602 - DNA, 20 bp, Artificial
  CRISPR gRNA sequence
actcaggaaatattcattgg

SEQ ID NO: 558603 - DNA, 20 bp, Artificial
  CRISPR gRNA sequence
aggaaatattcattgggcat

SEQ ID NO: 558604 - DNA, 20 bp, Artificial
  CRISPR gRNA sequence
attgggcatctattctatat

SEQ ID NO: 558605 - DNA, 20 bp, Artificial
  CRISPR gRNA sequence
ggcatctattctatataaga

SEQ ID NO: 558606 - DNA, 20 bp, Artificial
  CRISPR gRNA sequence
ttctatataagatccttgag

SEQ ID NO: 558607 - DNA, 20 bp, Artificial
  CRISPR gRNA sequence
tatataagatccttgagaac

SEQ ID NO: 558608 - DNA, 20 bp, Artificial
  CRISPR gRNA sequence
tataagatccttgagaacaa

SEQ ID NO: 558609 - DNA, 20 bp, Artificial
  CRISPR gRNA sequence
gagaacaagacagacaccgt

SEQ ID NO: 558610 - DNA, 20 bp, Artificial
  CRISPR gRNA sequence
agaacaagacagacaccgtc

SEQ ID NO: 558611 - DNA, 20 bp, Artificial
  CRISPR gRNA sequence
ccttcttagagttgacattc

SEQ ID NO: 558612 - DNA, 20 bp, Artificial
  CRISPR gRNA sequence
cttcttagagttgacattct

SEQ ID NO: 558613 - DNA, 20 bp, Artificial
  CRISPR gRNA sequence
cttagagttgacattctatt

SEQ ID NO: 558614 - DNA, 20 bp, Artificial
  CRISPR gRNA sequence
ttagagttgacattctatta

SEQ ID NO: 558615 - DNA, 20 bp, Artificial
  CRISPR gRNA sequence
agagttgacattctattagg

SEQ ID NO: 558616 - DNA, 20 bp, Artificial
  CRISPR gRNA sequence
gagttgacattctattaggg

SEQ ID NO: 558617 - DNA, 20 bp, Artificial
  CRISPR gRNA sequence
acattctattaggggaggca

SEQ ID NO: 558618 - DNA, 20 bp, Artificial
  CRISPR gRNA sequence
tattaggggaggcagaattt

SEQ ID NO: 558619 - DNA, 20 bp, Artificial
  CRISPR gRNA sequence
ttaggggaggcagaatttac

SEQ ID NO: 558620 - DNA, 20 bp, Artificial
  CRISPR gRNA sequence
ggggaggcagaatttacaca

SEQ ID NO: 558621 - DNA, 20 bp, Artificial
  CRISPR gRNA sequence
acacaaataattagacaatg

SEQ ID NO: 558622 - DNA, 20 bp, Artificial
  CRISPR gRNA sequence
cacaaataattagacaatgc

SEQ ID NO: 558623 - DNA, 20 bp, Artificial
  CRISPR gRNA sequence
gacaatgcccaactgcaact

SEQ ID NO: 558624 - DNA, 20 bp, Artificial
  CRISPR gRNA sequence
caactgtgataattgctgct

SEQ ID NO: 558625 - DNA, 20 bp, Artificial
  CRISPR gRNA sequence
tgataattgctgctaagtaa

SEQ ID NO: 558626 - DNA, 20 bp, Artificial
  CRISPR gRNA sequence
ctgctaagtaaaagcatcag

SEQ ID NO: 558627 - DNA, 20 bp, Artificial
  CRISPR gRNA sequence
ctaagtaaaagcatcaggtg

SEQ ID NO: 558628 - DNA, 20 bp, Artificial
  CRISPR gRNA sequence
agtaaaagcatcaggtgtca

SEQ ID NO: 558629 - DNA, 20 bp, Artificial
  CRISPR gRNA sequence
acttagggaactaacaaggg

SEQ ID NO: 558630 - DNA, 20 bp, Artificial
  CRISPR gRNA sequence
cttagggaactaacaagggg

SEQ ID NO: 558631 - DNA, 20 bp, Artificial
  CRISPR gRNA sequence
agggaactaacaaggggtta

SEQ ID NO: 558632 - DNA, 20 bp, Artificial
  CRISPR gRNA sequence
gggaactaacaaggggttag

SEQ ID NO: 558633 - DNA, 20 bp, Artificial
  CRISPR gRNA sequence
acaaggggttagggaaggca

SEQ ID NO: 558634 - DNA, 20 bp, Artificial
  CRISPR gRNA sequence
gggaaggcagttcccttccc

SEQ ID NO: 558635 - DNA, 20 bp, Artificial
  CRISPR gRNA sequence
ccttccctaaaagaagttct

SEQ ID NO: 558636 - DNA, 20 bp, Artificial
  CRISPR gRNA sequence
ccctaaaagaagttctgagg

SEQ ID NO: 558637 - DNA, 20 bp, Artificial
  CRISPR gRNA sequence
cctaaaagaagttctgaggc

SEQ ID NO: 558638 - DNA, 20 bp, Artificial
  CRISPR gRNA sequence
aaagaagttctgaggcacaa

SEQ ID NO: 558639 - DNA, 20 bp, Artificial
  CRISPR gRNA sequence
tgaggcacaagcagcagtta

SEQ ID NO: 558640 - DNA, 20 bp, Artificial
  CRISPR gRNA sequence
aggcacaagcagcagttaac

SEQ ID NO: 558641 - DNA, 20 bp, Artificial
  CRISPR gRNA sequence
actatgcccaggagagcagg

SEQ ID NO: 558642 - DNA, 20 bp, Artificial
  CRISPR gRNA sequence
tgcccaggagagcagggcag

SEQ ID NO: 558643 - DNA, 20 bp, Artificial
  CRISPR gRNA sequence
agagaacaattatgcagacc

SEQ ID NO: 558644 - DNA, 20 bp, Artificial
  CRISPR gRNA sequence
tgcagaccttgaagcaggag

SEQ ID NO: 558645 - DNA, 20 bp, Artificial
  CRISPR gRNA sequence
gaagcaggagcaatggcatg

SEQ ID NO: 558646 - DNA, 20 bp, Artificial
  CRISPR gRNA sequence
aagcaggagcaatggcatga

SEQ ID NO: 558647 - DNA, 20 bp, Artificial
  CRISPR gRNA sequence
catacacaagcacagccagc

SEQ ID NO: 558648 - DNA, 20 bp, Artificial
  CRISPR gRNA sequence
gcaaggcatcaaacaaacac

SEQ ID NO: 558649 - DNA, 20 bp, Artificial
  CRISPR gRNA sequence
caaggcatcaaacaaacaca

SEQ ID NO: 558650 - DNA, 20 bp, Artificial
  CRISPR gRNA sequence
tagtattgaagtaaagaaag

SEQ ID NO: 558651 - DNA, 20 bp, Artificial
  CRISPR gRNA sequence
gtattgaagtaaagaaagcc

SEQ ID NO: 558652 - DNA, 20 bp, Artificial
  CRISPR gRNA sequence
aagtaaagaaagccatagaa

SEQ ID NO: 558653 - DNA, 20 bp, Artificial
  CRISPR gRNA sequence
caaacaggatggggacaaaa

SEQ ID NO: 558654 - DNA, 20 bp, Artificial
  CRISPR gRNA sequence
aaacaggatggggacaaaat

SEQ ID NO: 558655 - DNA, 20 bp, Artificial
  CRISPR gRNA sequence
tttctttaaaaaatgtattt

SEQ ID NO: 558656 - DNA, 20 bp, Artificial
  CRISPR gRNA sequence
tctttaaaaaatgtatttta

SEQ ID NO: 558657 - DNA, 20 bp, Artificial
  CRISPR gRNA sequence
ctttaaaaaatgtattttaa

SEQ ID NO: 558658 - DNA, 20 bp, Artificial
  CRISPR gRNA sequence
tttaaaaaatgtattttaaa

SEQ ID NO: 558659 - DNA, 20 bp, Artificial
  CRISPR gRNA sequence
taaaaaatgtattttaaaac

SEQ ID NO: 558660 - DNA, 20 bp, Artificial
  CRISPR gRNA sequence
aaaaaatgtattttaaaaca

SEQ ID NO: 558661 - DNA, 20 bp, Artificial
  CRISPR gRNA sequence
aaaaatgtattttaaaacat

SEQ ID NO: 558662 - DNA, 20 bp, Artificial
  CRISPR gRNA sequence
taaaacataaattatacata

SEQ ID NO: 558663 - DNA, 20 bp, Artificial
  CRISPR gRNA sequence
aaaacataaattatacatag

SEQ ID NO: 558664 - DNA, 20 bp, Artificial
  CRISPR gRNA sequence
aaacataaattatacataga

SEQ ID NO: 558665 - DNA, 20 bp, Artificial
  CRISPR gRNA sequence
tacatagacacatacataca

SEQ ID NO: 558666 - DNA, 20 bp, Artificial
  CRISPR gRNA sequence
tacactaatgaaaaacgatc

SEQ ID NO: 558667 - DNA, 20 bp, Artificial
  CRISPR gRNA sequence
acactaatgaaaaacgatca

SEQ ID NO: 558668 - DNA, 20 bp, Artificial
  CRISPR gRNA sequence
cactaatgaaaaacgatcat

SEQ ID NO: 558669 - DNA, 20 bp, Artificial
  CRISPR gRNA sequence
atgaaaaacgatcatataag

SEQ ID NO: 558670 - DNA, 20 bp, Artificial
  CRISPR gRNA sequence
tttcagtcctcttatctggg

SEQ ID NO: 558671 - DNA, 20 bp, Artificial
  CRISPR gRNA sequence
ttcagtcctcttatctgggt

SEQ ID NO: 558672 - DNA, 20 bp, Artificial
  CRISPR gRNA sequence
tcagtcctcttatctgggtg

SEQ ID NO: 558673 - DNA, 20 bp, Artificial
  CRISPR gRNA sequence
cagtcctcttatctgggtgc

SEQ ID NO: 558674 - DNA, 20 bp, Artificial
  CRISPR gRNA sequence
agtcctcttatctgggtgcc

SEQ ID NO: 558675 - DNA, 20 bp, Artificial
  CRISPR gRNA sequence
ttatctgggtgccttaccca

SEQ ID NO: 558676 - DNA, 20 bp, Artificial
  CRISPR gRNA sequence
atctgggtgccttacccact

SEQ ID NO: 558677 - DNA, 20 bp, Artificial
  CRISPR gRNA sequence
tctgggtgccttacccactc

SEQ ID NO: 558678 - DNA, 20 bp, Artificial
  CRISPR gRNA sequence
ggtgccttacccactctctt

SEQ ID NO: 558679 - DNA, 20 bp, Artificial
  CRISPR gRNA sequence
acccactctcttaaccccat

SEQ ID NO: 558680 - DNA, 20 bp, Artificial
  CRISPR gRNA sequence
cccactctcttaaccccata

SEQ ID NO: 558681 - DNA, 20 bp, Artificial
  CRISPR gRNA sequence
tcttaaccccataacaatct

SEQ ID NO: 558682 - DNA, 20 bp, Artificial
  CRISPR gRNA sequence
ttaaccccataacaatctcc

SEQ ID NO: 558683 - DNA, 20 bp, Artificial
  CRISPR gRNA sequence
aaccccataacaatctccag

SEQ ID NO: 558684 - DNA, 20 bp, Artificial
  CRISPR gRNA sequence
accccataacaatctccagt

SEQ ID NO: 558685 - DNA, 20 bp, Artificial
  CRISPR gRNA sequence
cagttctataatctacatta

SEQ ID NO: 558686 - DNA, 20 bp, Artificial
  CRISPR gRNA sequence
tataatctacattaacaaat

SEQ ID NO: 558687 - DNA, 20 bp, Artificial
  CRISPR gRNA sequence
taatctacattaacaaatca

SEQ ID NO: 558688 - DNA, 20 bp, Artificial
  CRISPR gRNA sequence
cattaacaaatcagaataca

SEQ ID NO: 558689 - DNA, 20 bp, Artificial
  CRISPR gRNA sequence
acaaatcagaatacatcttt

SEQ ID NO: 558690 - DNA, 20 bp, Artificial
  CRISPR gRNA sequence
tcaatatttttctctcatat

SEQ ID NO: 558691 - DNA, 20 bp, Artificial
  CRISPR gRNA sequence
caatatttttctctcatata

SEQ ID NO: 558692 - DNA, 20 bp, Artificial
  CRISPR gRNA sequence
aatatttttctctcatatag

SEQ ID NO: 558693 - DNA, 20 bp, Artificial
  CRISPR gRNA sequence
ttctctcatatagtcaaata

SEQ ID NO: 558694 - DNA, 20 bp, Artificial
  CRISPR gRNA sequence
tctctcatatagtcaaatag

SEQ ID NO: 558695 - DNA, 20 bp, Artificial
  CRISPR gRNA sequence
ctctcatatagtcaaataga

SEQ ID NO: 558696 - DNA, 20 bp, Artificial
  CRISPR gRNA sequence
tctcatatagtcaaatagat

SEQ ID NO: 558697 - DNA, 20 bp, Artificial
  CRISPR gRNA sequence
tcatatagtcaaatagatac

SEQ ID NO: 558698 - DNA, 20 bp, Artificial
  CRISPR gRNA sequence
atatagtcaaatagatacaa

SEQ ID NO: 558699 - DNA, 20 bp, Artificial
  CRISPR gRNA sequence
gaagataccgtgggtttggt

SEQ ID NO: 558700 - DNA, 20 bp, Artificial
  CRISPR gRNA sequence
aagataccgtgggtttggtc

SEQ ID NO: 558701 - DNA, 20 bp, Artificial
  CRISPR gRNA sequence
ggtcccagacaacagcaatc

SEQ ID NO: 558702 - DNA, 20 bp, Artificial
  CRISPR gRNA sequence
gtcccagacaacagcaatca

SEQ ID NO: 558703 - DNA, 20 bp, Artificial
  CRISPR gRNA sequence
tctggtttcccagggcatat

SEQ ID NO: 558704 - DNA, 20 bp, Artificial
  CRISPR gRNA sequence
ctggtttcccagggcatata

SEQ ID NO: 558705 - DNA, 20 bp, Artificial
  CRISPR gRNA sequence
tggtttcccagggcatataa

SEQ ID NO: 558706 - DNA, 20 bp, Artificial
  CRISPR gRNA sequence
gtttcccagggcatataaat

SEQ ID NO: 558707 - DNA, 20 bp, Artificial
  CRISPR gRNA sequence
cccagggcatataaatgtta

SEQ ID NO: 558708 - DNA, 20 bp, Artificial
  CRISPR gRNA sequence
ccagggcatataaatgttat

SEQ ID NO: 558709 - DNA, 20 bp, Artificial
  CRISPR gRNA sequence
tgtttacactatactgtagt

SEQ ID NO: 558710 - DNA, 20 bp, Artificial
  CRISPR gRNA sequence
acactatactgtagtctatt

SEQ ID NO: 558711 - DNA, 20 bp, Artificial
  CRISPR gRNA sequence
cactatactgtagtctatta

SEQ ID NO: 558712 - DNA, 20 bp, Artificial
  CRISPR gRNA sequence
tactgtagtctattaaagtg

SEQ ID NO: 558713 - DNA, 20 bp, Artificial
  CRISPR gRNA sequence
tagtctattaaagtgttcaa

SEQ ID NO: 558714 - DNA, 20 bp, Artificial
  CRISPR gRNA sequence
ttaaagtgttcaatagcatt

SEQ ID NO: 558715 - DNA, 20 bp, Artificial
  CRISPR gRNA sequence
aagtgttcaatagcattatg

SEQ ID NO: 558716 - DNA, 20 bp, Artificial
  CRISPR gRNA sequence
aatagcattatgtctaaaaa

SEQ ID NO: 558717 - DNA, 20 bp, Artificial
  CRISPR gRNA sequence
tgtctaaaaacacaatgtac

SEQ ID NO: 558718 - DNA, 20 bp, Artificial
  CRISPR gRNA sequence
aaaacacaatgtacatattt

SEQ ID NO: 558719 - DNA, 20 bp, Artificial
  CRISPR gRNA sequence
aattaaaaaatactttattg

SEQ ID NO: 558720 - DNA, 20 bp, Artificial
  CRISPR gRNA sequence
attaaaaaatactttattgc

SEQ ID NO: 558721 - DNA, 20 bp, Artificial
  CRISPR gRNA sequence
aaaaatactttattgctgaa

SEQ ID NO: 558722 - DNA, 20 bp, Artificial
  CRISPR gRNA sequence
tattgctgaaaaaaaaaaca

SEQ ID NO: 558723 - DNA, 20 bp, Artificial
  CRISPR gRNA sequence
attgctgaaaaaaaaaacat

SEQ ID NO: 558724 - DNA, 20 bp, Artificial
  CRISPR gRNA sequence
ttgctgaaaaaaaaaacatg

SEQ ID NO: 558725 - DNA, 20 bp, Artificial
  CRISPR gRNA sequence
ctgaaaaaaaaaacatgcta

SEQ ID NO: 558726 - DNA, 20 bp, Artificial
  CRISPR gRNA sequence
aaaaaaaaaacatgctaaca

SEQ ID NO: 558727 - DNA, 20 bp, Artificial
  CRISPR gRNA sequence
acaatcatttgagccttcag

SEQ ID NO: 558728 - DNA, 20 bp, Artificial
  CRISPR gRNA sequence
gagccttcagcaagtcctaa

SEQ ID NO: 558729 - DNA, 20 bp, Artificial
  CRISPR gRNA sequence
agccttcagcaagtcctaat

SEQ ID NO: 558730 - DNA, 20 bp, Artificial
  CRISPR gRNA sequence
cagcaagtcctaatattttt

SEQ ID NO: 558731 - DNA, 20 bp, Artificial
  CRISPR gRNA sequence
agcaagtcctaatatttttg

SEQ ID NO: 558732 - DNA, 20 bp, Artificial
  CRISPR gRNA sequence
atatttttgctggtgaaagg

SEQ ID NO: 558733 - DNA, 20 bp, Artificial
  CRISPR gRNA sequence
ttgctggtgaaaggtcttgc

SEQ ID NO: 558734 - DNA, 20 bp, Artificial
  CRISPR gRNA sequence
tgctggtgaaaggtcttgcc

SEQ ID NO: 558735 - DNA, 20 bp, Artificial
  CRISPR gRNA sequence
gctggtgaaaggtcttgcct

SEQ ID NO: 558736 - DNA, 20 bp, Artificial
  CRISPR gRNA sequence
ctggtgaaaggtcttgcctc

SEQ ID NO: 558737 - DNA, 20 bp, Artificial
  CRISPR gRNA sequence
gtgaaaggtcttgcctcaat

SEQ ID NO: 558738 - DNA, 20 bp, Artificial
  CRISPR gRNA sequence
gcctcaatgttgatggctgc

SEQ ID NO: 558739 - DNA, 20 bp, Artificial
  CRISPR gRNA sequence
cctcaatgttgatggctgct

SEQ ID NO: 558740 - DNA, 20 bp, Artificial
  CRISPR gRNA sequence
aatgttgatggctgctgact

SEQ ID NO: 558741 - DNA, 20 bp, Artificial
  CRISPR gRNA sequence
atggctgctgactgatcagg

SEQ ID NO: 558742 - DNA, 20 bp, Artificial
  CRISPR gRNA sequence
ctgactgatcagggtgttgg

SEQ ID NO: 558743 - DNA, 20 bp, Artificial
  CRISPR gRNA sequence
actgatcagggtgttggttg

SEQ ID NO: 558744 - DNA, 20 bp, Artificial
  CRISPR gRNA sequence
atcagggtgttggttgctaa

SEQ ID NO: 558745 - DNA, 20 bp, Artificial
  CRISPR gRNA sequence
gttgctaaaggctgcaatgg

SEQ ID NO: 558746 - DNA, 20 bp, Artificial
  CRISPR gRNA sequence
ctaaaggctgcaatggctgt

SEQ ID NO: 558747 - DNA, 20 bp, Artificial
  CRISPR gRNA sequence
aaggctgcaatggctgtggc

SEQ ID NO: 558748 - DNA, 20 bp, Artificial
  CRISPR gRNA sequence
caatggctgtggcaatttct

SEQ ID NO: 558749 - DNA, 20 bp, Artificial
  CRISPR gRNA sequence
tggcaatttcttaaaagaag

SEQ ID NO: 558750 - DNA, 20 bp, Artificial
  CRISPR gRNA sequence
cttaaaagaagacaatgatg

SEQ ID NO: 558751 - DNA, 20 bp, Artificial
  CRISPR gRNA sequence
ttaaaagaagacaatgatga

SEQ ID NO: 558752 - DNA, 20 bp, Artificial
  CRISPR gRNA sequence
aaaagaagacaatgatgagt

SEQ ID NO: 558753 - DNA, 20 bp, Artificial
  CRISPR gRNA sequence
aaagaagacaatgatgagtt

SEQ ID NO: 558754 - DNA, 20 bp, Artificial
  CRISPR gRNA sequence
tgctgcatcaatggaccctt

SEQ ID NO: 558755 - DNA, 20 bp, Artificial
  CRISPR gRNA sequence
gctgcatcaatggacccttc

SEQ ID NO: 558756 - DNA, 20 bp, Artificial
  CRISPR gRNA sequence
ctgcatcaatggacccttcc

SEQ ID NO: 558757 - DNA, 20 bp, Artificial
  CRISPR gRNA sequence
catcaatggacccttccttt

SEQ ID NO: 558758 - DNA, 20 bp, Artificial
  CRISPR gRNA sequence
cctttcacaaaatatttctc

SEQ ID NO: 558759 - DNA, 20 bp, Artificial
  CRISPR gRNA sequence
ctttcacaaaatatttctca

SEQ ID NO: 558760 - DNA, 20 bp, Artificial
  CRISPR gRNA sequence
tcacaaaatatttctcagag

SEQ ID NO: 558761 - DNA, 20 bp, Artificial
  CRISPR gRNA sequence
cacaaaatatttctcagagg

SEQ ID NO: 558762 - DNA, 20 bp, Artificial
  CRISPR gRNA sequence
acaaaatatttctcagaggc

SEQ ID NO: 558763 - DNA, 20 bp, Artificial
  CRISPR gRNA sequence
ctcagaggcatccaatgctg

SEQ ID NO: 558764 - DNA, 20 bp, Artificial
  CRISPR gRNA sequence
tcagaggcatccaatgctgt

SEQ ID NO: 558765 - DNA, 20 bp, Artificial
  CRISPR gRNA sequence
agaggcatccaatgctgttt

SEQ ID NO: 558766 - DNA, 20 bp, Artificial
  CRISPR gRNA sequence
tttgatagaattttactcac

SEQ ID NO: 558767 - DNA, 20 bp, Artificial
  CRISPR gRNA sequence
gatagaattttactcacagt

SEQ ID NO: 558768 - DNA, 20 bp, Artificial
  CRISPR gRNA sequence
atagaattttactcacagta

SEQ ID NO: 558769 - DNA, 20 bp, Artificial
  CRISPR gRNA sequence
tactcacagtaaaactgctt

SEQ ID NO: 558770 - DNA, 20 bp, Artificial
  CRISPR gRNA sequence
actcacagtaaaactgcttt

SEQ ID NO: 558771 - DNA, 20 bp, Artificial
  CRISPR gRNA sequence
ctcacagtaaaactgctttc

SEQ ID NO: 558772 - DNA, 20 bp, Artificial
  CRISPR gRNA sequence
acagtaaaactgctttcaaa

SEQ ID NO: 558773 - DNA, 20 bp, Artificial
  CRISPR gRNA sequence
ctttcaaaattagagtaaat

SEQ ID NO: 558774 - DNA, 20 bp, Artificial
  CRISPR gRNA sequence
tcaaaattagagtaaatttt

SEQ ID NO: 558775 - DNA, 20 bp, Artificial
  CRISPR gRNA sequence
caaaattagagtaaattttc

SEQ ID NO: 558776 - DNA, 20 bp, Artificial
  CRISPR gRNA sequence
aaaattagagtaaattttct

SEQ ID NO: 558777 - DNA, 20 bp, Artificial
  CRISPR gRNA sequence
gagtaaattttctcaaatcc

SEQ ID NO: 558778 - DNA, 20 bp, Artificial
  CRISPR gRNA sequence
tctcaaatcctgctgctgct

SEQ ID NO: 558779 - DNA, 20 bp, Artificial
  CRISPR gRNA sequence
ctcaaatcctgctgctgctt

SEQ ID NO: 558780 - DNA, 20 bp, Artificial
  CRISPR gRNA sequence
tcaaatcctgctgctgcttt

SEQ ID NO: 558781 - DNA, 20 bp, Artificial
  CRISPR gRNA sequence
aaatcctgctgctgctttat

SEQ ID NO: 558782 - DNA, 20 bp, Artificial
  CRISPR gRNA sequence
ctgctgctttatcaactaaa

SEQ ID NO: 558783 - DNA, 20 bp, Artificial
  CRISPR gRNA sequence
ctgctttatcaactaaattt

SEQ ID NO: 558784 - DNA, 20 bp, Artificial
  CRISPR gRNA sequence
ctttatcaactaaatttatg

SEQ ID NO: 558785 - DNA, 20 bp, Artificial
  CRISPR gRNA sequence
tatcaactaaatttatgtaa

SEQ ID NO: 558786 - DNA, 20 bp, Artificial
  CRISPR gRNA sequence
atcaactaaatttatgtaat

SEQ ID NO: 558787 - DNA, 20 bp, Artificial
  CRISPR gRNA sequence
tcaactaaatttatgtaata

SEQ ID NO: 558788 - DNA, 20 bp, Artificial
  CRISPR gRNA sequence
aatttatgtaatactcttaa

SEQ ID NO: 558789 - DNA, 20 bp, Artificial
  CRISPR gRNA sequence
atgtaatactcttaaccctt

SEQ ID NO: 558790 - DNA, 20 bp, Artificial
  CRISPR gRNA sequence
tgtaatactcttaacccttt

SEQ ID NO: 558791 - DNA, 20 bp, Artificial
  CRISPR gRNA sequence
ttaaccctttgttgtcattt

SEQ ID NO: 558792 - DNA, 20 bp, Artificial
  CRISPR gRNA sequence
aaccctttgttgtcatttaa

SEQ ID NO: 558793 - DNA, 20 bp, Artificial
  CRISPR gRNA sequence
accctttgttgtcatttaaa

SEQ ID NO: 558794 - DNA, 20 bp, Artificial
  CRISPR gRNA sequence
tgttgtcatttaaacaatgt

SEQ ID NO: 558795 - DNA, 20 bp, Artificial
  CRISPR gRNA sequence
gttgtcatttaaacaatgtt

SEQ ID NO: 558796 - DNA, 20 bp, Artificial
  CRISPR gRNA sequence
ttgtcatttaaacaatgttc

SEQ ID NO: 558797 - DNA, 20 bp, Artificial
  CRISPR gRNA sequence
tcatttaaacaatgttcaca

SEQ ID NO: 558798 - DNA, 20 bp, Artificial
  CRISPR gRNA sequence
aaacaatgttcacagcatct

SEQ ID NO: 558799 - DNA, 20 bp, Artificial
  CRISPR gRNA sequence
aacaatgttcacagcatctt

SEQ ID NO: 558800 - DNA, 20 bp, Artificial
  CRISPR gRNA sequence
acagcatcttcaccaggagt

SEQ ID NO: 558801 - DNA, 20 bp, Artificial
  CRISPR gRNA sequence
caccaggagtatagatgcca

SEQ ID NO: 558802 - DNA, 20 bp, Artificial
  CRISPR gRNA sequence
accaggagtatagatgccat

SEQ ID NO: 558803 - DNA, 20 bp, Artificial
  CRISPR gRNA sequence
aagaaaccactttctttgct

SEQ ID NO: 558804 - DNA, 20 bp, Artificial
  CRISPR gRNA sequence
tctttgctcatccataagaa

SEQ ID NO: 558805 - DNA, 20 bp, Artificial
  CRISPR gRNA sequence
ctttgctcatccataagaag

SEQ ID NO: 558806 - DNA, 20 bp, Artificial
  CRISPR gRNA sequence
tttgctcatccataagaagc

SEQ ID NO: 558807 - DNA, 20 bp, Artificial
  CRISPR gRNA sequence
tgctcatccataagaagcaa

SEQ ID NO: 558808 - DNA, 20 bp, Artificial
  CRISPR gRNA sequence
gctcatccataagaagcaac

SEQ ID NO: 558809 - DNA, 20 bp, Artificial
  CRISPR gRNA sequence
ctcatccataagaagcaact

SEQ ID NO: 558810 - DNA, 20 bp, Artificial
  CRISPR gRNA sequence
atccataagaagcaactcct

SEQ ID NO: 558811 - DNA, 20 bp, Artificial
  CRISPR gRNA sequence
ctcattggctcaattttcat

SEQ ID NO: 558812 - DNA, 20 bp, Artificial
  CRISPR gRNA sequence
attggctcaattttcatcat

SEQ ID NO: 558813 - DNA, 20 bp, Artificial
  CRISPR gRNA sequence
gctcaattttcatcatgaga

SEQ ID NO: 558814 - DNA, 20 bp, Artificial
  CRISPR gRNA sequence
aattttcatcatgagattgt

SEQ ID NO: 558815 - DNA, 20 bp, Artificial
  CRISPR gRNA sequence
tcatcatgagattgtggcaa

SEQ ID NO: 558816 - DNA, 20 bp, Artificial
  CRISPR gRNA sequence
catcatgagattgtggcaac

SEQ ID NO: 558817 - DNA, 20 bp, Artificial
  CRISPR gRNA sequence
atcatgagattgtggcaact

SEQ ID NO: 558818 - DNA, 20 bp, Artificial
  CRISPR gRNA sequence
tggcaactgagtgacatatt

SEQ ID NO: 558819 - DNA, 20 bp, Artificial
  CRISPR gRNA sequence
agtgacatattcaggctcca

SEQ ID NO: 558820 - DNA, 20 bp, Artificial
  CRISPR gRNA sequence
aggctccacttctatttttc

SEQ ID NO: 558821 - DNA, 20 bp, Artificial
  CRISPR gRNA sequence
cacttctatttttcttgcta

SEQ ID NO: 558822 - DNA, 20 bp, Artificial
  CRISPR gRNA sequence
ctatttttcttgctatttcc

SEQ ID NO: 558823 - DNA, 20 bp, Artificial
  CRISPR gRNA sequence
tatttttcttgctatttcca

SEQ ID NO: 558824 - DNA, 20 bp, Artificial
  CRISPR gRNA sequence
tttttcttgctatttccacc

SEQ ID NO: 558825 - DNA, 20 bp, Artificial
  CRISPR gRNA sequence
ttcttgctatttccaccctt

SEQ ID NO: 558826 - DNA, 20 bp, Artificial
  CRISPR gRNA sequence
tcttgctatttccacccttc

SEQ ID NO: 558827 - DNA, 20 bp, Artificial
  CRISPR gRNA sequence
cttgctatttccacccttca

SEQ ID NO: 558828 - DNA, 20 bp, Artificial
  CRISPR gRNA sequence
ttgctatttccacccttcaa

SEQ ID NO: 558829 - DNA, 20 bp, Artificial
  CRISPR gRNA sequence
gctatttccacccttcaaag

SEQ ID NO: 558830 - DNA, 20 bp, Artificial
  CRISPR gRNA sequence
ctatttccacccttcaaagt

SEQ ID NO: 558831 - DNA, 20 bp, Artificial
  CRISPR gRNA sequence
tttccacccttcaaagtcat

SEQ ID NO: 558832 - DNA, 20 bp, Artificial
  CRISPR gRNA sequence
ccacccttcaaagtcatcca

SEQ ID NO: 558833 - DNA, 20 bp, Artificial
  CRISPR gRNA sequence
cacccttcaaagtcatccat

SEQ ID NO: 558834 - DNA, 20 bp, Artificial
  CRISPR gRNA sequence
caaagtcatccatgaggatc

SEQ ID NO: 558835 - DNA, 20 bp, Artificial
  CRISPR gRNA sequence
aaagtcatccatgaggatcg

SEQ ID NO: 558836 - DNA, 20 bp, Artificial
  CRISPR gRNA sequence
ttccaaactcctgttaatat

SEQ ID NO: 558837 - DNA, 20 bp, Artificial
  CRISPR gRNA sequence
ccaaactcctgttaatattg

SEQ ID NO: 558838 - DNA, 20 bp, Artificial
  CRISPR gRNA sequence
caaactcctgttaatattga

SEQ ID NO: 558839 - DNA, 20 bp, Artificial
  CRISPR gRNA sequence
ctgttaatattgatattttg

SEQ ID NO: 558840 - DNA, 20 bp, Artificial
  CRISPR gRNA sequence
ttaatattgatattttgacc

SEQ ID NO: 558841 - DNA, 20 bp, Artificial
  CRISPR gRNA sequence
atattgatattttgacctga

SEQ ID NO: 558842 - DNA, 20 bp, Artificial
  CRISPR gRNA sequence
atattttgacctgacgattg

SEQ ID NO: 558843 - DNA, 20 bp, Artificial
  CRISPR gRNA sequence
tgacctgacgattggaatca

SEQ ID NO: 558844 - DNA, 20 bp, Artificial
  CRISPR gRNA sequence
gacctgacgattggaatcaa

SEQ ID NO: 558845 - DNA, 20 bp, Artificial
  CRISPR gRNA sequence
acctgacgattggaatcaaa

SEQ ID NO: 558846 - DNA, 20 bp, Artificial
  CRISPR gRNA sequence
acgattggaatcaaattctt

SEQ ID NO: 558847 - DNA, 20 bp, Artificial
  CRISPR gRNA sequence
gaatcaaattcttccaaact

SEQ ID NO: 558848 - DNA, 20 bp, Artificial
  CRISPR gRNA sequence
ttccaaactcctgttaatgt

SEQ ID NO: 558849 - DNA, 20 bp, Artificial
  CRISPR gRNA sequence
ccaaactcctgttaatgttg

SEQ ID NO: 558850 - DNA, 20 bp, Artificial
  CRISPR gRNA sequence
caaactcctgttaatgttga

SEQ ID NO: 558851 - DNA, 20 bp, Artificial
  CRISPR gRNA sequence
ctgttaatgttgatattttg

SEQ ID NO: 558852 - DNA, 20 bp, Artificial
  CRISPR gRNA sequence
ttaatgttgatattttgatc

SEQ ID NO: 558853 - DNA, 20 bp, Artificial
  CRISPR gRNA sequence
atgttgatattttgatcttc

SEQ ID NO: 558854 - DNA, 20 bp, Artificial
  CRISPR gRNA sequence
atattttgatcttctcccat

SEQ ID NO: 558855 - DNA, 20 bp, Artificial
  CRISPR gRNA sequence
tgatcttctcccatgaacca

SEQ ID NO: 558856 - DNA, 20 bp, Artificial
  CRISPR gRNA sequence
gatcttctcccatgaaccac

SEQ ID NO: 558857 - DNA, 20 bp, Artificial
  CRISPR gRNA sequence
atcttctcccatgaaccaca

SEQ ID NO: 558858 - DNA, 20 bp, Artificial
  CRISPR gRNA sequence
ctcccatgaaccacaaatat

SEQ ID NO: 558859 - DNA, 20 bp, Artificial
  CRISPR gRNA sequence
tcccatgaaccacaaatatt

SEQ ID NO: 558860 - DNA, 20 bp, Artificial
  CRISPR gRNA sequence
ccatgaaccacaaatattct

SEQ ID NO: 558861 - DNA, 20 bp, Artificial
  CRISPR gRNA sequence
ttaatgacatctagaatgct

SEQ ID NO: 558862 - DNA, 20 bp, Artificial
  CRISPR gRNA sequence
aatgacatctagaatgctga

SEQ ID NO: 558863 - DNA, 20 bp, Artificial
  CRISPR gRNA sequence
atgacatctagaatgctgaa

SEQ ID NO: 558864 - DNA, 20 bp, Artificial
  CRISPR gRNA sequence
gaatgctgaatcctttcaga

SEQ ID NO: 558865 - DNA, 20 bp, Artificial
  CRISPR gRNA sequence
aatcctttcagaaggttgtc

SEQ ID NO: 558866 - DNA, 20 bp, Artificial
  CRISPR gRNA sequence
tcagaaggttgtcaatttac

SEQ ID NO: 558867 - DNA, 20 bp, Artificial
  CRISPR gRNA sequence
cagaaggttgtcaatttact

SEQ ID NO: 558868 - DNA, 20 bp, Artificial
  CRISPR gRNA sequence
agaaggttgtcaatttactt

SEQ ID NO: 558869 - DNA, 20 bp, Artificial
  CRISPR gRNA sequence
tcaatttactttgcccagat

SEQ ID NO: 558870 - DNA, 20 bp, Artificial
  CRISPR gRNA sequence
actttgcccagattcatcag

SEQ ID NO: 558871 - DNA, 20 bp, Artificial
  CRISPR gRNA sequence
ctttgcccagattcatcaga

SEQ ID NO: 558872 - DNA, 20 bp, Artificial
  CRISPR gRNA sequence
tgcccagattcatcagaaga

SEQ ID NO: 558873 - DNA, 20 bp, Artificial
  CRISPR gRNA sequence
gcccagattcatcagaagaa

SEQ ID NO: 558874 - DNA, 20 bp, Artificial
  CRISPR gRNA sequence
cccagattcatcagaagaat

SEQ ID NO: 558875 - DNA, 20 bp, Artificial
  CRISPR gRNA sequence
atcagaagaataattatcta

SEQ ID NO: 558876 - DNA, 20 bp, Artificial
  CRISPR gRNA sequence
tctatggcagctatagcctt

SEQ ID NO: 558877 - DNA, 20 bp, Artificial
  CRISPR gRNA sequence
tggcagctatagccttacca

SEQ ID NO: 558878 - DNA, 20 bp, Artificial
  CRISPR gRNA sequence
tagccttaccaagtgtattc

SEQ ID NO: 558879 - DNA, 20 bp, Artificial
  CRISPR gRNA sequence
accaagtgtattcctacata

SEQ ID NO: 558880 - DNA, 20 bp, Artificial
  CRISPR gRNA sequence
ccaagtgtattcctacataa

SEQ ID NO: 558881 - DNA, 20 bp, Artificial
  CRISPR gRNA sequence
ctacataataagacttcaaa

SEQ ID NO: 558882 - DNA, 20 bp, Artificial
  CRISPR gRNA sequence
cataataagacttcaaaggc

SEQ ID NO: 558883 - DNA, 20 bp, Artificial
  CRISPR gRNA sequence
caaaggcaaaattactcctt

SEQ ID NO: 558884 - DNA, 20 bp, Artificial
  CRISPR gRNA sequence
aaaggcaaaattactccttg

SEQ ID NO: 558885 - DNA, 20 bp, Artificial
  CRISPR gRNA sequence
ctccttgatccatgggctgc

SEQ ID NO: 558886 - DNA, 20 bp, Artificial
  CRISPR gRNA sequence
cttgatccatgggctgcaga

SEQ ID NO: 558887 - DNA, 20 bp, Artificial
  CRISPR gRNA sequence
gatccatgggctgcagaatg

SEQ ID NO: 558888 - DNA, 20 bp, Artificial
  CRISPR gRNA sequence
atccatgggctgcagaatgg

SEQ ID NO: 558889 - DNA, 20 bp, Artificial
  CRISPR gRNA sequence
cagaatggatgttgtattag

SEQ ID NO: 558890 - DNA, 20 bp, Artificial
  CRISPR gRNA sequence
tattagcaagcatgaaaaca

SEQ ID NO: 558891 - DNA, 20 bp, Artificial
  CRISPR gRNA sequence
gcaagcatgaaaacaacact

SEQ ID NO: 558892 - DNA, 20 bp, Artificial
  CRISPR gRNA sequence
atctccttgtacatctccat

SEQ ID NO: 558893 - DNA, 20 bp, Artificial
  CRISPR gRNA sequence
cttgtacatctccatcagag

SEQ ID NO: 558894 - DNA, 20 bp, Artificial
  CRISPR gRNA sequence
gtacatctccatcagagctc

SEQ ID NO: 558895 - DNA, 20 bp, Artificial
  CRISPR gRNA sequence
tacatctccatcagagctct

SEQ ID NO: 558896 - DNA, 20 bp, Artificial
  CRISPR gRNA sequence
catcagagctcttgggtgat

SEQ ID NO: 558897 - DNA, 20 bp, Artificial
  CRISPR gRNA sequence
ttgggtgattaggtgcattg

SEQ ID NO: 558898 - DNA, 20 bp, Artificial
  CRISPR gRNA sequence
gggtgattaggtgcattgtc

SEQ ID NO: 558899 - DNA, 20 bp, Artificial
  CRISPR gRNA sequence
ggtgattaggtgcattgtca

SEQ ID NO: 558900 - DNA, 20 bp, Artificial
  CRISPR gRNA sequence
ggtgcattgtcaacaagcaa

SEQ ID NO: 558901 - DNA, 20 bp, Artificial
  CRISPR gRNA sequence
tcaacaagcaataatatact

SEQ ID NO: 558902 - DNA, 20 bp, Artificial
  CRISPR gRNA sequence
aaatgaatcttttttttcta

SEQ ID NO: 558903 - DNA, 20 bp, Artificial
  CRISPR gRNA sequence
ttttttctaagcagtaagta

SEQ ID NO: 558904 - DNA, 20 bp, Artificial
  CRISPR gRNA sequence
tttttctaagcagtaagtat

SEQ ID NO: 558905 - DNA, 20 bp, Artificial
  CRISPR gRNA sequence
ttttctaagcagtaagtatt

SEQ ID NO: 558906 - DNA, 20 bp, Artificial
  CRISPR gRNA sequence
tttctaagcagtaagtatta

SEQ ID NO: 558907 - DNA, 20 bp, Artificial
  CRISPR gRNA sequence
ttctaagcagtaagtattaa

SEQ ID NO: 558908 - DNA, 20 bp, Artificial
  CRISPR gRNA sequence
tctaagcagtaagtattaac

SEQ ID NO: 558909 - DNA, 20 bp, Artificial
  CRISPR gRNA sequence
ctaagcagtaagtattaaca

SEQ ID NO: 558910 - DNA, 20 bp, Artificial
  CRISPR gRNA sequence
taagcagtaagtattaacag

SEQ ID NO: 558911 - DNA, 20 bp, Artificial
  CRISPR gRNA sequence
agcagtaagtattaacagtg

SEQ ID NO: 558912 - DNA, 20 bp, Artificial
  CRISPR gRNA sequence
acagtgggcttacaatattc

SEQ ID NO: 558913 - DNA, 20 bp, Artificial
  CRISPR gRNA sequence
acaatattcagtaaaccatg

SEQ ID NO: 558914 - DNA, 20 bp, Artificial
  CRISPR gRNA sequence
caatattcagtaaaccatgc

SEQ ID NO: 558915 - DNA, 20 bp, Artificial
  CRISPR gRNA sequence
agtaaaccatgctgtaaaca

SEQ ID NO: 558916 - DNA, 20 bp, Artificial
  CRISPR gRNA sequence
taaacagatgtgctgtcatc

SEQ ID NO: 558917 - DNA, 20 bp, Artificial
  CRISPR gRNA sequence
tcatccagcctgttgttcca

SEQ ID NO: 558918 - DNA, 20 bp, Artificial
  CRISPR gRNA sequence
ttgttccattttatagagca

SEQ ID NO: 558919 - DNA, 20 bp, Artificial
  CRISPR gRNA sequence
ttccattttatagagcacaa

SEQ ID NO: 558920 - DNA, 20 bp, Artificial
  CRISPR gRNA sequence
cattttatagagcacaagca

SEQ ID NO: 558921 - DNA, 20 bp, Artificial
  CRISPR gRNA sequence
tatagagcacaagcagaata

SEQ ID NO: 558922 - DNA, 20 bp, Artificial
  CRISPR gRNA sequence
atagagcacaagcagaatag

SEQ ID NO: 558923 - DNA, 20 bp, Artificial
  CRISPR gRNA sequence
tagagcacaagcagaataga

SEQ ID NO: 558924 - DNA, 20 bp, Artificial
  CRISPR gRNA sequence
agcctaattcttaagggccc

SEQ ID NO: 558925 - DNA, 20 bp, Artificial
  CRISPR gRNA sequence
gcctaattcttaagggccct

SEQ ID NO: 558926 - DNA, 20 bp, Artificial
  CRISPR gRNA sequence
attcttaagggccctaaaaa

SEQ ID NO: 558927 - DNA, 20 bp, Artificial
  CRISPR gRNA sequence
ttaagggccctaaaaatttt

SEQ ID NO: 558928 - DNA, 20 bp, Artificial
  CRISPR gRNA sequence
aagggccctaaaaattttca

SEQ ID NO: 558929 - DNA, 20 bp, Artificial
  CRISPR gRNA sequence
agggccctaaaaattttcag

SEQ ID NO: 558930 - DNA, 20 bp, Artificial
  CRISPR gRNA sequence
aaaattttcagagtggtaaa

SEQ ID NO: 558931 - DNA, 20 bp, Artificial
  CRISPR gRNA sequence
tcagagtggtaaatgagcac

SEQ ID NO: 558932 - DNA, 20 bp, Artificial
  CRISPR gRNA sequence
cagagtggtaaatgagcact

SEQ ID NO: 558933 - DNA, 20 bp, Artificial
  CRISPR gRNA sequence
agagtggtaaatgagcactg

SEQ ID NO: 558934 - DNA, 20 bp, Artificial
  CRISPR gRNA sequence
gcttcaacttaaagtcatca

SEQ ID NO: 558935 - DNA, 20 bp, Artificial
  CRISPR gRNA sequence
caacttaaagtcatcagctg

SEQ ID NO: 558936 - DNA, 20 bp, Artificial
  CRISPR gRNA sequence
aacttaaagtcatcagctgc

SEQ ID NO: 558937 - DNA, 20 bp, Artificial
  CRISPR gRNA sequence
aaagtcatcagctgcattag

SEQ ID NO: 558938 - DNA, 20 bp, Artificial
  CRISPR gRNA sequence
aagtcatcagctgcattagc

SEQ ID NO: 558939 - DNA, 20 bp, Artificial
  CRISPR gRNA sequence
cattagcccacacaacaaga

SEQ ID NO: 558940 - DNA, 20 bp, Artificial
  CRISPR gRNA sequence
gcccacacaacaagagagtc

SEQ ID NO: 558941 - DNA, 20 bp, Artificial
  CRISPR gRNA sequence
tcctttcaagcctgaagttg

SEQ ID NO: 558942 - DNA, 20 bp, Artificial
  CRISPR gRNA sequence
tcaagcctgaagttgacttc

SEQ ID NO: 558943 - DNA, 20 bp, Artificial
  CRISPR gRNA sequence
caagcctgaagttgacttct

SEQ ID NO: 558944 - DNA, 20 bp, Artificial
  CRISPR gRNA sequence
aagcctgaagttgacttctc

SEQ ID NO: 558945 - DNA, 20 bp, Artificial
  CRISPR gRNA sequence
aagttgacttctcctgtcta

SEQ ID NO: 558946 - DNA, 20 bp, Artificial
  CRISPR gRNA sequence
acttctcctgtctagctatg

SEQ ID NO: 558947 - DNA, 20 bp, Artificial
  CRISPR gRNA sequence
ctcctgtctagctatggaag

SEQ ID NO: 558948 - DNA, 20 bp, Artificial
  CRISPR gRNA sequence
tcctgtctagctatggaagt

SEQ ID NO: 558949 - DNA, 20 bp, Artificial
  CRISPR gRNA sequence
ctgtctagctatggaagtcc

SEQ ID NO: 558950 - DNA, 20 bp, Artificial
  CRISPR gRNA sequence
tctagctatggaagtcctag

SEQ ID NO: 558951 - DNA, 20 bp, Artificial
  CRISPR gRNA sequence
gctatggaagtcctagatgg

SEQ ID NO: 558952 - DNA, 20 bp, Artificial
  CRISPR gRNA sequence
tggaagtcctagatggcatc

SEQ ID NO: 558953 - DNA, 20 bp, Artificial
  CRISPR gRNA sequence
gatggcatcttcttccagta

SEQ ID NO: 558954 - DNA, 20 bp, Artificial
  CRISPR gRNA sequence
cttccagtagaaggttgttt

SEQ ID NO: 558955 - DNA, 20 bp, Artificial
  CRISPR gRNA sequence
ttccagtagaaggttgtttt

SEQ ID NO: 558956 - DNA, 20 bp, Artificial
  CRISPR gRNA sequence
ccagtagaaggttgttttgt

SEQ ID NO: 558957 - DNA, 20 bp, Artificial
  CRISPR gRNA sequence
cagtagaaggttgttttgtc

SEQ ID NO: 558958 - DNA, 20 bp, Artificial
  CRISPR gRNA sequence
ttttgtctacattgaaaatc

SEQ ID NO: 558959 - DNA, 20 bp, Artificial
  CRISPR gRNA sequence
tgtctacattgaaaatctgt

SEQ ID NO: 558960 - DNA, 20 bp, Artificial
  CRISPR gRNA sequence
gtctacattgaaaatctgtt

SEQ ID NO: 558961 - DNA, 20 bp, Artificial
  CRISPR gRNA sequence
tctacattgaaaatctgttg

SEQ ID NO: 558962 - DNA, 20 bp, Artificial
  CRISPR gRNA sequence
cattgaaaatctgttgtttc

SEQ ID NO: 558963 - DNA, 20 bp, Artificial
  CRISPR gRNA sequence
aaaatctgttgtttcatgta

SEQ ID NO: 558964 - DNA, 20 bp, Artificial
  CRISPR gRNA sequence
ttgtttcatgtatcctgcac

SEQ ID NO: 558965 - DNA, 20 bp, Artificial
  CRISPR gRNA sequence
tttcatgtatcctgcaccag

SEQ ID NO: 558966 - DNA, 20 bp, Artificial
  CRISPR gRNA sequence
catgtatcctgcaccagtaa

SEQ ID NO: 558967 - DNA, 20 bp, Artificial
  CRISPR gRNA sequence
atgtatcctgcaccagtaat

SEQ ID NO: 558968 - DNA, 20 bp, Artificial
  CRISPR gRNA sequence
caccagtaatcttagatctt

SEQ ID NO: 558969 - DNA, 20 bp, Artificial
  CRISPR gRNA sequence
agatcttctggataatttct

SEQ ID NO: 558970 - DNA, 20 bp, Artificial
  CRISPR gRNA sequence
gatcttctggataatttctt

SEQ ID NO: 558971 - DNA, 20 bp, Artificial
  CRISPR gRNA sequence
ctggataatttcttgcagct

SEQ ID NO: 558972 - DNA, 20 bp, Artificial
  CRISPR gRNA sequence
tggataatttcttgcagctt

SEQ ID NO: 558973 - DNA, 20 bp, Artificial
  CRISPR gRNA sequence
gataatttcttgcagcttct

SEQ ID NO: 558974 - DNA, 20 bp, Artificial
  CRISPR gRNA sequence
cttgcagcttctacatcaac

SEQ ID NO: 558975 - DNA, 20 bp, Artificial
  CRISPR gRNA sequence
ttgcagcttctacatcaaca

SEQ ID NO: 558976 - DNA, 20 bp, Artificial
  CRISPR gRNA sequence
gcagcttctacatcaacact

SEQ ID NO: 558977 - DNA, 20 bp, Artificial
  CRISPR gRNA sequence
cagcttctacatcaacactt

SEQ ID NO: 558978 - DNA, 20 bp, Artificial
  CRISPR gRNA sequence
ctacatcaacacttgctgct

SEQ ID NO: 558979 - DNA, 20 bp, Artificial
  CRISPR gRNA sequence
tacatcaacacttgctgctt

SEQ ID NO: 558980 - DNA, 20 bp, Artificial
  CRISPR gRNA sequence
catcaacacttgctgcttta

SEQ ID NO: 558981 - DNA, 20 bp, Artificial
  CRISPR gRNA sequence
gctgctttacttcacagttt

SEQ ID NO: 558982 - DNA, 20 bp, Artificial
  CRISPR gRNA sequence
ctgctttacttcacagtttt

SEQ ID NO: 558983 - DNA, 20 bp, Artificial
  CRISPR gRNA sequence
ctttacttcacagttttatg

SEQ ID NO: 558984 - DNA, 20 bp, Artificial
  CRISPR gRNA sequence
tacttcacagttttatgtta

SEQ ID NO: 558985 - DNA, 20 bp, Artificial
  CRISPR gRNA sequence
acttcacagttttatgttat

SEQ ID NO: 558986 - DNA, 20 bp, Artificial
  CRISPR gRNA sequence
cttcacagttttatgttatg

SEQ ID NO: 558987 - DNA, 20 bp, Artificial
  CRISPR gRNA sequence
cacagttttatgttatggag

SEQ ID NO: 558988 - DNA, 20 bp, Artificial
  CRISPR gRNA sequence
acagttttatgttatggaga

SEQ ID NO: 558989 - DNA, 20 bp, Artificial
  CRISPR gRNA sequence
tatgttatggagatggcttt

SEQ ID NO: 558990 - DNA, 20 bp, Artificial
  CRISPR gRNA sequence
atgttatggagatggctttc

SEQ ID NO: 558991 - DNA, 20 bp, Artificial
  CRISPR gRNA sequence
tgttatggagatggctttct

SEQ ID NO: 558992 - DNA, 20 bp, Artificial
  CRISPR gRNA sequence
tggagatggctttcttccta

SEQ ID NO: 558993 - DNA, 20 bp, Artificial
  CRISPR gRNA sequence
tcttcctaagatctcatgaa

SEQ ID NO: 558994 - DNA, 20 bp, Artificial
  CRISPR gRNA sequence
cttcctaagatctcatgaac

SEQ ID NO: 558995 - DNA, 20 bp, Artificial
  CRISPR gRNA sequence
ttcctaagatctcatgaact

SEQ ID NO: 558996 - DNA, 20 bp, Artificial
  CRISPR gRNA sequence
cctaagatctcatgaactaa

SEQ ID NO: 558997 - DNA, 20 bp, Artificial
  CRISPR gRNA sequence
ctaagatctcatgaactaac

SEQ ID NO: 558998 - DNA, 20 bp, Artificial
  CRISPR gRNA sequence
agatctcatgaactaacctc

SEQ ID NO: 558999 - DNA, 20 bp, Artificial
  CRISPR gRNA sequence
atgaactaacctctgatagc

SEQ ID NO: 559000 - DNA, 20 bp, Artificial
  CRISPR gRNA sequence
acctctgatagcttcaaact

SEQ ID NO: 559001 - DNA, 20 bp, Artificial
  CRISPR gRNA sequence
tgatagcttcaaacttttct

SEQ ID NO: 559002 - DNA, 20 bp, Artificial
  CRISPR gRNA sequence
atagcttcaaacttttctcc

SEQ ID NO: 559003 - DNA, 20 bp, Artificial
  CRISPR gRNA sequence
caaacttttctcctgcagct

SEQ ID NO: 559004 - DNA, 20 bp, Artificial
  CRISPR gRNA sequence
aaacttttctcctgcagctt

SEQ ID NO: 559005 - DNA, 20 bp, Artificial
  CRISPR gRNA sequence
ttctcctgcagctttctcac

SEQ ID NO: 559006 - DNA, 20 bp, Artificial
  CRISPR gRNA sequence
tctcctgcagctttctcacc

SEQ ID NO: 559007 - DNA, 20 bp, Artificial
  CRISPR gRNA sequence
ctcctgcagctttctcacct

SEQ ID NO: 559008 - DNA, 20 bp, Artificial
  CRISPR gRNA sequence
tcctgcagctttctcacctc

SEQ ID NO: 559009 - DNA, 20 bp, Artificial
  CRISPR gRNA sequence
ctgcagctttctcacctctc

SEQ ID NO: 559010 - DNA, 20 bp, Artificial
  CRISPR gRNA sequence
cagctttctcacctctctca

SEQ ID NO: 559011 - DNA, 20 bp, Artificial
  CRISPR gRNA sequence
tctcacctctctcagccttc

SEQ ID NO: 559012 - DNA, 20 bp, Artificial
  CRISPR gRNA sequence
ctcacctctctcagccttca

SEQ ID NO: 559013 - DNA, 20 bp, Artificial
  CRISPR gRNA sequence
tcacctctctcagccttcac

SEQ ID NO: 559014 - DNA, 20 bp, Artificial
  CRISPR gRNA sequence
acctctctcagccttcacag

SEQ ID NO: 559015 - DNA, 20 bp, Artificial
  CRISPR gRNA sequence
tctcagccttcacagaacta

SEQ ID NO: 559016 - DNA, 20 bp, Artificial
  CRISPR gRNA sequence
tcagccttcacagaactaaa

SEQ ID NO: 559017 - DNA, 20 bp, Artificial
  CRISPR gRNA sequence
agccttcacagaactaaaga

SEQ ID NO: 559018 - DNA, 20 bp, Artificial
  CRISPR gRNA sequence
cacagaactaaagagagtta

SEQ ID NO: 559019 - DNA, 20 bp, Artificial
  CRISPR gRNA sequence
acagaactaaagagagttag

SEQ ID NO: 559020 - DNA, 20 bp, Artificial
  CRISPR gRNA sequence
aagagagttagggtcttgct

SEQ ID NO: 559021 - DNA, 20 bp, Artificial
  CRISPR gRNA sequence
gggtcttgctctggattagg

SEQ ID NO: 559022 - DNA, 20 bp, Artificial
  CRISPR gRNA sequence
gctctggattaggctttgga

SEQ ID NO: 559023 - DNA, 20 bp, Artificial
  CRISPR gRNA sequence
ctctggattaggctttggat

SEQ ID NO: 559024 - DNA, 20 bp, Artificial
  CRISPR gRNA sequence
tggattaggctttggattaa

SEQ ID NO: 559025 - DNA, 20 bp, Artificial
  CRISPR gRNA sequence
gattaggctttggattaagg

SEQ ID NO: 559026 - DNA, 20 bp, Artificial
  CRISPR gRNA sequence
ggctttggattaagggaatg

SEQ ID NO: 559027 - DNA, 20 bp, Artificial
  CRISPR gRNA sequence
tggattaagggaatgttgta

SEQ ID NO: 559028 - DNA, 20 bp, Artificial
  CRISPR gRNA sequence
ggattaagggaatgttgtag

SEQ ID NO: 559029 - DNA, 20 bp, Artificial
  CRISPR gRNA sequence
gattaagggaatgttgtagc

SEQ ID NO: 559030 - DNA, 20 bp, Artificial
  CRISPR gRNA sequence
agggaatgttgtagctggct

SEQ ID NO: 559031 - DNA, 20 bp, Artificial
  CRISPR gRNA sequence
tagctggcttgatcttctat

SEQ ID NO: 559032 - DNA, 20 bp, Artificial
  CRISPR gRNA sequence
gcttgatcttctatgcagac

SEQ ID NO: 559033 - DNA, 20 bp, Artificial
  CRISPR gRNA sequence
gatcttctatgcagactact

SEQ ID NO: 559034 - DNA, 20 bp, Artificial
  CRISPR gRNA sequence
atcttctatgcagactactc

SEQ ID NO: 559035 - DNA, 20 bp, Artificial
  CRISPR gRNA sequence
ctatgcagactactcgaact

SEQ ID NO: 559036 - DNA, 20 bp, Artificial
  CRISPR gRNA sequence
tatgcagactactcgaactt

SEQ ID NO: 559037 - DNA, 20 bp, Artificial
  CRISPR gRNA sequence
tgcagactactcgaactttc

SEQ ID NO: 559038 - DNA, 20 bp, Artificial
  CRISPR gRNA sequence
ctcgaactttctccatctgc

SEQ ID NO: 559039 - DNA, 20 bp, Artificial
  CRISPR gRNA sequence
gaactttctccatctgcaat

SEQ ID NO: 559040 - DNA, 20 bp, Artificial
  CRISPR gRNA sequence
tctccatctgcaataacgct

SEQ ID NO: 559041 - DNA, 20 bp, Artificial
  CRISPR gRNA sequence
ctccatctgcaataacgctg

SEQ ID NO: 559042 - DNA, 20 bp, Artificial
  CRISPR gRNA sequence
tccatctgcaataacgctgt

SEQ ID NO: 559043 - DNA, 20 bp, Artificial
  CRISPR gRNA sequence
catctgcaataacgctgttt

SEQ ID NO: 559044 - DNA, 20 bp, Artificial
  CRISPR gRNA sequence
caataacgctgtttcacttt

SEQ ID NO: 559045 - DNA, 20 bp, Artificial
  CRISPR gRNA sequence
tttcactttcttatttatgt

SEQ ID NO: 559046 - DNA, 20 bp, Artificial
  CRISPR gRNA sequence
cactttcttatttatgtgtt

SEQ ID NO: 559047 - DNA, 20 bp, Artificial
  CRISPR gRNA sequence
actttcttatttatgtgttc

SEQ ID NO: 559048 - DNA, 20 bp, Artificial
  CRISPR gRNA sequence
tcttatttatgtgttcactg

SEQ ID NO: 559049 - DNA, 20 bp, Artificial
  CRISPR gRNA sequence
cttatttatgtgttcactga

SEQ ID NO: 559050 - DNA, 20 bp, Artificial
  CRISPR gRNA sequence
ttatttatgtgttcactgaa

SEQ ID NO: 559051 - DNA, 20 bp, Artificial
  CRISPR gRNA sequence
atttatgtgttcactgaagt

SEQ ID NO: 559052 - DNA, 20 bp, Artificial
  CRISPR gRNA sequence
tttatgtgttcactgaagta

SEQ ID NO: 559053 - DNA, 20 bp, Artificial
  CRISPR gRNA sequence
atgtgttcactgaagtagca

SEQ ID NO: 559054 - DNA, 20 bp, Artificial
  CRISPR gRNA sequence
tgtgttcactgaagtagcac

SEQ ID NO: 559055 - DNA, 20 bp, Artificial
  CRISPR gRNA sequence
actgaagtagcacttttaat

SEQ ID NO: 559056 - DNA, 20 bp, Artificial
  CRISPR gRNA sequence
aagtagcacttttaatttcc

SEQ ID NO: 559057 - DNA, 20 bp, Artificial
  CRISPR gRNA sequence
ttaatttccttcaagaactt

SEQ ID NO: 559058 - DNA, 20 bp, Artificial
  CRISPR gRNA sequence
taatttccttcaagaacttt

SEQ ID NO: 559059 - DNA, 20 bp, Artificial
  CRISPR gRNA sequence
aatttccttcaagaactttt

SEQ ID NO: 559060 - DNA, 20 bp, Artificial
  CRISPR gRNA sequence
atttccttcaagaacttttc

SEQ ID NO: 559061 - DNA, 20 bp, Artificial
  CRISPR gRNA sequence
ccttcaagaacttttccttt

SEQ ID NO: 559062 - DNA, 20 bp, Artificial
  CRISPR gRNA sequence
cttcaagaacttttcctttg

SEQ ID NO: 559063 - DNA, 20 bp, Artificial
  CRISPR gRNA sequence
caagaacttttcctttgaat

SEQ ID NO: 559064 - DNA, 20 bp, Artificial
  CRISPR gRNA sequence
aagaacttttcctttgaatt

SEQ ID NO: 559065 - DNA, 20 bp, Artificial
  CRISPR gRNA sequence
ttcctttgaattcacaactt

SEQ ID NO: 559066 - DNA, 20 bp, Artificial
  CRISPR gRNA sequence
tcctttgaattcacaacttc

SEQ ID NO: 559067 - DNA, 20 bp, Artificial
  CRISPR gRNA sequence
cctttgaattcacaacttca

SEQ ID NO: 559068 - DNA, 20 bp, Artificial
  CRISPR gRNA sequence
ctttgaattcacaacttcac

SEQ ID NO: 559069 - DNA, 20 bp, Artificial
  CRISPR gRNA sequence
tgaattcacaacttcactaa

SEQ ID NO: 559070 - DNA, 20 bp, Artificial
  CRISPR gRNA sequence
gaattcacaacttcactaac

SEQ ID NO: 559071 - DNA, 20 bp, Artificial
  CRISPR gRNA sequence
aattcacaacttcactaact

SEQ ID NO: 559072 - DNA, 20 bp, Artificial
  CRISPR gRNA sequence
acaacttcactaactctttg

SEQ ID NO: 559073 - DNA, 20 bp, Artificial
  CRISPR gRNA sequence
cactaactctttggcataaa

SEQ ID NO: 559074 - DNA, 20 bp, Artificial
  CRISPR gRNA sequence
actaactctttggcataaaa

SEQ ID NO: 559075 - DNA, 20 bp, Artificial
  CRISPR gRNA sequence
actctttggcataaaaggcc

SEQ ID NO: 559076 - DNA, 20 bp, Artificial
  CRISPR gRNA sequence
tttggcataaaaggcctagt

SEQ ID NO: 559077 - DNA, 20 bp, Artificial
  CRISPR gRNA sequence
tggcataaaaggcctagttt

SEQ ID NO: 559078 - DNA, 20 bp, Artificial
  CRISPR gRNA sequence
ggcataaaaggcctagtttt

SEQ ID NO: 559079 - DNA, 20 bp, Artificial
  CRISPR gRNA sequence
gcataaaaggcctagttttc

SEQ ID NO: 559080 - DNA, 20 bp, Artificial
  CRISPR gRNA sequence
gttttcagcccatcgtggct

SEQ ID NO: 559081 - DNA, 20 bp, Artificial
  CRISPR gRNA sequence
tcagcccatcgtggcttttt

SEQ ID NO: 559082 - DNA, 20 bp, Artificial
  CRISPR gRNA sequence
cagcccatcgtggctttttt

SEQ ID NO: 559083 - DNA, 20 bp, Artificial
  CRISPR gRNA sequence
agcccatcgtggcttttttt

SEQ ID NO: 559084 - DNA, 20 bp, Artificial
  CRISPR gRNA sequence
tttttttttctttctttctt

SEQ ID NO: 559085 - DNA, 20 bp, Artificial
  CRISPR gRNA sequence
ttttttttctttctttcttt

SEQ ID NO: 559086 - DNA, 20 bp, Artificial
  CRISPR gRNA sequence
tttttttctttctttctttt

SEQ ID NO: 559087 - DNA, 20 bp, Artificial
  CRISPR gRNA sequence
ttttttctttctttcttttt

SEQ ID NO: 559088 - DNA, 20 bp, Artificial
  CRISPR gRNA sequence
tttttctttctttctttttt

SEQ ID NO: 559089 - DNA, 20 bp, Artificial
  CRISPR gRNA sequence
ttttctttctttcttttttt

SEQ ID NO: 559090 - DNA, 20 bp, Artificial
  CRISPR gRNA sequence
tttctttctttctttttttt

SEQ ID NO: 559091 - DNA, 20 bp, Artificial
  CRISPR gRNA sequence
ttctttctttcttttttttt

SEQ ID NO: 559092 - DNA, 20 bp, Artificial
  CRISPR gRNA sequence
tctttctttctttttttttt

SEQ ID NO: 559093 - DNA, 20 bp, Artificial
  CRISPR gRNA sequence
ctttctttcttttttttttt

SEQ ID NO: 559094 - DNA, 20 bp, Artificial
  CRISPR gRNA sequence
tttctttctttttttttttt

SEQ ID NO: 559095 - DNA, 20 bp, Artificial
  CRISPR gRNA sequence
tctttctttttttttttttt

SEQ ID NO: 559096 - DNA, 20 bp, Artificial
  CRISPR gRNA sequence
ctttcttttttttttttttt

SEQ ID NO: 559097 - DNA, 20 bp, Artificial
  CRISPR gRNA sequence
tttctttttttttttttttc

SEQ ID NO: 559098 - DNA, 20 bp, Artificial
  CRISPR gRNA sequence
tctttttttttttttttctt

SEQ ID NO: 559099 - DNA, 20 bp, Artificial
  CRISPR gRNA sequence
ctttttttttttttttcttc

SEQ ID NO: 559100 - DNA, 20 bp, Artificial
  CRISPR gRNA sequence
tttttttttttttttcttca

SEQ ID NO: 559101 - DNA, 20 bp, Artificial
  CRISPR gRNA sequence
tttttttttttttcttcaga

SEQ ID NO: 559102 - DNA, 20 bp, Artificial
  CRISPR gRNA sequence
ttttttttttttcttcagac

SEQ ID NO: 559103 - DNA, 20 bp, Artificial
  CRISPR gRNA sequence
tttttttttttcttcagaca

SEQ ID NO: 559104 - DNA, 20 bp, Artificial
  CRISPR gRNA sequence
ttttttttttcttcagacag

SEQ ID NO: 559105 - DNA, 20 bp, Artificial
  CRISPR gRNA sequence
tttttttttcttcagacaga

SEQ ID NO: 559106 - DNA, 20 bp, Artificial
  CRISPR gRNA sequence
ttttttttcttcagacagag

SEQ ID NO: 559107 - DNA, 20 bp, Artificial
  CRISPR gRNA sequence
tttttttcttcagacagagt

SEQ ID NO: 559108 - DNA, 20 bp, Artificial
  CRISPR gRNA sequence
ttttttcttcagacagagtt

SEQ ID NO: 559109 - DNA, 20 bp, Artificial
  CRISPR gRNA sequence
tttttcttcagacagagttt

SEQ ID NO: 559110 - DNA, 20 bp, Artificial
  CRISPR gRNA sequence
ttttcttcagacagagtttc

SEQ ID NO: 559111 - DNA, 20 bp, Artificial
  CRISPR gRNA sequence
tttcttcagacagagtttca

SEQ ID NO: 559112 - DNA, 20 bp, Artificial
  CRISPR gRNA sequence
ttcttcagacagagtttcat

SEQ ID NO: 559113 - DNA, 20 bp, Artificial
  CRISPR gRNA sequence
tcttcagacagagtttcatt

SEQ ID NO: 559114 - DNA, 20 bp, Artificial
  CRISPR gRNA sequence
cttcagacagagtttcattc

SEQ ID NO: 559115 - DNA, 20 bp, Artificial
  CRISPR gRNA sequence
ttcagacagagtttcattct

SEQ ID NO: 559116 - DNA, 20 bp, Artificial
  CRISPR gRNA sequence
cagacagagtttcattcttg

SEQ ID NO: 559117 - DNA, 20 bp, Artificial
  CRISPR gRNA sequence
agacagagtttcattcttgt

SEQ ID NO: 559118 - DNA, 20 bp, Artificial
  CRISPR gRNA sequence
cattcttgtagcccagactg

SEQ ID NO: 559119 - DNA, 20 bp, Artificial
  CRISPR gRNA sequence
attcttgtagcccagactgg

SEQ ID NO: 559120 - DNA, 20 bp, Artificial
  CRISPR gRNA sequence
ttgtagcccagactggagtg

SEQ ID NO: 559121 - DNA, 20 bp, Artificial
  CRISPR gRNA sequence
gtagcccagactggagtgca

SEQ ID NO: 559122 - DNA, 20 bp, Artificial
  CRISPR gRNA sequence
tagcccagactggagtgcaa

SEQ ID NO: 559123 - DNA, 20 bp, Artificial
  CRISPR gRNA sequence
gagtgcaatagtgccatctt

SEQ ID NO: 559124 - DNA, 20 bp, Artificial
  CRISPR gRNA sequence
ggctcactgcaacatctgcc

SEQ ID NO: 559125 - DNA, 20 bp, Artificial
  CRISPR gRNA sequence
gctcactgcaacatctgcct

SEQ ID NO: 559126 - DNA, 20 bp, Artificial
  CRISPR gRNA sequence
actgcaacatctgcctttca

SEQ ID NO: 559127 - DNA, 20 bp, Artificial
  CRISPR gRNA sequence
caacatctgcctttcaggtt

SEQ ID NO: 559128 - DNA, 20 bp, Artificial
  CRISPR gRNA sequence
cctttcaggttcaagcgatt

SEQ ID NO: 559129 - DNA, 20 bp, Artificial
  CRISPR gRNA sequence
tcaggttcaagcgattctcc

SEQ ID NO: 559130 - DNA, 20 bp, Artificial
  CRISPR gRNA sequence
caggttcaagcgattctcct

SEQ ID NO: 559131 - DNA, 20 bp, Artificial
  CRISPR gRNA sequence
aggttcaagcgattctcctg

SEQ ID NO: 559132 - DNA, 20 bp, Artificial
  CRISPR gRNA sequence
aagcgattctcctgcctcag

SEQ ID NO: 559133 - DNA, 20 bp, Artificial
  CRISPR gRNA sequence
tcctgcctcagcctcccaac

SEQ ID NO: 559134 - DNA, 20 bp, Artificial
  CRISPR gRNA sequence
ctgcctcagcctcccaacca

SEQ ID NO: 559135 - DNA, 20 bp, Artificial
  CRISPR gRNA sequence
cctcagcctcccaaccagct

SEQ ID NO: 559136 - DNA, 20 bp, Artificial
  CRISPR gRNA sequence
agcctcccaaccagctggga

SEQ ID NO: 559137 - DNA, 20 bp, Artificial
  CRISPR gRNA sequence
ccaaccagctgggattacag

SEQ ID NO: 559138 - DNA, 20 bp, Artificial
  CRISPR gRNA sequence
ggattacaggtgcccaccac

SEQ ID NO: 559139 - DNA, 20 bp, Artificial
  CRISPR gRNA sequence
caggtgcccaccaccacacc

SEQ ID NO: 559140 - DNA, 20 bp, Artificial
  CRISPR gRNA sequence
atttttgtatttttagtaga

SEQ ID NO: 559141 - DNA, 20 bp, Artificial
  CRISPR gRNA sequence
ttgtatttttagtagagacg

SEQ ID NO: 559142 - DNA, 20 bp, Artificial
  CRISPR gRNA sequence
tgtatttttagtagagacgg

SEQ ID NO: 559143 - DNA, 20 bp, Artificial
  CRISPR gRNA sequence
gtatttttagtagagacggg

SEQ ID NO: 559144 - DNA, 20 bp, Artificial
  CRISPR gRNA sequence
tatttttagtagagacgggg

SEQ ID NO: 559145 - DNA, 20 bp, Artificial
  CRISPR gRNA sequence
ttagtagagacggggtttcg

SEQ ID NO: 559146 - DNA, 20 bp, Artificial
  CRISPR gRNA sequence
tagtagagacggggtttcgc

SEQ ID NO: 559147 - DNA, 20 bp, Artificial
  CRISPR gRNA sequence
agtagagacggggtttcgcc

SEQ ID NO: 559148 - DNA, 20 bp, Artificial
  CRISPR gRNA sequence
gtagagacggggtttcgcca

SEQ ID NO: 559149 - DNA, 20 bp, Artificial
  CRISPR gRNA sequence
cgccatgttggccaggttgg

SEQ ID NO: 559150 - DNA, 20 bp, Artificial
  CRISPR gRNA sequence
gccatgttggccaggttggt

SEQ ID NO: 559151 - DNA, 20 bp, Artificial
  CRISPR gRNA sequence
gccaggttggtctcaaactt

SEQ ID NO: 559152 - DNA, 20 bp, Artificial
  CRISPR gRNA sequence
gtctcaaacttctgacctca

SEQ ID NO: 559153 - DNA, 20 bp, Artificial
  CRISPR gRNA sequence
aaacttctgacctcaggtga

SEQ ID NO: 559154 - DNA, 20 bp, Artificial
  CRISPR gRNA sequence
ctgacctcaggtgatccacc

SEQ ID NO: 559155 - DNA, 20 bp, Artificial
  CRISPR gRNA sequence
tgacctcaggtgatccaccc

SEQ ID NO: 559156 - DNA, 20 bp, Artificial
  CRISPR gRNA sequence
acctcaggtgatccacccac

SEQ ID NO: 559157 - DNA, 20 bp, Artificial
  CRISPR gRNA sequence
aggtgatccacccaccttgg

SEQ ID NO: 559158 - DNA, 20 bp, Artificial
  CRISPR gRNA sequence
ggcctcccaaagtgctggga

SEQ ID NO: 559159 - DNA, 20 bp, Artificial
  CRISPR gRNA sequence
gcctcccaaagtgctgggat

SEQ ID NO: 559160 - DNA, 20 bp, Artificial
  CRISPR gRNA sequence
ccaaagtgctgggattacag

SEQ ID NO: 559161 - DNA, 20 bp, Artificial
  CRISPR gRNA sequence
ggattacagttgtgagccac

SEQ ID NO: 559162 - DNA, 20 bp, Artificial
  CRISPR gRNA sequence
cagttgtgagccaccacgcc

SEQ ID NO: 559163 - DNA, 20 bp, Artificial
  CRISPR gRNA sequence
tgagccaccacgcccggcca

SEQ ID NO: 559164 - DNA, 20 bp, Artificial
  CRISPR gRNA sequence
tcatggcttttcacatgcct

SEQ ID NO: 559165 - DNA, 20 bp, Artificial
  CRISPR gRNA sequence
ttcacatgccttcctcacta

SEQ ID NO: 559166 - DNA, 20 bp, Artificial
  CRISPR gRNA sequence
tcacatgccttcctcactaa

SEQ ID NO: 559167 - DNA, 20 bp, Artificial
  CRISPR gRNA sequence
cacatgccttcctcactaag

SEQ ID NO: 559168 - DNA, 20 bp, Artificial
  CRISPR gRNA sequence
acatgccttcctcactaagc

SEQ ID NO: 559169 - DNA, 20 bp, Artificial
  CRISPR gRNA sequence
cctcactaagcttaatcatt

SEQ ID NO: 559170 - DNA, 20 bp, Artificial
  CRISPR gRNA sequence
ctcactaagcttaatcattt

SEQ ID NO: 559171 - DNA, 20 bp, Artificial
  CRISPR gRNA sequence
actaagcttaatcatttcta

SEQ ID NO: 559172 - DNA, 20 bp, Artificial
  CRISPR gRNA sequence
agcttaatcatttctagttt

SEQ ID NO: 559173 - DNA, 20 bp, Artificial
  CRISPR gRNA sequence
aatcatttctagtttttaat

SEQ ID NO: 559174 - DNA, 20 bp, Artificial
  CRISPR gRNA sequence
atcatttctagtttttaatt

SEQ ID NO: 559175 - DNA, 20 bp, Artificial
  CRISPR gRNA sequence
ctagtttttaatttaaagtg

SEQ ID NO: 559176 - DNA, 20 bp, Artificial
  CRISPR gRNA sequence
tagtttttaatttaaagtga

SEQ ID NO: 559177 - DNA, 20 bp, Artificial
  CRISPR gRNA sequence
gtttttaatttaaagtgaga

SEQ ID NO: 559178 - DNA, 20 bp, Artificial
  CRISPR gRNA sequence
ttaatttaaagtgagagaca

SEQ ID NO: 559179 - DNA, 20 bp, Artificial
  CRISPR gRNA sequence
taatttaaagtgagagacag

SEQ ID NO: 559180 - DNA, 20 bp, Artificial
  CRISPR gRNA sequence
aatttaaagtgagagacagt

SEQ ID NO: 559181 - DNA, 20 bp, Artificial
  CRISPR gRNA sequence
atttaaagtgagagacagtg

SEQ ID NO: 559182 - DNA, 20 bp, Artificial
  CRISPR gRNA sequence
aaagtgagagacagtgcaac

SEQ ID NO: 559183 - DNA, 20 bp, Artificial
  CRISPR gRNA sequence
aagtgagagacagtgcaact

SEQ ID NO: 559184 - DNA, 20 bp, Artificial
  CRISPR gRNA sequence
ttcttttcacttgagcactt

SEQ ID NO: 559185 - DNA, 20 bp, Artificial
  CRISPR gRNA sequence
cttttcacttgagcacttag

SEQ ID NO: 559186 - DNA, 20 bp, Artificial
  CRISPR gRNA sequence
ttttcacttgagcacttaga

SEQ ID NO: 559187 - DNA, 20 bp, Artificial
  CRISPR gRNA sequence
ttcacttgagcacttagaag

SEQ ID NO: 559188 - DNA, 20 bp, Artificial
  CRISPR gRNA sequence
tcacttgagcacttagaagc

SEQ ID NO: 559189 - DNA, 20 bp, Artificial
  CRISPR gRNA sequence
cacttgagcacttagaagcc

SEQ ID NO: 559190 - DNA, 20 bp, Artificial
  CRISPR gRNA sequence
acttgagcacttagaagcca

SEQ ID NO: 559191 - DNA, 20 bp, Artificial
  CRISPR gRNA sequence
gagcacttagaagccattgc

SEQ ID NO: 559192 - DNA, 20 bp, Artificial
  CRISPR gRNA sequence
agcacttagaagccattgca

SEQ ID NO: 559193 - DNA, 20 bp, Artificial
  CRISPR gRNA sequence
agaagccattgcagggttat

SEQ ID NO: 559194 - DNA, 20 bp, Artificial
  CRISPR gRNA sequence
gaagccattgcagggttatt

SEQ ID NO: 559195 - DNA, 20 bp, Artificial
  CRISPR gRNA sequence
cagggttattaaattggcct

SEQ ID NO: 559196 - DNA, 20 bp, Artificial
  CRISPR gRNA sequence
ttaaattggcctaatttcag

SEQ ID NO: 559197 - DNA, 20 bp, Artificial
  CRISPR gRNA sequence
aattggcctaatttcagtat

SEQ ID NO: 559198 - DNA, 20 bp, Artificial
  CRISPR gRNA sequence
gcctaatttcagtatcattg

SEQ ID NO: 559199 - DNA, 20 bp, Artificial
  CRISPR gRNA sequence
atttcagtatcattgtctca

SEQ ID NO: 559200 - DNA, 20 bp, Artificial
  CRISPR gRNA sequence
cagtatcattgtctcaggtg

SEQ ID NO: 559201 - DNA, 20 bp, Artificial
  CRISPR gRNA sequence
agtatcattgtctcaggtga

SEQ ID NO: 559202 - DNA, 20 bp, Artificial
  CRISPR gRNA sequence
tctcaggtgacaagggaggc

SEQ ID NO: 559203 - DNA, 20 bp, Artificial
  CRISPR gRNA sequence
aggtgacaagggaggccagg

SEQ ID NO: 559204 - DNA, 20 bp, Artificial
  CRISPR gRNA sequence
atcaattaagttcaccgtct

SEQ ID NO: 559205 - DNA, 20 bp, Artificial
  CRISPR gRNA sequence
tcaattaagttcaccgtctt

SEQ ID NO: 559206 - DNA, 20 bp, Artificial
  CRISPR gRNA sequence
agttcaccgtcttatacgca

SEQ ID NO: 559207 - DNA, 20 bp, Artificial
  CRISPR gRNA sequence
accgtcttatacgcatggtt

SEQ ID NO: 559208 - DNA, 20 bp, Artificial
  CRISPR gRNA sequence
atacgcatggttcttggcat

SEQ ID NO: 559209 - DNA, 20 bp, Artificial
  CRISPR gRNA sequence
tacgcatggttcttggcatc

SEQ ID NO: 559210 - DNA, 20 bp, Artificial
  CRISPR gRNA sequence
ttggcatcccaaaacaatga

SEQ ID NO: 559211 - DNA, 20 bp, Artificial
  CRISPR gRNA sequence
ggcatcccaaaacaatgaca

SEQ ID NO: 559212 - DNA, 20 bp, Artificial
  CRISPR gRNA sequence
gcatcccaaaacaatgacaa

SEQ ID NO: 559213 - DNA, 20 bp, Artificial
  CRISPR gRNA sequence
atcacagatcaccataacag

SEQ ID NO: 559214 - DNA, 20 bp, Artificial
  CRISPR gRNA sequence
aatattgtgggaattactaa

SEQ ID NO: 559215 - DNA, 20 bp, Artificial
  CRISPR gRNA sequence
tgggaattactaaaatgtaa

SEQ ID NO: 559216 - DNA, 20 bp, Artificial
  CRISPR gRNA sequence
ctaaaatgtaacagagagac

SEQ ID NO: 559217 - DNA, 20 bp, Artificial
  CRISPR gRNA sequence
aaatgtaacagagagacaaa

SEQ ID NO: 559218 - DNA, 20 bp, Artificial
  CRISPR gRNA sequence
ggcactgatggacttgctta

SEQ ID NO: 559219 - DNA, 20 bp, Artificial
  CRISPR gRNA sequence
atggacttgcttaaagctgg

SEQ ID NO: 559220 - DNA, 20 bp, Artificial
  CRISPR gRNA sequence
gcttaaagctgggttgtcac

SEQ ID NO: 559221 - DNA, 20 bp, Artificial
  CRISPR gRNA sequence
cttaaagctgggttgtcacg

SEQ ID NO: 559222 - DNA, 20 bp, Artificial
  CRISPR gRNA sequence
aaagctgggttgtcacgaac

SEQ ID NO: 559223 - DNA, 20 bp, Artificial
  CRISPR gRNA sequence
aagctgggttgtcacgaacc

SEQ ID NO: 559224 - DNA, 20 bp, Artificial
  CRISPR gRNA sequence
ggttgtcacgaaccttcaat

SEQ ID NO: 559225 - DNA, 20 bp, Artificial
  CRISPR gRNA sequence
tcacgaaccttcaatttgta

SEQ ID NO: 559226 - DNA, 20 bp, Artificial
  CRISPR gRNA sequence
caatttgtaaaaagcacatt

SEQ ID NO: 559227 - DNA, 20 bp, Artificial
  CRISPR gRNA sequence
aatttgtaaaaagcacatta

SEQ ID NO: 559228 - DNA, 20 bp, Artificial
  CRISPR gRNA sequence
gtaaaaagcacattatctgt

SEQ ID NO: 559229 - DNA, 20 bp, Artificial
  CRISPR gRNA sequence
taaaaagcacattatctgtg

SEQ ID NO: 559230 - DNA, 20 bp, Artificial
  CRISPR gRNA sequence
tctgtgaagtgcaataaagt

SEQ ID NO: 559231 - DNA, 20 bp, Artificial
  CRISPR gRNA sequence
tgaagtgcaataaagtgaaa

SEQ ID NO: 559232 - DNA, 20 bp, Artificial
  CRISPR gRNA sequence
agggatttaccattctttaa

SEQ ID NO: 559233 - DNA, 20 bp, Artificial
  CRISPR gRNA sequence
accattctttaataaaaatg

SEQ ID NO: 559234 - DNA, 20 bp, Artificial
  CRISPR gRNA sequence
ccattctttaataaaaatgg

SEQ ID NO: 559235 - DNA, 20 bp, Artificial
  CRISPR gRNA sequence
tttaataaaaatggtcttat

SEQ ID NO: 559236 - DNA, 20 bp, Artificial
  CRISPR gRNA sequence
taataaaaatggtcttatgc

SEQ ID NO: 559237 - DNA, 20 bp, Artificial
  CRISPR gRNA sequence
aataaaaatggtcttatgca

SEQ ID NO: 559238 - DNA, 20 bp, Artificial
  CRISPR gRNA sequence
ataaaaatggtcttatgcac

SEQ ID NO: 559239 - DNA, 20 bp, Artificial
  CRISPR gRNA sequence
atgcacacttctctacatcc

SEQ ID NO: 559240 - DNA, 20 bp, Artificial
  CRISPR gRNA sequence
tgcacacttctctacatccc

SEQ ID NO: 559241 - DNA, 20 bp, Artificial
  CRISPR gRNA sequence
ctctacatcccgcctttcca

SEQ ID NO: 559242 - DNA, 20 bp, Artificial
  CRISPR gRNA sequence
tctacatcccgcctttccat

SEQ ID NO: 559243 - DNA, 20 bp, Artificial
  CRISPR gRNA sequence
tacatcccgcctttccatta

SEQ ID NO: 559244 - DNA, 20 bp, Artificial
  CRISPR gRNA sequence
catcccgcctttccattaat

SEQ ID NO: 559245 - DNA, 20 bp, Artificial
  CRISPR gRNA sequence
tccattaatatgtcataaaa

SEQ ID NO: 559246 - DNA, 20 bp, Artificial
  CRISPR gRNA sequence
ccattaatatgtcataaaat

SEQ ID NO: 559247 - DNA, 20 bp, Artificial
  CRISPR gRNA sequence
cattaatatgtcataaaatc

SEQ ID NO: 559248 - DNA, 20 bp, Artificial
  CRISPR gRNA sequence
atatgtcataaaatctcctt

SEQ ID NO: 559249 - DNA, 20 bp, Artificial
  CRISPR gRNA sequence
cttgaaatcaactggtatag

SEQ ID NO: 559250 - DNA, 20 bp, Artificial
  CRISPR gRNA sequence
gaaatcaactggtatagcta

SEQ ID NO: 559251 - DNA, 20 bp, Artificial
  CRISPR gRNA sequence
aaatcaactggtatagctat

SEQ ID NO: 559252 - DNA, 20 bp, Artificial
  CRISPR gRNA sequence
gtatagctatactttattct

SEQ ID NO: 559253 - DNA, 20 bp, Artificial
  CRISPR gRNA sequence
tactttattctttttaataa

SEQ ID NO: 559254 - DNA, 20 bp, Artificial
  CRISPR gRNA sequence
tattctttttaataactaca

SEQ ID NO: 559255 - DNA, 20 bp, Artificial
  CRISPR gRNA sequence
attctttttaataactacat

SEQ ID NO: 559256 - DNA, 20 bp, Artificial
  CRISPR gRNA sequence
ttctttttaataactacata

SEQ ID NO: 559257 - DNA, 20 bp, Artificial
  CRISPR gRNA sequence
tttttaataactacataata

SEQ ID NO: 559258 - DNA, 20 bp, Artificial
  CRISPR gRNA sequence
tttaataactacataatatt

SEQ ID NO: 559259 - DNA, 20 bp, Artificial
  CRISPR gRNA sequence
ttaataactacataatattc

SEQ ID NO: 559260 - DNA, 20 bp, Artificial
  CRISPR gRNA sequence
taataactacataatattcc

SEQ ID NO: 559261 - DNA, 20 bp, Artificial
  CRISPR gRNA sequence
aataactacataatattcca

SEQ ID NO: 559262 - DNA, 20 bp, Artificial
  CRISPR gRNA sequence
ataactacataatattccag

SEQ ID NO: 559263 - DNA, 20 bp, Artificial
  CRISPR gRNA sequence
cataatattccagagcatga

SEQ ID NO: 559264 - DNA, 20 bp, Artificial
  CRISPR gRNA sequence
cagagcatgagggaaccata

SEQ ID NO: 559265 - DNA, 20 bp, Artificial
  CRISPR gRNA sequence
atctgccatccaccactgat

SEQ ID NO: 559266 - DNA, 20 bp, Artificial
  CRISPR gRNA sequence
ccatccaccactgatgaaca

SEQ ID NO: 559267 - DNA, 20 bp, Artificial
  CRISPR gRNA sequence
atgaacactccttttgtggc

SEQ ID NO: 559268 - DNA, 20 bp, Artificial
  CRISPR gRNA sequence
cttttgtggctagctttgtc

SEQ ID NO: 559269 - DNA, 20 bp, Artificial
  CRISPR gRNA sequence
ttgtggctagctttgtctat

SEQ ID NO: 559270 - DNA, 20 bp, Artificial
  CRISPR gRNA sequence
tgtggctagctttgtctatt

SEQ ID NO: 559271 - DNA, 20 bp, Artificial
  CRISPR gRNA sequence
gtggctagctttgtctattg

SEQ ID NO: 559272 - DNA, 20 bp, Artificial
  CRISPR gRNA sequence
tggctagctttgtctattgc

SEQ ID NO: 559273 - DNA, 20 bp, Artificial
  CRISPR gRNA sequence
gctttgtctattgcagttac

SEQ ID NO: 559274 - DNA, 20 bp, Artificial
  CRISPR gRNA sequence
tgtctattgcagttacaccg

SEQ ID NO: 559275 - DNA, 20 bp, Artificial
  CRISPR gRNA sequence
gtctattgcagttacaccgc

SEQ ID NO: 559276 - DNA, 20 bp, Artificial
  CRISPR gRNA sequence
tctattgcagttacaccgca

SEQ ID NO: 559277 - DNA, 20 bp, Artificial
  CRISPR gRNA sequence
ttgcagttacaccgcaataa

SEQ ID NO: 559278 - DNA, 20 bp, Artificial
  CRISPR gRNA sequence
cagttacaccgcaataacta

SEQ ID NO: 559279 - DNA, 20 bp, Artificial
  CRISPR gRNA sequence
caccgcaataactatcctgt

SEQ ID NO: 559280 - DNA, 20 bp, Artificial
  CRISPR gRNA sequence
tcctgtacatatgtcctgat

SEQ ID NO: 559281 - DNA, 20 bp, Artificial
  CRISPR gRNA sequence
tacatatgtcctgatgtatt

SEQ ID NO: 559282 - DNA, 20 bp, Artificial
  CRISPR gRNA sequence
atgtatttatggtttcatat

SEQ ID NO: 559283 - DNA, 20 bp, Artificial
  CRISPR gRNA sequence
atggtttcatatttatgtgg

SEQ ID NO: 559284 - DNA, 20 bp, Artificial
  CRISPR gRNA sequence
tggtttcatatttatgtggg

SEQ ID NO: 559285 - DNA, 20 bp, Artificial
  CRISPR gRNA sequence
catatttatgtgggagtaga

SEQ ID NO: 559286 - DNA, 20 bp, Artificial
  CRISPR gRNA sequence
atatttatgtgggagtagag

SEQ ID NO: 559287 - DNA, 20 bp, Artificial
  CRISPR gRNA sequence
atgtgggagtagagtggagc

SEQ ID NO: 559288 - DNA, 20 bp, Artificial
  CRISPR gRNA sequence
tgtgggagtagagtggagct

SEQ ID NO: 559289 - DNA, 20 bp, Artificial
  CRISPR gRNA sequence
ggagttgctacatcaaaagg

SEQ ID NO: 559290 - DNA, 20 bp, Artificial
  CRISPR gRNA sequence
ctacatcaaaaggtaaatag

SEQ ID NO: 559291 - DNA, 20 bp, Artificial
  CRISPR gRNA sequence
catcaaaaggtaaatagatt

SEQ ID NO: 559292 - DNA, 20 bp, Artificial
  CRISPR gRNA sequence
tttttattttaatagaagtt

SEQ ID NO: 559293 - DNA, 20 bp, Artificial
  CRISPR gRNA sequence
ttttattttaatagaagttg

SEQ ID NO: 559294 - DNA, 20 bp, Artificial
  CRISPR gRNA sequence
tttattttaatagaagttgc

SEQ ID NO: 559295 - DNA, 20 bp, Artificial
  CRISPR gRNA sequence
ttattttaatagaagttgct

SEQ ID NO: 559296 - DNA, 20 bp, Artificial
  CRISPR gRNA sequence
tattttaatagaagttgctg

SEQ ID NO: 559297 - DNA, 20 bp, Artificial
  CRISPR gRNA sequence
attttaatagaagttgctgc

SEQ ID NO: 559298 - DNA, 20 bp, Artificial
  CRISPR gRNA sequence
ttttaatagaagttgctgca

SEQ ID NO: 559299 - DNA, 20 bp, Artificial
  CRISPR gRNA sequence
taatagaagttgctgcattg

SEQ ID NO: 559300 - DNA, 20 bp, Artificial
  CRISPR gRNA sequence
aatagaagttgctgcattgt

SEQ ID NO: 559301 - DNA, 20 bp, Artificial
  CRISPR gRNA sequence
atagaagttgctgcattgtt

SEQ ID NO: 559302 - DNA, 20 bp, Artificial
  CRISPR gRNA sequence
ctgcattgtttacaaaaaag

SEQ ID NO: 559303 - DNA, 20 bp, Artificial
  CRISPR gRNA sequence
cattgtttacaaaaaagact

SEQ ID NO: 559304 - DNA, 20 bp, Artificial
  CRISPR gRNA sequence
tttacaaaaaagactttggc

SEQ ID NO: 559305 - DNA, 20 bp, Artificial
  CRISPR gRNA sequence
acaaaaaagactttggcaat

SEQ ID NO: 559306 - DNA, 20 bp, Artificial
  CRISPR gRNA sequence
caaaaaagactttggcaatt

SEQ ID NO: 559307 - DNA, 20 bp, Artificial
  CRISPR gRNA sequence
tggcaatttacatctccatc

SEQ ID NO: 559308 - DNA, 20 bp, Artificial
  CRISPR gRNA sequence
ggcaatttacatctccatca

SEQ ID NO: 559309 - DNA, 20 bp, Artificial
  CRISPR gRNA sequence
gcaatttacatctccatcag

SEQ ID NO: 559310 - DNA, 20 bp, Artificial
  CRISPR gRNA sequence
acatctccatcagtaatgcc

SEQ ID NO: 559311 - DNA, 20 bp, Artificial
  CRISPR gRNA sequence
catctccatcagtaatgcct

SEQ ID NO: 559312 - DNA, 20 bp, Artificial
  CRISPR gRNA sequence
catcagtaatgcctgagttg

SEQ ID NO: 559313 - DNA, 20 bp, Artificial
  CRISPR gRNA sequence
agttgccctttccttggact

SEQ ID NO: 559314 - DNA, 20 bp, Artificial
  CRISPR gRNA sequence
ccctttccttggactcctga

SEQ ID NO: 559315 - DNA, 20 bp, Artificial
  CRISPR gRNA sequence
tccttggactcctgacagca

SEQ ID NO: 559316 - DNA, 20 bp, Artificial
  CRISPR gRNA sequence
ccttggactcctgacagcat

SEQ ID NO: 559317 - DNA, 20 bp, Artificial
  CRISPR gRNA sequence
cttggactcctgacagcatt

SEQ ID NO: 559318 - DNA, 20 bp, Artificial
  CRISPR gRNA sequence
ggactcctgacagcattagg

SEQ ID NO: 559319 - DNA, 20 bp, Artificial
  CRISPR gRNA sequence
gactcctgacagcattaggt

SEQ ID NO: 559320 - DNA, 20 bp, Artificial
  CRISPR gRNA sequence
ctgacagcattaggtaattt

SEQ ID NO: 559321 - DNA, 20 bp, Artificial
  CRISPR gRNA sequence
acagcattaggtaatttttt

SEQ ID NO: 559322 - DNA, 20 bp, Artificial
  CRISPR gRNA sequence
ggtaattttttttttatgtt

SEQ ID NO: 559323 - DNA, 20 bp, Artificial
  CRISPR gRNA sequence
tttttttatgtttaattttt

SEQ ID NO: 559324 - DNA, 20 bp, Artificial
  CRISPR gRNA sequence
ttttttatgtttaatttttg

SEQ ID NO: 559325 - DNA, 20 bp, Artificial
  CRISPR gRNA sequence
tttttatgtttaatttttgg

SEQ ID NO: 559326 - DNA, 20 bp, Artificial
  CRISPR gRNA sequence
ttttatgtttaatttttggg

SEQ ID NO: 559327 - DNA, 20 bp, Artificial
  CRISPR gRNA sequence
tttatgtttaatttttgggc

SEQ ID NO: 559328 - DNA, 20 bp, Artificial
  CRISPR gRNA sequence
ttatgtttaatttttgggca

SEQ ID NO: 559329 - DNA, 20 bp, Artificial
  CRISPR gRNA sequence
tatgtttaatttttgggcaa

SEQ ID NO: 559330 - DNA, 20 bp, Artificial
  CRISPR gRNA sequence
atgtttaatttttgggcaaa

SEQ ID NO: 559331 - DNA, 20 bp, Artificial
  CRISPR gRNA sequence
tgtttaatttttgggcaaat

SEQ ID NO: 559332 - DNA, 20 bp, Artificial
  CRISPR gRNA sequence
aatttttgggcaaatagtga

SEQ ID NO: 559333 - DNA, 20 bp, Artificial
  CRISPR gRNA sequence
atttttgggcaaatagtgac

SEQ ID NO: 559334 - DNA, 20 bp, Artificial
  CRISPR gRNA sequence
ttgggcaaatagtgacattt

SEQ ID NO: 559335 - DNA, 20 bp, Artificial
  CRISPR gRNA sequence
tgggcaaatagtgacatttc

SEQ ID NO: 559336 - DNA, 20 bp, Artificial
  CRISPR gRNA sequence
gggcaaatagtgacatttca

SEQ ID NO: 559337 - DNA, 20 bp, Artificial
  CRISPR gRNA sequence
ggcaaatagtgacatttcat

SEQ ID NO: 559338 - DNA, 20 bp, Artificial
  CRISPR gRNA sequence
cattgatacttgaatttgca

SEQ ID NO: 559339 - DNA, 20 bp, Artificial
  CRISPR gRNA sequence
attgatacttgaatttgcat

SEQ ID NO: 559340 - DNA, 20 bp, Artificial
  CRISPR gRNA sequence
atacttgaatttgcattttc

SEQ ID NO: 559341 - DNA, 20 bp, Artificial
  CRISPR gRNA sequence
gaatttgcattttcccaacc

SEQ ID NO: 559342 - DNA, 20 bp, Artificial
  CRISPR gRNA sequence
aatttgcattttcccaacct

SEQ ID NO: 559343 - DNA, 20 bp, Artificial
  CRISPR gRNA sequence
gcattttcccaacctttaaa

SEQ ID NO: 559344 - DNA, 20 bp, Artificial
  CRISPR gRNA sequence
cattttcccaacctttaaaa

SEQ ID NO: 559345 - DNA, 20 bp, Artificial
  CRISPR gRNA sequence
tcccaacctttaaaaattta

SEQ ID NO: 559346 - DNA, 20 bp, Artificial
  CRISPR gRNA sequence
cccaacctttaaaaatttaa

SEQ ID NO: 559347 - DNA, 20 bp, Artificial
  CRISPR gRNA sequence
ccaacctttaaaaatttaag

SEQ ID NO: 559348 - DNA, 20 bp, Artificial
  CRISPR gRNA sequence
taaaaatttaagcatctctt

SEQ ID NO: 559349 - DNA, 20 bp, Artificial
  CRISPR gRNA sequence
aaaaatttaagcatctcttc

SEQ ID NO: 559350 - DNA, 20 bp, Artificial
  CRISPR gRNA sequence
aaaatttaagcatctcttct

SEQ ID NO: 559351 - DNA, 20 bp, Artificial
  CRISPR gRNA sequence
aagcatctcttctgcttgtt

SEQ ID NO: 559352 - DNA, 20 bp, Artificial
  CRISPR gRNA sequence
agcatctcttctgcttgttg

SEQ ID NO: 559353 - DNA, 20 bp, Artificial
  CRISPR gRNA sequence
ttctgcttgttgatttggat

SEQ ID NO: 559354 - DNA, 20 bp, Artificial
  CRISPR gRNA sequence
ctgcttgttgatttggattt

SEQ ID NO: 559355 - DNA, 20 bp, Artificial
  CRISPR gRNA sequence
tgcttgttgatttggatttc

SEQ ID NO: 559356 - DNA, 20 bp, Artificial
  CRISPR gRNA sequence
cttgttgatttggatttctt

SEQ ID NO: 559357 - DNA, 20 bp, Artificial
  CRISPR gRNA sequence
gttgatttggatttcttttt

SEQ ID NO: 559358 - DNA, 20 bp, Artificial
  CRISPR gRNA sequence
ttgatttggatttctttttc

SEQ ID NO: 559359 - DNA, 20 bp, Artificial
  CRISPR gRNA sequence
atttggatttctttttctga

SEQ ID NO: 559360 - DNA, 20 bp, Artificial
  CRISPR gRNA sequence
ggatttctttttctgagaaa

SEQ ID NO: 559361 - DNA, 20 bp, Artificial
  CRISPR gRNA sequence
gatttctttttctgagaaat

SEQ ID NO: 559362 - DNA, 20 bp, Artificial
  CRISPR gRNA sequence
ctttttctgagaaatgtctt

SEQ ID NO: 559363 - DNA, 20 bp, Artificial
  CRISPR gRNA sequence
tttttctgagaaatgtcttt

SEQ ID NO: 559364 - DNA, 20 bp, Artificial
  CRISPR gRNA sequence
tttctgagaaatgtcttttc

SEQ ID NO: 559365 - DNA, 20 bp, Artificial
  CRISPR gRNA sequence
ttctgagaaatgtcttttca

SEQ ID NO: 559366 - DNA, 20 bp, Artificial
  CRISPR gRNA sequence
tctgagaaatgtcttttcac

SEQ ID NO: 559367 - DNA, 20 bp, Artificial
  CRISPR gRNA sequence
ctgagaaatgtcttttcaca

SEQ ID NO: 559368 - DNA, 20 bp, Artificial
  CRISPR gRNA sequence
tgagaaatgtcttttcacat

SEQ ID NO: 559369 - DNA, 20 bp, Artificial
  CRISPR gRNA sequence
agaaatgtcttttcacatcc

SEQ ID NO: 559370 - DNA, 20 bp, Artificial
  CRISPR gRNA sequence
ttcacatcctctttttttgt

SEQ ID NO: 559371 - DNA, 20 bp, Artificial
  CRISPR gRNA sequence
tcacatcctctttttttgta

SEQ ID NO: 559372 - DNA, 20 bp, Artificial
  CRISPR gRNA sequence
cacatcctctttttttgtat

SEQ ID NO: 559373 - DNA, 20 bp, Artificial
  CRISPR gRNA sequence
acatcctctttttttgtatt

SEQ ID NO: 559374 - DNA, 20 bp, Artificial
  CRISPR gRNA sequence
tttttttgtattagattgtt

SEQ ID NO: 559375 - DNA, 20 bp, Artificial
  CRISPR gRNA sequence
tttttgtattagattgtttg

SEQ ID NO: 559376 - DNA, 20 bp, Artificial
  CRISPR gRNA sequence
ttttgtattagattgtttgt

SEQ ID NO: 559377 - DNA, 20 bp, Artificial
  CRISPR gRNA sequence
tttgtattagattgtttgtt

SEQ ID NO: 559378 - DNA, 20 bp, Artificial
  CRISPR gRNA sequence
ttgtattagattgtttgttt

SEQ ID NO: 559379 - DNA, 20 bp, Artificial
  CRISPR gRNA sequence
tgtattagattgtttgtttt

SEQ ID NO: 559380 - DNA, 20 bp, Artificial
  CRISPR gRNA sequence
gtattagattgtttgttttt

SEQ ID NO: 559381 - DNA, 20 bp, Artificial
  CRISPR gRNA sequence
tattagattgtttgtttttt

SEQ ID NO: 559382 - DNA, 20 bp, Artificial
  CRISPR gRNA sequence
gattgtttgtttttttcttc

SEQ ID NO: 559383 - DNA, 20 bp, Artificial
  CRISPR gRNA sequence
tttgtttttttcttctcaaa

SEQ ID NO: 559384 - DNA, 20 bp, Artificial
  CRISPR gRNA sequence
gtttttttcttctcaaagtt

SEQ ID NO: 559385 - DNA, 20 bp, Artificial
  CRISPR gRNA sequence
tttttttcttctcaaagttt

SEQ ID NO: 559386 - DNA, 20 bp, Artificial
  CRISPR gRNA sequence
ttttcttctcaaagtttaaa

SEQ ID NO: 559387 - DNA, 20 bp, Artificial
  CRISPR gRNA sequence
tttcttctcaaagtttaaag

SEQ ID NO: 559388 - DNA, 20 bp, Artificial
  CRISPR gRNA sequence
ttcttctcaaagtttaaagg

SEQ ID NO: 559389 - DNA, 20 bp, Artificial
  CRISPR gRNA sequence
tcttctcaaagtttaaaggc

SEQ ID NO: 559390 - DNA, 20 bp, Artificial
  CRISPR gRNA sequence
cttctcaaagtttaaaggct

SEQ ID NO: 559391 - DNA, 20 bp, Artificial
  CRISPR gRNA sequence
ttctcaaagtttaaaggctc

SEQ ID NO: 559392 - DNA, 20 bp, Artificial
  CRISPR gRNA sequence
ctcaaagtttaaaggctcct

SEQ ID NO: 559393 - DNA, 20 bp, Artificial
  CRISPR gRNA sequence
tcaaagtttaaaggctcctt

SEQ ID NO: 559394 - DNA, 20 bp, Artificial
  CRISPR gRNA sequence
aaagtttaaaggctccttat

SEQ ID NO: 559395 - DNA, 20 bp, Artificial
  CRISPR gRNA sequence
aaaggctccttatatgttat

SEQ ID NO: 559396 - DNA, 20 bp, Artificial
  CRISPR gRNA sequence
aaggctccttatatgttata

SEQ ID NO: 559397 - DNA, 20 bp, Artificial
  CRISPR gRNA sequence
cttatatgttatatattttt

SEQ ID NO: 559398 - DNA, 20 bp, Artificial
  CRISPR gRNA sequence
atatgttatatatttttatc

SEQ ID NO: 559399 - DNA, 20 bp, Artificial
  CRISPR gRNA sequence
tatgttatatatttttatct

SEQ ID NO: 559400 - DNA, 20 bp, Artificial
  CRISPR gRNA sequence
tatatttttatctgtattat

SEQ ID NO: 559401 - DNA, 20 bp, Artificial
  CRISPR gRNA sequence
ttatctgtattatagttttt

SEQ ID NO: 559402 - DNA, 20 bp, Artificial
  CRISPR gRNA sequence
tatctgtattatagtttttt

SEQ ID NO: 559403 - DNA, 20 bp, Artificial
  CRISPR gRNA sequence
atctgtattatagttttttt

SEQ ID NO: 559404 - DNA, 20 bp, Artificial
  CRISPR gRNA sequence
tctgtattatagtttttttt

SEQ ID NO: 559405 - DNA, 20 bp, Artificial
  CRISPR gRNA sequence
tattatagttttttttcaaa

SEQ ID NO: 559406 - DNA, 20 bp, Artificial
  CRISPR gRNA sequence
tagttttttttcaaatacag

SEQ ID NO: 559407 - DNA, 20 bp, Artificial
  CRISPR gRNA sequence
tttttcaaatacagcctttg

SEQ ID NO: 559408 - DNA, 20 bp, Artificial
  CRISPR gRNA sequence
ttttcaaatacagcctttgc

SEQ ID NO: 559409 - DNA, 20 bp, Artificial
  CRISPR gRNA sequence
tttcaaatacagcctttgcc

SEQ ID NO: 559410 - DNA, 20 bp, Artificial
  CRISPR gRNA sequence
ttcaaatacagcctttgcct

SEQ ID NO: 559411 - DNA, 20 bp, Artificial
  CRISPR gRNA sequence
tcaaatacagcctttgccta

SEQ ID NO: 559412 - DNA, 20 bp, Artificial
  CRISPR gRNA sequence
caaatacagcctttgcctat

SEQ ID NO: 559413 - DNA, 20 bp, Artificial
  CRISPR gRNA sequence
aaatacagcctttgcctatt

SEQ ID NO: 559414 - DNA, 20 bp, Artificial
  CRISPR gRNA sequence
tgcctattgaatttactaaa

SEQ ID NO: 559415 - DNA, 20 bp, Artificial
  CRISPR gRNA sequence
gcctattgaatttactaaat

SEQ ID NO: 559416 - DNA, 20 bp, Artificial
  CRISPR gRNA sequence
cctattgaatttactaaatg

SEQ ID NO: 559417 - DNA, 20 bp, Artificial
  CRISPR gRNA sequence
ttgaatttactaaatgaata

SEQ ID NO: 559418 - DNA, 20 bp, Artificial
  CRISPR gRNA sequence
aatttactaaatgaatatct

SEQ ID NO: 559419 - DNA, 20 bp, Artificial
  CRISPR gRNA sequence
actaaatgaatatcttccat

SEQ ID NO: 559420 - DNA, 20 bp, Artificial
  CRISPR gRNA sequence
ctaaatgaatatcttccata

SEQ ID NO: 559421 - DNA, 20 bp, Artificial
  CRISPR gRNA sequence
aatgaatatcttccatacaa

SEQ ID NO: 559422 - DNA, 20 bp, Artificial
  CRISPR gRNA sequence
ccatacaaagtttctatatt

SEQ ID NO: 559423 - DNA, 20 bp, Artificial
  CRISPR gRNA sequence
catacaaagtttctatattt

SEQ ID NO: 559424 - DNA, 20 bp, Artificial
  CRISPR gRNA sequence
ctatatttttacataatgaa

SEQ ID NO: 559425 - DNA, 20 bp, Artificial
  CRISPR gRNA sequence
tatatttttacataatgaaa

SEQ ID NO: 559426 - DNA, 20 bp, Artificial
  CRISPR gRNA sequence
tatttttacataatgaaagt

SEQ ID NO: 559427 - DNA, 20 bp, Artificial
  CRISPR gRNA sequence
ttacataatgaaagtgttta

SEQ ID NO: 559428 - DNA, 20 bp, Artificial
  CRISPR gRNA sequence
tacataatgaaagtgtttat

SEQ ID NO: 559429 - DNA, 20 bp, Artificial
  CRISPR gRNA sequence
acataatgaaagtgtttatc

SEQ ID NO: 559430 - DNA, 20 bp, Artificial
  CRISPR gRNA sequence
cataatgaaagtgtttatct

SEQ ID NO: 559431 - DNA, 20 bp, Artificial
  CRISPR gRNA sequence
atcttttctggctatggtgt

SEQ ID NO: 559432 - DNA, 20 bp, Artificial
  CRISPR gRNA sequence
tcttttctggctatggtgtg

SEQ ID NO: 559433 - DNA, 20 bp, Artificial
  CRISPR gRNA sequence
ttctggctatggtgtggaag

SEQ ID NO: 559434 - DNA, 20 bp, Artificial
  CRISPR gRNA sequence
tctggctatggtgtggaaga

SEQ ID NO: 559435 - DNA, 20 bp, Artificial
  CRISPR gRNA sequence
ctggctatggtgtggaagac

SEQ ID NO: 559436 - DNA, 20 bp, Artificial
  CRISPR gRNA sequence
tggctatggtgtggaagact

SEQ ID NO: 559437 - DNA, 20 bp, Artificial
  CRISPR gRNA sequence
gctatggtgtggaagactga

SEQ ID NO: 559438 - DNA, 20 bp, Artificial
  CRISPR gRNA sequence
tggtgtggaagactgatggg

SEQ ID NO: 559439 - DNA, 20 bp, Artificial
  CRISPR gRNA sequence
atgggaggggtaagactaga

SEQ ID NO: 559440 - DNA, 20 bp, Artificial
  CRISPR gRNA sequence
gatagcaagagatccatcag

SEQ ID NO: 559441 - DNA, 20 bp, Artificial
  CRISPR gRNA sequence
cagactggtcaagaggcagc

SEQ ID NO: 559442 - DNA, 20 bp, Artificial
  CRISPR gRNA sequence
agactggtcaagaggcagca

SEQ ID NO: 559443 - DNA, 20 bp, Artificial
  CRISPR gRNA sequence
gtcaagaggcagcattgtgc

SEQ ID NO: 559444 - DNA, 20 bp, Artificial
  CRISPR gRNA sequence
tgctaggcaaagtggttcaa

SEQ ID NO: 559445 - DNA, 20 bp, Artificial
  CRISPR gRNA sequence
ggcaaagtggttcaagagac

SEQ ID NO: 559446 - DNA, 20 bp, Artificial
  CRISPR gRNA sequence
aagagacattagggaggtaa

SEQ ID NO: 559447 - DNA, 20 bp, Artificial
  CRISPR gRNA sequence
gggaggtaaaactgggagaa

SEQ ID NO: 559448 - DNA, 20 bp, Artificial
  CRISPR gRNA sequence
ggagaactagatgattgaca

SEQ ID NO: 559449 - DNA, 20 bp, Artificial
  CRISPR gRNA sequence
gatgattgacagcatatggg

SEQ ID NO: 559450 - DNA, 20 bp, Artificial
  CRISPR gRNA sequence
acagcatatggggtaaagga

SEQ ID NO: 559451 - DNA, 20 bp, Artificial
  CRISPR gRNA sequence
ttacttcctcctaggtgggt

SEQ ID NO: 559452 - DNA, 20 bp, Artificial
  CRISPR gRNA sequence
acttcctcctaggtgggttg

SEQ ID NO: 559453 - DNA, 20 bp, Artificial
  CRISPR gRNA sequence
cttcctcctaggtgggttgt

SEQ ID NO: 559454 - DNA, 20 bp, Artificial
  CRISPR gRNA sequence
cctcctaggtgggttgtggt

SEQ ID NO: 559455 - DNA, 20 bp, Artificial
  CRISPR gRNA sequence
ctcctaggtgggttgtggtg

SEQ ID NO: 559456 - DNA, 20 bp, Artificial
  CRISPR gRNA sequence
ctaggtgggttgtggtgtct

SEQ ID NO: 559457 - DNA, 20 bp, Artificial
  CRISPR gRNA sequence
ggtgggttgtggtgtctttc

SEQ ID NO: 559458 - DNA, 20 bp, Artificial
  CRISPR gRNA sequence
tggtgtctttccctaagaaa

SEQ ID NO: 559459 - DNA, 20 bp, Artificial
  CRISPR gRNA sequence
tccctaagaaaggaaacaca

SEQ ID NO: 559460 - DNA, 20 bp, Artificial
  CRISPR gRNA sequence
ccctaagaaaggaaacacag

SEQ ID NO: 559461 - DNA, 20 bp, Artificial
  CRISPR gRNA sequence
cctaagaaaggaaacacagc

SEQ ID NO: 559462 - DNA, 20 bp, Artificial
  CRISPR gRNA sequence
agaaaggaaacacagcagga

SEQ ID NO: 559463 - DNA, 20 bp, Artificial
  CRISPR gRNA sequence
agactggcctggaacatcat

SEQ ID NO: 559464 - DNA, 20 bp, Artificial
  CRISPR gRNA sequence
gcctggaacatcatgctttc

SEQ ID NO: 559465 - DNA, 20 bp, Artificial
  CRISPR gRNA sequence
gaacatcatgctttcagttt

SEQ ID NO: 559466 - DNA, 20 bp, Artificial
  CRISPR gRNA sequence
tcagtttgacactgttcagt

SEQ ID NO: 559467 - DNA, 20 bp, Artificial
  CRISPR gRNA sequence
cagtttgacactgttcagtg

SEQ ID NO: 559468 - DNA, 20 bp, Artificial
  CRISPR gRNA sequence
agtttgacactgttcagtgt

SEQ ID NO: 559469 - DNA, 20 bp, Artificial
  CRISPR gRNA sequence
gacactgttcagtgtgaggg

SEQ ID NO: 559470 - DNA, 20 bp, Artificial
  CRISPR gRNA sequence
acactgttcagtgtgagggg

SEQ ID NO: 559471 - DNA, 20 bp, Artificial
  CRISPR gRNA sequence
ttcagtgtgaggggtctgtg

SEQ ID NO: 559472 - DNA, 20 bp, Artificial
  CRISPR gRNA sequence
agtgtgaggggtctgtgaga

SEQ ID NO: 559473 - DNA, 20 bp, Artificial
  CRISPR gRNA sequence
tgagacatccaagcaaagat

SEQ ID NO: 559474 - DNA, 20 bp, Artificial
  CRISPR gRNA sequence
ctaagtacacaggtctggga

SEQ ID NO: 559475 - DNA, 20 bp, Artificial
  CRISPR gRNA sequence
agtacacaggtctgggactc

SEQ ID NO: 559476 - DNA, 20 bp, Artificial
  CRISPR gRNA sequence
ggactcacaggaaaggatac

SEQ ID NO: 559477 - DNA, 20 bp, Artificial
  CRISPR gRNA sequence
acaggaaaggatacagattt

SEQ ID NO: 559478 - DNA, 20 bp, Artificial
  CRISPR gRNA sequence
gggagtcatcacatttctag

SEQ ID NO: 559479 - DNA, 20 bp, Artificial
  CRISPR gRNA sequence
ggagtcatcacatttctagt

SEQ ID NO: 559480 - DNA, 20 bp, Artificial
  CRISPR gRNA sequence
ctagtggctccaatggaggc

SEQ ID NO: 559481 - DNA, 20 bp, Artificial
  CRISPR gRNA sequence
tagtggctccaatggaggcc

SEQ ID NO: 559482 - DNA, 20 bp, Artificial
  CRISPR gRNA sequence
gtggctccaatggaggccat

SEQ ID NO: 559483 - DNA, 20 bp, Artificial
  CRISPR gRNA sequence
caatggaggccattaggacc

SEQ ID NO: 559484 - DNA, 20 bp, Artificial
  CRISPR gRNA sequence
ggaccatcaccttgggagag

SEQ ID NO: 559485 - DNA, 20 bp, Artificial
  CRISPR gRNA sequence
gggagagcgtatgaagtggg

SEQ ID NO: 559486 - DNA, 20 bp, Artificial
  CRISPR gRNA sequence
ggagagcgtatgaagtggga

SEQ ID NO: 559487 - DNA, 20 bp, Artificial
  CRISPR gRNA sequence
ggacctgtgctttaaagctt

SEQ ID NO: 559488 - DNA, 20 bp, Artificial
  CRISPR gRNA sequence
gacctgtgctttaaagcttg

SEQ ID NO: 559489 - DNA, 20 bp, Artificial
  CRISPR gRNA sequence
tgctttaaagcttggctaga

SEQ ID NO: 559490 - DNA, 20 bp, Artificial
  CRISPR gRNA sequence
taaagcttggctagagggga

SEQ ID NO: 559491 - DNA, 20 bp, Artificial
  CRISPR gRNA sequence
aaagcttggctagaggggaa

SEQ ID NO: 559492 - DNA, 20 bp, Artificial
  CRISPR gRNA sequence
aagcttggctagaggggaaa

SEQ ID NO: 559493 - DNA, 20 bp, Artificial
  CRISPR gRNA sequence
ggctagaggggaaaacactg

SEQ ID NO: 559494 - DNA, 20 bp, Artificial
  CRISPR gRNA sequence
gctagaggggaaaacactgg

SEQ ID NO: 559495 - DNA, 20 bp, Artificial
  CRISPR gRNA sequence
gaggggaaaacactggctaa

SEQ ID NO: 559496 - DNA, 20 bp, Artificial
  CRISPR gRNA sequence
gctaaggagactgagagaga

SEQ ID NO: 559497 - DNA, 20 bp, Artificial
  CRISPR gRNA sequence
aggagactgagagagacctg

SEQ ID NO: 559498 - DNA, 20 bp, Artificial
  CRISPR gRNA sequence
agagagacctgggaagtaga

SEQ ID NO: 559499 - DNA, 20 bp, Artificial
  CRISPR gRNA sequence
ggaagtagaagaaaggccag

SEQ ID NO: 559500 - DNA, 20 bp, Artificial
  CRISPR gRNA sequence
caagacaagagtcaacatgt

SEQ ID NO: 559501 - DNA, 20 bp, Artificial
  CRISPR gRNA sequence
gactgaataaaaggcactag

SEQ ID NO: 559502 - DNA, 20 bp, Artificial
  CRISPR gRNA sequence
actgaataaaaggcactagt

SEQ ID NO: 559503 - DNA, 20 bp, Artificial
  CRISPR gRNA sequence
aataaaaggcactagtgata

SEQ ID NO: 559504 - DNA, 20 bp, Artificial
  CRISPR gRNA sequence
gtgatattactcagatagta

SEQ ID NO: 559505 - DNA, 20 bp, Artificial
  CRISPR gRNA sequence
ctcagatagtaggaaaaaga

SEQ ID NO: 559506 - DNA, 20 bp, Artificial
  CRISPR gRNA sequence
agatagtaggaaaaagatgg

SEQ ID NO: 559507 - DNA, 20 bp, Artificial
  CRISPR gRNA sequence
aaatgtaagcagaattaaac

SEQ ID NO: 559508 - DNA, 20 bp, Artificial
  CRISPR gRNA sequence
aacacacatacaaaaacaca

SEQ ID NO: 559509 - DNA, 20 bp, Artificial
  CRISPR gRNA sequence
atttttgcttatgctctaaa

SEQ ID NO: 559510 - DNA, 20 bp, Artificial
  CRISPR gRNA sequence
tttttgcttatgctctaaaa

SEQ ID NO: 559511 - DNA, 20 bp, Artificial
  CRISPR gRNA sequence
ttgcttatgctctaaaagaa

SEQ ID NO: 559512 - DNA, 20 bp, Artificial
  CRISPR gRNA sequence
tgcttatgctctaaaagaac

SEQ ID NO: 559513 - DNA, 20 bp, Artificial
  CRISPR gRNA sequence
gcttatgctctaaaagaacc

SEQ ID NO: 559514 - DNA, 20 bp, Artificial
  CRISPR gRNA sequence
cttatgctctaaaagaacct

SEQ ID NO: 559515 - DNA, 20 bp, Artificial
  CRISPR gRNA sequence
atgctctaaaagaacctgta

SEQ ID NO: 559516 - DNA, 20 bp, Artificial
  CRISPR gRNA sequence
tgctctaaaagaacctgtag

SEQ ID NO: 559517 - DNA, 20 bp, Artificial
  CRISPR gRNA sequence
taaaagaacctgtagtttca

SEQ ID NO: 559518 - DNA, 20 bp, Artificial
  CRISPR gRNA sequence
aaagaacctgtagtttcact

SEQ ID NO: 559519 - DNA, 20 bp, Artificial
  CRISPR gRNA sequence
tagtttcactgaatactggg

SEQ ID NO: 559520 - DNA, 20 bp, Artificial
  CRISPR gRNA sequence
cactgaatactgggatctgg

SEQ ID NO: 559521 - DNA, 20 bp, Artificial
  CRISPR gRNA sequence
actgaatactgggatctggg

SEQ ID NO: 559522 - DNA, 20 bp, Artificial
  CRISPR gRNA sequence
aatactgggatctgggtgat

SEQ ID NO: 559523 - DNA, 20 bp, Artificial
  CRISPR gRNA sequence
ggatctgggtgatatttatt

SEQ ID NO: 559524 - DNA, 20 bp, Artificial
  CRISPR gRNA sequence
ggtgatatttattcaggatg

SEQ ID NO: 559525 - DNA, 20 bp, Artificial
  CRISPR gRNA sequence
attcaggatgttaacaaata

SEQ ID NO: 559526 - DNA, 20 bp, Artificial
  CRISPR gRNA sequence
ttcaggatgttaacaaataa

SEQ ID NO: 559527 - DNA, 20 bp, Artificial
  CRISPR gRNA sequence
aggatgttaacaaataaaac

SEQ ID NO: 559528 - DNA, 20 bp, Artificial
  CRISPR gRNA sequence
acaaataaaacaatagtata

SEQ ID NO: 559529 - DNA, 20 bp, Artificial
  CRISPR gRNA sequence
cataaagagatatgcataat

SEQ ID NO: 559530 - DNA, 20 bp, Artificial
  CRISPR gRNA sequence
attttaaagttatctatact

SEQ ID NO: 559531 - DNA, 20 bp, Artificial
  CRISPR gRNA sequence
taaagttatctatactagta

SEQ ID NO: 559532 - DNA, 20 bp, Artificial
  CRISPR gRNA sequence
aaagttatctatactagtaa

SEQ ID NO: 559533 - DNA, 20 bp, Artificial
  CRISPR gRNA sequence
aagttatctatactagtaaa

SEQ ID NO: 559534 - DNA, 20 bp, Artificial
  CRISPR gRNA sequence
tctatactagtaaataataa

SEQ ID NO: 559535 - DNA, 20 bp, Artificial
  CRISPR gRNA sequence
tactagtaaataataatcta

SEQ ID NO: 559536 - DNA, 20 bp, Artificial
  CRISPR gRNA sequence
gtaaataataatctagtcta

SEQ ID NO: 559537 - DNA, 20 bp, Artificial
  CRISPR gRNA sequence
gtctaatagttaaacaattt

SEQ ID NO: 559538 - DNA, 20 bp, Artificial
  CRISPR gRNA sequence
atagttaaacaatttagtat

SEQ ID NO: 559539 - DNA, 20 bp, Artificial
  CRISPR gRNA sequence
aacaatttagtattatgcca

SEQ ID NO: 559540 - DNA, 20 bp, Artificial
  CRISPR gRNA sequence
agtattatgccatggcttac

SEQ ID NO: 559541 - DNA, 20 bp, Artificial
  CRISPR gRNA sequence
gtattatgccatggcttact

SEQ ID NO: 559542 - DNA, 20 bp, Artificial
  CRISPR gRNA sequence
tgccatggcttactatgtgg

SEQ ID NO: 559543 - DNA, 20 bp, Artificial
  CRISPR gRNA sequence
actatgtggttattttaaaa

SEQ ID NO: 559544 - DNA, 20 bp, Artificial
  CRISPR gRNA sequence
ctatgtggttattttaaaaa

SEQ ID NO: 559545 - DNA, 20 bp, Artificial
  CRISPR gRNA sequence
tgtggttattttaaaaaagg

SEQ ID NO: 559546 - DNA, 20 bp, Artificial
  CRISPR gRNA sequence
ttttaaaaaaggaaacagga

SEQ ID NO: 559547 - DNA, 20 bp, Artificial
  CRISPR gRNA sequence
taaaaaaggaaacaggatat

SEQ ID NO: 559548 - DNA, 20 bp, Artificial
  CRISPR gRNA sequence
aaaaaaggaaacaggatatt

SEQ ID NO: 559549 - DNA, 20 bp, Artificial
  CRISPR gRNA sequence
aaaaaggaaacaggatattc

SEQ ID NO: 559550 - DNA, 20 bp, Artificial
  CRISPR gRNA sequence
tccttttattattgggaatt

SEQ ID NO: 559551 - DNA, 20 bp, Artificial
  CRISPR gRNA sequence
cttttattattgggaatttg

SEQ ID NO: 559552 - DNA, 20 bp, Artificial
  CRISPR gRNA sequence
ttattattgggaatttggaa

SEQ ID NO: 559553 - DNA, 20 bp, Artificial
  CRISPR gRNA sequence
tattattgggaatttggaaa

SEQ ID NO: 559554 - DNA, 20 bp, Artificial
  CRISPR gRNA sequence
attattgggaatttggaaaa

SEQ ID NO: 559555 - DNA, 20 bp, Artificial
  CRISPR gRNA sequence
ttattgggaatttggaaaat

SEQ ID NO: 559556 - DNA, 20 bp, Artificial
  CRISPR gRNA sequence
ttgggaatttggaaaatttc

SEQ ID NO: 559557 - DNA, 20 bp, Artificial
  CRISPR gRNA sequence
ggaatttggaaaatttctta

SEQ ID NO: 559558 - DNA, 20 bp, Artificial
  CRISPR gRNA sequence
ggaaaatttcttaatattaa

SEQ ID NO: 559559 - DNA, 20 bp, Artificial
  CRISPR gRNA sequence
gaaaatttcttaatattaaa

SEQ ID NO: 559560 - DNA, 20 bp, Artificial
  CRISPR gRNA sequence
cttaatattaaaaataaaaa

SEQ ID NO: 559561 - DNA, 20 bp, Artificial
  CRISPR gRNA sequence
ttaatattaaaaataaaaag

SEQ ID NO: 559562 - DNA, 20 bp, Artificial
  CRISPR gRNA sequence
aatattaaaaataaaaagtt

SEQ ID NO: 559563 - DNA, 20 bp, Artificial
  CRISPR gRNA sequence
atattaaaaataaaaagtta

SEQ ID NO: 559564 - DNA, 20 bp, Artificial
  CRISPR gRNA sequence
aaaataaaaagttatagaaa

SEQ ID NO: 559565 - DNA, 20 bp, Artificial
  CRISPR gRNA sequence
tagaaatatatatgcagaat

SEQ ID NO: 559566 - DNA, 20 bp, Artificial
  CRISPR gRNA sequence
ctctttttaaaaacaataaa

SEQ ID NO: 559567 - DNA, 20 bp, Artificial
  CRISPR gRNA sequence
tttttaaaaacaataaagag

SEQ ID NO: 559568 - DNA, 20 bp, Artificial
  CRISPR gRNA sequence
tttaaaaacaataaagaggc

SEQ ID NO: 559569 - DNA, 20 bp, Artificial
  CRISPR gRNA sequence
ttaaaaacaataaagaggcc

SEQ ID NO: 559570 - DNA, 20 bp, Artificial
  CRISPR gRNA sequence
taaaaacaataaagaggcca

SEQ ID NO: 559571 - DNA, 20 bp, Artificial
  CRISPR gRNA sequence
aaaaacaataaagaggccag

SEQ ID NO: 559572 - DNA, 20 bp, Artificial
  CRISPR gRNA sequence
aaaacaataaagaggccaga

SEQ ID NO: 559573 - DNA, 20 bp, Artificial
  CRISPR gRNA sequence
atgcctacaattctagcact

SEQ ID NO: 559574 - DNA, 20 bp, Artificial
  CRISPR gRNA sequence
caattctagcactttggtag

SEQ ID NO: 559575 - DNA, 20 bp, Artificial
  CRISPR gRNA sequence
tagcactttggtaggccaaa

SEQ ID NO: 559576 - DNA, 20 bp, Artificial
  CRISPR gRNA sequence
gcactttggtaggccaaagt

SEQ ID NO: 559577 - DNA, 20 bp, Artificial
  CRISPR gRNA sequence
tggtaggccaaagtggaagg

SEQ ID NO: 559578 - DNA, 20 bp, Artificial
  CRISPR gRNA sequence
ggtaggccaaagtggaagga

SEQ ID NO: 559579 - DNA, 20 bp, Artificial
  CRISPR gRNA sequence
gtaggccaaagtggaaggat

SEQ ID NO: 559580 - DNA, 20 bp, Artificial
  CRISPR gRNA sequence
gagcccaggagtttgatacc

SEQ ID NO: 559581 - DNA, 20 bp, Artificial
  CRISPR gRNA sequence
agcccaggagtttgatacca

SEQ ID NO: 559582 - DNA, 20 bp, Artificial
  CRISPR gRNA sequence
gataccagcctgggcaatgt

SEQ ID NO: 559583 - DNA, 20 bp, Artificial
  CRISPR gRNA sequence
ataccagcctgggcaatgta

SEQ ID NO: 559584 - DNA, 20 bp, Artificial
  CRISPR gRNA sequence
ggcaatgtagtgagaccctg

SEQ ID NO: 559585 - DNA, 20 bp, Artificial
  CRISPR gRNA sequence
tctctaccaaaaaatatata

SEQ ID NO: 559586 - DNA, 20 bp, Artificial
  CRISPR gRNA sequence
taccaaaaaatatatatata

SEQ ID NO: 559587 - DNA, 20 bp, Artificial
  CRISPR gRNA sequence
ccaaaaaatatatatatatt

SEQ ID NO: 559588 - DNA, 20 bp, Artificial
  CRISPR gRNA sequence
taactataaaaagacatgaa

SEQ ID NO: 559589 - DNA, 20 bp, Artificial
  CRISPR gRNA sequence
aactataaaaagacatgaat

SEQ ID NO: 559590 - DNA, 20 bp, Artificial
  CRISPR gRNA sequence
actataaaaagacatgaata

SEQ ID NO: 559591 - DNA, 20 bp, Artificial
  CRISPR gRNA sequence
taaaaagacatgaatacatg

SEQ ID NO: 559592 - DNA, 20 bp, Artificial
  CRISPR gRNA sequence
tcacttgctctttttttaga

SEQ ID NO: 559593 - DNA, 20 bp, Artificial
  CRISPR gRNA sequence
acttgctctttttttagact

SEQ ID NO: 559594 - DNA, 20 bp, Artificial
  CRISPR gRNA sequence
gctctttttttagactggaa

SEQ ID NO: 559595 - DNA, 20 bp, Artificial
  CRISPR gRNA sequence
ctctttttttagactggaaa

SEQ ID NO: 559596 - DNA, 20 bp, Artificial
  CRISPR gRNA sequence
tttttttagactggaaagag

SEQ ID NO: 559597 - DNA, 20 bp, Artificial
  CRISPR gRNA sequence
tttttagactggaaagagac

SEQ ID NO: 559598 - DNA, 20 bp, Artificial
  CRISPR gRNA sequence
ttttagactggaaagagaca

SEQ ID NO: 559599 - DNA, 20 bp, Artificial
  CRISPR gRNA sequence
tttagactggaaagagacac

SEQ ID NO: 559600 - DNA, 20 bp, Artificial
  CRISPR gRNA sequence
ttagactggaaagagacacc

SEQ ID NO: 559601 - DNA, 20 bp, Artificial
  CRISPR gRNA sequence
tagactggaaagagacaccc

SEQ ID NO: 559602 - DNA, 20 bp, Artificial
  CRISPR gRNA sequence
agactggaaagagacaccct

SEQ ID NO: 559603 - DNA, 20 bp, Artificial
  CRISPR gRNA sequence
gactggaaagagacacccta

SEQ ID NO: 559604 - DNA, 20 bp, Artificial
  CRISPR gRNA sequence
gaaagagacaccctaaatga

SEQ ID NO: 559605 - DNA, 20 bp, Artificial
  CRISPR gRNA sequence
aatgattaacagtggttgtt

SEQ ID NO: 559606 - DNA, 20 bp, Artificial
  CRISPR gRNA sequence
acagtggttgtttttaaagt

SEQ ID NO: 559607 - DNA, 20 bp, Artificial
  CRISPR gRNA sequence
tttttaaagtaaccacggtt

SEQ ID NO: 559608 - DNA, 20 bp, Artificial
  CRISPR gRNA sequence
ttaaagtaaccacggttact

SEQ ID NO: 559609 - DNA, 20 bp, Artificial
  CRISPR gRNA sequence
taaagtaaccacggttactt

SEQ ID NO: 559610 - DNA, 20 bp, Artificial
  CRISPR gRNA sequence
aaagtaaccacggttacttt

SEQ ID NO: 559611 - DNA, 20 bp, Artificial
  CRISPR gRNA sequence
aagtaaccacggttacttta

SEQ ID NO: 559612 - DNA, 20 bp, Artificial
  CRISPR gRNA sequence
ctttagagattgtggtgatg

SEQ ID NO: 559613 - DNA, 20 bp, Artificial
  CRISPR gRNA sequence
tagagattgtggtgatggtg

SEQ ID NO: 559614 - DNA, 20 bp, Artificial
  CRISPR gRNA sequence
agagattgtggtgatggtga

SEQ ID NO: 559615 - DNA, 20 bp, Artificial
  CRISPR gRNA sequence
gagattgtggtgatggtgag

SEQ ID NO: 559616 - DNA, 20 bp, Artificial
  CRISPR gRNA sequence
tggtgatggtgagatttcaa

SEQ ID NO: 559617 - DNA, 20 bp, Artificial
  CRISPR gRNA sequence
caatttattacttattactt

SEQ ID NO: 559618 - DNA, 20 bp, Artificial
  CRISPR gRNA sequence
aatttattacttattactta

SEQ ID NO: 559619 - DNA, 20 bp, Artificial
  CRISPR gRNA sequence
attacttattacttaataca

SEQ ID NO: 559620 - DNA, 20 bp, Artificial
  CRISPR gRNA sequence
ttacttattacttaatacag

SEQ ID NO: 559621 - DNA, 20 bp, Artificial
  CRISPR gRNA sequence
cttattacttaatacaggtc

SEQ ID NO: 559622 - DNA, 20 bp, Artificial
  CRISPR gRNA sequence
attacttaatacaggtcaca

SEQ ID NO: 559623 - DNA, 20 bp, Artificial
  CRISPR gRNA sequence
ttacttaatacaggtcacat

SEQ ID NO: 559624 - DNA, 20 bp, Artificial
  CRISPR gRNA sequence
cttaatacaggtcacattga

SEQ ID NO: 559625 - DNA, 20 bp, Artificial
  CRISPR gRNA sequence
aatacaggtcacattgaaaa

SEQ ID NO: 559626 - DNA, 20 bp, Artificial
  CRISPR gRNA sequence
atacaggtcacattgaaaaa

SEQ ID NO: 559627 - DNA, 20 bp, Artificial
  CRISPR gRNA sequence
aaaaatatgttacttttgaa

SEQ ID NO: 559628 - DNA, 20 bp, Artificial
  CRISPR gRNA sequence
cttttgaagacaaatatcct

SEQ ID NO: 559629 - DNA, 20 bp, Artificial
  CRISPR gRNA sequence
ttgaagacaaatatcctatt

SEQ ID NO: 559630 - DNA, 20 bp, Artificial
  CRISPR gRNA sequence
tgaagacaaatatcctatta

SEQ ID NO: 559631 - DNA, 20 bp, Artificial
  CRISPR gRNA sequence
gaagacaaatatcctattac

SEQ ID NO: 559632 - DNA, 20 bp, Artificial
  CRISPR gRNA sequence
aagacaaatatcctattact

SEQ ID NO: 559633 - DNA, 20 bp, Artificial
  CRISPR gRNA sequence
ttactattataatattaaaa

SEQ ID NO: 559634 - DNA, 20 bp, Artificial
  CRISPR gRNA sequence
ctattataatattaaaacta

SEQ ID NO: 559635 - DNA, 20 bp, Artificial
  CRISPR gRNA sequence
ttataatattaaaactatgt

SEQ ID NO: 559636 - DNA, 20 bp, Artificial
  CRISPR gRNA sequence
taatattaaaactatgtaaa

SEQ ID NO: 559637 - DNA, 20 bp, Artificial
  CRISPR gRNA sequence
aaactatgtaaatttttttt

SEQ ID NO: 559638 - DNA, 20 bp, Artificial
  CRISPR gRNA sequence
tgtaaattttttttaaatag

SEQ ID NO: 559639 - DNA, 20 bp, Artificial
  CRISPR gRNA sequence
tttttaaatagaattattca

SEQ ID NO: 559640 - DNA, 20 bp, Artificial
  CRISPR gRNA sequence
ttttaaatagaattattcaa

SEQ ID NO: 559641 - DNA, 20 bp, Artificial
  CRISPR gRNA sequence
tttaaatagaattattcaac

SEQ ID NO: 559642 - DNA, 20 bp, Artificial
  CRISPR gRNA sequence
ttaaatagaattattcaacc

SEQ ID NO: 559643 - DNA, 20 bp, Artificial
  CRISPR gRNA sequence
taaatagaattattcaacca

SEQ ID NO: 559644 - DNA, 20 bp, Artificial
  CRISPR gRNA sequence
aaatagaattattcaaccaa

SEQ ID NO: 559645 - DNA, 20 bp, Artificial
  CRISPR gRNA sequence
aatagaattattcaaccaag

SEQ ID NO: 559646 - DNA, 20 bp, Artificial
  CRISPR gRNA sequence
ttcaaccaagaggaggagtt

SEQ ID NO: 559647 - DNA, 20 bp, Artificial
  CRISPR gRNA sequence
aaccaagaggaggagttgtt

SEQ ID NO: 559648 - DNA, 20 bp, Artificial
  CRISPR gRNA sequence
ttaagaactgtctctaaaac

SEQ ID NO: 559649 - DNA, 20 bp, Artificial
  CRISPR gRNA sequence
agaactgtctctaaaactaa

SEQ ID NO: 559650 - DNA, 20 bp, Artificial
  CRISPR gRNA sequence
tctctaaaactaatatctac

SEQ ID NO: 559651 - DNA, 20 bp, Artificial
  CRISPR gRNA sequence
taaaactaatatctacctct

SEQ ID NO: 559652 - DNA, 20 bp, Artificial
  CRISPR gRNA sequence
aaactaatatctacctctac

SEQ ID NO: 559653 - DNA, 20 bp, Artificial
  CRISPR gRNA sequence
atatctacctctactttgtg

SEQ ID NO: 559654 - DNA, 20 bp, Artificial
  CRISPR gRNA sequence
cctctactttgtgtgcatgg

SEQ ID NO: 559655 - DNA, 20 bp, Artificial
  CRISPR gRNA sequence
tactttgtgtgcatgggtat

SEQ ID NO: 559656 - DNA, 20 bp, Artificial
  CRISPR gRNA sequence
ctttgtgtgcatgggtatat

SEQ ID NO: 559657 - DNA, 20 bp, Artificial
  CRISPR gRNA sequence
tgtgtgcatgggtatatcta

SEQ ID NO: 559658 - DNA, 20 bp, Artificial
  CRISPR gRNA sequence
gtgtgcatgggtatatctat

SEQ ID NO: 559659 - DNA, 20 bp, Artificial
  CRISPR gRNA sequence
tgtgcatgggtatatctatt

SEQ ID NO: 559660 - DNA, 20 bp, Artificial
  CRISPR gRNA sequence
ttatttccttcctacagtaa

SEQ ID NO: 559661 - DNA, 20 bp, Artificial
  CRISPR gRNA sequence
tttccttcctacagtaaagt

SEQ ID NO: 559662 - DNA, 20 bp, Artificial
  CRISPR gRNA sequence
ccttcctacagtaaagtctt

SEQ ID NO: 559663 - DNA, 20 bp, Artificial
  CRISPR gRNA sequence
cttcctacagtaaagtcttt

SEQ ID NO: 559664 - DNA, 20 bp, Artificial
  CRISPR gRNA sequence
cctacagtaaagtcttttct

SEQ ID NO: 559665 - DNA, 20 bp, Artificial
  CRISPR gRNA sequence
ctacagtaaagtcttttctg

SEQ ID NO: 559666 - DNA, 20 bp, Artificial
  CRISPR gRNA sequence
cagtaaagtcttttctgttg

SEQ ID NO: 559667 - DNA, 20 bp, Artificial
  CRISPR gRNA sequence
ttctgttgcacttccaaggc

SEQ ID NO: 559668 - DNA, 20 bp, Artificial
  CRISPR gRNA sequence
tctgttgcacttccaaggcc

SEQ ID NO: 559669 - DNA, 20 bp, Artificial
  CRISPR gRNA sequence
ctgttgcacttccaaggcca

SEQ ID NO: 559670 - DNA, 20 bp, Artificial
  CRISPR gRNA sequence
tgttgcacttccaaggccaa

SEQ ID NO: 559671 - DNA, 20 bp, Artificial
  CRISPR gRNA sequence
ttgcacttccaaggccaaca

SEQ ID NO: 559672 - DNA, 20 bp, Artificial
  CRISPR gRNA sequence
cacttccaaggccaacacta

SEQ ID NO: 559673 - DNA, 20 bp, Artificial
  CRISPR gRNA sequence
ccaaggccaacactaaagta

SEQ ID NO: 559674 - DNA, 20 bp, Artificial
  CRISPR gRNA sequence
caaggccaacactaaagtaa

SEQ ID NO: 559675 - DNA, 20 bp, Artificial
  CRISPR gRNA sequence
aagtaagttgctaagataat

SEQ ID NO: 559676 - DNA, 20 bp, Artificial
  CRISPR gRNA sequence
ctaagataatttctaatgaa

SEQ ID NO: 559677 - DNA, 20 bp, Artificial
  CRISPR gRNA sequence
agataatttctaatgaacaa

SEQ ID NO: 559678 - DNA, 20 bp, Artificial
  CRISPR gRNA sequence
ctaatgaacaaaagaacaat

SEQ ID NO: 559679 - DNA, 20 bp, Artificial
  CRISPR gRNA sequence
taatgaacaaaagaacaata

SEQ ID NO: 559680 - DNA, 20 bp, Artificial
  CRISPR gRNA sequence
atgaacaaaagaacaataga

SEQ ID NO: 559681 - DNA, 20 bp, Artificial
  CRISPR gRNA sequence
tttctcaaaggtcacaaacc

SEQ ID NO: 559682 - DNA, 20 bp, Artificial
  CRISPR gRNA sequence
ttctcaaaggtcacaaacca

SEQ ID NO: 559683 - DNA, 20 bp, Artificial
  CRISPR gRNA sequence
tctcaaaggtcacaaaccat

SEQ ID NO: 559684 - DNA, 20 bp, Artificial
  CRISPR gRNA sequence
ctcaaaggtcacaaaccatg

SEQ ID NO: 559685 - DNA, 20 bp, Artificial
  CRISPR gRNA sequence
tcaaaggtcacaaaccatgg

SEQ ID NO: 559686 - DNA, 20 bp, Artificial
  CRISPR gRNA sequence
aaaggtcacaaaccatggat

SEQ ID NO: 559687 - DNA, 20 bp, Artificial
  CRISPR gRNA sequence
gttgctttgctgataccact

SEQ ID NO: 559688 - DNA, 20 bp, Artificial
  CRISPR gRNA sequence
ttgctttgctgataccactg

SEQ ID NO: 559689 - DNA, 20 bp, Artificial
  CRISPR gRNA sequence
ctttgctgataccactgagt

SEQ ID NO: 559690 - DNA, 20 bp, Artificial
  CRISPR gRNA sequence
tgctgataccactgagtggt

SEQ ID NO: 559691 - DNA, 20 bp, Artificial
  CRISPR gRNA sequence
gctgataccactgagtggtc

SEQ ID NO: 559692 - DNA, 20 bp, Artificial
  CRISPR gRNA sequence
ctgataccactgagtggtca

SEQ ID NO: 559693 - DNA, 20 bp, Artificial
  CRISPR gRNA sequence
ataccactgagtggtcagaa

SEQ ID NO: 559694 - DNA, 20 bp, Artificial
  CRISPR gRNA sequence
agtggtcagaaaagggactg

SEQ ID NO: 559695 - DNA, 20 bp, Artificial
  CRISPR gRNA sequence
tagggacgctaataaccatg

SEQ ID NO: 559696 - DNA, 20 bp, Artificial
  CRISPR gRNA sequence
ataaccatgccagagtgcag

SEQ ID NO: 559697 - DNA, 20 bp, Artificial
  CRISPR gRNA sequence
tgaagccagcaaggcccagg

SEQ ID NO: 559698 - DNA, 20 bp, Artificial
  CRISPR gRNA sequence
gaagccagcaaggcccaggg

SEQ ID NO: 559699 - DNA, 20 bp, Artificial
  CRISPR gRNA sequence
aagccagcaaggcccagggt

SEQ ID NO: 559700 - DNA, 20 bp, Artificial
  CRISPR gRNA sequence
ccaaaggcctccccacacta

SEQ ID NO: 559701 - DNA, 20 bp, Artificial
  CRISPR gRNA sequence
cccacactagatctcctcag

SEQ ID NO: 559702 - DNA, 20 bp, Artificial
  CRISPR gRNA sequence
gatctcctcagctgtgaagt

SEQ ID NO: 559703 - DNA, 20 bp, Artificial
  CRISPR gRNA sequence
ctcagctgtgaagtagaaat

SEQ ID NO: 559704 - DNA, 20 bp, Artificial
  CRISPR gRNA sequence
agctgtgaagtagaaatcat

SEQ ID NO: 559705 - DNA, 20 bp, Artificial
  CRISPR gRNA sequence
tgaagtagaaatcataatgc

SEQ ID NO: 559706 - DNA, 20 bp, Artificial
  CRISPR gRNA sequence
ttttcaggtttgaataaaat

SEQ ID NO: 559707 - DNA, 20 bp, Artificial
  CRISPR gRNA sequence
tcaggtttgaataaaattga

SEQ ID NO: 559708 - DNA, 20 bp, Artificial
  CRISPR gRNA sequence
caggtttgaataaaattgag

SEQ ID NO: 559709 - DNA, 20 bp, Artificial
  CRISPR gRNA sequence
aggtttgaataaaattgaga

SEQ ID NO: 559710 - DNA, 20 bp, Artificial
  CRISPR gRNA sequence
gaataaaattgagagtcttt

SEQ ID NO: 559711 - DNA, 20 bp, Artificial
  CRISPR gRNA sequence
aataaaattgagagtctttt

SEQ ID NO: 559712 - DNA, 20 bp, Artificial
  CRISPR gRNA sequence
agagtctttttacactggtt

SEQ ID NO: 559713 - DNA, 20 bp, Artificial
  CRISPR gRNA sequence
tttacactggttgacatgga

SEQ ID NO: 559714 - DNA, 20 bp, Artificial
  CRISPR gRNA sequence
ttacactggttgacatggaa

SEQ ID NO: 559715 - DNA, 20 bp, Artificial
  CRISPR gRNA sequence
tacactggttgacatggaat

SEQ ID NO: 559716 - DNA, 20 bp, Artificial
  CRISPR gRNA sequence
acactggttgacatggaata

SEQ ID NO: 559717 - DNA, 20 bp, Artificial
  CRISPR gRNA sequence
cactggttgacatggaatag

SEQ ID NO: 559718 - DNA, 20 bp, Artificial
  CRISPR gRNA sequence
gttgacatggaataggcttt

SEQ ID NO: 559719 - DNA, 20 bp, Artificial
  CRISPR gRNA sequence
acatggaataggctttcaaa

SEQ ID NO: 559720 - DNA, 20 bp, Artificial
  CRISPR gRNA sequence
tcaaaggttttctctctttt

SEQ ID NO: 559721 - DNA, 20 bp, Artificial
  CRISPR gRNA sequence
caaaggttttctctcttttt

SEQ ID NO: 559722 - DNA, 20 bp, Artificial
  CRISPR gRNA sequence
aaaggttttctctctttttc

SEQ ID NO: 559723 - DNA, 20 bp, Artificial
  CRISPR gRNA sequence
tctctctttttcttttaatg

SEQ ID NO: 559724 - DNA, 20 bp, Artificial
  CRISPR gRNA sequence
ctctctttttcttttaatga

SEQ ID NO: 559725 - DNA, 20 bp, Artificial
  CRISPR gRNA sequence
tctctttttcttttaatgag

SEQ ID NO: 559726 - DNA, 20 bp, Artificial
  CRISPR gRNA sequence
tctttttcttttaatgagtt

SEQ ID NO: 559727 - DNA, 20 bp, Artificial
  CRISPR gRNA sequence
tttttcttttaatgagttag

SEQ ID NO: 559728 - DNA, 20 bp, Artificial
  CRISPR gRNA sequence
tttcttttaatgagttaggt

SEQ ID NO: 559729 - DNA, 20 bp, Artificial
  CRISPR gRNA sequence
ttcttttaatgagttaggtc

SEQ ID NO: 559730 - DNA, 20 bp, Artificial
  CRISPR gRNA sequence
tcttttaatgagttaggtca

SEQ ID NO: 559731 - DNA, 20 bp, Artificial
  CRISPR gRNA sequence
cttttaatgagttaggtcaa

SEQ ID NO: 559732 - DNA, 20 bp, Artificial
  CRISPR gRNA sequence
ttttaatgagttaggtcaac

SEQ ID NO: 559733 - DNA, 20 bp, Artificial
  CRISPR gRNA sequence
ttaatgagttaggtcaacat

SEQ ID NO: 559734 - DNA, 20 bp, Artificial
  CRISPR gRNA sequence
taatgagttaggtcaacatc

SEQ ID NO: 559735 - DNA, 20 bp, Artificial
  CRISPR gRNA sequence
aatgagttaggtcaacatca

SEQ ID NO: 559736 - DNA, 20 bp, Artificial
  CRISPR gRNA sequence
atgagttaggtcaacatcaa

SEQ ID NO: 559737 - DNA, 20 bp, Artificial
  CRISPR gRNA sequence
ggtcaacatcaaggtattca

SEQ ID NO: 559738 - DNA, 20 bp, Artificial
  CRISPR gRNA sequence
acactgtctgaattaactgg

SEQ ID NO: 559739 - DNA, 20 bp, Artificial
  CRISPR gRNA sequence
tctgaattaactgggtgaga

SEQ ID NO: 559740 - DNA, 20 bp, Artificial
  CRISPR gRNA sequence
aattaactgggtgagaactg

SEQ ID NO: 559741 - DNA, 20 bp, Artificial
  CRISPR gRNA sequence
actgggtgagaactgggcat

SEQ ID NO: 559742 - DNA, 20 bp, Artificial
  CRISPR gRNA sequence
ggtgagaactgggcatgggg

SEQ ID NO: 559743 - DNA, 20 bp, Artificial
  CRISPR gRNA sequence
ggcatggggtgagtttttgc

SEQ ID NO: 559744 - DNA, 20 bp, Artificial
  CRISPR gRNA sequence
ttgctgtttaaaagcaaaga

SEQ ID NO: 559745 - DNA, 20 bp, Artificial
  CRISPR gRNA sequence
tgctgtttaaaagcaaagag

SEQ ID NO: 559746 - DNA, 20 bp, Artificial
  CRISPR gRNA sequence
gctgtttaaaagcaaagaga

SEQ ID NO: 559747 - DNA, 20 bp, Artificial
  CRISPR gRNA sequence
ctgtttaaaagcaaagagag

SEQ ID NO: 559748 - DNA, 20 bp, Artificial
  CRISPR gRNA sequence
tttaaaagcaaagagagatg

SEQ ID NO: 559749 - DNA, 20 bp, Artificial
  CRISPR gRNA sequence
aaaagcaaagagagatggag

SEQ ID NO: 559750 - DNA, 20 bp, Artificial
  CRISPR gRNA sequence
aaagcaaagagagatggagg

SEQ ID NO: 559751 - DNA, 20 bp, Artificial
  CRISPR gRNA sequence
tatcagtgatcgcctaaaaa

SEQ ID NO: 559752 - DNA, 20 bp, Artificial
  CRISPR gRNA sequence
atcagtgatcgcctaaaaag

SEQ ID NO: 559753 - DNA, 20 bp, Artificial
  CRISPR gRNA sequence
tcagtgatcgcctaaaaaga

SEQ ID NO: 559754 - DNA, 20 bp, Artificial
  CRISPR gRNA sequence
aaaagattttctatgctagc

SEQ ID NO: 559755 - DNA, 20 bp, Artificial
  CRISPR gRNA sequence
tctatgctagccagataatt

SEQ ID NO: 559756 - DNA, 20 bp, Artificial
  CRISPR gRNA sequence
ctatgctagccagataattt

SEQ ID NO: 559757 - DNA, 20 bp, Artificial
  CRISPR gRNA sequence
tatgctagccagataatttt

SEQ ID NO: 559758 - DNA, 20 bp, Artificial
  CRISPR gRNA sequence
tgctagccagataatttttg

SEQ ID NO: 559759 - DNA, 20 bp, Artificial
  CRISPR gRNA sequence
gccagataatttttgaaggt

SEQ ID NO: 559760 - DNA, 20 bp, Artificial
  CRISPR gRNA sequence
ttgaaggtttttttgttttg

SEQ ID NO: 559761 - DNA, 20 bp, Artificial
  CRISPR gRNA sequence
tgaaggtttttttgttttga

SEQ ID NO: 559762 - DNA, 20 bp, Artificial
  CRISPR gRNA sequence
gaaggtttttttgttttgaa

SEQ ID NO: 559763 - DNA, 20 bp, Artificial
  CRISPR gRNA sequence
aaggtttttttgttttgaag

SEQ ID NO: 559764 - DNA, 20 bp, Artificial
  CRISPR gRNA sequence
ttttgttttgaagaattttg

SEQ ID NO: 559765 - DNA, 20 bp, Artificial
  CRISPR gRNA sequence
tttgttttgaagaattttga

SEQ ID NO: 559766 - DNA, 20 bp, Artificial
  CRISPR gRNA sequence
ttgttttgaagaattttgaa

SEQ ID NO: 559767 - DNA, 20 bp, Artificial
  CRISPR gRNA sequence
tgttttgaagaattttgaat

SEQ ID NO: 559768 - DNA, 20 bp, Artificial
  CRISPR gRNA sequence
gttttgaagaattttgaatt

SEQ ID NO: 559769 - DNA, 20 bp, Artificial
  CRISPR gRNA sequence
ttttgaagaattttgaattt

SEQ ID NO: 559770 - DNA, 20 bp, Artificial
  CRISPR gRNA sequence
tgaagaattttgaatttttt

SEQ ID NO: 559771 - DNA, 20 bp, Artificial
  CRISPR gRNA sequence
gaagaattttgaattttttt

SEQ ID NO: 559772 - DNA, 20 bp, Artificial
  CRISPR gRNA sequence
aagaattttgaatttttttt

SEQ ID NO: 559773 - DNA, 20 bp, Artificial
  CRISPR gRNA sequence
tgaattttttttaaataaag

SEQ ID NO: 559774 - DNA, 20 bp, Artificial
  CRISPR gRNA sequence
gaattttttttaaataaaga

SEQ ID NO: 559775 - DNA, 20 bp, Artificial
  CRISPR gRNA sequence
aattttttttaaataaagat

SEQ ID NO: 559776 - DNA, 20 bp, Artificial
  CRISPR gRNA sequence
tttttaaataaagatatgag

SEQ ID NO: 559777 - DNA, 20 bp, Artificial
  CRISPR gRNA sequence
ttttaaataaagatatgagg

SEQ ID NO: 559778 - DNA, 20 bp, Artificial
  CRISPR gRNA sequence
tttaaataaagatatgaggg

SEQ ID NO: 559779 - DNA, 20 bp, Artificial
  CRISPR gRNA sequence
ttaaataaagatatgagggt

SEQ ID NO: 559780 - DNA, 20 bp, Artificial
  CRISPR gRNA sequence
taaataaagatatgagggta

SEQ ID NO: 559781 - DNA, 20 bp, Artificial
  CRISPR gRNA sequence
aaataaagatatgagggtac

SEQ ID NO: 559782 - DNA, 20 bp, Artificial
  CRISPR gRNA sequence
aataaagatatgagggtacc

SEQ ID NO: 559783 - DNA, 20 bp, Artificial
  CRISPR gRNA sequence
atacctaatcagcactacat

SEQ ID NO: 559784 - DNA, 20 bp, Artificial
  CRISPR gRNA sequence
atcagcactacatgtataga

SEQ ID NO: 559785 - DNA, 20 bp, Artificial
  CRISPR gRNA sequence
catgtatagagtgatcacat

SEQ ID NO: 559786 - DNA, 20 bp, Artificial
  CRISPR gRNA sequence
aaaacaggtctgatctcaaa

SEQ ID NO: 559787 - DNA, 20 bp, Artificial
  CRISPR gRNA sequence
atctcaaatattctgttgca

SEQ ID NO: 559788 - DNA, 20 bp, Artificial
  CRISPR gRNA sequence
aaatattctgttgcagtgtt

SEQ ID NO: 559789 - DNA, 20 bp, Artificial
  CRISPR gRNA sequence
tgttgcagtgtttctacaaa

SEQ ID NO: 559790 - DNA, 20 bp, Artificial
  CRISPR gRNA sequence
ttgcagtgtttctacaaaac

SEQ ID NO: 559791 - DNA, 20 bp, Artificial
  CRISPR gRNA sequence
cagtgtttctacaaaacatc

SEQ ID NO: 559792 - DNA, 20 bp, Artificial
  CRISPR gRNA sequence
ctacaaaacatcaacacctc

SEQ ID NO: 559793 - DNA, 20 bp, Artificial
  CRISPR gRNA sequence
tacaaaacatcaacacctca

SEQ ID NO: 559794 - DNA, 20 bp, Artificial
  CRISPR gRNA sequence
caaaacatcaacacctcaat

SEQ ID NO: 559795 - DNA, 20 bp, Artificial
  CRISPR gRNA sequence
aattttaatagttctttttg

SEQ ID NO: 559796 - DNA, 20 bp, Artificial
  CRISPR gRNA sequence
taatagttctttttgtatgg

SEQ ID NO: 559797 - DNA, 20 bp, Artificial
  CRISPR gRNA sequence
aatagttctttttgtatggc

SEQ ID NO: 559798 - DNA, 20 bp, Artificial
  CRISPR gRNA sequence
atagttctttttgtatggcc

SEQ ID NO: 559799 - DNA, 20 bp, Artificial
  CRISPR gRNA sequence
tttttgtatggcctgaagtt

SEQ ID NO: 559800 - DNA, 20 bp, Artificial
  CRISPR gRNA sequence
tttgtatggcctgaagttgt

SEQ ID NO: 559801 - DNA, 20 bp, Artificial
  CRISPR gRNA sequence
ttgtatggcctgaagttgta

SEQ ID NO: 559802 - DNA, 20 bp, Artificial
  CRISPR gRNA sequence
tgtatggcctgaagttgtaa

SEQ ID NO: 559803 - DNA, 20 bp, Artificial
  CRISPR gRNA sequence
gtatggcctgaagttgtaac

SEQ ID NO: 559804 - DNA, 20 bp, Artificial
  CRISPR gRNA sequence
tatggcctgaagttgtaact

SEQ ID NO: 559805 - DNA, 20 bp, Artificial
  CRISPR gRNA sequence
aagttgtaactggaacccaa

SEQ ID NO: 559806 - DNA, 20 bp, Artificial
  CRISPR gRNA sequence
taactggaacccaagtttta

SEQ ID NO: 559807 - DNA, 20 bp, Artificial
  CRISPR gRNA sequence
gaacccaagttttatagatg

SEQ ID NO: 559808 - DNA, 20 bp, Artificial
  CRISPR gRNA sequence
tatagatgaagtatcctgat

SEQ ID NO: 559809 - DNA, 20 bp, Artificial
  CRISPR gRNA sequence
atagatgaagtatcctgatt

SEQ ID NO: 559810 - DNA, 20 bp, Artificial
  CRISPR gRNA sequence
tagatgaagtatcctgattt

SEQ ID NO: 559811 - DNA, 20 bp, Artificial
  CRISPR gRNA sequence
atttcttatttagaaaatct

SEQ ID NO: 559812 - DNA, 20 bp, Artificial
  CRISPR gRNA sequence
cttatttagaaaatctggtc

SEQ ID NO: 559813 - DNA, 20 bp, Artificial
  CRISPR gRNA sequence
ttatttagaaaatctggtca

SEQ ID NO: 559814 - DNA, 20 bp, Artificial
  CRISPR gRNA sequence
atttagaaaatctggtcacc

SEQ ID NO: 559815 - DNA, 20 bp, Artificial
  CRISPR gRNA sequence
tttagaaaatctggtcaccg

SEQ ID NO: 559816 - DNA, 20 bp, Artificial
  CRISPR gRNA sequence
agaaaatctggtcaccgtta

SEQ ID NO: 559817 - DNA, 20 bp, Artificial
  CRISPR gRNA sequence
gaaaatctggtcaccgttaa

SEQ ID NO: 559818 - DNA, 20 bp, Artificial
  CRISPR gRNA sequence
gtcaccgttaactatgggtt

SEQ ID NO: 559819 - DNA, 20 bp, Artificial
  CRISPR gRNA sequence
actatgggttaatgaaaagg

SEQ ID NO: 559820 - DNA, 20 bp, Artificial
  CRISPR gRNA sequence
tgggttaatgaaaaggaact

SEQ ID NO: 559821 - DNA, 20 bp, Artificial
  CRISPR gRNA sequence
atgaaaaggaactctcaacc

SEQ ID NO: 559822 - DNA, 20 bp, Artificial
  CRISPR gRNA sequence
tcaacccccagcacaaattc

SEQ ID NO: 559823 - DNA, 20 bp, Artificial
  CRISPR gRNA sequence
aacccccagcacaaattcct

SEQ ID NO: 559824 - DNA, 20 bp, Artificial
  CRISPR gRNA sequence
ctctgcaaattattactcag

SEQ ID NO: 559825 - DNA, 20 bp, Artificial
  CRISPR gRNA sequence
tgcaaattattactcagggc

SEQ ID NO: 559826 - DNA, 20 bp, Artificial
  CRISPR gRNA sequence
caaattattactcagggcct

SEQ ID NO: 559827 - DNA, 20 bp, Artificial
  CRISPR gRNA sequence
ttactcagggcctgagattc

SEQ ID NO: 559828 - DNA, 20 bp, Artificial
  CRISPR gRNA sequence
ctcagggcctgagattcaga

SEQ ID NO: 559829 - DNA, 20 bp, Artificial
  CRISPR gRNA sequence
agggcctgagattcagattg

SEQ ID NO: 559830 - DNA, 20 bp, Artificial
  CRISPR gRNA sequence
agattcagattgactggtac

SEQ ID NO: 559831 - DNA, 20 bp, Artificial
  CRISPR gRNA sequence
agattgactggtactttttt

SEQ ID NO: 559832 - DNA, 20 bp, Artificial
  CRISPR gRNA sequence
actggtacttttttttttta

SEQ ID NO: 559833 - DNA, 20 bp, Artificial
  CRISPR gRNA sequence
gtactttttttttttactta

SEQ ID NO: 559834 - DNA, 20 bp, Artificial
  CRISPR gRNA sequence
tttttttttacttaatctaa

SEQ ID NO: 559835 - DNA, 20 bp, Artificial
  CRISPR gRNA sequence
ttttttttacttaatctaac

SEQ ID NO: 559836 - DNA, 20 bp, Artificial
  CRISPR gRNA sequence
tttttttacttaatctaaca

SEQ ID NO: 559837 - DNA, 20 bp, Artificial
  CRISPR gRNA sequence
ttttttacttaatctaacac

SEQ ID NO: 559838 - DNA, 20 bp, Artificial
  CRISPR gRNA sequence
tttttacttaatctaacact

SEQ ID NO: 559839 - DNA, 20 bp, Artificial
  CRISPR gRNA sequence
ttttacttaatctaacactt

SEQ ID NO: 559840 - DNA, 20 bp, Artificial
  CRISPR gRNA sequence
tttacttaatctaacacttg

SEQ ID NO: 559841 - DNA, 20 bp, Artificial
  CRISPR gRNA sequence
ttacttaatctaacacttgt

SEQ ID NO: 559842 - DNA, 20 bp, Artificial
  CRISPR gRNA sequence
tacttaatctaacacttgta

SEQ ID NO: 559843 - DNA, 20 bp, Artificial
  CRISPR gRNA sequence
acttaatctaacacttgtat

SEQ ID NO: 559844 - DNA, 20 bp, Artificial
  CRISPR gRNA sequence
cttaatctaacacttgtatg

SEQ ID NO: 559845 - DNA, 20 bp, Artificial
  CRISPR gRNA sequence
aatctaacacttgtatggcc

SEQ ID NO: 559846 - DNA, 20 bp, Artificial
  CRISPR gRNA sequence
atctaacacttgtatggccc

SEQ ID NO: 559847 - DNA, 20 bp, Artificial
  CRISPR gRNA sequence
acacttgtatggccctggct

SEQ ID NO: 559848 - DNA, 20 bp, Artificial
  CRISPR gRNA sequence
gtatggccctggctctgtgc

SEQ ID NO: 559849 - DNA, 20 bp, Artificial
  CRISPR gRNA sequence
tatggccctggctctgtgcc

SEQ ID NO: 559850 - DNA, 20 bp, Artificial
  CRISPR gRNA sequence
gctctgtgccaggcactgtt

SEQ ID NO: 559851 - DNA, 20 bp, Artificial
  CRISPR gRNA sequence
tgtgccaggcactgttgcaa

SEQ ID NO: 559852 - DNA, 20 bp, Artificial
  CRISPR gRNA sequence
tgccaggcactgttgcaagg

SEQ ID NO: 559853 - DNA, 20 bp, Artificial
  CRISPR gRNA sequence
ttgcaagggctctataaata

SEQ ID NO: 559854 - DNA, 20 bp, Artificial
  CRISPR gRNA sequence
caagggctctataaataggt

SEQ ID NO: 559855 - DNA, 20 bp, Artificial
  CRISPR gRNA sequence
tataaataggtactcaccac

SEQ ID NO: 559856 - DNA, 20 bp, Artificial
  CRISPR gRNA sequence
taaataggtactcaccactg

SEQ ID NO: 559857 - DNA, 20 bp, Artificial
  CRISPR gRNA sequence
accactgggagcagtggctc

SEQ ID NO: 559858 - DNA, 20 bp, Artificial
  CRISPR gRNA sequence
ggagcagtggctcatgcctg

SEQ ID NO: 559859 - DNA, 20 bp, Artificial
  CRISPR gRNA sequence
atgcctgtaatcccagcact

SEQ ID NO: 559860 - DNA, 20 bp, Artificial
  CRISPR gRNA sequence
taatcccagcactttgggag

SEQ ID NO: 559861 - DNA, 20 bp, Artificial
  CRISPR gRNA sequence
tgggaggccaaggcaggtgg

SEQ ID NO: 559862 - DNA, 20 bp, Artificial
  CRISPR gRNA sequence
gggaggccaaggcaggtgga

SEQ ID NO: 559863 - DNA, 20 bp, Artificial
  CRISPR gRNA sequence
ggaggccaaggcaggtggat

SEQ ID NO: 559864 - DNA, 20 bp, Artificial
  CRISPR gRNA sequence
gaggtcaggagttccagacc

SEQ ID NO: 559865 - DNA, 20 bp, Artificial
  CRISPR gRNA sequence
aggtcaggagttccagacca

SEQ ID NO: 559866 - DNA, 20 bp, Artificial
  CRISPR gRNA sequence
cagaccagcctggccaacat

SEQ ID NO: 559867 - DNA, 20 bp, Artificial
  CRISPR gRNA sequence
gccaacatggtgaaaccccg

SEQ ID NO: 559868 - DNA, 20 bp, Artificial
  CRISPR gRNA sequence
tactaaaaatacaaaattag

SEQ ID NO: 559869 - DNA, 20 bp, Artificial
  CRISPR gRNA sequence
ctaaaaatacaaaattagct

SEQ ID NO: 559870 - DNA, 20 bp, Artificial
  CRISPR gRNA sequence
aaaatacaaaattagctggg

SEQ ID NO: 559871 - DNA, 20 bp, Artificial
  CRISPR gRNA sequence
gctgggcgtggtggcactcg

SEQ ID NO: 559872 - DNA, 20 bp, Artificial
  CRISPR gRNA sequence
ggcgtggtggcactcgcctg

SEQ ID NO: 559873 - DNA, 20 bp, Artificial
  CRISPR gRNA sequence
gcctgtaatcccagttacat

SEQ ID NO: 559874 - DNA, 20 bp, Artificial
  CRISPR gRNA sequence
taatcccagttacatgggag

SEQ ID NO: 559875 - DNA, 20 bp, Artificial
  CRISPR gRNA sequence
catgggaggctgaggcagga

SEQ ID NO: 559876 - DNA, 20 bp, Artificial
  CRISPR gRNA sequence
aggcaggagaatcgcttgaa

SEQ ID NO: 559877 - DNA, 20 bp, Artificial
  CRISPR gRNA sequence
gaacccgggaggtggaggtt

SEQ ID NO: 559878 - DNA, 20 bp, Artificial
  CRISPR gRNA sequence
aacccgggaggtggaggttg

SEQ ID NO: 559879 - DNA, 20 bp, Artificial
  CRISPR gRNA sequence
cagtggccaagactgtgcca

SEQ ID NO: 559880 - DNA, 20 bp, Artificial
  CRISPR gRNA sequence
tgccactgcactccagcctg

SEQ ID NO: 559881 - DNA, 20 bp, Artificial
  CRISPR gRNA sequence
cactccagcctgggtgacag

SEQ ID NO: 559882 - DNA, 20 bp, Artificial
  CRISPR gRNA sequence
cagcctgggtgacagagcaa

SEQ ID NO: 559883 - DNA, 20 bp, Artificial
  CRISPR gRNA sequence
ggtgacagagcaagactcca

SEQ ID NO: 559884 - DNA, 20 bp, Artificial
  CRISPR gRNA sequence
catctcagaaaaaaaaaaaa

SEQ ID NO: 559885 - DNA, 20 bp, Artificial
  CRISPR gRNA sequence
agaaaaaaaaaaaaaaaaaa

SEQ ID NO: 559886 - DNA, 20 bp, Artificial
  CRISPR gRNA sequence
aaaacatattaagaaggttt

SEQ ID NO: 559887 - DNA, 20 bp, Artificial
  CRISPR gRNA sequence
agaaggttttatttctaacc

SEQ ID NO: 559888 - DNA, 20 bp, Artificial
  CRISPR gRNA sequence
tatttctaaccttattattt

SEQ ID NO: 559889 - DNA, 20 bp, Artificial
  CRISPR gRNA sequence
atttctaaccttattatttt

SEQ ID NO: 559890 - DNA, 20 bp, Artificial
  CRISPR gRNA sequence
tttctaaccttattattttg

SEQ ID NO: 559891 - DNA, 20 bp, Artificial
  CRISPR gRNA sequence
ctaaccttattattttgcag

SEQ ID NO: 559892 - DNA, 20 bp, Artificial
  CRISPR gRNA sequence
taaccttattattttgcagg

SEQ ID NO: 559893 - DNA, 20 bp, Artificial
  CRISPR gRNA sequence
accttattattttgcaggtg

SEQ ID NO: 559894 - DNA, 20 bp, Artificial
  CRISPR gRNA sequence
attattttgcaggtgaggaa

SEQ ID NO: 559895 - DNA, 20 bp, Artificial
  CRISPR gRNA sequence
ttattttgcaggtgaggaaa

SEQ ID NO: 559896 - DNA, 20 bp, Artificial
  CRISPR gRNA sequence
ttttgcaggtgaggaaactg

SEQ ID NO: 559897 - DNA, 20 bp, Artificial
  CRISPR gRNA sequence
tgcaggtgaggaaactgagg

SEQ ID NO: 559898 - DNA, 20 bp, Artificial
  CRISPR gRNA sequence
gcaggtgaggaaactgaggc

SEQ ID NO: 559899 - DNA, 20 bp, Artificial
  CRISPR gRNA sequence
caggtgaggaaactgaggca

SEQ ID NO: 559900 - DNA, 20 bp, Artificial
  CRISPR gRNA sequence
aggcacaacaatgttaagta

SEQ ID NO: 559901 - DNA, 20 bp, Artificial
  CRISPR gRNA sequence
agtaatgaagccagatttga

SEQ ID NO: 559902 - DNA, 20 bp, Artificial
  CRISPR gRNA sequence
gaacctggacaatctgactg

SEQ ID NO: 559903 - DNA, 20 bp, Artificial
  CRISPR gRNA sequence
aacctggacaatctgactgc

SEQ ID NO: 559904 - DNA, 20 bp, Artificial
  CRISPR gRNA sequence
gacaatctgactgcagaatc

SEQ ID NO: 559905 - DNA, 20 bp, Artificial
  CRISPR gRNA sequence
actgcagaatcagtgctctt

SEQ ID NO: 559906 - DNA, 20 bp, Artificial
  CRISPR gRNA sequence
cagaatcagtgctcttaacc

SEQ ID NO: 559907 - DNA, 20 bp, Artificial
  CRISPR gRNA sequence
ttaaccattgtttcttattt

SEQ ID NO: 559908 - DNA, 20 bp, Artificial
  CRISPR gRNA sequence
aaccattgtttcttatttag

SEQ ID NO: 559909 - DNA, 20 bp, Artificial
  CRISPR gRNA sequence
accattgtttcttatttagc

SEQ ID NO: 559910 - DNA, 20 bp, Artificial
  CRISPR gRNA sequence
tttcttatttagcttgctac

SEQ ID NO: 559911 - DNA, 20 bp, Artificial
  CRISPR gRNA sequence
cttatttagcttgctacatg

SEQ ID NO: 559912 - DNA, 20 bp, Artificial
  CRISPR gRNA sequence
ttatttagcttgctacatgg

SEQ ID NO: 559913 - DNA, 20 bp, Artificial
  CRISPR gRNA sequence
atttagcttgctacatggca

SEQ ID NO: 559914 - DNA, 20 bp, Artificial
  CRISPR gRNA sequence
tttagcttgctacatggcat

SEQ ID NO: 559915 - DNA, 20 bp, Artificial
  CRISPR gRNA sequence
agcttgctacatggcataag

SEQ ID NO: 559916 - DNA, 20 bp, Artificial
  CRISPR gRNA sequence
gcttgctacatggcataagg

SEQ ID NO: 559917 - DNA, 20 bp, Artificial
  CRISPR gRNA sequence
gctacatggcataaggctct

SEQ ID NO: 559918 - DNA, 20 bp, Artificial
  CRISPR gRNA sequence
ctacatggcataaggctctt

SEQ ID NO: 559919 - DNA, 20 bp, Artificial
  CRISPR gRNA sequence
catggcataaggctcttaaa

SEQ ID NO: 559920 - DNA, 20 bp, Artificial
  CRISPR gRNA sequence
ttaaagatagtgacatgatg

SEQ ID NO: 559921 - DNA, 20 bp, Artificial
  CRISPR gRNA sequence
aaagatagtgacatgatgca

SEQ ID NO: 559922 - DNA, 20 bp, Artificial
  CRISPR gRNA sequence
aagatagtgacatgatgcag

SEQ ID NO: 559923 - DNA, 20 bp, Artificial
  CRISPR gRNA sequence
ctcaggatacaatctataga

SEQ ID NO: 559924 - DNA, 20 bp, Artificial
  CRISPR gRNA sequence
tcaggatacaatctatagac

SEQ ID NO: 559925 - DNA, 20 bp, Artificial
  CRISPR gRNA sequence
aggatacaatctatagacag

SEQ ID NO: 559926 - DNA, 20 bp, Artificial
  CRISPR gRNA sequence
tagacagcattggaacagca

SEQ ID NO: 559927 - DNA, 20 bp, Artificial
  CRISPR gRNA sequence
gaacagcagatgttgcaaat

SEQ ID NO: 559928 - DNA, 20 bp, Artificial
  CRISPR gRNA sequence
caaatgagaaagtcaaactg

SEQ ID NO: 559929 - DNA, 20 bp, Artificial
  CRISPR gRNA sequence
agttaagcacacctccaaac

SEQ ID NO: 559930 - DNA, 20 bp, Artificial
  CRISPR gRNA sequence
agcacacctccaaacctaca

SEQ ID NO: 559931 - DNA, 20 bp, Artificial
  CRISPR gRNA sequence
caaacctacaggtgaggcac

SEQ ID NO: 559932 - DNA, 20 bp, Artificial
  CRISPR gRNA sequence
caggtgaggcactaagctct

SEQ ID NO: 559933 - DNA, 20 bp, Artificial
  CRISPR gRNA sequence
agctctgtggtttccaaatc

SEQ ID NO: 559934 - DNA, 20 bp, Artificial
  CRISPR gRNA sequence
tgtggtttccaaatcatcga

SEQ ID NO: 559935 - DNA, 20 bp, Artificial
  CRISPR gRNA sequence
tggtttccaaatcatcgaat

SEQ ID NO: 559936 - DNA, 20 bp, Artificial
  CRISPR gRNA sequence
ccaaatcatcgaatgctaga

SEQ ID NO: 559937 - DNA, 20 bp, Artificial
  CRISPR gRNA sequence
caaatcatcgaatgctagag

SEQ ID NO: 559938 - DNA, 20 bp, Artificial
  CRISPR gRNA sequence
gagctgaagagggcctcaga

SEQ ID NO: 559939 - DNA, 20 bp, Artificial
  CRISPR gRNA sequence
aagagggcctcagagagcaa

SEQ ID NO: 559940 - DNA, 20 bp, Artificial
  CRISPR gRNA sequence
agagagcaagactccagtca

SEQ ID NO: 559941 - DNA, 20 bp, Artificial
  CRISPR gRNA sequence
cagtcaaggaagaaaaagcc

SEQ ID NO: 559942 - DNA, 20 bp, Artificial
  CRISPR gRNA sequence
tggcaaatgacgcattagac

SEQ ID NO: 559943 - DNA, 20 bp, Artificial
  CRISPR gRNA sequence
gacgaagaccagcaattcca

SEQ ID NO: 559944 - DNA, 20 bp, Artificial
  CRISPR gRNA sequence
cacccacagaggagatacca

SEQ ID NO: 559945 - DNA, 20 bp, Artificial
  CRISPR gRNA sequence
gtgaggacttgcgcaccagt

SEQ ID NO: 559946 - DNA, 20 bp, Artificial
  CRISPR gRNA sequence
gcgcaccagtgagcctacag

SEQ ID NO: 559947 - DNA, 20 bp, Artificial
  CRISPR gRNA sequence
cgcaccagtgagcctacagg

SEQ ID NO: 559948 - DNA, 20 bp, Artificial
  CRISPR gRNA sequence
cagggaggggcctgccatgt

SEQ ID NO: 559949 - DNA, 20 bp, Artificial
  CRISPR gRNA sequence
ccatgtggaaacaggagctg

SEQ ID NO: 559950 - DNA, 20 bp, Artificial
  CRISPR gRNA sequence
tgcctcagctcctgccatgt

SEQ ID NO: 559951 - DNA, 20 bp, Artificial
  CRISPR gRNA sequence
agctcctgccatgtggaaac

SEQ ID NO: 559952 - DNA, 20 bp, Artificial
  CRISPR gRNA sequence
ctgccatgtggaaacagagg

SEQ ID NO: 559953 - DNA, 20 bp, Artificial
  CRISPR gRNA sequence
ccatgtggaaacagaggccc

SEQ ID NO: 559954 - DNA, 20 bp, Artificial
  CRISPR gRNA sequence
ccaggttcccaatttttcaa

SEQ ID NO: 559955 - DNA, 20 bp, Artificial
  CRISPR gRNA sequence
ccaatttttcaaaaaaagcc

SEQ ID NO: 559956 - DNA, 20 bp, Artificial
  CRISPR gRNA sequence
ttcaaaaaaagccagatatt

SEQ ID NO: 559957 - DNA, 20 bp, Artificial
  CRISPR gRNA sequence
tcaaaaaaagccagatattc

SEQ ID NO: 559958 - DNA, 20 bp, Artificial
  CRISPR gRNA sequence
caaaaaaagccagatattca

SEQ ID NO: 559959 - DNA, 20 bp, Artificial
  CRISPR gRNA sequence
aaaaaaagccagatattcac

SEQ ID NO: 559960 - DNA, 20 bp, Artificial
  CRISPR gRNA sequence
acattttgtgtgaaaattcc

SEQ ID NO: 559961 - DNA, 20 bp, Artificial
  CRISPR gRNA sequence
tgtgtgaaaattcctgttct

SEQ ID NO: 559962 - DNA, 20 bp, Artificial
  CRISPR gRNA sequence
gtgtgaaaattcctgttctt

SEQ ID NO: 559963 - DNA, 20 bp, Artificial
  CRISPR gRNA sequence
tgtgaaaattcctgttcttg

SEQ ID NO: 559964 - DNA, 20 bp, Artificial
  CRISPR gRNA sequence
ctgttcttgaaagttggcaa

SEQ ID NO: 559965 - DNA, 20 bp, Artificial
  CRISPR gRNA sequence
ttcttgaaagttggcaacta

SEQ ID NO: 559966 - DNA, 20 bp, Artificial
  CRISPR gRNA sequence
ttgaaagttggcaactaatt

SEQ ID NO: 559967 - DNA, 20 bp, Artificial
  CRISPR gRNA sequence
gaaagttggcaactaattca

SEQ ID NO: 559968 - DNA, 20 bp, Artificial
  CRISPR gRNA sequence
aaagttggcaactaattcaa

SEQ ID NO: 559969 - DNA, 20 bp, Artificial
  CRISPR gRNA sequence
gcaactaattcaaatctgag

SEQ ID NO: 559970 - DNA, 20 bp, Artificial
  CRISPR gRNA sequence
attcaaatctgagcttaggg

SEQ ID NO: 559971 - DNA, 20 bp, Artificial
  CRISPR gRNA sequence
aaatctgagcttaggggtaa

SEQ ID NO: 559972 - DNA, 20 bp, Artificial
  CRISPR gRNA sequence
agcttaggggtaaccccagc

SEQ ID NO: 559973 - DNA, 20 bp, Artificial
  CRISPR gRNA sequence
aggggtaaccccagccaggc

SEQ ID NO: 559974 - DNA, 20 bp, Artificial
  CRISPR gRNA sequence
ggggtaaccccagccaggct

SEQ ID NO: 559975 - DNA, 20 bp, Artificial
  CRISPR gRNA sequence
gccctatcaggacaaggaca

SEQ ID NO: 559976 - DNA, 20 bp, Artificial
  CRISPR gRNA sequence
tcaggacaaggacaaaggtg

SEQ ID NO: 559977 - DNA, 20 bp, Artificial
  CRISPR gRNA sequence
ctgtttttggctgtatcccc

SEQ ID NO: 559978 - DNA, 20 bp, Artificial
  CRISPR gRNA sequence
tttttggctgtatccccata

SEQ ID NO: 559979 - DNA, 20 bp, Artificial
  CRISPR gRNA sequence
ttggctgtatccccatatgt

SEQ ID NO: 559980 - DNA, 20 bp, Artificial
  CRISPR gRNA sequence
tggctgtatccccatatgtc

SEQ ID NO: 559981 - DNA, 20 bp, Artificial
  CRISPR gRNA sequence
ggctgtatccccatatgtct

SEQ ID NO: 559982 - DNA, 20 bp, Artificial
  CRISPR gRNA sequence
gctgtatccccatatgtctg

SEQ ID NO: 559983 - DNA, 20 bp, Artificial
  CRISPR gRNA sequence
tatccccatatgtctggcat

SEQ ID NO: 559984 - DNA, 20 bp, Artificial
  CRISPR gRNA sequence
gcatatggactttcaataaa

SEQ ID NO: 559985 - DNA, 20 bp, Artificial
  CRISPR gRNA sequence
tcaataaatatctgttgaat

SEQ ID NO: 559986 - DNA, 20 bp, Artificial
  CRISPR gRNA sequence
caataaatatctgttgaatg

SEQ ID NO: 559987 - DNA, 20 bp, Artificial
  CRISPR gRNA sequence
aataaatatctgttgaatga

SEQ ID NO: 559988 - DNA, 20 bp, Artificial
  CRISPR gRNA sequence
ttgaatgaattaactaaaat

SEQ ID NO: 559989 - DNA, 20 bp, Artificial
  CRISPR gRNA sequence
aatgaattaactaaaatgat

SEQ ID NO: 559990 - DNA, 20 bp, Artificial
  CRISPR gRNA sequence
actaaaatgattaaaataca

SEQ ID NO: 559991 - DNA, 20 bp, Artificial
  CRISPR gRNA sequence
aaatgattaaaatacaactt

SEQ ID NO: 559992 - DNA, 20 bp, Artificial
  CRISPR gRNA sequence
aaatacaacttaaatgtagt

SEQ ID NO: 559993 - DNA, 20 bp, Artificial
  CRISPR gRNA sequence
aaatgtagttcaaaagataa

SEQ ID NO: 559994 - DNA, 20 bp, Artificial
  CRISPR gRNA sequence
aatgtagttcaaaagataag

SEQ ID NO: 559995 - DNA, 20 bp, Artificial
  CRISPR gRNA sequence
aaaagataaggcttcctgac

SEQ ID NO: 559996 - DNA, 20 bp, Artificial
  CRISPR gRNA sequence
cctgacagaatagcaaaatt

SEQ ID NO: 559997 - DNA, 20 bp, Artificial
  CRISPR gRNA sequence
ctgacagaatagcaaaattt

SEQ ID NO: 559998 - DNA, 20 bp, Artificial
  CRISPR gRNA sequence
acagaatagcaaaatttgac

SEQ ID NO: 559999 - DNA, 20 bp, Artificial
  CRISPR gRNA sequence
gacagtcaccccaaaccctg

SEQ ID NO: 560000 - DNA, 20 bp, Artificial
  CRISPR gRNA sequence
acagtcaccccaaaccctgg

SEQ ID NO: 560001 - DNA, 20 bp, Artificial
  CRISPR gRNA sequence
ggctttgtgaaatcccaaat

SEQ ID NO: 560002 - DNA, 20 bp, Artificial
  CRISPR gRNA sequence
tgtgaaatcccaaattgctg

SEQ ID NO: 560003 - DNA, 20 bp, Artificial
  CRISPR gRNA sequence
gtgaaatcccaaattgctgt

SEQ ID NO: 560004 - DNA, 20 bp, Artificial
  CRISPR gRNA sequence
tgaaatcccaaattgctgtg

SEQ ID NO: 560005 - DNA, 20 bp, Artificial
  CRISPR gRNA sequence
ctgtggaacctggctgaaga

SEQ ID NO: 560006 - DNA, 20 bp, Artificial
  CRISPR gRNA sequence
tggaacctggctgaagaagg

SEQ ID NO: 560007 - DNA, 20 bp, Artificial
  CRISPR gRNA sequence
gctgaagaaggaggacttcg

SEQ ID NO: 560008 - DNA, 20 bp, Artificial
  CRISPR gRNA sequence
aagaaggaggacttcgtaag

SEQ ID NO: 560009 - DNA, 20 bp, Artificial
  CRISPR gRNA sequence
cgtaaggagagatggagaaa

SEQ ID NO: 560010 - DNA, 20 bp, Artificial
  CRISPR gRNA sequence
gtaaggagagatggagaaag

SEQ ID NO: 560011 - DNA, 20 bp, Artificial
  CRISPR gRNA sequence
aactggagcttaaaaataaa

SEQ ID NO: 560012 - DNA, 20 bp, Artificial
  CRISPR gRNA sequence
actggagcttaaaaataaaa

SEQ ID NO: 560013 - DNA, 20 bp, Artificial
  CRISPR gRNA sequence
gagcttaaaaataaaatggc

SEQ ID NO: 560014 - DNA, 20 bp, Artificial
  CRISPR gRNA sequence
aaaaataaaatggctcagga

SEQ ID NO: 560015 - DNA, 20 bp, Artificial
  CRISPR gRNA sequence
aaaataaaatggctcaggag

SEQ ID NO: 560016 - DNA, 20 bp, Artificial
  CRISPR gRNA sequence
aggagccctcatatacaacc

SEQ ID NO: 560017 - DNA, 20 bp, Artificial
  CRISPR gRNA sequence
atatacaaccaaaacagact

SEQ ID NO: 560018 - DNA, 20 bp, Artificial
  CRISPR gRNA sequence
agtttttcagccccactttc

SEQ ID NO: 560019 - DNA, 20 bp, Artificial
  CRISPR gRNA sequence
ttcagccccactttctgcct

SEQ ID NO: 560020 - DNA, 20 bp, Artificial
  CRISPR gRNA sequence
tcagccccactttctgcctc

SEQ ID NO: 560021 - DNA, 20 bp, Artificial
  CRISPR gRNA sequence
cagccccactttctgcctca

SEQ ID NO: 560022 - DNA, 20 bp, Artificial
  CRISPR gRNA sequence
agccccactttctgcctcat

SEQ ID NO: 560023 - DNA, 20 bp, Artificial
  CRISPR gRNA sequence
tctgcctcatcaccaaagca

SEQ ID NO: 560024 - DNA, 20 bp, Artificial
  CRISPR gRNA sequence
ctgcctcatcaccaaagcaa

SEQ ID NO: 560025 - DNA, 20 bp, Artificial
  CRISPR gRNA sequence
tgcctcatcaccaaagcaag

SEQ ID NO: 560026 - DNA, 20 bp, Artificial
  CRISPR gRNA sequence
cctcatcaccaaagcaagat

SEQ ID NO: 560027 - DNA, 20 bp, Artificial
  CRISPR gRNA sequence
atcaccaaagcaagatggga

SEQ ID NO: 560028 - DNA, 20 bp, Artificial
  CRISPR gRNA sequence
cgggctccaccttcccaact

SEQ ID NO: 560029 - DNA, 20 bp, Artificial
  CRISPR gRNA sequence
caccttcccaactccacagc

SEQ ID NO: 560030 - DNA, 20 bp, Artificial
  CRISPR gRNA sequence
cccaactccacagctgtccc

SEQ ID NO: 560031 - DNA, 20 bp, Artificial
  CRISPR gRNA sequence
ccaactccacagctgtccct

SEQ ID NO: 560032 - DNA, 20 bp, Artificial
  CRISPR gRNA sequence
cacagctgtcccttttgaga

SEQ ID NO: 560033 - DNA, 20 bp, Artificial
  CRISPR gRNA sequence
tcccttttgagatgttccct

SEQ ID NO: 560034 - DNA, 20 bp, Artificial
  CRISPR gRNA sequence
ttgagatgttccctctcaag

SEQ ID NO: 560035 - DNA, 20 bp, Artificial
  CRISPR gRNA sequence
tgagatgttccctctcaagt

SEQ ID NO: 560036 - DNA, 20 bp, Artificial
  CRISPR gRNA sequence
gagatgttccctctcaagtt

SEQ ID NO: 560037 - DNA, 20 bp, Artificial
  CRISPR gRNA sequence
agatgttccctctcaagttt

SEQ ID NO: 560038 - DNA, 20 bp, Artificial
  CRISPR gRNA sequence
cctctcaagtttaagtagat

SEQ ID NO: 560039 - DNA, 20 bp, Artificial
  CRISPR gRNA sequence
tcaagtttaagtagatttta

SEQ ID NO: 560040 - DNA, 20 bp, Artificial
  CRISPR gRNA sequence
aagtttaagtagattttacc

SEQ ID NO: 560041 - DNA, 20 bp, Artificial
  CRISPR gRNA sequence
aagtagattttaccaactaa

SEQ ID NO: 560042 - DNA, 20 bp, Artificial
  CRISPR gRNA sequence
agtagattttaccaactaag

SEQ ID NO: 560043 - DNA, 20 bp, Artificial
  CRISPR gRNA sequence
taccaactaagtgttatagg

SEQ ID NO: 560044 - DNA, 20 bp, Artificial
  CRISPR gRNA sequence
accaactaagtgttatagga

SEQ ID NO: 560045 - DNA, 20 bp, Artificial
  CRISPR gRNA sequence
ccaactaagtgttataggat

SEQ ID NO: 560046 - DNA, 20 bp, Artificial
  CRISPR gRNA sequence
agtgttataggatgcagggc

SEQ ID NO: 560047 - DNA, 20 bp, Artificial
  CRISPR gRNA sequence
taggatgcagggcaccacac

SEQ ID NO: 560048 - DNA, 20 bp, Artificial
  CRISPR gRNA sequence
gtacccactcatggatgtca

SEQ ID NO: 560049 - DNA, 20 bp, Artificial
  CRISPR gRNA sequence
tacccactcatggatgtcag

SEQ ID NO: 560050 - DNA, 20 bp, Artificial
  CRISPR gRNA sequence
atggatgtcagccccaatca

SEQ ID NO: 560051 - DNA, 20 bp, Artificial
  CRISPR gRNA sequence
aacagcctcgctatggtttg

SEQ ID NO: 560052 - DNA, 20 bp, Artificial
  CRISPR gRNA sequence
acagcctcgctatggtttga

SEQ ID NO: 560053 - DNA, 20 bp, Artificial
  CRISPR gRNA sequence
gctatggtttgaggaggttc

SEQ ID NO: 560054 - DNA, 20 bp, Artificial
  CRISPR gRNA sequence
tggtttgaggaggttcactg

SEQ ID NO: 560055 - DNA, 20 bp, Artificial
  CRISPR gRNA sequence
gaggaggttcactgatgtca

SEQ ID NO: 560056 - DNA, 20 bp, Artificial
  CRISPR gRNA sequence
aggaggttcactgatgtcat

SEQ ID NO: 560057 - DNA, 20 bp, Artificial
  CRISPR gRNA sequence
actgatgtcatttctttctt

SEQ ID NO: 560058 - DNA, 20 bp, Artificial
  CRISPR gRNA sequence
atgtcatttctttcttttct

SEQ ID NO: 560059 - DNA, 20 bp, Artificial
  CRISPR gRNA sequence
ctttcttttctttcttttta

SEQ ID NO: 560060 - DNA, 20 bp, Artificial
  CRISPR gRNA sequence
tttcttttctttctttttat

SEQ ID NO: 560061 - DNA, 20 bp, Artificial
  CRISPR gRNA sequence
tcttttctttctttttattt

SEQ ID NO: 560062 - DNA, 20 bp, Artificial
  CRISPR gRNA sequence
cttttctttctttttatttt

SEQ ID NO: 560063 - DNA, 20 bp, Artificial
  CRISPR gRNA sequence
ttttctttctttttattttt

SEQ ID NO: 560064 - DNA, 20 bp, Artificial
  CRISPR gRNA sequence
ttctttctttttatttttct

SEQ ID NO: 560065 - DNA, 20 bp, Artificial
  CRISPR gRNA sequence
tctttctttttatttttctc

SEQ ID NO: 560066 - DNA, 20 bp, Artificial
  CRISPR gRNA sequence
ctttctttttatttttctct

SEQ ID NO: 560067 - DNA, 20 bp, Artificial
  CRISPR gRNA sequence
tttctttttatttttctctt

SEQ ID NO: 560068 - DNA, 20 bp, Artificial
  CRISPR gRNA sequence
tctttttatttttctctttc

SEQ ID NO: 560069 - DNA, 20 bp, Artificial
  CRISPR gRNA sequence
ctttttatttttctctttct

SEQ ID NO: 560070 - DNA, 20 bp, Artificial
  CRISPR gRNA sequence
tttttatttttctctttctt

SEQ ID NO: 560071 - DNA, 20 bp, Artificial
  CRISPR gRNA sequence
tttatttttctctttctttc

SEQ ID NO: 560072 - DNA, 20 bp, Artificial
  CRISPR gRNA sequence
ttatttttctctttctttcc

SEQ ID NO: 560073 - DNA, 20 bp, Artificial
  CRISPR gRNA sequence
tatttttctctttctttccc

SEQ ID NO: 560074 - DNA, 20 bp, Artificial
  CRISPR gRNA sequence
atttttctctttctttccct

SEQ ID NO: 560075 - DNA, 20 bp, Artificial
  CRISPR gRNA sequence
tttttctctttctttccctc

SEQ ID NO: 560076 - DNA, 20 bp, Artificial
  CRISPR gRNA sequence
ttctctttctttccctctct

SEQ ID NO: 560077 - DNA, 20 bp, Artificial
  CRISPR gRNA sequence
tctctttctttccctctctc

SEQ ID NO: 560078 - DNA, 20 bp, Artificial
  CRISPR gRNA sequence
ctctttctttccctctctct

SEQ ID NO: 560079 - DNA, 20 bp, Artificial
  CRISPR gRNA sequence
tctttctttccctctctctc

SEQ ID NO: 560080 - DNA, 20 bp, Artificial
  CRISPR gRNA sequence
tttctttccctctctctctc

SEQ ID NO: 560081 - DNA, 20 bp, Artificial
  CRISPR gRNA sequence
tctttccctctctctctccc

SEQ ID NO: 560082 - DNA, 20 bp, Artificial
  CRISPR gRNA sequence
ctttccctctctctctccct

SEQ ID NO: 560083 - DNA, 20 bp, Artificial
  CRISPR gRNA sequence
tttccctctctctctccctc

SEQ ID NO: 560084 - DNA, 20 bp, Artificial
  CRISPR gRNA sequence
tccctctctctctccctcct

SEQ ID NO: 560085 - DNA, 20 bp, Artificial
  CRISPR gRNA sequence
ccctctctctctccctcctt

SEQ ID NO: 560086 - DNA, 20 bp, Artificial
  CRISPR gRNA sequence
cctctctctctccctccttc

SEQ ID NO: 560087 - DNA, 20 bp, Artificial
  CRISPR gRNA sequence
tctctctccctccttccctc

SEQ ID NO: 560088 - DNA, 20 bp, Artificial
  CRISPR gRNA sequence
tctctccctccttccctccc

SEQ ID NO: 560089 - DNA, 20 bp, Artificial
  CRISPR gRNA sequence
tctccctccttccctcccct

SEQ ID NO: 560090 - DNA, 20 bp, Artificial
  CRISPR gRNA sequence
tccctccttccctccccttc

SEQ ID NO: 560091 - DNA, 20 bp, Artificial
  CRISPR gRNA sequence
cctccttccctccccttcct

SEQ ID NO: 560092 - DNA, 20 bp, Artificial
  CRISPR gRNA sequence
cttccctccccttccttcct

SEQ ID NO: 560093 - DNA, 20 bp, Artificial
  CRISPR gRNA sequence
ccctccccttccttccttcc

SEQ ID NO: 560094 - DNA, 20 bp, Artificial
  CRISPR gRNA sequence
cctccccttccttccttcct

SEQ ID NO: 560095 - DNA, 20 bp, Artificial
  CRISPR gRNA sequence
cccttccttccttccttcct

SEQ ID NO: 560096 - DNA, 20 bp, Artificial
  CRISPR gRNA sequence
ccttccttccttcctttttc

SEQ ID NO: 560097 - DNA, 20 bp, Artificial
  CRISPR gRNA sequence
cttccttccttcctttttct

SEQ ID NO: 560098 - DNA, 20 bp, Artificial
  CRISPR gRNA sequence
ccttccttcctttttctttt

SEQ ID NO: 560099 - DNA, 20 bp, Artificial
  CRISPR gRNA sequence
cttccttcctttttcttttt

SEQ ID NO: 560100 - DNA, 20 bp, Artificial
  CRISPR gRNA sequence
ccttcctttttctttttgga

SEQ ID NO: 560101 - DNA, 20 bp, Artificial
  CRISPR gRNA sequence
cttcctttttctttttggag

SEQ ID NO: 560102 - DNA, 20 bp, Artificial
  CRISPR gRNA sequence
cctttttctttttggagaca

SEQ ID NO: 560103 - DNA, 20 bp, Artificial
  CRISPR gRNA sequence
ctttttctttttggagacag

SEQ ID NO: 560104 - DNA, 20 bp, Artificial
  CRISPR gRNA sequence
tttctttttggagacagggt

SEQ ID NO: 560105 - DNA, 20 bp, Artificial
  CRISPR gRNA sequence
ttctttttggagacagggtc

SEQ ID NO: 560106 - DNA, 20 bp, Artificial
  CRISPR gRNA sequence
tctttttggagacagggtct

SEQ ID NO: 560107 - DNA, 20 bp, Artificial
  CRISPR gRNA sequence
ctttttggagacagggtctc

SEQ ID NO: 560108 - DNA, 20 bp, Artificial
  CRISPR gRNA sequence
tttttggagacagggtctca

SEQ ID NO: 560109 - DNA, 20 bp, Artificial
  CRISPR gRNA sequence
tttggagacagggtctcatt

SEQ ID NO: 560110 - DNA, 20 bp, Artificial
  CRISPR gRNA sequence
ttggagacagggtctcattc

SEQ ID NO: 560111 - DNA, 20 bp, Artificial
  CRISPR gRNA sequence
tggagacagggtctcattct

SEQ ID NO: 560112 - DNA, 20 bp, Artificial
  CRISPR gRNA sequence
ggagacagggtctcattctg

SEQ ID NO: 560113 - DNA, 20 bp, Artificial
  CRISPR gRNA sequence
gagacagggtctcattctgt

SEQ ID NO: 560114 - DNA, 20 bp, Artificial
  CRISPR gRNA sequence
attctgtcacccaggttggt

SEQ ID NO: 560115 - DNA, 20 bp, Artificial
  CRISPR gRNA sequence
tgtcacccaggttggtgtgc

SEQ ID NO: 560116 - DNA, 20 bp, Artificial
  CRISPR gRNA sequence
tcacccaggttggtgtgcag

SEQ ID NO: 560117 - DNA, 20 bp, Artificial
  CRISPR gRNA sequence
gtgtgcagtggtgcaatcgt

SEQ ID NO: 560118 - DNA, 20 bp, Artificial
  CRISPR gRNA sequence
actgtagcttcaacctcctg

SEQ ID NO: 560119 - DNA, 20 bp, Artificial
  CRISPR gRNA sequence
tagcttcaacctcctgggct

SEQ ID NO: 560120 - DNA, 20 bp, Artificial
  CRISPR gRNA sequence
caacctcctgggctcaagtg

SEQ ID NO: 560121 - DNA, 20 bp, Artificial
  CRISPR gRNA sequence
aacctcctgggctcaagtga

SEQ ID NO: 560122 - DNA, 20 bp, Artificial
  CRISPR gRNA sequence
ctgggctcaagtgatccttc

SEQ ID NO: 560123 - DNA, 20 bp, Artificial
  CRISPR gRNA sequence
ggctcaagtgatccttctgc

SEQ ID NO: 560124 - DNA, 20 bp, Artificial
  CRISPR gRNA sequence
aagtgatccttctgcctcag

SEQ ID NO: 560125 - DNA, 20 bp, Artificial
  CRISPR gRNA sequence
ctgcctcagcctcccaagta

SEQ ID NO: 560126 - DNA, 20 bp, Artificial
  CRISPR gRNA sequence
tgcctcagcctcccaagtag

SEQ ID NO: 560127 - DNA, 20 bp, Artificial
  CRISPR gRNA sequence
cctcagcctcccaagtagct

SEQ ID NO: 560128 - DNA, 20 bp, Artificial
  CRISPR gRNA sequence
agcctcccaagtagctagaa

SEQ ID NO: 560129 - DNA, 20 bp, Artificial
  CRISPR gRNA sequence
ccaagtagctagaactacag

SEQ ID NO: 560130 - DNA, 20 bp, Artificial
  CRISPR gRNA sequence
gaactacagttgcatgccac

SEQ ID NO: 560131 - DNA, 20 bp, Artificial
  CRISPR gRNA sequence
cagttgcatgccaccacgcc

SEQ ID NO: 560132 - DNA, 20 bp, Artificial
  CRISPR gRNA sequence
catgccaccacgcccagcta

SEQ ID NO: 560133 - DNA, 20 bp, Artificial
  CRISPR gRNA sequence
atttttatattttttgtaga

SEQ ID NO: 560134 - DNA, 20 bp, Artificial
  CRISPR gRNA sequence
ttatattttttgtagaaaca

SEQ ID NO: 560135 - DNA, 20 bp, Artificial
  CRISPR gRNA sequence
tatattttttgtagaaacaa

SEQ ID NO: 560136 - DNA, 20 bp, Artificial
  CRISPR gRNA sequence
atattttttgtagaaacaag

SEQ ID NO: 560137 - DNA, 20 bp, Artificial
  CRISPR gRNA sequence
tattttttgtagaaacaagg

SEQ ID NO: 560138 - DNA, 20 bp, Artificial
  CRISPR gRNA sequence
tttgtagaaacaaggtctca

SEQ ID NO: 560139 - DNA, 20 bp, Artificial
  CRISPR gRNA sequence
ttgtagaaacaaggtctcac

SEQ ID NO: 560140 - DNA, 20 bp, Artificial
  CRISPR gRNA sequence
tgtagaaacaaggtctcact

SEQ ID NO: 560141 - DNA, 20 bp, Artificial
  CRISPR gRNA sequence
gtagaaacaaggtctcacta

SEQ ID NO: 560142 - DNA, 20 bp, Artificial
  CRISPR gRNA sequence
tagaaacaaggtctcactat

SEQ ID NO: 560143 - DNA, 20 bp, Artificial
  CRISPR gRNA sequence
actatgttgctcaggctgat

SEQ ID NO: 560144 - DNA, 20 bp, Artificial
  CRISPR gRNA sequence
tgttgctcaggctgatctca

SEQ ID NO: 560145 - DNA, 20 bp, Artificial
  CRISPR gRNA sequence
ctcaggctgatctcaaactc

SEQ ID NO: 560146 - DNA, 20 bp, Artificial
  CRISPR gRNA sequence
aggctgatctcaaactcgtg

SEQ ID NO: 560147 - DNA, 20 bp, Artificial
  CRISPR gRNA sequence
atctcaaactcgtgggctca

SEQ ID NO: 560148 - DNA, 20 bp, Artificial
  CRISPR gRNA sequence
aaactcgtgggctcaagtga

SEQ ID NO: 560149 - DNA, 20 bp, Artificial
  CRISPR gRNA sequence
gtgggctcaagtgatcctcc

SEQ ID NO: 560150 - DNA, 20 bp, Artificial
  CRISPR gRNA sequence
aagtgatcctcctccctggg

SEQ ID NO: 560151 - DNA, 20 bp, Artificial
  CRISPR gRNA sequence
ctccctgggccttctgaagt

SEQ ID NO: 560152 - DNA, 20 bp, Artificial
  CRISPR gRNA sequence
cctgggccttctgaagtgct

SEQ ID NO: 560153 - DNA, 20 bp, Artificial
  CRISPR gRNA sequence
ggccttctgaagtgctgaga

SEQ ID NO: 560154 - DNA, 20 bp, Artificial
  CRISPR gRNA sequence
ctgaagtgctgagattacaa

SEQ ID NO: 560155 - DNA, 20 bp, Artificial
  CRISPR gRNA sequence
tgaagtgctgagattacaag

SEQ ID NO: 560156 - DNA, 20 bp, Artificial
  CRISPR gRNA sequence
aagtgctgagattacaagca

SEQ ID NO: 560157 - DNA, 20 bp, Artificial
  CRISPR gRNA sequence
agattacaagcatgagccac

SEQ ID NO: 560158 - DNA, 20 bp, Artificial
  CRISPR gRNA sequence
caagcatgagccaccatgcc

SEQ ID NO: 560159 - DNA, 20 bp, Artificial
  CRISPR gRNA sequence
agagacaagctaatcactct

SEQ ID NO: 560160 - DNA, 20 bp, Artificial
  CRISPR gRNA sequence
gagacaagctaatcactctt

SEQ ID NO: 560161 - DNA, 20 bp, Artificial
  CRISPR gRNA sequence
atcactcttccgggatttga

SEQ ID NO: 560162 - DNA, 20 bp, Artificial
  CRISPR gRNA sequence
ttccgggatttgaaggaaag

SEQ ID NO: 560163 - DNA, 20 bp, Artificial
  CRISPR gRNA sequence
ccgggatttgaaggaaaggg

SEQ ID NO: 560164 - DNA, 20 bp, Artificial
  CRISPR gRNA sequence
cgggatttgaaggaaagggt

SEQ ID NO: 560165 - DNA, 20 bp, Artificial
  CRISPR gRNA sequence
gaaggaaagggttttcttga

SEQ ID NO: 560166 - DNA, 20 bp, Artificial
  CRISPR gRNA sequence
aaggaaagggttttcttgag

SEQ ID NO: 560167 - DNA, 20 bp, Artificial
  CRISPR gRNA sequence
tcttgagtttgttcttagaa

SEQ ID NO: 560168 - DNA, 20 bp, Artificial
  CRISPR gRNA sequence
cttgagtttgttcttagaaa

SEQ ID NO: 560169 - DNA, 20 bp, Artificial
  CRISPR gRNA sequence
ttgagtttgttcttagaaat

SEQ ID NO: 560170 - DNA, 20 bp, Artificial
  CRISPR gRNA sequence
gagtttgttcttagaaataa

SEQ ID NO: 560171 - DNA, 20 bp, Artificial
  CRISPR gRNA sequence
agtttgttcttagaaataaa

SEQ ID NO: 560172 - DNA, 20 bp, Artificial
  CRISPR gRNA sequence
gttcttagaaataaacaatg

SEQ ID NO: 560173 - DNA, 20 bp, Artificial
  CRISPR gRNA sequence
ttcttagaaataaacaatgt

SEQ ID NO: 560174 - DNA, 20 bp, Artificial
  CRISPR gRNA sequence
ttagaaataaacaatgtaat

SEQ ID NO: 560175 - DNA, 20 bp, Artificial
  CRISPR gRNA sequence
agaaataaacaatgtaattt

SEQ ID NO: 560176 - DNA, 20 bp, Artificial
  CRISPR gRNA sequence
gaaataaacaatgtaatttt

SEQ ID NO: 560177 - DNA, 20 bp, Artificial
  CRISPR gRNA sequence
taagatacttctctctctct

SEQ ID NO: 560178 - DNA, 20 bp, Artificial
  CRISPR gRNA sequence
aagatacttctctctctctc

SEQ ID NO: 560179 - DNA, 20 bp, Artificial
  CRISPR gRNA sequence
agatacttctctctctctct

SEQ ID NO: 560180 - DNA, 20 bp, Artificial
  CRISPR gRNA sequence
ctctctctctctctaaaata

SEQ ID NO: 560181 - DNA, 20 bp, Artificial
  CRISPR gRNA sequence
tctctctctctctaaaatat

SEQ ID NO: 560182 - DNA, 20 bp, Artificial
  CRISPR gRNA sequence
tctctctctctaaaatattt

SEQ ID NO: 560183 - DNA, 20 bp, Artificial
  CRISPR gRNA sequence
tctctctctaaaatatttta

SEQ ID NO: 560184 - DNA, 20 bp, Artificial
  CRISPR gRNA sequence
tctctctaaaatattttaag

SEQ ID NO: 560185 - DNA, 20 bp, Artificial
  CRISPR gRNA sequence
tctctaaaatattttaaggc

SEQ ID NO: 560186 - DNA, 20 bp, Artificial
  CRISPR gRNA sequence
tctaaaatattttaaggctc

SEQ ID NO: 560187 - DNA, 20 bp, Artificial
  CRISPR gRNA sequence
taaaatattttaaggctcac

SEQ ID NO: 560188 - DNA, 20 bp, Artificial
  CRISPR gRNA sequence
aaatattttaaggctcacac

SEQ ID NO: 560189 - DNA, 20 bp, Artificial
  CRISPR gRNA sequence
taaggctcacactgcctgca

SEQ ID NO: 560190 - DNA, 20 bp, Artificial
  CRISPR gRNA sequence
aaggctcacactgcctgcag

SEQ ID NO: 560191 - DNA, 20 bp, Artificial
  CRISPR gRNA sequence
aggctcacactgcctgcaga

SEQ ID NO: 560192 - DNA, 20 bp, Artificial
  CRISPR gRNA sequence
acactgcctgcagattttag

SEQ ID NO: 560193 - DNA, 20 bp, Artificial
  CRISPR gRNA sequence
cctgcagattttagcaggta

SEQ ID NO: 560194 - DNA, 20 bp, Artificial
  CRISPR gRNA sequence
cagattttagcaggtaaagt

SEQ ID NO: 560195 - DNA, 20 bp, Artificial
  CRISPR gRNA sequence
tagcaggtaaagtaaaagtt

SEQ ID NO: 560196 - DNA, 20 bp, Artificial
  CRISPR gRNA sequence
agcaggtaaagtaaaagttc

SEQ ID NO: 560197 - DNA, 20 bp, Artificial
  CRISPR gRNA sequence
gcaggtaaagtaaaagttca

SEQ ID NO: 560198 - DNA, 20 bp, Artificial
  CRISPR gRNA sequence
atttgaccaaaaaaaaaaaa

SEQ ID NO: 560199 - DNA, 20 bp, Artificial
  CRISPR gRNA sequence
gaccaaaaaaaaaaaaaaaa

SEQ ID NO: 560200 - DNA, 20 bp, Artificial
  CRISPR gRNA sequence
accaaaaaaaaaaaaaaaag

SEQ ID NO: 560201 - DNA, 20 bp, Artificial
  CRISPR gRNA sequence
ccttaaaagtttcagtacct

SEQ ID NO: 560202 - DNA, 20 bp, Artificial
  CRISPR gRNA sequence
aaaagtttcagtacctgaat

SEQ ID NO: 560203 - DNA, 20 bp, Artificial
  CRISPR gRNA sequence
aaagtttcagtacctgaata

SEQ ID NO: 560204 - DNA, 20 bp, Artificial
  CRISPR gRNA sequence
cagtacctgaatatatgaat

SEQ ID NO: 560205 - DNA, 20 bp, Artificial
  CRISPR gRNA sequence
agtacctgaatatatgaata

SEQ ID NO: 560206 - DNA, 20 bp, Artificial
  CRISPR gRNA sequence
aatatatgaatattggtatt

SEQ ID NO: 560207 - DNA, 20 bp, Artificial
  CRISPR gRNA sequence
gtatttccctctgaatataa

SEQ ID NO: 560208 - DNA, 20 bp, Artificial
  CRISPR gRNA sequence
ccctctgaatataagacatc

SEQ ID NO: 560209 - DNA, 20 bp, Artificial
  CRISPR gRNA sequence
cctctgaatataagacatca

SEQ ID NO: 560210 - DNA, 20 bp, Artificial
  CRISPR gRNA sequence
tgaatataagacatcataat

SEQ ID NO: 560211 - DNA, 20 bp, Artificial
  CRISPR gRNA sequence
aatataagacatcataatgg

SEQ ID NO: 560212 - DNA, 20 bp, Artificial
  CRISPR gRNA sequence
atttaaagcctcgtgcaagc

SEQ ID NO: 560213 - DNA, 20 bp, Artificial
  CRISPR gRNA sequence
aaagcctcgtgcaagcccag

SEQ ID NO: 560214 - DNA, 20 bp, Artificial
  CRISPR gRNA sequence
aagcctcgtgcaagcccaga

SEQ ID NO: 560215 - DNA, 20 bp, Artificial
  CRISPR gRNA sequence
gtgcaagcccagagatagca

SEQ ID NO: 560216 - DNA, 20 bp, Artificial
  CRISPR gRNA sequence
ggggcatttttgctcccaag

SEQ ID NO: 560217 - DNA, 20 bp, Artificial
  CRISPR gRNA sequence
gggcatttttgctcccaagt

SEQ ID NO: 560218 - DNA, 20 bp, Artificial
  CRISPR gRNA sequence
ttgctcccaagtgagcagat

SEQ ID NO: 560219 - DNA, 20 bp, Artificial
  CRISPR gRNA sequence
tgctcccaagtgagcagatg

SEQ ID NO: 560220 - DNA, 20 bp, Artificial
  CRISPR gRNA sequence
gctcccaagtgagcagatgg

SEQ ID NO: 560221 - DNA, 20 bp, Artificial
  CRISPR gRNA sequence
ctcccaagtgagcagatgga

SEQ ID NO: 560222 - DNA, 20 bp, Artificial
  CRISPR gRNA sequence
ccaagtgagcagatggattt

SEQ ID NO: 560223 - DNA, 20 bp, Artificial
  CRISPR gRNA sequence
ctcatctggatatgggtcac

SEQ ID NO: 560224 - DNA, 20 bp, Artificial
  CRISPR gRNA sequence
tcatctggatatgggtcact

SEQ ID NO: 560225 - DNA, 20 bp, Artificial
  CRISPR gRNA sequence
atctggatatgggtcactga

SEQ ID NO: 560226 - DNA, 20 bp, Artificial
  CRISPR gRNA sequence
gatatgggtcactgagcaca

SEQ ID NO: 560227 - DNA, 20 bp, Artificial
  CRISPR gRNA sequence
agcacagccttgtccctctc

SEQ ID NO: 560228 - DNA, 20 bp, Artificial
  CRISPR gRNA sequence
gtccctctcacttctctgcg

SEQ ID NO: 560229 - DNA, 20 bp, Artificial
  CRISPR gRNA sequence
tccctctcacttctctgcgt

SEQ ID NO: 560230 - DNA, 20 bp, Artificial
  CRISPR gRNA sequence
tcacttctctgcgtttggtc

SEQ ID NO: 560231 - DNA, 20 bp, Artificial
  CRISPR gRNA sequence
acttctctgcgtttggtctt

SEQ ID NO: 560232 - DNA, 20 bp, Artificial
  CRISPR gRNA sequence
ctctgcgtttggtcttcaca

SEQ ID NO: 560233 - DNA, 20 bp, Artificial
  CRISPR gRNA sequence
tctgcgtttggtcttcacat

SEQ ID NO: 560234 - DNA, 20 bp, Artificial
  CRISPR gRNA sequence
tgcgtttggtcttcacatca

SEQ ID NO: 560235 - DNA, 20 bp, Artificial
  CRISPR gRNA sequence
cgtttggtcttcacatcacg

SEQ ID NO: 560236 - DNA, 20 bp, Artificial
  CRISPR gRNA sequence
ggtcttcacatcacggcaca

SEQ ID NO: 560237 - DNA, 20 bp, Artificial
  CRISPR gRNA sequence
gtcttcacatcacggcacat

SEQ ID NO: 560238 - DNA, 20 bp, Artificial
  CRISPR gRNA sequence
cacatcacggcacattttca

SEQ ID NO: 560239 - DNA, 20 bp, Artificial
  CRISPR gRNA sequence
acatcacggcacattttcag

SEQ ID NO: 560240 - DNA, 20 bp, Artificial
  CRISPR gRNA sequence
tcagttgatgcctacttgca

SEQ ID NO: 560241 - DNA, 20 bp, Artificial
  CRISPR gRNA sequence
cagttgatgcctacttgcag

SEQ ID NO: 560242 - DNA, 20 bp, Artificial
  CRISPR gRNA sequence
agttgatgcctacttgcagt

SEQ ID NO: 560243 - DNA, 20 bp, Artificial
  CRISPR gRNA sequence
atgcctacttgcagtatcag

SEQ ID NO: 560244 - DNA, 20 bp, Artificial
  CRISPR gRNA sequence
cttgcagtatcaggatgtgt

SEQ ID NO: 560245 - DNA, 20 bp, Artificial
  CRISPR gRNA sequence
gcagtatcaggatgtgtggc

SEQ ID NO: 560246 - DNA, 20 bp, Artificial
  CRISPR gRNA sequence
cagtatcaggatgtgtggca

SEQ ID NO: 560247 - DNA, 20 bp, Artificial
  CRISPR gRNA sequence
ggaagcaacatctctatcta

SEQ ID NO: 560248 - DNA, 20 bp, Artificial
  CRISPR gRNA sequence
tatctacacacccatatatg

SEQ ID NO: 560249 - DNA, 20 bp, Artificial
  CRISPR gRNA sequence
tctacacacccatatatgca

SEQ ID NO: 560250 - DNA, 20 bp, Artificial
  CRISPR gRNA sequence
cacacccatatatgcattta

SEQ ID NO: 560251 - DNA, 20 bp, Artificial
  CRISPR gRNA sequence
atagtattgaggagcggcca

SEQ ID NO: 560252 - DNA, 20 bp, Artificial
  CRISPR gRNA sequence
tagtattgaggagcggccaa

SEQ ID NO: 560253 - DNA, 20 bp, Artificial
  CRISPR gRNA sequence
aggagcggccaatctcctaa

SEQ ID NO: 560254 - DNA, 20 bp, Artificial
  CRISPR gRNA sequence
ctaaaatgtctaggctagta

SEQ ID NO: 560255 - DNA, 20 bp, Artificial
  CRISPR gRNA sequence
aaatgtctaggctagtaatt

SEQ ID NO: 560256 - DNA, 20 bp, Artificial
  CRISPR gRNA sequence
ggctagtaattgtatcaaat

SEQ ID NO: 560257 - DNA, 20 bp, Artificial
  CRISPR gRNA sequence
gtaattgtatcaaataacct

SEQ ID NO: 560258 - DNA, 20 bp, Artificial
  CRISPR gRNA sequence
tatcaaataacctgtcctat

SEQ ID NO: 560259 - DNA, 20 bp, Artificial
  CRISPR gRNA sequence
tcctattaaggccataaata

SEQ ID NO: 560260 - DNA, 20 bp, Artificial
  CRISPR gRNA sequence
ttaaggccataaatattctc

SEQ ID NO: 560261 - DNA, 20 bp, Artificial
  CRISPR gRNA sequence
aggccataaatattctcata

SEQ ID NO: 560262 - DNA, 20 bp, Artificial
  CRISPR gRNA sequence
tcatattagtcagtcccaat

SEQ ID NO: 560263 - DNA, 20 bp, Artificial
  CRISPR gRNA sequence
atattagtcagtcccaattt

SEQ ID NO: 560264 - DNA, 20 bp, Artificial
  CRISPR gRNA sequence
gtcagtcccaattttggggg

SEQ ID NO: 560265 - DNA, 20 bp, Artificial
  CRISPR gRNA sequence
tgggggtagaaaatgtgctt

SEQ ID NO: 560266 - DNA, 20 bp, Artificial
  CRISPR gRNA sequence
gggggtagaaaatgtgctta

SEQ ID NO: 560267 - DNA, 20 bp, Artificial
  CRISPR gRNA sequence
ggggtagaaaatgtgcttac

SEQ ID NO: 560268 - DNA, 20 bp, Artificial
  CRISPR gRNA sequence
accaggcatggagataataa

SEQ ID NO: 560269 - DNA, 20 bp, Artificial
  CRISPR gRNA sequence
ccaggcatggagataataaa

SEQ ID NO: 560270 - DNA, 20 bp, Artificial
  CRISPR gRNA sequence
tttgttttaactcaatcaag

SEQ ID NO: 560271 - DNA, 20 bp, Artificial
  CRISPR gRNA sequence
gttttaactcaatcaagttt

SEQ ID NO: 560272 - DNA, 20 bp, Artificial
  CRISPR gRNA sequence
ttttaactcaatcaagtttc

SEQ ID NO: 560273 - DNA, 20 bp, Artificial
  CRISPR gRNA sequence
taactcaatcaagtttcata

SEQ ID NO: 560274 - DNA, 20 bp, Artificial
  CRISPR gRNA sequence
aactcaatcaagtttcatac

SEQ ID NO: 560275 - DNA, 20 bp, Artificial
  CRISPR gRNA sequence
actcaatcaagtttcataca

SEQ ID NO: 560276 - DNA, 20 bp, Artificial
  CRISPR gRNA sequence
aatcaagtttcatacagttg

SEQ ID NO: 560277 - DNA, 20 bp, Artificial
  CRISPR gRNA sequence
catacagttgtgactcttgc

SEQ ID NO: 560278 - DNA, 20 bp, Artificial
  CRISPR gRNA sequence
atacagttgtgactcttgcc

SEQ ID NO: 560279 - DNA, 20 bp, Artificial
  CRISPR gRNA sequence
tgactcttgcctagctctta

SEQ ID NO: 560280 - DNA, 20 bp, Artificial
  CRISPR gRNA sequence
ttgcctagctcttagcaagt

SEQ ID NO: 560281 - DNA, 20 bp, Artificial
  CRISPR gRNA sequence
gcctagctcttagcaagtcc

SEQ ID NO: 560282 - DNA, 20 bp, Artificial
  CRISPR gRNA sequence
cctagctcttagcaagtcca

SEQ ID NO: 560283 - DNA, 20 bp, Artificial
  CRISPR gRNA sequence
gctcttagcaagtccaatcc

SEQ ID NO: 560284 - DNA, 20 bp, Artificial
  CRISPR gRNA sequence
ttagcaagtccaatccaagg

SEQ ID NO: 560285 - DNA, 20 bp, Artificial
  CRISPR gRNA sequence
agcaagtccaatccaaggag

SEQ ID NO: 560286 - DNA, 20 bp, Artificial
  CRISPR gRNA sequence
gcaagtccaatccaaggagc

SEQ ID NO: 560287 - DNA, 20 bp, Artificial
  CRISPR gRNA sequence
ggccagctcagcctcagtaa

SEQ ID NO: 560288 - DNA, 20 bp, Artificial
  CRISPR gRNA sequence
agcctcagtaataatattta

SEQ ID NO: 560289 - DNA, 20 bp, Artificial
  CRISPR gRNA sequence
agtaataatatttaacagta

SEQ ID NO: 560290 - DNA, 20 bp, Artificial
  CRISPR gRNA sequence
aacagtagcagcagcacgaa

SEQ ID NO: 560291 - DNA, 20 bp, Artificial
  CRISPR gRNA sequence
acagtagcagcagcacgaag

SEQ ID NO: 560292 - DNA, 20 bp, Artificial
  CRISPR gRNA sequence
actgcaggcttactatgtga

SEQ ID NO: 560293 - DNA, 20 bp, Artificial
  CRISPR gRNA sequence
caggcttactatgtgacaag

SEQ ID NO: 560294 - DNA, 20 bp, Artificial
  CRISPR gRNA sequence
actatgtgacaagcacttgt

SEQ ID NO: 560295 - DNA, 20 bp, Artificial
  CRISPR gRNA sequence
ctatgtgacaagcacttgtt

SEQ ID NO: 560296 - DNA, 20 bp, Artificial
  CRISPR gRNA sequence
tgtgacaagcacttgttcca

SEQ ID NO: 560297 - DNA, 20 bp, Artificial
  CRISPR gRNA sequence
gttccaagagctgtttgtgt

SEQ ID NO: 560298 - DNA, 20 bp, Artificial
  CRISPR gRNA sequence
ttccaagagctgtttgtgta

SEQ ID NO: 560299 - DNA, 20 bp, Artificial
  CRISPR gRNA sequence
caagagctgtttgtgtatta

SEQ ID NO: 560300 - DNA, 20 bp, Artificial
  CRISPR gRNA sequence
tttgtgtattaactcattta

SEQ ID NO: 560301 - DNA, 20 bp, Artificial
  CRISPR gRNA sequence
gtgtattaactcatttaatc

SEQ ID NO: 560302 - DNA, 20 bp, Artificial
  CRISPR gRNA sequence
tgtattaactcatttaatcc

SEQ ID NO: 560303 - DNA, 20 bp, Artificial
  CRISPR gRNA sequence
actcatttaatcctcaactc

SEQ ID NO: 560304 - DNA, 20 bp, Artificial
  CRISPR gRNA sequence
atttaatcctcaactcaact

SEQ ID NO: 560305 - DNA, 20 bp, Artificial
  CRISPR gRNA sequence
aatcctcaactcaactctga

SEQ ID NO: 560306 - DNA, 20 bp, Artificial
  CRISPR gRNA sequence
atcctcaactcaactctgag

SEQ ID NO: 560307 - DNA, 20 bp, Artificial
  CRISPR gRNA sequence
aactcaactctgaggtagtt

SEQ ID NO: 560308 - DNA, 20 bp, Artificial
  CRISPR gRNA sequence
aactctgaggtagttcttat

SEQ ID NO: 560309 - DNA, 20 bp, Artificial
  CRISPR gRNA sequence
tgaggtagttcttattattc

SEQ ID NO: 560310 - DNA, 20 bp, Artificial
  CRISPR gRNA sequence
aggtagttcttattattcat

SEQ ID NO: 560311 - DNA, 20 bp, Artificial
  CRISPR gRNA sequence
ttattattcatttatttgtt

SEQ ID NO: 560312 - DNA, 20 bp, Artificial
  CRISPR gRNA sequence
attattcatttatttgttca

SEQ ID NO: 560313 - DNA, 20 bp, Artificial
  CRISPR gRNA sequence
ttattcatttatttgttcat

SEQ ID NO: 560314 - DNA, 20 bp, Artificial
  CRISPR gRNA sequence
ttcatttatttgttcatcaa

SEQ ID NO: 560315 - DNA, 20 bp, Artificial
  CRISPR gRNA sequence
atttatttgttcatcaaatg

SEQ ID NO: 560316 - DNA, 20 bp, Artificial
  CRISPR gRNA sequence
atttgttcatcaaatgttca

SEQ ID NO: 560317 - DNA, 20 bp, Artificial
  CRISPR gRNA sequence
tttgttcatcaaatgttcat

SEQ ID NO: 560318 - DNA, 20 bp, Artificial
  CRISPR gRNA sequence
gttcatcaaatgttcatgga

SEQ ID NO: 560319 - DNA, 20 bp, Artificial
  CRISPR gRNA sequence
ttcatcaaatgttcatggag

SEQ ID NO: 560320 - DNA, 20 bp, Artificial
  CRISPR gRNA sequence
atcaaatgttcatggagtcc

SEQ ID NO: 560321 - DNA, 20 bp, Artificial
  CRISPR gRNA sequence
atggagtcctgcctatgtgc

SEQ ID NO: 560322 - DNA, 20 bp, Artificial
  CRISPR gRNA sequence
cctatgtgccagacactgaa

SEQ ID NO: 560323 - DNA, 20 bp, Artificial
  CRISPR gRNA sequence
tgtgccagacactgaaataa

SEQ ID NO: 560324 - DNA, 20 bp, Artificial
  CRISPR gRNA sequence
aaataagcaggcaggatata

SEQ ID NO: 560325 - DNA, 20 bp, Artificial
  CRISPR gRNA sequence
ttggagtctatttttcagtg

SEQ ID NO: 560326 - DNA, 20 bp, Artificial
  CRISPR gRNA sequence
ggagtctatttttcagtgga

SEQ ID NO: 560327 - DNA, 20 bp, Artificial
  CRISPR gRNA sequence
gagtctatttttcagtggag

SEQ ID NO: 560328 - DNA, 20 bp, Artificial
  CRISPR gRNA sequence
tttttcagtggagggaagaa

SEQ ID NO: 560329 - DNA, 20 bp, Artificial
  CRISPR gRNA sequence
ttcagtggagggaagaacat

SEQ ID NO: 560330 - DNA, 20 bp, Artificial
  CRISPR gRNA sequence
tcagtggagggaagaacata

SEQ ID NO: 560331 - DNA, 20 bp, Artificial
  CRISPR gRNA sequence
cagtggagggaagaacataa

SEQ ID NO: 560332 - DNA, 20 bp, Artificial
  CRISPR gRNA sequence
agtggagggaagaacataat

SEQ ID NO: 560333 - DNA, 20 bp, Artificial
  CRISPR gRNA sequence
ttatttggatgatgttggat

SEQ ID NO: 560334 - DNA, 20 bp, Artificial
  CRISPR gRNA sequence
tatttggatgatgttggatg

SEQ ID NO: 560335 - DNA, 20 bp, Artificial
  CRISPR gRNA sequence
atttggatgatgttggatga

SEQ ID NO: 560336 - DNA, 20 bp, Artificial
  CRISPR gRNA sequence
tttggatgatgttggatgat

SEQ ID NO: 560337 - DNA, 20 bp, Artificial
  CRISPR gRNA sequence
ggatgatgttggatgatgtt

SEQ ID NO: 560338 - DNA, 20 bp, Artificial
  CRISPR gRNA sequence
gatgatgttggatgatgtta

SEQ ID NO: 560339 - DNA, 20 bp, Artificial
  CRISPR gRNA sequence
gatgatgttaagtgctatag

SEQ ID NO: 560340 - DNA, 20 bp, Artificial
  CRISPR gRNA sequence
agtgctatagagaaaaataa

SEQ ID NO: 560341 - DNA, 20 bp, Artificial
  CRISPR gRNA sequence
tagagaaaaataaagcagag

SEQ ID NO: 560342 - DNA, 20 bp, Artificial
  CRISPR gRNA sequence
aggagtactggtaaggaaag

SEQ ID NO: 560343 - DNA, 20 bp, Artificial
  CRISPR gRNA sequence
gtaaggaaaggagttggatg

SEQ ID NO: 560344 - DNA, 20 bp, Artificial
  CRISPR gRNA sequence
gatggcatggggggcagtca

SEQ ID NO: 560345 - DNA, 20 bp, Artificial
  CRISPR gRNA sequence
gcatctgagcagagtccaga

SEQ ID NO: 560346 - DNA, 20 bp, Artificial
  CRISPR gRNA sequence
agcagagtccagaaaagcag

SEQ ID NO: 560347 - DNA, 20 bp, Artificial
  CRISPR gRNA sequence
agaacatctggggtgagagt

SEQ ID NO: 560348 - DNA, 20 bp, Artificial
  CRISPR gRNA sequence
gggtgagagtgagaaaggag

SEQ ID NO: 560349 - DNA, 20 bp, Artificial
  CRISPR gRNA sequence
tttcttgagaacacgcctat

SEQ ID NO: 560350 - DNA, 20 bp, Artificial
  CRISPR gRNA sequence
cttgagaacacgcctatcaa

SEQ ID NO: 560351 - DNA, 20 bp, Artificial
  CRISPR gRNA sequence
ttgagaacacgcctatcaaa

SEQ ID NO: 560352 - DNA, 20 bp, Artificial
  CRISPR gRNA sequence
gagaacacgcctatcaaagt

SEQ ID NO: 560353 - DNA, 20 bp, Artificial
  CRISPR gRNA sequence
agaacacgcctatcaaagta

SEQ ID NO: 560354 - DNA, 20 bp, Artificial
  CRISPR gRNA sequence
tcaaagtaaggtggtttgct

SEQ ID NO: 560355 - DNA, 20 bp, Artificial
  CRISPR gRNA sequence
gctccgctggacacttggtt

SEQ ID NO: 560356 - DNA, 20 bp, Artificial
  CRISPR gRNA sequence
ctccgctggacacttggttg

SEQ ID NO: 560357 - DNA, 20 bp, Artificial
  CRISPR gRNA sequence
cgctggacacttggttgata

SEQ ID NO: 560358 - DNA, 20 bp, Artificial
  CRISPR gRNA sequence
gacacttggttgatagagaa

SEQ ID NO: 560359 - DNA, 20 bp, Artificial
  CRISPR gRNA sequence
ggttgatagagaaggtcaaa

SEQ ID NO: 560360 - DNA, 20 bp, Artificial
  CRISPR gRNA sequence
gttgatagagaaggtcaaag

SEQ ID NO: 560361 - DNA, 20 bp, Artificial
  CRISPR gRNA sequence
atagagaaggtcaaagattc

SEQ ID NO: 560362 - DNA, 20 bp, Artificial
  CRISPR gRNA sequence
cgaagcaccaggctacagat

SEQ ID NO: 560363 - DNA, 20 bp, Artificial
  CRISPR gRNA sequence
cagatgaagaaatggactga

SEQ ID NO: 560364 - DNA, 20 bp, Artificial
  CRISPR gRNA sequence
agagggtcagctgactgcat

SEQ ID NO: 560365 - DNA, 20 bp, Artificial
  CRISPR gRNA sequence
actgcattcactcagctagc

SEQ ID NO: 560366 - DNA, 20 bp, Artificial
  CRISPR gRNA sequence
cattcactcagctagcaagg

SEQ ID NO: 560367 - DNA, 20 bp, Artificial
  CRISPR gRNA sequence
actcagctagcaaggggcag

SEQ ID NO: 560368 - DNA, 20 bp, Artificial
  CRISPR gRNA sequence
agctagcaaggggcagagct

SEQ ID NO: 560369 - DNA, 20 bp, Artificial
  CRISPR gRNA sequence
gcaaggggcagagctggtgt

SEQ ID NO: 560370 - DNA, 20 bp, Artificial
  CRISPR gRNA sequence
gtgtccagacacaggcagtc

SEQ ID NO: 560371 - DNA, 20 bp, Artificial
  CRISPR gRNA sequence
cactgttggccagaacatca

SEQ ID NO: 560372 - DNA, 20 bp, Artificial
  CRISPR gRNA sequence
ttggccagaacatcagatgc

SEQ ID NO: 560373 - DNA, 20 bp, Artificial
  CRISPR gRNA sequence
gccagaacatcagatgcctt

SEQ ID NO: 560374 - DNA, 20 bp, Artificial
  CRISPR gRNA sequence
ggttggggccattcctcttt

SEQ ID NO: 560375 - DNA, 20 bp, Artificial
  CRISPR gRNA sequence
gttggggccattcctctttt

SEQ ID NO: 560376 - DNA, 20 bp, Artificial
  CRISPR gRNA sequence
gggccattcctcttttttcc

SEQ ID NO: 560377 - DNA, 20 bp, Artificial
  CRISPR gRNA sequence
ctcttttttcctgatcgatt

SEQ ID NO: 560378 - DNA, 20 bp, Artificial
  CRISPR gRNA sequence
ttttttcctgatcgattcca

SEQ ID NO: 560379 - DNA, 20 bp, Artificial
  CRISPR gRNA sequence
ttttcctgatcgattccacc

SEQ ID NO: 560380 - DNA, 20 bp, Artificial
  CRISPR gRNA sequence
tttcctgatcgattccaccc

SEQ ID NO: 560381 - DNA, 20 bp, Artificial
  CRISPR gRNA sequence
ttcctgatcgattccaccct

SEQ ID NO: 560382 - DNA, 20 bp, Artificial
  CRISPR gRNA sequence
tcctgatcgattccaccctt

SEQ ID NO: 560383 - DNA, 20 bp, Artificial
  CRISPR gRNA sequence
cctgatcgattccaccctta

SEQ ID NO: 560384 - DNA, 20 bp, Artificial
  CRISPR gRNA sequence
ctgatcgattccacccttag

SEQ ID NO: 560385 - DNA, 20 bp, Artificial
  CRISPR gRNA sequence
atcgattccacccttagccg

SEQ ID NO: 560386 - DNA, 20 bp, Artificial
  CRISPR gRNA sequence
cacccttagccggtcccagt

SEQ ID NO: 560387 - DNA, 20 bp, Artificial
  CRISPR gRNA sequence
agccggtcccagttagtgac

SEQ ID NO: 560388 - DNA, 20 bp, Artificial
  CRISPR gRNA sequence
gccggtcccagttagtgact

SEQ ID NO: 560389 - DNA, 20 bp, Artificial
  CRISPR gRNA sequence
gtgacttctcttatttcctt

SEQ ID NO: 560390 - DNA, 20 bp, Artificial
  CRISPR gRNA sequence
ctcttatttccttaagacag

SEQ ID NO: 560391 - DNA, 20 bp, Artificial
  CRISPR gRNA sequence
tcttatttccttaagacaga

SEQ ID NO: 560392 - DNA, 20 bp, Artificial
  CRISPR gRNA sequence
ttatttccttaagacagaga

SEQ ID NO: 560393 - DNA, 20 bp, Artificial
  CRISPR gRNA sequence
atttccttaagacagagatt

SEQ ID NO: 560394 - DNA, 20 bp, Artificial
  CRISPR gRNA sequence
tttccttaagacagagattt

SEQ ID NO: 560395 - DNA, 20 bp, Artificial
  CRISPR gRNA sequence
ccttaagacagagatttact

SEQ ID NO: 560396 - DNA, 20 bp, Artificial
  CRISPR gRNA sequence
cttaagacagagatttactg

SEQ ID NO: 560397 - DNA, 20 bp, Artificial
  CRISPR gRNA sequence
aagacagagatttactgatt

SEQ ID NO: 560398 - DNA, 20 bp, Artificial
  CRISPR gRNA sequence
agacagagatttactgattt

SEQ ID NO: 560399 - DNA, 20 bp, Artificial
  CRISPR gRNA sequence
actgatttcagccacaccac

SEQ ID NO: 560400 - DNA, 20 bp, Artificial
  CRISPR gRNA sequence
ctgatttcagccacaccacc

SEQ ID NO: 560401 - DNA, 20 bp, Artificial
  CRISPR gRNA sequence
atttcagccacaccaccacc

SEQ ID NO: 560402 - DNA, 20 bp, Artificial
  CRISPR gRNA sequence
cagccacaccaccaccagtt

SEQ ID NO: 560403 - DNA, 20 bp, Artificial
  CRISPR gRNA sequence
agccacaccaccaccagttt

SEQ ID NO: 560404 - DNA, 20 bp, Artificial
  CRISPR gRNA sequence
ccctgccctcatctacttca

SEQ ID NO: 560405 - DNA, 20 bp, Artificial
  CRISPR gRNA sequence
cctgccctcatctacttcat

SEQ ID NO: 560406 - DNA, 20 bp, Artificial
  CRISPR gRNA sequence
ccctcatctacttcatactg

SEQ ID NO: 560407 - DNA, 20 bp, Artificial
  CRISPR gRNA sequence
atctacttcatactgaaact

SEQ ID NO: 560408 - DNA, 20 bp, Artificial
  CRISPR gRNA sequence
cttcatactgaaactgcagc

SEQ ID NO: 560409 - DNA, 20 bp, Artificial
  CRISPR gRNA sequence
catactgaaactgcagccac

SEQ ID NO: 560410 - DNA, 20 bp, Artificial
  CRISPR gRNA sequence
atactgaaactgcagccacc

SEQ ID NO: 560411 - DNA, 20 bp, Artificial
  CRISPR gRNA sequence
aaactgcagccacctgtctc

SEQ ID NO: 560412 - DNA, 20 bp, Artificial
  CRISPR gRNA sequence
cagccacctgtctcccaacg

SEQ ID NO: 560413 - DNA, 20 bp, Artificial
  CRISPR gRNA sequence
tctcccaacggttacaaacc

SEQ ID NO: 560414 - DNA, 20 bp, Artificial
  CRISPR gRNA sequence
ccaacggttacaaaccctcg

SEQ ID NO: 560415 - DNA, 20 bp, Artificial
  CRISPR gRNA sequence
caaaccctcggtccccaagg

SEQ ID NO: 560416 - DNA, 20 bp, Artificial
  CRISPR gRNA sequence
ggtccccaaggccagagcaa

SEQ ID NO: 560417 - DNA, 20 bp, Artificial
  CRISPR gRNA sequence
ccggaccttgctctcagctg

SEQ ID NO: 560418 - DNA, 20 bp, Artificial
  CRISPR gRNA sequence
gctctcagctgtcaatctgc

SEQ ID NO: 560419 - DNA, 20 bp, Artificial
  CRISPR gRNA sequence
ctctcagctgtcaatctgcc

SEQ ID NO: 560420 - DNA, 20 bp, Artificial
  CRISPR gRNA sequence
tcagctgtcaatctgcctcc

SEQ ID NO: 560421 - DNA, 20 bp, Artificial
  CRISPR gRNA sequence
agctgtcaatctgcctcctc

SEQ ID NO: 560422 - DNA, 20 bp, Artificial
  CRISPR gRNA sequence
tcaatctgcctcctcgataa

SEQ ID NO: 560423 - DNA, 20 bp, Artificial
  CRISPR gRNA sequence
cctcctcgataagttcatca

SEQ ID NO: 560424 - DNA, 20 bp, Artificial
  CRISPR gRNA sequence
ctcgataagttcatcaagaa

SEQ ID NO: 560425 - DNA, 20 bp, Artificial
  CRISPR gRNA sequence
gataagttcatcaagaatta

SEQ ID NO: 560426 - DNA, 20 bp, Artificial
  CRISPR gRNA sequence
atcaagaattaagatgttgg

SEQ ID NO: 560427 - DNA, 20 bp, Artificial
  CRISPR gRNA sequence
agatgttggttctctaaatc

SEQ ID NO: 560428 - DNA, 20 bp, Artificial
  CRISPR gRNA sequence
gttctctaaatcaacttctt

SEQ ID NO: 560429 - DNA, 20 bp, Artificial
  CRISPR gRNA sequence
tctaaatcaacttctttctg

SEQ ID NO: 560430 - DNA, 20 bp, Artificial
  CRISPR gRNA sequence
taaatcaacttctttctgta

SEQ ID NO: 560431 - DNA, 20 bp, Artificial
  CRISPR gRNA sequence
aatcaacttctttctgtact

SEQ ID NO: 560432 - DNA, 20 bp, Artificial
  CRISPR gRNA sequence
ctttctgtactttccttcta

SEQ ID NO: 560433 - DNA, 20 bp, Artificial
  CRISPR gRNA sequence
tttctgtactttccttctaa

SEQ ID NO: 560434 - DNA, 20 bp, Artificial
  CRISPR gRNA sequence
tctgtactttccttctaata

SEQ ID NO: 560435 - DNA, 20 bp, Artificial
  CRISPR gRNA sequence
ctgtactttccttctaatat

SEQ ID NO: 560436 - DNA, 20 bp, Artificial
  CRISPR gRNA sequence
tgtactttccttctaatatg

SEQ ID NO: 560437 - DNA, 20 bp, Artificial
  CRISPR gRNA sequence
tactttccttctaatatgat

SEQ ID NO: 560438 - DNA, 20 bp, Artificial
  CRISPR gRNA sequence
tccttctaatatgatgctaa

SEQ ID NO: 560439 - DNA, 20 bp, Artificial
  CRISPR gRNA sequence
ccttctaatatgatgctaaa

SEQ ID NO: 560440 - DNA, 20 bp, Artificial
  CRISPR gRNA sequence
cttctaatatgatgctaaaa

SEQ ID NO: 560441 - DNA, 20 bp, Artificial
  CRISPR gRNA sequence
ctaatatgatgctaaaatag

SEQ ID NO: 560442 - DNA, 20 bp, Artificial
  CRISPR gRNA sequence
taatatgatgctaaaatagt

SEQ ID NO: 560443 - DNA, 20 bp, Artificial
  CRISPR gRNA sequence
atatgatgctaaaatagttt

SEQ ID NO: 560444 - DNA, 20 bp, Artificial
  CRISPR gRNA sequence
aaatagtttcctttttaatt

SEQ ID NO: 560445 - DNA, 20 bp, Artificial
  CRISPR gRNA sequence
cctttttaattcttgttctt

SEQ ID NO: 560446 - DNA, 20 bp, Artificial
  CRISPR gRNA sequence
ctttttaattcttgttcttg

SEQ ID NO: 560447 - DNA, 20 bp, Artificial
  CRISPR gRNA sequence
tttaattcttgttcttgcac

SEQ ID NO: 560448 - DNA, 20 bp, Artificial
  CRISPR gRNA sequence
ttaattcttgttcttgcact

SEQ ID NO: 560449 - DNA, 20 bp, Artificial
  CRISPR gRNA sequence
taattcttgttcttgcactt

SEQ ID NO: 560450 - DNA, 20 bp, Artificial
  CRISPR gRNA sequence
aattcttgttcttgcactta

SEQ ID NO: 560451 - DNA, 20 bp, Artificial
  CRISPR gRNA sequence
attcttgttcttgcacttaa

SEQ ID NO: 560452 - DNA, 20 bp, Artificial
  CRISPR gRNA sequence
ttgttcttgcacttaaccta

SEQ ID NO: 560453 - DNA, 20 bp, Artificial
  CRISPR gRNA sequence
gttcttgcacttaacctatt

SEQ ID NO: 560454 - DNA, 20 bp, Artificial
  CRISPR gRNA sequence
ttcttgcacttaacctattt

SEQ ID NO: 560455 - DNA, 20 bp, Artificial
  CRISPR gRNA sequence
ttgcacttaacctatttctt

SEQ ID NO: 560456 - DNA, 20 bp, Artificial
  CRISPR gRNA sequence
gcacttaacctatttcttct

SEQ ID NO: 560457 - DNA, 20 bp, Artificial
  CRISPR gRNA sequence
cacttaacctatttcttctt

SEQ ID NO: 560458 - DNA, 20 bp, Artificial
  CRISPR gRNA sequence
aacctatttcttctttctca

SEQ ID NO: 560459 - DNA, 20 bp, Artificial
  CRISPR gRNA sequence
acctatttcttctttctcaa

SEQ ID NO: 560460 - DNA, 20 bp, Artificial
  CRISPR gRNA sequence
tttcttctttctcaagatgt

SEQ ID NO: 560461 - DNA, 20 bp, Artificial
  CRISPR gRNA sequence
cttctttctcaagatgtttc

SEQ ID NO: 560462 - DNA, 20 bp, Artificial
  CRISPR gRNA sequence
ttctttctcaagatgtttcc

SEQ ID NO: 560463 - DNA, 20 bp, Artificial
  CRISPR gRNA sequence
ctttctcaagatgtttccct

SEQ ID NO: 560464 - DNA, 20 bp, Artificial
  CRISPR gRNA sequence
tttctcaagatgtttccctt

SEQ ID NO: 560465 - DNA, 20 bp, Artificial
  CRISPR gRNA sequence
tctcaagatgtttcccttta

SEQ ID NO: 560466 - DNA, 20 bp, Artificial
  CRISPR gRNA sequence
ctcaagatgtttccctttag

SEQ ID NO: 560467 - DNA, 20 bp, Artificial
  CRISPR gRNA sequence
tcaagatgtttccctttaga

SEQ ID NO: 560468 - DNA, 20 bp, Artificial
  CRISPR gRNA sequence
aagatgtttccctttagacc

SEQ ID NO: 560469 - DNA, 20 bp, Artificial
  CRISPR gRNA sequence
ccctttagacctatgcaatc

SEQ ID NO: 560470 - DNA, 20 bp, Artificial
  CRISPR gRNA sequence
cctttagacctatgcaatcc

SEQ ID NO: 560471 - DNA, 20 bp, Artificial
  CRISPR gRNA sequence
tagacctatgcaatccatca

SEQ ID NO: 560472 - DNA, 20 bp, Artificial
  CRISPR gRNA sequence
agacctatgcaatccatcaa

SEQ ID NO: 560473 - DNA, 20 bp, Artificial
  CRISPR gRNA sequence
gacctatgcaatccatcaaa

SEQ ID NO: 560474 - DNA, 20 bp, Artificial
  CRISPR gRNA sequence
tgcaatccatcaaagtagct

SEQ ID NO: 560475 - DNA, 20 bp, Artificial
  CRISPR gRNA sequence
ccagctacaagtggctagtg

SEQ ID NO: 560476 - DNA, 20 bp, Artificial
  CRISPR gRNA sequence
caagtggctagtgagaacct

SEQ ID NO: 560477 - DNA, 20 bp, Artificial
  CRISPR gRNA sequence
gtgagaacctgaaatatggt

SEQ ID NO: 560478 - DNA, 20 bp, Artificial
  CRISPR gRNA sequence
aaatatggttagttcaaatg

SEQ ID NO: 560479 - DNA, 20 bp, Artificial
  CRISPR gRNA sequence
gttcaaatggagatgtgttc

SEQ ID NO: 560480 - DNA, 20 bp, Artificial
  CRISPR gRNA sequence
aaatggagatgtgttctgag

SEQ ID NO: 560481 - DNA, 20 bp, Artificial
  CRISPR gRNA sequence
tgagtatcaaatacacacca

SEQ ID NO: 560482 - DNA, 20 bp, Artificial
  CRISPR gRNA sequence
agtatcaaatacacaccaga

SEQ ID NO: 560483 - DNA, 20 bp, Artificial
  CRISPR gRNA sequence
aagacctggtattaaaaagt

SEQ ID NO: 560484 - DNA, 20 bp, Artificial
  CRISPR gRNA sequence
gtattaaaaagtggaacata

SEQ ID NO: 560485 - DNA, 20 bp, Artificial
  CRISPR gRNA sequence
aaaagtggaacataaaatct

SEQ ID NO: 560486 - DNA, 20 bp, Artificial
  CRISPR gRNA sequence
ttgttaatatttttttgtag

SEQ ID NO: 560487 - DNA, 20 bp, Artificial
  CRISPR gRNA sequence
gttaatatttttttgtagta

SEQ ID NO: 560488 - DNA, 20 bp, Artificial
  CRISPR gRNA sequence
ttaatatttttttgtagtaa

SEQ ID NO: 560489 - DNA, 20 bp, Artificial
  CRISPR gRNA sequence
atatttttttgtagtaacta

SEQ ID NO: 560490 - DNA, 20 bp, Artificial
  CRISPR gRNA sequence
ttttgtagtaactactaggt

SEQ ID NO: 560491 - DNA, 20 bp, Artificial
  CRISPR gRNA sequence
tttgtagtaactactaggtt

SEQ ID NO: 560492 - DNA, 20 bp, Artificial
  CRISPR gRNA sequence
ttgtagtaactactaggtta

SEQ ID NO: 560493 - DNA, 20 bp, Artificial
  CRISPR gRNA sequence
tgtagtaactactaggttag

SEQ ID NO: 560494 - DNA, 20 bp, Artificial
  CRISPR gRNA sequence
gtagtaactactaggttagt

SEQ ID NO: 560495 - DNA, 20 bp, Artificial
  CRISPR gRNA sequence
tagtaactactaggttagtg

SEQ ID NO: 560496 - DNA, 20 bp, Artificial
  CRISPR gRNA sequence
ctaggttagtgcaaaagtaa

SEQ ID NO: 560497 - DNA, 20 bp, Artificial
  CRISPR gRNA sequence
ggttagtgcaaaagtaattg

SEQ ID NO: 560498 - DNA, 20 bp, Artificial
  CRISPR gRNA sequence
gtgcaaaagtaattgccggt

SEQ ID NO: 560499 - DNA, 20 bp, Artificial
  CRISPR gRNA sequence
ccggtttttgccattaaaaa

SEQ ID NO: 560500 - DNA, 20 bp, Artificial
  CRISPR gRNA sequence
ttgccattaaaaaaaaatag

SEQ ID NO: 560501 - DNA, 20 bp, Artificial
  CRISPR gRNA sequence
tgccattaaaaaaaaatagc

SEQ ID NO: 560502 - DNA, 20 bp, Artificial
  CRISPR gRNA sequence
gccattaaaaaaaaatagca

SEQ ID NO: 560503 - DNA, 20 bp, Artificial
  CRISPR gRNA sequence
ccattaaaaaaaaatagcaa

SEQ ID NO: 560504 - DNA, 20 bp, Artificial
  CRISPR gRNA sequence
aaaaaaaatagcaaaaacca

SEQ ID NO: 560505 - DNA, 20 bp, Artificial
  CRISPR gRNA sequence
ttgcaccaacctaatacatg

SEQ ID NO: 560506 - DNA, 20 bp, Artificial
  CRISPR gRNA sequence
tgcaccaacctaatacatgt

SEQ ID NO: 560507 - DNA, 20 bp, Artificial
  CRISPR gRNA sequence
gcaccaacctaatacatgtc

SEQ ID NO: 560508 - DNA, 20 bp, Artificial
  CRISPR gRNA sequence
caccaacctaatacatgtcg

SEQ ID NO: 560509 - DNA, 20 bp, Artificial
  CRISPR gRNA sequence
atacatgtcgaaatgaaaat

SEQ ID NO: 560510 - DNA, 20 bp, Artificial
  CRISPR gRNA sequence
tggatatattaggttaacta

SEQ ID NO: 560511 - DNA, 20 bp, Artificial
  CRISPR gRNA sequence
ggttaactaaaatatattat

SEQ ID NO: 560512 - DNA, 20 bp, Artificial
  CRISPR gRNA sequence
actaaaatatattattaaaa

SEQ ID NO: 560513 - DNA, 20 bp, Artificial
  CRISPR gRNA sequence
aaatatattattaaaattaa

SEQ ID NO: 560514 - DNA, 20 bp, Artificial
  CRISPR gRNA sequence
ttaaaattaatttcacatgt

SEQ ID NO: 560515 - DNA, 20 bp, Artificial
  CRISPR gRNA sequence
aaattaatttcacatgttcc

SEQ ID NO: 560516 - DNA, 20 bp, Artificial
  CRISPR gRNA sequence
atttcacatgttccatatta

SEQ ID NO: 560517 - DNA, 20 bp, Artificial
  CRISPR gRNA sequence
cacatgttccatattatact

SEQ ID NO: 560518 - DNA, 20 bp, Artificial
  CRISPR gRNA sequence
acatgttccatattatactt

SEQ ID NO: 560519 - DNA, 20 bp, Artificial
  CRISPR gRNA sequence
catattatacttctatttga

SEQ ID NO: 560520 - DNA, 20 bp, Artificial
  CRISPR gRNA sequence
tacttctatttgagagcact

SEQ ID NO: 560521 - DNA, 20 bp, Artificial
  CRISPR gRNA sequence
ctatttgagagcacttcttt

SEQ ID NO: 560522 - DNA, 20 bp, Artificial
  CRISPR gRNA sequence
tatttgagagcacttcttta

SEQ ID NO: 560523 - DNA, 20 bp, Artificial
  CRISPR gRNA sequence
tttgagagcacttctttagc

SEQ ID NO: 560524 - DNA, 20 bp, Artificial
  CRISPR gRNA sequence
gagagcacttctttagcctg

SEQ ID NO: 560525 - DNA, 20 bp, Artificial
  CRISPR gRNA sequence
agagcacttctttagcctgt

SEQ ID NO: 560526 - DNA, 20 bp, Artificial
  CRISPR gRNA sequence
ctttagcctgttgtttcaag

SEQ ID NO: 560527 - DNA, 20 bp, Artificial
  CRISPR gRNA sequence
tttagcctgttgtttcaaga

SEQ ID NO: 560528 - DNA, 20 bp, Artificial
  CRISPR gRNA sequence
tagcctgttgtttcaagaca

SEQ ID NO: 560529 - DNA, 20 bp, Artificial
  CRISPR gRNA sequence
agcctgttgtttcaagacac

SEQ ID NO: 560530 - DNA, 20 bp, Artificial
  CRISPR gRNA sequence
gcctgttgtttcaagacact

SEQ ID NO: 560531 - DNA, 20 bp, Artificial
  CRISPR gRNA sequence
ttgtttcaagacactcacat

SEQ ID NO: 560532 - DNA, 20 bp, Artificial
  CRISPR gRNA sequence
tttcaagacactcacatccc

SEQ ID NO: 560533 - DNA, 20 bp, Artificial
  CRISPR gRNA sequence
caagacactcacatcccacc

SEQ ID NO: 560534 - DNA, 20 bp, Artificial
  CRISPR gRNA sequence
aagacactcacatcccacct

SEQ ID NO: 560535 - DNA, 20 bp, Artificial
  CRISPR gRNA sequence
acatcccacctttctcaaag

SEQ ID NO: 560536 - DNA, 20 bp, Artificial
  CRISPR gRNA sequence
tctcaaaggccacatttgtc

SEQ ID NO: 560537 - DNA, 20 bp, Artificial
  CRISPR gRNA sequence
ctcaaaggccacatttgtct

SEQ ID NO: 560538 - DNA, 20 bp, Artificial
  CRISPR gRNA sequence
tcaaaggccacatttgtctt

SEQ ID NO: 560539 - DNA, 20 bp, Artificial
  CRISPR gRNA sequence
aaaggccacatttgtctttg

SEQ ID NO: 560540 - DNA, 20 bp, Artificial
  CRISPR gRNA sequence
gtctttgactgttctcacct

SEQ ID NO: 560541 - DNA, 20 bp, Artificial
  CRISPR gRNA sequence
tctttgactgttctcacctt

SEQ ID NO: 560542 - DNA, 20 bp, Artificial
  CRISPR gRNA sequence
tgactgttctcaccttagat

SEQ ID NO: 560543 - DNA, 20 bp, Artificial
  CRISPR gRNA sequence
gactgttctcaccttagata

SEQ ID NO: 560544 - DNA, 20 bp, Artificial
  CRISPR gRNA sequence
actgttctcaccttagatag

SEQ ID NO: 560545 - DNA, 20 bp, Artificial
  CRISPR gRNA sequence
ttctcaccttagataggata

SEQ ID NO: 560546 - DNA, 20 bp, Artificial
  CRISPR gRNA sequence
tcaccttagataggatacag

SEQ ID NO: 560547 - DNA, 20 bp, Artificial
  CRISPR gRNA sequence
accttagataggatacagct

SEQ ID NO: 560548 - DNA, 20 bp, Artificial
  CRISPR gRNA sequence
agataggatacagctgagat

SEQ ID NO: 560549 - DNA, 20 bp, Artificial
  CRISPR gRNA sequence
gataggatacagctgagatc

SEQ ID NO: 560550 - DNA, 20 bp, Artificial
  CRISPR gRNA sequence
agatccacagtatgctttag

SEQ ID NO: 560551 - DNA, 20 bp, Artificial
  CRISPR gRNA sequence
tagggaataaggttcttact

SEQ ID NO: 560552 - DNA, 20 bp, Artificial
  CRISPR gRNA sequence
agggaataaggttcttacta

SEQ ID NO: 560553 - DNA, 20 bp, Artificial
  CRISPR gRNA sequence
gggaataaggttcttactag

SEQ ID NO: 560554 - DNA, 20 bp, Artificial
  CRISPR gRNA sequence
ttactagatcggttaaggct

SEQ ID NO: 560555 - DNA, 20 bp, Artificial
  CRISPR gRNA sequence
actagatcggttaaggctgt

SEQ ID NO: 560556 - DNA, 20 bp, Artificial
  CRISPR gRNA sequence
ctagatcggttaaggctgtg

SEQ ID NO: 560557 - DNA, 20 bp, Artificial
  CRISPR gRNA sequence
gatcggttaaggctgtgagt

SEQ ID NO: 560558 - DNA, 20 bp, Artificial
  CRISPR gRNA sequence
aggctgtgagtgtttttaaa

SEQ ID NO: 560559 - DNA, 20 bp, Artificial
  CRISPR gRNA sequence
tgagtgtttttaaatctatt

SEQ ID NO: 560560 - DNA, 20 bp, Artificial
  CRISPR gRNA sequence
ttaaatctattctccaaagt

SEQ ID NO: 560561 - DNA, 20 bp, Artificial
  CRISPR gRNA sequence
taaatctattctccaaagtc

SEQ ID NO: 560562 - DNA, 20 bp, Artificial
  CRISPR gRNA sequence
aaatctattctccaaagtct

SEQ ID NO: 560563 - DNA, 20 bp, Artificial
  CRISPR gRNA sequence
aatctattctccaaagtctg

SEQ ID NO: 560564 - DNA, 20 bp, Artificial
  CRISPR gRNA sequence
ttctccaaagtctgattcaa

SEQ ID NO: 560565 - DNA, 20 bp, Artificial
  CRISPR gRNA sequence
tccaaagtctgattcaaggt

SEQ ID NO: 560566 - DNA, 20 bp, Artificial
  CRISPR gRNA sequence
caaagtctgattcaaggtat

SEQ ID NO: 560567 - DNA, 20 bp, Artificial
  CRISPR gRNA sequence
attcaaggtatttcaataca

SEQ ID NO: 560568 - DNA, 20 bp, Artificial
  CRISPR gRNA sequence
aaggtatttcaatacagtac

SEQ ID NO: 560569 - DNA, 20 bp, Artificial
  CRISPR gRNA sequence
caatacagtactgatcattt

SEQ ID NO: 560570 - DNA, 20 bp, Artificial
  CRISPR gRNA sequence
aatacagtactgatcatttc

SEQ ID NO: 560571 - DNA, 20 bp, Artificial
  CRISPR gRNA sequence
atcatttcactaaaattcct

SEQ ID NO: 560572 - DNA, 20 bp, Artificial
  CRISPR gRNA sequence
cactaaaattccttgagaat

SEQ ID NO: 560573 - DNA, 20 bp, Artificial
  CRISPR gRNA sequence
actaaaattccttgagaatc

SEQ ID NO: 560574 - DNA, 20 bp, Artificial
  CRISPR gRNA sequence
aaattccttgagaatccttg

SEQ ID NO: 560575 - DNA, 20 bp, Artificial
  CRISPR gRNA sequence
cttgagaatccttgttattt

SEQ ID NO: 560576 - DNA, 20 bp, Artificial
  CRISPR gRNA sequence
gagaatccttgttattttct

SEQ ID NO: 560577 - DNA, 20 bp, Artificial
  CRISPR gRNA sequence
agaatccttgttattttcta

SEQ ID NO: 560578 - DNA, 20 bp, Artificial
  CRISPR gRNA sequence
gttattttctagatactcag

SEQ ID NO: 560579 - DNA, 20 bp, Artificial
  CRISPR gRNA sequence
ttattttctagatactcagt

SEQ ID NO: 560580 - DNA, 20 bp, Artificial
  CRISPR gRNA sequence
ttttctagatactcagttca

SEQ ID NO: 560581 - DNA, 20 bp, Artificial
  CRISPR gRNA sequence
tctagatactcagttcatcg

SEQ ID NO: 560582 - DNA, 20 bp, Artificial
  CRISPR gRNA sequence
ctagatactcagttcatcgt

SEQ ID NO: 560583 - DNA, 20 bp, Artificial
  CRISPR gRNA sequence
tagatactcagttcatcgtt

SEQ ID NO: 560584 - DNA, 20 bp, Artificial
  CRISPR gRNA sequence
gatactcagttcatcgttgg

SEQ ID NO: 560585 - DNA, 20 bp, Artificial
  CRISPR gRNA sequence
agttcatcgttgggaaactc

SEQ ID NO: 560586 - DNA, 20 bp, Artificial
  CRISPR gRNA sequence
atcgttgggaaactctattg

SEQ ID NO: 560587 - DNA, 20 bp, Artificial
  CRISPR gRNA sequence
ggaaactctattgcaagtag

SEQ ID NO: 560588 - DNA, 20 bp, Artificial
  CRISPR gRNA sequence
tattgcaagtagtttacaat

SEQ ID NO: 560589 - DNA, 20 bp, Artificial
  CRISPR gRNA sequence
ttgcaagtagtttacaatgg

SEQ ID NO: 560590 - DNA, 20 bp, Artificial
  CRISPR gRNA sequence
caagtagtttacaatggcac

SEQ ID NO: 560591 - DNA, 20 bp, Artificial
  CRISPR gRNA sequence
acaatggcacagcctcatta

SEQ ID NO: 560592 - DNA, 20 bp, Artificial
  CRISPR gRNA sequence
caatggcacagcctcattag

SEQ ID NO: 560593 - DNA, 20 bp, Artificial
  CRISPR gRNA sequence
attagtttcttattaatctg

SEQ ID NO: 560594 - DNA, 20 bp, Artificial
  CRISPR gRNA sequence
gtttcttattaatctgattt

SEQ ID NO: 560595 - DNA, 20 bp, Artificial
  CRISPR gRNA sequence
cttattaatctgatttttta

SEQ ID NO: 560596 - DNA, 20 bp, Artificial
  CRISPR gRNA sequence
ttattaatctgattttttat

SEQ ID NO: 560597 - DNA, 20 bp, Artificial
  CRISPR gRNA sequence
attaatctgattttttattt

SEQ ID NO: 560598 - DNA, 20 bp, Artificial
  CRISPR gRNA sequence
ttaatctgattttttatttt

SEQ ID NO: 560599 - DNA, 20 bp, Artificial
  CRISPR gRNA sequence
atctgattttttattttttt

SEQ ID NO: 560600 - DNA, 20 bp, Artificial
  CRISPR gRNA sequence
attttttatttttttctgaa

SEQ ID NO: 560601 - DNA, 20 bp, Artificial
  CRISPR gRNA sequence
tttatttttttctgaatgtg

SEQ ID NO: 560602 - DNA, 20 bp, Artificial
  CRISPR gRNA sequence
ttatttttttctgaatgtgt

SEQ ID NO: 560603 - DNA, 20 bp, Artificial
  CRISPR gRNA sequence
tatttttttctgaatgtgta

SEQ ID NO: 560604 - DNA, 20 bp, Artificial
  CRISPR gRNA sequence
atttttttctgaatgtgtat

SEQ ID NO: 560605 - DNA, 20 bp, Artificial
  CRISPR gRNA sequence
tttttttctgaatgtgtatg

SEQ ID NO: 560606 - DNA, 20 bp, Artificial
  CRISPR gRNA sequence
ttttctgaatgtgtatgtta

SEQ ID NO: 560607 - DNA, 20 bp, Artificial
  CRISPR gRNA sequence
tttctgaatgtgtatgttaa

SEQ ID NO: 560608 - DNA, 20 bp, Artificial
  CRISPR gRNA sequence
ttctgaatgtgtatgttaaa

SEQ ID NO: 560609 - DNA, 20 bp, Artificial
  CRISPR gRNA sequence
tctgaatgtgtatgttaaac

SEQ ID NO: 560610 - DNA, 20 bp, Artificial
  CRISPR gRNA sequence
ctgaatgtgtatgttaaact

SEQ ID NO: 560611 - DNA, 20 bp, Artificial
  CRISPR gRNA sequence
tgaatgtgtatgttaaactt

SEQ ID NO: 560612 - DNA, 20 bp, Artificial
  CRISPR gRNA sequence
aatgtgtatgttaaacttca

SEQ ID NO: 560613 - DNA, 20 bp, Artificial
  CRISPR gRNA sequence
aacttcaattttcttctaat

SEQ ID NO: 560614 - DNA, 20 bp, Artificial
  CRISPR gRNA sequence
caattttcttctaattttta

SEQ ID NO: 560615 - DNA, 20 bp, Artificial
  CRISPR gRNA sequence
aattttcttctaatttttaa

SEQ ID NO: 560616 - DNA, 20 bp, Artificial
  CRISPR gRNA sequence
tcttctaatttttaactggc

SEQ ID NO: 560617 - DNA, 20 bp, Artificial
  CRISPR gRNA sequence
cttctaatttttaactggca

SEQ ID NO: 560618 - DNA, 20 bp, Artificial
  CRISPR gRNA sequence
ttctaatttttaactggcat

SEQ ID NO: 560619 - DNA, 20 bp, Artificial
  CRISPR gRNA sequence
ctaatttttaactggcatag

SEQ ID NO: 560620 - DNA, 20 bp, Artificial
  CRISPR gRNA sequence
taatttttaactggcatagg

SEQ ID NO: 560621 - DNA, 20 bp, Artificial
  CRISPR gRNA sequence
atttttaactggcataggaa

SEQ ID NO: 560622 - DNA, 20 bp, Artificial
  CRISPR gRNA sequence
ttaactggcataggaagaaa

SEQ ID NO: 560623 - DNA, 20 bp, Artificial
  CRISPR gRNA sequence
taactggcataggaagaaaa

SEQ ID NO: 560624 - DNA, 20 bp, Artificial
  CRISPR gRNA sequence
aactggcataggaagaaaat

SEQ ID NO: 560625 - DNA, 20 bp, Artificial
  CRISPR gRNA sequence
actggcataggaagaaaatg

SEQ ID NO: 560626 - DNA, 20 bp, Artificial
  CRISPR gRNA sequence
gcataggaagaaaatgttca

SEQ ID NO: 560627 - DNA, 20 bp, Artificial
  CRISPR gRNA sequence
aagaaactacagactggtca

SEQ ID NO: 560628 - DNA, 20 bp, Artificial
  CRISPR gRNA sequence
cagactggtcagcccagtgg

SEQ ID NO: 560629 - DNA, 20 bp, Artificial
  CRISPR gRNA sequence
gtcagcccagtggaaattca

SEQ ID NO: 560630 - DNA, 20 bp, Artificial
  CRISPR gRNA sequence
aggcactaatctcaacagac

SEQ ID NO: 560631 - DNA, 20 bp, Artificial
  CRISPR gRNA sequence
atctcaacagacattttggg

SEQ ID NO: 560632 - DNA, 20 bp, Artificial
  CRISPR gRNA sequence
aacagacattttggggaaca

SEQ ID NO: 560633 - DNA, 20 bp, Artificial
  CRISPR gRNA sequence
tggggaacattgtaaagtaa

SEQ ID NO: 560634 - DNA, 20 bp, Artificial
  CRISPR gRNA sequence
ggggaacattgtaaagtaag

SEQ ID NO: 560635 - DNA, 20 bp, Artificial
  CRISPR gRNA sequence
gggaacattgtaaagtaagc

SEQ ID NO: 560636 - DNA, 20 bp, Artificial
  CRISPR gRNA sequence
taaagtaagcaaagttcact

SEQ ID NO: 560637 - DNA, 20 bp, Artificial
  CRISPR gRNA sequence
actagaacctataaagtaac

SEQ ID NO: 560638 - DNA, 20 bp, Artificial
  CRISPR gRNA sequence
gaacctataaagtaaccaaa

SEQ ID NO: 560639 - DNA, 20 bp, Artificial
  CRISPR gRNA sequence
taaagtaaccaaaaagcatt

SEQ ID NO: 560640 - DNA, 20 bp, Artificial
  CRISPR gRNA sequence
tccttggaggctgatgggca

SEQ ID NO: 560641 - DNA, 20 bp, Artificial
  CRISPR gRNA sequence
ccttggaggctgatgggcag

SEQ ID NO: 560642 - DNA, 20 bp, Artificial
  CRISPR gRNA sequence
cttggaggctgatgggcagg

SEQ ID NO: 560643 - DNA, 20 bp, Artificial
  CRISPR gRNA sequence
ggaggctgatgggcaggcac

SEQ ID NO: 560644 - DNA, 20 bp, Artificial
  CRISPR gRNA sequence
gaggctgatgggcaggcact

SEQ ID NO: 560645 - DNA, 20 bp, Artificial
  CRISPR gRNA sequence
atgggcaggcactgaaagtt

SEQ ID NO: 560646 - DNA, 20 bp, Artificial
  CRISPR gRNA sequence
aaagttatctccaaagagga

SEQ ID NO: 560647 - DNA, 20 bp, Artificial
  CRISPR gRNA sequence
tctccaaagaggaactgcta

SEQ ID NO: 560648 - DNA, 20 bp, Artificial
  CRISPR gRNA sequence
caaagaggaactgctaaaat

SEQ ID NO: 560649 - DNA, 20 bp, Artificial
  CRISPR gRNA sequence
ctaaaatgttttcccctcct

SEQ ID NO: 560650 - DNA, 20 bp, Artificial
  CRISPR gRNA sequence
aaatgttttcccctcctttt

SEQ ID NO: 560651 - DNA, 20 bp, Artificial
  CRISPR gRNA sequence
tcccctccttttctagggac

SEQ ID NO: 560652 - DNA, 20 bp, Artificial
  CRISPR gRNA sequence
cccctccttttctagggaca

SEQ ID NO: 560653 - DNA, 20 bp, Artificial
  CRISPR gRNA sequence
ccctccttttctagggacag

SEQ ID NO: 560654 - DNA, 20 bp, Artificial
  CRISPR gRNA sequence
cttttctagggacagtctct

SEQ ID NO: 560655 - DNA, 20 bp, Artificial
  CRISPR gRNA sequence
ttctagggacagtctctgta

SEQ ID NO: 560656 - DNA, 20 bp, Artificial
  CRISPR gRNA sequence
tctagggacagtctctgtat

SEQ ID NO: 560657 - DNA, 20 bp, Artificial
  CRISPR gRNA sequence
ctagggacagtctctgtatc

SEQ ID NO: 560658 - DNA, 20 bp, Artificial
  CRISPR gRNA sequence
tagggacagtctctgtatct

SEQ ID NO: 560659 - DNA, 20 bp, Artificial
  CRISPR gRNA sequence
gggacagtctctgtatctta

SEQ ID NO: 560660 - DNA, 20 bp, Artificial
  CRISPR gRNA sequence
tgtatcttatagtcacactt

SEQ ID NO: 560661 - DNA, 20 bp, Artificial
  CRISPR gRNA sequence
tatcttatagtcacacttta

SEQ ID NO: 560662 - DNA, 20 bp, Artificial
  CRISPR gRNA sequence
atagtcacactttatattca

SEQ ID NO: 560663 - DNA, 20 bp, Artificial
  CRISPR gRNA sequence
tagtcacactttatattcaa

SEQ ID NO: 560664 - DNA, 20 bp, Artificial
  CRISPR gRNA sequence
tatattcaaacctgaactta

SEQ ID NO: 560665 - DNA, 20 bp, Artificial
  CRISPR gRNA sequence
atattcaaacctgaacttat

SEQ ID NO: 560666 - DNA, 20 bp, Artificial
  CRISPR gRNA sequence
tattcaaacctgaacttatc

SEQ ID NO: 560667 - DNA, 20 bp, Artificial
  CRISPR gRNA sequence
aaacctgaacttatctgaga

SEQ ID NO: 560668 - DNA, 20 bp, Artificial
  CRISPR gRNA sequence
aacttatctgagaaaagaga

SEQ ID NO: 560669 - DNA, 20 bp, Artificial
  CRISPR gRNA sequence
atctgagaaaagagaaacgg

SEQ ID NO: 560670 - DNA, 20 bp, Artificial
  CRISPR gRNA sequence
tctgagaaaagagaaacggc

SEQ ID NO: 560671 - DNA, 20 bp, Artificial
  CRISPR gRNA sequence
agaaaagagaaacggctgca

SEQ ID NO: 560672 - DNA, 20 bp, Artificial
  CRISPR gRNA sequence
catcctggtttcacttacaa

SEQ ID NO: 560673 - DNA, 20 bp, Artificial
  CRISPR gRNA sequence
gtttcacttacaaccctgag

SEQ ID NO: 560674 - DNA, 20 bp, Artificial
  CRISPR gRNA sequence
cacttacaaccctgagatgg

SEQ ID NO: 560675 - DNA, 20 bp, Artificial
  CRISPR gRNA sequence
acttacaaccctgagatgga

SEQ ID NO: 560676 - DNA, 20 bp, Artificial
  CRISPR gRNA sequence
acaaccctgagatggaagtt

SEQ ID NO: 560677 - DNA, 20 bp, Artificial
  CRISPR gRNA sequence
caaccctgagatggaagttg

SEQ ID NO: 560678 - DNA, 20 bp, Artificial
  CRISPR gRNA sequence
agatggaagttgagatttgt

SEQ ID NO: 560679 - DNA, 20 bp, Artificial
  CRISPR gRNA sequence
agatttgtcattgcagaatt

SEQ ID NO: 560680 - DNA, 20 bp, Artificial
  CRISPR gRNA sequence
gtcattgcagaatttaaggg

SEQ ID NO: 560681 - DNA, 20 bp, Artificial
  CRISPR gRNA sequence
tcattgcagaatttaagggt

SEQ ID NO: 560682 - DNA, 20 bp, Artificial
  CRISPR gRNA sequence
cagaatttaagggtctgtgt

SEQ ID NO: 560683 - DNA, 20 bp, Artificial
  CRISPR gRNA sequence
aagggtctgtgtccttaagt

SEQ ID NO: 560684 - DNA, 20 bp, Artificial
  CRISPR gRNA sequence
agggtctgtgtccttaagta

SEQ ID NO: 560685 - DNA, 20 bp, Artificial
  CRISPR gRNA sequence
tgtccttaagtaaaaccttc

SEQ ID NO: 560686 - DNA, 20 bp, Artificial
  CRISPR gRNA sequence
aagtaaaaccttctggtcac

SEQ ID NO: 560687 - DNA, 20 bp, Artificial
  CRISPR gRNA sequence
agtaaaaccttctggtcacc

SEQ ID NO: 560688 - DNA, 20 bp, Artificial
  CRISPR gRNA sequence
ctggtcacccctcaagtaaa

SEQ ID NO: 560689 - DNA, 20 bp, Artificial
  CRISPR gRNA sequence
tggtcacccctcaagtaaag

SEQ ID NO: 560690 - DNA, 20 bp, Artificial
  CRISPR gRNA sequence
gtcacccctcaagtaaagct

SEQ ID NO: 560691 - DNA, 20 bp, Artificial
  CRISPR gRNA sequence
aagtaaagcttcaaaaaagc

SEQ ID NO: 560692 - DNA, 20 bp, Artificial
  CRISPR gRNA sequence
caaaaaagcttaggcacttg

SEQ ID NO: 560693 - DNA, 20 bp, Artificial
  CRISPR gRNA sequence
aaaaaagcttaggcacttgt

SEQ ID NO: 560694 - DNA, 20 bp, Artificial
  CRISPR gRNA sequence
aggcacttgtgcagaaacag

SEQ ID NO: 560695 - DNA, 20 bp, Artificial
  CRISPR gRNA sequence
ggcacttgtgcagaaacagc

SEQ ID NO: 560696 - DNA, 20 bp, Artificial
  CRISPR gRNA sequence
gtgcagaaacagcatgagaa

SEQ ID NO: 560697 - DNA, 20 bp, Artificial
  CRISPR gRNA sequence
tgcagaaacagcatgagaag

SEQ ID NO: 560698 - DNA, 20 bp, Artificial
  CRISPR gRNA sequence
acacatataagggctgattt

SEQ ID NO: 560699 - DNA, 20 bp, Artificial
  CRISPR gRNA sequence
cacatataagggctgattta

SEQ ID NO: 560700 - DNA, 20 bp, Artificial
  CRISPR gRNA sequence
atttatgcaaagtttctact

SEQ ID NO: 560701 - DNA, 20 bp, Artificial
  CRISPR gRNA sequence
atgcaaagtttctactttta

SEQ ID NO: 560702 - DNA, 20 bp, Artificial
  CRISPR gRNA sequence
tgcaaagtttctacttttaa

SEQ ID NO: 560703 - DNA, 20 bp, Artificial
  CRISPR gRNA sequence
ctacttttaaacagagaaac

SEQ ID NO: 560704 - DNA, 20 bp, Artificial
  CRISPR gRNA sequence
tacttttaaacagagaaacc

SEQ ID NO: 560705 - DNA, 20 bp, Artificial
  CRISPR gRNA sequence
cttttaaacagagaaaccaa

SEQ ID NO: 560706 - DNA, 20 bp, Artificial
  CRISPR gRNA sequence
ttaaacagagaaaccaatac

SEQ ID NO: 560707 - DNA, 20 bp, Artificial
  CRISPR gRNA sequence
taaacagagaaaccaatacc

SEQ ID NO: 560708 - DNA, 20 bp, Artificial
  CRISPR gRNA sequence
aaacagagaaaccaatacct

SEQ ID NO: 560709 - DNA, 20 bp, Artificial
  CRISPR gRNA sequence
aacagagaaaccaataccta

SEQ ID NO: 560710 - DNA, 20 bp, Artificial
  CRISPR gRNA sequence
ccctcaaagcctgtatttac

SEQ ID NO: 560711 - DNA, 20 bp, Artificial
  CRISPR gRNA sequence
aaagcctgtatttactaaag

SEQ ID NO: 560712 - DNA, 20 bp, Artificial
  CRISPR gRNA sequence
tatttactaaagaaatgtta

SEQ ID NO: 560713 - DNA, 20 bp, Artificial
  CRISPR gRNA sequence
actaaagaaatgttagagtg

SEQ ID NO: 560714 - DNA, 20 bp, Artificial
  CRISPR gRNA sequence
ctaaagaaatgttagagtga

SEQ ID NO: 560715 - DNA, 20 bp, Artificial
  CRISPR gRNA sequence
aagaaatgttagagtgacaa

SEQ ID NO: 560716 - DNA, 20 bp, Artificial
  CRISPR gRNA sequence
gagtgacaaggaggtcaata

SEQ ID NO: 560717 - DNA, 20 bp, Artificial
  CRISPR gRNA sequence
ttcaaatctggttcttaaaa

SEQ ID NO: 560718 - DNA, 20 bp, Artificial
  CRISPR gRNA sequence
aaatctggttcttaaaaaga

SEQ ID NO: 560719 - DNA, 20 bp, Artificial
  CRISPR gRNA sequence
gttcttaaaaagaggttcta

SEQ ID NO: 560720 - DNA, 20 bp, Artificial
  CRISPR gRNA sequence
ttaaaaagaggttctaagac

SEQ ID NO: 560721 - DNA, 20 bp, Artificial
  CRISPR gRNA sequence
aaaaagaggttctaagacta

SEQ ID NO: 560722 - DNA, 20 bp, Artificial
  CRISPR gRNA sequence
aaaagaggttctaagactat

SEQ ID NO: 560723 - DNA, 20 bp, Artificial
  CRISPR gRNA sequence
taagactattttaaaacttc

SEQ ID NO: 560724 - DNA, 20 bp, Artificial
  CRISPR gRNA sequence
agactattttaaaacttctg

SEQ ID NO: 560725 - DNA, 20 bp, Artificial
  CRISPR gRNA sequence
ttttaaaacttctgaaagat

SEQ ID NO: 560726 - DNA, 20 bp, Artificial
  CRISPR gRNA sequence
taaaacttctgaaagatgcc

SEQ ID NO: 560727 - DNA, 20 bp, Artificial
  CRISPR gRNA sequence
aaaacttctgaaagatgccc

SEQ ID NO: 560728 - DNA, 20 bp, Artificial
  CRISPR gRNA sequence
aaacttctgaaagatgccca

SEQ ID NO: 560729 - DNA, 20 bp, Artificial
  CRISPR gRNA sequence
ctgaaagatgcccatcaaaa

SEQ ID NO: 560730 - DNA, 20 bp, Artificial
  CRISPR gRNA sequence
tgaaagatgcccatcaaaat

SEQ ID NO: 560731 - DNA, 20 bp, Artificial
  CRISPR gRNA sequence
aaagatgcccatcaaaatta

SEQ ID NO: 560732 - DNA, 20 bp, Artificial
  CRISPR gRNA sequence
aaacaaaaaaacatagcaac

SEQ ID NO: 560733 - DNA, 20 bp, Artificial
  CRISPR gRNA sequence
gattagatccgggtttttta

SEQ ID NO: 560734 - DNA, 20 bp, Artificial
  CRISPR gRNA sequence
attagatccgggttttttaa

SEQ ID NO: 560735 - DNA, 20 bp, Artificial
  CRISPR gRNA sequence
gatccgggttttttaacaaa

SEQ ID NO: 560736 - DNA, 20 bp, Artificial
  CRISPR gRNA sequence
tttaacaaaagacactcttg

SEQ ID NO: 560737 - DNA, 20 bp, Artificial
  CRISPR gRNA sequence
ttaacaaaagacactcttgt

SEQ ID NO: 560738 - DNA, 20 bp, Artificial
  CRISPR gRNA sequence
taacaaaagacactcttgtg

SEQ ID NO: 560739 - DNA, 20 bp, Artificial
  CRISPR gRNA sequence
aacaaaagacactcttgtga

SEQ ID NO: 560740 - DNA, 20 bp, Artificial
  CRISPR gRNA sequence
acaaaagacactcttgtgac

SEQ ID NO: 560741 - DNA, 20 bp, Artificial
  CRISPR gRNA sequence
ttgtgacaagtggggaaatc

SEQ ID NO: 560742 - DNA, 20 bp, Artificial
  CRISPR gRNA sequence
gtgacaagtggggaaatctg

SEQ ID NO: 560743 - DNA, 20 bp, Artificial
  CRISPR gRNA sequence
tgacaagtggggaaatctga

SEQ ID NO: 560744 - DNA, 20 bp, Artificial
  CRISPR gRNA sequence
aatacgggtaaaagttaggt

SEQ ID NO: 560745 - DNA, 20 bp, Artificial
  CRISPR gRNA sequence
ggtgatgttacaggattagt

SEQ ID NO: 560746 - DNA, 20 bp, Artificial
  CRISPR gRNA sequence
caggattagtgttaatattt

SEQ ID NO: 560747 - DNA, 20 bp, Artificial
  CRISPR gRNA sequence
gtgttaatatttatagatgt

SEQ ID NO: 560748 - DNA, 20 bp, Artificial
  CRISPR gRNA sequence
atatttatagatgttatgat

SEQ ID NO: 560749 - DNA, 20 bp, Artificial
  CRISPR gRNA sequence
atagatgttatgatgttatt

SEQ ID NO: 560750 - DNA, 20 bp, Artificial
  CRISPR gRNA sequence
tagatgttatgatgttattg

SEQ ID NO: 560751 - DNA, 20 bp, Artificial
  CRISPR gRNA sequence
tgatgttattgagattatgc

SEQ ID NO: 560752 - DNA, 20 bp, Artificial
  CRISPR gRNA sequence
ttgagattatgcaaaagtgt

SEQ ID NO: 560753 - DNA, 20 bp, Artificial
  CRISPR gRNA sequence
agattatgcaaaagtgtcta

SEQ ID NO: 560754 - DNA, 20 bp, Artificial
  CRISPR gRNA sequence
tgcaaaagtgtctaggagtg

SEQ ID NO: 560755 - DNA, 20 bp, Artificial
  CRISPR gRNA sequence
ggagtgaaatgtgggtacct

SEQ ID NO: 560756 - DNA, 20 bp, Artificial
  CRISPR gRNA sequence
gagaatgtaaatataataat

SEQ ID NO: 560757 - DNA, 20 bp, Artificial
  CRISPR gRNA sequence
ataataaatatgtcaataaa

SEQ ID NO: 560758 - DNA, 20 bp, Artificial
  CRISPR gRNA sequence
ccattgtaaattctatgtcc

SEQ ID NO: 560759 - DNA, 20 bp, Artificial
  CRISPR gRNA sequence
taaattctatgtcccaaaga

SEQ ID NO: 560760 - DNA, 20 bp, Artificial
  CRISPR gRNA sequence
tatgtcccaaagaagcaccc

SEQ ID NO: 560761 - DNA, 20 bp, Artificial
  CRISPR gRNA sequence
tgtcccaaagaagcacccct

SEQ ID NO: 560762 - DNA, 20 bp, Artificial
  CRISPR gRNA sequence
accattacaaattatgatat

SEQ ID NO: 560763 - DNA, 20 bp, Artificial
  CRISPR gRNA sequence
caaattatgatattaaatac

SEQ ID NO: 560764 - DNA, 20 bp, Artificial
  CRISPR gRNA sequence
tgatattaaatacaattttg

SEQ ID NO: 560765 - DNA, 20 bp, Artificial
  CRISPR gRNA sequence
aatacaattttgcatgactg

SEQ ID NO: 560766 - DNA, 20 bp, Artificial
  CRISPR gRNA sequence
tgcatgactggtaattgtgc

SEQ ID NO: 560767 - DNA, 20 bp, Artificial
  CRISPR gRNA sequence
gcatgactggtaattgtgct

SEQ ID NO: 560768 - DNA, 20 bp, Artificial
  CRISPR gRNA sequence
catgactggtaattgtgctg

SEQ ID NO: 560769 - DNA, 20 bp, Artificial
  CRISPR gRNA sequence
gtaattgtgctgacctatat

SEQ ID NO: 560770 - DNA, 20 bp, Artificial
  CRISPR gRNA sequence
tgctgacctatatttcccat

SEQ ID NO: 560771 - DNA, 20 bp, Artificial
  CRISPR gRNA sequence
acctatatttcccatgtttt

SEQ ID NO: 560772 - DNA, 20 bp, Artificial
  CRISPR gRNA sequence
tatttcccatgttttagcag

SEQ ID NO: 560773 - DNA, 20 bp, Artificial
  CRISPR gRNA sequence
cccatgttttagcagaattt

SEQ ID NO: 560774 - DNA, 20 bp, Artificial
  CRISPR gRNA sequence
ccatgttttagcagaatttc

SEQ ID NO: 560775 - DNA, 20 bp, Artificial
  CRISPR gRNA sequence
tagcagaatttcattggaca

SEQ ID NO: 560776 - DNA, 20 bp, Artificial
  CRISPR gRNA sequence
agcagaatttcattggacaa

SEQ ID NO: 560777 - DNA, 20 bp, Artificial
  CRISPR gRNA sequence
gcagaatttcattggacaat

SEQ ID NO: 560778 - DNA, 20 bp, Artificial
  CRISPR gRNA sequence
cattggacaatgtatacatg

SEQ ID NO: 560779 - DNA, 20 bp, Artificial
  CRISPR gRNA sequence
attggacaatgtatacatgt

SEQ ID NO: 560780 - DNA, 20 bp, Artificial
  CRISPR gRNA sequence
gacaatgtatacatgttgga

SEQ ID NO: 560781 - DNA, 20 bp, Artificial
  CRISPR gRNA sequence
gatataagaaatcagtagta

SEQ ID NO: 560782 - DNA, 20 bp, Artificial
  CRISPR gRNA sequence
atcttcaaaaagttgcttag

SEQ ID NO: 560783 - DNA, 20 bp, Artificial
  CRISPR gRNA sequence
caaaaagttgcttagtggat

SEQ ID NO: 560784 - DNA, 20 bp, Artificial
  CRISPR gRNA sequence
aaaaagttgcttagtggatc

SEQ ID NO: 560785 - DNA, 20 bp, Artificial
  CRISPR gRNA sequence
cttagtggatctcaggctag

SEQ ID NO: 560786 - DNA, 20 bp, Artificial
  CRISPR gRNA sequence
agtggatctcaggctaggga

SEQ ID NO: 560787 - DNA, 20 bp, Artificial
  CRISPR gRNA sequence
gtggatctcaggctagggat

SEQ ID NO: 560788 - DNA, 20 bp, Artificial
  CRISPR gRNA sequence
aggctagggatacaacagag

SEQ ID NO: 560789 - DNA, 20 bp, Artificial
  CRISPR gRNA sequence
gggatacaacagagcatata

SEQ ID NO: 560790 - DNA, 20 bp, Artificial
  CRISPR gRNA sequence
tgattcagagagaatcaaag

SEQ ID NO: 560791 - DNA, 20 bp, Artificial
  CRISPR gRNA sequence
attcagagagaatcaaagtt

SEQ ID NO: 560792 - DNA, 20 bp, Artificial
  CRISPR gRNA sequence
agagagaatcaaagttcaag

SEQ ID NO: 560793 - DNA, 20 bp, Artificial
  CRISPR gRNA sequence
aagttcactctgccacttat

SEQ ID NO: 560794 - DNA, 20 bp, Artificial
  CRISPR gRNA sequence
actctgccacttatttgctg

SEQ ID NO: 560795 - DNA, 20 bp, Artificial
  CRISPR gRNA sequence
tgccacttatttgctgtgtg

SEQ ID NO: 560796 - DNA, 20 bp, Artificial
  CRISPR gRNA sequence
ccacttatttgctgtgtgaa

SEQ ID NO: 560797 - DNA, 20 bp, Artificial
  CRISPR gRNA sequence
atttgctgtgtgaacttgga

SEQ ID NO: 560798 - DNA, 20 bp, Artificial
  CRISPR gRNA sequence
tttgctgtgtgaacttggac

SEQ ID NO: 560799 - DNA, 20 bp, Artificial
  CRISPR gRNA sequence
gctgtgtgaacttggacaca

SEQ ID NO: 560800 - DNA, 20 bp, Artificial
  CRISPR gRNA sequence
ctgtgtgaacttggacacat

SEQ ID NO: 560801 - DNA, 20 bp, Artificial
  CRISPR gRNA sequence
tgtgaacttggacacattac

SEQ ID NO: 560802 - DNA, 20 bp, Artificial
  CRISPR gRNA sequence
ggacacattactgaacctac

SEQ ID NO: 560803 - DNA, 20 bp, Artificial
  CRISPR gRNA sequence
gacacattactgaacctacc

SEQ ID NO: 560804 - DNA, 20 bp, Artificial
  CRISPR gRNA sequence
ctgaacctacctaagctttg

SEQ ID NO: 560805 - DNA, 20 bp, Artificial
  CRISPR gRNA sequence
aacctacctaagctttgttc

SEQ ID NO: 560806 - DNA, 20 bp, Artificial
  CRISPR gRNA sequence
cctaagctttgttctcctat

SEQ ID NO: 560807 - DNA, 20 bp, Artificial
  CRISPR gRNA sequence
agctttgttctcctattaaa

SEQ ID NO: 560808 - DNA, 20 bp, Artificial
  CRISPR gRNA sequence
tgttctcctattaaatgttc

SEQ ID NO: 560809 - DNA, 20 bp, Artificial
  CRISPR gRNA sequence
gttctcctattaaatgttcc

SEQ ID NO: 560810 - DNA, 20 bp, Artificial
  CRISPR gRNA sequence
ttctcctattaaatgttccc

SEQ ID NO: 560811 - DNA, 20 bp, Artificial
  CRISPR gRNA sequence
tcctattaaatgttccctat

SEQ ID NO: 560812 - DNA, 20 bp, Artificial
  CRISPR gRNA sequence
ctattaaatgttccctatgt

SEQ ID NO: 560813 - DNA, 20 bp, Artificial
  CRISPR gRNA sequence
ttaaatgttccctatgtaat

SEQ ID NO: 560814 - DNA, 20 bp, Artificial
  CRISPR gRNA sequence
aatgttccctatgtaataaa

SEQ ID NO: 560815 - DNA, 20 bp, Artificial
  CRISPR gRNA sequence
cctatgtaataaaatcagtg

SEQ ID NO: 560816 - DNA, 20 bp, Artificial
  CRISPR gRNA sequence
tgtaataaaatcagtgtgac

SEQ ID NO: 560817 - DNA, 20 bp, Artificial
  CRISPR gRNA sequence
aataaaaacatctcaaatct

SEQ ID NO: 560818 - DNA, 20 bp, Artificial
  CRISPR gRNA sequence
aaatctgaagcatagctcct

SEQ ID NO: 560819 - DNA, 20 bp, Artificial
  CRISPR gRNA sequence
aagcatagctcctggcacag

SEQ ID NO: 560820 - DNA, 20 bp, Artificial
  CRISPR gRNA sequence
ctggcacagagcaggtactt

SEQ ID NO: 560821 - DNA, 20 bp, Artificial
  CRISPR gRNA sequence
gcacagagcaggtacttacc

SEQ ID NO: 560822 - DNA, 20 bp, Artificial
  CRISPR gRNA sequence
acctcctagtggctattatt

SEQ ID NO: 560823 - DNA, 20 bp, Artificial
  CRISPR gRNA sequence
cctcctagtggctattatta

SEQ ID NO: 560824 - DNA, 20 bp, Artificial
  CRISPR gRNA sequence
ctagtggctattattactta

SEQ ID NO: 560825 - DNA, 20 bp, Artificial
  CRISPR gRNA sequence
gtggctattattacttacac

SEQ ID NO: 560826 - DNA, 20 bp, Artificial
  CRISPR gRNA sequence
ttattacttacactctgtta

SEQ ID NO: 560827 - DNA, 20 bp, Artificial
  CRISPR gRNA sequence
ttacttacactctgttataa

SEQ ID NO: 560828 - DNA, 20 bp, Artificial
  CRISPR gRNA sequence
cttacactctgttataacac

SEQ ID NO: 560829 - DNA, 20 bp, Artificial
  CRISPR gRNA sequence
acactctgttataacactgg

SEQ ID NO: 560830 - DNA, 20 bp, Artificial
  CRISPR gRNA sequence
cactctgttataacactggg

SEQ ID NO: 560831 - DNA, 20 bp, Artificial
  CRISPR gRNA sequence
tgttataacactgggcctag

SEQ ID NO: 560832 - DNA, 20 bp, Artificial
  CRISPR gRNA sequence
ttataacactgggcctagtt

SEQ ID NO: 560833 - DNA, 20 bp, Artificial
  CRISPR gRNA sequence
taacactgggcctagttttc

SEQ ID NO: 560834 - DNA, 20 bp, Artificial
  CRISPR gRNA sequence
ggcctagttttcctatagga

SEQ ID NO: 560835 - DNA, 20 bp, Artificial
  CRISPR gRNA sequence
gttttcctataggaacacac

SEQ ID NO: 560836 - DNA, 20 bp, Artificial
  CRISPR gRNA sequence
tcctataggaacacacaaca

SEQ ID NO: 560837 - DNA, 20 bp, Artificial
  CRISPR gRNA sequence
cctataggaacacacaacac

SEQ ID NO: 560838 - DNA, 20 bp, Artificial
  CRISPR gRNA sequence
ctataggaacacacaacact

SEQ ID NO: 560839 - DNA, 20 bp, Artificial
  CRISPR gRNA sequence
taggaacacacaacactatt

SEQ ID NO: 560840 - DNA, 20 bp, Artificial
  CRISPR gRNA sequence
ttttaacttggattatcttt

SEQ ID NO: 560841 - DNA, 20 bp, Artificial
  CRISPR gRNA sequence
taacttggattatctttgct

SEQ ID NO: 560842 - DNA, 20 bp, Artificial
  CRISPR gRNA sequence
aacttggattatctttgcta

SEQ ID NO: 560843 - DNA, 20 bp, Artificial
  CRISPR gRNA sequence
acttggattatctttgctaa

SEQ ID NO: 560844 - DNA, 20 bp, Artificial
  CRISPR gRNA sequence
ggattatctttgctaaataa

SEQ ID NO: 560845 - DNA, 20 bp, Artificial
  CRISPR gRNA sequence
gattatctttgctaaataaa

SEQ ID NO: 560846 - DNA, 20 bp, Artificial
  CRISPR gRNA sequence
tctttgctaaataaaaaaac

SEQ ID NO: 560847 - DNA, 20 bp, Artificial
  CRISPR gRNA sequence
tgctaaataaaaaaacacag

SEQ ID NO: 560848 - DNA, 20 bp, Artificial
  CRISPR gRNA sequence
gctaaataaaaaaacacaga

SEQ ID NO: 560849 - DNA, 20 bp, Artificial
  CRISPR gRNA sequence
ctaaataaaaaaacacagac

SEQ ID NO: 560850 - DNA, 20 bp, Artificial
  CRISPR gRNA sequence
aataaaaaaacacagactgt

SEQ ID NO: 560851 - DNA, 20 bp, Artificial
  CRISPR gRNA sequence
tctaagtctcaactccagca

SEQ ID NO: 560852 - DNA, 20 bp, Artificial
  CRISPR gRNA sequence
agtctcaactccagcaaagc

SEQ ID NO: 560853 - DNA, 20 bp, Artificial
  CRISPR gRNA sequence
aactccagcaaagcacatga

SEQ ID NO: 560854 - DNA, 20 bp, Artificial
  CRISPR gRNA sequence
cagcaaagcacatgaacaag

SEQ ID NO: 560855 - DNA, 20 bp, Artificial
  CRISPR gRNA sequence
acataataatgtgagataat

SEQ ID NO: 560856 - DNA, 20 bp, Artificial
  CRISPR gRNA sequence
caaatggagaaatgctggac

SEQ ID NO: 560857 - DNA, 20 bp, Artificial
  CRISPR gRNA sequence
aaatggagaaatgctggaca

SEQ ID NO: 560858 - DNA, 20 bp, Artificial
  CRISPR gRNA sequence
gacaaatacattgtcatcta

SEQ ID NO: 560859 - DNA, 20 bp, Artificial
  CRISPR gRNA sequence
tcatctaatgttcagattca

SEQ ID NO: 560860 - DNA, 20 bp, Artificial
  CRISPR gRNA sequence
atgttcagattcaacaatct

SEQ ID NO: 560861 - DNA, 20 bp, Artificial
  CRISPR gRNA sequence
agattcaacaatctttacta

SEQ ID NO: 560862 - DNA, 20 bp, Artificial
  CRISPR gRNA sequence
aacaatctttactattaaaa

SEQ ID NO: 560863 - DNA, 20 bp, Artificial
  CRISPR gRNA sequence
tactattaaaaaaaaacaga

SEQ ID NO: 560864 - DNA, 20 bp, Artificial
  CRISPR gRNA sequence
actattaaaaaaaaacagat

SEQ ID NO: 560865 - DNA, 20 bp, Artificial
  CRISPR gRNA sequence
ctattaaaaaaaaacagatc

SEQ ID NO: 560866 - DNA, 20 bp, Artificial
  CRISPR gRNA sequence
ttaaaaaaaaacagatcaat

SEQ ID NO: 560867 - DNA, 20 bp, Artificial
  CRISPR gRNA sequence
aaaaaaaacagatcaatata

SEQ ID NO: 560868 - DNA, 20 bp, Artificial
  CRISPR gRNA sequence
taaaaaataatacatgactt

SEQ ID NO: 560869 - DNA, 20 bp, Artificial
  CRISPR gRNA sequence
aaaaaataatacatgacttc

SEQ ID NO: 560870 - DNA, 20 bp, Artificial
  CRISPR gRNA sequence
aaaaataatacatgacttct

SEQ ID NO: 560871 - DNA, 20 bp, Artificial
  CRISPR gRNA sequence
ctgcatacaaggaacttaaa

SEQ ID NO: 560872 - DNA, 20 bp, Artificial
  CRISPR gRNA sequence
tgcatacaaggaacttaaaa

SEQ ID NO: 560873 - DNA, 20 bp, Artificial
  CRISPR gRNA sequence
catacaaggaacttaaaatc

SEQ ID NO: 560874 - DNA, 20 bp, Artificial
  CRISPR gRNA sequence
aaaatctagttatgcagata

SEQ ID NO: 560875 - DNA, 20 bp, Artificial
  CRISPR gRNA sequence
aaatctagttatgcagatag

SEQ ID NO: 560876 - DNA, 20 bp, Artificial
  CRISPR gRNA sequence
gttatgcagatagttggcaa

SEQ ID NO: 560877 - DNA, 20 bp, Artificial
  CRISPR gRNA sequence
tgcagatagttggcaataaa

SEQ ID NO: 560878 - DNA, 20 bp, Artificial
  CRISPR gRNA sequence
gcaataaaggatctgtaaaa

SEQ ID NO: 560879 - DNA, 20 bp, Artificial
  CRISPR gRNA sequence
taaaatgtcaacaacagcag

SEQ ID NO: 560880 - DNA, 20 bp, Artificial
  CRISPR gRNA sequence
tgttaataataaaatagttc

SEQ ID NO: 560881 - DNA, 20 bp, Artificial
  CRISPR gRNA sequence
ttaataataaaatagttcct

SEQ ID NO: 560882 - DNA, 20 bp, Artificial
  CRISPR gRNA sequence
ataataaaatagttcctacc

SEQ ID NO: 560883 - DNA, 20 bp, Artificial
  CRISPR gRNA sequence
ctacctttttattttttatt

SEQ ID NO: 560884 - DNA, 20 bp, Artificial
  CRISPR gRNA sequence
cctttttattttttattttt

SEQ ID NO: 560885 - DNA, 20 bp, Artificial
  CRISPR gRNA sequence
tttattttttatttttttgc

SEQ ID NO: 560886 - DNA, 20 bp, Artificial
  CRISPR gRNA sequence
ttattttttatttttttgct

SEQ ID NO: 560887 - DNA, 20 bp, Artificial
  CRISPR gRNA sequence
tattttttatttttttgctc

SEQ ID NO: 560888 - DNA, 20 bp, Artificial
  CRISPR gRNA sequence
attttttatttttttgctct

SEQ ID NO: 560889 - DNA, 20 bp, Artificial
  CRISPR gRNA sequence
ttttttatttttttgctctg

SEQ ID NO: 560890 - DNA, 20 bp, Artificial
  CRISPR gRNA sequence
tttatttttttgctctgtta

SEQ ID NO: 560891 - DNA, 20 bp, Artificial
  CRISPR gRNA sequence
ttatttttttgctctgttac

SEQ ID NO: 560892 - DNA, 20 bp, Artificial
  CRISPR gRNA sequence
tatttttttgctctgttacc

SEQ ID NO: 560893 - DNA, 20 bp, Artificial
  CRISPR gRNA sequence
atttttttgctctgttaccc

SEQ ID NO: 560894 - DNA, 20 bp, Artificial
  CRISPR gRNA sequence
tttttttgctctgttaccca

SEQ ID NO: 560895 - DNA, 20 bp, Artificial
  CRISPR gRNA sequence
ttttgctctgttacccaggc

SEQ ID NO: 560896 - DNA, 20 bp, Artificial
  CRISPR gRNA sequence
tttgctctgttacccaggct

SEQ ID NO: 560897 - DNA, 20 bp, Artificial
  CRISPR gRNA sequence
ttgctctgttacccaggctg

SEQ ID NO: 560898 - DNA, 20 bp, Artificial
  CRISPR gRNA sequence
tgctctgttacccaggctgg

SEQ ID NO: 560899 - DNA, 20 bp, Artificial
  CRISPR gRNA sequence
gctctgttacccaggctgga

SEQ ID NO: 560900 - DNA, 20 bp, Artificial
  CRISPR gRNA sequence
ctctgttacccaggctggaa

SEQ ID NO: 560901 - DNA, 20 bp, Artificial
  CRISPR gRNA sequence
tgttacccaggctggaatgc

SEQ ID NO: 560902 - DNA, 20 bp, Artificial
  CRISPR gRNA sequence
ttacccaggctggaatgcag

SEQ ID NO: 560903 - DNA, 20 bp, Artificial
  CRISPR gRNA sequence
cccaggctggaatgcagttg

SEQ ID NO: 560904 - DNA, 20 bp, Artificial
  CRISPR gRNA sequence
gaatgcagttgtgtcatcat

SEQ ID NO: 560905 - DNA, 20 bp, Artificial
  CRISPR gRNA sequence
tgtcatcatggctcactgca

SEQ ID NO: 560906 - DNA, 20 bp, Artificial
  CRISPR gRNA sequence
actgcagcctcaaattccca

SEQ ID NO: 560907 - DNA, 20 bp, Artificial
  CRISPR gRNA sequence
cagcctcaaattcccagact

SEQ ID NO: 560908 - DNA, 20 bp, Artificial
  CRISPR gRNA sequence
aaattcccagactcaagcaa

SEQ ID NO: 560909 - DNA, 20 bp, Artificial
  CRISPR gRNA sequence
ccagactcaagcaattgcca

SEQ ID NO: 560910 - DNA, 20 bp, Artificial
  CRISPR gRNA sequence
aagcaattgccaggctcatc

SEQ ID NO: 560911 - DNA, 20 bp, Artificial
  CRISPR gRNA sequence
ccaggctcatctcagcctcc

SEQ ID NO: 560912 - DNA, 20 bp, Artificial
  CRISPR gRNA sequence
atctcagcctcctgagtagc

SEQ ID NO: 560913 - DNA, 20 bp, Artificial
  CRISPR gRNA sequence
agcctcctgagtagctggga

SEQ ID NO: 560914 - DNA, 20 bp, Artificial
  CRISPR gRNA sequence
ctgagtagctgggactacag

SEQ ID NO: 560915 - DNA, 20 bp, Artificial
  CRISPR gRNA sequence
agtagctgggactacaggcg

SEQ ID NO: 560916 - DNA, 20 bp, Artificial
  CRISPR gRNA sequence
ggactacaggcgtgcaccac

SEQ ID NO: 560917 - DNA, 20 bp, Artificial
  CRISPR gRNA sequence
caggcgtgcaccaccacacc

SEQ ID NO: 560918 - DNA, 20 bp, Artificial
  CRISPR gRNA sequence
gctaactttttgtagagatg

SEQ ID NO: 560919 - DNA, 20 bp, Artificial
  CRISPR gRNA sequence
actttttgtagagatggggt

SEQ ID NO: 560920 - DNA, 20 bp, Artificial
  CRISPR gRNA sequence
tttgtagagatggggtgtat

SEQ ID NO: 560921 - DNA, 20 bp, Artificial
  CRISPR gRNA sequence
ttgtagagatggggtgtatt

SEQ ID NO: 560922 - DNA, 20 bp, Artificial
  CRISPR gRNA sequence
tgtagagatggggtgtatta

SEQ ID NO: 560923 - DNA, 20 bp, Artificial
  CRISPR gRNA sequence
gtagagatggggtgtattag

SEQ ID NO: 560924 - DNA, 20 bp, Artificial
  CRISPR gRNA sequence
tagagatggggtgtattagt

SEQ ID NO: 560925 - DNA, 20 bp, Artificial
  CRISPR gRNA sequence
gtccattctcgcactgctaa

SEQ ID NO: 560926 - DNA, 20 bp, Artificial
  CRISPR gRNA sequence
tcgcactgctaataatgaca

SEQ ID NO: 560927 - DNA, 20 bp, Artificial
  CRISPR gRNA sequence
gcactgctaataatgacata

SEQ ID NO: 560928 - DNA, 20 bp, Artificial
  CRISPR gRNA sequence
ctaataatgacatacatgag

SEQ ID NO: 560929 - DNA, 20 bp, Artificial
  CRISPR gRNA sequence
ataatgacatacatgagact

SEQ ID NO: 560930 - DNA, 20 bp, Artificial
  CRISPR gRNA sequence
ggtaatttatcaaggaaaga

SEQ ID NO: 560931 - DNA, 20 bp, Artificial
  CRISPR gRNA sequence
atcaaggaaagaggctcaat

SEQ ID NO: 560932 - DNA, 20 bp, Artificial
  CRISPR gRNA sequence
tcaaggaaagaggctcaatg

SEQ ID NO: 560933 - DNA, 20 bp, Artificial
  CRISPR gRNA sequence
aatggactcacagttccaca

SEQ ID NO: 560934 - DNA, 20 bp, Artificial
  CRISPR gRNA sequence
acagttccacatggccaggg

SEQ ID NO: 560935 - DNA, 20 bp, Artificial
  CRISPR gRNA sequence
cacatggccagggaaacctc

SEQ ID NO: 560936 - DNA, 20 bp, Artificial
  CRISPR gRNA sequence
acaatcatggcagaaggcaa

SEQ ID NO: 560937 - DNA, 20 bp, Artificial
  CRISPR gRNA sequence
aatggtggcaggcaagagag

SEQ ID NO: 560938 - DNA, 20 bp, Artificial
  CRISPR gRNA sequence
atggtggcaggcaagagaga

SEQ ID NO: 560939 - DNA, 20 bp, Artificial
  CRISPR gRNA sequence
ccctttatgaaaccatcaga

SEQ ID NO: 560940 - DNA, 20 bp, Artificial
  CRISPR gRNA sequence
tatgaaaccatcagatcttg

SEQ ID NO: 560941 - DNA, 20 bp, Artificial
  CRISPR gRNA sequence
atgaaaccatcagatcttgt

SEQ ID NO: 560942 - DNA, 20 bp, Artificial
  CRISPR gRNA sequence
tgaaaccatcagatcttgtg

SEQ ID NO: 560943 - DNA, 20 bp, Artificial
  CRISPR gRNA sequence
gtgagacttattcactatca

SEQ ID NO: 560944 - DNA, 20 bp, Artificial
  CRISPR gRNA sequence
tgagacttattcactatcac

SEQ ID NO: 560945 - DNA, 20 bp, Artificial
  CRISPR gRNA sequence
attcactatcacaagaacag

SEQ ID NO: 560946 - DNA, 20 bp, Artificial
  CRISPR gRNA sequence
ttcactatcacaagaacagt

SEQ ID NO: 560947 - DNA, 20 bp, Artificial
  CRISPR gRNA sequence
actatcacaagaacagtata

SEQ ID NO: 560948 - DNA, 20 bp, Artificial
  CRISPR gRNA sequence
tcacaagaacagtatagagg

SEQ ID NO: 560949 - DNA, 20 bp, Artificial
  CRISPR gRNA sequence
ccctcatgattcaattatct

SEQ ID NO: 560950 - DNA, 20 bp, Artificial
  CRISPR gRNA sequence
atgattcaattatctccacc

SEQ ID NO: 560951 - DNA, 20 bp, Artificial
  CRISPR gRNA sequence
aattatctccacctggccct

SEQ ID NO: 560952 - DNA, 20 bp, Artificial
  CRISPR gRNA sequence
tctccacctggccctgccct

SEQ ID NO: 560953 - DNA, 20 bp, Artificial
  CRISPR gRNA sequence
cacctggccctgcccttgac

SEQ ID NO: 560954 - DNA, 20 bp, Artificial
  CRISPR gRNA sequence
gccctgcccttgacacacgg

SEQ ID NO: 560955 - DNA, 20 bp, Artificial
  CRISPR gRNA sequence
cccttgacacacggggatta

SEQ ID NO: 560956 - DNA, 20 bp, Artificial
  CRISPR gRNA sequence
gacacacggggattattaca

SEQ ID NO: 560957 - DNA, 20 bp, Artificial
  CRISPR gRNA sequence
acacacggggattattacaa

SEQ ID NO: 560958 - DNA, 20 bp, Artificial
  CRISPR gRNA sequence
ttacaattcaaggtgagatt

SEQ ID NO: 560959 - DNA, 20 bp, Artificial
  CRISPR gRNA sequence
caattcaaggtgagatttgg

SEQ ID NO: 560960 - DNA, 20 bp, Artificial
  CRISPR gRNA sequence
aaggtgagatttgggtgggg

SEQ ID NO: 560961 - DNA, 20 bp, Artificial
  CRISPR gRNA sequence
gggtggggacacagccaaac

SEQ ID NO: 560962 - DNA, 20 bp, Artificial
  CRISPR gRNA sequence
ggtggggacacagccaaacc

SEQ ID NO: 560963 - DNA, 20 bp, Artificial
  CRISPR gRNA sequence
caccccggcccctcccaaat

SEQ ID NO: 560964 - DNA, 20 bp, Artificial
  CRISPR gRNA sequence
ccaaatctcatgtcctcaca

SEQ ID NO: 560965 - DNA, 20 bp, Artificial
  CRISPR gRNA sequence
atgtcctcacatttcaaaac

SEQ ID NO: 560966 - DNA, 20 bp, Artificial
  CRISPR gRNA sequence
acatttcaaaacacaataat

SEQ ID NO: 560967 - DNA, 20 bp, Artificial
  CRISPR gRNA sequence
caaaacacaataatgccctt

SEQ ID NO: 560968 - DNA, 20 bp, Artificial
  CRISPR gRNA sequence
aaaacacaataatgcccttc

SEQ ID NO: 560969 - DNA, 20 bp, Artificial
  CRISPR gRNA sequence
ccaacagtccctcaaaatct

SEQ ID NO: 560970 - DNA, 20 bp, Artificial
  CRISPR gRNA sequence
caacagtccctcaaaatctt

SEQ ID NO: 560971 - DNA, 20 bp, Artificial
  CRISPR gRNA sequence
aaaatcttaacttattccag

SEQ ID NO: 560972 - DNA, 20 bp, Artificial
  CRISPR gRNA sequence
aacttattccagcattaatc

SEQ ID NO: 560973 - DNA, 20 bp, Artificial
  CRISPR gRNA sequence
acttattccagcattaatcc

SEQ ID NO: 560974 - DNA, 20 bp, Artificial
  CRISPR gRNA sequence
attccagcattaatccaaaa

SEQ ID NO: 560975 - DNA, 20 bp, Artificial
  CRISPR gRNA sequence
ttccagcattaatccaaaag

SEQ ID NO: 560976 - DNA, 20 bp, Artificial
  CRISPR gRNA sequence
cagcattaatccaaaagtct

SEQ ID NO: 560977 - DNA, 20 bp, Artificial
  CRISPR gRNA sequence
atccaaaagtctaaatccaa

SEQ ID NO: 560978 - DNA, 20 bp, Artificial
  CRISPR gRNA sequence
aatccaaagtctcatcggag

SEQ ID NO: 560979 - DNA, 20 bp, Artificial
  CRISPR gRNA sequence
atcggagataaggcaagtac

SEQ ID NO: 560980 - DNA, 20 bp, Artificial
  CRISPR gRNA sequence
ccacctatgagcctgtaaaa

SEQ ID NO: 560981 - DNA, 20 bp, Artificial
  CRISPR gRNA sequence
cacctatgagcctgtaaaat

SEQ ID NO: 560982 - DNA, 20 bp, Artificial
  CRISPR gRNA sequence
tgagcctgtaaaatcaaagg

SEQ ID NO: 560983 - DNA, 20 bp, Artificial
  CRISPR gRNA sequence
taaaatcaaaggcaagttag

SEQ ID NO: 560984 - DNA, 20 bp, Artificial
  CRISPR gRNA sequence
gttacttcctagatacaatg

SEQ ID NO: 560985 - DNA, 20 bp, Artificial
  CRISPR gRNA sequence
cttcctagatacaatggggg

SEQ ID NO: 560986 - DNA, 20 bp, Artificial
  CRISPR gRNA sequence
cctagatacaatgggggtac

SEQ ID NO: 560987 - DNA, 20 bp, Artificial
  CRISPR gRNA sequence
ctagatacaatgggggtaca

SEQ ID NO: 560988 - DNA, 20 bp, Artificial
  CRISPR gRNA sequence
gatacaatgggggtacaggt

SEQ ID NO: 560989 - DNA, 20 bp, Artificial
  CRISPR gRNA sequence
agtaaatatatccattccaa

SEQ ID NO: 560990 - DNA, 20 bp, Artificial
  CRISPR gRNA sequence
caaatgggagaaattgtcca

SEQ ID NO: 560991 - DNA, 20 bp, Artificial
  CRISPR gRNA sequence
tccaaaacaaaagggctaca

SEQ ID NO: 560992 - DNA, 20 bp, Artificial
  CRISPR gRNA sequence
caggccccatgcaagtccta

SEQ ID NO: 560993 - DNA, 20 bp, Artificial
  CRISPR gRNA sequence
aatccaatagggcagtctta

SEQ ID NO: 560994 - DNA, 20 bp, Artificial
  CRISPR gRNA sequence
aaaccttaaagttccaaaat

SEQ ID NO: 560995 - DNA, 20 bp, Artificial
  CRISPR gRNA sequence
aaccttaaagttccaaaatg

SEQ ID NO: 560996 - DNA, 20 bp, Artificial
  CRISPR gRNA sequence
aaagttccaaaatgatctcc

SEQ ID NO: 560997 - DNA, 20 bp, Artificial
  CRISPR gRNA sequence
aagttccaaaatgatctcct

SEQ ID NO: 560998 - DNA, 20 bp, Artificial
  CRISPR gRNA sequence
caaaatgatctcctttgact

SEQ ID NO: 560999 - DNA, 20 bp, Artificial
  CRISPR gRNA sequence
ctttgactccatgcctcaca

SEQ ID NO: 561000 - DNA, 20 bp, Artificial
  CRISPR gRNA sequence
tgactccatgcctcacatcc

SEQ ID NO: 561001 - DNA, 20 bp, Artificial
  CRISPR gRNA sequence
gactccatgcctcacatcca

SEQ ID NO: 561002 - DNA, 20 bp, Artificial
  CRISPR gRNA sequence
actccatgcctcacatccag

SEQ ID NO: 561003 - DNA, 20 bp, Artificial
  CRISPR gRNA sequence
catgcctcacatccaggtga

SEQ ID NO: 561004 - DNA, 20 bp, Artificial
  CRISPR gRNA sequence
acatccaggtgacgcaagag

SEQ ID NO: 561005 - DNA, 20 bp, Artificial
  CRISPR gRNA sequence
ccacaaccttgggcagctct

SEQ ID NO: 561006 - DNA, 20 bp, Artificial
  CRISPR gRNA sequence
gggcagctcttcccctgtgg

SEQ ID NO: 561007 - DNA, 20 bp, Artificial
  CRISPR gRNA sequence
ggcagctcttcccctgtggc

SEQ ID NO: 561008 - DNA, 20 bp, Artificial
  CRISPR gRNA sequence
ttcccctgtggctttgcagg

SEQ ID NO: 561009 - DNA, 20 bp, Artificial
  CRISPR gRNA sequence
cccctgtggctttgcagggt

SEQ ID NO: 561010 - DNA, 20 bp, Artificial
  CRISPR gRNA sequence
ccctgtggctttgcagggta

SEQ ID NO: 561011 - DNA, 20 bp, Artificial
  CRISPR gRNA sequence
tggctttgcagggtacagcc

SEQ ID NO: 561012 - DNA, 20 bp, Artificial
  CRISPR gRNA sequence
tgcagggtacagccatcctc

SEQ ID NO: 561013 - DNA, 20 bp, Artificial
  CRISPR gRNA sequence
gcagggtacagccatcctcc

SEQ ID NO: 561014 - DNA, 20 bp, Artificial
  CRISPR gRNA sequence
cagggtacagccatcctcct

SEQ ID NO: 561015 - DNA, 20 bp, Artificial
  CRISPR gRNA sequence
ctggctgctttcatgagctg

SEQ ID NO: 561016 - DNA, 20 bp, Artificial
  CRISPR gRNA sequence
gctgctttcatgagctggca

SEQ ID NO: 561017 - DNA, 20 bp, Artificial
  CRISPR gRNA sequence
ctttcatgagctggcattaa

SEQ ID NO: 561018 - DNA, 20 bp, Artificial
  CRISPR gRNA sequence
tcatgagctggcattaagtg

SEQ ID NO: 561019 - DNA, 20 bp, Artificial
  CRISPR gRNA sequence
catgagctggcattaagtgt

SEQ ID NO: 561020 - DNA, 20 bp, Artificial
  CRISPR gRNA sequence
atgagctggcattaagtgtc

SEQ ID NO: 561021 - DNA, 20 bp, Artificial
  CRISPR gRNA sequence
gcattaagtgtctgtggctt

SEQ ID NO: 561022 - DNA, 20 bp, Artificial
  CRISPR gRNA sequence
agtgtctgtggcttttccag

SEQ ID NO: 561023 - DNA, 20 bp, Artificial
  CRISPR gRNA sequence
tggcttttccaggtacacgg

SEQ ID NO: 561024 - DNA, 20 bp, Artificial
  CRISPR gRNA sequence
ttccaggtacacggtgcaag

SEQ ID NO: 561025 - DNA, 20 bp, Artificial
  CRISPR gRNA sequence
tccaggtacacggtgcaagc

SEQ ID NO: 561026 - DNA, 20 bp, Artificial
  CRISPR gRNA sequence
ccaggtacacggtgcaagct

SEQ ID NO: 561027 - DNA, 20 bp, Artificial
  CRISPR gRNA sequence
caggtacacggtgcaagctc

SEQ ID NO: 561028 - DNA, 20 bp, Artificial
  CRISPR gRNA sequence
tcggtggatctaccattccg

SEQ ID NO: 561029 - DNA, 20 bp, Artificial
  CRISPR gRNA sequence
ggtggatctaccattccggg

SEQ ID NO: 561030 - DNA, 20 bp, Artificial
  CRISPR gRNA sequence
ccattccggggtctggtgga

SEQ ID NO: 561031 - DNA, 20 bp, Artificial
  CRISPR gRNA sequence
cggggtctggtggatgatgg

SEQ ID NO: 561032 - DNA, 20 bp, Artificial
  CRISPR gRNA sequence
gtggatgatggccctcttct

SEQ ID NO: 561033 - DNA, 20 bp, Artificial
  CRISPR gRNA sequence
ttctcacagctccactaggc

SEQ ID NO: 561034 - DNA, 20 bp, Artificial
  CRISPR gRNA sequence
ctcacagctccactaggcgg

SEQ ID NO: 561035 - DNA, 20 bp, Artificial
  CRISPR gRNA sequence
tcacagctccactaggcggt

SEQ ID NO: 561036 - DNA, 20 bp, Artificial
  CRISPR gRNA sequence
acagctccactaggcggtgc

SEQ ID NO: 561037 - DNA, 20 bp, Artificial
  CRISPR gRNA sequence
cactaggcggtgccccagtg

SEQ ID NO: 561038 - DNA, 20 bp, Artificial
  CRISPR gRNA sequence
ggcggtgccccagtggggac

SEQ ID NO: 561039 - DNA, 20 bp, Artificial
  CRISPR gRNA sequence
tgtgtgggggctccaactcc

SEQ ID NO: 561040 - DNA, 20 bp, Artificial
  CRISPR gRNA sequence
tgtgggggctccaactccac

SEQ ID NO: 561041 - DNA, 20 bp, Artificial
  CRISPR gRNA sequence
caactccacatttcccttcc

SEQ ID NO: 561042 - DNA, 20 bp, Artificial
  CRISPR gRNA sequence
cacatttcccttccacactg

SEQ ID NO: 561043 - DNA, 20 bp, Artificial
  CRISPR gRNA sequence
cccttccacactgccctagc

SEQ ID NO: 561044 - DNA, 20 bp, Artificial
  CRISPR gRNA sequence
ccttccacactgccctagca

SEQ ID NO: 561045 - DNA, 20 bp, Artificial
  CRISPR gRNA sequence
ccacactgccctagcagagg

SEQ ID NO: 561046 - DNA, 20 bp, Artificial
  CRISPR gRNA sequence
cacactgccctagcagaggt

SEQ ID NO: 561047 - DNA, 20 bp, Artificial
  CRISPR gRNA sequence
ccctagcagaggttctccat

SEQ ID NO: 561048 - DNA, 20 bp, Artificial
  CRISPR gRNA sequence
gcagaggttctccatgaggg

SEQ ID NO: 561049 - DNA, 20 bp, Artificial
  CRISPR gRNA sequence
tccatgagggtcccactcct

SEQ ID NO: 561050 - DNA, 20 bp, Artificial
  CRISPR gRNA sequence
catgagggtcccactcctgc

SEQ ID NO: 561051 - DNA, 20 bp, Artificial
  CRISPR gRNA sequence
ctgcagcaaacttctgcctg

SEQ ID NO: 561052 - DNA, 20 bp, Artificial
  CRISPR gRNA sequence
cagcaaacttctgcctggac

SEQ ID NO: 561053 - DNA, 20 bp, Artificial
  CRISPR gRNA sequence
ctgcctggacatccaggcat

SEQ ID NO: 561054 - DNA, 20 bp, Artificial
  CRISPR gRNA sequence
tgcctggacatccaggcatt

SEQ ID NO: 561055 - DNA, 20 bp, Artificial
  CRISPR gRNA sequence
cctggacatccaggcatttc

SEQ ID NO: 561056 - DNA, 20 bp, Artificial
  CRISPR gRNA sequence
gacatccaggcatttccata

SEQ ID NO: 561057 - DNA, 20 bp, Artificial
  CRISPR gRNA sequence
ccatacatcctctgaaatct

SEQ ID NO: 561058 - DNA, 20 bp, Artificial
  CRISPR gRNA sequence
catacatcctctgaaatcta

SEQ ID NO: 561059 - DNA, 20 bp, Artificial
  CRISPR gRNA sequence
tgaaatctaggcagaggttc

SEQ ID NO: 561060 - DNA, 20 bp, Artificial
  CRISPR gRNA sequence
aaatctaggcagaggttctc

SEQ ID NO: 561061 - DNA, 20 bp, Artificial
  CRISPR gRNA sequence
ggcagaggttctcaaacctc

SEQ ID NO: 561062 - DNA, 20 bp, Artificial
  CRISPR gRNA sequence
tcaaacctcaattcttgact

SEQ ID NO: 561063 - DNA, 20 bp, Artificial
  CRISPR gRNA sequence
aaacctcaattcttgacttc

SEQ ID NO: 561064 - DNA, 20 bp, Artificial
  CRISPR gRNA sequence
aattcttgacttctgtgcat

SEQ ID NO: 561065 - DNA, 20 bp, Artificial
  CRISPR gRNA sequence
ttgacttctgtgcatccaca

SEQ ID NO: 561066 - DNA, 20 bp, Artificial
  CRISPR gRNA sequence
gacttctgtgcatccacagg

SEQ ID NO: 561067 - DNA, 20 bp, Artificial
  CRISPR gRNA sequence
acttctgtgcatccacaggc

SEQ ID NO: 561068 - DNA, 20 bp, Artificial
  CRISPR gRNA sequence
ctgtgcatccacaggcccaa

SEQ ID NO: 561069 - DNA, 20 bp, Artificial
  CRISPR gRNA sequence
tgtgcatccacaggcccaac

SEQ ID NO: 561070 - DNA, 20 bp, Artificial
  CRISPR gRNA sequence
tgcatccacaggcccaacac

SEQ ID NO: 561071 - DNA, 20 bp, Artificial
  CRISPR gRNA sequence
accctctgaagcaacagcct

SEQ ID NO: 561072 - DNA, 20 bp, Artificial
  CRISPR gRNA sequence
ccctctgaagcaacagcctg

SEQ ID NO: 561073 - DNA, 20 bp, Artificial
  CRISPR gRNA sequence
tgaagcaacagcctgagtgg

SEQ ID NO: 561074 - DNA, 20 bp, Artificial
  CRISPR gRNA sequence
aagcaacagcctgagtggta

SEQ ID NO: 561075 - DNA, 20 bp, Artificial
  CRISPR gRNA sequence
agtggtatgttggccccttt

SEQ ID NO: 561076 - DNA, 20 bp, Artificial
  CRISPR gRNA sequence
gccccttttagccatggctg

SEQ ID NO: 561077 - DNA, 20 bp, Artificial
  CRISPR gRNA sequence
ttagccatggctggagctaa

SEQ ID NO: 561078 - DNA, 20 bp, Artificial
  CRISPR gRNA sequence
tagccatggctggagctaaa

SEQ ID NO: 561079 - DNA, 20 bp, Artificial
  CRISPR gRNA sequence
agccatggctggagctaaaa

SEQ ID NO: 561080 - DNA, 20 bp, Artificial
  CRISPR gRNA sequence
gccatggctggagctaaaac

SEQ ID NO: 561081 - DNA, 20 bp, Artificial
  CRISPR gRNA sequence
gagctaaaacagctggcatg

SEQ ID NO: 561082 - DNA, 20 bp, Artificial
  CRISPR gRNA sequence
aaacagctggcatgcagggc

SEQ ID NO: 561083 - DNA, 20 bp, Artificial
  CRISPR gRNA sequence
gcatgcagggctccatgttt

SEQ ID NO: 561084 - DNA, 20 bp, Artificial
  CRISPR gRNA sequence
catgtttggaggctgcaaag

SEQ ID NO: 561085 - DNA, 20 bp, Artificial
  CRISPR gRNA sequence
ggaggctgcaaagagcaggg

SEQ ID NO: 561086 - DNA, 20 bp, Artificial
  CRISPR gRNA sequence
gaggctgcaaagagcagggg

SEQ ID NO: 561087 - DNA, 20 bp, Artificial
  CRISPR gRNA sequence
caaagagcaggggggccctg

SEQ ID NO: 561088 - DNA, 20 bp, Artificial
  CRISPR gRNA sequence
ggtccagcccatgaaacaat

SEQ ID NO: 561089 - DNA, 20 bp, Artificial
  CRISPR gRNA sequence
ttccctccaaggcctccagg

SEQ ID NO: 561090 - DNA, 20 bp, Artificial
  CRISPR gRNA sequence
tccctccaaggcctccaggc

SEQ ID NO: 561091 - DNA, 20 bp, Artificial
  CRISPR gRNA sequence
ccctccaaggcctccaggcc

SEQ ID NO: 561092 - DNA, 20 bp, Artificial
  CRISPR gRNA sequence
cctccaaggcctccaggcct

SEQ ID NO: 561093 - DNA, 20 bp, Artificial
  CRISPR gRNA sequence
caaggcctccaggcctgtga

SEQ ID NO: 561094 - DNA, 20 bp, Artificial
  CRISPR gRNA sequence
caggcctgtgataggagggg

SEQ ID NO: 561095 - DNA, 20 bp, Artificial
  CRISPR gRNA sequence
tgataggaggggctgccatg

SEQ ID NO: 561096 - DNA, 20 bp, Artificial
  CRISPR gRNA sequence
ccatgaaggtttctgatatg

SEQ ID NO: 561097 - DNA, 20 bp, Artificial
  CRISPR gRNA sequence
ctgatatgccctggagacat

SEQ ID NO: 561098 - DNA, 20 bp, Artificial
  CRISPR gRNA sequence
tgatatgccctggagacatt

SEQ ID NO: 561099 - DNA, 20 bp, Artificial
  CRISPR gRNA sequence
atatgccctggagacatttt

SEQ ID NO: 561100 - DNA, 20 bp, Artificial
  CRISPR gRNA sequence
gagacattttccccattgtc

SEQ ID NO: 561101 - DNA, 20 bp, Artificial
  CRISPR gRNA sequence
tccccattgtcttcgtgatt

SEQ ID NO: 561102 - DNA, 20 bp, Artificial
  CRISPR gRNA sequence
ccccattgtcttcgtgatta

SEQ ID NO: 561103 - DNA, 20 bp, Artificial
  CRISPR gRNA sequence
cccattgtcttcgtgattaa

SEQ ID NO: 561104 - DNA, 20 bp, Artificial
  CRISPR gRNA sequence
tcttcgtgattaacatttgg

SEQ ID NO: 561105 - DNA, 20 bp, Artificial
  CRISPR gRNA sequence
cgtgattaacatttggctcc

SEQ ID NO: 561106 - DNA, 20 bp, Artificial
  CRISPR gRNA sequence
gtgattaacatttggctcct

SEQ ID NO: 561107 - DNA, 20 bp, Artificial
  CRISPR gRNA sequence
acatttggctcctcattact

SEQ ID NO: 561108 - DNA, 20 bp, Artificial
  CRISPR gRNA sequence
ggctcctcattacttaatgc

SEQ ID NO: 561109 - DNA, 20 bp, Artificial
  CRISPR gRNA sequence
gctcctcattacttaatgca

SEQ ID NO: 561110 - DNA, 20 bp, Artificial
  CRISPR gRNA sequence
ctcattacttaatgcaaatt

SEQ ID NO: 561111 - DNA, 20 bp, Artificial
  CRISPR gRNA sequence
attacttaatgcaaatttct

SEQ ID NO: 561112 - DNA, 20 bp, Artificial
  CRISPR gRNA sequence
cttaatgcaaatttctgcag

SEQ ID NO: 561113 - DNA, 20 bp, Artificial
  CRISPR gRNA sequence
aatgcaaatttctgcagctg

SEQ ID NO: 561114 - DNA, 20 bp, Artificial
  CRISPR gRNA sequence
atgcaaatttctgcagctgg

SEQ ID NO: 561115 - DNA, 20 bp, Artificial
  CRISPR gRNA sequence
ctgcagctggcttgaatttt

SEQ ID NO: 561116 - DNA, 20 bp, Artificial
  CRISPR gRNA sequence
tgcagctggcttgaattttt

SEQ ID NO: 561117 - DNA, 20 bp, Artificial
  CRISPR gRNA sequence
cagctggcttgaatttttcc

SEQ ID NO: 561118 - DNA, 20 bp, Artificial
  CRISPR gRNA sequence
gcttgaatttttcctcagaa

SEQ ID NO: 561119 - DNA, 20 bp, Artificial
  CRISPR gRNA sequence
gaatttttcctcagaaaagg

SEQ ID NO: 561120 - DNA, 20 bp, Artificial
  CRISPR gRNA sequence
aatttttcctcagaaaaggg

SEQ ID NO: 561121 - DNA, 20 bp, Artificial
  CRISPR gRNA sequence
ttcctcagaaaaggggtttt

SEQ ID NO: 561122 - DNA, 20 bp, Artificial
  CRISPR gRNA sequence
tcctcagaaaaggggttttt

SEQ ID NO: 561123 - DNA, 20 bp, Artificial
  CRISPR gRNA sequence
cctcagaaaaggggtttttc

SEQ ID NO: 561124 - DNA, 20 bp, Artificial
  CRISPR gRNA sequence
ctcagaaaaggggtttttct

SEQ ID NO: 561125 - DNA, 20 bp, Artificial
  CRISPR gRNA sequence
agaaaaggggtttttctttt

SEQ ID NO: 561126 - DNA, 20 bp, Artificial
  CRISPR gRNA sequence
ttcttttctattgcatcatt

SEQ ID NO: 561127 - DNA, 20 bp, Artificial
  CRISPR gRNA sequence
tcttttctattgcatcattg

SEQ ID NO: 561128 - DNA, 20 bp, Artificial
  CRISPR gRNA sequence
cttttctattgcatcattgg

SEQ ID NO: 561129 - DNA, 20 bp, Artificial
  CRISPR gRNA sequence
ttttctattgcatcattggg

SEQ ID NO: 561130 - DNA, 20 bp, Artificial
  CRISPR gRNA sequence
ttctattgcatcattgggct

SEQ ID NO: 561131 - DNA, 20 bp, Artificial
  CRISPR gRNA sequence
tctattgcatcattgggctg

SEQ ID NO: 561132 - DNA, 20 bp, Artificial
  CRISPR gRNA sequence
ctattgcatcattgggctgc

SEQ ID NO: 561133 - DNA, 20 bp, Artificial
  CRISPR gRNA sequence
tattgcatcattgggctgca

SEQ ID NO: 561134 - DNA, 20 bp, Artificial
  CRISPR gRNA sequence
ttgcatcattgggctgcaaa

SEQ ID NO: 561135 - DNA, 20 bp, Artificial
  CRISPR gRNA sequence
catcattgggctgcaaattt

SEQ ID NO: 561136 - DNA, 20 bp, Artificial
  CRISPR gRNA sequence
ggctgcaaattttttgaact

SEQ ID NO: 561137 - DNA, 20 bp, Artificial
  CRISPR gRNA sequence
caaattttttgaacttttat

SEQ ID NO: 561138 - DNA, 20 bp, Artificial
  CRISPR gRNA sequence
tttgaacttttatgccctgc

SEQ ID NO: 561139 - DNA, 20 bp, Artificial
  CRISPR gRNA sequence
ttgaacttttatgccctgct

SEQ ID NO: 561140 - DNA, 20 bp, Artificial
  CRISPR gRNA sequence
tgaacttttatgccctgcta

SEQ ID NO: 561141 - DNA, 20 bp, Artificial
  CRISPR gRNA sequence
gaacttttatgccctgctat

SEQ ID NO: 561142 - DNA, 20 bp, Artificial
  CRISPR gRNA sequence
aacttttatgccctgctatc

SEQ ID NO: 561143 - DNA, 20 bp, Artificial
  CRISPR gRNA sequence
ttatgccctgctatcctttt

SEQ ID NO: 561144 - DNA, 20 bp, Artificial
  CRISPR gRNA sequence
tatgccctgctatcctttta

SEQ ID NO: 561145 - DNA, 20 bp, Artificial
  CRISPR gRNA sequence
atgccctgctatccttttaa

SEQ ID NO: 561146 - DNA, 20 bp, Artificial
  CRISPR gRNA sequence
tgccctgctatccttttaaa

SEQ ID NO: 561147 - DNA, 20 bp, Artificial
  CRISPR gRNA sequence
ctatccttttaaacataagt

SEQ ID NO: 561148 - DNA, 20 bp, Artificial
  CRISPR gRNA sequence
tccttttaaacataagttcc

SEQ ID NO: 561149 - DNA, 20 bp, Artificial
  CRISPR gRNA sequence
ttaaacataagttccaattc

SEQ ID NO: 561150 - DNA, 20 bp, Artificial
  CRISPR gRNA sequence
taaacataagttccaattcc

SEQ ID NO: 561151 - DNA, 20 bp, Artificial
  CRISPR gRNA sequence
aaacataagttccaattcca

SEQ ID NO: 561152 - DNA, 20 bp, Artificial
  CRISPR gRNA sequence
aacataagttccaattccaa

SEQ ID NO: 561153 - DNA, 20 bp, Artificial
  CRISPR gRNA sequence
caattccaaaccacatcttt

SEQ ID NO: 561154 - DNA, 20 bp, Artificial
  CRISPR gRNA sequence
caaaccacatctttgtgaac

SEQ ID NO: 561155 - DNA, 20 bp, Artificial
  CRISPR gRNA sequence
tgtgaacatataaaactgaa

SEQ ID NO: 561156 - DNA, 20 bp, Artificial
  CRISPR gRNA sequence
gtgaacatataaaactgaat

SEQ ID NO: 561157 - DNA, 20 bp, Artificial
  CRISPR gRNA sequence
tgaacatataaaactgaatg

SEQ ID NO: 561158 - DNA, 20 bp, Artificial
  CRISPR gRNA sequence
aatgcttttaacagcaacca

SEQ ID NO: 561159 - DNA, 20 bp, Artificial
  CRISPR gRNA sequence
ttaacagcaaccaagccacc

SEQ ID NO: 561160 - DNA, 20 bp, Artificial
  CRISPR gRNA sequence
taacagcaaccaagccacct

SEQ ID NO: 561161 - DNA, 20 bp, Artificial
  CRISPR gRNA sequence
aacagcaaccaagccacctc

SEQ ID NO: 561162 - DNA, 20 bp, Artificial
  CRISPR gRNA sequence
acagcaaccaagccacctct

SEQ ID NO: 561163 - DNA, 20 bp, Artificial
  CRISPR gRNA sequence
ttgaatgctttgctgcttag

SEQ ID NO: 561164 - DNA, 20 bp, Artificial
  CRISPR gRNA sequence
gaatgctttgctgcttagaa

SEQ ID NO: 561165 - DNA, 20 bp, Artificial
  CRISPR gRNA sequence
aatgctttgctgcttagaaa

SEQ ID NO: 561166 - DNA, 20 bp, Artificial
  CRISPR gRNA sequence
tgctgcttagaaatttcttc

SEQ ID NO: 561167 - DNA, 20 bp, Artificial
  CRISPR gRNA sequence
gctgcttagaaatttcttcc

SEQ ID NO: 561168 - DNA, 20 bp, Artificial
  CRISPR gRNA sequence
ctgcttagaaatttcttcca

SEQ ID NO: 561169 - DNA, 20 bp, Artificial
  CRISPR gRNA sequence
cttagaaatttcttccacca

SEQ ID NO: 561170 - DNA, 20 bp, Artificial
  CRISPR gRNA sequence
agaaatttcttccaccagat

SEQ ID NO: 561171 - DNA, 20 bp, Artificial
  CRISPR gRNA sequence
gaaatttcttccaccagatg

SEQ ID NO: 561172 - DNA, 20 bp, Artificial
  CRISPR gRNA sequence
cttccaccagatgccctaaa

SEQ ID NO: 561173 - DNA, 20 bp, Artificial
  CRISPR gRNA sequence
ttccaccagatgccctaaat

SEQ ID NO: 561174 - DNA, 20 bp, Artificial
  CRISPR gRNA sequence
ccaccagatgccctaaataa

SEQ ID NO: 561175 - DNA, 20 bp, Artificial
  CRISPR gRNA sequence
caccagatgccctaaataat

SEQ ID NO: 561176 - DNA, 20 bp, Artificial
  CRISPR gRNA sequence
aataatttctctcaagttca

SEQ ID NO: 561177 - DNA, 20 bp, Artificial
  CRISPR gRNA sequence
ctctcaagttcaaagttcca

SEQ ID NO: 561178 - DNA, 20 bp, Artificial
  CRISPR gRNA sequence
tctcaagttcaaagttccac

SEQ ID NO: 561179 - DNA, 20 bp, Artificial
  CRISPR gRNA sequence
tcaagttcaaagttccacgt

SEQ ID NO: 561180 - DNA, 20 bp, Artificial
  CRISPR gRNA sequence
aagttcaaagttccacgtat

SEQ ID NO: 561181 - DNA, 20 bp, Artificial
  CRISPR gRNA sequence
aaagttccacgtatctttag

SEQ ID NO: 561182 - DNA, 20 bp, Artificial
  CRISPR gRNA sequence
cacgtatctttagggcacag

SEQ ID NO: 561183 - DNA, 20 bp, Artificial
  CRISPR gRNA sequence
tagggcacaggcaaaatgct

SEQ ID NO: 561184 - DNA, 20 bp, Artificial
  CRISPR gRNA sequence
agggcacaggcaaaatgctg

SEQ ID NO: 561185 - DNA, 20 bp, Artificial
  CRISPR gRNA sequence
gggcacaggcaaaatgctgc

SEQ ID NO: 561186 - DNA, 20 bp, Artificial
  CRISPR gRNA sequence
ccagtctctttgctaaaaca

SEQ ID NO: 561187 - DNA, 20 bp, Artificial
  CRISPR gRNA sequence
tttgctaaaacatattaaga

SEQ ID NO: 561188 - DNA, 20 bp, Artificial
  CRISPR gRNA sequence
tgctaaaacatattaagagt

SEQ ID NO: 561189 - DNA, 20 bp, Artificial
  CRISPR gRNA sequence
gctaaaacatattaagagtc

SEQ ID NO: 561190 - DNA, 20 bp, Artificial
  CRISPR gRNA sequence
ctaaaacatattaagagtca

SEQ ID NO: 561191 - DNA, 20 bp, Artificial
  CRISPR gRNA sequence
aaacatattaagagtcacct

SEQ ID NO: 561192 - DNA, 20 bp, Artificial
  CRISPR gRNA sequence
agagtcacctttattccagt

SEQ ID NO: 561193 - DNA, 20 bp, Artificial
  CRISPR gRNA sequence
tattccagttcccaacaatt

SEQ ID NO: 561194 - DNA, 20 bp, Artificial
  CRISPR gRNA sequence
attccagttcccaacaattg

SEQ ID NO: 561195 - DNA, 20 bp, Artificial
  CRISPR gRNA sequence
ttccagttcccaacaattgt

SEQ ID NO: 561196 - DNA, 20 bp, Artificial
  CRISPR gRNA sequence
cagttcccaacaattgttcc

SEQ ID NO: 561197 - DNA, 20 bp, Artificial
  CRISPR gRNA sequence
ccaacaattgttcctcatct

SEQ ID NO: 561198 - DNA, 20 bp, Artificial
  CRISPR gRNA sequence
ttcctcatctccatctgaga

SEQ ID NO: 561199 - DNA, 20 bp, Artificial
  CRISPR gRNA sequence
ctcatctccatctgagatga

SEQ ID NO: 561200 - DNA, 20 bp, Artificial
  CRISPR gRNA sequence
atctccatctgagatgagca

SEQ ID NO: 561201 - DNA, 20 bp, Artificial
  CRISPR gRNA sequence
catctgagatgagcagcatt

SEQ ID NO: 561202 - DNA, 20 bp, Artificial
  CRISPR gRNA sequence
agatgagcagcatttggtca

SEQ ID NO: 561203 - DNA, 20 bp, Artificial
  CRISPR gRNA sequence
ggtcaaagccattcaacaag

SEQ ID NO: 561204 - DNA, 20 bp, Artificial
  CRISPR gRNA sequence
gtcaaagccattcaacaagt

SEQ ID NO: 561205 - DNA, 20 bp, Artificial
  CRISPR gRNA sequence
aacaagtctctaggaagttc

SEQ ID NO: 561206 - DNA, 20 bp, Artificial
  CRISPR gRNA sequence
taggaagttccaaactttcc

SEQ ID NO: 561207 - DNA, 20 bp, Artificial
  CRISPR gRNA sequence
ggaagttccaaactttccca

SEQ ID NO: 561208 - DNA, 20 bp, Artificial
  CRISPR gRNA sequence
caaactttcccacatcttcc

SEQ ID NO: 561209 - DNA, 20 bp, Artificial
  CRISPR gRNA sequence
tcccacatcttcctgtcttc

SEQ ID NO: 561210 - DNA, 20 bp, Artificial
  CRISPR gRNA sequence
cccacatcttcctgtcttct

SEQ ID NO: 561211 - DNA, 20 bp, Artificial
  CRISPR gRNA sequence
ccacatcttcctgtcttctt

SEQ ID NO: 561212 - DNA, 20 bp, Artificial
  CRISPR gRNA sequence
cctgtcttcttctgagtctt

SEQ ID NO: 561213 - DNA, 20 bp, Artificial
  CRISPR gRNA sequence
ctgtcttcttctgagtcttc

SEQ ID NO: 561214 - DNA, 20 bp, Artificial
  CRISPR gRNA sequence
tcttcttctgagtcttccaa

SEQ ID NO: 561215 - DNA, 20 bp, Artificial
  CRISPR gRNA sequence
cttctgagtcttccaaacta

SEQ ID NO: 561216 - DNA, 20 bp, Artificial
  CRISPR gRNA sequence
ttctgagtcttccaaactat

SEQ ID NO: 561217 - DNA, 20 bp, Artificial
  CRISPR gRNA sequence
ctgagtcttccaaactattc

SEQ ID NO: 561218 - DNA, 20 bp, Artificial
  CRISPR gRNA sequence
tgagtcttccaaactattcc

SEQ ID NO: 561219 - DNA, 20 bp, Artificial
  CRISPR gRNA sequence
agtcttccaaactattccaa

SEQ ID NO: 561220 - DNA, 20 bp, Artificial
  CRISPR gRNA sequence
ccaaactattccaatccctg

SEQ ID NO: 561221 - DNA, 20 bp, Artificial
  CRISPR gRNA sequence
caaactattccaatccctgc

SEQ ID NO: 561222 - DNA, 20 bp, Artificial
  CRISPR gRNA sequence
ttccaatccctgcctgttac

SEQ ID NO: 561223 - DNA, 20 bp, Artificial
  CRISPR gRNA sequence
caatccctgcctgttaccca

SEQ ID NO: 561224 - DNA, 20 bp, Artificial
  CRISPR gRNA sequence
cctgttacccagttccaaag

SEQ ID NO: 561225 - DNA, 20 bp, Artificial
  CRISPR gRNA sequence
ttacccagttccaaagttgc

SEQ ID NO: 561226 - DNA, 20 bp, Artificial
  CRISPR gRNA sequence
cccagttccaaagttgcttc

SEQ ID NO: 561227 - DNA, 20 bp, Artificial
  CRISPR gRNA sequence
caaagttgcttccacatttt

SEQ ID NO: 561228 - DNA, 20 bp, Artificial
  CRISPR gRNA sequence
cttccacattttcaggtatc

SEQ ID NO: 561229 - DNA, 20 bp, Artificial
  CRISPR gRNA sequence
ccacattttcaggtatcttt

SEQ ID NO: 561230 - DNA, 20 bp, Artificial
  CRISPR gRNA sequence
cacattttcaggtatctttg

SEQ ID NO: 561231 - DNA, 20 bp, Artificial
  CRISPR gRNA sequence
tcaggtatctttgcagcagt

SEQ ID NO: 561232 - DNA, 20 bp, Artificial
  CRISPR gRNA sequence
caggtatctttgcagcagtg

SEQ ID NO: 561233 - DNA, 20 bp, Artificial
  CRISPR gRNA sequence
aggtatctttgcagcagtgc

SEQ ID NO: 561234 - DNA, 20 bp, Artificial
  CRISPR gRNA sequence
tgcagcagtgccccactacc

SEQ ID NO: 561235 - DNA, 20 bp, Artificial
  CRISPR gRNA sequence
gcagcagtgccccactaccc

SEQ ID NO: 561236 - DNA, 20 bp, Artificial
  CRISPR gRNA sequence
cagcagtgccccactaccca

SEQ ID NO: 561237 - DNA, 20 bp, Artificial
  CRISPR gRNA sequence
cccagtaccaatttactata

SEQ ID NO: 561238 - DNA, 20 bp, Artificial
  CRISPR gRNA sequence
actatattagtccattctca

SEQ ID NO: 561239 - DNA, 20 bp, Artificial
  CRISPR gRNA sequence
ctatattagtccattctcat

SEQ ID NO: 561240 - DNA, 20 bp, Artificial
  CRISPR gRNA sequence
tattagtccattctcatgct

SEQ ID NO: 561241 - DNA, 20 bp, Artificial
  CRISPR gRNA sequence
gtccattctcatgctgctaa

SEQ ID NO: 561242 - DNA, 20 bp, Artificial
  CRISPR gRNA sequence
tcatgctgctaataaagaca

SEQ ID NO: 561243 - DNA, 20 bp, Artificial
  CRISPR gRNA sequence
atgctgctaataaagacata

SEQ ID NO: 561244 - DNA, 20 bp, Artificial
  CRISPR gRNA sequence
ctaataaagacatacccaag

SEQ ID NO: 561245 - DNA, 20 bp, Artificial
  CRISPR gRNA sequence
ataaagacatacccaagact

SEQ ID NO: 561246 - DNA, 20 bp, Artificial
  CRISPR gRNA sequence
ggtaatttataaaggaaaga

SEQ ID NO: 561247 - DNA, 20 bp, Artificial
  CRISPR gRNA sequence
ataaaggaaagaagttcaat

SEQ ID NO: 561248 - DNA, 20 bp, Artificial
  CRISPR gRNA sequence
taaaggaaagaagttcaatg

SEQ ID NO: 561249 - DNA, 20 bp, Artificial
  CRISPR gRNA sequence
aatgaactcacagttccacc

SEQ ID NO: 561250 - DNA, 20 bp, Artificial
  CRISPR gRNA sequence
acagttccacctggccaggg

SEQ ID NO: 561251 - DNA, 20 bp, Artificial
  CRISPR gRNA sequence
cacctggccagggaggcccc

SEQ ID NO: 561252 - DNA, 20 bp, Artificial
  CRISPR gRNA sequence
gccagggaggccccacaatc

SEQ ID NO: 561253 - DNA, 20 bp, Artificial
  CRISPR gRNA sequence
acatggcagtaggcaagaga

SEQ ID NO: 561254 - DNA, 20 bp, Artificial
  CRISPR gRNA sequence
catggcagtaggcaagagag

SEQ ID NO: 561255 - DNA, 20 bp, Artificial
  CRISPR gRNA sequence
gtgcaggggaatccccattt

SEQ ID NO: 561256 - DNA, 20 bp, Artificial
  CRISPR gRNA sequence
tgcaggggaatccccattta

SEQ ID NO: 561257 - DNA, 20 bp, Artificial
  CRISPR gRNA sequence
ataaaatcatcaaatattgt

SEQ ID NO: 561258 - DNA, 20 bp, Artificial
  CRISPR gRNA sequence
taaaatcatcaaatattgtg

SEQ ID NO: 561259 - DNA, 20 bp, Artificial
  CRISPR gRNA sequence
tgagacttattcactatctg

SEQ ID NO: 561260 - DNA, 20 bp, Artificial
  CRISPR gRNA sequence
attcactatctgagaacagt

SEQ ID NO: 561261 - DNA, 20 bp, Artificial
  CRISPR gRNA sequence
ttcactatctgagaacagta

SEQ ID NO: 561262 - DNA, 20 bp, Artificial
  CRISPR gRNA sequence
actatctgagaacagtatgg

SEQ ID NO: 561263 - DNA, 20 bp, Artificial
  CRISPR gRNA sequence
tctgagaacagtatggggga

SEQ ID NO: 561264 - DNA, 20 bp, Artificial
  CRISPR gRNA sequence
agaacagtatgggggaaact

SEQ ID NO: 561265 - DNA, 20 bp, Artificial
  CRISPR gRNA sequence
cccttatgattcaattatct

SEQ ID NO: 561266 - DNA, 20 bp, Artificial
  CRISPR gRNA sequence
atgattcaattatctccacc

SEQ ID NO: 561267 - DNA, 20 bp, Artificial
  CRISPR gRNA sequence
tgattcaattatctccacct

SEQ ID NO: 561268 - DNA, 20 bp, Artificial
  CRISPR gRNA sequence
aattatctccacctagccct

SEQ ID NO: 561269 - DNA, 20 bp, Artificial
  CRISPR gRNA sequence
tctccacctagccctgccct

SEQ ID NO: 561270 - DNA, 20 bp, Artificial
  CRISPR gRNA sequence
cacctagccctgcccttgac

SEQ ID NO: 561271 - DNA, 20 bp, Artificial
  CRISPR gRNA sequence
gccctgcccttgacatatgg

SEQ ID NO: 561272 - DNA, 20 bp, Artificial
  CRISPR gRNA sequence
cccttgacatatggggatta

SEQ ID NO: 561273 - DNA, 20 bp, Artificial
  CRISPR gRNA sequence
gacatatggggattattaca

SEQ ID NO: 561274 - DNA, 20 bp, Artificial
  CRISPR gRNA sequence
acatatggggattattacaa

SEQ ID NO: 561275 - DNA, 20 bp, Artificial
  CRISPR gRNA sequence
ttacaattcaacgtaagatt

SEQ ID NO: 561276 - DNA, 20 bp, Artificial
  CRISPR gRNA sequence
caattcaacgtaagatttgg

SEQ ID NO: 561277 - DNA, 20 bp, Artificial
  CRISPR gRNA sequence
aacgtaagatttgggtggga

SEQ ID NO: 561278 - DNA, 20 bp, Artificial
  CRISPR gRNA sequence
gggtgggaacacagagccaa

SEQ ID NO: 561279 - DNA, 20 bp, Artificial
  CRISPR gRNA sequence
ggtgggaacacagagccaaa

SEQ ID NO: 561280 - DNA, 20 bp, Artificial
  CRISPR gRNA sequence
cagcatgttgcttaggatgg

SEQ ID NO: 561281 - DNA, 20 bp, Artificial
  CRISPR gRNA sequence
agcatgttgcttaggatggt

SEQ ID NO: 561282 - DNA, 20 bp, Artificial
  CRISPR gRNA sequence
cttaggatggtctcgaactc

SEQ ID NO: 561283 - DNA, 20 bp, Artificial
  CRISPR gRNA sequence
aggatggtctcgaactcctg

SEQ ID NO: 561284 - DNA, 20 bp, Artificial
  CRISPR gRNA sequence
ggatggtctcgaactcctgg

SEQ ID NO: 561285 - DNA, 20 bp, Artificial
  CRISPR gRNA sequence
gaactcctgggctcaaaaga

SEQ ID NO: 561286 - DNA, 20 bp, Artificial
  CRISPR gRNA sequence
ctgggctcaaaagatctgcc

SEQ ID NO: 561287 - DNA, 20 bp, Artificial
  CRISPR gRNA sequence
ggctcaaaagatctgcccac

SEQ ID NO: 561288 - DNA, 20 bp, Artificial
  CRISPR gRNA sequence
aaaagatctgcccacctcag

SEQ ID NO: 561289 - DNA, 20 bp, Artificial
  CRISPR gRNA sequence
cccacctcagcctctcagtg

SEQ ID NO: 561290 - DNA, 20 bp, Artificial
  CRISPR gRNA sequence
agcctctcagtgctaggatt

SEQ ID NO: 561291 - DNA, 20 bp, Artificial
  CRISPR gRNA sequence
tcagtgctaggattacaggc

SEQ ID NO: 561292 - DNA, 20 bp, Artificial
  CRISPR gRNA sequence
agtgctaggattacaggcat

SEQ ID NO: 561293 - DNA, 20 bp, Artificial
  CRISPR gRNA sequence
ggattacaggcatgcaccac

SEQ ID NO: 561294 - DNA, 20 bp, Artificial
  CRISPR gRNA sequence
caggcatgcaccaccactct

SEQ ID NO: 561295 - DNA, 20 bp, Artificial
  CRISPR gRNA sequence
tcagccaagttcatactttt

SEQ ID NO: 561296 - DNA, 20 bp, Artificial
  CRISPR gRNA sequence
agccaagttcatacttttga

SEQ ID NO: 561297 - DNA, 20 bp, Artificial
  CRISPR gRNA sequence
atacttttgagttcttgcta

SEQ ID NO: 561298 - DNA, 20 bp, Artificial
  CRISPR gRNA sequence
ttgagttcttgctacttgcc

SEQ ID NO: 561299 - DNA, 20 bp, Artificial
  CRISPR gRNA sequence
tgagttcttgctacttgccc

SEQ ID NO: 561300 - DNA, 20 bp, Artificial
  CRISPR gRNA sequence
gagttcttgctacttgccca

SEQ ID NO: 561301 - DNA, 20 bp, Artificial
  CRISPR gRNA sequence
agttcttgctacttgcccag

SEQ ID NO: 561302 - DNA, 20 bp, Artificial
  CRISPR gRNA sequence
ttgctacttgcccagcacta

SEQ ID NO: 561303 - DNA, 20 bp, Artificial
  CRISPR gRNA sequence
gctacttgcccagcactatc

SEQ ID NO: 561304 - DNA, 20 bp, Artificial
  CRISPR gRNA sequence
ctacttgcccagcactatcc

SEQ ID NO: 561305 - DNA, 20 bp, Artificial
  CRISPR gRNA sequence
cttgcccagcactatccagg

SEQ ID NO: 561306 - DNA, 20 bp, Artificial
  CRISPR gRNA sequence
gcccagcactatccaggccc

SEQ ID NO: 561307 - DNA, 20 bp, Artificial
  CRISPR gRNA sequence
cccagcactatccaggccct

SEQ ID NO: 561308 - DNA, 20 bp, Artificial
  CRISPR gRNA sequence
tccaggccctatccacatgt

SEQ ID NO: 561309 - DNA, 20 bp, Artificial
  CRISPR gRNA sequence
tccacatgtcattccactaa

SEQ ID NO: 561310 - DNA, 20 bp, Artificial
  CRISPR gRNA sequence
cactaatgcaagcccacacc

SEQ ID NO: 561311 - DNA, 20 bp, Artificial
  CRISPR gRNA sequence
atgcaagcccacaccaaatc

SEQ ID NO: 561312 - DNA, 20 bp, Artificial
  CRISPR gRNA sequence
ccagctccaccttcaaaaca

SEQ ID NO: 561313 - DNA, 20 bp, Artificial
  CRISPR gRNA sequence
caccttcaaaacacatccag

SEQ ID NO: 561314 - DNA, 20 bp, Artificial
  CRISPR gRNA sequence
caaaacacatccagatatct

SEQ ID NO: 561315 - DNA, 20 bp, Artificial
  CRISPR gRNA sequence
aaaacacatccagatatctc

SEQ ID NO: 561316 - DNA, 20 bp, Artificial
  CRISPR gRNA sequence
ccacccccagtgattccttt

SEQ ID NO: 561317 - DNA, 20 bp, Artificial
  CRISPR gRNA sequence
ctttcctgcattgcccctgc

SEQ ID NO: 561318 - DNA, 20 bp, Artificial
  CRISPR gRNA sequence
tcctgcattgcccctgcagc

SEQ ID NO: 561319 - DNA, 20 bp, Artificial
  CRISPR gRNA sequence
cctgcattgcccctgcagcc

SEQ ID NO: 561320 - DNA, 20 bp, Artificial
  CRISPR gRNA sequence
ctgcattgcccctgcagcct

SEQ ID NO: 561321 - DNA, 20 bp, Artificial
  CRISPR gRNA sequence
cattgcccctgcagcctaac

SEQ ID NO: 561322 - DNA, 20 bp, Artificial
  CRISPR gRNA sequence
cccctgcagcctaaccaacc

SEQ ID NO: 561323 - DNA, 20 bp, Artificial
  CRISPR gRNA sequence
cagcctaaccaacctccctg

SEQ ID NO: 561324 - DNA, 20 bp, Artificial
  CRISPR gRNA sequence
accaacctccctgctcttcc

SEQ ID NO: 561325 - DNA, 20 bp, Artificial
  CRISPR gRNA sequence
cctgctcttccttttctctc

SEQ ID NO: 561326 - DNA, 20 bp, Artificial
  CRISPR gRNA sequence
ctcttccttttctctcctct

SEQ ID NO: 561327 - DNA, 20 bp, Artificial
  CRISPR gRNA sequence
ttccttttctctcctctaca

SEQ ID NO: 561328 - DNA, 20 bp, Artificial
  CRISPR gRNA sequence
ccttttctctcctctacaga

SEQ ID NO: 561329 - DNA, 20 bp, Artificial
  CRISPR gRNA sequence
cttttctctcctctacagac

SEQ ID NO: 561330 - DNA, 20 bp, Artificial
  CRISPR gRNA sequence
ttctctcctctacagactat

SEQ ID NO: 561331 - DNA, 20 bp, Artificial
  CRISPR gRNA sequence
tctctcctctacagactatt

SEQ ID NO: 561332 - DNA, 20 bp, Artificial
  CRISPR gRNA sequence
ctctcctctacagactattc

SEQ ID NO: 561333 - DNA, 20 bp, Artificial
  CRISPR gRNA sequence
tctcctctacagactattca

SEQ ID NO: 561334 - DNA, 20 bp, Artificial
  CRISPR gRNA sequence
tcctctacagactattcatc

SEQ ID NO: 561335 - DNA, 20 bp, Artificial
  CRISPR gRNA sequence
ctctacagactattcatcca

SEQ ID NO: 561336 - DNA, 20 bp, Artificial
  CRISPR gRNA sequence
tacagactattcatccagca

SEQ ID NO: 561337 - DNA, 20 bp, Artificial
  CRISPR gRNA sequence
cagactattcatccagcagc

SEQ ID NO: 561338 - DNA, 20 bp, Artificial
  CRISPR gRNA sequence
ttcatccagcagccagaata

SEQ ID NO: 561339 - DNA, 20 bp, Artificial
  CRISPR gRNA sequence
atccagcagccagaataatt

SEQ ID NO: 561340 - DNA, 20 bp, Artificial
  CRISPR gRNA sequence
ttttaaacatccaagtcatc

SEQ ID NO: 561341 - DNA, 20 bp, Artificial
  CRISPR gRNA sequence
ttaaacatccaagtcatcat

SEQ ID NO: 561342 - DNA, 20 bp, Artificial
  CRISPR gRNA sequence
taaacatccaagtcatcata

SEQ ID NO: 561343 - DNA, 20 bp, Artificial
  CRISPR gRNA sequence
aaacatccaagtcatcataa

SEQ ID NO: 561344 - DNA, 20 bp, Artificial
  CRISPR gRNA sequence
aacatccaagtcatcataat

SEQ ID NO: 561345 - DNA, 20 bp, Artificial
  CRISPR gRNA sequence
cactcctgttcaaaatcctt

SEQ ID NO: 561346 - DNA, 20 bp, Artificial
  CRISPR gRNA sequence
actcctgttcaaaatccttc

SEQ ID NO: 561347 - DNA, 20 bp, Artificial
  CRISPR gRNA sequence
ctgttcaaaatccttcaaaa

SEQ ID NO: 561348 - DNA, 20 bp, Artificial
  CRISPR gRNA sequence
ttcaaaatccttcaaaactt

SEQ ID NO: 561349 - DNA, 20 bp, Artificial
  CRISPR gRNA sequence
aaaatccttcaaaactttcc

SEQ ID NO: 561350 - DNA, 20 bp, Artificial
  CRISPR gRNA sequence
caaaactttccagtcactga

SEQ ID NO: 561351 - DNA, 20 bp, Artificial
  CRISPR gRNA sequence
aaaactttccagtcactgaa

SEQ ID NO: 561352 - DNA, 20 bp, Artificial
  CRISPR gRNA sequence
tccagtcactgaaagcaaaa

SEQ ID NO: 561353 - DNA, 20 bp, Artificial
  CRISPR gRNA sequence
ccagtcactgaaagcaaaaa

SEQ ID NO: 561354 - DNA, 20 bp, Artificial
  CRISPR gRNA sequence
cagtcactgaaagcaaaaag

SEQ ID NO: 561355 - DNA, 20 bp, Artificial
  CRISPR gRNA sequence
aaagcaaaaaggccaaaata

SEQ ID NO: 561356 - DNA, 20 bp, Artificial
  CRISPR gRNA sequence
aaaaggccctaaaaacttta

SEQ ID NO: 561357 - DNA, 20 bp, Artificial
  CRISPR gRNA sequence
aaaggccctaaaaactttat

SEQ ID NO: 561358 - DNA, 20 bp, Artificial
  CRISPR gRNA sequence
aaaactttatctacaggatc

SEQ ID NO: 561359 - DNA, 20 bp, Artificial
  CRISPR gRNA sequence
tatctacaggatccaaccct

SEQ ID NO: 561360 - DNA, 20 bp, Artificial
  CRISPR gRNA sequence
atctacaggatccaaccctg

SEQ ID NO: 561361 - DNA, 20 bp, Artificial
  CRISPR gRNA sequence
tctacaggatccaaccctga

SEQ ID NO: 561362 - DNA, 20 bp, Artificial
  CRISPR gRNA sequence
caggatccaaccctgactac

SEQ ID NO: 561363 - DNA, 20 bp, Artificial
  CRISPR gRNA sequence
actacttttataacttcatt

SEQ ID NO: 561364 - DNA, 20 bp, Artificial
  CRISPR gRNA sequence
cttttataacttcattttct

SEQ ID NO: 561365 - DNA, 20 bp, Artificial
  CRISPR gRNA sequence
ttataacttcattttctacc

SEQ ID NO: 561366 - DNA, 20 bp, Artificial
  CRISPR gRNA sequence
tataacttcattttctacca

SEQ ID NO: 561367 - DNA, 20 bp, Artificial
  CRISPR gRNA sequence
ataacttcattttctaccac

SEQ ID NO: 561368 - DNA, 20 bp, Artificial
  CRISPR gRNA sequence
taacttcattttctaccact

SEQ ID NO: 561369 - DNA, 20 bp, Artificial
  CRISPR gRNA sequence
cattttctaccactctccac

SEQ ID NO: 561370 - DNA, 20 bp, Artificial
  CRISPR gRNA sequence
attttctaccactctccacc

SEQ ID NO: 561371 - DNA, 20 bp, Artificial
  CRISPR gRNA sequence
tctaccactctccaccacaa

SEQ ID NO: 561372 - DNA, 20 bp, Artificial
  CRISPR gRNA sequence
ctaccactctccaccacaat

SEQ ID NO: 561373 - DNA, 20 bp, Artificial
  CRISPR gRNA sequence
taccactctccaccacaatg

SEQ ID NO: 561374 - DNA, 20 bp, Artificial
  CRISPR gRNA sequence
ccactctccaccacaatggt

SEQ ID NO: 561375 - DNA, 20 bp, Artificial
  CRISPR gRNA sequence
tccaccacaatggtatcctt

SEQ ID NO: 561376 - DNA, 20 bp, Artificial
  CRISPR gRNA sequence
caccacaatggtatccttga

SEQ ID NO: 561377 - DNA, 20 bp, Artificial
  CRISPR gRNA sequence
gaagtttcttaaacgcttga

SEQ ID NO: 561378 - DNA, 20 bp, Artificial
  CRISPR gRNA sequence
aagtttcttaaacgcttgaa

SEQ ID NO: 561379 - DNA, 20 bp, Artificial
  CRISPR gRNA sequence
cttaaacgcttgaagcctat

SEQ ID NO: 561380 - DNA, 20 bp, Artificial
  CRISPR gRNA sequence
ttaaacgcttgaagcctatc

SEQ ID NO: 561381 - DNA, 20 bp, Artificial
  CRISPR gRNA sequence
aaacgcttgaagcctatctc

SEQ ID NO: 561382 - DNA, 20 bp, Artificial
  CRISPR gRNA sequence
aacgcttgaagcctatctca

SEQ ID NO: 561383 - DNA, 20 bp, Artificial
  CRISPR gRNA sequence
gaagcctatctcagggtcct

SEQ ID NO: 561384 - DNA, 20 bp, Artificial
  CRISPR gRNA sequence
aagcctatctcagggtcctg

SEQ ID NO: 561385 - DNA, 20 bp, Artificial
  CRISPR gRNA sequence
tctcagggtcctgagtagta

SEQ ID NO: 561386 - DNA, 20 bp, Artificial
  CRISPR gRNA sequence
agggtcctgagtagtagacc

SEQ ID NO: 561387 - DNA, 20 bp, Artificial
  CRISPR gRNA sequence
agtagtagacctggaatatc

SEQ ID NO: 561388 - DNA, 20 bp, Artificial
  CRISPR gRNA sequence
gaatatcactcccccagata

SEQ ID NO: 561389 - DNA, 20 bp, Artificial
  CRISPR gRNA sequence
ccccagatagccttgtggcc

SEQ ID NO: 561390 - DNA, 20 bp, Artificial
  CRISPR gRNA sequence
gtggcctatctctcacttcc

SEQ ID NO: 561391 - DNA, 20 bp, Artificial
  CRISPR gRNA sequence
tggcctatctctcacttcct

SEQ ID NO: 561392 - DNA, 20 bp, Artificial
  CRISPR gRNA sequence
tctctcacttccttaagtgt

SEQ ID NO: 561393 - DNA, 20 bp, Artificial
  CRISPR gRNA sequence
tcacttccttaagtgtatga

SEQ ID NO: 561394 - DNA, 20 bp, Artificial
  CRISPR gRNA sequence
acttccttaagtgtatgatc

SEQ ID NO: 561395 - DNA, 20 bp, Artificial
  CRISPR gRNA sequence
ccttaagtgtatgatcaatt

SEQ ID NO: 561396 - DNA, 20 bp, Artificial
  CRISPR gRNA sequence
cttaagtgtatgatcaattg

SEQ ID NO: 561397 - DNA, 20 bp, Artificial
  CRISPR gRNA sequence
aagtgtatgatcaattgtca

SEQ ID NO: 561398 - DNA, 20 bp, Artificial
  CRISPR gRNA sequence
agtgtatgatcaattgtcac

SEQ ID NO: 561399 - DNA, 20 bp, Artificial
  CRISPR gRNA sequence
tcaccctattaaagagaccc

SEQ ID NO: 561400 - DNA, 20 bp, Artificial
  CRISPR gRNA sequence
ttaaagagaccctccctgac

SEQ ID NO: 561401 - DNA, 20 bp, Artificial
  CRISPR gRNA sequence
aagagaccctccctgaccac

SEQ ID NO: 561402 - DNA, 20 bp, Artificial
  CRISPR gRNA sequence
cctgaccacactatgtaata

SEQ ID NO: 561403 - DNA, 20 bp, Artificial
  CRISPR gRNA sequence
accacactatgtaatactaa

SEQ ID NO: 561404 - DNA, 20 bp, Artificial
  CRISPR gRNA sequence
tgtaatactaaccagcagag

SEQ ID NO: 561405 - DNA, 20 bp, Artificial
  CRISPR gRNA sequence
accagcagagggtagctgaa

SEQ ID NO: 561406 - DNA, 20 bp, Artificial
  CRISPR gRNA sequence
aatgaactaccatatagcca

SEQ ID NO: 561407 - DNA, 20 bp, Artificial
  CRISPR gRNA sequence
ccatatagccaccctatgag

SEQ ID NO: 561408 - DNA, 20 bp, Artificial
  CRISPR gRNA sequence
tgagggactgtacagctgtg

SEQ ID NO: 561409 - DNA, 20 bp, Artificial
  CRISPR gRNA sequence
tacagctgtgaaaaagaatg

SEQ ID NO: 561410 - DNA, 20 bp, Artificial
  CRISPR gRNA sequence
tgaaaaagaatgaggtggat

SEQ ID NO: 561411 - DNA, 20 bp, Artificial
  CRISPR gRNA sequence
tatgaagtgatagggaatga

SEQ ID NO: 561412 - DNA, 20 bp, Artificial
  CRISPR gRNA sequence
tgaagtgatagggaatgatt

SEQ ID NO: 561413 - DNA, 20 bp, Artificial
  CRISPR gRNA sequence
tccagatgtatggttaagtg

SEQ ID NO: 561414 - DNA, 20 bp, Artificial
  CRISPR gRNA sequence
ccagatgtatggttaagtga

SEQ ID NO: 561415 - DNA, 20 bp, Artificial
  CRISPR gRNA sequence
cagatgtatggttaagtgac

SEQ ID NO: 561416 - DNA, 20 bp, Artificial
  CRISPR gRNA sequence
agtgacaaaaatgagataca

SEQ ID NO: 561417 - DNA, 20 bp, Artificial
  CRISPR gRNA sequence
ccttgtttaagaagggtagt

SEQ ID NO: 561418 - DNA, 20 bp, Artificial
  CRISPR gRNA sequence
gtttaagaagggtagttaga

SEQ ID NO: 561419 - DNA, 20 bp, Artificial
  CRISPR gRNA sequence
tttaagaagggtagttagaa

SEQ ID NO: 561420 - DNA, 20 bp, Artificial
  CRISPR gRNA sequence
aagaagggtagttagaaaaa

SEQ ID NO: 561421 - DNA, 20 bp, Artificial
  CRISPR gRNA sequence
agaagggtagttagaaaaaa

SEQ ID NO: 561422 - DNA, 20 bp, Artificial
  CRISPR gRNA sequence
gaaaaaaaaaaaagaatcca

SEQ ID NO: 561423 - DNA, 20 bp, Artificial
  CRISPR gRNA sequence
ttttttgttttgttttgttt

SEQ ID NO: 561424 - DNA, 20 bp, Artificial
  CRISPR gRNA sequence
tttttgttttgttttgtttt

SEQ ID NO: 561425 - DNA, 20 bp, Artificial
  CRISPR gRNA sequence
ttttgttttgttttgttttt

SEQ ID NO: 561426 - DNA, 20 bp, Artificial
  CRISPR gRNA sequence
tttgttttgttttgtttttt

SEQ ID NO: 561427 - DNA, 20 bp, Artificial
  CRISPR gRNA sequence
ttgttttgttttgttttttt

SEQ ID NO: 561428 - DNA, 20 bp, Artificial
  CRISPR gRNA sequence
tgttttgttttgtttttttg

SEQ ID NO: 561429 - DNA, 20 bp, Artificial
  CRISPR gRNA sequence
gttttgttttgtttttttgt

SEQ ID NO: 561430 - DNA, 20 bp, Artificial
  CRISPR gRNA sequence
ttttgttttgtttttttgtt

SEQ ID NO: 561431 - DNA, 20 bp, Artificial
  CRISPR gRNA sequence
tgttttgtttttttgttttt

SEQ ID NO: 561432 - DNA, 20 bp, Artificial
  CRISPR gRNA sequence
gttttgtttttttgtttttt

SEQ ID NO: 561433 - DNA, 20 bp, Artificial
  CRISPR gRNA sequence
ttttgtttttttgttttttt

SEQ ID NO: 561434 - DNA, 20 bp, Artificial
  CRISPR gRNA sequence
tgtttttttgtttttttttt

SEQ ID NO: 561435 - DNA, 20 bp, Artificial
  CRISPR gRNA sequence
gtttttttgttttttttttt

SEQ ID NO: 561436 - DNA, 20 bp, Artificial
  CRISPR gRNA sequence
tttttttgtttttttttttt

SEQ ID NO: 561437 - DNA, 20 bp, Artificial
  CRISPR gRNA sequence
ttttgttttttttttttgag

SEQ ID NO: 561438 - DNA, 20 bp, Artificial
  CRISPR gRNA sequence
tttgttttttttttttgaga

SEQ ID NO: 561439 - DNA, 20 bp, Artificial
  CRISPR gRNA sequence
ttgttttttttttttgagac

SEQ ID NO: 561440 - DNA, 20 bp, Artificial
  CRISPR gRNA sequence
tgttttttttttttgagaca

SEQ ID NO: 561441 - DNA, 20 bp, Artificial
  CRISPR gRNA sequence
gttttttttttttgagacag

SEQ ID NO: 561442 - DNA, 20 bp, Artificial
  CRISPR gRNA sequence
ttttttttttttgagacaga

SEQ ID NO: 561443 - DNA, 20 bp, Artificial
  CRISPR gRNA sequence
tttttttttgagacagagtc

SEQ ID NO: 561444 - DNA, 20 bp, Artificial
  CRISPR gRNA sequence
ttttttttgagacagagtct

SEQ ID NO: 561445 - DNA, 20 bp, Artificial
  CRISPR gRNA sequence
tttttttgagacagagtctc

SEQ ID NO: 561446 - DNA, 20 bp, Artificial
  CRISPR gRNA sequence
ttttttgagacagagtctca

SEQ ID NO: 561447 - DNA, 20 bp, Artificial
  CRISPR gRNA sequence
tttttgagacagagtctcac

SEQ ID NO: 561448 - DNA, 20 bp, Artificial
  CRISPR gRNA sequence
ttttgagacagagtctcact

SEQ ID NO: 561449 - DNA, 20 bp, Artificial
  CRISPR gRNA sequence
tttgagacagagtctcactc

SEQ ID NO: 561450 - DNA, 20 bp, Artificial
  CRISPR gRNA sequence
ttgagacagagtctcactcc

SEQ ID NO: 561451 - DNA, 20 bp, Artificial
  CRISPR gRNA sequence
tgagacagagtctcactccg

SEQ ID NO: 561452 - DNA, 20 bp, Artificial
  CRISPR gRNA sequence
gagacagagtctcactccgt

SEQ ID NO: 561453 - DNA, 20 bp, Artificial
  CRISPR gRNA sequence
agacagagtctcactccgtc

SEQ ID NO: 561454 - DNA, 20 bp, Artificial
  CRISPR gRNA sequence
actccgtcacccaggctgga

SEQ ID NO: 561455 - DNA, 20 bp, Artificial
  CRISPR gRNA sequence
cgtcacccaggctggagtgc

SEQ ID NO: 561456 - DNA, 20 bp, Artificial
  CRISPR gRNA sequence
gagtgcagtgttgtaatctt

SEQ ID NO: 561457 - DNA, 20 bp, Artificial
  CRISPR gRNA sequence
taatcttggctcactgcagt

SEQ ID NO: 561458 - DNA, 20 bp, Artificial
  CRISPR gRNA sequence
ggctcactgcagtctctgcc

SEQ ID NO: 561459 - DNA, 20 bp, Artificial
  CRISPR gRNA sequence
gctcactgcagtctctgcct

SEQ ID NO: 561460 - DNA, 20 bp, Artificial
  CRISPR gRNA sequence
actgcagtctctgcctcctg

SEQ ID NO: 561461 - DNA, 20 bp, Artificial
  CRISPR gRNA sequence
cagtctctgcctcctggttc

SEQ ID NO: 561462 - DNA, 20 bp, Artificial
  CRISPR gRNA sequence
tgcctcctggttcaggccat

SEQ ID NO: 561463 - DNA, 20 bp, Artificial
  CRISPR gRNA sequence
cctcctggttcaggccattc

SEQ ID NO: 561464 - DNA, 20 bp, Artificial
  CRISPR gRNA sequence
ctggttcaggccattctcct

SEQ ID NO: 561465 - DNA, 20 bp, Artificial
  CRISPR gRNA sequence
gttcaggccattctcctgcc

SEQ ID NO: 561466 - DNA, 20 bp, Artificial
  CRISPR gRNA sequence
aggccattctcctgcctcag

SEQ ID NO: 561467 - DNA, 20 bp, Artificial
  CRISPR gRNA sequence
tcctgcctcagcctcctagg

SEQ ID NO: 561468 - DNA, 20 bp, Artificial
  CRISPR gRNA sequence
ctgcctcagcctcctaggta

SEQ ID NO: 561469 - DNA, 20 bp, Artificial
  CRISPR gRNA sequence
cctcagcctcctaggtagct

SEQ ID NO: 561470 - DNA, 20 bp, Artificial
  CRISPR gRNA sequence
agcctcctaggtagctggaa

SEQ ID NO: 561471 - DNA, 20 bp, Artificial
  CRISPR gRNA sequence
ctaggtagctggaattacag

SEQ ID NO: 561472 - DNA, 20 bp, Artificial
  CRISPR gRNA sequence
ggtagctggaattacaggcg

SEQ ID NO: 561473 - DNA, 20 bp, Artificial
  CRISPR gRNA sequence
gaattacaggcgtgtgccac

SEQ ID NO: 561474 - DNA, 20 bp, Artificial
  CRISPR gRNA sequence
caggcgtgtgccaccatgcc

SEQ ID NO: 561475 - DNA, 20 bp, Artificial
  CRISPR gRNA sequence
attttttgttttagtagaga

SEQ ID NO: 561476 - DNA, 20 bp, Artificial
  CRISPR gRNA sequence
tttgttttagtagagacagg

SEQ ID NO: 561477 - DNA, 20 bp, Artificial
  CRISPR gRNA sequence
ttgttttagtagagacaggg

SEQ ID NO: 561478 - DNA, 20 bp, Artificial
  CRISPR gRNA sequence
tgttttagtagagacagggt

SEQ ID NO: 561479 - DNA, 20 bp, Artificial
  CRISPR gRNA sequence
gttttagtagagacagggtt

SEQ ID NO: 561480 - DNA, 20 bp, Artificial
  CRISPR gRNA sequence
ttttagtagagacagggttt

SEQ ID NO: 561481 - DNA, 20 bp, Artificial
  CRISPR gRNA sequence
tagtagagacagggtttcac

SEQ ID NO: 561482 - DNA, 20 bp, Artificial
  CRISPR gRNA sequence
agtagagacagggtttcact

SEQ ID NO: 561483 - DNA, 20 bp, Artificial
  CRISPR gRNA sequence
gtagagacagggtttcactg

SEQ ID NO: 561484 - DNA, 20 bp, Artificial
  CRISPR gRNA sequence
cactgcgttagccaggatgg

SEQ ID NO: 561485 - DNA, 20 bp, Artificial
  CRISPR gRNA sequence
actgcgttagccaggatggt

SEQ ID NO: 561486 - DNA, 20 bp, Artificial
  CRISPR gRNA sequence
cgttagccaggatggtctca

SEQ ID NO: 561487 - DNA, 20 bp, Artificial
  CRISPR gRNA sequence
gccaggatggtctcaatctc

SEQ ID NO: 561488 - DNA, 20 bp, Artificial
  CRISPR gRNA sequence
aatctcctgaccttgtgatc

SEQ ID NO: 561489 - DNA, 20 bp, Artificial
  CRISPR gRNA sequence
ctgaccttgtgatccgcccg

SEQ ID NO: 561490 - DNA, 20 bp, Artificial
  CRISPR gRNA sequence
accttgtgatccgcccgcct

SEQ ID NO: 561491 - DNA, 20 bp, Artificial
  CRISPR gRNA sequence
gtgatccgcccgccttggcc

SEQ ID NO: 561492 - DNA, 20 bp, Artificial
  CRISPR gRNA sequence
tgatccgcccgccttggcct

SEQ ID NO: 561493 - DNA, 20 bp, Artificial
  CRISPR gRNA sequence
ggcctcccaaagtgctggga

SEQ ID NO: 561494 - DNA, 20 bp, Artificial
  CRISPR gRNA sequence
gcctcccaaagtgctgggat

SEQ ID NO: 561495 - DNA, 20 bp, Artificial
  CRISPR gRNA sequence
ccaaagtgctgggattacag

SEQ ID NO: 561496 - DNA, 20 bp, Artificial
  CRISPR gRNA sequence
ggattacagtcatgagtcac

SEQ ID NO: 561497 - DNA, 20 bp, Artificial
  CRISPR gRNA sequence
cagtcatgagtcactgcacc

SEQ ID NO: 561498 - DNA, 20 bp, Artificial
  CRISPR gRNA sequence
cacccggccagaatccaagt

SEQ ID NO: 561499 - DNA, 20 bp, Artificial
  CRISPR gRNA sequence
ttgaatatagtattgcatat

SEQ ID NO: 561500 - DNA, 20 bp, Artificial
  CRISPR gRNA sequence
tgaatatagtattgcatatt

SEQ ID NO: 561501 - DNA, 20 bp, Artificial
  CRISPR gRNA sequence
gaatatagtattgcatattc

SEQ ID NO: 561502 - DNA, 20 bp, Artificial
  CRISPR gRNA sequence
aatatagtattgcatattca

SEQ ID NO: 561503 - DNA, 20 bp, Artificial
  CRISPR gRNA sequence
catattcactgggatataca

SEQ ID NO: 561504 - DNA, 20 bp, Artificial
  CRISPR gRNA sequence
actgggatatacagatattt

SEQ ID NO: 561505 - DNA, 20 bp, Artificial
  CRISPR gRNA sequence
ggatatacagatatttctta

SEQ ID NO: 561506 - DNA, 20 bp, Artificial
  CRISPR gRNA sequence
cttattatggagttatatct

SEQ ID NO: 561507 - DNA, 20 bp, Artificial
  CRISPR gRNA sequence
ttattatggagttatatctt

SEQ ID NO: 561508 - DNA, 20 bp, Artificial
  CRISPR gRNA sequence
attatggagttatatcttga

SEQ ID NO: 561509 - DNA, 20 bp, Artificial
  CRISPR gRNA sequence
ttatggagttatatcttgaa

SEQ ID NO: 561510 - DNA, 20 bp, Artificial
  CRISPR gRNA sequence
tggagttatatcttgaaaaa

SEQ ID NO: 561511 - DNA, 20 bp, Artificial
  CRISPR gRNA sequence
tatcttgaaaaactcattgt

SEQ ID NO: 561512 - DNA, 20 bp, Artificial
  CRISPR gRNA sequence
gaaaaactcattgtagagtt

SEQ ID NO: 561513 - DNA, 20 bp, Artificial
  CRISPR gRNA sequence
aaaaactcattgtagagttg

SEQ ID NO: 561514 - DNA, 20 bp, Artificial
  CRISPR gRNA sequence
attgtagagttgaaaaatct

SEQ ID NO: 561515 - DNA, 20 bp, Artificial
  CRISPR gRNA sequence
tagagttgaaaaatcttaag

SEQ ID NO: 561516 - DNA, 20 bp, Artificial
  CRISPR gRNA sequence
aaaaatcttaagtcgaacca

SEQ ID NO: 561517 - DNA, 20 bp, Artificial
  CRISPR gRNA sequence
aagtcgaaccattgctaagt

SEQ ID NO: 561518 - DNA, 20 bp, Artificial
  CRISPR gRNA sequence
agtcgaaccattgctaagtt

SEQ ID NO: 561519 - DNA, 20 bp, Artificial
  CRISPR gRNA sequence
ctaagttggagactgtaatg

SEQ ID NO: 561520 - DNA, 20 bp, Artificial
  CRISPR gRNA sequence
agttggagactgtaatgaaa

SEQ ID NO: 561521 - DNA, 20 bp, Artificial
  CRISPR gRNA sequence
gagactgtaatgaaaaataa

SEQ ID NO: 561522 - DNA, 20 bp, Artificial
  CRISPR gRNA sequence
taatgaaaaataaaaggaac

SEQ ID NO: 561523 - DNA, 20 bp, Artificial
  CRISPR gRNA sequence
taaagaaatctttaactgta

SEQ ID NO: 561524 - DNA, 20 bp, Artificial
  CRISPR gRNA sequence
taactgtatttagtaagttt

SEQ ID NO: 561525 - DNA, 20 bp, Artificial
  CRISPR gRNA sequence
aactgtatttagtaagtttg

SEQ ID NO: 561526 - DNA, 20 bp, Artificial
  CRISPR gRNA sequence
actgtatttagtaagtttgt

SEQ ID NO: 561527 - DNA, 20 bp, Artificial
  CRISPR gRNA sequence
tatttagtaagtttgtagtt

SEQ ID NO: 561528 - DNA, 20 bp, Artificial
  CRISPR gRNA sequence
agtaagtttgtagttggtag

SEQ ID NO: 561529 - DNA, 20 bp, Artificial
  CRISPR gRNA sequence
gtaagtttgtagttggtagt

SEQ ID NO: 561530 - DNA, 20 bp, Artificial
  CRISPR gRNA sequence
gtagttggtagtagattggt

SEQ ID NO: 561531 - DNA, 20 bp, Artificial
  CRISPR gRNA sequence
tagttggtagtagattggta

SEQ ID NO: 561532 - DNA, 20 bp, Artificial
  CRISPR gRNA sequence
gtagtagattggtatagcaa

SEQ ID NO: 561533 - DNA, 20 bp, Artificial
  CRISPR gRNA sequence
gtatagcaactgtaaaatga

SEQ ID NO: 561534 - DNA, 20 bp, Artificial
  CRISPR gRNA sequence
taaaatgatttggggtttaa

SEQ ID NO: 561535 - DNA, 20 bp, Artificial
  CRISPR gRNA sequence
ggggtttaatgtagattagg

SEQ ID NO: 561536 - DNA, 20 bp, Artificial
  CRISPR gRNA sequence
gggtttaatgtagattagga

SEQ ID NO: 561537 - DNA, 20 bp, Artificial
  CRISPR gRNA sequence
aatgtagattaggaaaatat

SEQ ID NO: 561538 - DNA, 20 bp, Artificial
  CRISPR gRNA sequence
atgtagattaggaaaatata

SEQ ID NO: 561539 - DNA, 20 bp, Artificial
  CRISPR gRNA sequence
ggaaaatatactgatgctac

SEQ ID NO: 561540 - DNA, 20 bp, Artificial
  CRISPR gRNA sequence
atgctactaagaacagagtt

SEQ ID NO: 561541 - DNA, 20 bp, Artificial
  CRISPR gRNA sequence
ctaagaacagagttctcact

SEQ ID NO: 561542 - DNA, 20 bp, Artificial
  CRISPR gRNA sequence
agaacagagttctcactgtg

SEQ ID NO: 561543 - DNA, 20 bp, Artificial
  CRISPR gRNA sequence
tcactgtgggagtaaggaga

SEQ ID NO: 561544 - DNA, 20 bp, Artificial
  CRISPR gRNA sequence
actgtgggagtaaggagatg

SEQ ID NO: 561545 - DNA, 20 bp, Artificial
  CRISPR gRNA sequence
tgggagtaaggagatgcaaa

SEQ ID NO: 561546 - DNA, 20 bp, Artificial
  CRISPR gRNA sequence
agcagcaagattattagtgt

SEQ ID NO: 561547 - DNA, 20 bp, Artificial
  CRISPR gRNA sequence
ttagtgttagaagtatcagg

SEQ ID NO: 561548 - DNA, 20 bp, Artificial
  CRISPR gRNA sequence
gtgttagaagtatcagggtg

SEQ ID NO: 561549 - DNA, 20 bp, Artificial
  CRISPR gRNA sequence
gaagtatcagggtgaactcc

SEQ ID NO: 561550 - DNA, 20 bp, Artificial
  CRISPR gRNA sequence
ctgactttgtaaaaactcta

SEQ ID NO: 561551 - DNA, 20 bp, Artificial
  CRISPR gRNA sequence
actttgtaaaaactctattt

SEQ ID NO: 561552 - DNA, 20 bp, Artificial
  CRISPR gRNA sequence
tgtaaaaactctatttctta

SEQ ID NO: 561553 - DNA, 20 bp, Artificial
  CRISPR gRNA sequence
gtaaaaactctatttcttaa

SEQ ID NO: 561554 - DNA, 20 bp, Artificial
  CRISPR gRNA sequence
taaaaactctatttcttaac

SEQ ID NO: 561555 - DNA, 20 bp, Artificial
  CRISPR gRNA sequence
tatttcttaactttgaaaac

SEQ ID NO: 561556 - DNA, 20 bp, Artificial
  CRISPR gRNA sequence
tttcttaactttgaaaactg

SEQ ID NO: 561557 - DNA, 20 bp, Artificial
  CRISPR gRNA sequence
cttaactttgaaaactgaca

SEQ ID NO: 561558 - DNA, 20 bp, Artificial
  CRISPR gRNA sequence
ttaactttgaaaactgacaa

SEQ ID NO: 561559 - DNA, 20 bp, Artificial
  CRISPR gRNA sequence
aactttgaaaactgacaagg

SEQ ID NO: 561560 - DNA, 20 bp, Artificial
  CRISPR gRNA sequence
actttgaaaactgacaaggc

SEQ ID NO: 561561 - DNA, 20 bp, Artificial
  CRISPR gRNA sequence
tgaaaactgacaaggctgag

SEQ ID NO: 561562 - DNA, 20 bp, Artificial
  CRISPR gRNA sequence
gaaaactgacaaggctgaga

SEQ ID NO: 561563 - DNA, 20 bp, Artificial
  CRISPR gRNA sequence
aaaactgacaaggctgagaa

SEQ ID NO: 561564 - DNA, 20 bp, Artificial
  CRISPR gRNA sequence
acaaggctgagaagcaatga

SEQ ID NO: 561565 - DNA, 20 bp, Artificial
  CRISPR gRNA sequence
agaagcaatgactctggtac

SEQ ID NO: 561566 - DNA, 20 bp, Artificial
  CRISPR gRNA sequence
tggtacctgtgggcacactt

SEQ ID NO: 561567 - DNA, 20 bp, Artificial
  CRISPR gRNA sequence
gtacctgtgggcacactttg

SEQ ID NO: 561568 - DNA, 20 bp, Artificial
  CRISPR gRNA sequence
tgggcacactttgcacccag

SEQ ID NO: 561569 - DNA, 20 bp, Artificial
  CRISPR gRNA sequence
tgcacccagaacttgatttc

SEQ ID NO: 561570 - DNA, 20 bp, Artificial
  CRISPR gRNA sequence
gcacccagaacttgatttct

SEQ ID NO: 561571 - DNA, 20 bp, Artificial
  CRISPR gRNA sequence
cacccagaacttgatttcta

SEQ ID NO: 561572 - DNA, 20 bp, Artificial
  CRISPR gRNA sequence
gatttctaaataccatctct

SEQ ID NO: 561573 - DNA, 20 bp, Artificial
  CRISPR gRNA sequence
atttctaaataccatctctc

SEQ ID NO: 561574 - DNA, 20 bp, Artificial
  CRISPR gRNA sequence
ctaaataccatctctcacta

SEQ ID NO: 561575 - DNA, 20 bp, Artificial
  CRISPR gRNA sequence
taaataccatctctcactaa

SEQ ID NO: 561576 - DNA, 20 bp, Artificial
  CRISPR gRNA sequence
aataccatctctcactaaaa

SEQ ID NO: 561577 - DNA, 20 bp, Artificial
  CRISPR gRNA sequence
tcactaaaagaaaccaggga

SEQ ID NO: 561578 - DNA, 20 bp, Artificial
  CRISPR gRNA sequence
actaaaagaaaccagggaac

SEQ ID NO: 561579 - DNA, 20 bp, Artificial
  CRISPR gRNA sequence
aaagaaaccagggaacctaa

SEQ ID NO: 561580 - DNA, 20 bp, Artificial
  CRISPR gRNA sequence
atgattcgaaggctgaggca

SEQ ID NO: 561581 - DNA, 20 bp, Artificial
  CRISPR gRNA sequence
gaaggctgaggcaggaacac

SEQ ID NO: 561582 - DNA, 20 bp, Artificial
  CRISPR gRNA sequence
aggcaggaacactacaagat

SEQ ID NO: 561583 - DNA, 20 bp, Artificial
  CRISPR gRNA sequence
caagatgagtccagaacatc

SEQ ID NO: 561584 - DNA, 20 bp, Artificial
  CRISPR gRNA sequence
tctgtgccagaaagtaagga

SEQ ID NO: 561585 - DNA, 20 bp, Artificial
  CRISPR gRNA sequence
ctgtgccagaaagtaaggaa

SEQ ID NO: 561586 - DNA, 20 bp, Artificial
  CRISPR gRNA sequence
tgtgccagaaagtaaggaag

SEQ ID NO: 561587 - DNA, 20 bp, Artificial
  CRISPR gRNA sequence
tgccagaaagtaaggaagtg

SEQ ID NO: 561588 - DNA, 20 bp, Artificial
  CRISPR gRNA sequence
aaaatcaaacaggaacaaac

SEQ ID NO: 561589 - DNA, 20 bp, Artificial
  CRISPR gRNA sequence
aaatcaaacaggaacaaaca

SEQ ID NO: 561590 - DNA, 20 bp, Artificial
  CRISPR gRNA sequence
tgaagcttgaaggtgttccc

SEQ ID NO: 561591 - DNA, 20 bp, Artificial
  CRISPR gRNA sequence
aagcttgaaggtgttcccac

SEQ ID NO: 561592 - DNA, 20 bp, Artificial
  CRISPR gRNA sequence
gaaggtgttcccacttgtca

SEQ ID NO: 561593 - DNA, 20 bp, Artificial
  CRISPR gRNA sequence
aaggtgttcccacttgtcaa

SEQ ID NO: 561594 - DNA, 20 bp, Artificial
  CRISPR gRNA sequence
ccacttgtcaaatgtggggt

SEQ ID NO: 561595 - DNA, 20 bp, Artificial
  CRISPR gRNA sequence
gtcaaatgtggggttgccga

SEQ ID NO: 561596 - DNA, 20 bp, Artificial
  CRISPR gRNA sequence
tcaaatgtggggttgccgag

SEQ ID NO: 561597 - DNA, 20 bp, Artificial
  CRISPR gRNA sequence
ccgagcatcaaaatggatga

SEQ ID NO: 561598 - DNA, 20 bp, Artificial
  CRISPR gRNA sequence
aaaaaagaatccatgagtcc

SEQ ID NO: 561599 - DNA, 20 bp, Artificial
  CRISPR gRNA sequence
aaaaagaatccatgagtcca

SEQ ID NO: 561600 - DNA, 20 bp, Artificial
  CRISPR gRNA sequence
ctaaaataaaagaaaaaaag

SEQ ID NO: 561601 - DNA, 20 bp, Artificial
  CRISPR gRNA sequence
taaaataaaagaaaaaaagg

SEQ ID NO: 561602 - DNA, 20 bp, Artificial
  CRISPR gRNA sequence
aaataaaagaaaaaaaggga

SEQ ID NO: 561603 - DNA, 20 bp, Artificial
  CRISPR gRNA sequence
tccattactgaacaatgtaa

SEQ ID NO: 561604 - DNA, 20 bp, Artificial
  CRISPR gRNA sequence
ctgaacaatgtaaactaata

SEQ ID NO: 561605 - DNA, 20 bp, Artificial
  CRISPR gRNA sequence
aacaatgtaaactaataaat

SEQ ID NO: 561606 - DNA, 20 bp, Artificial
  CRISPR gRNA sequence
ataaatatatatatagagag

SEQ ID NO: 561607 - DNA, 20 bp, Artificial
  CRISPR gRNA sequence
ctgggtggctcatgcctata

SEQ ID NO: 561608 - DNA, 20 bp, Artificial
  CRISPR gRNA sequence
ggtggctcatgcctataatc

SEQ ID NO: 561609 - DNA, 20 bp, Artificial
  CRISPR gRNA sequence
atgcctataatcccgacact

SEQ ID NO: 561610 - DNA, 20 bp, Artificial
  CRISPR gRNA sequence
taatcccgacactttgggaa

SEQ ID NO: 561611 - DNA, 20 bp, Artificial
  CRISPR gRNA sequence
tgggaaactgacttgggagg

SEQ ID NO: 561612 - DNA, 20 bp, Artificial
  CRISPR gRNA sequence
gggaaactgacttgggagga

SEQ ID NO: 561613 - DNA, 20 bp, Artificial
  CRISPR gRNA sequence
ggaaactgacttgggaggat

SEQ ID NO: 561614 - DNA, 20 bp, Artificial
  CRISPR gRNA sequence
acttgggaggattgcttgag

SEQ ID NO: 561615 - DNA, 20 bp, Artificial
  CRISPR gRNA sequence
gggaggattgcttgagccca

SEQ ID NO: 561616 - DNA, 20 bp, Artificial
  CRISPR gRNA sequence
ggaggattgcttgagcccag

SEQ ID NO: 561617 - DNA, 20 bp, Artificial
  CRISPR gRNA sequence
cttgagcccaggagttcaag

SEQ ID NO: 561618 - DNA, 20 bp, Artificial
  CRISPR gRNA sequence
gagcccaggagttcaagacc

SEQ ID NO: 561619 - DNA, 20 bp, Artificial
  CRISPR gRNA sequence
agcccaggagttcaagacca

SEQ ID NO: 561620 - DNA, 20 bp, Artificial
  CRISPR gRNA sequence
aagaccagcctgggcaacat

SEQ ID NO: 561621 - DNA, 20 bp, Artificial
  CRISPR gRNA sequence
ggcaacatggcaaaaccccg

SEQ ID NO: 561622 - DNA, 20 bp, Artificial
  CRISPR gRNA sequence
tataaaaaatacaaaaaaat

SEQ ID NO: 561623 - DNA, 20 bp, Artificial
  CRISPR gRNA sequence
taaaaaatacaaaaaaatta

SEQ ID NO: 561624 - DNA, 20 bp, Artificial
  CRISPR gRNA sequence
ggtggacgtgaaggcatgtc

SEQ ID NO: 561625 - DNA, 20 bp, Artificial
  CRISPR gRNA sequence
tagtcccagctatttggaaa

SEQ ID NO: 561626 - DNA, 20 bp, Artificial
  CRISPR gRNA sequence
tttggaaactgaggtgggag

SEQ ID NO: 561627 - DNA, 20 bp, Artificial
  CRISPR gRNA sequence
ggaaactgaggtgggaggat

SEQ ID NO: 561628 - DNA, 20 bp, Artificial
  CRISPR gRNA sequence
gaaactgaggtgggaggatc

SEQ ID NO: 561629 - DNA, 20 bp, Artificial
  CRISPR gRNA sequence
aggtgggaggatcgcttgag

SEQ ID NO: 561630 - DNA, 20 bp, Artificial
  CRISPR gRNA sequence
gagtctgggagatcaaggct

SEQ ID NO: 561631 - DNA, 20 bp, Artificial
  CRISPR gRNA sequence
agtctgggagatcaaggctg

SEQ ID NO: 561632 - DNA, 20 bp, Artificial
  CRISPR gRNA sequence
ggagatcaaggctgcagtga

SEQ ID NO: 561633 - DNA, 20 bp, Artificial
  CRISPR gRNA sequence
cagtgagccataattgtgtc

SEQ ID NO: 561634 - DNA, 20 bp, Artificial
  CRISPR gRNA sequence
tgtcactatactctagcctg

SEQ ID NO: 561635 - DNA, 20 bp, Artificial
  CRISPR gRNA sequence
tactctagcctgggcaacag

SEQ ID NO: 561636 - DNA, 20 bp, Artificial
  CRISPR gRNA sequence
tagcctgggcaacagagtga

SEQ ID NO: 561637 - DNA, 20 bp, Artificial
  CRISPR gRNA sequence
gcctgggcaacagagtgaga

SEQ ID NO: 561638 - DNA, 20 bp, Artificial
  CRISPR gRNA sequence
ggcaacagagtgagactgtg

SEQ ID NO: 561639 - DNA, 20 bp, Artificial
  CRISPR gRNA sequence
tgtctcaaaagaaaagagaa

SEQ ID NO: 561640 - DNA, 20 bp, Artificial
  CRISPR gRNA sequence
aaaagaaaagagaaaaggca

SEQ ID NO: 561641 - DNA, 20 bp, Artificial
  CRISPR gRNA sequence
ccatttgaaaatattttagt

SEQ ID NO: 561642 - DNA, 20 bp, Artificial
  CRISPR gRNA sequence
gaaaatattttagtggctgg

SEQ ID NO: 561643 - DNA, 20 bp, Artificial
  CRISPR gRNA sequence
aaaatattttagtggctgga

SEQ ID NO: 561644 - DNA, 20 bp, Artificial
  CRISPR gRNA sequence
tagtggctggatgtggtggt

SEQ ID NO: 561645 - DNA, 20 bp, Artificial
  CRISPR gRNA sequence
agtggctggatgtggtggtt

SEQ ID NO: 561646 - DNA, 20 bp, Artificial
  CRISPR gRNA sequence
gtggctggatgtggtggttc

SEQ ID NO: 561647 - DNA, 20 bp, Artificial
  CRISPR gRNA sequence
gatgtggtggttcatgcctg

SEQ ID NO: 561648 - DNA, 20 bp, Artificial
  CRISPR gRNA sequence
atgcctgtaatcccaacact

SEQ ID NO: 561649 - DNA, 20 bp, Artificial
  CRISPR gRNA sequence
taatcccaacacttcggtag

SEQ ID NO: 561650 - DNA, 20 bp, Artificial
  CRISPR gRNA sequence
cggtaggccaaggagggagg

SEQ ID NO: 561651 - DNA, 20 bp, Artificial
  CRISPR gRNA sequence
ggtaggccaaggagggagga

SEQ ID NO: 561652 - DNA, 20 bp, Artificial
  CRISPR gRNA sequence
gagcccaggagtttaagacc

SEQ ID NO: 561653 - DNA, 20 bp, Artificial
  CRISPR gRNA sequence
agcccaggagtttaagacca

SEQ ID NO: 561654 - DNA, 20 bp, Artificial
  CRISPR gRNA sequence
aagaccagtctgggcaacat

SEQ ID NO: 561655 - DNA, 20 bp, Artificial
  CRISPR gRNA sequence
agaccagtctgggcaacata

SEQ ID NO: 561656 - DNA, 20 bp, Artificial
  CRISPR gRNA sequence
ggcaacatagggaaaccctg

SEQ ID NO: 561657 - DNA, 20 bp, Artificial
  CRISPR gRNA sequence
tttctacaaaaactaaaaaa

SEQ ID NO: 561658 - DNA, 20 bp, Artificial
  CRISPR gRNA sequence
ctacaaaaactaaaaaaaaa

SEQ ID NO: 561659 - DNA, 20 bp, Artificial
  CRISPR gRNA sequence
tacaaaaactaaaaaaaaat

SEQ ID NO: 561660 - DNA, 20 bp, Artificial
  CRISPR gRNA sequence
caaaaactaaaaaaaaatta

SEQ ID NO: 561661 - DNA, 20 bp, Artificial
  CRISPR gRNA sequence
aaaaaaaattagccaagcat

SEQ ID NO: 561662 - DNA, 20 bp, Artificial
  CRISPR gRNA sequence
gccaagcatggtggcatgca

SEQ ID NO: 561663 - DNA, 20 bp, Artificial
  CRISPR gRNA sequence
tagtcctggctactcagaag

SEQ ID NO: 561664 - DNA, 20 bp, Artificial
  CRISPR gRNA sequence
gctactcagaaggctgaggt

SEQ ID NO: 561665 - DNA, 20 bp, Artificial
  CRISPR gRNA sequence
ctcagaaggctgaggtggca

SEQ ID NO: 561666 - DNA, 20 bp, Artificial
  CRISPR gRNA sequence
agaaggctgaggtggcagaa

SEQ ID NO: 561667 - DNA, 20 bp, Artificial
  CRISPR gRNA sequence
aggtggcagaattgcttgag

SEQ ID NO: 561668 - DNA, 20 bp, Artificial
  CRISPR gRNA sequence
cttgagcctcagaggtcgag

SEQ ID NO: 561669 - DNA, 20 bp, Artificial
  CRISPR gRNA sequence
gagcctcagaggtcgaggct

SEQ ID NO: 561670 - DNA, 20 bp, Artificial
  CRISPR gRNA sequence
agcctcagaggtcgaggctg

SEQ ID NO: 561671 - DNA, 20 bp, Artificial
  CRISPR gRNA sequence
agaggtcgaggctggagtta

SEQ ID NO: 561672 - DNA, 20 bp, Artificial
  CRISPR gRNA sequence
gagttagctgtgatagcacc

SEQ ID NO: 561673 - DNA, 20 bp, Artificial
  CRISPR gRNA sequence
gctgtgatagcacccctgta

SEQ ID NO: 561674 - DNA, 20 bp, Artificial
  CRISPR gRNA sequence
tgatagcacccctgtactcc

SEQ ID NO: 561675 - DNA, 20 bp, Artificial
  CRISPR gRNA sequence
tactccagcctgggtgacac

SEQ ID NO: 561676 - DNA, 20 bp, Artificial
  CRISPR gRNA sequence
cagcctgggtgacacagtga

SEQ ID NO: 561677 - DNA, 20 bp, Artificial
  CRISPR gRNA sequence
ggtgacacagtgagaccctg

SEQ ID NO: 561678 - DNA, 20 bp, Artificial
  CRISPR gRNA sequence
tctcaaaaaataaaataaaa

SEQ ID NO: 561679 - DNA, 20 bp, Artificial
  CRISPR gRNA sequence
aaaaaataaaataaaatatt

SEQ ID NO: 561680 - DNA, 20 bp, Artificial
  CRISPR gRNA sequence
tagtgataatggattctggg

SEQ ID NO: 561681 - DNA, 20 bp, Artificial
  CRISPR gRNA sequence
agtgataatggattctggga

SEQ ID NO: 561682 - DNA, 20 bp, Artificial
  CRISPR gRNA sequence
gtgataatggattctgggaa

SEQ ID NO: 561683 - DNA, 20 bp, Artificial
  CRISPR gRNA sequence
tgggaagaatcaccatagga

SEQ ID NO: 561684 - DNA, 20 bp, Artificial
  CRISPR gRNA sequence
ggaagaatcaccataggata

SEQ ID NO: 561685 - DNA, 20 bp, Artificial
  CRISPR gRNA sequence
aaaccactgaatgaacaatg

SEQ ID NO: 561686 - DNA, 20 bp, Artificial
  CRISPR gRNA sequence
aatgaacaatggctggagaa

SEQ ID NO: 561687 - DNA, 20 bp, Artificial
  CRISPR gRNA sequence
gagaacaggatattcactca

SEQ ID NO: 561688 - DNA, 20 bp, Artificial
  CRISPR gRNA sequence
actcaacctcaaaacatcac

SEQ ID NO: 561689 - DNA, 20 bp, Artificial
  CRISPR gRNA sequence
aacctcaaaacatcacttaa

SEQ ID NO: 561690 - DNA, 20 bp, Artificial
  CRISPR gRNA sequence
aaaacatcacttaacacatc

SEQ ID NO: 561691 - DNA, 20 bp, Artificial
  CRISPR gRNA sequence
aacacatcatttattactta

SEQ ID NO: 561692 - DNA, 20 bp, Artificial
  CRISPR gRNA sequence
acacatcatttattacttac

SEQ ID NO: 561693 - DNA, 20 bp, Artificial
  CRISPR gRNA sequence
attacttacaaaggtaaaat

SEQ ID NO: 561694 - DNA, 20 bp, Artificial
  CRISPR gRNA sequence
ttacttacaaaggtaaaatg

SEQ ID NO: 561695 - DNA, 20 bp, Artificial
  CRISPR gRNA sequence
cttacaaaggtaaaatggtg

SEQ ID NO: 561696 - DNA, 20 bp, Artificial
  CRISPR gRNA sequence
acaaaggtaaaatggtgcct

SEQ ID NO: 561697 - DNA, 20 bp, Artificial
  CRISPR gRNA sequence
caaaggtaaaatggtgcctc

SEQ ID NO: 561698 - DNA, 20 bp, Artificial
  CRISPR gRNA sequence
tacaatggagaaatctggta

SEQ ID NO: 561699 - DNA, 20 bp, Artificial
  CRISPR gRNA sequence
caatggagaaatctggtaaa

SEQ ID NO: 561700 - DNA, 20 bp, Artificial
  CRISPR gRNA sequence
gtaaacttcactttaaccaa

SEQ ID NO: 561701 - DNA, 20 bp, Artificial
  CRISPR gRNA sequence
cactttaaccaaatgtcaaa

SEQ ID NO: 561702 - DNA, 20 bp, Artificial
  CRISPR gRNA sequence
actttaaccaaatgtcaaag

SEQ ID NO: 561703 - DNA, 20 bp, Artificial
  CRISPR gRNA sequence
taaccaaatgtcaaagttaa

SEQ ID NO: 561704 - DNA, 20 bp, Artificial
  CRISPR gRNA sequence
aaccaaatgtcaaagttaac

SEQ ID NO: 561705 - DNA, 20 bp, Artificial
  CRISPR gRNA sequence
accaaatgtcaaagttaaca

SEQ ID NO: 561706 - DNA, 20 bp, Artificial
  CRISPR gRNA sequence
acatctccaataatgtgaca

SEQ ID NO: 561707 - DNA, 20 bp, Artificial
  CRISPR gRNA sequence
caataatgtgacaaacagac

SEQ ID NO: 561708 - DNA, 20 bp, Artificial
  CRISPR gRNA sequence
cctgatgtgacacactgaga

SEQ ID NO: 561709 - DNA, 20 bp, Artificial
  CRISPR gRNA sequence
ctgatgtgacacactgagaa

SEQ ID NO: 561710 - DNA, 20 bp, Artificial
  CRISPR gRNA sequence
atgtgacacactgagaagga

SEQ ID NO: 561711 - DNA, 20 bp, Artificial
  CRISPR gRNA sequence
agaaggacccaacatagcta

SEQ ID NO: 561712 - DNA, 20 bp, Artificial
  CRISPR gRNA sequence
tgaagtattcctgctacaaa

SEQ ID NO: 561713 - DNA, 20 bp, Artificial
  CRISPR gRNA sequence
ctgctacaaagagttacaac

SEQ ID NO: 561714 - DNA, 20 bp, Artificial
  CRISPR gRNA sequence
ctacaaagagttacaaccag

SEQ ID NO: 561715 - DNA, 20 bp, Artificial
  CRISPR gRNA sequence
caaagagttacaaccagaat

SEQ ID NO: 561716 - DNA, 20 bp, Artificial
  CRISPR gRNA sequence
caaccagaatctgatcatga

SEQ ID NO: 561717 - DNA, 20 bp, Artificial
  CRISPR gRNA sequence
atcatgaggaaacaagcagg

SEQ ID NO: 561718 - DNA, 20 bp, Artificial
  CRISPR gRNA sequence
ggtaaagcaactagcccaga

SEQ ID NO: 561719 - DNA, 20 bp, Artificial
  CRISPR gRNA sequence
gcccagacacttcaaaaatg

SEQ ID NO: 561720 - DNA, 20 bp, Artificial
  CRISPR gRNA sequence
caaaaatgatgatgtcttaa

SEQ ID NO: 561721 - DNA, 20 bp, Artificial
  CRISPR gRNA sequence
aaaaatgatgatgtcttaaa

SEQ ID NO: 561722 - DNA, 20 bp, Artificial
  CRISPR gRNA sequence
aaagtaccaaaaaaaaaaaa

SEQ ID NO: 561723 - DNA, 20 bp, Artificial
  CRISPR gRNA sequence
aagtaccaaaaaaaaaaaaa

SEQ ID NO: 561724 - DNA, 20 bp, Artificial
  CRISPR gRNA sequence
taggttaaagggggttaaaa

SEQ ID NO: 561725 - DNA, 20 bp, Artificial
  CRISPR gRNA sequence
aggttaaagggggttaaaaa

SEQ ID NO: 561726 - DNA, 20 bp, Artificial
  CRISPR gRNA sequence
ggttaaagggggttaaaaag

SEQ ID NO: 561727 - DNA, 20 bp, Artificial
  CRISPR gRNA sequence
aagggggttaaaaaggcatg

SEQ ID NO: 561728 - DNA, 20 bp, Artificial
  CRISPR gRNA sequence
aaaaggcatgattatcaaat

SEQ ID NO: 561729 - DNA, 20 bp, Artificial
  CRISPR gRNA sequence
tcaaatgaagtatgtggtgc

SEQ ID NO: 561730 - DNA, 20 bp, Artificial
  CRISPR gRNA sequence
gcttctgggttctctaccag

SEQ ID NO: 561731 - DNA, 20 bp, Artificial
  CRISPR gRNA sequence
ctgggttctctaccaggaaa

SEQ ID NO: 561732 - DNA, 20 bp, Artificial
  CRISPR gRNA sequence
tgggttctctaccaggaaac

SEQ ID NO: 561733 - DNA, 20 bp, Artificial
  CRISPR gRNA sequence
ggttctctaccaggaaacag

SEQ ID NO: 561734 - DNA, 20 bp, Artificial
  CRISPR gRNA sequence
tctaccaggaaacagtattg

SEQ ID NO: 561735 - DNA, 20 bp, Artificial
  CRISPR gRNA sequence
taccaggaaacagtattgta

SEQ ID NO: 561736 - DNA, 20 bp, Artificial
  CRISPR gRNA sequence
ccaggaaacagtattgtatc

SEQ ID NO: 561737 - DNA, 20 bp, Artificial
  CRISPR gRNA sequence
tatcaatgccacatttccag

SEQ ID NO: 561738 - DNA, 20 bp, Artificial
  CRISPR gRNA sequence
ccagattatgatgattctgt

SEQ ID NO: 561739 - DNA, 20 bp, Artificial
  CRISPR gRNA sequence
cagattatgatgattctgtg

SEQ ID NO: 561740 - DNA, 20 bp, Artificial
  CRISPR gRNA sequence
tgatgattctgtgacttgtt

SEQ ID NO: 561741 - DNA, 20 bp, Artificial
  CRISPR gRNA sequence
tgtgacttgttggagaatgc

SEQ ID NO: 561742 - DNA, 20 bp, Artificial
  CRISPR gRNA sequence
tgacttgttggagaatgctc

SEQ ID NO: 561743 - DNA, 20 bp, Artificial
  CRISPR gRNA sequence
gttggagaatgctcttgttc

SEQ ID NO: 561744 - DNA, 20 bp, Artificial
  CRISPR gRNA sequence
ttggagaatgctcttgttct

SEQ ID NO: 561745 - DNA, 20 bp, Artificial
  CRISPR gRNA sequence
gagaatgctcttgttcttat

SEQ ID NO: 561746 - DNA, 20 bp, Artificial
  CRISPR gRNA sequence
ttgttcttatgagacatatg

SEQ ID NO: 561747 - DNA, 20 bp, Artificial
  CRISPR gRNA sequence
gttcttatgagacatatgat

SEQ ID NO: 561748 - DNA, 20 bp, Artificial
  CRISPR gRNA sequence
ttcttatgagacatatgata

SEQ ID NO: 561749 - DNA, 20 bp, Artificial
  CRISPR gRNA sequence
ttatgagacatatgataaag

SEQ ID NO: 561750 - DNA, 20 bp, Artificial
  CRISPR gRNA sequence
atgagacatatgataaagaa

SEQ ID NO: 561751 - DNA, 20 bp, Artificial
  CRISPR gRNA sequence
tgagacatatgataaagaat

SEQ ID NO: 561752 - DNA, 20 bp, Artificial
  CRISPR gRNA sequence
caggtgaggtgtcatgagat

SEQ ID NO: 561753 - DNA, 20 bp, Artificial
  CRISPR gRNA sequence
aaactctcaaatggtttggc

SEQ ID NO: 561754 - DNA, 20 bp, Artificial
  CRISPR gRNA sequence
tcaaatggtttggcaaaaat

SEQ ID NO: 561755 - DNA, 20 bp, Artificial
  CRISPR gRNA sequence
aaatggtttggcaaaaataa

SEQ ID NO: 561756 - DNA, 20 bp, Artificial
  CRISPR gRNA sequence
ggcaaaaataacagatggca

SEQ ID NO: 561757 - DNA, 20 bp, Artificial
  CRISPR gRNA sequence
gcaaaaataacagatggcaa

SEQ ID NO: 561758 - DNA, 20 bp, Artificial
  CRISPR gRNA sequence
atgtgacagttaactggtga

SEQ ID NO: 561759 - DNA, 20 bp, Artificial
  CRISPR gRNA sequence
actggtgattcaaggagaaa

SEQ ID NO: 561760 - DNA, 20 bp, Artificial
  CRISPR gRNA sequence
gtgattcaaggagaaagtac

SEQ ID NO: 561761 - DNA, 20 bp, Artificial
  CRISPR gRNA sequence
aaggagaaagtacgcaaatg

SEQ ID NO: 561762 - DNA, 20 bp, Artificial
  CRISPR gRNA sequence
actgtactaattttgcaact

SEQ ID NO: 561763 - DNA, 20 bp, Artificial
  CRISPR gRNA sequence
tactaattttgcaactgtcc

SEQ ID NO: 561764 - DNA, 20 bp, Artificial
  CRISPR gRNA sequence
attttgcaactgtcctaaag

SEQ ID NO: 561765 - DNA, 20 bp, Artificial
  CRISPR gRNA sequence
tgcaactgtcctaaagattt

SEQ ID NO: 561766 - DNA, 20 bp, Artificial
  CRISPR gRNA sequence
gcaactgtcctaaagatttt

SEQ ID NO: 561767 - DNA, 20 bp, Artificial
  CRISPR gRNA sequence
caactgtcctaaagatttta

SEQ ID NO: 561768 - DNA, 20 bp, Artificial
  CRISPR gRNA sequence
tcctaaagattttaattgtt

SEQ ID NO: 561769 - DNA, 20 bp, Artificial
  CRISPR gRNA sequence
aagattttaattgttctaaa

SEQ ID NO: 561770 - DNA, 20 bp, Artificial
  CRISPR gRNA sequence
taattgttctaaaatttcaa

SEQ ID NO: 561771 - DNA, 20 bp, Artificial
  CRISPR gRNA sequence
aattgttctaaaatttcaaa

SEQ ID NO: 561772 - DNA, 20 bp, Artificial
  CRISPR gRNA sequence
attgttctaaaatttcaaaa

SEQ ID NO: 561773 - DNA, 20 bp, Artificial
  CRISPR gRNA sequence
ttctaaaatttcaaaaaaaa

SEQ ID NO: 561774 - DNA, 20 bp, Artificial
  CRISPR gRNA sequence
taaaatttcaaaaaaaaccc

SEQ ID NO: 561775 - DNA, 20 bp, Artificial
  CRISPR gRNA sequence
aaatttcaaaaaaaacccta

SEQ ID NO: 561776 - DNA, 20 bp, Artificial
  CRISPR gRNA sequence
caaaaaaaaccctaaactga

SEQ ID NO: 561777 - DNA, 20 bp, Artificial
  CRISPR gRNA sequence
aaaaaaaaccctaaactgaa

SEQ ID NO: 561778 - DNA, 20 bp, Artificial
  CRISPR gRNA sequence
aactgaagtattaacgactt

SEQ ID NO: 561779 - DNA, 20 bp, Artificial
  CRISPR gRNA sequence
aagtattaacgacttccatc

SEQ ID NO: 561780 - DNA, 20 bp, Artificial
  CRISPR gRNA sequence
acgacttccatcaccccttt

SEQ ID NO: 561781 - DNA, 20 bp, Artificial
  CRISPR gRNA sequence
ccatcacccctttctttgct

SEQ ID NO: 561782 - DNA, 20 bp, Artificial
  CRISPR gRNA sequence
catcacccctttctttgctt

SEQ ID NO: 561783 - DNA, 20 bp, Artificial
  CRISPR gRNA sequence
tctttgctttactcatctct

SEQ ID NO: 561784 - DNA, 20 bp, Artificial
  CRISPR gRNA sequence
ctttgctttactcatctctg

SEQ ID NO: 561785 - DNA, 20 bp, Artificial
  CRISPR gRNA sequence
tttgctttactcatctctgt

SEQ ID NO: 561786 - DNA, 20 bp, Artificial
  CRISPR gRNA sequence
tgctttactcatctctgtac

SEQ ID NO: 561787 - DNA, 20 bp, Artificial
  CRISPR gRNA sequence
gctttactcatctctgtact

SEQ ID NO: 561788 - DNA, 20 bp, Artificial
  CRISPR gRNA sequence
ctttactcatctctgtacta

SEQ ID NO: 561789 - DNA, 20 bp, Artificial
  CRISPR gRNA sequence
tactcatctctgtactagta

SEQ ID NO: 561790 - DNA, 20 bp, Artificial
  CRISPR gRNA sequence
actcatctctgtactagtaa

SEQ ID NO: 561791 - DNA, 20 bp, Artificial
  CRISPR gRNA sequence
ctcatctctgtactagtaaa

SEQ ID NO: 561792 - DNA, 20 bp, Artificial
  CRISPR gRNA sequence
atctctgtactagtaaatgt

SEQ ID NO: 561793 - DNA, 20 bp, Artificial
  CRISPR gRNA sequence
tgtactagtaaatgtttact

SEQ ID NO: 561794 - DNA, 20 bp, Artificial
  CRISPR gRNA sequence
tactagtaaatgtttacttt

SEQ ID NO: 561795 - DNA, 20 bp, Artificial
  CRISPR gRNA sequence
gtaaatgtttactttatcac

SEQ ID NO: 561796 - DNA, 20 bp, Artificial
  CRISPR gRNA sequence
actttatcaccatccagcat

SEQ ID NO: 561797 - DNA, 20 bp, Artificial
  CRISPR gRNA sequence
ctttatcaccatccagcatc

SEQ ID NO: 561798 - DNA, 20 bp, Artificial
  CRISPR gRNA sequence
tatcaccatccagcatccat

SEQ ID NO: 561799 - DNA, 20 bp, Artificial
  CRISPR gRNA sequence
atcaccatccagcatccatg

SEQ ID NO: 561800 - DNA, 20 bp, Artificial
  CRISPR gRNA sequence
tcaccatccagcatccatgt

SEQ ID NO: 561801 - DNA, 20 bp, Artificial
  CRISPR gRNA sequence
ttactcatttacttactgtc

SEQ ID NO: 561802 - DNA, 20 bp, Artificial
  CRISPR gRNA sequence
tactcatttacttactgtct

SEQ ID NO: 561803 - DNA, 20 bp, Artificial
  CRISPR gRNA sequence
actcatttacttactgtctc

SEQ ID NO: 561804 - DNA, 20 bp, Artificial
  CRISPR gRNA sequence
ctcatttacttactgtctct

SEQ ID NO: 561805 - DNA, 20 bp, Artificial
  CRISPR gRNA sequence
atttacttactgtctctctc

SEQ ID NO: 561806 - DNA, 20 bp, Artificial
  CRISPR gRNA sequence
acttactgtctctctccctc

SEQ ID NO: 561807 - DNA, 20 bp, Artificial
  CRISPR gRNA sequence
cttactgtctctctccctca

SEQ ID NO: 561808 - DNA, 20 bp, Artificial
  CRISPR gRNA sequence
actgtctctctccctcacta

SEQ ID NO: 561809 - DNA, 20 bp, Artificial
  CRISPR gRNA sequence
ctgtctctctccctcactat

SEQ ID NO: 561810 - DNA, 20 bp, Artificial
  CRISPR gRNA sequence
tctctctccctcactataag

SEQ ID NO: 561811 - DNA, 20 bp, Artificial
  CRISPR gRNA sequence
tctccctcactataaggtga

SEQ ID NO: 561812 - DNA, 20 bp, Artificial
  CRISPR gRNA sequence
tccctcactataaggtgagc

SEQ ID NO: 561813 - DNA, 20 bp, Artificial
  CRISPR gRNA sequence
cctcactataaggtgagctt

SEQ ID NO: 561814 - DNA, 20 bp, Artificial
  CRISPR gRNA sequence
actataaggtgagcttcaca

SEQ ID NO: 561815 - DNA, 20 bp, Artificial
  CRISPR gRNA sequence
taaggtgagcttcacaaagg

SEQ ID NO: 561816 - DNA, 20 bp, Artificial
  CRISPR gRNA sequence
cacaaaggcagggaactgtg

SEQ ID NO: 561817 - DNA, 20 bp, Artificial
  CRISPR gRNA sequence
acaaaggcagggaactgtgc

SEQ ID NO: 561818 - DNA, 20 bp, Artificial
  CRISPR gRNA sequence
tgcatagcttgctgtatccc

SEQ ID NO: 561819 - DNA, 20 bp, Artificial
  CRISPR gRNA sequence
gctgtatcccccgtccattg

SEQ ID NO: 561820 - DNA, 20 bp, Artificial
  CRISPR gRNA sequence
ctgtatcccccgtccattgt

SEQ ID NO: 561821 - DNA, 20 bp, Artificial
  CRISPR gRNA sequence
tatcccccgtccattgtgca

SEQ ID NO: 561822 - DNA, 20 bp, Artificial
  CRISPR gRNA sequence
tgcagtgcttaacatataat

SEQ ID NO: 561823 - DNA, 20 bp, Artificial
  CRISPR gRNA sequence
aacatataattgacactcag

SEQ ID NO: 561824 - DNA, 20 bp, Artificial
  CRISPR gRNA sequence
acatataattgacactcagt

SEQ ID NO: 561825 - DNA, 20 bp, Artificial
  CRISPR gRNA sequence
acactcagtaaatatttatt

SEQ ID NO: 561826 - DNA, 20 bp, Artificial
  CRISPR gRNA sequence
agtaaatatttattgcatga

SEQ ID NO: 561827 - DNA, 20 bp, Artificial
  CRISPR gRNA sequence
attgcatgactgatgttccc

SEQ ID NO: 561828 - DNA, 20 bp, Artificial
  CRISPR gRNA sequence
ttgcatgactgatgttccca

SEQ ID NO: 561829 - DNA, 20 bp, Artificial
  CRISPR gRNA sequence
catgactgatgttcccagta

SEQ ID NO: 561830 - DNA, 20 bp, Artificial
  CRISPR gRNA sequence
atgttcccagtaattctatg

SEQ ID NO: 561831 - DNA, 20 bp, Artificial
  CRISPR gRNA sequence
ccagtaattctatgaagtgg

SEQ ID NO: 561832 - DNA, 20 bp, Artificial
  CRISPR gRNA sequence
tatgaagtgggtttattatt

SEQ ID NO: 561833 - DNA, 20 bp, Artificial
  CRISPR gRNA sequence
tgaagtgggtttattattct

SEQ ID NO: 561834 - DNA, 20 bp, Artificial
  CRISPR gRNA sequence
attattctcctttccctcat

SEQ ID NO: 561835 - DNA, 20 bp, Artificial
  CRISPR gRNA sequence
ttattctcctttccctcatg

SEQ ID NO: 561836 - DNA, 20 bp, Artificial
  CRISPR gRNA sequence
ttctcctttccctcatgtga

SEQ ID NO: 561837 - DNA, 20 bp, Artificial
  CRISPR gRNA sequence
tcctttccctcatgtgagtg

SEQ ID NO: 561838 - DNA, 20 bp, Artificial
  CRISPR gRNA sequence
ctttccctcatgtgagtggt

SEQ ID NO: 561839 - DNA, 20 bp, Artificial
  CRISPR gRNA sequence
tccctcatgtgagtggtact

SEQ ID NO: 561840 - DNA, 20 bp, Artificial
  CRISPR gRNA sequence
ccctcatgtgagtggtactc

SEQ ID NO: 561841 - DNA, 20 bp, Artificial
  CRISPR gRNA sequence
cctcatgtgagtggtactct

SEQ ID NO: 561842 - DNA, 20 bp, Artificial
  CRISPR gRNA sequence
atgtgagtggtactctcttc

SEQ ID NO: 561843 - DNA, 20 bp, Artificial
  CRISPR gRNA sequence
tcttcaaaagtgaaggtact

SEQ ID NO: 561844 - DNA, 20 bp, Artificial
  CRISPR gRNA sequence
ttcaaaagtgaaggtactga

SEQ ID NO: 561845 - DNA, 20 bp, Artificial
  CRISPR gRNA sequence
caaaagtgaaggtactgaag

SEQ ID NO: 561846 - DNA, 20 bp, Artificial
  CRISPR gRNA sequence
aaaagtgaaggtactgaagt

SEQ ID NO: 561847 - DNA, 20 bp, Artificial
  CRISPR gRNA sequence
aagtgaagagaagttaggga

SEQ ID NO: 561848 - DNA, 20 bp, Artificial
  CRISPR gRNA sequence
gggaactcacacaagttcat

SEQ ID NO: 561849 - DNA, 20 bp, Artificial
  CRISPR gRNA sequence
acacaagttcatgactcagg

SEQ ID NO: 561850 - DNA, 20 bp, Artificial
  CRISPR gRNA sequence
atgactcaggtgaggagtgg

SEQ ID NO: 561851 - DNA, 20 bp, Artificial
  CRISPR gRNA sequence
aggtgaggagtggggccagg

SEQ ID NO: 561852 - DNA, 20 bp, Artificial
  CRISPR gRNA sequence
ggcatctgaccccagagctg

SEQ ID NO: 561853 - DNA, 20 bp, Artificial
  CRISPR gRNA sequence
accccagagctgatgctgtt

SEQ ID NO: 561854 - DNA, 20 bp, Artificial
  CRISPR gRNA sequence
atgctgttaatcactgcatt

SEQ ID NO: 561855 - DNA, 20 bp, Artificial
  CRISPR gRNA sequence
ttaatcactgcatttgcagc

SEQ ID NO: 561856 - DNA, 20 bp, Artificial
  CRISPR gRNA sequence
atcactgcatttgcagcttc

SEQ ID NO: 561857 - DNA, 20 bp, Artificial
  CRISPR gRNA sequence
catttgcagcttccctaatg

SEQ ID NO: 561858 - DNA, 20 bp, Artificial
  CRISPR gRNA sequence
gcagcttccctaatgaggca

SEQ ID NO: 561859 - DNA, 20 bp, Artificial
  CRISPR gRNA sequence
cagcttccctaatgaggcag

SEQ ID NO: 561860 - DNA, 20 bp, Artificial
  CRISPR gRNA sequence
ccctaatgaggcaggcttgg

SEQ ID NO: 561861 - DNA, 20 bp, Artificial
  CRISPR gRNA sequence
cctaatgaggcaggcttggg

SEQ ID NO: 561862 - DNA, 20 bp, Artificial
  CRISPR gRNA sequence
atgaggcaggcttgggtccc

SEQ ID NO: 561863 - DNA, 20 bp, Artificial
  CRISPR gRNA sequence
gggtccccaaaaggggatat

SEQ ID NO: 561864 - DNA, 20 bp, Artificial
  CRISPR gRNA sequence
ggtccccaaaaggggatata

SEQ ID NO: 561865 - DNA, 20 bp, Artificial
  CRISPR gRNA sequence
agtcttgtctttagtttaag

SEQ ID NO: 561866 - DNA, 20 bp, Artificial
  CRISPR gRNA sequence
gtctttagtttaaggcctat

SEQ ID NO: 561867 - DNA, 20 bp, Artificial
  CRISPR gRNA sequence
tctttagtttaaggcctatg

SEQ ID NO: 561868 - DNA, 20 bp, Artificial
  CRISPR gRNA sequence
tagtttaaggcctatgcaga

SEQ ID NO: 561869 - DNA, 20 bp, Artificial
  CRISPR gRNA sequence
agtttaaggcctatgcagag

SEQ ID NO: 561870 - DNA, 20 bp, Artificial
  CRISPR gRNA sequence
gtttaaggcctatgcagagc

SEQ ID NO: 561871 - DNA, 20 bp, Artificial
  CRISPR gRNA sequence
aaggcctatgcagagcagtt

SEQ ID NO: 561872 - DNA, 20 bp, Artificial
  CRISPR gRNA sequence
aggcctatgcagagcagttt

SEQ ID NO: 561873 - DNA, 20 bp, Artificial
  CRISPR gRNA sequence
tgcagagcagtttataaata

SEQ ID NO: 561874 - DNA, 20 bp, Artificial
  CRISPR gRNA sequence
ataaatacatgtttgctgaa

SEQ ID NO: 561875 - DNA, 20 bp, Artificial
  CRISPR gRNA sequence
taaatacatgtttgctgaat

SEQ ID NO: 561876 - DNA, 20 bp, Artificial
  CRISPR gRNA sequence
gctgaatcaaatgacttctg

SEQ ID NO: 561877 - DNA, 20 bp, Artificial
  CRISPR gRNA sequence
ctgaatcaaatgacttctga

SEQ ID NO: 561878 - DNA, 20 bp, Artificial
  CRISPR gRNA sequence
aatcaaatgacttctgaatg

SEQ ID NO: 561879 - DNA, 20 bp, Artificial
  CRISPR gRNA sequence
ctgaatgaatacatgaatta

SEQ ID NO: 561880 - DNA, 20 bp, Artificial
  CRISPR gRNA sequence
tgaatgaatacatgaattag

SEQ ID NO: 561881 - DNA, 20 bp, Artificial
  CRISPR gRNA sequence
aatgaatacatgaattaggt

SEQ ID NO: 561882 - DNA, 20 bp, Artificial
  CRISPR gRNA sequence
ggtgagagagatcaccagga

SEQ ID NO: 561883 - DNA, 20 bp, Artificial
  CRISPR gRNA sequence
aaataatctgttggaggtgg

SEQ ID NO: 561884 - DNA, 20 bp, Artificial
  CRISPR gRNA sequence
ttggaggtggagcttgggca

SEQ ID NO: 561885 - DNA, 20 bp, Artificial
  CRISPR gRNA sequence
gaggtggagcttgggcaaac

SEQ ID NO: 561886 - DNA, 20 bp, Artificial
  CRISPR gRNA sequence
gggcaaactgggtttgcagt

SEQ ID NO: 561887 - DNA, 20 bp, Artificial
  CRISPR gRNA sequence
ggcaaactgggtttgcagtg

SEQ ID NO: 561888 - DNA, 20 bp, Artificial
  CRISPR gRNA sequence
ggtttgcagtggaagggaga

SEQ ID NO: 561889 - DNA, 20 bp, Artificial
  CRISPR gRNA sequence
gcagtggaagggagaacaca

SEQ ID NO: 561890 - DNA, 20 bp, Artificial
  CRISPR gRNA sequence
cagtggaagggagaacacag

SEQ ID NO: 561891 - DNA, 20 bp, Artificial
  CRISPR gRNA sequence
gcctggaggagagttacccc

SEQ ID NO: 561892 - DNA, 20 bp, Artificial
  CRISPR gRNA sequence
cctggaggagagttacccca

SEQ ID NO: 561893 - DNA, 20 bp, Artificial
  CRISPR gRNA sequence
gaggagagttaccccatcca

SEQ ID NO: 561894 - DNA, 20 bp, Artificial
  CRISPR gRNA sequence
ccccatccattcaattaatc

SEQ ID NO: 561895 - DNA, 20 bp, Artificial
  CRISPR gRNA sequence
aattaatccctgtttgtatc

SEQ ID NO: 561896 - DNA, 20 bp, Artificial
  CRISPR gRNA sequence
atccctgtttgtatctcttc

SEQ ID NO: 561897 - DNA, 20 bp, Artificial
  CRISPR gRNA sequence
tttgtatctcttcttttccc

SEQ ID NO: 561898 - DNA, 20 bp, Artificial
  CRISPR gRNA sequence
gtatctcttcttttccccag

SEQ ID NO: 561899 - DNA, 20 bp, Artificial
  CRISPR gRNA sequence
tatctcttcttttccccagc

SEQ ID NO: 561900 - DNA, 20 bp, Artificial
  CRISPR gRNA sequence
ttcttttccccagccacccg

SEQ ID NO: 561901 - DNA, 20 bp, Artificial
  CRISPR gRNA sequence
cttttccccagccacccgca

SEQ ID NO: 561902 - DNA, 20 bp, Artificial
  CRISPR gRNA sequence
ttttccccagccacccgcac

SEQ ID NO: 561903 - DNA, 20 bp, Artificial
  CRISPR gRNA sequence
ttccccagccacccgcacat

SEQ ID NO: 561904 - DNA, 20 bp, Artificial
  CRISPR gRNA sequence
tccccagccacccgcacatg

SEQ ID NO: 561905 - DNA, 20 bp, Artificial
  CRISPR gRNA sequence
ccccagccacccgcacatga

SEQ ID NO: 561906 - DNA, 20 bp, Artificial
  CRISPR gRNA sequence
cccagccacccgcacatgaa

SEQ ID NO: 561907 - DNA, 20 bp, Artificial
  CRISPR gRNA sequence
cccagagctatttgggccct

SEQ ID NO: 561908 - DNA, 20 bp, Artificial
  CRISPR gRNA sequence
tttgggccctgtgatggtag

SEQ ID NO: 561909 - DNA, 20 bp, Artificial
  CRISPR gRNA sequence
gggccctgtgatggtagtcc

SEQ ID NO: 561910 - DNA, 20 bp, Artificial
  CRISPR gRNA sequence
ggccctgtgatggtagtcca

SEQ ID NO: 561911 - DNA, 20 bp, Artificial
  CRISPR gRNA sequence
tgatggtagtccaccctggc

SEQ ID NO: 561912 - DNA, 20 bp, Artificial
  CRISPR gRNA sequence
gccttctggcctccctgcct

SEQ ID NO: 561913 - DNA, 20 bp, Artificial
  CRISPR gRNA sequence
ctggcctccctgcctccaat

SEQ ID NO: 561914 - DNA, 20 bp, Artificial
  CRISPR gRNA sequence
tggcctccctgcctccaatt

SEQ ID NO: 561915 - DNA, 20 bp, Artificial
  CRISPR gRNA sequence
gcctccctgcctccaattcc

SEQ ID NO: 561916 - DNA, 20 bp, Artificial
  CRISPR gRNA sequence
cctgcctccaattcctcctg

SEQ ID NO: 561917 - DNA, 20 bp, Artificial
  CRISPR gRNA sequence
cctccaattcctcctgactg

SEQ ID NO: 561918 - DNA, 20 bp, Artificial
  CRISPR gRNA sequence
caattcctcctgactgcagc

SEQ ID NO: 561919 - DNA, 20 bp, Artificial
  CRISPR gRNA sequence
ctcctgactgcagccttcct

SEQ ID NO: 561920 - DNA, 20 bp, Artificial
  CRISPR gRNA sequence
ctgactgcagccttcctctt

SEQ ID NO: 561921 - DNA, 20 bp, Artificial
  CRISPR gRNA sequence
actgcagccttcctctttgt

SEQ ID NO: 561922 - DNA, 20 bp, Artificial
  CRISPR gRNA sequence
cagccttcctctttgttgct

SEQ ID NO: 561923 - DNA, 20 bp, Artificial
  CRISPR gRNA sequence
cctctttgttgctaacagat

SEQ ID NO: 561924 - DNA, 20 bp, Artificial
  CRISPR gRNA sequence
ctctttgttgctaacagatt

SEQ ID NO: 561925 - DNA, 20 bp, Artificial
  CRISPR gRNA sequence
tttgttgctaacagattctt

SEQ ID NO: 561926 - DNA, 20 bp, Artificial
  CRISPR gRNA sequence
tgttgctaacagattcttct

SEQ ID NO: 561927 - DNA, 20 bp, Artificial
  CRISPR gRNA sequence
gttgctaacagattcttctt

SEQ ID NO: 561928 - DNA, 20 bp, Artificial
  CRISPR gRNA sequence
ttgctaacagattcttcttc

SEQ ID NO: 561929 - DNA, 20 bp, Artificial
  CRISPR gRNA sequence
ctaacagattcttcttccca

SEQ ID NO: 561930 - DNA, 20 bp, Artificial
  CRISPR gRNA sequence
acagattcttcttcccaggc

SEQ ID NO: 561931 - DNA, 20 bp, Artificial
  CRISPR gRNA sequence
ttcttcccaggcgcatggtc

SEQ ID NO: 561932 - DNA, 20 bp, Artificial
  CRISPR gRNA sequence
cttcccaggcgcatggtcct

SEQ ID NO: 561933 - DNA, 20 bp, Artificial
  CRISPR gRNA sequence
ttcccaggcgcatggtcctg

SEQ ID NO: 561934 - DNA, 20 bp, Artificial
  CRISPR gRNA sequence
cccaggcgcatggtcctgat

SEQ ID NO: 561935 - DNA, 20 bp, Artificial
  CRISPR gRNA sequence
ccaggcgcatggtcctgatc

SEQ ID NO: 561936 - DNA, 20 bp, Artificial
  CRISPR gRNA sequence
atcctgtaaggcccaggaga

SEQ ID NO: 561937 - DNA, 20 bp, Artificial
  CRISPR gRNA sequence
taaggcccaggagaagctct

SEQ ID NO: 561938 - DNA, 20 bp, Artificial
  CRISPR gRNA sequence
tctcagctcagagaatccag

SEQ ID NO: 561939 - DNA, 20 bp, Artificial
  CRISPR gRNA sequence
tcagctcagagaatccagac

SEQ ID NO: 561940 - DNA, 20 bp, Artificial
  CRISPR gRNA sequence
agctcagagaatccagactc

SEQ ID NO: 561941 - DNA, 20 bp, Artificial
  CRISPR gRNA sequence
agagaatccagactccctaa

SEQ ID NO: 561942 - DNA, 20 bp, Artificial
  CRISPR gRNA sequence
cctaaggggacactcagcaa

SEQ ID NO: 561943 - DNA, 20 bp, Artificial
  CRISPR gRNA sequence
aggggacactcagcaatctt

SEQ ID NO: 561944 - DNA, 20 bp, Artificial
  CRISPR gRNA sequence
agcaatcttttcccacatta

SEQ ID NO: 561945 - DNA, 20 bp, Artificial
  CRISPR gRNA sequence
ttcccacattatcacatgtc

SEQ ID NO: 561946 - DNA, 20 bp, Artificial
  CRISPR gRNA sequence
tcccacattatcacatgtcc

SEQ ID NO: 561947 - DNA, 20 bp, Artificial
  CRISPR gRNA sequence
cccacattatcacatgtcca

SEQ ID NO: 561948 - DNA, 20 bp, Artificial
  CRISPR gRNA sequence
ccacattatcacatgtccac

SEQ ID NO: 561949 - DNA, 20 bp, Artificial
  CRISPR gRNA sequence
tcacatgtccacacatcacc

SEQ ID NO: 561950 - DNA, 20 bp, Artificial
  CRISPR gRNA sequence
gaaggctgggctcaaatatc

SEQ ID NO: 561951 - DNA, 20 bp, Artificial
  CRISPR gRNA sequence
aaggctgggctcaaatatcc

SEQ ID NO: 561952 - DNA, 20 bp, Artificial
  CRISPR gRNA sequence
ggctcaaatatcctccctcc

SEQ ID NO: 561953 - DNA, 20 bp, Artificial
  CRISPR gRNA sequence
aaatatcctccctcccatga

SEQ ID NO: 561954 - DNA, 20 bp, Artificial
  CRISPR gRNA sequence
cctcccatgaagactgcttc

SEQ ID NO: 561955 - DNA, 20 bp, Artificial
  CRISPR gRNA sequence
ccatgaagactgcttcacaa

SEQ ID NO: 561956 - DNA, 20 bp, Artificial
  CRISPR gRNA sequence
cttcacaaaagacacttgat

SEQ ID NO: 561957 - DNA, 20 bp, Artificial
  CRISPR gRNA sequence
cacaaaagacacttgatttc

SEQ ID NO: 561958 - DNA, 20 bp, Artificial
  CRISPR gRNA sequence
acaaaagacacttgatttca

SEQ ID NO: 561959 - DNA, 20 bp, Artificial
  CRISPR gRNA sequence
gatttcacaaaagagactgc

SEQ ID NO: 561960 - DNA, 20 bp, Artificial
  CRISPR gRNA sequence
atttcacaaaagagactgcc

SEQ ID NO: 561961 - DNA, 20 bp, Artificial
  CRISPR gRNA sequence
cacaaaagagactgccttct

SEQ ID NO: 561962 - DNA, 20 bp, Artificial
  CRISPR gRNA sequence
acaaaagagactgccttctt

SEQ ID NO: 561963 - DNA, 20 bp, Artificial
  CRISPR gRNA sequence
ccttcttcttccctctgtac

SEQ ID NO: 561964 - DNA, 20 bp, Artificial
  CRISPR gRNA sequence
cttcttccctctgtaccctc

SEQ ID NO: 561965 - DNA, 20 bp, Artificial
  CRISPR gRNA sequence
ttcttccctctgtaccctca

SEQ ID NO: 561966 - DNA, 20 bp, Artificial
  CRISPR gRNA sequence
cttccctctgtaccctcaca

SEQ ID NO: 561967 - DNA, 20 bp, Artificial
  CRISPR gRNA sequence
ttccctctgtaccctcacag

SEQ ID NO: 561968 - DNA, 20 bp, Artificial
  CRISPR gRNA sequence
ccctctgtaccctcacagct

SEQ ID NO: 561969 - DNA, 20 bp, Artificial
  CRISPR gRNA sequence
cctctgtaccctcacagctc

SEQ ID NO: 561970 - DNA, 20 bp, Artificial
  CRISPR gRNA sequence
tgtaccctcacagctcacct

SEQ ID NO: 561971 - DNA, 20 bp, Artificial
  CRISPR gRNA sequence
taccctcacagctcaccttt

SEQ ID NO: 561972 - DNA, 20 bp, Artificial
  CRISPR gRNA sequence
acagctcacctttttttttt

SEQ ID NO: 561973 - DNA, 20 bp, Artificial
  CRISPR gRNA sequence
accttttttttttttttttt

SEQ ID NO: 561974 - DNA, 20 bp, Artificial
  CRISPR gRNA sequence
tttttttttttttttttttt

SEQ ID NO: 561975 - DNA, 20 bp, Artificial
  CRISPR gRNA sequence
tttttttttttttttttttg

SEQ ID NO: 561976 - DNA, 20 bp, Artificial
  CRISPR gRNA sequence
ttttttttttttttttttga

SEQ ID NO: 561977 - DNA, 20 bp, Artificial
  CRISPR gRNA sequence
tttttttttttttttttgag

SEQ ID NO: 561978 - DNA, 20 bp, Artificial
  CRISPR gRNA sequence
ttttttttttttttttgaga

SEQ ID NO: 561979 - DNA, 20 bp, Artificial
  CRISPR gRNA sequence
tttttttttttttttgagac

SEQ ID NO: 561980 - DNA, 20 bp, Artificial
  CRISPR gRNA sequence
ttttttttttttttgagaca

SEQ ID NO: 561981 - DNA, 20 bp, Artificial
  CRISPR gRNA sequence
tttttttttttttgagacag

SEQ ID NO: 561982 - DNA, 20 bp, Artificial
  CRISPR gRNA sequence
ttttttttttttgagacagg

SEQ ID NO: 561983 - DNA, 20 bp, Artificial
  CRISPR gRNA sequence
tttttttttttgagacaggt

SEQ ID NO: 561984 - DNA, 20 bp, Artificial
  CRISPR gRNA sequence
ttttttttttgagacaggtc

SEQ ID NO: 561985 - DNA, 20 bp, Artificial
  CRISPR gRNA sequence
tttttttttgagacaggtca

SEQ ID NO: 561986 - DNA, 20 bp, Artificial
  CRISPR gRNA sequence
ttttttttgagacaggtcat

SEQ ID NO: 561987 - DNA, 20 bp, Artificial
  CRISPR gRNA sequence
tttttttgagacaggtcata

SEQ ID NO: 561988 - DNA, 20 bp, Artificial
  CRISPR gRNA sequence
ttttttgagacaggtcatat

SEQ ID NO: 561989 - DNA, 20 bp, Artificial
  CRISPR gRNA sequence
tttttgagacaggtcatatt

SEQ ID NO: 561990 - DNA, 20 bp, Artificial
  CRISPR gRNA sequence
ttttgagacaggtcatattc

SEQ ID NO: 561991 - DNA, 20 bp, Artificial
  CRISPR gRNA sequence
tttgagacaggtcatattct

SEQ ID NO: 561992 - DNA, 20 bp, Artificial
  CRISPR gRNA sequence
ttgagacaggtcatattctg

SEQ ID NO: 561993 - DNA, 20 bp, Artificial
  CRISPR gRNA sequence
tgagacaggtcatattctgt

SEQ ID NO: 561994 - DNA, 20 bp, Artificial
  CRISPR gRNA sequence
gagacaggtcatattctgtc

SEQ ID NO: 561995 - DNA, 20 bp, Artificial
  CRISPR gRNA sequence
agacaggtcatattctgtca

SEQ ID NO: 561996 - DNA, 20 bp, Artificial
  CRISPR gRNA sequence
tgtcacccaggctggagttc

SEQ ID NO: 561997 - DNA, 20 bp, Artificial
  CRISPR gRNA sequence
tcacccaggctggagttcag

SEQ ID NO: 561998 - DNA, 20 bp, Artificial
  CRISPR gRNA sequence
gagttcagtggcacaatcac

SEQ ID NO: 561999 - DNA, 20 bp, Artificial
  CRISPR gRNA sequence
agtggcacaatcacagctca

SEQ ID NO: 562000 - DNA, 20 bp, Artificial
  CRISPR gRNA sequence
actgcatcctctgcctccgg

SEQ ID NO: 562001 - DNA, 20 bp, Artificial
  CRISPR gRNA sequence
catcctctgcctccgggact

SEQ ID NO: 562002 - DNA, 20 bp, Artificial
  CRISPR gRNA sequence
tgcctccgggactcaggtga

SEQ ID NO: 562003 - DNA, 20 bp, Artificial
  CRISPR gRNA sequence
cctccgggactcaggtgatt

SEQ ID NO: 562004 - DNA, 20 bp, Artificial
  CRISPR gRNA sequence
cgggactcaggtgattctcc

SEQ ID NO: 562005 - DNA, 20 bp, Artificial
  CRISPR gRNA sequence
aggtgattctcccacctcag

SEQ ID NO: 562006 - DNA, 20 bp, Artificial
  CRISPR gRNA sequence
tcccacctcagccttccgag

SEQ ID NO: 562007 - DNA, 20 bp, Artificial
  CRISPR gRNA sequence
ccacctcagccttccgagta

SEQ ID NO: 562008 - DNA, 20 bp, Artificial
  CRISPR gRNA sequence
agccttccgagtagctggga

SEQ ID NO: 562009 - DNA, 20 bp, Artificial
  CRISPR gRNA sequence
ccgagtagctgggactatag

SEQ ID NO: 562010 - DNA, 20 bp, Artificial
  CRISPR gRNA sequence
cgagtagctgggactatagg

SEQ ID NO: 562011 - DNA, 20 bp, Artificial
  CRISPR gRNA sequence
ggactataggtatgcgccac

SEQ ID NO: 562012 - DNA, 20 bp, Artificial
  CRISPR gRNA sequence
taggtatgcgccaccacgct

SEQ ID NO: 562013 - DNA, 20 bp, Artificial
  CRISPR gRNA sequence
agctaatttttgtatttttt

SEQ ID NO: 562014 - DNA, 20 bp, Artificial
  CRISPR gRNA sequence
atttttgtattttttgtaga

SEQ ID NO: 562015 - DNA, 20 bp, Artificial
  CRISPR gRNA sequence
ttgtattttttgtagagccg

SEQ ID NO: 562016 - DNA, 20 bp, Artificial
  CRISPR gRNA sequence
tgtattttttgtagagccga

SEQ ID NO: 562017 - DNA, 20 bp, Artificial
  CRISPR gRNA sequence
gtattttttgtagagccgat

SEQ ID NO: 562018 - DNA, 20 bp, Artificial
  CRISPR gRNA sequence
tattttttgtagagccgatc

SEQ ID NO: 562019 - DNA, 20 bp, Artificial
  CRISPR gRNA sequence
tttgtagagccgatctttca

SEQ ID NO: 562020 - DNA, 20 bp, Artificial
  CRISPR gRNA sequence
ttgtagagccgatctttcac

SEQ ID NO: 562021 - DNA, 20 bp, Artificial
  CRISPR gRNA sequence
tgtagagccgatctttcacc

SEQ ID NO: 562022 - DNA, 20 bp, Artificial
  CRISPR gRNA sequence
gtagagccgatctttcaccg

SEQ ID NO: 562023 - DNA, 20 bp, Artificial
  CRISPR gRNA sequence
tagagccgatctttcaccgt

SEQ ID NO: 562024 - DNA, 20 bp, Artificial
  CRISPR gRNA sequence
tcaccgtgttggccctgctg

SEQ ID NO: 562025 - DNA, 20 bp, Artificial
  CRISPR gRNA sequence
caccgtgttggccctgctgg

SEQ ID NO: 562026 - DNA, 20 bp, Artificial
  CRISPR gRNA sequence
accgtgttggccctgctggt

SEQ ID NO: 562027 - DNA, 20 bp, Artificial
  CRISPR gRNA sequence
gccctgctggtctccgattc

SEQ ID NO: 562028 - DNA, 20 bp, Artificial
  CRISPR gRNA sequence
ctggtctccgattcctggcc

SEQ ID NO: 562029 - DNA, 20 bp, Artificial
  CRISPR gRNA sequence
gtctccgattcctggcctca

SEQ ID NO: 562030 - DNA, 20 bp, Artificial
  CRISPR gRNA sequence
cgattcctggcctcaagtga

SEQ ID NO: 562031 - DNA, 20 bp, Artificial
  CRISPR gRNA sequence
ctggcctcaagtgatccacc

SEQ ID NO: 562032 - DNA, 20 bp, Artificial
  CRISPR gRNA sequence
gcctcaagtgatccacctgc

SEQ ID NO: 562033 - DNA, 20 bp, Artificial
  CRISPR gRNA sequence
aagtgatccacctgcctcag

SEQ ID NO: 562034 - DNA, 20 bp, Artificial
  CRISPR gRNA sequence
cctcagcctcccaaagtgct

SEQ ID NO: 562035 - DNA, 20 bp, Artificial
  CRISPR gRNA sequence
agcctcccaaagtgctagga

SEQ ID NO: 562036 - DNA, 20 bp, Artificial
  CRISPR gRNA sequence
ccaaagtgctaggatgacag

SEQ ID NO: 562037 - DNA, 20 bp, Artificial
  CRISPR gRNA sequence
ggatgacaggtgtaagccac

SEQ ID NO: 562038 - DNA, 20 bp, Artificial
  CRISPR gRNA sequence
ttacaacactgacttatctg

SEQ ID NO: 562039 - DNA, 20 bp, Artificial
  CRISPR gRNA sequence
acaacactgacttatctgat

SEQ ID NO: 562040 - DNA, 20 bp, Artificial
  CRISPR gRNA sequence
caacactgacttatctgatc

SEQ ID NO: 562041 - DNA, 20 bp, Artificial
  CRISPR gRNA sequence
acttatctgatcgtgcgggt

SEQ ID NO: 562042 - DNA, 20 bp, Artificial
  CRISPR gRNA sequence
atctgatcgtgcgggtactt

SEQ ID NO: 562043 - DNA, 20 bp, Artificial
  CRISPR gRNA sequence
tctgatcgtgcgggtacttt

SEQ ID NO: 562044 - DNA, 20 bp, Artificial
  CRISPR gRNA sequence
atcgtgcgggtacttttgag

SEQ ID NO: 562045 - DNA, 20 bp, Artificial
  CRISPR gRNA sequence
ttgagtctatctcaacccct

SEQ ID NO: 562046 - DNA, 20 bp, Artificial
  CRISPR gRNA sequence
tgagtctatctcaacccctc

SEQ ID NO: 562047 - DNA, 20 bp, Artificial
  CRISPR gRNA sequence
gagtctatctcaacccctcc

SEQ ID NO: 562048 - DNA, 20 bp, Artificial
  CRISPR gRNA sequence
agtctatctcaacccctccc

SEQ ID NO: 562049 - DNA, 20 bp, Artificial
  CRISPR gRNA sequence
tctcaacccctcccccttgg

SEQ ID NO: 562050 - DNA, 20 bp, Artificial
  CRISPR gRNA sequence
aacccctcccccttggctgt

SEQ ID NO: 562051 - DNA, 20 bp, Artificial
  CRISPR gRNA sequence
ccccttggctgtcttccata

SEQ ID NO: 562052 - DNA, 20 bp, Artificial
  CRISPR gRNA sequence
ggctgtcttccatagatgca

SEQ ID NO: 562053 - DNA, 20 bp, Artificial
  CRISPR gRNA sequence
gctgtcttccatagatgcac

SEQ ID NO: 562054 - DNA, 20 bp, Artificial
  CRISPR gRNA sequence
tcttccatagatgcacacgc

SEQ ID NO: 562055 - DNA, 20 bp, Artificial
  CRISPR gRNA sequence
ccatagatgcacacgcgcac

SEQ ID NO: 562056 - DNA, 20 bp, Artificial
  CRISPR gRNA sequence
catagatgcacacgcgcacc

SEQ ID NO: 562057 - DNA, 20 bp, Artificial
  CRISPR gRNA sequence
ccgggcaggcagcggacgct

SEQ ID NO: 562058 - DNA, 20 bp, Artificial
  CRISPR gRNA sequence
agcaaacggacggacgggct

SEQ ID NO: 562059 - DNA, 20 bp, Artificial
  CRISPR gRNA sequence
gagggctggcagtggggtgc

SEQ ID NO: 562060 - DNA, 20 bp, Artificial
  CRISPR gRNA sequence
gcagtggggtgcaggagcca

SEQ ID NO: 562061 - DNA, 20 bp, Artificial
  CRISPR gRNA sequence
aagtacagttgaactcgctg

SEQ ID NO: 562062 - DNA, 20 bp, Artificial
  CRISPR gRNA sequence
aactcgctgggaggttactg

SEQ ID NO: 562063 - DNA, 20 bp, Artificial
  CRISPR gRNA sequence
gctgggaggttactgctgta

SEQ ID NO: 562064 - DNA, 20 bp, Artificial
  CRISPR gRNA sequence
ggaggttactgctgtactcc

SEQ ID NO: 562065 - DNA, 20 bp, Artificial
  CRISPR gRNA sequence
ctgctgtactcccggggttt

SEQ ID NO: 562066 - DNA, 20 bp, Artificial
  CRISPR gRNA sequence
ctgtactcccggggttttgc

SEQ ID NO: 562067 - DNA, 20 bp, Artificial
  CRISPR gRNA sequence
tactcccggggttttgctat

SEQ ID NO: 562068 - DNA, 20 bp, Artificial
  CRISPR gRNA sequence
ccggggttttgctatggcct

SEQ ID NO: 562069 - DNA, 20 bp, Artificial
  CRISPR gRNA sequence
tgctatggcctgactggggc

SEQ ID NO: 562070 - DNA, 20 bp, Artificial
  CRISPR gRNA sequence
gctatggcctgactggggcc

SEQ ID NO: 562071 - DNA, 20 bp, Artificial
  CRISPR gRNA sequence
ctatggcctgactggggcca

SEQ ID NO: 562072 - DNA, 20 bp, Artificial
  CRISPR gRNA sequence
tggcctgactggggccaatg

SEQ ID NO: 562073 - DNA, 20 bp, Artificial
  CRISPR gRNA sequence
actggggccaatgtgtggag

SEQ ID NO: 562074 - DNA, 20 bp, Artificial
  CRISPR gRNA sequence
gggccaatgtgtggagggtg

SEQ ID NO: 562075 - DNA, 20 bp, Artificial
  CRISPR gRNA sequence
tttcctgaggttgttgtgac

SEQ ID NO: 562076 - DNA, 20 bp, Artificial
  CRISPR gRNA sequence
cctgaggttgttgtgacgac

SEQ ID NO: 562077 - DNA, 20 bp, Artificial
  CRISPR gRNA sequence
ctgaggttgttgtgacgact

SEQ ID NO: 562078 - DNA, 20 bp, Artificial
  CRISPR gRNA sequence
aggttgttgtgacgacttgg

SEQ ID NO: 562079 - DNA, 20 bp, Artificial
  CRISPR gRNA sequence
ttgtgacgacttggctgaca

SEQ ID NO: 562080 - DNA, 20 bp, Artificial
  CRISPR gRNA sequence
tgacgacttggctgacaaca

SEQ ID NO: 562081 - DNA, 20 bp, Artificial
  CRISPR gRNA sequence
ggctgacaacacacggagag

SEQ ID NO: 562082 - DNA, 20 bp, Artificial
  CRISPR gRNA sequence
gctgacaacacacggagagg

SEQ ID NO: 562083 - DNA, 20 bp, Artificial
  CRISPR gRNA sequence
acaacacacggagaggatgg

SEQ ID NO: 562084 - DNA, 20 bp, Artificial
  CRISPR gRNA sequence
tgatactagtttttaggatt

SEQ ID NO: 562085 - DNA, 20 bp, Artificial
  CRISPR gRNA sequence
atactagtttttaggatttg

SEQ ID NO: 562086 - DNA, 20 bp, Artificial
  CRISPR gRNA sequence
gtttttaggatttgagggga

SEQ ID NO: 562087 - DNA, 20 bp, Artificial
  CRISPR gRNA sequence
ttaggatttgaggggaggaa

SEQ ID NO: 562088 - DNA, 20 bp, Artificial
  CRISPR gRNA sequence
taggatttgaggggaggaaa

SEQ ID NO: 562089 - DNA, 20 bp, Artificial
  CRISPR gRNA sequence
aggatttgaggggaggaaaa

SEQ ID NO: 562090 - DNA, 20 bp, Artificial
  CRISPR gRNA sequence
ggatttgaggggaggaaaaa

SEQ ID NO: 562091 - DNA, 20 bp, Artificial
  CRISPR gRNA sequence
gaggggaggaaaaaggagca

SEQ ID NO: 562092 - DNA, 20 bp, Artificial
  CRISPR gRNA sequence
aggggaggaaaaaggagcag

SEQ ID NO: 562093 - DNA, 20 bp, Artificial
  CRISPR gRNA sequence
aggaatcccaacgtgaggcc

SEQ ID NO: 562094 - DNA, 20 bp, Artificial
  CRISPR gRNA sequence
ggaatcccaacgtgaggccg

SEQ ID NO: 562095 - DNA, 20 bp, Artificial
  CRISPR gRNA sequence
ccgactgggcttcctagttg

SEQ ID NO: 562096 - DNA, 20 bp, Artificial
  CRISPR gRNA sequence
ggcttcctagttgcctaccc

SEQ ID NO: 562097 - DNA, 20 bp, Artificial
  CRISPR gRNA sequence
cctagttgcctacccgctcc

SEQ ID NO: 562098 - DNA, 20 bp, Artificial
  CRISPR gRNA sequence
ctagttgcctacccgctcct

SEQ ID NO: 562099 - DNA, 20 bp, Artificial
  CRISPR gRNA sequence
gttgcctacccgctcctcgc

SEQ ID NO: 562100 - DNA, 20 bp, Artificial
  CRISPR gRNA sequence
cctacccgctcctcgctgtg

SEQ ID NO: 562101 - DNA, 20 bp, Artificial
  CRISPR gRNA sequence
cccgctcctcgctgtggggc

SEQ ID NO: 562102 - DNA, 20 bp, Artificial
  CRISPR gRNA sequence
ctcgctgtggggcgattctg

SEQ ID NO: 562103 - DNA, 20 bp, Artificial
  CRISPR gRNA sequence
gctgtggggcgattctgaaa

SEQ ID NO: 562104 - DNA, 20 bp, Artificial
  CRISPR gRNA sequence
tggggcgattctgaaaagtc

SEQ ID NO: 562105 - DNA, 20 bp, Artificial
  CRISPR gRNA sequence
tgaaaagtcctctctgctga

SEQ ID NO: 562106 - DNA, 20 bp, Artificial
  CRISPR gRNA sequence
aaaagtcctctctgctgata

SEQ ID NO: 562107 - DNA, 20 bp, Artificial
  CRISPR gRNA sequence
tctgctgatacggcggacgc

SEQ ID NO: 562108 - DNA, 20 bp, Artificial
  CRISPR gRNA sequence
tgctgatacggcggacgccg

SEQ ID NO: 562109 - DNA, 20 bp, Artificial
  CRISPR gRNA sequence
ctgatacggcggacgccgcg

SEQ ID NO: 562110 - DNA, 20 bp, Artificial
  CRISPR gRNA sequence
atacggcggacgccgcgcgg

SEQ ID NO: 562111 - DNA, 20 bp, Artificial
  CRISPR gRNA sequence
gagcaggtggcatccgcgcc

SEQ ID NO: 562112 - DNA, 20 bp, Artificial
  CRISPR gRNA sequence
cccgtcccgggcgcgttcac

SEQ ID NO: 562113 - DNA, 20 bp, Artificial
  CRISPR gRNA sequence
acggctgggaaaaattttgc

SEQ ID NO: 562114 - DNA, 20 bp, Artificial
  CRISPR gRNA sequence
ggaaaaattttgcagtccgc

SEQ ID NO: 562115 - DNA, 20 bp, Artificial
  CRISPR gRNA sequence
tgcagtccgctgaagcgctc

SEQ ID NO: 562116 - DNA, 20 bp, Artificial
  CRISPR gRNA sequence
gcagtccgctgaagcgctca

SEQ ID NO: 562117 - DNA, 20 bp, Artificial
  CRISPR gRNA sequence
cagtccgctgaagcgctcag

SEQ ID NO: 562118 - DNA, 20 bp, Artificial
  CRISPR gRNA sequence
aagcgctcagcgacgttact

SEQ ID NO: 562119 - DNA, 20 bp, Artificial
  CRISPR gRNA sequence
agcgacgttactggggaagc

SEQ ID NO: 562120 - DNA, 20 bp, Artificial
  CRISPR gRNA sequence
ctggggaagcccaggaagga

SEQ ID NO: 562121 - DNA, 20 bp, Artificial
  CRISPR gRNA sequence
gggaagcccaggaaggaact

SEQ ID NO: 562122 - DNA, 20 bp, Artificial
  CRISPR gRNA sequence
ggtcactggagctcgggagg

SEQ ID NO: 562123 - DNA, 20 bp, Artificial
  CRISPR gRNA sequence
gtcactggagctcgggaggg

SEQ ID NO: 562124 - DNA, 20 bp, Artificial
  CRISPR gRNA sequence
gagctcgggagggggccggc

SEQ ID NO: 562125 - DNA, 20 bp, Artificial
  CRISPR gRNA sequence
gggagggggccggcgggggg

SEQ ID NO: 562126 - DNA, 20 bp, Artificial
  CRISPR gRNA sequence
gcgggccggagcccgtcctt

SEQ ID NO: 562127 - DNA, 20 bp, Artificial
  CRISPR gRNA sequence
ccctaaggccacacagttcc

SEQ ID NO: 562128 - DNA, 20 bp, Artificial
  CRISPR gRNA sequence
cctaaggccacacagttcct

SEQ ID NO: 562129 - DNA, 20 bp, Artificial
  CRISPR gRNA sequence
aggccacacagttccttgct

SEQ ID NO: 562130 - DNA, 20 bp, Artificial
  CRISPR gRNA sequence
cttgctgactccatgaggga

SEQ ID NO: 562131 - DNA, 20 bp, Artificial
  CRISPR gRNA sequence
gctgactccatgagggacac

SEQ ID NO: 562132 - DNA, 20 bp, Artificial
  CRISPR gRNA sequence
ctgactccatgagggacact

SEQ ID NO: 562133 - DNA, 20 bp, Artificial
  CRISPR gRNA sequence
actccatgagggacactggc

SEQ ID NO: 562134 - DNA, 20 bp, Artificial
  CRISPR gRNA sequence
catgagggacactggcgatg

SEQ ID NO: 562135 - DNA, 20 bp, Artificial
  CRISPR gRNA sequence
gcgatgaaataacaactttc

SEQ ID NO: 562136 - DNA, 20 bp, Artificial
  CRISPR gRNA sequence
tctcttcctgaaaaggctcc

SEQ ID NO: 562137 - DNA, 20 bp, Artificial
  CRISPR gRNA sequence
ctcttcctgaaaaggctccc

SEQ ID NO: 562138 - DNA, 20 bp, Artificial
  CRISPR gRNA sequence
tcttcctgaaaaggctccca

SEQ ID NO: 562139 - DNA, 20 bp, Artificial
  CRISPR gRNA sequence
ttcctgaaaaggctcccacg

SEQ ID NO: 562140 - DNA, 20 bp, Artificial
  CRISPR gRNA sequence
cctgaaaaggctcccacggc

SEQ ID NO: 562141 - DNA, 20 bp, Artificial
  CRISPR gRNA sequence
ctgaaaaggctcccacggct

SEQ ID NO: 562142 - DNA, 20 bp, Artificial
  CRISPR gRNA sequence
aaaaggctcccacggctgag

SEQ ID NO: 562143 - DNA, 20 bp, Artificial
  CRISPR gRNA sequence
ccacggctgagttgttcccg

SEQ ID NO: 562144 - DNA, 20 bp, Artificial
  CRISPR gRNA sequence
agttgttcccggcccacagc

SEQ ID NO: 562145 - DNA, 20 bp, Artificial
  CRISPR gRNA sequence
ttcccggcccacagcgaccc

SEQ ID NO: 562146 - DNA, 20 bp, Artificial
  CRISPR gRNA sequence
ccggcccacagcgacccgtc

SEQ ID NO: 562147 - DNA, 20 bp, Artificial
  CRISPR gRNA sequence
tgatcggcaaccgcctcgag

SEQ ID NO: 562148 - DNA, 20 bp, Artificial
  CRISPR gRNA sequence
atcggcaaccgcctcgagcc

SEQ ID NO: 562149 - DNA, 20 bp, Artificial
  CRISPR gRNA sequence
gagcccggcgcgtccaccca

SEQ ID NO: 562150 - DNA, 20 bp, Artificial
  CRISPR gRNA sequence
ggtgctgcccagtacccgcc

SEQ ID NO: 562151 - DNA, 20 bp, Artificial
  CRISPR gRNA sequence
cccagtacccgccggccggc

SEQ ID NO: 562152 - DNA, 20 bp, Artificial
  CRISPR gRNA sequence
gggcaggcttcactcaccaa

SEQ ID NO: 562153 - DNA, 20 bp, Artificial
  CRISPR gRNA sequence
cactcaccaaagcagtgcag

SEQ ID NO: 562154 - DNA, 20 bp, Artificial
  CRISPR gRNA sequence
actcaccaaagcagtgcagc

SEQ ID NO: 562155 - DNA, 20 bp, Artificial
  CRISPR gRNA sequence
accaaagcagtgcagcaggc

SEQ ID NO: 562156 - DNA, 20 bp, Artificial
  CRISPR gRNA sequence
aggacccccagggcccgccc

SEQ ID NO: 562157 - DNA, 20 bp, Artificial
  CRISPR gRNA sequence
ccagcaaccatggctcgtcg

SEQ ID NO: 562158 - DNA, 20 bp, Artificial
  CRISPR gRNA sequence
gtcgggccggcctctgcgcg

SEQ ID NO: 562159 - DNA, 20 bp, Artificial
  CRISPR gRNA sequence
tgcgcgagtgcccagccaca

SEQ ID NO: 562160 - DNA, 20 bp, Artificial
  CRISPR gRNA sequence
cgcgagtgcccagccacaag

SEQ ID NO: 562161 - DNA, 20 bp, Artificial
  CRISPR gRNA sequence
agttcaagcaccgcctacgc

SEQ ID NO: 562162 - DNA, 20 bp, Artificial
  CRISPR gRNA sequence
aagcaccgcctacgcggtcg

SEQ ID NO: 562163 - DNA, 20 bp, Artificial
  CRISPR gRNA sequence
cgcggtcggccagaagtagg

SEQ ID NO: 562164 - DNA, 20 bp, Artificial
  CRISPR gRNA sequence
cgccccgccctgggctggca

SEQ ID NO: 562165 - DNA, 20 bp, Artificial
  CRISPR gRNA sequence
ggctggcagccggcggcccg

SEQ ID NO: 562166 - DNA, 20 bp, Artificial
  CRISPR gRNA sequence
gcagccggcggcccgccccg

SEQ ID NO: 562167 - DNA, 20 bp, Artificial
  CRISPR gRNA sequence
cctcccccaccctccgcggc

SEQ ID NO: 562168 - DNA, 20 bp, Artificial
  CRISPR gRNA sequence
ctcccccaccctccgcggcg

SEQ ID NO: 562169 - DNA, 20 bp, Artificial
  CRISPR gRNA sequence
ccccaccctccgcggcgccg

SEQ ID NO: 562170 - DNA, 20 bp, Artificial
  CRISPR gRNA sequence
cgcggcgccgcgtttgtctt

SEQ ID NO: 562171 - DNA, 20 bp, Artificial
  CRISPR gRNA sequence
gtcttcgcgcttccactccc

SEQ ID NO: 562172 - DNA, 20 bp, Artificial
  CRISPR gRNA sequence
tcttcgcgcttccactcccc

SEQ ID NO: 562173 - DNA, 20 bp, Artificial
  CRISPR gRNA sequence
cgcgcttccactccccgggc

SEQ ID NO: 562174 - DNA, 20 bp, Artificial
  CRISPR gRNA sequence
gcgcttccactccccgggcg

SEQ ID NO: 562175 - DNA, 20 bp, Artificial
  CRISPR gRNA sequence
ccactccccgggcgcgcctc

SEQ ID NO: 562176 - DNA, 20 bp, Artificial
  CRISPR gRNA sequence
cactccccgggcgcgcctct

SEQ ID NO: 562177 - DNA, 20 bp, Artificial
  CRISPR gRNA sequence
cccgggcgcgcctctggcct

SEQ ID NO: 562178 - DNA, 20 bp, Artificial
  CRISPR gRNA sequence
tggcctcggctctgcgcgcc

SEQ ID NO: 562179 - DNA, 20 bp, Artificial
  CRISPR gRNA sequence
gcctcggctctgcgcgcctc

SEQ ID NO: 562180 - DNA, 20 bp, Artificial
  CRISPR gRNA sequence
ggctctgcgcgcctccttcc

SEQ ID NO: 562181 - DNA, 20 bp, Artificial
  CRISPR gRNA sequence
ccagcccagggcggggcgga

SEQ ID NO: 562182 - DNA, 20 bp, Artificial
  CRISPR gRNA sequence
cttctggccgaccgcgtagg

SEQ ID NO: 562183 - DNA, 20 bp, Artificial
  CRISPR gRNA sequence
ctggccgaccgcgtaggcgg

SEQ ID NO: 562184 - DNA, 20 bp, Artificial
  CRISPR gRNA sequence
tggccgaccgcgtaggcggt

SEQ ID NO: 562185 - DNA, 20 bp, Artificial
  CRISPR gRNA sequence
gccgaccgcgtaggcggtgc

SEQ ID NO: 562186 - DNA, 20 bp, Artificial
  CRISPR gRNA sequence
gaacttagggctgcttgtgg

SEQ ID NO: 562187 - DNA, 20 bp, Artificial
  CRISPR gRNA sequence
aacttagggctgcttgtggc

SEQ ID NO: 562188 - DNA, 20 bp, Artificial
  CRISPR gRNA sequence
agggctgcttgtggctgggc

SEQ ID NO: 562189 - DNA, 20 bp, Artificial
  CRISPR gRNA sequence
gggctgcttgtggctgggca

SEQ ID NO: 562190 - DNA, 20 bp, Artificial
  CRISPR gRNA sequence
cttgtggctgggcactcgcg

SEQ ID NO: 562191 - DNA, 20 bp, Artificial
  CRISPR gRNA sequence
gtggctgggcactcgcgcag

SEQ ID NO: 562192 - DNA, 20 bp, Artificial
  CRISPR gRNA sequence
tggctgggcactcgcgcaga

SEQ ID NO: 562193 - DNA, 20 bp, Artificial
  CRISPR gRNA sequence
ggcactcgcgcagaggccgg

SEQ ID NO: 562194 - DNA, 20 bp, Artificial
  CRISPR gRNA sequence
gcgcagaggccggcccgacg

SEQ ID NO: 562195 - DNA, 20 bp, Artificial
  CRISPR gRNA sequence
ctgggagcgacgcggggcgg

SEQ ID NO: 562196 - DNA, 20 bp, Artificial
  CRISPR gRNA sequence
ggagcgacgcggggcgggcc

SEQ ID NO: 562197 - DNA, 20 bp, Artificial
  CRISPR gRNA sequence
ggggtcctcagcgtggtctg

SEQ ID NO: 562198 - DNA, 20 bp, Artificial
  CRISPR gRNA sequence
agcgtggtctgcctgctgca

SEQ ID NO: 562199 - DNA, 20 bp, Artificial
  CRISPR gRNA sequence
cctgctgcactgctttggtg

SEQ ID NO: 562200 - DNA, 20 bp, Artificial
  CRISPR gRNA sequence
ctgcactgctttggtgagtg

SEQ ID NO: 562201 - DNA, 20 bp, Artificial
  CRISPR gRNA sequence
cactgctttggtgagtgaag

SEQ ID NO: 562202 - DNA, 20 bp, Artificial
  CRISPR gRNA sequence
ctttggtgagtgaagcctgc

SEQ ID NO: 562203 - DNA, 20 bp, Artificial
  CRISPR gRNA sequence
tggtgagtgaagcctgcccc

SEQ ID NO: 562204 - DNA, 20 bp, Artificial
  CRISPR gRNA sequence
ggtgagtgaagcctgcccca

SEQ ID NO: 562205 - DNA, 20 bp, Artificial
  CRISPR gRNA sequence
gtgagtgaagcctgccccag

SEQ ID NO: 562206 - DNA, 20 bp, Artificial
  CRISPR gRNA sequence
ccccaggggccccgcgccgg

SEQ ID NO: 562207 - DNA, 20 bp, Artificial
  CRISPR gRNA sequence
ggcagcacccaggctgggtg

SEQ ID NO: 562208 - DNA, 20 bp, Artificial
  CRISPR gRNA sequence
ggtggacgcgccgggctcga

SEQ ID NO: 562209 - DNA, 20 bp, Artificial
  CRISPR gRNA sequence
gaggcggttgccgatcagag

SEQ ID NO: 562210 - DNA, 20 bp, Artificial
  CRISPR gRNA sequence
ccgatcagagacgggtgggg

SEQ ID NO: 562211 - DNA, 20 bp, Artificial
  CRISPR gRNA sequence
tgggccgggaacaactcagc

SEQ ID NO: 562212 - DNA, 20 bp, Artificial
  CRISPR gRNA sequence
agccgtgggagccttttcag

SEQ ID NO: 562213 - DNA, 20 bp, Artificial
  CRISPR gRNA sequence
ttcaggaagagaaagttgtt

SEQ ID NO: 562214 - DNA, 20 bp, Artificial
  CRISPR gRNA sequence
tcaggaagagaaagttgtta

SEQ ID NO: 562215 - DNA, 20 bp, Artificial
  CRISPR gRNA sequence
caggaagagaaagttgttat

SEQ ID NO: 562216 - DNA, 20 bp, Artificial
  CRISPR gRNA sequence
aggaagagaaagttgttatt

SEQ ID NO: 562217 - DNA, 20 bp, Artificial
  CRISPR gRNA sequence
ttatttcatcgccagtgtcc

SEQ ID NO: 562218 - DNA, 20 bp, Artificial
  CRISPR gRNA sequence
tttcatcgccagtgtccctc

SEQ ID NO: 562219 - DNA, 20 bp, Artificial
  CRISPR gRNA sequence
catcgccagtgtccctcatg

SEQ ID NO: 562220 - DNA, 20 bp, Artificial
  CRISPR gRNA sequence
atcgccagtgtccctcatgg

SEQ ID NO: 562221 - DNA, 20 bp, Artificial
  CRISPR gRNA sequence
atggagtcagcaaggaactg

SEQ ID NO: 562222 - DNA, 20 bp, Artificial
  CRISPR gRNA sequence
tgtggccttagggaaggacg

SEQ ID NO: 562223 - DNA, 20 bp, Artificial
  CRISPR gRNA sequence
agggaaggacgggctccggc

SEQ ID NO: 562224 - DNA, 20 bp, Artificial
  CRISPR gRNA sequence
gggaaggacgggctccggcc

SEQ ID NO: 562225 - DNA, 20 bp, Artificial
  CRISPR gRNA sequence
cggcccgctagcctctcctg

SEQ ID NO: 562226 - DNA, 20 bp, Artificial
  CRISPR gRNA sequence
gcctctcctgcggggcctgc

SEQ ID NO: 562227 - DNA, 20 bp, Artificial
  CRISPR gRNA sequence
tcctgcggggcctgcgcccc

SEQ ID NO: 562228 - DNA, 20 bp, Artificial
  CRISPR gRNA sequence
ctgcggggcctgcgcccccc

SEQ ID NO: 562229 - DNA, 20 bp, Artificial
  CRISPR gRNA sequence
cggggcctgcgcccccccgc

SEQ ID NO: 562230 - DNA, 20 bp, Artificial
  CRISPR gRNA sequence
cgcccccccgccggccccct

SEQ ID NO: 562231 - DNA, 20 bp, Artificial
  CRISPR gRNA sequence
ccgagctccagtgaccaagt

SEQ ID NO: 562232 - DNA, 20 bp, Artificial
  CRISPR gRNA sequence
cagtgaccaagttccttcct

SEQ ID NO: 562233 - DNA, 20 bp, Artificial
  CRISPR gRNA sequence
cttcctgggcttccccagta

SEQ ID NO: 562234 - DNA, 20 bp, Artificial
  CRISPR gRNA sequence
cctgggcttccccagtaacg

SEQ ID NO: 562235 - DNA, 20 bp, Artificial
  CRISPR gRNA sequence
ctgggcttccccagtaacgt

SEQ ID NO: 562236 - DNA, 20 bp, Artificial
  CRISPR gRNA sequence
ggcttccccagtaacgtcgc

SEQ ID NO: 562237 - DNA, 20 bp, Artificial
  CRISPR gRNA sequence
ccccagtaacgtcgctgagc

SEQ ID NO: 562238 - DNA, 20 bp, Artificial
  CRISPR gRNA sequence
cccagtaacgtcgctgagcg

SEQ ID NO: 562239 - DNA, 20 bp, Artificial
  CRISPR gRNA sequence
agcgcttcagcggactgcaa

SEQ ID NO: 562240 - DNA, 20 bp, Artificial
  CRISPR gRNA sequence
cagcggactgcaaaattttt

SEQ ID NO: 562241 - DNA, 20 bp, Artificial
  CRISPR gRNA sequence
agcggactgcaaaatttttc

SEQ ID NO: 562242 - DNA, 20 bp, Artificial
  CRISPR gRNA sequence
caaaatttttcccagccgtg

SEQ ID NO: 562243 - DNA, 20 bp, Artificial
  CRISPR gRNA sequence
ttcccagccgtgaacgcgcc

SEQ ID NO: 562244 - DNA, 20 bp, Artificial
  CRISPR gRNA sequence
tcccagccgtgaacgcgccc

SEQ ID NO: 562245 - DNA, 20 bp, Artificial
  CRISPR gRNA sequence
cccagccgtgaacgcgcccg

SEQ ID NO: 562246 - DNA, 20 bp, Artificial
  CRISPR gRNA sequence
ccagccgtgaacgcgcccgg

SEQ ID NO: 562247 - DNA, 20 bp, Artificial
  CRISPR gRNA sequence
ctcgagggcgacgcctgctg

SEQ ID NO: 562248 - DNA, 20 bp, Artificial
  CRISPR gRNA sequence
gagggcgacgcctgctgccc

SEQ ID NO: 562249 - DNA, 20 bp, Artificial
  CRISPR gRNA sequence
ctgccctccccgcgcggtgc

SEQ ID NO: 562250 - DNA, 20 bp, Artificial
  CRISPR gRNA sequence
ccctccccgcgcggtgccgt

SEQ ID NO: 562251 - DNA, 20 bp, Artificial
  CRISPR gRNA sequence
cccgcgcggtgccgtccccg

SEQ ID NO: 562252 - DNA, 20 bp, Artificial
  CRISPR gRNA sequence
ttcagaatcgccccacagcg

SEQ ID NO: 562253 - DNA, 20 bp, Artificial
  CRISPR gRNA sequence
tcagaatcgccccacagcga

SEQ ID NO: 562254 - DNA, 20 bp, Artificial
  CRISPR gRNA sequence
cagaatcgccccacagcgag

SEQ ID NO: 562255 - DNA, 20 bp, Artificial
  CRISPR gRNA sequence
agaatcgccccacagcgagg

SEQ ID NO: 562256 - DNA, 20 bp, Artificial
  CRISPR gRNA sequence
ggaagcccagtcggcagcgg

SEQ ID NO: 562257 - DNA, 20 bp, Artificial
  CRISPR gRNA sequence
acgttgggattcctaagtgg

SEQ ID NO: 562258 - DNA, 20 bp, Artificial
  CRISPR gRNA sequence
ggattcctaagtggtgcgac

SEQ ID NO: 562259 - DNA, 20 bp, Artificial
  CRISPR gRNA sequence
ctaagtggtgcgactcctgc

SEQ ID NO: 562260 - DNA, 20 bp, Artificial
  CRISPR gRNA sequence
agtggtgcgactcctgctcc

SEQ ID NO: 562261 - DNA, 20 bp, Artificial
  CRISPR gRNA sequence
ctgctcctttttcctcccct

SEQ ID NO: 562262 - DNA, 20 bp, Artificial
  CRISPR gRNA sequence
ctcctttttcctcccctcaa

SEQ ID NO: 562263 - DNA, 20 bp, Artificial
  CRISPR gRNA sequence
ctttttcctcccctcaaatc

SEQ ID NO: 562264 - DNA, 20 bp, Artificial
  CRISPR gRNA sequence
tttcctcccctcaaatccta

SEQ ID NO: 562265 - DNA, 20 bp, Artificial
  CRISPR gRNA sequence
ttcctcccctcaaatcctaa

SEQ ID NO: 562266 - DNA, 20 bp, Artificial
  CRISPR gRNA sequence
tcctcccctcaaatcctaaa

SEQ ID NO: 562267 - DNA, 20 bp, Artificial
  CRISPR gRNA sequence
cctcccctcaaatcctaaaa

SEQ ID NO: 562268 - DNA, 20 bp, Artificial
  CRISPR gRNA sequence
ctcccctcaaatcctaaaaa

SEQ ID NO: 562269 - DNA, 20 bp, Artificial
  CRISPR gRNA sequence
ccctcaaatcctaaaaacta

SEQ ID NO: 562270 - DNA, 20 bp, Artificial
  CRISPR gRNA sequence
aaatcctaaaaactagtatc

SEQ ID NO: 562271 - DNA, 20 bp, Artificial
  CRISPR gRNA sequence
aaaactagtatcagaactgg

SEQ ID NO: 562272 - DNA, 20 bp, Artificial
  CRISPR gRNA sequence
gtatcagaactggttccatc

SEQ ID NO: 562273 - DNA, 20 bp, Artificial
  CRISPR gRNA sequence
gttccatcctctccgtgtgt

SEQ ID NO: 562274 - DNA, 20 bp, Artificial
  CRISPR gRNA sequence
catcctctccgtgtgttgtc

SEQ ID NO: 562275 - DNA, 20 bp, Artificial
  CRISPR gRNA sequence
tccgtgtgttgtcagccaag

SEQ ID NO: 562276 - DNA, 20 bp, Artificial
  CRISPR gRNA sequence
cgtgtgttgtcagccaagtc

SEQ ID NO: 562277 - DNA, 20 bp, Artificial
  CRISPR gRNA sequence
tcagccaagtcgtcacaaca

SEQ ID NO: 562278 - DNA, 20 bp, Artificial
  CRISPR gRNA sequence
aggaaataggtccccttctt

SEQ ID NO: 562279 - DNA, 20 bp, Artificial
  CRISPR gRNA sequence
cttcccattttgcctcccca

SEQ ID NO: 562280 - DNA, 20 bp, Artificial
  CRISPR gRNA sequence
ttcccattttgcctccccat

SEQ ID NO: 562281 - DNA, 20 bp, Artificial
  CRISPR gRNA sequence
cccattttgcctccccatcc

SEQ ID NO: 562282 - DNA, 20 bp, Artificial
  CRISPR gRNA sequence
ccattttgcctccccatcct

SEQ ID NO: 562283 - DNA, 20 bp, Artificial
  CRISPR gRNA sequence
tgcctccccatcctccttca

SEQ ID NO: 562284 - DNA, 20 bp, Artificial
  CRISPR gRNA sequence
gcctccccatcctccttcac

SEQ ID NO: 562285 - DNA, 20 bp, Artificial
  CRISPR gRNA sequence
cctccccatcctccttcacc

SEQ ID NO: 562286 - DNA, 20 bp, Artificial
  CRISPR gRNA sequence
cccatcctccttcaccctcc

SEQ ID NO: 562287 - DNA, 20 bp, Artificial
  CRISPR gRNA sequence
cttcaccctccacacattgg

SEQ ID NO: 562288 - DNA, 20 bp, Artificial
  CRISPR gRNA sequence
caccctccacacattggccc

SEQ ID NO: 562289 - DNA, 20 bp, Artificial
  CRISPR gRNA sequence
accctccacacattggcccc

SEQ ID NO: 562290 - DNA, 20 bp, Artificial
  CRISPR gRNA sequence
cacacattggccccagtcag

SEQ ID NO: 562291 - DNA, 20 bp, Artificial
  CRISPR gRNA sequence
gccccagtcaggccatagca

SEQ ID NO: 562292 - DNA, 20 bp, Artificial
  CRISPR gRNA sequence
ccagcgagttcaactgtact

SEQ ID NO: 562293 - DNA, 20 bp, Artificial
  CRISPR gRNA sequence
aactgtacttgaggggttct

SEQ ID NO: 562294 - DNA, 20 bp, Artificial
  CRISPR gRNA sequence
tacttgaggggttctcatgg

SEQ ID NO: 562295 - DNA, 20 bp, Artificial
  CRISPR gRNA sequence
gaggggttctcatggctggc

SEQ ID NO: 562296 - DNA, 20 bp, Artificial
  CRISPR gRNA sequence
aggggttctcatggctggct

SEQ ID NO: 562297 - DNA, 20 bp, Artificial
  CRISPR gRNA sequence
tcatggctggctcctgcacc

SEQ ID NO: 562298 - DNA, 20 bp, Artificial
  CRISPR gRNA sequence
atggctggctcctgcacccc

SEQ ID NO: 562299 - DNA, 20 bp, Artificial
  CRISPR gRNA sequence
gctcctgcaccccactgcca

SEQ ID NO: 562300 - DNA, 20 bp, Artificial
  CRISPR gRNA sequence
ctgcaccccactgccagccc

SEQ ID NO: 562301 - DNA, 20 bp, Artificial
  CRISPR gRNA sequence
caccccactgccagccctcc

SEQ ID NO: 562302 - DNA, 20 bp, Artificial
  CRISPR gRNA sequence
ccagccctccagcccgtccg

SEQ ID NO: 562303 - DNA, 20 bp, Artificial
  CRISPR gRNA sequence
cagcccgtccgtccgtttgc

SEQ ID NO: 562304 - DNA, 20 bp, Artificial
  CRISPR gRNA sequence
gctcagcgtccgctgcctgc

SEQ ID NO: 562305 - DNA, 20 bp, Artificial
  CRISPR gRNA sequence
ctcagcgtccgctgcctgcc

SEQ ID NO: 562306 - DNA, 20 bp, Artificial
  CRISPR gRNA sequence
agcgtccgctgcctgcccgg

SEQ ID NO: 562307 - DNA, 20 bp, Artificial
  CRISPR gRNA sequence
cctgcccgggaggtgcgcgt

SEQ ID NO: 562308 - DNA, 20 bp, Artificial
  CRISPR gRNA sequence
cccgggaggtgcgcgtgtgc

SEQ ID NO: 562309 - DNA, 20 bp, Artificial
  CRISPR gRNA sequence
tggaagacagccaaggggga

SEQ ID NO: 562310 - DNA, 20 bp, Artificial
  CRISPR gRNA sequence
agatagactcaaaagtaccc

SEQ ID NO: 562311 - DNA, 20 bp, Artificial
  CRISPR gRNA sequence
aaaagtacccgcacgatcag

SEQ ID NO: 562312 - DNA, 20 bp, Artificial
  CRISPR gRNA sequence
taagaggcctgggctgggcg

SEQ ID NO: 562313 - DNA, 20 bp, Artificial
  CRISPR gRNA sequence
ggctgggcgtggtggcttac

SEQ ID NO: 562314 - DNA, 20 bp, Artificial
  CRISPR gRNA sequence
ggcgtggtggcttacacctg

SEQ ID NO: 562315 - DNA, 20 bp, Artificial
  CRISPR gRNA sequence
acacctgtcatcctagcact

SEQ ID NO: 562316 - DNA, 20 bp, Artificial
  CRISPR gRNA sequence
cacctgtcatcctagcactt

SEQ ID NO: 562317 - DNA, 20 bp, Artificial
  CRISPR gRNA sequence
tcatcctagcactttgggag

SEQ ID NO: 562318 - DNA, 20 bp, Artificial
  CRISPR gRNA sequence
gcactttgggaggctgaggc

SEQ ID NO: 562319 - DNA, 20 bp, Artificial
  CRISPR gRNA sequence
tgggaggctgaggcaggtgg

SEQ ID NO: 562320 - DNA, 20 bp, Artificial
  CRISPR gRNA sequence
gggaggctgaggcaggtgga

SEQ ID NO: 562321 - DNA, 20 bp, Artificial
  CRISPR gRNA sequence
ggaggctgaggcaggtggat

SEQ ID NO: 562322 - DNA, 20 bp, Artificial
  CRISPR gRNA sequence
aggcaggtggatcacttgag

SEQ ID NO: 562323 - DNA, 20 bp, Artificial
  CRISPR gRNA sequence
gaggccaggaatcggagacc

SEQ ID NO: 562324 - DNA, 20 bp, Artificial
  CRISPR gRNA sequence
aggccaggaatcggagacca

SEQ ID NO: 562325 - DNA, 20 bp, Artificial
  CRISPR gRNA sequence
tacaaaaaatacaaaaatta

SEQ ID NO: 562326 - DNA, 20 bp, Artificial
  CRISPR gRNA sequence
caaaaaatacaaaaattagc

SEQ ID NO: 562327 - DNA, 20 bp, Artificial
  CRISPR gRNA sequence
gctgagcgtggtggcgcata

SEQ ID NO: 562328 - DNA, 20 bp, Artificial
  CRISPR gRNA sequence
agcgtggtggcgcataccta

SEQ ID NO: 562329 - DNA, 20 bp, Artificial
  CRISPR gRNA sequence
tagtcccagctactcggaag

SEQ ID NO: 562330 - DNA, 20 bp, Artificial
  CRISPR gRNA sequence
ctcggaaggctgaggtggga

SEQ ID NO: 562331 - DNA, 20 bp, Artificial
  CRISPR gRNA sequence
ggaaggctgaggtgggagaa

SEQ ID NO: 562332 - DNA, 20 bp, Artificial
  CRISPR gRNA sequence
aggtgggagaatcacctgag

SEQ ID NO: 562333 - DNA, 20 bp, Artificial
  CRISPR gRNA sequence
agtcccggaggcagaggatg

SEQ ID NO: 562334 - DNA, 20 bp, Artificial
  CRISPR gRNA sequence
tgattgtgccactgaactcc

SEQ ID NO: 562335 - DNA, 20 bp, Artificial
  CRISPR gRNA sequence
tgccactgaactccagcctg

SEQ ID NO: 562336 - DNA, 20 bp, Artificial
  CRISPR gRNA sequence
aactccagcctgggtgacag

SEQ ID NO: 562337 - DNA, 20 bp, Artificial
  CRISPR gRNA sequence
cagcctgggtgacagaatat

SEQ ID NO: 562338 - DNA, 20 bp, Artificial
  CRISPR gRNA sequence
ggtgacagaatatgacctgt

SEQ ID NO: 562339 - DNA, 20 bp, Artificial
  CRISPR gRNA sequence
tctcaaaaaaaaaaaaaaaa

SEQ ID NO: 562340 - DNA, 20 bp, Artificial
  CRISPR gRNA sequence
aaaaaaaaaaaaaaaaaaaa

SEQ ID NO: 562341 - DNA, 20 bp, Artificial
  CRISPR gRNA sequence
tgagggtacagagggaagaa

SEQ ID NO: 562342 - DNA, 20 bp, Artificial
  CRISPR gRNA sequence
ttttgtgaaatcaagtgtct

SEQ ID NO: 562343 - DNA, 20 bp, Artificial
  CRISPR gRNA sequence
ttgtgaaatcaagtgtcttt

SEQ ID NO: 562344 - DNA, 20 bp, Artificial
  CRISPR gRNA sequence
tgtgaaatcaagtgtctttt

SEQ ID NO: 562345 - DNA, 20 bp, Artificial
  CRISPR gRNA sequence
gtgaaatcaagtgtcttttg

SEQ ID NO: 562346 - DNA, 20 bp, Artificial
  CRISPR gRNA sequence
tgaaatcaagtgtcttttgt

SEQ ID NO: 562347 - DNA, 20 bp, Artificial
  CRISPR gRNA sequence
ttgtgaagcagtcttcatgg

SEQ ID NO: 562348 - DNA, 20 bp, Artificial
  CRISPR gRNA sequence
tgtgaagcagtcttcatggg

SEQ ID NO: 562349 - DNA, 20 bp, Artificial
  CRISPR gRNA sequence
gtgaagcagtcttcatggga

SEQ ID NO: 562350 - DNA, 20 bp, Artificial
  CRISPR gRNA sequence
tgaagcagtcttcatgggag

SEQ ID NO: 562351 - DNA, 20 bp, Artificial
  CRISPR gRNA sequence
catgggagggaggatatttg

SEQ ID NO: 562352 - DNA, 20 bp, Artificial
  CRISPR gRNA sequence
atgggagggaggatatttga

SEQ ID NO: 562353 - DNA, 20 bp, Artificial
  CRISPR gRNA sequence
gagcccagccttcaaggact

SEQ ID NO: 562354 - DNA, 20 bp, Artificial
  CRISPR gRNA sequence
agcccagccttcaaggactg

SEQ ID NO: 562355 - DNA, 20 bp, Artificial
  CRISPR gRNA sequence
caaggactggtgatgtgtgg

SEQ ID NO: 562356 - DNA, 20 bp, Artificial
  CRISPR gRNA sequence
aaggactggtgatgtgtgga

SEQ ID NO: 562357 - DNA, 20 bp, Artificial
  CRISPR gRNA sequence
gtgatgtgtggacatgtgat

SEQ ID NO: 562358 - DNA, 20 bp, Artificial
  CRISPR gRNA sequence
ctgagtgtccccttagggag

SEQ ID NO: 562359 - DNA, 20 bp, Artificial
  CRISPR gRNA sequence
agtgtccccttagggagtct

SEQ ID NO: 562360 - DNA, 20 bp, Artificial
  CRISPR gRNA sequence
agggagtctggattctctga

SEQ ID NO: 562361 - DNA, 20 bp, Artificial
  CRISPR gRNA sequence
gggagtctggattctctgag

SEQ ID NO: 562362 - DNA, 20 bp, Artificial
  CRISPR gRNA sequence
gattctctgagctgagagag

SEQ ID NO: 562363 - DNA, 20 bp, Artificial
  CRISPR gRNA sequence
tctgagctgagagagcttct

SEQ ID NO: 562364 - DNA, 20 bp, Artificial
  CRISPR gRNA sequence
tgagctgagagagcttctcc

SEQ ID NO: 562365 - DNA, 20 bp, Artificial
  CRISPR gRNA sequence
agctgagagagcttctcctg

SEQ ID NO: 562366 - DNA, 20 bp, Artificial
  CRISPR gRNA sequence
agagagcttctcctgggcct

SEQ ID NO: 562367 - DNA, 20 bp, Artificial
  CRISPR gRNA sequence
ctcctgggccttacaggatc

SEQ ID NO: 562368 - DNA, 20 bp, Artificial
  CRISPR gRNA sequence
tcctgggccttacaggatca

SEQ ID NO: 562369 - DNA, 20 bp, Artificial
  CRISPR gRNA sequence
ctgggccttacaggatcagg

SEQ ID NO: 562370 - DNA, 20 bp, Artificial
  CRISPR gRNA sequence
ggccttacaggatcaggacc

SEQ ID NO: 562371 - DNA, 20 bp, Artificial
  CRISPR gRNA sequence
acaggatcaggaccatgcgc

SEQ ID NO: 562372 - DNA, 20 bp, Artificial
  CRISPR gRNA sequence
caggatcaggaccatgcgcc

SEQ ID NO: 562373 - DNA, 20 bp, Artificial
  CRISPR gRNA sequence
ggaagaagaatctgttagca

SEQ ID NO: 562374 - DNA, 20 bp, Artificial
  CRISPR gRNA sequence
ttagcaacaaagaggaaggc

SEQ ID NO: 562375 - DNA, 20 bp, Artificial
  CRISPR gRNA sequence
gcaacaaagaggaaggctgc

SEQ ID NO: 562376 - DNA, 20 bp, Artificial
  CRISPR gRNA sequence
cagtcaggaggaattggagg

SEQ ID NO: 562377 - DNA, 20 bp, Artificial
  CRISPR gRNA sequence
gaggcagggaggccagaagg

SEQ ID NO: 562378 - DNA, 20 bp, Artificial
  CRISPR gRNA sequence
ccatcacagggcccaaatag

SEQ ID NO: 562379 - DNA, 20 bp, Artificial
  CRISPR gRNA sequence
tggggagttcatgtgcgggt

SEQ ID NO: 562380 - DNA, 20 bp, Artificial
  CRISPR gRNA sequence
gggagttcatgtgcgggtgg

SEQ ID NO: 562381 - DNA, 20 bp, Artificial
  CRISPR gRNA sequence
atgtgcgggtggctggggaa

SEQ ID NO: 562382 - DNA, 20 bp, Artificial
  CRISPR gRNA sequence
gggaaaagaagagatacaaa

SEQ ID NO: 562383 - DNA, 20 bp, Artificial
  CRISPR gRNA sequence
attgaatggatggggtaact

SEQ ID NO: 562384 - DNA, 20 bp, Artificial
  CRISPR gRNA sequence
aatggatggggtaactctcc

SEQ ID NO: 562385 - DNA, 20 bp, Artificial
  CRISPR gRNA sequence
tcctccaggcaagctggtcc

SEQ ID NO: 562386 - DNA, 20 bp, Artificial
  CRISPR gRNA sequence
ctccaggcaagctggtccct

SEQ ID NO: 562387 - DNA, 20 bp, Artificial
  CRISPR gRNA sequence
caggcaagctggtccctcat

SEQ ID NO: 562388 - DNA, 20 bp, Artificial
  CRISPR gRNA sequence
gtccctcattccctggcacc

SEQ ID NO: 562389 - DNA, 20 bp, Artificial
  CRISPR gRNA sequence
attccctggcaccttgggtc

SEQ ID NO: 562390 - DNA, 20 bp, Artificial
  CRISPR gRNA sequence
cctggcaccttgggtcactg

SEQ ID NO: 562391 - DNA, 20 bp, Artificial
  CRISPR gRNA sequence
gcaccttgggtcactgctgc

SEQ ID NO: 562392 - DNA, 20 bp, Artificial
  CRISPR gRNA sequence
gggtcactgctgcctgtacc

SEQ ID NO: 562393 - DNA, 20 bp, Artificial
  CRISPR gRNA sequence
ggtcactgctgcctgtacct

SEQ ID NO: 562394 - DNA, 20 bp, Artificial
  CRISPR gRNA sequence
ctgcctgtacctgtgttctc

SEQ ID NO: 562395 - DNA, 20 bp, Artificial
  CRISPR gRNA sequence
cctgtacctgtgttctccct

SEQ ID NO: 562396 - DNA, 20 bp, Artificial
  CRISPR gRNA sequence
tacctgtgttctcccttcca

SEQ ID NO: 562397 - DNA, 20 bp, Artificial
  CRISPR gRNA sequence
tgttctcccttccactgcaa

SEQ ID NO: 562398 - DNA, 20 bp, Artificial
  CRISPR gRNA sequence
tcccttccactgcaaaccca

SEQ ID NO: 562399 - DNA, 20 bp, Artificial
  CRISPR gRNA sequence
ccttccactgcaaacccagt

SEQ ID NO: 562400 - DNA, 20 bp, Artificial
  CRISPR gRNA sequence
ccactgcaaacccagtttgc

SEQ ID NO: 562401 - DNA, 20 bp, Artificial
  CRISPR gRNA sequence
cactgcaaacccagtttgcc

SEQ ID NO: 562402 - DNA, 20 bp, Artificial
  CRISPR gRNA sequence
caaacccagtttgcccaagc

SEQ ID NO: 562403 - DNA, 20 bp, Artificial
  CRISPR gRNA sequence
gcccaagctccacctccaac

SEQ ID NO: 562404 - DNA, 20 bp, Artificial
  CRISPR gRNA sequence
cccaagctccacctccaaca

SEQ ID NO: 562405 - DNA, 20 bp, Artificial
  CRISPR gRNA sequence
cacctccaacagattatttg

SEQ ID NO: 562406 - DNA, 20 bp, Artificial
  CRISPR gRNA sequence
caacagattatttgaactgt

SEQ ID NO: 562407 - DNA, 20 bp, Artificial
  CRISPR gRNA sequence
tttgaactgtcccttcctgg

SEQ ID NO: 562408 - DNA, 20 bp, Artificial
  CRISPR gRNA sequence
gaactgtcccttcctggtga

SEQ ID NO: 562409 - DNA, 20 bp, Artificial
  CRISPR gRNA sequence
aactgtcccttcctggtgat

SEQ ID NO: 562410 - DNA, 20 bp, Artificial
  CRISPR gRNA sequence
tcccttcctggtgatctctc

SEQ ID NO: 562411 - DNA, 20 bp, Artificial
  CRISPR gRNA sequence
cctggtgatctctctcacct

SEQ ID NO: 562412 - DNA, 20 bp, Artificial
  CRISPR gRNA sequence
ctggtgatctctctcaccta

SEQ ID NO: 562413 - DNA, 20 bp, Artificial
  CRISPR gRNA sequence
gtgatctctctcacctaatt

SEQ ID NO: 562414 - DNA, 20 bp, Artificial
  CRISPR gRNA sequence
tctcacctaattcatgtatt

SEQ ID NO: 562415 - DNA, 20 bp, Artificial
  CRISPR gRNA sequence
tcacctaattcatgtattca

SEQ ID NO: 562416 - DNA, 20 bp, Artificial
  CRISPR gRNA sequence
acctaattcatgtattcatt

SEQ ID NO: 562417 - DNA, 20 bp, Artificial
  CRISPR gRNA sequence
attcatgtattcattcagaa

SEQ ID NO: 562418 - DNA, 20 bp, Artificial
  CRISPR gRNA sequence
atgtattcattcagaagtca

SEQ ID NO: 562419 - DNA, 20 bp, Artificial
  CRISPR gRNA sequence
attcagaagtcatttgattc

SEQ ID NO: 562420 - DNA, 20 bp, Artificial
  CRISPR gRNA sequence
agaagtcatttgattcagca

SEQ ID NO: 562421 - DNA, 20 bp, Artificial
  CRISPR gRNA sequence
gattcagcaaacatgtattt

SEQ ID NO: 562422 - DNA, 20 bp, Artificial
  CRISPR gRNA sequence
attcagcaaacatgtattta

SEQ ID NO: 562423 - DNA, 20 bp, Artificial
  CRISPR gRNA sequence
agcaaacatgtatttataaa

SEQ ID NO: 562424 - DNA, 20 bp, Artificial
  CRISPR gRNA sequence
ataaactgctctgcataggc

SEQ ID NO: 562425 - DNA, 20 bp, Artificial
  CRISPR gRNA sequence
taaactgctctgcataggcc

SEQ ID NO: 562426 - DNA, 20 bp, Artificial
  CRISPR gRNA sequence
ctctgcataggccttaaact

SEQ ID NO: 562427 - DNA, 20 bp, Artificial
  CRISPR gRNA sequence
tgcataggccttaaactaaa

SEQ ID NO: 562428 - DNA, 20 bp, Artificial
  CRISPR gRNA sequence
cataggccttaaactaaaga

SEQ ID NO: 562429 - DNA, 20 bp, Artificial
  CRISPR gRNA sequence
aaactaaagacaagactgaa

SEQ ID NO: 562430 - DNA, 20 bp, Artificial
  CRISPR gRNA sequence
aactaaagacaagactgaat

SEQ ID NO: 562431 - DNA, 20 bp, Artificial
  CRISPR gRNA sequence
aagacaagactgaatgggta

SEQ ID NO: 562432 - DNA, 20 bp, Artificial
  CRISPR gRNA sequence
aatgggtatatccccttttg

SEQ ID NO: 562433 - DNA, 20 bp, Artificial
  CRISPR gRNA sequence
ttggggacccaagcctgcct

SEQ ID NO: 562434 - DNA, 20 bp, Artificial
  CRISPR gRNA sequence
tggggacccaagcctgcctc

SEQ ID NO: 562435 - DNA, 20 bp, Artificial
  CRISPR gRNA sequence
ggggacccaagcctgcctca

SEQ ID NO: 562436 - DNA, 20 bp, Artificial
  CRISPR gRNA sequence
gggacccaagcctgcctcat

SEQ ID NO: 562437 - DNA, 20 bp, Artificial
  CRISPR gRNA sequence
cctcattagggaagctgcaa

SEQ ID NO: 562438 - DNA, 20 bp, Artificial
  CRISPR gRNA sequence
attagggaagctgcaaatgc

SEQ ID NO: 562439 - DNA, 20 bp, Artificial
  CRISPR gRNA sequence
gggaagctgcaaatgcagtg

SEQ ID NO: 562440 - DNA, 20 bp, Artificial
  CRISPR gRNA sequence
caaatgcagtgattaacagc

SEQ ID NO: 562441 - DNA, 20 bp, Artificial
  CRISPR gRNA sequence
acagcatcagctctggggtc

SEQ ID NO: 562442 - DNA, 20 bp, Artificial
  CRISPR gRNA sequence
tggggtcagatgcctagctt

SEQ ID NO: 562443 - DNA, 20 bp, Artificial
  CRISPR gRNA sequence
gggtcagatgcctagctttg

SEQ ID NO: 562444 - DNA, 20 bp, Artificial
  CRISPR gRNA sequence
gctttggatcctggccccac

SEQ ID NO: 562445 - DNA, 20 bp, Artificial
  CRISPR gRNA sequence
tggatcctggccccactcct

SEQ ID NO: 562446 - DNA, 20 bp, Artificial
  CRISPR gRNA sequence
ggatcctggccccactcctc

SEQ ID NO: 562447 - DNA, 20 bp, Artificial
  CRISPR gRNA sequence
gatcctggccccactcctca

SEQ ID NO: 562448 - DNA, 20 bp, Artificial
  CRISPR gRNA sequence
gccccactcctcacctgagt

SEQ ID NO: 562449 - DNA, 20 bp, Artificial
  CRISPR gRNA sequence
ctcacctgagtcatgaactt

SEQ ID NO: 562450 - DNA, 20 bp, Artificial
  CRISPR gRNA sequence
acctgagtcatgaacttgtg

SEQ ID NO: 562451 - DNA, 20 bp, Artificial
  CRISPR gRNA sequence
agtcatgaacttgtgtgagt

SEQ ID NO: 562452 - DNA, 20 bp, Artificial
  CRISPR gRNA sequence
gtgtgagttccctaacttct

SEQ ID NO: 562453 - DNA, 20 bp, Artificial
  CRISPR gRNA sequence
tgtgagttccctaacttctc

SEQ ID NO: 562454 - DNA, 20 bp, Artificial
  CRISPR gRNA sequence
cctaacttctcttcacttca

SEQ ID NO: 562455 - DNA, 20 bp, Artificial
  CRISPR gRNA sequence
acttctcttcacttcagtac

SEQ ID NO: 562456 - DNA, 20 bp, Artificial
  CRISPR gRNA sequence
ctcttcacttcagtaccttc

SEQ ID NO: 562457 - DNA, 20 bp, Artificial
  CRISPR gRNA sequence
tcttcacttcagtaccttca

SEQ ID NO: 562458 - DNA, 20 bp, Artificial
  CRISPR gRNA sequence
ttcacttcagtaccttcact

SEQ ID NO: 562459 - DNA, 20 bp, Artificial
  CRISPR gRNA sequence
cacttcagtaccttcacttt

SEQ ID NO: 562460 - DNA, 20 bp, Artificial
  CRISPR gRNA sequence
acttcagtaccttcactttt

SEQ ID NO: 562461 - DNA, 20 bp, Artificial
  CRISPR gRNA sequence
cagtaccttcacttttgaag

SEQ ID NO: 562462 - DNA, 20 bp, Artificial
  CRISPR gRNA sequence
agtaccttcacttttgaaga

SEQ ID NO: 562463 - DNA, 20 bp, Artificial
  CRISPR gRNA sequence
cacttttgaagagagtacca

SEQ ID NO: 562464 - DNA, 20 bp, Artificial
  CRISPR gRNA sequence
acttttgaagagagtaccac

SEQ ID NO: 562465 - DNA, 20 bp, Artificial
  CRISPR gRNA sequence
ttgaagagagtaccactcac

SEQ ID NO: 562466 - DNA, 20 bp, Artificial
  CRISPR gRNA sequence
tgaagagagtaccactcaca

SEQ ID NO: 562467 - DNA, 20 bp, Artificial
  CRISPR gRNA sequence
gaagagagtaccactcacat

SEQ ID NO: 562468 - DNA, 20 bp, Artificial
  CRISPR gRNA sequence
aagagagtaccactcacatg

SEQ ID NO: 562469 - DNA, 20 bp, Artificial
  CRISPR gRNA sequence
acatgagggaaaggagaata

SEQ ID NO: 562470 - DNA, 20 bp, Artificial
  CRISPR gRNA sequence
catagaattactgggaacat

SEQ ID NO: 562471 - DNA, 20 bp, Artificial
  CRISPR gRNA sequence
atagaattactgggaacatc

SEQ ID NO: 562472 - DNA, 20 bp, Artificial
  CRISPR gRNA sequence
ctgggaacatcagtcatgca

SEQ ID NO: 562473 - DNA, 20 bp, Artificial
  CRISPR gRNA sequence
ggaacatcagtcatgcaata

SEQ ID NO: 562474 - DNA, 20 bp, Artificial
  CRISPR gRNA sequence
actgagtgtcaattatatgt

SEQ ID NO: 562475 - DNA, 20 bp, Artificial
  CRISPR gRNA sequence
ctgagtgtcaattatatgtt

SEQ ID NO: 562476 - DNA, 20 bp, Artificial
  CRISPR gRNA sequence
agtgtcaattatatgttaag

SEQ ID NO: 562477 - DNA, 20 bp, Artificial
  CRISPR gRNA sequence
tatgttaagcactgcacaat

SEQ ID NO: 562478 - DNA, 20 bp, Artificial
  CRISPR gRNA sequence
agcactgcacaatggacggg

SEQ ID NO: 562479 - DNA, 20 bp, Artificial
  CRISPR gRNA sequence
cacaatggacgggggataca

SEQ ID NO: 562480 - DNA, 20 bp, Artificial
  CRISPR gRNA sequence
tgcacagttccctgcctttg

SEQ ID NO: 562481 - DNA, 20 bp, Artificial
  CRISPR gRNA sequence
cctgcctttgtgaagctcac

SEQ ID NO: 562482 - DNA, 20 bp, Artificial
  CRISPR gRNA sequence
cctttgtgaagctcacctta

SEQ ID NO: 562483 - DNA, 20 bp, Artificial
  CRISPR gRNA sequence
tgtgaagctcaccttatagt

SEQ ID NO: 562484 - DNA, 20 bp, Artificial
  CRISPR gRNA sequence
gtgaagctcaccttatagtg

SEQ ID NO: 562485 - DNA, 20 bp, Artificial
  CRISPR gRNA sequence
tgaagctcaccttatagtga

SEQ ID NO: 562486 - DNA, 20 bp, Artificial
  CRISPR gRNA sequence
accttatagtgagggagaga

SEQ ID NO: 562487 - DNA, 20 bp, Artificial
  CRISPR gRNA sequence
atagtgagggagagagacag

SEQ ID NO: 562488 - DNA, 20 bp, Artificial
  CRISPR gRNA sequence
tagtgagggagagagacagt

SEQ ID NO: 562489 - DNA, 20 bp, Artificial
  CRISPR gRNA sequence
gatggtgataaagtaaacat

SEQ ID NO: 562490 - DNA, 20 bp, Artificial
  CRISPR gRNA sequence
actagtacagagatgagtaa

SEQ ID NO: 562491 - DNA, 20 bp, Artificial
  CRISPR gRNA sequence
ctagtacagagatgagtaaa

SEQ ID NO: 562492 - DNA, 20 bp, Artificial
  CRISPR gRNA sequence
gtacagagatgagtaaagca

SEQ ID NO: 562493 - DNA, 20 bp, Artificial
  CRISPR gRNA sequence
atacttcagtttagggtttt

SEQ ID NO: 562494 - DNA, 20 bp, Artificial
  CRISPR gRNA sequence
cagtttagggttttttttga

SEQ ID NO: 562495 - DNA, 20 bp, Artificial
  CRISPR gRNA sequence
agtttagggttttttttgaa

SEQ ID NO: 562496 - DNA, 20 bp, Artificial
  CRISPR gRNA sequence
agggttttttttgaaatttt

SEQ ID NO: 562497 - DNA, 20 bp, Artificial
  CRISPR gRNA sequence
gggttttttttgaaatttta

SEQ ID NO: 562498 - DNA, 20 bp, Artificial
  CRISPR gRNA sequence
tttttgaaattttagaacaa

SEQ ID NO: 562499 - DNA, 20 bp, Artificial
  CRISPR gRNA sequence
ttttgaaattttagaacaat

SEQ ID NO: 562500 - DNA, 20 bp, Artificial
  CRISPR gRNA sequence
tttgaaattttagaacaatt

SEQ ID NO: 562501 - DNA, 20 bp, Artificial
  CRISPR gRNA sequence
ttgaaattttagaacaatta

SEQ ID NO: 562502 - DNA, 20 bp, Artificial
  CRISPR gRNA sequence
tgaaattttagaacaattaa

SEQ ID NO: 562503 - DNA, 20 bp, Artificial
  CRISPR gRNA sequence
gaaattttagaacaattaaa

SEQ ID NO: 562504 - DNA, 20 bp, Artificial
  CRISPR gRNA sequence
aaattttagaacaattaaaa

SEQ ID NO: 562505 - DNA, 20 bp, Artificial
  CRISPR gRNA sequence
tagaacaattaaaatcttta

SEQ ID NO: 562506 - DNA, 20 bp, Artificial
  CRISPR gRNA sequence
agaacaattaaaatctttag

SEQ ID NO: 562507 - DNA, 20 bp, Artificial
  CRISPR gRNA sequence
gaacaattaaaatctttagg

SEQ ID NO: 562508 - DNA, 20 bp, Artificial
  CRISPR gRNA sequence
aaatctttaggacagttgca

SEQ ID NO: 562509 - DNA, 20 bp, Artificial
  CRISPR gRNA sequence
taggacagttgcaaaattag

SEQ ID NO: 562510 - DNA, 20 bp, Artificial
  CRISPR gRNA sequence
aggacagttgcaaaattagt

SEQ ID NO: 562511 - DNA, 20 bp, Artificial
  CRISPR gRNA sequence
ggacagttgcaaaattagta

SEQ ID NO: 562512 - DNA, 20 bp, Artificial
  CRISPR gRNA sequence
caaaattagtacagtgaaca

SEQ ID NO: 562513 - DNA, 20 bp, Artificial
  CRISPR gRNA sequence
gtacagtgaacatttgcgta

SEQ ID NO: 562514 - DNA, 20 bp, Artificial
  CRISPR gRNA sequence
gcgtactttctccttgaatc

SEQ ID NO: 562515 - DNA, 20 bp, Artificial
  CRISPR gRNA sequence
cgtactttctccttgaatca

SEQ ID NO: 562516 - DNA, 20 bp, Artificial
  CRISPR gRNA sequence
tctccttgaatcaccagtta

SEQ ID NO: 562517 - DNA, 20 bp, Artificial
  CRISPR gRNA sequence
ctccttgaatcaccagttaa

SEQ ID NO: 562518 - DNA, 20 bp, Artificial
  CRISPR gRNA sequence
tccttgaatcaccagttaac

SEQ ID NO: 562519 - DNA, 20 bp, Artificial
  CRISPR gRNA sequence
cttgaatcaccagttaactg

SEQ ID NO: 562520 - DNA, 20 bp, Artificial
  CRISPR gRNA sequence
gaatcaccagttaactgtca

SEQ ID NO: 562521 - DNA, 20 bp, Artificial
  CRISPR gRNA sequence
aatcaccagttaactgtcac

SEQ ID NO: 562522 - DNA, 20 bp, Artificial
  CRISPR gRNA sequence
actgtcacattagttttctt

SEQ ID NO: 562523 - DNA, 20 bp, Artificial
  CRISPR gRNA sequence
tcacattagttttctttgtt

SEQ ID NO: 562524 - DNA, 20 bp, Artificial
  CRISPR gRNA sequence
gttttctttgttatttttgc

SEQ ID NO: 562525 - DNA, 20 bp, Artificial
  CRISPR gRNA sequence
tctttgttatttttgccatc

SEQ ID NO: 562526 - DNA, 20 bp, Artificial
  CRISPR gRNA sequence
ctttgttatttttgccatct

SEQ ID NO: 562527 - DNA, 20 bp, Artificial
  CRISPR gRNA sequence
tttgttatttttgccatctg

SEQ ID NO: 562528 - DNA, 20 bp, Artificial
  CRISPR gRNA sequence
tgttatttttgccatctgtt

SEQ ID NO: 562529 - DNA, 20 bp, Artificial
  CRISPR gRNA sequence
gttatttttgccatctgtta

SEQ ID NO: 562530 - DNA, 20 bp, Artificial
  CRISPR gRNA sequence
ttatttttgccatctgttat

SEQ ID NO: 562531 - DNA, 20 bp, Artificial
  CRISPR gRNA sequence
tttttgccatctgttatttt

SEQ ID NO: 562532 - DNA, 20 bp, Artificial
  CRISPR gRNA sequence
ttgccatctgttatttttgc

SEQ ID NO: 562533 - DNA, 20 bp, Artificial
  CRISPR gRNA sequence
tgccatctgttatttttgcc

SEQ ID NO: 562534 - DNA, 20 bp, Artificial
  CRISPR gRNA sequence
gccatctgttatttttgcca

SEQ ID NO: 562535 - DNA, 20 bp, Artificial
  CRISPR gRNA sequence
ccatctgttatttttgccaa

SEQ ID NO: 562536 - DNA, 20 bp, Artificial
  CRISPR gRNA sequence
ttatttttgccaaaccattt

SEQ ID NO: 562537 - DNA, 20 bp, Artificial
  CRISPR gRNA sequence
tttttgccaaaccatttgag

SEQ ID NO: 562538 - DNA, 20 bp, Artificial
  CRISPR gRNA sequence
ttgccaaaccatttgagagt

SEQ ID NO: 562539 - DNA, 20 bp, Artificial
  CRISPR gRNA sequence
tgccaaaccatttgagagtt

SEQ ID NO: 562540 - DNA, 20 bp, Artificial
  CRISPR gRNA sequence
gccaaaccatttgagagttt

SEQ ID NO: 562541 - DNA, 20 bp, Artificial
  CRISPR gRNA sequence
ccaaaccatttgagagtttc

SEQ ID NO: 562542 - DNA, 20 bp, Artificial
  CRISPR gRNA sequence
gagagtttcagatctcatga

SEQ ID NO: 562543 - DNA, 20 bp, Artificial
  CRISPR gRNA sequence
agagtttcagatctcatgac

SEQ ID NO: 562544 - DNA, 20 bp, Artificial
  CRISPR gRNA sequence
cagatctcatgacacctcac

SEQ ID NO: 562545 - DNA, 20 bp, Artificial
  CRISPR gRNA sequence
agatctcatgacacctcacc

SEQ ID NO: 562546 - DNA, 20 bp, Artificial
  CRISPR gRNA sequence
atgacacctcacctgtaatt

SEQ ID NO: 562547 - DNA, 20 bp, Artificial
  CRISPR gRNA sequence
acctgtaattctttatcata

SEQ ID NO: 562548 - DNA, 20 bp, Artificial
  CRISPR gRNA sequence
taattctttatcatatgtct

SEQ ID NO: 562549 - DNA, 20 bp, Artificial
  CRISPR gRNA sequence
tttatcatatgtctcataag

SEQ ID NO: 562550 - DNA, 20 bp, Artificial
  CRISPR gRNA sequence
tatcatatgtctcataagaa

SEQ ID NO: 562551 - DNA, 20 bp, Artificial
  CRISPR gRNA sequence
atcatatgtctcataagaac

SEQ ID NO: 562552 - DNA, 20 bp, Artificial
  CRISPR gRNA sequence
tcatatgtctcataagaaca

SEQ ID NO: 562553 - DNA, 20 bp, Artificial
  CRISPR gRNA sequence
ataagaacaagagcattctc

SEQ ID NO: 562554 - DNA, 20 bp, Artificial
  CRISPR gRNA sequence
tccaacaagtcacagaatca

SEQ ID NO: 562555 - DNA, 20 bp, Artificial
  CRISPR gRNA sequence
caacaagtcacagaatcatc

SEQ ID NO: 562556 - DNA, 20 bp, Artificial
  CRISPR gRNA sequence
gaaatgtggcattgatacaa

SEQ ID NO: 562557 - DNA, 20 bp, Artificial
  CRISPR gRNA sequence
atacaatactgtttcctggt

SEQ ID NO: 562558 - DNA, 20 bp, Artificial
  CRISPR gRNA sequence
tttcctggtagagaacccag

SEQ ID NO: 562559 - DNA, 20 bp, Artificial
  CRISPR gRNA sequence
cctggtagagaacccagaag

SEQ ID NO: 562560 - DNA, 20 bp, Artificial
  CRISPR gRNA sequence
ctggtagagaacccagaagc

SEQ ID NO: 562561 - DNA, 20 bp, Artificial
  CRISPR gRNA sequence
gtagagaacccagaagccag

SEQ ID NO: 562562 - DNA, 20 bp, Artificial
  CRISPR gRNA sequence
caccacatacttcatttgat

SEQ ID NO: 562563 - DNA, 20 bp, Artificial
  CRISPR gRNA sequence
catttgataatcatgccttt

SEQ ID NO: 562564 - DNA, 20 bp, Artificial
  CRISPR gRNA sequence
atttgataatcatgcctttt

SEQ ID NO: 562565 - DNA, 20 bp, Artificial
  CRISPR gRNA sequence
gataatcatgcctttttaac

SEQ ID NO: 562566 - DNA, 20 bp, Artificial
  CRISPR gRNA sequence
ataatcatgcctttttaacc

SEQ ID NO: 562567 - DNA, 20 bp, Artificial
  CRISPR gRNA sequence
tttaaccccctttaacctaa

SEQ ID NO: 562568 - DNA, 20 bp, Artificial
  CRISPR gRNA sequence
ttaaccccctttaacctaaa

SEQ ID NO: 562569 - DNA, 20 bp, Artificial
  CRISPR gRNA sequence
taaccccctttaacctaaaa

SEQ ID NO: 562570 - DNA, 20 bp, Artificial
  CRISPR gRNA sequence
aaccccctttaacctaaaac

SEQ ID NO: 562571 - DNA, 20 bp, Artificial
  CRISPR gRNA sequence
accccctttaacctaaaact

SEQ ID NO: 562572 - DNA, 20 bp, Artificial
  CRISPR gRNA sequence
taacctaaaactgttgcttt

SEQ ID NO: 562573 - DNA, 20 bp, Artificial
  CRISPR gRNA sequence
aacctaaaactgttgctttt

SEQ ID NO: 562574 - DNA, 20 bp, Artificial
  CRISPR gRNA sequence
acctaaaactgttgcttttt

SEQ ID NO: 562575 - DNA, 20 bp, Artificial
  CRISPR gRNA sequence
aaactgttgctttttttttt

SEQ ID NO: 562576 - DNA, 20 bp, Artificial
  CRISPR gRNA sequence
ttgctttttttttttttttt

SEQ ID NO: 562577 - DNA, 20 bp, Artificial
  CRISPR gRNA sequence
cttttttttttttttttttt

SEQ ID NO: 562578 - DNA, 20 bp, Artificial
  CRISPR gRNA sequence
ttttttttttttttttttgg

SEQ ID NO: 562579 - DNA, 20 bp, Artificial
  CRISPR gRNA sequence
tttttttttttttttttggt

SEQ ID NO: 562580 - DNA, 20 bp, Artificial
  CRISPR gRNA sequence
ttttttttttttttttggta

SEQ ID NO: 562581 - DNA, 20 bp, Artificial
  CRISPR gRNA sequence
tttttttttttttttggtac

SEQ ID NO: 562582 - DNA, 20 bp, Artificial
  CRISPR gRNA sequence
ttttttttttttttggtact

SEQ ID NO: 562583 - DNA, 20 bp, Artificial
  CRISPR gRNA sequence
tttttttttttttggtactt

SEQ ID NO: 562584 - DNA, 20 bp, Artificial
  CRISPR gRNA sequence
ttttttttttttggtacttt

SEQ ID NO: 562585 - DNA, 20 bp, Artificial
  CRISPR gRNA sequence
tttttttttttggtacttta

SEQ ID NO: 562586 - DNA, 20 bp, Artificial
  CRISPR gRNA sequence
ttttttttttggtactttaa

SEQ ID NO: 562587 - DNA, 20 bp, Artificial
  CRISPR gRNA sequence
tttttttttggtactttaag

SEQ ID NO: 562588 - DNA, 20 bp, Artificial
  CRISPR gRNA sequence
ttttttttggtactttaaga

SEQ ID NO: 562589 - DNA, 20 bp, Artificial
  CRISPR gRNA sequence
tttttttggtactttaagac

SEQ ID NO: 562590 - DNA, 20 bp, Artificial
  CRISPR gRNA sequence
ttttttggtactttaagaca

SEQ ID NO: 562591 - DNA, 20 bp, Artificial
  CRISPR gRNA sequence
tttttggtactttaagacat

SEQ ID NO: 562592 - DNA, 20 bp, Artificial
  CRISPR gRNA sequence
ttttggtactttaagacatc

SEQ ID NO: 562593 - DNA, 20 bp, Artificial
  CRISPR gRNA sequence
tttggtactttaagacatca

SEQ ID NO: 562594 - DNA, 20 bp, Artificial
  CRISPR gRNA sequence
ttggtactttaagacatcat

SEQ ID NO: 562595 - DNA, 20 bp, Artificial
  CRISPR gRNA sequence
tggtactttaagacatcatc

SEQ ID NO: 562596 - DNA, 20 bp, Artificial
  CRISPR gRNA sequence
ggtactttaagacatcatca

SEQ ID NO: 562597 - DNA, 20 bp, Artificial
  CRISPR gRNA sequence
gtactttaagacatcatcat

SEQ ID NO: 562598 - DNA, 20 bp, Artificial
  CRISPR gRNA sequence
taagacatcatcatttttga

SEQ ID NO: 562599 - DNA, 20 bp, Artificial
  CRISPR gRNA sequence
aagacatcatcatttttgaa

SEQ ID NO: 562600 - DNA, 20 bp, Artificial
  CRISPR gRNA sequence
agacatcatcatttttgaag

SEQ ID NO: 562601 - DNA, 20 bp, Artificial
  CRISPR gRNA sequence
ttgaagtgtctgggctagtt

SEQ ID NO: 562602 - DNA, 20 bp, Artificial
  CRISPR gRNA sequence
tgaagtgtctgggctagttg

SEQ ID NO: 562603 - DNA, 20 bp, Artificial
  CRISPR gRNA sequence
gaagtgtctgggctagttgc

SEQ ID NO: 562604 - DNA, 20 bp, Artificial
  CRISPR gRNA sequence
aagtgtctgggctagttgct

SEQ ID NO: 562605 - DNA, 20 bp, Artificial
  CRISPR gRNA sequence
ggctagttgctttaccgaat

SEQ ID NO: 562606 - DNA, 20 bp, Artificial
  CRISPR gRNA sequence
gttgctttaccgaatgtccc

SEQ ID NO: 562607 - DNA, 20 bp, Artificial
  CRISPR gRNA sequence
ctttaccgaatgtccctttg

SEQ ID NO: 562608 - DNA, 20 bp, Artificial
  CRISPR gRNA sequence
taccgaatgtccctttggat

SEQ ID NO: 562609 - DNA, 20 bp, Artificial
  CRISPR gRNA sequence
accgaatgtccctttggatg

SEQ ID NO: 562610 - DNA, 20 bp, Artificial
  CRISPR gRNA sequence
ccgaatgtccctttggatgt

SEQ ID NO: 562611 - DNA, 20 bp, Artificial
  CRISPR gRNA sequence
tggatgtggattgcctgctt

SEQ ID NO: 562612 - DNA, 20 bp, Artificial
  CRISPR gRNA sequence
ggatgtggattgcctgcttg

SEQ ID NO: 562613 - DNA, 20 bp, Artificial
  CRISPR gRNA sequence
gatgtggattgcctgcttgt

SEQ ID NO: 562614 - DNA, 20 bp, Artificial
  CRISPR gRNA sequence
cctgcttgtttcctcatgat

SEQ ID NO: 562615 - DNA, 20 bp, Artificial
  CRISPR gRNA sequence
cttgtttcctcatgatcaga

SEQ ID NO: 562616 - DNA, 20 bp, Artificial
  CRISPR gRNA sequence
gtttcctcatgatcagattc

SEQ ID NO: 562617 - DNA, 20 bp, Artificial
  CRISPR gRNA sequence
tttcctcatgatcagattct

SEQ ID NO: 562618 - DNA, 20 bp, Artificial
  CRISPR gRNA sequence
cctcatgatcagattctggt

SEQ ID NO: 562619 - DNA, 20 bp, Artificial
  CRISPR gRNA sequence
ctcatgatcagattctggtt

SEQ ID NO: 562620 - DNA, 20 bp, Artificial
  CRISPR gRNA sequence
atgatcagattctggttgta

SEQ ID NO: 562621 - DNA, 20 bp, Artificial
  CRISPR gRNA sequence
tggttgtaactctttgtagc

SEQ ID NO: 562622 - DNA, 20 bp, Artificial
  CRISPR gRNA sequence
gttgtaactctttgtagcag

SEQ ID NO: 562623 - DNA, 20 bp, Artificial
  CRISPR gRNA sequence
taactctttgtagcaggaat

SEQ ID NO: 562624 - DNA, 20 bp, Artificial
  CRISPR gRNA sequence
tttgtagcaggaatacttca

SEQ ID NO: 562625 - DNA, 20 bp, Artificial
  CRISPR gRNA sequence
tgtagcaggaatacttcata

SEQ ID NO: 562626 - DNA, 20 bp, Artificial
  CRISPR gRNA sequence
gtagcaggaatacttcatag

SEQ ID NO: 562627 - DNA, 20 bp, Artificial
  CRISPR gRNA sequence
tagcaggaatacttcatagc

SEQ ID NO: 562628 - DNA, 20 bp, Artificial
  CRISPR gRNA sequence
catagctatgttgggtcctt

SEQ ID NO: 562629 - DNA, 20 bp, Artificial
  CRISPR gRNA sequence
atagctatgttgggtccttc

SEQ ID NO: 562630 - DNA, 20 bp, Artificial
  CRISPR gRNA sequence
tgttgggtccttctcagtgt

SEQ ID NO: 562631 - DNA, 20 bp, Artificial
  CRISPR gRNA sequence
ggtccttctcagtgtgtcac

SEQ ID NO: 562632 - DNA, 20 bp, Artificial
  CRISPR gRNA sequence
ctcagtgtgtcacatcagga

SEQ ID NO: 562633 - DNA, 20 bp, Artificial
  CRISPR gRNA sequence
tcagtgtgtcacatcaggaa

SEQ ID NO: 562634 - DNA, 20 bp, Artificial
  CRISPR gRNA sequence
agtgtgtcacatcaggaaga

SEQ ID NO: 562635 - DNA, 20 bp, Artificial
  CRISPR gRNA sequence
tttgtcacattattggagat

SEQ ID NO: 562636 - DNA, 20 bp, Artificial
  CRISPR gRNA sequence
gtcacattattggagatgtt

SEQ ID NO: 562637 - DNA, 20 bp, Artificial
  CRISPR gRNA sequence
tcacattattggagatgtta

SEQ ID NO: 562638 - DNA, 20 bp, Artificial
  CRISPR gRNA sequence
ttggagatgttaactttgac

SEQ ID NO: 562639 - DNA, 20 bp, Artificial
  CRISPR gRNA sequence
gagatgttaactttgacatt

SEQ ID NO: 562640 - DNA, 20 bp, Artificial
  CRISPR gRNA sequence
actttgacatttggttaaag

SEQ ID NO: 562641 - DNA, 20 bp, Artificial
  CRISPR gRNA sequence
tgacatttggttaaagtgaa

SEQ ID NO: 562642 - DNA, 20 bp, Artificial
  CRISPR gRNA sequence
gacatttggttaaagtgaag

SEQ ID NO: 562643 - DNA, 20 bp, Artificial
  CRISPR gRNA sequence
acatttggttaaagtgaagt

SEQ ID NO: 562644 - DNA, 20 bp, Artificial
  CRISPR gRNA sequence
ggttaaagtgaagtttacca

SEQ ID NO: 562645 - DNA, 20 bp, Artificial
  CRISPR gRNA sequence
gttaaagtgaagtttaccag

SEQ ID NO: 562646 - DNA, 20 bp, Artificial
  CRISPR gRNA sequence
aagtgaagtttaccagattt

SEQ ID NO: 562647 - DNA, 20 bp, Artificial
  CRISPR gRNA sequence
accagatttctccattgtag

SEQ ID NO: 562648 - DNA, 20 bp, Artificial
  CRISPR gRNA sequence
ccagatttctccattgtaga

SEQ ID NO: 562649 - DNA, 20 bp, Artificial
  CRISPR gRNA sequence
ctccattgtagaggcaccat

SEQ ID NO: 562650 - DNA, 20 bp, Artificial
  CRISPR gRNA sequence
tccattgtagaggcaccatt

SEQ ID NO: 562651 - DNA, 20 bp, Artificial
  CRISPR gRNA sequence
cattgtagaggcaccatttt

SEQ ID NO: 562652 - DNA, 20 bp, Artificial
  CRISPR gRNA sequence
tagaggcaccattttacctt

SEQ ID NO: 562653 - DNA, 20 bp, Artificial
  CRISPR gRNA sequence
tacctttgtaagtaataaat

SEQ ID NO: 562654 - DNA, 20 bp, Artificial
  CRISPR gRNA sequence
acctttgtaagtaataaatg

SEQ ID NO: 562655 - DNA, 20 bp, Artificial
  CRISPR gRNA sequence
cctttgtaagtaataaatga

SEQ ID NO: 562656 - DNA, 20 bp, Artificial
  CRISPR gRNA sequence
tgtaagtaataaatgatgtg

SEQ ID NO: 562657 - DNA, 20 bp, Artificial
  CRISPR gRNA sequence
gtaagtaataaatgatgtgt

SEQ ID NO: 562658 - DNA, 20 bp, Artificial
  CRISPR gRNA sequence
taagtaataaatgatgtgtt

SEQ ID NO: 562659 - DNA, 20 bp, Artificial
  CRISPR gRNA sequence
agtgatgttttgaggttgag

SEQ ID NO: 562660 - DNA, 20 bp, Artificial
  CRISPR gRNA sequence
tgaggttgagtgaatatcct

SEQ ID NO: 562661 - DNA, 20 bp, Artificial
  CRISPR gRNA sequence
gaggttgagtgaatatcctg

SEQ ID NO: 562662 - DNA, 20 bp, Artificial
  CRISPR gRNA sequence
aggttgagtgaatatcctgt

SEQ ID NO: 562663 - DNA, 20 bp, Artificial
  CRISPR gRNA sequence
agtgaatatcctgttctcca

SEQ ID NO: 562664 - DNA, 20 bp, Artificial
  CRISPR gRNA sequence
ttctccagccattgttcatt

SEQ ID NO: 562665 - DNA, 20 bp, Artificial
  CRISPR gRNA sequence
tccagccattgttcattcag

SEQ ID NO: 562666 - DNA, 20 bp, Artificial
  CRISPR gRNA sequence
cagccattgttcattcagtg

SEQ ID NO: 562667 - DNA, 20 bp, Artificial
  CRISPR gRNA sequence
ttcattcagtggttttagta

SEQ ID NO: 562668 - DNA, 20 bp, Artificial
  CRISPR gRNA sequence
attcagtggttttagtatcc

SEQ ID NO: 562669 - DNA, 20 bp, Artificial
  CRISPR gRNA sequence
agtggttttagtatcctatg

SEQ ID NO: 562670 - DNA, 20 bp, Artificial
  CRISPR gRNA sequence
tagtatcctatggtgattct

SEQ ID NO: 562671 - DNA, 20 bp, Artificial
  CRISPR gRNA sequence
agtatcctatggtgattctt

SEQ ID NO: 562672 - DNA, 20 bp, Artificial
  CRISPR gRNA sequence
gtatcctatggtgattcttc

SEQ ID NO: 562673 - DNA, 20 bp, Artificial
  CRISPR gRNA sequence
tggtgattcttcccagaatc

SEQ ID NO: 562674 - DNA, 20 bp, Artificial
  CRISPR gRNA sequence
ttcccagaatccattatcac

SEQ ID NO: 562675 - DNA, 20 bp, Artificial
  CRISPR gRNA sequence
cccagaatccattatcacta

SEQ ID NO: 562676 - DNA, 20 bp, Artificial
  CRISPR gRNA sequence
ccagaatccattatcactaa

SEQ ID NO: 562677 - DNA, 20 bp, Artificial
  CRISPR gRNA sequence
tcactaaaatattttatttt

SEQ ID NO: 562678 - DNA, 20 bp, Artificial
  CRISPR gRNA sequence
aaatattttattttattttt

SEQ ID NO: 562679 - DNA, 20 bp, Artificial
  CRISPR gRNA sequence
tattttattttttgagacag

SEQ ID NO: 562680 - DNA, 20 bp, Artificial
  CRISPR gRNA sequence
attttattttttgagacagg

SEQ ID NO: 562681 - DNA, 20 bp, Artificial
  CRISPR gRNA sequence
ttttattttttgagacaggg

SEQ ID NO: 562682 - DNA, 20 bp, Artificial
  CRISPR gRNA sequence
tattttttgagacagggtct

SEQ ID NO: 562683 - DNA, 20 bp, Artificial
  CRISPR gRNA sequence
attttttgagacagggtctc

SEQ ID NO: 562684 - DNA, 20 bp, Artificial
  CRISPR gRNA sequence
ttttttgagacagggtctca

SEQ ID NO: 562685 - DNA, 20 bp, Artificial
  CRISPR gRNA sequence
tttgagacagggtctcactg

SEQ ID NO: 562686 - DNA, 20 bp, Artificial
  CRISPR gRNA sequence
ttgagacagggtctcactgt

SEQ ID NO: 562687 - DNA, 20 bp, Artificial
  CRISPR gRNA sequence
tgagacagggtctcactgtg

SEQ ID NO: 562688 - DNA, 20 bp, Artificial
  CRISPR gRNA sequence
gagacagggtctcactgtgt

SEQ ID NO: 562689 - DNA, 20 bp, Artificial
  CRISPR gRNA sequence
agacagggtctcactgtgtc

SEQ ID NO: 562690 - DNA, 20 bp, Artificial
  CRISPR gRNA sequence
actgtgtcacccaggctgga

SEQ ID NO: 562691 - DNA, 20 bp, Artificial
  CRISPR gRNA sequence
tgtcacccaggctggagtac

SEQ ID NO: 562692 - DNA, 20 bp, Artificial
  CRISPR gRNA sequence
gagtacaggggtgctatcac

SEQ ID NO: 562693 - DNA, 20 bp, Artificial
  CRISPR gRNA sequence
tcacagctaactccagcctc

SEQ ID NO: 562694 - DNA, 20 bp, Artificial
  CRISPR gRNA sequence
actccagcctcgacctctga

SEQ ID NO: 562695 - DNA, 20 bp, Artificial
  CRISPR gRNA sequence
cagcctcgacctctgaggct

SEQ ID NO: 562696 - DNA, 20 bp, Artificial
  CRISPR gRNA sequence
gacctctgaggctcaagcaa

SEQ ID NO: 562697 - DNA, 20 bp, Artificial
  CRISPR gRNA sequence
tgaggctcaagcaattctgc

SEQ ID NO: 562698 - DNA, 20 bp, Artificial
  CRISPR gRNA sequence
aggctcaagcaattctgcca

SEQ ID NO: 562699 - DNA, 20 bp, Artificial
  CRISPR gRNA sequence
aagcaattctgccacctcag

SEQ ID NO: 562700 - DNA, 20 bp, Artificial
  CRISPR gRNA sequence
tgccacctcagccttctgag

SEQ ID NO: 562701 - DNA, 20 bp, Artificial
  CRISPR gRNA sequence
ccacctcagccttctgagta

SEQ ID NO: 562702 - DNA, 20 bp, Artificial
  CRISPR gRNA sequence
agccttctgagtagccagga

SEQ ID NO: 562703 - DNA, 20 bp, Artificial
  CRISPR gRNA sequence
ctgagtagccaggactacag

SEQ ID NO: 562704 - DNA, 20 bp, Artificial
  CRISPR gRNA sequence
tgagtagccaggactacagg

SEQ ID NO: 562705 - DNA, 20 bp, Artificial
  CRISPR gRNA sequence
agtagccaggactacaggtg

SEQ ID NO: 562706 - DNA, 20 bp, Artificial
  CRISPR gRNA sequence
caggtgcatgccaccatgct

SEQ ID NO: 562707 - DNA, 20 bp, Artificial
  CRISPR gRNA sequence
ggctaatttttttttagttt

SEQ ID NO: 562708 - DNA, 20 bp, Artificial
  CRISPR gRNA sequence
gctaatttttttttagtttt

SEQ ID NO: 562709 - DNA, 20 bp, Artificial
  CRISPR gRNA sequence
atttttttttagtttttgta

SEQ ID NO: 562710 - DNA, 20 bp, Artificial
  CRISPR gRNA sequence
ttttttagtttttgtagaaa

SEQ ID NO: 562711 - DNA, 20 bp, Artificial
  CRISPR gRNA sequence
tttttagtttttgtagaaac

SEQ ID NO: 562712 - DNA, 20 bp, Artificial
  CRISPR gRNA sequence
ttttagtttttgtagaaaca

SEQ ID NO: 562713 - DNA, 20 bp, Artificial
  CRISPR gRNA sequence
tttagtttttgtagaaacag

SEQ ID NO: 562714 - DNA, 20 bp, Artificial
  CRISPR gRNA sequence
ttagtttttgtagaaacagg

SEQ ID NO: 562715 - DNA, 20 bp, Artificial
  CRISPR gRNA sequence
tagtttttgtagaaacaggg

SEQ ID NO: 562716 - DNA, 20 bp, Artificial
  CRISPR gRNA sequence
agtttttgtagaaacagggt

SEQ ID NO: 562717 - DNA, 20 bp, Artificial
  CRISPR gRNA sequence
gtttttgtagaaacagggtt

SEQ ID NO: 562718 - DNA, 20 bp, Artificial
  CRISPR gRNA sequence
ttgtagaaacagggtttccc

SEQ ID NO: 562719 - DNA, 20 bp, Artificial
  CRISPR gRNA sequence
tgtagaaacagggtttccct

SEQ ID NO: 562720 - DNA, 20 bp, Artificial
  CRISPR gRNA sequence
gtagaaacagggtttcccta

SEQ ID NO: 562721 - DNA, 20 bp, Artificial
  CRISPR gRNA sequence
tagaaacagggtttccctat

SEQ ID NO: 562722 - DNA, 20 bp, Artificial
  CRISPR gRNA sequence
ccctatgttgcccagactgg

SEQ ID NO: 562723 - DNA, 20 bp, Artificial
  CRISPR gRNA sequence
cctatgttgcccagactggt

SEQ ID NO: 562724 - DNA, 20 bp, Artificial
  CRISPR gRNA sequence
tgttgcccagactggtctta

SEQ ID NO: 562725 - DNA, 20 bp, Artificial
  CRISPR gRNA sequence
cccagactggtcttaaactc

SEQ ID NO: 562726 - DNA, 20 bp, Artificial
  CRISPR gRNA sequence
gtcttaaactcctgggctca

SEQ ID NO: 562727 - DNA, 20 bp, Artificial
  CRISPR gRNA sequence
aaactcctgggctcaagtga

SEQ ID NO: 562728 - DNA, 20 bp, Artificial
  CRISPR gRNA sequence
aactcctgggctcaagtgat

SEQ ID NO: 562729 - DNA, 20 bp, Artificial
  CRISPR gRNA sequence
ctgggctcaagtgatcctcc

SEQ ID NO: 562730 - DNA, 20 bp, Artificial
  CRISPR gRNA sequence
ggctcaagtgatcctccctc

SEQ ID NO: 562731 - DNA, 20 bp, Artificial
  CRISPR gRNA sequence
aagtgatcctccctccttgg

SEQ ID NO: 562732 - DNA, 20 bp, Artificial
  CRISPR gRNA sequence
cctccttggcctaccgaagt

SEQ ID NO: 562733 - DNA, 20 bp, Artificial
  CRISPR gRNA sequence
cttggcctaccgaagtgttg

SEQ ID NO: 562734 - DNA, 20 bp, Artificial
  CRISPR gRNA sequence
ggcctaccgaagtgttggga

SEQ ID NO: 562735 - DNA, 20 bp, Artificial
  CRISPR gRNA sequence
gcctaccgaagtgttgggat

SEQ ID NO: 562736 - DNA, 20 bp, Artificial
  CRISPR gRNA sequence
ccgaagtgttgggattacag

SEQ ID NO: 562737 - DNA, 20 bp, Artificial
  CRISPR gRNA sequence
ggattacaggcatgaaccac

SEQ ID NO: 562738 - DNA, 20 bp, Artificial
  CRISPR gRNA sequence
caggcatgaaccaccacatc

SEQ ID NO: 562739 - DNA, 20 bp, Artificial
  CRISPR gRNA sequence
aaatattttcaaatggtaat

SEQ ID NO: 562740 - DNA, 20 bp, Artificial
  CRISPR gRNA sequence
tcaaatggtaattttcttcc

SEQ ID NO: 562741 - DNA, 20 bp, Artificial
  CRISPR gRNA sequence
caaatggtaattttcttccc

SEQ ID NO: 562742 - DNA, 20 bp, Artificial
  CRISPR gRNA sequence
aaatggtaattttcttcccc

SEQ ID NO: 562743 - DNA, 20 bp, Artificial
  CRISPR gRNA sequence
tcttcccccacccttgtccc

SEQ ID NO: 562744 - DNA, 20 bp, Artificial
  CRISPR gRNA sequence
cttcccccacccttgtccct

SEQ ID NO: 562745 - DNA, 20 bp, Artificial
  CRISPR gRNA sequence
ttcccccacccttgtccctt

SEQ ID NO: 562746 - DNA, 20 bp, Artificial
  CRISPR gRNA sequence
cccccacccttgtccctttc

SEQ ID NO: 562747 - DNA, 20 bp, Artificial
  CRISPR gRNA sequence
ccccacccttgtccctttct

SEQ ID NO: 562748 - DNA, 20 bp, Artificial
  CRISPR gRNA sequence
gtccctttcttctccctccc

SEQ ID NO: 562749 - DNA, 20 bp, Artificial
  CRISPR gRNA sequence
tccctttcttctccctccct

SEQ ID NO: 562750 - DNA, 20 bp, Artificial
  CRISPR gRNA sequence
tcttctccctccctcccttc

SEQ ID NO: 562751 - DNA, 20 bp, Artificial
  CRISPR gRNA sequence
cttctccctccctcccttcc

SEQ ID NO: 562752 - DNA, 20 bp, Artificial
  CRISPR gRNA sequence
ttctccctccctcccttcct

SEQ ID NO: 562753 - DNA, 20 bp, Artificial
  CRISPR gRNA sequence
ctccctccctcccttccttc

SEQ ID NO: 562754 - DNA, 20 bp, Artificial
  CRISPR gRNA sequence
tccctccctcccttccttcc

SEQ ID NO: 562755 - DNA, 20 bp, Artificial
  CRISPR gRNA sequence
cctccctcccttccttccat

SEQ ID NO: 562756 - DNA, 20 bp, Artificial
  CRISPR gRNA sequence
cctcccttccttccatcctt

SEQ ID NO: 562757 - DNA, 20 bp, Artificial
  CRISPR gRNA sequence
ccttccttccatccttcctc

SEQ ID NO: 562758 - DNA, 20 bp, Artificial
  CRISPR gRNA sequence
ccttccatccttcctctctc

SEQ ID NO: 562759 - DNA, 20 bp, Artificial
  CRISPR gRNA sequence
cttccatccttcctctctcc

SEQ ID NO: 562760 - DNA, 20 bp, Artificial
  CRISPR gRNA sequence
ccatccttcctctctcccct

SEQ ID NO: 562761 - DNA, 20 bp, Artificial
  CRISPR gRNA sequence
catccttcctctctcccctc

SEQ ID NO: 562762 - DNA, 20 bp, Artificial
  CRISPR gRNA sequence
cctctctcccctcccctccc

SEQ ID NO: 562763 - DNA, 20 bp, Artificial
  CRISPR gRNA sequence
ctctctcccctcccctccct

SEQ ID NO: 562764 - DNA, 20 bp, Artificial
  CRISPR gRNA sequence
tctcccctcccctccctccc

SEQ ID NO: 562765 - DNA, 20 bp, Artificial
  CRISPR gRNA sequence
tcccctcccctccctccctc

SEQ ID NO: 562766 - DNA, 20 bp, Artificial
  CRISPR gRNA sequence
ccctcccctccctccctccc

SEQ ID NO: 562767 - DNA, 20 bp, Artificial
  CRISPR gRNA sequence
ccctccctccctcccctccc

SEQ ID NO: 562768 - DNA, 20 bp, Artificial
  CRISPR gRNA sequence
cctccctcccctcccctccc

SEQ ID NO: 562769 - DNA, 20 bp, Artificial
  CRISPR gRNA sequence
cctcccctcccctccctttc

SEQ ID NO: 562770 - DNA, 20 bp, Artificial
  CRISPR gRNA sequence
ccctcccctccctttccctc

SEQ ID NO: 562771 - DNA, 20 bp, Artificial
  CRISPR gRNA sequence
ccctccctttccctcccctc

SEQ ID NO: 562772 - DNA, 20 bp, Artificial
  CRISPR gRNA sequence
cctttccctcccctccccct

SEQ ID NO: 562773 - DNA, 20 bp, Artificial
  CRISPR gRNA sequence
tccctcccctccccctccct

SEQ ID NO: 562774 - DNA, 20 bp, Artificial
  CRISPR gRNA sequence
ccctcccctccccctccctt

SEQ ID NO: 562775 - DNA, 20 bp, Artificial
  CRISPR gRNA sequence
cctcccctccccctcccttc

SEQ ID NO: 562776 - DNA, 20 bp, Artificial
  CRISPR gRNA sequence
ccctccccctcccttcctgt

SEQ ID NO: 562777 - DNA, 20 bp, Artificial
  CRISPR gRNA sequence
cccctcccttcctgtccctt

SEQ ID NO: 562778 - DNA, 20 bp, Artificial
  CRISPR gRNA sequence
ccttcctgtcccttcccttc

SEQ ID NO: 562779 - DNA, 20 bp, Artificial
  CRISPR gRNA sequence
cctgtcccttcccttccctt

SEQ ID NO: 562780 - DNA, 20 bp, Artificial
  CRISPR gRNA sequence
ctgtcccttcccttcccttc

SEQ ID NO: 562781 - DNA, 20 bp, Artificial
  CRISPR gRNA sequence
tcccttcccttcccttccct

SEQ ID NO: 562782 - DNA, 20 bp, Artificial
  CRISPR gRNA sequence
cccttcccttcccttccctt

SEQ ID NO: 562783 - DNA, 20 bp, Artificial
  CRISPR gRNA sequence
ccttcccttcccttcccttc

SEQ ID NO: 562784 - DNA, 20 bp, Artificial
  CRISPR gRNA sequence
cccttcccttcccttccctt

SEQ ID NO: 562785 - DNA, 20 bp, Artificial
  CRISPR gRNA sequence
ccttcccttcccttcccttc

SEQ ID NO: 562786 - DNA, 20 bp, Artificial
  CRISPR gRNA sequence
cccttcccttcccttctttc

SEQ ID NO: 562787 - DNA, 20 bp, Artificial
  CRISPR gRNA sequence
ccttcccttcccttctttcc

SEQ ID NO: 562788 - DNA, 20 bp, Artificial
  CRISPR gRNA sequence
cccttcccttctttccttct

SEQ ID NO: 562789 - DNA, 20 bp, Artificial
  CRISPR gRNA sequence
ccttcccttctttccttctt

SEQ ID NO: 562790 - DNA, 20 bp, Artificial
  CRISPR gRNA sequence
cccttctttccttctttgtt

SEQ ID NO: 562791 - DNA, 20 bp, Artificial
  CRISPR gRNA sequence
ccttctttccttctttgttt

SEQ ID NO: 562792 - DNA, 20 bp, Artificial
  CRISPR gRNA sequence
ctttccttctttgtttcatt

SEQ ID NO: 562793 - DNA, 20 bp, Artificial
  CRISPR gRNA sequence
tttccttctttgtttcattg

SEQ ID NO: 562794 - DNA, 20 bp, Artificial
  CRISPR gRNA sequence
tccttctttgtttcattgcc

SEQ ID NO: 562795 - DNA, 20 bp, Artificial
  CRISPR gRNA sequence
ccttctttgtttcattgcct

SEQ ID NO: 562796 - DNA, 20 bp, Artificial
  CRISPR gRNA sequence
cttctttgtttcattgcctt

SEQ ID NO: 562797 - DNA, 20 bp, Artificial
  CRISPR gRNA sequence
ctttgtttcattgccttttc

SEQ ID NO: 562798 - DNA, 20 bp, Artificial
  CRISPR gRNA sequence
tttgtttcattgccttttct

SEQ ID NO: 562799 - DNA, 20 bp, Artificial
  CRISPR gRNA sequence
tgtttcattgccttttctct

SEQ ID NO: 562800 - DNA, 20 bp, Artificial
  CRISPR gRNA sequence
gtttcattgccttttctctt

SEQ ID NO: 562801 - DNA, 20 bp, Artificial
  CRISPR gRNA sequence
tttcattgccttttctcttt

SEQ ID NO: 562802 - DNA, 20 bp, Artificial
  CRISPR gRNA sequence
cattgccttttctcttttct

SEQ ID NO: 562803 - DNA, 20 bp, Artificial
  CRISPR gRNA sequence
attgccttttctcttttctt

SEQ ID NO: 562804 - DNA, 20 bp, Artificial
  CRISPR gRNA sequence
ccttttctcttttcttttga

SEQ ID NO: 562805 - DNA, 20 bp, Artificial
  CRISPR gRNA sequence
ttctcttttcttttgagaca

SEQ ID NO: 562806 - DNA, 20 bp, Artificial
  CRISPR gRNA sequence
tctcttttcttttgagacac

SEQ ID NO: 562807 - DNA, 20 bp, Artificial
  CRISPR gRNA sequence
ctcttttcttttgagacaca

SEQ ID NO: 562808 - DNA, 20 bp, Artificial
  CRISPR gRNA sequence
tcttttcttttgagacacag

SEQ ID NO: 562809 - DNA, 20 bp, Artificial
  CRISPR gRNA sequence
ttttcttttgagacacagtc

SEQ ID NO: 562810 - DNA, 20 bp, Artificial
  CRISPR gRNA sequence
ttcttttgagacacagtctc

SEQ ID NO: 562811 - DNA, 20 bp, Artificial
  CRISPR gRNA sequence
tcttttgagacacagtctca

SEQ ID NO: 562812 - DNA, 20 bp, Artificial
  CRISPR gRNA sequence
cttttgagacacagtctcac

SEQ ID NO: 562813 - DNA, 20 bp, Artificial
  CRISPR gRNA sequence
ttttgagacacagtctcact

SEQ ID NO: 562814 - DNA, 20 bp, Artificial
  CRISPR gRNA sequence
ttgagacacagtctcactct

SEQ ID NO: 562815 - DNA, 20 bp, Artificial
  CRISPR gRNA sequence
tgagacacagtctcactctg

SEQ ID NO: 562816 - DNA, 20 bp, Artificial
  CRISPR gRNA sequence
gagacacagtctcactctgt

SEQ ID NO: 562817 - DNA, 20 bp, Artificial
  CRISPR gRNA sequence
agacacagtctcactctgtt

SEQ ID NO: 562818 - DNA, 20 bp, Artificial
  CRISPR gRNA sequence
actctgttgcccaggctaga

SEQ ID NO: 562819 - DNA, 20 bp, Artificial
  CRISPR gRNA sequence
tgttgcccaggctagagtat

SEQ ID NO: 562820 - DNA, 20 bp, Artificial
  CRISPR gRNA sequence
ttgcccaggctagagtatag

SEQ ID NO: 562821 - DNA, 20 bp, Artificial
  CRISPR gRNA sequence
cccaggctagagtatagtga

SEQ ID NO: 562822 - DNA, 20 bp, Artificial
  CRISPR gRNA sequence
gagtatagtgacacaattat

SEQ ID NO: 562823 - DNA, 20 bp, Artificial
  CRISPR gRNA sequence
tggctcactgcagccttgat

SEQ ID NO: 562824 - DNA, 20 bp, Artificial
  CRISPR gRNA sequence
actgcagccttgatctccca

SEQ ID NO: 562825 - DNA, 20 bp, Artificial
  CRISPR gRNA sequence
cagccttgatctcccagact

SEQ ID NO: 562826 - DNA, 20 bp, Artificial
  CRISPR gRNA sequence
gatctcccagactcaagcga

SEQ ID NO: 562827 - DNA, 20 bp, Artificial
  CRISPR gRNA sequence
atctcccagactcaagcgat

SEQ ID NO: 562828 - DNA, 20 bp, Artificial
  CRISPR gRNA sequence
ccagactcaagcgatcctcc

SEQ ID NO: 562829 - DNA, 20 bp, Artificial
  CRISPR gRNA sequence
aagcgatcctcccacctcag

SEQ ID NO: 562830 - DNA, 20 bp, Artificial
  CRISPR gRNA sequence
ccacctcagtttccaaatag

SEQ ID NO: 562831 - DNA, 20 bp, Artificial
  CRISPR gRNA sequence
agtttccaaatagctgggac

SEQ ID NO: 562832 - DNA, 20 bp, Artificial
  CRISPR gRNA sequence
ccaaatagctgggactacag

SEQ ID NO: 562833 - DNA, 20 bp, Artificial
  CRISPR gRNA sequence
caaatagctgggactacagg

SEQ ID NO: 562834 - DNA, 20 bp, Artificial
  CRISPR gRNA sequence
ggactacagggacatgcctt

SEQ ID NO: 562835 - DNA, 20 bp, Artificial
  CRISPR gRNA sequence
cagggacatgccttcacgtc

SEQ ID NO: 562836 - DNA, 20 bp, Artificial
  CRISPR gRNA sequence
cacgtccacctaattttttt

SEQ ID NO: 562837 - DNA, 20 bp, Artificial
  CRISPR gRNA sequence
acgtccacctaatttttttg

SEQ ID NO: 562838 - DNA, 20 bp, Artificial
  CRISPR gRNA sequence
atttttttgtattttttata

SEQ ID NO: 562839 - DNA, 20 bp, Artificial
  CRISPR gRNA sequence
ttttgtattttttatagaga

SEQ ID NO: 562840 - DNA, 20 bp, Artificial
  CRISPR gRNA sequence
tttgtattttttatagagac

SEQ ID NO: 562841 - DNA, 20 bp, Artificial
  CRISPR gRNA sequence
ttgtattttttatagagacg

SEQ ID NO: 562842 - DNA, 20 bp, Artificial
  CRISPR gRNA sequence
tgtattttttatagagacgg

SEQ ID NO: 562843 - DNA, 20 bp, Artificial
  CRISPR gRNA sequence
gtattttttatagagacggg

SEQ ID NO: 562844 - DNA, 20 bp, Artificial
  CRISPR gRNA sequence
tattttttatagagacgggg

SEQ ID NO: 562845 - DNA, 20 bp, Artificial
  CRISPR gRNA sequence
tttatagagacggggttttg

SEQ ID NO: 562846 - DNA, 20 bp, Artificial
  CRISPR gRNA sequence
ttatagagacggggttttgc

SEQ ID NO: 562847 - DNA, 20 bp, Artificial
  CRISPR gRNA sequence
tatagagacggggttttgcc

SEQ ID NO: 562848 - DNA, 20 bp, Artificial
  CRISPR gRNA sequence
atagagacggggttttgcca

SEQ ID NO: 562849 - DNA, 20 bp, Artificial
  CRISPR gRNA sequence
tagagacggggttttgccat

SEQ ID NO: 562850 - DNA, 20 bp, Artificial
  CRISPR gRNA sequence
tgccatgttgcccaggctgg

SEQ ID NO: 562851 - DNA, 20 bp, Artificial
  CRISPR gRNA sequence
gccatgttgcccaggctggt

SEQ ID NO: 562852 - DNA, 20 bp, Artificial
  CRISPR gRNA sequence
ccatgttgcccaggctggtc

SEQ ID NO: 562853 - DNA, 20 bp, Artificial
  CRISPR gRNA sequence
cccaggctggtcttgaactc

SEQ ID NO: 562854 - DNA, 20 bp, Artificial
  CRISPR gRNA sequence
gtcttgaactcctgggctca

SEQ ID NO: 562855 - DNA, 20 bp, Artificial
  CRISPR gRNA sequence
gaactcctgggctcaagcaa

SEQ ID NO: 562856 - DNA, 20 bp, Artificial
  CRISPR gRNA sequence
aactcctgggctcaagcaat

SEQ ID NO: 562857 - DNA, 20 bp, Artificial
  CRISPR gRNA sequence
ctgggctcaagcaatcctcc

SEQ ID NO: 562858 - DNA, 20 bp, Artificial
  CRISPR gRNA sequence
ggctcaagcaatcctcccaa

SEQ ID NO: 562859 - DNA, 20 bp, Artificial
  CRISPR gRNA sequence
aagcaatcctcccaagtcag

SEQ ID NO: 562860 - DNA, 20 bp, Artificial
  CRISPR gRNA sequence
ccaagtcagtttcccaaagt

SEQ ID NO: 562861 - DNA, 20 bp, Artificial
  CRISPR gRNA sequence
cccaaagtgtcgggattata

SEQ ID NO: 562862 - DNA, 20 bp, Artificial
  CRISPR gRNA sequence
ccaaagtgtcgggattatag

SEQ ID NO: 562863 - DNA, 20 bp, Artificial
  CRISPR gRNA sequence
taggcatgagccacccagca

SEQ ID NO: 562864 - DNA, 20 bp, Artificial
  CRISPR gRNA sequence
tctcttctgtttctctctat

SEQ ID NO: 562865 - DNA, 20 bp, Artificial
  CRISPR gRNA sequence
ctcttctgtttctctctata

SEQ ID NO: 562866 - DNA, 20 bp, Artificial
  CRISPR gRNA sequence
tcttctgtttctctctatat

SEQ ID NO: 562867 - DNA, 20 bp, Artificial
  CRISPR gRNA sequence
ttctgtttctctctatatat

SEQ ID NO: 562868 - DNA, 20 bp, Artificial
  CRISPR gRNA sequence
ctgtttctctctatatatat

SEQ ID NO: 562869 - DNA, 20 bp, Artificial
  CRISPR gRNA sequence
tgtttctctctatatatata

SEQ ID NO: 562870 - DNA, 20 bp, Artificial
  CRISPR gRNA sequence
tttctctctatatatatatt

SEQ ID NO: 562871 - DNA, 20 bp, Artificial
  CRISPR gRNA sequence
ctctctatatatatatttat

SEQ ID NO: 562872 - DNA, 20 bp, Artificial
  CRISPR gRNA sequence
tctctatatatatatttatt

SEQ ID NO: 562873 - DNA, 20 bp, Artificial
  CRISPR gRNA sequence
tctatatatatatttattag

SEQ ID NO: 562874 - DNA, 20 bp, Artificial
  CRISPR gRNA sequence
tatatatatatttattagtt

SEQ ID NO: 562875 - DNA, 20 bp, Artificial
  CRISPR gRNA sequence
tatatatatttattagttta

SEQ ID NO: 562876 - DNA, 20 bp, Artificial
  CRISPR gRNA sequence
attagtttacattgttcagt

SEQ ID NO: 562877 - DNA, 20 bp, Artificial
  CRISPR gRNA sequence
ttagtttacattgttcagta

SEQ ID NO: 562878 - DNA, 20 bp, Artificial
  CRISPR gRNA sequence
gtttacattgttcagtaatg

SEQ ID NO: 562879 - DNA, 20 bp, Artificial
  CRISPR gRNA sequence
acattgttcagtaatggata

SEQ ID NO: 562880 - DNA, 20 bp, Artificial
  CRISPR gRNA sequence
cattgttcagtaatggatag

SEQ ID NO: 562881 - DNA, 20 bp, Artificial
  CRISPR gRNA sequence
ttcagtaatggatagctttt

SEQ ID NO: 562882 - DNA, 20 bp, Artificial
  CRISPR gRNA sequence
agtaatggatagcttttgca

SEQ ID NO: 562883 - DNA, 20 bp, Artificial
  CRISPR gRNA sequence
ttgcacacacatcctccctt

SEQ ID NO: 562884 - DNA, 20 bp, Artificial
  CRISPR gRNA sequence
tgcacacacatcctcccttt

SEQ ID NO: 562885 - DNA, 20 bp, Artificial
  CRISPR gRNA sequence
gcacacacatcctccctttt

SEQ ID NO: 562886 - DNA, 20 bp, Artificial
  CRISPR gRNA sequence
cacacacatcctcccttttt

SEQ ID NO: 562887 - DNA, 20 bp, Artificial
  CRISPR gRNA sequence
cctttttttcttttatttta

SEQ ID NO: 562888 - DNA, 20 bp, Artificial
  CRISPR gRNA sequence
tttttcttttattttagaag

SEQ ID NO: 562889 - DNA, 20 bp, Artificial
  CRISPR gRNA sequence
ttttcttttattttagaagg

SEQ ID NO: 562890 - DNA, 20 bp, Artificial
  CRISPR gRNA sequence
tttcttttattttagaaggt

SEQ ID NO: 562891 - DNA, 20 bp, Artificial
  CRISPR gRNA sequence
ttcttttattttagaaggtt

SEQ ID NO: 562892 - DNA, 20 bp, Artificial
  CRISPR gRNA sequence
tcttttattttagaaggtta

SEQ ID NO: 562893 - DNA, 20 bp, Artificial
  CRISPR gRNA sequence
cttttattttagaaggttat

SEQ ID NO: 562894 - DNA, 20 bp, Artificial
  CRISPR gRNA sequence
ttttattttagaaggttatg

SEQ ID NO: 562895 - DNA, 20 bp, Artificial
  CRISPR gRNA sequence
ttattttagaaggttatgtg

SEQ ID NO: 562896 - DNA, 20 bp, Artificial
  CRISPR gRNA sequence
tattttagaaggttatgtgg

SEQ ID NO: 562897 - DNA, 20 bp, Artificial
  CRISPR gRNA sequence
attttagaaggttatgtgga

SEQ ID NO: 562898 - DNA, 20 bp, Artificial
  CRISPR gRNA sequence
ttttagaaggttatgtggac

SEQ ID NO: 562899 - DNA, 20 bp, Artificial
  CRISPR gRNA sequence
tagaaggttatgtggactca

SEQ ID NO: 562900 - DNA, 20 bp, Artificial
  CRISPR gRNA sequence
agaaggttatgtggactcat

SEQ ID NO: 562901 - DNA, 20 bp, Artificial
  CRISPR gRNA sequence
gaaggttatgtggactcatg

SEQ ID NO: 562902 - DNA, 20 bp, Artificial
  CRISPR gRNA sequence
tgtggactcatggattcttt

SEQ ID NO: 562903 - DNA, 20 bp, Artificial
  CRISPR gRNA sequence
atggattcttttttaaatat

SEQ ID NO: 562904 - DNA, 20 bp, Artificial
  CRISPR gRNA sequence
ttttttaaatatggcattcc

SEQ ID NO: 562905 - DNA, 20 bp, Artificial
  CRISPR gRNA sequence
ttttaaatatggcattcctg

SEQ ID NO: 562906 - DNA, 20 bp, Artificial
  CRISPR gRNA sequence
tttaaatatggcattcctgt

SEQ ID NO: 562907 - DNA, 20 bp, Artificial
  CRISPR gRNA sequence
ttaaatatggcattcctgtc

SEQ ID NO: 562908 - DNA, 20 bp, Artificial
  CRISPR gRNA sequence
taaatatggcattcctgtca

SEQ ID NO: 562909 - DNA, 20 bp, Artificial
  CRISPR gRNA sequence
aaatatggcattcctgtcat

SEQ ID NO: 562910 - DNA, 20 bp, Artificial
  CRISPR gRNA sequence
aatatggcattcctgtcatc

SEQ ID NO: 562911 - DNA, 20 bp, Artificial
  CRISPR gRNA sequence
ctgtcatccattttgatgct

SEQ ID NO: 562912 - DNA, 20 bp, Artificial
  CRISPR gRNA sequence
tcatccattttgatgctcgg

SEQ ID NO: 562913 - DNA, 20 bp, Artificial
  CRISPR gRNA sequence
tgatgctcggcaaccccaca

SEQ ID NO: 562914 - DNA, 20 bp, Artificial
  CRISPR gRNA sequence
gatgctcggcaaccccacat

SEQ ID NO: 562915 - DNA, 20 bp, Artificial
  CRISPR gRNA sequence
atgctcggcaaccccacatt

SEQ ID NO: 562916 - DNA, 20 bp, Artificial
  CRISPR gRNA sequence
ggcaaccccacatttgacaa

SEQ ID NO: 562917 - DNA, 20 bp, Artificial
  CRISPR gRNA sequence
gacaagtgggaacaccttca

SEQ ID NO: 562918 - DNA, 20 bp, Artificial
  CRISPR gRNA sequence
acaagtgggaacaccttcaa

SEQ ID NO: 562919 - DNA, 20 bp, Artificial
  CRISPR gRNA sequence
caagcttcagagtccttttg

SEQ ID NO: 562920 - DNA, 20 bp, Artificial
  CRISPR gRNA sequence
aagcttcagagtccttttgc

SEQ ID NO: 562921 - DNA, 20 bp, Artificial
  CRISPR gRNA sequence
cagagtccttttgctctgtt

SEQ ID NO: 562922 - DNA, 20 bp, Artificial
  CRISPR gRNA sequence
agagtccttttgctctgttt

SEQ ID NO: 562923 - DNA, 20 bp, Artificial
  CRISPR gRNA sequence
ttgctctgtttgttcctgtt

SEQ ID NO: 562924 - DNA, 20 bp, Artificial
  CRISPR gRNA sequence
tgctctgtttgttcctgttt

SEQ ID NO: 562925 - DNA, 20 bp, Artificial
  CRISPR gRNA sequence
gctctgtttgttcctgtttg

SEQ ID NO: 562926 - DNA, 20 bp, Artificial
  CRISPR gRNA sequence
ctctgtttgttcctgtttga

SEQ ID NO: 562927 - DNA, 20 bp, Artificial
  CRISPR gRNA sequence
tgtttgttcctgtttgattt

SEQ ID NO: 562928 - DNA, 20 bp, Artificial
  CRISPR gRNA sequence
tttgttcctgtttgatttta

SEQ ID NO: 562929 - DNA, 20 bp, Artificial
  CRISPR gRNA sequence
gttcctgtttgattttaaac

SEQ ID NO: 562930 - DNA, 20 bp, Artificial
  CRISPR gRNA sequence
ttcctgtttgattttaaaca

SEQ ID NO: 562931 - DNA, 20 bp, Artificial
  CRISPR gRNA sequence
ctgtttgattttaaacactt

SEQ ID NO: 562932 - DNA, 20 bp, Artificial
  CRISPR gRNA sequence
tttgattttaaacacttcct

SEQ ID NO: 562933 - DNA, 20 bp, Artificial
  CRISPR gRNA sequence
gattttaaacacttccttac

SEQ ID NO: 562934 - DNA, 20 bp, Artificial
  CRISPR gRNA sequence
attttaaacacttccttact

SEQ ID NO: 562935 - DNA, 20 bp, Artificial
  CRISPR gRNA sequence
taaacacttccttactttct

SEQ ID NO: 562936 - DNA, 20 bp, Artificial
  CRISPR gRNA sequence
aaacacttccttactttctg

SEQ ID NO: 562937 - DNA, 20 bp, Artificial
  CRISPR gRNA sequence
aacacttccttactttctgg

SEQ ID NO: 562938 - DNA, 20 bp, Artificial
  CRISPR gRNA sequence
ccttactttctggcacagaa

SEQ ID NO: 562939 - DNA, 20 bp, Artificial
  CRISPR gRNA sequence
cttactttctggcacagaaa

SEQ ID NO: 562940 - DNA, 20 bp, Artificial
  CRISPR gRNA sequence
actttctggcacagaaagat

SEQ ID NO: 562941 - DNA, 20 bp, Artificial
  CRISPR gRNA sequence
ctttctggcacagaaagatg

SEQ ID NO: 562942 - DNA, 20 bp, Artificial
  CRISPR gRNA sequence
tctggcacagaaagatgttc

SEQ ID NO: 562943 - DNA, 20 bp, Artificial
  CRISPR gRNA sequence
ctggcacagaaagatgttct

SEQ ID NO: 562944 - DNA, 20 bp, Artificial
  CRISPR gRNA sequence
tggcacagaaagatgttctg

SEQ ID NO: 562945 - DNA, 20 bp, Artificial
  CRISPR gRNA sequence
gcacagaaagatgttctgga

SEQ ID NO: 562946 - DNA, 20 bp, Artificial
  CRISPR gRNA sequence
tggactcatcttgtagtgtt

SEQ ID NO: 562947 - DNA, 20 bp, Artificial
  CRISPR gRNA sequence
gactcatcttgtagtgttcc

SEQ ID NO: 562948 - DNA, 20 bp, Artificial
  CRISPR gRNA sequence
atcttgtagtgttcctgcct

SEQ ID NO: 562949 - DNA, 20 bp, Artificial
  CRISPR gRNA sequence
gtagtgttcctgcctcagcc

SEQ ID NO: 562950 - DNA, 20 bp, Artificial
  CRISPR gRNA sequence
tagtgttcctgcctcagcct

SEQ ID NO: 562951 - DNA, 20 bp, Artificial
  CRISPR gRNA sequence
ctgcctcagccttcgaatca

SEQ ID NO: 562952 - DNA, 20 bp, Artificial
  CRISPR gRNA sequence
cctcagccttcgaatcatta

SEQ ID NO: 562953 - DNA, 20 bp, Artificial
  CRISPR gRNA sequence
agccttcgaatcattaggtt

SEQ ID NO: 562954 - DNA, 20 bp, Artificial
  CRISPR gRNA sequence
cgaatcattaggttccctgg

SEQ ID NO: 562955 - DNA, 20 bp, Artificial
  CRISPR gRNA sequence
gaatcattaggttccctggt

SEQ ID NO: 562956 - DNA, 20 bp, Artificial
  CRISPR gRNA sequence
ggttccctggtttcttttag

SEQ ID NO: 562957 - DNA, 20 bp, Artificial
  CRISPR gRNA sequence
cctggtttcttttagtgaga

SEQ ID NO: 562958 - DNA, 20 bp, Artificial
  CRISPR gRNA sequence
gtttcttttagtgagagatg

SEQ ID NO: 562959 - DNA, 20 bp, Artificial
  CRISPR gRNA sequence
cttttagtgagagatggtat

SEQ ID NO: 562960 - DNA, 20 bp, Artificial
  CRISPR gRNA sequence
ttttagtgagagatggtatt

SEQ ID NO: 562961 - DNA, 20 bp, Artificial
  CRISPR gRNA sequence
ttagtgagagatggtattta

SEQ ID NO: 562962 - DNA, 20 bp, Artificial
  CRISPR gRNA sequence
tagtgagagatggtatttag

SEQ ID NO: 562963 - DNA, 20 bp, Artificial
  CRISPR gRNA sequence
agtgagagatggtatttaga

SEQ ID NO: 562964 - DNA, 20 bp, Artificial
  CRISPR gRNA sequence
gtgagagatggtatttagaa

SEQ ID NO: 562965 - DNA, 20 bp, Artificial
  CRISPR gRNA sequence
agaaatcaagttctgggtgc

SEQ ID NO: 562966 - DNA, 20 bp, Artificial
  CRISPR gRNA sequence
gaaatcaagttctgggtgca

SEQ ID NO: 562967 - DNA, 20 bp, Artificial
  CRISPR gRNA sequence
tgggtgcaaagtgtgcccac

SEQ ID NO: 562968 - DNA, 20 bp, Artificial
  CRISPR gRNA sequence
ggtgcaaagtgtgcccacag

SEQ ID NO: 562969 - DNA, 20 bp, Artificial
  CRISPR gRNA sequence
cttctcagccttgtcagttt

SEQ ID NO: 562970 - DNA, 20 bp, Artificial
  CRISPR gRNA sequence
ctcagccttgtcagttttca

SEQ ID NO: 562971 - DNA, 20 bp, Artificial
  CRISPR gRNA sequence
tcagccttgtcagttttcaa

SEQ ID NO: 562972 - DNA, 20 bp, Artificial
  CRISPR gRNA sequence
agccttgtcagttttcaaag

SEQ ID NO: 562973 - DNA, 20 bp, Artificial
  CRISPR gRNA sequence
gtcagttttcaaagttaaga

SEQ ID NO: 562974 - DNA, 20 bp, Artificial
  CRISPR gRNA sequence
tcagttttcaaagttaagaa

SEQ ID NO: 562975 - DNA, 20 bp, Artificial
  CRISPR gRNA sequence
tcaaagttaagaaatagagt

SEQ ID NO: 562976 - DNA, 20 bp, Artificial
  CRISPR gRNA sequence
caaagttaagaaatagagtt

SEQ ID NO: 562977 - DNA, 20 bp, Artificial
  CRISPR gRNA sequence
aaagttaagaaatagagttt

SEQ ID NO: 562978 - DNA, 20 bp, Artificial
  CRISPR gRNA sequence
agaaatagagtttttacaaa

SEQ ID NO: 562979 - DNA, 20 bp, Artificial
  CRISPR gRNA sequence
ttacaaagtcaggagttcac

SEQ ID NO: 562980 - DNA, 20 bp, Artificial
  CRISPR gRNA sequence
tacaaagtcaggagttcacc

SEQ ID NO: 562981 - DNA, 20 bp, Artificial
  CRISPR gRNA sequence
acaaagtcaggagttcaccc

SEQ ID NO: 562982 - DNA, 20 bp, Artificial
  CRISPR gRNA sequence
caaagtcaggagttcaccct

SEQ ID NO: 562983 - DNA, 20 bp, Artificial
  CRISPR gRNA sequence
accctgatacttctaacact

SEQ ID NO: 562984 - DNA, 20 bp, Artificial
  CRISPR gRNA sequence
atacttctaacactaataat

SEQ ID NO: 562985 - DNA, 20 bp, Artificial
  CRISPR gRNA sequence
ctaacactaataatcttgct

SEQ ID NO: 562986 - DNA, 20 bp, Artificial
  CRISPR gRNA sequence
taacactaataatcttgctg

SEQ ID NO: 562987 - DNA, 20 bp, Artificial
  CRISPR gRNA sequence
acactaataatcttgctgct

SEQ ID NO: 562988 - DNA, 20 bp, Artificial
  CRISPR gRNA sequence
ataatcttgctgcttagttc

SEQ ID NO: 562989 - DNA, 20 bp, Artificial
  CRISPR gRNA sequence
gctgcttagttcttctgcct

SEQ ID NO: 562990 - DNA, 20 bp, Artificial
  CRISPR gRNA sequence
ctgcttagttcttctgcctc

SEQ ID NO: 562991 - DNA, 20 bp, Artificial
  CRISPR gRNA sequence
cttagttcttctgcctcttc

SEQ ID NO: 562992 - DNA, 20 bp, Artificial
  CRISPR gRNA sequence
agttcttctgcctcttctgc

SEQ ID NO: 562993 - DNA, 20 bp, Artificial
  CRISPR gRNA sequence
gttcttctgcctcttctgct

SEQ ID NO: 562994 - DNA, 20 bp, Artificial
  CRISPR gRNA sequence
ttctgcctcttctgctcttc

SEQ ID NO: 562995 - DNA, 20 bp, Artificial
  CRISPR gRNA sequence
ctgcctcttctgctcttcca

SEQ ID NO: 562996 - DNA, 20 bp, Artificial
  CRISPR gRNA sequence
tgcctcttctgctcttccat

SEQ ID NO: 562997 - DNA, 20 bp, Artificial
  CRISPR gRNA sequence
cctcttctgctcttccatat

SEQ ID NO: 562998 - DNA, 20 bp, Artificial
  CRISPR gRNA sequence
ttctgctcttccatatttgc

SEQ ID NO: 562999 - DNA, 20 bp, Artificial
  CRISPR gRNA sequence
ctgctcttccatatttgcat

SEQ ID NO: 563000 - DNA, 20 bp, Artificial
  CRISPR gRNA sequence
tgctcttccatatttgcatc

SEQ ID NO: 563001 - DNA, 20 bp, Artificial
  CRISPR gRNA sequence
ctcttccatatttgcatctc

SEQ ID NO: 563002 - DNA, 20 bp, Artificial
  CRISPR gRNA sequence
ttccatatttgcatctcctt

SEQ ID NO: 563003 - DNA, 20 bp, Artificial
  CRISPR gRNA sequence
ccatatttgcatctccttac

SEQ ID NO: 563004 - DNA, 20 bp, Artificial
  CRISPR gRNA sequence
catatttgcatctccttact

SEQ ID NO: 563005 - DNA, 20 bp, Artificial
  CRISPR gRNA sequence
gcatctccttactcccacag

SEQ ID NO: 563006 - DNA, 20 bp, Artificial
  CRISPR gRNA sequence
catctccttactcccacagt

SEQ ID NO: 563007 - DNA, 20 bp, Artificial
  CRISPR gRNA sequence
cttactcccacagtgagaac

SEQ ID NO: 563008 - DNA, 20 bp, Artificial
  CRISPR gRNA sequence
actcccacagtgagaactct

SEQ ID NO: 563009 - DNA, 20 bp, Artificial
  CRISPR gRNA sequence
ctcccacagtgagaactctg

SEQ ID NO: 563010 - DNA, 20 bp, Artificial
  CRISPR gRNA sequence
ccacagtgagaactctgttc

SEQ ID NO: 563011 - DNA, 20 bp, Artificial
  CRISPR gRNA sequence
tgttcttagtagcatcagta

SEQ ID NO: 563012 - DNA, 20 bp, Artificial
  CRISPR gRNA sequence
ttcttagtagcatcagtata

SEQ ID NO: 563013 - DNA, 20 bp, Artificial
  CRISPR gRNA sequence
ttagtagcatcagtatattt

SEQ ID NO: 563014 - DNA, 20 bp, Artificial
  CRISPR gRNA sequence
agtagcatcagtatattttc

SEQ ID NO: 563015 - DNA, 20 bp, Artificial
  CRISPR gRNA sequence
gtagcatcagtatattttcc

SEQ ID NO: 563016 - DNA, 20 bp, Artificial
  CRISPR gRNA sequence
tcctaatctacattaaaccc

SEQ ID NO: 563017 - DNA, 20 bp, Artificial
  CRISPR gRNA sequence
cctaatctacattaaacccc

SEQ ID NO: 563018 - DNA, 20 bp, Artificial
  CRISPR gRNA sequence
ctaatctacattaaacccca

SEQ ID NO: 563019 - DNA, 20 bp, Artificial
  CRISPR gRNA sequence
atctacattaaaccccaaat

SEQ ID NO: 563020 - DNA, 20 bp, Artificial
  CRISPR gRNA sequence
cattaaaccccaaatcattt

SEQ ID NO: 563021 - DNA, 20 bp, Artificial
  CRISPR gRNA sequence
aaccccaaatcattttacag

SEQ ID NO: 563022 - DNA, 20 bp, Artificial
  CRISPR gRNA sequence
tacagttgctataccaatct

SEQ ID NO: 563023 - DNA, 20 bp, Artificial
  CRISPR gRNA sequence
acagttgctataccaatcta

SEQ ID NO: 563024 - DNA, 20 bp, Artificial
  CRISPR gRNA sequence
cagttgctataccaatctac

SEQ ID NO: 563025 - DNA, 20 bp, Artificial
  CRISPR gRNA sequence
ctataccaatctactaccaa

SEQ ID NO: 563026 - DNA, 20 bp, Artificial
  CRISPR gRNA sequence
taccaatctactaccaacta

SEQ ID NO: 563027 - DNA, 20 bp, Artificial
  CRISPR gRNA sequence
ctaccaactacaaacttact

SEQ ID NO: 563028 - DNA, 20 bp, Artificial
  CRISPR gRNA sequence
ccaactacaaacttactaaa

SEQ ID NO: 563029 - DNA, 20 bp, Artificial
  CRISPR gRNA sequence
caaacttactaaatacagtt

SEQ ID NO: 563030 - DNA, 20 bp, Artificial
  CRISPR gRNA sequence
actaaatacagttaaagatt

SEQ ID NO: 563031 - DNA, 20 bp, Artificial
  CRISPR gRNA sequence
ctaaatacagttaaagattt

SEQ ID NO: 563032 - DNA, 20 bp, Artificial
  CRISPR gRNA sequence
aatacagttaaagatttctt

SEQ ID NO: 563033 - DNA, 20 bp, Artificial
  CRISPR gRNA sequence
aagatttctttacagttcct

SEQ ID NO: 563034 - DNA, 20 bp, Artificial
  CRISPR gRNA sequence
ctttacagttccttttattt

SEQ ID NO: 563035 - DNA, 20 bp, Artificial
  CRISPR gRNA sequence
tttacagttccttttatttt

SEQ ID NO: 563036 - DNA, 20 bp, Artificial
  CRISPR gRNA sequence
tacagttccttttatttttc

SEQ ID NO: 563037 - DNA, 20 bp, Artificial
  CRISPR gRNA sequence
acagttccttttatttttca

SEQ ID NO: 563038 - DNA, 20 bp, Artificial
  CRISPR gRNA sequence
cagttccttttatttttcat

SEQ ID NO: 563039 - DNA, 20 bp, Artificial
  CRISPR gRNA sequence
cttttatttttcattacagt

SEQ ID NO: 563040 - DNA, 20 bp, Artificial
  CRISPR gRNA sequence
ttatttttcattacagtctc

SEQ ID NO: 563041 - DNA, 20 bp, Artificial
  CRISPR gRNA sequence
tatttttcattacagtctcc

SEQ ID NO: 563042 - DNA, 20 bp, Artificial
  CRISPR gRNA sequence
atttttcattacagtctcca

SEQ ID NO: 563043 - DNA, 20 bp, Artificial
  CRISPR gRNA sequence
tttttcattacagtctccaa

SEQ ID NO: 563044 - DNA, 20 bp, Artificial
  CRISPR gRNA sequence
ttcattacagtctccaactt

SEQ ID NO: 563045 - DNA, 20 bp, Artificial
  CRISPR gRNA sequence
tcattacagtctccaactta

SEQ ID NO: 563046 - DNA, 20 bp, Artificial
  CRISPR gRNA sequence
cattacagtctccaacttag

SEQ ID NO: 563047 - DNA, 20 bp, Artificial
  CRISPR gRNA sequence
attacagtctccaacttagc

SEQ ID NO: 563048 - DNA, 20 bp, Artificial
  CRISPR gRNA sequence
cagtctccaacttagcaatg

SEQ ID NO: 563049 - DNA, 20 bp, Artificial
  CRISPR gRNA sequence
caacttagcaatggttcgac

SEQ ID NO: 563050 - DNA, 20 bp, Artificial
  CRISPR gRNA sequence
agcaatggttcgacttaaga

SEQ ID NO: 563051 - DNA, 20 bp, Artificial
  CRISPR gRNA sequence
gcaatggttcgacttaagat

SEQ ID NO: 563052 - DNA, 20 bp, Artificial
  CRISPR gRNA sequence
gacttaagatttttcaactc

SEQ ID NO: 563053 - DNA, 20 bp, Artificial
  CRISPR gRNA sequence
aagatttttcaactctacaa

SEQ ID NO: 563054 - DNA, 20 bp, Artificial
  CRISPR gRNA sequence
agatttttcaactctacaat

SEQ ID NO: 563055 - DNA, 20 bp, Artificial
  CRISPR gRNA sequence
ttcaactctacaatgagttt

SEQ ID NO: 563056 - DNA, 20 bp, Artificial
  CRISPR gRNA sequence
tcaactctacaatgagtttt

SEQ ID NO: 563057 - DNA, 20 bp, Artificial
  CRISPR gRNA sequence
caactctacaatgagttttt

SEQ ID NO: 563058 - DNA, 20 bp, Artificial
  CRISPR gRNA sequence
aactctacaatgagtttttc

SEQ ID NO: 563059 - DNA, 20 bp, Artificial
  CRISPR gRNA sequence
tacaatgagtttttcaagat

SEQ ID NO: 563060 - DNA, 20 bp, Artificial
  CRISPR gRNA sequence
caatgagtttttcaagatat

SEQ ID NO: 563061 - DNA, 20 bp, Artificial
  CRISPR gRNA sequence
ttcaagatataactccataa

SEQ ID NO: 563062 - DNA, 20 bp, Artificial
  CRISPR gRNA sequence
tcaagatataactccataat

SEQ ID NO: 563063 - DNA, 20 bp, Artificial
  CRISPR gRNA sequence
caagatataactccataata

SEQ ID NO: 563064 - DNA, 20 bp, Artificial
  CRISPR gRNA sequence
aagatataactccataataa

SEQ ID NO: 563065 - DNA, 20 bp, Artificial
  CRISPR gRNA sequence
cataataagaaatatctgta

SEQ ID NO: 563066 - DNA, 20 bp, Artificial
  CRISPR gRNA sequence
tatatcccagtgaatatgca

SEQ ID NO: 563067 - DNA, 20 bp, Artificial
  CRISPR gRNA sequence
tattcaaaagttacttggat

SEQ ID NO: 563068 - DNA, 20 bp, Artificial
  CRISPR gRNA sequence
aaaagttacttggattctgg

SEQ ID NO: 563069 - DNA, 20 bp, Artificial
  CRISPR gRNA sequence
cttggattctggccgggtgc

SEQ ID NO: 563070 - DNA, 20 bp, Artificial
  CRISPR gRNA sequence
ggattctggccgggtgcagt

SEQ ID NO: 563071 - DNA, 20 bp, Artificial
  CRISPR gRNA sequence
gattctggccgggtgcagtg

SEQ ID NO: 563072 - DNA, 20 bp, Artificial
  CRISPR gRNA sequence
tggccgggtgcagtgactca

SEQ ID NO: 563073 - DNA, 20 bp, Artificial
  CRISPR gRNA sequence
gccgggtgcagtgactcatg

SEQ ID NO: 563074 - DNA, 20 bp, Artificial
  CRISPR gRNA sequence
atgactgtaatcccagcact

SEQ ID NO: 563075 - DNA, 20 bp, Artificial
  CRISPR gRNA sequence
taatcccagcactttgggag

SEQ ID NO: 563076 - DNA, 20 bp, Artificial
  CRISPR gRNA sequence
tgggaggccaaggcgggcgg

SEQ ID NO: 563077 - DNA, 20 bp, Artificial
  CRISPR gRNA sequence
gggaggccaaggcgggcgga

SEQ ID NO: 563078 - DNA, 20 bp, Artificial
  CRISPR gRNA sequence
ggaggccaaggcgggcggat

SEQ ID NO: 563079 - DNA, 20 bp, Artificial
  CRISPR gRNA sequence
agaccatcctggctaacgca

SEQ ID NO: 563080 - DNA, 20 bp, Artificial
  CRISPR gRNA sequence
gctaacgcagtgaaaccctg

SEQ ID NO: 563081 - DNA, 20 bp, Artificial
  CRISPR gRNA sequence
acgcagtgaaaccctgtctc

SEQ ID NO: 563082 - DNA, 20 bp, Artificial
  CRISPR gRNA sequence
tctctactaaaacaaaaaat

SEQ ID NO: 563083 - DNA, 20 bp, Artificial
  CRISPR gRNA sequence
tactaaaacaaaaaattagc

SEQ ID NO: 563084 - DNA, 20 bp, Artificial
  CRISPR gRNA sequence
ctaaaacaaaaaattagctg

SEQ ID NO: 563085 - DNA, 20 bp, Artificial
  CRISPR gRNA sequence
aaacaaaaaattagctgggc

SEQ ID NO: 563086 - DNA, 20 bp, Artificial
  CRISPR gRNA sequence
gctgggcatggtggcacacg

SEQ ID NO: 563087 - DNA, 20 bp, Artificial
  CRISPR gRNA sequence
ggcatggtggcacacgcctg

SEQ ID NO: 563088 - DNA, 20 bp, Artificial
  CRISPR gRNA sequence
taattccagctacctaggag

SEQ ID NO: 563089 - DNA, 20 bp, Artificial
  CRISPR gRNA sequence
cagctacctaggaggctgag

SEQ ID NO: 563090 - DNA, 20 bp, Artificial
  CRISPR gRNA sequence
cctaggaggctgaggcagga

SEQ ID NO: 563091 - DNA, 20 bp, Artificial
  CRISPR gRNA sequence
ggaggctgaggcaggagaat

SEQ ID NO: 563092 - DNA, 20 bp, Artificial
  CRISPR gRNA sequence
aggcaggagaatggcctgaa

SEQ ID NO: 563093 - DNA, 20 bp, Artificial
  CRISPR gRNA sequence
aaccaggaggcagagactgc

SEQ ID NO: 563094 - DNA, 20 bp, Artificial
  CRISPR gRNA sequence
cagtgagccaagattacaac

SEQ ID NO: 563095 - DNA, 20 bp, Artificial
  CRISPR gRNA sequence
caacactgcactccagcctg

SEQ ID NO: 563096 - DNA, 20 bp, Artificial
  CRISPR gRNA sequence
cactccagcctgggtgacgg

SEQ ID NO: 563097 - DNA, 20 bp, Artificial
  CRISPR gRNA sequence
cagcctgggtgacggagtga

SEQ ID NO: 563098 - DNA, 20 bp, Artificial
  CRISPR gRNA sequence
ggtgacggagtgagactctg

SEQ ID NO: 563099 - DNA, 20 bp, Artificial
  CRISPR gRNA sequence
tgtctcaaaaaaaaaaaaca

SEQ ID NO: 563100 - DNA, 20 bp, Artificial
  CRISPR gRNA sequence
tctcaaaaaaaaaaaacaaa

SEQ ID NO: 563101 - DNA, 20 bp, Artificial
  CRISPR gRNA sequence
aaaaaaaaaaaacaaaaaaa

SEQ ID NO: 563102 - DNA, 20 bp, Artificial
  CRISPR gRNA sequence
tttggattcttttttttttt

SEQ ID NO: 563103 - DNA, 20 bp, Artificial
  CRISPR gRNA sequence
ggattcttttttttttttct

SEQ ID NO: 563104 - DNA, 20 bp, Artificial
  CRISPR gRNA sequence
gattcttttttttttttcta

SEQ ID NO: 563105 - DNA, 20 bp, Artificial
  CRISPR gRNA sequence
ttttttttttttctaactac

SEQ ID NO: 563106 - DNA, 20 bp, Artificial
  CRISPR gRNA sequence
ttttttttttctaactaccc

SEQ ID NO: 563107 - DNA, 20 bp, Artificial
  CRISPR gRNA sequence
tttttttttctaactaccct

SEQ ID NO: 563108 - DNA, 20 bp, Artificial
  CRISPR gRNA sequence
ttttttttctaactaccctt

SEQ ID NO: 563109 - DNA, 20 bp, Artificial
  CRISPR gRNA sequence
tttttttctaactacccttc

SEQ ID NO: 563110 - DNA, 20 bp, Artificial
  CRISPR gRNA sequence
ttttttctaactacccttct

SEQ ID NO: 563111 - DNA, 20 bp, Artificial
  CRISPR gRNA sequence
tttttctaactacccttctt

SEQ ID NO: 563112 - DNA, 20 bp, Artificial
  CRISPR gRNA sequence
ttttctaactacccttctta

SEQ ID NO: 563113 - DNA, 20 bp, Artificial
  CRISPR gRNA sequence
tttctaactacccttcttaa

SEQ ID NO: 563114 - DNA, 20 bp, Artificial
  CRISPR gRNA sequence
ttctaactacccttcttaaa

SEQ ID NO: 563115 - DNA, 20 bp, Artificial
  CRISPR gRNA sequence
tctaactacccttcttaaac

SEQ ID NO: 563116 - DNA, 20 bp, Artificial
  CRISPR gRNA sequence
ctaactacccttcttaaaca

SEQ ID NO: 563117 - DNA, 20 bp, Artificial
  CRISPR gRNA sequence
taactacccttcttaaacaa

SEQ ID NO: 563118 - DNA, 20 bp, Artificial
  CRISPR gRNA sequence
actacccttcttaaacaagg

SEQ ID NO: 563119 - DNA, 20 bp, Artificial
  CRISPR gRNA sequence
cccttcttaaacaaggtaac

SEQ ID NO: 563120 - DNA, 20 bp, Artificial
  CRISPR gRNA sequence
cttaaacaaggtaacactct

SEQ ID NO: 563121 - DNA, 20 bp, Artificial
  CRISPR gRNA sequence
ttaaacaaggtaacactcta

SEQ ID NO: 563122 - DNA, 20 bp, Artificial
  CRISPR gRNA sequence
aaacaaggtaacactctatg

SEQ ID NO: 563123 - DNA, 20 bp, Artificial
  CRISPR gRNA sequence
aacaaggtaacactctatgt

SEQ ID NO: 563124 - DNA, 20 bp, Artificial
  CRISPR gRNA sequence
tatgtatttttttgtatctc

SEQ ID NO: 563125 - DNA, 20 bp, Artificial
  CRISPR gRNA sequence
tgtatttttttgtatctcat

SEQ ID NO: 563126 - DNA, 20 bp, Artificial
  CRISPR gRNA sequence
ttttgtatctcatttttgtc

SEQ ID NO: 563127 - DNA, 20 bp, Artificial
  CRISPR gRNA sequence
tttgtatctcatttttgtca

SEQ ID NO: 563128 - DNA, 20 bp, Artificial
  CRISPR gRNA sequence
ttgtatctcatttttgtcac

SEQ ID NO: 563129 - DNA, 20 bp, Artificial
  CRISPR gRNA sequence
tgtatctcatttttgtcact

SEQ ID NO: 563130 - DNA, 20 bp, Artificial
  CRISPR gRNA sequence
gtatctcatttttgtcactt

SEQ ID NO: 563131 - DNA, 20 bp, Artificial
  CRISPR gRNA sequence
tatctcatttttgtcactta

SEQ ID NO: 563132 - DNA, 20 bp, Artificial
  CRISPR gRNA sequence
atttttgtcacttaaccata

SEQ ID NO: 563133 - DNA, 20 bp, Artificial
  CRISPR gRNA sequence
ttgtcacttaaccatacatc

SEQ ID NO: 563134 - DNA, 20 bp, Artificial
  CRISPR gRNA sequence
tgtcacttaaccatacatct

SEQ ID NO: 563135 - DNA, 20 bp, Artificial
  CRISPR gRNA sequence
gtcacttaaccatacatctg

SEQ ID NO: 563136 - DNA, 20 bp, Artificial
  CRISPR gRNA sequence
tcacttaaccatacatctgg

SEQ ID NO: 563137 - DNA, 20 bp, Artificial
  CRISPR gRNA sequence
aaccatacatctggaaaatc

SEQ ID NO: 563138 - DNA, 20 bp, Artificial
  CRISPR gRNA sequence
accatacatctggaaaatca

SEQ ID NO: 563139 - DNA, 20 bp, Artificial
  CRISPR gRNA sequence
gaaaatcattccctatcact

SEQ ID NO: 563140 - DNA, 20 bp, Artificial
  CRISPR gRNA sequence
cctatcacttcatagagatc

SEQ ID NO: 563141 - DNA, 20 bp, Artificial
  CRISPR gRNA sequence
tcacttcatagagatccacc

SEQ ID NO: 563142 - DNA, 20 bp, Artificial
  CRISPR gRNA sequence
catagagatccacctcattc

SEQ ID NO: 563143 - DNA, 20 bp, Artificial
  CRISPR gRNA sequence
atagagatccacctcattct

SEQ ID NO: 563144 - DNA, 20 bp, Artificial
  CRISPR gRNA sequence
attctttttcacagctgtac

SEQ ID NO: 563145 - DNA, 20 bp, Artificial
  CRISPR gRNA sequence
tttttcacagctgtacagtc

SEQ ID NO: 563146 - DNA, 20 bp, Artificial
  CRISPR gRNA sequence
tttcacagctgtacagtccc

SEQ ID NO: 563147 - DNA, 20 bp, Artificial
  CRISPR gRNA sequence
ttcacagctgtacagtccct

SEQ ID NO: 563148 - DNA, 20 bp, Artificial
  CRISPR gRNA sequence
tcacagctgtacagtccctc

SEQ ID NO: 563149 - DNA, 20 bp, Artificial
  CRISPR gRNA sequence
cacagctgtacagtccctca

SEQ ID NO: 563150 - DNA, 20 bp, Artificial
  CRISPR gRNA sequence
acagctgtacagtccctcat

SEQ ID NO: 563151 - DNA, 20 bp, Artificial
  CRISPR gRNA sequence
tacagtccctcatagggtgg

SEQ ID NO: 563152 - DNA, 20 bp, Artificial
  CRISPR gRNA sequence
atagggtggctatatggtag

SEQ ID NO: 563153 - DNA, 20 bp, Artificial
  CRISPR gRNA sequence
tatggtagttcattcagcta

SEQ ID NO: 563154 - DNA, 20 bp, Artificial
  CRISPR gRNA sequence
attcagctaccctctgctgg

SEQ ID NO: 563155 - DNA, 20 bp, Artificial
  CRISPR gRNA sequence
agctaccctctgctggttag

SEQ ID NO: 563156 - DNA, 20 bp, Artificial
  CRISPR gRNA sequence
ccctctgctggttagtatta

SEQ ID NO: 563157 - DNA, 20 bp, Artificial
  CRISPR gRNA sequence
tgctggttagtattacatag

SEQ ID NO: 563158 - DNA, 20 bp, Artificial
  CRISPR gRNA sequence
ctggttagtattacatagtg

SEQ ID NO: 563159 - DNA, 20 bp, Artificial
  CRISPR gRNA sequence
gttagtattacatagtgtgg

SEQ ID NO: 563160 - DNA, 20 bp, Artificial
  CRISPR gRNA sequence
gtattacatagtgtggtcag

SEQ ID NO: 563161 - DNA, 20 bp, Artificial
  CRISPR gRNA sequence
catagtgtggtcagggaggg

SEQ ID NO: 563162 - DNA, 20 bp, Artificial
  CRISPR gRNA sequence
tttaatagggtgacaattga

SEQ ID NO: 563163 - DNA, 20 bp, Artificial
  CRISPR gRNA sequence
taatagggtgacaattgatc

SEQ ID NO: 563164 - DNA, 20 bp, Artificial
  CRISPR gRNA sequence
aatagggtgacaattgatca

SEQ ID NO: 563165 - DNA, 20 bp, Artificial
  CRISPR gRNA sequence
atagggtgacaattgatcat

SEQ ID NO: 563166 - DNA, 20 bp, Artificial
  CRISPR gRNA sequence
atcatacacttaaggaagtg

SEQ ID NO: 563167 - DNA, 20 bp, Artificial
  CRISPR gRNA sequence
aaggaagtgagagataggcc

SEQ ID NO: 563168 - DNA, 20 bp, Artificial
  CRISPR gRNA sequence
aggaagtgagagataggcca

SEQ ID NO: 563169 - DNA, 20 bp, Artificial
  CRISPR gRNA sequence
tctgggggagtgatattcca

SEQ ID NO: 563170 - DNA, 20 bp, Artificial
  CRISPR gRNA sequence
ggggagtgatattccaggtc

SEQ ID NO: 563171 - DNA, 20 bp, Artificial
  CRISPR gRNA sequence
caggtctactactcaggacc

SEQ ID NO: 563172 - DNA, 20 bp, Artificial
  CRISPR gRNA sequence
ctactcaggaccctgagata

SEQ ID NO: 563173 - DNA, 20 bp, Artificial
  CRISPR gRNA sequence
ctcaggaccctgagataggc

SEQ ID NO: 563174 - DNA, 20 bp, Artificial
  CRISPR gRNA sequence
aggaccctgagataggcttc

SEQ ID NO: 563175 - DNA, 20 bp, Artificial
  CRISPR gRNA sequence
agataggcttcaagcgttta

SEQ ID NO: 563176 - DNA, 20 bp, Artificial
  CRISPR gRNA sequence
caagcgtttaagaaacttca

SEQ ID NO: 563177 - DNA, 20 bp, Artificial
  CRISPR gRNA sequence
aagcgtttaagaaacttcaa

SEQ ID NO: 563178 - DNA, 20 bp, Artificial
  CRISPR gRNA sequence
aagaaacttcaaggatacca

SEQ ID NO: 563179 - DNA, 20 bp, Artificial
  CRISPR gRNA sequence
agaaacttcaaggataccat

SEQ ID NO: 563180 - DNA, 20 bp, Artificial
  CRISPR gRNA sequence
caaggataccattgtggtgg

SEQ ID NO: 563181 - DNA, 20 bp, Artificial
  CRISPR gRNA sequence
aaggataccattgtggtgga

SEQ ID NO: 563182 - DNA, 20 bp, Artificial
  CRISPR gRNA sequence
tggtggagagtggtagaaaa

SEQ ID NO: 563183 - DNA, 20 bp, Artificial
  CRISPR gRNA sequence
taaaagtagtcagggttgga

SEQ ID NO: 563184 - DNA, 20 bp, Artificial
  CRISPR gRNA sequence
gatcctgtagataaagtttt

SEQ ID NO: 563185 - DNA, 20 bp, Artificial
  CRISPR gRNA sequence
tagataaagtttttagggcc

SEQ ID NO: 563186 - DNA, 20 bp, Artificial
  CRISPR gRNA sequence
ttagggccttttaaatattt

SEQ ID NO: 563187 - DNA, 20 bp, Artificial
  CRISPR gRNA sequence
tagggccttttaaatatttt

SEQ ID NO: 563188 - DNA, 20 bp, Artificial
  CRISPR gRNA sequence
agggccttttaaatattttg

SEQ ID NO: 563189 - DNA, 20 bp, Artificial
  CRISPR gRNA sequence
gggccttttaaatattttgg

SEQ ID NO: 563190 - DNA, 20 bp, Artificial
  CRISPR gRNA sequence
ttaaatattttggccttttt

SEQ ID NO: 563191 - DNA, 20 bp, Artificial
  CRISPR gRNA sequence
taaatattttggcctttttg

SEQ ID NO: 563192 - DNA, 20 bp, Artificial
  CRISPR gRNA sequence
aaatattttggcctttttgc

SEQ ID NO: 563193 - DNA, 20 bp, Artificial
  CRISPR gRNA sequence
aatattttggcctttttgct

SEQ ID NO: 563194 - DNA, 20 bp, Artificial
  CRISPR gRNA sequence
tggcctttttgctttcagtg

SEQ ID NO: 563195 - DNA, 20 bp, Artificial
  CRISPR gRNA sequence
ggcctttttgctttcagtga

SEQ ID NO: 563196 - DNA, 20 bp, Artificial
  CRISPR gRNA sequence
gcctttttgctttcagtgac

SEQ ID NO: 563197 - DNA, 20 bp, Artificial
  CRISPR gRNA sequence
tttgctttcagtgactggaa

SEQ ID NO: 563198 - DNA, 20 bp, Artificial
  CRISPR gRNA sequence
ttgctttcagtgactggaaa

SEQ ID NO: 563199 - DNA, 20 bp, Artificial
  CRISPR gRNA sequence
tgctttcagtgactggaaag

SEQ ID NO: 563200 - DNA, 20 bp, Artificial
  CRISPR gRNA sequence
gctttcagtgactggaaagt

SEQ ID NO: 563201 - DNA, 20 bp, Artificial
  CRISPR gRNA sequence
ctttcagtgactggaaagtt

SEQ ID NO: 563202 - DNA, 20 bp, Artificial
  CRISPR gRNA sequence
tcagtgactggaaagttttg

SEQ ID NO: 563203 - DNA, 20 bp, Artificial
  CRISPR gRNA sequence
cagtgactggaaagttttga

SEQ ID NO: 563204 - DNA, 20 bp, Artificial
  CRISPR gRNA sequence
agtgactggaaagttttgaa

SEQ ID NO: 563205 - DNA, 20 bp, Artificial
  CRISPR gRNA sequence
gaaagttttgaaggattttg

SEQ ID NO: 563206 - DNA, 20 bp, Artificial
  CRISPR gRNA sequence
tgaaggattttgaacaggag

SEQ ID NO: 563207 - DNA, 20 bp, Artificial
  CRISPR gRNA sequence
gaaggattttgaacaggagt

SEQ ID NO: 563208 - DNA, 20 bp, Artificial
  CRISPR gRNA sequence
aaggattttgaacaggagtg

SEQ ID NO: 563209 - DNA, 20 bp, Artificial
  CRISPR gRNA sequence
tgaacaggagtgaaattatg

SEQ ID NO: 563210 - DNA, 20 bp, Artificial
  CRISPR gRNA sequence
gaacaggagtgaaattatga

SEQ ID NO: 563211 - DNA, 20 bp, Artificial
  CRISPR gRNA sequence
aacaggagtgaaattatgat

SEQ ID NO: 563212 - DNA, 20 bp, Artificial
  CRISPR gRNA sequence
tgatgacttggatgtttaaa

SEQ ID NO: 563213 - DNA, 20 bp, Artificial
  CRISPR gRNA sequence
ggatgtttaaaagaattatt

SEQ ID NO: 563214 - DNA, 20 bp, Artificial
  CRISPR gRNA sequence
gatgtttaaaagaattattc

SEQ ID NO: 563215 - DNA, 20 bp, Artificial
  CRISPR gRNA sequence
aaaagaattattctggctgc

SEQ ID NO: 563216 - DNA, 20 bp, Artificial
  CRISPR gRNA sequence
aaagaattattctggctgct

SEQ ID NO: 563217 - DNA, 20 bp, Artificial
  CRISPR gRNA sequence
ttctggctgctggatgaata

SEQ ID NO: 563218 - DNA, 20 bp, Artificial
  CRISPR gRNA sequence
tggctgctggatgaatagtc

SEQ ID NO: 563219 - DNA, 20 bp, Artificial
  CRISPR gRNA sequence
gctgctggatgaatagtctg

SEQ ID NO: 563220 - DNA, 20 bp, Artificial
  CRISPR gRNA sequence
ctggatgaatagtctgtaga

SEQ ID NO: 563221 - DNA, 20 bp, Artificial
  CRISPR gRNA sequence
gatgaatagtctgtagagga

SEQ ID NO: 563222 - DNA, 20 bp, Artificial
  CRISPR gRNA sequence
tagaggagagaaaaggaaga

SEQ ID NO: 563223 - DNA, 20 bp, Artificial
  CRISPR gRNA sequence
gttaggctgcaggggcaatg

SEQ ID NO: 563224 - DNA, 20 bp, Artificial
  CRISPR gRNA sequence
ggctgcaggggcaatgcagg

SEQ ID NO: 563225 - DNA, 20 bp, Artificial
  CRISPR gRNA sequence
caggggcaatgcaggaaagg

SEQ ID NO: 563226 - DNA, 20 bp, Artificial
  CRISPR gRNA sequence
ggggtgggagatatctggat

SEQ ID NO: 563227 - DNA, 20 bp, Artificial
  CRISPR gRNA sequence
gatgtgttttgaaggtggag

SEQ ID NO: 563228 - DNA, 20 bp, Artificial
  CRISPR gRNA sequence
tgaaggtggagctggcagga

SEQ ID NO: 563229 - DNA, 20 bp, Artificial
  CRISPR gRNA sequence
gaaggtggagctggcaggat

SEQ ID NO: 563230 - DNA, 20 bp, Artificial
  CRISPR gRNA sequence
aaggtggagctggcaggatt

SEQ ID NO: 563231 - DNA, 20 bp, Artificial
  CRISPR gRNA sequence
gcaggatttggtgtgggctt

SEQ ID NO: 563232 - DNA, 20 bp, Artificial
  CRISPR gRNA sequence
ggtgtgggcttgcattagtg

SEQ ID NO: 563233 - DNA, 20 bp, Artificial
  CRISPR gRNA sequence
gtgtgggcttgcattagtgg

SEQ ID NO: 563234 - DNA, 20 bp, Artificial
  CRISPR gRNA sequence
gcattagtggaatgacatgt

SEQ ID NO: 563235 - DNA, 20 bp, Artificial
  CRISPR gRNA sequence
cattagtggaatgacatgtg

SEQ ID NO: 563236 - DNA, 20 bp, Artificial
  CRISPR gRNA sequence
gtggaatgacatgtggatag

SEQ ID NO: 563237 - DNA, 20 bp, Artificial
  CRISPR gRNA sequence
gatagtgctgggcaagtagc

SEQ ID NO: 563238 - DNA, 20 bp, Artificial
  CRISPR gRNA sequence
ggcaagtagcaagaactcaa

SEQ ID NO: 563239 - DNA, 20 bp, Artificial
  CRISPR gRNA sequence
aaaagtatgaacttggctga

SEQ ID NO: 563240 - DNA, 20 bp, Artificial
  CRISPR gRNA sequence
ggctgagagtggtggtgcat

SEQ ID NO: 563241 - DNA, 20 bp, Artificial
  CRISPR gRNA sequence
gctgagagtggtggtgcatg

SEQ ID NO: 563242 - DNA, 20 bp, Artificial
  CRISPR gRNA sequence
agagtggtggtgcatgcctg

SEQ ID NO: 563243 - DNA, 20 bp, Artificial
  CRISPR gRNA sequence
taatcctagcactgagaggc

SEQ ID NO: 563244 - DNA, 20 bp, Artificial
  CRISPR gRNA sequence
gcactgagaggctgaggtgg

SEQ ID NO: 563245 - DNA, 20 bp, Artificial
  CRISPR gRNA sequence
agaggctgaggtgggcagat

SEQ ID NO: 563246 - DNA, 20 bp, Artificial
  CRISPR gRNA sequence
aggtgggcagatcttttgag

SEQ ID NO: 563247 - DNA, 20 bp, Artificial
  CRISPR gRNA sequence
ttgagcccaggagttcgaga

SEQ ID NO: 563248 - DNA, 20 bp, Artificial
  CRISPR gRNA sequence
tgagcccaggagttcgagac

SEQ ID NO: 563249 - DNA, 20 bp, Artificial
  CRISPR gRNA sequence
gagcccaggagttcgagacc

SEQ ID NO: 563250 - DNA, 20 bp, Artificial
  CRISPR gRNA sequence
agcccaggagttcgagacca

SEQ ID NO: 563251 - DNA, 20 bp, Artificial
  CRISPR gRNA sequence
gagaccatcctaagcaacat

SEQ ID NO: 563252 - DNA, 20 bp, Artificial
  CRISPR gRNA sequence
agcaacatgctgaaacccca

SEQ ID NO: 563253 - DNA, 20 bp, Artificial
  CRISPR gRNA sequence
aaaccccatgatatggtttg

SEQ ID NO: 563254 - DNA, 20 bp, Artificial
  CRISPR gRNA sequence
ggctctgtgttcccacccaa

SEQ ID NO: 563255 - DNA, 20 bp, Artificial
  CRISPR gRNA sequence
gctctgtgttcccacccaaa

SEQ ID NO: 563256 - DNA, 20 bp, Artificial
  CRISPR gRNA sequence
tgtgttcccacccaaatctt

SEQ ID NO: 563257 - DNA, 20 bp, Artificial
  CRISPR gRNA sequence
tgttcccacccaaatcttac

SEQ ID NO: 563258 - DNA, 20 bp, Artificial
  CRISPR gRNA sequence
ccacccaaatcttacgttga

SEQ ID NO: 563259 - DNA, 20 bp, Artificial
  CRISPR gRNA sequence
acgttgaattgtaataatcc

SEQ ID NO: 563260 - DNA, 20 bp, Artificial
  CRISPR gRNA sequence
cgttgaattgtaataatccc

SEQ ID NO: 563261 - DNA, 20 bp, Artificial
  CRISPR gRNA sequence
aattgtaataatccccatat

SEQ ID NO: 563262 - DNA, 20 bp, Artificial
  CRISPR gRNA sequence
taataatccccatatgtcaa

SEQ ID NO: 563263 - DNA, 20 bp, Artificial
  CRISPR gRNA sequence
ggtggagataattgaatcat

SEQ ID NO: 563264 - DNA, 20 bp, Artificial
  CRISPR gRNA sequence
aatcataagggcagtttccc

SEQ ID NO: 563265 - DNA, 20 bp, Artificial
  CRISPR gRNA sequence
cccccatactgttctcagat

SEQ ID NO: 563266 - DNA, 20 bp, Artificial
  CRISPR gRNA sequence
ccccatactgttctcagata

SEQ ID NO: 563267 - DNA, 20 bp, Artificial
  CRISPR gRNA sequence
ttctcagatagtgaataagt

SEQ ID NO: 563268 - DNA, 20 bp, Artificial
  CRISPR gRNA sequence
tcagatagtgaataagtctc

SEQ ID NO: 563269 - DNA, 20 bp, Artificial
  CRISPR gRNA sequence
agatagtgaataagtctcac

SEQ ID NO: 563270 - DNA, 20 bp, Artificial
  CRISPR gRNA sequence
acaatatttgatgattttat

SEQ ID NO: 563271 - DNA, 20 bp, Artificial
  CRISPR gRNA sequence
gatgattttataaatgggga

SEQ ID NO: 563272 - DNA, 20 bp, Artificial
  CRISPR gRNA sequence
atgattttataaatggggat

SEQ ID NO: 563273 - DNA, 20 bp, Artificial
  CRISPR gRNA sequence
tataaatggggattcccctg

SEQ ID NO: 563274 - DNA, 20 bp, Artificial
  CRISPR gRNA sequence
ataaatggggattcccctgc

SEQ ID NO: 563275 - DNA, 20 bp, Artificial
  CRISPR gRNA sequence
taaatggggattcccctgca

SEQ ID NO: 563276 - DNA, 20 bp, Artificial
  CRISPR gRNA sequence
ccctgcacaagctctctctt

SEQ ID NO: 563277 - DNA, 20 bp, Artificial
  CRISPR gRNA sequence
cacaagctctctcttgccta

SEQ ID NO: 563278 - DNA, 20 bp, Artificial
  CRISPR gRNA sequence
tctcttgcctactgccatgt

SEQ ID NO: 563279 - DNA, 20 bp, Artificial
  CRISPR gRNA sequence
tcttgcctactgccatgtaa

SEQ ID NO: 563280 - DNA, 20 bp, Artificial
  CRISPR gRNA sequence
ttgcctactgccatgtaaga

SEQ ID NO: 563281 - DNA, 20 bp, Artificial
  CRISPR gRNA sequence
gcctactgccatgtaagatg

SEQ ID NO: 563282 - DNA, 20 bp, Artificial
  CRISPR gRNA sequence
cctactgccatgtaagatgt

SEQ ID NO: 563283 - DNA, 20 bp, Artificial
  CRISPR gRNA sequence
ctgccatgtaagatgtgcct

SEQ ID NO: 563284 - DNA, 20 bp, Artificial
  CRISPR gRNA sequence
ccatgtaagatgtgccttac

SEQ ID NO: 563285 - DNA, 20 bp, Artificial
  CRISPR gRNA sequence
acttctcctttgcattctgc

SEQ ID NO: 563286 - DNA, 20 bp, Artificial
  CRISPR gRNA sequence
cttctcctttgcattctgcc

SEQ ID NO: 563287 - DNA, 20 bp, Artificial
  CRISPR gRNA sequence
ctcctttgcattctgccatg

SEQ ID NO: 563288 - DNA, 20 bp, Artificial
  CRISPR gRNA sequence
tcctttgcattctgccatga

SEQ ID NO: 563289 - DNA, 20 bp, Artificial
  CRISPR gRNA sequence
ctttgcattctgccatgatt

SEQ ID NO: 563290 - DNA, 20 bp, Artificial
  CRISPR gRNA sequence
tgcattctgccatgattgtg

SEQ ID NO: 563291 - DNA, 20 bp, Artificial
  CRISPR gRNA sequence
gcattctgccatgattgtgg

SEQ ID NO: 563292 - DNA, 20 bp, Artificial
  CRISPR gRNA sequence
cattctgccatgattgtggg

SEQ ID NO: 563293 - DNA, 20 bp, Artificial
  CRISPR gRNA sequence
tgccatgattgtggggcctc

SEQ ID NO: 563294 - DNA, 20 bp, Artificial
  CRISPR gRNA sequence
ccatgattgtggggcctccc

SEQ ID NO: 563295 - DNA, 20 bp, Artificial
  CRISPR gRNA sequence
tggggcctccctggccaggt

SEQ ID NO: 563296 - DNA, 20 bp, Artificial
  CRISPR gRNA sequence
cctggccaggtggaactgtg

SEQ ID NO: 563297 - DNA, 20 bp, Artificial
  CRISPR gRNA sequence
gccaggtggaactgtgagtt

SEQ ID NO: 563298 - DNA, 20 bp, Artificial
  CRISPR gRNA sequence
tgagttcattgaacttcttt

SEQ ID NO: 563299 - DNA, 20 bp, Artificial
  CRISPR gRNA sequence
attgaacttctttcctttat

SEQ ID NO: 563300 - DNA, 20 bp, Artificial
  CRISPR gRNA sequence
aacttctttcctttataaat

SEQ ID NO: 563301 - DNA, 20 bp, Artificial
  CRISPR gRNA sequence
ctttcctttataaattaccc

SEQ ID NO: 563302 - DNA, 20 bp, Artificial
  CRISPR gRNA sequence
tttcctttataaattaccca

SEQ ID NO: 563303 - DNA, 20 bp, Artificial
  CRISPR gRNA sequence
tcctttataaattacccagt

SEQ ID NO: 563304 - DNA, 20 bp, Artificial
  CRISPR gRNA sequence
cctttataaattacccagtc

SEQ ID NO: 563305 - DNA, 20 bp, Artificial
  CRISPR gRNA sequence
ctttataaattacccagtct

SEQ ID NO: 563306 - DNA, 20 bp, Artificial
  CRISPR gRNA sequence
tataaattacccagtcttgg

SEQ ID NO: 563307 - DNA, 20 bp, Artificial
  CRISPR gRNA sequence
ataaattacccagtcttggg

SEQ ID NO: 563308 - DNA, 20 bp, Artificial
  CRISPR gRNA sequence
taaattacccagtcttgggt

SEQ ID NO: 563309 - DNA, 20 bp, Artificial
  CRISPR gRNA sequence
cccagtcttgggtatgtctt

SEQ ID NO: 563310 - DNA, 20 bp, Artificial
  CRISPR gRNA sequence
gggtatgtctttattagcag

SEQ ID NO: 563311 - DNA, 20 bp, Artificial
  CRISPR gRNA sequence
ggtatgtctttattagcagc

SEQ ID NO: 563312 - DNA, 20 bp, Artificial
  CRISPR gRNA sequence
tattagcagcatgagaatgg

SEQ ID NO: 563313 - DNA, 20 bp, Artificial
  CRISPR gRNA sequence
attagcagcatgagaatgga

SEQ ID NO: 563314 - DNA, 20 bp, Artificial
  CRISPR gRNA sequence
ttagcagcatgagaatggac

SEQ ID NO: 563315 - DNA, 20 bp, Artificial
  CRISPR gRNA sequence
gcagcatgagaatggactaa

SEQ ID NO: 563316 - DNA, 20 bp, Artificial
  CRISPR gRNA sequence
atatagtaaattggtactgg

SEQ ID NO: 563317 - DNA, 20 bp, Artificial
  CRISPR gRNA sequence
gtactgggtagtggggcact

SEQ ID NO: 563318 - DNA, 20 bp, Artificial
  CRISPR gRNA sequence
ggtagtggggcactgctgca

SEQ ID NO: 563319 - DNA, 20 bp, Artificial
  CRISPR gRNA sequence
ctgcaaagatacctgaaaat

SEQ ID NO: 563320 - DNA, 20 bp, Artificial
  CRISPR gRNA sequence
caaagatacctgaaaatgtg

SEQ ID NO: 563321 - DNA, 20 bp, Artificial
  CRISPR gRNA sequence
aaaatgtggaagcaactttg

SEQ ID NO: 563322 - DNA, 20 bp, Artificial
  CRISPR gRNA sequence
tggaactgggtaacaggcag

SEQ ID NO: 563323 - DNA, 20 bp, Artificial
  CRISPR gRNA sequence
ggaactgggtaacaggcagg

SEQ ID NO: 563324 - DNA, 20 bp, Artificial
  CRISPR gRNA sequence
gaactgggtaacaggcaggg

SEQ ID NO: 563325 - DNA, 20 bp, Artificial
  CRISPR gRNA sequence
ggtaacaggcagggattgga

SEQ ID NO: 563326 - DNA, 20 bp, Artificial
  CRISPR gRNA sequence
gaatagtttggaagactcag

SEQ ID NO: 563327 - DNA, 20 bp, Artificial
  CRISPR gRNA sequence
ggaagactcagaagaagaca

SEQ ID NO: 563328 - DNA, 20 bp, Artificial
  CRISPR gRNA sequence
gaagactcagaagaagacag

SEQ ID NO: 563329 - DNA, 20 bp, Artificial
  CRISPR gRNA sequence
agaagaagacaggaagatgt

SEQ ID NO: 563330 - DNA, 20 bp, Artificial
  CRISPR gRNA sequence
ggaacttcctagagacttgt

SEQ ID NO: 563331 - DNA, 20 bp, Artificial
  CRISPR gRNA sequence
gaacttcctagagacttgtt

SEQ ID NO: 563332 - DNA, 20 bp, Artificial
  CRISPR gRNA sequence
cctagagacttgttgaatgg

SEQ ID NO: 563333 - DNA, 20 bp, Artificial
  CRISPR gRNA sequence
ctagagacttgttgaatggc

SEQ ID NO: 563334 - DNA, 20 bp, Artificial
  CRISPR gRNA sequence
gagacttgttgaatggcttt

SEQ ID NO: 563335 - DNA, 20 bp, Artificial
  CRISPR gRNA sequence
gttgaatggctttgaccaaa

SEQ ID NO: 563336 - DNA, 20 bp, Artificial
  CRISPR gRNA sequence
ttgaatggctttgaccaaat

SEQ ID NO: 563337 - DNA, 20 bp, Artificial
  CRISPR gRNA sequence
aatggctttgaccaaatgct

SEQ ID NO: 563338 - DNA, 20 bp, Artificial
  CRISPR gRNA sequence
tgaccaaatgctgctcatct

SEQ ID NO: 563339 - DNA, 20 bp, Artificial
  CRISPR gRNA sequence
gaccaaatgctgctcatctc

SEQ ID NO: 563340 - DNA, 20 bp, Artificial
  CRISPR gRNA sequence
accaaatgctgctcatctca

SEQ ID NO: 563341 - DNA, 20 bp, Artificial
  CRISPR gRNA sequence
ctcatctcagatggagatga

SEQ ID NO: 563342 - DNA, 20 bp, Artificial
  CRISPR gRNA sequence
atctcagatggagatgagga

SEQ ID NO: 563343 - DNA, 20 bp, Artificial
  CRISPR gRNA sequence
agatggagatgaggaacaat

SEQ ID NO: 563344 - DNA, 20 bp, Artificial
  CRISPR gRNA sequence
ttgggaactggaataaaggt

SEQ ID NO: 563345 - DNA, 20 bp, Artificial
  CRISPR gRNA sequence
ggaactggaataaaggtgac

SEQ ID NO: 563346 - DNA, 20 bp, Artificial
  CRISPR gRNA sequence
gaataaaggtgactcttaat

SEQ ID NO: 563347 - DNA, 20 bp, Artificial
  CRISPR gRNA sequence
ttaatatgttttagcaaaga

SEQ ID NO: 563348 - DNA, 20 bp, Artificial
  CRISPR gRNA sequence
aatatgttttagcaaagaga

SEQ ID NO: 563349 - DNA, 20 bp, Artificial
  CRISPR gRNA sequence
atatgttttagcaaagagac

SEQ ID NO: 563350 - DNA, 20 bp, Artificial
  CRISPR gRNA sequence
tagcaaagagactggcagca

SEQ ID NO: 563351 - DNA, 20 bp, Artificial
  CRISPR gRNA sequence
agcaaagagactggcagcat

SEQ ID NO: 563352 - DNA, 20 bp, Artificial
  CRISPR gRNA sequence
gcaaagagactggcagcatt

SEQ ID NO: 563353 - DNA, 20 bp, Artificial
  CRISPR gRNA sequence
gcagcattttgcctgtgccc

SEQ ID NO: 563354 - DNA, 20 bp, Artificial
  CRISPR gRNA sequence
tgcctgtgccctaaagatac

SEQ ID NO: 563355 - DNA, 20 bp, Artificial
  CRISPR gRNA sequence
gcctgtgccctaaagatacg

SEQ ID NO: 563356 - DNA, 20 bp, Artificial
  CRISPR gRNA sequence
cctgtgccctaaagatacgt

SEQ ID NO: 563357 - DNA, 20 bp, Artificial
  CRISPR gRNA sequence
tgccctaaagatacgtggaa

SEQ ID NO: 563358 - DNA, 20 bp, Artificial
  CRISPR gRNA sequence
aagatacgtggaactttgaa

SEQ ID NO: 563359 - DNA, 20 bp, Artificial
  CRISPR gRNA sequence
tgaacttgagagaaattatt

SEQ ID NO: 563360 - DNA, 20 bp, Artificial
  CRISPR gRNA sequence
gaacttgagagaaattattt

SEQ ID NO: 563361 - DNA, 20 bp, Artificial
  CRISPR gRNA sequence
aacttgagagaaattattta

SEQ ID NO: 563362 - DNA, 20 bp, Artificial
  CRISPR gRNA sequence
gagagaaattatttagggca

SEQ ID NO: 563363 - DNA, 20 bp, Artificial
  CRISPR gRNA sequence
agagaaattatttagggcat

SEQ ID NO: 563364 - DNA, 20 bp, Artificial
  CRISPR gRNA sequence
tttagggcatctggtggaag

SEQ ID NO: 563365 - DNA, 20 bp, Artificial
  CRISPR gRNA sequence
agggcatctggtggaagaaa

SEQ ID NO: 563366 - DNA, 20 bp, Artificial
  CRISPR gRNA sequence
gggcatctggtggaagaaat

SEQ ID NO: 563367 - DNA, 20 bp, Artificial
  CRISPR gRNA sequence
gtggaagaaatttctaagca

SEQ ID NO: 563368 - DNA, 20 bp, Artificial
  CRISPR gRNA sequence
ctaagcagcaaagcattcaa

SEQ ID NO: 563369 - DNA, 20 bp, Artificial
  CRISPR gRNA sequence
taagcagcaaagcattcaag

SEQ ID NO: 563370 - DNA, 20 bp, Artificial
  CRISPR gRNA sequence
agcagcaaagcattcaagag

SEQ ID NO: 563371 - DNA, 20 bp, Artificial
  CRISPR gRNA sequence
aagaggtggcttggttgctg

SEQ ID NO: 563372 - DNA, 20 bp, Artificial
  CRISPR gRNA sequence
ggttgctgttaaaagcattc

SEQ ID NO: 563373 - DNA, 20 bp, Artificial
  CRISPR gRNA sequence
gttgctgttaaaagcattca

SEQ ID NO: 563374 - DNA, 20 bp, Artificial
  CRISPR gRNA sequence
ctgttaaaagcattcagttt

SEQ ID NO: 563375 - DNA, 20 bp, Artificial
  CRISPR gRNA sequence
ttaaaagcattcagttttat

SEQ ID NO: 563376 - DNA, 20 bp, Artificial
  CRISPR gRNA sequence
aaagcattcagttttatatg

SEQ ID NO: 563377 - DNA, 20 bp, Artificial
  CRISPR gRNA sequence
agttttatatgttcacaaag

SEQ ID NO: 563378 - DNA, 20 bp, Artificial
  CRISPR gRNA sequence
tatatgttcacaaagatgtg

SEQ ID NO: 563379 - DNA, 20 bp, Artificial
  CRISPR gRNA sequence
atatgttcacaaagatgtgg

SEQ ID NO: 563380 - DNA, 20 bp, Artificial
  CRISPR gRNA sequence
tatgttcacaaagatgtggt

SEQ ID NO: 563381 - DNA, 20 bp, Artificial
  CRISPR gRNA sequence
acaaagatgtggtttggaat

SEQ ID NO: 563382 - DNA, 20 bp, Artificial
  CRISPR gRNA sequence
ggaattggaacttatgttta

SEQ ID NO: 563383 - DNA, 20 bp, Artificial
  CRISPR gRNA sequence
gaattggaacttatgtttaa

SEQ ID NO: 563384 - DNA, 20 bp, Artificial
  CRISPR gRNA sequence
gaacttatgtttaaaaggat

SEQ ID NO: 563385 - DNA, 20 bp, Artificial
  CRISPR gRNA sequence
atgtttaaaaggatagcagg

SEQ ID NO: 563386 - DNA, 20 bp, Artificial
  CRISPR gRNA sequence
tgtttaaaaggatagcaggg

SEQ ID NO: 563387 - DNA, 20 bp, Artificial
  CRISPR gRNA sequence
aaaaggatagcagggcataa

SEQ ID NO: 563388 - DNA, 20 bp, Artificial
  CRISPR gRNA sequence
aaaggatagcagggcataaa

SEQ ID NO: 563389 - DNA, 20 bp, Artificial
  CRISPR gRNA sequence
aaaaaatttgcagcccaatg

SEQ ID NO: 563390 - DNA, 20 bp, Artificial
  CRISPR gRNA sequence
gcagcccaatgatgcaatag

SEQ ID NO: 563391 - DNA, 20 bp, Artificial
  CRISPR gRNA sequence
cagcccaatgatgcaataga

SEQ ID NO: 563392 - DNA, 20 bp, Artificial
  CRISPR gRNA sequence
ttctgaggaaaaattcaagc

SEQ ID NO: 563393 - DNA, 20 bp, Artificial
  CRISPR gRNA sequence
tctgaggaaaaattcaagcc

SEQ ID NO: 563394 - DNA, 20 bp, Artificial
  CRISPR gRNA sequence
ctgaggaaaaattcaagcca

SEQ ID NO: 563395 - DNA, 20 bp, Artificial
  CRISPR gRNA sequence
tgaggaaaaattcaagccag

SEQ ID NO: 563396 - DNA, 20 bp, Artificial
  CRISPR gRNA sequence
aggaaaaattcaagccagct

SEQ ID NO: 563397 - DNA, 20 bp, Artificial
  CRISPR gRNA sequence
aagccagctgcagaaatttg

SEQ ID NO: 563398 - DNA, 20 bp, Artificial
  CRISPR gRNA sequence
cagaaatttgcattaagtaa

SEQ ID NO: 563399 - DNA, 20 bp, Artificial
  CRISPR gRNA sequence
gcattaagtaatgaggagcc

SEQ ID NO: 563400 - DNA, 20 bp, Artificial
  CRISPR gRNA sequence
cattaagtaatgaggagcca

SEQ ID NO: 563401 - DNA, 20 bp, Artificial
  CRISPR gRNA sequence
agtaatgaggagccaaatgt

SEQ ID NO: 563402 - DNA, 20 bp, Artificial
  CRISPR gRNA sequence
atcacgaagacaatggggaa

SEQ ID NO: 563403 - DNA, 20 bp, Artificial
  CRISPR gRNA sequence
cagggcatatcagaaacctt

SEQ ID NO: 563404 - DNA, 20 bp, Artificial
  CRISPR gRNA sequence
catggcagcccctcctatca

SEQ ID NO: 563405 - DNA, 20 bp, Artificial
  CRISPR gRNA sequence
atggcagcccctcctatcac

SEQ ID NO: 563406 - DNA, 20 bp, Artificial
  CRISPR gRNA sequence
ctatcacaggcctggaggcc

SEQ ID NO: 563407 - DNA, 20 bp, Artificial
  CRISPR gRNA sequence
tcacaggcctggaggccttg

SEQ ID NO: 563408 - DNA, 20 bp, Artificial
  CRISPR gRNA sequence
gaggccttggagggaaaaat

SEQ ID NO: 563409 - DNA, 20 bp, Artificial
  CRISPR gRNA sequence
ggagggaaaaattgtttcat

SEQ ID NO: 563410 - DNA, 20 bp, Artificial
  CRISPR gRNA sequence
gagggaaaaattgtttcatg

SEQ ID NO: 563411 - DNA, 20 bp, Artificial
  CRISPR gRNA sequence
tttcatgggctggacccagg

SEQ ID NO: 563412 - DNA, 20 bp, Artificial
  CRISPR gRNA sequence
catgggctggacccagggcc

SEQ ID NO: 563413 - DNA, 20 bp, Artificial
  CRISPR gRNA sequence
atgggctggacccagggccc

SEQ ID NO: 563414 - DNA, 20 bp, Artificial
  CRISPR gRNA sequence
gacccagggcccccctgctc

SEQ ID NO: 563415 - DNA, 20 bp, Artificial
  CRISPR gRNA sequence
ctctttgcagcctccaaaca

SEQ ID NO: 563416 - DNA, 20 bp, Artificial
  CRISPR gRNA sequence
tttgcagcctccaaacatgg

SEQ ID NO: 563417 - DNA, 20 bp, Artificial
  CRISPR gRNA sequence
tgcagcctccaaacatggag

SEQ ID NO: 563418 - DNA, 20 bp, Artificial
  CRISPR gRNA sequence
gcagcctccaaacatggagc

SEQ ID NO: 563419 - DNA, 20 bp, Artificial
  CRISPR gRNA sequence
cagcctccaaacatggagcc

SEQ ID NO: 563420 - DNA, 20 bp, Artificial
  CRISPR gRNA sequence
caaacatggagccctgcatg

SEQ ID NO: 563421 - DNA, 20 bp, Artificial
  CRISPR gRNA sequence
catgccagctgttttagctc

SEQ ID NO: 563422 - DNA, 20 bp, Artificial
  CRISPR gRNA sequence
ttttagctccagccatggct

SEQ ID NO: 563423 - DNA, 20 bp, Artificial
  CRISPR gRNA sequence
tagctccagccatggctaaa

SEQ ID NO: 563424 - DNA, 20 bp, Artificial
  CRISPR gRNA sequence
agctccagccatggctaaaa

SEQ ID NO: 563425 - DNA, 20 bp, Artificial
  CRISPR gRNA sequence
gctccagccatggctaaaag

SEQ ID NO: 563426 - DNA, 20 bp, Artificial
  CRISPR gRNA sequence
cagccatggctaaaaggggc

SEQ ID NO: 563427 - DNA, 20 bp, Artificial
  CRISPR gRNA sequence
aaaggggccaacataccact

SEQ ID NO: 563428 - DNA, 20 bp, Artificial
  CRISPR gRNA sequence
aggctgttgcttcagagggt

SEQ ID NO: 563429 - DNA, 20 bp, Artificial
  CRISPR gRNA sequence
ttgcttcagagggtaagcct

SEQ ID NO: 563430 - DNA, 20 bp, Artificial
  CRISPR gRNA sequence
cttcagagggtaagccttgg

SEQ ID NO: 563431 - DNA, 20 bp, Artificial
  CRISPR gRNA sequence
cagagggtaagccttggtgg

SEQ ID NO: 563432 - DNA, 20 bp, Artificial
  CRISPR gRNA sequence
agagggtaagccttggtggc

SEQ ID NO: 563433 - DNA, 20 bp, Artificial
  CRISPR gRNA sequence
ggtggcttacatgtggtgtt

SEQ ID NO: 563434 - DNA, 20 bp, Artificial
  CRISPR gRNA sequence
gtggcttacatgtggtgttg

SEQ ID NO: 563435 - DNA, 20 bp, Artificial
  CRISPR gRNA sequence
acatgtggtgttgggcctgt

SEQ ID NO: 563436 - DNA, 20 bp, Artificial
  CRISPR gRNA sequence
catgtggtgttgggcctgtg

SEQ ID NO: 563437 - DNA, 20 bp, Artificial
  CRISPR gRNA sequence
ggcctgtggatgcacagaag

SEQ ID NO: 563438 - DNA, 20 bp, Artificial
  CRISPR gRNA sequence
tggatgcacagaagtcaaga

SEQ ID NO: 563439 - DNA, 20 bp, Artificial
  CRISPR gRNA sequence
aggtttgagaacctctgcct

SEQ ID NO: 563440 - DNA, 20 bp, Artificial
  CRISPR gRNA sequence
gagaacctctgcctagattt

SEQ ID NO: 563441 - DNA, 20 bp, Artificial
  CRISPR gRNA sequence
agaacctctgcctagatttc

SEQ ID NO: 563442 - DNA, 20 bp, Artificial
  CRISPR gRNA sequence
tgcctagatttcagaggatg

SEQ ID NO: 563443 - DNA, 20 bp, Artificial
  CRISPR gRNA sequence
cctagatttcagaggatgta

SEQ ID NO: 563444 - DNA, 20 bp, Artificial
  CRISPR gRNA sequence
gatttcagaggatgtatgga

SEQ ID NO: 563445 - DNA, 20 bp, Artificial
  CRISPR gRNA sequence
cagaggatgtatggaaatgc

SEQ ID NO: 563446 - DNA, 20 bp, Artificial
  CRISPR gRNA sequence
agaggatgtatggaaatgcc

SEQ ID NO: 563447 - DNA, 20 bp, Artificial
  CRISPR gRNA sequence
gatgtccaggcagaagtttg

SEQ ID NO: 563448 - DNA, 20 bp, Artificial
  CRISPR gRNA sequence
gctgcaggagtgggaccctc

SEQ ID NO: 563449 - DNA, 20 bp, Artificial
  CRISPR gRNA sequence
ctgcaggagtgggaccctca

SEQ ID NO: 563450 - DNA, 20 bp, Artificial
  CRISPR gRNA sequence
caggagtgggaccctcatgg

SEQ ID NO: 563451 - DNA, 20 bp, Artificial
  CRISPR gRNA sequence
atggagaacctctgctaggg

SEQ ID NO: 563452 - DNA, 20 bp, Artificial
  CRISPR gRNA sequence
tgctagggcagtgtggaagg

SEQ ID NO: 563453 - DNA, 20 bp, Artificial
  CRISPR gRNA sequence
ctagggcagtgtggaaggga

SEQ ID NO: 563454 - DNA, 20 bp, Artificial
  CRISPR gRNA sequence
gggcagtgtggaagggaaat

SEQ ID NO: 563455 - DNA, 20 bp, Artificial
  CRISPR gRNA sequence
gagcccccacacagagtccc

SEQ ID NO: 563456 - DNA, 20 bp, Artificial
  CRISPR gRNA sequence
gggcaccgcctagtggagct

SEQ ID NO: 563457 - DNA, 20 bp, Artificial
  CRISPR gRNA sequence
gtggagctgtgagaagaggg

SEQ ID NO: 563458 - DNA, 20 bp, Artificial
  CRISPR gRNA sequence
tgagaagagggccatcatcc

SEQ ID NO: 563459 - DNA, 20 bp, Artificial
  CRISPR gRNA sequence
gcaccgtgtacctggaaaag

SEQ ID NO: 563460 - DNA, 20 bp, Artificial
  CRISPR gRNA sequence
caccgtgtacctggaaaagc

SEQ ID NO: 563461 - DNA, 20 bp, Artificial
  CRISPR gRNA sequence
gaaaagccacagacacttaa

SEQ ID NO: 563462 - DNA, 20 bp, Artificial
  CRISPR gRNA sequence
aatgccagctcatgaaagca

SEQ ID NO: 563463 - DNA, 20 bp, Artificial
  CRISPR gRNA sequence
atgccagctcatgaaagcag

SEQ ID NO: 563464 - DNA, 20 bp, Artificial
  CRISPR gRNA sequence
atgaaagcagccaggaggat

SEQ ID NO: 563465 - DNA, 20 bp, Artificial
  CRISPR gRNA sequence
taccctgcaaagccacaggg

SEQ ID NO: 563466 - DNA, 20 bp, Artificial
  CRISPR gRNA sequence
caaagccacaggggaagagc

SEQ ID NO: 563467 - DNA, 20 bp, Artificial
  CRISPR gRNA sequence
cccaaggttgtgggagccca

SEQ ID NO: 563468 - DNA, 20 bp, Artificial
  CRISPR gRNA sequence
tgggagcccatctcttgcgt

SEQ ID NO: 563469 - DNA, 20 bp, Artificial
  CRISPR gRNA sequence
ttgcgtcacctggatgtgag

SEQ ID NO: 563470 - DNA, 20 bp, Artificial
  CRISPR gRNA sequence
gcgtcacctggatgtgaggc

SEQ ID NO: 563471 - DNA, 20 bp, Artificial
  CRISPR gRNA sequence
cgtcacctggatgtgaggca

SEQ ID NO: 563472 - DNA, 20 bp, Artificial
  CRISPR gRNA sequence
gatgtgaggcatggagtcaa

SEQ ID NO: 563473 - DNA, 20 bp, Artificial
  CRISPR gRNA sequence
tggaactttaaggtttaaga

SEQ ID NO: 563474 - DNA, 20 bp, Artificial
  CRISPR gRNA sequence
ggaactttaaggtttaagac

SEQ ID NO: 563475 - DNA, 20 bp, Artificial
  CRISPR gRNA sequence
gaactttaaggtttaagact

SEQ ID NO: 563476 - DNA, 20 bp, Artificial
  CRISPR gRNA sequence
taaggtttaagactgcccta

SEQ ID NO: 563477 - DNA, 20 bp, Artificial
  CRISPR gRNA sequence
aaggtttaagactgccctat

SEQ ID NO: 563478 - DNA, 20 bp, Artificial
  CRISPR gRNA sequence
aggtttaagactgccctatt

SEQ ID NO: 563479 - DNA, 20 bp, Artificial
  CRISPR gRNA sequence
aagactgccctattggattt

SEQ ID NO: 563480 - DNA, 20 bp, Artificial
  CRISPR gRNA sequence
agactgccctattggattta

SEQ ID NO: 563481 - DNA, 20 bp, Artificial
  CRISPR gRNA sequence
ccctattggatttaggactt

SEQ ID NO: 563482 - DNA, 20 bp, Artificial
  CRISPR gRNA sequence
ttggatttaggacttgcatg

SEQ ID NO: 563483 - DNA, 20 bp, Artificial
  CRISPR gRNA sequence
gatttaggacttgcatgggg

SEQ ID NO: 563484 - DNA, 20 bp, Artificial
  CRISPR gRNA sequence
aggacttgcatggggcctgt

SEQ ID NO: 563485 - DNA, 20 bp, Artificial
  CRISPR gRNA sequence
ggacttgcatggggcctgta

SEQ ID NO: 563486 - DNA, 20 bp, Artificial
  CRISPR gRNA sequence
gcatggggcctgtagccctt

SEQ ID NO: 563487 - DNA, 20 bp, Artificial
  CRISPR gRNA sequence
catggggcctgtagcccttt

SEQ ID NO: 563488 - DNA, 20 bp, Artificial
  CRISPR gRNA sequence
tagcccttttgttttggaca

SEQ ID NO: 563489 - DNA, 20 bp, Artificial
  CRISPR gRNA sequence
ttgttttggacaatttctcc

SEQ ID NO: 563490 - DNA, 20 bp, Artificial
  CRISPR gRNA sequence
tgttttggacaatttctccc

SEQ ID NO: 563491 - DNA, 20 bp, Artificial
  CRISPR gRNA sequence
gttttggacaatttctccca

SEQ ID NO: 563492 - DNA, 20 bp, Artificial
  CRISPR gRNA sequence
ttttggacaatttctcccat

SEQ ID NO: 563493 - DNA, 20 bp, Artificial
  CRISPR gRNA sequence
tggacaatttctcccatttg

SEQ ID NO: 563494 - DNA, 20 bp, Artificial
  CRISPR gRNA sequence
ggacaatttctcccatttgg

SEQ ID NO: 563495 - DNA, 20 bp, Artificial
  CRISPR gRNA sequence
gacaatttctcccatttgga

SEQ ID NO: 563496 - DNA, 20 bp, Artificial
  CRISPR gRNA sequence
ctcccatttggaatggatat

SEQ ID NO: 563497 - DNA, 20 bp, Artificial
  CRISPR gRNA sequence
tcccatttggaatggatata

SEQ ID NO: 563498 - DNA, 20 bp, Artificial
  CRISPR gRNA sequence
ccatttggaatggatatatt

SEQ ID NO: 563499 - DNA, 20 bp, Artificial
  CRISPR gRNA sequence
ggaatggatatatttactca

SEQ ID NO: 563500 - DNA, 20 bp, Artificial
  CRISPR gRNA sequence
gaatggatatatttactcag

SEQ ID NO: 563501 - DNA, 20 bp, Artificial
  CRISPR gRNA sequence
actcagcacctgtaccccca

SEQ ID NO: 563502 - DNA, 20 bp, Artificial
  CRISPR gRNA sequence
ctcagcacctgtacccccat

SEQ ID NO: 563503 - DNA, 20 bp, Artificial
  CRISPR gRNA sequence
agcacctgtacccccattgt

SEQ ID NO: 563504 - DNA, 20 bp, Artificial
  CRISPR gRNA sequence
tacccccattgtatctagga

SEQ ID NO: 563505 - DNA, 20 bp, Artificial
  CRISPR gRNA sequence
tatctaggaagtaactaact

SEQ ID NO: 563506 - DNA, 20 bp, Artificial
  CRISPR gRNA sequence
ggaagtaactaacttgcctt

SEQ ID NO: 563507 - DNA, 20 bp, Artificial
  CRISPR gRNA sequence
acttgcctttgattttacag

SEQ ID NO: 563508 - DNA, 20 bp, Artificial
  CRISPR gRNA sequence
gcctttgattttacaggctc

SEQ ID NO: 563509 - DNA, 20 bp, Artificial
  CRISPR gRNA sequence
cctttgattttacaggctca

SEQ ID NO: 563510 - DNA, 20 bp, Artificial
  CRISPR gRNA sequence
tgattttacaggctcatagg

SEQ ID NO: 563511 - DNA, 20 bp, Artificial
  CRISPR gRNA sequence
gattttacaggctcataggt

SEQ ID NO: 563512 - DNA, 20 bp, Artificial
  CRISPR gRNA sequence
attttacaggctcataggtg

SEQ ID NO: 563513 - DNA, 20 bp, Artificial
  CRISPR gRNA sequence
tacaggctcataggtggaag

SEQ ID NO: 563514 - DNA, 20 bp, Artificial
  CRISPR gRNA sequence
acaggctcataggtggaagg

SEQ ID NO: 563515 - DNA, 20 bp, Artificial
  CRISPR gRNA sequence
caggctcataggtggaaggt

SEQ ID NO: 563516 - DNA, 20 bp, Artificial
  CRISPR gRNA sequence
ataggtggaaggtacttgcc

SEQ ID NO: 563517 - DNA, 20 bp, Artificial
  CRISPR gRNA sequence
gccttatctccgatgagact

SEQ ID NO: 563518 - DNA, 20 bp, Artificial
  CRISPR gRNA sequence
ccttatctccgatgagactt

SEQ ID NO: 563519 - DNA, 20 bp, Artificial
  CRISPR gRNA sequence
atctccgatgagactttgga

SEQ ID NO: 563520 - DNA, 20 bp, Artificial
  CRISPR gRNA sequence
tctccgatgagactttggat

SEQ ID NO: 563521 - DNA, 20 bp, Artificial
  CRISPR gRNA sequence
cgatgagactttggatttag

SEQ ID NO: 563522 - DNA, 20 bp, Artificial
  CRISPR gRNA sequence
tggatttagacttttggatt

SEQ ID NO: 563523 - DNA, 20 bp, Artificial
  CRISPR gRNA sequence
ggatttagacttttggatta

SEQ ID NO: 563524 - DNA, 20 bp, Artificial
  CRISPR gRNA sequence
gatttagacttttggattaa

SEQ ID NO: 563525 - DNA, 20 bp, Artificial
  CRISPR gRNA sequence
agacttttggattaatgctg

SEQ ID NO: 563526 - DNA, 20 bp, Artificial
  CRISPR gRNA sequence
gacttttggattaatgctgg

SEQ ID NO: 563527 - DNA, 20 bp, Artificial
  CRISPR gRNA sequence
ttggattaatgctggaataa

SEQ ID NO: 563528 - DNA, 20 bp, Artificial
  CRISPR gRNA sequence
tggattaatgctggaataag

SEQ ID NO: 563529 - DNA, 20 bp, Artificial
  CRISPR gRNA sequence
ggattaatgctggaataagt

SEQ ID NO: 563530 - DNA, 20 bp, Artificial
  CRISPR gRNA sequence
gattaatgctggaataagtt

SEQ ID NO: 563531 - DNA, 20 bp, Artificial
  CRISPR gRNA sequence
atgctggaataagttaagat

SEQ ID NO: 563532 - DNA, 20 bp, Artificial
  CRISPR gRNA sequence
gaataagttaagattttgag

SEQ ID NO: 563533 - DNA, 20 bp, Artificial
  CRISPR gRNA sequence
agattttgagggactgttgg

SEQ ID NO: 563534 - DNA, 20 bp, Artificial
  CRISPR gRNA sequence
tgagggactgttggaagggc

SEQ ID NO: 563535 - DNA, 20 bp, Artificial
  CRISPR gRNA sequence
gagggactgttggaagggca

SEQ ID NO: 563536 - DNA, 20 bp, Artificial
  CRISPR gRNA sequence
agggactgttggaagggcat

SEQ ID NO: 563537 - DNA, 20 bp, Artificial
  CRISPR gRNA sequence
ttggaagggcattattgtgt

SEQ ID NO: 563538 - DNA, 20 bp, Artificial
  CRISPR gRNA sequence
gaagggcattattgtgtttt

SEQ ID NO: 563539 - DNA, 20 bp, Artificial
  CRISPR gRNA sequence
ttgtgttttgaaatgtgagg

SEQ ID NO: 563540 - DNA, 20 bp, Artificial
  CRISPR gRNA sequence
tgttttgaaatgtgaggaca

SEQ ID NO: 563541 - DNA, 20 bp, Artificial
  CRISPR gRNA sequence
tgaaatgtgaggacatgaga

SEQ ID NO: 563542 - DNA, 20 bp, Artificial
  CRISPR gRNA sequence
gaaatgtgaggacatgagat

SEQ ID NO: 563543 - DNA, 20 bp, Artificial
  CRISPR gRNA sequence
aaatgtgaggacatgagatt

SEQ ID NO: 563544 - DNA, 20 bp, Artificial
  CRISPR gRNA sequence
gggaggggccggggtggaat

SEQ ID NO: 563545 - DNA, 20 bp, Artificial
  CRISPR gRNA sequence
ggaggggccggggtggaatg

SEQ ID NO: 563546 - DNA, 20 bp, Artificial
  CRISPR gRNA sequence
ggctgtgtccccacccaaat

SEQ ID NO: 563547 - DNA, 20 bp, Artificial
  CRISPR gRNA sequence
gctgtgtccccacccaaatc

SEQ ID NO: 563548 - DNA, 20 bp, Artificial
  CRISPR gRNA sequence
tgtccccacccaaatctcac

SEQ ID NO: 563549 - DNA, 20 bp, Artificial
  CRISPR gRNA sequence
accttgaattgtaataatcc

SEQ ID NO: 563550 - DNA, 20 bp, Artificial
  CRISPR gRNA sequence
gaattgtaataatccccgtg

SEQ ID NO: 563551 - DNA, 20 bp, Artificial
  CRISPR gRNA sequence
aattgtaataatccccgtgt

SEQ ID NO: 563552 - DNA, 20 bp, Artificial
  CRISPR gRNA sequence
taataatccccgtgtgtcaa

SEQ ID NO: 563553 - DNA, 20 bp, Artificial
  CRISPR gRNA sequence
aatcatgagggcagtttcct

SEQ ID NO: 563554 - DNA, 20 bp, Artificial
  CRISPR gRNA sequence
cctctatactgttcttgtga

SEQ ID NO: 563555 - DNA, 20 bp, Artificial
  CRISPR gRNA sequence
ctctatactgttcttgtgat

SEQ ID NO: 563556 - DNA, 20 bp, Artificial
  CRISPR gRNA sequence
tatactgttcttgtgatagt

SEQ ID NO: 563557 - DNA, 20 bp, Artificial
  CRISPR gRNA sequence
tactgttcttgtgatagtga

SEQ ID NO: 563558 - DNA, 20 bp, Artificial
  CRISPR gRNA sequence
ttcttgtgatagtgaataag

SEQ ID NO: 563559 - DNA, 20 bp, Artificial
  CRISPR gRNA sequence
ttgtgatagtgaataagtct

SEQ ID NO: 563560 - DNA, 20 bp, Artificial
  CRISPR gRNA sequence
gtgatagtgaataagtctca

SEQ ID NO: 563561 - DNA, 20 bp, Artificial
  CRISPR gRNA sequence
tgatagtgaataagtctcac

SEQ ID NO: 563562 - DNA, 20 bp, Artificial
  CRISPR gRNA sequence
acaagatctgatggtttcat

SEQ ID NO: 563563 - DNA, 20 bp, Artificial
  CRISPR gRNA sequence
atggtttcataaaggggagt

SEQ ID NO: 563564 - DNA, 20 bp, Artificial
  CRISPR gRNA sequence
cataaaggggagttcccctg

SEQ ID NO: 563565 - DNA, 20 bp, Artificial
  CRISPR gRNA sequence
ataaaggggagttcccctgc

SEQ ID NO: 563566 - DNA, 20 bp, Artificial
  CRISPR gRNA sequence
ccctgcacacgctctctctt

SEQ ID NO: 563567 - DNA, 20 bp, Artificial
  CRISPR gRNA sequence
cacacgctctctcttgcctg

SEQ ID NO: 563568 - DNA, 20 bp, Artificial
  CRISPR gRNA sequence
tctcttgcctgccaccatta

SEQ ID NO: 563569 - DNA, 20 bp, Artificial
  CRISPR gRNA sequence
tcttgcctgccaccattaag

SEQ ID NO: 563570 - DNA, 20 bp, Artificial
  CRISPR gRNA sequence
ttgcctgccaccattaagac

SEQ ID NO: 563571 - DNA, 20 bp, Artificial
  CRISPR gRNA sequence
gcctgccaccattaagacat

SEQ ID NO: 563572 - DNA, 20 bp, Artificial
  CRISPR gRNA sequence
cctgccaccattaagacatg

SEQ ID NO: 563573 - DNA, 20 bp, Artificial
  CRISPR gRNA sequence
ccaccattaagacatgactt

SEQ ID NO: 563574 - DNA, 20 bp, Artificial
  CRISPR gRNA sequence
agacatgactttgcttctcc

SEQ ID NO: 563575 - DNA, 20 bp, Artificial
  CRISPR gRNA sequence
tgcttctcctttgccttctg

SEQ ID NO: 563576 - DNA, 20 bp, Artificial
  CRISPR gRNA sequence
gcttctcctttgccttctgc

SEQ ID NO: 563577 - DNA, 20 bp, Artificial
  CRISPR gRNA sequence
cttctcctttgccttctgcc

SEQ ID NO: 563578 - DNA, 20 bp, Artificial
  CRISPR gRNA sequence
ctcctttgccttctgccatg

SEQ ID NO: 563579 - DNA, 20 bp, Artificial
  CRISPR gRNA sequence
tcctttgccttctgccatga

SEQ ID NO: 563580 - DNA, 20 bp, Artificial
  CRISPR gRNA sequence
ctttgccttctgccatgatt

SEQ ID NO: 563581 - DNA, 20 bp, Artificial
  CRISPR gRNA sequence
tgccttctgccatgattgtg

SEQ ID NO: 563582 - DNA, 20 bp, Artificial
  CRISPR gRNA sequence
gccttctgccatgattgtga

SEQ ID NO: 563583 - DNA, 20 bp, Artificial
  CRISPR gRNA sequence
ccttctgccatgattgtgag

SEQ ID NO: 563584 - DNA, 20 bp, Artificial
  CRISPR gRNA sequence
ctgccatgattgtgaggttt

SEQ ID NO: 563585 - DNA, 20 bp, Artificial
  CRISPR gRNA sequence
tgccatgattgtgaggtttc

SEQ ID NO: 563586 - DNA, 20 bp, Artificial
  CRISPR gRNA sequence
ccatgattgtgaggtttccc

SEQ ID NO: 563587 - DNA, 20 bp, Artificial
  CRISPR gRNA sequence
tgaggtttccctggccatgt

SEQ ID NO: 563588 - DNA, 20 bp, Artificial
  CRISPR gRNA sequence
ccctggccatgtggaactgt

SEQ ID NO: 563589 - DNA, 20 bp, Artificial
  CRISPR gRNA sequence
cctggccatgtggaactgtg

SEQ ID NO: 563590 - DNA, 20 bp, Artificial
  CRISPR gRNA sequence
gccatgtggaactgtgagtc

SEQ ID NO: 563591 - DNA, 20 bp, Artificial
  CRISPR gRNA sequence
tgagtccattgagcctcttt

SEQ ID NO: 563592 - DNA, 20 bp, Artificial
  CRISPR gRNA sequence
agcctctttccttgataaat

SEQ ID NO: 563593 - DNA, 20 bp, Artificial
  CRISPR gRNA sequence
tttccttgataaattaccca

SEQ ID NO: 563594 - DNA, 20 bp, Artificial
  CRISPR gRNA sequence
tccttgataaattacccagt

SEQ ID NO: 563595 - DNA, 20 bp, Artificial
  CRISPR gRNA sequence
ccttgataaattacccagtc

SEQ ID NO: 563596 - DNA, 20 bp, Artificial
  CRISPR gRNA sequence
cttgataaattacccagtct

SEQ ID NO: 563597 - DNA, 20 bp, Artificial
  CRISPR gRNA sequence
gataaattacccagtctcat

SEQ ID NO: 563598 - DNA, 20 bp, Artificial
  CRISPR gRNA sequence
ataaattacccagtctcatg

SEQ ID NO: 563599 - DNA, 20 bp, Artificial
  CRISPR gRNA sequence
cccagtctcatgtatgtcat

SEQ ID NO: 563600 - DNA, 20 bp, Artificial
  CRISPR gRNA sequence
atgtatgtcattattagcag

SEQ ID NO: 563601 - DNA, 20 bp, Artificial
  CRISPR gRNA sequence
ttagcagtgcgagaatggac

SEQ ID NO: 563602 - DNA, 20 bp, Artificial
  CRISPR gRNA sequence
gcagtgcgagaatggactaa

SEQ ID NO: 563603 - DNA, 20 bp, Artificial
  CRISPR gRNA sequence
atacaccccatctctacaaa

SEQ ID NO: 563604 - DNA, 20 bp, Artificial
  CRISPR gRNA sequence
tacaaaaagttagccaggtg

SEQ ID NO: 563605 - DNA, 20 bp, Artificial
  CRISPR gRNA sequence
caaaaagttagccaggtgtg

SEQ ID NO: 563606 - DNA, 20 bp, Artificial
  CRISPR gRNA sequence
gccaggtgtggtggtgcacg

SEQ ID NO: 563607 - DNA, 20 bp, Artificial
  CRISPR gRNA sequence
tagtcccagctactcaggag

SEQ ID NO: 563608 - DNA, 20 bp, Artificial
  CRISPR gRNA sequence
ctcaggaggctgagatgagc

SEQ ID NO: 563609 - DNA, 20 bp, Artificial
  CRISPR gRNA sequence
aggaggctgagatgagcctg

SEQ ID NO: 563610 - DNA, 20 bp, Artificial
  CRISPR gRNA sequence
agatgagcctggcaattgct

SEQ ID NO: 563611 - DNA, 20 bp, Artificial
  CRISPR gRNA sequence
gcaattgcttgagtctggga

SEQ ID NO: 563612 - DNA, 20 bp, Artificial
  CRISPR gRNA sequence
cttgagtctgggaatttgag

SEQ ID NO: 563613 - DNA, 20 bp, Artificial
  CRISPR gRNA sequence
gagtctgggaatttgaggct

SEQ ID NO: 563614 - DNA, 20 bp, Artificial
  CRISPR gRNA sequence
agtctgggaatttgaggctg

SEQ ID NO: 563615 - DNA, 20 bp, Artificial
  CRISPR gRNA sequence
ggaatttgaggctgcagtga

SEQ ID NO: 563616 - DNA, 20 bp, Artificial
  CRISPR gRNA sequence
gaggctgcagtgagccatga

SEQ ID NO: 563617 - DNA, 20 bp, Artificial
  CRISPR gRNA sequence
aggctgcagtgagccatgat

SEQ ID NO: 563618 - DNA, 20 bp, Artificial
  CRISPR gRNA sequence
cagtgagccatgatgacaca

SEQ ID NO: 563619 - DNA, 20 bp, Artificial
  CRISPR gRNA sequence
cattccagcctgggtaacag

SEQ ID NO: 563620 - DNA, 20 bp, Artificial
  CRISPR gRNA sequence
cagcctgggtaacagagcaa

SEQ ID NO: 563621 - DNA, 20 bp, Artificial
  CRISPR gRNA sequence
ggtaacagagcaaaaaaata

SEQ ID NO: 563622 - DNA, 20 bp, Artificial
  CRISPR gRNA sequence
ttttattattaacagagtct

SEQ ID NO: 563623 - DNA, 20 bp, Artificial
  CRISPR gRNA sequence
tattattaacagagtctgtc

SEQ ID NO: 563624 - DNA, 20 bp, Artificial
  CRISPR gRNA sequence
attattaacagagtctgtct

SEQ ID NO: 563625 - DNA, 20 bp, Artificial
  CRISPR gRNA sequence
ttattaacagagtctgtctt

SEQ ID NO: 563626 - DNA, 20 bp, Artificial
  CRISPR gRNA sequence
ttaacagagtctgtcttatt

SEQ ID NO: 563627 - DNA, 20 bp, Artificial
  CRISPR gRNA sequence
acagagtctgtcttattctg

SEQ ID NO: 563628 - DNA, 20 bp, Artificial
  CRISPR gRNA sequence
tcttattctgctgttgttga

SEQ ID NO: 563629 - DNA, 20 bp, Artificial
  CRISPR gRNA sequence
attctgctgttgttgacatt

SEQ ID NO: 563630 - DNA, 20 bp, Artificial
  CRISPR gRNA sequence
ttctgctgttgttgacattt

SEQ ID NO: 563631 - DNA, 20 bp, Artificial
  CRISPR gRNA sequence
tgctgttgttgacattttac

SEQ ID NO: 563632 - DNA, 20 bp, Artificial
  CRISPR gRNA sequence
ctgttgttgacattttacag

SEQ ID NO: 563633 - DNA, 20 bp, Artificial
  CRISPR gRNA sequence
ttgttgacattttacagatc

SEQ ID NO: 563634 - DNA, 20 bp, Artificial
  CRISPR gRNA sequence
ttgacattttacagatcctt

SEQ ID NO: 563635 - DNA, 20 bp, Artificial
  CRISPR gRNA sequence
acattttacagatcctttat

SEQ ID NO: 563636 - DNA, 20 bp, Artificial
  CRISPR gRNA sequence
tacagatcctttattgccaa

SEQ ID NO: 563637 - DNA, 20 bp, Artificial
  CRISPR gRNA sequence
acagatcctttattgccaac

SEQ ID NO: 563638 - DNA, 20 bp, Artificial
  CRISPR gRNA sequence
cagatcctttattgccaact

SEQ ID NO: 563639 - DNA, 20 bp, Artificial
  CRISPR gRNA sequence
tattgccaactatctgcata

SEQ ID NO: 563640 - DNA, 20 bp, Artificial
  CRISPR gRNA sequence
attgccaactatctgcataa

SEQ ID NO: 563641 - DNA, 20 bp, Artificial
  CRISPR gRNA sequence
ttgccaactatctgcataac

SEQ ID NO: 563642 - DNA, 20 bp, Artificial
  CRISPR gRNA sequence
ccaactatctgcataactag

SEQ ID NO: 563643 - DNA, 20 bp, Artificial
  CRISPR gRNA sequence
tctgcataactagattttaa

SEQ ID NO: 563644 - DNA, 20 bp, Artificial
  CRISPR gRNA sequence
cataactagattttaagttc

SEQ ID NO: 563645 - DNA, 20 bp, Artificial
  CRISPR gRNA sequence
gattttaagttccttgtatg

SEQ ID NO: 563646 - DNA, 20 bp, Artificial
  CRISPR gRNA sequence
taagttccttgtatgcagaa

SEQ ID NO: 563647 - DNA, 20 bp, Artificial
  CRISPR gRNA sequence
aagttccttgtatgcagaag

SEQ ID NO: 563648 - DNA, 20 bp, Artificial
  CRISPR gRNA sequence
agttccttgtatgcagaagt

SEQ ID NO: 563649 - DNA, 20 bp, Artificial
  CRISPR gRNA sequence
cttgtatgcagaagtcatgt

SEQ ID NO: 563650 - DNA, 20 bp, Artificial
  CRISPR gRNA sequence
gtatgcagaagtcatgtatt

SEQ ID NO: 563651 - DNA, 20 bp, Artificial
  CRISPR gRNA sequence
tatgcagaagtcatgtatta

SEQ ID NO: 563652 - DNA, 20 bp, Artificial
  CRISPR gRNA sequence
ttttttaaaattttccttat

SEQ ID NO: 563653 - DNA, 20 bp, Artificial
  CRISPR gRNA sequence
tttaaaattttccttatatt

SEQ ID NO: 563654 - DNA, 20 bp, Artificial
  CRISPR gRNA sequence
ttaaaattttccttatattg

SEQ ID NO: 563655 - DNA, 20 bp, Artificial
  CRISPR gRNA sequence
taaaattttccttatattga

SEQ ID NO: 563656 - DNA, 20 bp, Artificial
  CRISPR gRNA sequence
aaaattttccttatattgat

SEQ ID NO: 563657 - DNA, 20 bp, Artificial
  CRISPR gRNA sequence
aaattttccttatattgatc

SEQ ID NO: 563658 - DNA, 20 bp, Artificial
  CRISPR gRNA sequence
tccttatattgatctgtttt

SEQ ID NO: 563659 - DNA, 20 bp, Artificial
  CRISPR gRNA sequence
ccttatattgatctgttttt

SEQ ID NO: 563660 - DNA, 20 bp, Artificial
  CRISPR gRNA sequence
cttatattgatctgtttttt

SEQ ID NO: 563661 - DNA, 20 bp, Artificial
  CRISPR gRNA sequence
atattgatctgttttttttt

SEQ ID NO: 563662 - DNA, 20 bp, Artificial
  CRISPR gRNA sequence
tattgatctgttttttttta

SEQ ID NO: 563663 - DNA, 20 bp, Artificial
  CRISPR gRNA sequence
atctgtttttttttaatagt

SEQ ID NO: 563664 - DNA, 20 bp, Artificial
  CRISPR gRNA sequence
tttttttttaatagtaaaga

SEQ ID NO: 563665 - DNA, 20 bp, Artificial
  CRISPR gRNA sequence
ttttttaatagtaaagattg

SEQ ID NO: 563666 - DNA, 20 bp, Artificial
  CRISPR gRNA sequence
tttttaatagtaaagattgt

SEQ ID NO: 563667 - DNA, 20 bp, Artificial
  CRISPR gRNA sequence
ttttaatagtaaagattgtt

SEQ ID NO: 563668 - DNA, 20 bp, Artificial
  CRISPR gRNA sequence
tttaatagtaaagattgttg

SEQ ID NO: 563669 - DNA, 20 bp, Artificial
  CRISPR gRNA sequence
ttaatagtaaagattgttga

SEQ ID NO: 563670 - DNA, 20 bp, Artificial
  CRISPR gRNA sequence
taatagtaaagattgttgaa

SEQ ID NO: 563671 - DNA, 20 bp, Artificial
  CRISPR gRNA sequence
aatagtaaagattgttgaat

SEQ ID NO: 563672 - DNA, 20 bp, Artificial
  CRISPR gRNA sequence
atagtaaagattgttgaatc

SEQ ID NO: 563673 - DNA, 20 bp, Artificial
  CRISPR gRNA sequence
ttgaatctgaacattagatg

SEQ ID NO: 563674 - DNA, 20 bp, Artificial
  CRISPR gRNA sequence
aatctgaacattagatgaca

SEQ ID NO: 563675 - DNA, 20 bp, Artificial
  CRISPR gRNA sequence
aacattagatgacaatgtat

SEQ ID NO: 563676 - DNA, 20 bp, Artificial
  CRISPR gRNA sequence
gatgacaatgtatttgtcca

SEQ ID NO: 563677 - DNA, 20 bp, Artificial
  CRISPR gRNA sequence
gtccagcatttctccatttg

SEQ ID NO: 563678 - DNA, 20 bp, Artificial
  CRISPR gRNA sequence
tccagcatttctccatttga

SEQ ID NO: 563679 - DNA, 20 bp, Artificial
  CRISPR gRNA sequence
ctccatttgaaattatctca

SEQ ID NO: 563680 - DNA, 20 bp, Artificial
  CRISPR gRNA sequence
tccatttgaaattatctcac

SEQ ID NO: 563681 - DNA, 20 bp, Artificial
  CRISPR gRNA sequence
catttgaaattatctcacat

SEQ ID NO: 563682 - DNA, 20 bp, Artificial
  CRISPR gRNA sequence
gaaattatctcacattatta

SEQ ID NO: 563683 - DNA, 20 bp, Artificial
  CRISPR gRNA sequence
aaattatctcacattattat

SEQ ID NO: 563684 - DNA, 20 bp, Artificial
  CRISPR gRNA sequence
tctcacattattatgtgaga

SEQ ID NO: 563685 - DNA, 20 bp, Artificial
  CRISPR gRNA sequence
acattattatgtgagacttg

SEQ ID NO: 563686 - DNA, 20 bp, Artificial
  CRISPR gRNA sequence
ttatgtgagacttgttcatg

SEQ ID NO: 563687 - DNA, 20 bp, Artificial
  CRISPR gRNA sequence
tgtgagacttgttcatgtgc

SEQ ID NO: 563688 - DNA, 20 bp, Artificial
  CRISPR gRNA sequence
gttcatgtgctttgctggag

SEQ ID NO: 563689 - DNA, 20 bp, Artificial
  CRISPR gRNA sequence
ttcatgtgctttgctggagt

SEQ ID NO: 563690 - DNA, 20 bp, Artificial
  CRISPR gRNA sequence
atgtgctttgctggagttga

SEQ ID NO: 563691 - DNA, 20 bp, Artificial
  CRISPR gRNA sequence
tgctggagttgagacttaga

SEQ ID NO: 563692 - DNA, 20 bp, Artificial
  CRISPR gRNA sequence
gctggagttgagacttagac

SEQ ID NO: 563693 - DNA, 20 bp, Artificial
  CRISPR gRNA sequence
ctggagttgagacttagaca

SEQ ID NO: 563694 - DNA, 20 bp, Artificial
  CRISPR gRNA sequence
gagttgagacttagacagtc

SEQ ID NO: 563695 - DNA, 20 bp, Artificial
  CRISPR gRNA sequence
agacttagacagtctgtgtt

SEQ ID NO: 563696 - DNA, 20 bp, Artificial
  CRISPR gRNA sequence
agacagtctgtgttttttta

SEQ ID NO: 563697 - DNA, 20 bp, Artificial
  CRISPR gRNA sequence
gacagtctgtgtttttttat

SEQ ID NO: 563698 - DNA, 20 bp, Artificial
  CRISPR gRNA sequence
tgtttttttatttagcaaag

SEQ ID NO: 563699 - DNA, 20 bp, Artificial
  CRISPR gRNA sequence
ttttatttagcaaagataat

SEQ ID NO: 563700 - DNA, 20 bp, Artificial
  CRISPR gRNA sequence
tttatttagcaaagataatc

SEQ ID NO: 563701 - DNA, 20 bp, Artificial
  CRISPR gRNA sequence
ttatttagcaaagataatcc

SEQ ID NO: 563702 - DNA, 20 bp, Artificial
  CRISPR gRNA sequence
tatttagcaaagataatcca

SEQ ID NO: 563703 - DNA, 20 bp, Artificial
  CRISPR gRNA sequence
atttagcaaagataatccaa

SEQ ID NO: 563704 - DNA, 20 bp, Artificial
  CRISPR gRNA sequence
tttagcaaagataatccaag

SEQ ID NO: 563705 - DNA, 20 bp, Artificial
  CRISPR gRNA sequence
agcaaagataatccaagtta

SEQ ID NO: 563706 - DNA, 20 bp, Artificial
  CRISPR gRNA sequence
gcaaagataatccaagttaa

SEQ ID NO: 563707 - DNA, 20 bp, Artificial
  CRISPR gRNA sequence
aaatagtgttgtgtgttcct

SEQ ID NO: 563708 - DNA, 20 bp, Artificial
  CRISPR gRNA sequence
tgtgttcctataggaaaact

SEQ ID NO: 563709 - DNA, 20 bp, Artificial
  CRISPR gRNA sequence
ctataggaaaactaggccca

SEQ ID NO: 563710 - DNA, 20 bp, Artificial
  CRISPR gRNA sequence
taggaaaactaggcccagtg

SEQ ID NO: 563711 - DNA, 20 bp, Artificial
  CRISPR gRNA sequence
ggcccagtgttataacagag

SEQ ID NO: 563712 - DNA, 20 bp, Artificial
  CRISPR gRNA sequence
taacagagtgtaagtaataa

SEQ ID NO: 563713 - DNA, 20 bp, Artificial
  CRISPR gRNA sequence
ggaggtaagtacctgctctg

SEQ ID NO: 563714 - DNA, 20 bp, Artificial
  CRISPR gRNA sequence
ctctgtgccaggagctatgc

SEQ ID NO: 563715 - DNA, 20 bp, Artificial
  CRISPR gRNA sequence
tgtgccaggagctatgcttc

SEQ ID NO: 563716 - DNA, 20 bp, Artificial
  CRISPR gRNA sequence
tgccaggagctatgcttcag

SEQ ID NO: 563717 - DNA, 20 bp, Artificial
  CRISPR gRNA sequence
tgcttcagatttgagatgtt

SEQ ID NO: 563718 - DNA, 20 bp, Artificial
  CRISPR gRNA sequence
cagatttgagatgtttttat

SEQ ID NO: 563719 - DNA, 20 bp, Artificial
  CRISPR gRNA sequence
agatttgagatgtttttatt

SEQ ID NO: 563720 - DNA, 20 bp, Artificial
  CRISPR gRNA sequence
gagatgtttttatttaattg

SEQ ID NO: 563721 - DNA, 20 bp, Artificial
  CRISPR gRNA sequence
agatgtttttatttaattgt

SEQ ID NO: 563722 - DNA, 20 bp, Artificial
  CRISPR gRNA sequence
ttatttaattgtcacactga

SEQ ID NO: 563723 - DNA, 20 bp, Artificial
  CRISPR gRNA sequence
tatttaattgtcacactgat

SEQ ID NO: 563724 - DNA, 20 bp, Artificial
  CRISPR gRNA sequence
atttaattgtcacactgatt

SEQ ID NO: 563725 - DNA, 20 bp, Artificial
  CRISPR gRNA sequence
tttaattgtcacactgattt

SEQ ID NO: 563726 - DNA, 20 bp, Artificial
  CRISPR gRNA sequence
aattgtcacactgattttat

SEQ ID NO: 563727 - DNA, 20 bp, Artificial
  CRISPR gRNA sequence
attgtcacactgattttatt

SEQ ID NO: 563728 - DNA, 20 bp, Artificial
  CRISPR gRNA sequence
tcacactgattttattacat

SEQ ID NO: 563729 - DNA, 20 bp, Artificial
  CRISPR gRNA sequence
attttattacatagggaaca

SEQ ID NO: 563730 - DNA, 20 bp, Artificial
  CRISPR gRNA sequence
tattacatagggaacattta

SEQ ID NO: 563731 - DNA, 20 bp, Artificial
  CRISPR gRNA sequence
attacatagggaacatttaa

SEQ ID NO: 563732 - DNA, 20 bp, Artificial
  CRISPR gRNA sequence
ttacatagggaacatttaat

SEQ ID NO: 563733 - DNA, 20 bp, Artificial
  CRISPR gRNA sequence
catagggaacatttaatagg

SEQ ID NO: 563734 - DNA, 20 bp, Artificial
  CRISPR gRNA sequence
aataggagaacaaagcttag

SEQ ID NO: 563735 - DNA, 20 bp, Artificial
  CRISPR gRNA sequence
ataggagaacaaagcttagg

SEQ ID NO: 563736 - DNA, 20 bp, Artificial
  CRISPR gRNA sequence
aggtaggttcagtaatgtgt

SEQ ID NO: 563737 - DNA, 20 bp, Artificial
  CRISPR gRNA sequence
ggtaggttcagtaatgtgtc

SEQ ID NO: 563738 - DNA, 20 bp, Artificial
  CRISPR gRNA sequence
agtaatgtgtccaagttcac

SEQ ID NO: 563739 - DNA, 20 bp, Artificial
  CRISPR gRNA sequence
acacagcaaataagtggcag

SEQ ID NO: 563740 - DNA, 20 bp, Artificial
  CRISPR gRNA sequence
gaactttgattctctctgaa

SEQ ID NO: 563741 - DNA, 20 bp, Artificial
  CRISPR gRNA sequence
aactttgattctctctgaat

SEQ ID NO: 563742 - DNA, 20 bp, Artificial
  CRISPR gRNA sequence
tgattctctctgaatcagaa

SEQ ID NO: 563743 - DNA, 20 bp, Artificial
  CRISPR gRNA sequence
gattctctctgaatcagaac

SEQ ID NO: 563744 - DNA, 20 bp, Artificial
  CRISPR gRNA sequence
attctctctgaatcagaacc

SEQ ID NO: 563745 - DNA, 20 bp, Artificial
  CRISPR gRNA sequence
tctctgaatcagaacctatt

SEQ ID NO: 563746 - DNA, 20 bp, Artificial
  CRISPR gRNA sequence
tctgaatcagaacctattcc

SEQ ID NO: 563747 - DNA, 20 bp, Artificial
  CRISPR gRNA sequence
tgaatcagaacctattcctt

SEQ ID NO: 563748 - DNA, 20 bp, Artificial
  CRISPR gRNA sequence
aatcagaacctattccttta

SEQ ID NO: 563749 - DNA, 20 bp, Artificial
  CRISPR gRNA sequence
ttcctttatatgctctgttg

SEQ ID NO: 563750 - DNA, 20 bp, Artificial
  CRISPR gRNA sequence
ctttatatgctctgttgtat

SEQ ID NO: 563751 - DNA, 20 bp, Artificial
  CRISPR gRNA sequence
tatatgctctgttgtatccc

SEQ ID NO: 563752 - DNA, 20 bp, Artificial
  CRISPR gRNA sequence
atatgctctgttgtatccct

SEQ ID NO: 563753 - DNA, 20 bp, Artificial
  CRISPR gRNA sequence
tatgctctgttgtatcccta

SEQ ID NO: 563754 - DNA, 20 bp, Artificial
  CRISPR gRNA sequence
tgttgtatccctagcctgag

SEQ ID NO: 563755 - DNA, 20 bp, Artificial
  CRISPR gRNA sequence
ttgtatccctagcctgagat

SEQ ID NO: 563756 - DNA, 20 bp, Artificial
  CRISPR gRNA sequence
tatccctagcctgagatcca

SEQ ID NO: 563757 - DNA, 20 bp, Artificial
  CRISPR gRNA sequence
gcctgagatccactaagcaa

SEQ ID NO: 563758 - DNA, 20 bp, Artificial
  CRISPR gRNA sequence
agatccactaagcaactttt

SEQ ID NO: 563759 - DNA, 20 bp, Artificial
  CRISPR gRNA sequence
agcaactttttgaagatgag

SEQ ID NO: 563760 - DNA, 20 bp, Artificial
  CRISPR gRNA sequence
tttgaagatgagtactactg

SEQ ID NO: 563761 - DNA, 20 bp, Artificial
  CRISPR gRNA sequence
ttgaagatgagtactactga

SEQ ID NO: 563762 - DNA, 20 bp, Artificial
  CRISPR gRNA sequence
tgaagatgagtactactgat

SEQ ID NO: 563763 - DNA, 20 bp, Artificial
  CRISPR gRNA sequence
gaagatgagtactactgatt

SEQ ID NO: 563764 - DNA, 20 bp, Artificial
  CRISPR gRNA sequence
aagatgagtactactgattt

SEQ ID NO: 563765 - DNA, 20 bp, Artificial
  CRISPR gRNA sequence
ctgatttcttatatccaaca

SEQ ID NO: 563766 - DNA, 20 bp, Artificial
  CRISPR gRNA sequence
atttcttatatccaacatgt

SEQ ID NO: 563767 - DNA, 20 bp, Artificial
  CRISPR gRNA sequence
cttatatccaacatgtatac

SEQ ID NO: 563768 - DNA, 20 bp, Artificial
  CRISPR gRNA sequence
ttatatccaacatgtataca

SEQ ID NO: 563769 - DNA, 20 bp, Artificial
  CRISPR gRNA sequence
atatccaacatgtatacatt

SEQ ID NO: 563770 - DNA, 20 bp, Artificial
  CRISPR gRNA sequence
tatccaacatgtatacattg

SEQ ID NO: 563771 - DNA, 20 bp, Artificial
  CRISPR gRNA sequence
tccaatgaaattctgctaaa

SEQ ID NO: 563772 - DNA, 20 bp, Artificial
  CRISPR gRNA sequence
tgctaaaacatgggaaatat

SEQ ID NO: 563773 - DNA, 20 bp, Artificial
  CRISPR gRNA sequence
ctaaaacatgggaaatatag

SEQ ID NO: 563774 - DNA, 20 bp, Artificial
  CRISPR gRNA sequence
aaacatgggaaatataggtc

SEQ ID NO: 563775 - DNA, 20 bp, Artificial
  CRISPR gRNA sequence
ccagtcatgcaaaattgtat

SEQ ID NO: 563776 - DNA, 20 bp, Artificial
  CRISPR gRNA sequence
tatttaatatcataatttgt

SEQ ID NO: 563777 - DNA, 20 bp, Artificial
  CRISPR gRNA sequence
aatatcataatttgtaatgg

SEQ ID NO: 563778 - DNA, 20 bp, Artificial
  CRISPR gRNA sequence
atatcataatttgtaatggt

SEQ ID NO: 563779 - DNA, 20 bp, Artificial
  CRISPR gRNA sequence
gtaatggtgaggggtgcttc

SEQ ID NO: 563780 - DNA, 20 bp, Artificial
  CRISPR gRNA sequence
taatggtgaggggtgcttct

SEQ ID NO: 563781 - DNA, 20 bp, Artificial
  CRISPR gRNA sequence
ctttgggacatagaatttac

SEQ ID NO: 563782 - DNA, 20 bp, Artificial
  CRISPR gRNA sequence
tttgggacatagaatttaca

SEQ ID NO: 563783 - DNA, 20 bp, Artificial
  CRISPR gRNA sequence
tgggacatagaatttacaat

SEQ ID NO: 563784 - DNA, 20 bp, Artificial
  CRISPR gRNA sequence
gggacatagaatttacaatg

SEQ ID NO: 563785 - DNA, 20 bp, Artificial
  CRISPR gRNA sequence
ggacatagaatttacaatgg

SEQ ID NO: 563786 - DNA, 20 bp, Artificial
  CRISPR gRNA sequence
acaatggcaatttattgaca

SEQ ID NO: 563787 - DNA, 20 bp, Artificial
  CRISPR gRNA sequence
caatggcaatttattgacat

SEQ ID NO: 563788 - DNA, 20 bp, Artificial
  CRISPR gRNA sequence
attgacatatttattattaa

SEQ ID NO: 563789 - DNA, 20 bp, Artificial
  CRISPR gRNA sequence
ttgacatatttattattaac

SEQ ID NO: 563790 - DNA, 20 bp, Artificial
  CRISPR gRNA sequence
acatatttattattaacatt

SEQ ID NO: 563791 - DNA, 20 bp, Artificial
  CRISPR gRNA sequence
attattaacattattatatt

SEQ ID NO: 563792 - DNA, 20 bp, Artificial
  CRISPR gRNA sequence
ttattaacattattatattt

SEQ ID NO: 563793 - DNA, 20 bp, Artificial
  CRISPR gRNA sequence
ttaacattattatatttaca

SEQ ID NO: 563794 - DNA, 20 bp, Artificial
  CRISPR gRNA sequence
acattattatatttacattc

SEQ ID NO: 563795 - DNA, 20 bp, Artificial
  CRISPR gRNA sequence
ttatatttacattctctagg

SEQ ID NO: 563796 - DNA, 20 bp, Artificial
  CRISPR gRNA sequence
tatttacattctctaggtac

SEQ ID NO: 563797 - DNA, 20 bp, Artificial
  CRISPR gRNA sequence
acattctctaggtacccaca

SEQ ID NO: 563798 - DNA, 20 bp, Artificial
  CRISPR gRNA sequence
cattctctaggtacccacat

SEQ ID NO: 563799 - DNA, 20 bp, Artificial
  CRISPR gRNA sequence
tctaggtacccacatttcac

SEQ ID NO: 563800 - DNA, 20 bp, Artificial
  CRISPR gRNA sequence
taggtacccacatttcactc

SEQ ID NO: 563801 - DNA, 20 bp, Artificial
  CRISPR gRNA sequence
ggtacccacatttcactcct

SEQ ID NO: 563802 - DNA, 20 bp, Artificial
  CRISPR gRNA sequence
cactcctagacacttttgca

SEQ ID NO: 563803 - DNA, 20 bp, Artificial
  CRISPR gRNA sequence
actcctagacacttttgcat

SEQ ID NO: 563804 - DNA, 20 bp, Artificial
  CRISPR gRNA sequence
ctagacacttttgcataatc

SEQ ID NO: 563805 - DNA, 20 bp, Artificial
  CRISPR gRNA sequence
gacacttttgcataatctca

SEQ ID NO: 563806 - DNA, 20 bp, Artificial
  CRISPR gRNA sequence
ttgcataatctcaataacat

SEQ ID NO: 563807 - DNA, 20 bp, Artificial
  CRISPR gRNA sequence
tgcataatctcaataacatc

SEQ ID NO: 563808 - DNA, 20 bp, Artificial
  CRISPR gRNA sequence
gcataatctcaataacatca

SEQ ID NO: 563809 - DNA, 20 bp, Artificial
  CRISPR gRNA sequence
cataatctcaataacatcat

SEQ ID NO: 563810 - DNA, 20 bp, Artificial
  CRISPR gRNA sequence
aataacatcataacatctat

SEQ ID NO: 563811 - DNA, 20 bp, Artificial
  CRISPR gRNA sequence
taaatattaacactaatcct

SEQ ID NO: 563812 - DNA, 20 bp, Artificial
  CRISPR gRNA sequence
acactaatcctgtaacatca

SEQ ID NO: 563813 - DNA, 20 bp, Artificial
  CRISPR gRNA sequence
atcctgtaacatcacctaac

SEQ ID NO: 563814 - DNA, 20 bp, Artificial
  CRISPR gRNA sequence
taacatcacctaacttttac

SEQ ID NO: 563815 - DNA, 20 bp, Artificial
  CRISPR gRNA sequence
acttttacccgtattcagat

SEQ ID NO: 563816 - DNA, 20 bp, Artificial
  CRISPR gRNA sequence
ttacccgtattcagatttcc

SEQ ID NO: 563817 - DNA, 20 bp, Artificial
  CRISPR gRNA sequence
tacccgtattcagatttccc

SEQ ID NO: 563818 - DNA, 20 bp, Artificial
  CRISPR gRNA sequence
acccgtattcagatttcccc

SEQ ID NO: 563819 - DNA, 20 bp, Artificial
  CRISPR gRNA sequence
cccgtattcagatttcccca

SEQ ID NO: 563820 - DNA, 20 bp, Artificial
  CRISPR gRNA sequence
agatttccccacttgtcaca

SEQ ID NO: 563821 - DNA, 20 bp, Artificial
  CRISPR gRNA sequence
ccccacttgtcacaagagtg

SEQ ID NO: 563822 - DNA, 20 bp, Artificial
  CRISPR gRNA sequence
cccacttgtcacaagagtgt

SEQ ID NO: 563823 - DNA, 20 bp, Artificial
  CRISPR gRNA sequence
gtcacaagagtgtcttttgt

SEQ ID NO: 563824 - DNA, 20 bp, Artificial
  CRISPR gRNA sequence
tcacaagagtgtcttttgtt

SEQ ID NO: 563825 - DNA, 20 bp, Artificial
  CRISPR gRNA sequence
ttgttaaaaaacccggatct

SEQ ID NO: 563826 - DNA, 20 bp, Artificial
  CRISPR gRNA sequence
tgttaaaaaacccggatcta

SEQ ID NO: 563827 - DNA, 20 bp, Artificial
  CRISPR gRNA sequence
gttaaaaaacccggatctaa

SEQ ID NO: 563828 - DNA, 20 bp, Artificial
  CRISPR gRNA sequence
ttaaaaaacccggatctaat

SEQ ID NO: 563829 - DNA, 20 bp, Artificial
  CRISPR gRNA sequence
aaaaacccggatctaatcaa

SEQ ID NO: 563830 - DNA, 20 bp, Artificial
  CRISPR gRNA sequence
atcaagtttcactcattgta

SEQ ID NO: 563831 - DNA, 20 bp, Artificial
  CRISPR gRNA sequence
cactcattgtattcgttgct

SEQ ID NO: 563832 - DNA, 20 bp, Artificial
  CRISPR gRNA sequence
actcattgtattcgttgcta

SEQ ID NO: 563833 - DNA, 20 bp, Artificial
  CRISPR gRNA sequence
attgtattcgttgctatgtt

SEQ ID NO: 563834 - DNA, 20 bp, Artificial
  CRISPR gRNA sequence
tattcgttgctatgtttttt

SEQ ID NO: 563835 - DNA, 20 bp, Artificial
  CRISPR gRNA sequence
gttgctatgtttttttgttt

SEQ ID NO: 563836 - DNA, 20 bp, Artificial
  CRISPR gRNA sequence
ctatgtttttttgttttaat

SEQ ID NO: 563837 - DNA, 20 bp, Artificial
  CRISPR gRNA sequence
tgtttttttgttttaatttt

SEQ ID NO: 563838 - DNA, 20 bp, Artificial
  CRISPR gRNA sequence
ttttgttttaattttgatgg

SEQ ID NO: 563839 - DNA, 20 bp, Artificial
  CRISPR gRNA sequence
tttgttttaattttgatggg

SEQ ID NO: 563840 - DNA, 20 bp, Artificial
  CRISPR gRNA sequence
ttgttttaattttgatgggc

SEQ ID NO: 563841 - DNA, 20 bp, Artificial
  CRISPR gRNA sequence
tgttttaattttgatgggca

SEQ ID NO: 563842 - DNA, 20 bp, Artificial
  CRISPR gRNA sequence
gttttaattttgatgggcat

SEQ ID NO: 563843 - DNA, 20 bp, Artificial
  CRISPR gRNA sequence
ttttaattttgatgggcatc

SEQ ID NO: 563844 - DNA, 20 bp, Artificial
  CRISPR gRNA sequence
taattttgatgggcatcttt

SEQ ID NO: 563845 - DNA, 20 bp, Artificial
  CRISPR gRNA sequence
aattttgatgggcatctttc

SEQ ID NO: 563846 - DNA, 20 bp, Artificial
  CRISPR gRNA sequence
attttgatgggcatctttca

SEQ ID NO: 563847 - DNA, 20 bp, Artificial
  CRISPR gRNA sequence
tgatgggcatctttcagaag

SEQ ID NO: 563848 - DNA, 20 bp, Artificial
  CRISPR gRNA sequence
gatgggcatctttcagaagt

SEQ ID NO: 563849 - DNA, 20 bp, Artificial
  CRISPR gRNA sequence
atgggcatctttcagaagtt

SEQ ID NO: 563850 - DNA, 20 bp, Artificial
  CRISPR gRNA sequence
tcagaagttttaaaatagtc

SEQ ID NO: 563851 - DNA, 20 bp, Artificial
  CRISPR gRNA sequence
cagaagttttaaaatagtct

SEQ ID NO: 563852 - DNA, 20 bp, Artificial
  CRISPR gRNA sequence
agaagttttaaaatagtctt

SEQ ID NO: 563853 - DNA, 20 bp, Artificial
  CRISPR gRNA sequence
taaaatagtcttagaacctc

SEQ ID NO: 563854 - DNA, 20 bp, Artificial
  CRISPR gRNA sequence
aaaatagtcttagaacctct

SEQ ID NO: 563855 - DNA, 20 bp, Artificial
  CRISPR gRNA sequence
aaatagtcttagaacctctt

SEQ ID NO: 563856 - DNA, 20 bp, Artificial
  CRISPR gRNA sequence
agaacctctttttaagaacc

SEQ ID NO: 563857 - DNA, 20 bp, Artificial
  CRISPR gRNA sequence
gaacctctttttaagaacca

SEQ ID NO: 563858 - DNA, 20 bp, Artificial
  CRISPR gRNA sequence
tttttaagaaccagatttga

SEQ ID NO: 563859 - DNA, 20 bp, Artificial
  CRISPR gRNA sequence
tttaagaaccagatttgaat

SEQ ID NO: 563860 - DNA, 20 bp, Artificial
  CRISPR gRNA sequence
ttaagaaccagatttgaata

SEQ ID NO: 563861 - DNA, 20 bp, Artificial
  CRISPR gRNA sequence
taagaaccagatttgaataa

SEQ ID NO: 563862 - DNA, 20 bp, Artificial
  CRISPR gRNA sequence
aagaaccagatttgaataat

SEQ ID NO: 563863 - DNA, 20 bp, Artificial
  CRISPR gRNA sequence
agaaccagatttgaataatt

SEQ ID NO: 563864 - DNA, 20 bp, Artificial
  CRISPR gRNA sequence
gaataatttattttattgac

SEQ ID NO: 563865 - DNA, 20 bp, Artificial
  CRISPR gRNA sequence
aataatttattttattgacc

SEQ ID NO: 563866 - DNA, 20 bp, Artificial
  CRISPR gRNA sequence
attttattgacctccttgtc

SEQ ID NO: 563867 - DNA, 20 bp, Artificial
  CRISPR gRNA sequence
ttttattgacctccttgtca

SEQ ID NO: 563868 - DNA, 20 bp, Artificial
  CRISPR gRNA sequence
tattgacctccttgtcactc

SEQ ID NO: 563869 - DNA, 20 bp, Artificial
  CRISPR gRNA sequence
attgacctccttgtcactct

SEQ ID NO: 563870 - DNA, 20 bp, Artificial
  CRISPR gRNA sequence
ttgacctccttgtcactcta

SEQ ID NO: 563871 - DNA, 20 bp, Artificial
  CRISPR gRNA sequence
acctccttgtcactctaaca

SEQ ID NO: 563872 - DNA, 20 bp, Artificial
  CRISPR gRNA sequence
cttgtcactctaacatttct

SEQ ID NO: 563873 - DNA, 20 bp, Artificial
  CRISPR gRNA sequence
gtcactctaacatttcttta

SEQ ID NO: 563874 - DNA, 20 bp, Artificial
  CRISPR gRNA sequence
tcactctaacatttctttag

SEQ ID NO: 563875 - DNA, 20 bp, Artificial
  CRISPR gRNA sequence
taacatttctttagtaaata

SEQ ID NO: 563876 - DNA, 20 bp, Artificial
  CRISPR gRNA sequence
acatttctttagtaaataca

SEQ ID NO: 563877 - DNA, 20 bp, Artificial
  CRISPR gRNA sequence
ctttagtaaatacaggcttt

SEQ ID NO: 563878 - DNA, 20 bp, Artificial
  CRISPR gRNA sequence
tttagtaaatacaggctttg

SEQ ID NO: 563879 - DNA, 20 bp, Artificial
  CRISPR gRNA sequence
tagtaaatacaggctttgag

SEQ ID NO: 563880 - DNA, 20 bp, Artificial
  CRISPR gRNA sequence
agtaaatacaggctttgagg

SEQ ID NO: 563881 - DNA, 20 bp, Artificial
  CRISPR gRNA sequence
gtaaatacaggctttgaggg

SEQ ID NO: 563882 - DNA, 20 bp, Artificial
  CRISPR gRNA sequence
tgagggtaggtattggtttc

SEQ ID NO: 563883 - DNA, 20 bp, Artificial
  CRISPR gRNA sequence
gagggtaggtattggtttct

SEQ ID NO: 563884 - DNA, 20 bp, Artificial
  CRISPR gRNA sequence
agggtaggtattggtttctc

SEQ ID NO: 563885 - DNA, 20 bp, Artificial
  CRISPR gRNA sequence
gtttctctgtttaaaagtag

SEQ ID NO: 563886 - DNA, 20 bp, Artificial
  CRISPR gRNA sequence
ctctgtttaaaagtagaaac

SEQ ID NO: 563887 - DNA, 20 bp, Artificial
  CRISPR gRNA sequence
tctgtttaaaagtagaaact

SEQ ID NO: 563888 - DNA, 20 bp, Artificial
  CRISPR gRNA sequence
tgtttaaaagtagaaacttt

SEQ ID NO: 563889 - DNA, 20 bp, Artificial
  CRISPR gRNA sequence
tttaaaagtagaaactttgc

SEQ ID NO: 563890 - DNA, 20 bp, Artificial
  CRISPR gRNA sequence
aaaagtagaaactttgcata

SEQ ID NO: 563891 - DNA, 20 bp, Artificial
  CRISPR gRNA sequence
aaagtagaaactttgcataa

SEQ ID NO: 563892 - DNA, 20 bp, Artificial
  CRISPR gRNA sequence
tgcataaatcagcccttata

SEQ ID NO: 563893 - DNA, 20 bp, Artificial
  CRISPR gRNA sequence
gcataaatcagcccttatat

SEQ ID NO: 563894 - DNA, 20 bp, Artificial
  CRISPR gRNA sequence
cataaatcagcccttatatg

SEQ ID NO: 563895 - DNA, 20 bp, Artificial
  CRISPR gRNA sequence
atatgtgtaagttttctgcc

SEQ ID NO: 563896 - DNA, 20 bp, Artificial
  CRISPR gRNA sequence
tatgtgtaagttttctgcct

SEQ ID NO: 563897 - DNA, 20 bp, Artificial
  CRISPR gRNA sequence
tctgccttttggtttcttct

SEQ ID NO: 563898 - DNA, 20 bp, Artificial
  CRISPR gRNA sequence
ctgccttttggtttcttctc

SEQ ID NO: 563899 - DNA, 20 bp, Artificial
  CRISPR gRNA sequence
tgccttttggtttcttctca

SEQ ID NO: 563900 - DNA, 20 bp, Artificial
  CRISPR gRNA sequence
ccttttggtttcttctcatg

SEQ ID NO: 563901 - DNA, 20 bp, Artificial
  CRISPR gRNA sequence
ttggtttcttctcatgctgt

SEQ ID NO: 563902 - DNA, 20 bp, Artificial
  CRISPR gRNA sequence
tggtttcttctcatgctgtt

SEQ ID NO: 563903 - DNA, 20 bp, Artificial
  CRISPR gRNA sequence
ggtttcttctcatgctgttt

SEQ ID NO: 563904 - DNA, 20 bp, Artificial
  CRISPR gRNA sequence
gtttcttctcatgctgtttc

SEQ ID NO: 563905 - DNA, 20 bp, Artificial
  CRISPR gRNA sequence
cttctcatgctgtttctgca

SEQ ID NO: 563906 - DNA, 20 bp, Artificial
  CRISPR gRNA sequence
ttctcatgctgtttctgcac

SEQ ID NO: 563907 - DNA, 20 bp, Artificial
  CRISPR gRNA sequence
ctcatgctgtttctgcacaa

SEQ ID NO: 563908 - DNA, 20 bp, Artificial
  CRISPR gRNA sequence
tcatgctgtttctgcacaag

SEQ ID NO: 563909 - DNA, 20 bp, Artificial
  CRISPR gRNA sequence
atgctgtttctgcacaagtg

SEQ ID NO: 563910 - DNA, 20 bp, Artificial
  CRISPR gRNA sequence
tttctgcacaagtgcctaag

SEQ ID NO: 563911 - DNA, 20 bp, Artificial
  CRISPR gRNA sequence
ctgcacaagtgcctaagctt

SEQ ID NO: 563912 - DNA, 20 bp, Artificial
  CRISPR gRNA sequence
tgcacaagtgcctaagcttt

SEQ ID NO: 563913 - DNA, 20 bp, Artificial
  CRISPR gRNA sequence
cacaagtgcctaagcttttt

SEQ ID NO: 563914 - DNA, 20 bp, Artificial
  CRISPR gRNA sequence
agcttttttgaagctttact

SEQ ID NO: 563915 - DNA, 20 bp, Artificial
  CRISPR gRNA sequence
ttttgaagctttacttgagg

SEQ ID NO: 563916 - DNA, 20 bp, Artificial
  CRISPR gRNA sequence
tttgaagctttacttgaggg

SEQ ID NO: 563917 - DNA, 20 bp, Artificial
  CRISPR gRNA sequence
ttgaagctttacttgagggg

SEQ ID NO: 563918 - DNA, 20 bp, Artificial
  CRISPR gRNA sequence
tgaagctttacttgaggggt

SEQ ID NO: 563919 - DNA, 20 bp, Artificial
  CRISPR gRNA sequence
gaagctttacttgaggggtg

SEQ ID NO: 563920 - DNA, 20 bp, Artificial
  CRISPR gRNA sequence
aagctttacttgaggggtga

SEQ ID NO: 563921 - DNA, 20 bp, Artificial
  CRISPR gRNA sequence
tacttgaggggtgaccagaa

SEQ ID NO: 563922 - DNA, 20 bp, Artificial
  CRISPR gRNA sequence
acttgaggggtgaccagaag

SEQ ID NO: 563923 - DNA, 20 bp, Artificial
  CRISPR gRNA sequence
cttgaggggtgaccagaagg

SEQ ID NO: 563924 - DNA, 20 bp, Artificial
  CRISPR gRNA sequence
gaggggtgaccagaaggttt

SEQ ID NO: 563925 - DNA, 20 bp, Artificial
  CRISPR gRNA sequence
aggggtgaccagaaggtttt

SEQ ID NO: 563926 - DNA, 20 bp, Artificial
  CRISPR gRNA sequence
tacttaaggacacagaccct

SEQ ID NO: 563927 - DNA, 20 bp, Artificial
  CRISPR gRNA sequence
acttaaggacacagaccctt

SEQ ID NO: 563928 - DNA, 20 bp, Artificial
  CRISPR gRNA sequence
cttaaggacacagaccctta

SEQ ID NO: 563929 - DNA, 20 bp, Artificial
  CRISPR gRNA sequence
aaggacacagacccttaaat

SEQ ID NO: 563930 - DNA, 20 bp, Artificial
  CRISPR gRNA sequence
aggacacagacccttaaatt

SEQ ID NO: 563931 - DNA, 20 bp, Artificial
  CRISPR gRNA sequence
aaattctgcaatgacaaatc

SEQ ID NO: 563932 - DNA, 20 bp, Artificial
  CRISPR gRNA sequence
aattctgcaatgacaaatct

SEQ ID NO: 563933 - DNA, 20 bp, Artificial
  CRISPR gRNA sequence
tgcaatgacaaatctcaact

SEQ ID NO: 563934 - DNA, 20 bp, Artificial
  CRISPR gRNA sequence
caatgacaaatctcaacttc

SEQ ID NO: 563935 - DNA, 20 bp, Artificial
  CRISPR gRNA sequence
aacttccatctcagggttgt

SEQ ID NO: 563936 - DNA, 20 bp, Artificial
  CRISPR gRNA sequence
ccatctcagggttgtaagtg

SEQ ID NO: 563937 - DNA, 20 bp, Artificial
  CRISPR gRNA sequence
catctcagggttgtaagtga

SEQ ID NO: 563938 - DNA, 20 bp, Artificial
  CRISPR gRNA sequence
agggttgtaagtgaaaccag

SEQ ID NO: 563939 - DNA, 20 bp, Artificial
  CRISPR gRNA sequence
taagtgaaaccaggatgcag

SEQ ID NO: 563940 - DNA, 20 bp, Artificial
  CRISPR gRNA sequence
ctcttttctcagataagttc

SEQ ID NO: 563941 - DNA, 20 bp, Artificial
  CRISPR gRNA sequence
tcttttctcagataagttca

SEQ ID NO: 563942 - DNA, 20 bp, Artificial
  CRISPR gRNA sequence
ttttctcagataagttcagg

SEQ ID NO: 563943 - DNA, 20 bp, Artificial
  CRISPR gRNA sequence
ttctcagataagttcaggtt

SEQ ID NO: 563944 - DNA, 20 bp, Artificial
  CRISPR gRNA sequence
tctcagataagttcaggttt

SEQ ID NO: 563945 - DNA, 20 bp, Artificial
  CRISPR gRNA sequence
ctcagataagttcaggtttg

SEQ ID NO: 563946 - DNA, 20 bp, Artificial
  CRISPR gRNA sequence
tcagataagttcaggtttga

SEQ ID NO: 563947 - DNA, 20 bp, Artificial
  CRISPR gRNA sequence
agataagttcaggtttgaat

SEQ ID NO: 563948 - DNA, 20 bp, Artificial
  CRISPR gRNA sequence
aggtttgaatataaagtgtg

SEQ ID NO: 563949 - DNA, 20 bp, Artificial
  CRISPR gRNA sequence
gaatataaagtgtgactata

SEQ ID NO: 563950 - DNA, 20 bp, Artificial
  CRISPR gRNA sequence
aatataaagtgtgactataa

SEQ ID NO: 563951 - DNA, 20 bp, Artificial
  CRISPR gRNA sequence
taagatacagagactgtccc

SEQ ID NO: 563952 - DNA, 20 bp, Artificial
  CRISPR gRNA sequence
tccctagaaaaggaggggaa

SEQ ID NO: 563953 - DNA, 20 bp, Artificial
  CRISPR gRNA sequence
gaaaaggaggggaaaacatt

SEQ ID NO: 563954 - DNA, 20 bp, Artificial
  CRISPR gRNA sequence
tagcagttcctctttggaga

SEQ ID NO: 563955 - DNA, 20 bp, Artificial
  CRISPR gRNA sequence
agcagttcctctttggagat

SEQ ID NO: 563956 - DNA, 20 bp, Artificial
  CRISPR gRNA sequence
gcagttcctctttggagata

SEQ ID NO: 563957 - DNA, 20 bp, Artificial
  CRISPR gRNA sequence
ctctttggagataactttca

SEQ ID NO: 563958 - DNA, 20 bp, Artificial
  CRISPR gRNA sequence
tttggagataactttcagtg

SEQ ID NO: 563959 - DNA, 20 bp, Artificial
  CRISPR gRNA sequence
tggagataactttcagtgcc

SEQ ID NO: 563960 - DNA, 20 bp, Artificial
  CRISPR gRNA sequence
ggagataactttcagtgcct

SEQ ID NO: 563961 - DNA, 20 bp, Artificial
  CRISPR gRNA sequence
gagataactttcagtgcctg

SEQ ID NO: 563962 - DNA, 20 bp, Artificial
  CRISPR gRNA sequence
tcagtgcctgcccatcagcc

SEQ ID NO: 563963 - DNA, 20 bp, Artificial
  CRISPR gRNA sequence
cagtgcctgcccatcagcct

SEQ ID NO: 563964 - DNA, 20 bp, Artificial
  CRISPR gRNA sequence
agtgcctgcccatcagcctc

SEQ ID NO: 563965 - DNA, 20 bp, Artificial
  CRISPR gRNA sequence
cccatcagcctccaaggaaa

SEQ ID NO: 563966 - DNA, 20 bp, Artificial
  CRISPR gRNA sequence
caaggaaaatgctttttggt

SEQ ID NO: 563967 - DNA, 20 bp, Artificial
  CRISPR gRNA sequence
tttggttactttataggttc

SEQ ID NO: 563968 - DNA, 20 bp, Artificial
  CRISPR gRNA sequence
ttggttactttataggttct

SEQ ID NO: 563969 - DNA, 20 bp, Artificial
  CRISPR gRNA sequence
tggttactttataggttcta

SEQ ID NO: 563970 - DNA, 20 bp, Artificial
  CRISPR gRNA sequence
ggttactttataggttctag

SEQ ID NO: 563971 - DNA, 20 bp, Artificial
  CRISPR gRNA sequence
gttactttataggttctagt

SEQ ID NO: 563972 - DNA, 20 bp, Artificial
  CRISPR gRNA sequence
ctttataggttctagtgaac

SEQ ID NO: 563973 - DNA, 20 bp, Artificial
  CRISPR gRNA sequence
tataggttctagtgaacttt

SEQ ID NO: 563974 - DNA, 20 bp, Artificial
  CRISPR gRNA sequence
ataggttctagtgaactttg

SEQ ID NO: 563975 - DNA, 20 bp, Artificial
  CRISPR gRNA sequence
taggttctagtgaactttgc

SEQ ID NO: 563976 - DNA, 20 bp, Artificial
  CRISPR gRNA sequence
tagtgaactttgcttacttt

SEQ ID NO: 563977 - DNA, 20 bp, Artificial
  CRISPR gRNA sequence
gtgaactttgcttactttac

SEQ ID NO: 563978 - DNA, 20 bp, Artificial
  CRISPR gRNA sequence
tgcttactttacaatgttcc

SEQ ID NO: 563979 - DNA, 20 bp, Artificial
  CRISPR gRNA sequence
gcttactttacaatgttccc

SEQ ID NO: 563980 - DNA, 20 bp, Artificial
  CRISPR gRNA sequence
cttactttacaatgttcccc

SEQ ID NO: 563981 - DNA, 20 bp, Artificial
  CRISPR gRNA sequence
actttacaatgttccccaaa

SEQ ID NO: 563982 - DNA, 20 bp, Artificial
  CRISPR gRNA sequence
ctttacaatgttccccaaaa

SEQ ID NO: 563983 - DNA, 20 bp, Artificial
  CRISPR gRNA sequence
tacaatgttccccaaaatgt

SEQ ID NO: 563984 - DNA, 20 bp, Artificial
  CRISPR gRNA sequence
acaatgttccccaaaatgtc

SEQ ID NO: 563985 - DNA, 20 bp, Artificial
  CRISPR gRNA sequence
caatgttccccaaaatgtct

SEQ ID NO: 563986 - DNA, 20 bp, Artificial
  CRISPR gRNA sequence
cccaaaatgtctgttgagat

SEQ ID NO: 563987 - DNA, 20 bp, Artificial
  CRISPR gRNA sequence
ttgagattagtgcctgaatt

SEQ ID NO: 563988 - DNA, 20 bp, Artificial
  CRISPR gRNA sequence
agattagtgcctgaatttcc

SEQ ID NO: 563989 - DNA, 20 bp, Artificial
  CRISPR gRNA sequence
gtgcctgaatttccactggg

SEQ ID NO: 563990 - DNA, 20 bp, Artificial
  CRISPR gRNA sequence
aatttccactgggctgacca

SEQ ID NO: 563991 - DNA, 20 bp, Artificial
  CRISPR gRNA sequence
ccactgggctgaccagtctg

SEQ ID NO: 563992 - DNA, 20 bp, Artificial
  CRISPR gRNA sequence
cactgggctgaccagtctgt

SEQ ID NO: 563993 - DNA, 20 bp, Artificial
  CRISPR gRNA sequence
ggctgaccagtctgtagttt

SEQ ID NO: 563994 - DNA, 20 bp, Artificial
  CRISPR gRNA sequence
accagtctgtagtttcttga

SEQ ID NO: 563995 - DNA, 20 bp, Artificial
  CRISPR gRNA sequence
tagtttcttgaacattttct

SEQ ID NO: 563996 - DNA, 20 bp, Artificial
  CRISPR gRNA sequence
cttgaacattttcttcctat

SEQ ID NO: 563997 - DNA, 20 bp, Artificial
  CRISPR gRNA sequence
ttgaacattttcttcctatg

SEQ ID NO: 563998 - DNA, 20 bp, Artificial
  CRISPR gRNA sequence
gaacattttcttcctatgcc

SEQ ID NO: 563999 - DNA, 20 bp, Artificial
  CRISPR gRNA sequence
aacattttcttcctatgcca

SEQ ID NO: 564000 - DNA, 20 bp, Artificial
  CRISPR gRNA sequence
tcttcctatgccagttaaaa

SEQ ID NO: 564001 - DNA, 20 bp, Artificial
  CRISPR gRNA sequence
cttcctatgccagttaaaaa

SEQ ID NO: 564002 - DNA, 20 bp, Artificial
  CRISPR gRNA sequence
ttcctatgccagttaaaaat

SEQ ID NO: 564003 - DNA, 20 bp, Artificial
  CRISPR gRNA sequence
cctatgccagttaaaaatta

SEQ ID NO: 564004 - DNA, 20 bp, Artificial
  CRISPR gRNA sequence
ctatgccagttaaaaattag

SEQ ID NO: 564005 - DNA, 20 bp, Artificial
  CRISPR gRNA sequence
tgccagttaaaaattagaag

SEQ ID NO: 564006 - DNA, 20 bp, Artificial
  CRISPR gRNA sequence
aaaattagaagaaaattgaa

SEQ ID NO: 564007 - DNA, 20 bp, Artificial
  CRISPR gRNA sequence
gaagaaaattgaagtttaac

SEQ ID NO: 564008 - DNA, 20 bp, Artificial
  CRISPR gRNA sequence
aagtttaacatacacattca

SEQ ID NO: 564009 - DNA, 20 bp, Artificial
  CRISPR gRNA sequence
aacatacacattcagaaaaa

SEQ ID NO: 564010 - DNA, 20 bp, Artificial
  CRISPR gRNA sequence
acatacacattcagaaaaaa

SEQ ID NO: 564011 - DNA, 20 bp, Artificial
  CRISPR gRNA sequence
agaaaaaaataaaaaatcag

SEQ ID NO: 564012 - DNA, 20 bp, Artificial
  CRISPR gRNA sequence
ataagaaactaatgaggctg

SEQ ID NO: 564013 - DNA, 20 bp, Artificial
  CRISPR gRNA sequence
atgaggctgtgccattgtaa

SEQ ID NO: 564014 - DNA, 20 bp, Artificial
  CRISPR gRNA sequence
tgccattgtaaactacttgc

SEQ ID NO: 564015 - DNA, 20 bp, Artificial
  CRISPR gRNA sequence
taaactacttgcaatagagt

SEQ ID NO: 564016 - DNA, 20 bp, Artificial
  CRISPR gRNA sequence
cttgcaatagagtttcccaa

SEQ ID NO: 564017 - DNA, 20 bp, Artificial
  CRISPR gRNA sequence
gcaatagagtttcccaacga

SEQ ID NO: 564018 - DNA, 20 bp, Artificial
  CRISPR gRNA sequence
caatagagtttcccaacgat

SEQ ID NO: 564019 - DNA, 20 bp, Artificial
  CRISPR gRNA sequence
cccaacgatgaactgagtat

SEQ ID NO: 564020 - DNA, 20 bp, Artificial
  CRISPR gRNA sequence
ccaacgatgaactgagtatc

SEQ ID NO: 564021 - DNA, 20 bp, Artificial
  CRISPR gRNA sequence
agtatctagaaaataacaag

SEQ ID NO: 564022 - DNA, 20 bp, Artificial
  CRISPR gRNA sequence
gaaaataacaaggattctca

SEQ ID NO: 564023 - DNA, 20 bp, Artificial
  CRISPR gRNA sequence
tcaaggaattttagtgaaat

SEQ ID NO: 564024 - DNA, 20 bp, Artificial
  CRISPR gRNA sequence
aaggaattttagtgaaatga

SEQ ID NO: 564025 - DNA, 20 bp, Artificial
  CRISPR gRNA sequence
tagtgaaatgatcagtactg

SEQ ID NO: 564026 - DNA, 20 bp, Artificial
  CRISPR gRNA sequence
agtgaaatgatcagtactgt

SEQ ID NO: 564027 - DNA, 20 bp, Artificial
  CRISPR gRNA sequence
gtgaaatgatcagtactgta

SEQ ID NO: 564028 - DNA, 20 bp, Artificial
  CRISPR gRNA sequence
tattgaaataccttgaatca

SEQ ID NO: 564029 - DNA, 20 bp, Artificial
  CRISPR gRNA sequence
aaataccttgaatcagactt

SEQ ID NO: 564030 - DNA, 20 bp, Artificial
  CRISPR gRNA sequence
gaatcagactttggagaata

SEQ ID NO: 564031 - DNA, 20 bp, Artificial
  CRISPR gRNA sequence
aatcagactttggagaatag

SEQ ID NO: 564032 - DNA, 20 bp, Artificial
  CRISPR gRNA sequence
tggagaatagatttaaaaac

SEQ ID NO: 564033 - DNA, 20 bp, Artificial
  CRISPR gRNA sequence
ggagaatagatttaaaaaca

SEQ ID NO: 564034 - DNA, 20 bp, Artificial
  CRISPR gRNA sequence
gagaatagatttaaaaacac

SEQ ID NO: 564035 - DNA, 20 bp, Artificial
  CRISPR gRNA sequence
aaaaacactcacagccttaa

SEQ ID NO: 564036 - DNA, 20 bp, Artificial
  CRISPR gRNA sequence
aaaacactcacagccttaac

SEQ ID NO: 564037 - DNA, 20 bp, Artificial
  CRISPR gRNA sequence
acagccttaaccgatctagt

SEQ ID NO: 564038 - DNA, 20 bp, Artificial
  CRISPR gRNA sequence
aaccgatctagtaagaacct

SEQ ID NO: 564039 - DNA, 20 bp, Artificial
  CRISPR gRNA sequence
accgatctagtaagaacctt

SEQ ID NO: 564040 - DNA, 20 bp, Artificial
  CRISPR gRNA sequence
gtaagaaccttattccctaa

SEQ ID NO: 564041 - DNA, 20 bp, Artificial
  CRISPR gRNA sequence
attccctaaagcatactgtg

SEQ ID NO: 564042 - DNA, 20 bp, Artificial
  CRISPR gRNA sequence
ttccctaaagcatactgtgg

SEQ ID NO: 564043 - DNA, 20 bp, Artificial
  CRISPR gRNA sequence
cctaaagcatactgtggatc

SEQ ID NO: 564044 - DNA, 20 bp, Artificial
  CRISPR gRNA sequence
aagcatactgtggatctcag

SEQ ID NO: 564045 - DNA, 20 bp, Artificial
  CRISPR gRNA sequence
tggatctcagctgtatccta

SEQ ID NO: 564046 - DNA, 20 bp, Artificial
  CRISPR gRNA sequence
agctgtatcctatctaaggt

SEQ ID NO: 564047 - DNA, 20 bp, Artificial
  CRISPR gRNA sequence
tatcctatctaaggtgagaa

SEQ ID NO: 564048 - DNA, 20 bp, Artificial
  CRISPR gRNA sequence
tctaaggtgagaacagtcaa

SEQ ID NO: 564049 - DNA, 20 bp, Artificial
  CRISPR gRNA sequence
aggtgagaacagtcaaagac

SEQ ID NO: 564050 - DNA, 20 bp, Artificial
  CRISPR gRNA sequence
tgagaaaggtgggatgtgag

SEQ ID NO: 564051 - DNA, 20 bp, Artificial
  CRISPR gRNA sequence
gagaaaggtgggatgtgagt

SEQ ID NO: 564052 - DNA, 20 bp, Artificial
  CRISPR gRNA sequence
agaaaggtgggatgtgagtg

SEQ ID NO: 564053 - DNA, 20 bp, Artificial
  CRISPR gRNA sequence
gaaacaacaggctaaagaag

SEQ ID NO: 564054 - DNA, 20 bp, Artificial
  CRISPR gRNA sequence
aaacaacaggctaaagaagt

SEQ ID NO: 564055 - DNA, 20 bp, Artificial
  CRISPR gRNA sequence
aagaagtgctctcaaataga

SEQ ID NO: 564056 - DNA, 20 bp, Artificial
  CRISPR gRNA sequence
tcaaatagaagtataatatg

SEQ ID NO: 564057 - DNA, 20 bp, Artificial
  CRISPR gRNA sequence
aaatagaagtataatatgga

SEQ ID NO: 564058 - DNA, 20 bp, Artificial
  CRISPR gRNA sequence
attttaataatatattttag

SEQ ID NO: 564059 - DNA, 20 bp, Artificial
  CRISPR gRNA sequence
taataatatattttagttaa

SEQ ID NO: 564060 - DNA, 20 bp, Artificial
  CRISPR gRNA sequence
aataatatattttagttaac

SEQ ID NO: 564061 - DNA, 20 bp, Artificial
  CRISPR gRNA sequence
ataatatattttagttaacc

SEQ ID NO: 564062 - DNA, 20 bp, Artificial
  CRISPR gRNA sequence
tagttaacctaatatatcca

SEQ ID NO: 564063 - DNA, 20 bp, Artificial
  CRISPR gRNA sequence
agttaacctaatatatccat

SEQ ID NO: 564064 - DNA, 20 bp, Artificial
  CRISPR gRNA sequence
gttaacctaatatatccata

SEQ ID NO: 564065 - DNA, 20 bp, Artificial
  CRISPR gRNA sequence
acctaatatatccataatat

SEQ ID NO: 564066 - DNA, 20 bp, Artificial
  CRISPR gRNA sequence
atatatccataatattttca

SEQ ID NO: 564067 - DNA, 20 bp, Artificial
  CRISPR gRNA sequence
tcatttcgacatgtattagg

SEQ ID NO: 564068 - DNA, 20 bp, Artificial
  CRISPR gRNA sequence
catttcgacatgtattaggt

SEQ ID NO: 564069 - DNA, 20 bp, Artificial
  CRISPR gRNA sequence
atttcgacatgtattaggtt

SEQ ID NO: 564070 - DNA, 20 bp, Artificial
  CRISPR gRNA sequence
cgacatgtattaggttggtg

SEQ ID NO: 564071 - DNA, 20 bp, Artificial
  CRISPR gRNA sequence
gacatgtattaggttggtgc

SEQ ID NO: 564072 - DNA, 20 bp, Artificial
  CRISPR gRNA sequence
ggttggtgcaaaagttattg

SEQ ID NO: 564073 - DNA, 20 bp, Artificial
  CRISPR gRNA sequence
gtgcaaaagttattgtggtt

SEQ ID NO: 564074 - DNA, 20 bp, Artificial
  CRISPR gRNA sequence
ttgtggtttttgctattttt

SEQ ID NO: 564075 - DNA, 20 bp, Artificial
  CRISPR gRNA sequence
tggtttttgctatttttttt

SEQ ID NO: 564076 - DNA, 20 bp, Artificial
  CRISPR gRNA sequence
ttgctatttttttttaatgg

SEQ ID NO: 564077 - DNA, 20 bp, Artificial
  CRISPR gRNA sequence
tgctatttttttttaatggc

SEQ ID NO: 564078 - DNA, 20 bp, Artificial
  CRISPR gRNA sequence
gctatttttttttaatggca

SEQ ID NO: 564079 - DNA, 20 bp, Artificial
  CRISPR gRNA sequence
ctatttttttttaatggcaa

SEQ ID NO: 564080 - DNA, 20 bp, Artificial
  CRISPR gRNA sequence
tttttttttaatggcaaaaa

SEQ ID NO: 564081 - DNA, 20 bp, Artificial
  CRISPR gRNA sequence
ttttttaatggcaaaaaccg

SEQ ID NO: 564082 - DNA, 20 bp, Artificial
  CRISPR gRNA sequence
tttttaatggcaaaaaccgg

SEQ ID NO: 564083 - DNA, 20 bp, Artificial
  CRISPR gRNA sequence
ttttaatggcaaaaaccggc

SEQ ID NO: 564084 - DNA, 20 bp, Artificial
  CRISPR gRNA sequence
tttaatggcaaaaaccggca

SEQ ID NO: 564085 - DNA, 20 bp, Artificial
  CRISPR gRNA sequence
ttaatggcaaaaaccggcaa

SEQ ID NO: 564086 - DNA, 20 bp, Artificial
  CRISPR gRNA sequence
taatggcaaaaaccggcaat

SEQ ID NO: 564087 - DNA, 20 bp, Artificial
  CRISPR gRNA sequence
aatggcaaaaaccggcaatt

SEQ ID NO: 564088 - DNA, 20 bp, Artificial
  CRISPR gRNA sequence
atggcaaaaaccggcaatta

SEQ ID NO: 564089 - DNA, 20 bp, Artificial
  CRISPR gRNA sequence
cttttgcactaacctagtag

SEQ ID NO: 564090 - DNA, 20 bp, Artificial
  CRISPR gRNA sequence
ttgcactaacctagtagtta

SEQ ID NO: 564091 - DNA, 20 bp, Artificial
  CRISPR gRNA sequence
tgcactaacctagtagttac

SEQ ID NO: 564092 - DNA, 20 bp, Artificial
  CRISPR gRNA sequence
gcactaacctagtagttact

SEQ ID NO: 564093 - DNA, 20 bp, Artificial
  CRISPR gRNA sequence
cactaacctagtagttacta

SEQ ID NO: 564094 - DNA, 20 bp, Artificial
  CRISPR gRNA sequence
acctagtagttactacaaaa

SEQ ID NO: 564095 - DNA, 20 bp, Artificial
  CRISPR gRNA sequence
gtagttactacaaaaaaata

SEQ ID NO: 564096 - DNA, 20 bp, Artificial
  CRISPR gRNA sequence
ctacaaaaaaatattaacaa

SEQ ID NO: 564097 - DNA, 20 bp, Artificial
  CRISPR gRNA sequence
caaaaaaatattaacaagag

SEQ ID NO: 564098 - DNA, 20 bp, Artificial
  CRISPR gRNA sequence
acaagagattttatgttcca

SEQ ID NO: 564099 - DNA, 20 bp, Artificial
  CRISPR gRNA sequence
tatgttccactttttaatac

SEQ ID NO: 564100 - DNA, 20 bp, Artificial
  CRISPR gRNA sequence
atgttccactttttaatacc

SEQ ID NO: 564101 - DNA, 20 bp, Artificial
  CRISPR gRNA sequence
tgttccactttttaatacca

SEQ ID NO: 564102 - DNA, 20 bp, Artificial
  CRISPR gRNA sequence
cactttttaataccaggtct

SEQ ID NO: 564103 - DNA, 20 bp, Artificial
  CRISPR gRNA sequence
tttaataccaggtcttcaga

SEQ ID NO: 564104 - DNA, 20 bp, Artificial
  CRISPR gRNA sequence
ttaataccaggtcttcagat

SEQ ID NO: 564105 - DNA, 20 bp, Artificial
  CRISPR gRNA sequence
taataccaggtcttcagatt

SEQ ID NO: 564106 - DNA, 20 bp, Artificial
  CRISPR gRNA sequence
aataccaggtcttcagattc

SEQ ID NO: 564107 - DNA, 20 bp, Artificial
  CRISPR gRNA sequence
ataccaggtcttcagattct

SEQ ID NO: 564108 - DNA, 20 bp, Artificial
  CRISPR gRNA sequence
cagattctggtgtgtatttg

SEQ ID NO: 564109 - DNA, 20 bp, Artificial
  CRISPR gRNA sequence
agattctggtgtgtatttga

SEQ ID NO: 564110 - DNA, 20 bp, Artificial
  CRISPR gRNA sequence
tggtgtgtatttgatactca

SEQ ID NO: 564111 - DNA, 20 bp, Artificial
  CRISPR gRNA sequence
gtgtgtatttgatactcaga

SEQ ID NO: 564112 - DNA, 20 bp, Artificial
  CRISPR gRNA sequence
gatactcagaacacatctcc

SEQ ID NO: 564113 - DNA, 20 bp, Artificial
  CRISPR gRNA sequence
atactcagaacacatctcca

SEQ ID NO: 564114 - DNA, 20 bp, Artificial
  CRISPR gRNA sequence
agaacacatctccatttgaa

SEQ ID NO: 564115 - DNA, 20 bp, Artificial
  CRISPR gRNA sequence
catttgaactaaccatattt

SEQ ID NO: 564116 - DNA, 20 bp, Artificial
  CRISPR gRNA sequence
gaactaaccatatttcaggt

SEQ ID NO: 564117 - DNA, 20 bp, Artificial
  CRISPR gRNA sequence
aactaaccatatttcaggtt

SEQ ID NO: 564118 - DNA, 20 bp, Artificial
  CRISPR gRNA sequence
accatatttcaggttctcac

SEQ ID NO: 564119 - DNA, 20 bp, Artificial
  CRISPR gRNA sequence
caggttctcactagccactt

SEQ ID NO: 564120 - DNA, 20 bp, Artificial
  CRISPR gRNA sequence
aggttctcactagccacttg

SEQ ID NO: 564121 - DNA, 20 bp, Artificial
  CRISPR gRNA sequence
tcactagccacttgtagctg

SEQ ID NO: 564122 - DNA, 20 bp, Artificial
  CRISPR gRNA sequence
actagccacttgtagctggt

SEQ ID NO: 564123 - DNA, 20 bp, Artificial
  CRISPR gRNA sequence
gccacttgtagctggtagct

SEQ ID NO: 564124 - DNA, 20 bp, Artificial
  CRISPR gRNA sequence
gtagctggtagctactttga

SEQ ID NO: 564125 - DNA, 20 bp, Artificial
  CRISPR gRNA sequence
tagctggtagctactttgat

SEQ ID NO: 564126 - DNA, 20 bp, Artificial
  CRISPR gRNA sequence
gtagctactttgatggattg

SEQ ID NO: 564127 - DNA, 20 bp, Artificial
  CRISPR gRNA sequence
ctttgatggattgcataggt

SEQ ID NO: 564128 - DNA, 20 bp, Artificial
  CRISPR gRNA sequence
tgatggattgcataggtcta

SEQ ID NO: 564129 - DNA, 20 bp, Artificial
  CRISPR gRNA sequence
gatggattgcataggtctaa

SEQ ID NO: 564130 - DNA, 20 bp, Artificial
  CRISPR gRNA sequence
atggattgcataggtctaaa

SEQ ID NO: 564131 - DNA, 20 bp, Artificial
  CRISPR gRNA sequence
cataggtctaaagggaaaca

SEQ ID NO: 564132 - DNA, 20 bp, Artificial
  CRISPR gRNA sequence
aagggaaacatcttgagaaa

SEQ ID NO: 564133 - DNA, 20 bp, Artificial
  CRISPR gRNA sequence
gagaaagaagaaataggtta

SEQ ID NO: 564134 - DNA, 20 bp, Artificial
  CRISPR gRNA sequence
agaaagaagaaataggttaa

SEQ ID NO: 564135 - DNA, 20 bp, Artificial
  CRISPR gRNA sequence
agtgcaagaacaagaattaa

SEQ ID NO: 564136 - DNA, 20 bp, Artificial
  CRISPR gRNA sequence
aaaaggaaactattttagca

SEQ ID NO: 564137 - DNA, 20 bp, Artificial
  CRISPR gRNA sequence
ttttagcatcatattagaag

SEQ ID NO: 564138 - DNA, 20 bp, Artificial
  CRISPR gRNA sequence
tagcatcatattagaaggaa

SEQ ID NO: 564139 - DNA, 20 bp, Artificial
  CRISPR gRNA sequence
agcatcatattagaaggaaa

SEQ ID NO: 564140 - DNA, 20 bp, Artificial
  CRISPR gRNA sequence
gcatcatattagaaggaaag

SEQ ID NO: 564141 - DNA, 20 bp, Artificial
  CRISPR gRNA sequence
gaaggaaagtacagaaagaa

SEQ ID NO: 564142 - DNA, 20 bp, Artificial
  CRISPR gRNA sequence
atttagagaaccaacatctt

SEQ ID NO: 564143 - DNA, 20 bp, Artificial
  CRISPR gRNA sequence
agagaaccaacatcttaatt

SEQ ID NO: 564144 - DNA, 20 bp, Artificial
  CRISPR gRNA sequence
gagaaccaacatcttaattc

SEQ ID NO: 564145 - DNA, 20 bp, Artificial
  CRISPR gRNA sequence
aattcttgatgaacttatcg

SEQ ID NO: 564146 - DNA, 20 bp, Artificial
  CRISPR gRNA sequence
attcttgatgaacttatcga

SEQ ID NO: 564147 - DNA, 20 bp, Artificial
  CRISPR gRNA sequence
ttgatgaacttatcgaggag

SEQ ID NO: 564148 - DNA, 20 bp, Artificial
  CRISPR gRNA sequence
gatgaacttatcgaggaggc

SEQ ID NO: 564149 - DNA, 20 bp, Artificial
  CRISPR gRNA sequence
atgaacttatcgaggaggca

SEQ ID NO: 564150 - DNA, 20 bp, Artificial
  CRISPR gRNA sequence
atcgaggaggcagattgaca

SEQ ID NO: 564151 - DNA, 20 bp, Artificial
  CRISPR gRNA sequence
tcgaggaggcagattgacag

SEQ ID NO: 564152 - DNA, 20 bp, Artificial
  CRISPR gRNA sequence
acagctgagagcaaggtccg

SEQ ID NO: 564153 - DNA, 20 bp, Artificial
  CRISPR gRNA sequence
agagcaaggtccgggaacct

SEQ ID NO: 564154 - DNA, 20 bp, Artificial
  CRISPR gRNA sequence
gctctggccttggggaccga

SEQ ID NO: 564155 - DNA, 20 bp, Artificial
  CRISPR gRNA sequence
ctctggccttggggaccgag

SEQ ID NO: 564156 - DNA, 20 bp, Artificial
  CRISPR gRNA sequence
tggccttggggaccgagggt

SEQ ID NO: 564157 - DNA, 20 bp, Artificial
  CRISPR gRNA sequence
gccttggggaccgagggttt

SEQ ID NO: 564158 - DNA, 20 bp, Artificial
  CRISPR gRNA sequence
ggggaccgagggtttgtaac

SEQ ID NO: 564159 - DNA, 20 bp, Artificial
  CRISPR gRNA sequence
gggaccgagggtttgtaacc

SEQ ID NO: 564160 - DNA, 20 bp, Artificial
  CRISPR gRNA sequence
gtaaccgttgggagacaggt

SEQ ID NO: 564161 - DNA, 20 bp, Artificial
  CRISPR gRNA sequence
taaccgttgggagacaggtg

SEQ ID NO: 564162 - DNA, 20 bp, Artificial
  CRISPR gRNA sequence
ggagacaggtggctgcagtt

SEQ ID NO: 564163 - DNA, 20 bp, Artificial
  CRISPR gRNA sequence
cagtttcagtatgaagtaga

SEQ ID NO: 564164 - DNA, 20 bp, Artificial
  CRISPR gRNA sequence
cagtatgaagtagatgaggg

SEQ ID NO: 564165 - DNA, 20 bp, Artificial
  CRISPR gRNA sequence
agtatgaagtagatgagggc

SEQ ID NO: 564166 - DNA, 20 bp, Artificial
  CRISPR gRNA sequence
gtggtggtgtggctgaaatc

SEQ ID NO: 564167 - DNA, 20 bp, Artificial
  CRISPR gRNA sequence
aaatcagtaaatctctgtct

SEQ ID NO: 564168 - DNA, 20 bp, Artificial
  CRISPR gRNA sequence
tgtcttaaggaaataagaga

SEQ ID NO: 564169 - DNA, 20 bp, Artificial
  CRISPR gRNA sequence
tcttaaggaaataagagaag

SEQ ID NO: 564170 - DNA, 20 bp, Artificial
  CRISPR gRNA sequence
aaggaaataagagaagtcac

SEQ ID NO: 564171 - DNA, 20 bp, Artificial
  CRISPR gRNA sequence
aggaaataagagaagtcact

SEQ ID NO: 564172 - DNA, 20 bp, Artificial
  CRISPR gRNA sequence
actgggaccggctaagggtg

SEQ ID NO: 564173 - DNA, 20 bp, Artificial
  CRISPR gRNA sequence
ggaccggctaagggtggaat

SEQ ID NO: 564174 - DNA, 20 bp, Artificial
  CRISPR gRNA sequence
agggtggaatcgatcaggaa

SEQ ID NO: 564175 - DNA, 20 bp, Artificial
  CRISPR gRNA sequence
atgttctggccaacagtgca

SEQ ID NO: 564176 - DNA, 20 bp, Artificial
  CRISPR gRNA sequence
tggccaacagtgcaggctct

SEQ ID NO: 564177 - DNA, 20 bp, Artificial
  CRISPR gRNA sequence
gccaacagtgcaggctctgg

SEQ ID NO: 564178 - DNA, 20 bp, Artificial
  CRISPR gRNA sequence
tggggccgactgcctgtgtc

SEQ ID NO: 564179 - DNA, 20 bp, Artificial
  CRISPR gRNA sequence
gggccgactgcctgtgtctg

SEQ ID NO: 564180 - DNA, 20 bp, Artificial
  CRISPR gRNA sequence
cctgtgtctggacaccagct

SEQ ID NO: 564181 - DNA, 20 bp, Artificial
  CRISPR gRNA sequence
tgtctggacaccagctctgc

SEQ ID NO: 564182 - DNA, 20 bp, Artificial
  CRISPR gRNA sequence
gacaccagctctgccccttg

SEQ ID NO: 564183 - DNA, 20 bp, Artificial
  CRISPR gRNA sequence
tgccccttgctagctgagtg

SEQ ID NO: 564184 - DNA, 20 bp, Artificial
  CRISPR gRNA sequence
ccccttgctagctgagtgaa

SEQ ID NO: 564185 - DNA, 20 bp, Artificial
  CRISPR gRNA sequence
gctagctgagtgaatgcagt

SEQ ID NO: 564186 - DNA, 20 bp, Artificial
  CRISPR gRNA sequence
ctagctgagtgaatgcagtc

SEQ ID NO: 564187 - DNA, 20 bp, Artificial
  CRISPR gRNA sequence
gctgagtgaatgcagtcagc

SEQ ID NO: 564188 - DNA, 20 bp, Artificial
  CRISPR gRNA sequence
agtgaatgcagtcagctgac

SEQ ID NO: 564189 - DNA, 20 bp, Artificial
  CRISPR gRNA sequence
accctctcagtccatttctt

SEQ ID NO: 564190 - DNA, 20 bp, Artificial
  CRISPR gRNA sequence
tcagtccatttcttcatctg

SEQ ID NO: 564191 - DNA, 20 bp, Artificial
  CRISPR gRNA sequence
agtccatttcttcatctgta

SEQ ID NO: 564192 - DNA, 20 bp, Artificial
  CRISPR gRNA sequence
cttcatctgtagcctggtgc

SEQ ID NO: 564193 - DNA, 20 bp, Artificial
  CRISPR gRNA sequence
ttcatctgtagcctggtgct

SEQ ID NO: 564194 - DNA, 20 bp, Artificial
  CRISPR gRNA sequence
catctgtagcctggtgcttc

SEQ ID NO: 564195 - DNA, 20 bp, Artificial
  CRISPR gRNA sequence
atctgtagcctggtgcttcg

SEQ ID NO: 564196 - DNA, 20 bp, Artificial
  CRISPR gRNA sequence
tagcctggtgcttcggaatc

SEQ ID NO: 564197 - DNA, 20 bp, Artificial
  CRISPR gRNA sequence
gtgcttcggaatctttgacc

SEQ ID NO: 564198 - DNA, 20 bp, Artificial
  CRISPR gRNA sequence
cggaatctttgaccttctct

SEQ ID NO: 564199 - DNA, 20 bp, Artificial
  CRISPR gRNA sequence
ggaatctttgaccttctcta

SEQ ID NO: 564200 - DNA, 20 bp, Artificial
  CRISPR gRNA sequence
tgaccttctctatcaaccaa

SEQ ID NO: 564201 - DNA, 20 bp, Artificial
  CRISPR gRNA sequence
gaccttctctatcaaccaag

SEQ ID NO: 564202 - DNA, 20 bp, Artificial
  CRISPR gRNA sequence
accttctctatcaaccaagt

SEQ ID NO: 564203 - DNA, 20 bp, Artificial
  CRISPR gRNA sequence
ctctatcaaccaagtgtcca

SEQ ID NO: 564204 - DNA, 20 bp, Artificial
  CRISPR gRNA sequence
tctatcaaccaagtgtccag

SEQ ID NO: 564205 - DNA, 20 bp, Artificial
  CRISPR gRNA sequence
tatcaaccaagtgtccagcg

SEQ ID NO: 564206 - DNA, 20 bp, Artificial
  CRISPR gRNA sequence
tcaaccaagtgtccagcgga

SEQ ID NO: 564207 - DNA, 20 bp, Artificial
  CRISPR gRNA sequence
actttgataggcgtgttctc

SEQ ID NO: 564208 - DNA, 20 bp, Artificial
  CRISPR gRNA sequence
ctttgataggcgtgttctca

SEQ ID NO: 564209 - DNA, 20 bp, Artificial
  CRISPR gRNA sequence
tgataggcgtgttctcaaga

SEQ ID NO: 564210 - DNA, 20 bp, Artificial
  CRISPR gRNA sequence
gataggcgtgttctcaagaa

SEQ ID NO: 564211 - DNA, 20 bp, Artificial
  CRISPR gRNA sequence
ataggcgtgttctcaagaaa

SEQ ID NO: 564212 - DNA, 20 bp, Artificial
  CRISPR gRNA sequence
tcaagaaataactcctttct

SEQ ID NO: 564213 - DNA, 20 bp, Artificial
  CRISPR gRNA sequence
aagaaataactcctttctca

SEQ ID NO: 564214 - DNA, 20 bp, Artificial
  CRISPR gRNA sequence
ctttctcactctcaccccag

SEQ ID NO: 564215 - DNA, 20 bp, Artificial
  CRISPR gRNA sequence
tctcactctcaccccagatg

SEQ ID NO: 564216 - DNA, 20 bp, Artificial
  CRISPR gRNA sequence
ctcactctcaccccagatgt

SEQ ID NO: 564217 - DNA, 20 bp, Artificial
  CRISPR gRNA sequence
tcactctcaccccagatgtt

SEQ ID NO: 564218 - DNA, 20 bp, Artificial
  CRISPR gRNA sequence
actctcaccccagatgttct

SEQ ID NO: 564219 - DNA, 20 bp, Artificial
  CRISPR gRNA sequence
tcaccccagatgttcttagg

SEQ ID NO: 564220 - DNA, 20 bp, Artificial
  CRISPR gRNA sequence
accccagatgttcttaggct

SEQ ID NO: 564221 - DNA, 20 bp, Artificial
  CRISPR gRNA sequence
ttaggctcgctcccctgctt

SEQ ID NO: 564222 - DNA, 20 bp, Artificial
  CRISPR gRNA sequence
aggctcgctcccctgctttt

SEQ ID NO: 564223 - DNA, 20 bp, Artificial
  CRISPR gRNA sequence
ggctcgctcccctgcttttc

SEQ ID NO: 564224 - DNA, 20 bp, Artificial
  CRISPR gRNA sequence
gctcccctgcttttctggac

SEQ ID NO: 564225 - DNA, 20 bp, Artificial
  CRISPR gRNA sequence
ccctgcttttctggactctg

SEQ ID NO: 564226 - DNA, 20 bp, Artificial
  CRISPR gRNA sequence
cttttctggactctgctcag

SEQ ID NO: 564227 - DNA, 20 bp, Artificial
  CRISPR gRNA sequence
ttctggactctgctcagatg

SEQ ID NO: 564228 - DNA, 20 bp, Artificial
  CRISPR gRNA sequence
tctggactctgctcagatgc

SEQ ID NO: 564229 - DNA, 20 bp, Artificial
  CRISPR gRNA sequence
ctggactctgctcagatgcc

SEQ ID NO: 564230 - DNA, 20 bp, Artificial
  CRISPR gRNA sequence
tggactctgctcagatgcca

SEQ ID NO: 564231 - DNA, 20 bp, Artificial
  CRISPR gRNA sequence
gactctgctcagatgccaac

SEQ ID NO: 564232 - DNA, 20 bp, Artificial
  CRISPR gRNA sequence
tgctcagatgccaacttatg

SEQ ID NO: 564233 - DNA, 20 bp, Artificial
  CRISPR gRNA sequence
ctcagatgccaacttatgac

SEQ ID NO: 564234 - DNA, 20 bp, Artificial
  CRISPR gRNA sequence
agatgccaacttatgactgc

SEQ ID NO: 564235 - DNA, 20 bp, Artificial
  CRISPR gRNA sequence
atgactgccccccatgccat

SEQ ID NO: 564236 - DNA, 20 bp, Artificial
  CRISPR gRNA sequence
tgactgccccccatgccatc

SEQ ID NO: 564237 - DNA, 20 bp, Artificial
  CRISPR gRNA sequence
ccccccatgccatccaactc

SEQ ID NO: 564238 - DNA, 20 bp, Artificial
  CRISPR gRNA sequence
ctttccttaccagtactcct

SEQ ID NO: 564239 - DNA, 20 bp, Artificial
  CRISPR gRNA sequence
tccttaccagtactcctcag

SEQ ID NO: 564240 - DNA, 20 bp, Artificial
  CRISPR gRNA sequence
ccttaccagtactcctcagc

SEQ ID NO: 564241 - DNA, 20 bp, Artificial
  CRISPR gRNA sequence
cttaccagtactcctcagcc

SEQ ID NO: 564242 - DNA, 20 bp, Artificial
  CRISPR gRNA sequence
accagtactcctcagccccc

SEQ ID NO: 564243 - DNA, 20 bp, Artificial
  CRISPR gRNA sequence
ccagtactcctcagccccca

SEQ ID NO: 564244 - DNA, 20 bp, Artificial
  CRISPR gRNA sequence
ctcagcccccacactctgct

SEQ ID NO: 564245 - DNA, 20 bp, Artificial
  CRISPR gRNA sequence
agcccccacactctgcttta

SEQ ID NO: 564246 - DNA, 20 bp, Artificial
  CRISPR gRNA sequence
tgctttatttttctctatag

SEQ ID NO: 564247 - DNA, 20 bp, Artificial
  CRISPR gRNA sequence
ctttatttttctctatagca

SEQ ID NO: 564248 - DNA, 20 bp, Artificial
  CRISPR gRNA sequence
tatttttctctatagcactt

SEQ ID NO: 564249 - DNA, 20 bp, Artificial
  CRISPR gRNA sequence
atttttctctatagcactta

SEQ ID NO: 564250 - DNA, 20 bp, Artificial
  CRISPR gRNA sequence
tttttctctatagcacttaa

SEQ ID NO: 564251 - DNA, 20 bp, Artificial
  CRISPR gRNA sequence
ttctctatagcacttaacat

SEQ ID NO: 564252 - DNA, 20 bp, Artificial
  CRISPR gRNA sequence
tctctatagcacttaacatc

SEQ ID NO: 564253 - DNA, 20 bp, Artificial
  CRISPR gRNA sequence
ctctatagcacttaacatca

SEQ ID NO: 564254 - DNA, 20 bp, Artificial
  CRISPR gRNA sequence
tctatagcacttaacatcat

SEQ ID NO: 564255 - DNA, 20 bp, Artificial
  CRISPR gRNA sequence
tatagcacttaacatcatcc

SEQ ID NO: 564256 - DNA, 20 bp, Artificial
  CRISPR gRNA sequence
tagcacttaacatcatccaa

SEQ ID NO: 564257 - DNA, 20 bp, Artificial
  CRISPR gRNA sequence
aacatcatccaacatcatcc

SEQ ID NO: 564258 - DNA, 20 bp, Artificial
  CRISPR gRNA sequence
acatcatccaacatcatcca

SEQ ID NO: 564259 - DNA, 20 bp, Artificial
  CRISPR gRNA sequence
actttttcatttattatgtt

SEQ ID NO: 564260 - DNA, 20 bp, Artificial
  CRISPR gRNA sequence
ctttttcatttattatgttc

SEQ ID NO: 564261 - DNA, 20 bp, Artificial
  CRISPR gRNA sequence
tttcatttattatgttcttc

SEQ ID NO: 564262 - DNA, 20 bp, Artificial
  CRISPR gRNA sequence
ttcatttattatgttcttcc

SEQ ID NO: 564263 - DNA, 20 bp, Artificial
  CRISPR gRNA sequence
tcatttattatgttcttccc

SEQ ID NO: 564264 - DNA, 20 bp, Artificial
  CRISPR gRNA sequence
catttattatgttcttccct

SEQ ID NO: 564265 - DNA, 20 bp, Artificial
  CRISPR gRNA sequence
atttattatgttcttccctc

SEQ ID NO: 564266 - DNA, 20 bp, Artificial
  CRISPR gRNA sequence
attatgttcttccctccact

SEQ ID NO: 564267 - DNA, 20 bp, Artificial
  CRISPR gRNA sequence
ttatgttcttccctccactg

SEQ ID NO: 564268 - DNA, 20 bp, Artificial
  CRISPR gRNA sequence
tgttcttccctccactgaaa

SEQ ID NO: 564269 - DNA, 20 bp, Artificial
  CRISPR gRNA sequence
ttccctccactgaaaaatag

SEQ ID NO: 564270 - DNA, 20 bp, Artificial
  CRISPR gRNA sequence
ccctccactgaaaaatagac

SEQ ID NO: 564271 - DNA, 20 bp, Artificial
  CRISPR gRNA sequence
cctccactgaaaaatagact

SEQ ID NO: 564272 - DNA, 20 bp, Artificial
  CRISPR gRNA sequence
cactgaaaaatagactccaa

SEQ ID NO: 564273 - DNA, 20 bp, Artificial
  CRISPR gRNA sequence
aaaaatagactccaagaggg

SEQ ID NO: 564274 - DNA, 20 bp, Artificial
  CRISPR gRNA sequence
caagagggctgggattttgt

SEQ ID NO: 564275 - DNA, 20 bp, Artificial
  CRISPR gRNA sequence
ggattttgtctgttttgttc

SEQ ID NO: 564276 - DNA, 20 bp, Artificial
  CRISPR gRNA sequence
tgtctgttttgttcattgct

SEQ ID NO: 564277 - DNA, 20 bp, Artificial
  CRISPR gRNA sequence
gtctgttttgttcattgcta

SEQ ID NO: 564278 - DNA, 20 bp, Artificial
  CRISPR gRNA sequence
tctgttttgttcattgctat

SEQ ID NO: 564279 - DNA, 20 bp, Artificial
  CRISPR gRNA sequence
ttttgttcattgctatatcc

SEQ ID NO: 564280 - DNA, 20 bp, Artificial
  CRISPR gRNA sequence
tgttcattgctatatcctgc

SEQ ID NO: 564281 - DNA, 20 bp, Artificial
  CRISPR gRNA sequence
gttcattgctatatcctgcc

SEQ ID NO: 564282 - DNA, 20 bp, Artificial
  CRISPR gRNA sequence
ttcattgctatatcctgcct

SEQ ID NO: 564283 - DNA, 20 bp, Artificial
  CRISPR gRNA sequence
attgctatatcctgcctgct

SEQ ID NO: 564284 - DNA, 20 bp, Artificial
  CRISPR gRNA sequence
ctatatcctgcctgcttatt

SEQ ID NO: 564285 - DNA, 20 bp, Artificial
  CRISPR gRNA sequence
tatcctgcctgcttatttca

SEQ ID NO: 564286 - DNA, 20 bp, Artificial
  CRISPR gRNA sequence
cctgcttatttcagtgtctg

SEQ ID NO: 564287 - DNA, 20 bp, Artificial
  CRISPR gRNA sequence
cttatttcagtgtctggcac

SEQ ID NO: 564288 - DNA, 20 bp, Artificial
  CRISPR gRNA sequence
atttcagtgtctggcacata

SEQ ID NO: 564289 - DNA, 20 bp, Artificial
  CRISPR gRNA sequence
tttcagtgtctggcacatag

SEQ ID NO: 564290 - DNA, 20 bp, Artificial
  CRISPR gRNA sequence
cagtgtctggcacataggca

SEQ ID NO: 564291 - DNA, 20 bp, Artificial
  CRISPR gRNA sequence
agtgtctggcacataggcag

SEQ ID NO: 564292 - DNA, 20 bp, Artificial
  CRISPR gRNA sequence
gcacataggcaggactccat

SEQ ID NO: 564293 - DNA, 20 bp, Artificial
  CRISPR gRNA sequence
catgaacatttgatgaacaa

SEQ ID NO: 564294 - DNA, 20 bp, Artificial
  CRISPR gRNA sequence
gatgaacaaataaatgaata

SEQ ID NO: 564295 - DNA, 20 bp, Artificial
  CRISPR gRNA sequence
atgaacaaataaatgaataa

SEQ ID NO: 564296 - DNA, 20 bp, Artificial
  CRISPR gRNA sequence
cctcagagttgagttgagga

SEQ ID NO: 564297 - DNA, 20 bp, Artificial
  CRISPR gRNA sequence
agagttgagttgaggattaa

SEQ ID NO: 564298 - DNA, 20 bp, Artificial
  CRISPR gRNA sequence
agttgaggattaaatgagtt

SEQ ID NO: 564299 - DNA, 20 bp, Artificial
  CRISPR gRNA sequence
aggattaaatgagttaatac

SEQ ID NO: 564300 - DNA, 20 bp, Artificial
  CRISPR gRNA sequence
aatgagttaatacacaaaca

SEQ ID NO: 564301 - DNA, 20 bp, Artificial
  CRISPR gRNA sequence
atacacaaacagctcttgga

SEQ ID NO: 564302 - DNA, 20 bp, Artificial
  CRISPR gRNA sequence
ttggaacaagtgcttgtcac

SEQ ID NO: 564303 - DNA, 20 bp, Artificial
  CRISPR gRNA sequence
ggaacaagtgcttgtcacat

SEQ ID NO: 564304 - DNA, 20 bp, Artificial
  CRISPR gRNA sequence
gaacaagtgcttgtcacata

SEQ ID NO: 564305 - DNA, 20 bp, Artificial
  CRISPR gRNA sequence
gtcacatagtaagcctgcag

SEQ ID NO: 564306 - DNA, 20 bp, Artificial
  CRISPR gRNA sequence
tcacatagtaagcctgcagt

SEQ ID NO: 564307 - DNA, 20 bp, Artificial
  CRISPR gRNA sequence
cagtgaatcttcgtgctgct

SEQ ID NO: 564308 - DNA, 20 bp, Artificial
  CRISPR gRNA sequence
cgtgctgctgctactgttaa

SEQ ID NO: 564309 - DNA, 20 bp, Artificial
  CRISPR gRNA sequence
gtgctgctgctactgttaaa

SEQ ID NO: 564310 - DNA, 20 bp, Artificial
  CRISPR gRNA sequence
ctgctactgttaaatattat

SEQ ID NO: 564311 - DNA, 20 bp, Artificial
  CRISPR gRNA sequence
ctactgttaaatattattac

SEQ ID NO: 564312 - DNA, 20 bp, Artificial
  CRISPR gRNA sequence
ctgttaaatattattactga

SEQ ID NO: 564313 - DNA, 20 bp, Artificial
  CRISPR gRNA sequence
ttaaatattattactgaggc

SEQ ID NO: 564314 - DNA, 20 bp, Artificial
  CRISPR gRNA sequence
aatattattactgaggctga

SEQ ID NO: 564315 - DNA, 20 bp, Artificial
  CRISPR gRNA sequence
ttactgaggctgagctggcc

SEQ ID NO: 564316 - DNA, 20 bp, Artificial
  CRISPR gRNA sequence
ctgaggctgagctggcctag

SEQ ID NO: 564317 - DNA, 20 bp, Artificial
  CRISPR gRNA sequence
aggctgagctggcctagggc

SEQ ID NO: 564318 - DNA, 20 bp, Artificial
  CRISPR gRNA sequence
agctggcctagggctccttg

SEQ ID NO: 564319 - DNA, 20 bp, Artificial
  CRISPR gRNA sequence
gcctagggctccttggattg

SEQ ID NO: 564320 - DNA, 20 bp, Artificial
  CRISPR gRNA sequence
gggctccttggattggactt

SEQ ID NO: 564321 - DNA, 20 bp, Artificial
  CRISPR gRNA sequence
cttggattggacttgctaag

SEQ ID NO: 564322 - DNA, 20 bp, Artificial
  CRISPR gRNA sequence
ggattggacttgctaagagc

SEQ ID NO: 564323 - DNA, 20 bp, Artificial
  CRISPR gRNA sequence
gattggacttgctaagagct

SEQ ID NO: 564324 - DNA, 20 bp, Artificial
  CRISPR gRNA sequence
gacttgctaagagctaggca

SEQ ID NO: 564325 - DNA, 20 bp, Artificial
  CRISPR gRNA sequence
gctaagagctaggcaagagt

SEQ ID NO: 564326 - DNA, 20 bp, Artificial
  CRISPR gRNA sequence
ctaagagctaggcaagagtc

SEQ ID NO: 564327 - DNA, 20 bp, Artificial
  CRISPR gRNA sequence
agagctaggcaagagtcaca

SEQ ID NO: 564328 - DNA, 20 bp, Artificial
  CRISPR gRNA sequence
ggcaagagtcacaactgtat

SEQ ID NO: 564329 - DNA, 20 bp, Artificial
  CRISPR gRNA sequence
tatgaaacttgattgagtta

SEQ ID NO: 564330 - DNA, 20 bp, Artificial
  CRISPR gRNA sequence
gattgagttaaaacaaacag

SEQ ID NO: 564331 - DNA, 20 bp, Artificial
  CRISPR gRNA sequence
attgagttaaaacaaacagt

SEQ ID NO: 564332 - DNA, 20 bp, Artificial
  CRISPR gRNA sequence
agttaaaacaaacagtgcta

SEQ ID NO: 564333 - DNA, 20 bp, Artificial
  CRISPR gRNA sequence
aaacaaacagtgctactcct

SEQ ID NO: 564334 - DNA, 20 bp, Artificial
  CRISPR gRNA sequence
ctcctctttattatctccat

SEQ ID NO: 564335 - DNA, 20 bp, Artificial
  CRISPR gRNA sequence
ctctttattatctccatgcc

SEQ ID NO: 564336 - DNA, 20 bp, Artificial
  CRISPR gRNA sequence
tttattatctccatgcctgg

SEQ ID NO: 564337 - DNA, 20 bp, Artificial
  CRISPR gRNA sequence
tattatctccatgcctggta

SEQ ID NO: 564338 - DNA, 20 bp, Artificial
  CRISPR gRNA sequence
attatctccatgcctggtaa

SEQ ID NO: 564339 - DNA, 20 bp, Artificial
  CRISPR gRNA sequence
ttatctccatgcctggtaag

SEQ ID NO: 564340 - DNA, 20 bp, Artificial
  CRISPR gRNA sequence
tctccatgcctggtaagcac

SEQ ID NO: 564341 - DNA, 20 bp, Artificial
  CRISPR gRNA sequence
catgcctggtaagcacattt

SEQ ID NO: 564342 - DNA, 20 bp, Artificial
  CRISPR gRNA sequence
gtaagcacattttctacccc

SEQ ID NO: 564343 - DNA, 20 bp, Artificial
  CRISPR gRNA sequence
tctacccccaaaattgggac

SEQ ID NO: 564344 - DNA, 20 bp, Artificial
  CRISPR gRNA sequence
ctacccccaaaattgggact

SEQ ID NO: 564345 - DNA, 20 bp, Artificial
  CRISPR gRNA sequence
tacccccaaaattgggactg

SEQ ID NO: 564346 - DNA, 20 bp, Artificial
  CRISPR gRNA sequence
cccccaaaattgggactgac

SEQ ID NO: 564347 - DNA, 20 bp, Artificial
  CRISPR gRNA sequence
ggactgactaatatgagaat

SEQ ID NO: 564348 - DNA, 20 bp, Artificial
  CRISPR gRNA sequence
actaatatgagaatatttat

SEQ ID NO: 564349 - DNA, 20 bp, Artificial
  CRISPR gRNA sequence
atatgagaatatttatggcc

SEQ ID NO: 564350 - DNA, 20 bp, Artificial
  CRISPR gRNA sequence
atggccttaataggacaggt

SEQ ID NO: 564351 - DNA, 20 bp, Artificial
  CRISPR gRNA sequence
tggccttaataggacaggtt

SEQ ID NO: 564352 - DNA, 20 bp, Artificial
  CRISPR gRNA sequence
aataggacaggttatttgat

SEQ ID NO: 564353 - DNA, 20 bp, Artificial
  CRISPR gRNA sequence
ataggacaggttatttgata

SEQ ID NO: 564354 - DNA, 20 bp, Artificial
  CRISPR gRNA sequence
tttgatacaattactagcct

SEQ ID NO: 564355 - DNA, 20 bp, Artificial
  CRISPR gRNA sequence
gatacaattactagcctaga

SEQ ID NO: 564356 - DNA, 20 bp, Artificial
  CRISPR gRNA sequence
atacaattactagcctagac

SEQ ID NO: 564357 - DNA, 20 bp, Artificial
  CRISPR gRNA sequence
ctagcctagacattttagga

SEQ ID NO: 564358 - DNA, 20 bp, Artificial
  CRISPR gRNA sequence
gcctagacattttaggagat

SEQ ID NO: 564359 - DNA, 20 bp, Artificial
  CRISPR gRNA sequence
gacattttaggagattggcc

SEQ ID NO: 564360 - DNA, 20 bp, Artificial
  CRISPR gRNA sequence
taggagattggccgctcctc

SEQ ID NO: 564361 - DNA, 20 bp, Artificial
  CRISPR gRNA sequence
aggagattggccgctcctca

SEQ ID NO: 564362 - DNA, 20 bp, Artificial
  CRISPR gRNA sequence
ggagattggccgctcctcaa

SEQ ID NO: 564363 - DNA, 20 bp, Artificial
  CRISPR gRNA sequence
gccgctcctcaatactataa

SEQ ID NO: 564364 - DNA, 20 bp, Artificial
  CRISPR gRNA sequence
ctcaatactataaatgcata

SEQ ID NO: 564365 - DNA, 20 bp, Artificial
  CRISPR gRNA sequence
aatactataaatgcatatat

SEQ ID NO: 564366 - DNA, 20 bp, Artificial
  CRISPR gRNA sequence
taaatgcatatatgggtgtg

SEQ ID NO: 564367 - DNA, 20 bp, Artificial
  CRISPR gRNA sequence
cttcccagattgccacacat

SEQ ID NO: 564368 - DNA, 20 bp, Artificial
  CRISPR gRNA sequence
cccagattgccacacatcct

SEQ ID NO: 564369 - DNA, 20 bp, Artificial
  CRISPR gRNA sequence
ccagattgccacacatcctg

SEQ ID NO: 564370 - DNA, 20 bp, Artificial
  CRISPR gRNA sequence
ccacacatcctgatactgca

SEQ ID NO: 564371 - DNA, 20 bp, Artificial
  CRISPR gRNA sequence
atactgcaagtaggcatcaa

SEQ ID NO: 564372 - DNA, 20 bp, Artificial
  CRISPR gRNA sequence
caagtaggcatcaactgaaa

SEQ ID NO: 564373 - DNA, 20 bp, Artificial
  CRISPR gRNA sequence
aaaatgtgccgtgatgtgaa

SEQ ID NO: 564374 - DNA, 20 bp, Artificial
  CRISPR gRNA sequence
tgctcagtgacccatatcca

SEQ ID NO: 564375 - DNA, 20 bp, Artificial
  CRISPR gRNA sequence
agtgacccatatccagatga

SEQ ID NO: 564376 - DNA, 20 bp, Artificial
  CRISPR gRNA sequence
ctcacttgggagcaaaaatg

SEQ ID NO: 564377 - DNA, 20 bp, Artificial
  CRISPR gRNA sequence
acttgggagcaaaaatgccc

SEQ ID NO: 564378 - DNA, 20 bp, Artificial
  CRISPR gRNA sequence
gggagcaaaaatgccccaag

SEQ ID NO: 564379 - DNA, 20 bp, Artificial
  CRISPR gRNA sequence
ggagcaaaaatgccccaaga

SEQ ID NO: 564380 - DNA, 20 bp, Artificial
  CRISPR gRNA sequence
ctatctctgggcttgcacga

SEQ ID NO: 564381 - DNA, 20 bp, Artificial
  CRISPR gRNA sequence
tctctgggcttgcacgaggc

SEQ ID NO: 564382 - DNA, 20 bp, Artificial
  CRISPR gRNA sequence
tgggcttgcacgaggcttta

SEQ ID NO: 564383 - DNA, 20 bp, Artificial
  CRISPR gRNA sequence
ggcttgcacgaggctttaaa

SEQ ID NO: 564384 - DNA, 20 bp, Artificial
  CRISPR gRNA sequence
gcacgaggctttaaatgaat

SEQ ID NO: 564385 - DNA, 20 bp, Artificial
  CRISPR gRNA sequence
cacgaggctttaaatgaatc

SEQ ID NO: 564386 - DNA, 20 bp, Artificial
  CRISPR gRNA sequence
taaatgaatcaccattatga

SEQ ID NO: 564387 - DNA, 20 bp, Artificial
  CRISPR gRNA sequence
aaatgaatcaccattatgat

SEQ ID NO: 564388 - DNA, 20 bp, Artificial
  CRISPR gRNA sequence
aatgaatcaccattatgatg

SEQ ID NO: 564389 - DNA, 20 bp, Artificial
  CRISPR gRNA sequence
tgatgtcttatattcagagg

SEQ ID NO: 564390 - DNA, 20 bp, Artificial
  CRISPR gRNA sequence
atattcagagggaaatacca

SEQ ID NO: 564391 - DNA, 20 bp, Artificial
  CRISPR gRNA sequence
tattcagagggaaataccaa

SEQ ID NO: 564392 - DNA, 20 bp, Artificial
  CRISPR gRNA sequence
agagggaaataccaatattc

SEQ ID NO: 564393 - DNA, 20 bp, Artificial
  CRISPR gRNA sequence
atatattcaggtactgaaac

SEQ ID NO: 564394 - DNA, 20 bp, Artificial
  CRISPR gRNA sequence
aggtactgaaacttttaagg

SEQ ID NO: 564395 - DNA, 20 bp, Artificial
  CRISPR gRNA sequence
aaacttttaagggaattttt

SEQ ID NO: 564396 - DNA, 20 bp, Artificial
  CRISPR gRNA sequence
ttaagggaatttttcttttt

SEQ ID NO: 564397 - DNA, 20 bp, Artificial
  CRISPR gRNA sequence
taagggaatttttctttttt

SEQ ID NO: 564398 - DNA, 20 bp, Artificial
  CRISPR gRNA sequence
aagggaatttttcttttttc

SEQ ID NO: 564399 - DNA, 20 bp, Artificial
  CRISPR gRNA sequence
agggaatttttcttttttct

SEQ ID NO: 564400 - DNA, 20 bp, Artificial
  CRISPR gRNA sequence
ttcttttttctttctttttt

SEQ ID NO: 564401 - DNA, 20 bp, Artificial
  CRISPR gRNA sequence
tcttttttctttcttttttt

SEQ ID NO: 564402 - DNA, 20 bp, Artificial
  CRISPR gRNA sequence
cttttttctttctttttttt

SEQ ID NO: 564403 - DNA, 20 bp, Artificial
  CRISPR gRNA sequence
ttttttctttcttttttttt

SEQ ID NO: 564404 - DNA, 20 bp, Artificial
  CRISPR gRNA sequence
ttttctttcttttttttttt

SEQ ID NO: 564405 - DNA, 20 bp, Artificial
  CRISPR gRNA sequence
tttctttctttttttttttt

SEQ ID NO: 564406 - DNA, 20 bp, Artificial
  CRISPR gRNA sequence
ttctttcttttttttttttt

SEQ ID NO: 564407 - DNA, 20 bp, Artificial
  CRISPR gRNA sequence
tctttctttttttttttttt

SEQ ID NO: 564408 - DNA, 20 bp, Artificial
  CRISPR gRNA sequence
ctttcttttttttttttttt

SEQ ID NO: 564409 - DNA, 20 bp, Artificial
  CRISPR gRNA sequence
tttctttttttttttttttt

SEQ ID NO: 564410 - DNA, 20 bp, Artificial
  CRISPR gRNA sequence
tcttttttttttttttttgg

SEQ ID NO: 564411 - DNA, 20 bp, Artificial
  CRISPR gRNA sequence
cttttttttttttttttggt

SEQ ID NO: 564412 - DNA, 20 bp, Artificial
  CRISPR gRNA sequence
ttttttttttttttttggtc

SEQ ID NO: 564413 - DNA, 20 bp, Artificial
  CRISPR gRNA sequence
ttttttttttttttggtcaa

SEQ ID NO: 564414 - DNA, 20 bp, Artificial
  CRISPR gRNA sequence
tttttttttttttggtcaaa

SEQ ID NO: 564415 - DNA, 20 bp, Artificial
  CRISPR gRNA sequence
ttttttttttttggtcaaat

SEQ ID NO: 564416 - DNA, 20 bp, Artificial
  CRISPR gRNA sequence
tttttttttttggtcaaatg

SEQ ID NO: 564417 - DNA, 20 bp, Artificial
  CRISPR gRNA sequence
ttttttttttggtcaaatga

SEQ ID NO: 564418 - DNA, 20 bp, Artificial
  CRISPR gRNA sequence
tttttttttggtcaaatgaa

SEQ ID NO: 564419 - DNA, 20 bp, Artificial
  CRISPR gRNA sequence
ttttttttggtcaaatgaac

SEQ ID NO: 564420 - DNA, 20 bp, Artificial
  CRISPR gRNA sequence
tttttttggtcaaatgaact

SEQ ID NO: 564421 - DNA, 20 bp, Artificial
  CRISPR gRNA sequence
ttttttggtcaaatgaactt

SEQ ID NO: 564422 - DNA, 20 bp, Artificial
  CRISPR gRNA sequence
tttttggtcaaatgaacttt

SEQ ID NO: 564423 - DNA, 20 bp, Artificial
  CRISPR gRNA sequence
ttttggtcaaatgaactttt

SEQ ID NO: 564424 - DNA, 20 bp, Artificial
  CRISPR gRNA sequence
tttggtcaaatgaactttta

SEQ ID NO: 564425 - DNA, 20 bp, Artificial
  CRISPR gRNA sequence
ttggtcaaatgaacttttac

SEQ ID NO: 564426 - DNA, 20 bp, Artificial
  CRISPR gRNA sequence
tggtcaaatgaacttttact

SEQ ID NO: 564427 - DNA, 20 bp, Artificial
  CRISPR gRNA sequence
ggtcaaatgaacttttactt

SEQ ID NO: 564428 - DNA, 20 bp, Artificial
  CRISPR gRNA sequence
gtcaaatgaacttttacttt

SEQ ID NO: 564429 - DNA, 20 bp, Artificial
  CRISPR gRNA sequence
ttactttacctgctaaaatc

SEQ ID NO: 564430 - DNA, 20 bp, Artificial
  CRISPR gRNA sequence
tactttacctgctaaaatct

SEQ ID NO: 564431 - DNA, 20 bp, Artificial
  CRISPR gRNA sequence
actttacctgctaaaatctg

SEQ ID NO: 564432 - DNA, 20 bp, Artificial
  CRISPR gRNA sequence
ctttacctgctaaaatctgc

SEQ ID NO: 564433 - DNA, 20 bp, Artificial
  CRISPR gRNA sequence
tacctgctaaaatctgcagg

SEQ ID NO: 564434 - DNA, 20 bp, Artificial
  CRISPR gRNA sequence
acctgctaaaatctgcaggc

SEQ ID NO: 564435 - DNA, 20 bp, Artificial
  CRISPR gRNA sequence
cctgctaaaatctgcaggca

SEQ ID NO: 564436 - DNA, 20 bp, Artificial
  CRISPR gRNA sequence
ctaaaatctgcaggcagtgt

SEQ ID NO: 564437 - DNA, 20 bp, Artificial
  CRISPR gRNA sequence
aaatctgcaggcagtgtgag

SEQ ID NO: 564438 - DNA, 20 bp, Artificial
  CRISPR gRNA sequence
caggcagtgtgagccttaaa

SEQ ID NO: 564439 - DNA, 20 bp, Artificial
  CRISPR gRNA sequence
aaaatattttagagagagag

SEQ ID NO: 564440 - DNA, 20 bp, Artificial
  CRISPR gRNA sequence
aaatattttagagagagaga

SEQ ID NO: 564441 - DNA, 20 bp, Artificial
  CRISPR gRNA sequence
tagagagagagagagaagta

SEQ ID NO: 564442 - DNA, 20 bp, Artificial
  CRISPR gRNA sequence
agagagagagagagaagtat

SEQ ID NO: 564443 - DNA, 20 bp, Artificial
  CRISPR gRNA sequence
gagagagagagagaagtatc

SEQ ID NO: 564444 - DNA, 20 bp, Artificial
  CRISPR gRNA sequence
aaaattacattgtttatttc

SEQ ID NO: 564445 - DNA, 20 bp, Artificial
  CRISPR gRNA sequence
aaattacattgtttatttct

SEQ ID NO: 564446 - DNA, 20 bp, Artificial
  CRISPR gRNA sequence
cattgtttatttctaagaac

SEQ ID NO: 564447 - DNA, 20 bp, Artificial
  CRISPR gRNA sequence
tttatttctaagaacaaact

SEQ ID NO: 564448 - DNA, 20 bp, Artificial
  CRISPR gRNA sequence
atttctaagaacaaactcaa

SEQ ID NO: 564449 - DNA, 20 bp, Artificial
  CRISPR gRNA sequence
tttctaagaacaaactcaag

SEQ ID NO: 564450 - DNA, 20 bp, Artificial
  CRISPR gRNA sequence
ctaagaacaaactcaagaaa

SEQ ID NO: 564451 - DNA, 20 bp, Artificial
  CRISPR gRNA sequence
taagaacaaactcaagaaaa

SEQ ID NO: 564452 - DNA, 20 bp, Artificial
  CRISPR gRNA sequence
agaacaaactcaagaaaacc

SEQ ID NO: 564453 - DNA, 20 bp, Artificial
  CRISPR gRNA sequence
aagaaaaccctttccttcaa

SEQ ID NO: 564454 - DNA, 20 bp, Artificial
  CRISPR gRNA sequence
tccttcaaatcccggaagag

SEQ ID NO: 564455 - DNA, 20 bp, Artificial
  CRISPR gRNA sequence
ccttcaaatcccggaagagt

SEQ ID NO: 564456 - DNA, 20 bp, Artificial
  CRISPR gRNA sequence
cttcaaatcccggaagagtg

SEQ ID NO: 564457 - DNA, 20 bp, Artificial
  CRISPR gRNA sequence
caaatcccggaagagtgatt

SEQ ID NO: 564458 - DNA, 20 bp, Artificial
  CRISPR gRNA sequence
aaatcccggaagagtgatta

SEQ ID NO: 564459 - DNA, 20 bp, Artificial
  CRISPR gRNA sequence
gcttgtctctaaggtatggc

SEQ ID NO: 564460 - DNA, 20 bp, Artificial
  CRISPR gRNA sequence
gtctctaaggtatggcattg

SEQ ID NO: 564461 - DNA, 20 bp, Artificial
  CRISPR gRNA sequence
tctctaaggtatggcattgg

SEQ ID NO: 564462 - DNA, 20 bp, Artificial
  CRISPR gRNA sequence
taaggtatggcattggctgg

SEQ ID NO: 564463 - DNA, 20 bp, Artificial
  CRISPR gRNA sequence
aggtatggcattggctgggc

SEQ ID NO: 564464 - DNA, 20 bp, Artificial
  CRISPR gRNA sequence
gctgggcatggtggctcatg

SEQ ID NO: 564465 - DNA, 20 bp, Artificial
  CRISPR gRNA sequence
ggcatggtggctcatgcttg

SEQ ID NO: 564466 - DNA, 20 bp, Artificial
  CRISPR gRNA sequence
atgcttgtaatctcagcact

SEQ ID NO: 564467 - DNA, 20 bp, Artificial
  CRISPR gRNA sequence
gtaatctcagcacttcagaa

SEQ ID NO: 564468 - DNA, 20 bp, Artificial
  CRISPR gRNA sequence
taatctcagcacttcagaag

SEQ ID NO: 564469 - DNA, 20 bp, Artificial
  CRISPR gRNA sequence
agcacttcagaaggcccagg

SEQ ID NO: 564470 - DNA, 20 bp, Artificial
  CRISPR gRNA sequence
cagaaggcccagggaggagg

SEQ ID NO: 564471 - DNA, 20 bp, Artificial
  CRISPR gRNA sequence
agaaggcccagggaggagga

SEQ ID NO: 564472 - DNA, 20 bp, Artificial
  CRISPR gRNA sequence
gagcccacgagtttgagatc

SEQ ID NO: 564473 - DNA, 20 bp, Artificial
  CRISPR gRNA sequence
agcccacgagtttgagatca

SEQ ID NO: 564474 - DNA, 20 bp, Artificial
  CRISPR gRNA sequence
gagatcagcctgagcaacat

SEQ ID NO: 564475 - DNA, 20 bp, Artificial
  CRISPR gRNA sequence
agatcagcctgagcaacata

SEQ ID NO: 564476 - DNA, 20 bp, Artificial
  CRISPR gRNA sequence
agcaacatagtgagaccttg

SEQ ID NO: 564477 - DNA, 20 bp, Artificial
  CRISPR gRNA sequence
gtttctacaaaaaatataaa

SEQ ID NO: 564478 - DNA, 20 bp, Artificial
  CRISPR gRNA sequence
tttctacaaaaaatataaaa

SEQ ID NO: 564479 - DNA, 20 bp, Artificial
  CRISPR gRNA sequence
ctacaaaaaatataaaaatt

SEQ ID NO: 564480 - DNA, 20 bp, Artificial
  CRISPR gRNA sequence
tacaaaaaatataaaaatta

SEQ ID NO: 564481 - DNA, 20 bp, Artificial
  CRISPR gRNA sequence
caaaaaatataaaaattagc

SEQ ID NO: 564482 - DNA, 20 bp, Artificial
  CRISPR gRNA sequence
gctgggcgtggtggcatgca

SEQ ID NO: 564483 - DNA, 20 bp, Artificial
  CRISPR gRNA sequence
ggcgtggtggcatgcaactg

SEQ ID NO: 564484 - DNA, 20 bp, Artificial
  CRISPR gRNA sequence
tagttctagctacttgggag

SEQ ID NO: 564485 - DNA, 20 bp, Artificial
  CRISPR gRNA sequence
tagctacttgggaggctgag

SEQ ID NO: 564486 - DNA, 20 bp, Artificial
  CRISPR gRNA sequence
gctacttgggaggctgaggc

SEQ ID NO: 564487 - DNA, 20 bp, Artificial
  CRISPR gRNA sequence
cttgggaggctgaggcagaa

SEQ ID NO: 564488 - DNA, 20 bp, Artificial
  CRISPR gRNA sequence
gggaggctgaggcagaagga

SEQ ID NO: 564489 - DNA, 20 bp, Artificial
  CRISPR gRNA sequence
ggaggctgaggcagaaggat

SEQ ID NO: 564490 - DNA, 20 bp, Artificial
  CRISPR gRNA sequence
aggcagaaggatcacttgag

SEQ ID NO: 564491 - DNA, 20 bp, Artificial
  CRISPR gRNA sequence
gagcccaggaggttgaagct

SEQ ID NO: 564492 - DNA, 20 bp, Artificial
  CRISPR gRNA sequence
agcccaggaggttgaagcta

SEQ ID NO: 564493 - DNA, 20 bp, Artificial
  CRISPR gRNA sequence
aagctacagtgagccacgat

SEQ ID NO: 564494 - DNA, 20 bp, Artificial
  CRISPR gRNA sequence
cagtgagccacgattgcacc

SEQ ID NO: 564495 - DNA, 20 bp, Artificial
  CRISPR gRNA sequence
caccactgcacaccaacctg

SEQ ID NO: 564496 - DNA, 20 bp, Artificial
  CRISPR gRNA sequence
cacaccaacctgggtgacag

SEQ ID NO: 564497 - DNA, 20 bp, Artificial
  CRISPR gRNA sequence
ggtgacagaatgagaccctg

SEQ ID NO: 564498 - DNA, 20 bp, Artificial
  CRISPR gRNA sequence
tctccaaaaagaaaaaggaa

SEQ ID NO: 564499 - DNA, 20 bp, Artificial
  CRISPR gRNA sequence
caaaaagaaaaaggaaggaa

SEQ ID NO: 564500 - DNA, 20 bp, Artificial
  CRISPR gRNA sequence
ctcaaaccatagcgaggctg

SEQ ID NO: 564501 - DNA, 20 bp, Artificial
  CRISPR gRNA sequence
aaaccatagcgaggctgtta

SEQ ID NO: 564502 - DNA, 20 bp, Artificial
  CRISPR gRNA sequence
ttaagtttgattggggctga

SEQ ID NO: 564503 - DNA, 20 bp, Artificial
  CRISPR gRNA sequence
agtttgattggggctgacat

SEQ ID NO: 564504 - DNA, 20 bp, Artificial
  CRISPR gRNA sequence
gattggggctgacatccatg

SEQ ID NO: 564505 - DNA, 20 bp, Artificial
  CRISPR gRNA sequence
attggggctgacatccatga

SEQ ID NO: 564506 - DNA, 20 bp, Artificial
  CRISPR gRNA sequence
gggctgacatccatgagtgg

SEQ ID NO: 564507 - DNA, 20 bp, Artificial
  CRISPR gRNA sequence
acatccatgagtgggtacaa

SEQ ID NO: 564508 - DNA, 20 bp, Artificial
  CRISPR gRNA sequence
atctggtgtggtgccctgca

SEQ ID NO: 564509 - DNA, 20 bp, Artificial
  CRISPR gRNA sequence
tctggtgtggtgccctgcat

SEQ ID NO: 564510 - DNA, 20 bp, Artificial
  CRISPR gRNA sequence
gtgtggtgccctgcatccta

SEQ ID NO: 564511 - DNA, 20 bp, Artificial
  CRISPR gRNA sequence
catcctataacacttagttg

SEQ ID NO: 564512 - DNA, 20 bp, Artificial
  CRISPR gRNA sequence
taacacttagttggtaaaat

SEQ ID NO: 564513 - DNA, 20 bp, Artificial
  CRISPR gRNA sequence
agttggtaaaatctacttaa

SEQ ID NO: 564514 - DNA, 20 bp, Artificial
  CRISPR gRNA sequence
gttggtaaaatctacttaaa

SEQ ID NO: 564515 - DNA, 20 bp, Artificial
  CRISPR gRNA sequence
gtaaaatctacttaaacttg

SEQ ID NO: 564516 - DNA, 20 bp, Artificial
  CRISPR gRNA sequence
cttaaacttgagagggaaca

SEQ ID NO: 564517 - DNA, 20 bp, Artificial
  CRISPR gRNA sequence
aaacttgagagggaacatct

SEQ ID NO: 564518 - DNA, 20 bp, Artificial
  CRISPR gRNA sequence
aacttgagagggaacatctc

SEQ ID NO: 564519 - DNA, 20 bp, Artificial
  CRISPR gRNA sequence
gagagggaacatctcaaaag

SEQ ID NO: 564520 - DNA, 20 bp, Artificial
  CRISPR gRNA sequence
agagggaacatctcaaaagg

SEQ ID NO: 564521 - DNA, 20 bp, Artificial
  CRISPR gRNA sequence
aaaagggacagctgtggagt

SEQ ID NO: 564522 - DNA, 20 bp, Artificial
  CRISPR gRNA sequence
tggagttgggaaggtggagc

SEQ ID NO: 564523 - DNA, 20 bp, Artificial
  CRISPR gRNA sequence
ggaaggtggagcccgcaggt

SEQ ID NO: 564524 - DNA, 20 bp, Artificial
  CRISPR gRNA sequence
ccatcttgctttggtgatga

SEQ ID NO: 564525 - DNA, 20 bp, Artificial
  CRISPR gRNA sequence
gctttggtgatgaggcagaa

SEQ ID NO: 564526 - DNA, 20 bp, Artificial
  CRISPR gRNA sequence
ctttggtgatgaggcagaaa

SEQ ID NO: 564527 - DNA, 20 bp, Artificial
  CRISPR gRNA sequence
tggtgatgaggcagaaagtg

SEQ ID NO: 564528 - DNA, 20 bp, Artificial
  CRISPR gRNA sequence
ggtgatgaggcagaaagtgg

SEQ ID NO: 564529 - DNA, 20 bp, Artificial
  CRISPR gRNA sequence
gtgatgaggcagaaagtggg

SEQ ID NO: 564530 - DNA, 20 bp, Artificial
  CRISPR gRNA sequence
aaaaactgagtctgttttgg

SEQ ID NO: 564531 - DNA, 20 bp, Artificial
  CRISPR gRNA sequence
agtctgttttggttgtatat

SEQ ID NO: 564532 - DNA, 20 bp, Artificial
  CRISPR gRNA sequence
ttttggttgtatatgagggc

SEQ ID NO: 564533 - DNA, 20 bp, Artificial
  CRISPR gRNA sequence
tggttgtatatgagggctcc

SEQ ID NO: 564534 - DNA, 20 bp, Artificial
  CRISPR gRNA sequence
ggttgtatatgagggctcct

SEQ ID NO: 564535 - DNA, 20 bp, Artificial
  CRISPR gRNA sequence
gttgtatatgagggctcctg

SEQ ID NO: 564536 - DNA, 20 bp, Artificial
  CRISPR gRNA sequence
tatatgagggctcctgagcc

SEQ ID NO: 564537 - DNA, 20 bp, Artificial
  CRISPR gRNA sequence
ctgagccattttatttttaa

SEQ ID NO: 564538 - DNA, 20 bp, Artificial
  CRISPR gRNA sequence
agccattttatttttaagct

SEQ ID NO: 564539 - DNA, 20 bp, Artificial
  CRISPR gRNA sequence
tatttttaagctccagttaa

SEQ ID NO: 564540 - DNA, 20 bp, Artificial
  CRISPR gRNA sequence
atttttaagctccagttaaa

SEQ ID NO: 564541 - DNA, 20 bp, Artificial
  CRISPR gRNA sequence
tttttaagctccagttaaac

SEQ ID NO: 564542 - DNA, 20 bp, Artificial
  CRISPR gRNA sequence
ttaagctccagttaaacttc

SEQ ID NO: 564543 - DNA, 20 bp, Artificial
  CRISPR gRNA sequence
taagctccagttaaacttct

SEQ ID NO: 564544 - DNA, 20 bp, Artificial
  CRISPR gRNA sequence
aagctccagttaaacttctt

SEQ ID NO: 564545 - DNA, 20 bp, Artificial
  CRISPR gRNA sequence
agctccagttaaacttcttt

SEQ ID NO: 564546 - DNA, 20 bp, Artificial
  CRISPR gRNA sequence
cagttaaacttctttctcca

SEQ ID NO: 564547 - DNA, 20 bp, Artificial
  CRISPR gRNA sequence
aacttctttctccatctctc

SEQ ID NO: 564548 - DNA, 20 bp, Artificial
  CRISPR gRNA sequence
ctttctccatctctccttac

SEQ ID NO: 564549 - DNA, 20 bp, Artificial
  CRISPR gRNA sequence
tttctccatctctccttacg

SEQ ID NO: 564550 - DNA, 20 bp, Artificial
  CRISPR gRNA sequence
tctccatctctccttacgaa

SEQ ID NO: 564551 - DNA, 20 bp, Artificial
  CRISPR gRNA sequence
ctccatctctccttacgaag

SEQ ID NO: 564552 - DNA, 20 bp, Artificial
  CRISPR gRNA sequence
tccatctctccttacgaagt

SEQ ID NO: 564553 - DNA, 20 bp, Artificial
  CRISPR gRNA sequence
catctctccttacgaagtcc

SEQ ID NO: 564554 - DNA, 20 bp, Artificial
  CRISPR gRNA sequence
tccttacgaagtcctccttc

SEQ ID NO: 564555 - DNA, 20 bp, Artificial
  CRISPR gRNA sequence
cttacgaagtcctccttctt

SEQ ID NO: 564556 - DNA, 20 bp, Artificial
  CRISPR gRNA sequence
acgaagtcctccttcttcag

SEQ ID NO: 564557 - DNA, 20 bp, Artificial
  CRISPR gRNA sequence
cgaagtcctccttcttcagc

SEQ ID NO: 564558 - DNA, 20 bp, Artificial
  CRISPR gRNA sequence
cttcttcagccaggttccac

SEQ ID NO: 564559 - DNA, 20 bp, Artificial
  CRISPR gRNA sequence
cttcagccaggttccacagc

SEQ ID NO: 564560 - DNA, 20 bp, Artificial
  CRISPR gRNA sequence
ttcagccaggttccacagca

SEQ ID NO: 564561 - DNA, 20 bp, Artificial
  CRISPR gRNA sequence
cagccaggttccacagcaat

SEQ ID NO: 564562 - DNA, 20 bp, Artificial
  CRISPR gRNA sequence
agccaggttccacagcaatt

SEQ ID NO: 564563 - DNA, 20 bp, Artificial
  CRISPR gRNA sequence
cacagcaatttgggatttca

SEQ ID NO: 564564 - DNA, 20 bp, Artificial
  CRISPR gRNA sequence
gggatttcacaaagcccagg

SEQ ID NO: 564565 - DNA, 20 bp, Artificial
  CRISPR gRNA sequence
ggatttcacaaagcccaggg

SEQ ID NO: 564566 - DNA, 20 bp, Artificial
  CRISPR gRNA sequence
cacaaagcccagggtttggg

SEQ ID NO: 564567 - DNA, 20 bp, Artificial
  CRISPR gRNA sequence
acaaagcccagggtttgggg

SEQ ID NO: 564568 - DNA, 20 bp, Artificial
  CRISPR gRNA sequence
ggggtgactgtcaaattttg

SEQ ID NO: 564569 - DNA, 20 bp, Artificial
  CRISPR gRNA sequence
gggtgactgtcaaattttgc

SEQ ID NO: 564570 - DNA, 20 bp, Artificial
  CRISPR gRNA sequence
tcaaattttgctattctgtc

SEQ ID NO: 564571 - DNA, 20 bp, Artificial
  CRISPR gRNA sequence
tgctattctgtcaggaagcc

SEQ ID NO: 564572 - DNA, 20 bp, Artificial
  CRISPR gRNA sequence
gctattctgtcaggaagcct

SEQ ID NO: 564573 - DNA, 20 bp, Artificial
  CRISPR gRNA sequence
ctattctgtcaggaagcctt

SEQ ID NO: 564574 - DNA, 20 bp, Artificial
  CRISPR gRNA sequence
ttctgtcaggaagccttatc

SEQ ID NO: 564575 - DNA, 20 bp, Artificial
  CRISPR gRNA sequence
tgtcaggaagccttatcttt

SEQ ID NO: 564576 - DNA, 20 bp, Artificial
  CRISPR gRNA sequence
tcaggaagccttatcttttg

SEQ ID NO: 564577 - DNA, 20 bp, Artificial
  CRISPR gRNA sequence
atcttttgaactacatttaa

SEQ ID NO: 564578 - DNA, 20 bp, Artificial
  CRISPR gRNA sequence
tcttttgaactacatttaag

SEQ ID NO: 564579 - DNA, 20 bp, Artificial
  CRISPR gRNA sequence
ttgaactacatttaagttgt

SEQ ID NO: 564580 - DNA, 20 bp, Artificial
  CRISPR gRNA sequence
tgaactacatttaagttgta

SEQ ID NO: 564581 - DNA, 20 bp, Artificial
  CRISPR gRNA sequence
gaactacatttaagttgtat

SEQ ID NO: 564582 - DNA, 20 bp, Artificial
  CRISPR gRNA sequence
aactacatttaagttgtatt

SEQ ID NO: 564583 - DNA, 20 bp, Artificial
  CRISPR gRNA sequence
catttaagttgtattttaat

SEQ ID NO: 564584 - DNA, 20 bp, Artificial
  CRISPR gRNA sequence
aagttgtattttaatcattt

SEQ ID NO: 564585 - DNA, 20 bp, Artificial
  CRISPR gRNA sequence
agttgtattttaatcatttt

SEQ ID NO: 564586 - DNA, 20 bp, Artificial
  CRISPR gRNA sequence
tattttaatcattttagtta

SEQ ID NO: 564587 - DNA, 20 bp, Artificial
  CRISPR gRNA sequence
taatcattttagttaattca

SEQ ID NO: 564588 - DNA, 20 bp, Artificial
  CRISPR gRNA sequence
aatcattttagttaattcat

SEQ ID NO: 564589 - DNA, 20 bp, Artificial
  CRISPR gRNA sequence
atcattttagttaattcatt

SEQ ID NO: 564590 - DNA, 20 bp, Artificial
  CRISPR gRNA sequence
tagttaattcattcaacaga

SEQ ID NO: 564591 - DNA, 20 bp, Artificial
  CRISPR gRNA sequence
agttaattcattcaacagat

SEQ ID NO: 564592 - DNA, 20 bp, Artificial
  CRISPR gRNA sequence
gttaattcattcaacagata

SEQ ID NO: 564593 - DNA, 20 bp, Artificial
  CRISPR gRNA sequence
attcattcaacagatattta

SEQ ID NO: 564594 - DNA, 20 bp, Artificial
  CRISPR gRNA sequence
attcaacagatatttattga

SEQ ID NO: 564595 - DNA, 20 bp, Artificial
  CRISPR gRNA sequence
aacagatatttattgaaagt

SEQ ID NO: 564596 - DNA, 20 bp, Artificial
  CRISPR gRNA sequence
attgaaagtccatatgccag

SEQ ID NO: 564597 - DNA, 20 bp, Artificial
  CRISPR gRNA sequence
ttgaaagtccatatgccaga

SEQ ID NO: 564598 - DNA, 20 bp, Artificial
  CRISPR gRNA sequence
aaagtccatatgccagacat

SEQ ID NO: 564599 - DNA, 20 bp, Artificial
  CRISPR gRNA sequence
tgtccttgtcctgatagggc

SEQ ID NO: 564600 - DNA, 20 bp, Artificial
  CRISPR gRNA sequence
gtccttgtcctgatagggct

SEQ ID NO: 564601 - DNA, 20 bp, Artificial
  CRISPR gRNA sequence
tccttgtcctgatagggcta

SEQ ID NO: 564602 - DNA, 20 bp, Artificial
  CRISPR gRNA sequence
gtcctgatagggctagcctg

SEQ ID NO: 564603 - DNA, 20 bp, Artificial
  CRISPR gRNA sequence
tcctgatagggctagcctgg

SEQ ID NO: 564604 - DNA, 20 bp, Artificial
  CRISPR gRNA sequence
atagggctagcctggctggg

SEQ ID NO: 564605 - DNA, 20 bp, Artificial
  CRISPR gRNA sequence
gcctggctggggttacccct

SEQ ID NO: 564606 - DNA, 20 bp, Artificial
  CRISPR gRNA sequence
gctggggttacccctaagct

SEQ ID NO: 564607 - DNA, 20 bp, Artificial
  CRISPR gRNA sequence
gggttacccctaagctcaga

SEQ ID NO: 564608 - DNA, 20 bp, Artificial
  CRISPR gRNA sequence
cccctaagctcagatttgaa

SEQ ID NO: 564609 - DNA, 20 bp, Artificial
  CRISPR gRNA sequence
agctcagatttgaattagtt

SEQ ID NO: 564610 - DNA, 20 bp, Artificial
  CRISPR gRNA sequence
agatttgaattagttgccaa

SEQ ID NO: 564611 - DNA, 20 bp, Artificial
  CRISPR gRNA sequence
gaattagttgccaactttca

SEQ ID NO: 564612 - DNA, 20 bp, Artificial
  CRISPR gRNA sequence
aattagttgccaactttcaa

SEQ ID NO: 564613 - DNA, 20 bp, Artificial
  CRISPR gRNA sequence
gttgccaactttcaagaaca

SEQ ID NO: 564614 - DNA, 20 bp, Artificial
  CRISPR gRNA sequence
ccaactttcaagaacaggaa

SEQ ID NO: 564615 - DNA, 20 bp, Artificial
  CRISPR gRNA sequence
tcaagaacaggaattttcac

SEQ ID NO: 564616 - DNA, 20 bp, Artificial
  CRISPR gRNA sequence
caagaacaggaattttcaca

SEQ ID NO: 564617 - DNA, 20 bp, Artificial
  CRISPR gRNA sequence
aagaacaggaattttcacac

SEQ ID NO: 564618 - DNA, 20 bp, Artificial
  CRISPR gRNA sequence
tcacacaaaatgtgaatatc

SEQ ID NO: 564619 - DNA, 20 bp, Artificial
  CRISPR gRNA sequence
cacacaaaatgtgaatatct

SEQ ID NO: 564620 - DNA, 20 bp, Artificial
  CRISPR gRNA sequence
acacaaaatgtgaatatctg

SEQ ID NO: 564621 - DNA, 20 bp, Artificial
  CRISPR gRNA sequence
gctttttttgaaaaattggg

SEQ ID NO: 564622 - DNA, 20 bp, Artificial
  CRISPR gRNA sequence
tttttgaaaaattgggaacc

SEQ ID NO: 564623 - DNA, 20 bp, Artificial
  CRISPR gRNA sequence
ttttgaaaaattgggaacct

SEQ ID NO: 564624 - DNA, 20 bp, Artificial
  CRISPR gRNA sequence
tttgaaaaattgggaacctg

SEQ ID NO: 564625 - DNA, 20 bp, Artificial
  CRISPR gRNA sequence
ttgaaaaattgggaacctgg

SEQ ID NO: 564626 - DNA, 20 bp, Artificial
  CRISPR gRNA sequence
tgaaaaattgggaacctggc

SEQ ID NO: 564627 - DNA, 20 bp, Artificial
  CRISPR gRNA sequence
gaaaaattgggaacctggca

SEQ ID NO: 564628 - DNA, 20 bp, Artificial
  CRISPR gRNA sequence
aaaaattgggaacctggcaa

SEQ ID NO: 564629 - DNA, 20 bp, Artificial
  CRISPR gRNA sequence
ggaacctggcaatggtgggc

SEQ ID NO: 564630 - DNA, 20 bp, Artificial
  CRISPR gRNA sequence
gcaatggtgggcctctgttt

SEQ ID NO: 564631 - DNA, 20 bp, Artificial
  CRISPR gRNA sequence
tgtttccacatggcaggagc

SEQ ID NO: 564632 - DNA, 20 bp, Artificial
  CRISPR gRNA sequence
tttccacatggcaggagctg

SEQ ID NO: 564633 - DNA, 20 bp, Artificial
  CRISPR gRNA sequence
ccacatggcaggagctgagg

SEQ ID NO: 564634 - DNA, 20 bp, Artificial
  CRISPR gRNA sequence
cacatggcaggagctgaggc

SEQ ID NO: 564635 - DNA, 20 bp, Artificial
  CRISPR gRNA sequence
aggcacagctcctgtttcca

SEQ ID NO: 564636 - DNA, 20 bp, Artificial
  CRISPR gRNA sequence
ctgtttccacatggcaggcc

SEQ ID NO: 564637 - DNA, 20 bp, Artificial
  CRISPR gRNA sequence
tttccacatggcaggcccct

SEQ ID NO: 564638 - DNA, 20 bp, Artificial
  CRISPR gRNA sequence
ccacatggcaggcccctccc

SEQ ID NO: 564639 - DNA, 20 bp, Artificial
  CRISPR gRNA sequence
cacatggcaggcccctccct

SEQ ID NO: 564640 - DNA, 20 bp, Artificial
  CRISPR gRNA sequence
cctgtaggctcactggtgcg

SEQ ID NO: 564641 - DNA, 20 bp, Artificial
  CRISPR gRNA sequence
taggctcactggtgcgcaag

SEQ ID NO: 564642 - DNA, 20 bp, Artificial
  CRISPR gRNA sequence
actggtgcgcaagtcctcac

SEQ ID NO: 564643 - DNA, 20 bp, Artificial
  CRISPR gRNA sequence
gtgcgcaagtcctcaccagt

SEQ ID NO: 564644 - DNA, 20 bp, Artificial
  CRISPR gRNA sequence
accagtcccttctgactcac

SEQ ID NO: 564645 - DNA, 20 bp, Artificial
  CRISPR gRNA sequence
ctgactcacacttggcccgc

SEQ ID NO: 564646 - DNA, 20 bp, Artificial
  CRISPR gRNA sequence
tgactcacacttggcccgct

SEQ ID NO: 564647 - DNA, 20 bp, Artificial
  CRISPR gRNA sequence
actcacacttggcccgctgg

SEQ ID NO: 564648 - DNA, 20 bp, Artificial
  CRISPR gRNA sequence
acacttggcccgctggtatc

SEQ ID NO: 564649 - DNA, 20 bp, Artificial
  CRISPR gRNA sequence
ggcccgctggtatctcctct

SEQ ID NO: 564650 - DNA, 20 bp, Artificial
  CRISPR gRNA sequence
gcccgctggtatctcctctg

SEQ ID NO: 564651 - DNA, 20 bp, Artificial
  CRISPR gRNA sequence
gtatctcctctgtgggtgga

SEQ ID NO: 564652 - DNA, 20 bp, Artificial
  CRISPR gRNA sequence
ctctgtgggtggaattgctg

SEQ ID NO: 564653 - DNA, 20 bp, Artificial
  CRISPR gRNA sequence
tgtgggtggaattgctggtc

SEQ ID NO: 564654 - DNA, 20 bp, Artificial
  CRISPR gRNA sequence
tgggtggaattgctggtctt

SEQ ID NO: 564655 - DNA, 20 bp, Artificial
  CRISPR gRNA sequence
ctggtcttcgtctaatgcgt

SEQ ID NO: 564656 - DNA, 20 bp, Artificial
  CRISPR gRNA sequence
gtcttcgtctaatgcgtcat

SEQ ID NO: 564657 - DNA, 20 bp, Artificial
  CRISPR gRNA sequence
cgtctaatgcgtcatttgcc

SEQ ID NO: 564658 - DNA, 20 bp, Artificial
  CRISPR gRNA sequence
gtctaatgcgtcatttgcca

SEQ ID NO: 564659 - DNA, 20 bp, Artificial
  CRISPR gRNA sequence
atgcgtcatttgccacagtt

SEQ ID NO: 564660 - DNA, 20 bp, Artificial
  CRISPR gRNA sequence
gccacagttctgtttctttg

SEQ ID NO: 564661 - DNA, 20 bp, Artificial
  CRISPR gRNA sequence
ccacagttctgtttctttgt

SEQ ID NO: 564662 - DNA, 20 bp, Artificial
  CRISPR gRNA sequence
tgtttctttgtgactccttt

SEQ ID NO: 564663 - DNA, 20 bp, Artificial
  CRISPR gRNA sequence
tttctttgtgactcctttgt

SEQ ID NO: 564664 - DNA, 20 bp, Artificial
  CRISPR gRNA sequence
ctttgtgactcctttgtttg

SEQ ID NO: 564665 - DNA, 20 bp, Artificial
  CRISPR gRNA sequence
tttgtgactcctttgtttgc

SEQ ID NO: 564666 - DNA, 20 bp, Artificial
  CRISPR gRNA sequence
tgtgactcctttgtttgctc

SEQ ID NO: 564667 - DNA, 20 bp, Artificial
  CRISPR gRNA sequence
gtgactcctttgtttgctcg

SEQ ID NO: 564668 - DNA, 20 bp, Artificial
  CRISPR gRNA sequence
tgactcctttgtttgctcgt

SEQ ID NO: 564669 - DNA, 20 bp, Artificial
  CRISPR gRNA sequence
ctttgtttgctcgttttctt

SEQ ID NO: 564670 - DNA, 20 bp, Artificial
  CRISPR gRNA sequence
tgtttgctcgttttcttttt

SEQ ID NO: 564671 - DNA, 20 bp, Artificial
  CRISPR gRNA sequence
gtttgctcgttttcttttta

SEQ ID NO: 564672 - DNA, 20 bp, Artificial
  CRISPR gRNA sequence
tttgctcgttttctttttat

SEQ ID NO: 564673 - DNA, 20 bp, Artificial
  CRISPR gRNA sequence
gctcgttttctttttattgt

SEQ ID NO: 564674 - DNA, 20 bp, Artificial
  CRISPR gRNA sequence
ctcgttttctttttattgtt

SEQ ID NO: 564675 - DNA, 20 bp, Artificial
  CRISPR gRNA sequence
gttttctttttattgtttct

SEQ ID NO: 564676 - DNA, 20 bp, Artificial
  CRISPR gRNA sequence
tctttttattgtttctggtc

SEQ ID NO: 564677 - DNA, 20 bp, Artificial
  CRISPR gRNA sequence
ctttttattgtttctggtct

SEQ ID NO: 564678 - DNA, 20 bp, Artificial
  CRISPR gRNA sequence
tttttattgtttctggtctg

SEQ ID NO: 564679 - DNA, 20 bp, Artificial
  CRISPR gRNA sequence
tttattgtttctggtctggc

SEQ ID NO: 564680 - DNA, 20 bp, Artificial
  CRISPR gRNA sequence
ttattgtttctggtctggct

SEQ ID NO: 564681 - DNA, 20 bp, Artificial
  CRISPR gRNA sequence
tattgtttctggtctggctt

SEQ ID NO: 564682 - DNA, 20 bp, Artificial
  CRISPR gRNA sequence
attgtttctggtctggcttt

SEQ ID NO: 564683 - DNA, 20 bp, Artificial
  CRISPR gRNA sequence
ttgtttctggtctggctttt

SEQ ID NO: 564684 - DNA, 20 bp, Artificial
  CRISPR gRNA sequence
tttctggtctggctttttct

SEQ ID NO: 564685 - DNA, 20 bp, Artificial
  CRISPR gRNA sequence
ctggtctggctttttcttcc

SEQ ID NO: 564686 - DNA, 20 bp, Artificial
  CRISPR gRNA sequence
tggtctggctttttcttcct

SEQ ID NO: 564687 - DNA, 20 bp, Artificial
  CRISPR gRNA sequence
gtctggctttttcttccttg

SEQ ID NO: 564688 - DNA, 20 bp, Artificial
  CRISPR gRNA sequence
gctttttcttccttgactgg

SEQ ID NO: 564689 - DNA, 20 bp, Artificial
  CRISPR gRNA sequence
tttcttccttgactggagtc

SEQ ID NO: 564690 - DNA, 20 bp, Artificial
  CRISPR gRNA sequence
ttcttccttgactggagtct

SEQ ID NO: 564691 - DNA, 20 bp, Artificial
  CRISPR gRNA sequence
tcttccttgactggagtctt

SEQ ID NO: 564692 - DNA, 20 bp, Artificial
  CRISPR gRNA sequence
cttccttgactggagtcttg

SEQ ID NO: 564693 - DNA, 20 bp, Artificial
  CRISPR gRNA sequence
ttccttgactggagtcttgc

SEQ ID NO: 564694 - DNA, 20 bp, Artificial
  CRISPR gRNA sequence
ccttgactggagtcttgctc

SEQ ID NO: 564695 - DNA, 20 bp, Artificial
  CRISPR gRNA sequence
cttgactggagtcttgctct

SEQ ID NO: 564696 - DNA, 20 bp, Artificial
  CRISPR gRNA sequence
gactggagtcttgctctctg

SEQ ID NO: 564697 - DNA, 20 bp, Artificial
  CRISPR gRNA sequence
actggagtcttgctctctga

SEQ ID NO: 564698 - DNA, 20 bp, Artificial
  CRISPR gRNA sequence
gagtcttgctctctgaggcc

SEQ ID NO: 564699 - DNA, 20 bp, Artificial
  CRISPR gRNA sequence
gctctctgaggccctcttca

SEQ ID NO: 564700 - DNA, 20 bp, Artificial
  CRISPR gRNA sequence
ctctctgaggccctcttcag

SEQ ID NO: 564701 - DNA, 20 bp, Artificial
  CRISPR gRNA sequence
tctgaggccctcttcagctc

SEQ ID NO: 564702 - DNA, 20 bp, Artificial
  CRISPR gRNA sequence
tgaggccctcttcagctcta

SEQ ID NO: 564703 - DNA, 20 bp, Artificial
  CRISPR gRNA sequence
aggccctcttcagctctagc

SEQ ID NO: 564704 - DNA, 20 bp, Artificial
  CRISPR gRNA sequence
ttcagctctagcattcgatg

SEQ ID NO: 564705 - DNA, 20 bp, Artificial
  CRISPR gRNA sequence
cagctctagcattcgatgat

SEQ ID NO: 564706 - DNA, 20 bp, Artificial
  CRISPR gRNA sequence
agctctagcattcgatgatt

SEQ ID NO: 564707 - DNA, 20 bp, Artificial
  CRISPR gRNA sequence
tagcattcgatgatttggaa

SEQ ID NO: 564708 - DNA, 20 bp, Artificial
  CRISPR gRNA sequence
gcattcgatgatttggaaac

SEQ ID NO: 564709 - DNA, 20 bp, Artificial
  CRISPR gRNA sequence
gatgatttggaaaccacaga

SEQ ID NO: 564710 - DNA, 20 bp, Artificial
  CRISPR gRNA sequence
ggaaaccacagagcttagtg

SEQ ID NO: 564711 - DNA, 20 bp, Artificial
  CRISPR gRNA sequence
gaaaccacagagcttagtgc

SEQ ID NO: 564712 - DNA, 20 bp, Artificial
  CRISPR gRNA sequence
agtgcctcacctgtaggttt

SEQ ID NO: 564713 - DNA, 20 bp, Artificial
  CRISPR gRNA sequence
gtgcctcacctgtaggtttg

SEQ ID NO: 564714 - DNA, 20 bp, Artificial
  CRISPR gRNA sequence
acctgtaggtttggaggtgt

SEQ ID NO: 564715 - DNA, 20 bp, Artificial
  CRISPR gRNA sequence
taggtttggaggtgtgctta

SEQ ID NO: 564716 - DNA, 20 bp, Artificial
  CRISPR gRNA sequence
ggaggtgtgcttaactcagt

SEQ ID NO: 564717 - DNA, 20 bp, Artificial
  CRISPR gRNA sequence
gaggtgtgcttaactcagtt

SEQ ID NO: 564718 - DNA, 20 bp, Artificial
  CRISPR gRNA sequence
aactcagtttgactttctca

SEQ ID NO: 564719 - DNA, 20 bp, Artificial
  CRISPR gRNA sequence
actcagtttgactttctcat

SEQ ID NO: 564720 - DNA, 20 bp, Artificial
  CRISPR gRNA sequence
agtttgactttctcatttgc

SEQ ID NO: 564721 - DNA, 20 bp, Artificial
  CRISPR gRNA sequence
gactttctcatttgcaacat

SEQ ID NO: 564722 - DNA, 20 bp, Artificial
  CRISPR gRNA sequence
actttctcatttgcaacatc

SEQ ID NO: 564723 - DNA, 20 bp, Artificial
  CRISPR gRNA sequence
tctcatttgcaacatctgct

SEQ ID NO: 564724 - DNA, 20 bp, Artificial
  CRISPR gRNA sequence
ctcatttgcaacatctgctg

SEQ ID NO: 564725 - DNA, 20 bp, Artificial
  CRISPR gRNA sequence
tcatttgcaacatctgctgt

SEQ ID NO: 564726 - DNA, 20 bp, Artificial
  CRISPR gRNA sequence
atttgcaacatctgctgttc

SEQ ID NO: 564727 - DNA, 20 bp, Artificial
  CRISPR gRNA sequence
gcaacatctgctgttccaat

SEQ ID NO: 564728 - DNA, 20 bp, Artificial
  CRISPR gRNA sequence
caacatctgctgttccaatg

SEQ ID NO: 564729 - DNA, 20 bp, Artificial
  CRISPR gRNA sequence
ctgttccaatgctgtctata

SEQ ID NO: 564730 - DNA, 20 bp, Artificial
  CRISPR gRNA sequence
ttccaatgctgtctatagat

SEQ ID NO: 564731 - DNA, 20 bp, Artificial
  CRISPR gRNA sequence
caatgctgtctatagattgt

SEQ ID NO: 564732 - DNA, 20 bp, Artificial
  CRISPR gRNA sequence
tctatagattgtatcctgag

SEQ ID NO: 564733 - DNA, 20 bp, Artificial
  CRISPR gRNA sequence
tagattgtatcctgagaaac

SEQ ID NO: 564734 - DNA, 20 bp, Artificial
  CRISPR gRNA sequence
tatcctgagaaaccctgcat

SEQ ID NO: 564735 - DNA, 20 bp, Artificial
  CRISPR gRNA sequence
agaaaccctgcatcatgtca

SEQ ID NO: 564736 - DNA, 20 bp, Artificial
  CRISPR gRNA sequence
catcatgtcactatctttaa

SEQ ID NO: 564737 - DNA, 20 bp, Artificial
  CRISPR gRNA sequence
tctttaagagccttatgcca

SEQ ID NO: 564738 - DNA, 20 bp, Artificial
  CRISPR gRNA sequence
taagagccttatgccatgta

SEQ ID NO: 564739 - DNA, 20 bp, Artificial
  CRISPR gRNA sequence
aagagccttatgccatgtag

SEQ ID NO: 564740 - DNA, 20 bp, Artificial
  CRISPR gRNA sequence
agagccttatgccatgtagc

SEQ ID NO: 564741 - DNA, 20 bp, Artificial
  CRISPR gRNA sequence
atgccatgtagcaagctaaa

SEQ ID NO: 564742 - DNA, 20 bp, Artificial
  CRISPR gRNA sequence
tgccatgtagcaagctaaat

SEQ ID NO: 564743 - DNA, 20 bp, Artificial
  CRISPR gRNA sequence
aataagaaacaatggttaag

SEQ ID NO: 564744 - DNA, 20 bp, Artificial
  CRISPR gRNA sequence
agagcactgattctgcagtc

SEQ ID NO: 564745 - DNA, 20 bp, Artificial
  CRISPR gRNA sequence
attctgcagtcagattgtcc

SEQ ID NO: 564746 - DNA, 20 bp, Artificial
  CRISPR gRNA sequence
tgcagtcagattgtccaggt

SEQ ID NO: 564747 - DNA, 20 bp, Artificial
  CRISPR gRNA sequence
cagtcagattgtccaggttc

SEQ ID NO: 564748 - DNA, 20 bp, Artificial
  CRISPR gRNA sequence
tccaggttcaaatctggctt

SEQ ID NO: 564749 - DNA, 20 bp, Artificial
  CRISPR gRNA sequence
aaatctggcttcattactta

SEQ ID NO: 564750 - DNA, 20 bp, Artificial
  CRISPR gRNA sequence
gcttcattacttaacattgt

SEQ ID NO: 564751 - DNA, 20 bp, Artificial
  CRISPR gRNA sequence
cattacttaacattgttgtg

SEQ ID NO: 564752 - DNA, 20 bp, Artificial
  CRISPR gRNA sequence
attacttaacattgttgtgc

SEQ ID NO: 564753 - DNA, 20 bp, Artificial
  CRISPR gRNA sequence
cttaacattgttgtgcctca

SEQ ID NO: 564754 - DNA, 20 bp, Artificial
  CRISPR gRNA sequence
aacattgttgtgcctcagtt

SEQ ID NO: 564755 - DNA, 20 bp, Artificial
  CRISPR gRNA sequence
acattgttgtgcctcagttt

SEQ ID NO: 564756 - DNA, 20 bp, Artificial
  CRISPR gRNA sequence
ttgtgcctcagtttcctcac

SEQ ID NO: 564757 - DNA, 20 bp, Artificial
  CRISPR gRNA sequence
tgcctcagtttcctcacctg

SEQ ID NO: 564758 - DNA, 20 bp, Artificial
  CRISPR gRNA sequence
agtttcctcacctgcaaaat

SEQ ID NO: 564759 - DNA, 20 bp, Artificial
  CRISPR gRNA sequence
cctcacctgcaaaataataa

SEQ ID NO: 564760 - DNA, 20 bp, Artificial
  CRISPR gRNA sequence
ctcacctgcaaaataataag

SEQ ID NO: 564761 - DNA, 20 bp, Artificial
  CRISPR gRNA sequence
acctgcaaaataataaggtt

SEQ ID NO: 564762 - DNA, 20 bp, Artificial
  CRISPR gRNA sequence
caaaataataaggttagaaa

SEQ ID NO: 564763 - DNA, 20 bp, Artificial
  CRISPR gRNA sequence
gaaataaaaccttcttaata

SEQ ID NO: 564764 - DNA, 20 bp, Artificial
  CRISPR gRNA sequence
cttaatatgtttttaggatt

SEQ ID NO: 564765 - DNA, 20 bp, Artificial
  CRISPR gRNA sequence
ttaatatgtttttaggattc

SEQ ID NO: 564766 - DNA, 20 bp, Artificial
  CRISPR gRNA sequence
aatatgtttttaggattctg

SEQ ID NO: 564767 - DNA, 20 bp, Artificial
  CRISPR gRNA sequence
atatgtttttaggattctga

SEQ ID NO: 564768 - DNA, 20 bp, Artificial
  CRISPR gRNA sequence
ttaggattctgatttttttt

SEQ ID NO: 564769 - DNA, 20 bp, Artificial
  CRISPR gRNA sequence
taggattctgattttttttt

SEQ ID NO: 564770 - DNA, 20 bp, Artificial
  CRISPR gRNA sequence
aggattctgatttttttttt

SEQ ID NO: 564771 - DNA, 20 bp, Artificial
  CRISPR gRNA sequence
ggattctgattttttttttt

SEQ ID NO: 564772 - DNA, 20 bp, Artificial
  CRISPR gRNA sequence
tgattttttttttttttttt

SEQ ID NO: 564773 - DNA, 20 bp, Artificial
  CRISPR gRNA sequence
attttttttttttttttttt

SEQ ID NO: 564774 - DNA, 20 bp, Artificial
  CRISPR gRNA sequence
tttttttttttttttttttt

SEQ ID NO: 564775 - DNA, 20 bp, Artificial
  CRISPR gRNA sequence
tttttttttttttttttttt

SEQ ID NO: 564776 - DNA, 20 bp, Artificial
  CRISPR gRNA sequence
tttttttttttttttttttt

SEQ ID NO: 564777 - DNA, 20 bp, Artificial
  CRISPR gRNA sequence
tttttttttttttttttttt

SEQ ID NO: 564778 - DNA, 20 bp, Artificial
  CRISPR gRNA sequence
tttttttttttttttttttc

SEQ ID NO: 564779 - DNA, 20 bp, Artificial
  CRISPR gRNA sequence
ttttttttttttttttttct

SEQ ID NO: 564780 - DNA, 20 bp, Artificial
  CRISPR gRNA sequence
tttttttttttttttttctg

SEQ ID NO: 564781 - DNA, 20 bp, Artificial
  CRISPR gRNA sequence
ttttttttttttttttctga

SEQ ID NO: 564782 - DNA, 20 bp, Artificial
  CRISPR gRNA sequence
tttttttttttttttctgag

SEQ ID NO: 564783 - DNA, 20 bp, Artificial
  CRISPR gRNA sequence
ttttttttttttttctgaga

SEQ ID NO: 564784 - DNA, 20 bp, Artificial
  CRISPR gRNA sequence
tttttttttttttctgagat

SEQ ID NO: 564785 - DNA, 20 bp, Artificial
  CRISPR gRNA sequence
ttttttttttttctgagatg

SEQ ID NO: 564786 - DNA, 20 bp, Artificial
  CRISPR gRNA sequence
tttttttttttctgagatgg

SEQ ID NO: 564787 - DNA, 20 bp, Artificial
  CRISPR gRNA sequence
ttttttttttctgagatgga

SEQ ID NO: 564788 - DNA, 20 bp, Artificial
  CRISPR gRNA sequence
tttttttttctgagatggag

SEQ ID NO: 564789 - DNA, 20 bp, Artificial
  CRISPR gRNA sequence
ttttttttctgagatggagt

SEQ ID NO: 564790 - DNA, 20 bp, Artificial
  CRISPR gRNA sequence
tttttttctgagatggagtc

SEQ ID NO: 564791 - DNA, 20 bp, Artificial
  CRISPR gRNA sequence
ttttttctgagatggagtct

SEQ ID NO: 564792 - DNA, 20 bp, Artificial
  CRISPR gRNA sequence
tttttctgagatggagtctt

SEQ ID NO: 564793 - DNA, 20 bp, Artificial
  CRISPR gRNA sequence
ttttctgagatggagtcttg

SEQ ID NO: 564794 - DNA, 20 bp, Artificial
  CRISPR gRNA sequence
tttctgagatggagtcttgc

SEQ ID NO: 564795 - DNA, 20 bp, Artificial
  CRISPR gRNA sequence
ttctgagatggagtcttgct

SEQ ID NO: 564796 - DNA, 20 bp, Artificial
  CRISPR gRNA sequence
tctgagatggagtcttgctc

SEQ ID NO: 564797 - DNA, 20 bp, Artificial
  CRISPR gRNA sequence
ctgagatggagtcttgctct

SEQ ID NO: 564798 - DNA, 20 bp, Artificial
  CRISPR gRNA sequence
tgagatggagtcttgctctg

SEQ ID NO: 564799 - DNA, 20 bp, Artificial
  CRISPR gRNA sequence
agatggagtcttgctctgtc

SEQ ID NO: 564800 - DNA, 20 bp, Artificial
  CRISPR gRNA sequence
gctctgtcacccaggctgga

SEQ ID NO: 564801 - DNA, 20 bp, Artificial
  CRISPR gRNA sequence
ctctgtcacccaggctggag

SEQ ID NO: 564802 - DNA, 20 bp, Artificial
  CRISPR gRNA sequence
tgtcacccaggctggagtgc

SEQ ID NO: 564803 - DNA, 20 bp, Artificial
  CRISPR gRNA sequence
tcacccaggctggagtgcag

SEQ ID NO: 564804 - DNA, 20 bp, Artificial
  CRISPR gRNA sequence
gagtgcagtggcacagtctt

SEQ ID NO: 564805 - DNA, 20 bp, Artificial
  CRISPR gRNA sequence
ggccactgcaacctccacct

SEQ ID NO: 564806 - DNA, 20 bp, Artificial
  CRISPR gRNA sequence
gccactgcaacctccacctc

SEQ ID NO: 564807 - DNA, 20 bp, Artificial
  CRISPR gRNA sequence
caacctccacctcccgggtt

SEQ ID NO: 564808 - DNA, 20 bp, Artificial
  CRISPR gRNA sequence
cacctcccgggttcaagcga

SEQ ID NO: 564809 - DNA, 20 bp, Artificial
  CRISPR gRNA sequence
ccgggttcaagcgattctcc

SEQ ID NO: 564810 - DNA, 20 bp, Artificial
  CRISPR gRNA sequence
aagcgattctcctgcctcag

SEQ ID NO: 564811 - DNA, 20 bp, Artificial
  CRISPR gRNA sequence
tcctgcctcagcctcccatg

SEQ ID NO: 564812 - DNA, 20 bp, Artificial
  CRISPR gRNA sequence
ctgcctcagcctcccatgta

SEQ ID NO: 564813 - DNA, 20 bp, Artificial
  CRISPR gRNA sequence
cctcagcctcccatgtaact

SEQ ID NO: 564814 - DNA, 20 bp, Artificial
  CRISPR gRNA sequence
agcctcccatgtaactggga

SEQ ID NO: 564815 - DNA, 20 bp, Artificial
  CRISPR gRNA sequence
ccatgtaactgggattacag

SEQ ID NO: 564816 - DNA, 20 bp, Artificial
  CRISPR gRNA sequence
ggattacaggcgagtgccac

SEQ ID NO: 564817 - DNA, 20 bp, Artificial
  CRISPR gRNA sequence
caggcgagtgccaccacgcc

SEQ ID NO: 564818 - DNA, 20 bp, Artificial
  CRISPR gRNA sequence
attttgtatttttagtagag

SEQ ID NO: 564819 - DNA, 20 bp, Artificial
  CRISPR gRNA sequence
tgtatttttagtagagacgg

SEQ ID NO: 564820 - DNA, 20 bp, Artificial
  CRISPR gRNA sequence
gtatttttagtagagacggg

SEQ ID NO: 564821 - DNA, 20 bp, Artificial
  CRISPR gRNA sequence
tatttttagtagagacgggg

SEQ ID NO: 564822 - DNA, 20 bp, Artificial
  CRISPR gRNA sequence
ttagtagagacggggtttca

SEQ ID NO: 564823 - DNA, 20 bp, Artificial
  CRISPR gRNA sequence
tagtagagacggggtttcac

SEQ ID NO: 564824 - DNA, 20 bp, Artificial
  CRISPR gRNA sequence
agtagagacggggtttcacc

SEQ ID NO: 564825 - DNA, 20 bp, Artificial
  CRISPR gRNA sequence
gtagagacggggtttcacca

SEQ ID NO: 564826 - DNA, 20 bp, Artificial
  CRISPR gRNA sequence
caccatgttggccaggctgg

SEQ ID NO: 564827 - DNA, 20 bp, Artificial
  CRISPR gRNA sequence
accatgttggccaggctggt

SEQ ID NO: 564828 - DNA, 20 bp, Artificial
  CRISPR gRNA sequence
gccaggctggtctggaactc

SEQ ID NO: 564829 - DNA, 20 bp, Artificial
  CRISPR gRNA sequence
gtctggaactcctgacctca

SEQ ID NO: 564830 - DNA, 20 bp, Artificial
  CRISPR gRNA sequence
gaactcctgacctcaagtga

SEQ ID NO: 564831 - DNA, 20 bp, Artificial
  CRISPR gRNA sequence
ctgacctcaagtgatccacc

SEQ ID NO: 564832 - DNA, 20 bp, Artificial
  CRISPR gRNA sequence
acctcaagtgatccacctgc

SEQ ID NO: 564833 - DNA, 20 bp, Artificial
  CRISPR gRNA sequence
aagtgatccacctgccttgg

SEQ ID NO: 564834 - DNA, 20 bp, Artificial
  CRISPR gRNA sequence
ccttggcctcccaaagtgct

SEQ ID NO: 564835 - DNA, 20 bp, Artificial
  CRISPR gRNA sequence
ggcctcccaaagtgctggga

SEQ ID NO: 564836 - DNA, 20 bp, Artificial
  CRISPR gRNA sequence
gcctcccaaagtgctgggat

SEQ ID NO: 564837 - DNA, 20 bp, Artificial
  CRISPR gRNA sequence
ccaaagtgctgggattacag

SEQ ID NO: 564838 - DNA, 20 bp, Artificial
  CRISPR gRNA sequence
ggattacaggcatgagccac

SEQ ID NO: 564839 - DNA, 20 bp, Artificial
  CRISPR gRNA sequence
caggcatgagccactgctcc

SEQ ID NO: 564840 - DNA, 20 bp, Artificial
  CRISPR gRNA sequence
ctcccagtggtgagtaccta

SEQ ID NO: 564841 - DNA, 20 bp, Artificial
  CRISPR gRNA sequence
ccagtggtgagtacctattt

SEQ ID NO: 564842 - DNA, 20 bp, Artificial
  CRISPR gRNA sequence
tttatagagcccttgcaaca

SEQ ID NO: 564843 - DNA, 20 bp, Artificial
  CRISPR gRNA sequence
atagagcccttgcaacagtg

SEQ ID NO: 564844 - DNA, 20 bp, Artificial
  CRISPR gRNA sequence
tagagcccttgcaacagtgc

SEQ ID NO: 564845 - DNA, 20 bp, Artificial
  CRISPR gRNA sequence
gcaacagtgcctggcacaga

SEQ ID NO: 564846 - DNA, 20 bp, Artificial
  CRISPR gRNA sequence
caacagtgcctggcacagag

SEQ ID NO: 564847 - DNA, 20 bp, Artificial
  CRISPR gRNA sequence
gcacagagccagggccatac

SEQ ID NO: 564848 - DNA, 20 bp, Artificial
  CRISPR gRNA sequence
gattaagtaaaaaaaaaaag

SEQ ID NO: 564849 - DNA, 20 bp, Artificial
  CRISPR gRNA sequence
agtaaaaaaaaaaagtacca

SEQ ID NO: 564850 - DNA, 20 bp, Artificial
  CRISPR gRNA sequence
aatctcaggccctgagtaat

SEQ ID NO: 564851 - DNA, 20 bp, Artificial
  CRISPR gRNA sequence
aggccctgagtaataatttg

SEQ ID NO: 564852 - DNA, 20 bp, Artificial
  CRISPR gRNA sequence
agtaataatttgcagaggaa

SEQ ID NO: 564853 - DNA, 20 bp, Artificial
  CRISPR gRNA sequence
gcagaggaatttgtgctggg

SEQ ID NO: 564854 - DNA, 20 bp, Artificial
  CRISPR gRNA sequence
cagaggaatttgtgctgggg

SEQ ID NO: 564855 - DNA, 20 bp, Artificial
  CRISPR gRNA sequence
gtgctgggggttgagagttc

SEQ ID NO: 564856 - DNA, 20 bp, Artificial
  CRISPR gRNA sequence
tgctgggggttgagagttcc

SEQ ID NO: 564857 - DNA, 20 bp, Artificial
  CRISPR gRNA sequence
ggggttgagagttccttttc

SEQ ID NO: 564858 - DNA, 20 bp, Artificial
  CRISPR gRNA sequence
agagttccttttcattaacc

SEQ ID NO: 564859 - DNA, 20 bp, Artificial
  CRISPR gRNA sequence
cttttcattaacccatagtt

SEQ ID NO: 564860 - DNA, 20 bp, Artificial
  CRISPR gRNA sequence
ttcattaacccatagttaac

SEQ ID NO: 564861 - DNA, 20 bp, Artificial
  CRISPR gRNA sequence
tcattaacccatagttaacg

SEQ ID NO: 564862 - DNA, 20 bp, Artificial
  CRISPR gRNA sequence
cattaacccatagttaacgg

SEQ ID NO: 564863 - DNA, 20 bp, Artificial
  CRISPR gRNA sequence
attaacccatagttaacggt

SEQ ID NO: 564864 - DNA, 20 bp, Artificial
  CRISPR gRNA sequence
acccatagttaacggtgacc

SEQ ID NO: 564865 - DNA, 20 bp, Artificial
  CRISPR gRNA sequence
acggtgaccagattttctaa

SEQ ID NO: 564866 - DNA, 20 bp, Artificial
  CRISPR gRNA sequence
tctaaataagaaatcaggat

SEQ ID NO: 564867 - DNA, 20 bp, Artificial
  CRISPR gRNA sequence
ctaaataagaaatcaggata

SEQ ID NO: 564868 - DNA, 20 bp, Artificial
  CRISPR gRNA sequence
taaataagaaatcaggatac

SEQ ID NO: 564869 - DNA, 20 bp, Artificial
  CRISPR gRNA sequence
aataagaaatcaggatactt

SEQ ID NO: 564870 - DNA, 20 bp, Artificial
  CRISPR gRNA sequence
catctataaaacttgggttc

SEQ ID NO: 564871 - DNA, 20 bp, Artificial
  CRISPR gRNA sequence
atctataaaacttgggttcc

SEQ ID NO: 564872 - DNA, 20 bp, Artificial
  CRISPR gRNA sequence
taaaacttgggttccagtta

SEQ ID NO: 564873 - DNA, 20 bp, Artificial
  CRISPR gRNA sequence
gggttccagttacaacttca

SEQ ID NO: 564874 - DNA, 20 bp, Artificial
  CRISPR gRNA sequence
ggttccagttacaacttcag

SEQ ID NO: 564875 - DNA, 20 bp, Artificial
  CRISPR gRNA sequence
cagttacaacttcaggccat

SEQ ID NO: 564876 - DNA, 20 bp, Artificial
  CRISPR gRNA sequence
caacttcaggccatacaaaa

SEQ ID NO: 564877 - DNA, 20 bp, Artificial
  CRISPR gRNA sequence
caggccatacaaaaagaact

SEQ ID NO: 564878 - DNA, 20 bp, Artificial
  CRISPR gRNA sequence
aggccatacaaaaagaacta

SEQ ID NO: 564879 - DNA, 20 bp, Artificial
  CRISPR gRNA sequence
ttaaaattgaggtgttgatg

SEQ ID NO: 564880 - DNA, 20 bp, Artificial
  CRISPR gRNA sequence
aaattgaggtgttgatgttt

SEQ ID NO: 564881 - DNA, 20 bp, Artificial
  CRISPR gRNA sequence
aggtgttgatgttttgtaga

SEQ ID NO: 564882 - DNA, 20 bp, Artificial
  CRISPR gRNA sequence
atgttttgtagaaacactgc

SEQ ID NO: 564883 - DNA, 20 bp, Artificial
  CRISPR gRNA sequence
tgtagaaacactgcaacaga

SEQ ID NO: 564884 - DNA, 20 bp, Artificial
  CRISPR gRNA sequence
gtagaaacactgcaacagaa

SEQ ID NO: 564885 - DNA, 20 bp, Artificial
  CRISPR gRNA sequence
tagaaacactgcaacagaat

SEQ ID NO: 564886 - DNA, 20 bp, Artificial
  CRISPR gRNA sequence
caacagaatatttgagatca

SEQ ID NO: 564887 - DNA, 20 bp, Artificial
  CRISPR gRNA sequence
gagatcagacctgtttttag

SEQ ID NO: 564888 - DNA, 20 bp, Artificial
  CRISPR gRNA sequence
agatcagacctgtttttaga

SEQ ID NO: 564889 - DNA, 20 bp, Artificial
  CRISPR gRNA sequence
tttttagatatgtgatcact

SEQ ID NO: 564890 - DNA, 20 bp, Artificial
  CRISPR gRNA sequence
ttagatatgtgatcactcta

SEQ ID NO: 564891 - DNA, 20 bp, Artificial
  CRISPR gRNA sequence
tagatatgtgatcactctat

SEQ ID NO: 564892 - DNA, 20 bp, Artificial
  CRISPR gRNA sequence
agatatgtgatcactctata

SEQ ID NO: 564893 - DNA, 20 bp, Artificial
  CRISPR gRNA sequence
gatatgtgatcactctatac

SEQ ID NO: 564894 - DNA, 20 bp, Artificial
  CRISPR gRNA sequence
tatacatgtagtgctgatta

SEQ ID NO: 564895 - DNA, 20 bp, Artificial
  CRISPR gRNA sequence
tacatgtagtgctgattagg

SEQ ID NO: 564896 - DNA, 20 bp, Artificial
  CRISPR gRNA sequence
attaggtattaggtaccctc

SEQ ID NO: 564897 - DNA, 20 bp, Artificial
  CRISPR gRNA sequence
ggtattaggtaccctcatat

SEQ ID NO: 564898 - DNA, 20 bp, Artificial
  CRISPR gRNA sequence
ggtaccctcatatctttatt

SEQ ID NO: 564899 - DNA, 20 bp, Artificial
  CRISPR gRNA sequence
atatctttatttaaaaaaaa

SEQ ID NO: 564900 - DNA, 20 bp, Artificial
  CRISPR gRNA sequence
tatttaaaaaaaattcaaaa

SEQ ID NO: 564901 - DNA, 20 bp, Artificial
  CRISPR gRNA sequence
atttaaaaaaaattcaaaat

SEQ ID NO: 564902 - DNA, 20 bp, Artificial
  CRISPR gRNA sequence
tttaaaaaaaattcaaaatt

SEQ ID NO: 564903 - DNA, 20 bp, Artificial
  CRISPR gRNA sequence
aaaaaaaattcaaaattctt

SEQ ID NO: 564904 - DNA, 20 bp, Artificial
  CRISPR gRNA sequence
aaaaaaattcaaaattcttc

SEQ ID NO: 564905 - DNA, 20 bp, Artificial
  CRISPR gRNA sequence
aaaattcttcaaaacaaaaa

SEQ ID NO: 564906 - DNA, 20 bp, Artificial
  CRISPR gRNA sequence
ttcaaaacaaaaaaaccttc

SEQ ID NO: 564907 - DNA, 20 bp, Artificial
  CRISPR gRNA sequence
caaaacaaaaaaaccttcaa

SEQ ID NO: 564908 - DNA, 20 bp, Artificial
  CRISPR gRNA sequence
aaaacaaaaaaaccttcaaa

SEQ ID NO: 564909 - DNA, 20 bp, Artificial
  CRISPR gRNA sequence
caaaaattatctggctagca

SEQ ID NO: 564910 - DNA, 20 bp, Artificial
  CRISPR gRNA sequence
aaaaattatctggctagcat

SEQ ID NO: 564911 - DNA, 20 bp, Artificial
  CRISPR gRNA sequence
tctggctagcatagaaaatc

SEQ ID NO: 564912 - DNA, 20 bp, Artificial
  CRISPR gRNA sequence
gctagcatagaaaatctttt

SEQ ID NO: 564913 - DNA, 20 bp, Artificial
  CRISPR gRNA sequence
gcatagaaaatctttttagg

SEQ ID NO: 564914 - DNA, 20 bp, Artificial
  CRISPR gRNA sequence
tttaggcgatcactgataaa

SEQ ID NO: 564915 - DNA, 20 bp, Artificial
  CRISPR gRNA sequence
ttaggcgatcactgataaaa

SEQ ID NO: 564916 - DNA, 20 bp, Artificial
  CRISPR gRNA sequence
taggcgatcactgataaaat

SEQ ID NO: 564917 - DNA, 20 bp, Artificial
  CRISPR gRNA sequence
aggcgatcactgataaaatt

SEQ ID NO: 564918 - DNA, 20 bp, Artificial
  CRISPR gRNA sequence
ggcgatcactgataaaattt

SEQ ID NO: 564919 - DNA, 20 bp, Artificial
  CRISPR gRNA sequence
ataaaattttttccctccct

SEQ ID NO: 564920 - DNA, 20 bp, Artificial
  CRISPR gRNA sequence
tttccctccctccatctctc

SEQ ID NO: 564921 - DNA, 20 bp, Artificial
  CRISPR gRNA sequence
ttccctccctccatctctct

SEQ ID NO: 564922 - DNA, 20 bp, Artificial
  CRISPR gRNA sequence
tccctccctccatctctctt

SEQ ID NO: 564923 - DNA, 20 bp, Artificial
  CRISPR gRNA sequence
ccctccctccatctctcttt

SEQ ID NO: 564924 - DNA, 20 bp, Artificial
  CRISPR gRNA sequence
cctccctccatctctctttg

SEQ ID NO: 564925 - DNA, 20 bp, Artificial
  CRISPR gRNA sequence
cctccatctctctttgcttt

SEQ ID NO: 564926 - DNA, 20 bp, Artificial
  CRISPR gRNA sequence
catctctctttgcttttaaa

SEQ ID NO: 564927 - DNA, 20 bp, Artificial
  CRISPR gRNA sequence
tctttgcttttaaacagcaa

SEQ ID NO: 564928 - DNA, 20 bp, Artificial
  CRISPR gRNA sequence
tttgcttttaaacagcaaaa

SEQ ID NO: 564929 - DNA, 20 bp, Artificial
  CRISPR gRNA sequence
tgcttttaaacagcaaaaac

SEQ ID NO: 564930 - DNA, 20 bp, Artificial
  CRISPR gRNA sequence
gcttttaaacagcaaaaact

SEQ ID NO: 564931 - DNA, 20 bp, Artificial
  CRISPR gRNA sequence
cttttaaacagcaaaaactc

SEQ ID NO: 564932 - DNA, 20 bp, Artificial
  CRISPR gRNA sequence
ttaaacagcaaaaactcacc

SEQ ID NO: 564933 - DNA, 20 bp, Artificial
  CRISPR gRNA sequence
taaacagcaaaaactcaccc

SEQ ID NO: 564934 - DNA, 20 bp, Artificial
  CRISPR gRNA sequence
aaacagcaaaaactcacccc

SEQ ID NO: 564935 - DNA, 20 bp, Artificial
  CRISPR gRNA sequence
aacagcaaaaactcacccca

SEQ ID NO: 564936 - DNA, 20 bp, Artificial
  CRISPR gRNA sequence
accccatgcccagttctcac

SEQ ID NO: 564937 - DNA, 20 bp, Artificial
  CRISPR gRNA sequence
tcacccagttaattcagaca

SEQ ID NO: 564938 - DNA, 20 bp, Artificial
  CRISPR gRNA sequence
acccagttaattcagacagt

SEQ ID NO: 564939 - DNA, 20 bp, Artificial
  CRISPR gRNA sequence
attcagacagtgtgaatacc

SEQ ID NO: 564940 - DNA, 20 bp, Artificial
  CRISPR gRNA sequence
agacagtgtgaataccttga

SEQ ID NO: 564941 - DNA, 20 bp, Artificial
  CRISPR gRNA sequence
gatgttgacctaactcatta

SEQ ID NO: 564942 - DNA, 20 bp, Artificial
  CRISPR gRNA sequence
atgttgacctaactcattaa

SEQ ID NO: 564943 - DNA, 20 bp, Artificial
  CRISPR gRNA sequence
acctaactcattaaaagaaa

SEQ ID NO: 564944 - DNA, 20 bp, Artificial
  CRISPR gRNA sequence
actcattaaaagaaaaagag

SEQ ID NO: 564945 - DNA, 20 bp, Artificial
  CRISPR gRNA sequence
attaaaagaaaaagagagaa

SEQ ID NO: 564946 - DNA, 20 bp, Artificial
  CRISPR gRNA sequence
aaagaaaaagagagaaaacc

SEQ ID NO: 564947 - DNA, 20 bp, Artificial
  CRISPR gRNA sequence
tgaaagcctattccatgtca

SEQ ID NO: 564948 - DNA, 20 bp, Artificial
  CRISPR gRNA sequence
gaaagcctattccatgtcaa

SEQ ID NO: 564949 - DNA, 20 bp, Artificial
  CRISPR gRNA sequence
aaagcctattccatgtcaac

SEQ ID NO: 564950 - DNA, 20 bp, Artificial
  CRISPR gRNA sequence
ttccatgtcaaccagtgtaa

SEQ ID NO: 564951 - DNA, 20 bp, Artificial
  CRISPR gRNA sequence
catgtcaaccagtgtaaaaa

SEQ ID NO: 564952 - DNA, 20 bp, Artificial
  CRISPR gRNA sequence
tcaattttattcaaacctga

SEQ ID NO: 564953 - DNA, 20 bp, Artificial
  CRISPR gRNA sequence
aattttattcaaacctgaaa

SEQ ID NO: 564954 - DNA, 20 bp, Artificial
  CRISPR gRNA sequence
tattcaaacctgaaaacaat

SEQ ID NO: 564955 - DNA, 20 bp, Artificial
  CRISPR gRNA sequence
attcaaacctgaaaacaatc

SEQ ID NO: 564956 - DNA, 20 bp, Artificial
  CRISPR gRNA sequence
ttcaaacctgaaaacaatct

SEQ ID NO: 564957 - DNA, 20 bp, Artificial
  CRISPR gRNA sequence
aaacctgaaaacaatctttt

SEQ ID NO: 564958 - DNA, 20 bp, Artificial
  CRISPR gRNA sequence
aaaacaatcttttatggtgg

SEQ ID NO: 564959 - DNA, 20 bp, Artificial
  CRISPR gRNA sequence
ttatggtgggcattatgatt

SEQ ID NO: 564960 - DNA, 20 bp, Artificial
  CRISPR gRNA sequence
tatggtgggcattatgattt

SEQ ID NO: 564961 - DNA, 20 bp, Artificial
  CRISPR gRNA sequence
atggtgggcattatgatttc

SEQ ID NO: 564962 - DNA, 20 bp, Artificial
  CRISPR gRNA sequence
tggtgggcattatgatttct

SEQ ID NO: 564963 - DNA, 20 bp, Artificial
  CRISPR gRNA sequence
tgatttctacttcacagctg

SEQ ID NO: 564964 - DNA, 20 bp, Artificial
  CRISPR gRNA sequence
ctacttcacagctgaggaga

SEQ ID NO: 564965 - DNA, 20 bp, Artificial
  CRISPR gRNA sequence
tacttcacagctgaggagat

SEQ ID NO: 564966 - DNA, 20 bp, Artificial
  CRISPR gRNA sequence
cttcacagctgaggagatct

SEQ ID NO: 564967 - DNA, 20 bp, Artificial
  CRISPR gRNA sequence
cacagctgaggagatctagt

SEQ ID NO: 564968 - DNA, 20 bp, Artificial
  CRISPR gRNA sequence
acagctgaggagatctagtg

SEQ ID NO: 564969 - DNA, 20 bp, Artificial
  CRISPR gRNA sequence
aggagatctagtgtggggag

SEQ ID NO: 564970 - DNA, 20 bp, Artificial
  CRISPR gRNA sequence
gtgtggggaggcctttggga

SEQ ID NO: 564971 - DNA, 20 bp, Artificial
  CRISPR gRNA sequence
tgggagttcaccctgggcct

SEQ ID NO: 564972 - DNA, 20 bp, Artificial
  CRISPR gRNA sequence
gggagttcaccctgggcctt

SEQ ID NO: 564973 - DNA, 20 bp, Artificial
  CRISPR gRNA sequence
ggagttcaccctgggccttg

SEQ ID NO: 564974 - DNA, 20 bp, Artificial
  CRISPR gRNA sequence
accctgggccttgctggctt

SEQ ID NO: 564975 - DNA, 20 bp, Artificial
  CRISPR gRNA sequence
ggccttgctggcttcaaaat

SEQ ID NO: 564976 - DNA, 20 bp, Artificial
  CRISPR gRNA sequence
gctggcttcaaaatctgggc

SEQ ID NO: 564977 - DNA, 20 bp, Artificial
  CRISPR gRNA sequence
ctggcttcaaaatctgggca

SEQ ID NO: 564978 - DNA, 20 bp, Artificial
  CRISPR gRNA sequence
gcttcaaaatctgggcactc

SEQ ID NO: 564979 - DNA, 20 bp, Artificial
  CRISPR gRNA sequence
caaaatctgggcactctctg

SEQ ID NO: 564980 - DNA, 20 bp, Artificial
  CRISPR gRNA sequence
aaaatctgggcactctctgt

SEQ ID NO: 564981 - DNA, 20 bp, Artificial
  CRISPR gRNA sequence
ggcactctctgttctgcact

SEQ ID NO: 564982 - DNA, 20 bp, Artificial
  CRISPR gRNA sequence
tctgttctgcactctggcat

SEQ ID NO: 564983 - DNA, 20 bp, Artificial
  CRISPR gRNA sequence
tgttctgcactctggcatgg

SEQ ID NO: 564984 - DNA, 20 bp, Artificial
  CRISPR gRNA sequence
ttctgcactctggcatggtt

SEQ ID NO: 564985 - DNA, 20 bp, Artificial
  CRISPR gRNA sequence
tgcactctggcatggttatt

SEQ ID NO: 564986 - DNA, 20 bp, Artificial
  CRISPR gRNA sequence
cactctggcatggttattag

SEQ ID NO: 564987 - DNA, 20 bp, Artificial
  CRISPR gRNA sequence
tggcatggttattagcgtcc

SEQ ID NO: 564988 - DNA, 20 bp, Artificial
  CRISPR gRNA sequence
gcatggttattagcgtccct

SEQ ID NO: 564989 - DNA, 20 bp, Artificial
  CRISPR gRNA sequence
ttagcgtccctacagtccct

SEQ ID NO: 564990 - DNA, 20 bp, Artificial
  CRISPR gRNA sequence
gcgtccctacagtccctttt

SEQ ID NO: 564991 - DNA, 20 bp, Artificial
  CRISPR gRNA sequence
cagtcccttttctgaccact

SEQ ID NO: 564992 - DNA, 20 bp, Artificial
  CRISPR gRNA sequence
ttctgaccactcagtggtat

SEQ ID NO: 564993 - DNA, 20 bp, Artificial
  CRISPR gRNA sequence
tctgaccactcagtggtatc

SEQ ID NO: 564994 - DNA, 20 bp, Artificial
  CRISPR gRNA sequence
ctgaccactcagtggtatca

SEQ ID NO: 564995 - DNA, 20 bp, Artificial
  CRISPR gRNA sequence
tgaccactcagtggtatcag

SEQ ID NO: 564996 - DNA, 20 bp, Artificial
  CRISPR gRNA sequence
accactcagtggtatcagca

SEQ ID NO: 564997 - DNA, 20 bp, Artificial
  CRISPR gRNA sequence
agtggtatcagcaaagcaac

SEQ ID NO: 564998 - DNA, 20 bp, Artificial
  CRISPR gRNA sequence
actgttgacaccattccttt

SEQ ID NO: 564999 - DNA, 20 bp, Artificial
  CRISPR gRNA sequence
ttgacaccattcctttgctc

SEQ ID NO: 565000 - DNA, 20 bp, Artificial
  CRISPR gRNA sequence
acaccattcctttgctccta

SEQ ID NO: 565001 - DNA, 20 bp, Artificial
  CRISPR gRNA sequence
ctttgctcctatttgtgtat

SEQ ID NO: 565002 - DNA, 20 bp, Artificial
  CRISPR gRNA sequence
tgctcctatttgtgtattca

SEQ ID NO: 565003 - DNA, 20 bp, Artificial
  CRISPR gRNA sequence
gctcctatttgtgtattcat

SEQ ID NO: 565004 - DNA, 20 bp, Artificial
  CRISPR gRNA sequence
ctcctatttgtgtattcatt

SEQ ID NO: 565005 - DNA, 20 bp, Artificial
  CRISPR gRNA sequence
ctatttgtgtattcattcat

SEQ ID NO: 565006 - DNA, 20 bp, Artificial
  CRISPR gRNA sequence
tttgtgtattcattcattca

SEQ ID NO: 565007 - DNA, 20 bp, Artificial
  CRISPR gRNA sequence
gtgtattcattcattcattc

SEQ ID NO: 565008 - DNA, 20 bp, Artificial
  CRISPR gRNA sequence
tgtattcattcattcattca

SEQ ID NO: 565009 - DNA, 20 bp, Artificial
  CRISPR gRNA sequence
attcattcattcattcattc

SEQ ID NO: 565010 - DNA, 20 bp, Artificial
  CRISPR gRNA sequence
attcattcattcattcgttc

SEQ ID NO: 565011 - DNA, 20 bp, Artificial
  CRISPR gRNA sequence
attcattcattcgttcatcc

SEQ ID NO: 565012 - DNA, 20 bp, Artificial
  CRISPR gRNA sequence
attcattcgttcatccatgg

SEQ ID NO: 565013 - DNA, 20 bp, Artificial
  CRISPR gRNA sequence
attcgttcatccatggtttg

SEQ ID NO: 565014 - DNA, 20 bp, Artificial
  CRISPR gRNA sequence
gttcatccatggtttgtgac

SEQ ID NO: 565015 - DNA, 20 bp, Artificial
  CRISPR gRNA sequence
atccatggtttgtgaccttt

SEQ ID NO: 565016 - DNA, 20 bp, Artificial
  CRISPR gRNA sequence
gtgacctttgagaaaaaact

SEQ ID NO: 565017 - DNA, 20 bp, Artificial
  CRISPR gRNA sequence
tgacctttgagaaaaaactc

SEQ ID NO: 565018 - DNA, 20 bp, Artificial
  CRISPR gRNA sequence
tgagaaaaaactcactcccc

SEQ ID NO: 565019 - DNA, 20 bp, Artificial
  CRISPR gRNA sequence
gagaaaaaactcactcccct

SEQ ID NO: 565020 - DNA, 20 bp, Artificial
  CRISPR gRNA sequence
agaaaaaactcactcccctt

SEQ ID NO: 565021 - DNA, 20 bp, Artificial
  CRISPR gRNA sequence
actcccctttcttctattgt

SEQ ID NO: 565022 - DNA, 20 bp, Artificial
  CRISPR gRNA sequence
ccctttcttctattgttctt

SEQ ID NO: 565023 - DNA, 20 bp, Artificial
  CRISPR gRNA sequence
tcttctattgttcttttgtt

SEQ ID NO: 565024 - DNA, 20 bp, Artificial
  CRISPR gRNA sequence
cttctattgttcttttgttc

SEQ ID NO: 565025 - DNA, 20 bp, Artificial
  CRISPR gRNA sequence
ttctattgttcttttgttca

SEQ ID NO: 565026 - DNA, 20 bp, Artificial
  CRISPR gRNA sequence
ctattgttcttttgttcatt

SEQ ID NO: 565027 - DNA, 20 bp, Artificial
  CRISPR gRNA sequence
tattgttcttttgttcatta

SEQ ID NO: 565028 - DNA, 20 bp, Artificial
  CRISPR gRNA sequence
ttgttcttttgttcattaga

SEQ ID NO: 565029 - DNA, 20 bp, Artificial
  CRISPR gRNA sequence
ttcttttgttcattagaaat

SEQ ID NO: 565030 - DNA, 20 bp, Artificial
  CRISPR gRNA sequence
ttttgttcattagaaattat

SEQ ID NO: 565031 - DNA, 20 bp, Artificial
  CRISPR gRNA sequence
ttgttcattagaaattatct

SEQ ID NO: 565032 - DNA, 20 bp, Artificial
  CRISPR gRNA sequence
tgttcattagaaattatctt

SEQ ID NO: 565033 - DNA, 20 bp, Artificial
  CRISPR gRNA sequence
gttcattagaaattatctta

SEQ ID NO: 565034 - DNA, 20 bp, Artificial
  CRISPR gRNA sequence
ttcattagaaattatcttag

SEQ ID NO: 565035 - DNA, 20 bp, Artificial
  CRISPR gRNA sequence
attagaaattatcttagcaa

SEQ ID NO: 565036 - DNA, 20 bp, Artificial
  CRISPR gRNA sequence
gaaattatcttagcaactta

SEQ ID NO: 565037 - DNA, 20 bp, Artificial
  CRISPR gRNA sequence
tcttagcaacttactttagt

SEQ ID NO: 565038 - DNA, 20 bp, Artificial
  CRISPR gRNA sequence
agcaacttactttagtgttg

SEQ ID NO: 565039 - DNA, 20 bp, Artificial
  CRISPR gRNA sequence
gcaacttactttagtgttgg

SEQ ID NO: 565040 - DNA, 20 bp, Artificial
  CRISPR gRNA sequence
actttagtgttggccttgga

SEQ ID NO: 565041 - DNA, 20 bp, Artificial
  CRISPR gRNA sequence
ctttagtgttggccttggaa

SEQ ID NO: 565042 - DNA, 20 bp, Artificial
  CRISPR gRNA sequence
tagtgttggccttggaagtg

SEQ ID NO: 565043 - DNA, 20 bp, Artificial
  CRISPR gRNA sequence
agtgttggccttggaagtgc

SEQ ID NO: 565044 - DNA, 20 bp, Artificial
  CRISPR gRNA sequence
gtgttggccttggaagtgca

SEQ ID NO: 565045 - DNA, 20 bp, Artificial
  CRISPR gRNA sequence
gccttggaagtgcaacagaa

SEQ ID NO: 565046 - DNA, 20 bp, Artificial
  CRISPR gRNA sequence
ggaagtgcaacagaaaagac

SEQ ID NO: 565047 - DNA, 20 bp, Artificial
  CRISPR gRNA sequence
gaagtgcaacagaaaagact

SEQ ID NO: 565048 - DNA, 20 bp, Artificial
  CRISPR gRNA sequence
tactgtaggaaggaaataat

SEQ ID NO: 565049 - DNA, 20 bp, Artificial
  CRISPR gRNA sequence
actgtaggaaggaaataata

SEQ ID NO: 565050 - DNA, 20 bp, Artificial
  CRISPR gRNA sequence
ctgtaggaaggaaataatag

SEQ ID NO: 565051 - DNA, 20 bp, Artificial
  CRISPR gRNA sequence
taggaaggaaataatagata

SEQ ID NO: 565052 - DNA, 20 bp, Artificial
  CRISPR gRNA sequence
gttttagagacagttcttaa

SEQ ID NO: 565053 - DNA, 20 bp, Artificial
  CRISPR gRNA sequence
tagagacagttcttaacaac

SEQ ID NO: 565054 - DNA, 20 bp, Artificial
  CRISPR gRNA sequence
agagacagttcttaacaact

SEQ ID NO: 565055 - DNA, 20 bp, Artificial
  CRISPR gRNA sequence
gagacagttcttaacaactc

SEQ ID NO: 565056 - DNA, 20 bp, Artificial
  CRISPR gRNA sequence
ttaacaactcctcctcttgg

SEQ ID NO: 565057 - DNA, 20 bp, Artificial
  CRISPR gRNA sequence
aacaactcctcctcttggtt

SEQ ID NO: 565058 - DNA, 20 bp, Artificial
  CRISPR gRNA sequence
acaactcctcctcttggttg

SEQ ID NO: 565059 - DNA, 20 bp, Artificial
  CRISPR gRNA sequence
ctcctcttggttgaataatt

SEQ ID NO: 565060 - DNA, 20 bp, Artificial
  CRISPR gRNA sequence
ctcttggttgaataattcta

SEQ ID NO: 565061 - DNA, 20 bp, Artificial
  CRISPR gRNA sequence
ttggttgaataattctattt

SEQ ID NO: 565062 - DNA, 20 bp, Artificial
  CRISPR gRNA sequence
ggttgaataattctatttaa

SEQ ID NO: 565063 - DNA, 20 bp, Artificial
  CRISPR gRNA sequence
gttgaataattctatttaaa

SEQ ID NO: 565064 - DNA, 20 bp, Artificial
  CRISPR gRNA sequence
aataattctatttaaaaaaa

SEQ ID NO: 565065 - DNA, 20 bp, Artificial
  CRISPR gRNA sequence
tatttaaaaaaaatttacat

SEQ ID NO: 565066 - DNA, 20 bp, Artificial
  CRISPR gRNA sequence
tttaaaaaaaatttacatag

SEQ ID NO: 565067 - DNA, 20 bp, Artificial
  CRISPR gRNA sequence
aaaaaaaatttacatagttt

SEQ ID NO: 565068 - DNA, 20 bp, Artificial
  CRISPR gRNA sequence
aaaaaaatttacatagtttt

SEQ ID NO: 565069 - DNA, 20 bp, Artificial
  CRISPR gRNA sequence
acatagttttaatattataa

SEQ ID NO: 565070 - DNA, 20 bp, Artificial
  CRISPR gRNA sequence
catagttttaatattataat

SEQ ID NO: 565071 - DNA, 20 bp, Artificial
  CRISPR gRNA sequence
taatattataatagtaatag

SEQ ID NO: 565072 - DNA, 20 bp, Artificial
  CRISPR gRNA sequence
aatattataatagtaatagg

SEQ ID NO: 565073 - DNA, 20 bp, Artificial
  CRISPR gRNA sequence
atattataatagtaatagga

SEQ ID NO: 565074 - DNA, 20 bp, Artificial
  CRISPR gRNA sequence
taatagtaataggatatttg

SEQ ID NO: 565075 - DNA, 20 bp, Artificial
  CRISPR gRNA sequence
gtcttcaaaagtaacatatt

SEQ ID NO: 565076 - DNA, 20 bp, Artificial
  CRISPR gRNA sequence
tcttcaaaagtaacatattt

SEQ ID NO: 565077 - DNA, 20 bp, Artificial
  CRISPR gRNA sequence
caaaagtaacatatttttca

SEQ ID NO: 565078 - DNA, 20 bp, Artificial
  CRISPR gRNA sequence
aaaagtaacatatttttcaa

SEQ ID NO: 565079 - DNA, 20 bp, Artificial
  CRISPR gRNA sequence
ttcaatgtgacctgtattaa

SEQ ID NO: 565080 - DNA, 20 bp, Artificial
  CRISPR gRNA sequence
tcaatgtgacctgtattaag

SEQ ID NO: 565081 - DNA, 20 bp, Artificial
  CRISPR gRNA sequence
caatgtgacctgtattaagt

SEQ ID NO: 565082 - DNA, 20 bp, Artificial
  CRISPR gRNA sequence
aatgtgacctgtattaagta

SEQ ID NO: 565083 - DNA, 20 bp, Artificial
  CRISPR gRNA sequence
tattaagtaataagtaataa

SEQ ID NO: 565084 - DNA, 20 bp, Artificial
  CRISPR gRNA sequence
agtaataagtaataaattga

SEQ ID NO: 565085 - DNA, 20 bp, Artificial
  CRISPR gRNA sequence
aaatctcaccatcaccacaa

SEQ ID NO: 565086 - DNA, 20 bp, Artificial
  CRISPR gRNA sequence
accatcaccacaatctctaa

SEQ ID NO: 565087 - DNA, 20 bp, Artificial
  CRISPR gRNA sequence
taaagtaaccgtggttactt

SEQ ID NO: 565088 - DNA, 20 bp, Artificial
  CRISPR gRNA sequence
aagtaaccgtggttacttta

SEQ ID NO: 565089 - DNA, 20 bp, Artificial
  CRISPR gRNA sequence
ctttaaaaacaaccactgtt

SEQ ID NO: 565090 - DNA, 20 bp, Artificial
  CRISPR gRNA sequence
taaaaacaaccactgttaat

SEQ ID NO: 565091 - DNA, 20 bp, Artificial
  CRISPR gRNA sequence
aaaaacaaccactgttaatc

SEQ ID NO: 565092 - DNA, 20 bp, Artificial
  CRISPR gRNA sequence
aaaacaaccactgttaatca

SEQ ID NO: 565093 - DNA, 20 bp, Artificial
  CRISPR gRNA sequence
ttaatcatttagggtgtctc

SEQ ID NO: 565094 - DNA, 20 bp, Artificial
  CRISPR gRNA sequence
atcatttagggtgtctcttt

SEQ ID NO: 565095 - DNA, 20 bp, Artificial
  CRISPR gRNA sequence
agggtgtctctttccagtct

SEQ ID NO: 565096 - DNA, 20 bp, Artificial
  CRISPR gRNA sequence
gggtgtctctttccagtcta

SEQ ID NO: 565097 - DNA, 20 bp, Artificial
  CRISPR gRNA sequence
tttccagtctaaaaaaagag

SEQ ID NO: 565098 - DNA, 20 bp, Artificial
  CRISPR gRNA sequence
tccagtctaaaaaaagagca

SEQ ID NO: 565099 - DNA, 20 bp, Artificial
  CRISPR gRNA sequence
ccagtctaaaaaaagagcaa

SEQ ID NO: 565100 - DNA, 20 bp, Artificial
  CRISPR gRNA sequence
cagtctaaaaaaagagcaag

SEQ ID NO: 565101 - DNA, 20 bp, Artificial
  CRISPR gRNA sequence
aaaaaagagcaagtgagaat

SEQ ID NO: 565102 - DNA, 20 bp, Artificial
  CRISPR gRNA sequence
atgtctttttatagttaaaa

SEQ ID NO: 565103 - DNA, 20 bp, Artificial
  CRISPR gRNA sequence
tttatagttaaaatatatat

SEQ ID NO: 565104 - DNA, 20 bp, Artificial
  CRISPR gRNA sequence
ttatagttaaaatatatata

SEQ ID NO: 565105 - DNA, 20 bp, Artificial
  CRISPR gRNA sequence
tatagttaaaatatatatat

SEQ ID NO: 565106 - DNA, 20 bp, Artificial
  CRISPR gRNA sequence
atagttaaaatatatatata

SEQ ID NO: 565107 - DNA, 20 bp, Artificial
  CRISPR gRNA sequence
tagttaaaatatatatatat

SEQ ID NO: 565108 - DNA, 20 bp, Artificial
  CRISPR gRNA sequence
aaatatatatatattttttg

SEQ ID NO: 565109 - DNA, 20 bp, Artificial
  CRISPR gRNA sequence
tttggtagagacagggtctc

SEQ ID NO: 565110 - DNA, 20 bp, Artificial
  CRISPR gRNA sequence
ttggtagagacagggtctca

SEQ ID NO: 565111 - DNA, 20 bp, Artificial
  CRISPR gRNA sequence
tggtagagacagggtctcac

SEQ ID NO: 565112 - DNA, 20 bp, Artificial
  CRISPR gRNA sequence
ggtagagacagggtctcact

SEQ ID NO: 565113 - DNA, 20 bp, Artificial
  CRISPR gRNA sequence
gtagagacagggtctcacta

SEQ ID NO: 565114 - DNA, 20 bp, Artificial
  CRISPR gRNA sequence
actacattgcccaggctggt

SEQ ID NO: 565115 - DNA, 20 bp, Artificial
  CRISPR gRNA sequence
cattgcccaggctggtatca

SEQ ID NO: 565116 - DNA, 20 bp, Artificial
  CRISPR gRNA sequence
cccaggctggtatcaaactc

SEQ ID NO: 565117 - DNA, 20 bp, Artificial
  CRISPR gRNA sequence
gtatcaaactcctgggctca

SEQ ID NO: 565118 - DNA, 20 bp, Artificial
  CRISPR gRNA sequence
ctgggctcaagtgatccttc

SEQ ID NO: 565119 - DNA, 20 bp, Artificial
  CRISPR gRNA sequence
ggctcaagtgatccttccac

SEQ ID NO: 565120 - DNA, 20 bp, Artificial
  CRISPR gRNA sequence
aagtgatccttccactttgg

SEQ ID NO: 565121 - DNA, 20 bp, Artificial
  CRISPR gRNA sequence
ccactttggcctaccaaagt

SEQ ID NO: 565122 - DNA, 20 bp, Artificial
  CRISPR gRNA sequence
cactttggcctaccaaagtg

SEQ ID NO: 565123 - DNA, 20 bp, Artificial
  CRISPR gRNA sequence
tggcctaccaaagtgctaga

SEQ ID NO: 565124 - DNA, 20 bp, Artificial
  CRISPR gRNA sequence
ggcctaccaaagtgctagaa

SEQ ID NO: 565125 - DNA, 20 bp, Artificial
  CRISPR gRNA sequence
gcctaccaaagtgctagaat

SEQ ID NO: 565126 - DNA, 20 bp, Artificial
  CRISPR gRNA sequence
ccaaagtgctagaattgtag

SEQ ID NO: 565127 - DNA, 20 bp, Artificial
  CRISPR gRNA sequence
gaattgtaggcatgagccac

SEQ ID NO: 565128 - DNA, 20 bp, Artificial
  CRISPR gRNA sequence
taggcatgagccaccacatc

SEQ ID NO: 565129 - DNA, 20 bp, Artificial
  CRISPR gRNA sequence
gcctctttattgtttttaaa

SEQ ID NO: 565130 - DNA, 20 bp, Artificial
  CRISPR gRNA sequence
tttattgtttttaaaaagag

SEQ ID NO: 565131 - DNA, 20 bp, Artificial
  CRISPR gRNA sequence
tattgtttttaaaaagagga

SEQ ID NO: 565132 - DNA, 20 bp, Artificial
  CRISPR gRNA sequence
attgtttttaaaaagaggaa

SEQ ID NO: 565133 - DNA, 20 bp, Artificial
  CRISPR gRNA sequence
ttgtttttaaaaagaggaat

SEQ ID NO: 565134 - DNA, 20 bp, Artificial
  CRISPR gRNA sequence
tttttaaaaagaggaatatt

SEQ ID NO: 565135 - DNA, 20 bp, Artificial
  CRISPR gRNA sequence
ttaaaaagaggaatattctg

SEQ ID NO: 565136 - DNA, 20 bp, Artificial
  CRISPR gRNA sequence
taaaaagaggaatattctgc

SEQ ID NO: 565137 - DNA, 20 bp, Artificial
  CRISPR gRNA sequence
aaaaagaggaatattctgca

SEQ ID NO: 565138 - DNA, 20 bp, Artificial
  CRISPR gRNA sequence
aaaagaggaatattctgcat

SEQ ID NO: 565139 - DNA, 20 bp, Artificial
  CRISPR gRNA sequence
tgcatatatatttctataac

SEQ ID NO: 565140 - DNA, 20 bp, Artificial
  CRISPR gRNA sequence
catatatatttctataactt

SEQ ID NO: 565141 - DNA, 20 bp, Artificial
  CRISPR gRNA sequence
ctataactttttatttttaa

SEQ ID NO: 565142 - DNA, 20 bp, Artificial
  CRISPR gRNA sequence
tataactttttatttttaat

SEQ ID NO: 565143 - DNA, 20 bp, Artificial
  CRISPR gRNA sequence
taactttttatttttaatat

SEQ ID NO: 565144 - DNA, 20 bp, Artificial
  CRISPR gRNA sequence
tttatttttaatattaagaa

SEQ ID NO: 565145 - DNA, 20 bp, Artificial
  CRISPR gRNA sequence
ttatttttaatattaagaaa

SEQ ID NO: 565146 - DNA, 20 bp, Artificial
  CRISPR gRNA sequence
tatttttaatattaagaaat

SEQ ID NO: 565147 - DNA, 20 bp, Artificial
  CRISPR gRNA sequence
atttttaatattaagaaatt

SEQ ID NO: 565148 - DNA, 20 bp, Artificial
  CRISPR gRNA sequence
tttttaatattaagaaattt

SEQ ID NO: 565149 - DNA, 20 bp, Artificial
  CRISPR gRNA sequence
ttaatattaagaaattttcc

SEQ ID NO: 565150 - DNA, 20 bp, Artificial
  CRISPR gRNA sequence
taatattaagaaattttcca

SEQ ID NO: 565151 - DNA, 20 bp, Artificial
  CRISPR gRNA sequence
aatattaagaaattttccaa

SEQ ID NO: 565152 - DNA, 20 bp, Artificial
  CRISPR gRNA sequence
atattaagaaattttccaaa

SEQ ID NO: 565153 - DNA, 20 bp, Artificial
  CRISPR gRNA sequence
agaaattttccaaattccca

SEQ ID NO: 565154 - DNA, 20 bp, Artificial
  CRISPR gRNA sequence
tccaaattcccaataataaa

SEQ ID NO: 565155 - DNA, 20 bp, Artificial
  CRISPR gRNA sequence
ccaaattcccaataataaaa

SEQ ID NO: 565156 - DNA, 20 bp, Artificial
  CRISPR gRNA sequence
caaattcccaataataaaag

SEQ ID NO: 565157 - DNA, 20 bp, Artificial
  CRISPR gRNA sequence
ccaataataaaaggagaata

SEQ ID NO: 565158 - DNA, 20 bp, Artificial
  CRISPR gRNA sequence
tttccttttttaaaataacc

SEQ ID NO: 565159 - DNA, 20 bp, Artificial
  CRISPR gRNA sequence
ccttttttaaaataaccaca

SEQ ID NO: 565160 - DNA, 20 bp, Artificial
  CRISPR gRNA sequence
cttttttaaaataaccacat

SEQ ID NO: 565161 - DNA, 20 bp, Artificial
  CRISPR gRNA sequence
ttttaaaataaccacatagt

SEQ ID NO: 565162 - DNA, 20 bp, Artificial
  CRISPR gRNA sequence
tttaaaataaccacatagta

SEQ ID NO: 565163 - DNA, 20 bp, Artificial
  CRISPR gRNA sequence
ttaaaataaccacatagtaa

SEQ ID NO: 565164 - DNA, 20 bp, Artificial
  CRISPR gRNA sequence
taaaataaccacatagtaag

SEQ ID NO: 565165 - DNA, 20 bp, Artificial
  CRISPR gRNA sequence
aaaataaccacatagtaagc

SEQ ID NO: 565166 - DNA, 20 bp, Artificial
  CRISPR gRNA sequence
aaataaccacatagtaagcc

SEQ ID NO: 565167 - DNA, 20 bp, Artificial
  CRISPR gRNA sequence
aattgtttaactattagact

SEQ ID NO: 565168 - DNA, 20 bp, Artificial
  CRISPR gRNA sequence
tttaactattagactagatt

SEQ ID NO: 565169 - DNA, 20 bp, Artificial
  CRISPR gRNA sequence
aactattagactagattatt

SEQ ID NO: 565170 - DNA, 20 bp, Artificial
  CRISPR gRNA sequence
actattagactagattatta

SEQ ID NO: 565171 - DNA, 20 bp, Artificial
  CRISPR gRNA sequence
ttagactagattattattta

SEQ ID NO: 565172 - DNA, 20 bp, Artificial
  CRISPR gRNA sequence
gactagattattatttacta

SEQ ID NO: 565173 - DNA, 20 bp, Artificial
  CRISPR gRNA sequence
gattattatttactagtata

SEQ ID NO: 565174 - DNA, 20 bp, Artificial
  CRISPR gRNA sequence
ttatttactagtatagataa

SEQ ID NO: 565175 - DNA, 20 bp, Artificial
  CRISPR gRNA sequence
tttactagtatagataactt

SEQ ID NO: 565176 - DNA, 20 bp, Artificial
  CRISPR gRNA sequence
actagtatagataactttaa

SEQ ID NO: 565177 - DNA, 20 bp, Artificial
  CRISPR gRNA sequence
ctagtatagataactttaaa

SEQ ID NO: 565178 - DNA, 20 bp, Artificial
  CRISPR gRNA sequence
gtatagataactttaaaatg

SEQ ID NO: 565179 - DNA, 20 bp, Artificial
  CRISPR gRNA sequence
taaaatgaatatcattatgc

SEQ ID NO: 565180 - DNA, 20 bp, Artificial
  CRISPR gRNA sequence
aaaatgaatatcattatgca

SEQ ID NO: 565181 - DNA, 20 bp, Artificial
  CRISPR gRNA sequence
aaatgaatatcattatgcat

SEQ ID NO: 565182 - DNA, 20 bp, Artificial
  CRISPR gRNA sequence
tgcatatctctttatgtagg

SEQ ID NO: 565183 - DNA, 20 bp, Artificial
  CRISPR gRNA sequence
tttatgtaggttatactatt

SEQ ID NO: 565184 - DNA, 20 bp, Artificial
  CRISPR gRNA sequence
tatgtaggttatactattgt

SEQ ID NO: 565185 - DNA, 20 bp, Artificial
  CRISPR gRNA sequence
atgtaggttatactattgtt

SEQ ID NO: 565186 - DNA, 20 bp, Artificial
  CRISPR gRNA sequence
tgtaggttatactattgttt

SEQ ID NO: 565187 - DNA, 20 bp, Artificial
  CRISPR gRNA sequence
tactattgttttatttgtta

SEQ ID NO: 565188 - DNA, 20 bp, Artificial
  CRISPR gRNA sequence
ttgttttatttgttaacatc

SEQ ID NO: 565189 - DNA, 20 bp, Artificial
  CRISPR gRNA sequence
ttttatttgttaacatcctg

SEQ ID NO: 565190 - DNA, 20 bp, Artificial
  CRISPR gRNA sequence
tatttgttaacatcctgaat

SEQ ID NO: 565191 - DNA, 20 bp, Artificial
  CRISPR gRNA sequence
atttgttaacatcctgaata

SEQ ID NO: 565192 - DNA, 20 bp, Artificial
  CRISPR gRNA sequence
tttgttaacatcctgaataa

SEQ ID NO: 565193 - DNA, 20 bp, Artificial
  CRISPR gRNA sequence
gttaacatcctgaataaata

SEQ ID NO: 565194 - DNA, 20 bp, Artificial
  CRISPR gRNA sequence
ttaacatcctgaataaatat

SEQ ID NO: 565195 - DNA, 20 bp, Artificial
  CRISPR gRNA sequence
acatcctgaataaatatcac

SEQ ID NO: 565196 - DNA, 20 bp, Artificial
  CRISPR gRNA sequence
aataaatatcacccagatcc

SEQ ID NO: 565197 - DNA, 20 bp, Artificial
  CRISPR gRNA sequence
agtgaaactacaggttcttt

SEQ ID NO: 565198 - DNA, 20 bp, Artificial
  CRISPR gRNA sequence
caggttcttttagagcataa

SEQ ID NO: 565199 - DNA, 20 bp, Artificial
  CRISPR gRNA sequence
ttttagagcataagcaaaaa

SEQ ID NO: 565200 - DNA, 20 bp, Artificial
  CRISPR gRNA sequence
ttagagcataagcaaaaata

SEQ ID NO: 565201 - DNA, 20 bp, Artificial
  CRISPR gRNA sequence
tagagcataagcaaaaataa

SEQ ID NO: 565202 - DNA, 20 bp, Artificial
  CRISPR gRNA sequence
agagcataagcaaaaataaa

SEQ ID NO: 565203 - DNA, 20 bp, Artificial
  CRISPR gRNA sequence
gagcataagcaaaaataaat

SEQ ID NO: 565204 - DNA, 20 bp, Artificial
  CRISPR gRNA sequence
tatgcatgtgtttttgtatg

SEQ ID NO: 565205 - DNA, 20 bp, Artificial
  CRISPR gRNA sequence
ttgtatgtgtgtttaattct

SEQ ID NO: 565206 - DNA, 20 bp, Artificial
  CRISPR gRNA sequence
tgtatgtgtgtttaattctg

SEQ ID NO: 565207 - DNA, 20 bp, Artificial
  CRISPR gRNA sequence
gtatgtgtgtttaattctgc

SEQ ID NO: 565208 - DNA, 20 bp, Artificial
  CRISPR gRNA sequence
tatgtgtgtttaattctgct

SEQ ID NO: 565209 - DNA, 20 bp, Artificial
  CRISPR gRNA sequence
aattctgcttacatttgaat

SEQ ID NO: 565210 - DNA, 20 bp, Artificial
  CRISPR gRNA sequence
attctgcttacatttgaatt

SEQ ID NO: 565211 - DNA, 20 bp, Artificial
  CRISPR gRNA sequence
tgcttacatttgaattttct

SEQ ID NO: 565212 - DNA, 20 bp, Artificial
  CRISPR gRNA sequence
cttacatttgaattttcttc

SEQ ID NO: 565213 - DNA, 20 bp, Artificial
  CRISPR gRNA sequence
acatttgaattttcttccat

SEQ ID NO: 565214 - DNA, 20 bp, Artificial
  CRISPR gRNA sequence
catttgaattttcttccatc

SEQ ID NO: 565215 - DNA, 20 bp, Artificial
  CRISPR gRNA sequence
gaattttcttccatcttttt

SEQ ID NO: 565216 - DNA, 20 bp, Artificial
  CRISPR gRNA sequence
aattttcttccatctttttc

SEQ ID NO: 565217 - DNA, 20 bp, Artificial
  CRISPR gRNA sequence
tcttccatctttttcctact

SEQ ID NO: 565218 - DNA, 20 bp, Artificial
  CRISPR gRNA sequence
cttccatctttttcctacta

SEQ ID NO: 565219 - DNA, 20 bp, Artificial
  CRISPR gRNA sequence
ttccatctttttcctactat

SEQ ID NO: 565220 - DNA, 20 bp, Artificial
  CRISPR gRNA sequence
ccatctttttcctactatct

SEQ ID NO: 565221 - DNA, 20 bp, Artificial
  CRISPR gRNA sequence
catctttttcctactatctg

SEQ ID NO: 565222 - DNA, 20 bp, Artificial
  CRISPR gRNA sequence
tttcctactatctgagtaat

SEQ ID NO: 565223 - DNA, 20 bp, Artificial
  CRISPR gRNA sequence
ttcctactatctgagtaata

SEQ ID NO: 565224 - DNA, 20 bp, Artificial
  CRISPR gRNA sequence
tcctactatctgagtaatat

SEQ ID NO: 565225 - DNA, 20 bp, Artificial
  CRISPR gRNA sequence
cctactatctgagtaatatc

SEQ ID NO: 565226 - DNA, 20 bp, Artificial
  CRISPR gRNA sequence
ctactatctgagtaatatca

SEQ ID NO: 565227 - DNA, 20 bp, Artificial
  CRISPR gRNA sequence
ctatctgagtaatatcacta

SEQ ID NO: 565228 - DNA, 20 bp, Artificial
  CRISPR gRNA sequence
tctgagtaatatcactagtg

SEQ ID NO: 565229 - DNA, 20 bp, Artificial
  CRISPR gRNA sequence
agtaatatcactagtgcctt

SEQ ID NO: 565230 - DNA, 20 bp, Artificial
  CRISPR gRNA sequence
gtgccttttattcagtcaag

SEQ ID NO: 565231 - DNA, 20 bp, Artificial
  CRISPR gRNA sequence
ttattcagtcaagtctccac

SEQ ID NO: 565232 - DNA, 20 bp, Artificial
  CRISPR gRNA sequence
tattcagtcaagtctccaca

SEQ ID NO: 565233 - DNA, 20 bp, Artificial
  CRISPR gRNA sequence
attcagtcaagtctccacat

SEQ ID NO: 565234 - DNA, 20 bp, Artificial
  CRISPR gRNA sequence
ttcagtcaagtctccacatg

SEQ ID NO: 565235 - DNA, 20 bp, Artificial
  CRISPR gRNA sequence
agtcaagtctccacatgttg

SEQ ID NO: 565236 - DNA, 20 bp, Artificial
  CRISPR gRNA sequence
cacatgttgactcttgtctt

SEQ ID NO: 565237 - DNA, 20 bp, Artificial
  CRISPR gRNA sequence
actcttgtcttggagttatg

SEQ ID NO: 565238 - DNA, 20 bp, Artificial
  CRISPR gRNA sequence
ttgtcttggagttatgatgc

SEQ ID NO: 565239 - DNA, 20 bp, Artificial
  CRISPR gRNA sequence
gtcttggagttatgatgcca

SEQ ID NO: 565240 - DNA, 20 bp, Artificial
  CRISPR gRNA sequence
tcttggagttatgatgccat

SEQ ID NO: 565241 - DNA, 20 bp, Artificial
  CRISPR gRNA sequence
ggagttatgatgccatcccc

SEQ ID NO: 565242 - DNA, 20 bp, Artificial
  CRISPR gRNA sequence
gagttatgatgccatccccc

SEQ ID NO: 565243 - DNA, 20 bp, Artificial
  CRISPR gRNA sequence
tgatgccatccccctcctgg

SEQ ID NO: 565244 - DNA, 20 bp, Artificial
  CRISPR gRNA sequence
ctggcctttcttctacttcc

SEQ ID NO: 565245 - DNA, 20 bp, Artificial
  CRISPR gRNA sequence
gcctttcttctacttcccag

SEQ ID NO: 565246 - DNA, 20 bp, Artificial
  CRISPR gRNA sequence
tcttctacttcccaggtctc

SEQ ID NO: 565247 - DNA, 20 bp, Artificial
  CRISPR gRNA sequence
cttctacttcccaggtctct

SEQ ID NO: 565248 - DNA, 20 bp, Artificial
  CRISPR gRNA sequence
ttctacttcccaggtctctc

SEQ ID NO: 565249 - DNA, 20 bp, Artificial
  CRISPR gRNA sequence
ctacttcccaggtctctctc

SEQ ID NO: 565250 - DNA, 20 bp, Artificial
  CRISPR gRNA sequence
tacttcccaggtctctctca

SEQ ID NO: 565251 - DNA, 20 bp, Artificial
  CRISPR gRNA sequence
cttcccaggtctctctcagt

SEQ ID NO: 565252 - DNA, 20 bp, Artificial
  CRISPR gRNA sequence
cccaggtctctctcagtctc

SEQ ID NO: 565253 - DNA, 20 bp, Artificial
  CRISPR gRNA sequence
ccaggtctctctcagtctcc

SEQ ID NO: 565254 - DNA, 20 bp, Artificial
  CRISPR gRNA sequence
tctcagtctccttagccagt

SEQ ID NO: 565255 - DNA, 20 bp, Artificial
  CRISPR gRNA sequence
tcagtctccttagccagtgt

SEQ ID NO: 565256 - DNA, 20 bp, Artificial
  CRISPR gRNA sequence
agtctccttagccagtgttt

SEQ ID NO: 565257 - DNA, 20 bp, Artificial
  CRISPR gRNA sequence
cttagccagtgttttcccct

SEQ ID NO: 565258 - DNA, 20 bp, Artificial
  CRISPR gRNA sequence
agccagtgttttcccctcta

SEQ ID NO: 565259 - DNA, 20 bp, Artificial
  CRISPR gRNA sequence
gccagtgttttcccctctag

SEQ ID NO: 565260 - DNA, 20 bp, Artificial
  CRISPR gRNA sequence
tcccctctagccaagcttta

SEQ ID NO: 565261 - DNA, 20 bp, Artificial
  CRISPR gRNA sequence
cccctctagccaagctttaa

SEQ ID NO: 565262 - DNA, 20 bp, Artificial
  CRISPR gRNA sequence
ccctctagccaagctttaaa

SEQ ID NO: 565263 - DNA, 20 bp, Artificial
  CRISPR gRNA sequence
tagccaagctttaaagcaca

SEQ ID NO: 565264 - DNA, 20 bp, Artificial
  CRISPR gRNA sequence
gccaagctttaaagcacagg

SEQ ID NO: 565265 - DNA, 20 bp, Artificial
  CRISPR gRNA sequence
taaagcacaggtccaagctg

SEQ ID NO: 565266 - DNA, 20 bp, Artificial
  CRISPR gRNA sequence
aaagcacaggtccaagctgc

SEQ ID NO: 565267 - DNA, 20 bp, Artificial
  CRISPR gRNA sequence
aagcacaggtccaagctgcc

SEQ ID NO: 565268 - DNA, 20 bp, Artificial
  CRISPR gRNA sequence
ccttttcccacttcatacgc

SEQ ID NO: 565269 - DNA, 20 bp, Artificial
  CRISPR gRNA sequence
ttcccacttcatacgctctc

SEQ ID NO: 565270 - DNA, 20 bp, Artificial
  CRISPR gRNA sequence
tcccacttcatacgctctcc

SEQ ID NO: 565271 - DNA, 20 bp, Artificial
  CRISPR gRNA sequence
cccacttcatacgctctccc

SEQ ID NO: 565272 - DNA, 20 bp, Artificial
  CRISPR gRNA sequence
ccacttcatacgctctccca

SEQ ID NO: 565273 - DNA, 20 bp, Artificial
  CRISPR gRNA sequence
catacgctctcccaaggtga

SEQ ID NO: 565274 - DNA, 20 bp, Artificial
  CRISPR gRNA sequence
atacgctctcccaaggtgat

SEQ ID NO: 565275 - DNA, 20 bp, Artificial
  CRISPR gRNA sequence
tcccaaggtgatggtcctaa

SEQ ID NO: 565276 - DNA, 20 bp, Artificial
  CRISPR gRNA sequence
ccaaggtgatggtcctaatg

SEQ ID NO: 565277 - DNA, 20 bp, Artificial
  CRISPR gRNA sequence
atggcctccattggagccac

SEQ ID NO: 565278 - DNA, 20 bp, Artificial
  CRISPR gRNA sequence
cattggagccactagaaatg

SEQ ID NO: 565279 - DNA, 20 bp, Artificial
  CRISPR gRNA sequence
gagccactagaaatgtgatg

SEQ ID NO: 565280 - DNA, 20 bp, Artificial
  CRISPR gRNA sequence
gaaatgtgatgactcccaaa

SEQ ID NO: 565281 - DNA, 20 bp, Artificial
  CRISPR gRNA sequence
ccaaatctgtatcctttcct

SEQ ID NO: 565282 - DNA, 20 bp, Artificial
  CRISPR gRNA sequence
tatcctttcctgtgagtccc

SEQ ID NO: 565283 - DNA, 20 bp, Artificial
  CRISPR gRNA sequence
tcctgtgagtcccagacctg

SEQ ID NO: 565284 - DNA, 20 bp, Artificial
  CRISPR gRNA sequence
cctgtgagtcccagacctgt

SEQ ID NO: 565285 - DNA, 20 bp, Artificial
  CRISPR gRNA sequence
ctgtgagtcccagacctgtg

SEQ ID NO: 565286 - DNA, 20 bp, Artificial
  CRISPR gRNA sequence
tgagtcccagacctgtgtac

SEQ ID NO: 565287 - DNA, 20 bp, Artificial
  CRISPR gRNA sequence
tgtacttagcagctactggg

SEQ ID NO: 565288 - DNA, 20 bp, Artificial
  CRISPR gRNA sequence
agcagctactgggcatcttt

SEQ ID NO: 565289 - DNA, 20 bp, Artificial
  CRISPR gRNA sequence
gcagctactgggcatctttg

SEQ ID NO: 565290 - DNA, 20 bp, Artificial
  CRISPR gRNA sequence
ctgggcatctttgcttggat

SEQ ID NO: 565291 - DNA, 20 bp, Artificial
  CRISPR gRNA sequence
ggcatctttgcttggatgtc

SEQ ID NO: 565292 - DNA, 20 bp, Artificial
  CRISPR gRNA sequence
tgcttggatgtctcacagac

SEQ ID NO: 565293 - DNA, 20 bp, Artificial
  CRISPR gRNA sequence
gcttggatgtctcacagacc

SEQ ID NO: 565294 - DNA, 20 bp, Artificial
  CRISPR gRNA sequence
cttggatgtctcacagaccc

SEQ ID NO: 565295 - DNA, 20 bp, Artificial
  CRISPR gRNA sequence
ggatgtctcacagacccctc

SEQ ID NO: 565296 - DNA, 20 bp, Artificial
  CRISPR gRNA sequence
gatgtctcacagacccctca

SEQ ID NO: 565297 - DNA, 20 bp, Artificial
  CRISPR gRNA sequence
acagacccctcacactgaac

SEQ ID NO: 565298 - DNA, 20 bp, Artificial
  CRISPR gRNA sequence
acactgaacagtgtcaaact

SEQ ID NO: 565299 - DNA, 20 bp, Artificial
  CRISPR gRNA sequence
aacagtgtcaaactgaaagc

SEQ ID NO: 565300 - DNA, 20 bp, Artificial
  CRISPR gRNA sequence
aaagcatgatgttccaggcc

SEQ ID NO: 565301 - DNA, 20 bp, Artificial
  CRISPR gRNA sequence
caggccagtcttagtcttcc

SEQ ID NO: 565302 - DNA, 20 bp, Artificial
  CRISPR gRNA sequence
agtcttcctgctgtgtttcc

SEQ ID NO: 565303 - DNA, 20 bp, Artificial
  CRISPR gRNA sequence
gtcttcctgctgtgtttcct

SEQ ID NO: 565304 - DNA, 20 bp, Artificial
  CRISPR gRNA sequence
cctgctgtgtttcctttctt

SEQ ID NO: 565305 - DNA, 20 bp, Artificial
  CRISPR gRNA sequence
ctgctgtgtttcctttctta

SEQ ID NO: 565306 - DNA, 20 bp, Artificial
  CRISPR gRNA sequence
ctgtgtttcctttcttaggg

SEQ ID NO: 565307 - DNA, 20 bp, Artificial
  CRISPR gRNA sequence
tgtttcctttcttagggaaa

SEQ ID NO: 565308 - DNA, 20 bp, Artificial
  CRISPR gRNA sequence
cctttcttagggaaagacac

SEQ ID NO: 565309 - DNA, 20 bp, Artificial
  CRISPR gRNA sequence
ctttcttagggaaagacacc

SEQ ID NO: 565310 - DNA, 20 bp, Artificial
  CRISPR gRNA sequence
tcttagggaaagacaccaca

SEQ ID NO: 565311 - DNA, 20 bp, Artificial
  CRISPR gRNA sequence
cttagggaaagacaccacaa

SEQ ID NO: 565312 - DNA, 20 bp, Artificial
  CRISPR gRNA sequence
ttagggaaagacaccacaac

SEQ ID NO: 565313 - DNA, 20 bp, Artificial
  CRISPR gRNA sequence
agggaaagacaccacaaccc

SEQ ID NO: 565314 - DNA, 20 bp, Artificial
  CRISPR gRNA sequence
gggaaagacaccacaaccca

SEQ ID NO: 565315 - DNA, 20 bp, Artificial
  CRISPR gRNA sequence
ggaggaagtaagagctgtga

SEQ ID NO: 565316 - DNA, 20 bp, Artificial
  CRISPR gRNA sequence
tgattcatcctggccctcct

SEQ ID NO: 565317 - DNA, 20 bp, Artificial
  CRISPR gRNA sequence
atcctggccctcctggcacc

SEQ ID NO: 565318 - DNA, 20 bp, Artificial
  CRISPR gRNA sequence
gccctcctggcacctcctct

SEQ ID NO: 565319 - DNA, 20 bp, Artificial
  CRISPR gRNA sequence
ctggcacctcctctcctcct

SEQ ID NO: 565320 - DNA, 20 bp, Artificial
  CRISPR gRNA sequence
gcacctcctctcctcctcct

SEQ ID NO: 565321 - DNA, 20 bp, Artificial
  CRISPR gRNA sequence
ctctcctcctcctttacccc

SEQ ID NO: 565322 - DNA, 20 bp, Artificial
  CRISPR gRNA sequence
tcctcctcctttaccccata

SEQ ID NO: 565323 - DNA, 20 bp, Artificial
  CRISPR gRNA sequence
ctcctcctttaccccatatg

SEQ ID NO: 565324 - DNA, 20 bp, Artificial
  CRISPR gRNA sequence
ctcctttaccccatatgctg

SEQ ID NO: 565325 - DNA, 20 bp, Artificial
  CRISPR gRNA sequence
ctttaccccatatgctgtca

SEQ ID NO: 565326 - DNA, 20 bp, Artificial
  CRISPR gRNA sequence
taccccatatgctgtcaatc

SEQ ID NO: 565327 - DNA, 20 bp, Artificial
  CRISPR gRNA sequence
accccatatgctgtcaatca

SEQ ID NO: 565328 - DNA, 20 bp, Artificial
  CRISPR gRNA sequence
ccccatatgctgtcaatcat

SEQ ID NO: 565329 - DNA, 20 bp, Artificial
  CRISPR gRNA sequence
tcaatcatctagttctccca

SEQ ID NO: 565330 - DNA, 20 bp, Artificial
  CRISPR gRNA sequence
gttctcccagttttacctcc

SEQ ID NO: 565331 - DNA, 20 bp, Artificial
  CRISPR gRNA sequence
tcccagttttacctccctaa

SEQ ID NO: 565332 - DNA, 20 bp, Artificial
  CRISPR gRNA sequence
ccagttttacctccctaatg

SEQ ID NO: 565333 - DNA, 20 bp, Artificial
  CRISPR gRNA sequence
tacctccctaatgtctcttg

SEQ ID NO: 565334 - DNA, 20 bp, Artificial
  CRISPR gRNA sequence
acctccctaatgtctcttga

SEQ ID NO: 565335 - DNA, 20 bp, Artificial
  CRISPR gRNA sequence
cctccctaatgtctcttgaa

SEQ ID NO: 565336 - DNA, 20 bp, Artificial
  CRISPR gRNA sequence
cctaatgtctcttgaaccac

SEQ ID NO: 565337 - DNA, 20 bp, Artificial
  CRISPR gRNA sequence
atgtctcttgaaccactttg

SEQ ID NO: 565338 - DNA, 20 bp, Artificial
  CRISPR gRNA sequence
ttgaaccactttgcctagca

SEQ ID NO: 565339 - DNA, 20 bp, Artificial
  CRISPR gRNA sequence
gaaccactttgcctagcaca

SEQ ID NO: 565340 - DNA, 20 bp, Artificial
  CRISPR gRNA sequence
aaccactttgcctagcacaa

SEQ ID NO: 565341 - DNA, 20 bp, Artificial
  CRISPR gRNA sequence
tgcctagcacaatgctgcct

SEQ ID NO: 565342 - DNA, 20 bp, Artificial
  CRISPR gRNA sequence
gcctagcacaatgctgcctc

SEQ ID NO: 565343 - DNA, 20 bp, Artificial
  CRISPR gRNA sequence
cctagcacaatgctgcctct

SEQ ID NO: 565344 - DNA, 20 bp, Artificial
  CRISPR gRNA sequence
gcacaatgctgcctcttgac

SEQ ID NO: 565345 - DNA, 20 bp, Artificial
  CRISPR gRNA sequence
cctcttgaccagtctgaaat

SEQ ID NO: 565346 - DNA, 20 bp, Artificial
  CRISPR gRNA sequence
ttgaccagtctgaaattgct

SEQ ID NO: 565347 - DNA, 20 bp, Artificial
  CRISPR gRNA sequence
gaccagtctgaaattgctgt

SEQ ID NO: 565348 - DNA, 20 bp, Artificial
  CRISPR gRNA sequence
accagtctgaaattgctgtc

SEQ ID NO: 565349 - DNA, 20 bp, Artificial
  CRISPR gRNA sequence
aaattgctgtctgatggatc

SEQ ID NO: 565350 - DNA, 20 bp, Artificial
  CRISPR gRNA sequence
ctgtctgatggatctcttgc

SEQ ID NO: 565351 - DNA, 20 bp, Artificial
  CRISPR gRNA sequence
tctgatggatctcttgctat

SEQ ID NO: 565352 - DNA, 20 bp, Artificial
  CRISPR gRNA sequence
atggatctcttgctatctag

SEQ ID NO: 565353 - DNA, 20 bp, Artificial
  CRISPR gRNA sequence
ttgctatctagtcttacccc

SEQ ID NO: 565354 - DNA, 20 bp, Artificial
  CRISPR gRNA sequence
gctatctagtcttacccctc

SEQ ID NO: 565355 - DNA, 20 bp, Artificial
  CRISPR gRNA sequence
ctatctagtcttacccctcc

SEQ ID NO: 565356 - DNA, 20 bp, Artificial
  CRISPR gRNA sequence
tctagtcttacccctcccat

SEQ ID NO: 565357 - DNA, 20 bp, Artificial
  CRISPR gRNA sequence
gtcttacccctcccatcagt

SEQ ID NO: 565358 - DNA, 20 bp, Artificial
  CRISPR gRNA sequence
acccctcccatcagtcttcc

SEQ ID NO: 565359 - DNA, 20 bp, Artificial
  CRISPR gRNA sequence
cccctcccatcagtcttcca

SEQ ID NO: 565360 - DNA, 20 bp, Artificial
  CRISPR gRNA sequence
ccatcagtcttccacaccat

SEQ ID NO: 565361 - DNA, 20 bp, Artificial
  CRISPR gRNA sequence
ccacaccatagccagaaaag

SEQ ID NO: 565362 - DNA, 20 bp, Artificial
  CRISPR gRNA sequence
cacaccatagccagaaaaga

SEQ ID NO: 565363 - DNA, 20 bp, Artificial
  CRISPR gRNA sequence
tcattatgtaaaaatataga

SEQ ID NO: 565364 - DNA, 20 bp, Artificial
  CRISPR gRNA sequence
cattatgtaaaaatatagaa

SEQ ID NO: 565365 - DNA, 20 bp, Artificial
  CRISPR gRNA sequence
attatgtaaaaatatagaaa

SEQ ID NO: 565366 - DNA, 20 bp, Artificial
  CRISPR gRNA sequence
tgtaaaaatatagaaacttt

SEQ ID NO: 565367 - DNA, 20 bp, Artificial
  CRISPR gRNA sequence
tgtatggaagatattcattt

SEQ ID NO: 565368 - DNA, 20 bp, Artificial
  CRISPR gRNA sequence
gtatggaagatattcattta

SEQ ID NO: 565369 - DNA, 20 bp, Artificial
  CRISPR gRNA sequence
tatggaagatattcatttag

SEQ ID NO: 565370 - DNA, 20 bp, Artificial
  CRISPR gRNA sequence
atttagtaaattcaataggc

SEQ ID NO: 565371 - DNA, 20 bp, Artificial
  CRISPR gRNA sequence
agtaaattcaataggcaaag

SEQ ID NO: 565372 - DNA, 20 bp, Artificial
  CRISPR gRNA sequence
gtaaattcaataggcaaagg

SEQ ID NO: 565373 - DNA, 20 bp, Artificial
  CRISPR gRNA sequence
aataggcaaaggctgtattt

SEQ ID NO: 565374 - DNA, 20 bp, Artificial
  CRISPR gRNA sequence
tatttgaaaaaaaactataa

SEQ ID NO: 565375 - DNA, 20 bp, Artificial
  CRISPR gRNA sequence
gaaaaaaaactataatacag

SEQ ID NO: 565376 - DNA, 20 bp, Artificial
  CRISPR gRNA sequence
aaaaaaaactataatacaga

SEQ ID NO: 565377 - DNA, 20 bp, Artificial
  CRISPR gRNA sequence
taatacagataaaaatatat

SEQ ID NO: 565378 - DNA, 20 bp, Artificial
  CRISPR gRNA sequence
taaactttgagaagaaaaaa

SEQ ID NO: 565379 - DNA, 20 bp, Artificial
  CRISPR gRNA sequence
aaactttgagaagaaaaaaa

SEQ ID NO: 565380 - DNA, 20 bp, Artificial
  CRISPR gRNA sequence
aactttgagaagaaaaaaac

SEQ ID NO: 565381 - DNA, 20 bp, Artificial
  CRISPR gRNA sequence
tgagaagaaaaaaacaaaca

SEQ ID NO: 565382 - DNA, 20 bp, Artificial
  CRISPR gRNA sequence
gagaagaaaaaaacaaacaa

SEQ ID NO: 565383 - DNA, 20 bp, Artificial
  CRISPR gRNA sequence
agaagaaaaaaacaaacaat

SEQ ID NO: 565384 - DNA, 20 bp, Artificial
  CRISPR gRNA sequence
atacaaaaaaagaggatgtg

SEQ ID NO: 565385 - DNA, 20 bp, Artificial
  CRISPR gRNA sequence
ctcagaaaaagaaatccaaa

SEQ ID NO: 565386 - DNA, 20 bp, Artificial
  CRISPR gRNA sequence
tcagaaaaagaaatccaaat

SEQ ID NO: 565387 - DNA, 20 bp, Artificial
  CRISPR gRNA sequence
agaaaaagaaatccaaatca

SEQ ID NO: 565388 - DNA, 20 bp, Artificial
  CRISPR gRNA sequence
aaatttttaaaggttgggaa

SEQ ID NO: 565389 - DNA, 20 bp, Artificial
  CRISPR gRNA sequence
aatttttaaaggttgggaaa

SEQ ID NO: 565390 - DNA, 20 bp, Artificial
  CRISPR gRNA sequence
ttaaaggttgggaaaatgca

SEQ ID NO: 565391 - DNA, 20 bp, Artificial
  CRISPR gRNA sequence
taaaggttgggaaaatgcaa

SEQ ID NO: 565392 - DNA, 20 bp, Artificial
  CRISPR gRNA sequence
aaaggttgggaaaatgcaaa

SEQ ID NO: 565393 - DNA, 20 bp, Artificial
  CRISPR gRNA sequence
aaggttgggaaaatgcaaat

SEQ ID NO: 565394 - DNA, 20 bp, Artificial
  CRISPR gRNA sequence
ggaaaatgcaaattcaagta

SEQ ID NO: 565395 - DNA, 20 bp, Artificial
  CRISPR gRNA sequence
aagtatcaatgaaatgtcac

SEQ ID NO: 565396 - DNA, 20 bp, Artificial
  CRISPR gRNA sequence
tttgcccaaaaattaaacat

SEQ ID NO: 565397 - DNA, 20 bp, Artificial
  CRISPR gRNA sequence
gcccaaaaattaaacataaa

SEQ ID NO: 565398 - DNA, 20 bp, Artificial
  CRISPR gRNA sequence
cccaaaaattaaacataaaa

SEQ ID NO: 565399 - DNA, 20 bp, Artificial
  CRISPR gRNA sequence
aacataaaaaaaaaattacc

SEQ ID NO: 565400 - DNA, 20 bp, Artificial
  CRISPR gRNA sequence
cctaatgctgtcaggagtcc

SEQ ID NO: 565401 - DNA, 20 bp, Artificial
  CRISPR gRNA sequence
atgctgtcaggagtccaagg

SEQ ID NO: 565402 - DNA, 20 bp, Artificial
  CRISPR gRNA sequence
tcaggagtccaaggaaaggg

SEQ ID NO: 565403 - DNA, 20 bp, Artificial
  CRISPR gRNA sequence
aggcattactgatggagatg

SEQ ID NO: 565404 - DNA, 20 bp, Artificial
  CRISPR gRNA sequence
ctgatggagatgtaaattgc

SEQ ID NO: 565405 - DNA, 20 bp, Artificial
  CRISPR gRNA sequence
atggagatgtaaattgccaa

SEQ ID NO: 565406 - DNA, 20 bp, Artificial
  CRISPR gRNA sequence
ccaaagtcttttttgtaaac

SEQ ID NO: 565407 - DNA, 20 bp, Artificial
  CRISPR gRNA sequence
ttttgtaaacaatgcagcaa

SEQ ID NO: 565408 - DNA, 20 bp, Artificial
  CRISPR gRNA sequence
tttgtaaacaatgcagcaac

SEQ ID NO: 565409 - DNA, 20 bp, Artificial
  CRISPR gRNA sequence
ttgtaaacaatgcagcaact

SEQ ID NO: 565410 - DNA, 20 bp, Artificial
  CRISPR gRNA sequence
tgtaaacaatgcagcaactt

SEQ ID NO: 565411 - DNA, 20 bp, Artificial
  CRISPR gRNA sequence
gtaaacaatgcagcaacttc

SEQ ID NO: 565412 - DNA, 20 bp, Artificial
  CRISPR gRNA sequence
taaacaatgcagcaacttct

SEQ ID NO: 565413 - DNA, 20 bp, Artificial
  CRISPR gRNA sequence
ctattaaaataaaaaaaatc

SEQ ID NO: 565414 - DNA, 20 bp, Artificial
  CRISPR gRNA sequence
tattaaaataaaaaaaatct

SEQ ID NO: 565415 - DNA, 20 bp, Artificial
  CRISPR gRNA sequence
ttaaaataaaaaaaatctat

SEQ ID NO: 565416 - DNA, 20 bp, Artificial
  CRISPR gRNA sequence
aaataaaaaaaatctattta

SEQ ID NO: 565417 - DNA, 20 bp, Artificial
  CRISPR gRNA sequence
tttaccttttgatgtagcaa

SEQ ID NO: 565418 - DNA, 20 bp, Artificial
  CRISPR gRNA sequence
accttttgatgtagcaactc

SEQ ID NO: 565419 - DNA, 20 bp, Artificial
  CRISPR gRNA sequence
ccttttgatgtagcaactcc

SEQ ID NO: 565420 - DNA, 20 bp, Artificial
  CRISPR gRNA sequence
ttgatgtagcaactcccagc

SEQ ID NO: 565421 - DNA, 20 bp, Artificial
  CRISPR gRNA sequence
tgatgtagcaactcccagct

SEQ ID NO: 565422 - DNA, 20 bp, Artificial
  CRISPR gRNA sequence
gatgtagcaactcccagctc

SEQ ID NO: 565423 - DNA, 20 bp, Artificial
  CRISPR gRNA sequence
atgtagcaactcccagctcc

SEQ ID NO: 565424 - DNA, 20 bp, Artificial
  CRISPR gRNA sequence
ccagctccactctactccca

SEQ ID NO: 565425 - DNA, 20 bp, Artificial
  CRISPR gRNA sequence
cactctactcccacataaat

SEQ ID NO: 565426 - DNA, 20 bp, Artificial
  CRISPR gRNA sequence
tactcccacataaatatgaa

SEQ ID NO: 565427 - DNA, 20 bp, Artificial
  CRISPR gRNA sequence
ctcccacataaatatgaaac

SEQ ID NO: 565428 - DNA, 20 bp, Artificial
  CRISPR gRNA sequence
ccacataaatatgaaaccat

SEQ ID NO: 565429 - DNA, 20 bp, Artificial
  CRISPR gRNA sequence
ttgcggtgtaactgcaatag

SEQ ID NO: 565430 - DNA, 20 bp, Artificial
  CRISPR gRNA sequence
cggtgtaactgcaatagaca

SEQ ID NO: 565431 - DNA, 20 bp, Artificial
  CRISPR gRNA sequence
caatagacaaagctagccac

SEQ ID NO: 565432 - DNA, 20 bp, Artificial
  CRISPR gRNA sequence
gccacaaaaggagtgttcat

SEQ ID NO: 565433 - DNA, 20 bp, Artificial
  CRISPR gRNA sequence
atcagtggtggatggcagat

SEQ ID NO: 565434 - DNA, 20 bp, Artificial
  CRISPR gRNA sequence
attatggttccctcatgctc

SEQ ID NO: 565435 - DNA, 20 bp, Artificial
  CRISPR gRNA sequence
tggttccctcatgctctgga

SEQ ID NO: 565436 - DNA, 20 bp, Artificial
  CRISPR gRNA sequence
cctcatgctctggaatatta

SEQ ID NO: 565437 - DNA, 20 bp, Artificial
  CRISPR gRNA sequence
atgctctggaatattatgta

SEQ ID NO: 565438 - DNA, 20 bp, Artificial
  CRISPR gRNA sequence
tggaatattatgtagttatt

SEQ ID NO: 565439 - DNA, 20 bp, Artificial
  CRISPR gRNA sequence
gaatattatgtagttattaa

SEQ ID NO: 565440 - DNA, 20 bp, Artificial
  CRISPR gRNA sequence
tgtagttattaaaaagaata

SEQ ID NO: 565441 - DNA, 20 bp, Artificial
  CRISPR gRNA sequence
ttaaaaagaataaagtatag

SEQ ID NO: 565442 - DNA, 20 bp, Artificial
  CRISPR gRNA sequence
aaaagaataaagtatagcta

SEQ ID NO: 565443 - DNA, 20 bp, Artificial
  CRISPR gRNA sequence
taccagttgatttcaaggag

SEQ ID NO: 565444 - DNA, 20 bp, Artificial
  CRISPR gRNA sequence
atttcaaggagattttatga

SEQ ID NO: 565445 - DNA, 20 bp, Artificial
  CRISPR gRNA sequence
caaggagattttatgacata

SEQ ID NO: 565446 - DNA, 20 bp, Artificial
  CRISPR gRNA sequence
aaggagattttatgacatat

SEQ ID NO: 565447 - DNA, 20 bp, Artificial
  CRISPR gRNA sequence
tatgacatattaatggaaag

SEQ ID NO: 565448 - DNA, 20 bp, Artificial
  CRISPR gRNA sequence
atgacatattaatggaaagg

SEQ ID NO: 565449 - DNA, 20 bp, Artificial
  CRISPR gRNA sequence
tgacatattaatggaaaggc

SEQ ID NO: 565450 - DNA, 20 bp, Artificial
  CRISPR gRNA sequence
atggaaaggcgggatgtaga

SEQ ID NO: 565451 - DNA, 20 bp, Artificial
  CRISPR gRNA sequence
ttattaaagaatggtaaatc

SEQ ID NO: 565452 - DNA, 20 bp, Artificial
  CRISPR gRNA sequence
tattaaagaatggtaaatcc

SEQ ID NO: 565453 - DNA, 20 bp, Artificial
  CRISPR gRNA sequence
attaaagaatggtaaatccc

SEQ ID NO: 565454 - DNA, 20 bp, Artificial
  CRISPR gRNA sequence
ttaaagaatggtaaatccct

SEQ ID NO: 565455 - DNA, 20 bp, Artificial
  CRISPR gRNA sequence
aagaatggtaaatccctcag

SEQ ID NO: 565456 - DNA, 20 bp, Artificial
  CRISPR gRNA sequence
aggcacacctccttttattg

SEQ ID NO: 565457 - DNA, 20 bp, Artificial
  CRISPR gRNA sequence
cttttattgcatttcacttt

SEQ ID NO: 565458 - DNA, 20 bp, Artificial
  CRISPR gRNA sequence
ttattgcatttcactttatt

SEQ ID NO: 565459 - DNA, 20 bp, Artificial
  CRISPR gRNA sequence
tattgcatttcactttattg

SEQ ID NO: 565460 - DNA, 20 bp, Artificial
  CRISPR gRNA sequence
attgcatttcactttattgc

SEQ ID NO: 565461 - DNA, 20 bp, Artificial
  CRISPR gRNA sequence
ttgcatttcactttattgca

SEQ ID NO: 565462 - DNA, 20 bp, Artificial
  CRISPR gRNA sequence
catttcactttattgcactt

SEQ ID NO: 565463 - DNA, 20 bp, Artificial
  CRISPR gRNA sequence
cactttattgcacttcacag

SEQ ID NO: 565464 - DNA, 20 bp, Artificial
  CRISPR gRNA sequence
actttattgcacttcacaga

SEQ ID NO: 565465 - DNA, 20 bp, Artificial
  CRISPR gRNA sequence
tattgcacttcacagataat

SEQ ID NO: 565466 - DNA, 20 bp, Artificial
  CRISPR gRNA sequence
attgcacttcacagataatg

SEQ ID NO: 565467 - DNA, 20 bp, Artificial
  CRISPR gRNA sequence
ttgcacttcacagataatgt

SEQ ID NO: 565468 - DNA, 20 bp, Artificial
  CRISPR gRNA sequence
cacttcacagataatgtgct

SEQ ID NO: 565469 - DNA, 20 bp, Artificial
  CRISPR gRNA sequence
cacagataatgtgcttttta

SEQ ID NO: 565470 - DNA, 20 bp, Artificial
  CRISPR gRNA sequence
acagataatgtgctttttac

SEQ ID NO: 565471 - DNA, 20 bp, Artificial
  CRISPR gRNA sequence
tttacaaattgaaggttcgt

SEQ ID NO: 565472 - DNA, 20 bp, Artificial
  CRISPR gRNA sequence
ttacaaattgaaggttcgtg

SEQ ID NO: 565473 - DNA, 20 bp, Artificial
  CRISPR gRNA sequence
tacaaattgaaggttcgtga

SEQ ID NO: 565474 - DNA, 20 bp, Artificial
  CRISPR gRNA sequence
acaaattgaaggttcgtgac

SEQ ID NO: 565475 - DNA, 20 bp, Artificial
  CRISPR gRNA sequence
caaattgaaggttcgtgaca

SEQ ID NO: 565476 - DNA, 20 bp, Artificial
  CRISPR gRNA sequence
aaggttcgtgacaacccagc

SEQ ID NO: 565477 - DNA, 20 bp, Artificial
  CRISPR gRNA sequence
gtgacaacccagctttaagc

SEQ ID NO: 565478 - DNA, 20 bp, Artificial
  CRISPR gRNA sequence
taagcaagtccatcagtgcc

SEQ ID NO: 565479 - DNA, 20 bp, Artificial
  CRISPR gRNA sequence
aagcaagtccatcagtgcct

SEQ ID NO: 565480 - DNA, 20 bp, Artificial
  CRISPR gRNA sequence
agcaagtccatcagtgccta

SEQ ID NO: 565481 - DNA, 20 bp, Artificial
  CRISPR gRNA sequence
actttatgttttgtctctct

SEQ ID NO: 565482 - DNA, 20 bp, Artificial
  CRISPR gRNA sequence
tatgttttgtctctctgtta

SEQ ID NO: 565483 - DNA, 20 bp, Artificial
  CRISPR gRNA sequence
atgttttgtctctctgttac

SEQ ID NO: 565484 - DNA, 20 bp, Artificial
  CRISPR gRNA sequence
tgttttgtctctctgttaca

SEQ ID NO: 565485 - DNA, 20 bp, Artificial
  CRISPR gRNA sequence
tgtctctctgttacatttta

SEQ ID NO: 565486 - DNA, 20 bp, Artificial
  CRISPR gRNA sequence
gtctctctgttacattttag

SEQ ID NO: 565487 - DNA, 20 bp, Artificial
  CRISPR gRNA sequence
tctctctgttacattttagt

SEQ ID NO: 565488 - DNA, 20 bp, Artificial
  CRISPR gRNA sequence
tctgttacattttagtaatt

SEQ ID NO: 565489 - DNA, 20 bp, Artificial
  CRISPR gRNA sequence
tgttacattttagtaattcc

SEQ ID NO: 565490 - DNA, 20 bp, Artificial
  CRISPR gRNA sequence
ttacattttagtaattccca

SEQ ID NO: 565491 - DNA, 20 bp, Artificial
  CRISPR gRNA sequence
cattttagtaattcccacaa

SEQ ID NO: 565492 - DNA, 20 bp, Artificial
  CRISPR gRNA sequence
tagtaattcccacaatattt

SEQ ID NO: 565493 - DNA, 20 bp, Artificial
  CRISPR gRNA sequence
agtaattcccacaatattta

SEQ ID NO: 565494 - DNA, 20 bp, Artificial
  CRISPR gRNA sequence
gtaattcccacaatatttaa

SEQ ID NO: 565495 - DNA, 20 bp, Artificial
  CRISPR gRNA sequence
ccacaatatttaacgctttt

SEQ ID NO: 565496 - DNA, 20 bp, Artificial
  CRISPR gRNA sequence
aacgctttttcattatcata

SEQ ID NO: 565497 - DNA, 20 bp, Artificial
  CRISPR gRNA sequence
acgctttttcattatcatat

SEQ ID NO: 565498 - DNA, 20 bp, Artificial
  CRISPR gRNA sequence
tttcattatcatatctgtta

SEQ ID NO: 565499 - DNA, 20 bp, Artificial
  CRISPR gRNA sequence
ttcattatcatatctgttat

SEQ ID NO: 565500 - DNA, 20 bp, Artificial
  CRISPR gRNA sequence
tcattatcatatctgttatg

SEQ ID NO: 565501 - DNA, 20 bp, Artificial
  CRISPR gRNA sequence
cattatcatatctgttatgg

SEQ ID NO: 565502 - DNA, 20 bp, Artificial
  CRISPR gRNA sequence
attatcatatctgttatggt

SEQ ID NO: 565503 - DNA, 20 bp, Artificial
  CRISPR gRNA sequence
tcatatctgttatggtgatc

SEQ ID NO: 565504 - DNA, 20 bp, Artificial
  CRISPR gRNA sequence
ttatggtgatctgtgatcag

SEQ ID NO: 565505 - DNA, 20 bp, Artificial
  CRISPR gRNA sequence
tggtgatctgtgatcagtga

SEQ ID NO: 565506 - DNA, 20 bp, Artificial
  CRISPR gRNA sequence
tgatcagtgatctttgatgt

SEQ ID NO: 565507 - DNA, 20 bp, Artificial
  CRISPR gRNA sequence
tgatgttactgttgtcattg

SEQ ID NO: 565508 - DNA, 20 bp, Artificial
  CRISPR gRNA sequence
gatgttactgttgtcattgt

SEQ ID NO: 565509 - DNA, 20 bp, Artificial
  CRISPR gRNA sequence
atgttactgttgtcattgtt

SEQ ID NO: 565510 - DNA, 20 bp, Artificial
  CRISPR gRNA sequence
ctgttgtcattgttttggga

SEQ ID NO: 565511 - DNA, 20 bp, Artificial
  CRISPR gRNA sequence
ttgtcattgttttgggatgc

SEQ ID NO: 565512 - DNA, 20 bp, Artificial
  CRISPR gRNA sequence
tcattgttttgggatgccaa

SEQ ID NO: 565513 - DNA, 20 bp, Artificial
  CRISPR gRNA sequence
ttttgggatgccaagaacca

SEQ ID NO: 565514 - DNA, 20 bp, Artificial
  CRISPR gRNA sequence
tgggatgccaagaaccatgc

SEQ ID NO: 565515 - DNA, 20 bp, Artificial
  CRISPR gRNA sequence
gggatgccaagaaccatgcg

SEQ ID NO: 565516 - DNA, 20 bp, Artificial
  CRISPR gRNA sequence
ggatgccaagaaccatgcgt

SEQ ID NO: 565517 - DNA, 20 bp, Artificial
  CRISPR gRNA sequence
aattgataaatgctatgtgt

SEQ ID NO: 565518 - DNA, 20 bp, Artificial
  CRISPR gRNA sequence
attgataaatgctatgtgtg

SEQ ID NO: 565519 - DNA, 20 bp, Artificial
  CRISPR gRNA sequence
ataaatgctatgtgtgttct

SEQ ID NO: 565520 - DNA, 20 bp, Artificial
  CRISPR gRNA sequence
tgtgtgttctgactgctcca

SEQ ID NO: 565521 - DNA, 20 bp, Artificial
  CRISPR gRNA sequence
tgactgctccactgactggc

SEQ ID NO: 565522 - DNA, 20 bp, Artificial
  CRISPR gRNA sequence
actgctccactgactggctg

SEQ ID NO: 565523 - DNA, 20 bp, Artificial
  CRISPR gRNA sequence
ctccactgactggctgttct

SEQ ID NO: 565524 - DNA, 20 bp, Artificial
  CRISPR gRNA sequence
cactgactggctgttctccc

SEQ ID NO: 565525 - DNA, 20 bp, Artificial
  CRISPR gRNA sequence
actggctgttctccccatct

SEQ ID NO: 565526 - DNA, 20 bp, Artificial
  CRISPR gRNA sequence
gctgttctccccatctttct

SEQ ID NO: 565527 - DNA, 20 bp, Artificial
  CRISPR gRNA sequence
ttctccccatctttctcctt

SEQ ID NO: 565528 - DNA, 20 bp, Artificial
  CRISPR gRNA sequence
tccccatctttctccttctc

SEQ ID NO: 565529 - DNA, 20 bp, Artificial
  CRISPR gRNA sequence
cccatctttctccttctcct

SEQ ID NO: 565530 - DNA, 20 bp, Artificial
  CRISPR gRNA sequence
tctccttctcctggcctccc

SEQ ID NO: 565531 - DNA, 20 bp, Artificial
  CRISPR gRNA sequence
ctccttctcctggcctccct

SEQ ID NO: 565532 - DNA, 20 bp, Artificial
  CRISPR gRNA sequence
tccttctcctggcctccctt

SEQ ID NO: 565533 - DNA, 20 bp, Artificial
  CRISPR gRNA sequence
cttctcctggcctcccttgt

SEQ ID NO: 565534 - DNA, 20 bp, Artificial
  CRISPR gRNA sequence
ctcctggcctcccttgtcac

SEQ ID NO: 565535 - DNA, 20 bp, Artificial
  CRISPR gRNA sequence
tcctggcctcccttgtcacc

SEQ ID NO: 565536 - DNA, 20 bp, Artificial
  CRISPR gRNA sequence
ctggcctcccttgtcacctg

SEQ ID NO: 565537 - DNA, 20 bp, Artificial
  CRISPR gRNA sequence
gcctcccttgtcacctgaga

SEQ ID NO: 565538 - DNA, 20 bp, Artificial
  CRISPR gRNA sequence
ccttgtcacctgagacaatg

SEQ ID NO: 565539 - DNA, 20 bp, Artificial
  CRISPR gRNA sequence
gtcacctgagacaatgatac

SEQ ID NO: 565540 - DNA, 20 bp, Artificial
  CRISPR gRNA sequence
tcacctgagacaatgatact

SEQ ID NO: 565541 - DNA, 20 bp, Artificial
  CRISPR gRNA sequence
agacaatgatactgaaatta

SEQ ID NO: 565542 - DNA, 20 bp, Artificial
  CRISPR gRNA sequence
aaattaggccaatttaataa

SEQ ID NO: 565543 - DNA, 20 bp, Artificial
  CRISPR gRNA sequence
ggccaatttaataaccctgc

SEQ ID NO: 565544 - DNA, 20 bp, Artificial
  CRISPR gRNA sequence
aataaccctgcaatggcttc

SEQ ID NO: 565545 - DNA, 20 bp, Artificial
  CRISPR gRNA sequence
ataaccctgcaatggcttct

SEQ ID NO: 565546 - DNA, 20 bp, Artificial
  CRISPR gRNA sequence
caatggcttctaagtgctca

SEQ ID NO: 565547 - DNA, 20 bp, Artificial
  CRISPR gRNA sequence
ctaagtgctcaagtgaaaag

SEQ ID NO: 565548 - DNA, 20 bp, Artificial
  CRISPR gRNA sequence
taagtgctcaagtgaaaaga

SEQ ID NO: 565549 - DNA, 20 bp, Artificial
  CRISPR gRNA sequence
agtgctcaagtgaaaagaag

SEQ ID NO: 565550 - DNA, 20 bp, Artificial
  CRISPR gRNA sequence
aagtgaaaagaagagttgca

SEQ ID NO: 565551 - DNA, 20 bp, Artificial
  CRISPR gRNA sequence
cactgtctctcactttaaat

SEQ ID NO: 565552 - DNA, 20 bp, Artificial
  CRISPR gRNA sequence
tctctcactttaaattaaaa

SEQ ID NO: 565553 - DNA, 20 bp, Artificial
  CRISPR gRNA sequence
tcactttaaattaaaaacta

SEQ ID NO: 565554 - DNA, 20 bp, Artificial
  CRISPR gRNA sequence
actttaaattaaaaactaga

SEQ ID NO: 565555 - DNA, 20 bp, Artificial
  CRISPR gRNA sequence
taaattaaaaactagaaatg

SEQ ID NO: 565556 - DNA, 20 bp, Artificial
  CRISPR gRNA sequence
aaattaaaaactagaaatga

SEQ ID NO: 565557 - DNA, 20 bp, Artificial
  CRISPR gRNA sequence
aattaaaaactagaaatgat

SEQ ID NO: 565558 - DNA, 20 bp, Artificial
  CRISPR gRNA sequence
aaaactagaaatgattaagc

SEQ ID NO: 565559 - DNA, 20 bp, Artificial
  CRISPR gRNA sequence
gaaatgattaagcttagtga

SEQ ID NO: 565560 - DNA, 20 bp, Artificial
  CRISPR gRNA sequence
agcttagtgaggaaggcatg

SEQ ID NO: 565561 - DNA, 20 bp, Artificial
  CRISPR gRNA sequence
agtgaggaaggcatgtgaaa

SEQ ID NO: 565562 - DNA, 20 bp, Artificial
  CRISPR gRNA sequence
gtgaggaaggcatgtgaaaa

SEQ ID NO: 565563 - DNA, 20 bp, Artificial
  CRISPR gRNA sequence
acaactgtaatcccagcact

SEQ ID NO: 565564 - DNA, 20 bp, Artificial
  CRISPR gRNA sequence
taatcccagcactttgggag

SEQ ID NO: 565565 - DNA, 20 bp, Artificial
  CRISPR gRNA sequence
tgggaggccaaggtgggtgg

SEQ ID NO: 565566 - DNA, 20 bp, Artificial
  CRISPR gRNA sequence
gggaggccaaggtgggtgga

SEQ ID NO: 565567 - DNA, 20 bp, Artificial
  CRISPR gRNA sequence
ggaggccaaggtgggtggat

SEQ ID NO: 565568 - DNA, 20 bp, Artificial
  CRISPR gRNA sequence
aggtcagaagtttgagacca

SEQ ID NO: 565569 - DNA, 20 bp, Artificial
  CRISPR gRNA sequence
gagaccaacctggccaacat

SEQ ID NO: 565570 - DNA, 20 bp, Artificial
  CRISPR gRNA sequence
agaccaacctggccaacatg

SEQ ID NO: 565571 - DNA, 20 bp, Artificial
  CRISPR gRNA sequence
gccaacatggcgaaaccccg

SEQ ID NO: 565572 - DNA, 20 bp, Artificial
  CRISPR gRNA sequence
tactaaaaatacaaaaatta

SEQ ID NO: 565573 - DNA, 20 bp, Artificial
  CRISPR gRNA sequence
ctaaaaatacaaaaattagc

SEQ ID NO: 565574 - DNA, 20 bp, Artificial
  CRISPR gRNA sequence
aaaatacaaaaattagctgg

SEQ ID NO: 565575 - DNA, 20 bp, Artificial
  CRISPR gRNA sequence
gctgggtgtggtggtgggca

SEQ ID NO: 565576 - DNA, 20 bp, Artificial
  CRISPR gRNA sequence
ggtgtggtggtgggcacctg

SEQ ID NO: 565577 - DNA, 20 bp, Artificial
  CRISPR gRNA sequence
taatcccagctggttgggag

SEQ ID NO: 565578 - DNA, 20 bp, Artificial
  CRISPR gRNA sequence
gttgggaggctgaggcagga

SEQ ID NO: 565579 - DNA, 20 bp, Artificial
  CRISPR gRNA sequence
ggaggctgaggcaggagaat

SEQ ID NO: 565580 - DNA, 20 bp, Artificial
  CRISPR gRNA sequence
aggcaggagaatcgcttgaa

SEQ ID NO: 565581 - DNA, 20 bp, Artificial
  CRISPR gRNA sequence
gaacctgaaaggcagatgtt

SEQ ID NO: 565582 - DNA, 20 bp, Artificial
  CRISPR gRNA sequence
aacctgaaaggcagatgttg

SEQ ID NO: 565583 - DNA, 20 bp, Artificial
  CRISPR gRNA sequence
aaaggcagatgttgcagtga

SEQ ID NO: 565584 - DNA, 20 bp, Artificial
  CRISPR gRNA sequence
cagtgagccaagatggcact

SEQ ID NO: 565585 - DNA, 20 bp, Artificial
  CRISPR gRNA sequence
ttgcactccagtctgggcta

SEQ ID NO: 565586 - DNA, 20 bp, Artificial
  CRISPR gRNA sequence
cactccagtctgggctacaa

SEQ ID NO: 565587 - DNA, 20 bp, Artificial
  CRISPR gRNA sequence
cagtctgggctacaagaatg

SEQ ID NO: 565588 - DNA, 20 bp, Artificial
  CRISPR gRNA sequence
ggctacaagaatgaaactct

SEQ ID NO: 565589 - DNA, 20 bp, Artificial
  CRISPR gRNA sequence
caagaatgaaactctgtctg

SEQ ID NO: 565590 - DNA, 20 bp, Artificial
  CRISPR gRNA sequence
tgtctgaagaaaaaaaaaaa

SEQ ID NO: 565591 - DNA, 20 bp, Artificial
  CRISPR gRNA sequence
tctgaagaaaaaaaaaaaaa

SEQ ID NO: 565592 - DNA, 20 bp, Artificial
  CRISPR gRNA sequence
aagaaaaaaaaaaaaaaaga

SEQ ID NO: 565593 - DNA, 20 bp, Artificial
  CRISPR gRNA sequence
aaaactaggccttttatgcc

SEQ ID NO: 565594 - DNA, 20 bp, Artificial
  CRISPR gRNA sequence
ggccttttatgccaaagagt

SEQ ID NO: 565595 - DNA, 20 bp, Artificial
  CRISPR gRNA sequence
ttatgccaaagagttagtga

SEQ ID NO: 565596 - DNA, 20 bp, Artificial
  CRISPR gRNA sequence
tatgccaaagagttagtgaa

SEQ ID NO: 565597 - DNA, 20 bp, Artificial
  CRISPR gRNA sequence
atgccaaagagttagtgaag

SEQ ID NO: 565598 - DNA, 20 bp, Artificial
  CRISPR gRNA sequence
tgccaaagagttagtgaagt

SEQ ID NO: 565599 - DNA, 20 bp, Artificial
  CRISPR gRNA sequence
gtgaagttgtgaattcaaag

SEQ ID NO: 565600 - DNA, 20 bp, Artificial
  CRISPR gRNA sequence
tgaattcaaaggaaaagttc

SEQ ID NO: 565601 - DNA, 20 bp, Artificial
  CRISPR gRNA sequence
aaaggaaaagttcttgaagg

SEQ ID NO: 565602 - DNA, 20 bp, Artificial
  CRISPR gRNA sequence
ttgaaggaaattaaaagtgc

SEQ ID NO: 565603 - DNA, 20 bp, Artificial
  CRISPR gRNA sequence
gaaggaaattaaaagtgcta

SEQ ID NO: 565604 - DNA, 20 bp, Artificial
  CRISPR gRNA sequence
aaggaaattaaaagtgctac

SEQ ID NO: 565605 - DNA, 20 bp, Artificial
  CRISPR gRNA sequence
aaagtgctacttcagtgaac

SEQ ID NO: 565606 - DNA, 20 bp, Artificial
  CRISPR gRNA sequence
cttcagtgaacacataaata

SEQ ID NO: 565607 - DNA, 20 bp, Artificial
  CRISPR gRNA sequence
cagtgaacacataaataaga

SEQ ID NO: 565608 - DNA, 20 bp, Artificial
  CRISPR gRNA sequence
agtgaacacataaataagaa

SEQ ID NO: 565609 - DNA, 20 bp, Artificial
  CRISPR gRNA sequence
ttgcagatggagaaagttcg

SEQ ID NO: 565610 - DNA, 20 bp, Artificial
  CRISPR gRNA sequence
cagatggagaaagttcgagt

SEQ ID NO: 565611 - DNA, 20 bp, Artificial
  CRISPR gRNA sequence
gagtagtctgcatagaagat

SEQ ID NO: 565612 - DNA, 20 bp, Artificial
  CRISPR gRNA sequence
catagaagatcaagccagct

SEQ ID NO: 565613 - DNA, 20 bp, Artificial
  CRISPR gRNA sequence
caacattcccttaatccaaa

SEQ ID NO: 565614 - DNA, 20 bp, Artificial
  CRISPR gRNA sequence
ccttaatccaaagcctaatc

SEQ ID NO: 565615 - DNA, 20 bp, Artificial
  CRISPR gRNA sequence
aatccaaagcctaatccaga

SEQ ID NO: 565616 - DNA, 20 bp, Artificial
  CRISPR gRNA sequence
atccaaagcctaatccagag

SEQ ID NO: 565617 - DNA, 20 bp, Artificial
  CRISPR gRNA sequence
atccagagcaagaccctaac

SEQ ID NO: 565618 - DNA, 20 bp, Artificial
  CRISPR gRNA sequence
actctctttagttctgtgaa

SEQ ID NO: 565619 - DNA, 20 bp, Artificial
  CRISPR gRNA sequence
tctttagttctgtgaaggct

SEQ ID NO: 565620 - DNA, 20 bp, Artificial
  CRISPR gRNA sequence
tttagttctgtgaaggctga

SEQ ID NO: 565621 - DNA, 20 bp, Artificial
  CRISPR gRNA sequence
tagttctgtgaaggctgaga

SEQ ID NO: 565622 - DNA, 20 bp, Artificial
  CRISPR gRNA sequence
agttctgtgaaggctgagag

SEQ ID NO: 565623 - DNA, 20 bp, Artificial
  CRISPR gRNA sequence
gttctgtgaaggctgagaga

SEQ ID NO: 565624 - DNA, 20 bp, Artificial
  CRISPR gRNA sequence
tgtgaaggctgagagaggtg

SEQ ID NO: 565625 - DNA, 20 bp, Artificial
  CRISPR gRNA sequence
tgaaggctgagagaggtgag

SEQ ID NO: 565626 - DNA, 20 bp, Artificial
  CRISPR gRNA sequence
agagaggtgagaaagctgca

SEQ ID NO: 565627 - DNA, 20 bp, Artificial
  CRISPR gRNA sequence
caggagaaaagtttgaagct

SEQ ID NO: 565628 - DNA, 20 bp, Artificial
  CRISPR gRNA sequence
gaagctatcagaggttagtt

SEQ ID NO: 565629 - DNA, 20 bp, Artificial
  CRISPR gRNA sequence
aagctatcagaggttagttc

SEQ ID NO: 565630 - DNA, 20 bp, Artificial
  CRISPR gRNA sequence
tcagaggttagttcatgaga

SEQ ID NO: 565631 - DNA, 20 bp, Artificial
  CRISPR gRNA sequence
gttcatgagatcttaggaag

SEQ ID NO: 565632 - DNA, 20 bp, Artificial
  CRISPR gRNA sequence
atgagatcttaggaagaaag

SEQ ID NO: 565633 - DNA, 20 bp, Artificial
  CRISPR gRNA sequence
aggaagaaagccatctccat

SEQ ID NO: 565634 - DNA, 20 bp, Artificial
  CRISPR gRNA sequence
ggaagaaagccatctccata

SEQ ID NO: 565635 - DNA, 20 bp, Artificial
  CRISPR gRNA sequence
cataacataaaactgtgaag

SEQ ID NO: 565636 - DNA, 20 bp, Artificial
  CRISPR gRNA sequence
tgaagtaaagcagcaagtgt

SEQ ID NO: 565637 - DNA, 20 bp, Artificial
  CRISPR gRNA sequence
atgtagaagctgcaagaaat

SEQ ID NO: 565638 - DNA, 20 bp, Artificial
  CRISPR gRNA sequence
caagaaattatccagaagat

SEQ ID NO: 565639 - DNA, 20 bp, Artificial
  CRISPR gRNA sequence
tccagaagatctaagattac

SEQ ID NO: 565640 - DNA, 20 bp, Artificial
  CRISPR gRNA sequence
agattactggtgcaggatac

SEQ ID NO: 565641 - DNA, 20 bp, Artificial
  CRISPR gRNA sequence
ctggtgcaggatacatgaaa

SEQ ID NO: 565642 - DNA, 20 bp, Artificial
  CRISPR gRNA sequence
gtgcaggatacatgaaacaa

SEQ ID NO: 565643 - DNA, 20 bp, Artificial
  CRISPR gRNA sequence
tcaatgtagacaaaacaacc

SEQ ID NO: 565644 - DNA, 20 bp, Artificial
  CRISPR gRNA sequence
caatgtagacaaaacaacct

SEQ ID NO: 565645 - DNA, 20 bp, Artificial
  CRISPR gRNA sequence
aatgtagacaaaacaacctt

SEQ ID NO: 565646 - DNA, 20 bp, Artificial
  CRISPR gRNA sequence
ctactggaagaagatgccat

SEQ ID NO: 565647 - DNA, 20 bp, Artificial
  CRISPR gRNA sequence
tactggaagaagatgccatc

SEQ ID NO: 565648 - DNA, 20 bp, Artificial
  CRISPR gRNA sequence
ctggaagaagatgccatcta

SEQ ID NO: 565649 - DNA, 20 bp, Artificial
  CRISPR gRNA sequence
gaagaagatgccatctagga

SEQ ID NO: 565650 - DNA, 20 bp, Artificial
  CRISPR gRNA sequence
ggacttccatagctagacag

SEQ ID NO: 565651 - DNA, 20 bp, Artificial
  CRISPR gRNA sequence
ccatagctagacaggagaag

SEQ ID NO: 565652 - DNA, 20 bp, Artificial
  CRISPR gRNA sequence
catagctagacaggagaagt

SEQ ID NO: 565653 - DNA, 20 bp, Artificial
  CRISPR gRNA sequence
gacaggagaagtcaacttca

SEQ ID NO: 565654 - DNA, 20 bp, Artificial
  CRISPR gRNA sequence
caggcttgaaaggacagctg

SEQ ID NO: 565655 - DNA, 20 bp, Artificial
  CRISPR gRNA sequence
aggcttgaaaggacagctga

SEQ ID NO: 565656 - DNA, 20 bp, Artificial
  CRISPR gRNA sequence
gaaaggacagctgactctct

SEQ ID NO: 565657 - DNA, 20 bp, Artificial
  CRISPR gRNA sequence
aaaggacagctgactctctt

SEQ ID NO: 565658 - DNA, 20 bp, Artificial
  CRISPR gRNA sequence
actctcttgttgtgtgggct

SEQ ID NO: 565659 - DNA, 20 bp, Artificial
  CRISPR gRNA sequence
tcttgttgtgtgggctaatg

SEQ ID NO: 565660 - DNA, 20 bp, Artificial
  CRISPR gRNA sequence
ttgttgtgtgggctaatgca

SEQ ID NO: 565661 - DNA, 20 bp, Artificial
  CRISPR gRNA sequence
gttgtgtgggctaatgcagc

SEQ ID NO: 565662 - DNA, 20 bp, Artificial
  CRISPR gRNA sequence
ttgtgtgggctaatgcagct

SEQ ID NO: 565663 - DNA, 20 bp, Artificial
  CRISPR gRNA sequence
tgtgggctaatgcagctgat

SEQ ID NO: 565664 - DNA, 20 bp, Artificial
  CRISPR gRNA sequence
atgcagctgatgactttaag

SEQ ID NO: 565665 - DNA, 20 bp, Artificial
  CRISPR gRNA sequence
atgactttaagttgaagcca

SEQ ID NO: 565666 - DNA, 20 bp, Artificial
  CRISPR gRNA sequence
taagttgaagccagtgctca

SEQ ID NO: 565667 - DNA, 20 bp, Artificial
  CRISPR gRNA sequence
aagttgaagccagtgctcat

SEQ ID NO: 565668 - DNA, 20 bp, Artificial
  CRISPR gRNA sequence
agttgaagccagtgctcatt

SEQ ID NO: 565669 - DNA, 20 bp, Artificial
  CRISPR gRNA sequence
aagccagtgctcatttacca

SEQ ID NO: 565670 - DNA, 20 bp, Artificial
  CRISPR gRNA sequence
atttaccactctgaaaattt

SEQ ID NO: 565671 - DNA, 20 bp, Artificial
  CRISPR gRNA sequence
accactctgaaaatttttag

SEQ ID NO: 565672 - DNA, 20 bp, Artificial
  CRISPR gRNA sequence
ccactctgaaaatttttagg

SEQ ID NO: 565673 - DNA, 20 bp, Artificial
  CRISPR gRNA sequence
tgaaaatttttagggccctt

SEQ ID NO: 565674 - DNA, 20 bp, Artificial
  CRISPR gRNA sequence
aaaatttttagggcccttaa

SEQ ID NO: 565675 - DNA, 20 bp, Artificial
  CRISPR gRNA sequence
ttagggcccttaagaattag

SEQ ID NO: 565676 - DNA, 20 bp, Artificial
  CRISPR gRNA sequence
tagggcccttaagaattagg

SEQ ID NO: 565677 - DNA, 20 bp, Artificial
  CRISPR gRNA sequence
agggcccttaagaattaggc

SEQ ID NO: 565678 - DNA, 20 bp, Artificial
  CRISPR gRNA sequence
gggcccttaagaattaggct

SEQ ID NO: 565679 - DNA, 20 bp, Artificial
  CRISPR gRNA sequence
aagaattaggctaaatctat

SEQ ID NO: 565680 - DNA, 20 bp, Artificial
  CRISPR gRNA sequence
agaattaggctaaatctatt

SEQ ID NO: 565681 - DNA, 20 bp, Artificial
  CRISPR gRNA sequence
ggctaaatctattctgcttg

SEQ ID NO: 565682 - DNA, 20 bp, Artificial
  CRISPR gRNA sequence
aatctattctgcttgtgctc

SEQ ID NO: 565683 - DNA, 20 bp, Artificial
  CRISPR gRNA sequence
ttctgcttgtgctctataaa

SEQ ID NO: 565684 - DNA, 20 bp, Artificial
  CRISPR gRNA sequence
tgcttgtgctctataaaatg

SEQ ID NO: 565685 - DNA, 20 bp, Artificial
  CRISPR gRNA sequence
cttgtgctctataaaatgga

SEQ ID NO: 565686 - DNA, 20 bp, Artificial
  CRISPR gRNA sequence
gtgctctataaaatggaaca

SEQ ID NO: 565687 - DNA, 20 bp, Artificial
  CRISPR gRNA sequence
tgctctataaaatggaacaa

SEQ ID NO: 565688 - DNA, 20 bp, Artificial
  CRISPR gRNA sequence
tataaaatggaacaacaggc

SEQ ID NO: 565689 - DNA, 20 bp, Artificial
  CRISPR gRNA sequence
taaaatggaacaacaggctg

SEQ ID NO: 565690 - DNA, 20 bp, Artificial
  CRISPR gRNA sequence
gatgacagcacatctgttta

SEQ ID NO: 565691 - DNA, 20 bp, Artificial
  CRISPR gRNA sequence
tttacagcatggtttactga

SEQ ID NO: 565692 - DNA, 20 bp, Artificial
  CRISPR gRNA sequence
acagcatggtttactgaata

SEQ ID NO: 565693 - DNA, 20 bp, Artificial
  CRISPR gRNA sequence
cagcatggtttactgaatat

SEQ ID NO: 565694 - DNA, 20 bp, Artificial
  CRISPR gRNA sequence
actgaatattgtaagcccac

SEQ ID NO: 565695 - DNA, 20 bp, Artificial
  CRISPR gRNA sequence
ctgaatattgtaagcccact

SEQ ID NO: 565696 - DNA, 20 bp, Artificial
  CRISPR gRNA sequence
aatattgtaagcccactgtt

SEQ ID NO: 565697 - DNA, 20 bp, Artificial
  CRISPR gRNA sequence
taagcccactgttaatactt

SEQ ID NO: 565698 - DNA, 20 bp, Artificial
  CRISPR gRNA sequence
ttaatacttactgcttagaa

SEQ ID NO: 565699 - DNA, 20 bp, Artificial
  CRISPR gRNA sequence
atacttactgcttagaaaaa

SEQ ID NO: 565700 - DNA, 20 bp, Artificial
  CRISPR gRNA sequence
actgcttagaaaaaaaagat

SEQ ID NO: 565701 - DNA, 20 bp, Artificial
  CRISPR gRNA sequence
ctgcttagaaaaaaaagatt

SEQ ID NO: 565702 - DNA, 20 bp, Artificial
  CRISPR gRNA sequence
cttagaaaaaaaagattcat

SEQ ID NO: 565703 - DNA, 20 bp, Artificial
  CRISPR gRNA sequence
agaaaaaaaagattcatttc

SEQ ID NO: 565704 - DNA, 20 bp, Artificial
  CRISPR gRNA sequence
gaaaaaaaagattcatttca

SEQ ID NO: 565705 - DNA, 20 bp, Artificial
  CRISPR gRNA sequence
atttcagtatattattgctt

SEQ ID NO: 565706 - DNA, 20 bp, Artificial
  CRISPR gRNA sequence
cagtatattattgcttgttg

SEQ ID NO: 565707 - DNA, 20 bp, Artificial
  CRISPR gRNA sequence
agtatattattgcttgttga

SEQ ID NO: 565708 - DNA, 20 bp, Artificial
  CRISPR gRNA sequence
ttgcttgttgacaatgcacc

SEQ ID NO: 565709 - DNA, 20 bp, Artificial
  CRISPR gRNA sequence
cttgttgacaatgcacctaa

SEQ ID NO: 565710 - DNA, 20 bp, Artificial
  CRISPR gRNA sequence
gttgacaatgcacctaatca

SEQ ID NO: 565711 - DNA, 20 bp, Artificial
  CRISPR gRNA sequence
ttgacaatgcacctaatcac

SEQ ID NO: 565712 - DNA, 20 bp, Artificial
  CRISPR gRNA sequence
acaatgcacctaatcaccca

SEQ ID NO: 565713 - DNA, 20 bp, Artificial
  CRISPR gRNA sequence
atcacccaagagctctgatg

SEQ ID NO: 565714 - DNA, 20 bp, Artificial
  CRISPR gRNA sequence
tgatggagatgtacaaggag

SEQ ID NO: 565715 - DNA, 20 bp, Artificial
  CRISPR gRNA sequence
atggagatgtacaaggagat

SEQ ID NO: 565716 - DNA, 20 bp, Artificial
  CRISPR gRNA sequence
ttttcatgcttgctaataca

SEQ ID NO: 565717 - DNA, 20 bp, Artificial
  CRISPR gRNA sequence
tcatgcttgctaatacaaca

SEQ ID NO: 565718 - DNA, 20 bp, Artificial
  CRISPR gRNA sequence
catgcttgctaatacaacat

SEQ ID NO: 565719 - DNA, 20 bp, Artificial
  CRISPR gRNA sequence
atgcttgctaatacaacatc

SEQ ID NO: 565720 - DNA, 20 bp, Artificial
  CRISPR gRNA sequence
gctaatacaacatccattct

SEQ ID NO: 565721 - DNA, 20 bp, Artificial
  CRISPR gRNA sequence
ctaatacaacatccattctg

SEQ ID NO: 565722 - DNA, 20 bp, Artificial
  CRISPR gRNA sequence
atacaacatccattctgcag

SEQ ID NO: 565723 - DNA, 20 bp, Artificial
  CRISPR gRNA sequence
tgcagcccatggatcaagga

SEQ ID NO: 565724 - DNA, 20 bp, Artificial
  CRISPR gRNA sequence
cagcccatggatcaaggagt

SEQ ID NO: 565725 - DNA, 20 bp, Artificial
  CRISPR gRNA sequence
tgcctttgaagtcttattat

SEQ ID NO: 565726 - DNA, 20 bp, Artificial
  CRISPR gRNA sequence
gcctttgaagtcttattatg

SEQ ID NO: 565727 - DNA, 20 bp, Artificial
  CRISPR gRNA sequence
cctttgaagtcttattatgt

SEQ ID NO: 565728 - DNA, 20 bp, Artificial
  CRISPR gRNA sequence
tgaagtcttattatgtagga

SEQ ID NO: 565729 - DNA, 20 bp, Artificial
  CRISPR gRNA sequence
gaagtcttattatgtaggaa

SEQ ID NO: 565730 - DNA, 20 bp, Artificial
  CRISPR gRNA sequence
aagtcttattatgtaggaat

SEQ ID NO: 565731 - DNA, 20 bp, Artificial
  CRISPR gRNA sequence
attatgtaggaatacacttg

SEQ ID NO: 565732 - DNA, 20 bp, Artificial
  CRISPR gRNA sequence
ttatgtaggaatacacttgg

SEQ ID NO: 565733 - DNA, 20 bp, Artificial
  CRISPR gRNA sequence
tgtaggaatacacttggtaa

SEQ ID NO: 565734 - DNA, 20 bp, Artificial
  CRISPR gRNA sequence
ggtaaggctatagctgccat

SEQ ID NO: 565735 - DNA, 20 bp, Artificial
  CRISPR gRNA sequence
gtaaggctatagctgccata

SEQ ID NO: 565736 - DNA, 20 bp, Artificial
  CRISPR gRNA sequence
tagctgccatagataattat

SEQ ID NO: 565737 - DNA, 20 bp, Artificial
  CRISPR gRNA sequence
ccatagataattattcttct

SEQ ID NO: 565738 - DNA, 20 bp, Artificial
  CRISPR gRNA sequence
ttcttctgatgaatctgggc

SEQ ID NO: 565739 - DNA, 20 bp, Artificial
  CRISPR gRNA sequence
ttctgatgaatctgggcaaa

SEQ ID NO: 565740 - DNA, 20 bp, Artificial
  CRISPR gRNA sequence
ctgatgaatctgggcaaagt

SEQ ID NO: 565741 - DNA, 20 bp, Artificial
  CRISPR gRNA sequence
tgatgaatctgggcaaagta

SEQ ID NO: 565742 - DNA, 20 bp, Artificial
  CRISPR gRNA sequence
atgaatctgggcaaagtaaa

SEQ ID NO: 565743 - DNA, 20 bp, Artificial
  CRISPR gRNA sequence
ggcaaagtaaattgacaacc

SEQ ID NO: 565744 - DNA, 20 bp, Artificial
  CRISPR gRNA sequence
acaaccttctgaaaggattc

SEQ ID NO: 565745 - DNA, 20 bp, Artificial
  CRISPR gRNA sequence
ctgaaaggattcagcattct

SEQ ID NO: 565746 - DNA, 20 bp, Artificial
  CRISPR gRNA sequence
tgaaaggattcagcattcta

SEQ ID NO: 565747 - DNA, 20 bp, Artificial
  CRISPR gRNA sequence
aaaggattcagcattctaga

SEQ ID NO: 565748 - DNA, 20 bp, Artificial
  CRISPR gRNA sequence
agcattctagatgtcattaa

SEQ ID NO: 565749 - DNA, 20 bp, Artificial
  CRISPR gRNA sequence
tagatgtcattaagaatatt

SEQ ID NO: 565750 - DNA, 20 bp, Artificial
  CRISPR gRNA sequence
gatgtcattaagaatatttg

SEQ ID NO: 565751 - DNA, 20 bp, Artificial
  CRISPR gRNA sequence
agaatatttgtggttcatgg

SEQ ID NO: 565752 - DNA, 20 bp, Artificial
  CRISPR gRNA sequence
gtggttcatgggagaagatc

SEQ ID NO: 565753 - DNA, 20 bp, Artificial
  CRISPR gRNA sequence
tggttcatgggagaagatca

SEQ ID NO: 565754 - DNA, 20 bp, Artificial
  CRISPR gRNA sequence
atgggagaagatcaaaatat

SEQ ID NO: 565755 - DNA, 20 bp, Artificial
  CRISPR gRNA sequence
acaggagtttggaagaattt

SEQ ID NO: 565756 - DNA, 20 bp, Artificial
  CRISPR gRNA sequence
ggaagaatttgattccaatc

SEQ ID NO: 565757 - DNA, 20 bp, Artificial
  CRISPR gRNA sequence
gaagaatttgattccaatcg

SEQ ID NO: 565758 - DNA, 20 bp, Artificial
  CRISPR gRNA sequence
gattccaatcgtcaggtcaa

SEQ ID NO: 565759 - DNA, 20 bp, Artificial
  CRISPR gRNA sequence
attccaatcgtcaggtcaaa

SEQ ID NO: 565760 - DNA, 20 bp, Artificial
  CRISPR gRNA sequence
caatcgtcaggtcaaaatat

SEQ ID NO: 565761 - DNA, 20 bp, Artificial
  CRISPR gRNA sequence
acaggagtttggaagaattt

SEQ ID NO: 565762 - DNA, 20 bp, Artificial
  CRISPR gRNA sequence
ggaagaatttgattccgatc

SEQ ID NO: 565763 - DNA, 20 bp, Artificial
  CRISPR gRNA sequence
gaagaatttgattccgatcc

SEQ ID NO: 565764 - DNA, 20 bp, Artificial
  CRISPR gRNA sequence
gattccgatcctcatggatg

SEQ ID NO: 565765 - DNA, 20 bp, Artificial
  CRISPR gRNA sequence
attccgatcctcatggatga

SEQ ID NO: 565766 - DNA, 20 bp, Artificial
  CRISPR gRNA sequence
cgatcctcatggatgacttt

SEQ ID NO: 565767 - DNA, 20 bp, Artificial
  CRISPR gRNA sequence
atggatgactttgaagggtg

SEQ ID NO: 565768 - DNA, 20 bp, Artificial
  CRISPR gRNA sequence
tgaagggtggaaatagcaag

SEQ ID NO: 565769 - DNA, 20 bp, Artificial
  CRISPR gRNA sequence
gaagggtggaaatagcaaga

SEQ ID NO: 565770 - DNA, 20 bp, Artificial
  CRISPR gRNA sequence
aagggtggaaatagcaagaa

SEQ ID NO: 565771 - DNA, 20 bp, Artificial
  CRISPR gRNA sequence
aatatgtcactcagttgcca

SEQ ID NO: 565772 - DNA, 20 bp, Artificial
  CRISPR gRNA sequence
agttgccacaatctcatgat

SEQ ID NO: 565773 - DNA, 20 bp, Artificial
  CRISPR gRNA sequence
ccacaatctcatgatgaaaa

SEQ ID NO: 565774 - DNA, 20 bp, Artificial
  CRISPR gRNA sequence
atgatgaaaattgagccaat

SEQ ID NO: 565775 - DNA, 20 bp, Artificial
  CRISPR gRNA sequence
agccaatgaggagttgcttc

SEQ ID NO: 565776 - DNA, 20 bp, Artificial
  CRISPR gRNA sequence
cttcttatggatgagcaaag

SEQ ID NO: 565777 - DNA, 20 bp, Artificial
  CRISPR gRNA sequence
cttatggatgagcaaagaaa

SEQ ID NO: 565778 - DNA, 20 bp, Artificial
  CRISPR gRNA sequence
ttatggatgagcaaagaaag

SEQ ID NO: 565779 - DNA, 20 bp, Artificial
  CRISPR gRNA sequence
atggatgagcaaagaaagtg

SEQ ID NO: 565780 - DNA, 20 bp, Artificial
  CRISPR gRNA sequence
tggatgagcaaagaaagtgg

SEQ ID NO: 565781 - DNA, 20 bp, Artificial
  CRISPR gRNA sequence
cttcagatggcatctatact

SEQ ID NO: 565782 - DNA, 20 bp, Artificial
  CRISPR gRNA sequence
ttcagatggcatctatactc

SEQ ID NO: 565783 - DNA, 20 bp, Artificial
  CRISPR gRNA sequence
cagatggcatctatactcct

SEQ ID NO: 565784 - DNA, 20 bp, Artificial
  CRISPR gRNA sequence
agatggcatctatactcctg

SEQ ID NO: 565785 - DNA, 20 bp, Artificial
  CRISPR gRNA sequence
tactcctggtgaagatgctg

SEQ ID NO: 565786 - DNA, 20 bp, Artificial
  CRISPR gRNA sequence
ctggtgaagatgctgtgaac

SEQ ID NO: 565787 - DNA, 20 bp, Artificial
  CRISPR gRNA sequence
gtgaagatgctgtgaacatt

SEQ ID NO: 565788 - DNA, 20 bp, Artificial
  CRISPR gRNA sequence
tgaacattgtttaaatgaca

SEQ ID NO: 565789 - DNA, 20 bp, Artificial
  CRISPR gRNA sequence
tttaaatgacaacaaagggt

SEQ ID NO: 565790 - DNA, 20 bp, Artificial
  CRISPR gRNA sequence
aaatgacaacaaagggttaa

SEQ ID NO: 565791 - DNA, 20 bp, Artificial
  CRISPR gRNA sequence
aatgacaacaaagggttaag

SEQ ID NO: 565792 - DNA, 20 bp, Artificial
  CRISPR gRNA sequence
agagtattacataaatttag

SEQ ID NO: 565793 - DNA, 20 bp, Artificial
  CRISPR gRNA sequence
cataaatttagttgataaag

SEQ ID NO: 565794 - DNA, 20 bp, Artificial
  CRISPR gRNA sequence
agttgataaagcagcagcag

SEQ ID NO: 565795 - DNA, 20 bp, Artificial
  CRISPR gRNA sequence
gttgataaagcagcagcagg

SEQ ID NO: 565796 - DNA, 20 bp, Artificial
  CRISPR gRNA sequence
ataaagcagcagcaggattt

SEQ ID NO: 565797 - DNA, 20 bp, Artificial
  CRISPR gRNA sequence
gagaaaatttactctaattt

SEQ ID NO: 565798 - DNA, 20 bp, Artificial
  CRISPR gRNA sequence
agaaaatttactctaatttt

SEQ ID NO: 565799 - DNA, 20 bp, Artificial
  CRISPR gRNA sequence
actctaattttgaaagcagt

SEQ ID NO: 565800 - DNA, 20 bp, Artificial
  CRISPR gRNA sequence
ctctaattttgaaagcagtt

SEQ ID NO: 565801 - DNA, 20 bp, Artificial
  CRISPR gRNA sequence
taattttgaaagcagtttta

SEQ ID NO: 565802 - DNA, 20 bp, Artificial
  CRISPR gRNA sequence
attttgaaagcagttttact

SEQ ID NO: 565803 - DNA, 20 bp, Artificial
  CRISPR gRNA sequence
tgaaagcagttttactgtga

SEQ ID NO: 565804 - DNA, 20 bp, Artificial
  CRISPR gRNA sequence
gaaagcagttttactgtgag

SEQ ID NO: 565805 - DNA, 20 bp, Artificial
  CRISPR gRNA sequence
aaagcagttttactgtgagt

SEQ ID NO: 565806 - DNA, 20 bp, Artificial
  CRISPR gRNA sequence
tactgtgagtaaaattctat

SEQ ID NO: 565807 - DNA, 20 bp, Artificial
  CRISPR gRNA sequence
actgtgagtaaaattctatc

SEQ ID NO: 565808 - DNA, 20 bp, Artificial
  CRISPR gRNA sequence
ctgtgagtaaaattctatca

SEQ ID NO: 565809 - DNA, 20 bp, Artificial
  CRISPR gRNA sequence
tgagtaaaattctatcaaac

SEQ ID NO: 565810 - DNA, 20 bp, Artificial
  CRISPR gRNA sequence
tatcaaacagcattggatgc

SEQ ID NO: 565811 - DNA, 20 bp, Artificial
  CRISPR gRNA sequence
tcaaacagcattggatgcct

SEQ ID NO: 565812 - DNA, 20 bp, Artificial
  CRISPR gRNA sequence
gatgcctctgagaaatattt

SEQ ID NO: 565813 - DNA, 20 bp, Artificial
  CRISPR gRNA sequence
tgagaaatattttgtgaaag

SEQ ID NO: 565814 - DNA, 20 bp, Artificial
  CRISPR gRNA sequence
agaaatattttgtgaaagga

SEQ ID NO: 565815 - DNA, 20 bp, Artificial
  CRISPR gRNA sequence
tgtgaaaggaagggtccatt

SEQ ID NO: 565816 - DNA, 20 bp, Artificial
  CRISPR gRNA sequence
gtgaaaggaagggtccattg

SEQ ID NO: 565817 - DNA, 20 bp, Artificial
  CRISPR gRNA sequence
tgaaaggaagggtccattga

SEQ ID NO: 565818 - DNA, 20 bp, Artificial
  CRISPR gRNA sequence
atgcagcaaaactcatcatt

SEQ ID NO: 565819 - DNA, 20 bp, Artificial
  CRISPR gRNA sequence
atcattgtcttcttttaaga

SEQ ID NO: 565820 - DNA, 20 bp, Artificial
  CRISPR gRNA sequence
tcttcttttaagaaattgcc

SEQ ID NO: 565821 - DNA, 20 bp, Artificial
  CRISPR gRNA sequence
cttttaagaaattgccacag

SEQ ID NO: 565822 - DNA, 20 bp, Artificial
  CRISPR gRNA sequence
ttttaagaaattgccacagc

SEQ ID NO: 565823 - DNA, 20 bp, Artificial
  CRISPR gRNA sequence
ttaagaaattgccacagcca

SEQ ID NO: 565824 - DNA, 20 bp, Artificial
  CRISPR gRNA sequence
taagaaattgccacagccat

SEQ ID NO: 565825 - DNA, 20 bp, Artificial
  CRISPR gRNA sequence
aagaaattgccacagccatt

SEQ ID NO: 565826 - DNA, 20 bp, Artificial
  CRISPR gRNA sequence
agaaattgccacagccattg

SEQ ID NO: 565827 - DNA, 20 bp, Artificial
  CRISPR gRNA sequence
ccacagccattgcagccttt

SEQ ID NO: 565828 - DNA, 20 bp, Artificial
  CRISPR gRNA sequence
cagcctttagcaaccaacac

SEQ ID NO: 565829 - DNA, 20 bp, Artificial
  CRISPR gRNA sequence
tagcaaccaacaccctgatc

SEQ ID NO: 565830 - DNA, 20 bp, Artificial
  CRISPR gRNA sequence
agcaaccaacaccctgatca

SEQ ID NO: 565831 - DNA, 20 bp, Artificial
  CRISPR gRNA sequence
gcaaccaacaccctgatcag

SEQ ID NO: 565832 - DNA, 20 bp, Artificial
  CRISPR gRNA sequence
atcagtcagcagccatcaac

SEQ ID NO: 565833 - DNA, 20 bp, Artificial
  CRISPR gRNA sequence
aggcaagacctttcaccagc

SEQ ID NO: 565834 - DNA, 20 bp, Artificial
  CRISPR gRNA sequence
tcaccagcaaaaatattagg

SEQ ID NO: 565835 - DNA, 20 bp, Artificial
  CRISPR gRNA sequence
caccagcaaaaatattagga

SEQ ID NO: 565836 - DNA, 20 bp, Artificial
  CRISPR gRNA sequence
accagcaaaaatattaggac

SEQ ID NO: 565837 - DNA, 20 bp, Artificial
  CRISPR gRNA sequence
ggacttgctgaaggctcaaa

SEQ ID NO: 565838 - DNA, 20 bp, Artificial
  CRISPR gRNA sequence
gctgaaggctcaaatgattg

SEQ ID NO: 565839 - DNA, 20 bp, Artificial
  CRISPR gRNA sequence
ctgaaggctcaaatgattgt

SEQ ID NO: 565840 - DNA, 20 bp, Artificial
  CRISPR gRNA sequence
aaggctcaaatgattgttag

SEQ ID NO: 565841 - DNA, 20 bp, Artificial
  CRISPR gRNA sequence
aaatgattgttagcatgttt

SEQ ID NO: 565842 - DNA, 20 bp, Artificial
  CRISPR gRNA sequence
ttagcatgttttttttttca

SEQ ID NO: 565843 - DNA, 20 bp, Artificial
  CRISPR gRNA sequence
gcatgttttttttttcagca

SEQ ID NO: 565844 - DNA, 20 bp, Artificial
  CRISPR gRNA sequence
tttttttcagcaataaagta

SEQ ID NO: 565845 - DNA, 20 bp, Artificial
  CRISPR gRNA sequence
ttttttcagcaataaagtat

SEQ ID NO: 565846 - DNA, 20 bp, Artificial
  CRISPR gRNA sequence
tttttcagcaataaagtatt

SEQ ID NO: 565847 - DNA, 20 bp, Artificial
  CRISPR gRNA sequence
ttttcagcaataaagtattt

SEQ ID NO: 565848 - DNA, 20 bp, Artificial
  CRISPR gRNA sequence
tttcagcaataaagtatttt

SEQ ID NO: 565849 - DNA, 20 bp, Artificial
  CRISPR gRNA sequence
ttcagcaataaagtattttt

SEQ ID NO: 565850 - DNA, 20 bp, Artificial
  CRISPR gRNA sequence
tcagcaataaagtatttttt

SEQ ID NO: 565851 - DNA, 20 bp, Artificial
  CRISPR gRNA sequence
cagcaataaagtatttttta

SEQ ID NO: 565852 - DNA, 20 bp, Artificial
  CRISPR gRNA sequence
agcaataaagtattttttaa

SEQ ID NO: 565853 - DNA, 20 bp, Artificial
  CRISPR gRNA sequence
tttaattaaatatgtacatt

SEQ ID NO: 565854 - DNA, 20 bp, Artificial
  CRISPR gRNA sequence
ttaattaaatatgtacattg

SEQ ID NO: 565855 - DNA, 20 bp, Artificial
  CRISPR gRNA sequence
taattaaatatgtacattgt

SEQ ID NO: 565856 - DNA, 20 bp, Artificial
  CRISPR gRNA sequence
aattaaatatgtacattgtg

SEQ ID NO: 565857 - DNA, 20 bp, Artificial
  CRISPR gRNA sequence
attaaatatgtacattgtgt

SEQ ID NO: 565858 - DNA, 20 bp, Artificial
  CRISPR gRNA sequence
aatatgtacattgtgttttt

SEQ ID NO: 565859 - DNA, 20 bp, Artificial
  CRISPR gRNA sequence
tgtttttagacataatgcta

SEQ ID NO: 565860 - DNA, 20 bp, Artificial
  CRISPR gRNA sequence
ttagacataatgctattgaa

SEQ ID NO: 565861 - DNA, 20 bp, Artificial
  CRISPR gRNA sequence
tagacataatgctattgaac

SEQ ID NO: 565862 - DNA, 20 bp, Artificial
  CRISPR gRNA sequence
agacataatgctattgaaca

SEQ ID NO: 565863 - DNA, 20 bp, Artificial
  CRISPR gRNA sequence
gacataatgctattgaacac

SEQ ID NO: 565864 - DNA, 20 bp, Artificial
  CRISPR gRNA sequence
ttgaacactttaatagacta

SEQ ID NO: 565865 - DNA, 20 bp, Artificial
  CRISPR gRNA sequence
aacactttaatagactacag

SEQ ID NO: 565866 - DNA, 20 bp, Artificial
  CRISPR gRNA sequence
taatagactacagtatagtg

SEQ ID NO: 565867 - DNA, 20 bp, Artificial
  CRISPR gRNA sequence
aatagactacagtatagtgt

SEQ ID NO: 565868 - DNA, 20 bp, Artificial
  CRISPR gRNA sequence
atagactacagtatagtgta

SEQ ID NO: 565869 - DNA, 20 bp, Artificial
  CRISPR gRNA sequence
cagtatagtgtaaacataac

SEQ ID NO: 565870 - DNA, 20 bp, Artificial
  CRISPR gRNA sequence
atatgccctgggaaaccaga

SEQ ID NO: 565871 - DNA, 20 bp, Artificial
  CRISPR gRNA sequence
tatgccctgggaaaccagaa

SEQ ID NO: 565872 - DNA, 20 bp, Artificial
  CRISPR gRNA sequence
ggaaaccagaaaatttgtgt

SEQ ID NO: 565873 - DNA, 20 bp, Artificial
  CRISPR gRNA sequence
gtgtgacacactttactctg

SEQ ID NO: 565874 - DNA, 20 bp, Artificial
  CRISPR gRNA sequence
tgtgacacactttactctga

SEQ ID NO: 565875 - DNA, 20 bp, Artificial
  CRISPR gRNA sequence
tactctgatatttacatgat

SEQ ID NO: 565876 - DNA, 20 bp, Artificial
  CRISPR gRNA sequence
actctgatatttacatgatt

SEQ ID NO: 565877 - DNA, 20 bp, Artificial
  CRISPR gRNA sequence
ctctgatatttacatgattg

SEQ ID NO: 565878 - DNA, 20 bp, Artificial
  CRISPR gRNA sequence
tgatatttacatgattgctg

SEQ ID NO: 565879 - DNA, 20 bp, Artificial
  CRISPR gRNA sequence
atatttacatgattgctgtt

SEQ ID NO: 565880 - DNA, 20 bp, Artificial
  CRISPR gRNA sequence
acatgattgctgttgtctgg

SEQ ID NO: 565881 - DNA, 20 bp, Artificial
  CRISPR gRNA sequence
catgattgctgttgtctggg

SEQ ID NO: 565882 - DNA, 20 bp, Artificial
  CRISPR gRNA sequence
ctgttgtctgggaccaaacc

SEQ ID NO: 565883 - DNA, 20 bp, Artificial
  CRISPR gRNA sequence
ttgtctgggaccaaacccac

SEQ ID NO: 565884 - DNA, 20 bp, Artificial
  CRISPR gRNA sequence
tctgggaccaaacccacggt

SEQ ID NO: 565885 - DNA, 20 bp, Artificial
  CRISPR gRNA sequence
ggaccaaacccacggtatct

SEQ ID NO: 565886 - DNA, 20 bp, Artificial
  CRISPR gRNA sequence
caagctatacctgtgtgtat

SEQ ID NO: 565887 - DNA, 20 bp, Artificial
  CRISPR gRNA sequence
aagctatacctgtgtgtatc

SEQ ID NO: 565888 - DNA, 20 bp, Artificial
  CRISPR gRNA sequence
tacctgtgtgtatccattat

SEQ ID NO: 565889 - DNA, 20 bp, Artificial
  CRISPR gRNA sequence
tgtgtatccattatatgtga

SEQ ID NO: 565890 - DNA, 20 bp, Artificial
  CRISPR gRNA sequence
tatgtgatacatgtttgtat

SEQ ID NO: 565891 - DNA, 20 bp, Artificial
  CRISPR gRNA sequence
gtatctatttgactatatga

SEQ ID NO: 565892 - DNA, 20 bp, Artificial
  CRISPR gRNA sequence
tatctatttgactatatgag

SEQ ID NO: 565893 - DNA, 20 bp, Artificial
  CRISPR gRNA sequence
tttgactatatgagagaaaa

SEQ ID NO: 565894 - DNA, 20 bp, Artificial
  CRISPR gRNA sequence
gactatatgagagaaaaata

SEQ ID NO: 565895 - DNA, 20 bp, Artificial
  CRISPR gRNA sequence
actatatgagagaaaaatat

SEQ ID NO: 565896 - DNA, 20 bp, Artificial
  CRISPR gRNA sequence
tatgagagaaaaatattgaa

SEQ ID NO: 565897 - DNA, 20 bp, Artificial
  CRISPR gRNA sequence
aaagatgtattctgatttgt

SEQ ID NO: 565898 - DNA, 20 bp, Artificial
  CRISPR gRNA sequence
tgatttgttaatgtagatta

SEQ ID NO: 565899 - DNA, 20 bp, Artificial
  CRISPR gRNA sequence
atttgttaatgtagattata

SEQ ID NO: 565900 - DNA, 20 bp, Artificial
  CRISPR gRNA sequence
gttaatgtagattatagaac

SEQ ID NO: 565901 - DNA, 20 bp, Artificial
  CRISPR gRNA sequence
ttaatgtagattatagaact

SEQ ID NO: 565902 - DNA, 20 bp, Artificial
  CRISPR gRNA sequence
atgtagattatagaactgga

SEQ ID NO: 565903 - DNA, 20 bp, Artificial
  CRISPR gRNA sequence
tagaactggagattgttatg

SEQ ID NO: 565904 - DNA, 20 bp, Artificial
  CRISPR gRNA sequence
gagattgttatggggttaag

SEQ ID NO: 565905 - DNA, 20 bp, Artificial
  CRISPR gRNA sequence
ttatggggttaagagagtgg

SEQ ID NO: 565906 - DNA, 20 bp, Artificial
  CRISPR gRNA sequence
tggggttaagagagtgggta

SEQ ID NO: 565907 - DNA, 20 bp, Artificial
  CRISPR gRNA sequence
agagagtgggtaaggcaccc

SEQ ID NO: 565908 - DNA, 20 bp, Artificial
  CRISPR gRNA sequence
aaaaaatacttatatgatcg

SEQ ID NO: 565909 - DNA, 20 bp, Artificial
  CRISPR gRNA sequence
atatgatcgtttttcattag

SEQ ID NO: 565910 - DNA, 20 bp, Artificial
  CRISPR gRNA sequence
tatgatcgtttttcattagt

SEQ ID NO: 565911 - DNA, 20 bp, Artificial
  CRISPR gRNA sequence
ttcattagtgtaaagttgta

SEQ ID NO: 565912 - DNA, 20 bp, Artificial
  CRISPR gRNA sequence
tcattagtgtaaagttgtat

SEQ ID NO: 565913 - DNA, 20 bp, Artificial
  CRISPR gRNA sequence
cattagtgtaaagttgtatg

SEQ ID NO: 565914 - DNA, 20 bp, Artificial
  CRISPR gRNA sequence
attagtgtaaagttgtatgt

SEQ ID NO: 565915 - DNA, 20 bp, Artificial
  CRISPR gRNA sequence
gtgtaaagttgtatgtatgt

SEQ ID NO: 565916 - DNA, 20 bp, Artificial
  CRISPR gRNA sequence
tatgtatgtgtctatgtata

SEQ ID NO: 565917 - DNA, 20 bp, Artificial
  CRISPR gRNA sequence
tgtataatttatgttttaaa

SEQ ID NO: 565918 - DNA, 20 bp, Artificial
  CRISPR gRNA sequence
atgttttaaaatacattttt

SEQ ID NO: 565919 - DNA, 20 bp, Artificial
  CRISPR gRNA sequence
tgttttaaaatacatttttt

SEQ ID NO: 565920 - DNA, 20 bp, Artificial
  CRISPR gRNA sequence
taaaatacattttttaaaga

SEQ ID NO: 565921 - DNA, 20 bp, Artificial
  CRISPR gRNA sequence
aaaatacattttttaaagaa

SEQ ID NO: 565922 - DNA, 20 bp, Artificial
  CRISPR gRNA sequence
aaatacattttttaaagaaa

SEQ ID NO: 565923 - DNA, 20 bp, Artificial
  CRISPR gRNA sequence
tttaaagaaagagttactct

SEQ ID NO: 565924 - DNA, 20 bp, Artificial
  CRISPR gRNA sequence
ttaaagaaagagttactctt

SEQ ID NO: 565925 - DNA, 20 bp, Artificial
  CRISPR gRNA sequence
taaagaaagagttactctta

SEQ ID NO: 565926 - DNA, 20 bp, Artificial
  CRISPR gRNA sequence
aaagaaagagttactcttat

SEQ ID NO: 565927 - DNA, 20 bp, Artificial
  CRISPR gRNA sequence
aagaaagagttactcttatt

SEQ ID NO: 565928 - DNA, 20 bp, Artificial
  CRISPR gRNA sequence
ctcttattttgtccccatcc

SEQ ID NO: 565929 - DNA, 20 bp, Artificial
  CRISPR gRNA sequence
ttattttgtccccatcctgt

SEQ ID NO: 565930 - DNA, 20 bp, Artificial
  CRISPR gRNA sequence
attttgtccccatcctgttt

SEQ ID NO: 565931 - DNA, 20 bp, Artificial
  CRISPR gRNA sequence
ttttgtccccatcctgtttg

SEQ ID NO: 565932 - DNA, 20 bp, Artificial
  CRISPR gRNA sequence
tgtccccatcctgtttgaaa

SEQ ID NO: 565933 - DNA, 20 bp, Artificial
  CRISPR gRNA sequence
gtccccatcctgtttgaaac

SEQ ID NO: 565934 - DNA, 20 bp, Artificial
  CRISPR gRNA sequence
tccccatcctgtttgaaact

SEQ ID NO: 565935 - DNA, 20 bp, Artificial
  CRISPR gRNA sequence
tttgaaactcttctatggct

SEQ ID NO: 565936 - DNA, 20 bp, Artificial
  CRISPR gRNA sequence
gaaactcttctatggctttc

SEQ ID NO: 565937 - DNA, 20 bp, Artificial
  CRISPR gRNA sequence
aaactcttctatggctttct

SEQ ID NO: 565938 - DNA, 20 bp, Artificial
  CRISPR gRNA sequence
ttctatggctttctttactt

SEQ ID NO: 565939 - DNA, 20 bp, Artificial
  CRISPR gRNA sequence
ctatggctttctttacttca

SEQ ID NO: 565940 - DNA, 20 bp, Artificial
  CRISPR gRNA sequence
tatggctttctttacttcaa

SEQ ID NO: 565941 - DNA, 20 bp, Artificial
  CRISPR gRNA sequence
tggctttctttacttcaata

SEQ ID NO: 565942 - DNA, 20 bp, Artificial
  CRISPR gRNA sequence
tctttacttcaatactagaa

SEQ ID NO: 565943 - DNA, 20 bp, Artificial
  CRISPR gRNA sequence
ctttacttcaatactagaat

SEQ ID NO: 565944 - DNA, 20 bp, Artificial
  CRISPR gRNA sequence
tttacttcaatactagaatt

SEQ ID NO: 565945 - DNA, 20 bp, Artificial
  CRISPR gRNA sequence
tacttcaatactagaattgt

SEQ ID NO: 565946 - DNA, 20 bp, Artificial
  CRISPR gRNA sequence
acttcaatactagaattgtg

SEQ ID NO: 565947 - DNA, 20 bp, Artificial
  CRISPR gRNA sequence
cttcaatactagaattgtgt

SEQ ID NO: 565948 - DNA, 20 bp, Artificial
  CRISPR gRNA sequence
caatactagaattgtgtttg

SEQ ID NO: 565949 - DNA, 20 bp, Artificial
  CRISPR gRNA sequence
aatactagaattgtgtttgt

SEQ ID NO: 565950 - DNA, 20 bp, Artificial
  CRISPR gRNA sequence
gaattgtgtttgtttgatgc

SEQ ID NO: 565951 - DNA, 20 bp, Artificial
  CRISPR gRNA sequence
tgtttgtttgatgccttgca

SEQ ID NO: 565952 - DNA, 20 bp, Artificial
  CRISPR gRNA sequence
gtttgatgccttgcaagggc

SEQ ID NO: 565953 - DNA, 20 bp, Artificial
  CRISPR gRNA sequence
tttgatgccttgcaagggct

SEQ ID NO: 565954 - DNA, 20 bp, Artificial
  CRISPR gRNA sequence
gatgccttgcaagggctggc

SEQ ID NO: 565955 - DNA, 20 bp, Artificial
  CRISPR gRNA sequence
atgccttgcaagggctggct

SEQ ID NO: 565956 - DNA, 20 bp, Artificial
  CRISPR gRNA sequence
gcaagggctggctgtgcttg

SEQ ID NO: 565957 - DNA, 20 bp, Artificial
  CRISPR gRNA sequence
caagggctggctgtgcttgt

SEQ ID NO: 565958 - DNA, 20 bp, Artificial
  CRISPR gRNA sequence
gctgtgcttgtgtatgcagc

SEQ ID NO: 565959 - DNA, 20 bp, Artificial
  CRISPR gRNA sequence
tgcttgtgtatgcagctcgg

SEQ ID NO: 565960 - DNA, 20 bp, Artificial
  CRISPR gRNA sequence
gtgtatgcagctcggcttat

SEQ ID NO: 565961 - DNA, 20 bp, Artificial
  CRISPR gRNA sequence
tgtatgcagctcggcttatg

SEQ ID NO: 565962 - DNA, 20 bp, Artificial
  CRISPR gRNA sequence
ggcttatgctacttttctca

SEQ ID NO: 565963 - DNA, 20 bp, Artificial
  CRISPR gRNA sequence
atgctacttttctcatgcca

SEQ ID NO: 565964 - DNA, 20 bp, Artificial
  CRISPR gRNA sequence
tgctacttttctcatgccat

SEQ ID NO: 565965 - DNA, 20 bp, Artificial
  CRISPR gRNA sequence
cttttctcatgccattgctc

SEQ ID NO: 565966 - DNA, 20 bp, Artificial
  CRISPR gRNA sequence
ttctcatgccattgctcctg

SEQ ID NO: 565967 - DNA, 20 bp, Artificial
  CRISPR gRNA sequence
tctcatgccattgctcctgc

SEQ ID NO: 565968 - DNA, 20 bp, Artificial
  CRISPR gRNA sequence
ctcatgccattgctcctgct

SEQ ID NO: 565969 - DNA, 20 bp, Artificial
  CRISPR gRNA sequence
tcatgccattgctcctgctt

SEQ ID NO: 565970 - DNA, 20 bp, Artificial
  CRISPR gRNA sequence
atgccattgctcctgcttca

SEQ ID NO: 565971 - DNA, 20 bp, Artificial
  CRISPR gRNA sequence
ctcctgcttcaaggtctgca

SEQ ID NO: 565972 - DNA, 20 bp, Artificial
  CRISPR gRNA sequence
ctgcttcaaggtctgcataa

SEQ ID NO: 565973 - DNA, 20 bp, Artificial
  CRISPR gRNA sequence
cttcaaggtctgcataattg

SEQ ID NO: 565974 - DNA, 20 bp, Artificial
  CRISPR gRNA sequence
caaggtctgcataattgttc

SEQ ID NO: 565975 - DNA, 20 bp, Artificial
  CRISPR gRNA sequence
aaggtctgcataattgttct

SEQ ID NO: 565976 - DNA, 20 bp, Artificial
  CRISPR gRNA sequence
cataattgttctcttaatgg

SEQ ID NO: 565977 - DNA, 20 bp, Artificial
  CRISPR gRNA sequence
ttctcttaatggggacctgc

SEQ ID NO: 565978 - DNA, 20 bp, Artificial
  CRISPR gRNA sequence
tcttaatggggacctgccct

SEQ ID NO: 565979 - DNA, 20 bp, Artificial
  CRISPR gRNA sequence
ttaatggggacctgccctgc

SEQ ID NO: 565980 - DNA, 20 bp, Artificial
  CRISPR gRNA sequence
aatggggacctgccctgctc

SEQ ID NO: 565981 - DNA, 20 bp, Artificial
  CRISPR gRNA sequence
atggggacctgccctgctct

SEQ ID NO: 565982 - DNA, 20 bp, Artificial
  CRISPR gRNA sequence
ccctgctctcctgggcatag

SEQ ID NO: 565983 - DNA, 20 bp, Artificial
  CRISPR gRNA sequence
ctctcctgggcatagttaac

SEQ ID NO: 565984 - DNA, 20 bp, Artificial
  CRISPR gRNA sequence
tcctgggcatagttaactgc

SEQ ID NO: 565985 - DNA, 20 bp, Artificial
  CRISPR gRNA sequence
ctgggcatagttaactgctg

SEQ ID NO: 565986 - DNA, 20 bp, Artificial
  CRISPR gRNA sequence
ggcatagttaactgctgctt

SEQ ID NO: 565987 - DNA, 20 bp, Artificial
  CRISPR gRNA sequence
actgctgcttgtgcctcaga

SEQ ID NO: 565988 - DNA, 20 bp, Artificial
  CRISPR gRNA sequence
ctgcttgtgcctcagaactt

SEQ ID NO: 565989 - DNA, 20 bp, Artificial
  CRISPR gRNA sequence
cttgtgcctcagaacttctt

SEQ ID NO: 565990 - DNA, 20 bp, Artificial
  CRISPR gRNA sequence
gtgcctcagaacttctttta

SEQ ID NO: 565991 - DNA, 20 bp, Artificial
  CRISPR gRNA sequence
tgcctcagaacttcttttag

SEQ ID NO: 565992 - DNA, 20 bp, Artificial
  CRISPR gRNA sequence
agaacttcttttagggaagg

SEQ ID NO: 565993 - DNA, 20 bp, Artificial
  CRISPR gRNA sequence
cttttagggaagggaactgc

SEQ ID NO: 565994 - DNA, 20 bp, Artificial
  CRISPR gRNA sequence
ttttagggaagggaactgcc

SEQ ID NO: 565995 - DNA, 20 bp, Artificial
  CRISPR gRNA sequence
ttagggaagggaactgcctt

SEQ ID NO: 565996 - DNA, 20 bp, Artificial
  CRISPR gRNA sequence
tagggaagggaactgccttc

SEQ ID NO: 565997 - DNA, 20 bp, Artificial
  CRISPR gRNA sequence
agggaagggaactgccttcc

SEQ ID NO: 565998 - DNA, 20 bp, Artificial
  CRISPR gRNA sequence
gggaagggaactgccttccc

SEQ ID NO: 565999 - DNA, 20 bp, Artificial
  CRISPR gRNA sequence
ccttccctaaccccttgtta

SEQ ID NO: 566000 - DNA, 20 bp, Artificial
  CRISPR gRNA sequence
ccctaaccccttgttagttc

SEQ ID NO: 566001 - DNA, 20 bp, Artificial
  CRISPR gRNA sequence
cctaaccccttgttagttcc

SEQ ID NO: 566002 - DNA, 20 bp, Artificial
  CRISPR gRNA sequence
accccttgttagttccctaa

SEQ ID NO: 566003 - DNA, 20 bp, Artificial
  CRISPR gRNA sequence
gttagttccctaagtaaatg

SEQ ID NO: 566004 - DNA, 20 bp, Artificial
  CRISPR gRNA sequence
ttagttccctaagtaaatgt

SEQ ID NO: 566005 - DNA, 20 bp, Artificial
  CRISPR gRNA sequence
gttccctaagtaaatgttct

SEQ ID NO: 566006 - DNA, 20 bp, Artificial
  CRISPR gRNA sequence
cctaagtaaatgttcttatt

SEQ ID NO: 566007 - DNA, 20 bp, Artificial
  CRISPR gRNA sequence
agtaaatgttcttattgaca

SEQ ID NO: 566008 - DNA, 20 bp, Artificial
  CRISPR gRNA sequence
ttattgacacctgatgcttt

SEQ ID NO: 566009 - DNA, 20 bp, Artificial
  CRISPR gRNA sequence
attgacacctgatgctttta

SEQ ID NO: 566010 - DNA, 20 bp, Artificial
  CRISPR gRNA sequence
ttgacacctgatgcttttac

SEQ ID NO: 566011 - DNA, 20 bp, Artificial
  CRISPR gRNA sequence
acacctgatgcttttactta

SEQ ID NO: 566012 - DNA, 20 bp, Artificial
  CRISPR gRNA sequence
atgcttttacttagcagcaa

SEQ ID NO: 566013 - DNA, 20 bp, Artificial
  CRISPR gRNA sequence
ttacttagcagcaattatca

SEQ ID NO: 566014 - DNA, 20 bp, Artificial
  CRISPR gRNA sequence
tacttagcagcaattatcac

SEQ ID NO: 566015 - DNA, 20 bp, Artificial
  CRISPR gRNA sequence
acttagcagcaattatcaca

SEQ ID NO: 566016 - DNA, 20 bp, Artificial
  CRISPR gRNA sequence
cttagcagcaattatcacag

SEQ ID NO: 566017 - DNA, 20 bp, Artificial
  CRISPR gRNA sequence
agcagcaattatcacagttg

SEQ ID NO: 566018 - DNA, 20 bp, Artificial
  CRISPR gRNA sequence
gcagcaattatcacagttgc

SEQ ID NO: 566019 - DNA, 20 bp, Artificial
  CRISPR gRNA sequence
tcacagttgcagttgggcat

SEQ ID NO: 566020 - DNA, 20 bp, Artificial
  CRISPR gRNA sequence
cagttgggcattgtctaatt

SEQ ID NO: 566021 - DNA, 20 bp, Artificial
  CRISPR gRNA sequence
ggcattgtctaattatttgt

SEQ ID NO: 566022 - DNA, 20 bp, Artificial
  CRISPR gRNA sequence
tctaattatttgtgtaaatt

SEQ ID NO: 566023 - DNA, 20 bp, Artificial
  CRISPR gRNA sequence
attatttgtgtaaattctgc

SEQ ID NO: 566024 - DNA, 20 bp, Artificial
  CRISPR gRNA sequence
tttgtgtaaattctgcctcc

SEQ ID NO: 566025 - DNA, 20 bp, Artificial
  CRISPR gRNA sequence
gtgtaaattctgcctcccct

SEQ ID NO: 566026 - DNA, 20 bp, Artificial
  CRISPR gRNA sequence
tgtaaattctgcctccccta

SEQ ID NO: 566027 - DNA, 20 bp, Artificial
  CRISPR gRNA sequence
tgcctcccctaatagaatgt

SEQ ID NO: 566028 - DNA, 20 bp, Artificial
  CRISPR gRNA sequence
cctcccctaatagaatgtca

SEQ ID NO: 566029 - DNA, 20 bp, Artificial
  CRISPR gRNA sequence
ccctaatagaatgtcaactc

SEQ ID NO: 566030 - DNA, 20 bp, Artificial
  CRISPR gRNA sequence
atagaatgtcaactctaaga

SEQ ID NO: 566031 - DNA, 20 bp, Artificial
  CRISPR gRNA sequence
taagaaggaagggacggtgt

SEQ ID NO: 566032 - DNA, 20 bp, Artificial
  CRISPR gRNA sequence
agaaggaagggacggtgtct

SEQ ID NO: 566033 - DNA, 20 bp, Artificial
  CRISPR gRNA sequence
tcttgttctcaaggatctta

SEQ ID NO: 566034 - DNA, 20 bp, Artificial
  CRISPR gRNA sequence
gttctcaaggatcttatata

SEQ ID NO: 566035 - DNA, 20 bp, Artificial
  CRISPR gRNA sequence
ttctcaaggatcttatatag

SEQ ID NO: 566036 - DNA, 20 bp, Artificial
  CRISPR gRNA sequence
tcaaggatcttatatagaat

SEQ ID NO: 566037 - DNA, 20 bp, Artificial
  CRISPR gRNA sequence
aaggatcttatatagaatag

SEQ ID NO: 566038 - DNA, 20 bp, Artificial
  CRISPR gRNA sequence
atatagaatagatgcccaat

SEQ ID NO: 566039 - DNA, 20 bp, Artificial
  CRISPR gRNA sequence
tatagaatagatgcccaatg

SEQ ID NO: 566040 - DNA, 20 bp, Artificial
  CRISPR gRNA sequence
cctgagtgaatgaataaatg

SEQ ID NO: 566041 - DNA, 20 bp, Artificial
  CRISPR gRNA sequence
ctgagtgaatgaataaatga

SEQ ID NO: 566042 - DNA, 20 bp, Artificial
  CRISPR gRNA sequence
agtgaatgaataaatgaatc

SEQ ID NO: 566043 - DNA, 20 bp, Artificial
  CRISPR gRNA sequence
aatgtgggaccacgctgttc

SEQ ID NO: 566044 - DNA, 20 bp, Artificial
  CRISPR gRNA sequence
ttctgaaagggcactgacca

SEQ ID NO: 566045 - DNA, 20 bp, Artificial
  CRISPR gRNA sequence
tgaaagggcactgaccaagg

SEQ ID NO: 566046 - DNA, 20 bp, Artificial
  CRISPR gRNA sequence
aaagggcactgaccaaggag

SEQ ID NO: 566047 - DNA, 20 bp, Artificial
  CRISPR gRNA sequence
accaaggagtcagacaatgt

SEQ ID NO: 566048 - DNA, 20 bp, Artificial
  CRISPR gRNA sequence
tggtcattgtgccgccataa

SEQ ID NO: 566049 - DNA, 20 bp, Artificial
  CRISPR gRNA sequence
gtcattgtgccgccataaac

SEQ ID NO: 566050 - DNA, 20 bp, Artificial
  CRISPR gRNA sequence
tgccgccataaacttgctga

SEQ ID NO: 566051 - DNA, 20 bp, Artificial
  CRISPR gRNA sequence
gctgagagacatggagcaag

SEQ ID NO: 566052 - DNA, 20 bp, Artificial
  CRISPR gRNA sequence
ctgagagacatggagcaagg

SEQ ID NO: 566053 - DNA, 20 bp, Artificial
  CRISPR gRNA sequence
agagacatggagcaaggtga

SEQ ID NO: 566054 - DNA, 20 bp, Artificial
  CRISPR gRNA sequence
ttggagcctgctttcctacc

SEQ ID NO: 566055 - DNA, 20 bp, Artificial
  CRISPR gRNA sequence
ggagcctgctttcctacctg

SEQ ID NO: 566056 - DNA, 20 bp, Artificial
  CRISPR gRNA sequence
gagcctgctttcctacctgt

SEQ ID NO: 566057 - DNA, 20 bp, Artificial
  CRISPR gRNA sequence
ctttcctacctgtaaatggg

SEQ ID NO: 566058 - DNA, 20 bp, Artificial
  CRISPR gRNA sequence
tcctacctgtaaatggggtt

SEQ ID NO: 566059 - DNA, 20 bp, Artificial
  CRISPR gRNA sequence
cctacctgtaaatggggtta

SEQ ID NO: 566060 - DNA, 20 bp, Artificial
  CRISPR gRNA sequence
ctacctgtaaatggggttaa

SEQ ID NO: 566061 - DNA, 20 bp, Artificial
  CRISPR gRNA sequence
cctgtaaatggggttaataa

SEQ ID NO: 566062 - DNA, 20 bp, Artificial
  CRISPR gRNA sequence
taaatggggttaataacacc

SEQ ID NO: 566063 - DNA, 20 bp, Artificial
  CRISPR gRNA sequence
ataacacctactgcaggtag

SEQ ID NO: 566064 - DNA, 20 bp, Artificial
  CRISPR gRNA sequence
ctgcaggtagacatggagag

SEQ ID NO: 566065 - DNA, 20 bp, Artificial
  CRISPR gRNA sequence
caggtagacatggagaggga

SEQ ID NO: 566066 - DNA, 20 bp, Artificial
  CRISPR gRNA sequence
aataaaattgccttatattt

SEQ ID NO: 566067 - DNA, 20 bp, Artificial
  CRISPR gRNA sequence
ccttatatttttcttggtgt

SEQ ID NO: 566068 - DNA, 20 bp, Artificial
  CRISPR gRNA sequence
atatttttcttggtgtcttg

SEQ ID NO: 566069 - DNA, 20 bp, Artificial
  CRISPR gRNA sequence
tatttttcttggtgtcttgt

SEQ ID NO: 566070 - DNA, 20 bp, Artificial
  CRISPR gRNA sequence
ttcttggtgtcttgtcactt

SEQ ID NO: 566071 - DNA, 20 bp, Artificial
  CRISPR gRNA sequence
tcttggtgtcttgtcacttc

SEQ ID NO: 566072 - DNA, 20 bp, Artificial
  CRISPR gRNA sequence
cttggtgtcttgtcacttca

SEQ ID NO: 566073 - DNA, 20 bp, Artificial
  CRISPR gRNA sequence
ttggtgtcttgtcacttcac

SEQ ID NO: 566074 - DNA, 20 bp, Artificial
  CRISPR gRNA sequence
ggtgtcttgtcacttcacca

SEQ ID NO: 566075 - DNA, 20 bp, Artificial
  CRISPR gRNA sequence
gtgtcttgtcacttcaccag

SEQ ID NO: 566076 - DNA, 20 bp, Artificial
  CRISPR gRNA sequence
gtcacttcaccagtgaaatg

SEQ ID NO: 566077 - DNA, 20 bp, Artificial
  CRISPR gRNA sequence
tcacttcaccagtgaaatgg

SEQ ID NO: 566078 - DNA, 20 bp, Artificial
  CRISPR gRNA sequence
caccagtgaaatgggagtaa

SEQ ID NO: 566079 - DNA, 20 bp, Artificial
  CRISPR gRNA sequence
accagtgaaatgggagtaat

SEQ ID NO: 566080 - DNA, 20 bp, Artificial
  CRISPR gRNA sequence
gactaaataatttttagagt

SEQ ID NO: 566081 - DNA, 20 bp, Artificial
  CRISPR gRNA sequence
actaaataatttttagagtt

SEQ ID NO: 566082 - DNA, 20 bp, Artificial
  CRISPR gRNA sequence
aataatttttagagtttctt

SEQ ID NO: 566083 - DNA, 20 bp, Artificial
  CRISPR gRNA sequence
ttagagtttcttctagttca

SEQ ID NO: 566084 - DNA, 20 bp, Artificial
  CRISPR gRNA sequence
tagagtttcttctagttcaa

SEQ ID NO: 566085 - DNA, 20 bp, Artificial
  CRISPR gRNA sequence
agagtttcttctagttcaaa

SEQ ID NO: 566086 - DNA, 20 bp, Artificial
  CRISPR gRNA sequence
gagtttcttctagttcaaaa

SEQ ID NO: 566087 - DNA, 20 bp, Artificial
  CRISPR gRNA sequence
cttctagttcaaaattatag

SEQ ID NO: 566088 - DNA, 20 bp, Artificial
  CRISPR gRNA sequence
ttctagttcaaaattatagt

SEQ ID NO: 566089 - DNA, 20 bp, Artificial
  CRISPR gRNA sequence
ctagttcaaaattatagttg

SEQ ID NO: 566090 - DNA, 20 bp, Artificial
  CRISPR gRNA sequence
tagttcaaaattatagttga

SEQ ID NO: 566091 - DNA, 20 bp, Artificial
  CRISPR gRNA sequence
gttcaaaattatagttgacc

SEQ ID NO: 566092 - DNA, 20 bp, Artificial
  CRISPR gRNA sequence
aaaattatagttgacccttg

SEQ ID NO: 566093 - DNA, 20 bp, Artificial
  CRISPR gRNA sequence
tagttgacccttgaacaaca

SEQ ID NO: 566094 - DNA, 20 bp, Artificial
  CRISPR gRNA sequence
acccttgaacaacatggcaa

SEQ ID NO: 566095 - DNA, 20 bp, Artificial
  CRISPR gRNA sequence
gaacaacatggcaattaggg

SEQ ID NO: 566096 - DNA, 20 bp, Artificial
  CRISPR gRNA sequence
aacaacatggcaattagggg

SEQ ID NO: 566097 - DNA, 20 bp, Artificial
  CRISPR gRNA sequence
ggggcaccaaccccttgagc

SEQ ID NO: 566098 - DNA, 20 bp, Artificial
  CRISPR gRNA sequence
gagcagtcaaaaatttatgt

SEQ ID NO: 566099 - DNA, 20 bp, Artificial
  CRISPR gRNA sequence
agcagtcaaaaatttatgta

SEQ ID NO: 566100 - DNA, 20 bp, Artificial
  CRISPR gRNA sequence
atgtataactcttgactccc

SEQ ID NO: 566101 - DNA, 20 bp, Artificial
  CRISPR gRNA sequence
tgtataactcttgactccca

SEQ ID NO: 566102 - DNA, 20 bp, Artificial
  CRISPR gRNA sequence
ttgactcccaaaaacttaac

SEQ ID NO: 566103 - DNA, 20 bp, Artificial
  CRISPR gRNA sequence
gactcccaaaaacttaactg

SEQ ID NO: 566104 - DNA, 20 bp, Artificial
  CRISPR gRNA sequence
actcccaaaaacttaactgc

SEQ ID NO: 566105 - DNA, 20 bp, Artificial
  CRISPR gRNA sequence
ccaaaaacttaactgctaat

SEQ ID NO: 566106 - DNA, 20 bp, Artificial
  CRISPR gRNA sequence
aactgctaatagcctaccag

SEQ ID NO: 566107 - DNA, 20 bp, Artificial
  CRISPR gRNA sequence
actgctaatagcctaccaga

SEQ ID NO: 566108 - DNA, 20 bp, Artificial
  CRISPR gRNA sequence
ctaatagcctaccagaagcc

SEQ ID NO: 566109 - DNA, 20 bp, Artificial
  CRISPR gRNA sequence
atagcctaccagaagcctta

SEQ ID NO: 566110 - DNA, 20 bp, Artificial
  CRISPR gRNA sequence
ccagaagccttaccaataac

SEQ ID NO: 566111 - DNA, 20 bp, Artificial
  CRISPR gRNA sequence
accaataacataaacaacac

SEQ ID NO: 566112 - DNA, 20 bp, Artificial
  CRISPR gRNA sequence
ccaataacataaacaacaca

SEQ ID NO: 566113 - DNA, 20 bp, Artificial
  CRISPR gRNA sequence
tctatgttatatgcattgca

SEQ ID NO: 566114 - DNA, 20 bp, Artificial
  CRISPR gRNA sequence
ctatgttatatgcattgcat

SEQ ID NO: 566115 - DNA, 20 bp, Artificial
  CRISPR gRNA sequence
tatgttatatgcattgcatg

SEQ ID NO: 566116 - DNA, 20 bp, Artificial
  CRISPR gRNA sequence
tgttatatgcattgcatgtt

SEQ ID NO: 566117 - DNA, 20 bp, Artificial
  CRISPR gRNA sequence
tatgcattgcatgttgtatt

SEQ ID NO: 566118 - DNA, 20 bp, Artificial
  CRISPR gRNA sequence
catgttgtattcttacacta

SEQ ID NO: 566119 - DNA, 20 bp, Artificial
  CRISPR gRNA sequence
tattcttacactaaattaag

SEQ ID NO: 566120 - DNA, 20 bp, Artificial
  CRISPR gRNA sequence
ttacactaaattaagctaga

SEQ ID NO: 566121 - DNA, 20 bp, Artificial
  CRISPR gRNA sequence
acactaaattaagctagaga

SEQ ID NO: 566122 - DNA, 20 bp, Artificial
  CRISPR gRNA sequence
cactaaattaagctagagaa

SEQ ID NO: 566123 - DNA, 20 bp, Artificial
  CRISPR gRNA sequence
aattaagctagagaaaagaa

SEQ ID NO: 566124 - DNA, 20 bp, Artificial
  CRISPR gRNA sequence
agctagagaaaagaacttat

SEQ ID NO: 566125 - DNA, 20 bp, Artificial
  CRISPR gRNA sequence
gagaaaagaacttattagga

SEQ ID NO: 566126 - DNA, 20 bp, Artificial
  CRISPR gRNA sequence
attaggaaaagcataaggtg

SEQ ID NO: 566127 - DNA, 20 bp, Artificial
  CRISPR gRNA sequence
ttaggaaaagcataaggtgt

SEQ ID NO: 566128 - DNA, 20 bp, Artificial
  CRISPR gRNA sequence
ggaaaagcataaggtgtaga

SEQ ID NO: 566129 - DNA, 20 bp, Artificial
  CRISPR gRNA sequence
gatcctcatctttcacctta

SEQ ID NO: 566130 - DNA, 20 bp, Artificial
  CRISPR gRNA sequence
atctttcaccttatataaaa

SEQ ID NO: 566131 - DNA, 20 bp, Artificial
  CRISPR gRNA sequence
tcaccttatataaaaatcaa

SEQ ID NO: 566132 - DNA, 20 bp, Artificial
  CRISPR gRNA sequence
caccttatataaaaatcaac

SEQ ID NO: 566133 - DNA, 20 bp, Artificial
  CRISPR gRNA sequence
accttatataaaaatcaact

SEQ ID NO: 566134 - DNA, 20 bp, Artificial
  CRISPR gRNA sequence
atataaaaatcaactcaagg

SEQ ID NO: 566135 - DNA, 20 bp, Artificial
  CRISPR gRNA sequence
tataaaaatcaactcaaggt

SEQ ID NO: 566136 - DNA, 20 bp, Artificial
  CRISPR gRNA sequence
aaggtggatcaaaaacttaa

SEQ ID NO: 566137 - DNA, 20 bp, Artificial
  CRISPR gRNA sequence
aaatctaagacctgaagcca

SEQ ID NO: 566138 - DNA, 20 bp, Artificial
  CRISPR gRNA sequence
aatctaagacctgaagccat

SEQ ID NO: 566139 - DNA, 20 bp, Artificial
  CRISPR gRNA sequence
agacctgaagccataaaaat

SEQ ID NO: 566140 - DNA, 20 bp, Artificial
  CRISPR gRNA sequence
aagccataaaaattctagaa

SEQ ID NO: 566141 - DNA, 20 bp, Artificial
  CRISPR gRNA sequence
tagaagataacatcagaaaa

SEQ ID NO: 566142 - DNA, 20 bp, Artificial
  CRISPR gRNA sequence
gaagataacatcagaaaaac

SEQ ID NO: 566143 - DNA, 20 bp, Artificial
  CRISPR gRNA sequence
ttctagactttggcttaggc

SEQ ID NO: 566144 - DNA, 20 bp, Artificial
  CRISPR gRNA sequence
ctagactttggcttaggcaa

SEQ ID NO: 566145 - DNA, 20 bp, Artificial
  CRISPR gRNA sequence
tagactttggcttaggcaaa

SEQ ID NO: 566146 - DNA, 20 bp, Artificial
  CRISPR gRNA sequence
gactttggcttaggcaaaag

SEQ ID NO: 566147 - DNA, 20 bp, Artificial
  CRISPR gRNA sequence
tggcttaggcaaaaggtcat

SEQ ID NO: 566148 - DNA, 20 bp, Artificial
  CRISPR gRNA sequence
ggcttaggcaaaaggtcatg

SEQ ID NO: 566149 - DNA, 20 bp, Artificial
  CRISPR gRNA sequence
gcttaggcaaaaggtcatga

SEQ ID NO: 566150 - DNA, 20 bp, Artificial
  CRISPR gRNA sequence
aggcaaaaggtcatgaccaa

SEQ ID NO: 566151 - DNA, 20 bp, Artificial
  CRISPR gRNA sequence
ggcaaaaggtcatgaccaag

SEQ ID NO: 566152 - DNA, 20 bp, Artificial
  CRISPR gRNA sequence
aaattaaaaagcttctgtac

SEQ ID NO: 566153 - DNA, 20 bp, Artificial
  CRISPR gRNA sequence
aattaaaaagcttctgtaca

SEQ ID NO: 566154 - DNA, 20 bp, Artificial
  CRISPR gRNA sequence
aaaagcttctgtacagcaat

SEQ ID NO: 566155 - DNA, 20 bp, Artificial
  CRISPR gRNA sequence
ctgtacagcaatataaacaa

SEQ ID NO: 566156 - DNA, 20 bp, Artificial
  CRISPR gRNA sequence
tgtacagcaatataaacaat

SEQ ID NO: 566157 - DNA, 20 bp, Artificial
  CRISPR gRNA sequence
tacagcaatataaacaatca

SEQ ID NO: 566158 - DNA, 20 bp, Artificial
  CRISPR gRNA sequence
acaaactatgtatctgacaa

SEQ ID NO: 566159 - DNA, 20 bp, Artificial
  CRISPR gRNA sequence
tgtatctgacaaaggaccaa

SEQ ID NO: 566160 - DNA, 20 bp, Artificial
  CRISPR gRNA sequence
acaaaggaccaatatccaga

SEQ ID NO: 566161 - DNA, 20 bp, Artificial
  CRISPR gRNA sequence
taaggaagtcaaacaaatca

SEQ ID NO: 566162 - DNA, 20 bp, Artificial
  CRISPR gRNA sequence
tcaaaggaggatatacaaat

SEQ ID NO: 566163 - DNA, 20 bp, Artificial
  CRISPR gRNA sequence
aaaggaggatatacaaatgg

SEQ ID NO: 566164 - DNA, 20 bp, Artificial
  CRISPR gRNA sequence
aacattactaattatcaggg

SEQ ID NO: 566165 - DNA, 20 bp, Artificial
  CRISPR gRNA sequence
ctaattatcagggaaatgca

SEQ ID NO: 566166 - DNA, 20 bp, Artificial
  CRISPR gRNA sequence
attatcagggaaatgcaaat

SEQ ID NO: 566167 - DNA, 20 bp, Artificial
  CRISPR gRNA sequence
tcagggaaatgcaaattgaa

SEQ ID NO: 566168 - DNA, 20 bp, Artificial
  CRISPR gRNA sequence
aaaccacaatgcaataccac

SEQ ID NO: 566169 - DNA, 20 bp, Artificial
  CRISPR gRNA sequence
actcctgcaagaatggccgt

SEQ ID NO: 566170 - DNA, 20 bp, Artificial
  CRISPR gRNA sequence
ctcctgcaagaatggccgta

SEQ ID NO: 566171 - DNA, 20 bp, Artificial
  CRISPR gRNA sequence
ctgcaagaatggccgtaatt

SEQ ID NO: 566172 - DNA, 20 bp, Artificial
  CRISPR gRNA sequence
caagaatggccgtaatttaa

SEQ ID NO: 566173 - DNA, 20 bp, Artificial
  CRISPR gRNA sequence
aaaaatcaaaaaataataga

SEQ ID NO: 566174 - DNA, 20 bp, Artificial
  CRISPR gRNA sequence
aaaatcaaaaaataatagat

SEQ ID NO: 566175 - DNA, 20 bp, Artificial
  CRISPR gRNA sequence
gcatgggtgtggtgggaaaa

SEQ ID NO: 566176 - DNA, 20 bp, Artificial
  CRISPR gRNA sequence
tacactgctggtgggaatgt

SEQ ID NO: 566177 - DNA, 20 bp, Artificial
  CRISPR gRNA sequence
ctggtgggaatgtaaactag

SEQ ID NO: 566178 - DNA, 20 bp, Artificial
  CRISPR gRNA sequence
gtgggaatgtaaactagtac

SEQ ID NO: 566179 - DNA, 20 bp, Artificial
  CRISPR gRNA sequence
gtacaaccactatggagatt

SEQ ID NO: 566180 - DNA, 20 bp, Artificial
  CRISPR gRNA sequence
tggagatttcttaagcaact

SEQ ID NO: 566181 - DNA, 20 bp, Artificial
  CRISPR gRNA sequence
cttaagcaactaaaagtaga

SEQ ID NO: 566182 - DNA, 20 bp, Artificial
  CRISPR gRNA sequence
ttaagcaactaaaagtagaa

SEQ ID NO: 566183 - DNA, 20 bp, Artificial
  CRISPR gRNA sequence
aagcaactaaaagtagaact

SEQ ID NO: 566184 - DNA, 20 bp, Artificial
  CRISPR gRNA sequence
agcaactaaaagtagaacta

SEQ ID NO: 566185 - DNA, 20 bp, Artificial
  CRISPR gRNA sequence
aaagtagaactaccatttga

SEQ ID NO: 566186 - DNA, 20 bp, Artificial
  CRISPR gRNA sequence
ccatttgatccagcaatccc

SEQ ID NO: 566187 - DNA, 20 bp, Artificial
  CRISPR gRNA sequence
gatccagcaatcccattact

SEQ ID NO: 566188 - DNA, 20 bp, Artificial
  CRISPR gRNA sequence
atccagcaatcccattactg

SEQ ID NO: 566189 - DNA, 20 bp, Artificial
  CRISPR gRNA sequence
ctgggtatctacccagagga

SEQ ID NO: 566190 - DNA, 20 bp, Artificial
  CRISPR gRNA sequence
ggtatctacccagaggaaaa

SEQ ID NO: 566191 - DNA, 20 bp, Artificial
  CRISPR gRNA sequence
cccagaggaaaacaagtcat

SEQ ID NO: 566192 - DNA, 20 bp, Artificial
  CRISPR gRNA sequence
tatgaaaaagacaacacaca

SEQ ID NO: 566193 - DNA, 20 bp, Artificial
  CRISPR gRNA sequence
atgaaaaagacaacacacaa

SEQ ID NO: 566194 - DNA, 20 bp, Artificial
  CRISPR gRNA sequence
tgaaaaagacaacacacaac

SEQ ID NO: 566195 - DNA, 20 bp, Artificial
  CRISPR gRNA sequence
cacacaacatctttatagtg

SEQ ID NO: 566196 - DNA, 20 bp, Artificial
  CRISPR gRNA sequence
tatagtggcacaactcgcaa

SEQ ID NO: 566197 - DNA, 20 bp, Artificial
  CRISPR gRNA sequence
atagtggcacaactcgcaat

SEQ ID NO: 566198 - DNA, 20 bp, Artificial
  CRISPR gRNA sequence
tagtggcacaactcgcaatt

SEQ ID NO: 566199 - DNA, 20 bp, Artificial
  CRISPR gRNA sequence
gcaattgcaaaaatatggaa

SEQ ID NO: 566200 - DNA, 20 bp, Artificial
  CRISPR gRNA sequence
caaaaatatggaatcagcat

SEQ ID NO: 566201 - DNA, 20 bp, Artificial
  CRISPR gRNA sequence
gtgtctgtaatcccagcact

SEQ ID NO: 566202 - DNA, 20 bp, Artificial
  CRISPR gRNA sequence
taatcccagcactttgggag

SEQ ID NO: 566203 - DNA, 20 bp, Artificial
  CRISPR gRNA sequence
tgggaggccaaggcgggcag

SEQ ID NO: 566204 - DNA, 20 bp, Artificial
  CRISPR gRNA sequence
gggaggccaaggcgggcaga

SEQ ID NO: 566205 - DNA, 20 bp, Artificial
  CRISPR gRNA sequence
ggaggccaaggcgggcagat

SEQ ID NO: 566206 - DNA, 20 bp, Artificial
  CRISPR gRNA sequence
gctaacatggtgaaaccccg

SEQ ID NO: 566207 - DNA, 20 bp, Artificial
  CRISPR gRNA sequence
acatggtgaaaccccgtctt

SEQ ID NO: 566208 - DNA, 20 bp, Artificial
  CRISPR gRNA sequence
tactaaaaatacaaaaaaaa

SEQ ID NO: 566209 - DNA, 20 bp, Artificial
  CRISPR gRNA sequence
actaaaaatacaaaaaaaaa

SEQ ID NO: 566210 - DNA, 20 bp, Artificial
  CRISPR gRNA sequence
ctaaaaatacaaaaaaaaaa

SEQ ID NO: 566211 - DNA, 20 bp, Artificial
  CRISPR gRNA sequence
aaaatacaaaaaaaaaatta

SEQ ID NO: 566212 - DNA, 20 bp, Artificial
  CRISPR gRNA sequence
gccgggcatggtggtgggcg

SEQ ID NO: 566213 - DNA, 20 bp, Artificial
  CRISPR gRNA sequence
tagtcccagctactcaggag

SEQ ID NO: 566214 - DNA, 20 bp, Artificial
  CRISPR gRNA sequence
ctcaggaggctgaggcagga

SEQ ID NO: 566215 - DNA, 20 bp, Artificial
  CRISPR gRNA sequence
aggaggctgaggcaggagaa

SEQ ID NO: 566216 - DNA, 20 bp, Artificial
  CRISPR gRNA sequence
aggcaggagaatggcgtgag

SEQ ID NO: 566217 - DNA, 20 bp, Artificial
  CRISPR gRNA sequence
ggaggtggaacttttagtga

SEQ ID NO: 566218 - DNA, 20 bp, Artificial
  CRISPR gRNA sequence
ttagtgagccgagatcacgc

SEQ ID NO: 566219 - DNA, 20 bp, Artificial
  CRISPR gRNA sequence
tagtgagccgagatcacgcc

SEQ ID NO: 566220 - DNA, 20 bp, Artificial
  CRISPR gRNA sequence
agtgagccgagatcacgcca

SEQ ID NO: 566221 - DNA, 20 bp, Artificial
  CRISPR gRNA sequence
gtgagccgagatcacgccac

SEQ ID NO: 566222 - DNA, 20 bp, Artificial
  CRISPR gRNA sequence
cactccagcctggggacaga

SEQ ID NO: 566223 - DNA, 20 bp, Artificial
  CRISPR gRNA sequence
cagcctggggacagagcgag

SEQ ID NO: 566224 - DNA, 20 bp, Artificial
  CRISPR gRNA sequence
gggacagagcgagactctgt

SEQ ID NO: 566225 - DNA, 20 bp, Artificial
  CRISPR gRNA sequence
tgtctcaaaagaaaaaaaaa

SEQ ID NO: 566226 - DNA, 20 bp, Artificial
  CRISPR gRNA sequence
tctcaaaagaaaaaaaaaaa

SEQ ID NO: 566227 - DNA, 20 bp, Artificial
  CRISPR gRNA sequence
aaaagaaaaaaaaaaaaaaa

SEQ ID NO: 566228 - DNA, 20 bp, Artificial
  CRISPR gRNA sequence
acagcaacctggatggaact

SEQ ID NO: 566229 - DNA, 20 bp, Artificial
  CRISPR gRNA sequence
gatggaactggagaccatta

SEQ ID NO: 566230 - DNA, 20 bp, Artificial
  CRISPR gRNA sequence
gagaccattattctaagtga

SEQ ID NO: 566231 - DNA, 20 bp, Artificial
  CRISPR gRNA sequence
ttctaagtgaagtaactcag

SEQ ID NO: 566232 - DNA, 20 bp, Artificial
  CRISPR gRNA sequence
taagtgaagtaactcaggaa

SEQ ID NO: 566233 - DNA, 20 bp, Artificial
  CRISPR gRNA sequence
agtgaagtaactcaggaatg

SEQ ID NO: 566234 - DNA, 20 bp, Artificial
  CRISPR gRNA sequence
aggaatggaaaaccaaacat

SEQ ID NO: 566235 - DNA, 20 bp, Artificial
  CRISPR gRNA sequence
taacttacaagtgggagcta

SEQ ID NO: 566236 - DNA, 20 bp, Artificial
  CRISPR gRNA sequence
acttacaagtgggagctaag

SEQ ID NO: 566237 - DNA, 20 bp, Artificial
  CRISPR gRNA sequence
acaagtgggagctaagctat

SEQ ID NO: 566238 - DNA, 20 bp, Artificial
  CRISPR gRNA sequence
caagtgggagctaagctatg

SEQ ID NO: 566239 - DNA, 20 bp, Artificial
  CRISPR gRNA sequence
agctatgtaagaatgataca

SEQ ID NO: 566240 - DNA, 20 bp, Artificial
  CRISPR gRNA sequence
tgtaagaatgatacagtgaa

SEQ ID NO: 566241 - DNA, 20 bp, Artificial
  CRISPR gRNA sequence
tggggacttgtggagaaggg

SEQ ID NO: 566242 - DNA, 20 bp, Artificial
  CRISPR gRNA sequence
ggggacttgtggagaagggt

SEQ ID NO: 566243 - DNA, 20 bp, Artificial
  CRISPR gRNA sequence
gggacttgtggagaagggtg

SEQ ID NO: 566244 - DNA, 20 bp, Artificial
  CRISPR gRNA sequence
gtggagaagggtgggatggg

SEQ ID NO: 566245 - DNA, 20 bp, Artificial
  CRISPR gRNA sequence
tggagaagggtgggatgggg

SEQ ID NO: 566246 - DNA, 20 bp, Artificial
  CRISPR gRNA sequence
cacactgggtacagtgtaca

SEQ ID NO: 566247 - DNA, 20 bp, Artificial
  CRISPR gRNA sequence
ggtacagtgtacaccagaat

SEQ ID NO: 566248 - DNA, 20 bp, Artificial
  CRISPR gRNA sequence
agaaatcacacccaaataac

SEQ ID NO: 566249 - DNA, 20 bp, Artificial
  CRISPR gRNA sequence
aaaaaaaaaaaaaaacttat

SEQ ID NO: 566250 - DNA, 20 bp, Artificial
  CRISPR gRNA sequence
atccatgtaaccaaacatca

SEQ ID NO: 566251 - DNA, 20 bp, Artificial
  CRISPR gRNA sequence
tccatgtaaccaaacatcac

SEQ ID NO: 566252 - DNA, 20 bp, Artificial
  CRISPR gRNA sequence
ttcccccaaaactattgaga

SEQ ID NO: 566253 - DNA, 20 bp, Artificial
  CRISPR gRNA sequence
ccccaaaactattgagataa

SEQ ID NO: 566254 - DNA, 20 bp, Artificial
  CRISPR gRNA sequence
ttgagataatagtaataaaa

SEQ ID NO: 566255 - DNA, 20 bp, Artificial
  CRISPR gRNA sequence
agataatagtaataaaaaaa

SEQ ID NO: 566256 - DNA, 20 bp, Artificial
  CRISPR gRNA sequence
aaaaaagaaaaaaaagcata

SEQ ID NO: 566257 - DNA, 20 bp, Artificial
  CRISPR gRNA sequence
aaaaagaaaaaaaagcataa

SEQ ID NO: 566258 - DNA, 20 bp, Artificial
  CRISPR gRNA sequence
actaagtgaaagtggatcat

SEQ ID NO: 566259 - DNA, 20 bp, Artificial
  CRISPR gRNA sequence
ctaagtgaaagtggatcatc

SEQ ID NO: 566260 - DNA, 20 bp, Artificial
  CRISPR gRNA sequence
agtgaaagtggatcatcaaa

SEQ ID NO: 566261 - DNA, 20 bp, Artificial
  CRISPR gRNA sequence
catcctcattatcttcacgt

SEQ ID NO: 566262 - DNA, 20 bp, Artificial
  CRISPR gRNA sequence
atcctcattatcttcacgtt

SEQ ID NO: 566263 - DNA, 20 bp, Artificial
  CRISPR gRNA sequence
attatcttcacgttaaagca

SEQ ID NO: 566264 - DNA, 20 bp, Artificial
  CRISPR gRNA sequence
tcttcacgttaaagcaggct

SEQ ID NO: 566265 - DNA, 20 bp, Artificial
  CRISPR gRNA sequence
cacgttaaagcaggctaagt

SEQ ID NO: 566266 - DNA, 20 bp, Artificial
  CRISPR gRNA sequence
acgttaaagcaggctaagtg

SEQ ID NO: 566267 - DNA, 20 bp, Artificial
  CRISPR gRNA sequence
aagcaggctaagtgggagga

SEQ ID NO: 566268 - DNA, 20 bp, Artificial
  CRISPR gRNA sequence
agtgggaggaggggttggtc

SEQ ID NO: 566269 - DNA, 20 bp, Artificial
  CRISPR gRNA sequence
gtcttgctatctcagggatg

SEQ ID NO: 566270 - DNA, 20 bp, Artificial
  CRISPR gRNA sequence
gctatctcagggatggcaga

SEQ ID NO: 566271 - DNA, 20 bp, Artificial
  CRISPR gRNA sequence
ctatctcagggatggcagag

SEQ ID NO: 566272 - DNA, 20 bp, Artificial
  CRISPR gRNA sequence
tctcagggatggcagaggcg

SEQ ID NO: 566273 - DNA, 20 bp, Artificial
  CRISPR gRNA sequence
agggatggcagaggcggaag

SEQ ID NO: 566274 - DNA, 20 bp, Artificial
  CRISPR gRNA sequence
aaacccatgttgttcaaggg

SEQ ID NO: 566275 - DNA, 20 bp, Artificial
  CRISPR gRNA sequence
ttcaagggtcaactgtactt

SEQ ID NO: 566276 - DNA, 20 bp, Artificial
  CRISPR gRNA sequence
aagggtcaactgtactttga

SEQ ID NO: 566277 - DNA, 20 bp, Artificial
  CRISPR gRNA sequence
tactttgatttcttctgagc

SEQ ID NO: 566278 - DNA, 20 bp, Artificial
  CRISPR gRNA sequence
tgatttcttctgagctgcag

SEQ ID NO: 566279 - DNA, 20 bp, Artificial
  CRISPR gRNA sequence
gatttcttctgagctgcagt

SEQ ID NO: 566280 - DNA, 20 bp, Artificial
  CRISPR gRNA sequence
atttcttctgagctgcagtc

SEQ ID NO: 566281 - DNA, 20 bp, Artificial
  CRISPR gRNA sequence
cttctgagctgcagtctccc

SEQ ID NO: 566282 - DNA, 20 bp, Artificial
  CRISPR gRNA sequence
ttctgagctgcagtctcccc

SEQ ID NO: 566283 - DNA, 20 bp, Artificial
  CRISPR gRNA sequence
ctgagctgcagtctcccctt

SEQ ID NO: 566284 - DNA, 20 bp, Artificial
  CRISPR gRNA sequence
tgagctgcagtctccccttt

SEQ ID NO: 566285 - DNA, 20 bp, Artificial
  CRISPR gRNA sequence
agctgcagtctcccctttct

SEQ ID NO: 566286 - DNA, 20 bp, Artificial
  CRISPR gRNA sequence
cagtctcccctttctctacc

SEQ ID NO: 566287 - DNA, 20 bp, Artificial
  CRISPR gRNA sequence
ccctttctctaccctcactt

SEQ ID NO: 566288 - DNA, 20 bp, Artificial
  CRISPR gRNA sequence
tctctaccctcacttccctc

SEQ ID NO: 566289 - DNA, 20 bp, Artificial
  CRISPR gRNA sequence
ctctaccctcacttccctcc

SEQ ID NO: 566290 - DNA, 20 bp, Artificial
  CRISPR gRNA sequence
tctaccctcacttccctcca

SEQ ID NO: 566291 - DNA, 20 bp, Artificial
  CRISPR gRNA sequence
taccctcacttccctccacc

SEQ ID NO: 566292 - DNA, 20 bp, Artificial
  CRISPR gRNA sequence
ccctcacttccctccaccac

SEQ ID NO: 566293 - DNA, 20 bp, Artificial
  CRISPR gRNA sequence
acttccctccaccactagct

SEQ ID NO: 566294 - DNA, 20 bp, Artificial
  CRISPR gRNA sequence
ccctccaccactagctccat

SEQ ID NO: 566295 - DNA, 20 bp, Artificial
  CRISPR gRNA sequence
cctccaccactagctccatt

SEQ ID NO: 566296 - DNA, 20 bp, Artificial
  CRISPR gRNA sequence
caccactagctccattcctg

SEQ ID NO: 566297 - DNA, 20 bp, Artificial
  CRISPR gRNA sequence
gctccattcctgactacttt

SEQ ID NO: 566298 - DNA, 20 bp, Artificial
  CRISPR gRNA sequence
cattcctgactactttcttc

SEQ ID NO: 566299 - DNA, 20 bp, Artificial
  CRISPR gRNA sequence
ctgactactttcttctactg

SEQ ID NO: 566300 - DNA, 20 bp, Artificial
  CRISPR gRNA sequence
actactttcttctactgttc

SEQ ID NO: 566301 - DNA, 20 bp, Artificial
  CRISPR gRNA sequence
ctttcttctactgttctcaa

SEQ ID NO: 566302 - DNA, 20 bp, Artificial
  CRISPR gRNA sequence
tcttctactgttctcaagcc

SEQ ID NO: 566303 - DNA, 20 bp, Artificial
  CRISPR gRNA sequence
cttctactgttctcaagccc

SEQ ID NO: 566304 - DNA, 20 bp, Artificial
  CRISPR gRNA sequence
ttctactgttctcaagccca

SEQ ID NO: 566305 - DNA, 20 bp, Artificial
  CRISPR gRNA sequence
ctactgttctcaagcccagg

SEQ ID NO: 566306 - DNA, 20 bp, Artificial
  CRISPR gRNA sequence
tactgttctcaagcccagga

SEQ ID NO: 566307 - DNA, 20 bp, Artificial
  CRISPR gRNA sequence
ctgttctcaagcccaggata

SEQ ID NO: 566308 - DNA, 20 bp, Artificial
  CRISPR gRNA sequence
ttctcaagcccaggatacat

SEQ ID NO: 566309 - DNA, 20 bp, Artificial
  CRISPR gRNA sequence
tcaagcccaggatacatcag

SEQ ID NO: 566310 - DNA, 20 bp, Artificial
  CRISPR gRNA sequence
aagcccaggatacatcagct

SEQ ID NO: 566311 - DNA, 20 bp, Artificial
  CRISPR gRNA sequence
tccctgggaaagacaaaaga

SEQ ID NO: 566312 - DNA, 20 bp, Artificial
  CRISPR gRNA sequence
cctgggaaagacaaaagaca

SEQ ID NO: 566313 - DNA, 20 bp, Artificial
  CRISPR gRNA sequence
ggaaagacaaaagacatctt

SEQ ID NO: 566314 - DNA, 20 bp, Artificial
  CRISPR gRNA sequence
catgccgccagggtatggca

SEQ ID NO: 566315 - DNA, 20 bp, Artificial
  CRISPR gRNA sequence
atgccgccagggtatggcag

SEQ ID NO: 566316 - DNA, 20 bp, Artificial
  CRISPR gRNA sequence
atctcatacctactctttca

SEQ ID NO: 566317 - DNA, 20 bp, Artificial
  CRISPR gRNA sequence
tctcatacctactctttcac

SEQ ID NO: 566318 - DNA, 20 bp, Artificial
  CRISPR gRNA sequence
atacctactctttcaccacc

SEQ ID NO: 566319 - DNA, 20 bp, Artificial
  CRISPR gRNA sequence
ctctttcaccaccaccctgc

SEQ ID NO: 566320 - DNA, 20 bp, Artificial
  CRISPR gRNA sequence
tttcaccaccaccctgccct

SEQ ID NO: 566321 - DNA, 20 bp, Artificial
  CRISPR gRNA sequence
tcaccaccaccctgccctct

SEQ ID NO: 566322 - DNA, 20 bp, Artificial
  CRISPR gRNA sequence
caccaccaccctgccctcta

SEQ ID NO: 566323 - DNA, 20 bp, Artificial
  CRISPR gRNA sequence
accaccaccctgccctctat

SEQ ID NO: 566324 - DNA, 20 bp, Artificial
  CRISPR gRNA sequence
ccctctatcactcattgttt

SEQ ID NO: 566325 - DNA, 20 bp, Artificial
  CRISPR gRNA sequence
tatcactcattgtttcattt

SEQ ID NO: 566326 - DNA, 20 bp, Artificial
  CRISPR gRNA sequence
tcactcattgtttcatttac

SEQ ID NO: 566327 - DNA, 20 bp, Artificial
  CRISPR gRNA sequence
attgtttcatttacatttat

SEQ ID NO: 566328 - DNA, 20 bp, Artificial
  CRISPR gRNA sequence
tttcatttacatttataaga

SEQ ID NO: 566329 - DNA, 20 bp, Artificial
  CRISPR gRNA sequence
catttacatttataagacat

SEQ ID NO: 566330 - DNA, 20 bp, Artificial
  CRISPR gRNA sequence
atttacatttataagacatt

SEQ ID NO: 566331 - DNA, 20 bp, Artificial
  CRISPR gRNA sequence
acatttataagacatttttg

SEQ ID NO: 566332 - DNA, 20 bp, Artificial
  CRISPR gRNA sequence
catttataagacatttttga

SEQ ID NO: 566333 - DNA, 20 bp, Artificial
  CRISPR gRNA sequence
ataagacatttttgagtttc

SEQ ID NO: 566334 - DNA, 20 bp, Artificial
  CRISPR gRNA sequence
taagacatttttgagtttcc

SEQ ID NO: 566335 - DNA, 20 bp, Artificial
  CRISPR gRNA sequence
ttgagtttccactattgtgt

SEQ ID NO: 566336 - DNA, 20 bp, Artificial
  CRISPR gRNA sequence
tgagtttccactattgtgtg

SEQ ID NO: 566337 - DNA, 20 bp, Artificial
  CRISPR gRNA sequence
gagtttccactattgtgtgt

SEQ ID NO: 566338 - DNA, 20 bp, Artificial
  CRISPR gRNA sequence
agtttccactattgtgtgtg

SEQ ID NO: 566339 - DNA, 20 bp, Artificial
  CRISPR gRNA sequence
ccactattgtgtgtggtaga

SEQ ID NO: 566340 - DNA, 20 bp, Artificial
  CRISPR gRNA sequence
cactattgtgtgtggtagac

SEQ ID NO: 566341 - DNA, 20 bp, Artificial
  CRISPR gRNA sequence
ttgtgtgtggtagactctca

SEQ ID NO: 566342 - DNA, 20 bp, Artificial
  CRISPR gRNA sequence
tgtgtggtagactctcaccc

SEQ ID NO: 566343 - DNA, 20 bp, Artificial
  CRISPR gRNA sequence
tcaccccttgaattctgtac

SEQ ID NO: 566344 - DNA, 20 bp, Artificial
  CRISPR gRNA sequence
accccttgaattctgtactt

SEQ ID NO: 566345 - DNA, 20 bp, Artificial
  CRISPR gRNA sequence
gaattctgtactttttcttg

SEQ ID NO: 566346 - DNA, 20 bp, Artificial
  CRISPR gRNA sequence
aattctgtactttttcttgt

SEQ ID NO: 566347 - DNA, 20 bp, Artificial
  CRISPR gRNA sequence
tgtactttttcttgtgcctt

SEQ ID NO: 566348 - DNA, 20 bp, Artificial
  CRISPR gRNA sequence
tactttttcttgtgccttcc

SEQ ID NO: 566349 - DNA, 20 bp, Artificial
  CRISPR gRNA sequence
tttcttgtgccttcccacat

SEQ ID NO: 566350 - DNA, 20 bp, Artificial
  CRISPR gRNA sequence
ttcttgtgccttcccacata

SEQ ID NO: 566351 - DNA, 20 bp, Artificial
  CRISPR gRNA sequence
tcttgtgccttcccacatac

SEQ ID NO: 566352 - DNA, 20 bp, Artificial
  CRISPR gRNA sequence
cttgtgccttcccacatact

SEQ ID NO: 566353 - DNA, 20 bp, Artificial
  CRISPR gRNA sequence
ttgtgccttcccacatactc

SEQ ID NO: 566354 - DNA, 20 bp, Artificial
  CRISPR gRNA sequence
gtgccttcccacatactctg

SEQ ID NO: 566355 - DNA, 20 bp, Artificial
  CRISPR gRNA sequence
tgccttcccacatactctgt

SEQ ID NO: 566356 - DNA, 20 bp, Artificial
  CRISPR gRNA sequence
cccacatactctgttgagtg

SEQ ID NO: 566357 - DNA, 20 bp, Artificial
  CRISPR gRNA sequence
ccacatactctgttgagtgg

SEQ ID NO: 566358 - DNA, 20 bp, Artificial
  CRISPR gRNA sequence
tgttgagtggaggaaataat

SEQ ID NO: 566359 - DNA, 20 bp, Artificial
  CRISPR gRNA sequence
ttgagtggaggaaataatgc

SEQ ID NO: 566360 - DNA, 20 bp, Artificial
  CRISPR gRNA sequence
agtggaggaaataatgcata

SEQ ID NO: 566361 - DNA, 20 bp, Artificial
  CRISPR gRNA sequence
gtgtgtttttgagggcagtt

SEQ ID NO: 566362 - DNA, 20 bp, Artificial
  CRISPR gRNA sequence
ttgagggcagttccccttaa

SEQ ID NO: 566363 - DNA, 20 bp, Artificial
  CRISPR gRNA sequence
tgagggcagttccccttaat

SEQ ID NO: 566364 - DNA, 20 bp, Artificial
  CRISPR gRNA sequence
gagggcagttccccttaatt

SEQ ID NO: 566365 - DNA, 20 bp, Artificial
  CRISPR gRNA sequence
agggcagttccccttaatta

SEQ ID NO: 566366 - DNA, 20 bp, Artificial
  CRISPR gRNA sequence
cccttaattaagggagatgg

SEQ ID NO: 566367 - DNA, 20 bp, Artificial
  CRISPR gRNA sequence
aattaagggagatgggttct

SEQ ID NO: 566368 - DNA, 20 bp, Artificial
  CRISPR gRNA sequence
attaagggagatgggttcta

SEQ ID NO: 566369 - DNA, 20 bp, Artificial
  CRISPR gRNA sequence
agggagatgggttctaaaaa

SEQ ID NO: 566370 - DNA, 20 bp, Artificial
  CRISPR gRNA sequence
taaaaagtccttgtagataa

SEQ ID NO: 566371 - DNA, 20 bp, Artificial
  CRISPR gRNA sequence
aaaagtccttgtagataaac

SEQ ID NO: 566372 - DNA, 20 bp, Artificial
  CRISPR gRNA sequence
gtagataaacaaatgggtga

SEQ ID NO: 566373 - DNA, 20 bp, Artificial
  CRISPR gRNA sequence
tagataaacaaatgggtgat

SEQ ID NO: 566374 - DNA, 20 bp, Artificial
  CRISPR gRNA sequence
gcttcttatctgaaattact

SEQ ID NO: 566375 - DNA, 20 bp, Artificial
  CRISPR gRNA sequence
cttcttatctgaaattacta

SEQ ID NO: 566376 - DNA, 20 bp, Artificial
  CRISPR gRNA sequence
cttatctgaaattactaaca

SEQ ID NO: 566377 - DNA, 20 bp, Artificial
  CRISPR gRNA sequence
ttatctgaaattactaacac

SEQ ID NO: 566378 - DNA, 20 bp, Artificial
  CRISPR gRNA sequence
atctgaaattactaacacag

SEQ ID NO: 566379 - DNA, 20 bp, Artificial
  CRISPR gRNA sequence
tctgaaattactaacacagt

SEQ ID NO: 566380 - DNA, 20 bp, Artificial
  CRISPR gRNA sequence
aaattactaacacagttgtc

SEQ ID NO: 566381 - DNA, 20 bp, Artificial
  CRISPR gRNA sequence
ctaacacagttgtctacaac

SEQ ID NO: 566382 - DNA, 20 bp, Artificial
  CRISPR gRNA sequence
acacagttgtctacaactgg

SEQ ID NO: 566383 - DNA, 20 bp, Artificial
  CRISPR gRNA sequence
tctacaactggtcattcagt

SEQ ID NO: 566384 - DNA, 20 bp, Artificial
  CRISPR gRNA sequence
caactggtcattcagtgttc

SEQ ID NO: 566385 - DNA, 20 bp, Artificial
  CRISPR gRNA sequence
gtcattcagtgttcttgatt

SEQ ID NO: 566386 - DNA, 20 bp, Artificial
  CRISPR gRNA sequence
agtgttcttgatttcccctg

SEQ ID NO: 566387 - DNA, 20 bp, Artificial
  CRISPR gRNA sequence
ttgatttcccctgtattatt

SEQ ID NO: 566388 - DNA, 20 bp, Artificial
  CRISPR gRNA sequence
gatttcccctgtattatttc

SEQ ID NO: 566389 - DNA, 20 bp, Artificial
  CRISPR gRNA sequence
atttcccctgtattatttca

SEQ ID NO: 566390 - DNA, 20 bp, Artificial
  CRISPR gRNA sequence
cccctgtattatttcaatta

SEQ ID NO: 566391 - DNA, 20 bp, Artificial
  CRISPR gRNA sequence
ccctgtattatttcaattac

SEQ ID NO: 566392 - DNA, 20 bp, Artificial
  CRISPR gRNA sequence
tattatttcaattaccctaa

SEQ ID NO: 566393 - DNA, 20 bp, Artificial
  CRISPR gRNA sequence
tttcaattaccctaattgct

SEQ ID NO: 566394 - DNA, 20 bp, Artificial
  CRISPR gRNA sequence
caattaccctaattgctact

SEQ ID NO: 566395 - DNA, 20 bp, Artificial
  CRISPR gRNA sequence
aattaccctaattgctacta

SEQ ID NO: 566396 - DNA, 20 bp, Artificial
  CRISPR gRNA sequence
ccctaattgctactaggcaa

SEQ ID NO: 566397 - DNA, 20 bp, Artificial
  CRISPR gRNA sequence
attgctactaggcaaaaact

SEQ ID NO: 566398 - DNA, 20 bp, Artificial
  CRISPR gRNA sequence
ctactaggcaaaaacttcag

SEQ ID NO: 566399 - DNA, 20 bp, Artificial
  CRISPR gRNA sequence
ctaggcaaaaacttcagtca

SEQ ID NO: 566400 - DNA, 20 bp, Artificial
  CRISPR gRNA sequence
ggcaaaaacttcagtcaaat

SEQ ID NO: 566401 - DNA, 20 bp, Artificial
  CRISPR gRNA sequence
cagtcaaattttaattgctc

SEQ ID NO: 566402 - DNA, 20 bp, Artificial
  CRISPR gRNA sequence
agtcaaattttaattgctct

SEQ ID NO: 566403 - DNA, 20 bp, Artificial
  CRISPR gRNA sequence
taattgctctttaatgttaa

SEQ ID NO: 566404 - DNA, 20 bp, Artificial
  CRISPR gRNA sequence
aattgctctttaatgttaac

SEQ ID NO: 566405 - DNA, 20 bp, Artificial
  CRISPR gRNA sequence
attgctctttaatgttaact

SEQ ID NO: 566406 - DNA, 20 bp, Artificial
  CRISPR gRNA sequence
ctctttaatgttaacttaaa

SEQ ID NO: 566407 - DNA, 20 bp, Artificial
  CRISPR gRNA sequence
tttaatgttaacttaaaata

SEQ ID NO: 566408 - DNA, 20 bp, Artificial
  CRISPR gRNA sequence
taatgttaacttaaaatagc

SEQ ID NO: 566409 - DNA, 20 bp, Artificial
  CRISPR gRNA sequence
aatgttaacttaaaatagct

SEQ ID NO: 566410 - DNA, 20 bp, Artificial
  CRISPR gRNA sequence
atgttaacttaaaatagctg

SEQ ID NO: 566411 - DNA, 20 bp, Artificial
  CRISPR gRNA sequence
acttaaaatagctgcagttt

SEQ ID NO: 566412 - DNA, 20 bp, Artificial
  CRISPR gRNA sequence
aaaatagctgcagttttttg

SEQ ID NO: 566413 - DNA, 20 bp, Artificial
  CRISPR gRNA sequence
aaatagctgcagttttttgt

SEQ ID NO: 566414 - DNA, 20 bp, Artificial
  CRISPR gRNA sequence
cagttttttgtttgtttgtt

SEQ ID NO: 566415 - DNA, 20 bp, Artificial
  CRISPR gRNA sequence
tttgtttgtttgttgagaca

SEQ ID NO: 566416 - DNA, 20 bp, Artificial
  CRISPR gRNA sequence
ttgtttgtttgttgagacag

SEQ ID NO: 566417 - DNA, 20 bp, Artificial
  CRISPR gRNA sequence
tgtttgtttgttgagacagg

SEQ ID NO: 566418 - DNA, 20 bp, Artificial
  CRISPR gRNA sequence
gtttgtttgttgagacaggt

SEQ ID NO: 566419 - DNA, 20 bp, Artificial
  CRISPR gRNA sequence
tttgtttgttgagacaggtc

SEQ ID NO: 566420 - DNA, 20 bp, Artificial
  CRISPR gRNA sequence
gtttgttgagacaggtcatg

SEQ ID NO: 566421 - DNA, 20 bp, Artificial
  CRISPR gRNA sequence
tttgttgagacaggtcatgc

SEQ ID NO: 566422 - DNA, 20 bp, Artificial
  CRISPR gRNA sequence
gttgagacaggtcatgctct

SEQ ID NO: 566423 - DNA, 20 bp, Artificial
  CRISPR gRNA sequence
ttgagacaggtcatgctctg

SEQ ID NO: 566424 - DNA, 20 bp, Artificial
  CRISPR gRNA sequence
agacaggtcatgctctgtca

SEQ ID NO: 566425 - DNA, 20 bp, Artificial
  CRISPR gRNA sequence
tgtcacccaggctggagtgc

SEQ ID NO: 566426 - DNA, 20 bp, Artificial
  CRISPR gRNA sequence
tcacccaggctggagtgcag

SEQ ID NO: 566427 - DNA, 20 bp, Artificial
  CRISPR gRNA sequence
gagtgcagtggcacaatcat

SEQ ID NO: 566428 - DNA, 20 bp, Artificial
  CRISPR gRNA sequence
actgcaatctctgcctcatg

SEQ ID NO: 566429 - DNA, 20 bp, Artificial
  CRISPR gRNA sequence
caatctctgcctcatggctt

SEQ ID NO: 566430 - DNA, 20 bp, Artificial
  CRISPR gRNA sequence
tgcctcatggcttcaagtaa

SEQ ID NO: 566431 - DNA, 20 bp, Artificial
  CRISPR gRNA sequence
cctcatggcttcaagtaatc

SEQ ID NO: 566432 - DNA, 20 bp, Artificial
  CRISPR gRNA sequence
atggcttcaagtaatcctct

SEQ ID NO: 566433 - DNA, 20 bp, Artificial
  CRISPR gRNA sequence
caagtaatcctcttcagcct

SEQ ID NO: 566434 - DNA, 20 bp, Artificial
  CRISPR gRNA sequence
aagtaatcctcttcagcctc

SEQ ID NO: 566435 - DNA, 20 bp, Artificial
  CRISPR gRNA sequence
ttcagcctcccaagtagctg

SEQ ID NO: 566436 - DNA, 20 bp, Artificial
  CRISPR gRNA sequence
cagcctcccaagtagctggg

SEQ ID NO: 566437 - DNA, 20 bp, Artificial
  CRISPR gRNA sequence
agcctcccaagtagctgggg

SEQ ID NO: 566438 - DNA, 20 bp, Artificial
  CRISPR gRNA sequence
ccaagtagctggggaccaca

SEQ ID NO: 566439 - DNA, 20 bp, Artificial
  CRISPR gRNA sequence
gggaccacaggtgtgtgcca

SEQ ID NO: 566440 - DNA, 20 bp, Artificial
  CRISPR gRNA sequence
attttttgtacttttcgtaa

SEQ ID NO: 566441 - DNA, 20 bp, Artificial
  CRISPR gRNA sequence
tttgtacttttcgtaaagat

SEQ ID NO: 566442 - DNA, 20 bp, Artificial
  CRISPR gRNA sequence
ttgtacttttcgtaaagatg

SEQ ID NO: 566443 - DNA, 20 bp, Artificial
  CRISPR gRNA sequence
tgtacttttcgtaaagatgg

SEQ ID NO: 566444 - DNA, 20 bp, Artificial
  CRISPR gRNA sequence
gtacttttcgtaaagatggg

SEQ ID NO: 566445 - DNA, 20 bp, Artificial
  CRISPR gRNA sequence
tacttttcgtaaagatgggg

SEQ ID NO: 566446 - DNA, 20 bp, Artificial
  CRISPR gRNA sequence
ttcgtaaagatggggtttcg

SEQ ID NO: 566447 - DNA, 20 bp, Artificial
  CRISPR gRNA sequence
tcgtaaagatggggtttcgc

SEQ ID NO: 566448 - DNA, 20 bp, Artificial
  CRISPR gRNA sequence
cgtaaagatggggtttcgcc

SEQ ID NO: 566449 - DNA, 20 bp, Artificial
  CRISPR gRNA sequence
gtaaagatggggtttcgcca

SEQ ID NO: 566450 - DNA, 20 bp, Artificial
  CRISPR gRNA sequence
cgccattttacccaggttgg

SEQ ID NO: 566451 - DNA, 20 bp, Artificial
  CRISPR gRNA sequence
gccattttacccaggttggt

SEQ ID NO: 566452 - DNA, 20 bp, Artificial
  CRISPR gRNA sequence
tacccaggttggtcttgaac

SEQ ID NO: 566453 - DNA, 20 bp, Artificial
  CRISPR gRNA sequence
acccaggttggtcttgaact

SEQ ID NO: 566454 - DNA, 20 bp, Artificial
  CRISPR gRNA sequence
cccaggttggtcttgaactc

SEQ ID NO: 566455 - DNA, 20 bp, Artificial
  CRISPR gRNA sequence
gtcttgaactcctgaactca

SEQ ID NO: 566456 - DNA, 20 bp, Artificial
  CRISPR gRNA sequence
gaactcctgaactcaagcaa

SEQ ID NO: 566457 - DNA, 20 bp, Artificial
  CRISPR gRNA sequence
aactcctgaactcaagcaat

SEQ ID NO: 566458 - DNA, 20 bp, Artificial
  CRISPR gRNA sequence
ctgaactcaagcaatccaac

SEQ ID NO: 566459 - DNA, 20 bp, Artificial
  CRISPR gRNA sequence
aactcaagcaatccaaccac

SEQ ID NO: 566460 - DNA, 20 bp, Artificial
  CRISPR gRNA sequence
aagcaatccaaccaccttgg

SEQ ID NO: 566461 - DNA, 20 bp, Artificial
  CRISPR gRNA sequence
ggcctcccaaaatgctggac

SEQ ID NO: 566462 - DNA, 20 bp, Artificial
  CRISPR gRNA sequence
gcctcccaaaatgctggact

SEQ ID NO: 566463 - DNA, 20 bp, Artificial
  CRISPR gRNA sequence
ccaaaatgctggacttacag

SEQ ID NO: 566464 - DNA, 20 bp, Artificial
  CRISPR gRNA sequence
gacttacaggcatgaaccac

SEQ ID NO: 566465 - DNA, 20 bp, Artificial
  CRISPR gRNA sequence
acaggcatgaaccacaggac

SEQ ID NO: 566466 - DNA, 20 bp, Artificial
  CRISPR gRNA sequence
caggcatgaaccacaggacc

SEQ ID NO: 566467 - DNA, 20 bp, Artificial
  CRISPR gRNA sequence
ctgttctctcttaacaagag

SEQ ID NO: 566468 - DNA, 20 bp, Artificial
  CRISPR gRNA sequence
ttctctcttaacaagagaca

SEQ ID NO: 566469 - DNA, 20 bp, Artificial
  CRISPR gRNA sequence
tctcttaacaagagacaagt

SEQ ID NO: 566470 - DNA, 20 bp, Artificial
  CRISPR gRNA sequence
tcttaacaagagacaagtcc

SEQ ID NO: 566471 - DNA, 20 bp, Artificial
  CRISPR gRNA sequence
ttaacaagagacaagtccta

SEQ ID NO: 566472 - DNA, 20 bp, Artificial
  CRISPR gRNA sequence
aacaagagacaagtcctaga

SEQ ID NO: 566473 - DNA, 20 bp, Artificial
  CRISPR gRNA sequence
acaagagacaagtcctagag

SEQ ID NO: 566474 - DNA, 20 bp, Artificial
  CRISPR gRNA sequence
gagcaagatgcatttaaacc

SEQ ID NO: 566475 - DNA, 20 bp, Artificial
  CRISPR gRNA sequence
aaacccactttggggtatca

SEQ ID NO: 566476 - DNA, 20 bp, Artificial
  CRISPR gRNA sequence
aacccactttggggtatcaa

SEQ ID NO: 566477 - DNA, 20 bp, Artificial
  CRISPR gRNA sequence
tggggtatcaaaaatatccc

SEQ ID NO: 566478 - DNA, 20 bp, Artificial
  CRISPR gRNA sequence
ggggtatcaaaaatatccca

SEQ ID NO: 566479 - DNA, 20 bp, Artificial
  CRISPR gRNA sequence
gggtatcaaaaatatcccaa

SEQ ID NO: 566480 - DNA, 20 bp, Artificial
  CRISPR gRNA sequence
gtggttctaataaatgttta

SEQ ID NO: 566481 - DNA, 20 bp, Artificial
  CRISPR gRNA sequence
tggttctaataaatgtttaa

SEQ ID NO: 566482 - DNA, 20 bp, Artificial
  CRISPR gRNA sequence
taataaatgtttaacaacta

SEQ ID NO: 566483 - DNA, 20 bp, Artificial
  CRISPR gRNA sequence
ataaatgtttaacaactagg

SEQ ID NO: 566484 - DNA, 20 bp, Artificial
  CRISPR gRNA sequence
aacaactaggttggtatgga

SEQ ID NO: 566485 - DNA, 20 bp, Artificial
  CRISPR gRNA sequence
acaactaggttggtatggag

SEQ ID NO: 566486 - DNA, 20 bp, Artificial
  CRISPR gRNA sequence
ggttggtatggaggttctga

SEQ ID NO: 566487 - DNA, 20 bp, Artificial
  CRISPR gRNA sequence
gtatggaggttctgatgtga

SEQ ID NO: 566488 - DNA, 20 bp, Artificial
  CRISPR gRNA sequence
tgatgtgaagcattagtcag

SEQ ID NO: 566489 - DNA, 20 bp, Artificial
  CRISPR gRNA sequence
atgtgaagcattagtcagtt

SEQ ID NO: 566490 - DNA, 20 bp, Artificial
  CRISPR gRNA sequence
gtcagtttctgtgctgttac

SEQ ID NO: 566491 - DNA, 20 bp, Artificial
  CRISPR gRNA sequence
ctgtgctgttactagatgtt

SEQ ID NO: 566492 - DNA, 20 bp, Artificial
  CRISPR gRNA sequence
tgtgctgttactagatgttc

SEQ ID NO: 566493 - DNA, 20 bp, Artificial
  CRISPR gRNA sequence
tgctgttactagatgttccc

SEQ ID NO: 566494 - DNA, 20 bp, Artificial
  CRISPR gRNA sequence
ttactagatgttccctaata

SEQ ID NO: 566495 - DNA, 20 bp, Artificial
  CRISPR gRNA sequence
ctagatgttccctaataggg

SEQ ID NO: 566496 - DNA, 20 bp, Artificial
  CRISPR gRNA sequence
gatgttccctaatagggctg

SEQ ID NO: 566497 - DNA, 20 bp, Artificial
  CRISPR gRNA sequence
cctaatagggctgggcagag

SEQ ID NO: 566498 - DNA, 20 bp, Artificial
  CRISPR gRNA sequence
atagggctgggcagagatgc

SEQ ID NO: 566499 - DNA, 20 bp, Artificial
  CRISPR gRNA sequence
ggcagagatgctaacaattg

SEQ ID NO: 566500 - DNA, 20 bp, Artificial
  CRISPR gRNA sequence
acaattggctcatgagggca

SEQ ID NO: 566501 - DNA, 20 bp, Artificial
  CRISPR gRNA sequence
gctcatgagggcaggtggac

SEQ ID NO: 566502 - DNA, 20 bp, Artificial
  CRISPR gRNA sequence
atgagggcaggtggacctgg

SEQ ID NO: 566503 - DNA, 20 bp, Artificial
  CRISPR gRNA sequence
gctccaacccaccactgcac

SEQ ID NO: 566504 - DNA, 20 bp, Artificial
  CRISPR gRNA sequence
caacccaccactgcacccaa

SEQ ID NO: 566505 - DNA, 20 bp, Artificial
  CRISPR gRNA sequence
cacccaatccctgagttctt

SEQ ID NO: 566506 - DNA, 20 bp, Artificial
  CRISPR gRNA sequence
agttcttaatcttcatcaca

SEQ ID NO: 566507 - DNA, 20 bp, Artificial
  CRISPR gRNA sequence
ttaatcttcatcacaccctc

SEQ ID NO: 566508 - DNA, 20 bp, Artificial
  CRISPR gRNA sequence
aatcttcatcacaccctcga

SEQ ID NO: 566509 - DNA, 20 bp, Artificial
  CRISPR gRNA sequence
atcttcatcacaccctcgac

SEQ ID NO: 566510 - DNA, 20 bp, Artificial
  CRISPR gRNA sequence
catcacaccctcgacttgct

SEQ ID NO: 566511 - DNA, 20 bp, Artificial
  CRISPR gRNA sequence
atcacaccctcgacttgctt

SEQ ID NO: 566512 - DNA, 20 bp, Artificial
  CRISPR gRNA sequence
gacttgcttcccagccattg

SEQ ID NO: 566513 - DNA, 20 bp, Artificial
  CRISPR gRNA sequence
gcttcccagccattgtttct

SEQ ID NO: 566514 - DNA, 20 bp, Artificial
  CRISPR gRNA sequence
cttcccagccattgtttctg

SEQ ID NO: 566515 - DNA, 20 bp, Artificial
  CRISPR gRNA sequence
cccagccattgtttctgatc

SEQ ID NO: 566516 - DNA, 20 bp, Artificial
  CRISPR gRNA sequence
ccagccattgtttctgatct

SEQ ID NO: 566517 - DNA, 20 bp, Artificial
  CRISPR gRNA sequence
tttctgatctcagttaatga

SEQ ID NO: 566518 - DNA, 20 bp, Artificial
  CRISPR gRNA sequence
ctgatctcagttaatgatgc

SEQ ID NO: 566519 - DNA, 20 bp, Artificial
  CRISPR gRNA sequence
tgatctcagttaatgatgcc

SEQ ID NO: 566520 - DNA, 20 bp, Artificial
  CRISPR gRNA sequence
atctcagttaatgatgcctc

SEQ ID NO: 566521 - DNA, 20 bp, Artificial
  CRISPR gRNA sequence
agttaatgatgcctctcagt

SEQ ID NO: 566522 - DNA, 20 bp, Artificial
  CRISPR gRNA sequence
atgatgcctctcagtcagcc

SEQ ID NO: 566523 - DNA, 20 bp, Artificial
  CRISPR gRNA sequence
tcagtcagccaaggagacct

SEQ ID NO: 566524 - DNA, 20 bp, Artificial
  CRISPR gRNA sequence
agtcagccaaggagacctga

SEQ ID NO: 566525 - DNA, 20 bp, Artificial
  CRISPR gRNA sequence
acagtcccatccacttcccc

SEQ ID NO: 566526 - DNA, 20 bp, Artificial
  CRISPR gRNA sequence
cccccaccctcatcactgaa

SEQ ID NO: 566527 - DNA, 20 bp, Artificial
  CRISPR gRNA sequence
ccccaccctcatcactgaat

SEQ ID NO: 566528 - DNA, 20 bp, Artificial
  CRISPR gRNA sequence
atcactgaatcctgttgact

SEQ ID NO: 566529 - DNA, 20 bp, Artificial
  CRISPR gRNA sequence
aatcctgttgacttctctct

SEQ ID NO: 566530 - DNA, 20 bp, Artificial
  CRISPR gRNA sequence
ttgacttctctctccagcat

SEQ ID NO: 566531 - DNA, 20 bp, Artificial
  CRISPR gRNA sequence
acttctctctccagcatctc

SEQ ID NO: 566532 - DNA, 20 bp, Artificial
  CRISPR gRNA sequence
ctctctccagcatctcctga

SEQ ID NO: 566533 - DNA, 20 bp, Artificial
  CRISPR gRNA sequence
tctctccagcatctcctgag

SEQ ID NO: 566534 - DNA, 20 bp, Artificial
  CRISPR gRNA sequence
tctccagcatctcctgagtc

SEQ ID NO: 566535 - DNA, 20 bp, Artificial
  CRISPR gRNA sequence
tccagcatctcctgagtctg

SEQ ID NO: 566536 - DNA, 20 bp, Artificial
  CRISPR gRNA sequence
cagcatctcctgagtctgtc

SEQ ID NO: 566537 - DNA, 20 bp, Artificial
  CRISPR gRNA sequence
ctgagtctgtccgcttgtct

SEQ ID NO: 566538 - DNA, 20 bp, Artificial
  CRISPR gRNA sequence
agtctgtccgcttgtctgtc

SEQ ID NO: 566539 - DNA, 20 bp, Artificial
  CRISPR gRNA sequence
tccgcttgtctgtccccact

SEQ ID NO: 566540 - DNA, 20 bp, Artificial
  CRISPR gRNA sequence
gtctgtccccactacaaaca

SEQ ID NO: 566541 - DNA, 20 bp, Artificial
  CRISPR gRNA sequence
tctgtccccactacaaacac

SEQ ID NO: 566542 - DNA, 20 bp, Artificial
  CRISPR gRNA sequence
tccccactacaaacaccctg

SEQ ID NO: 566543 - DNA, 20 bp, Artificial
  CRISPR gRNA sequence
caaacaccctgctctggtct

SEQ ID NO: 566544 - DNA, 20 bp, Artificial
  CRISPR gRNA sequence
ctctggtctgtcctgtccat

SEQ ID NO: 566545 - DNA, 20 bp, Artificial
  CRISPR gRNA sequence
tggtctgtcctgtccatgga

SEQ ID NO: 566546 - DNA, 20 bp, Artificial
  CRISPR gRNA sequence
gtctgtcctgtccatggact

SEQ ID NO: 566547 - DNA, 20 bp, Artificial
  CRISPR gRNA sequence
tcctgtccatggacttcatt

SEQ ID NO: 566548 - DNA, 20 bp, Artificial
  CRISPR gRNA sequence
tccatggacttcattgctac

SEQ ID NO: 566549 - DNA, 20 bp, Artificial
  CRISPR gRNA sequence
cattgctacagcattgactt

SEQ ID NO: 566550 - DNA, 20 bp, Artificial
  CRISPR gRNA sequence
attgctacagcattgacttt

SEQ ID NO: 566551 - DNA, 20 bp, Artificial
  CRISPR gRNA sequence
ctacagcattgactttcatt

SEQ ID NO: 566552 - DNA, 20 bp, Artificial
  CRISPR gRNA sequence
cagcattgactttcattata

SEQ ID NO: 566553 - DNA, 20 bp, Artificial
  CRISPR gRNA sequence
actttcattataatttccct

SEQ ID NO: 566554 - DNA, 20 bp, Artificial
  CRISPR gRNA sequence
tcattataatttccctgcct

SEQ ID NO: 566555 - DNA, 20 bp, Artificial
  CRISPR gRNA sequence
cattataatttccctgcctc

SEQ ID NO: 566556 - DNA, 20 bp, Artificial
  CRISPR gRNA sequence
attataatttccctgcctct

SEQ ID NO: 566557 - DNA, 20 bp, Artificial
  CRISPR gRNA sequence
taatttccctgcctctgtgc

SEQ ID NO: 566558 - DNA, 20 bp, Artificial
  CRISPR gRNA sequence
ccctgcctctgtgctggccc

SEQ ID NO: 566559 - DNA, 20 bp, Artificial
  CRISPR gRNA sequence
cctgcctctgtgctggcccc

SEQ ID NO: 566560 - DNA, 20 bp, Artificial
  CRISPR gRNA sequence
cctctgtgctggcccctgtc

SEQ ID NO: 566561 - DNA, 20 bp, Artificial
  CRISPR gRNA sequence
tgtgctggcccctgtcagcc

SEQ ID NO: 566562 - DNA, 20 bp, Artificial
  CRISPR gRNA sequence
tgctggcccctgtcagccgc

SEQ ID NO: 566563 - DNA, 20 bp, Artificial
  CRISPR gRNA sequence
gcccctgtcagccgctctct

SEQ ID NO: 566564 - DNA, 20 bp, Artificial
  CRISPR gRNA sequence
tcagccgctctctactctaa

SEQ ID NO: 566565 - DNA, 20 bp, Artificial
  CRISPR gRNA sequence
tctactctaaagacagtcag

SEQ ID NO: 566566 - DNA, 20 bp, Artificial
  CRISPR gRNA sequence
tactctaaagacagtcagcc

SEQ ID NO: 566567 - DNA, 20 bp, Artificial
  CRISPR gRNA sequence
ctctaaagacagtcagcctg

SEQ ID NO: 566568 - DNA, 20 bp, Artificial
  CRISPR gRNA sequence
taaagacagtcagcctgctg

SEQ ID NO: 566569 - DNA, 20 bp, Artificial
  CRISPR gRNA sequence
aagacagtcagcctgctgac

SEQ ID NO: 566570 - DNA, 20 bp, Artificial
  CRISPR gRNA sequence
ctgacacttaaattatgtta

SEQ ID NO: 566571 - DNA, 20 bp, Artificial
  CRISPR gRNA sequence
acacttaaattatgttaggc

SEQ ID NO: 566572 - DNA, 20 bp, Artificial
  CRISPR gRNA sequence
aaattatgttaggccagtct

SEQ ID NO: 566573 - DNA, 20 bp, Artificial
  CRISPR gRNA sequence
aattatgttaggccagtctt

SEQ ID NO: 566574 - DNA, 20 bp, Artificial
  CRISPR gRNA sequence
tgttaggccagtcttgttaa

SEQ ID NO: 566575 - DNA, 20 bp, Artificial
  CRISPR gRNA sequence
ggccagtcttgttaaaaacc

SEQ ID NO: 566576 - DNA, 20 bp, Artificial
  CRISPR gRNA sequence
gttaaaaacctttctgtggc

SEQ ID NO: 566577 - DNA, 20 bp, Artificial
  CRISPR gRNA sequence
ttaaaaacctttctgtggct

SEQ ID NO: 566578 - DNA, 20 bp, Artificial
  CRISPR gRNA sequence
aaaacctttctgtggcttcc

SEQ ID NO: 566579 - DNA, 20 bp, Artificial
  CRISPR gRNA sequence
tctgtggcttcctctccatt

SEQ ID NO: 566580 - DNA, 20 bp, Artificial
  CRISPR gRNA sequence
ctgtggcttcctctccatta

SEQ ID NO: 566581 - DNA, 20 bp, Artificial
  CRISPR gRNA sequence
tgtggcttcctctccattag

SEQ ID NO: 566582 - DNA, 20 bp, Artificial
  CRISPR gRNA sequence
tggcttcctctccattagga

SEQ ID NO: 566583 - DNA, 20 bp, Artificial
  CRISPR gRNA sequence
cctctccattaggatcagtc

SEQ ID NO: 566584 - DNA, 20 bp, Artificial
  CRISPR gRNA sequence
ctctccattaggatcagtcc

SEQ ID NO: 566585 - DNA, 20 bp, Artificial
  CRISPR gRNA sequence
tccattaggatcagtccaaa

SEQ ID NO: 566586 - DNA, 20 bp, Artificial
  CRISPR gRNA sequence
cattaggatcagtccaaacc

SEQ ID NO: 566587 - DNA, 20 bp, Artificial
  CRISPR gRNA sequence
ggatcagtccaaacccttag

SEQ ID NO: 566588 - DNA, 20 bp, Artificial
  CRISPR gRNA sequence
agcgttccttactttagcac

SEQ ID NO: 566589 - DNA, 20 bp, Artificial
  CRISPR gRNA sequence
gcgttccttactttagcaca

SEQ ID NO: 566590 - DNA, 20 bp, Artificial
  CRISPR gRNA sequence
cttactttagcacacatagg

SEQ ID NO: 566591 - DNA, 20 bp, Artificial
  CRISPR gRNA sequence
actttagcacacataggctg

SEQ ID NO: 566592 - DNA, 20 bp, Artificial
  CRISPR gRNA sequence
ctttagcacacataggctgt

SEQ ID NO: 566593 - DNA, 20 bp, Artificial
  CRISPR gRNA sequence
tagcacacataggctgtggg

SEQ ID NO: 566594 - DNA, 20 bp, Artificial
  CRISPR gRNA sequence
agcacacataggctgtgggc

SEQ ID NO: 566595 - DNA, 20 bp, Artificial
  CRISPR gRNA sequence
gcacacataggctgtgggct

SEQ ID NO: 566596 - DNA, 20 bp, Artificial
  CRISPR gRNA sequence
tgggctggcctttgtctgtc

SEQ ID NO: 566597 - DNA, 20 bp, Artificial
  CRISPR gRNA sequence
gcctttgtctgtcttgttcc

SEQ ID NO: 566598 - DNA, 20 bp, Artificial
  CRISPR gRNA sequence
tgtctgtcttgttccccacc

SEQ ID NO: 566599 - DNA, 20 bp, Artificial
  CRISPR gRNA sequence
gtctgtcttgttccccacca

SEQ ID NO: 566600 - DNA, 20 bp, Artificial
  CRISPR gRNA sequence
tctgtcttgttccccaccag

SEQ ID NO: 566601 - DNA, 20 bp, Artificial
  CRISPR gRNA sequence
tcttgttccccaccagccac

SEQ ID NO: 566602 - DNA, 20 bp, Artificial
  CRISPR gRNA sequence
gttccccaccagccacccct

SEQ ID NO: 566603 - DNA, 20 bp, Artificial
  CRISPR gRNA sequence
ttccccaccagccacccctt

SEQ ID NO: 566604 - DNA, 20 bp, Artificial
  CRISPR gRNA sequence
cccaccagccaccccttgcc

SEQ ID NO: 566605 - DNA, 20 bp, Artificial
  CRISPR gRNA sequence
gccctcctcattctagctgt

SEQ ID NO: 566606 - DNA, 20 bp, Artificial
  CRISPR gRNA sequence
ccctcctcattctagctgtt

SEQ ID NO: 566607 - DNA, 20 bp, Artificial
  CRISPR gRNA sequence
ctcattctagctgttaggaa

SEQ ID NO: 566608 - DNA, 20 bp, Artificial
  CRISPR gRNA sequence
attctagctgttaggaatca

SEQ ID NO: 566609 - DNA, 20 bp, Artificial
  CRISPR gRNA sequence
tagctgttaggaatcacgtg

SEQ ID NO: 566610 - DNA, 20 bp, Artificial
  CRISPR gRNA sequence
gctgttaggaatcacgtgtg

SEQ ID NO: 566611 - DNA, 20 bp, Artificial
  CRISPR gRNA sequence
ttaggaatcacgtgtgtatc

SEQ ID NO: 566612 - DNA, 20 bp, Artificial
  CRISPR gRNA sequence
ggaatcacgtgtgtatcctc

SEQ ID NO: 566613 - DNA, 20 bp, Artificial
  CRISPR gRNA sequence
aagcacaccatgctctttct

SEQ ID NO: 566614 - DNA, 20 bp, Artificial
  CRISPR gRNA sequence
tttctccattcagggccttc

SEQ ID NO: 566615 - DNA, 20 bp, Artificial
  CRISPR gRNA sequence
tctccattcagggccttcct

SEQ ID NO: 566616 - DNA, 20 bp, Artificial
  CRISPR gRNA sequence
ctccattcagggccttcctt

SEQ ID NO: 566617 - DNA, 20 bp, Artificial
  CRISPR gRNA sequence
tccattcagggccttccttt

SEQ ID NO: 566618 - DNA, 20 bp, Artificial
  CRISPR gRNA sequence
cattcagggccttcctttgg

SEQ ID NO: 566619 - DNA, 20 bp, Artificial
  CRISPR gRNA sequence
agggccttcctttgggggtg

SEQ ID NO: 566620 - DNA, 20 bp, Artificial
  CRISPR gRNA sequence
cctttgggggtgctgcttcc

SEQ ID NO: 566621 - DNA, 20 bp, Artificial
  CRISPR gRNA sequence
ctttgggggtgctgcttcct

SEQ ID NO: 566622 - DNA, 20 bp, Artificial
  CRISPR gRNA sequence
tgggggtgctgcttcctata

SEQ ID NO: 566623 - DNA, 20 bp, Artificial
  CRISPR gRNA sequence
gggggtgctgcttcctatat

SEQ ID NO: 566624 - DNA, 20 bp, Artificial
  CRISPR gRNA sequence
ggggtgctgcttcctatata

SEQ ID NO: 566625 - DNA, 20 bp, Artificial
  CRISPR gRNA sequence
cttcctatatatctgtatga

SEQ ID NO: 566626 - DNA, 20 bp, Artificial
  CRISPR gRNA sequence
cctatatatctgtatgatca

SEQ ID NO: 566627 - DNA, 20 bp, Artificial
  CRISPR gRNA sequence
ctatatatctgtatgatcat

SEQ ID NO: 566628 - DNA, 20 bp, Artificial
  CRISPR gRNA sequence
tatatctgtatgatcatctc

SEQ ID NO: 566629 - DNA, 20 bp, Artificial
  CRISPR gRNA sequence
tatgatcatctcttcttcca

SEQ ID NO: 566630 - DNA, 20 bp, Artificial
  CRISPR gRNA sequence
ttcttccactccccacccac

SEQ ID NO: 566631 - DNA, 20 bp, Artificial
  CRISPR gRNA sequence
cttccactccccacccactc

SEQ ID NO: 566632 - DNA, 20 bp, Artificial
  CRISPR gRNA sequence
ttccactccccacccactca

SEQ ID NO: 566633 - DNA, 20 bp, Artificial
  CRISPR gRNA sequence
ccactccccacccactcacc

SEQ ID NO: 566634 - DNA, 20 bp, Artificial
  CRISPR gRNA sequence
cactccccacccactcacct

SEQ ID NO: 566635 - DNA, 20 bp, Artificial
  CRISPR gRNA sequence
cccacccactcacctaccca

SEQ ID NO: 566636 - DNA, 20 bp, Artificial
  CRISPR gRNA sequence
acctacccagccctgcggcc

SEQ ID NO: 566637 - DNA, 20 bp, Artificial
  CRISPR gRNA sequence
cccagccctgcggcctaact

SEQ ID NO: 566638 - DNA, 20 bp, Artificial
  CRISPR gRNA sequence
cggcctaactgccttttatc

SEQ ID NO: 566639 - DNA, 20 bp, Artificial
  CRISPR gRNA sequence
actgccttttatccttcagt

SEQ ID NO: 566640 - DNA, 20 bp, Artificial
  CRISPR gRNA sequence
ccttttatccttcagtgatt

SEQ ID NO: 566641 - DNA, 20 bp, Artificial
  CRISPR gRNA sequence
ttatccttcagtgatttgca

SEQ ID NO: 566642 - DNA, 20 bp, Artificial
  CRISPR gRNA sequence
tatccttcagtgatttgcac

SEQ ID NO: 566643 - DNA, 20 bp, Artificial
  CRISPR gRNA sequence
atccttcagtgatttgcacg

SEQ ID NO: 566644 - DNA, 20 bp, Artificial
  CRISPR gRNA sequence
tccttcagtgatttgcacgt

SEQ ID NO: 566645 - DNA, 20 bp, Artificial
  CRISPR gRNA sequence
cagtgatttgcacgttatgt

SEQ ID NO: 566646 - DNA, 20 bp, Artificial
  CRISPR gRNA sequence
agtgatttgcacgttatgtc

SEQ ID NO: 566647 - DNA, 20 bp, Artificial
  CRISPR gRNA sequence
gcacgttatgtcagttccag

SEQ ID NO: 566648 - DNA, 20 bp, Artificial
  CRISPR gRNA sequence
cacgttatgtcagttccagc

SEQ ID NO: 566649 - DNA, 20 bp, Artificial
  CRISPR gRNA sequence
tgtcagttccagcatgactt

SEQ ID NO: 566650 - DNA, 20 bp, Artificial
  CRISPR gRNA sequence
cagcatgacttccttgggga

SEQ ID NO: 566651 - DNA, 20 bp, Artificial
  CRISPR gRNA sequence
ccttggggaggccctagacc

SEQ ID NO: 566652 - DNA, 20 bp, Artificial
  CRISPR gRNA sequence
cttggggaggccctagacca

SEQ ID NO: 566653 - DNA, 20 bp, Artificial
  CRISPR gRNA sequence
ggggaggccctagaccaggc

SEQ ID NO: 566654 - DNA, 20 bp, Artificial
  CRISPR gRNA sequence
gggaggccctagaccaggca

SEQ ID NO: 566655 - DNA, 20 bp, Artificial
  CRISPR gRNA sequence
gaccaggcagctcccctcat

SEQ ID NO: 566656 - DNA, 20 bp, Artificial
  CRISPR gRNA sequence
ccctcatgcagcccctgatg

SEQ ID NO: 566657 - DNA, 20 bp, Artificial
  CRISPR gRNA sequence
atgcagcccctgatgtagag

SEQ ID NO: 566658 - DNA, 20 bp, Artificial
  CRISPR gRNA sequence
atgtagagcctgctccctgt

SEQ ID NO: 566659 - DNA, 20 bp, Artificial
  CRISPR gRNA sequence
ctccctgtcttctccacacg

SEQ ID NO: 566660 - DNA, 20 bp, Artificial
  CRISPR gRNA sequence
cctgtcttctccacacgtga

SEQ ID NO: 566661 - DNA, 20 bp, Artificial
  CRISPR gRNA sequence
tcttctccacacgtgaggct

SEQ ID NO: 566662 - DNA, 20 bp, Artificial
  CRISPR gRNA sequence
ctccacacgtgaggctcctg

SEQ ID NO: 566663 - DNA, 20 bp, Artificial
  CRISPR gRNA sequence
tccacacgtgaggctcctgg

SEQ ID NO: 566664 - DNA, 20 bp, Artificial
  CRISPR gRNA sequence
cacacgtgaggctcctggag

SEQ ID NO: 566665 - DNA, 20 bp, Artificial
  CRISPR gRNA sequence
ctggagggcctggaacaacc

SEQ ID NO: 566666 - DNA, 20 bp, Artificial
  CRISPR gRNA sequence
gagggcctggaacaacccca

SEQ ID NO: 566667 - DNA, 20 bp, Artificial
  CRISPR gRNA sequence
gaacaaccccatattcccag

SEQ ID NO: 566668 - DNA, 20 bp, Artificial
  CRISPR gRNA sequence
ccagcccagcccgtactacc

SEQ ID NO: 566669 - DNA, 20 bp, Artificial
  CRISPR gRNA sequence
cctggcagatggttggtgct

SEQ ID NO: 566670 - DNA, 20 bp, Artificial
  CRISPR gRNA sequence
gcagatggttggtgctccat

SEQ ID NO: 566671 - DNA, 20 bp, Artificial
  CRISPR gRNA sequence
gtgctccatgaatgtcgggt

SEQ ID NO: 566672 - DNA, 20 bp, Artificial
  CRISPR gRNA sequence
catgaatgtcgggtccattt

SEQ ID NO: 566673 - DNA, 20 bp, Artificial
  CRISPR gRNA sequence
cttggatttatgcaggtccc

SEQ ID NO: 566674 - DNA, 20 bp, Artificial
  CRISPR gRNA sequence
ttggatttatgcaggtccca

SEQ ID NO: 566675 - DNA, 20 bp, Artificial
  CRISPR gRNA sequence
ggatttatgcaggtcccagt

SEQ ID NO: 566676 - DNA, 20 bp, Artificial
  CRISPR gRNA sequence
gatttatgcaggtcccagtt

SEQ ID NO: 566677 - DNA, 20 bp, Artificial
  CRISPR gRNA sequence
atgcaggtcccagttttcta

SEQ ID NO: 566678 - DNA, 20 bp, Artificial
  CRISPR gRNA sequence
tgcaggtcccagttttctat

SEQ ID NO: 566679 - DNA, 20 bp, Artificial
  CRISPR gRNA sequence
tctattaaagagtaagctcc

SEQ ID NO: 566680 - DNA, 20 bp, Artificial
  CRISPR gRNA sequence
ctattaaagagtaagctcca

SEQ ID NO: 566681 - DNA, 20 bp, Artificial
  CRISPR gRNA sequence
tattaaagagtaagctccac

SEQ ID NO: 566682 - DNA, 20 bp, Artificial
  CRISPR gRNA sequence
ttaaagagtaagctccacat

SEQ ID NO: 566683 - DNA, 20 bp, Artificial
  CRISPR gRNA sequence
aagagtaagctccacatggt

SEQ ID NO: 566684 - DNA, 20 bp, Artificial
  CRISPR gRNA sequence
cacatggtcaaacatgttct

SEQ ID NO: 566685 - DNA, 20 bp, Artificial
  CRISPR gRNA sequence
ttacttcctgtattttgtgt

SEQ ID NO: 566686 - DNA, 20 bp, Artificial
  CRISPR gRNA sequence
acttcctgtattttgtgtca

SEQ ID NO: 566687 - DNA, 20 bp, Artificial
  CRISPR gRNA sequence
cttcctgtattttgtgtcag

SEQ ID NO: 566688 - DNA, 20 bp, Artificial
  CRISPR gRNA sequence
cctgtattttgtgtcagcag

SEQ ID NO: 566689 - DNA, 20 bp, Artificial
  CRISPR gRNA sequence
ctgtattttgtgtcagcagt

SEQ ID NO: 566690 - DNA, 20 bp, Artificial
  CRISPR gRNA sequence
tattttgtgtcagcagtttg

SEQ ID NO: 566691 - DNA, 20 bp, Artificial
  CRISPR gRNA sequence
tgtgtcagcagtttgtcagc

SEQ ID NO: 566692 - DNA, 20 bp, Artificial
  CRISPR gRNA sequence
gtgtcagcagtttgtcagct

SEQ ID NO: 566693 - DNA, 20 bp, Artificial
  CRISPR gRNA sequence
tgtcagcagtttgtcagctt

SEQ ID NO: 566694 - DNA, 20 bp, Artificial
  CRISPR gRNA sequence
gtcagcttagcacaaaaagt

SEQ ID NO: 566695 - DNA, 20 bp, Artificial
  CRISPR gRNA sequence
tcagcttagcacaaaaagta

SEQ ID NO: 566696 - DNA, 20 bp, Artificial
  CRISPR gRNA sequence
agcacaaaaagtacctgatg

SEQ ID NO: 566697 - DNA, 20 bp, Artificial
  CRISPR gRNA sequence
gcacaaaaagtacctgatga

SEQ ID NO: 566698 - DNA, 20 bp, Artificial
  CRISPR gRNA sequence
atgaataatttctgccacca

SEQ ID NO: 566699 - DNA, 20 bp, Artificial
  CRISPR gRNA sequence
ctgccaccaaagtcatgttg

SEQ ID NO: 566700 - DNA, 20 bp, Artificial
  CRISPR gRNA sequence
tgccaccaaagtcatgttgt

SEQ ID NO: 566701 - DNA, 20 bp, Artificial
  CRISPR gRNA sequence
ccaccaaagtcatgttgttt

SEQ ID NO: 566702 - DNA, 20 bp, Artificial
  CRISPR gRNA sequence
ttttttctaaccaatttttt

SEQ ID NO: 566703 - DNA, 20 bp, Artificial
  CRISPR gRNA sequence
tttctaaccaattttttttt

SEQ ID NO: 566704 - DNA, 20 bp, Artificial
  CRISPR gRNA sequence
ttctaaccaatttttttttc

SEQ ID NO: 566705 - DNA, 20 bp, Artificial
  CRISPR gRNA sequence
tctaaccaatttttttttct

SEQ ID NO: 566706 - DNA, 20 bp, Artificial
  CRISPR gRNA sequence
ctaaccaatttttttttctc

SEQ ID NO: 566707 - DNA, 20 bp, Artificial
  CRISPR gRNA sequence
taaccaatttttttttctct

SEQ ID NO: 566708 - DNA, 20 bp, Artificial
  CRISPR gRNA sequence
accaatttttttttctctcc

SEQ ID NO: 566709 - DNA, 20 bp, Artificial
  CRISPR gRNA sequence
ttttttctctcctaggtttc

SEQ ID NO: 566710 - DNA, 20 bp, Artificial
  CRISPR gRNA sequence
tttttctctcctaggtttca

SEQ ID NO: 566711 - DNA, 20 bp, Artificial
  CRISPR gRNA sequence
ttttctctcctaggtttcat

SEQ ID NO: 566712 - DNA, 20 bp, Artificial
  CRISPR gRNA sequence
tttctctcctaggtttcatc

SEQ ID NO: 566713 - DNA, 20 bp, Artificial
  CRISPR gRNA sequence
ttctctcctaggtttcatca

SEQ ID NO: 566714 - DNA, 20 bp, Artificial
  CRISPR gRNA sequence
tctctcctaggtttcatcag

SEQ ID NO: 566715 - DNA, 20 bp, Artificial
  CRISPR gRNA sequence
ctctcctaggtttcatcagc

SEQ ID NO: 566716 - DNA, 20 bp, Artificial
  CRISPR gRNA sequence
tctcctaggtttcatcagct

SEQ ID NO: 566717 - DNA, 20 bp, Artificial
  CRISPR gRNA sequence
tcctaggtttcatcagctgt

SEQ ID NO: 566718 - DNA, 20 bp, Artificial
  CRISPR gRNA sequence
ctaggtttcatcagctgttt

SEQ ID NO: 566719 - DNA, 20 bp, Artificial
  CRISPR gRNA sequence
ggtttcatcagctgtttttc

SEQ ID NO: 566720 - DNA, 20 bp, Artificial
  CRISPR gRNA sequence
catcagctgtttttcccaac

SEQ ID NO: 566721 - DNA, 20 bp, Artificial
  CRISPR gRNA sequence
atcagctgtttttcccaaca

SEQ ID NO: 566722 - DNA, 20 bp, Artificial
  CRISPR gRNA sequence
tttttcccaacaaatatatg

SEQ ID NO: 566723 - DNA, 20 bp, Artificial
  CRISPR gRNA sequence
ttcccaacaaatatatggtg

SEQ ID NO: 566724 - DNA, 20 bp, Artificial
  CRISPR gRNA sequence
tcccaacaaatatatggtgt

SEQ ID NO: 566725 - DNA, 20 bp, Artificial
  CRISPR gRNA sequence
cccaacaaatatatggtgtt

SEQ ID NO: 566726 - DNA, 20 bp, Artificial
  CRISPR gRNA sequence
ccaacaaatatatggtgttg

SEQ ID NO: 566727 - DNA, 20 bp, Artificial
  CRISPR gRNA sequence
tgtatgggaatgtaactttc

SEQ ID NO: 566728 - DNA, 20 bp, Artificial
  CRISPR gRNA sequence
tccatgtaccaagcaatgtg

SEQ ID NO: 566729 - DNA, 20 bp, Artificial
  CRISPR gRNA sequence
ccatgtaccaagcaatgtgc

SEQ ID NO: 566730 - DNA, 20 bp, Artificial
  CRISPR gRNA sequence
catgtaccaagcaatgtgcc

SEQ ID NO: 566731 - DNA, 20 bp, Artificial
  CRISPR gRNA sequence
taaaagaggtcctatggaaa

SEQ ID NO: 566732 - DNA, 20 bp, Artificial
  CRISPR gRNA sequence
aaaagaggtcctatggaaaa

SEQ ID NO: 566733 - DNA, 20 bp, Artificial
  CRISPR gRNA sequence
aaagaggtcctatggaaaaa

SEQ ID NO: 566734 - DNA, 20 bp, Artificial
  CRISPR gRNA sequence
tggaaaaaacaaaaggataa

SEQ ID NO: 566735 - DNA, 20 bp, Artificial
  CRISPR gRNA sequence
cagaactggaaaattctgaa

SEQ ID NO: 566736 - DNA, 20 bp, Artificial
  CRISPR gRNA sequence
gaaaattctgaattcagagc

SEQ ID NO: 566737 - DNA, 20 bp, Artificial
  CRISPR gRNA sequence
tgaattcagagctttctcat

SEQ ID NO: 566738 - DNA, 20 bp, Artificial
  CRISPR gRNA sequence
aattcagagctttctcatct

SEQ ID NO: 566739 - DNA, 20 bp, Artificial
  CRISPR gRNA sequence
agagctttctcatcttttaa

SEQ ID NO: 566740 - DNA, 20 bp, Artificial
  CRISPR gRNA sequence
tctcatcttttaaaaatagg

SEQ ID NO: 566741 - DNA, 20 bp, Artificial
  CRISPR gRNA sequence
ctcatcttttaaaaataggg

SEQ ID NO: 566742 - DNA, 20 bp, Artificial
  CRISPR gRNA sequence
tcatcttttaaaaatagggt

SEQ ID NO: 566743 - DNA, 20 bp, Artificial
  CRISPR gRNA sequence
atcttttaaaaatagggttt

SEQ ID NO: 566744 - DNA, 20 bp, Artificial
  CRISPR gRNA sequence
ttaaaaatagggtttattta

SEQ ID NO: 566745 - DNA, 20 bp, Artificial
  CRISPR gRNA sequence
taaaaatagggtttatttag

SEQ ID NO: 566746 - DNA, 20 bp, Artificial
  CRISPR gRNA sequence
aaaaatagggtttatttaga

SEQ ID NO: 566747 - DNA, 20 bp, Artificial
  CRISPR gRNA sequence
aaaatagggtttatttagac

SEQ ID NO: 566748 - DNA, 20 bp, Artificial
  CRISPR gRNA sequence
atttagacactgtgtcaggt

SEQ ID NO: 566749 - DNA, 20 bp, Artificial
  CRISPR gRNA sequence
tttagacactgtgtcaggta

SEQ ID NO: 566750 - DNA, 20 bp, Artificial
  CRISPR gRNA sequence
agacactgtgtcaggtagcc

SEQ ID NO: 566751 - DNA, 20 bp, Artificial
  CRISPR gRNA sequence
gacactgtgtcaggtagcct

SEQ ID NO: 566752 - DNA, 20 bp, Artificial
  CRISPR gRNA sequence
tgtcaggtagcctcactatc

SEQ ID NO: 566753 - DNA, 20 bp, Artificial
  CRISPR gRNA sequence
actatctacaacttaacatc

SEQ ID NO: 566754 - DNA, 20 bp, Artificial
  CRISPR gRNA sequence
tctacaacttaacatcatca

SEQ ID NO: 566755 - DNA, 20 bp, Artificial
  CRISPR gRNA sequence
caacttaacatcatcagatg

SEQ ID NO: 566756 - DNA, 20 bp, Artificial
  CRISPR gRNA sequence
aacatcatcagatgaagatg

SEQ ID NO: 566757 - DNA, 20 bp, Artificial
  CRISPR gRNA sequence
acatcatcagatgaagatga

SEQ ID NO: 566758 - DNA, 20 bp, Artificial
  CRISPR gRNA sequence
ctgataccatgaagttcttt

SEQ ID NO: 566759 - DNA, 20 bp, Artificial
  CRISPR gRNA sequence
ataccatgaagttctttctt

SEQ ID NO: 566760 - DNA, 20 bp, Artificial
  CRISPR gRNA sequence
tttctttatgtgcttggtga

SEQ ID NO: 566761 - DNA, 20 bp, Artificial
  CRISPR gRNA sequence
tctttatgtgcttggtgagt

SEQ ID NO: 566762 - DNA, 20 bp, Artificial
  CRISPR gRNA sequence
ctttatgtgcttggtgagta

SEQ ID NO: 566763 - DNA, 20 bp, Artificial
  CRISPR gRNA sequence
tttatgtgcttggtgagtat

SEQ ID NO: 566764 - DNA, 20 bp, Artificial
  CRISPR gRNA sequence
tatgtgcttggtgagtattc

SEQ ID NO: 566765 - DNA, 20 bp, Artificial
  CRISPR gRNA sequence
atgtgcttggtgagtattcc

SEQ ID NO: 566766 - DNA, 20 bp, Artificial
  CRISPR gRNA sequence
tgtgcttggtgagtattcca

SEQ ID NO: 566767 - DNA, 20 bp, Artificial
  CRISPR gRNA sequence
ggtgagtattccataagttg

SEQ ID NO: 566768 - DNA, 20 bp, Artificial
  CRISPR gRNA sequence
gtgagtattccataagttga

SEQ ID NO: 566769 - DNA, 20 bp, Artificial
  CRISPR gRNA sequence
cataagttgatttgtttaaa

SEQ ID NO: 566770 - DNA, 20 bp, Artificial
  CRISPR gRNA sequence
atttgtttaaaatggcaaat

SEQ ID NO: 566771 - DNA, 20 bp, Artificial
  CRISPR gRNA sequence
gtttaaaatggcaaatttcc

SEQ ID NO: 566772 - DNA, 20 bp, Artificial
  CRISPR gRNA sequence
tttaaaatggcaaatttcca

SEQ ID NO: 566773 - DNA, 20 bp, Artificial
  CRISPR gRNA sequence
aaaatggcaaatttccattt

SEQ ID NO: 566774 - DNA, 20 bp, Artificial
  CRISPR gRNA sequence
aaatggcaaatttccatttt

SEQ ID NO: 566775 - DNA, 20 bp, Artificial
  CRISPR gRNA sequence
ccatttttttagtctgtttt

SEQ ID NO: 566776 - DNA, 20 bp, Artificial
  CRISPR gRNA sequence
catttttttagtctgttttc

SEQ ID NO: 566777 - DNA, 20 bp, Artificial
  CRISPR gRNA sequence
ttttagtctgttttcagaga

SEQ ID NO: 566778 - DNA, 20 bp, Artificial
  CRISPR gRNA sequence
tttagtctgttttcagagac

SEQ ID NO: 566779 - DNA, 20 bp, Artificial
  CRISPR gRNA sequence
ttagtctgttttcagagact

SEQ ID NO: 566780 - DNA, 20 bp, Artificial
  CRISPR gRNA sequence
tagtctgttttcagagacta

SEQ ID NO: 566781 - DNA, 20 bp, Artificial
  CRISPR gRNA sequence
agtctgttttcagagactag

SEQ ID NO: 566782 - DNA, 20 bp, Artificial
  CRISPR gRNA sequence
gtctgttttcagagactagc

SEQ ID NO: 566783 - DNA, 20 bp, Artificial
  CRISPR gRNA sequence
ttttcagagactagcacaaa

SEQ ID NO: 566784 - DNA, 20 bp, Artificial
  CRISPR gRNA sequence
tcagagactagcacaaatta

SEQ ID NO: 566785 - DNA, 20 bp, Artificial
  CRISPR gRNA sequence
cagagactagcacaaattaa

SEQ ID NO: 566786 - DNA, 20 bp, Artificial
  CRISPR gRNA sequence
agagactagcacaaattaat

SEQ ID NO: 566787 - DNA, 20 bp, Artificial
  CRISPR gRNA sequence
gcacaaattaatggtctatg

SEQ ID NO: 566788 - DNA, 20 bp, Artificial
  CRISPR gRNA sequence
atggtctatgagaaaagaat

SEQ ID NO: 566789 - DNA, 20 bp, Artificial
  CRISPR gRNA sequence
tgagaaaagaattagatgtt

SEQ ID NO: 566790 - DNA, 20 bp, Artificial
  CRISPR gRNA sequence
gatgttacctgttgtcaggg

SEQ ID NO: 566791 - DNA, 20 bp, Artificial
  CRISPR gRNA sequence
cctgttgtcagggttttctc

SEQ ID NO: 566792 - DNA, 20 bp, Artificial
  CRISPR gRNA sequence
ttgtcagggttttctccttt

SEQ ID NO: 566793 - DNA, 20 bp, Artificial
  CRISPR gRNA sequence
tcagggttttctccttttct

SEQ ID NO: 566794 - DNA, 20 bp, Artificial
  CRISPR gRNA sequence
tctccttttctggtatagag

SEQ ID NO: 566795 - DNA, 20 bp, Artificial
  CRISPR gRNA sequence
ctccttttctggtatagagg

SEQ ID NO: 566796 - DNA, 20 bp, Artificial
  CRISPR gRNA sequence
tccttttctggtatagagga

SEQ ID NO: 566797 - DNA, 20 bp, Artificial
  CRISPR gRNA sequence
cttttctggtatagaggagc

SEQ ID NO: 566798 - DNA, 20 bp, Artificial
  CRISPR gRNA sequence
ttctggtatagaggagctag

SEQ ID NO: 566799 - DNA, 20 bp, Artificial
  CRISPR gRNA sequence
tctggtatagaggagctagc

SEQ ID NO: 566800 - DNA, 20 bp, Artificial
  CRISPR gRNA sequence
ctggtatagaggagctagct

SEQ ID NO: 566801 - DNA, 20 bp, Artificial
  CRISPR gRNA sequence
tggtatagaggagctagcta

SEQ ID NO: 566802 - DNA, 20 bp, Artificial
  CRISPR gRNA sequence
gtatagaggagctagctact

SEQ ID NO: 566803 - DNA, 20 bp, Artificial
  CRISPR gRNA sequence
gctactttcaattcctttgt

SEQ ID NO: 566804 - DNA, 20 bp, Artificial
  CRISPR gRNA sequence
ctttcaattcctttgtcatt

SEQ ID NO: 566805 - DNA, 20 bp, Artificial
  CRISPR gRNA sequence
tcaattcctttgtcattcct

SEQ ID NO: 566806 - DNA, 20 bp, Artificial
  CRISPR gRNA sequence
caattcctttgtcattcctc

SEQ ID NO: 566807 - DNA, 20 bp, Artificial
  CRISPR gRNA sequence
aattcctttgtcattcctct

SEQ ID NO: 566808 - DNA, 20 bp, Artificial
  CRISPR gRNA sequence
ctttgtcattcctctgggtg

SEQ ID NO: 566809 - DNA, 20 bp, Artificial
  CRISPR gRNA sequence
tgtcattcctctgggtgagg

SEQ ID NO: 566810 - DNA, 20 bp, Artificial
  CRISPR gRNA sequence
gtcattcctctgggtgagga

SEQ ID NO: 566811 - DNA, 20 bp, Artificial
  CRISPR gRNA sequence
tcattcctctgggtgaggag

SEQ ID NO: 566812 - DNA, 20 bp, Artificial
  CRISPR gRNA sequence
ctctgggtgaggagagaatc

SEQ ID NO: 566813 - DNA, 20 bp, Artificial
  CRISPR gRNA sequence
tgggtgaggagagaatctaa

SEQ ID NO: 566814 - DNA, 20 bp, Artificial
  CRISPR gRNA sequence
ggtgaggagagaatctaacc

SEQ ID NO: 566815 - DNA, 20 bp, Artificial
  CRISPR gRNA sequence
accaaggtggggagaacagt

SEQ ID NO: 566816 - DNA, 20 bp, Artificial
  CRISPR gRNA sequence
tcttactaggaatgttttgg

SEQ ID NO: 566817 - DNA, 20 bp, Artificial
  CRISPR gRNA sequence
actaggaatgttttggaaag

SEQ ID NO: 566818 - DNA, 20 bp, Artificial
  CRISPR gRNA sequence
ctaggaatgttttggaaaga

SEQ ID NO: 566819 - DNA, 20 bp, Artificial
  CRISPR gRNA sequence
ggaatgttttggaaagagat

SEQ ID NO: 566820 - DNA, 20 bp, Artificial
  CRISPR gRNA sequence
tggaaagagatgtagtgaca

SEQ ID NO: 566821 - DNA, 20 bp, Artificial
  CRISPR gRNA sequence
ggaaagagatgtagtgacag

SEQ ID NO: 566822 - DNA, 20 bp, Artificial
  CRISPR gRNA sequence
gaaagagatgtagtgacagc

SEQ ID NO: 566823 - DNA, 20 bp, Artificial
  CRISPR gRNA sequence
gcttagaactctttgggctc

SEQ ID NO: 566824 - DNA, 20 bp, Artificial
  CRISPR gRNA sequence
agaactctttgggctccact

SEQ ID NO: 566825 - DNA, 20 bp, Artificial
  CRISPR gRNA sequence
gaactctttgggctccactg

SEQ ID NO: 566826 - DNA, 20 bp, Artificial
  CRISPR gRNA sequence
tttgggctccactgatagat

SEQ ID NO: 566827 - DNA, 20 bp, Artificial
  CRISPR gRNA sequence
tgggctccactgatagatgt

SEQ ID NO: 566828 - DNA, 20 bp, Artificial
  CRISPR gRNA sequence
gggctccactgatagatgtt

SEQ ID NO: 566829 - DNA, 20 bp, Artificial
  CRISPR gRNA sequence
ggctccactgatagatgtta

SEQ ID NO: 566830 - DNA, 20 bp, Artificial
  CRISPR gRNA sequence
cactgatagatgttactcta

SEQ ID NO: 566831 - DNA, 20 bp, Artificial
  CRISPR gRNA sequence
atagatgttactctataaag

SEQ ID NO: 566832 - DNA, 20 bp, Artificial
  CRISPR gRNA sequence
ctctataaagttcctgcttc

SEQ ID NO: 566833 - DNA, 20 bp, Artificial
  CRISPR gRNA sequence
tataaagttcctgcttcccc

SEQ ID NO: 566834 - DNA, 20 bp, Artificial
  CRISPR gRNA sequence
taaagttcctgcttccccac

SEQ ID NO: 566835 - DNA, 20 bp, Artificial
  CRISPR gRNA sequence
ctgcttccccacacagcggg

SEQ ID NO: 566836 - DNA, 20 bp, Artificial
  CRISPR gRNA sequence
cttccccacacagcggggag

SEQ ID NO: 566837 - DNA, 20 bp, Artificial
  CRISPR gRNA sequence
ccccacacagcggggagatt

SEQ ID NO: 566838 - DNA, 20 bp, Artificial
  CRISPR gRNA sequence
cccacacagcggggagattg

SEQ ID NO: 566839 - DNA, 20 bp, Artificial
  CRISPR gRNA sequence
tttttcctcctgcaccattt

SEQ ID NO: 566840 - DNA, 20 bp, Artificial
  CRISPR gRNA sequence
ttcctcctgcaccattttat

SEQ ID NO: 566841 - DNA, 20 bp, Artificial
  CRISPR gRNA sequence
tcctcctgcaccattttatt

SEQ ID NO: 566842 - DNA, 20 bp, Artificial
  CRISPR gRNA sequence
cctcctgcaccattttattt

SEQ ID NO: 566843 - DNA, 20 bp, Artificial
  CRISPR gRNA sequence
ctcctgcaccattttattta

SEQ ID NO: 566844 - DNA, 20 bp, Artificial
  CRISPR gRNA sequence
ctgcaccattttatttaatt

SEQ ID NO: 566845 - DNA, 20 bp, Artificial
  CRISPR gRNA sequence
caccattttatttaattaat

SEQ ID NO: 566846 - DNA, 20 bp, Artificial
  CRISPR gRNA sequence
tatttaattaatttatttat

SEQ ID NO: 566847 - DNA, 20 bp, Artificial
  CRISPR gRNA sequence
atttaattaatttatttatt

SEQ ID NO: 566848 - DNA, 20 bp, Artificial
  CRISPR gRNA sequence
tttaattaatttatttattt

SEQ ID NO: 566849 - DNA, 20 bp, Artificial
  CRISPR gRNA sequence
aattaatttatttattttga

SEQ ID NO: 566850 - DNA, 20 bp, Artificial
  CRISPR gRNA sequence
attaatttatttattttgag

SEQ ID NO: 566851 - DNA, 20 bp, Artificial
  CRISPR gRNA sequence
atttatttattttgagaagg

SEQ ID NO: 566852 - DNA, 20 bp, Artificial
  CRISPR gRNA sequence
atttattttgagaaggagtc

SEQ ID NO: 566853 - DNA, 20 bp, Artificial
  CRISPR gRNA sequence
tttattttgagaaggagtct

SEQ ID NO: 566854 - DNA, 20 bp, Artificial
  CRISPR gRNA sequence
attttgagaaggagtctcac

SEQ ID NO: 566855 - DNA, 20 bp, Artificial
  CRISPR gRNA sequence
ttttgagaaggagtctcact

SEQ ID NO: 566856 - DNA, 20 bp, Artificial
  CRISPR gRNA sequence
tgagaaggagtctcactctg

SEQ ID NO: 566857 - DNA, 20 bp, Artificial
  CRISPR gRNA sequence
gagaaggagtctcactctgt

SEQ ID NO: 566858 - DNA, 20 bp, Artificial
  CRISPR gRNA sequence
agaaggagtctcactctgtt

SEQ ID NO: 566859 - DNA, 20 bp, Artificial
  CRISPR gRNA sequence
actctgttaccaaggccaga

SEQ ID NO: 566860 - DNA, 20 bp, Artificial
  CRISPR gRNA sequence
tgttaccaaggccagagtgc

SEQ ID NO: 566861 - DNA, 20 bp, Artificial
  CRISPR gRNA sequence
ttaccaaggccagagtgcag

SEQ ID NO: 566862 - DNA, 20 bp, Artificial
  CRISPR gRNA sequence
ccaaggccagagtgcagtgg

SEQ ID NO: 566863 - DNA, 20 bp, Artificial
  CRISPR gRNA sequence
ggctgactgcaacctctgcc

SEQ ID NO: 566864 - DNA, 20 bp, Artificial
  CRISPR gRNA sequence
gctgactgcaacctctgcct

SEQ ID NO: 566865 - DNA, 20 bp, Artificial
  CRISPR gRNA sequence
actgcaacctctgcctccca

SEQ ID NO: 566866 - DNA, 20 bp, Artificial
  CRISPR gRNA sequence
caacctctgcctcccaggtt

SEQ ID NO: 566867 - DNA, 20 bp, Artificial
  CRISPR gRNA sequence
tgcctcccaggttcaaagtg

SEQ ID NO: 566868 - DNA, 20 bp, Artificial
  CRISPR gRNA sequence
cctcccaggttcaaagtgat

SEQ ID NO: 566869 - DNA, 20 bp, Artificial
  CRISPR gRNA sequence
ccaggttcaaagtgatttta

SEQ ID NO: 566870 - DNA, 20 bp, Artificial
  CRISPR gRNA sequence
aaagtgattttactgtctca

SEQ ID NO: 566871 - DNA, 20 bp, Artificial
  CRISPR gRNA sequence
tactgtctcagcctcccaag

SEQ ID NO: 566872 - DNA, 20 bp, Artificial
  CRISPR gRNA sequence
actgtctcagcctcccaagt

SEQ ID NO: 566873 - DNA, 20 bp, Artificial
  CRISPR gRNA sequence
ctgtctcagcctcccaagta

SEQ ID NO: 566874 - DNA, 20 bp, Artificial
  CRISPR gRNA sequence
tctcagcctcccaagtagct

SEQ ID NO: 566875 - DNA, 20 bp, Artificial
  CRISPR gRNA sequence
agcctcccaagtagctggga

SEQ ID NO: 566876 - DNA, 20 bp, Artificial
  CRISPR gRNA sequence
ccaagtagctgggactacag

SEQ ID NO: 566877 - DNA, 20 bp, Artificial
  CRISPR gRNA sequence
ggactacaggcccgcaccac

SEQ ID NO: 566878 - DNA, 20 bp, Artificial
  CRISPR gRNA sequence
caggcccgcaccaccatgcc

SEQ ID NO: 566879 - DNA, 20 bp, Artificial
  CRISPR gRNA sequence
atttttgtattttagtagag

SEQ ID NO: 566880 - DNA, 20 bp, Artificial
  CRISPR gRNA sequence
ttgtattttagtagagatgg

SEQ ID NO: 566881 - DNA, 20 bp, Artificial
  CRISPR gRNA sequence
tgtattttagtagagatggt

SEQ ID NO: 566882 - DNA, 20 bp, Artificial
  CRISPR gRNA sequence
gtattttagtagagatggtg

SEQ ID NO: 566883 - DNA, 20 bp, Artificial
  CRISPR gRNA sequence
tattttagtagagatggtgt

SEQ ID NO: 566884 - DNA, 20 bp, Artificial
  CRISPR gRNA sequence
tagtagagatggtgtttcac

SEQ ID NO: 566885 - DNA, 20 bp, Artificial
  CRISPR gRNA sequence
agtagagatggtgtttcact

SEQ ID NO: 566886 - DNA, 20 bp, Artificial
  CRISPR gRNA sequence
gtagagatggtgtttcactg

SEQ ID NO: 566887 - DNA, 20 bp, Artificial
  CRISPR gRNA sequence
cactgtgttggccaggctgg

SEQ ID NO: 566888 - DNA, 20 bp, Artificial
  CRISPR gRNA sequence
actgtgttggccaggctggt

SEQ ID NO: 566889 - DNA, 20 bp, Artificial
  CRISPR gRNA sequence
tgttggccaggctggtctca

SEQ ID NO: 566890 - DNA, 20 bp, Artificial
  CRISPR gRNA sequence
gccaggctggtctcaaactc

SEQ ID NO: 566891 - DNA, 20 bp, Artificial
  CRISPR gRNA sequence
gtctcaaactcctgagctca

SEQ ID NO: 566892 - DNA, 20 bp, Artificial
  CRISPR gRNA sequence
aaactcctgagctcaggtga

SEQ ID NO: 566893 - DNA, 20 bp, Artificial
  CRISPR gRNA sequence
ctgagctcaggtgatccacc

SEQ ID NO: 566894 - DNA, 20 bp, Artificial
  CRISPR gRNA sequence
agctcaggtgatccacccgc

SEQ ID NO: 566895 - DNA, 20 bp, Artificial
  CRISPR gRNA sequence
aggtgatccacccgcctcag

SEQ ID NO: 566896 - DNA, 20 bp, Artificial
  CRISPR gRNA sequence
agcctcccaaagtgctggga

SEQ ID NO: 566897 - DNA, 20 bp, Artificial
  CRISPR gRNA sequence
ccaaagtgctgggattacac

SEQ ID NO: 566898 - DNA, 20 bp, Artificial
  CRISPR gRNA sequence
ggattacactcatgagccac

SEQ ID NO: 566899 - DNA, 20 bp, Artificial
  CRISPR gRNA sequence
cactcatgagccaccacacc

SEQ ID NO: 566900 - DNA, 20 bp, Artificial
  CRISPR gRNA sequence
atgagccaccacacccagct

SEQ ID NO: 566901 - DNA, 20 bp, Artificial
  CRISPR gRNA sequence
ctgcaccattttaaactgaa

SEQ ID NO: 566902 - DNA, 20 bp, Artificial
  CRISPR gRNA sequence
caccattttaaactgaaact

SEQ ID NO: 566903 - DNA, 20 bp, Artificial
  CRISPR gRNA sequence
taaactgaaactagagagag

SEQ ID NO: 566904 - DNA, 20 bp, Artificial
  CRISPR gRNA sequence
aaactgaaactagagagagg

SEQ ID NO: 566905 - DNA, 20 bp, Artificial
  CRISPR gRNA sequence
aactgaaactagagagaggg

SEQ ID NO: 566906 - DNA, 20 bp, Artificial
  CRISPR gRNA sequence
aaactagagagaggggacac

SEQ ID NO: 566907 - DNA, 20 bp, Artificial
  CRISPR gRNA sequence
gagagaggggacacatttct

SEQ ID NO: 566908 - DNA, 20 bp, Artificial
  CRISPR gRNA sequence
ctccctgcttctcactgaca

SEQ ID NO: 566909 - DNA, 20 bp, Artificial
  CRISPR gRNA sequence
tccctgcttctcactgacac

SEQ ID NO: 566910 - DNA, 20 bp, Artificial
  CRISPR gRNA sequence
cctgcttctcactgacactc

SEQ ID NO: 566911 - DNA, 20 bp, Artificial
  CRISPR gRNA sequence
cttctcactgacactcctcc

SEQ ID NO: 566912 - DNA, 20 bp, Artificial
  CRISPR gRNA sequence
ctcactgacactcctccctg

SEQ ID NO: 566913 - DNA, 20 bp, Artificial
  CRISPR gRNA sequence
tcactgacactcctccctgg

SEQ ID NO: 566914 - DNA, 20 bp, Artificial
  CRISPR gRNA sequence
actgacactcctccctggtc

SEQ ID NO: 566915 - DNA, 20 bp, Artificial
  CRISPR gRNA sequence
acactcctccctggtctcta

SEQ ID NO: 566916 - DNA, 20 bp, Artificial
  CRISPR gRNA sequence
ctccctggtctctaaagccc

SEQ ID NO: 566917 - DNA, 20 bp, Artificial
  CRISPR gRNA sequence
cctggtctctaaagcccctt

SEQ ID NO: 566918 - DNA, 20 bp, Artificial
  CRISPR gRNA sequence
gtctctaaagccccttttgt

SEQ ID NO: 566919 - DNA, 20 bp, Artificial
  CRISPR gRNA sequence
taaagccccttttgtgttgc

SEQ ID NO: 566920 - DNA, 20 bp, Artificial
  CRISPR gRNA sequence
aagccccttttgtgttgcag

SEQ ID NO: 566921 - DNA, 20 bp, Artificial
  CRISPR gRNA sequence
ttgtgttgcagtcttgtata

SEQ ID NO: 566922 - DNA, 20 bp, Artificial
  CRISPR gRNA sequence
tgtgttgcagtcttgtatag

SEQ ID NO: 566923 - DNA, 20 bp, Artificial
  CRISPR gRNA sequence
gtgttgcagtcttgtatagg

SEQ ID NO: 566924 - DNA, 20 bp, Artificial
  CRISPR gRNA sequence
tgttgcagtcttgtataggc

SEQ ID NO: 566925 - DNA, 20 bp, Artificial
  CRISPR gRNA sequence
cagtcttgtataggcccctg

SEQ ID NO: 566926 - DNA, 20 bp, Artificial
  CRISPR gRNA sequence
gtataggcccctgcctcaca

SEQ ID NO: 566927 - DNA, 20 bp, Artificial
  CRISPR gRNA sequence
tataggcccctgcctcacat

SEQ ID NO: 566928 - DNA, 20 bp, Artificial
  CRISPR gRNA sequence
cctcacatgccagtgtttct

SEQ ID NO: 566929 - DNA, 20 bp, Artificial
  CRISPR gRNA sequence
acatgccagtgtttcttggt

SEQ ID NO: 566930 - DNA, 20 bp, Artificial
  CRISPR gRNA sequence
cttggtcattttaaggcctg

SEQ ID NO: 566931 - DNA, 20 bp, Artificial
  CRISPR gRNA sequence
ttggtcattttaaggcctgc

SEQ ID NO: 566932 - DNA, 20 bp, Artificial
  CRISPR gRNA sequence
ggtcattttaaggcctgcct

SEQ ID NO: 566933 - DNA, 20 bp, Artificial
  CRISPR gRNA sequence
gtcattttaaggcctgcctc

SEQ ID NO: 566934 - DNA, 20 bp, Artificial
  CRISPR gRNA sequence
taaggcctgcctcattttca

SEQ ID NO: 566935 - DNA, 20 bp, Artificial
  CRISPR gRNA sequence
aaggcctgcctcattttcat

SEQ ID NO: 566936 - DNA, 20 bp, Artificial
  CRISPR gRNA sequence
aggcctgcctcattttcatt

SEQ ID NO: 566937 - DNA, 20 bp, Artificial
  CRISPR gRNA sequence
cctcattttcattgtttctg

SEQ ID NO: 566938 - DNA, 20 bp, Artificial
  CRISPR gRNA sequence
attttcattgtttctgacat

SEQ ID NO: 566939 - DNA, 20 bp, Artificial
  CRISPR gRNA sequence
tcattgtttctgacattcct

SEQ ID NO: 566940 - DNA, 20 bp, Artificial
  CRISPR gRNA sequence
cattgtttctgacattcctg

SEQ ID NO: 566941 - DNA, 20 bp, Artificial
  CRISPR gRNA sequence
attgtttctgacattcctgg

SEQ ID NO: 566942 - DNA, 20 bp, Artificial
  CRISPR gRNA sequence
tttctgacattcctggtgtc

SEQ ID NO: 566943 - DNA, 20 bp, Artificial
  CRISPR gRNA sequence
ctgacattcctggtgtcttg

SEQ ID NO: 566944 - DNA, 20 bp, Artificial
  CRISPR gRNA sequence
tgacattcctggtgtcttgg

SEQ ID NO: 566945 - DNA, 20 bp, Artificial
  CRISPR gRNA sequence
acattcctggtgtcttggtg

SEQ ID NO: 566946 - DNA, 20 bp, Artificial
  CRISPR gRNA sequence
ctggtgtcttggtggttgca

SEQ ID NO: 566947 - DNA, 20 bp, Artificial
  CRISPR gRNA sequence
gtgtcttggtggttgcaata

SEQ ID NO: 566948 - DNA, 20 bp, Artificial
  CRISPR gRNA sequence
ggtggttgcaatatttaaat

SEQ ID NO: 566949 - DNA, 20 bp, Artificial
  CRISPR gRNA sequence
gtggttgcaatatttaaatt

SEQ ID NO: 566950 - DNA, 20 bp, Artificial
  CRISPR gRNA sequence
caatatttaaattaaaattc

SEQ ID NO: 566951 - DNA, 20 bp, Artificial
  CRISPR gRNA sequence
aaattaaaattctttcaata

SEQ ID NO: 566952 - DNA, 20 bp, Artificial
  CRISPR gRNA sequence
aattaaaattctttcaatat

SEQ ID NO: 566953 - DNA, 20 bp, Artificial
  CRISPR gRNA sequence
aaattctttcaatattgtcc

SEQ ID NO: 566954 - DNA, 20 bp, Artificial
  CRISPR gRNA sequence
tttcaatattgtccttgatc

SEQ ID NO: 566955 - DNA, 20 bp, Artificial
  CRISPR gRNA sequence
tcaatattgtccttgatcgc

SEQ ID NO: 566956 - DNA, 20 bp, Artificial
  CRISPR gRNA sequence
caatattgtccttgatcgcc

SEQ ID NO: 566957 - DNA, 20 bp, Artificial
  CRISPR gRNA sequence
aatattgtccttgatcgcct

SEQ ID NO: 566958 - DNA, 20 bp, Artificial
  CRISPR gRNA sequence
tccttgatcgcctctcctgt

SEQ ID NO: 566959 - DNA, 20 bp, Artificial
  CRISPR gRNA sequence
gatcgcctctcctgtaagga

SEQ ID NO: 566960 - DNA, 20 bp, Artificial
  CRISPR gRNA sequence
atcgcctctcctgtaaggat

SEQ ID NO: 566961 - DNA, 20 bp, Artificial
  CRISPR gRNA sequence
tcctgtaaggatcttttcct

SEQ ID NO: 566962 - DNA, 20 bp, Artificial
  CRISPR gRNA sequence
ctgtaaggatcttttcctct

SEQ ID NO: 566963 - DNA, 20 bp, Artificial
  CRISPR gRNA sequence
taaggatcttttcctctacg

SEQ ID NO: 566964 - DNA, 20 bp, Artificial
  CRISPR gRNA sequence
ttcctctacgttacccacta

SEQ ID NO: 566965 - DNA, 20 bp, Artificial
  CRISPR gRNA sequence
tcctctacgttacccactac

SEQ ID NO: 566966 - DNA, 20 bp, Artificial
  CRISPR gRNA sequence
cctctacgttacccactacc

SEQ ID NO: 566967 - DNA, 20 bp, Artificial
  CRISPR gRNA sequence
ctctacgttacccactaccc

SEQ ID NO: 566968 - DNA, 20 bp, Artificial
  CRISPR gRNA sequence
tacgttacccactacccatg

SEQ ID NO: 566969 - DNA, 20 bp, Artificial
  CRISPR gRNA sequence
cgttacccactacccatgga

SEQ ID NO: 566970 - DNA, 20 bp, Artificial
  CRISPR gRNA sequence
cccactacccatggatgtaa

SEQ ID NO: 566971 - DNA, 20 bp, Artificial
  CRISPR gRNA sequence
cccatggatgtaaccgagaa

SEQ ID NO: 566972 - DNA, 20 bp, Artificial
  CRISPR gRNA sequence
atcattacctcaatgtcagg

SEQ ID NO: 566973 - DNA, 20 bp, Artificial
  CRISPR gRNA sequence
cctcaatgtcaggtgtctca

SEQ ID NO: 566974 - DNA, 20 bp, Artificial
  CRISPR gRNA sequence
aatgtcaggtgtctcactct

SEQ ID NO: 566975 - DNA, 20 bp, Artificial
  CRISPR gRNA sequence
actctgaccaccatgccctg

SEQ ID NO: 566976 - DNA, 20 bp, Artificial
  CRISPR gRNA sequence
tgaccaccatgccctgtcct

SEQ ID NO: 566977 - DNA, 20 bp, Artificial
  CRISPR gRNA sequence
accaccatgccctgtccttg

SEQ ID NO: 566978 - DNA, 20 bp, Artificial
  CRISPR gRNA sequence
tccttgatgatgctgatgct

SEQ ID NO: 566979 - DNA, 20 bp, Artificial
  CRISPR gRNA sequence
gatgatgctgatgctgacag

SEQ ID NO: 566980 - DNA, 20 bp, Artificial
  CRISPR gRNA sequence
atgatgctgatgctgacagt

SEQ ID NO: 566981 - DNA, 20 bp, Artificial
  CRISPR gRNA sequence
atgctgacagtccttcacac

SEQ ID NO: 566982 - DNA, 20 bp, Artificial
  CRISPR gRNA sequence
acagtccttcacacacctga

SEQ ID NO: 566983 - DNA, 20 bp, Artificial
  CRISPR gRNA sequence
cacacacctgatgtccctgc

SEQ ID NO: 566984 - DNA, 20 bp, Artificial
  CRISPR gRNA sequence
acacacctgatgtccctgct

SEQ ID NO: 566985 - DNA, 20 bp, Artificial
  CRISPR gRNA sequence
atgtccctgctgccctccct

SEQ ID NO: 566986 - DNA, 20 bp, Artificial
  CRISPR gRNA sequence
ctgccctccctactcagcct

SEQ ID NO: 566987 - DNA, 20 bp, Artificial
  CRISPR gRNA sequence
ccctccctactcagcctgag

SEQ ID NO: 566988 - DNA, 20 bp, Artificial
  CRISPR gRNA sequence
cctactcagcctgagtgctg

SEQ ID NO: 566989 - DNA, 20 bp, Artificial
  CRISPR gRNA sequence
ctcagcctgagtgctgttgt

SEQ ID NO: 566990 - DNA, 20 bp, Artificial
  CRISPR gRNA sequence
agcctgagtgctgttgtcac

SEQ ID NO: 566991 - DNA, 20 bp, Artificial
  CRISPR gRNA sequence
agtgctgttgtcactcacta

SEQ ID NO: 566992 - DNA, 20 bp, Artificial
  CRISPR gRNA sequence
ttgtcactcactagactcag

SEQ ID NO: 566993 - DNA, 20 bp, Artificial
  CRISPR gRNA sequence
tcactcactagactcagtcc

SEQ ID NO: 566994 - DNA, 20 bp, Artificial
  CRISPR gRNA sequence
actagactcagtccgttgca

SEQ ID NO: 566995 - DNA, 20 bp, Artificial
  CRISPR gRNA sequence
gactcagtccgttgcagaca

SEQ ID NO: 566996 - DNA, 20 bp, Artificial
  CRISPR gRNA sequence
agtccgttgcagacacactt

SEQ ID NO: 566997 - DNA, 20 bp, Artificial
  CRISPR gRNA sequence
cagacacacttagcttcctt

SEQ ID NO: 566998 - DNA, 20 bp, Artificial
  CRISPR gRNA sequence
agcttccttgctcctttgct

SEQ ID NO: 566999 - DNA, 20 bp, Artificial
  CRISPR gRNA sequence
gcttccttgctcctttgctg

SEQ ID NO: 567000 - DNA, 20 bp, Artificial
  CRISPR gRNA sequence
ccttgctcctttgctggctt

SEQ ID NO: 567001 - DNA, 20 bp, Artificial
  CRISPR gRNA sequence
cttgctcctttgctggcttg

SEQ ID NO: 567002 - DNA, 20 bp, Artificial
  CRISPR gRNA sequence
gctcctttgctggcttgtca

SEQ ID NO: 567003 - DNA, 20 bp, Artificial
  CRISPR gRNA sequence
ctcctttgctggcttgtcat

SEQ ID NO: 567004 - DNA, 20 bp, Artificial
  CRISPR gRNA sequence
ctttgctggcttgtcatact

SEQ ID NO: 567005 - DNA, 20 bp, Artificial
  CRISPR gRNA sequence
tgctggcttgtcatactcgc

SEQ ID NO: 567006 - DNA, 20 bp, Artificial
  CRISPR gRNA sequence
gctggcttgtcatactcgca

SEQ ID NO: 567007 - DNA, 20 bp, Artificial
  CRISPR gRNA sequence
ctggcttgtcatactcgcat

SEQ ID NO: 567008 - DNA, 20 bp, Artificial
  CRISPR gRNA sequence
gcttgtcatactcgcatggc

SEQ ID NO: 567009 - DNA, 20 bp, Artificial
  CRISPR gRNA sequence
gtcatactcgcatggccaga

SEQ ID NO: 567010 - DNA, 20 bp, Artificial
  CRISPR gRNA sequence
tcatactcgcatggccagat

SEQ ID NO: 567011 - DNA, 20 bp, Artificial
  CRISPR gRNA sequence
gcatggccagattacagcta

SEQ ID NO: 567012 - DNA, 20 bp, Artificial
  CRISPR gRNA sequence
cagctagattaagtccgctg

SEQ ID NO: 567013 - DNA, 20 bp, Artificial
  CRISPR gRNA sequence
gattaagtccgctgctttgc

SEQ ID NO: 567014 - DNA, 20 bp, Artificial
  CRISPR gRNA sequence
agtccgctgctttgcctatt

SEQ ID NO: 567015 - DNA, 20 bp, Artificial
  CRISPR gRNA sequence
ctttgcctattctgtgctca

SEQ ID NO: 567016 - DNA, 20 bp, Artificial
  CRISPR gRNA sequence
tgcctattctgtgctcacac

SEQ ID NO: 567017 - DNA, 20 bp, Artificial
  CRISPR gRNA sequence
gcctattctgtgctcacacc

SEQ ID NO: 567018 - DNA, 20 bp, Artificial
  CRISPR gRNA sequence
cctattctgtgctcacaccc

SEQ ID NO: 567019 - DNA, 20 bp, Artificial
  CRISPR gRNA sequence
ttctgtgctcacacccatgt

SEQ ID NO: 567020 - DNA, 20 bp, Artificial
  CRISPR gRNA sequence
tgtgctcacacccatgtggt

SEQ ID NO: 567021 - DNA, 20 bp, Artificial
  CRISPR gRNA sequence
tgctcacacccatgtggttg

SEQ ID NO: 567022 - DNA, 20 bp, Artificial
  CRISPR gRNA sequence
acacccatgtggttgcagaa

SEQ ID NO: 567023 - DNA, 20 bp, Artificial
  CRISPR gRNA sequence
cagaaaaatacaccacccta

SEQ ID NO: 567024 - DNA, 20 bp, Artificial
  CRISPR gRNA sequence
caaagtcctgcacttttaat

SEQ ID NO: 567025 - DNA, 20 bp, Artificial
  CRISPR gRNA sequence
cacttttaatttctctaatc

SEQ ID NO: 567026 - DNA, 20 bp, Artificial
  CRISPR gRNA sequence
ttaatttctctaatcactta

SEQ ID NO: 567027 - DNA, 20 bp, Artificial
  CRISPR gRNA sequence
taatttctctaatcacttac

SEQ ID NO: 567028 - DNA, 20 bp, Artificial
  CRISPR gRNA sequence
aatttctctaatcacttacc

SEQ ID NO: 567029 - DNA, 20 bp, Artificial
  CRISPR gRNA sequence
atttctctaatcacttacct

SEQ ID NO: 567030 - DNA, 20 bp, Artificial
  CRISPR gRNA sequence
ctctaatcacttacctcaat

SEQ ID NO: 567031 - DNA, 20 bp, Artificial
  CRISPR gRNA sequence
tctaatcacttacctcaatt

SEQ ID NO: 567032 - DNA, 20 bp, Artificial
  CRISPR gRNA sequence
taatcacttacctcaattaa

SEQ ID NO: 567033 - DNA, 20 bp, Artificial
  CRISPR gRNA sequence
atcacttacctcaattaagt

SEQ ID NO: 567034 - DNA, 20 bp, Artificial
  CRISPR gRNA sequence
acctcaattaagttggtatt

SEQ ID NO: 567035 - DNA, 20 bp, Artificial
  CRISPR gRNA sequence
cctcaattaagttggtattt

SEQ ID NO: 567036 - DNA, 20 bp, Artificial
  CRISPR gRNA sequence
aattaagttggtatttccta

SEQ ID NO: 567037 - DNA, 20 bp, Artificial
  CRISPR gRNA sequence
agttggtatttcctagcctg

SEQ ID NO: 567038 - DNA, 20 bp, Artificial
  CRISPR gRNA sequence
gtatttcctagcctgttcac

SEQ ID NO: 567039 - DNA, 20 bp, Artificial
  CRISPR gRNA sequence
cctagcctgttcacttaccc

SEQ ID NO: 567040 - DNA, 20 bp, Artificial
  CRISPR gRNA sequence
ctagcctgttcacttaccca

SEQ ID NO: 567041 - DNA, 20 bp, Artificial
  CRISPR gRNA sequence
gcctgttcacttacccactc

SEQ ID NO: 567042 - DNA, 20 bp, Artificial
  CRISPR gRNA sequence
ttcacttacccactctccta

SEQ ID NO: 567043 - DNA, 20 bp, Artificial
  CRISPR gRNA sequence
acttacccactctcctagca

SEQ ID NO: 567044 - DNA, 20 bp, Artificial
  CRISPR gRNA sequence
acccactctcctagcagtta

SEQ ID NO: 567045 - DNA, 20 bp, Artificial
  CRISPR gRNA sequence
cccactctcctagcagttac

SEQ ID NO: 567046 - DNA, 20 bp, Artificial
  CRISPR gRNA sequence
tcctagcagttactttttct

SEQ ID NO: 567047 - DNA, 20 bp, Artificial
  CRISPR gRNA sequence
ctagcagttactttttctct

SEQ ID NO: 567048 - DNA, 20 bp, Artificial
  CRISPR gRNA sequence
gcagttactttttctctcct

SEQ ID NO: 567049 - DNA, 20 bp, Artificial
  CRISPR gRNA sequence
ctttttctctcctcaaatct

SEQ ID NO: 567050 - DNA, 20 bp, Artificial
  CRISPR gRNA sequence
tttctctcctcaaatcttga

SEQ ID NO: 567051 - DNA, 20 bp, Artificial
  CRISPR gRNA sequence
ttctctcctcaaatcttgaa

SEQ ID NO: 567052 - DNA, 20 bp, Artificial
  CRISPR gRNA sequence
tctctcctcaaatcttgaat

SEQ ID NO: 567053 - DNA, 20 bp, Artificial
  CRISPR gRNA sequence
ctctcctcaaatcttgaata

SEQ ID NO: 567054 - DNA, 20 bp, Artificial
  CRISPR gRNA sequence
tctcctcaaatcttgaatac

SEQ ID NO: 567055 - DNA, 20 bp, Artificial
  CRISPR gRNA sequence
tcctcaaatcttgaatacct

SEQ ID NO: 567056 - DNA, 20 bp, Artificial
  CRISPR gRNA sequence
ctcaaatcttgaatacctcc

SEQ ID NO: 567057 - DNA, 20 bp, Artificial
  CRISPR gRNA sequence
aaatcttgaatacctccttc

SEQ ID NO: 567058 - DNA, 20 bp, Artificial
  CRISPR gRNA sequence
gaatacctccttctctagac

SEQ ID NO: 567059 - DNA, 20 bp, Artificial
  CRISPR gRNA sequence
aatacctccttctctagact

SEQ ID NO: 567060 - DNA, 20 bp, Artificial
  CRISPR gRNA sequence
cttctctagactgactcttc

SEQ ID NO: 567061 - DNA, 20 bp, Artificial
  CRISPR gRNA sequence
ctctagactgactcttcagc

SEQ ID NO: 567062 - DNA, 20 bp, Artificial
  CRISPR gRNA sequence
tctagactgactcttcagct

SEQ ID NO: 567063 - DNA, 20 bp, Artificial
  CRISPR gRNA sequence
tagactgactcttcagctga

SEQ ID NO: 567064 - DNA, 20 bp, Artificial
  CRISPR gRNA sequence
gactgactcttcagctgaag

SEQ ID NO: 567065 - DNA, 20 bp, Artificial
  CRISPR gRNA sequence
actcttcagctgaaggcttt

SEQ ID NO: 567066 - DNA, 20 bp, Artificial
  CRISPR gRNA sequence
ttcagctgaaggctttgctt

SEQ ID NO: 567067 - DNA, 20 bp, Artificial
  CRISPR gRNA sequence
cagctgaaggctttgcttct

SEQ ID NO: 567068 - DNA, 20 bp, Artificial
  CRISPR gRNA sequence
agctgaaggctttgcttctt

SEQ ID NO: 567069 - DNA, 20 bp, Artificial
  CRISPR gRNA sequence
aaggctttgcttcttatttc

SEQ ID NO: 567070 - DNA, 20 bp, Artificial
  CRISPR gRNA sequence
tgcttcttatttcactaagg

SEQ ID NO: 567071 - DNA, 20 bp, Artificial
  CRISPR gRNA sequence
gcttcttatttcactaagga

SEQ ID NO: 567072 - DNA, 20 bp, Artificial
  CRISPR gRNA sequence
cttcttatttcactaaggag

SEQ ID NO: 567073 - DNA, 20 bp, Artificial
  CRISPR gRNA sequence
cttatttcactaaggagaat

SEQ ID NO: 567074 - DNA, 20 bp, Artificial
  CRISPR gRNA sequence
ttatttcactaaggagaata

SEQ ID NO: 567075 - DNA, 20 bp, Artificial
  CRISPR gRNA sequence
atttcactaaggagaataag

SEQ ID NO: 567076 - DNA, 20 bp, Artificial
  CRISPR gRNA sequence
tttcactaaggagaataagc

SEQ ID NO: 567077 - DNA, 20 bp, Artificial
  CRISPR gRNA sequence
cactaaggagaataagcaat

SEQ ID NO: 567078 - DNA, 20 bp, Artificial
  CRISPR gRNA sequence
actaaggagaataagcaatc

SEQ ID NO: 567079 - DNA, 20 bp, Artificial
  CRISPR gRNA sequence
aggagaataagcaatcagag

SEQ ID NO: 567080 - DNA, 20 bp, Artificial
  CRISPR gRNA sequence
ccacaagctctcaccacctg

SEQ ID NO: 567081 - DNA, 20 bp, Artificial
  CRISPR gRNA sequence
cacaagctctcaccacctgc

SEQ ID NO: 567082 - DNA, 20 bp, Artificial
  CRISPR gRNA sequence
tcaccacctgcctaccttcc

SEQ ID NO: 567083 - DNA, 20 bp, Artificial
  CRISPR gRNA sequence
accacctgcctaccttccta

SEQ ID NO: 567084 - DNA, 20 bp, Artificial
  CRISPR gRNA sequence
cctaccttcctacccatacc

SEQ ID NO: 567085 - DNA, 20 bp, Artificial
  CRISPR gRNA sequence
ccttcctacccatacctgag

SEQ ID NO: 567086 - DNA, 20 bp, Artificial
  CRISPR gRNA sequence
cctacccatacctgagcctg

SEQ ID NO: 567087 - DNA, 20 bp, Artificial
  CRISPR gRNA sequence
ctacccatacctgagcctgt

SEQ ID NO: 567088 - DNA, 20 bp, Artificial
  CRISPR gRNA sequence
cccatacctgagcctgtagg

SEQ ID NO: 567089 - DNA, 20 bp, Artificial
  CRISPR gRNA sequence
agcctgtaggccctgctttc

SEQ ID NO: 567090 - DNA, 20 bp, Artificial
  CRISPR gRNA sequence
taggccctgctttctctcct

SEQ ID NO: 567091 - DNA, 20 bp, Artificial
  CRISPR gRNA sequence
ctttctctcctgatatgaat

SEQ ID NO: 567092 - DNA, 20 bp, Artificial
  CRISPR gRNA sequence
tctctcctgatatgaatgga

SEQ ID NO: 567093 - DNA, 20 bp, Artificial
  CRISPR gRNA sequence
ctctcctgatatgaatggac

SEQ ID NO: 567094 - DNA, 20 bp, Artificial
  CRISPR gRNA sequence
tctcctgatatgaatggact

SEQ ID NO: 567095 - DNA, 20 bp, Artificial
  CRISPR gRNA sequence
tcctgatatgaatggacttt

SEQ ID NO: 567096 - DNA, 20 bp, Artificial
  CRISPR gRNA sequence
ctgatatgaatggactttct

SEQ ID NO: 567097 - DNA, 20 bp, Artificial
  CRISPR gRNA sequence
atatgaatggactttctgag

SEQ ID NO: 567098 - DNA, 20 bp, Artificial
  CRISPR gRNA sequence
tctgagttctcacctgaagt

SEQ ID NO: 567099 - DNA, 20 bp, Artificial
  CRISPR gRNA sequence
ctgagttctcacctgaagtt

SEQ ID NO: 567100 - DNA, 20 bp, Artificial
  CRISPR gRNA sequence
tgagttctcacctgaagtta

SEQ ID NO: 567101 - DNA, 20 bp, Artificial
  CRISPR gRNA sequence
agttctcacctgaagttaaa

SEQ ID NO: 567102 - DNA, 20 bp, Artificial
  CRISPR gRNA sequence
tcacctgaagttaaactttc

SEQ ID NO: 567103 - DNA, 20 bp, Artificial
  CRISPR gRNA sequence
acctgaagttaaactttcca

SEQ ID NO: 567104 - DNA, 20 bp, Artificial
  CRISPR gRNA sequence
aagttaaactttccacgtgt

SEQ ID NO: 567105 - DNA, 20 bp, Artificial
  CRISPR gRNA sequence
aactttccacgtgtgccctg

SEQ ID NO: 567106 - DNA, 20 bp, Artificial
  CRISPR gRNA sequence
tccacgtgtgccctggatcc

SEQ ID NO: 567107 - DNA, 20 bp, Artificial
  CRISPR gRNA sequence
ccacgtgtgccctggatccc

SEQ ID NO: 567108 - DNA, 20 bp, Artificial
  CRISPR gRNA sequence
cacgtgtgccctggatccca

SEQ ID NO: 567109 - DNA, 20 bp, Artificial
  CRISPR gRNA sequence
gatcccacctcctcttgccg

SEQ ID NO: 567110 - DNA, 20 bp, Artificial
  CRISPR gRNA sequence
ctcttgccgtcctcgggaat

SEQ ID NO: 567111 - DNA, 20 bp, Artificial
  CRISPR gRNA sequence
ttgccgtcctcgggaatatc

SEQ ID NO: 567112 - DNA, 20 bp, Artificial
  CRISPR gRNA sequence
gccgtcctcgggaatatcac

SEQ ID NO: 567113 - DNA, 20 bp, Artificial
  CRISPR gRNA sequence
ccgtcctcgggaatatcacc

SEQ ID NO: 567114 - DNA, 20 bp, Artificial
  CRISPR gRNA sequence
gggaatatcaccctagtgct

SEQ ID NO: 567115 - DNA, 20 bp, Artificial
  CRISPR gRNA sequence
gtgcttctacccactctctc

SEQ ID NO: 567116 - DNA, 20 bp, Artificial
  CRISPR gRNA sequence
ctacccactctctcctgatg

SEQ ID NO: 567117 - DNA, 20 bp, Artificial
  CRISPR gRNA sequence
tacccactctctcctgatga

SEQ ID NO: 567118 - DNA, 20 bp, Artificial
  CRISPR gRNA sequence
cccactctctcctgatgaga

SEQ ID NO: 567119 - DNA, 20 bp, Artificial
  CRISPR gRNA sequence
tctcctgatgagaatttccc

SEQ ID NO: 567120 - DNA, 20 bp, Artificial
  CRISPR gRNA sequence
tcctgatgagaatttccccc

SEQ ID NO: 567121 - DNA, 20 bp, Artificial
  CRISPR gRNA sequence
ctgatgagaatttcccccat

SEQ ID NO: 567122 - DNA, 20 bp, Artificial
  CRISPR gRNA sequence
atgagaatttcccccataag

SEQ ID NO: 567123 - DNA, 20 bp, Artificial
  CRISPR gRNA sequence
cccccataagttgatggttc

SEQ ID NO: 567124 - DNA, 20 bp, Artificial
  CRISPR gRNA sequence
ccccataagttgatggttca

SEQ ID NO: 567125 - DNA, 20 bp, Artificial
  CRISPR gRNA sequence
atggttcattttaagtggca

SEQ ID NO: 567126 - DNA, 20 bp, Artificial
  CRISPR gRNA sequence
attttaagtggcatacatat

SEQ ID NO: 567127 - DNA, 20 bp, Artificial
  CRISPR gRNA sequence
taagtggcatacatatatac

SEQ ID NO: 567128 - DNA, 20 bp, Artificial
  CRISPR gRNA sequence
aagtggcatacatatatact

SEQ ID NO: 567129 - DNA, 20 bp, Artificial
  CRISPR gRNA sequence
agtggcatacatatatactg

SEQ ID NO: 567130 - DNA, 20 bp, Artificial
  CRISPR gRNA sequence
tcattaaaactttctcatga

SEQ ID NO: 567131 - DNA, 20 bp, Artificial
  CRISPR gRNA sequence
aaactttctcatgatccctg

SEQ ID NO: 567132 - DNA, 20 bp, Artificial
  CRISPR gRNA sequence
tctcatgatccctgtacccc

SEQ ID NO: 567133 - DNA, 20 bp, Artificial
  CRISPR gRNA sequence
ctcatgatccctgtacccct

SEQ ID NO: 567134 - DNA, 20 bp, Artificial
  CRISPR gRNA sequence
tcatgatccctgtacccctc

SEQ ID NO: 567135 - DNA, 20 bp, Artificial
  CRISPR gRNA sequence
atgatccctgtacccctcca

SEQ ID NO: 567136 - DNA, 20 bp, Artificial
  CRISPR gRNA sequence
tacccctccagccaccacca

SEQ ID NO: 567137 - DNA, 20 bp, Artificial
  CRISPR gRNA sequence
cagccaccaccacctgctgt

SEQ ID NO: 567138 - DNA, 20 bp, Artificial
  CRISPR gRNA sequence
ctgtcttcactttatagaaa

SEQ ID NO: 567139 - DNA, 20 bp, Artificial
  CRISPR gRNA sequence
tcttcactttatagaaaatc

SEQ ID NO: 567140 - DNA, 20 bp, Artificial
  CRISPR gRNA sequence
cactttatagaaaatctcct

SEQ ID NO: 567141 - DNA, 20 bp, Artificial
  CRISPR gRNA sequence
actttatagaaaatctcctt

SEQ ID NO: 567142 - DNA, 20 bp, Artificial
  CRISPR gRNA sequence
tatagaaaatctccttgaag

SEQ ID NO: 567143 - DNA, 20 bp, Artificial
  CRISPR gRNA sequence
atagaaaatctccttgaaga

SEQ ID NO: 567144 - DNA, 20 bp, Artificial
  CRISPR gRNA sequence
tagaaaatctccttgaagaa

SEQ ID NO: 567145 - DNA, 20 bp, Artificial
  CRISPR gRNA sequence
cttgaagaagttgtccatat

SEQ ID NO: 567146 - DNA, 20 bp, Artificial
  CRISPR gRNA sequence
gaagaagttgtccatattca

SEQ ID NO: 567147 - DNA, 20 bp, Artificial
  CRISPR gRNA sequence
aagaagttgtccatattcac

SEQ ID NO: 567148 - DNA, 20 bp, Artificial
  CRISPR gRNA sequence
tccatattcacttattctga

SEQ ID NO: 567149 - DNA, 20 bp, Artificial
  CRISPR gRNA sequence
acttattctgatcccttata

SEQ ID NO: 567150 - DNA, 20 bp, Artificial
  CRISPR gRNA sequence
attctgatcccttatattca

SEQ ID NO: 567151 - DNA, 20 bp, Artificial
  CRISPR gRNA sequence
ttctgatcccttatattcac

SEQ ID NO: 567152 - DNA, 20 bp, Artificial
  CRISPR gRNA sequence
tgatcccttatattcacttt

SEQ ID NO: 567153 - DNA, 20 bp, Artificial
  CRISPR gRNA sequence
atcccttatattcactttta

SEQ ID NO: 567154 - DNA, 20 bp, Artificial
  CRISPR gRNA sequence
atattcacttttaacccact

SEQ ID NO: 567155 - DNA, 20 bp, Artificial
  CRISPR gRNA sequence
tattcacttttaacccactc

SEQ ID NO: 567156 - DNA, 20 bp, Artificial
  CRISPR gRNA sequence
acttttaacccactccaaat

SEQ ID NO: 567157 - DNA, 20 bp, Artificial
  CRISPR gRNA sequence
ttaacccactccaaataggc

SEQ ID NO: 567158 - DNA, 20 bp, Artificial
  CRISPR gRNA sequence
taacccactccaaataggct

SEQ ID NO: 567159 - DNA, 20 bp, Artificial
  CRISPR gRNA sequence
aacccactccaaataggctt

SEQ ID NO: 567160 - DNA, 20 bp, Artificial
  CRISPR gRNA sequence
acccactccaaataggcttt

SEQ ID NO: 567161 - DNA, 20 bp, Artificial
  CRISPR gRNA sequence
caaataggctttcatctgca

SEQ ID NO: 567162 - DNA, 20 bp, Artificial
  CRISPR gRNA sequence
tcatctgcactgctatgcca

SEQ ID NO: 567163 - DNA, 20 bp, Artificial
  CRISPR gRNA sequence
catctgcactgctatgccaa

SEQ ID NO: 567164 - DNA, 20 bp, Artificial
  CRISPR gRNA sequence
atctgcactgctatgccaaa

SEQ ID NO: 567165 - DNA, 20 bp, Artificial
  CRISPR gRNA sequence
cactgctatgccaaaactcc

SEQ ID NO: 567166 - DNA, 20 bp, Artificial
  CRISPR gRNA sequence
ctatgccaaaactcctctag

SEQ ID NO: 567167 - DNA, 20 bp, Artificial
  CRISPR gRNA sequence
tgccaaaactcctctagacc

SEQ ID NO: 567168 - DNA, 20 bp, Artificial
  CRISPR gRNA sequence
ctctagacctccttgttaat

SEQ ID NO: 567169 - DNA, 20 bp, Artificial
  CRISPR gRNA sequence
tagacctccttgttaataaa

SEQ ID NO: 567170 - DNA, 20 bp, Artificial
  CRISPR gRNA sequence
gacctccttgttaataaatc

SEQ ID NO: 567171 - DNA, 20 bp, Artificial
  CRISPR gRNA sequence
cttgttaataaatccagtgg

SEQ ID NO: 567172 - DNA, 20 bp, Artificial
  CRISPR gRNA sequence
gttaataaatccagtggttc

SEQ ID NO: 567173 - DNA, 20 bp, Artificial
  CRISPR gRNA sequence
ttaataaatccagtggttca

SEQ ID NO: 567174 - DNA, 20 bp, Artificial
  CRISPR gRNA sequence
ataaatccagtggttcattc

SEQ ID NO: 567175 - DNA, 20 bp, Artificial
  CRISPR gRNA sequence
attctcagtccatgtcattc

SEQ ID NO: 567176 - DNA, 20 bp, Artificial
  CRISPR gRNA sequence
tcagtccatgtcattcttga

SEQ ID NO: 567177 - DNA, 20 bp, Artificial
  CRISPR gRNA sequence
agtccatgtcattcttgact

SEQ ID NO: 567178 - DNA, 20 bp, Artificial
  CRISPR gRNA sequence
ttgacttctcagcagctttt

SEQ ID NO: 567179 - DNA, 20 bp, Artificial
  CRISPR gRNA sequence
gacttctcagcagcttttga

SEQ ID NO: 567180 - DNA, 20 bp, Artificial
  CRISPR gRNA sequence
acttctcagcagcttttgac

SEQ ID NO: 567181 - DNA, 20 bp, Artificial
  CRISPR gRNA sequence
ctcagcagcttttgacatag

SEQ ID NO: 567182 - DNA, 20 bp, Artificial
  CRISPR gRNA sequence
tcagcagcttttgacatagc

SEQ ID NO: 567183 - DNA, 20 bp, Artificial
  CRISPR gRNA sequence
agcagcttttgacatagctg

SEQ ID NO: 567184 - DNA, 20 bp, Artificial
  CRISPR gRNA sequence
ttgacatagctgatcactcc

SEQ ID NO: 567185 - DNA, 20 bp, Artificial
  CRISPR gRNA sequence
tgacatagctgatcactccc

SEQ ID NO: 567186 - DNA, 20 bp, Artificial
  CRISPR gRNA sequence
gacatagctgatcactccct

SEQ ID NO: 567187 - DNA, 20 bp, Artificial
  CRISPR gRNA sequence
acatagctgatcactccctc

SEQ ID NO: 567188 - DNA, 20 bp, Artificial
  CRISPR gRNA sequence
atcactccctcctccaagta

SEQ ID NO: 567189 - DNA, 20 bp, Artificial
  CRISPR gRNA sequence
cctcctccaagtactgtctt

SEQ ID NO: 567190 - DNA, 20 bp, Artificial
  CRISPR gRNA sequence
ctccaagtactgtcttcact

SEQ ID NO: 567191 - DNA, 20 bp, Artificial
  CRISPR gRNA sequence
caagtactgtcttcacttga

SEQ ID NO: 567192 - DNA, 20 bp, Artificial
  CRISPR gRNA sequence
tcttcacttgacatccagga

SEQ ID NO: 567193 - DNA, 20 bp, Artificial
  CRISPR gRNA sequence
cacttgacatccaggatacc

SEQ ID NO: 567194 - DNA, 20 bp, Artificial
  CRISPR gRNA sequence
acttgacatccaggatacca

SEQ ID NO: 567195 - DNA, 20 bp, Artificial
  CRISPR gRNA sequence
gacatccaggataccaccct

SEQ ID NO: 567196 - DNA, 20 bp, Artificial
  CRISPR gRNA sequence
acatccaggataccacccta

SEQ ID NO: 567197 - DNA, 20 bp, Artificial
  CRISPR gRNA sequence
ttcatgtttctttctctttt

SEQ ID NO: 567198 - DNA, 20 bp, Artificial
  CRISPR gRNA sequence
atgtttctttctcttttttc

SEQ ID NO: 567199 - DNA, 20 bp, Artificial
  CRISPR gRNA sequence
ctttctcttttttccttgag

SEQ ID NO: 567200 - DNA, 20 bp, Artificial
  CRISPR gRNA sequence
tttctcttttttccttgaga

SEQ ID NO: 567201 - DNA, 20 bp, Artificial
  CRISPR gRNA sequence
tctcttttttccttgagagg

SEQ ID NO: 567202 - DNA, 20 bp, Artificial
  CRISPR gRNA sequence
ctcttttttccttgagaggg

SEQ ID NO: 567203 - DNA, 20 bp, Artificial
  CRISPR gRNA sequence
tcttttttccttgagagggg

SEQ ID NO: 567204 - DNA, 20 bp, Artificial
  CRISPR gRNA sequence
ttttttccttgagagggggt

SEQ ID NO: 567205 - DNA, 20 bp, Artificial
  CRISPR gRNA sequence
ttttccttgagagggggttt

SEQ ID NO: 567206 - DNA, 20 bp, Artificial
  CRISPR gRNA sequence
tttccttgagagggggtttc

SEQ ID NO: 567207 - DNA, 20 bp, Artificial
  CRISPR gRNA sequence
ttccttgagagggggtttcg

SEQ ID NO: 567208 - DNA, 20 bp, Artificial
  CRISPR gRNA sequence
tccttgagagggggtttcgc

SEQ ID NO: 567209 - DNA, 20 bp, Artificial
  CRISPR gRNA sequence
ccttgagagggggtttcgcc

SEQ ID NO: 567210 - DNA, 20 bp, Artificial
  CRISPR gRNA sequence
cttgagagggggtttcgccc

SEQ ID NO: 567211 - DNA, 20 bp, Artificial
  CRISPR gRNA sequence
gagagggggtttcgcccttg

SEQ ID NO: 567212 - DNA, 20 bp, Artificial
  CRISPR gRNA sequence
agagggggtttcgcccttgt

SEQ ID NO: 567213 - DNA, 20 bp, Artificial
  CRISPR gRNA sequence
cgcccttgttgcccaggctg

SEQ ID NO: 567214 - DNA, 20 bp, Artificial
  CRISPR gRNA sequence
gcccttgttgcccaggctgg

SEQ ID NO: 567215 - DNA, 20 bp, Artificial
  CRISPR gRNA sequence
gttgcccaggctggaatgca

SEQ ID NO: 567216 - DNA, 20 bp, Artificial
  CRISPR gRNA sequence
ttgcccaggctggaatgcaa

SEQ ID NO: 567217 - DNA, 20 bp, Artificial
  CRISPR gRNA sequence
cccaggctggaatgcaatgg

SEQ ID NO: 567218 - DNA, 20 bp, Artificial
  CRISPR gRNA sequence
gaatgcaatggcgcgatctc

SEQ ID NO: 567219 - DNA, 20 bp, Artificial
  CRISPR gRNA sequence
agctcactgcaacctatgcc

SEQ ID NO: 567220 - DNA, 20 bp, Artificial
  CRISPR gRNA sequence
actgcaacctatgcctcccg

SEQ ID NO: 567221 - DNA, 20 bp, Artificial
  CRISPR gRNA sequence
caacctatgcctcccgggtt

SEQ ID NO: 567222 - DNA, 20 bp, Artificial
  CRISPR gRNA sequence
tgcctcccgggttcaagtga

SEQ ID NO: 567223 - DNA, 20 bp, Artificial
  CRISPR gRNA sequence
ccgggttcaagtgaatcttc

SEQ ID NO: 567224 - DNA, 20 bp, Artificial
  CRISPR gRNA sequence
aagtgaatcttctgcctcag

SEQ ID NO: 567225 - DNA, 20 bp, Artificial
  CRISPR gRNA sequence
ctgcctcagcctcctgaaca

SEQ ID NO: 567226 - DNA, 20 bp, Artificial
  CRISPR gRNA sequence
tgcctcagcctcctgaacag

SEQ ID NO: 567227 - DNA, 20 bp, Artificial
  CRISPR gRNA sequence
cctcagcctcctgaacagtt

SEQ ID NO: 567228 - DNA, 20 bp, Artificial
  CRISPR gRNA sequence
agcctcctgaacagttgaga

SEQ ID NO: 567229 - DNA, 20 bp, Artificial
  CRISPR gRNA sequence
ctgaacagttgagattacag

SEQ ID NO: 567230 - DNA, 20 bp, Artificial
  CRISPR gRNA sequence
aacagttgagattacaggca

SEQ ID NO: 567231 - DNA, 20 bp, Artificial
  CRISPR gRNA sequence
agattacaggcatgcaccac

SEQ ID NO: 567232 - DNA, 20 bp, Artificial
  CRISPR gRNA sequence
caggcatgcaccaccatgcc

SEQ ID NO: 567233 - DNA, 20 bp, Artificial
  CRISPR gRNA sequence
gctaattttgtatttttagt

SEQ ID NO: 567234 - DNA, 20 bp, Artificial
  CRISPR gRNA sequence
attttgtatttttagtagag

SEQ ID NO: 567235 - DNA, 20 bp, Artificial
  CRISPR gRNA sequence
tgtatttttagtagagatgg

SEQ ID NO: 567236 - DNA, 20 bp, Artificial
  CRISPR gRNA sequence
gtatttttagtagagatggg

SEQ ID NO: 567237 - DNA, 20 bp, Artificial
  CRISPR gRNA sequence
tatttttagtagagatgggg

SEQ ID NO: 567238 - DNA, 20 bp, Artificial
  CRISPR gRNA sequence
ttagtagagatggggtttca

SEQ ID NO: 567239 - DNA, 20 bp, Artificial
  CRISPR gRNA sequence
tagtagagatggggtttcac

SEQ ID NO: 567240 - DNA, 20 bp, Artificial
  CRISPR gRNA sequence
agtagagatggggtttcacc

SEQ ID NO: 567241 - DNA, 20 bp, Artificial
  CRISPR gRNA sequence
gtagagatggggtttcacca

SEQ ID NO: 567242 - DNA, 20 bp, Artificial
  CRISPR gRNA sequence
caccatgttggtcaggctgg

SEQ ID NO: 567243 - DNA, 20 bp, Artificial
  CRISPR gRNA sequence
accatgttggtcaggctggt

SEQ ID NO: 567244 - DNA, 20 bp, Artificial
  CRISPR gRNA sequence
gtcaggctggtcttgaactc

SEQ ID NO: 567245 - DNA, 20 bp, Artificial
  CRISPR gRNA sequence
gtcttgaactcctgacctca

SEQ ID NO: 567246 - DNA, 20 bp, Artificial
  CRISPR gRNA sequence
gaactcctgacctcaggtga

SEQ ID NO: 567247 - DNA, 20 bp, Artificial
  CRISPR gRNA sequence
aactcctgacctcaggtgat

SEQ ID NO: 567248 - DNA, 20 bp, Artificial
  CRISPR gRNA sequence
ctgacctcaggtgatccacc

SEQ ID NO: 567249 - DNA, 20 bp, Artificial
  CRISPR gRNA sequence
acctcaggtgatccacctgc

SEQ ID NO: 567250 - DNA, 20 bp, Artificial
  CRISPR gRNA sequence
aggtgatccacctgccttgg

SEQ ID NO: 567251 - DNA, 20 bp, Artificial
  CRISPR gRNA sequence
ccttggcctcccaaagtgtt

SEQ ID NO: 567252 - DNA, 20 bp, Artificial
  CRISPR gRNA sequence
ggcctcccaaagtgttggga

SEQ ID NO: 567253 - DNA, 20 bp, Artificial
  CRISPR gRNA sequence
gcctcccaaagtgttgggat

SEQ ID NO: 567254 - DNA, 20 bp, Artificial
  CRISPR gRNA sequence
ccaaagtgttgggattacag

SEQ ID NO: 567255 - DNA, 20 bp, Artificial
  CRISPR gRNA sequence
ggattacaggtgtgagccac

SEQ ID NO: 567256 - DNA, 20 bp, Artificial
  CRISPR gRNA sequence
caggtgtgagccactgtgcc

SEQ ID NO: 567257 - DNA, 20 bp, Artificial
  CRISPR gRNA sequence
tgcctggcttcacatttctt

SEQ ID NO: 567258 - DNA, 20 bp, Artificial
  CRISPR gRNA sequence
gcttcacatttctttctaac

SEQ ID NO: 567259 - DNA, 20 bp, Artificial
  CRISPR gRNA sequence
cacatttctttctaacacac

SEQ ID NO: 567260 - DNA, 20 bp, Artificial
  CRISPR gRNA sequence
acatttctttctaacacact

SEQ ID NO: 567261 - DNA, 20 bp, Artificial
  CRISPR gRNA sequence
ctttctaacacactgactat

SEQ ID NO: 567262 - DNA, 20 bp, Artificial
  CRISPR gRNA sequence
tttctaacacactgactatt

SEQ ID NO: 567263 - DNA, 20 bp, Artificial
  CRISPR gRNA sequence
tctaacacactgactattcc

SEQ ID NO: 567264 - DNA, 20 bp, Artificial
  CRISPR gRNA sequence
ctaacacactgactattcct

SEQ ID NO: 567265 - DNA, 20 bp, Artificial
  CRISPR gRNA sequence
taacacactgactattcctt

SEQ ID NO: 567266 - DNA, 20 bp, Artificial
  CRISPR gRNA sequence
acacactgactattcctttt

SEQ ID NO: 567267 - DNA, 20 bp, Artificial
  CRISPR gRNA sequence
actattccttttcagcttct

SEQ ID NO: 567268 - DNA, 20 bp, Artificial
  CRISPR gRNA sequence
ttccttttcagcttcttttg

SEQ ID NO: 567269 - DNA, 20 bp, Artificial
  CRISPR gRNA sequence
cttttcagcttcttttgcta

SEQ ID NO: 567270 - DNA, 20 bp, Artificial
  CRISPR gRNA sequence
ttcagcttcttttgctagtt

SEQ ID NO: 567271 - DNA, 20 bp, Artificial
  CRISPR gRNA sequence
tcagcttcttttgctagttt

SEQ ID NO: 567272 - DNA, 20 bp, Artificial
  CRISPR gRNA sequence
cagcttcttttgctagtttc

SEQ ID NO: 567273 - DNA, 20 bp, Artificial
  CRISPR gRNA sequence
agcttcttttgctagtttcc

SEQ ID NO: 567274 - DNA, 20 bp, Artificial
  CRISPR gRNA sequence
cttttgctagtttccttgtt

SEQ ID NO: 567275 - DNA, 20 bp, Artificial
  CRISPR gRNA sequence
ttttgctagtttccttgttt

SEQ ID NO: 567276 - DNA, 20 bp, Artificial
  CRISPR gRNA sequence
ttgctagtttccttgtttcc

SEQ ID NO: 567277 - DNA, 20 bp, Artificial
  CRISPR gRNA sequence
tgctagtttccttgtttccc

SEQ ID NO: 567278 - DNA, 20 bp, Artificial
  CRISPR gRNA sequence
gctagtttccttgtttcccc

SEQ ID NO: 567279 - DNA, 20 bp, Artificial
  CRISPR gRNA sequence
ctagtttccttgtttcccca

SEQ ID NO: 567280 - DNA, 20 bp, Artificial
  CRISPR gRNA sequence
gtttccttgtttccccaacc

SEQ ID NO: 567281 - DNA, 20 bp, Artificial
  CRISPR gRNA sequence
ccttgtttccccaacctctt

SEQ ID NO: 567282 - DNA, 20 bp, Artificial
  CRISPR gRNA sequence
cttgtttccccaacctctta

SEQ ID NO: 567283 - DNA, 20 bp, Artificial
  CRISPR gRNA sequence
gtttccccaacctcttaaca

SEQ ID NO: 567284 - DNA, 20 bp, Artificial
  CRISPR gRNA sequence
tttccccaacctcttaacac

SEQ ID NO: 567285 - DNA, 20 bp, Artificial
  CRISPR gRNA sequence
ccccaacctcttaacactgg

SEQ ID NO: 567286 - DNA, 20 bp, Artificial
  CRISPR gRNA sequence
cccaacctcttaacactgga

SEQ ID NO: 567287 - DNA, 20 bp, Artificial
  CRISPR gRNA sequence
ttaacactggaaacatcaag

SEQ ID NO: 567288 - DNA, 20 bp, Artificial
  CRISPR gRNA sequence
aacactggaaacatcaaggc

SEQ ID NO: 567289 - DNA, 20 bp, Artificial
  CRISPR gRNA sequence
acactggaaacatcaaggct

SEQ ID NO: 567290 - DNA, 20 bp, Artificial
  CRISPR gRNA sequence
gaaacatcaaggcttaagcc

SEQ ID NO: 567291 - DNA, 20 bp, Artificial
  CRISPR gRNA sequence
aagccttaggtctctttcct

SEQ ID NO: 567292 - DNA, 20 bp, Artificial
  CRISPR gRNA sequence
agccttaggtctctttcctt

SEQ ID NO: 567293 - DNA, 20 bp, Artificial
  CRISPR gRNA sequence
aggtctctttccttttctgt

SEQ ID NO: 567294 - DNA, 20 bp, Artificial
  CRISPR gRNA sequence
ggtctctttccttttctgtc

SEQ ID NO: 567295 - DNA, 20 bp, Artificial
  CRISPR gRNA sequence
tttccttttctgtctgcgtt

SEQ ID NO: 567296 - DNA, 20 bp, Artificial
  CRISPR gRNA sequence
tccttttctgtctgcgttca

SEQ ID NO: 567297 - DNA, 20 bp, Artificial
  CRISPR gRNA sequence
ccttttctgtctgcgttcat

SEQ ID NO: 567298 - DNA, 20 bp, Artificial
  CRISPR gRNA sequence
cttttctgtctgcgttcata

SEQ ID NO: 567299 - DNA, 20 bp, Artificial
  CRISPR gRNA sequence
ttctgtctgcgttcatagcc

SEQ ID NO: 567300 - DNA, 20 bp, Artificial
  CRISPR gRNA sequence
tctgtctgcgttcatagcca

SEQ ID NO: 567301 - DNA, 20 bp, Artificial
  CRISPR gRNA sequence
ctgtctgcgttcatagccag

SEQ ID NO: 567302 - DNA, 20 bp, Artificial
  CRISPR gRNA sequence
tgtctgcgttcatagccagt

SEQ ID NO: 567303 - DNA, 20 bp, Artificial
  CRISPR gRNA sequence
tctgcgttcatagccagtgg

SEQ ID NO: 567304 - DNA, 20 bp, Artificial
  CRISPR gRNA sequence
cgttcatagccagtgggtga

SEQ ID NO: 567305 - DNA, 20 bp, Artificial
  CRISPR gRNA sequence
atagccagtgggtgagctca

SEQ ID NO: 567306 - DNA, 20 bp, Artificial
  CRISPR gRNA sequence
atcccatgtcagggctttaa

SEQ ID NO: 567307 - DNA, 20 bp, Artificial
  CRISPR gRNA sequence
taaatatcatctcaatgcta

SEQ ID NO: 567308 - DNA, 20 bp, Artificial
  CRISPR gRNA sequence
aaatatcatctcaatgctaa

SEQ ID NO: 567309 - DNA, 20 bp, Artificial
  CRISPR gRNA sequence
aatatcatctcaatgctaat

SEQ ID NO: 567310 - DNA, 20 bp, Artificial
  CRISPR gRNA sequence
aatgctaataatgtacagat

SEQ ID NO: 567311 - DNA, 20 bp, Artificial
  CRISPR gRNA sequence
ataatgtacagatctagagc

SEQ ID NO: 567312 - DNA, 20 bp, Artificial
  CRISPR gRNA sequence
gagctctagcccagagtacc

SEQ ID NO: 567313 - DNA, 20 bp, Artificial
  CRISPR gRNA sequence
tagcccagagtaccccgccg

SEQ ID NO: 567314 - DNA, 20 bp, Artificial
  CRISPR gRNA sequence
gcccagagtaccccgccgag

SEQ ID NO: 567315 - DNA, 20 bp, Artificial
  CRISPR gRNA sequence
cttatgtgtatacctgactg

SEQ ID NO: 567316 - DNA, 20 bp, Artificial
  CRISPR gRNA sequence
atgtgtatacctgactgccc

SEQ ID NO: 567317 - DNA, 20 bp, Artificial
  CRISPR gRNA sequence
tgtgtatacctgactgccca

SEQ ID NO: 567318 - DNA, 20 bp, Artificial
  CRISPR gRNA sequence
actgcccagtgtacctctcc

SEQ ID NO: 567319 - DNA, 20 bp, Artificial
  CRISPR gRNA sequence
cccagtgtacctctccagtc

SEQ ID NO: 567320 - DNA, 20 bp, Artificial
  CRISPR gRNA sequence
tccagtcagacatctaattg

SEQ ID NO: 567321 - DNA, 20 bp, Artificial
  CRISPR gRNA sequence
cagtcagacatctaattggc

SEQ ID NO: 567322 - DNA, 20 bp, Artificial
  CRISPR gRNA sequence
attggcctttcaaatatcac

SEQ ID NO: 567323 - DNA, 20 bp, Artificial
  CRISPR gRNA sequence
gcctttcaaatatcacaagt

SEQ ID NO: 567324 - DNA, 20 bp, Artificial
  CRISPR gRNA sequence
tcaaatatcacaagtccaaa

SEQ ID NO: 567325 - DNA, 20 bp, Artificial
  CRISPR gRNA sequence
caaatatcacaagtccaaaa

SEQ ID NO: 567326 - DNA, 20 bp, Artificial
  CRISPR gRNA sequence
aaatatcacaagtccaaaag

SEQ ID NO: 567327 - DNA, 20 bp, Artificial
  CRISPR gRNA sequence
attatcttccccttaaaacc

SEQ ID NO: 567328 - DNA, 20 bp, Artificial
  CRISPR gRNA sequence
tcttccccttaaaacctgct

SEQ ID NO: 567329 - DNA, 20 bp, Artificial
  CRISPR gRNA sequence
ccccttaaaacctgctgctc

SEQ ID NO: 567330 - DNA, 20 bp, Artificial
  CRISPR gRNA sequence
cccttaaaacctgctgctcc

SEQ ID NO: 567331 - DNA, 20 bp, Artificial
  CRISPR gRNA sequence
aaaacctgctgctcctcccc

SEQ ID NO: 567332 - DNA, 20 bp, Artificial
  CRISPR gRNA sequence
aaacctgctgctcctcccca

SEQ ID NO: 567333 - DNA, 20 bp, Artificial
  CRISPR gRNA sequence
ctgctcctccccaaatcttt

SEQ ID NO: 567334 - DNA, 20 bp, Artificial
  CRISPR gRNA sequence
ctcctccccaaatcttttcc

SEQ ID NO: 567335 - DNA, 20 bp, Artificial
  CRISPR gRNA sequence
ctccccaaatcttttccctt

SEQ ID NO: 567336 - DNA, 20 bp, Artificial
  CRISPR gRNA sequence
cccaaatcttttcccttttg

SEQ ID NO: 567337 - DNA, 20 bp, Artificial
  CRISPR gRNA sequence
ttcccttttggttaatggca

SEQ ID NO: 567338 - DNA, 20 bp, Artificial
  CRISPR gRNA sequence
tcccttttggttaatggcag

SEQ ID NO: 567339 - DNA, 20 bp, Artificial
  CRISPR gRNA sequence
cccttttggttaatggcagc

SEQ ID NO: 567340 - DNA, 20 bp, Artificial
  CRISPR gRNA sequence
ccttttggttaatggcagcc

SEQ ID NO: 567341 - DNA, 20 bp, Artificial
  CRISPR gRNA sequence
ttggttaatggcagccccat

SEQ ID NO: 567342 - DNA, 20 bp, Artificial
  CRISPR gRNA sequence
tggttaatggcagccccatc

SEQ ID NO: 567343 - DNA, 20 bp, Artificial
  CRISPR gRNA sequence
ggttaatggcagccccatcc

SEQ ID NO: 567344 - DNA, 20 bp, Artificial
  CRISPR gRNA sequence
gttaatggcagccccatcct

SEQ ID NO: 567345 - DNA, 20 bp, Artificial
  CRISPR gRNA sequence
atggcagccccatcctttca

SEQ ID NO: 567346 - DNA, 20 bp, Artificial
  CRISPR gRNA sequence
tcagctggtcagtctgaaac

SEQ ID NO: 567347 - DNA, 20 bp, Artificial
  CRISPR gRNA sequence
cagctggtcagtctgaaacc

SEQ ID NO: 567348 - DNA, 20 bp, Artificial
  CRISPR gRNA sequence
agctggtcagtctgaaaccg

SEQ ID NO: 567349 - DNA, 20 bp, Artificial
  CRISPR gRNA sequence
gtcagtctgaaaccgggatg

SEQ ID NO: 567350 - DNA, 20 bp, Artificial
  CRISPR gRNA sequence
aaaccgggatgtcatccttg

SEQ ID NO: 567351 - DNA, 20 bp, Artificial
  CRISPR gRNA sequence
gatacctctctttttcttga

SEQ ID NO: 567352 - DNA, 20 bp, Artificial
  CRISPR gRNA sequence
atacctctctttttcttgaa

SEQ ID NO: 567353 - DNA, 20 bp, Artificial
  CRISPR gRNA sequence
tctttttcttgaataccaca

SEQ ID NO: 567354 - DNA, 20 bp, Artificial
  CRISPR gRNA sequence
tttttcttgaataccacatt

SEQ ID NO: 567355 - DNA, 20 bp, Artificial
  CRISPR gRNA sequence
tttcttgaataccacattca

SEQ ID NO: 567356 - DNA, 20 bp, Artificial
  CRISPR gRNA sequence
ttcttgaataccacattcac

SEQ ID NO: 567357 - DNA, 20 bp, Artificial
  CRISPR gRNA sequence
tcttgaataccacattcact

SEQ ID NO: 567358 - DNA, 20 bp, Artificial
  CRISPR gRNA sequence
cttgaataccacattcactc

SEQ ID NO: 567359 - DNA, 20 bp, Artificial
  CRISPR gRNA sequence
ttgaataccacattcactct

SEQ ID NO: 567360 - DNA, 20 bp, Artificial
  CRISPR gRNA sequence
gaataccacattcactctac

SEQ ID NO: 567361 - DNA, 20 bp, Artificial
  CRISPR gRNA sequence
aataccacattcactctacc

SEQ ID NO: 567362 - DNA, 20 bp, Artificial
  CRISPR gRNA sequence
actctaccaggaagttgtat

SEQ ID NO: 567363 - DNA, 20 bp, Artificial
  CRISPR gRNA sequence
taccaggaagttgtattggt

SEQ ID NO: 567364 - DNA, 20 bp, Artificial
  CRISPR gRNA sequence
ccaggaagttgtattggttc

SEQ ID NO: 567365 - DNA, 20 bp, Artificial
  CRISPR gRNA sequence
tattggttctaccagaatga

SEQ ID NO: 567366 - DNA, 20 bp, Artificial
  CRISPR gRNA sequence
gttctaccagaatgatcttt

SEQ ID NO: 567367 - DNA, 20 bp, Artificial
  CRISPR gRNA sequence
taccagaatgatctttttaa

SEQ ID NO: 567368 - DNA, 20 bp, Artificial
  CRISPR gRNA sequence
ccagaatgatctttttaaaa

SEQ ID NO: 567369 - DNA, 20 bp, Artificial
  CRISPR gRNA sequence
tttaaaacagaagtcagatc

SEQ ID NO: 567370 - DNA, 20 bp, Artificial
  CRISPR gRNA sequence
ttaaaacagaagtcagatca

SEQ ID NO: 567371 - DNA, 20 bp, Artificial
  CRISPR gRNA sequence
taaaacagaagtcagatcat

SEQ ID NO: 567372 - DNA, 20 bp, Artificial
  CRISPR gRNA sequence
aaaacagaagtcagatcatg

SEQ ID NO: 567373 - DNA, 20 bp, Artificial
  CRISPR gRNA sequence
aaacagaagtcagatcatgt

SEQ ID NO: 567374 - DNA, 20 bp, Artificial
  CRISPR gRNA sequence
atctgtgtggaactttctaa

SEQ ID NO: 567375 - DNA, 20 bp, Artificial
  CRISPR gRNA sequence
tgtggaactttctaatggcc

SEQ ID NO: 567376 - DNA, 20 bp, Artificial
  CRISPR gRNA sequence
tctaatggccccatctaact

SEQ ID NO: 567377 - DNA, 20 bp, Artificial
  CRISPR gRNA sequence
ctaatggccccatctaactc

SEQ ID NO: 567378 - DNA, 20 bp, Artificial
  CRISPR gRNA sequence
taatggccccatctaactct

SEQ ID NO: 567379 - DNA, 20 bp, Artificial
  CRISPR gRNA sequence
atggccccatctaactctgt

SEQ ID NO: 567380 - DNA, 20 bp, Artificial
  CRISPR gRNA sequence
actctgttaaagctaaaatg

SEQ ID NO: 567381 - DNA, 20 bp, Artificial
  CRISPR gRNA sequence
tgttaaagctaaaatgtgta

SEQ ID NO: 567382 - DNA, 20 bp, Artificial
  CRISPR gRNA sequence
ttaaagctaaaatgtgtaaa

SEQ ID NO: 567383 - DNA, 20 bp, Artificial
  CRISPR gRNA sequence
aagctaaaatgtgtaaagcg

SEQ ID NO: 567384 - DNA, 20 bp, Artificial
  CRISPR gRNA sequence
aaatgtgtaaagcgacttgc

SEQ ID NO: 567385 - DNA, 20 bp, Artificial
  CRISPR gRNA sequence
gcaaggctatgtgaggtctg

SEQ ID NO: 567386 - DNA, 20 bp, Artificial
  CRISPR gRNA sequence
caaggctatgtgaggtctga

SEQ ID NO: 567387 - DNA, 20 bp, Artificial
  CRISPR gRNA sequence
tgtgaggtctgacccctgtg

SEQ ID NO: 567388 - DNA, 20 bp, Artificial
  CRISPR gRNA sequence
acccctgtggactctattta

SEQ ID NO: 567389 - DNA, 20 bp, Artificial
  CRISPR gRNA sequence
tggactctatttagacaaat

SEQ ID NO: 567390 - DNA, 20 bp, Artificial
  CRISPR gRNA sequence
tatttagacaaatacagctt

SEQ ID NO: 567391 - DNA, 20 bp, Artificial
  CRISPR gRNA sequence
tttagacaaatacagcttgc

SEQ ID NO: 567392 - DNA, 20 bp, Artificial
  CRISPR gRNA sequence
agacaaatacagcttgctaa

SEQ ID NO: 567393 - DNA, 20 bp, Artificial
  CRISPR gRNA sequence
gacaaatacagcttgctaag

SEQ ID NO: 567394 - DNA, 20 bp, Artificial
  CRISPR gRNA sequence
gctaagatgtcaaagtatcc

SEQ ID NO: 567395 - DNA, 20 bp, Artificial
  CRISPR gRNA sequence
ctaagatgtcaaagtatcct

SEQ ID NO: 567396 - DNA, 20 bp, Artificial
  CRISPR gRNA sequence
agatgtcaaagtatcctctt

SEQ ID NO: 567397 - DNA, 20 bp, Artificial
  CRISPR gRNA sequence
ttagaagatttccttgaaaa

SEQ ID NO: 567398 - DNA, 20 bp, Artificial
  CRISPR gRNA sequence
agaagatttccttgaaaaag

SEQ ID NO: 567399 - DNA, 20 bp, Artificial
  CRISPR gRNA sequence
gaagatttccttgaaaaagt

SEQ ID NO: 567400 - DNA, 20 bp, Artificial
  CRISPR gRNA sequence
ccttgaaaaagtagaatctt

SEQ ID NO: 567401 - DNA, 20 bp, Artificial
  CRISPR gRNA sequence
cttgaaaaagtagaatcttt

SEQ ID NO: 567402 - DNA, 20 bp, Artificial
  CRISPR gRNA sequence
gaaaaagtagaatctttgaa

SEQ ID NO: 567403 - DNA, 20 bp, Artificial
  CRISPR gRNA sequence
aaaaagtagaatctttgaaa

SEQ ID NO: 567404 - DNA, 20 bp, Artificial
  CRISPR gRNA sequence
tgaaacatggacattgggga

SEQ ID NO: 567405 - DNA, 20 bp, Artificial
  CRISPR gRNA sequence
gaaacatggacattggggat

SEQ ID NO: 567406 - DNA, 20 bp, Artificial
  CRISPR gRNA sequence
aaacatggacattggggatc

SEQ ID NO: 567407 - DNA, 20 bp, Artificial
  CRISPR gRNA sequence
gggatctgataatttataga

SEQ ID NO: 567408 - DNA, 20 bp, Artificial
  CRISPR gRNA sequence
ataatttatagatagggcca

SEQ ID NO: 567409 - DNA, 20 bp, Artificial
  CRISPR gRNA sequence
atagatagggccaacaaaca

SEQ ID NO: 567410 - DNA, 20 bp, Artificial
  CRISPR gRNA sequence
tagatagggccaacaaacaa

SEQ ID NO: 567411 - DNA, 20 bp, Artificial
  CRISPR gRNA sequence
agtcagaatttagatcacac

SEQ ID NO: 567412 - DNA, 20 bp, Artificial
  CRISPR gRNA sequence
agatcacacattttaagagc

SEQ ID NO: 567413 - DNA, 20 bp, Artificial
  CRISPR gRNA sequence
gatcacacattttaagagcc

SEQ ID NO: 567414 - DNA, 20 bp, Artificial
  CRISPR gRNA sequence
taagagccctttttatagag

SEQ ID NO: 567415 - DNA, 20 bp, Artificial
  CRISPR gRNA sequence
aagagccctttttatagagt

SEQ ID NO: 567416 - DNA, 20 bp, Artificial
  CRISPR gRNA sequence
agagccctttttatagagtt

SEQ ID NO: 567417 - DNA, 20 bp, Artificial
  CRISPR gRNA sequence
tttatagagtttgtaaaact

SEQ ID NO: 567418 - DNA, 20 bp, Artificial
  CRISPR gRNA sequence
ttatagagtttgtaaaacta

SEQ ID NO: 567419 - DNA, 20 bp, Artificial
  CRISPR gRNA sequence
tatagagtttgtaaaactaa

SEQ ID NO: 567420 - DNA, 20 bp, Artificial
  CRISPR gRNA sequence
atagagtttgtaaaactaat

SEQ ID NO: 567421 - DNA, 20 bp, Artificial
  CRISPR gRNA sequence
tagagtttgtaaaactaatt

SEQ ID NO: 567422 - DNA, 20 bp, Artificial
  CRISPR gRNA sequence
gtaaaactaattcaaaacat

SEQ ID NO: 567423 - DNA, 20 bp, Artificial
  CRISPR gRNA sequence
taaaactaattcaaaacatt

SEQ ID NO: 567424 - DNA, 20 bp, Artificial
  CRISPR gRNA sequence
attcaaaacatttgaataaa

SEQ ID NO: 567425 - DNA, 20 bp, Artificial
  CRISPR gRNA sequence
aaaacatttgaataaatttc

SEQ ID NO: 567426 - DNA, 20 bp, Artificial
  CRISPR gRNA sequence
gaataaatttctcctcttaa

SEQ ID NO: 567427 - DNA, 20 bp, Artificial
  CRISPR gRNA sequence
aataaatttctcctcttaaa

SEQ ID NO: 567428 - DNA, 20 bp, Artificial
  CRISPR gRNA sequence
ctcctcttaaacttgatgaa

SEQ ID NO: 567429 - DNA, 20 bp, Artificial
  CRISPR gRNA sequence
tcctcttaaacttgatgaac

SEQ ID NO: 567430 - DNA, 20 bp, Artificial
  CRISPR gRNA sequence
ctcttaaacttgatgaactg

SEQ ID NO: 567431 - DNA, 20 bp, Artificial
  CRISPR gRNA sequence
ttaaacttgatgaactgttt

SEQ ID NO: 567432 - DNA, 20 bp, Artificial
  CRISPR gRNA sequence
aaacttgatgaactgtttta

SEQ ID NO: 567433 - DNA, 20 bp, Artificial
  CRISPR gRNA sequence
aacttgatgaactgttttaa

SEQ ID NO: 567434 - DNA, 20 bp, Artificial
  CRISPR gRNA sequence
gatgaactgttttaaaataa

SEQ ID NO: 567435 - DNA, 20 bp, Artificial
  CRISPR gRNA sequence
atgaactgttttaaaataat

SEQ ID NO: 567436 - DNA, 20 bp, Artificial
  CRISPR gRNA sequence
ttttaaaataatttaaaata

SEQ ID NO: 567437 - DNA, 20 bp, Artificial
  CRISPR gRNA sequence
taaaataatttaaaatattc

SEQ ID NO: 567438 - DNA, 20 bp, Artificial
  CRISPR gRNA sequence
aaaataatttaaaatattct

SEQ ID NO: 567439 - DNA, 20 bp, Artificial
  CRISPR gRNA sequence
aaataatttaaaatattcta

SEQ ID NO: 567440 - DNA, 20 bp, Artificial
  CRISPR gRNA sequence
aaaatattctaggccgggca

SEQ ID NO: 567441 - DNA, 20 bp, Artificial
  CRISPR gRNA sequence
aaatattctaggccgggcat

SEQ ID NO: 567442 - DNA, 20 bp, Artificial
  CRISPR gRNA sequence
taggccgggcattgtggctc

SEQ ID NO: 567443 - DNA, 20 bp, Artificial
  CRISPR gRNA sequence
ggccgggcattgtggctcaa

SEQ ID NO: 567444 - DNA, 20 bp, Artificial
  CRISPR gRNA sequence
tggctcaaggctataatccc

SEQ ID NO: 567445 - DNA, 20 bp, Artificial
  CRISPR gRNA sequence
aaggctataatcccagcact

SEQ ID NO: 567446 - DNA, 20 bp, Artificial
  CRISPR gRNA sequence
taatcccagcactttgtgag

SEQ ID NO: 567447 - DNA, 20 bp, Artificial
  CRISPR gRNA sequence
tgtgaggctgaggagggagg

SEQ ID NO: 567448 - DNA, 20 bp, Artificial
  CRISPR gRNA sequence
gtgaggctgaggagggaggg

SEQ ID NO: 567449 - DNA, 20 bp, Artificial
  CRISPR gRNA sequence
tgaggctgaggagggagggt

SEQ ID NO: 567450 - DNA, 20 bp, Artificial
  CRISPR gRNA sequence
aggagggagggttgcttaag

SEQ ID NO: 567451 - DNA, 20 bp, Artificial
  CRISPR gRNA sequence
cttaagcccagtagttcaag

SEQ ID NO: 567452 - DNA, 20 bp, Artificial
  CRISPR gRNA sequence
aagcccagtagttcaagacc

SEQ ID NO: 567453 - DNA, 20 bp, Artificial
  CRISPR gRNA sequence
agcccagtagttcaagacca

SEQ ID NO: 567454 - DNA, 20 bp, Artificial
  CRISPR gRNA sequence
aagaccatcctaggcaacat

SEQ ID NO: 567455 - DNA, 20 bp, Artificial
  CRISPR gRNA sequence
ggcaacatagcaagactcca

SEQ ID NO: 567456 - DNA, 20 bp, Artificial
  CRISPR gRNA sequence
catctctacaaaaataaaat

SEQ ID NO: 567457 - DNA, 20 bp, Artificial
  CRISPR gRNA sequence
tacaaaaataaaataattaa

SEQ ID NO: 567458 - DNA, 20 bp, Artificial
  CRISPR gRNA sequence
caaaaataaaataattaacc

SEQ ID NO: 567459 - DNA, 20 bp, Artificial
  CRISPR gRNA sequence
accaggcatggtggtgcatg

SEQ ID NO: 567460 - DNA, 20 bp, Artificial
  CRISPR gRNA sequence
tagtcccagctactcaagag

SEQ ID NO: 567461 - DNA, 20 bp, Artificial
  CRISPR gRNA sequence
ctcaagaggctgaggtggga

SEQ ID NO: 567462 - DNA, 20 bp, Artificial
  CRISPR gRNA sequence
aagaggctgaggtgggagga

SEQ ID NO: 567463 - DNA, 20 bp, Artificial
  CRISPR gRNA sequence
aggtgggaggatcccttgag

SEQ ID NO: 567464 - DNA, 20 bp, Artificial
  CRISPR gRNA sequence
gagcccaggaggctgaggct

SEQ ID NO: 567465 - DNA, 20 bp, Artificial
  CRISPR gRNA sequence
agcccaggaggctgaggctg

SEQ ID NO: 567466 - DNA, 20 bp, Artificial
  CRISPR gRNA sequence
aggctgcagtgagccatgat

SEQ ID NO: 567467 - DNA, 20 bp, Artificial
  CRISPR gRNA sequence
cagtgagccatgattgcacc

SEQ ID NO: 567468 - DNA, 20 bp, Artificial
  CRISPR gRNA sequence
cacctctgcactccagtctg

SEQ ID NO: 567469 - DNA, 20 bp, Artificial
  CRISPR gRNA sequence
tgcactccagtctgggtgac

SEQ ID NO: 567470 - DNA, 20 bp, Artificial
  CRISPR gRNA sequence
cactccagtctgggtgacag

SEQ ID NO: 567471 - DNA, 20 bp, Artificial
  CRISPR gRNA sequence
cagtctgggtgacagaccaa

SEQ ID NO: 567472 - DNA, 20 bp, Artificial
  CRISPR gRNA sequence
ggtgacagaccaagaccctg

SEQ ID NO: 567473 - DNA, 20 bp, Artificial
  CRISPR gRNA sequence
cctcaaaataactagctaaa

SEQ ID NO: 567474 - DNA, 20 bp, Artificial
  CRISPR gRNA sequence
aaaataactagctaaataaa

SEQ ID NO: 567475 - DNA, 20 bp, Artificial
  CRISPR gRNA sequence
gctaaataaattaattaaat

SEQ ID NO: 567476 - DNA, 20 bp, Artificial
  CRISPR gRNA sequence
aataaattaattaaataaaa

SEQ ID NO: 567477 - DNA, 20 bp, Artificial
  CRISPR gRNA sequence
attaaataaaatattctatg

SEQ ID NO: 567478 - DNA, 20 bp, Artificial
  CRISPR gRNA sequence
aataaaatattctatggcac

SEQ ID NO: 567479 - DNA, 20 bp, Artificial
  CRISPR gRNA sequence
tatggcacctcagcaaaggt

SEQ ID NO: 567480 - DNA, 20 bp, Artificial
  CRISPR gRNA sequence
tggcacctcagcaaaggtat

SEQ ID NO: 567481 - DNA, 20 bp, Artificial
  CRISPR gRNA sequence
agcaaaggtatggttttgtt

SEQ ID NO: 567482 - DNA, 20 bp, Artificial
  CRISPR gRNA sequence
tgttagtcagaccaactgga

SEQ ID NO: 567483 - DNA, 20 bp, Artificial
  CRISPR gRNA sequence
gttagtcagaccaactggat

SEQ ID NO: 567484 - DNA, 20 bp, Artificial
  CRISPR gRNA sequence
ttagtcagaccaactggata

SEQ ID NO: 567485 - DNA, 20 bp, Artificial
  CRISPR gRNA sequence
gtcagaccaactggatagac

SEQ ID NO: 567486 - DNA, 20 bp, Artificial
  CRISPR gRNA sequence
gatagaccttaggaagcctg

SEQ ID NO: 567487 - DNA, 20 bp, Artificial
  CRISPR gRNA sequence
aggaagcctgcagaggagta

SEQ ID NO: 567488 - DNA, 20 bp, Artificial
  CRISPR gRNA sequence
ggaagcctgcagaggagtaa

SEQ ID NO: 567489 - DNA, 20 bp, Artificial
  CRISPR gRNA sequence
cagaggagtaaagtacaggg

SEQ ID NO: 567490 - DNA, 20 bp, Artificial
  CRISPR gRNA sequence
tgatcaggaggcagtgatat

SEQ ID NO: 567491 - DNA, 20 bp, Artificial
  CRISPR gRNA sequence
gatcaggaggcagtgatatt

SEQ ID NO: 567492 - DNA, 20 bp, Artificial
  CRISPR gRNA sequence
atcaggaggcagtgatattg

SEQ ID NO: 567493 - DNA, 20 bp, Artificial
  CRISPR gRNA sequence
atagtattgagtgtgggact

SEQ ID NO: 567494 - DNA, 20 bp, Artificial
  CRISPR gRNA sequence
agtgtgggacttaaagtcct

SEQ ID NO: 567495 - DNA, 20 bp, Artificial
  CRISPR gRNA sequence
aaagtcctggtttgagagtc

SEQ ID NO: 567496 - DNA, 20 bp, Artificial
  CRISPR gRNA sequence
aagtcctggtttgagagtct

SEQ ID NO: 567497 - DNA, 20 bp, Artificial
  CRISPR gRNA sequence
gtttgagagtctggacatca

SEQ ID NO: 567498 - DNA, 20 bp, Artificial
  CRISPR gRNA sequence
gagagtctggacatcagctt

SEQ ID NO: 567499 - DNA, 20 bp, Artificial
  CRISPR gRNA sequence
agagtctggacatcagcttg

SEQ ID NO: 567500 - DNA, 20 bp, Artificial
  CRISPR gRNA sequence
gacatcagcttgtagcagtg

SEQ ID NO: 567501 - DNA, 20 bp, Artificial
  CRISPR gRNA sequence
gtagcagtggggagccattg

SEQ ID NO: 567502 - DNA, 20 bp, Artificial
  CRISPR gRNA sequence
tagcagtggggagccattgt

SEQ ID NO: 567503 - DNA, 20 bp, Artificial
  CRISPR gRNA sequence
tgtcctatactggagcaagg

SEQ ID NO: 567504 - DNA, 20 bp, Artificial
  CRISPR gRNA sequence
tactggagcaaggaagtgac

SEQ ID NO: 567505 - DNA, 20 bp, Artificial
  CRISPR gRNA sequence
gagcaaggaagtgacttgat

SEQ ID NO: 567506 - DNA, 20 bp, Artificial
  CRISPR gRNA sequence
gataaaatacatttttggaa

SEQ ID NO: 567507 - DNA, 20 bp, Artificial
  CRISPR gRNA sequence
ataaaatacatttttggaag

SEQ ID NO: 567508 - DNA, 20 bp, Artificial
  CRISPR gRNA sequence
ttggaagattaatgtgatgg

SEQ ID NO: 567509 - DNA, 20 bp, Artificial
  CRISPR gRNA sequence
tggaagattaatgtgatggt

SEQ ID NO: 567510 - DNA, 20 bp, Artificial
  CRISPR gRNA sequence
ggaagattaatgtgatggtg

SEQ ID NO: 567511 - DNA, 20 bp, Artificial
  CRISPR gRNA sequence
gaagattaatgtgatggtgc

SEQ ID NO: 567512 - DNA, 20 bp, Artificial
  CRISPR gRNA sequence
atgtgatggtgcatacttat

SEQ ID NO: 567513 - DNA, 20 bp, Artificial
  CRISPR gRNA sequence
atgatggattaaagagagga

SEQ ID NO: 567514 - DNA, 20 bp, Artificial
  CRISPR gRNA sequence
tgatggattaaagagaggag

SEQ ID NO: 567515 - DNA, 20 bp, Artificial
  CRISPR gRNA sequence
aagagaggagatgtcaagtt

SEQ ID NO: 567516 - DNA, 20 bp, Artificial
  CRISPR gRNA sequence
gaagctactatcatccaggt

SEQ ID NO: 567517 - DNA, 20 bp, Artificial
  CRISPR gRNA sequence
ctatcatccaggtagataga

SEQ ID NO: 567518 - DNA, 20 bp, Artificial
  CRISPR gRNA sequence
tcatccaggtagatagaggg

SEQ ID NO: 567519 - DNA, 20 bp, Artificial
  CRISPR gRNA sequence
caagatgtaggttttggttg

SEQ ID NO: 567520 - DNA, 20 bp, Artificial
  CRISPR gRNA sequence
tggttgtaaaaagacataag

SEQ ID NO: 567521 - DNA, 20 bp, Artificial
  CRISPR gRNA sequence
ggttgtaaaaagacataaga

SEQ ID NO: 567522 - DNA, 20 bp, Artificial
  CRISPR gRNA sequence
gttgtaaaaagacataagat

SEQ ID NO: 567523 - DNA, 20 bp, Artificial
  CRISPR gRNA sequence
taaaaagacataagatgact

SEQ ID NO: 567524 - DNA, 20 bp, Artificial
  CRISPR gRNA sequence
taggtttcacatctgcatga

SEQ ID NO: 567525 - DNA, 20 bp, Artificial
  CRISPR gRNA sequence
ggtttcacatctgcatgata

SEQ ID NO: 567526 - DNA, 20 bp, Artificial
  CRISPR gRNA sequence
cacatctgcatgataaaatg

SEQ ID NO: 567527 - DNA, 20 bp, Artificial
  CRISPR gRNA sequence
acatctgcatgataaaatga

SEQ ID NO: 567528 - DNA, 20 bp, Artificial
  CRISPR gRNA sequence
catgataaaatgattggtca

SEQ ID NO: 567529 - DNA, 20 bp, Artificial
  CRISPR gRNA sequence
gtcatactattttttttttt

SEQ ID NO: 567530 - DNA, 20 bp, Artificial
  CRISPR gRNA sequence
tttttttttttttttaagaa

SEQ ID NO: 567531 - DNA, 20 bp, Artificial
  CRISPR gRNA sequence
ttttttttttttaagaaaag

SEQ ID NO: 567532 - DNA, 20 bp, Artificial
  CRISPR gRNA sequence
tttttttttttaagaaaaga

SEQ ID NO: 567533 - DNA, 20 bp, Artificial
  CRISPR gRNA sequence
ttttttttttaagaaaagag

SEQ ID NO: 567534 - DNA, 20 bp, Artificial
  CRISPR gRNA sequence
tttttttttaagaaaagagg

SEQ ID NO: 567535 - DNA, 20 bp, Artificial
  CRISPR gRNA sequence
ttttttttaagaaaagagga

SEQ ID NO: 567536 - DNA, 20 bp, Artificial
  CRISPR gRNA sequence
tttttttaagaaaagaggaa

SEQ ID NO: 567537 - DNA, 20 bp, Artificial
  CRISPR gRNA sequence
ttttttaagaaaagaggaag

SEQ ID NO: 567538 - DNA, 20 bp, Artificial
  CRISPR gRNA sequence
tttttaagaaaagaggaagt

SEQ ID NO: 567539 - DNA, 20 bp, Artificial
  CRISPR gRNA sequence
ttttaagaaaagaggaagtc

SEQ ID NO: 567540 - DNA, 20 bp, Artificial
  CRISPR gRNA sequence
tttaagaaaagaggaagtca

SEQ ID NO: 567541 - DNA, 20 bp, Artificial
  CRISPR gRNA sequence
ttaagaaaagaggaagtcat

SEQ ID NO: 567542 - DNA, 20 bp, Artificial
  CRISPR gRNA sequence
taagaaaagaggaagtcata

SEQ ID NO: 567543 - DNA, 20 bp, Artificial
  CRISPR gRNA sequence
aagaaaagaggaagtcatac

SEQ ID NO: 567544 - DNA, 20 bp, Artificial
  CRISPR gRNA sequence
agaaaagaggaagtcatact

SEQ ID NO: 567545 - DNA, 20 bp, Artificial
  CRISPR gRNA sequence
ccttgaggtaatgttaacac

SEQ ID NO: 567546 - DNA, 20 bp, Artificial
  CRISPR gRNA sequence
cttgaggtaatgttaacact

SEQ ID NO: 567547 - DNA, 20 bp, Artificial
  CRISPR gRNA sequence
gaggtaatgttaacacttgt

SEQ ID NO: 567548 - DNA, 20 bp, Artificial
  CRISPR gRNA sequence
aggtaatgttaacacttgtt

SEQ ID NO: 567549 - DNA, 20 bp, Artificial
  CRISPR gRNA sequence
acacttgttttagtaacctg

SEQ ID NO: 567550 - DNA, 20 bp, Artificial
  CRISPR gRNA sequence
gttttagtaacctggtaatc

SEQ ID NO: 567551 - DNA, 20 bp, Artificial
  CRISPR gRNA sequence
ttttagtaacctggtaatct

SEQ ID NO: 567552 - DNA, 20 bp, Artificial
  CRISPR gRNA sequence
tagtaacctggtaatcttct

SEQ ID NO: 567553 - DNA, 20 bp, Artificial
  CRISPR gRNA sequence
agtaacctggtaatcttcta

SEQ ID NO: 567554 - DNA, 20 bp, Artificial
  CRISPR gRNA sequence
gtaacctggtaatcttctag

SEQ ID NO: 567555 - DNA, 20 bp, Artificial
  CRISPR gRNA sequence
gtaatcttctagagacacca

SEQ ID NO: 567556 - DNA, 20 bp, Artificial
  CRISPR gRNA sequence
ctagagacaccagacctaat

SEQ ID NO: 567557 - DNA, 20 bp, Artificial
  CRISPR gRNA sequence
tagagacaccagacctaata

SEQ ID NO: 567558 - DNA, 20 bp, Artificial
  CRISPR gRNA sequence
gagacaccagacctaatagg

SEQ ID NO: 567559 - DNA, 20 bp, Artificial
  CRISPR gRNA sequence
ataggagacttccagtgagc

SEQ ID NO: 567560 - DNA, 20 bp, Artificial
  CRISPR gRNA sequence
ccagtgagcatattttggac

SEQ ID NO: 567561 - DNA, 20 bp, Artificial
  CRISPR gRNA sequence
cagtgagcatattttggaca

SEQ ID NO: 567562 - DNA, 20 bp, Artificial
  CRISPR gRNA sequence
tggacagggggatttcctgg

SEQ ID NO: 567563 - DNA, 20 bp, Artificial
  CRISPR gRNA sequence
ggacagggggatttcctggc

SEQ ID NO: 567564 - DNA, 20 bp, Artificial
  CRISPR gRNA sequence
gacagggggatttcctggca

SEQ ID NO: 567565 - DNA, 20 bp, Artificial
  CRISPR gRNA sequence
cctggcacttcctaaattca

SEQ ID NO: 567566 - DNA, 20 bp, Artificial
  CRISPR gRNA sequence
ctggcacttcctaaattcag

SEQ ID NO: 567567 - DNA, 20 bp, Artificial
  CRISPR gRNA sequence
gcacttcctaaattcagggc

SEQ ID NO: 567568 - DNA, 20 bp, Artificial
  CRISPR gRNA sequence
cctaaattcagggcatccac

SEQ ID NO: 567569 - DNA, 20 bp, Artificial
  CRISPR gRNA sequence
ctaaattcagggcatccact

SEQ ID NO: 567570 - DNA, 20 bp, Artificial
  CRISPR gRNA sequence
aattcagggcatccacttcc

SEQ ID NO: 567571 - DNA, 20 bp, Artificial
  CRISPR gRNA sequence
agggcatccacttccttctg

SEQ ID NO: 567572 - DNA, 20 bp, Artificial
  CRISPR gRNA sequence
ccttctgtgtgtacattgag

SEQ ID NO: 567573 - DNA, 20 bp, Artificial
  CRISPR gRNA sequence
cttctgtgtgtacattgaga

SEQ ID NO: 567574 - DNA, 20 bp, Artificial
  CRISPR gRNA sequence
ctgtgtgtacattgagatct

SEQ ID NO: 567575 - DNA, 20 bp, Artificial
  CRISPR gRNA sequence
tgtgtgtacattgagatctg

SEQ ID NO: 567576 - DNA, 20 bp, Artificial
  CRISPR gRNA sequence
tgtgtacattgagatctggc

SEQ ID NO: 567577 - DNA, 20 bp, Artificial
  CRISPR gRNA sequence
agatctggctttcctccata

SEQ ID NO: 567578 - DNA, 20 bp, Artificial
  CRISPR gRNA sequence
gctttcctccatacccaaaa

SEQ ID NO: 567579 - DNA, 20 bp, Artificial
  CRISPR gRNA sequence
tcctccatacccaaaagtcc

SEQ ID NO: 567580 - DNA, 20 bp, Artificial
  CRISPR gRNA sequence
cctccatacccaaaagtccc

SEQ ID NO: 567581 - DNA, 20 bp, Artificial
  CRISPR gRNA sequence
ctccatacccaaaagtcccc

SEQ ID NO: 567582 - DNA, 20 bp, Artificial
  CRISPR gRNA sequence
catacccaaaagtcccctta

SEQ ID NO: 567583 - DNA, 20 bp, Artificial
  CRISPR gRNA sequence
aaaatttctacttctgaggt

SEQ ID NO: 567584 - DNA, 20 bp, Artificial
  CRISPR gRNA sequence
aaatttctacttctgaggtt

SEQ ID NO: 567585 - DNA, 20 bp, Artificial
  CRISPR gRNA sequence
ctacttctgaggtttattag

SEQ ID NO: 567586 - DNA, 20 bp, Artificial
  CRISPR gRNA sequence
tacttctgaggtttattagt

SEQ ID NO: 567587 - DNA, 20 bp, Artificial
  CRISPR gRNA sequence
cttctgaggtttattagtcc

SEQ ID NO: 567588 - DNA, 20 bp, Artificial
  CRISPR gRNA sequence
ctgaggtttattagtccttt

SEQ ID NO: 567589 - DNA, 20 bp, Artificial
  CRISPR gRNA sequence
tgaggtttattagtcctttc

SEQ ID NO: 567590 - DNA, 20 bp, Artificial
  CRISPR gRNA sequence
aggtttattagtcctttccc

SEQ ID NO: 567591 - DNA, 20 bp, Artificial
  CRISPR gRNA sequence
attagtcctttcccatcttt

SEQ ID NO: 567592 - DNA, 20 bp, Artificial
  CRISPR gRNA sequence
ttagtcctttcccatctttt

SEQ ID NO: 567593 - DNA, 20 bp, Artificial
  CRISPR gRNA sequence
gtcctttcccatctttttat

SEQ ID NO: 567594 - DNA, 20 bp, Artificial
  CRISPR gRNA sequence
tcccatctttttatggacct

SEQ ID NO: 567595 - DNA, 20 bp, Artificial
  CRISPR gRNA sequence
cccatctttttatggacctt

SEQ ID NO: 567596 - DNA, 20 bp, Artificial
  CRISPR gRNA sequence
ccatctttttatggaccttc

SEQ ID NO: 567597 - DNA, 20 bp, Artificial
  CRISPR gRNA sequence
tttatggaccttcatcacat

SEQ ID NO: 567598 - DNA, 20 bp, Artificial
  CRISPR gRNA sequence
ttatggaccttcatcacatc

SEQ ID NO: 567599 - DNA, 20 bp, Artificial
  CRISPR gRNA sequence
tatggaccttcatcacatct

SEQ ID NO: 567600 - DNA, 20 bp, Artificial
  CRISPR gRNA sequence
atggaccttcatcacatctc

SEQ ID NO: 567601 - DNA, 20 bp, Artificial
  CRISPR gRNA sequence
tggaccttcatcacatctca

SEQ ID NO: 567602 - DNA, 20 bp, Artificial
  CRISPR gRNA sequence
catcacatctcagatgatga

SEQ ID NO: 567603 - DNA, 20 bp, Artificial
  CRISPR gRNA sequence
atcacatctcagatgatgat

SEQ ID NO: 567604 - DNA, 20 bp, Artificial
  CRISPR gRNA sequence
agatgatgatttttatgtaa

SEQ ID NO: 567605 - DNA, 20 bp, Artificial
  CRISPR gRNA sequence
ttatgtaagtagaattaact

SEQ ID NO: 567606 - DNA, 20 bp, Artificial
  CRISPR gRNA sequence
tatgtaagtagaattaactg

SEQ ID NO: 567607 - DNA, 20 bp, Artificial
  CRISPR gRNA sequence
atgtaagtagaattaactgc

SEQ ID NO: 567608 - DNA, 20 bp, Artificial
  CRISPR gRNA sequence
tgtaagtagaattaactgcc

SEQ ID NO: 567609 - DNA, 20 bp, Artificial
  CRISPR gRNA sequence
actgccctgtccttaactgg

SEQ ID NO: 567610 - DNA, 20 bp, Artificial
  CRISPR gRNA sequence
ccctgtccttaactgggctg

SEQ ID NO: 567611 - DNA, 20 bp, Artificial
  CRISPR gRNA sequence
tccttaactgggctggattg

SEQ ID NO: 567612 - DNA, 20 bp, Artificial
  CRISPR gRNA sequence
aactgggctggattgatact

SEQ ID NO: 567613 - DNA, 20 bp, Artificial
  CRISPR gRNA sequence
actgggctggattgatactt

SEQ ID NO: 567614 - DNA, 20 bp, Artificial
  CRISPR gRNA sequence
ggctggattgatacttgacc

SEQ ID NO: 567615 - DNA, 20 bp, Artificial
  CRISPR gRNA sequence
gattgatacttgacctttac

SEQ ID NO: 567616 - DNA, 20 bp, Artificial
  CRISPR gRNA sequence
atacttgacctttactaaaa

SEQ ID NO: 567617 - DNA, 20 bp, Artificial
  CRISPR gRNA sequence
gacctttactaaaattcgtg

SEQ ID NO: 567618 - DNA, 20 bp, Artificial
  CRISPR gRNA sequence
acctttactaaaattcgtga

SEQ ID NO: 567619 - DNA, 20 bp, Artificial
  CRISPR gRNA sequence
tactaaaattcgtgaaaata

SEQ ID NO: 567620 - DNA, 20 bp, Artificial
  CRISPR gRNA sequence
actaaaattcgtgaaaatat

SEQ ID NO: 567621 - DNA, 20 bp, Artificial
  CRISPR gRNA sequence
ctaaaattcgtgaaaatata

SEQ ID NO: 567622 - DNA, 20 bp, Artificial
  CRISPR gRNA sequence
aaattcgtgaaaatatacac

SEQ ID NO: 567623 - DNA, 20 bp, Artificial
  CRISPR gRNA sequence
gtgaaaatatacacatattt

SEQ ID NO: 567624 - DNA, 20 bp, Artificial
  CRISPR gRNA sequence
ctataaaatgtcatcagata

SEQ ID NO: 567625 - DNA, 20 bp, Artificial
  CRISPR gRNA sequence
tataaaatgtcatcagatat

SEQ ID NO: 567626 - DNA, 20 bp, Artificial
  CRISPR gRNA sequence
taaaatgtcatcagatatgt

SEQ ID NO: 567627 - DNA, 20 bp, Artificial
  CRISPR gRNA sequence
tcattttttacacagcagtg

SEQ ID NO: 567628 - DNA, 20 bp, Artificial
  CRISPR gRNA sequence
attttttacacagcagtgaa

SEQ ID NO: 567629 - DNA, 20 bp, Artificial
  CRISPR gRNA sequence
tttacacagcagtgaactca

SEQ ID NO: 567630 - DNA, 20 bp, Artificial
  CRISPR gRNA sequence
ttacacagcagtgaactcaa

SEQ ID NO: 567631 - DNA, 20 bp, Artificial
  CRISPR gRNA sequence
tacacagcagtgaactcaat

SEQ ID NO: 567632 - DNA, 20 bp, Artificial
  CRISPR gRNA sequence
acacagcagtgaactcaatt

SEQ ID NO: 567633 - DNA, 20 bp, Artificial
  CRISPR gRNA sequence
cacagcagtgaactcaattc

SEQ ID NO: 567634 - DNA, 20 bp, Artificial
  CRISPR gRNA sequence
aattcattaattataaattg

SEQ ID NO: 567635 - DNA, 20 bp, Artificial
  CRISPR gRNA sequence
attaattataaattgactaa

SEQ ID NO: 567636 - DNA, 20 bp, Artificial
  CRISPR gRNA sequence
attataaattgactaattgt

SEQ ID NO: 567637 - DNA, 20 bp, Artificial
  CRISPR gRNA sequence
taaattgactaattgtctta

SEQ ID NO: 567638 - DNA, 20 bp, Artificial
  CRISPR gRNA sequence
actaattgtcttagggagga

SEQ ID NO: 567639 - DNA, 20 bp, Artificial
  CRISPR gRNA sequence
attgtcttagggaggaagta

SEQ ID NO: 567640 - DNA, 20 bp, Artificial
  CRISPR gRNA sequence
tcttagggaggaagtaggca

SEQ ID NO: 567641 - DNA, 20 bp, Artificial
  CRISPR gRNA sequence
agggaggaagtaggcacatt

SEQ ID NO: 567642 - DNA, 20 bp, Artificial
  CRISPR gRNA sequence
gggaggaagtaggcacattt

SEQ ID NO: 567643 - DNA, 20 bp, Artificial
  CRISPR gRNA sequence
cttgccagtttaatgctgct

SEQ ID NO: 567644 - DNA, 20 bp, Artificial
  CRISPR gRNA sequence
ttgccagtttaatgctgctt

SEQ ID NO: 567645 - DNA, 20 bp, Artificial
  CRISPR gRNA sequence
gccagtttaatgctgcttaa

SEQ ID NO: 567646 - DNA, 20 bp, Artificial
  CRISPR gRNA sequence
ccagtttaatgctgcttaaa

SEQ ID NO: 567647 - DNA, 20 bp, Artificial
  CRISPR gRNA sequence
aatgctgcttaaagtagagg

SEQ ID NO: 567648 - DNA, 20 bp, Artificial
  CRISPR gRNA sequence
atgctgcttaaagtagaggt

SEQ ID NO: 567649 - DNA, 20 bp, Artificial
  CRISPR gRNA sequence
cttaaagtagaggtataacg

SEQ ID NO: 567650 - DNA, 20 bp, Artificial
  CRISPR gRNA sequence
aaagtagaggtataacgaat

SEQ ID NO: 567651 - DNA, 20 bp, Artificial
  CRISPR gRNA sequence
aagtagaggtataacgaata

SEQ ID NO: 567652 - DNA, 20 bp, Artificial
  CRISPR gRNA sequence
gttagatacagctgtggtaa

SEQ ID NO: 567653 - DNA, 20 bp, Artificial
  CRISPR gRNA sequence
ttagatacagctgtggtaag

SEQ ID NO: 567654 - DNA, 20 bp, Artificial
  CRISPR gRNA sequence
gatacagctgtggtaagtcc

SEQ ID NO: 567655 - DNA, 20 bp, Artificial
  CRISPR gRNA sequence
tggtaagtcccacgggcagc

SEQ ID NO: 567656 - DNA, 20 bp, Artificial
  CRISPR gRNA sequence
atagaaggaaaagatctgag

SEQ ID NO: 567657 - DNA, 20 bp, Artificial
  CRISPR gRNA sequence
tagaaggaaaagatctgagg

SEQ ID NO: 567658 - DNA, 20 bp, Artificial
  CRISPR gRNA sequence
aggtgtagaaactgtgatct

SEQ ID NO: 567659 - DNA, 20 bp, Artificial
  CRISPR gRNA sequence
tgatctaggtgctgcagaaa

SEQ ID NO: 567660 - DNA, 20 bp, Artificial
  CRISPR gRNA sequence
ggtgctgcagaaaggcttgc

SEQ ID NO: 567661 - DNA, 20 bp, Artificial
  CRISPR gRNA sequence
cagaaaggcttgcacacttt

SEQ ID NO: 567662 - DNA, 20 bp, Artificial
  CRISPR gRNA sequence
gcacacttttagatgagttg

SEQ ID NO: 567663 - DNA, 20 bp, Artificial
  CRISPR gRNA sequence
cacacttttagatgagttgg

SEQ ID NO: 567664 - DNA, 20 bp, Artificial
  CRISPR gRNA sequence
ttagatgagttggataggca

SEQ ID NO: 567665 - DNA, 20 bp, Artificial
  CRISPR gRNA sequence
tagatgagttggataggcac

SEQ ID NO: 567666 - DNA, 20 bp, Artificial
  CRISPR gRNA sequence
agatgagttggataggcact

SEQ ID NO: 567667 - DNA, 20 bp, Artificial
  CRISPR gRNA sequence
gatgagttggataggcactt

SEQ ID NO: 567668 - DNA, 20 bp, Artificial
  CRISPR gRNA sequence
gataggcacttctacctttg

SEQ ID NO: 567669 - DNA, 20 bp, Artificial
  CRISPR gRNA sequence
ctacctttgccatctggcaa

SEQ ID NO: 567670 - DNA, 20 bp, Artificial
  CRISPR gRNA sequence
tacctttgccatctggcaac

SEQ ID NO: 567671 - DNA, 20 bp, Artificial
  CRISPR gRNA sequence
cctttgccatctggcaactg

SEQ ID NO: 567672 - DNA, 20 bp, Artificial
  CRISPR gRNA sequence
tgccatctggcaactgttgt

SEQ ID NO: 567673 - DNA, 20 bp, Artificial
  CRISPR gRNA sequence
gccatctggcaactgttgtg

SEQ ID NO: 567674 - DNA, 20 bp, Artificial
  CRISPR gRNA sequence
ccatctggcaactgttgtgt

SEQ ID NO: 567675 - DNA, 20 bp, Artificial
  CRISPR gRNA sequence
gcaactgttgtgtaatgaga

SEQ ID NO: 567676 - DNA, 20 bp, Artificial
  CRISPR gRNA sequence
ttgtgtaatgagatagccag

SEQ ID NO: 567677 - DNA, 20 bp, Artificial
  CRISPR gRNA sequence
tgtaatgagatagccagaaa

SEQ ID NO: 567678 - DNA, 20 bp, Artificial
  CRISPR gRNA sequence
ctacctagtcaagggagttc

SEQ ID NO: 567679 - DNA, 20 bp, Artificial
  CRISPR gRNA sequence
tacctagtcaagggagttct

SEQ ID NO: 567680 - DNA, 20 bp, Artificial
  CRISPR gRNA sequence
cctagtcaagggagttctag

SEQ ID NO: 567681 - DNA, 20 bp, Artificial
  CRISPR gRNA sequence
gtcaagggagttctagcaac

SEQ ID NO: 567682 - DNA, 20 bp, Artificial
  CRISPR gRNA sequence
tagcaacttagaagataata

SEQ ID NO: 567683 - DNA, 20 bp, Artificial
  CRISPR gRNA sequence
gcaacttagaagataatact

SEQ ID NO: 567684 - DNA, 20 bp, Artificial
  CRISPR gRNA sequence
agaagataatactaacactt

SEQ ID NO: 567685 - DNA, 20 bp, Artificial
  CRISPR gRNA sequence
gaagataatactaacacttc

SEQ ID NO: 567686 - DNA, 20 bp, Artificial
  CRISPR gRNA sequence
acacttcttcatgtttcccc

SEQ ID NO: 567687 - DNA, 20 bp, Artificial
  CRISPR gRNA sequence
cttcatgtttcccctgaaat

SEQ ID NO: 567688 - DNA, 20 bp, Artificial
  CRISPR gRNA sequence
ttcatgtttcccctgaaatt

SEQ ID NO: 567689 - DNA, 20 bp, Artificial
  CRISPR gRNA sequence
catgtttcccctgaaattac

SEQ ID NO: 567690 - DNA, 20 bp, Artificial
  CRISPR gRNA sequence
atgtttcccctgaaattact

SEQ ID NO: 567691 - DNA, 20 bp, Artificial
  CRISPR gRNA sequence
cccctgaaattactttcata

SEQ ID NO: 567692 - DNA, 20 bp, Artificial
  CRISPR gRNA sequence
ccctgaaattactttcatat

SEQ ID NO: 567693 - DNA, 20 bp, Artificial
  CRISPR gRNA sequence
aaattactttcatattctgt

SEQ ID NO: 567694 - DNA, 20 bp, Artificial
  CRISPR gRNA sequence
ctttcatattctgttttttt

SEQ ID NO: 567695 - DNA, 20 bp, Artificial
  CRISPR gRNA sequence
tcatattctgttttttttct

SEQ ID NO: 567696 - DNA, 20 bp, Artificial
  CRISPR gRNA sequence
catattctgttttttttctt

SEQ ID NO: 567697 - DNA, 20 bp, Artificial
  CRISPR gRNA sequence
atattctgttttttttcttt

SEQ ID NO: 567698 - DNA, 20 bp, Artificial
  CRISPR gRNA sequence
tgttttttttcttttctttt

SEQ ID NO: 567699 - DNA, 20 bp, Artificial
  CRISPR gRNA sequence
ttttttttcttttcttttct

SEQ ID NO: 567700 - DNA, 20 bp, Artificial
  CRISPR gRNA sequence
tttttcttttcttttctttt

SEQ ID NO: 567701 - DNA, 20 bp, Artificial
  CRISPR gRNA sequence
ttttcttttcttttcttttc

SEQ ID NO: 567702 - DNA, 20 bp, Artificial
  CRISPR gRNA sequence
tttcttttcttttcttttct

SEQ ID NO: 567703 - DNA, 20 bp, Artificial
  CRISPR gRNA sequence
ttcttttcttttcttttctt

SEQ ID NO: 567704 - DNA, 20 bp, Artificial
  CRISPR gRNA sequence
tcttttcttttcttttcttt

SEQ ID NO: 567705 - DNA, 20 bp, Artificial
  CRISPR gRNA sequence
cttttcttttcttttctttt

SEQ ID NO: 567706 - DNA, 20 bp, Artificial
  CRISPR gRNA sequence
ttttcttttcttttcttttc

SEQ ID NO: 567707 - DNA, 20 bp, Artificial
  CRISPR gRNA sequence
ttcttttcttttcttttctt

SEQ ID NO: 567708 - DNA, 20 bp, Artificial
  CRISPR gRNA sequence
tcttttcttttcttttcttt

SEQ ID NO: 567709 - DNA, 20 bp, Artificial
  CRISPR gRNA sequence
cttttcttttcttttctttt

SEQ ID NO: 567710 - DNA, 20 bp, Artificial
  CRISPR gRNA sequence
ttttcttttcttttcttttt

SEQ ID NO: 567711 - DNA, 20 bp, Artificial
  CRISPR gRNA sequence
ttcttttcttttctttttta

SEQ ID NO: 567712 - DNA, 20 bp, Artificial
  CRISPR gRNA sequence
tcttttcttttcttttttac

SEQ ID NO: 567713 - DNA, 20 bp, Artificial
  CRISPR gRNA sequence
cttttcttttcttttttaca

SEQ ID NO: 567714 - DNA, 20 bp, Artificial
  CRISPR gRNA sequence
ttttcttttcttttttacaa

SEQ ID NO: 567715 - DNA, 20 bp, Artificial
  CRISPR gRNA sequence
ttcttttcttttttacaaac

SEQ ID NO: 567716 - DNA, 20 bp, Artificial
  CRISPR gRNA sequence
tcttttcttttttacaaacc

SEQ ID NO: 567717 - DNA, 20 bp, Artificial
  CRISPR gRNA sequence
cttttcttttttacaaaccc

SEQ ID NO: 567718 - DNA, 20 bp, Artificial
  CRISPR gRNA sequence
ttttcttttttacaaaccct

SEQ ID NO: 567719 - DNA, 20 bp, Artificial
  CRISPR gRNA sequence
ttcttttttacaaaccctgc

SEQ ID NO: 567720 - DNA, 20 bp, Artificial
  CRISPR gRNA sequence
tcttttttacaaaccctgca

SEQ ID NO: 567721 - DNA, 20 bp, Artificial
  CRISPR gRNA sequence
cttttttacaaaccctgcat

SEQ ID NO: 567722 - DNA, 20 bp, Artificial
  CRISPR gRNA sequence
ttttttacaaaccctgcatg

SEQ ID NO: 567723 - DNA, 20 bp, Artificial
  CRISPR gRNA sequence
ttttacaaaccctgcatgtg

SEQ ID NO: 567724 - DNA, 20 bp, Artificial
  CRISPR gRNA sequence
tttacaaaccctgcatgtgg

SEQ ID NO: 567725 - DNA, 20 bp, Artificial
  CRISPR gRNA sequence
ttacaaaccctgcatgtggc

SEQ ID NO: 567726 - DNA, 20 bp, Artificial
  CRISPR gRNA sequence
tacaaaccctgcatgtggca

SEQ ID NO: 567727 - DNA, 20 bp, Artificial
  CRISPR gRNA sequence
acaaaccctgcatgtggcac

SEQ ID NO: 567728 - DNA, 20 bp, Artificial
  CRISPR gRNA sequence
caaaccctgcatgtggcact

SEQ ID NO: 567729 - DNA, 20 bp, Artificial
  CRISPR gRNA sequence
catgtggcactcagtcatat

SEQ ID NO: 567730 - DNA, 20 bp, Artificial
  CRISPR gRNA sequence
agtcatattctgtttgacct

SEQ ID NO: 567731 - DNA, 20 bp, Artificial
  CRISPR gRNA sequence
tgtttgacctttacagtgac

SEQ ID NO: 567732 - DNA, 20 bp, Artificial
  CRISPR gRNA sequence
tttgacctttacagtgacct

SEQ ID NO: 567733 - DNA, 20 bp, Artificial
  CRISPR gRNA sequence
gacctttacagtgacctgat

SEQ ID NO: 567734 - DNA, 20 bp, Artificial
  CRISPR gRNA sequence
acctttacagtgacctgata

SEQ ID NO: 567735 - DNA, 20 bp, Artificial
  CRISPR gRNA sequence
tacagtgacctgatacagca

SEQ ID NO: 567736 - DNA, 20 bp, Artificial
  CRISPR gRNA sequence
acagtgacctgatacagcat

SEQ ID NO: 567737 - DNA, 20 bp, Artificial
  CRISPR gRNA sequence
cagtgacctgatacagcatt

SEQ ID NO: 567738 - DNA, 20 bp, Artificial
  CRISPR gRNA sequence
atacagcattccctttcaca

SEQ ID NO: 567739 - DNA, 20 bp, Artificial
  CRISPR gRNA sequence
cctttcacagatgaaaataa

SEQ ID NO: 567740 - DNA, 20 bp, Artificial
  CRISPR gRNA sequence
tcacagatgaaaataagaca

SEQ ID NO: 567741 - DNA, 20 bp, Artificial
  CRISPR gRNA sequence
cacagatgaaaataagacag

SEQ ID NO: 567742 - DNA, 20 bp, Artificial
  CRISPR gRNA sequence
acagatgaaaataagacagt

SEQ ID NO: 567743 - DNA, 20 bp, Artificial
  CRISPR gRNA sequence
aggagtccgtttctctgtaa

SEQ ID NO: 567744 - DNA, 20 bp, Artificial
  CRISPR gRNA sequence
ggagtccgtttctctgtaag

SEQ ID NO: 567745 - DNA, 20 bp, Artificial
  CRISPR gRNA sequence
ctctgtaagtagaacaagag

SEQ ID NO: 567746 - DNA, 20 bp, Artificial
  CRISPR gRNA sequence
tctgtaagtagaacaagaga

SEQ ID NO: 567747 - DNA, 20 bp, Artificial
  CRISPR gRNA sequence
tgtaagtagaacaagagacc

SEQ ID NO: 567748 - DNA, 20 bp, Artificial
  CRISPR gRNA sequence
taagtagaacaagagacctg

SEQ ID NO: 567749 - DNA, 20 bp, Artificial
  CRISPR gRNA sequence
gatggatgctttcttaaaac

SEQ ID NO: 567750 - DNA, 20 bp, Artificial
  CRISPR gRNA sequence
tcttaaaactcttccagctc

SEQ ID NO: 567751 - DNA, 20 bp, Artificial
  CRISPR gRNA sequence
cttaaaactcttccagctcc

SEQ ID NO: 567752 - DNA, 20 bp, Artificial
  CRISPR gRNA sequence
ttaaaactcttccagctcct

SEQ ID NO: 567753 - DNA, 20 bp, Artificial
  CRISPR gRNA sequence
aaaactcttccagctcctaa

SEQ ID NO: 567754 - DNA, 20 bp, Artificial
  CRISPR gRNA sequence
aaactcttccagctcctaaa

SEQ ID NO: 567755 - DNA, 20 bp, Artificial
  CRISPR gRNA sequence
ttccagctcctaaaaggact

SEQ ID NO: 567756 - DNA, 20 bp, Artificial
  CRISPR gRNA sequence
ccagctcctaaaaggactgt

SEQ ID NO: 567757 - DNA, 20 bp, Artificial
  CRISPR gRNA sequence
cagctcctaaaaggactgtg

SEQ ID NO: 567758 - DNA, 20 bp, Artificial
  CRISPR gRNA sequence
ctaaaaggactgtggcccca

SEQ ID NO: 567759 - DNA, 20 bp, Artificial
  CRISPR gRNA sequence
aaaggactgtggccccaggt

SEQ ID NO: 567760 - DNA, 20 bp, Artificial
  CRISPR gRNA sequence
tggccccaggtcacacagca

SEQ ID NO: 567761 - DNA, 20 bp, Artificial
  CRISPR gRNA sequence
aggcttgatcaaacctccca

SEQ ID NO: 567762 - DNA, 20 bp, Artificial
  CRISPR gRNA sequence
gatcaaacctcccaactcct

SEQ ID NO: 567763 - DNA, 20 bp, Artificial
  CRISPR gRNA sequence
atcaaacctcccaactccta

SEQ ID NO: 567764 - DNA, 20 bp, Artificial
  CRISPR gRNA sequence
ccaactcctactcagtgact

SEQ ID NO: 567765 - DNA, 20 bp, Artificial
  CRISPR gRNA sequence
ctactcagtgactcttctca

SEQ ID NO: 567766 - DNA, 20 bp, Artificial
  CRISPR gRNA sequence
ctcagtgactcttctcatca

SEQ ID NO: 567767 - DNA, 20 bp, Artificial
  CRISPR gRNA sequence
agtgactcttctcatcatat

SEQ ID NO: 567768 - DNA, 20 bp, Artificial
  CRISPR gRNA sequence
ttctcatcatatcacatacc

SEQ ID NO: 567769 - DNA, 20 bp, Artificial
  CRISPR gRNA sequence
ctcatcatatcacataccct

SEQ ID NO: 567770 - DNA, 20 bp, Artificial
  CRISPR gRNA sequence
tcatcatatcacataccctc

SEQ ID NO: 567771 - DNA, 20 bp, Artificial
  CRISPR gRNA sequence
atcatatcacataccctccg

SEQ ID NO: 567772 - DNA, 20 bp, Artificial
  CRISPR gRNA sequence
cggggagcctcggcttcctg

SEQ ID NO: 567773 - DNA, 20 bp, Artificial
  CRISPR gRNA sequence
ggcttcctggagttggaaac

SEQ ID NO: 567774 - DNA, 20 bp, Artificial
  CRISPR gRNA sequence
cctggagttggaaactcaca

SEQ ID NO: 567775 - DNA, 20 bp, Artificial
  CRISPR gRNA sequence
ctggagttggaaactcacag

SEQ ID NO: 567776 - DNA, 20 bp, Artificial
  CRISPR gRNA sequence
gagttggaaactcacagcca

SEQ ID NO: 567777 - DNA, 20 bp, Artificial
  CRISPR gRNA sequence
gaaactcacagccaatggcc

SEQ ID NO: 567778 - DNA, 20 bp, Artificial
  CRISPR gRNA sequence
acagccaatggccgtgtgct

SEQ ID NO: 567779 - DNA, 20 bp, Artificial
  CRISPR gRNA sequence
tattacagctagcatttgtt

SEQ ID NO: 567780 - DNA, 20 bp, Artificial
  CRISPR gRNA sequence
ttacagctagcatttgttaa

SEQ ID NO: 567781 - DNA, 20 bp, Artificial
  CRISPR gRNA sequence
cagctagcatttgttaagta

SEQ ID NO: 567782 - DNA, 20 bp, Artificial
  CRISPR gRNA sequence
gcatttgttaagtacttact

SEQ ID NO: 567783 - DNA, 20 bp, Artificial
  CRISPR gRNA sequence
gttaagtacttactctgtgc

SEQ ID NO: 567784 - DNA, 20 bp, Artificial
  CRISPR gRNA sequence
ttaagtacttactctgtgca

SEQ ID NO: 567785 - DNA, 20 bp, Artificial
  CRISPR gRNA sequence
agtacttactctgtgcaggc

SEQ ID NO: 567786 - DNA, 20 bp, Artificial
  CRISPR gRNA sequence
actctgtgcaggcactacat

SEQ ID NO: 567787 - DNA, 20 bp, Artificial
  CRISPR gRNA sequence
ctctgtgcaggcactacatg

SEQ ID NO: 567788 - DNA, 20 bp, Artificial
  CRISPR gRNA sequence
tgtgcaggcactacatgtta

SEQ ID NO: 567789 - DNA, 20 bp, Artificial
  CRISPR gRNA sequence
tgcaggcactacatgttaat

SEQ ID NO: 567790 - DNA, 20 bp, Artificial
  CRISPR gRNA sequence
catgttaattcatatgttga

SEQ ID NO: 567791 - DNA, 20 bp, Artificial
  CRISPR gRNA sequence
attcatatgttgattattat

SEQ ID NO: 567792 - DNA, 20 bp, Artificial
  CRISPR gRNA sequence
atatgttgattattatctgt

SEQ ID NO: 567793 - DNA, 20 bp, Artificial
  CRISPR gRNA sequence
attattatctgtgttaactc

SEQ ID NO: 567794 - DNA, 20 bp, Artificial
  CRISPR gRNA sequence
ttatctgtgttaactcattt

SEQ ID NO: 567795 - DNA, 20 bp, Artificial
  CRISPR gRNA sequence
tctgtgttaactcatttaat

SEQ ID NO: 567796 - DNA, 20 bp, Artificial
  CRISPR gRNA sequence
tgttaactcatttaatctca

SEQ ID NO: 567797 - DNA, 20 bp, Artificial
  CRISPR gRNA sequence
actcatttaatctcattaca

SEQ ID NO: 567798 - DNA, 20 bp, Artificial
  CRISPR gRNA sequence
atttaatctcattacagtct

SEQ ID NO: 567799 - DNA, 20 bp, Artificial
  CRISPR gRNA sequence
aatctcattacagtctgata

SEQ ID NO: 567800 - DNA, 20 bp, Artificial
  CRISPR gRNA sequence
atctcattacagtctgatag

SEQ ID NO: 567801 - DNA, 20 bp, Artificial
  CRISPR gRNA sequence
attacagtctgatagagtaa

SEQ ID NO: 567802 - DNA, 20 bp, Artificial
  CRISPR gRNA sequence
cagtctgatagagtaagtac

SEQ ID NO: 567803 - DNA, 20 bp, Artificial
  CRISPR gRNA sequence
atagagtaagtactatttgt

SEQ ID NO: 567804 - DNA, 20 bp, Artificial
  CRISPR gRNA sequence
tttgtgtccttattgtagag

SEQ ID NO: 567805 - DNA, 20 bp, Artificial
  CRISPR gRNA sequence
gtgtccttattgtagagagg

SEQ ID NO: 567806 - DNA, 20 bp, Artificial
  CRISPR gRNA sequence
tgtccttattgtagagagga

SEQ ID NO: 567807 - DNA, 20 bp, Artificial
  CRISPR gRNA sequence
attgtagagaggaggaaacc

SEQ ID NO: 567808 - DNA, 20 bp, Artificial
  CRISPR gRNA sequence
ttgtagagaggaggaaacct

SEQ ID NO: 567809 - DNA, 20 bp, Artificial
  CRISPR gRNA sequence
tagagaggaggaaacctaga

SEQ ID NO: 567810 - DNA, 20 bp, Artificial
  CRISPR gRNA sequence
gacacaaggtgatttaagta

SEQ ID NO: 567811 - DNA, 20 bp, Artificial
  CRISPR gRNA sequence
aagtaacttgcccaatgtca

SEQ ID NO: 567812 - DNA, 20 bp, Artificial
  CRISPR gRNA sequence
agtaacttgcccaatgtcaa

SEQ ID NO: 567813 - DNA, 20 bp, Artificial
  CRISPR gRNA sequence
gcccaatgtcaaatggctct

SEQ ID NO: 567814 - DNA, 20 bp, Artificial
  CRISPR gRNA sequence
cccaatgtcaaatggctctt

SEQ ID NO: 567815 - DNA, 20 bp, Artificial
  CRISPR gRNA sequence
ttagtcatgaagctgggata

SEQ ID NO: 567816 - DNA, 20 bp, Artificial
  CRISPR gRNA sequence
agtcatgaagctgggatatg

SEQ ID NO: 567817 - DNA, 20 bp, Artificial
  CRISPR gRNA sequence
gtcatgaagctgggatatgc

SEQ ID NO: 567818 - DNA, 20 bp, Artificial
  CRISPR gRNA sequence
ggatatgcactcaggcagct

SEQ ID NO: 567819 - DNA, 20 bp, Artificial
  CRISPR gRNA sequence
aggcagctgggcttctgagt

SEQ ID NO: 567820 - DNA, 20 bp, Artificial
  CRISPR gRNA sequence
ggcttctgagtccatgctaa

SEQ ID NO: 567821 - DNA, 20 bp, Artificial
  CRISPR gRNA sequence
ctgagtccatgctaaacacc

SEQ ID NO: 567822 - DNA, 20 bp, Artificial
  CRISPR gRNA sequence
tgagtccatgctaaacacca

SEQ ID NO: 567823 - DNA, 20 bp, Artificial
  CRISPR gRNA sequence
agtccatgctaaacaccata

SEQ ID NO: 567824 - DNA, 20 bp, Artificial
  CRISPR gRNA sequence
aacaccatactgtacctctt

SEQ ID NO: 567825 - DNA, 20 bp, Artificial
  CRISPR gRNA sequence
tacctctttggagatagcgg

SEQ ID NO: 567826 - DNA, 20 bp, Artificial
  CRISPR gRNA sequence
tttggagatagcgggtagaa

SEQ ID NO: 567827 - DNA, 20 bp, Artificial
  CRISPR gRNA sequence
tggagatagcgggtagaaga

SEQ ID NO: 567828 - DNA, 20 bp, Artificial
  CRISPR gRNA sequence
ggagatagcgggtagaagaa

SEQ ID NO: 567829 - DNA, 20 bp, Artificial
  CRISPR gRNA sequence
gagatagcgggtagaagaat

SEQ ID NO: 567830 - DNA, 20 bp, Artificial
  CRISPR gRNA sequence
acattttatttgaagactgt

SEQ ID NO: 567831 - DNA, 20 bp, Artificial
  CRISPR gRNA sequence
cattttatttgaagactgtc

SEQ ID NO: 567832 - DNA, 20 bp, Artificial
  CRISPR gRNA sequence
tatttgaagactgtctctct

SEQ ID NO: 567833 - DNA, 20 bp, Artificial
  CRISPR gRNA sequence
atttgaagactgtctctctg

SEQ ID NO: 567834 - DNA, 20 bp, Artificial
  CRISPR gRNA sequence
tttgaagactgtctctctga

SEQ ID NO: 567835 - DNA, 20 bp, Artificial
  CRISPR gRNA sequence
gaagactgtctctctgaatc

SEQ ID NO: 567836 - DNA, 20 bp, Artificial
  CRISPR gRNA sequence
aagactgtctctctgaatct

SEQ ID NO: 567837 - DNA, 20 bp, Artificial
  CRISPR gRNA sequence
tctctctgaatctatccttc

SEQ ID NO: 567838 - DNA, 20 bp, Artificial
  CRISPR gRNA sequence
tctgaatctatccttctatc

SEQ ID NO: 567839 - DNA, 20 bp, Artificial
  CRISPR gRNA sequence
tgaatctatccttctatcca

SEQ ID NO: 567840 - DNA, 20 bp, Artificial
  CRISPR gRNA sequence
aatctatccttctatccatc

SEQ ID NO: 567841 - DNA, 20 bp, Artificial
  CRISPR gRNA sequence
tccttctatccatctgtctc

SEQ ID NO: 567842 - DNA, 20 bp, Artificial
  CRISPR gRNA sequence
ctatccatctgtctccccat

SEQ ID NO: 567843 - DNA, 20 bp, Artificial
  CRISPR gRNA sequence
tatccatctgtctccccatc

SEQ ID NO: 567844 - DNA, 20 bp, Artificial
  CRISPR gRNA sequence
tccatctgtctccccatctg

SEQ ID NO: 567845 - DNA, 20 bp, Artificial
  CRISPR gRNA sequence
tctccccatctgtcctgtac

SEQ ID NO: 567846 - DNA, 20 bp, Artificial
  CRISPR gRNA sequence
cccatctgtcctgtactgct

SEQ ID NO: 567847 - DNA, 20 bp, Artificial
  CRISPR gRNA sequence
tcctgtactgcttgtgagga

SEQ ID NO: 567848 - DNA, 20 bp, Artificial
  CRISPR gRNA sequence
tactgcttgtgaggagccat

SEQ ID NO: 567849 - DNA, 20 bp, Artificial
  CRISPR gRNA sequence
cttgtgaggagccatctgtg

SEQ ID NO: 567850 - DNA, 20 bp, Artificial
  CRISPR gRNA sequence
gtgaggagccatctgtgtgc

SEQ ID NO: 567851 - DNA, 20 bp, Artificial
  CRISPR gRNA sequence
tgaggagccatctgtgtgcc

SEQ ID NO: 567852 - DNA, 20 bp, Artificial
  CRISPR gRNA sequence
tgtgccttgcattatgtcat

SEQ ID NO: 567853 - DNA, 20 bp, Artificial
  CRISPR gRNA sequence
gcattatgtcatgtgctgtg

SEQ ID NO: 567854 - DNA, 20 bp, Artificial
  CRISPR gRNA sequence
cattatgtcatgtgctgtgg

SEQ ID NO: 567855 - DNA, 20 bp, Artificial
  CRISPR gRNA sequence
tgtcatgtgctgtggttgaa

SEQ ID NO: 567856 - DNA, 20 bp, Artificial
  CRISPR gRNA sequence
tggttgaaaggtgagtcata

SEQ ID NO: 567857 - DNA, 20 bp, Artificial
  CRISPR gRNA sequence
aaaggtgagtcatacctagt

SEQ ID NO: 567858 - DNA, 20 bp, Artificial
  CRISPR gRNA sequence
gtctttgccctccaaagata

SEQ ID NO: 567859 - DNA, 20 bp, Artificial
  CRISPR gRNA sequence
tgccctccaaagatacacag

SEQ ID NO: 567860 - DNA, 20 bp, Artificial
  CRISPR gRNA sequence
gccctccaaagatacacagt

SEQ ID NO: 567861 - DNA, 20 bp, Artificial
  CRISPR gRNA sequence
ccctccaaagatacacagtc

SEQ ID NO: 567862 - DNA, 20 bp, Artificial
  CRISPR gRNA sequence
caaagatacacagtctctgg

SEQ ID NO: 567863 - DNA, 20 bp, Artificial
  CRISPR gRNA sequence
tggggctgatgatgcacctc

SEQ ID NO: 567864 - DNA, 20 bp, Artificial
  CRISPR gRNA sequence
gggctgatgatgcacctctg

SEQ ID NO: 567865 - DNA, 20 bp, Artificial
  CRISPR gRNA sequence
atgatgcacctctgttcagt

SEQ ID NO: 567866 - DNA, 20 bp, Artificial
  CRISPR gRNA sequence
tgttcagttcagaaagtgct

SEQ ID NO: 567867 - DNA, 20 bp, Artificial
  CRISPR gRNA sequence
ttcagttcagaaagtgctgg

SEQ ID NO: 567868 - DNA, 20 bp, Artificial
  CRISPR gRNA sequence
agttcagaaagtgctggatg

SEQ ID NO: 567869 - DNA, 20 bp, Artificial
  CRISPR gRNA sequence
agaaagtgctggatgaaaga

SEQ ID NO: 567870 - DNA, 20 bp, Artificial
  CRISPR gRNA sequence
gatgaaagactagacattgg

SEQ ID NO: 567871 - DNA, 20 bp, Artificial
  CRISPR gRNA sequence
gacattggcagagctagatc

SEQ ID NO: 567872 - DNA, 20 bp, Artificial
  CRISPR gRNA sequence
gcagagctagatcaatacat

SEQ ID NO: 567873 - DNA, 20 bp, Artificial
  CRISPR gRNA sequence
gatcaatacattagaatctg

SEQ ID NO: 567874 - DNA, 20 bp, Artificial
  CRISPR gRNA sequence
gaatctgcaacagaacaaac

SEQ ID NO: 567875 - DNA, 20 bp, Artificial
  CRISPR gRNA sequence
caacagaacaaacaggccac

SEQ ID NO: 567876 - DNA, 20 bp, Artificial
  CRISPR gRNA sequence
ggatggtggggctcaggaat

SEQ ID NO: 567877 - DNA, 20 bp, Artificial
  CRISPR gRNA sequence
aggaatctgtatttttaaca

SEQ ID NO: 567878 - DNA, 20 bp, Artificial
  CRISPR gRNA sequence
tatttttaacaagcaccctt

SEQ ID NO: 567879 - DNA, 20 bp, Artificial
  CRISPR gRNA sequence
ttaacaagcacccttggtga

SEQ ID NO: 567880 - DNA, 20 bp, Artificial
  CRISPR gRNA sequence
taacaagcacccttggtgat

SEQ ID NO: 567881 - DNA, 20 bp, Artificial
  CRISPR gRNA sequence
aacaagcacccttggtgatt

SEQ ID NO: 567882 - DNA, 20 bp, Artificial
  CRISPR gRNA sequence
acaagcacccttggtgattc

SEQ ID NO: 567883 - DNA, 20 bp, Artificial
  CRISPR gRNA sequence
ggtgattcttaggcacctta

SEQ ID NO: 567884 - DNA, 20 bp, Artificial
  CRISPR gRNA sequence
gtgattcttaggcaccttaa

SEQ ID NO: 567885 - DNA, 20 bp, Artificial
  CRISPR gRNA sequence
ttaggcaccttaaaatttga

SEQ ID NO: 567886 - DNA, 20 bp, Artificial
  CRISPR gRNA sequence
aggcaccttaaaatttgaga

SEQ ID NO: 567887 - DNA, 20 bp, Artificial
  CRISPR gRNA sequence
ggcaccttaaaatttgagaa

SEQ ID NO: 567888 - DNA, 20 bp, Artificial
  CRISPR gRNA sequence
aaaatttgagaaatgcttca

SEQ ID NO: 567889 - DNA, 20 bp, Artificial
  CRISPR gRNA sequence
aaatttgagaaatgcttcaa

SEQ ID NO: 567890 - DNA, 20 bp, Artificial
  CRISPR gRNA sequence
gagaaatgcttcaaaggacc

SEQ ID NO: 567891 - DNA, 20 bp, Artificial
  CRISPR gRNA sequence
agaaatgcttcaaaggacca

SEQ ID NO: 567892 - DNA, 20 bp, Artificial
  CRISPR gRNA sequence
caaaggaccatttctaagga

SEQ ID NO: 567893 - DNA, 20 bp, Artificial
  CRISPR gRNA sequence
aaaggaccatttctaaggag

SEQ ID NO: 567894 - DNA, 20 bp, Artificial
  CRISPR gRNA sequence
ctaaggaggtagaaagcttg

SEQ ID NO: 567895 - DNA, 20 bp, Artificial
  CRISPR gRNA sequence
taaggaggtagaaagcttgg

SEQ ID NO: 567896 - DNA, 20 bp, Artificial
  CRISPR gRNA sequence
aggaggtagaaagcttggtt

SEQ ID NO: 567897 - DNA, 20 bp, Artificial
  CRISPR gRNA sequence
ggttttctgcccctgagaaa

SEQ ID NO: 567898 - DNA, 20 bp, Artificial
  CRISPR gRNA sequence
gttttctgcccctgagaaat

SEQ ID NO: 567899 - DNA, 20 bp, Artificial
  CRISPR gRNA sequence
tctgcccctgagaaatgccc

SEQ ID NO: 567900 - DNA, 20 bp, Artificial
  CRISPR gRNA sequence
ctgcccctgagaaatgccca

SEQ ID NO: 567901 - DNA, 20 bp, Artificial
  CRISPR gRNA sequence
tgcccctgagaaatgcccag

SEQ ID NO: 567902 - DNA, 20 bp, Artificial
  CRISPR gRNA sequence
cccctgagaaatgcccagcc

SEQ ID NO: 567903 - DNA, 20 bp, Artificial
  CRISPR gRNA sequence
agaaatgcccagcctagtta

SEQ ID NO: 567904 - DNA, 20 bp, Artificial
  CRISPR gRNA sequence
gttacagaggcaggcataag

SEQ ID NO: 567905 - DNA, 20 bp, Artificial
  CRISPR gRNA sequence
cagaggcaggcataagtata

SEQ ID NO: 567906 - DNA, 20 bp, Artificial
  CRISPR gRNA sequence
agaacaggcatttttgaact

SEQ ID NO: 567907 - DNA, 20 bp, Artificial
  CRISPR gRNA sequence
ttgaactattctggggatgc

SEQ ID NO: 567908 - DNA, 20 bp, Artificial
  CRISPR gRNA sequence
tgaactattctggggatgca

SEQ ID NO: 567909 - DNA, 20 bp, Artificial
  CRISPR gRNA sequence
gaactattctggggatgcat

SEQ ID NO: 567910 - DNA, 20 bp, Artificial
  CRISPR gRNA sequence
aactattctggggatgcatg

SEQ ID NO: 567911 - DNA, 20 bp, Artificial
  CRISPR gRNA sequence
ttctggggatgcatgttcct

SEQ ID NO: 567912 - DNA, 20 bp, Artificial
  CRISPR gRNA sequence
tggggatgcatgttccttgg

SEQ ID NO: 567913 - DNA, 20 bp, Artificial
  CRISPR gRNA sequence
gggatgcatgttccttggaa

SEQ ID NO: 567914 - DNA, 20 bp, Artificial
  CRISPR gRNA sequence
cttggaagtcccctgagggc

SEQ ID NO: 567915 - DNA, 20 bp, Artificial
  CRISPR gRNA sequence
ggaagtcccctgagggctgc

SEQ ID NO: 567916 - DNA, 20 bp, Artificial
  CRISPR gRNA sequence
gaagtcccctgagggctgct

SEQ ID NO: 567917 - DNA, 20 bp, Artificial
  CRISPR gRNA sequence
agggctgctatggggtgggg

SEQ ID NO: 567918 - DNA, 20 bp, Artificial
  CRISPR gRNA sequence
ctatggggtggggtgggcaa

SEQ ID NO: 567919 - DNA, 20 bp, Artificial
  CRISPR gRNA sequence
tggggtggggtgggcaaaag

SEQ ID NO: 567920 - DNA, 20 bp, Artificial
  CRISPR gRNA sequence
ggagagcagggctctaggct

SEQ ID NO: 567921 - DNA, 20 bp, Artificial
  CRISPR gRNA sequence
taggctttcaattttgagtc

SEQ ID NO: 567922 - DNA, 20 bp, Artificial
  CRISPR gRNA sequence
ggctttcaattttgagtcaa

SEQ ID NO: 567923 - DNA, 20 bp, Artificial
  CRISPR gRNA sequence
tcaattttgagtcaactaga

SEQ ID NO: 567924 - DNA, 20 bp, Artificial
  CRISPR gRNA sequence
caattttgagtcaactagag

SEQ ID NO: 567925 - DNA, 20 bp, Artificial
  CRISPR gRNA sequence
aattttgagtcaactagagc

SEQ ID NO: 567926 - DNA, 20 bp, Artificial
  CRISPR gRNA sequence
tgagtcaactagagcaactt

SEQ ID NO: 567927 - DNA, 20 bp, Artificial
  CRISPR gRNA sequence
gagtcaactagagcaacttc

SEQ ID NO: 567928 - DNA, 20 bp, Artificial
  CRISPR gRNA sequence
agtcaactagagcaacttct

SEQ ID NO: 567929 - DNA, 20 bp, Artificial
  CRISPR gRNA sequence
gagcaacttcttatccattg

SEQ ID NO: 567930 - DNA, 20 bp, Artificial
  CRISPR gRNA sequence
cttatccattggattggatt

SEQ ID NO: 567931 - DNA, 20 bp, Artificial
  CRISPR gRNA sequence
ttatccattggattggattg

SEQ ID NO: 567932 - DNA, 20 bp, Artificial
  CRISPR gRNA sequence
atccattggattggattgcc

SEQ ID NO: 567933 - DNA, 20 bp, Artificial
  CRISPR gRNA sequence
tccattggattggattgcca

SEQ ID NO: 567934 - DNA, 20 bp, Artificial
  CRISPR gRNA sequence
gattggattgccactgaaga

SEQ ID NO: 567935 - DNA, 20 bp, Artificial
  CRISPR gRNA sequence
gattgccactgaagatttaa

SEQ ID NO: 567936 - DNA, 20 bp, Artificial
  CRISPR gRNA sequence
ccactgaagatttaattctg

SEQ ID NO: 567937 - DNA, 20 bp, Artificial
  CRISPR gRNA sequence
aagatttaattctgagaaat

SEQ ID NO: 567938 - DNA, 20 bp, Artificial
  CRISPR gRNA sequence
aattctgagaaattccactg

SEQ ID NO: 567939 - DNA, 20 bp, Artificial
  CRISPR gRNA sequence
attctgagaaattccactgc

SEQ ID NO: 567940 - DNA, 20 bp, Artificial
  CRISPR gRNA sequence
tgagaaattccactgcttaa

SEQ ID NO: 567941 - DNA, 20 bp, Artificial
  CRISPR gRNA sequence
agaaattccactgcttaaaa

SEQ ID NO: 567942 - DNA, 20 bp, Artificial
  CRISPR gRNA sequence
cactgcttaaaagatgatta

SEQ ID NO: 567943 - DNA, 20 bp, Artificial
  CRISPR gRNA sequence
cttaaaagatgattaaaagt

SEQ ID NO: 567944 - DNA, 20 bp, Artificial
  CRISPR gRNA sequence
aaaagatgattaaaagtctt

SEQ ID NO: 567945 - DNA, 20 bp, Artificial
  CRISPR gRNA sequence
aaagatgattaaaagtcttt

SEQ ID NO: 567946 - DNA, 20 bp, Artificial
  CRISPR gRNA sequence
aaagtctttttaattaaaga

SEQ ID NO: 567947 - DNA, 20 bp, Artificial
  CRISPR gRNA sequence
tttaattaaagaaaatctta

SEQ ID NO: 567948 - DNA, 20 bp, Artificial
  CRISPR gRNA sequence
ttaattaaagaaaatcttaa

SEQ ID NO: 567949 - DNA, 20 bp, Artificial
  CRISPR gRNA sequence
taattaaagaaaatcttaag

SEQ ID NO: 567950 - DNA, 20 bp, Artificial
  CRISPR gRNA sequence
aattaaagaaaatcttaagg

SEQ ID NO: 567951 - DNA, 20 bp, Artificial
  CRISPR gRNA sequence
attaaagaaaatcttaagga

SEQ ID NO: 567952 - DNA, 20 bp, Artificial
  CRISPR gRNA sequence
aagaaaatcttaaggaagta

SEQ ID NO: 567953 - DNA, 20 bp, Artificial
  CRISPR gRNA sequence
aaggaagtatgtaaggactt

SEQ ID NO: 567954 - DNA, 20 bp, Artificial
  CRISPR gRNA sequence
aggaagtatgtaaggacttg

SEQ ID NO: 567955 - DNA, 20 bp, Artificial
  CRISPR gRNA sequence
gtgtgagctagattaaactt

SEQ ID NO: 567956 - DNA, 20 bp, Artificial
  CRISPR gRNA sequence
tgtgagctagattaaactta

SEQ ID NO: 567957 - DNA, 20 bp, Artificial
  CRISPR gRNA sequence
gattaaacttaaaaactagg

SEQ ID NO: 567958 - DNA, 20 bp, Artificial
  CRISPR gRNA sequence
aacttaaaaactaggaagcc

SEQ ID NO: 567959 - DNA, 20 bp, Artificial
  CRISPR gRNA sequence
aaaaactaggaagccccaag

SEQ ID NO: 567960 - DNA, 20 bp, Artificial
  CRISPR gRNA sequence
aaaactaggaagccccaagt

SEQ ID NO: 567961 - DNA, 20 bp, Artificial
  CRISPR gRNA sequence
ggaagccccaagtagaaagg

SEQ ID NO: 567962 - DNA, 20 bp, Artificial
  CRISPR gRNA sequence
tggtttctaccaaggcaggc

SEQ ID NO: 567963 - DNA, 20 bp, Artificial
  CRISPR gRNA sequence
gtttctaccaaggcaggctg

SEQ ID NO: 567964 - DNA, 20 bp, Artificial
  CRISPR gRNA sequence
ctaccaaggcaggctgggta

SEQ ID NO: 567965 - DNA, 20 bp, Artificial
  CRISPR gRNA sequence
taccaaggcaggctgggtac

SEQ ID NO: 567966 - DNA, 20 bp, Artificial
  CRISPR gRNA sequence
ccaaggcaggctgggtactt

SEQ ID NO: 567967 - DNA, 20 bp, Artificial
  CRISPR gRNA sequence
ggtactttatttaactgagc

SEQ ID NO: 567968 - DNA, 20 bp, Artificial
  CRISPR gRNA sequence
tatttaactgagcgagaagg

SEQ ID NO: 567969 - DNA, 20 bp, Artificial
  CRISPR gRNA sequence
atttaactgagcgagaagga

SEQ ID NO: 567970 - DNA, 20 bp, Artificial
  CRISPR gRNA sequence
tttaactgagcgagaaggaa

SEQ ID NO: 567971 - DNA, 20 bp, Artificial
  CRISPR gRNA sequence
aactgagcgagaaggaattc

SEQ ID NO: 567972 - DNA, 20 bp, Artificial
  CRISPR gRNA sequence
actgagcgagaaggaattca

SEQ ID NO: 567973 - DNA, 20 bp, Artificial
  CRISPR gRNA sequence
agcgagaaggaattcaggag

SEQ ID NO: 567974 - DNA, 20 bp, Artificial
  CRISPR gRNA sequence
aggaggaggagaagatgggg

SEQ ID NO: 567975 - DNA, 20 bp, Artificial
  CRISPR gRNA sequence
aatgcttttatttttcagat

SEQ ID NO: 567976 - DNA, 20 bp, Artificial
  CRISPR gRNA sequence
ttatttttcagattataatt

SEQ ID NO: 567977 - DNA, 20 bp, Artificial
  CRISPR gRNA sequence
tatttttcagattataattg

SEQ ID NO: 567978 - DNA, 20 bp, Artificial
  CRISPR gRNA sequence
atttttcagattataattgg

SEQ ID NO: 567979 - DNA, 20 bp, Artificial
  CRISPR gRNA sequence
tttttcagattataattgga

SEQ ID NO: 567980 - DNA, 20 bp, Artificial
  CRISPR gRNA sequence
ttcagattataattggagca

SEQ ID NO: 567981 - DNA, 20 bp, Artificial
  CRISPR gRNA sequence
tcagattataattggagcat

SEQ ID NO: 567982 - DNA, 20 bp, Artificial
  CRISPR gRNA sequence
cagattataattggagcata

SEQ ID NO: 567983 - DNA, 20 bp, Artificial
  CRISPR gRNA sequence
agattataattggagcataa

SEQ ID NO: 567984 - DNA, 20 bp, Artificial
  CRISPR gRNA sequence
taattggagcataagcatta

SEQ ID NO: 567985 - DNA, 20 bp, Artificial
  CRISPR gRNA sequence
gagcataagcattaacttgt

SEQ ID NO: 567986 - DNA, 20 bp, Artificial
  CRISPR gRNA sequence
acttgtcttagaaaacatca

SEQ ID NO: 567987 - DNA, 20 bp, Artificial
  CRISPR gRNA sequence
gtcttagaaaacatcatttt

SEQ ID NO: 567988 - DNA, 20 bp, Artificial
  CRISPR gRNA sequence
tcttagaaaacatcatttta

SEQ ID NO: 567989 - DNA, 20 bp, Artificial
  CRISPR gRNA sequence
agaaaacatcattttaaatg

SEQ ID NO: 567990 - DNA, 20 bp, Artificial
  CRISPR gRNA sequence
gaaaacatcattttaaatga

SEQ ID NO: 567991 - DNA, 20 bp, Artificial
  CRISPR gRNA sequence
taaatgacaacatagtattc

SEQ ID NO: 567992 - DNA, 20 bp, Artificial
  CRISPR gRNA sequence
aaatgacaacatagtattcc

SEQ ID NO: 567993 - DNA, 20 bp, Artificial
  CRISPR gRNA sequence
aatgacaacatagtattcca

SEQ ID NO: 567994 - DNA, 20 bp, Artificial
  CRISPR gRNA sequence
cattatcttggtgaacctaa

SEQ ID NO: 567995 - DNA, 20 bp, Artificial
  CRISPR gRNA sequence
tcttggtgaacctaaattta

SEQ ID NO: 567996 - DNA, 20 bp, Artificial
  CRISPR gRNA sequence
ggtgaacctaaatttactta

SEQ ID NO: 567997 - DNA, 20 bp, Artificial
  CRISPR gRNA sequence
gtgaacctaaatttacttaa

SEQ ID NO: 567998 - DNA, 20 bp, Artificial
  CRISPR gRNA sequence
aatttacttaaatgctcttt

SEQ ID NO: 567999 - DNA, 20 bp, Artificial
  CRISPR gRNA sequence
acttaaatgctctttttagt

SEQ ID NO: 568000 - DNA, 20 bp, Artificial
  CRISPR gRNA sequence
cttaaatgctctttttagta

SEQ ID NO: 568001 - DNA, 20 bp, Artificial
  CRISPR gRNA sequence
aaatgctctttttagtagac

SEQ ID NO: 568002 - DNA, 20 bp, Artificial
  CRISPR gRNA sequence
aatgctctttttagtagacg

SEQ ID NO: 568003 - DNA, 20 bp, Artificial
  CRISPR gRNA sequence
tttttagtagacgtttataa

SEQ ID NO: 568004 - DNA, 20 bp, Artificial
  CRISPR gRNA sequence
tttagtagacgtttataatg

SEQ ID NO: 568005 - DNA, 20 bp, Artificial
  CRISPR gRNA sequence
ttagtagacgtttataatgt

SEQ ID NO: 568006 - DNA, 20 bp, Artificial
  CRISPR gRNA sequence
tagtagacgtttataatgta

SEQ ID NO: 568007 - DNA, 20 bp, Artificial
  CRISPR gRNA sequence
agtagacgtttataatgtat

SEQ ID NO: 568008 - DNA, 20 bp, Artificial
  CRISPR gRNA sequence
gtagacgtttataatgtatc

SEQ ID NO: 568009 - DNA, 20 bp, Artificial
  CRISPR gRNA sequence
ataatgtatcaatactttat

SEQ ID NO: 568010 - DNA, 20 bp, Artificial
  CRISPR gRNA sequence
taatgtatcaatactttatt

SEQ ID NO: 568011 - DNA, 20 bp, Artificial
  CRISPR gRNA sequence
tattatcccagtgctaccat

SEQ ID NO: 568012 - DNA, 20 bp, Artificial
  CRISPR gRNA sequence
attatcccagtgctaccatg

SEQ ID NO: 568013 - DNA, 20 bp, Artificial
  CRISPR gRNA sequence
ttatcccagtgctaccatga

SEQ ID NO: 568014 - DNA, 20 bp, Artificial
  CRISPR gRNA sequence
tcccagtgctaccatgacca

SEQ ID NO: 568015 - DNA, 20 bp, Artificial
  CRISPR gRNA sequence
ccatgaccattgttgtatat

SEQ ID NO: 568016 - DNA, 20 bp, Artificial
  CRISPR gRNA sequence
ttgtatattacatatgtttt

SEQ ID NO: 568017 - DNA, 20 bp, Artificial
  CRISPR gRNA sequence
tatattacatatgtttttgc

SEQ ID NO: 568018 - DNA, 20 bp, Artificial
  CRISPR gRNA sequence
catatgtttttgcatgtttc

SEQ ID NO: 568019 - DNA, 20 bp, Artificial
  CRISPR gRNA sequence
ttgcatgtttcctcaggcct

SEQ ID NO: 568020 - DNA, 20 bp, Artificial
  CRISPR gRNA sequence
tgcatgtttcctcaggcctc

SEQ ID NO: 568021 - DNA, 20 bp, Artificial
  CRISPR gRNA sequence
gcatgtttcctcaggcctct

SEQ ID NO: 568022 - DNA, 20 bp, Artificial
  CRISPR gRNA sequence
catgtttcctcaggcctctt

SEQ ID NO: 568023 - DNA, 20 bp, Artificial
  CRISPR gRNA sequence
cctcaggcctcttatgatta

SEQ ID NO: 568024 - DNA, 20 bp, Artificial
  CRISPR gRNA sequence
ctcaggcctcttatgattaa

SEQ ID NO: 568025 - DNA, 20 bp, Artificial
  CRISPR gRNA sequence
aggcctcttatgattaattg

SEQ ID NO: 568026 - DNA, 20 bp, Artificial
  CRISPR gRNA sequence
ttatgattaattgctggagg

SEQ ID NO: 568027 - DNA, 20 bp, Artificial
  CRISPR gRNA sequence
atgattaattgctggagggt

SEQ ID NO: 568028 - DNA, 20 bp, Artificial
  CRISPR gRNA sequence
tgattaattgctggagggta

SEQ ID NO: 568029 - DNA, 20 bp, Artificial
  CRISPR gRNA sequence
attgctggagggtagctgag

SEQ ID NO: 568030 - DNA, 20 bp, Artificial
  CRISPR gRNA sequence
ctggagggtagctgagacgc

SEQ ID NO: 568031 - DNA, 20 bp, Artificial
  CRISPR gRNA sequence
gagggtagctgagacgcaag

SEQ ID NO: 568032 - DNA, 20 bp, Artificial
  CRISPR gRNA sequence
agacgcaagaaggcatatga

SEQ ID NO: 568033 - DNA, 20 bp, Artificial
  CRISPR gRNA sequence
acaaataaatgactcatagg

SEQ ID NO: 568034 - DNA, 20 bp, Artificial
  CRISPR gRNA sequence
ataggacaaagtaattagcc

SEQ ID NO: 568035 - DNA, 20 bp, Artificial
  CRISPR gRNA sequence
gccttgaggcttttaaaggg

SEQ ID NO: 568036 - DNA, 20 bp, Artificial
  CRISPR gRNA sequence
gaggcttttaaagggcaaca

SEQ ID NO: 568037 - DNA, 20 bp, Artificial
  CRISPR gRNA sequence
aggcttttaaagggcaacaa

SEQ ID NO: 568038 - DNA, 20 bp, Artificial
  CRISPR gRNA sequence
ttaaagggcaacaatggcag

SEQ ID NO: 568039 - DNA, 20 bp, Artificial
  CRISPR gRNA sequence
taaagggcaacaatggcaga

SEQ ID NO: 568040 - DNA, 20 bp, Artificial
  CRISPR gRNA sequence
aaagggcaacaatggcagaa

SEQ ID NO: 568041 - DNA, 20 bp, Artificial
  CRISPR gRNA sequence
aagggcaacaatggcagaat

SEQ ID NO: 568042 - DNA, 20 bp, Artificial
  CRISPR gRNA sequence
gtgtcttaactcatccttgt

SEQ ID NO: 568043 - DNA, 20 bp, Artificial
  CRISPR gRNA sequence
aactcatccttgtaggtcca

SEQ ID NO: 568044 - DNA, 20 bp, Artificial
  CRISPR gRNA sequence
actcatccttgtaggtccat

SEQ ID NO: 568045 - DNA, 20 bp, Artificial
  CRISPR gRNA sequence
atccttgtaggtccatgctg

SEQ ID NO: 568046 - DNA, 20 bp, Artificial
  CRISPR gRNA sequence
gtaggtccatgctgccttag

SEQ ID NO: 568047 - DNA, 20 bp, Artificial
  CRISPR gRNA sequence
taggtccatgctgccttagc

SEQ ID NO: 568048 - DNA, 20 bp, Artificial
  CRISPR gRNA sequence
ccttagccaataggaggcac

SEQ ID NO: 568049 - DNA, 20 bp, Artificial
  CRISPR gRNA sequence
agccaataggaggcacttcc

SEQ ID NO: 568050 - DNA, 20 bp, Artificial
  CRISPR gRNA sequence
gccaataggaggcacttcct

SEQ ID NO: 568051 - DNA, 20 bp, Artificial
  CRISPR gRNA sequence
cctagaagaagggtgggagt

SEQ ID NO: 568052 - DNA, 20 bp, Artificial
  CRISPR gRNA sequence
ctagaagaagggtgggagtg

SEQ ID NO: 568053 - DNA, 20 bp, Artificial
  CRISPR gRNA sequence
gaagaagggtgggagtgagg

SEQ ID NO: 568054 - DNA, 20 bp, Artificial
  CRISPR gRNA sequence
tggacaggcaggtctgtgac

SEQ ID NO: 568055 - DNA, 20 bp, Artificial
  CRISPR gRNA sequence
gacaggcaggtctgtgacac

SEQ ID NO: 568056 - DNA, 20 bp, Artificial
  CRISPR gRNA sequence
tgacacatgctgctccctgc

SEQ ID NO: 568057 - DNA, 20 bp, Artificial
  CRISPR gRNA sequence
ctccctgcactgcctattaa

SEQ ID NO: 568058 - DNA, 20 bp, Artificial
  CRISPR gRNA sequence
cctgcactgcctattaacag

SEQ ID NO: 568059 - DNA, 20 bp, Artificial
  CRISPR gRNA sequence
cactgcctattaacaggtcc

SEQ ID NO: 568060 - DNA, 20 bp, Artificial
  CRISPR gRNA sequence
cctattaacaggtccagccc

SEQ ID NO: 568061 - DNA, 20 bp, Artificial
  CRISPR gRNA sequence
ttaacaggtccagcccaacc

SEQ ID NO: 568062 - DNA, 20 bp, Artificial
  CRISPR gRNA sequence
acaggtccagcccaaccaat

SEQ ID NO: 568063 - DNA, 20 bp, Artificial
  CRISPR gRNA sequence
tgtgtagctccacctttcac

SEQ ID NO: 568064 - DNA, 20 bp, Artificial
  CRISPR gRNA sequence
tgtagctccacctttcacaa

SEQ ID NO: 568065 - DNA, 20 bp, Artificial
  CRISPR gRNA sequence
cacctttcacaaaatgtatt

SEQ ID NO: 568066 - DNA, 20 bp, Artificial
  CRISPR gRNA sequence
tcacaaaatgtattgagtca

SEQ ID NO: 568067 - DNA, 20 bp, Artificial
  CRISPR gRNA sequence
cacaaaatgtattgagtcag

SEQ ID NO: 568068 - DNA, 20 bp, Artificial
  CRISPR gRNA sequence
acaaaatgtattgagtcaga

SEQ ID NO: 568069 - DNA, 20 bp, Artificial
  CRISPR gRNA sequence
agtcagatgtattatggact

SEQ ID NO: 568070 - DNA, 20 bp, Artificial
  CRISPR gRNA sequence
tggactttcctttcacaaaa

SEQ ID NO: 568071 - DNA, 20 bp, Artificial
  CRISPR gRNA sequence
tcctttcacaaaatgctttg

SEQ ID NO: 568072 - DNA, 20 bp, Artificial
  CRISPR gRNA sequence
cctttcacaaaatgctttga

SEQ ID NO: 568073 - DNA, 20 bp, Artificial
  CRISPR gRNA sequence
ctttcacaaaatgctttgag

SEQ ID NO: 568074 - DNA, 20 bp, Artificial
  CRISPR gRNA sequence
tcacaaaatgctttgagtca

SEQ ID NO: 568075 - DNA, 20 bp, Artificial
  CRISPR gRNA sequence
cacaaaatgctttgagtcag

SEQ ID NO: 568076 - DNA, 20 bp, Artificial
  CRISPR gRNA sequence
acaaaatgctttgagtcaga

SEQ ID NO: 568077 - DNA, 20 bp, Artificial
  CRISPR gRNA sequence
tgagtcagacgtgttatgga

SEQ ID NO: 568078 - DNA, 20 bp, Artificial
  CRISPR gRNA sequence
gagtcagacgtgttatggaa

SEQ ID NO: 568079 - DNA, 20 bp, Artificial
  CRISPR gRNA sequence
agtcagacgtgttatggaat

SEQ ID NO: 568080 - DNA, 20 bp, Artificial
  CRISPR gRNA sequence
tggaattaaaattttttttt

SEQ ID NO: 568081 - DNA, 20 bp, Artificial
  CRISPR gRNA sequence
aaatttttttttacattttg

SEQ ID NO: 568082 - DNA, 20 bp, Artificial
  CRISPR gRNA sequence
ttttttacattttggaaagg

SEQ ID NO: 568083 - DNA, 20 bp, Artificial
  CRISPR gRNA sequence
tttttacattttggaaaggt

SEQ ID NO: 568084 - DNA, 20 bp, Artificial
  CRISPR gRNA sequence
ttttacattttggaaaggta

SEQ ID NO: 568085 - DNA, 20 bp, Artificial
  CRISPR gRNA sequence
tttacattttggaaaggtaa

SEQ ID NO: 568086 - DNA, 20 bp, Artificial
  CRISPR gRNA sequence
ttacattttggaaaggtaat

SEQ ID NO: 568087 - DNA, 20 bp, Artificial
  CRISPR gRNA sequence
tacattttggaaaggtaata

SEQ ID NO: 568088 - DNA, 20 bp, Artificial
  CRISPR gRNA sequence
acattttggaaaggtaatac

SEQ ID NO: 568089 - DNA, 20 bp, Artificial
  CRISPR gRNA sequence
cattttggaaaggtaataca

SEQ ID NO: 568090 - DNA, 20 bp, Artificial
  CRISPR gRNA sequence
tggaaaggtaatacaaagta

SEQ ID NO: 568091 - DNA, 20 bp, Artificial
  CRISPR gRNA sequence
ggaaaggtaatacaaagtat

SEQ ID NO: 568092 - DNA, 20 bp, Artificial
  CRISPR gRNA sequence
gaaaggtaatacaaagtatt

SEQ ID NO: 568093 - DNA, 20 bp, Artificial
  CRISPR gRNA sequence
cctctgcatattaagcaccc

SEQ ID NO: 568094 - DNA, 20 bp, Artificial
  CRISPR gRNA sequence
ctctgcatattaagcacccc

SEQ ID NO: 568095 - DNA, 20 bp, Artificial
  CRISPR gRNA sequence
tgcatattaagcaccccact

SEQ ID NO: 568096 - DNA, 20 bp, Artificial
  CRISPR gRNA sequence
catattaagcaccccactta

SEQ ID NO: 568097 - DNA, 20 bp, Artificial
  CRISPR gRNA sequence
agcaccccacttaattatgg

SEQ ID NO: 568098 - DNA, 20 bp, Artificial
  CRISPR gRNA sequence
aattatggggagcaccctat

SEQ ID NO: 568099 - DNA, 20 bp, Artificial
  CRISPR gRNA sequence
attatggggagcaccctatg

SEQ ID NO: 568100 - DNA, 20 bp, Artificial
  CRISPR gRNA sequence
tggggagcaccctatgggtc

SEQ ID NO: 568101 - DNA, 20 bp, Artificial
  CRISPR gRNA sequence
tgggtcaagcataggaacaa

SEQ ID NO: 568102 - DNA, 20 bp, Artificial
  CRISPR gRNA sequence
acttcattcctatatattta

SEQ ID NO: 568103 - DNA, 20 bp, Artificial
  CRISPR gRNA sequence
cttcattcctatatatttaa

SEQ ID NO: 568104 - DNA, 20 bp, Artificial
  CRISPR gRNA sequence
cattcctatatatttaaaga

SEQ ID NO: 568105 - DNA, 20 bp, Artificial
  CRISPR gRNA sequence
attcctatatatttaaagac

SEQ ID NO: 568106 - DNA, 20 bp, Artificial
  CRISPR gRNA sequence
ctatatatttaaagacaagg

SEQ ID NO: 568107 - DNA, 20 bp, Artificial
  CRISPR gRNA sequence
tatatttaaagacaaggtct

SEQ ID NO: 568108 - DNA, 20 bp, Artificial
  CRISPR gRNA sequence
aaagacaaggtctcagtctg

SEQ ID NO: 568109 - DNA, 20 bp, Artificial
  CRISPR gRNA sequence
aagacaaggtctcagtctga

SEQ ID NO: 568110 - DNA, 20 bp, Artificial
  CRISPR gRNA sequence
agtctgatgcaatcatagcc

SEQ ID NO: 568111 - DNA, 20 bp, Artificial
  CRISPR gRNA sequence
atgcaatcatagcccactgt

SEQ ID NO: 568112 - DNA, 20 bp, Artificial
  CRISPR gRNA sequence
tgtgtagtgagctagagtgc

SEQ ID NO: 568113 - DNA, 20 bp, Artificial
  CRISPR gRNA sequence
gagtgcactggcacaattat

SEQ ID NO: 568114 - DNA, 20 bp, Artificial
  CRISPR gRNA sequence
gcacaattataactcactgt

SEQ ID NO: 568115 - DNA, 20 bp, Artificial
  CRISPR gRNA sequence
taactcactgtagcttcaga

SEQ ID NO: 568116 - DNA, 20 bp, Artificial
  CRISPR gRNA sequence
actgtagcttcagattcctt

SEQ ID NO: 568117 - DNA, 20 bp, Artificial
  CRISPR gRNA sequence
tagcttcagattccttggtt

SEQ ID NO: 568118 - DNA, 20 bp, Artificial
  CRISPR gRNA sequence
cagattccttggttcaagca

SEQ ID NO: 568119 - DNA, 20 bp, Artificial
  CRISPR gRNA sequence
agattccttggttcaagcag

SEQ ID NO: 568120 - DNA, 20 bp, Artificial
  CRISPR gRNA sequence
cttggttcaagcagttgcaa

SEQ ID NO: 568121 - DNA, 20 bp, Artificial
  CRISPR gRNA sequence
ggttcaagcagttgcaagta

SEQ ID NO: 568122 - DNA, 20 bp, Artificial
  CRISPR gRNA sequence
gttcaagcagttgcaagtag

SEQ ID NO: 568123 - DNA, 20 bp, Artificial
  CRISPR gRNA sequence
aagcagttgcaagtagctga

SEQ ID NO: 568124 - DNA, 20 bp, Artificial
  CRISPR gRNA sequence
caagtagctgagactacagg

SEQ ID NO: 568125 - DNA, 20 bp, Artificial
  CRISPR gRNA sequence
agactacaggcaggagccat

SEQ ID NO: 568126 - DNA, 20 bp, Artificial
  CRISPR gRNA sequence
caggcaggagccatcatggc

SEQ ID NO: 568127 - DNA, 20 bp, Artificial
  CRISPR gRNA sequence
gctaatctttaaacttttta

SEQ ID NO: 568128 - DNA, 20 bp, Artificial
  CRISPR gRNA sequence
atctttaaactttttataaa

SEQ ID NO: 568129 - DNA, 20 bp, Artificial
  CRISPR gRNA sequence
taaactttttataaagacag

SEQ ID NO: 568130 - DNA, 20 bp, Artificial
  CRISPR gRNA sequence
aaactttttataaagacagg

SEQ ID NO: 568131 - DNA, 20 bp, Artificial
  CRISPR gRNA sequence
aactttttataaagacaggg

SEQ ID NO: 568132 - DNA, 20 bp, Artificial
  CRISPR gRNA sequence
tttataaagacagggtcttg

SEQ ID NO: 568133 - DNA, 20 bp, Artificial
  CRISPR gRNA sequence
ttataaagacagggtcttgc

SEQ ID NO: 568134 - DNA, 20 bp, Artificial
  CRISPR gRNA sequence
tataaagacagggtcttgct

SEQ ID NO: 568135 - DNA, 20 bp, Artificial
  CRISPR gRNA sequence
ataaagacagggtcttgcta

SEQ ID NO: 568136 - DNA, 20 bp, Artificial
  CRISPR gRNA sequence
taaagacagggtcttgctat

SEQ ID NO: 568137 - DNA, 20 bp, Artificial
  CRISPR gRNA sequence
gctatgttgcccaggctggt

SEQ ID NO: 568138 - DNA, 20 bp, Artificial
  CRISPR gRNA sequence
ctatgttgcccaggctggtc

SEQ ID NO: 568139 - DNA, 20 bp, Artificial
  CRISPR gRNA sequence
tgttgcccaggctggtcttg

SEQ ID NO: 568140 - DNA, 20 bp, Artificial
  CRISPR gRNA sequence
cccaggctggtcttgaactc

SEQ ID NO: 568141 - DNA, 20 bp, Artificial
  CRISPR gRNA sequence
gtcttgaactcctggcctca

SEQ ID NO: 568142 - DNA, 20 bp, Artificial
  CRISPR gRNA sequence
gaactcctggcctcaagcca

SEQ ID NO: 568143 - DNA, 20 bp, Artificial
  CRISPR gRNA sequence
aactcctggcctcaagccat

SEQ ID NO: 568144 - DNA, 20 bp, Artificial
  CRISPR gRNA sequence
ctggcctcaagccatcctcc

SEQ ID NO: 568145 - DNA, 20 bp, Artificial
  CRISPR gRNA sequence
gcctcaagccatcctcctgc

SEQ ID NO: 568146 - DNA, 20 bp, Artificial
  CRISPR gRNA sequence
aagccatcctcctgcctcag

SEQ ID NO: 568147 - DNA, 20 bp, Artificial
  CRISPR gRNA sequence
ctgcctcagcctcccaaagt

SEQ ID NO: 568148 - DNA, 20 bp, Artificial
  CRISPR gRNA sequence
cctcagcctcccaaagtgct

SEQ ID NO: 568149 - DNA, 20 bp, Artificial
  CRISPR gRNA sequence
agcctcccaaagtgctggga

SEQ ID NO: 568150 - DNA, 20 bp, Artificial
  CRISPR gRNA sequence
ccaaagtgctgggagtatag

SEQ ID NO: 568151 - DNA, 20 bp, Artificial
  CRISPR gRNA sequence
ggagtatagccatgagccac

SEQ ID NO: 568152 - DNA, 20 bp, Artificial
  CRISPR gRNA sequence
tgtcctgccaagcacaggaa

SEQ ID NO: 568153 - DNA, 20 bp, Artificial
  CRISPR gRNA sequence
ccaagcacaggaatattttt

SEQ ID NO: 568154 - DNA, 20 bp, Artificial
  CRISPR gRNA sequence
ttgtggtgaaacgataatga

SEQ ID NO: 568155 - DNA, 20 bp, Artificial
  CRISPR gRNA sequence
tgtggtgaaacgataatgaa

SEQ ID NO: 568156 - DNA, 20 bp, Artificial
  CRISPR gRNA sequence
gtggtgaaacgataatgaat

SEQ ID NO: 568157 - DNA, 20 bp, Artificial
  CRISPR gRNA sequence
tggtgaaacgataatgaata

SEQ ID NO: 568158 - DNA, 20 bp, Artificial
  CRISPR gRNA sequence
gaagtgagtgagaaagactc

SEQ ID NO: 568159 - DNA, 20 bp, Artificial
  CRISPR gRNA sequence
aagtgagtgagaaagactca

SEQ ID NO: 568160 - DNA, 20 bp, Artificial
  CRISPR gRNA sequence
aaatccttgtgttaattcag

SEQ ID NO: 568161 - DNA, 20 bp, Artificial
  CRISPR gRNA sequence
gtgttaattcaggtcaggtc

SEQ ID NO: 568162 - DNA, 20 bp, Artificial
  CRISPR gRNA sequence
tgttaattcaggtcaggtca

SEQ ID NO: 568163 - DNA, 20 bp, Artificial
  CRISPR gRNA sequence
attcaggtcaggtcaggatt

SEQ ID NO: 568164 - DNA, 20 bp, Artificial
  CRISPR gRNA sequence
aggtcaggtcaggatttgca

SEQ ID NO: 568165 - DNA, 20 bp, Artificial
  CRISPR gRNA sequence
gcagctaaacgattttgcta

SEQ ID NO: 568166 - DNA, 20 bp, Artificial
  CRISPR gRNA sequence
cagctaaacgattttgctac

SEQ ID NO: 568167 - DNA, 20 bp, Artificial
  CRISPR gRNA sequence
aacgattttgctaccaactt

SEQ ID NO: 568168 - DNA, 20 bp, Artificial
  CRISPR gRNA sequence
tgctaccaacttgcgaagac

SEQ ID NO: 568169 - DNA, 20 bp, Artificial
  CRISPR gRNA sequence
gctaccaacttgcgaagact

SEQ ID NO: 568170 - DNA, 20 bp, Artificial
  CRISPR gRNA sequence
ctaccaacttgcgaagactc

SEQ ID NO: 568171 - DNA, 20 bp, Artificial
  CRISPR gRNA sequence
ccaacttgcgaagactcttt

SEQ ID NO: 568172 - DNA, 20 bp, Artificial
  CRISPR gRNA sequence
gcgaagactcttttggcttc

SEQ ID NO: 568173 - DNA, 20 bp, Artificial
  CRISPR gRNA sequence
cgaagactcttttggcttca

SEQ ID NO: 568174 - DNA, 20 bp, Artificial
  CRISPR gRNA sequence
ttttggcttcagagattttt

SEQ ID NO: 568175 - DNA, 20 bp, Artificial
  CRISPR gRNA sequence
ttggcttcagagattttttg

SEQ ID NO: 568176 - DNA, 20 bp, Artificial
  CRISPR gRNA sequence
tggcttcagagattttttga

SEQ ID NO: 568177 - DNA, 20 bp, Artificial
  CRISPR gRNA sequence
ggcttcagagattttttgat

SEQ ID NO: 568178 - DNA, 20 bp, Artificial
  CRISPR gRNA sequence
gcttcagagattttttgatt

SEQ ID NO: 568179 - DNA, 20 bp, Artificial
  CRISPR gRNA sequence
cagagattttttgatttaag

SEQ ID NO: 568180 - DNA, 20 bp, Artificial
  CRISPR gRNA sequence
agagattttttgatttaaga

SEQ ID NO: 568181 - DNA, 20 bp, Artificial
  CRISPR gRNA sequence
tttgatttaagaattgagga

SEQ ID NO: 568182 - DNA, 20 bp, Artificial
  CRISPR gRNA sequence
ttgatttaagaattgaggat

SEQ ID NO: 568183 - DNA, 20 bp, Artificial
  CRISPR gRNA sequence
tgatttaagaattgaggata

SEQ ID NO: 568184 - DNA, 20 bp, Artificial
  CRISPR gRNA sequence
gatttaagaattgaggataa

SEQ ID NO: 568185 - DNA, 20 bp, Artificial
  CRISPR gRNA sequence
atttaagaattgaggataag

SEQ ID NO: 568186 - DNA, 20 bp, Artificial
  CRISPR gRNA sequence
aagaattgaggataagggat

SEQ ID NO: 568187 - DNA, 20 bp, Artificial
  CRISPR gRNA sequence
agaattgaggataagggatt

SEQ ID NO: 568188 - DNA, 20 bp, Artificial
  CRISPR gRNA sequence
aggataagggatttggggcc

SEQ ID NO: 568189 - DNA, 20 bp, Artificial
  CRISPR gRNA sequence
ggggcctgtattggtctgtt

SEQ ID NO: 568190 - DNA, 20 bp, Artificial
  CRISPR gRNA sequence
gggcctgtattggtctgttt

SEQ ID NO: 568191 - DNA, 20 bp, Artificial
  CRISPR gRNA sequence
tattggtctgttttcacact

SEQ ID NO: 568192 - DNA, 20 bp, Artificial
  CRISPR gRNA sequence
gtctgttttcacactgctat

SEQ ID NO: 568193 - DNA, 20 bp, Artificial
  CRISPR gRNA sequence
ttttcacactgctataaaga

SEQ ID NO: 568194 - DNA, 20 bp, Artificial
  CRISPR gRNA sequence
tcacactgctataaagaact

SEQ ID NO: 568195 - DNA, 20 bp, Artificial
  CRISPR gRNA sequence
cacactgctataaagaacta

SEQ ID NO: 568196 - DNA, 20 bp, Artificial
  CRISPR gRNA sequence
acactgctataaagaactac

SEQ ID NO: 568197 - DNA, 20 bp, Artificial
  CRISPR gRNA sequence
ctataaagaactacctgaaa

SEQ ID NO: 568198 - DNA, 20 bp, Artificial
  CRISPR gRNA sequence
taaagaactacctgaaactg

SEQ ID NO: 568199 - DNA, 20 bp, Artificial
  CRISPR gRNA sequence
cctgaaactgggtaatttat

SEQ ID NO: 568200 - DNA, 20 bp, Artificial
  CRISPR gRNA sequence
aaactgggtaatttataaag

SEQ ID NO: 568201 - DNA, 20 bp, Artificial
  CRISPR gRNA sequence
ggtaatttataaagaaaaga

SEQ ID NO: 568202 - DNA, 20 bp, Artificial
  CRISPR gRNA sequence
ataaagaaaagaggtttaat

SEQ ID NO: 568203 - DNA, 20 bp, Artificial
  CRISPR gRNA sequence
taaagaaaagaggtttaatt

SEQ ID NO: 568204 - DNA, 20 bp, Artificial
  CRISPR gRNA sequence
aattgactcacagttccaca

SEQ ID NO: 568205 - DNA, 20 bp, Artificial
  CRISPR gRNA sequence
attgactcacagttccacat

SEQ ID NO: 568206 - DNA, 20 bp, Artificial
  CRISPR gRNA sequence
actcacagttccacatggct

SEQ ID NO: 568207 - DNA, 20 bp, Artificial
  CRISPR gRNA sequence
acagttccacatggctgggg

SEQ ID NO: 568208 - DNA, 20 bp, Artificial
  CRISPR gRNA sequence
cacatggctggggaggcctc

SEQ ID NO: 568209 - DNA, 20 bp, Artificial
  CRISPR gRNA sequence
gggaggcctcgggaaactta

SEQ ID NO: 568210 - DNA, 20 bp, Artificial
  CRISPR gRNA sequence
gggaaacttacaatcatggc

SEQ ID NO: 568211 - DNA, 20 bp, Artificial
  CRISPR gRNA sequence
acaatcatggcagaaggcga

SEQ ID NO: 568212 - DNA, 20 bp, Artificial
  CRISPR gRNA sequence
caatcatggcagaaggcgaa

SEQ ID NO: 568213 - DNA, 20 bp, Artificial
  CRISPR gRNA sequence
ttttcacaaggcagcaggag

SEQ ID NO: 568214 - DNA, 20 bp, Artificial
  CRISPR gRNA sequence
tttcacaaggcagcaggaga

SEQ ID NO: 568215 - DNA, 20 bp, Artificial
  CRISPR gRNA sequence
ttcacaaggcagcaggagag

SEQ ID NO: 568216 - DNA, 20 bp, Artificial
  CRISPR gRNA sequence
tcacaaggcagcaggagaga

SEQ ID NO: 568217 - DNA, 20 bp, Artificial
  CRISPR gRNA sequence
cacaaggcagcaggagagag

SEQ ID NO: 568218 - DNA, 20 bp, Artificial
  CRISPR gRNA sequence
acaaggcagcaggagagaga

SEQ ID NO: 568219 - DNA, 20 bp, Artificial
  CRISPR gRNA sequence
ccacacacttttaaaccaac

SEQ ID NO: 568220 - DNA, 20 bp, Artificial
  CRISPR gRNA sequence
ttaaaccaacagatgtcatg

SEQ ID NO: 568221 - DNA, 20 bp, Artificial
  CRISPR gRNA sequence
taaaccaacagatgtcatga

SEQ ID NO: 568222 - DNA, 20 bp, Artificial
  CRISPR gRNA sequence
aaaccaacagatgtcatgag

SEQ ID NO: 568223 - DNA, 20 bp, Artificial
  CRISPR gRNA sequence
aaccaacagatgtcatgaga

SEQ ID NO: 568224 - DNA, 20 bp, Artificial
  CRISPR gRNA sequence
actctctatcactagaatag

SEQ ID NO: 568225 - DNA, 20 bp, Artificial
  CRISPR gRNA sequence
tctatcactagaatagcatg

SEQ ID NO: 568226 - DNA, 20 bp, Artificial
  CRISPR gRNA sequence
tatcactagaatagcatggg

SEQ ID NO: 568227 - DNA, 20 bp, Artificial
  CRISPR gRNA sequence
tcactagaatagcatgggga

SEQ ID NO: 568228 - DNA, 20 bp, Artificial
  CRISPR gRNA sequence
gaatagcatggggaaaccat

SEQ ID NO: 568229 - DNA, 20 bp, Artificial
  CRISPR gRNA sequence
ccaccaggtccctctctcga

SEQ ID NO: 568230 - DNA, 20 bp, Artificial
  CRISPR gRNA sequence
tctcgacacatgggaattac

SEQ ID NO: 568231 - DNA, 20 bp, Artificial
  CRISPR gRNA sequence
tcgacacatgggaattacaa

SEQ ID NO: 568232 - DNA, 20 bp, Artificial
  CRISPR gRNA sequence
gacacatgggaattacaatt

SEQ ID NO: 568233 - DNA, 20 bp, Artificial
  CRISPR gRNA sequence
caattcaagatgagatttgg

SEQ ID NO: 568234 - DNA, 20 bp, Artificial
  CRISPR gRNA sequence
aagatgagatttgggtgagg

SEQ ID NO: 568235 - DNA, 20 bp, Artificial
  CRISPR gRNA sequence
gggtgaggacccagagccaa

SEQ ID NO: 568236 - DNA, 20 bp, Artificial
  CRISPR gRNA sequence
ggtgaggacccagagccaaa

SEQ ID NO: 568237 - DNA, 20 bp, Artificial
  CRISPR gRNA sequence
aatttattctgttaaatttg

SEQ ID NO: 568238 - DNA, 20 bp, Artificial
  CRISPR gRNA sequence
attctgttaaatttgaacag

SEQ ID NO: 568239 - DNA, 20 bp, Artificial
  CRISPR gRNA sequence
ttctgttaaatttgaacagg

SEQ ID NO: 568240 - DNA, 20 bp, Artificial
  CRISPR gRNA sequence
tgttaaatttgaacaggtag

SEQ ID NO: 568241 - DNA, 20 bp, Artificial
  CRISPR gRNA sequence
ttaaatttgaacaggtagat

SEQ ID NO: 568242 - DNA, 20 bp, Artificial
  CRISPR gRNA sequence
aatttgaacaggtagatctg

SEQ ID NO: 568243 - DNA, 20 bp, Artificial
  CRISPR gRNA sequence
gaacaggtagatctgaccta

SEQ ID NO: 568244 - DNA, 20 bp, Artificial
  CRISPR gRNA sequence
aacaggtagatctgacctag

SEQ ID NO: 568245 - DNA, 20 bp, Artificial
  CRISPR gRNA sequence
acctagcaaaagaaagaatt

SEQ ID NO: 568246 - DNA, 20 bp, Artificial
  CRISPR gRNA sequence
gcaaaagaaagaattctcgc

SEQ ID NO: 568247 - DNA, 20 bp, Artificial
  CRISPR gRNA sequence
tcgctccttgatgctcaagg

SEQ ID NO: 568248 - DNA, 20 bp, Artificial
  CRISPR gRNA sequence
gctccttgatgctcaaggag

SEQ ID NO: 568249 - DNA, 20 bp, Artificial
  CRISPR gRNA sequence
cttgatgctcaaggagtttg

SEQ ID NO: 568250 - DNA, 20 bp, Artificial
  CRISPR gRNA sequence
gatgctcaaggagtttgtct

SEQ ID NO: 568251 - DNA, 20 bp, Artificial
  CRISPR gRNA sequence
atgctcaaggagtttgtctg

SEQ ID NO: 568252 - DNA, 20 bp, Artificial
  CRISPR gRNA sequence
aaggagtttgtctgctcatc

SEQ ID NO: 568253 - DNA, 20 bp, Artificial
  CRISPR gRNA sequence
gtctgctcatcctttcaagc

SEQ ID NO: 568254 - DNA, 20 bp, Artificial
  CRISPR gRNA sequence
tctgctcatcctttcaagct

SEQ ID NO: 568255 - DNA, 20 bp, Artificial
  CRISPR gRNA sequence
ctcatcctttcaagcttgta

SEQ ID NO: 568256 - DNA, 20 bp, Artificial
  CRISPR gRNA sequence
atcctttcaagcttgtaagg

SEQ ID NO: 568257 - DNA, 20 bp, Artificial
  CRISPR gRNA sequence
tcaagcttgtaaggaggttg

SEQ ID NO: 568258 - DNA, 20 bp, Artificial
  CRISPR gRNA sequence
caagcttgtaaggaggttgc

SEQ ID NO: 568259 - DNA, 20 bp, Artificial
  CRISPR gRNA sequence
aagcttgtaaggaggttgcg

SEQ ID NO: 568260 - DNA, 20 bp, Artificial
  CRISPR gRNA sequence
gtaaggaggttgcgagctct

SEQ ID NO: 568261 - DNA, 20 bp, Artificial
  CRISPR gRNA sequence
taaggaggttgcgagctctt

SEQ ID NO: 568262 - DNA, 20 bp, Artificial
  CRISPR gRNA sequence
cgagctcttcataaatttgc

SEQ ID NO: 568263 - DNA, 20 bp, Artificial
  CRISPR gRNA sequence
ttcataaatttgcagatgat

SEQ ID NO: 568264 - DNA, 20 bp, Artificial
  CRISPR gRNA sequence
cataaatttgcagatgataa

SEQ ID NO: 568265 - DNA, 20 bp, Artificial
  CRISPR gRNA sequence
ataaatttgcagatgataag

SEQ ID NO: 568266 - DNA, 20 bp, Artificial
  CRISPR gRNA sequence
gcagatgataagtctaaata

SEQ ID NO: 568267 - DNA, 20 bp, Artificial
  CRISPR gRNA sequence
cagatgataagtctaaatat

SEQ ID NO: 568268 - DNA, 20 bp, Artificial
  CRISPR gRNA sequence
aatattactattttctgtac

SEQ ID NO: 568269 - DNA, 20 bp, Artificial
  CRISPR gRNA sequence
ctattttctgtactaaatat

SEQ ID NO: 568270 - DNA, 20 bp, Artificial
  CRISPR gRNA sequence
ttttctgtactaaatattat

SEQ ID NO: 568271 - DNA, 20 bp, Artificial
  CRISPR gRNA sequence
tctgtactaaatattatact

SEQ ID NO: 568272 - DNA, 20 bp, Artificial
  CRISPR gRNA sequence
ctgtactaaatattatactt

SEQ ID NO: 568273 - DNA, 20 bp, Artificial
  CRISPR gRNA sequence
tgtactaaatattatacttt

SEQ ID NO: 568274 - DNA, 20 bp, Artificial
  CRISPR gRNA sequence
tactaaatattatacttttt

SEQ ID NO: 568275 - DNA, 20 bp, Artificial
  CRISPR gRNA sequence
aatattatacttttttttcc

SEQ ID NO: 568276 - DNA, 20 bp, Artificial
  CRISPR gRNA sequence
tacttttttttccagagtct

SEQ ID NO: 568277 - DNA, 20 bp, Artificial
  CRISPR gRNA sequence
ttttttccagagtctcttcc

SEQ ID NO: 568278 - DNA, 20 bp, Artificial
  CRISPR gRNA sequence
tttttccagagtctcttcca

SEQ ID NO: 568279 - DNA, 20 bp, Artificial
  CRISPR gRNA sequence
ttttccagagtctcttccat

SEQ ID NO: 568280 - DNA, 20 bp, Artificial
  CRISPR gRNA sequence
tttccagagtctcttccatc

SEQ ID NO: 568281 - DNA, 20 bp, Artificial
  CRISPR gRNA sequence
ttccagagtctcttccatct

SEQ ID NO: 568282 - DNA, 20 bp, Artificial
  CRISPR gRNA sequence
tccagagtctcttccatctc

SEQ ID NO: 568283 - DNA, 20 bp, Artificial
  CRISPR gRNA sequence
ccagagtctcttccatctcc

SEQ ID NO: 568284 - DNA, 20 bp, Artificial
  CRISPR gRNA sequence
cagagtctcttccatctccc

SEQ ID NO: 568285 - DNA, 20 bp, Artificial
  CRISPR gRNA sequence
ttccatctcccacactaact

SEQ ID NO: 568286 - DNA, 20 bp, Artificial
  CRISPR gRNA sequence
ccatctcccacactaacttg

SEQ ID NO: 568287 - DNA, 20 bp, Artificial
  CRISPR gRNA sequence
catctcccacactaacttgt

SEQ ID NO: 568288 - DNA, 20 bp, Artificial
  CRISPR gRNA sequence
ccacactaacttgtgcattg

SEQ ID NO: 568289 - DNA, 20 bp, Artificial
  CRISPR gRNA sequence
acttgtgcattgactaatgg

SEQ ID NO: 568290 - DNA, 20 bp, Artificial
  CRISPR gRNA sequence
gtgcattgactaatggaagc

SEQ ID NO: 568291 - DNA, 20 bp, Artificial
  CRISPR gRNA sequence
tgcattgactaatggaagca

SEQ ID NO: 568292 - DNA, 20 bp, Artificial
  CRISPR gRNA sequence
actaatggaagcattgaagt

SEQ ID NO: 568293 - DNA, 20 bp, Artificial
  CRISPR gRNA sequence
atggaagcattgaagtccaa

SEQ ID NO: 568294 - DNA, 20 bp, Artificial
  CRISPR gRNA sequence
aagtccaatgcatgatacca

SEQ ID NO: 568295 - DNA, 20 bp, Artificial
  CRISPR gRNA sequence
caacagccatcgaggactta

SEQ ID NO: 568296 - DNA, 20 bp, Artificial
  CRISPR gRNA sequence
ataatgtactcatgggattg

SEQ ID NO: 568297 - DNA, 20 bp, Artificial
  CRISPR gRNA sequence
taatgtactcatgggattgt

SEQ ID NO: 568298 - DNA, 20 bp, Artificial
  CRISPR gRNA sequence
atgggattgtcctatggagc

SEQ ID NO: 568299 - DNA, 20 bp, Artificial
  CRISPR gRNA sequence
tcctatggagcaatgtaaac

SEQ ID NO: 568300 - DNA, 20 bp, Artificial
  CRISPR gRNA sequence
tggagcaatgtaaacgtaac

SEQ ID NO: 568301 - DNA, 20 bp, Artificial
  CRISPR gRNA sequence
aaccagtatatattttaaga

SEQ ID NO: 568302 - DNA, 20 bp, Artificial
  CRISPR gRNA sequence
taagatggaaaatgatcttc

SEQ ID NO: 568303 - DNA, 20 bp, Artificial
  CRISPR gRNA sequence
aagatggaaaatgatcttcc

SEQ ID NO: 568304 - DNA, 20 bp, Artificial
  CRISPR gRNA sequence
agatggaaaatgatcttcca

SEQ ID NO: 568305 - DNA, 20 bp, Artificial
  CRISPR gRNA sequence
ccacaaaaaatacagtgtac

SEQ ID NO: 568306 - DNA, 20 bp, Artificial
  CRISPR gRNA sequence
cacaaaaaatacagtgtact

SEQ ID NO: 568307 - DNA, 20 bp, Artificial
  CRISPR gRNA sequence
ttagcaatccattatttaat

SEQ ID NO: 568308 - DNA, 20 bp, Artificial
  CRISPR gRNA sequence
agcaatccattatttaatac

SEQ ID NO: 568309 - DNA, 20 bp, Artificial
  CRISPR gRNA sequence
gcaatccattatttaataca

SEQ ID NO: 568310 - DNA, 20 bp, Artificial
  CRISPR gRNA sequence
tttaatacaacatcatcaat

SEQ ID NO: 568311 - DNA, 20 bp, Artificial
  CRISPR gRNA sequence
aatacaacatcatcaatcat

SEQ ID NO: 568312 - DNA, 20 bp, Artificial
  CRISPR gRNA sequence
atacaacatcatcaatcatt

SEQ ID NO: 568313 - DNA, 20 bp, Artificial
  CRISPR gRNA sequence
tgacaacctgtatcccaagc

SEQ ID NO: 568314 - DNA, 20 bp, Artificial
  CRISPR gRNA sequence
gacaacctgtatcccaagca

SEQ ID NO: 568315 - DNA, 20 bp, Artificial
  CRISPR gRNA sequence
acaacctgtatcccaagcag

SEQ ID NO: 568316 - DNA, 20 bp, Artificial
  CRISPR gRNA sequence
tatcccaagcagcggtgagt

SEQ ID NO: 568317 - DNA, 20 bp, Artificial
  CRISPR gRNA sequence
aatgtgtcatggaggctttc

SEQ ID NO: 568318 - DNA, 20 bp, Artificial
  CRISPR gRNA sequence
tcagaccacagatgtggtga

SEQ ID NO: 568319 - DNA, 20 bp, Artificial
  CRISPR gRNA sequence
cagaccacagatgtggtgac

SEQ ID NO: 568320 - DNA, 20 bp, Artificial
  CRISPR gRNA sequence
agaccacagatgtggtgact

SEQ ID NO: 568321 - DNA, 20 bp, Artificial
  CRISPR gRNA sequence
acacaaggttcacaattttg

SEQ ID NO: 568322 - DNA, 20 bp, Artificial
  CRISPR gRNA sequence
acaattttgaaatgtaaaac

SEQ ID NO: 568323 - DNA, 20 bp, Artificial
  CRISPR gRNA sequence
tgaaatgtaaaacaagttac

SEQ ID NO: 568324 - DNA, 20 bp, Artificial
  CRISPR gRNA sequence
gaaatgtaaaacaagttaca

SEQ ID NO: 568325 - DNA, 20 bp, Artificial
  CRISPR gRNA sequence
aaatgtaaaacaagttacaa

SEQ ID NO: 568326 - DNA, 20 bp, Artificial
  CRISPR gRNA sequence
caattttttttttttttttt

SEQ ID NO: 568327 - DNA, 20 bp, Artificial
  CRISPR gRNA sequence
tttttttttttttttttttt

SEQ ID NO: 568328 - DNA, 20 bp, Artificial
  CRISPR gRNA sequence
tttttttttttttttttttt

SEQ ID NO: 568329 - DNA, 20 bp, Artificial
  CRISPR gRNA sequence
tttttttttttttttttttt

SEQ ID NO: 568330 - DNA, 20 bp, Artificial
  CRISPR gRNA sequence
tttttttttttttttttttt

SEQ ID NO: 568331 - DNA, 20 bp, Artificial
  CRISPR gRNA sequence
tttttttttttttttttttt

SEQ ID NO: 568332 - DNA, 20 bp, Artificial
  CRISPR gRNA sequence
tttttttttttttttttttt

SEQ ID NO: 568333 - DNA, 20 bp, Artificial
  CRISPR gRNA sequence
tttttttttttttttttttg

SEQ ID NO: 568334 - DNA, 20 bp, Artificial
  CRISPR gRNA sequence
ttttttttttttttttttga

SEQ ID NO: 568335 - DNA, 20 bp, Artificial
  CRISPR gRNA sequence
tttttttttttttttttgag

SEQ ID NO: 568336 - DNA, 20 bp, Artificial
  CRISPR gRNA sequence
ttttttttttttttttgaga

SEQ ID NO: 568337 - DNA, 20 bp, Artificial
  CRISPR gRNA sequence
tttttttttttttttgagac

SEQ ID NO: 568338 - DNA, 20 bp, Artificial
  CRISPR gRNA sequence
ttttttttttttttgagaca

SEQ ID NO: 568339 - DNA, 20 bp, Artificial
  CRISPR gRNA sequence
tttttttttttttgagacag

SEQ ID NO: 568340 - DNA, 20 bp, Artificial
  CRISPR gRNA sequence
ttttttttttttgagacaga

SEQ ID NO: 568341 - DNA, 20 bp, Artificial
  CRISPR gRNA sequence
tttttttttttgagacagag

SEQ ID NO: 568342 - DNA, 20 bp, Artificial
  CRISPR gRNA sequence
ttttttttttgagacagagt

SEQ ID NO: 568343 - DNA, 20 bp, Artificial
  CRISPR gRNA sequence
tttttttttgagacagagtc

SEQ ID NO: 568344 - DNA, 20 bp, Artificial
  CRISPR gRNA sequence
ttttttttgagacagagtct

SEQ ID NO: 568345 - DNA, 20 bp, Artificial
  CRISPR gRNA sequence
tttttttgagacagagtctc

SEQ ID NO: 568346 - DNA, 20 bp, Artificial
  CRISPR gRNA sequence
ttttttgagacagagtctcg

SEQ ID NO: 568347 - DNA, 20 bp, Artificial
  CRISPR gRNA sequence
tttttgagacagagtctcgc

SEQ ID NO: 568348 - DNA, 20 bp, Artificial
  CRISPR gRNA sequence
ttttgagacagagtctcgct

SEQ ID NO: 568349 - DNA, 20 bp, Artificial
  CRISPR gRNA sequence
tttgagacagagtctcgctc

SEQ ID NO: 568350 - DNA, 20 bp, Artificial
  CRISPR gRNA sequence
ttgagacagagtctcgctct

SEQ ID NO: 568351 - DNA, 20 bp, Artificial
  CRISPR gRNA sequence
tgagacagagtctcgctctg

SEQ ID NO: 568352 - DNA, 20 bp, Artificial
  CRISPR gRNA sequence
gagacagagtctcgctctgt

SEQ ID NO: 568353 - DNA, 20 bp, Artificial
  CRISPR gRNA sequence
agacagagtctcgctctgtc

SEQ ID NO: 568354 - DNA, 20 bp, Artificial
  CRISPR gRNA sequence
gctctgtcgcccaggctgga

SEQ ID NO: 568355 - DNA, 20 bp, Artificial
  CRISPR gRNA sequence
tgtcgcccaggctggagtgc

SEQ ID NO: 568356 - DNA, 20 bp, Artificial
  CRISPR gRNA sequence
tcgcccaggctggagtgcag

SEQ ID NO: 568357 - DNA, 20 bp, Artificial
  CRISPR gRNA sequence
gagtgcagtggcgcgatctc

SEQ ID NO: 568358 - DNA, 20 bp, Artificial
  CRISPR gRNA sequence
ggctcactgcaagctccgcc

SEQ ID NO: 568359 - DNA, 20 bp, Artificial
  CRISPR gRNA sequence
actgcaagctccgcctcctg

SEQ ID NO: 568360 - DNA, 20 bp, Artificial
  CRISPR gRNA sequence
caagctccgcctcctgggtt

SEQ ID NO: 568361 - DNA, 20 bp, Artificial
  CRISPR gRNA sequence
cgcctcctgggttcacgcca

SEQ ID NO: 568362 - DNA, 20 bp, Artificial
  CRISPR gRNA sequence
ctgggttcacgccattctcc

SEQ ID NO: 568363 - DNA, 20 bp, Artificial
  CRISPR gRNA sequence
ggttcacgccattctcctgc

SEQ ID NO: 568364 - DNA, 20 bp, Artificial
  CRISPR gRNA sequence
acgccattctcctgcctcag

SEQ ID NO: 568365 - DNA, 20 bp, Artificial
  CRISPR gRNA sequence
tcctgcctcagcctcccgag

SEQ ID NO: 568366 - DNA, 20 bp, Artificial
  CRISPR gRNA sequence
ctgcctcagcctcccgagta

SEQ ID NO: 568367 - DNA, 20 bp, Artificial
  CRISPR gRNA sequence
cctcagcctcccgagtagct

SEQ ID NO: 568368 - DNA, 20 bp, Artificial
  CRISPR gRNA sequence
agcctcccgagtagctggga

SEQ ID NO: 568369 - DNA, 20 bp, Artificial
  CRISPR gRNA sequence
ccgagtagctgggactacag

SEQ ID NO: 568370 - DNA, 20 bp, Artificial
  CRISPR gRNA sequence
ggactacaggcgcccgccac

SEQ ID NO: 568371 - DNA, 20 bp, Artificial
  CRISPR gRNA sequence
caggcgcccgccaccacgcc

SEQ ID NO: 568372 - DNA, 20 bp, Artificial
  CRISPR gRNA sequence
attttttgtatttttagtag

SEQ ID NO: 568373 - DNA, 20 bp, Artificial
  CRISPR gRNA sequence
tttgtatttttagtagagac

SEQ ID NO: 568374 - DNA, 20 bp, Artificial
  CRISPR gRNA sequence
ttgtatttttagtagagacg

SEQ ID NO: 568375 - DNA, 20 bp, Artificial
  CRISPR gRNA sequence
tgtatttttagtagagacgg

SEQ ID NO: 568376 - DNA, 20 bp, Artificial
  CRISPR gRNA sequence
gtatttttagtagagacggg

SEQ ID NO: 568377 - DNA, 20 bp, Artificial
  CRISPR gRNA sequence
tatttttagtagagacgggg

SEQ ID NO: 568378 - DNA, 20 bp, Artificial
  CRISPR gRNA sequence
ttagtagagacggggtttca

SEQ ID NO: 568379 - DNA, 20 bp, Artificial
  CRISPR gRNA sequence
tagtagagacggggtttcac

SEQ ID NO: 568380 - DNA, 20 bp, Artificial
  CRISPR gRNA sequence
agtagagacggggtttcacc

SEQ ID NO: 568381 - DNA, 20 bp, Artificial
  CRISPR gRNA sequence
gtagagacggggtttcaccg

SEQ ID NO: 568382 - DNA, 20 bp, Artificial
  CRISPR gRNA sequence
caccgtgttagccaggatgg

SEQ ID NO: 568383 - DNA, 20 bp, Artificial
  CRISPR gRNA sequence
accgtgttagccaggatggt

SEQ ID NO: 568384 - DNA, 20 bp, Artificial
  CRISPR gRNA sequence
gccaggatggtctcgatctc

SEQ ID NO: 568385 - DNA, 20 bp, Artificial
  CRISPR gRNA sequence
gatctcctgacctcgtgatc

SEQ ID NO: 568386 - DNA, 20 bp, Artificial
  CRISPR gRNA sequence
ctgacctcgtgatccgcccg

SEQ ID NO: 568387 - DNA, 20 bp, Artificial
  CRISPR gRNA sequence
acctcgtgatccgcccgcct

SEQ ID NO: 568388 - DNA, 20 bp, Artificial
  CRISPR gRNA sequence
gtgatccgcccgcctcggcc

SEQ ID NO: 568389 - DNA, 20 bp, Artificial
  CRISPR gRNA sequence
ggcctcccaaagtgctggga

SEQ ID NO: 568390 - DNA, 20 bp, Artificial
  CRISPR gRNA sequence
ccaaagtgctgggattacag

SEQ ID NO: 568391 - DNA, 20 bp, Artificial
  CRISPR gRNA sequence
ggattacaggcgtgagccac

SEQ ID NO: 568392 - DNA, 20 bp, Artificial
  CRISPR gRNA sequence
caggcgtgagccaccgcgcc

SEQ ID NO: 568393 - DNA, 20 bp, Artificial
  CRISPR gRNA sequence
caatttttaacagaaacccc

SEQ ID NO: 568394 - DNA, 20 bp, Artificial
  CRISPR gRNA sequence
ttaacagaaaccccattata

SEQ ID NO: 568395 - DNA, 20 bp, Artificial
  CRISPR gRNA sequence
taacagaaaccccattatag

SEQ ID NO: 568396 - DNA, 20 bp, Artificial
  CRISPR gRNA sequence
aacagaaaccccattataga

SEQ ID NO: 568397 - DNA, 20 bp, Artificial
  CRISPR gRNA sequence
acagaaaccccattatagat

SEQ ID NO: 568398 - DNA, 20 bp, Artificial
  CRISPR gRNA sequence
tagatacaaagctaacatta

SEQ ID NO: 568399 - DNA, 20 bp, Artificial
  CRISPR gRNA sequence
acattatttagcactttctg

SEQ ID NO: 568400 - DNA, 20 bp, Artificial
  CRISPR gRNA sequence
tttagcactttctgtgttga

SEQ ID NO: 568401 - DNA, 20 bp, Artificial
  CRISPR gRNA sequence
agcactttctgtgttgagca

SEQ ID NO: 568402 - DNA, 20 bp, Artificial
  CRISPR gRNA sequence
gcactttctgtgttgagcac

SEQ ID NO: 568403 - DNA, 20 bp, Artificial
  CRISPR gRNA sequence
tctgtgttgagcaccattct

SEQ ID NO: 568404 - DNA, 20 bp, Artificial
  CRISPR gRNA sequence
ctgtgttgagcaccattcta

SEQ ID NO: 568405 - DNA, 20 bp, Artificial
  CRISPR gRNA sequence
tgtgttgagcaccattctaa

SEQ ID NO: 568406 - DNA, 20 bp, Artificial
  CRISPR gRNA sequence
tgttgagcaccattctaata

SEQ ID NO: 568407 - DNA, 20 bp, Artificial
  CRISPR gRNA sequence
agcaccattctaatacatat

SEQ ID NO: 568408 - DNA, 20 bp, Artificial
  CRISPR gRNA sequence
taatacatatgttaattaat

SEQ ID NO: 568409 - DNA, 20 bp, Artificial
  CRISPR gRNA sequence
atacatatgttaattaattc

SEQ ID NO: 568410 - DNA, 20 bp, Artificial
  CRISPR gRNA sequence
attaattcaatcttcacatc

SEQ ID NO: 568411 - DNA, 20 bp, Artificial
  CRISPR gRNA sequence
attcaatcttcacatcaatc

SEQ ID NO: 568412 - DNA, 20 bp, Artificial
  CRISPR gRNA sequence
aatcttcacatcaatcctca

SEQ ID NO: 568413 - DNA, 20 bp, Artificial
  CRISPR gRNA sequence
cacatcaatcctcatacaac

SEQ ID NO: 568414 - DNA, 20 bp, Artificial
  CRISPR gRNA sequence
acatcaatcctcatacaacc

SEQ ID NO: 568415 - DNA, 20 bp, Artificial
  CRISPR gRNA sequence
atacaacctataagttgtgt

SEQ ID NO: 568416 - DNA, 20 bp, Artificial
  CRISPR gRNA sequence
taagttgtgtactagtactt

SEQ ID NO: 568417 - DNA, 20 bp, Artificial
  CRISPR gRNA sequence
tgtactagtacttatccctg

SEQ ID NO: 568418 - DNA, 20 bp, Artificial
  CRISPR gRNA sequence
gtacttatccctgtttcctg

SEQ ID NO: 568419 - DNA, 20 bp, Artificial
  CRISPR gRNA sequence
atccctgtttcctggtgaga

SEQ ID NO: 568420 - DNA, 20 bp, Artificial
  CRISPR gRNA sequence
tccctgtttcctggtgagaa

SEQ ID NO: 568421 - DNA, 20 bp, Artificial
  CRISPR gRNA sequence
tttcctggtgagaaaccaac

SEQ ID NO: 568422 - DNA, 20 bp, Artificial
  CRISPR gRNA sequence
cctggtgagaaaccaacaga

SEQ ID NO: 568423 - DNA, 20 bp, Artificial
  CRISPR gRNA sequence
ctggtgagaaaccaacagag

SEQ ID NO: 568424 - DNA, 20 bp, Artificial
  CRISPR gRNA sequence
gtgagaaaccaacagagaga

SEQ ID NO: 568425 - DNA, 20 bp, Artificial
  CRISPR gRNA sequence
aagttgtttgctcaaggtaa

SEQ ID NO: 568426 - DNA, 20 bp, Artificial
  CRISPR gRNA sequence
agttgtttgctcaaggtaac

SEQ ID NO: 568427 - DNA, 20 bp, Artificial
  CRISPR gRNA sequence
tttgctcaaggtaacagcta

SEQ ID NO: 568428 - DNA, 20 bp, Artificial
  CRISPR gRNA sequence
gctcaaggtaacagctagta

SEQ ID NO: 568429 - DNA, 20 bp, Artificial
  CRISPR gRNA sequence
ctcaaggtaacagctagtaa

SEQ ID NO: 568430 - DNA, 20 bp, Artificial
  CRISPR gRNA sequence
aaggtaacagctagtaagtg

SEQ ID NO: 568431 - DNA, 20 bp, Artificial
  CRISPR gRNA sequence
gtaagtggcagaacctggct

SEQ ID NO: 568432 - DNA, 20 bp, Artificial
  CRISPR gRNA sequence
gctttgagtagaggctatct

SEQ ID NO: 568433 - DNA, 20 bp, Artificial
  CRISPR gRNA sequence
tgagtagaggctatctggct

SEQ ID NO: 568434 - DNA, 20 bp, Artificial
  CRISPR gRNA sequence
gagtagaggctatctggctc

SEQ ID NO: 568435 - DNA, 20 bp, Artificial
  CRISPR gRNA sequence
agtagaggctatctggctct

SEQ ID NO: 568436 - DNA, 20 bp, Artificial
  CRISPR gRNA sequence
tctggctctagagcccatgg

SEQ ID NO: 568437 - DNA, 20 bp, Artificial
  CRISPR gRNA sequence
gctctagagcccatggtttt

SEQ ID NO: 568438 - DNA, 20 bp, Artificial
  CRISPR gRNA sequence
tagagcccatggttttaact

SEQ ID NO: 568439 - DNA, 20 bp, Artificial
  CRISPR gRNA sequence
gagcccatggttttaactat

SEQ ID NO: 568440 - DNA, 20 bp, Artificial
  CRISPR gRNA sequence
taactattcacaatgctgct

SEQ ID NO: 568441 - DNA, 20 bp, Artificial
  CRISPR gRNA sequence
aactattcacaatgctgctt

SEQ ID NO: 568442 - DNA, 20 bp, Artificial
  CRISPR gRNA sequence
actattcacaatgctgcttt

SEQ ID NO: 568443 - DNA, 20 bp, Artificial
  CRISPR gRNA sequence
ttcacaatgctgctttataa

SEQ ID NO: 568444 - DNA, 20 bp, Artificial
  CRISPR gRNA sequence
acaatgctgctttataatat

SEQ ID NO: 568445 - DNA, 20 bp, Artificial
  CRISPR gRNA sequence
ctttataatattgttataat

SEQ ID NO: 568446 - DNA, 20 bp, Artificial
  CRISPR gRNA sequence
tataatattgttataatatc

SEQ ID NO: 568447 - DNA, 20 bp, Artificial
  CRISPR gRNA sequence
ataatattgttataatatca

SEQ ID NO: 568448 - DNA, 20 bp, Artificial
  CRISPR gRNA sequence
taatattgttataatatcat

SEQ ID NO: 568449 - DNA, 20 bp, Artificial
  CRISPR gRNA sequence
ttataatatcattatgttct

SEQ ID NO: 568450 - DNA, 20 bp, Artificial
  CRISPR gRNA sequence
taatatcattatgttctgaa

SEQ ID NO: 568451 - DNA, 20 bp, Artificial
  CRISPR gRNA sequence
tgttctgaaaggttacatat

SEQ ID NO: 568452 - DNA, 20 bp, Artificial
  CRISPR gRNA sequence
tgaaaggttacatatctact

SEQ ID NO: 568453 - DNA, 20 bp, Artificial
  CRISPR gRNA sequence
aaaggttacatatctactac

SEQ ID NO: 568454 - DNA, 20 bp, Artificial
  CRISPR gRNA sequence
catatctactacaggaacat

SEQ ID NO: 568455 - DNA, 20 bp, Artificial
  CRISPR gRNA sequence
ctacaggaacatgcatttga

SEQ ID NO: 568456 - DNA, 20 bp, Artificial
  CRISPR gRNA sequence
caggaacatgcatttgatat

SEQ ID NO: 568457 - DNA, 20 bp, Artificial
  CRISPR gRNA sequence
gatatgtttccttaggccta

SEQ ID NO: 568458 - DNA, 20 bp, Artificial
  CRISPR gRNA sequence
atatgtttccttaggcctaa

SEQ ID NO: 568459 - DNA, 20 bp, Artificial
  CRISPR gRNA sequence
ccttaggcctaacactaagt

SEQ ID NO: 568460 - DNA, 20 bp, Artificial
  CRISPR gRNA sequence
cttaggcctaacactaagtt

SEQ ID NO: 568461 - DNA, 20 bp, Artificial
  CRISPR gRNA sequence
aggcctaacactaagttaat

SEQ ID NO: 568462 - DNA, 20 bp, Artificial
  CRISPR gRNA sequence
ggcctaacactaagttaata

SEQ ID NO: 568463 - DNA, 20 bp, Artificial
  CRISPR gRNA sequence
acactaagttaatatcatga

SEQ ID NO: 568464 - DNA, 20 bp, Artificial
  CRISPR gRNA sequence
agttaatatcatgacaatct

SEQ ID NO: 568465 - DNA, 20 bp, Artificial
  CRISPR gRNA sequence
atatcatgacaatctgtctt

SEQ ID NO: 568466 - DNA, 20 bp, Artificial
  CRISPR gRNA sequence
tcttggctatgattttctaa

SEQ ID NO: 568467 - DNA, 20 bp, Artificial
  CRISPR gRNA sequence
ggctatgattttctaatgtt

SEQ ID NO: 568468 - DNA, 20 bp, Artificial
  CRISPR gRNA sequence
gctatgattttctaatgttg

SEQ ID NO: 568469 - DNA, 20 bp, Artificial
  CRISPR gRNA sequence
tgattttctaatgttgtttt

SEQ ID NO: 568470 - DNA, 20 bp, Artificial
  CRISPR gRNA sequence
tctaatgttgttttagtatt

SEQ ID NO: 568471 - DNA, 20 bp, Artificial
  CRISPR gRNA sequence
ctaatgttgttttagtatta

SEQ ID NO: 568472 - DNA, 20 bp, Artificial
  CRISPR gRNA sequence
taatgttgttttagtattat

SEQ ID NO: 568473 - DNA, 20 bp, Artificial
  CRISPR gRNA sequence
atgttgttttagtattattt

SEQ ID NO: 568474 - DNA, 20 bp, Artificial
  CRISPR gRNA sequence
ttttagtattatttacattt

SEQ ID NO: 568475 - DNA, 20 bp, Artificial
  CRISPR gRNA sequence
tagtattatttacatttgta

SEQ ID NO: 568476 - DNA, 20 bp, Artificial
  CRISPR gRNA sequence
agtattatttacatttgtaa

SEQ ID NO: 568477 - DNA, 20 bp, Artificial
  CRISPR gRNA sequence
gtattatttacatttgtaat

SEQ ID NO: 568478 - DNA, 20 bp, Artificial
  CRISPR gRNA sequence
tttacatttgtaatttttat

SEQ ID NO: 568479 - DNA, 20 bp, Artificial
  CRISPR gRNA sequence
acatttgtaatttttattat

SEQ ID NO: 568480 - DNA, 20 bp, Artificial
  CRISPR gRNA sequence
catttgtaatttttattatc

SEQ ID NO: 568481 - DNA, 20 bp, Artificial
  CRISPR gRNA sequence
gtaatttttattatctgttt

SEQ ID NO: 568482 - DNA, 20 bp, Artificial
  CRISPR gRNA sequence
taatttttattatctgtttt

SEQ ID NO: 568483 - DNA, 20 bp, Artificial
  CRISPR gRNA sequence
ttattatctgttttttacat

SEQ ID NO: 568484 - DNA, 20 bp, Artificial
  CRISPR gRNA sequence
tattatctgttttttacatt

SEQ ID NO: 568485 - DNA, 20 bp, Artificial
  CRISPR gRNA sequence
attatctgttttttacatta

SEQ ID NO: 568486 - DNA, 20 bp, Artificial
  CRISPR gRNA sequence
ttatctgttttttacattat

SEQ ID NO: 568487 - DNA, 20 bp, Artificial
  CRISPR gRNA sequence
tctgttttttacattatatc

SEQ ID NO: 568488 - DNA, 20 bp, Artificial
  CRISPR gRNA sequence
ttttttacattatatcccca

SEQ ID NO: 568489 - DNA, 20 bp, Artificial
  CRISPR gRNA sequence
tttacattatatccccagtt

SEQ ID NO: 568490 - DNA, 20 bp, Artificial
  CRISPR gRNA sequence
ttacattatatccccagttt

SEQ ID NO: 568491 - DNA, 20 bp, Artificial
  CRISPR gRNA sequence
tacattatatccccagttta

SEQ ID NO: 568492 - DNA, 20 bp, Artificial
  CRISPR gRNA sequence
acattatatccccagtttaa

SEQ ID NO: 568493 - DNA, 20 bp, Artificial
  CRISPR gRNA sequence
cattatatccccagtttaac

SEQ ID NO: 568494 - DNA, 20 bp, Artificial
  CRISPR gRNA sequence
tatccccagtttaacaaaca

SEQ ID NO: 568495 - DNA, 20 bp, Artificial
  CRISPR gRNA sequence
aacaaacaaaaaggtcagtg

SEQ ID NO: 568496 - DNA, 20 bp, Artificial
  CRISPR gRNA sequence
acaaacaaaaaggtcagtga

SEQ ID NO: 568497 - DNA, 20 bp, Artificial
  CRISPR gRNA sequence
gaaagtggtttattaaaata

SEQ ID NO: 568498 - DNA, 20 bp, Artificial
  CRISPR gRNA sequence
aaagtggtttattaaaatat

SEQ ID NO: 568499 - DNA, 20 bp, Artificial
  CRISPR gRNA sequence
attaaaatataaaagagacg

SEQ ID NO: 568500 - DNA, 20 bp, Artificial
  CRISPR gRNA sequence
ttaaaatataaaagagacga

SEQ ID NO: 568501 - DNA, 20 bp, Artificial
  CRISPR gRNA sequence
aaatataaaagagacgaaaa

SEQ ID NO: 568502 - DNA, 20 bp, Artificial
  CRISPR gRNA sequence
ttattcagaataatataatt

SEQ ID NO: 568503 - DNA, 20 bp, Artificial
  CRISPR gRNA sequence
ttcagaataatataattgta

SEQ ID NO: 568504 - DNA, 20 bp, Artificial
  CRISPR gRNA sequence
agaataatataattgtaaat

SEQ ID NO: 568505 - DNA, 20 bp, Artificial
  CRISPR gRNA sequence
taaatagtgaacaggattcc

SEQ ID NO: 568506 - DNA, 20 bp, Artificial
  CRISPR gRNA sequence
cagggcaaatagagaatatg

SEQ ID NO: 568507 - DNA, 20 bp, Artificial
  CRISPR gRNA sequence
tagggctgggataaggtgag

SEQ ID NO: 568508 - DNA, 20 bp, Artificial
  CRISPR gRNA sequence
gggctgggataaggtgagtc

SEQ ID NO: 568509 - DNA, 20 bp, Artificial
  CRISPR gRNA sequence
ggataaggtgagtctatgaa

SEQ ID NO: 568510 - DNA, 20 bp, Artificial
  CRISPR gRNA sequence
tgaatgaaatttttctgaac

SEQ ID NO: 568511 - DNA, 20 bp, Artificial
  CRISPR gRNA sequence
ttctgaacaagcagctgaaa

SEQ ID NO: 568512 - DNA, 20 bp, Artificial
  CRISPR gRNA sequence
tctgaacaagcagctgaaac

SEQ ID NO: 568513 - DNA, 20 bp, Artificial
  CRISPR gRNA sequence
ctgaacaagcagctgaaaca

SEQ ID NO: 568514 - DNA, 20 bp, Artificial
  CRISPR gRNA sequence
tgaacaagcagctgaaacag

SEQ ID NO: 568515 - DNA, 20 bp, Artificial
  CRISPR gRNA sequence
aacaagcagctgaaacagat

SEQ ID NO: 568516 - DNA, 20 bp, Artificial
  CRISPR gRNA sequence
aaacagataagggaaattag

SEQ ID NO: 568517 - DNA, 20 bp, Artificial
  CRISPR gRNA sequence
gcaaatacaagaaatatatg

SEQ ID NO: 568518 - DNA, 20 bp, Artificial
  CRISPR gRNA sequence
ggattttaactggtgagcca

SEQ ID NO: 568519 - DNA, 20 bp, Artificial
  CRISPR gRNA sequence
gattttaactggtgagccat

SEQ ID NO: 568520 - DNA, 20 bp, Artificial
  CRISPR gRNA sequence
taactggtgagccattctaa

SEQ ID NO: 568521 - DNA, 20 bp, Artificial
  CRISPR gRNA sequence
aactggtgagccattctaag

SEQ ID NO: 568522 - DNA, 20 bp, Artificial
  CRISPR gRNA sequence
actggtgagccattctaagt

SEQ ID NO: 568523 - DNA, 20 bp, Artificial
  CRISPR gRNA sequence
gtgagccattctaagtctcc

SEQ ID NO: 568524 - DNA, 20 bp, Artificial
  CRISPR gRNA sequence
taagtctcccatttattgtc

SEQ ID NO: 568525 - DNA, 20 bp, Artificial
  CRISPR gRNA sequence
agtctcccatttattgtctt

SEQ ID NO: 568526 - DNA, 20 bp, Artificial
  CRISPR gRNA sequence
ccatttattgtcttttctga

SEQ ID NO: 568527 - DNA, 20 bp, Artificial
  CRISPR gRNA sequence
attgtcttttctgaaccctt

SEQ ID NO: 568528 - DNA, 20 bp, Artificial
  CRISPR gRNA sequence
ttgtcttttctgaacccttt

SEQ ID NO: 568529 - DNA, 20 bp, Artificial
  CRISPR gRNA sequence
tcttttctgaaccctttcaa

SEQ ID NO: 568530 - DNA, 20 bp, Artificial
  CRISPR gRNA sequence
ttctgaaccctttcaaacaa

SEQ ID NO: 568531 - DNA, 20 bp, Artificial
  CRISPR gRNA sequence
tctgaaccctttcaaacaat

SEQ ID NO: 568532 - DNA, 20 bp, Artificial
  CRISPR gRNA sequence
ctgaaccctttcaaacaata

SEQ ID NO: 568533 - DNA, 20 bp, Artificial
  CRISPR gRNA sequence
tgaaccctttcaaacaataa

SEQ ID NO: 568534 - DNA, 20 bp, Artificial
  CRISPR gRNA sequence
aaccctttcaaacaataact

SEQ ID NO: 568535 - DNA, 20 bp, Artificial
  CRISPR gRNA sequence
tcaaacaataacttaaagcc

SEQ ID NO: 568536 - DNA, 20 bp, Artificial
  CRISPR gRNA sequence
caaacaataacttaaagcca

SEQ ID NO: 568537 - DNA, 20 bp, Artificial
  CRISPR gRNA sequence
aaacaataacttaaagccat

SEQ ID NO: 568538 - DNA, 20 bp, Artificial
  CRISPR gRNA sequence
aaagccattaaagttatatt

SEQ ID NO: 568539 - DNA, 20 bp, Artificial
  CRISPR gRNA sequence
aagccattaaagttatatta

SEQ ID NO: 568540 - DNA, 20 bp, Artificial
  CRISPR gRNA sequence
aagttatattattttcagac

SEQ ID NO: 568541 - DNA, 20 bp, Artificial
  CRISPR gRNA sequence
tattattttcagacaaagca

SEQ ID NO: 568542 - DNA, 20 bp, Artificial
  CRISPR gRNA sequence
ttttcagacaaagcagagtc

SEQ ID NO: 568543 - DNA, 20 bp, Artificial
  CRISPR gRNA sequence
tcagacaaagcagagtcact

SEQ ID NO: 568544 - DNA, 20 bp, Artificial
  CRISPR gRNA sequence
cagacaaagcagagtcactt

SEQ ID NO: 568545 - DNA, 20 bp, Artificial
  CRISPR gRNA sequence
agacaaagcagagtcacttt

SEQ ID NO: 568546 - DNA, 20 bp, Artificial
  CRISPR gRNA sequence
ttgggaaaggaaagacattt

SEQ ID NO: 568547 - DNA, 20 bp, Artificial
  CRISPR gRNA sequence
tgggaaaggaaagacatttt

SEQ ID NO: 568548 - DNA, 20 bp, Artificial
  CRISPR gRNA sequence
gggaaaggaaagacattttt

SEQ ID NO: 568549 - DNA, 20 bp, Artificial
  CRISPR gRNA sequence
ggaaaggaaagacatttttc

SEQ ID NO: 568550 - DNA, 20 bp, Artificial
  CRISPR gRNA sequence
ttcaagaaaaagtagacgtc

SEQ ID NO: 568551 - DNA, 20 bp, Artificial
  CRISPR gRNA sequence
tcaagaaaaagtagacgtcc

SEQ ID NO: 568552 - DNA, 20 bp, Artificial
  CRISPR gRNA sequence
caagaaaaagtagacgtcct

SEQ ID NO: 568553 - DNA, 20 bp, Artificial
  CRISPR gRNA sequence
aagaaaaagtagacgtcctc

SEQ ID NO: 568554 - DNA, 20 bp, Artificial
  CRISPR gRNA sequence
gtcagggtgggcagcgccgc

SEQ ID NO: 568555 - DNA, 20 bp, Artificial
  CRISPR gRNA sequence
gggcttggggcctggagcgg

SEQ ID NO: 568556 - DNA, 20 bp, Artificial
  CRISPR gRNA sequence
ggggcctggagcggcccctc

SEQ ID NO: 568557 - DNA, 20 bp, Artificial
  CRISPR gRNA sequence
gggcctggagcggcccctcc

SEQ ID NO: 568558 - DNA, 20 bp, Artificial
  CRISPR gRNA sequence
gagcggcccctcccagcacc

SEQ ID NO: 568559 - DNA, 20 bp, Artificial
  CRISPR gRNA sequence
ccagcacccggtgcgcccct

SEQ ID NO: 568560 - DNA, 20 bp, Artificial
  CRISPR gRNA sequence
ccctgccgcccactgccctg

SEQ ID NO: 568561 - DNA, 20 bp, Artificial
  CRISPR gRNA sequence
ccgcccactgccctgaaggt

SEQ ID NO: 568562 - DNA, 20 bp, Artificial
  CRISPR gRNA sequence
ccctgaaggtcaagtcgctt

SEQ ID NO: 568563 - DNA, 20 bp, Artificial
  CRISPR gRNA sequence
aaggtcaagtcgctttgttc

SEQ ID NO: 568564 - DNA, 20 bp, Artificial
  CRISPR gRNA sequence
tgttctgcgctgcgggcggc

SEQ ID NO: 568565 - DNA, 20 bp, Artificial
  CRISPR gRNA sequence
gttctgcgctgcgggcggct

SEQ ID NO: 568566 - DNA, 20 bp, Artificial
  CRISPR gRNA sequence
ttctgcgctgcgggcggctt

SEQ ID NO: 568567 - DNA, 20 bp, Artificial
  CRISPR gRNA sequence
tgcgctgcgggcggcttcct

SEQ ID NO: 568568 - DNA, 20 bp, Artificial
  CRISPR gRNA sequence
cgctgcgggcggcttcctcg

SEQ ID NO: 568569 - DNA, 20 bp, Artificial
  CRISPR gRNA sequence
cgggcggcttcctcgccggc

SEQ ID NO: 568570 - DNA, 20 bp, Artificial
  CRISPR gRNA sequence
cctcgccggcggcccagcgg

SEQ ID NO: 568571 - DNA, 20 bp, Artificial
  CRISPR gRNA sequence
ctcgccggcggcccagcgga

SEQ ID NO: 568572 - DNA, 20 bp, Artificial
  CRISPR gRNA sequence
gccggcggcccagcggagga

SEQ ID NO: 568573 - DNA, 20 bp, Artificial
  CRISPR gRNA sequence
gcagctcaaatctcccgcta

SEQ ID NO: 568574 - DNA, 20 bp, Artificial
  CRISPR gRNA sequence
aaatctcccgctagcccagc

SEQ ID NO: 568575 - DNA, 20 bp, Artificial
  CRISPR gRNA sequence
ccgctagcccagccagcccc

SEQ ID NO: 568576 - DNA, 20 bp, Artificial
  CRISPR gRNA sequence
gcccagccagccccgcgtac

SEQ ID NO: 568577 - DNA, 20 bp, Artificial
  CRISPR gRNA sequence
aggcttcccgtttttaaggt

SEQ ID NO: 568578 - DNA, 20 bp, Artificial
  CRISPR gRNA sequence
cccgtttttaaggtggagac

SEQ ID NO: 568579 - DNA, 20 bp, Artificial
  CRISPR gRNA sequence
ccgtttttaaggtggagacg

SEQ ID NO: 568580 - DNA, 20 bp, Artificial
  CRISPR gRNA sequence
ttaaggtggagacgtccagg

SEQ ID NO: 568581 - DNA, 20 bp, Artificial
  CRISPR gRNA sequence
taaggtggagacgtccagga

SEQ ID NO: 568582 - DNA, 20 bp, Artificial
  CRISPR gRNA sequence
aaggtggagacgtccaggac

SEQ ID NO: 568583 - DNA, 20 bp, Artificial
  CRISPR gRNA sequence
aggtggagacgtccaggacc

SEQ ID NO: 568584 - DNA, 20 bp, Artificial
  CRISPR gRNA sequence
tttattagatgtttaggaat

SEQ ID NO: 568585 - DNA, 20 bp, Artificial
  CRISPR gRNA sequence
tattagatgtttaggaattt

SEQ ID NO: 568586 - DNA, 20 bp, Artificial
  CRISPR gRNA sequence
attagatgtttaggaatttg

SEQ ID NO: 568587 - DNA, 20 bp, Artificial
  CRISPR gRNA sequence
ttagatgtttaggaatttga

SEQ ID NO: 568588 - DNA, 20 bp, Artificial
  CRISPR gRNA sequence
gatgtttaggaatttgagtt

SEQ ID NO: 568589 - DNA, 20 bp, Artificial
  CRISPR gRNA sequence
aggaatttgagtttttccgt

SEQ ID NO: 568590 - DNA, 20 bp, Artificial
  CRISPR gRNA sequence
ggaatttgagtttttccgta

SEQ ID NO: 568591 - DNA, 20 bp, Artificial
  CRISPR gRNA sequence
gagtttttccgtagggcgat

SEQ ID NO: 568592 - DNA, 20 bp, Artificial
  CRISPR gRNA sequence
agtttttccgtagggcgatg

SEQ ID NO: 568593 - DNA, 20 bp, Artificial
  CRISPR gRNA sequence
ttccgtagggcgatggtcat

SEQ ID NO: 568594 - DNA, 20 bp, Artificial
  CRISPR gRNA sequence
tccgtagggcgatggtcatc

SEQ ID NO: 568595 - DNA, 20 bp, Artificial
  CRISPR gRNA sequence
ccgtagggcgatggtcatcg

SEQ ID NO: 568596 - DNA, 20 bp, Artificial
  CRISPR gRNA sequence
cgtagggcgatggtcatcgt

SEQ ID NO: 568597 - DNA, 20 bp, Artificial
  CRISPR gRNA sequence
tggggtcaggctgggctaac

SEQ ID NO: 568598 - DNA, 20 bp, Artificial
  CRISPR gRNA sequence
ggctaactggggttttgatt

SEQ ID NO: 568599 - DNA, 20 bp, Artificial
  CRISPR gRNA sequence
actggggttttgattgtaag

SEQ ID NO: 568600 - DNA, 20 bp, Artificial
  CRISPR gRNA sequence
gggttttgattgtaagtttc

SEQ ID NO: 568601 - DNA, 20 bp, Artificial
  CRISPR gRNA sequence
tgattgtaagtttcgtgtgg

SEQ ID NO: 568602 - DNA, 20 bp, Artificial
  CRISPR gRNA sequence
gattgtaagtttcgtgtgga

SEQ ID NO: 568603 - DNA, 20 bp, Artificial
  CRISPR gRNA sequence
attgtaagtttcgtgtggac

SEQ ID NO: 568604 - DNA, 20 bp, Artificial
  CRISPR gRNA sequence
taagtttcgtgtggacgagg

SEQ ID NO: 568605 - DNA, 20 bp, Artificial
  CRISPR gRNA sequence
cgtgtggacgagggcatgtc

SEQ ID NO: 568606 - DNA, 20 bp, Artificial
  CRISPR gRNA sequence
gtgtggacgagggcatgtct

SEQ ID NO: 568607 - DNA, 20 bp, Artificial
  CRISPR gRNA sequence
atggggaagaaagtccttgg

SEQ ID NO: 568608 - DNA, 20 bp, Artificial
  CRISPR gRNA sequence
ggcattgcatctcagctgtt

SEQ ID NO: 568609 - DNA, 20 bp, Artificial
  CRISPR gRNA sequence
gcattgcatctcagctgttg

SEQ ID NO: 568610 - DNA, 20 bp, Artificial
  CRISPR gRNA sequence
catctcagctgttgggagct

SEQ ID NO: 568611 - DNA, 20 bp, Artificial
  CRISPR gRNA sequence
agctgttgggagctgtgcgg

SEQ ID NO: 568612 - DNA, 20 bp, Artificial
  CRISPR gRNA sequence
ttgggagctgtgcggtgcga

SEQ ID NO: 568613 - DNA, 20 bp, Artificial
  CRISPR gRNA sequence
ggagctgtgcggtgcgagcc

SEQ ID NO: 568614 - DNA, 20 bp, Artificial
  CRISPR gRNA sequence
tgcggtgcgagccagatggg

SEQ ID NO: 568615 - DNA, 20 bp, Artificial
  CRISPR gRNA sequence
cccgaggactggcctgagtg

SEQ ID NO: 568616 - DNA, 20 bp, Artificial
  CRISPR gRNA sequence
gcctgagtgccttagcctag

SEQ ID NO: 568617 - DNA, 20 bp, Artificial
  CRISPR gRNA sequence
agtgccttagcctagttact

SEQ ID NO: 568618 - DNA, 20 bp, Artificial
  CRISPR gRNA sequence
agcctagttactcacgggac

SEQ ID NO: 568619 - DNA, 20 bp, Artificial
  CRISPR gRNA sequence
gcctagttactcacgggact

SEQ ID NO: 568620 - DNA, 20 bp, Artificial
  CRISPR gRNA sequence
gttactcacgggacttggtt

SEQ ID NO: 568621 - DNA, 20 bp, Artificial
  CRISPR gRNA sequence
ctcacgggacttggtttacc

SEQ ID NO: 568622 - DNA, 20 bp, Artificial
  CRISPR gRNA sequence
acgggacttggtttaccaga

SEQ ID NO: 568623 - DNA, 20 bp, Artificial
  CRISPR gRNA sequence
ggtttaccagacaaggggat

SEQ ID NO: 568624 - DNA, 20 bp, Artificial
  CRISPR gRNA sequence
gtttaccagacaaggggata

SEQ ID NO: 568625 - DNA, 20 bp, Artificial
  CRISPR gRNA sequence
accagacaaggggataaaaa

SEQ ID NO: 568626 - DNA, 20 bp, Artificial
  CRISPR gRNA sequence
ccagacaaggggataaaaac

SEQ ID NO: 568627 - DNA, 20 bp, Artificial
  CRISPR gRNA sequence
agatggcagataacagtttt

SEQ ID NO: 568628 - DNA, 20 bp, Artificial
  CRISPR gRNA sequence
ttcagatggggttccttcag

SEQ ID NO: 568629 - DNA, 20 bp, Artificial
  CRISPR gRNA sequence
tcagatggggttccttcaga

SEQ ID NO: 568630 - DNA, 20 bp, Artificial
  CRISPR gRNA sequence
cagatggggttccttcagat

SEQ ID NO: 568631 - DNA, 20 bp, Artificial
  CRISPR gRNA sequence
agatggggttccttcagatt

SEQ ID NO: 568632 - DNA, 20 bp, Artificial
  CRISPR gRNA sequence
cttcagatttcgtggaagct

SEQ ID NO: 568633 - DNA, 20 bp, Artificial
  CRISPR gRNA sequence
cagatttcgtggaagctgct

SEQ ID NO: 568634 - DNA, 20 bp, Artificial
  CRISPR gRNA sequence
agatttcgtggaagctgcta

SEQ ID NO: 568635 - DNA, 20 bp, Artificial
  CRISPR gRNA sequence
cgtggaagctgctaaaaatg

SEQ ID NO: 568636 - DNA, 20 bp, Artificial
  CRISPR gRNA sequence
gtggaagctgctaaaaatgc

SEQ ID NO: 568637 - DNA, 20 bp, Artificial
  CRISPR gRNA sequence
ctaaaaatgcaagtaagacg

SEQ ID NO: 568638 - DNA, 20 bp, Artificial
  CRISPR gRNA sequence
aaaatgcaagtaagacggaa

SEQ ID NO: 568639 - DNA, 20 bp, Artificial
  CRISPR gRNA sequence
acggatcaggtgatgcagaa

SEQ ID NO: 568640 - DNA, 20 bp, Artificial
  CRISPR gRNA sequence
gagttttggcagctttacag

SEQ ID NO: 568641 - DNA, 20 bp, Artificial
  CRISPR gRNA sequence
tggcagctttacaggagcga

SEQ ID NO: 568642 - DNA, 20 bp, Artificial
  CRISPR gRNA sequence
ggcagctttacaggagcgac

SEQ ID NO: 568643 - DNA, 20 bp, Artificial
  CRISPR gRNA sequence
gcagctttacaggagcgact

SEQ ID NO: 568644 - DNA, 20 bp, Artificial
  CRISPR gRNA sequence
tacaggagcgacttgacaat

SEQ ID NO: 568645 - DNA, 20 bp, Artificial
  CRISPR gRNA sequence
acaggagcgacttgacaatg

SEQ ID NO: 568646 - DNA, 20 bp, Artificial
  CRISPR gRNA sequence
caggagcgacttgacaatgc

SEQ ID NO: 568647 - DNA, 20 bp, Artificial
  CRISPR gRNA sequence
gacaatgcccctcacacccc

SEQ ID NO: 568648 - DNA, 20 bp, Artificial
  CRISPR gRNA sequence
acaatgcccctcacacccct

SEQ ID NO: 568649 - DNA, 20 bp, Artificial
  CRISPR gRNA sequence
acaccccttccagctacatc

SEQ ID NO: 568650 - DNA, 20 bp, Artificial
  CRISPR gRNA sequence
ccagctacatcgaaacttta

SEQ ID NO: 568651 - DNA, 20 bp, Artificial
  CRISPR gRNA sequence
cagctacatcgaaactttac

SEQ ID NO: 568652 - DNA, 20 bp, Artificial
  CRISPR gRNA sequence
catcgaaactttacctaaag

SEQ ID NO: 568653 - DNA, 20 bp, Artificial
  CRISPR gRNA sequence
tacctaaagcagtaaaaaga

SEQ ID NO: 568654 - DNA, 20 bp, Artificial
  CRISPR gRNA sequence
acctaaagcagtaaaaagaa

SEQ ID NO: 568655 - DNA, 20 bp, Artificial
  CRISPR gRNA sequence
cctaaagcagtaaaaagaag

SEQ ID NO: 568656 - DNA, 20 bp, Artificial
  CRISPR gRNA sequence
aagcagtaaaaagaagaatt

SEQ ID NO: 568657 - DNA, 20 bp, Artificial
  CRISPR gRNA sequence
atgcattgaaacaaattcag

SEQ ID NO: 568658 - DNA, 20 bp, Artificial
  CRISPR gRNA sequence
aaacaaattcaggtgagatg

SEQ ID NO: 568659 - DNA, 20 bp, Artificial
  CRISPR gRNA sequence
aggtgagatgcgctcatata

SEQ ID NO: 568660 - DNA, 20 bp, Artificial
  CRISPR gRNA sequence
atatagaagccaagttctat

SEQ ID NO: 568661 - DNA, 20 bp, Artificial
  CRISPR gRNA sequence
tatgaagaagttcatgactt

SEQ ID NO: 568662 - DNA, 20 bp, Artificial
  CRISPR gRNA sequence
tgaagaagttcatgacttgg

SEQ ID NO: 568663 - DNA, 20 bp, Artificial
  CRISPR gRNA sequence
atgacttggaaagaaaatat

SEQ ID NO: 568664 - DNA, 20 bp, Artificial
  CRISPR gRNA sequence
ggaaagaaaatatgcagcat

SEQ ID NO: 568665 - DNA, 20 bp, Artificial
  CRISPR gRNA sequence
gaaagaaaatatgcagcatt

SEQ ID NO: 568666 - DNA, 20 bp, Artificial
  CRISPR gRNA sequence
taccagcctctctttgacga

SEQ ID NO: 568667 - DNA, 20 bp, Artificial
  CRISPR gRNA sequence
tctttgacgagagaagagaa

SEQ ID NO: 568668 - DNA, 20 bp, Artificial
  CRISPR gRNA sequence
tttgacgagagaagagaatt

SEQ ID NO: 568669 - DNA, 20 bp, Artificial
  CRISPR gRNA sequence
tgacgagagaagagaattta

SEQ ID NO: 568670 - DNA, 20 bp, Artificial
  CRISPR gRNA sequence
gacgagagaagagaatttat

SEQ ID NO: 568671 - DNA, 20 bp, Artificial
  CRISPR gRNA sequence
acgagagaagagaatttatc

SEQ ID NO: 568672 - DNA, 20 bp, Artificial
  CRISPR gRNA sequence
atcaccggtgatgttgaacc

SEQ ID NO: 568673 - DNA, 20 bp, Artificial
  CRISPR gRNA sequence
tcaccggtgatgttgaacca

SEQ ID NO: 568674 - DNA, 20 bp, Artificial
  CRISPR gRNA sequence
aaccaacatctgatatggaa

SEQ ID NO: 568675 - DNA, 20 bp, Artificial
  CRISPR gRNA sequence
atatggaatcagaatggcac

SEQ ID NO: 568676 - DNA, 20 bp, Artificial
  CRISPR gRNA sequence
gctggagacaggaaaaataa

SEQ ID NO: 568677 - DNA, 20 bp, Artificial
  CRISPR gRNA sequence
gagacaggaaaaataaagta

SEQ ID NO: 568678 - DNA, 20 bp, Artificial
  CRISPR gRNA sequence
aagagccaaatcccaaagga

SEQ ID NO: 568679 - DNA, 20 bp, Artificial
  CRISPR gRNA sequence
cagagttctggtttaccatc

SEQ ID NO: 568680 - DNA, 20 bp, Artificial
  CRISPR gRNA sequence
tggtttaccatctttagaaa

SEQ ID NO: 568681 - DNA, 20 bp, Artificial
  CRISPR gRNA sequence
gtttaccatctttagaaatg

SEQ ID NO: 568682 - DNA, 20 bp, Artificial
  CRISPR gRNA sequence
accatctttagaaatgtaga

SEQ ID NO: 568683 - DNA, 20 bp, Artificial
  CRISPR gRNA sequence
ccatctttagaaatgtagat

SEQ ID NO: 568684 - DNA, 20 bp, Artificial
  CRISPR gRNA sequence
tagaaatgtagatatgctaa

SEQ ID NO: 568685 - DNA, 20 bp, Artificial
  CRISPR gRNA sequence
agaaatgtagatatgctaag

SEQ ID NO: 568686 - DNA, 20 bp, Artificial
  CRISPR gRNA sequence
gaaatgtagatatgctaagt

SEQ ID NO: 568687 - DNA, 20 bp, Artificial
  CRISPR gRNA sequence
agtgaattagtccaggaata

SEQ ID NO: 568688 - DNA, 20 bp, Artificial
  CRISPR gRNA sequence
gtccaggaatatgatgaacc

SEQ ID NO: 568689 - DNA, 20 bp, Artificial
  CRISPR gRNA sequence
gaaatacctgcaggatatta

SEQ ID NO: 568690 - DNA, 20 bp, Artificial
  CRISPR gRNA sequence
aaatacctgcaggatattaa

SEQ ID NO: 568691 - DNA, 20 bp, Artificial
  CRISPR gRNA sequence
caggatattaaagtgaagtt

SEQ ID NO: 568692 - DNA, 20 bp, Artificial
  CRISPR gRNA sequence
aagtgaagttttctgaccct

SEQ ID NO: 568693 - DNA, 20 bp, Artificial
  CRISPR gRNA sequence
tctgaccctggacagcctat

SEQ ID NO: 568694 - DNA, 20 bp, Artificial
  CRISPR gRNA sequence
ctgaccctggacagcctatg

SEQ ID NO: 568695 - DNA, 20 bp, Artificial
  CRISPR gRNA sequence
tgaccctggacagcctatgt

SEQ ID NO: 568696 - DNA, 20 bp, Artificial
  CRISPR gRNA sequence
accctggacagcctatgtct

SEQ ID NO: 568697 - DNA, 20 bp, Artificial
  CRISPR gRNA sequence
gacagcctatgtctttcata

SEQ ID NO: 568698 - DNA, 20 bp, Artificial
  CRISPR gRNA sequence
tgtctttcatattaagagtt

SEQ ID NO: 568699 - DNA, 20 bp, Artificial
  CRISPR gRNA sequence
tcatattaagagttccactt

SEQ ID NO: 568700 - DNA, 20 bp, Artificial
  CRISPR gRNA sequence
catattaagagttccacttt

SEQ ID NO: 568701 - DNA, 20 bp, Artificial
  CRISPR gRNA sequence
atattaagagttccactttc

SEQ ID NO: 568702 - DNA, 20 bp, Artificial
  CRISPR gRNA sequence
agagttccactttcaaccca

SEQ ID NO: 568703 - DNA, 20 bp, Artificial
  CRISPR gRNA sequence
cactttcaacccaatgactg

SEQ ID NO: 568704 - DNA, 20 bp, Artificial
  CRISPR gRNA sequence
tcaacccaatgactgctttg

SEQ ID NO: 568705 - DNA, 20 bp, Artificial
  CRISPR gRNA sequence
caacccaatgactgctttgc

SEQ ID NO: 568706 - DNA, 20 bp, Artificial
  CRISPR gRNA sequence
aacccaatgactgctttgcc

SEQ ID NO: 568707 - DNA, 20 bp, Artificial
  CRISPR gRNA sequence
ctttgccaactcagtcctga

SEQ ID NO: 568708 - DNA, 20 bp, Artificial
  CRISPR gRNA sequence
tgccaactcagtcctgacaa

SEQ ID NO: 568709 - DNA, 20 bp, Artificial
  CRISPR gRNA sequence
gccaactcagtcctgacaaa

SEQ ID NO: 568710 - DNA, 20 bp, Artificial
  CRISPR gRNA sequence
ccaactcagtcctgacaaaa

SEQ ID NO: 568711 - DNA, 20 bp, Artificial
  CRISPR gRNA sequence
agtcctgacaaaaacctgca

SEQ ID NO: 568712 - DNA, 20 bp, Artificial
  CRISPR gRNA sequence
acaaaaacctgcaagatgaa

SEQ ID NO: 568713 - DNA, 20 bp, Artificial
  CRISPR gRNA sequence
caagatgaaatcagaaccag

SEQ ID NO: 568714 - DNA, 20 bp, Artificial
  CRISPR gRNA sequence
atcccttttcatttgcaggt

SEQ ID NO: 568715 - DNA, 20 bp, Artificial
  CRISPR gRNA sequence
ttcatttgcaggtcctgaga

SEQ ID NO: 568716 - DNA, 20 bp, Artificial
  CRISPR gRNA sequence
tcatttgcaggtcctgagat

SEQ ID NO: 568717 - DNA, 20 bp, Artificial
  CRISPR gRNA sequence
catttgcaggtcctgagatc

SEQ ID NO: 568718 - DNA, 20 bp, Artificial
  CRISPR gRNA sequence
atttgcaggtcctgagatca

SEQ ID NO: 568719 - DNA, 20 bp, Artificial
  CRISPR gRNA sequence
gcaggtcctgagatcatgga

SEQ ID NO: 568720 - DNA, 20 bp, Artificial
  CRISPR gRNA sequence
caggtcctgagatcatggac

SEQ ID NO: 568721 - DNA, 20 bp, Artificial
  CRISPR gRNA sequence
agatcatggactgcgatggg

SEQ ID NO: 568722 - DNA, 20 bp, Artificial
  CRISPR gRNA sequence
cgatgggtgtactattgact

SEQ ID NO: 568723 - DNA, 20 bp, Artificial
  CRISPR gRNA sequence
ttgactggaagaaaggaaag

SEQ ID NO: 568724 - DNA, 20 bp, Artificial
  CRISPR gRNA sequence
actggaagaaaggaaagaat

SEQ ID NO: 568725 - DNA, 20 bp, Artificial
  CRISPR gRNA sequence
gaagaaaggaaagaatgtta

SEQ ID NO: 568726 - DNA, 20 bp, Artificial
  CRISPR gRNA sequence
ctgtcaaaaccatcaagaaa

SEQ ID NO: 568727 - DNA, 20 bp, Artificial
  CRISPR gRNA sequence
tcaaaaccatcaagaaaaag

SEQ ID NO: 568728 - DNA, 20 bp, Artificial
  CRISPR gRNA sequence
ttagaacaattaccaaacaa

SEQ ID NO: 568729 - DNA, 20 bp, Artificial
  CRISPR gRNA sequence
gaacaattaccaaacaagta

SEQ ID NO: 568730 - DNA, 20 bp, Artificial
  CRISPR gRNA sequence
ccaaacaagtatccaatgag

SEQ ID NO: 568731 - DNA, 20 bp, Artificial
  CRISPR gRNA sequence
ttcaacttcttcaatccact

SEQ ID NO: 568732 - DNA, 20 bp, Artificial
  CRISPR gRNA sequence
tcaacttcttcaatccactg

SEQ ID NO: 568733 - DNA, 20 bp, Artificial
  CRISPR gRNA sequence
caacttcttcaatccactga

SEQ ID NO: 568734 - DNA, 20 bp, Artificial
  CRISPR gRNA sequence
aacttcttcaatccactgaa

SEQ ID NO: 568735 - DNA, 20 bp, Artificial
  CRISPR gRNA sequence
cttcaatccactgaaagcat

SEQ ID NO: 568736 - DNA, 20 bp, Artificial
  CRISPR gRNA sequence
ttcaatccactgaaagcatc

SEQ ID NO: 568737 - DNA, 20 bp, Artificial
  CRISPR gRNA sequence
caatccactgaaagcatctg

SEQ ID NO: 568738 - DNA, 20 bp, Artificial
  CRISPR gRNA sequence
aatccactgaaagcatctgg

SEQ ID NO: 568739 - DNA, 20 bp, Artificial
  CRISPR gRNA sequence
aaagcatctggggacggaga

SEQ ID NO: 568740 - DNA, 20 bp, Artificial
  CRISPR gRNA sequence
gggacggagaatcactggat

SEQ ID NO: 568741 - DNA, 20 bp, Artificial
  CRISPR gRNA sequence
gataaagattctgaattcgt

SEQ ID NO: 568742 - DNA, 20 bp, Artificial
  CRISPR gRNA sequence
tgaattcgtattagcctctg

SEQ ID NO: 568743 - DNA, 20 bp, Artificial
  CRISPR gRNA sequence
aattcgtattagcctctgat

SEQ ID NO: 568744 - DNA, 20 bp, Artificial
  CRISPR gRNA sequence
gtattagcctctgattttga

SEQ ID NO: 568745 - DNA, 20 bp, Artificial
  CRISPR gRNA sequence
gcctctgattttgaaattgg

SEQ ID NO: 568746 - DNA, 20 bp, Artificial
  CRISPR gRNA sequence
tgattttgaaattggacact

SEQ ID NO: 568747 - DNA, 20 bp, Artificial
  CRISPR gRNA sequence
attttgaaattggacacttt

SEQ ID NO: 568748 - DNA, 20 bp, Artificial
  CRISPR gRNA sequence
tgaaattggacactttttcc

SEQ ID NO: 568749 - DNA, 20 bp, Artificial
  CRISPR gRNA sequence
gaaattggacactttttccg

SEQ ID NO: 568750 - DNA, 20 bp, Artificial
  CRISPR gRNA sequence
aaattggacactttttccgt

SEQ ID NO: 568751 - DNA, 20 bp, Artificial
  CRISPR gRNA sequence
gacactttttccgtgagcgg

SEQ ID NO: 568752 - DNA, 20 bp, Artificial
  CRISPR gRNA sequence
tttccgtgagcggaccacag

SEQ ID NO: 568753 - DNA, 20 bp, Artificial
  CRISPR gRNA sequence
ttccgtgagcggaccacagg

SEQ ID NO: 568754 - DNA, 20 bp, Artificial
  CRISPR gRNA sequence
tccgtgagcggaccacaggc

SEQ ID NO: 568755 - DNA, 20 bp, Artificial
  CRISPR gRNA sequence
ccgtgagcggaccacaggct

SEQ ID NO: 568756 - DNA, 20 bp, Artificial
  CRISPR gRNA sequence
cgtgagcggaccacaggctg

SEQ ID NO: 568757 - DNA, 20 bp, Artificial
  CRISPR gRNA sequence
tgctgtacttcgctggggag

SEQ ID NO: 568758 - DNA, 20 bp, Artificial
  CRISPR gRNA sequence
tacttcgctggggaggcctt

SEQ ID NO: 568759 - DNA, 20 bp, Artificial
  CRISPR gRNA sequence
cgctggggaggccttaaagg

SEQ ID NO: 568760 - DNA, 20 bp, Artificial
  CRISPR gRNA sequence
gctggggaggccttaaagga

SEQ ID NO: 568761 - DNA, 20 bp, Artificial
  CRISPR gRNA sequence
gggaggccttaaaggatgat

SEQ ID NO: 568762 - DNA, 20 bp, Artificial
  CRISPR gRNA sequence
aaaggatgatgacaattttg

SEQ ID NO: 568763 - DNA, 20 bp, Artificial
  CRISPR gRNA sequence
aaggatgatgacaattttga

SEQ ID NO: 568764 - DNA, 20 bp, Artificial
  CRISPR gRNA sequence
tgacgaaggtgaagaagaag

SEQ ID NO: 568765 - DNA, 20 bp, Artificial
  CRISPR gRNA sequence
gacgaaggtgaagaagaaga

SEQ ID NO: 568766 - DNA, 20 bp, Artificial
  CRISPR gRNA sequence
acgaaggtgaagaagaagag

SEQ ID NO: 568767 - DNA, 20 bp, Artificial
  CRISPR gRNA sequence
gaaggtgatgaggagggaga

SEQ ID NO: 568768 - DNA, 20 bp, Artificial
  CRISPR gRNA sequence
atcccaacaaggaacccagc

SEQ ID NO: 568769 - DNA, 20 bp, Artificial
  CRISPR gRNA sequence
gcagaccggctgtcgcgact

SEQ ID NO: 568770 - DNA, 20 bp, Artificial
  CRISPR gRNA sequence
tcgcgactccgggcctgtag

SEQ ID NO: 568771 - DNA, 20 bp, Artificial
  CRISPR gRNA sequence
cgggcctgtagcgggaggcc

SEQ ID NO: 568772 - DNA, 20 bp, Artificial
  CRISPR gRNA sequence
tagcgggaggcctcagtctt

SEQ ID NO: 568773 - DNA, 20 bp, Artificial
  CRISPR gRNA sequence
agtctttgccgcatgcggca

SEQ ID NO: 568774 - DNA, 20 bp, Artificial
  CRISPR gRNA sequence
tgccgcatgcggcacaatcc

SEQ ID NO: 568775 - DNA, 20 bp, Artificial
  CRISPR gRNA sequence
gccgcatgcggcacaatccc

SEQ ID NO: 568776 - DNA, 20 bp, Artificial
  CRISPR gRNA sequence
ccgcatgcggcacaatcccg

SEQ ID NO: 568777 - DNA, 20 bp, Artificial
  CRISPR gRNA sequence
actccatctaatcgttttca

SEQ ID NO: 568778 - DNA, 20 bp, Artificial
  CRISPR gRNA sequence
ctccatctaatcgttttcaa

SEQ ID NO: 568779 - DNA, 20 bp, Artificial
  CRISPR gRNA sequence
catctaatcgttttcaagtg

SEQ ID NO: 568780 - DNA, 20 bp, Artificial
  CRISPR gRNA sequence
atcgttttcaagtgcatgat

SEQ ID NO: 568781 - DNA, 20 bp, Artificial
  CRISPR gRNA sequence
tcaagtgcatgattttcact

SEQ ID NO: 568782 - DNA, 20 bp, Artificial
  CRISPR gRNA sequence
caagtgcatgattttcactt

SEQ ID NO: 568783 - DNA, 20 bp, Artificial
  CRISPR gRNA sequence
aagtgcatgattttcacttt

SEQ ID NO: 568784 - DNA, 20 bp, Artificial
  CRISPR gRNA sequence
tcactttcacttttcctttt

SEQ ID NO: 568785 - DNA, 20 bp, Artificial
  CRISPR gRNA sequence
cactttcacttttccttttt

SEQ ID NO: 568786 - DNA, 20 bp, Artificial
  CRISPR gRNA sequence
actttcacttttcctttttc

SEQ ID NO: 568787 - DNA, 20 bp, Artificial
  CRISPR gRNA sequence
tcacttttcctttttcctta

SEQ ID NO: 568788 - DNA, 20 bp, Artificial
  CRISPR gRNA sequence
cacttttcctttttccttat

SEQ ID NO: 568789 - DNA, 20 bp, Artificial
  CRISPR gRNA sequence
acttttcctttttccttatt

SEQ ID NO: 568790 - DNA, 20 bp, Artificial
  CRISPR gRNA sequence
ttcctttttccttattattt

SEQ ID NO: 568791 - DNA, 20 bp, Artificial
  CRISPR gRNA sequence
tcctttttccttattatttt

SEQ ID NO: 568792 - DNA, 20 bp, Artificial
  CRISPR gRNA sequence
cctttttccttattattttg

SEQ ID NO: 568793 - DNA, 20 bp, Artificial
  CRISPR gRNA sequence
ctttttccttattattttgc

SEQ ID NO: 568794 - DNA, 20 bp, Artificial
  CRISPR gRNA sequence
tttccttattattttgctta

SEQ ID NO: 568795 - DNA, 20 bp, Artificial
  CRISPR gRNA sequence
ttccttattattttgcttaa

SEQ ID NO: 568796 - DNA, 20 bp, Artificial
  CRISPR gRNA sequence
tccttattattttgcttaat

SEQ ID NO: 568797 - DNA, 20 bp, Artificial
  CRISPR gRNA sequence
ccttattattttgcttaatg

SEQ ID NO: 568798 - DNA, 20 bp, Artificial
  CRISPR gRNA sequence
cttattattttgcttaatgt

SEQ ID NO: 568799 - DNA, 20 bp, Artificial
  CRISPR gRNA sequence
attattttgcttaatgtgta

SEQ ID NO: 568800 - DNA, 20 bp, Artificial
  CRISPR gRNA sequence
ttattttgcttaatgtgtac

SEQ ID NO: 568801 - DNA, 20 bp, Artificial
  CRISPR gRNA sequence
ttttgcttaatgtgtacagt

SEQ ID NO: 568802 - DNA, 20 bp, Artificial
  CRISPR gRNA sequence
tgcttaatgtgtacagtggc

SEQ ID NO: 568803 - DNA, 20 bp, Artificial
  CRISPR gRNA sequence
gcttaatgtgtacagtggca

SEQ ID NO: 568804 - DNA, 20 bp, Artificial
  CRISPR gRNA sequence
cttaatgtgtacagtggcaa

SEQ ID NO: 568805 - DNA, 20 bp, Artificial
  CRISPR gRNA sequence
aatgtgtacagtggcaactg

SEQ ID NO: 568806 - DNA, 20 bp, Artificial
  CRISPR gRNA sequence
atgtgtacagtggcaactga

SEQ ID NO: 568807 - DNA, 20 bp, Artificial
  CRISPR gRNA sequence
aaatgcatttcagaaatagg

SEQ ID NO: 568808 - DNA, 20 bp, Artificial
  CRISPR gRNA sequence
cagaaataggaggttttgtc

SEQ ID NO: 568809 - DNA, 20 bp, Artificial
  CRISPR gRNA sequence
agaaataggaggttttgtcc

SEQ ID NO: 568810 - DNA, 20 bp, Artificial
  CRISPR gRNA sequence
tgtccaataccctctgcagc

SEQ ID NO: 568811 - DNA, 20 bp, Artificial
  CRISPR gRNA sequence
gtccaataccctctgcagcc

SEQ ID NO: 568812 - DNA, 20 bp, Artificial
  CRISPR gRNA sequence
tccaataccctctgcagcct

SEQ ID NO: 568813 - DNA, 20 bp, Artificial
  CRISPR gRNA sequence
tgcagccttggtgcctgtag

SEQ ID NO: 568814 - DNA, 20 bp, Artificial
  CRISPR gRNA sequence
cagccttggtgcctgtagct

SEQ ID NO: 568815 - DNA, 20 bp, Artificial
  CRISPR gRNA sequence
ggtgcctgtagctctggact

SEQ ID NO: 568816 - DNA, 20 bp, Artificial
  CRISPR gRNA sequence
gtgcctgtagctctggactt

SEQ ID NO: 568817 - DNA, 20 bp, Artificial
  CRISPR gRNA sequence
tagctctggacttgcctgga

SEQ ID NO: 568818 - DNA, 20 bp, Artificial
  CRISPR gRNA sequence
tggacttgcctggacccttc

SEQ ID NO: 568819 - DNA, 20 bp, Artificial
  CRISPR gRNA sequence
gacttgcctggacccttccc

SEQ ID NO: 568820 - DNA, 20 bp, Artificial
  CRISPR gRNA sequence
gcctggacccttccctgcgg

SEQ ID NO: 568821 - DNA, 20 bp, Artificial
  CRISPR gRNA sequence
cctggacccttccctgcggg

SEQ ID NO: 568822 - DNA, 20 bp, Artificial
  CRISPR gRNA sequence
gacccttccctgcgggaggg

SEQ ID NO: 568823 - DNA, 20 bp, Artificial
  CRISPR gRNA sequence
ccctgcgggagggccccata

SEQ ID NO: 568824 - DNA, 20 bp, Artificial
  CRISPR gRNA sequence
cctgcgggagggccccatag

SEQ ID NO: 568825 - DNA, 20 bp, Artificial
  CRISPR gRNA sequence
cgggagggccccatagaccc

SEQ ID NO: 568826 - DNA, 20 bp, Artificial
  CRISPR gRNA sequence
gggtggggtgggatggggtg

SEQ ID NO: 568827 - DNA, 20 bp, Artificial
  CRISPR gRNA sequence
ggctaaaagggccgaggtct

SEQ ID NO: 568828 - DNA, 20 bp, Artificial
  CRISPR gRNA sequence
gctaaaagggccgaggtctg

SEQ ID NO: 568829 - DNA, 20 bp, Artificial
  CRISPR gRNA sequence
aaagggccgaggtctggtga

SEQ ID NO: 568830 - DNA, 20 bp, Artificial
  CRISPR gRNA sequence
gtgatgaggttccagggatc

SEQ ID NO: 568831 - DNA, 20 bp, Artificial
  CRISPR gRNA sequence
cagggatctagaacctctcc

SEQ ID NO: 568832 - DNA, 20 bp, Artificial
  CRISPR gRNA sequence
gaacctctcctaccactcct

SEQ ID NO: 568833 - DNA, 20 bp, Artificial
  CRISPR gRNA sequence
tcctaccactcctgcagttg

SEQ ID NO: 568834 - DNA, 20 bp, Artificial
  CRISPR gRNA sequence
ctaccactcctgcagttgga

SEQ ID NO: 568835 - DNA, 20 bp, Artificial
  CRISPR gRNA sequence
ccactcctgcagttggactg

SEQ ID NO: 568836 - DNA, 20 bp, Artificial
  CRISPR gRNA sequence
ctgcagttggactgaattct

SEQ ID NO: 568837 - DNA, 20 bp, Artificial
  CRISPR gRNA sequence
cagttggactgaattctttc

SEQ ID NO: 568838 - DNA, 20 bp, Artificial
  CRISPR gRNA sequence
gactgaattctttcctttca

SEQ ID NO: 568839 - DNA, 20 bp, Artificial
  CRISPR gRNA sequence
aattctttcctttcatttga

SEQ ID NO: 568840 - DNA, 20 bp, Artificial
  CRISPR gRNA sequence
tttcctttcatttgaagaaa

SEQ ID NO: 568841 - DNA, 20 bp, Artificial
  CRISPR gRNA sequence
tcctttcatttgaagaaacc

SEQ ID NO: 568842 - DNA, 20 bp, Artificial
  CRISPR gRNA sequence
cctttcatttgaagaaaccc

SEQ ID NO: 568843 - DNA, 20 bp, Artificial
  CRISPR gRNA sequence
ctttcatttgaagaaaccca

SEQ ID NO: 568844 - DNA, 20 bp, Artificial
  CRISPR gRNA sequence
tcatttgaagaaacccactc

SEQ ID NO: 568845 - DNA, 20 bp, Artificial
  CRISPR gRNA sequence
catttgaagaaacccactcg

SEQ ID NO: 568846 - DNA, 20 bp, Artificial
  CRISPR gRNA sequence
atttgaagaaacccactcgc

SEQ ID NO: 568847 - DNA, 20 bp, Artificial
  CRISPR gRNA sequence
gaagaaacccactcgctgtt

SEQ ID NO: 568848 - DNA, 20 bp, Artificial
  CRISPR gRNA sequence
aagaaacccactcgctgttt

SEQ ID NO: 568849 - DNA, 20 bp, Artificial
  CRISPR gRNA sequence
gctgttttcagctgcttaat

SEQ ID NO: 568850 - DNA, 20 bp, Artificial
  CRISPR gRNA sequence
ttttcagctgcttaatctgc

SEQ ID NO: 568851 - DNA, 20 bp, Artificial
  CRISPR gRNA sequence
tcagctgcttaatctgctga

SEQ ID NO: 568852 - DNA, 20 bp, Artificial
  CRISPR gRNA sequence
cagctgcttaatctgctgag

SEQ ID NO: 568853 - DNA, 20 bp, Artificial
  CRISPR gRNA sequence
agctgcttaatctgctgagt

SEQ ID NO: 568854 - DNA, 20 bp, Artificial
  CRISPR gRNA sequence
cttaatctgctgagtgtgca

SEQ ID NO: 568855 - DNA, 20 bp, Artificial
  CRISPR gRNA sequence
aatctgctgagtgtgcagcc

SEQ ID NO: 568856 - DNA, 20 bp, Artificial
  CRISPR gRNA sequence
atctgctgagtgtgcagcct

SEQ ID NO: 568857 - DNA, 20 bp, Artificial
  CRISPR gRNA sequence
ctgagtgtgcagcctgcatc

SEQ ID NO: 568858 - DNA, 20 bp, Artificial
  CRISPR gRNA sequence
agtgtgcagcctgcatcacc

SEQ ID NO: 568859 - DNA, 20 bp, Artificial
  CRISPR gRNA sequence
catcacctgctgtatgctaa

SEQ ID NO: 568860 - DNA, 20 bp, Artificial
  CRISPR gRNA sequence
ctgtatgctaatcatctcag

SEQ ID NO: 568861 - DNA, 20 bp, Artificial
  CRISPR gRNA sequence
tatgctaatcatctcagaag

SEQ ID NO: 568862 - DNA, 20 bp, Artificial
  CRISPR gRNA sequence
atcatctcagaagggccgtg

SEQ ID NO: 568863 - DNA, 20 bp, Artificial
  CRISPR gRNA sequence
agaagggccgtgtagagtag

SEQ ID NO: 568864 - DNA, 20 bp, Artificial
  CRISPR gRNA sequence
tccttaggatgttgcttttt

SEQ ID NO: 568865 - DNA, 20 bp, Artificial
  CRISPR gRNA sequence
cttaggatgttgctttttga

SEQ ID NO: 568866 - DNA, 20 bp, Artificial
  CRISPR gRNA sequence
aggatgttgctttttgatct

SEQ ID NO: 568867 - DNA, 20 bp, Artificial
  CRISPR gRNA sequence
ggatgttgctttttgatctt

SEQ ID NO: 568868 - DNA, 20 bp, Artificial
  CRISPR gRNA sequence
ctttttgatcttctttttta

SEQ ID NO: 568869 - DNA, 20 bp, Artificial
  CRISPR gRNA sequence
tttgatcttcttttttaagg

SEQ ID NO: 568870 - DNA, 20 bp, Artificial
  CRISPR gRNA sequence
ttgatcttcttttttaaggg

SEQ ID NO: 568871 - DNA, 20 bp, Artificial
  CRISPR gRNA sequence
tgatcttcttttttaagggt

SEQ ID NO: 568872 - DNA, 20 bp, Artificial
  CRISPR gRNA sequence
gatcttcttttttaagggtt

SEQ ID NO: 568873 - DNA, 20 bp, Artificial
  CRISPR gRNA sequence
atcttcttttttaagggttg

SEQ ID NO: 568874 - DNA, 20 bp, Artificial
  CRISPR gRNA sequence
cttttttaagggttgggtca

SEQ ID NO: 568875 - DNA, 20 bp, Artificial
  CRISPR gRNA sequence
ttttttaagggttgggtcag

SEQ ID NO: 568876 - DNA, 20 bp, Artificial
  CRISPR gRNA sequence
ttttaagggttgggtcaggg

SEQ ID NO: 568877 - DNA, 20 bp, Artificial
  CRISPR gRNA sequence
tttaagggttgggtcagggt

SEQ ID NO: 568878 - DNA, 20 bp, Artificial
  CRISPR gRNA sequence
ttaagggttgggtcagggtt

SEQ ID NO: 568879 - DNA, 20 bp, Artificial
  CRISPR gRNA sequence
taagggttgggtcagggttg

SEQ ID NO: 568880 - DNA, 20 bp, Artificial
  CRISPR gRNA sequence
aagggttgggtcagggttgt

SEQ ID NO: 568881 - DNA, 20 bp, Artificial
  CRISPR gRNA sequence
agggttgggtcagggttgtg

SEQ ID NO: 568882 - DNA, 20 bp, Artificial
  CRISPR gRNA sequence
ggtcagggttgtggcacacc

SEQ ID NO: 568883 - DNA, 20 bp, Artificial
  CRISPR gRNA sequence
tggcacaccagctcaggcga

SEQ ID NO: 568884 - DNA, 20 bp, Artificial
  CRISPR gRNA sequence
aggcgagagctgccacgggt

SEQ ID NO: 568885 - DNA, 20 bp, Artificial
  CRISPR gRNA sequence
ccacgggtcacctcatattt

SEQ ID NO: 568886 - DNA, 20 bp, Artificial
  CRISPR gRNA sequence
atatttatttatcccttctt

SEQ ID NO: 568887 - DNA, 20 bp, Artificial
  CRISPR gRNA sequence
atttatcccttcttgcctgt

SEQ ID NO: 568888 - DNA, 20 bp, Artificial
  CRISPR gRNA sequence
tttatcccttcttgcctgtg

SEQ ID NO: 568889 - DNA, 20 bp, Artificial
  CRISPR gRNA sequence
atcccttcttgcctgtgagg

SEQ ID NO: 568890 - DNA, 20 bp, Artificial
  CRISPR gRNA sequence
tcccttcttgcctgtgagga

SEQ ID NO: 568891 - DNA, 20 bp, Artificial
  CRISPR gRNA sequence
cttgcctgtgaggactgcgg

SEQ ID NO: 568892 - DNA, 20 bp, Artificial
  CRISPR gRNA sequence
ttgcctgtgaggactgcggc

SEQ ID NO: 568893 - DNA, 20 bp, Artificial
  CRISPR gRNA sequence
gcctgtgaggactgcggcct

SEQ ID NO: 568894 - DNA, 20 bp, Artificial
  CRISPR gRNA sequence
cctgtgaggactgcggcctt

SEQ ID NO: 568895 - DNA, 20 bp, Artificial
  CRISPR gRNA sequence
tgaggactgcggccttttgc

SEQ ID NO: 568896 - DNA, 20 bp, Artificial
  CRISPR gRNA sequence
cggccttttgctgtcgctcg

SEQ ID NO: 568897 - DNA, 20 bp, Artificial
  CRISPR gRNA sequence
ttgctgtcgctcgtccttgc

SEQ ID NO: 568898 - DNA, 20 bp, Artificial
  CRISPR gRNA sequence
tgctgtcgctcgtccttgcc

SEQ ID NO: 568899 - DNA, 20 bp, Artificial
  CRISPR gRNA sequence
gctgtcgctcgtccttgcca

SEQ ID NO: 568900 - DNA, 20 bp, Artificial
  CRISPR gRNA sequence
ctgtcgctcgtccttgccat

SEQ ID NO: 568901 - DNA, 20 bp, Artificial
  CRISPR gRNA sequence
tcgctcgtccttgccatttc

SEQ ID NO: 568902 - DNA, 20 bp, Artificial
  CRISPR gRNA sequence
gtccttgccatttctgaacc

SEQ ID NO: 568903 - DNA, 20 bp, Artificial
  CRISPR gRNA sequence
gccatttctgaaccaccctg

SEQ ID NO: 568904 - DNA, 20 bp, Artificial
  CRISPR gRNA sequence
ccatttctgaaccaccctgg

SEQ ID NO: 568905 - DNA, 20 bp, Artificial
  CRISPR gRNA sequence
ctgaaccaccctggtgacct

SEQ ID NO: 568906 - DNA, 20 bp, Artificial
  CRISPR gRNA sequence
tgaaccaccctggtgacctg

SEQ ID NO: 568907 - DNA, 20 bp, Artificial
  CRISPR gRNA sequence
aaccaccctggtgacctgag

SEQ ID NO: 568908 - DNA, 20 bp, Artificial
  CRISPR gRNA sequence
gtgacctgagcaggaagatg

SEQ ID NO: 568909 - DNA, 20 bp, Artificial
  CRISPR gRNA sequence
agcaggaagatgtgccactt

SEQ ID NO: 568910 - DNA, 20 bp, Artificial
  CRISPR gRNA sequence
cctagcaggagcaagggctg

SEQ ID NO: 568911 - DNA, 20 bp, Artificial
  CRISPR gRNA sequence
ctagcaggagcaagggctgt

SEQ ID NO: 568912 - DNA, 20 bp, Artificial
  CRISPR gRNA sequence
gcaggagcaagggctgtgcg

SEQ ID NO: 568913 - DNA, 20 bp, Artificial
  CRISPR gRNA sequence
tgcggaagaaacactgcttc

SEQ ID NO: 568914 - DNA, 20 bp, Artificial
  CRISPR gRNA sequence
cttcctgccaccagggctga

SEQ ID NO: 568915 - DNA, 20 bp, Artificial
  CRISPR gRNA sequence
cctgccaccagggctgaaga

SEQ ID NO: 568916 - DNA, 20 bp, Artificial
  CRISPR gRNA sequence
ctgccaccagggctgaagac

SEQ ID NO: 568917 - DNA, 20 bp, Artificial
  CRISPR gRNA sequence
ccaccagggctgaagacgcg

SEQ ID NO: 568918 - DNA, 20 bp, Artificial
  CRISPR gRNA sequence
aagacgcgagcctgtcctcg

SEQ ID NO: 568919 - DNA, 20 bp, Artificial
  CRISPR gRNA sequence
tcctcgtgacacaggcaccg

SEQ ID NO: 568920 - DNA, 20 bp, Artificial
  CRISPR gRNA sequence
gtgacacaggcaccgccctg

SEQ ID NO: 568921 - DNA, 20 bp, Artificial
  CRISPR gRNA sequence
ctgccggagttgggattcgg

SEQ ID NO: 568922 - DNA, 20 bp, Artificial
  CRISPR gRNA sequence
ccggagttgggattcggcag

SEQ ID NO: 568923 - DNA, 20 bp, Artificial
  CRISPR gRNA sequence
ggattcggcagtgttctcca

SEQ ID NO: 568924 - DNA, 20 bp, Artificial
  CRISPR gRNA sequence
ggcagtgttctccagtgagg

SEQ ID NO: 568925 - DNA, 20 bp, Artificial
  CRISPR gRNA sequence
tccagtgaggggctgggctg

SEQ ID NO: 568926 - DNA, 20 bp, Artificial
  CRISPR gRNA sequence
cagtgaggggctgggctggg

SEQ ID NO: 568927 - DNA, 20 bp, Artificial
  CRISPR gRNA sequence
ggctgggaagtcctgcgttt

SEQ ID NO: 568928 - DNA, 20 bp, Artificial
  CRISPR gRNA sequence
ggaagtcctgcgtttcattt

SEQ ID NO: 568929 - DNA, 20 bp, Artificial
  CRISPR gRNA sequence
cgtttcatttgagcatatga

SEQ ID NO: 568930 - DNA, 20 bp, Artificial
  CRISPR gRNA sequence
catttgagcatatgagcgtc

SEQ ID NO: 568931 - DNA, 20 bp, Artificial
  CRISPR gRNA sequence
atttgagcatatgagcgtca

SEQ ID NO: 568932 - DNA, 20 bp, Artificial
  CRISPR gRNA sequence
gagcatatgagcgtcaagtc

SEQ ID NO: 568933 - DNA, 20 bp, Artificial
  CRISPR gRNA sequence
agcatatgagcgtcaagtcc

SEQ ID NO: 568934 - DNA, 20 bp, Artificial
  CRISPR gRNA sequence
ctttctcagtagtcccattg

SEQ ID NO: 568935 - DNA, 20 bp, Artificial
  CRISPR gRNA sequence
tctcagtagtcccattgctg

SEQ ID NO: 568936 - DNA, 20 bp, Artificial
  CRISPR gRNA sequence
ctcagtagtcccattgctgg

SEQ ID NO: 568937 - DNA, 20 bp, Artificial
  CRISPR gRNA sequence
tcagtagtcccattgctggg

SEQ ID NO: 568938 - DNA, 20 bp, Artificial
  CRISPR gRNA sequence
agtagtcccattgctgggcc

SEQ ID NO: 568939 - DNA, 20 bp, Artificial
  CRISPR gRNA sequence
ctgggccccaccattcatcc

SEQ ID NO: 568940 - DNA, 20 bp, Artificial
  CRISPR gRNA sequence
ggccccaccattcatcctgt

SEQ ID NO: 568941 - DNA, 20 bp, Artificial
  CRISPR gRNA sequence
atcctgtctgaaggtcctgg

SEQ ID NO: 568942 - DNA, 20 bp, Artificial
  CRISPR gRNA sequence
tctgaaggtcctggttggtg

SEQ ID NO: 568943 - DNA, 20 bp, Artificial
  CRISPR gRNA sequence
aaggtcctggttggtgtgac

SEQ ID NO: 568944 - DNA, 20 bp, Artificial
  CRISPR gRNA sequence
gttggtgtgaccggttggtg

SEQ ID NO: 568945 - DNA, 20 bp, Artificial
  CRISPR gRNA sequence
gtgtgaccggttggtggctg

SEQ ID NO: 568946 - DNA, 20 bp, Artificial
  CRISPR gRNA sequence
gtggctggtgagtggggttt

SEQ ID NO: 568947 - DNA, 20 bp, Artificial
  CRISPR gRNA sequence
gtgagtggggtttccaagtg

SEQ ID NO: 568948 - DNA, 20 bp, Artificial
  CRISPR gRNA sequence
ccaagtgggtgacagcgctc

SEQ ID NO: 568949 - DNA, 20 bp, Artificial
  CRISPR gRNA sequence
caagtgggtgacagcgctct

SEQ ID NO: 568950 - DNA, 20 bp, Artificial
  CRISPR gRNA sequence
tgtggcagccggggatggcc

SEQ ID NO: 568951 - DNA, 20 bp, Artificial
  CRISPR gRNA sequence
tggcagccggggatggcctt

SEQ ID NO: 568952 - DNA, 20 bp, Artificial
  CRISPR gRNA sequence
gtccgcgctgaccaggcctg

SEQ ID NO: 568953 - DNA, 20 bp, Artificial
  CRISPR gRNA sequence
tccgcgctgaccaggcctgt

SEQ ID NO: 568954 - DNA, 20 bp, Artificial
  CRISPR gRNA sequence
accaggcctgtagagagtgc

SEQ ID NO: 568955 - DNA, 20 bp, Artificial
  CRISPR gRNA sequence
tagagagtgctcagcctaac

SEQ ID NO: 568956 - DNA, 20 bp, Artificial
  CRISPR gRNA sequence
agcctaaccttagaacacat

SEQ ID NO: 568957 - DNA, 20 bp, Artificial
  CRISPR gRNA sequence
accttagaacacatttataa

SEQ ID NO: 568958 - DNA, 20 bp, Artificial
  CRISPR gRNA sequence
agaacacatttataactgaa

SEQ ID NO: 568959 - DNA, 20 bp, Artificial
  CRISPR gRNA sequence
gaacacatttataactgaat

SEQ ID NO: 568960 - DNA, 20 bp, Artificial
  CRISPR gRNA sequence
ataactgaatacagtgtttt

SEQ ID NO: 568961 - DNA, 20 bp, Artificial
  CRISPR gRNA sequence
taactgaatacagtgttttc

SEQ ID NO: 568962 - DNA, 20 bp, Artificial
  CRISPR gRNA sequence
aatacagtgttttcaatttg

SEQ ID NO: 568963 - DNA, 20 bp, Artificial
  CRISPR gRNA sequence
tcaatttgtacataatagtt

SEQ ID NO: 568964 - DNA, 20 bp, Artificial
  CRISPR gRNA sequence
caatttgtacataatagtta

SEQ ID NO: 568965 - DNA, 20 bp, Artificial
  CRISPR gRNA sequence
aatttgtacataatagttag

SEQ ID NO: 568966 - DNA, 20 bp, Artificial
  CRISPR gRNA sequence
gtacataatagttagaatat

SEQ ID NO: 568967 - DNA, 20 bp, Artificial
  CRISPR gRNA sequence
tacataatagttagaatatt

SEQ ID NO: 568968 - DNA, 20 bp, Artificial
  CRISPR gRNA sequence
gaatattctattaaagttat

SEQ ID NO: 568969 - DNA, 20 bp, Artificial
  CRISPR gRNA sequence
tattaaagttatgaaacacg

SEQ ID NO: 568970 - DNA, 20 bp, Artificial
  CRISPR gRNA sequence
ttaaagttatgaaacacgga

SEQ ID NO: 568971 - DNA, 20 bp, Artificial
  CRISPR gRNA sequence
aagttatgaaacacggagaa

SEQ ID NO: 568972 - DNA, 20 bp, Artificial
  CRISPR gRNA sequence
tgaaacacggagaaaaaaaa

SEQ ID NO: 568973 - DNA, 20 bp, Artificial
  CRISPR gRNA sequence
ataactgatagatttgattt

SEQ ID NO: 568974 - DNA, 20 bp, Artificial
  CRISPR gRNA sequence
taactgatagatttgatttt

SEQ ID NO: 568975 - DNA, 20 bp, Artificial
  CRISPR gRNA sequence
atagatttgatttttgaaga

SEQ ID NO: 568976 - DNA, 20 bp, Artificial
  CRISPR gRNA sequence
gatttttgaagacagagaaa

SEQ ID NO: 568977 - DNA, 20 bp, Artificial
  CRISPR gRNA sequence
atttttgaagacagagaaaa

SEQ ID NO: 568978 - DNA, 20 bp, Artificial
  CRISPR gRNA sequence
ttgaagacagagaaaagatc

SEQ ID NO: 568979 - DNA, 20 bp, Artificial
  CRISPR gRNA sequence
tgaagacagagaaaagatca

SEQ ID NO: 568980 - DNA, 20 bp, Artificial
  CRISPR gRNA sequence
gaagacagagaaaagatcaa

SEQ ID NO: 568981 - DNA, 20 bp, Artificial
  CRISPR gRNA sequence
aagacagagaaaagatcaaa

SEQ ID NO: 568982 - DNA, 20 bp, Artificial
  CRISPR gRNA sequence
aaaggagcactgtttgtaca

SEQ ID NO: 568983 - DNA, 20 bp, Artificial
  CRISPR gRNA sequence
tttgtacaagtcacacaatt

SEQ ID NO: 568984 - DNA, 20 bp, Artificial
  CRISPR gRNA sequence
gtacaagtcacacaattgca

SEQ ID NO: 568985 - DNA, 20 bp, Artificial
  CRISPR gRNA sequence
tacaagtcacacaattgcaa

SEQ ID NO: 568986 - DNA, 20 bp, Artificial
  CRISPR gRNA sequence
caagaagtttttaaaacgag

SEQ ID NO: 568987 - DNA, 20 bp, Artificial
  CRISPR gRNA sequence
ttaaaacgagctgcaaagtt

SEQ ID NO: 568988 - DNA, 20 bp, Artificial
  CRISPR gRNA sequence
taaaacgagctgcaaagtta

SEQ ID NO: 568989 - DNA, 20 bp, Artificial
  CRISPR gRNA sequence
aaaacgagctgcaaagttaa

SEQ ID NO: 568990 - DNA, 20 bp, Artificial
  CRISPR gRNA sequence
aaacgagctgcaaagttaaa

SEQ ID NO: 568991 - DNA, 20 bp, Artificial
  CRISPR gRNA sequence
caaagttaaaatagttaagc

SEQ ID NO: 568992 - DNA, 20 bp, Artificial
  CRISPR gRNA sequence
aaatagttaagcttggagca

SEQ ID NO: 568993 - DNA, 20 bp, Artificial
  CRISPR gRNA sequence
agcttggagcaaacattcct

SEQ ID NO: 568994 - DNA, 20 bp, Artificial
  CRISPR gRNA sequence
ggagcaaacattcctttatt

SEQ ID NO: 568995 - DNA, 20 bp, Artificial
  CRISPR gRNA sequence
gagcaaacattcctttatta

SEQ ID NO: 568996 - DNA, 20 bp, Artificial
  CRISPR gRNA sequence
ctttattaattccacctttt

SEQ ID NO: 568997 - DNA, 20 bp, Artificial
  CRISPR gRNA sequence
tattaattccaccttttgag

SEQ ID NO: 568998 - DNA, 20 bp, Artificial
  CRISPR gRNA sequence
attaattccaccttttgagt

SEQ ID NO: 568999 - DNA, 20 bp, Artificial
  CRISPR gRNA sequence
ttaattccaccttttgagtg

SEQ ID NO: 569000 - DNA, 20 bp, Artificial
  CRISPR gRNA sequence
attccaccttttgagtgtta

SEQ ID NO: 569001 - DNA, 20 bp, Artificial
  CRISPR gRNA sequence
caccttttgagtgttacata

SEQ ID NO: 569002 - DNA, 20 bp, Artificial
  CRISPR gRNA sequence
ttgagtgttacataataccc

SEQ ID NO: 569003 - DNA, 20 bp, Artificial
  CRISPR gRNA sequence
tgagtgttacataataccca

SEQ ID NO: 569004 - DNA, 20 bp, Artificial
  CRISPR gRNA sequence
gagtgttacataatacccaa

SEQ ID NO: 569005 - DNA, 20 bp, Artificial
  CRISPR gRNA sequence
agtgttacataatacccaag

SEQ ID NO: 569006 - DNA, 20 bp, Artificial
  CRISPR gRNA sequence
cataatacccaaggcatacg

SEQ ID NO: 569007 - DNA, 20 bp, Artificial
  CRISPR gRNA sequence
gttgtaaaagcagatagttg

SEQ ID NO: 569008 - DNA, 20 bp, Artificial
  CRISPR gRNA sequence
ttgtaaaagcagatagttgc

SEQ ID NO: 569009 - DNA, 20 bp, Artificial
  CRISPR gRNA sequence
taaaagcagatagttgcttt

SEQ ID NO: 569010 - DNA, 20 bp, Artificial
  CRISPR gRNA sequence
ctttataatgggaacaacaa

SEQ ID NO: 569011 - DNA, 20 bp, Artificial
  CRISPR gRNA sequence
tataatgggaacaacaaaaa

SEQ ID NO: 569012 - DNA, 20 bp, Artificial
  CRISPR gRNA sequence
ataatgggaacaacaaaaaa

SEQ ID NO: 569013 - DNA, 20 bp, Artificial
  CRISPR gRNA sequence
taatgggaacaacaaaaaat

SEQ ID NO: 569014 - DNA, 20 bp, Artificial
  CRISPR gRNA sequence
ttgccttttggtatatgtgt

SEQ ID NO: 569015 - DNA, 20 bp, Artificial
  CRISPR gRNA sequence
tgccttttggtatatgtgtg

SEQ ID NO: 569016 - DNA, 20 bp, Artificial
  CRISPR gRNA sequence
gccttttggtatatgtgtgc

SEQ ID NO: 569017 - DNA, 20 bp, Artificial
  CRISPR gRNA sequence
ccttttggtatatgtgtgct

SEQ ID NO: 569018 - DNA, 20 bp, Artificial
  CRISPR gRNA sequence
ttggtatatgtgtgctgcat

SEQ ID NO: 569019 - DNA, 20 bp, Artificial
  CRISPR gRNA sequence
tggtatatgtgtgctgcatc

SEQ ID NO: 569020 - DNA, 20 bp, Artificial
  CRISPR gRNA sequence
ggtatatgtgtgctgcatct

SEQ ID NO: 569021 - DNA, 20 bp, Artificial
  CRISPR gRNA sequence
gtatatgtgtgctgcatcta

SEQ ID NO: 569022 - DNA, 20 bp, Artificial
  CRISPR gRNA sequence
catctaactgacaaggggga

SEQ ID NO: 569023 - DNA, 20 bp, Artificial
  CRISPR gRNA sequence
actgacaagggggaagaaga

SEQ ID NO: 569024 - DNA, 20 bp, Artificial
  CRISPR gRNA sequence
acaagggggaagaagatgac

SEQ ID NO: 569025 - DNA, 20 bp, Artificial
  CRISPR gRNA sequence
aaatcttgaaaagttttaag

SEQ ID NO: 569026 - DNA, 20 bp, Artificial
  CRISPR gRNA sequence
gaaaagttttaagtgttcca

SEQ ID NO: 569027 - DNA, 20 bp, Artificial
  CRISPR gRNA sequence
aaaagttttaagtgttccaa

SEQ ID NO: 569028 - DNA, 20 bp, Artificial
  CRISPR gRNA sequence
taagtgttccaagagacaaa

SEQ ID NO: 569029 - DNA, 20 bp, Artificial
  CRISPR gRNA sequence
aagtgttccaagagacaaaa

SEQ ID NO: 569030 - DNA, 20 bp, Artificial
  CRISPR gRNA sequence
agtgttccaagagacaaaat

SEQ ID NO: 569031 - DNA, 20 bp, Artificial
  CRISPR gRNA sequence
caagagacaaaatacttgaa

SEQ ID NO: 569032 - DNA, 20 bp, Artificial
  CRISPR gRNA sequence
gaaggaaataatttctgagt

SEQ ID NO: 569033 - DNA, 20 bp, Artificial
  CRISPR gRNA sequence
aaggaaataatttctgagta

SEQ ID NO: 569034 - DNA, 20 bp, Artificial
  CRISPR gRNA sequence
ctgagtaagatccctctata

SEQ ID NO: 569035 - DNA, 20 bp, Artificial
  CRISPR gRNA sequence
tgagtaagatccctctatag

SEQ ID NO: 569036 - DNA, 20 bp, Artificial
  CRISPR gRNA sequence
agtaagatccctctatagaa

SEQ ID NO: 569037 - DNA, 20 bp, Artificial
  CRISPR gRNA sequence
tatagaattacatggaatat

SEQ ID NO: 569038 - DNA, 20 bp, Artificial
  CRISPR gRNA sequence
tagaattacatggaatattt

SEQ ID NO: 569039 - DNA, 20 bp, Artificial
  CRISPR gRNA sequence
catggaatattttaggggat

SEQ ID NO: 569040 - DNA, 20 bp, Artificial
  CRISPR gRNA sequence
taggggatttttaaaggttt

SEQ ID NO: 569041 - DNA, 20 bp, Artificial
  CRISPR gRNA sequence
aggggatttttaaaggtttt

SEQ ID NO: 569042 - DNA, 20 bp, Artificial
  CRISPR gRNA sequence
ggggatttttaaaggttttg

SEQ ID NO: 569043 - DNA, 20 bp, Artificial
  CRISPR gRNA sequence
ttaaaggttttgcccttgca

SEQ ID NO: 569044 - DNA, 20 bp, Artificial
  CRISPR gRNA sequence
taaaggttttgcccttgcaa

SEQ ID NO: 569045 - DNA, 20 bp, Artificial
  CRISPR gRNA sequence
aaaggttttgcccttgcaaa

SEQ ID NO: 569046 - DNA, 20 bp, Artificial
  CRISPR gRNA sequence
aaggttttgcccttgcaaaa

SEQ ID NO: 569047 - DNA, 20 bp, Artificial
  CRISPR gRNA sequence
tgcccttgcaaaactttatg

SEQ ID NO: 569048 - DNA, 20 bp, Artificial
  CRISPR gRNA sequence
gcccttgcaaaactttatgt

SEQ ID NO: 569049 - DNA, 20 bp, Artificial
  CRISPR gRNA sequence
cccttgcaaaactttatgtt

SEQ ID NO: 569050 - DNA, 20 bp, Artificial
  CRISPR gRNA sequence
gcaaaactttatgtttaact

SEQ ID NO: 569051 - DNA, 20 bp, Artificial
  CRISPR gRNA sequence
caaaactttatgtttaactt

SEQ ID NO: 569052 - DNA, 20 bp, Artificial
  CRISPR gRNA sequence
tatgtttaactttatgtttg

SEQ ID NO: 569053 - DNA, 20 bp, Artificial
  CRISPR gRNA sequence
atgtttaactttatgtttgc

SEQ ID NO: 569054 - DNA, 20 bp, Artificial
  CRISPR gRNA sequence
tgtttaactttatgtttgcc

SEQ ID NO: 569055 - DNA, 20 bp, Artificial
  CRISPR gRNA sequence
aactttatgtttgccattag

SEQ ID NO: 569056 - DNA, 20 bp, Artificial
  CRISPR gRNA sequence
actttatgtttgccattaga

SEQ ID NO: 569057 - DNA, 20 bp, Artificial
  CRISPR gRNA sequence
tatgtttgccattagaattt

SEQ ID NO: 569058 - DNA, 20 bp, Artificial
  CRISPR gRNA sequence
atgtttgccattagaatttg

SEQ ID NO: 569059 - DNA, 20 bp, Artificial
  CRISPR gRNA sequence
tgtttgccattagaatttga

SEQ ID NO: 569060 - DNA, 20 bp, Artificial
  CRISPR gRNA sequence
gccattagaatttgaagaca

SEQ ID NO: 569061 - DNA, 20 bp, Artificial
  CRISPR gRNA sequence
ccattagaatttgaagacac

SEQ ID NO: 569062 - DNA, 20 bp, Artificial
  CRISPR gRNA sequence
gaatttgaagacacaaagta

SEQ ID NO: 569063 - DNA, 20 bp, Artificial
  CRISPR gRNA sequence
gaagacacaaagtaaaatta

SEQ ID NO: 569064 - DNA, 20 bp, Artificial
  CRISPR gRNA sequence
aagacacaaagtaaaattac

SEQ ID NO: 569065 - DNA, 20 bp, Artificial
  CRISPR gRNA sequence
ctcttactgaaagtaagatt

SEQ ID NO: 569066 - DNA, 20 bp, Artificial
  CRISPR gRNA sequence
ttactgaaagtaagattact

SEQ ID NO: 569067 - DNA, 20 bp, Artificial
  CRISPR gRNA sequence
actgaaagtaagattacttt

SEQ ID NO: 569068 - DNA, 20 bp, Artificial
  CRISPR gRNA sequence
ctgaaagtaagattactttc

SEQ ID NO: 569069 - DNA, 20 bp, Artificial
  CRISPR gRNA sequence
aaagtaagattactttccct

SEQ ID NO: 569070 - DNA, 20 bp, Artificial
  CRISPR gRNA sequence
ctttccctgtaaatagtctg

SEQ ID NO: 569071 - DNA, 20 bp, Artificial
  CRISPR gRNA sequence
tccctgtaaatagtctggta

SEQ ID NO: 569072 - DNA, 20 bp, Artificial
  CRISPR gRNA sequence
ccctgtaaatagtctggtaa

SEQ ID NO: 569073 - DNA, 20 bp, Artificial
  CRISPR gRNA sequence
cctgtaaatagtctggtaaa

SEQ ID NO: 569074 - DNA, 20 bp, Artificial
  CRISPR gRNA sequence
taaatagtctggtaaaagat

SEQ ID NO: 569075 - DNA, 20 bp, Artificial
  CRISPR gRNA sequence
gtaaaagatcataagaggaa

SEQ ID NO: 569076 - DNA, 20 bp, Artificial
  CRISPR gRNA sequence
ctcttattgatttgaaataa

SEQ ID NO: 569077 - DNA, 20 bp, Artificial
  CRISPR gRNA sequence
ttattgatttgaaataagta

SEQ ID NO: 569078 - DNA, 20 bp, Artificial
  CRISPR gRNA sequence
attgatttgaaataagtact

SEQ ID NO: 569079 - DNA, 20 bp, Artificial
  CRISPR gRNA sequence
ttgatttgaaataagtacta

SEQ ID NO: 569080 - DNA, 20 bp, Artificial
  CRISPR gRNA sequence
atttgaaataagtactatta

SEQ ID NO: 569081 - DNA, 20 bp, Artificial
  CRISPR gRNA sequence
gaaataagtactattaattt

SEQ ID NO: 569082 - DNA, 20 bp, Artificial
  CRISPR gRNA sequence
aaataagtactattaatttg

SEQ ID NO: 569083 - DNA, 20 bp, Artificial
  CRISPR gRNA sequence
ttaatttgaaaaaattcttt

SEQ ID NO: 569084 - DNA, 20 bp, Artificial
  CRISPR gRNA sequence
atttgaaaaaattcttttaa

SEQ ID NO: 569085 - DNA, 20 bp, Artificial
  CRISPR gRNA sequence
gaaaaaattcttttaattat

SEQ ID NO: 569086 - DNA, 20 bp, Artificial
  CRISPR gRNA sequence
aaaaaattcttttaattatt

SEQ ID NO: 569087 - DNA, 20 bp, Artificial
  CRISPR gRNA sequence
ttttaattattaaataatgg

SEQ ID NO: 569088 - DNA, 20 bp, Artificial
  CRISPR gRNA sequence
ttaattattaaataatggtg

SEQ ID NO: 569089 - DNA, 20 bp, Artificial
  CRISPR gRNA sequence
taattattaaataatggtga

SEQ ID NO: 569090 - DNA, 20 bp, Artificial
  CRISPR gRNA sequence
aattattaaataatggtgat

SEQ ID NO: 569091 - DNA, 20 bp, Artificial
  CRISPR gRNA sequence
attattaaataatggtgatt

SEQ ID NO: 569092 - DNA, 20 bp, Artificial
  CRISPR gRNA sequence
ttaaataatggtgatttatc

SEQ ID NO: 569093 - DNA, 20 bp, Artificial
  CRISPR gRNA sequence
aataatggtgatttatcctt

SEQ ID NO: 569094 - DNA, 20 bp, Artificial
  CRISPR gRNA sequence
atccttcttttacattttct

SEQ ID NO: 569095 - DNA, 20 bp, Artificial
  CRISPR gRNA sequence
tccttcttttacattttctt

SEQ ID NO: 569096 - DNA, 20 bp, Artificial
  CRISPR gRNA sequence
cttttacattttcttccaaa

SEQ ID NO: 569097 - DNA, 20 bp, Artificial
  CRISPR gRNA sequence
ttttacattttcttccaaat

SEQ ID NO: 569098 - DNA, 20 bp, Artificial
  CRISPR gRNA sequence
ttacattttcttccaaattg

SEQ ID NO: 569099 - DNA, 20 bp, Artificial
  CRISPR gRNA sequence
tacattttcttccaaattga

SEQ ID NO: 569100 - DNA, 20 bp, Artificial
  CRISPR gRNA sequence
acattttcttccaaattgat

SEQ ID NO: 569101 - DNA, 20 bp, Artificial
  CRISPR gRNA sequence
cattttcttccaaattgata

SEQ ID NO: 569102 - DNA, 20 bp, Artificial
  CRISPR gRNA sequence
tcttccaaattgatagttca

SEQ ID NO: 569103 - DNA, 20 bp, Artificial
  CRISPR gRNA sequence
cttccaaattgatagttcac

SEQ ID NO: 569104 - DNA, 20 bp, Artificial
  CRISPR gRNA sequence
ttccaaattgatagttcaca

SEQ ID NO: 569105 - DNA, 20 bp, Artificial
  CRISPR gRNA sequence
ccaaattgatagttcacata

SEQ ID NO: 569106 - DNA, 20 bp, Artificial
  CRISPR gRNA sequence
caaattgatagttcacatat

SEQ ID NO: 569107 - DNA, 20 bp, Artificial
  CRISPR gRNA sequence
atagttcacatatatacaac

SEQ ID NO: 569108 - DNA, 20 bp, Artificial
  CRISPR gRNA sequence
acatatatacaacagatttt

SEQ ID NO: 569109 - DNA, 20 bp, Artificial
  CRISPR gRNA sequence
tgaaagtttgaggaatgttg

SEQ ID NO: 569110 - DNA, 20 bp, Artificial
  CRISPR gRNA sequence
gaaagtttgaggaatgttgc

SEQ ID NO: 569111 - DNA, 20 bp, Artificial
  CRISPR gRNA sequence
aaagtttgaggaatgttgct

SEQ ID NO: 569112 - DNA, 20 bp, Artificial
  CRISPR gRNA sequence
gaggaatgttgcttgatagg

SEQ ID NO: 569113 - DNA, 20 bp, Artificial
  CRISPR gRNA sequence
aggaatgttgcttgataggt

SEQ ID NO: 569114 - DNA, 20 bp, Artificial
  CRISPR gRNA sequence
cttgataggtcttaggttta

SEQ ID NO: 569115 - DNA, 20 bp, Artificial
  CRISPR gRNA sequence
gataggtcttaggtttaaat

SEQ ID NO: 569116 - DNA, 20 bp, Artificial
  CRISPR gRNA sequence
ataggtcttaggtttaaatc

SEQ ID NO: 569117 - DNA, 20 bp, Artificial
  CRISPR gRNA sequence
aggtttaaatcctggagtag

SEQ ID NO: 569118 - DNA, 20 bp, Artificial
  CRISPR gRNA sequence
ggtttaaatcctggagtagt

SEQ ID NO: 569119 - DNA, 20 bp, Artificial
  CRISPR gRNA sequence
aaatcctggagtagtgttga

SEQ ID NO: 569120 - DNA, 20 bp, Artificial
  CRISPR gRNA sequence
aatcctggagtagtgttgac

SEQ ID NO: 569121 - DNA, 20 bp, Artificial
  CRISPR gRNA sequence
gagtagtgttgacatctgag

SEQ ID NO: 569122 - DNA, 20 bp, Artificial
  CRISPR gRNA sequence
acatctgagacatatgtctg

SEQ ID NO: 569123 - DNA, 20 bp, Artificial
  CRISPR gRNA sequence
agacatatgtctgggcttct

SEQ ID NO: 569124 - DNA, 20 bp, Artificial
  CRISPR gRNA sequence
ggcttctgaccctggtttct

SEQ ID NO: 569125 - DNA, 20 bp, Artificial
  CRISPR gRNA sequence
ctgaccctggtttctgttaa

SEQ ID NO: 569126 - DNA, 20 bp, Artificial
  CRISPR gRNA sequence
tgaccctggtttctgttaac

SEQ ID NO: 569127 - DNA, 20 bp, Artificial
  CRISPR gRNA sequence
accctggtttctgttaacca

SEQ ID NO: 569128 - DNA, 20 bp, Artificial
  CRISPR gRNA sequence
gtttctgttaaccaaatatt

SEQ ID NO: 569129 - DNA, 20 bp, Artificial
  CRISPR gRNA sequence
ctgttaaccaaatattggag

SEQ ID NO: 569130 - DNA, 20 bp, Artificial
  CRISPR gRNA sequence
tgttaaccaaatattggagg

SEQ ID NO: 569131 - DNA, 20 bp, Artificial
  CRISPR gRNA sequence
ttaaccaaatattggaggac

SEQ ID NO: 569132 - DNA, 20 bp, Artificial
  CRISPR gRNA sequence
accaaatattggaggacctt

SEQ ID NO: 569133 - DNA, 20 bp, Artificial
  CRISPR gRNA sequence
gaggaccttctccttttaaa

SEQ ID NO: 569134 - DNA, 20 bp, Artificial
  CRISPR gRNA sequence
ctccttttaaaatgcaaacc

SEQ ID NO: 569135 - DNA, 20 bp, Artificial
  CRISPR gRNA sequence
tccttttaaaatgcaaacca

SEQ ID NO: 569136 - DNA, 20 bp, Artificial
  CRISPR gRNA sequence
cttttaaaatgcaaaccagg

SEQ ID NO: 569137 - DNA, 20 bp, Artificial
  CRISPR gRNA sequence
ttaaaatgcaaaccaggagc

SEQ ID NO: 569138 - DNA, 20 bp, Artificial
  CRISPR gRNA sequence
taaaatgcaaaccaggagct

SEQ ID NO: 569139 - DNA, 20 bp, Artificial
  CRISPR gRNA sequence
aaaatgcaaaccaggagctg

SEQ ID NO: 569140 - DNA, 20 bp, Artificial
  CRISPR gRNA sequence
aaatgcaaaccaggagctga

SEQ ID NO: 569141 - DNA, 20 bp, Artificial
  CRISPR gRNA sequence
aacttaatgatcttaatggt

SEQ ID NO: 569142 - DNA, 20 bp, Artificial
  CRISPR gRNA sequence
aatgatcttaatggttcttt

SEQ ID NO: 569143 - DNA, 20 bp, Artificial
  CRISPR gRNA sequence
atgatcttaatggttctttt

SEQ ID NO: 569144 - DNA, 20 bp, Artificial
  CRISPR gRNA sequence
aatggttcttttgaacagta

SEQ ID NO: 569145 - DNA, 20 bp, Artificial
  CRISPR gRNA sequence
atggttcttttgaacagtaa

SEQ ID NO: 569146 - DNA, 20 bp, Artificial
  CRISPR gRNA sequence
ttttgaacagtaacagtcta

SEQ ID NO: 569147 - DNA, 20 bp, Artificial
  CRISPR gRNA sequence
ttgaacagtaacagtctagg

SEQ ID NO: 569148 - DNA, 20 bp, Artificial
  CRISPR gRNA sequence
tgaacagtaacagtctagga

SEQ ID NO: 569149 - DNA, 20 bp, Artificial
  CRISPR gRNA sequence
gaacagtaacagtctaggat

SEQ ID NO: 569150 - DNA, 20 bp, Artificial
  CRISPR gRNA sequence
aacagtaacagtctaggatc

SEQ ID NO: 569151 - DNA, 20 bp, Artificial
  CRISPR gRNA sequence
ggatctttttttttctgaga

SEQ ID NO: 569152 - DNA, 20 bp, Artificial
  CRISPR gRNA sequence
tttttttctgagatgatttt

SEQ ID NO: 569153 - DNA, 20 bp, Artificial
  CRISPR gRNA sequence
ttttttctgagatgattttt

SEQ ID NO: 569154 - DNA, 20 bp, Artificial
  CRISPR gRNA sequence
tttttctgagatgatttttg

SEQ ID NO: 569155 - DNA, 20 bp, Artificial
  CRISPR gRNA sequence
ttttctgagatgatttttga

SEQ ID NO: 569156 - DNA, 20 bp, Artificial
  CRISPR gRNA sequence
tttctgagatgatttttgaa

SEQ ID NO: 569157 - DNA, 20 bp, Artificial
  CRISPR gRNA sequence
ttctgagatgatttttgaat

SEQ ID NO: 569158 - DNA, 20 bp, Artificial
  CRISPR gRNA sequence
tctgagatgatttttgaatg

SEQ ID NO: 569159 - DNA, 20 bp, Artificial
  CRISPR gRNA sequence
ctgagatgatttttgaatgc

SEQ ID NO: 569160 - DNA, 20 bp, Artificial
  CRISPR gRNA sequence
tgagatgatttttgaatgct

SEQ ID NO: 569161 - DNA, 20 bp, Artificial
  CRISPR gRNA sequence
agatgatttttgaatgcttt

SEQ ID NO: 569162 - DNA, 20 bp, Artificial
  CRISPR gRNA sequence
ttgaatgcttttgtgtggaa

SEQ ID NO: 569163 - DNA, 20 bp, Artificial
  CRISPR gRNA sequence
tgaatgcttttgtgtggaac

SEQ ID NO: 569164 - DNA, 20 bp, Artificial
  CRISPR gRNA sequence
gaatgcttttgtgtggaacc

SEQ ID NO: 569165 - DNA, 20 bp, Artificial
  CRISPR gRNA sequence
aatgcttttgtgtggaacca

SEQ ID NO: 569166 - DNA, 20 bp, Artificial
  CRISPR gRNA sequence
ttgtgtggaaccacatgcat

SEQ ID NO: 569167 - DNA, 20 bp, Artificial
  CRISPR gRNA sequence
tgtgtggaaccacatgcatc

SEQ ID NO: 569168 - DNA, 20 bp, Artificial
  CRISPR gRNA sequence
gtgtggaaccacatgcatca

SEQ ID NO: 569169 - DNA, 20 bp, Artificial
  CRISPR gRNA sequence
tgtggaaccacatgcatcat

SEQ ID NO: 569170 - DNA, 20 bp, Artificial
  CRISPR gRNA sequence
aatactagatcttacttttt

SEQ ID NO: 569171 - DNA, 20 bp, Artificial
  CRISPR gRNA sequence
gatcttactttttcaggttt

SEQ ID NO: 569172 - DNA, 20 bp, Artificial
  CRISPR gRNA sequence
actttttcaggttttgattt

SEQ ID NO: 569173 - DNA, 20 bp, Artificial
  CRISPR gRNA sequence
ctttttcaggttttgatttc

SEQ ID NO: 569174 - DNA, 20 bp, Artificial
  CRISPR gRNA sequence
tttcaggttttgatttctca

SEQ ID NO: 569175 - DNA, 20 bp, Artificial
  CRISPR gRNA sequence
ttcaggttttgatttctcat

SEQ ID NO: 569176 - DNA, 20 bp, Artificial
  CRISPR gRNA sequence
tcaggttttgatttctcatc

SEQ ID NO: 569177 - DNA, 20 bp, Artificial
  CRISPR gRNA sequence
caggttttgatttctcatct

SEQ ID NO: 569178 - DNA, 20 bp, Artificial
  CRISPR gRNA sequence
aggttttgatttctcatcta

SEQ ID NO: 569179 - DNA, 20 bp, Artificial
  CRISPR gRNA sequence
tgatttctcatctaaacttt

SEQ ID NO: 569180 - DNA, 20 bp, Artificial
  CRISPR gRNA sequence
gatttctcatctaaactttc

SEQ ID NO: 569181 - DNA, 20 bp, Artificial
  CRISPR gRNA sequence
atttctcatctaaactttcc

SEQ ID NO: 569182 - DNA, 20 bp, Artificial
  CRISPR gRNA sequence
ctcatctaaactttccaatg

SEQ ID NO: 569183 - DNA, 20 bp, Artificial
  CRISPR gRNA sequence
tcatctaaactttccaatgc

SEQ ID NO: 569184 - DNA, 20 bp, Artificial
  CRISPR gRNA sequence
atctaaactttccaatgctt

SEQ ID NO: 569185 - DNA, 20 bp, Artificial
  CRISPR gRNA sequence
aactttccaatgctttatca

SEQ ID NO: 569186 - DNA, 20 bp, Artificial
  CRISPR gRNA sequence
tccaatgctttatcagtgaa

SEQ ID NO: 569187 - DNA, 20 bp, Artificial
  CRISPR gRNA sequence
ccaatgctttatcagtgaag

SEQ ID NO: 569188 - DNA, 20 bp, Artificial
  CRISPR gRNA sequence
caatgctttatcagtgaagc

SEQ ID NO: 569189 - DNA, 20 bp, Artificial
  CRISPR gRNA sequence
tatcagtgaagcaaactaac

SEQ ID NO: 569190 - DNA, 20 bp, Artificial
  CRISPR gRNA sequence
atcagtgaagcaaactaact

SEQ ID NO: 569191 - DNA, 20 bp, Artificial
  CRISPR gRNA sequence
tcagtgaagcaaactaactc

SEQ ID NO: 569192 - DNA, 20 bp, Artificial
  CRISPR gRNA sequence
actcacattgactagcctgc

SEQ ID NO: 569193 - DNA, 20 bp, Artificial
  CRISPR gRNA sequence
acattgactagcctgctctc

SEQ ID NO: 569194 - DNA, 20 bp, Artificial
  CRISPR gRNA sequence
actagcctgctctcctttag

SEQ ID NO: 569195 - DNA, 20 bp, Artificial
  CRISPR gRNA sequence
gcctgctctcctttagcaaa

SEQ ID NO: 569196 - DNA, 20 bp, Artificial
  CRISPR gRNA sequence
ctctcctttagcaaaccctt

SEQ ID NO: 569197 - DNA, 20 bp, Artificial
  CRISPR gRNA sequence
tcctttagcaaacccttcaa

SEQ ID NO: 569198 - DNA, 20 bp, Artificial
  CRISPR gRNA sequence
ctttagcaaacccttcaaat

SEQ ID NO: 569199 - DNA, 20 bp, Artificial
  CRISPR gRNA sequence
tagcaaacccttcaaataaa

SEQ ID NO: 569200 - DNA, 20 bp, Artificial
  CRISPR gRNA sequence
agcaaacccttcaaataaat

SEQ ID NO: 569201 - DNA, 20 bp, Artificial
  CRISPR gRNA sequence
gcaaacccttcaaataaatg

SEQ ID NO: 569202 - DNA, 20 bp, Artificial
  CRISPR gRNA sequence
caaataaatgcctcatttgc

SEQ ID NO: 569203 - DNA, 20 bp, Artificial
  CRISPR gRNA sequence
aaataaatgcctcatttgct

SEQ ID NO: 569204 - DNA, 20 bp, Artificial
  CRISPR gRNA sequence
atttgctcctcaccactatc

SEQ ID NO: 569205 - DNA, 20 bp, Artificial
  CRISPR gRNA sequence
gctcctcaccactatcattt

SEQ ID NO: 569206 - DNA, 20 bp, Artificial
  CRISPR gRNA sequence
ctcctcaccactatcatttt

SEQ ID NO: 569207 - DNA, 20 bp, Artificial
  CRISPR gRNA sequence
ctcaccactatcattttaga

SEQ ID NO: 569208 - DNA, 20 bp, Artificial
  CRISPR gRNA sequence
accactatcattttagattg

SEQ ID NO: 569209 - DNA, 20 bp, Artificial
  CRISPR gRNA sequence
tcattttagattggccagac

SEQ ID NO: 569210 - DNA, 20 bp, Artificial
  CRISPR gRNA sequence
tagattggccagacagttgt

SEQ ID NO: 569211 - DNA, 20 bp, Artificial
  CRISPR gRNA sequence
agattggccagacagttgtt

SEQ ID NO: 569212 - DNA, 20 bp, Artificial
  CRISPR gRNA sequence
gattggccagacagttgtta

SEQ ID NO: 569213 - DNA, 20 bp, Artificial
  CRISPR gRNA sequence
gccagacagttgttacttac

SEQ ID NO: 569214 - DNA, 20 bp, Artificial
  CRISPR gRNA sequence
ttacttaccttttaagaatg

SEQ ID NO: 569215 - DNA, 20 bp, Artificial
  CRISPR gRNA sequence
cttaccttttaagaatgagg

SEQ ID NO: 569216 - DNA, 20 bp, Artificial
  CRISPR gRNA sequence
accttttaagaatgaggaga

SEQ ID NO: 569217 - DNA, 20 bp, Artificial
  CRISPR gRNA sequence
ccttttaagaatgaggagac

SEQ ID NO: 569218 - DNA, 20 bp, Artificial
  CRISPR gRNA sequence
ttaagaatgaggagacaggt

SEQ ID NO: 569219 - DNA, 20 bp, Artificial
  CRISPR gRNA sequence
taagaatgaggagacaggta

SEQ ID NO: 569220 - DNA, 20 bp, Artificial
  CRISPR gRNA sequence
aagaatgaggagacaggtag

SEQ ID NO: 569221 - DNA, 20 bp, Artificial
  CRISPR gRNA sequence
agaatgaggagacaggtagc

SEQ ID NO: 569222 - DNA, 20 bp, Artificial
  CRISPR gRNA sequence
acacctgtaatcccaacact

SEQ ID NO: 569223 - DNA, 20 bp, Artificial
  CRISPR gRNA sequence
taatcccaacactttgggag

SEQ ID NO: 569224 - DNA, 20 bp, Artificial
  CRISPR gRNA sequence
tgggaggctgaggcgggtgg

SEQ ID NO: 569225 - DNA, 20 bp, Artificial
  CRISPR gRNA sequence
gggaggctgaggcgggtgga

SEQ ID NO: 569226 - DNA, 20 bp, Artificial
  CRISPR gRNA sequence
ggaggctgaggcgggtggat

SEQ ID NO: 569227 - DNA, 20 bp, Artificial
  CRISPR gRNA sequence
aggcgggtggatcacgaggt

SEQ ID NO: 569228 - DNA, 20 bp, Artificial
  CRISPR gRNA sequence
gctaacacggtgaaaccccg

SEQ ID NO: 569229 - DNA, 20 bp, Artificial
  CRISPR gRNA sequence
acacggtgaaaccccgtctg

SEQ ID NO: 569230 - DNA, 20 bp, Artificial
  CRISPR gRNA sequence
tactaaaaatacaaaaaatt

SEQ ID NO: 569231 - DNA, 20 bp, Artificial
  CRISPR gRNA sequence
aaaatacaaaaaattagtca

SEQ ID NO: 569232 - DNA, 20 bp, Artificial
  CRISPR gRNA sequence
gtcaggtgtgttggtgggca

SEQ ID NO: 569233 - DNA, 20 bp, Artificial
  CRISPR gRNA sequence
gtgggcacctgtagtcccag

SEQ ID NO: 569234 - DNA, 20 bp, Artificial
  CRISPR gRNA sequence
tagtcccagctacttgggag

SEQ ID NO: 569235 - DNA, 20 bp, Artificial
  CRISPR gRNA sequence
cttgggaggctgaggcagga

SEQ ID NO: 569236 - DNA, 20 bp, Artificial
  CRISPR gRNA sequence
gggaggctgaggcaggagaa

SEQ ID NO: 569237 - DNA, 20 bp, Artificial
  CRISPR gRNA sequence
ggaggctgaggcaggagaat

SEQ ID NO: 569238 - DNA, 20 bp, Artificial
  CRISPR gRNA sequence
aggcaggagaatggcatgaa

SEQ ID NO: 569239 - DNA, 20 bp, Artificial
  CRISPR gRNA sequence
gcagtgagctgagaccacac

SEQ ID NO: 569240 - DNA, 20 bp, Artificial
  CRISPR gRNA sequence
agaccacaccactgcactcc

SEQ ID NO: 569241 - DNA, 20 bp, Artificial
  CRISPR gRNA sequence
cactccagcctgggtgacag

SEQ ID NO: 569242 - DNA, 20 bp, Artificial
  CRISPR gRNA sequence
cagcctgggtgacagagtga

SEQ ID NO: 569243 - DNA, 20 bp, Artificial
  CRISPR gRNA sequence
ggtgacagagtgagattccg

SEQ ID NO: 569244 - DNA, 20 bp, Artificial
  CRISPR gRNA sequence
cgtctcaaaaaaaaaaaaaa

SEQ ID NO: 569245 - DNA, 20 bp, Artificial
  CRISPR gRNA sequence
aaaaaaaaaaaaaagaatga

SEQ ID NO: 569246 - DNA, 20 bp, Artificial
  CRISPR gRNA sequence
gcccagggtcacttaagtat

SEQ ID NO: 569247 - DNA, 20 bp, Artificial
  CRISPR gRNA sequence
cccagggtcacttaagtatt

SEQ ID NO: 569248 - DNA, 20 bp, Artificial
  CRISPR gRNA sequence
aagtattggagatagaatta

SEQ ID NO: 569249 - DNA, 20 bp, Artificial
  CRISPR gRNA sequence
agtattggagatagaattaa

SEQ ID NO: 569250 - DNA, 20 bp, Artificial
  CRISPR gRNA sequence
gagatagaattaaaatttag

SEQ ID NO: 569251 - DNA, 20 bp, Artificial
  CRISPR gRNA sequence
aaatttaggtctttgaattc

SEQ ID NO: 569252 - DNA, 20 bp, Artificial
  CRISPR gRNA sequence
aggtctttgaattccagagt

SEQ ID NO: 569253 - DNA, 20 bp, Artificial
  CRISPR gRNA sequence
ggtctttgaattccagagtg

SEQ ID NO: 569254 - DNA, 20 bp, Artificial
  CRISPR gRNA sequence
tgaattccagagtgtttttg

SEQ ID NO: 569255 - DNA, 20 bp, Artificial
  CRISPR gRNA sequence
gaattccagagtgtttttgt

SEQ ID NO: 569256 - DNA, 20 bp, Artificial
  CRISPR gRNA sequence
aattccagagtgtttttgta

SEQ ID NO: 569257 - DNA, 20 bp, Artificial
  CRISPR gRNA sequence
cagagtgtttttgtatgata

SEQ ID NO: 569258 - DNA, 20 bp, Artificial
  CRISPR gRNA sequence
ttgtatgataccatcctgac

SEQ ID NO: 569259 - DNA, 20 bp, Artificial
  CRISPR gRNA sequence
tgtatgataccatcctgact

SEQ ID NO: 569260 - DNA, 20 bp, Artificial
  CRISPR gRNA sequence
gtatgataccatcctgactc

SEQ ID NO: 569261 - DNA, 20 bp, Artificial
  CRISPR gRNA sequence
tatgataccatcctgactct

SEQ ID NO: 569262 - DNA, 20 bp, Artificial
  CRISPR gRNA sequence
actctctatacgtttcaaaa

SEQ ID NO: 569263 - DNA, 20 bp, Artificial
  CRISPR gRNA sequence
tctatacgtttcaaaataaa

SEQ ID NO: 569264 - DNA, 20 bp, Artificial
  CRISPR gRNA sequence
tatacgtttcaaaataaatc

SEQ ID NO: 569265 - DNA, 20 bp, Artificial
  CRISPR gRNA sequence
tacgtttcaaaataaatcaa

SEQ ID NO: 569266 - DNA, 20 bp, Artificial
  CRISPR gRNA sequence
caaaataaatcaaattttaa

SEQ ID NO: 569267 - DNA, 20 bp, Artificial
  CRISPR gRNA sequence
aaaataaatcaaattttaaa

SEQ ID NO: 569268 - DNA, 20 bp, Artificial
  CRISPR gRNA sequence
taaagttttctttgatttat

SEQ ID NO: 569269 - DNA, 20 bp, Artificial
  CRISPR gRNA sequence
aaagttttctttgatttatt

SEQ ID NO: 569270 - DNA, 20 bp, Artificial
  CRISPR gRNA sequence
aagttttctttgatttattc

SEQ ID NO: 569271 - DNA, 20 bp, Artificial
  CRISPR gRNA sequence
tctttgatttattcatatga

SEQ ID NO: 569272 - DNA, 20 bp, Artificial
  CRISPR gRNA sequence
ctttgatttattcatatgaa

SEQ ID NO: 569273 - DNA, 20 bp, Artificial
  CRISPR gRNA sequence
tttgatttattcatatgaat

SEQ ID NO: 569274 - DNA, 20 bp, Artificial
  CRISPR gRNA sequence
tgatttattcatatgaatga

SEQ ID NO: 569275 - DNA, 20 bp, Artificial
  CRISPR gRNA sequence
gatttattcatatgaatgag

SEQ ID NO: 569276 - DNA, 20 bp, Artificial
  CRISPR gRNA sequence
atttattcatatgaatgagc

SEQ ID NO: 569277 - DNA, 20 bp, Artificial
  CRISPR gRNA sequence
attcatatgaatgagctaga

SEQ ID NO: 569278 - DNA, 20 bp, Artificial
  CRISPR gRNA sequence
ttcatatgaatgagctagag

SEQ ID NO: 569279 - DNA, 20 bp, Artificial
  CRISPR gRNA sequence
atatgaatgagctagagaaa

SEQ ID NO: 569280 - DNA, 20 bp, Artificial
  CRISPR gRNA sequence
gagaaacccatactatatag

SEQ ID NO: 569281 - DNA, 20 bp, Artificial
  CRISPR gRNA sequence
tatagatatacatagtagat

SEQ ID NO: 569282 - DNA, 20 bp, Artificial
  CRISPR gRNA sequence
gtcaaatgtaacttaatttt

SEQ ID NO: 569283 - DNA, 20 bp, Artificial
  CRISPR gRNA sequence
aattttttacctcattatct

SEQ ID NO: 569284 - DNA, 20 bp, Artificial
  CRISPR gRNA sequence
attttttacctcattatctc

SEQ ID NO: 569285 - DNA, 20 bp, Artificial
  CRISPR gRNA sequence
tttacctcattatctcatgt

SEQ ID NO: 569286 - DNA, 20 bp, Artificial
  CRISPR gRNA sequence
ttacctcattatctcatgtt

SEQ ID NO: 569287 - DNA, 20 bp, Artificial
  CRISPR gRNA sequence
tacctcattatctcatgttt

SEQ ID NO: 569288 - DNA, 20 bp, Artificial
  CRISPR gRNA sequence
acctcattatctcatgtttc

SEQ ID NO: 569289 - DNA, 20 bp, Artificial
  CRISPR gRNA sequence
cctcattatctcatgtttct

SEQ ID NO: 569290 - DNA, 20 bp, Artificial
  CRISPR gRNA sequence
attatctcatgtttcttgta

SEQ ID NO: 569291 - DNA, 20 bp, Artificial
  CRISPR gRNA sequence
tctcatgtttcttgtaacat

SEQ ID NO: 569292 - DNA, 20 bp, Artificial
  CRISPR gRNA sequence
atgtttcttgtaacattttg

SEQ ID NO: 569293 - DNA, 20 bp, Artificial
  CRISPR gRNA sequence
cttgtaacattttgtctagt

SEQ ID NO: 569294 - DNA, 20 bp, Artificial
  CRISPR gRNA sequence
ttgtaacattttgtctagta

SEQ ID NO: 569295 - DNA, 20 bp, Artificial
  CRISPR gRNA sequence
gtaacattttgtctagtagg

SEQ ID NO: 569296 - DNA, 20 bp, Artificial
  CRISPR gRNA sequence
taacattttgtctagtagga

SEQ ID NO: 569297 - DNA, 20 bp, Artificial
  CRISPR gRNA sequence
tgtctagtaggacctttttg

SEQ ID NO: 569298 - DNA, 20 bp, Artificial
  CRISPR gRNA sequence
gtctagtaggacctttttgt

SEQ ID NO: 569299 - DNA, 20 bp, Artificial
  CRISPR gRNA sequence
tctagtaggacctttttgtg

SEQ ID NO: 569300 - DNA, 20 bp, Artificial
  CRISPR gRNA sequence
gtaggacctttttgtggttt

SEQ ID NO: 569301 - DNA, 20 bp, Artificial
  CRISPR gRNA sequence
tttgtggtttgtcatcattt

SEQ ID NO: 569302 - DNA, 20 bp, Artificial
  CRISPR gRNA sequence
ttgtggtttgtcatcatttt

SEQ ID NO: 569303 - DNA, 20 bp, Artificial
  CRISPR gRNA sequence
tgtggtttgtcatcatttta

SEQ ID NO: 569304 - DNA, 20 bp, Artificial
  CRISPR gRNA sequence
gtggtttgtcatcattttag

SEQ ID NO: 569305 - DNA, 20 bp, Artificial
  CRISPR gRNA sequence
tggtttgtcatcattttagt

SEQ ID NO: 569306 - DNA, 20 bp, Artificial
  CRISPR gRNA sequence
gtcatcattttagtcatgac

SEQ ID NO: 569307 - DNA, 20 bp, Artificial
  CRISPR gRNA sequence
tcatcattttagtcatgaca

SEQ ID NO: 569308 - DNA, 20 bp, Artificial
  CRISPR gRNA sequence
tagtcatgacatctactgtc

SEQ ID NO: 569309 - DNA, 20 bp, Artificial
  CRISPR gRNA sequence
agtcatgacatctactgtca

SEQ ID NO: 569310 - DNA, 20 bp, Artificial
  CRISPR gRNA sequence
gtcatgacatctactgtcat

SEQ ID NO: 569311 - DNA, 20 bp, Artificial
  CRISPR gRNA sequence
ctgtcataccgtcactgcaa

SEQ ID NO: 569312 - DNA, 20 bp, Artificial
  CRISPR gRNA sequence
tcataccgtcactgcaaccc

SEQ ID NO: 569313 - DNA, 20 bp, Artificial
  CRISPR gRNA sequence
caacccagaaatggggcgat

SEQ ID NO: 569314 - DNA, 20 bp, Artificial
  CRISPR gRNA sequence
ctaactagttaaacacaatc

SEQ ID NO: 569315 - DNA, 20 bp, Artificial
  CRISPR gRNA sequence
actagttaaacacaatctaa

SEQ ID NO: 569316 - DNA, 20 bp, Artificial
  CRISPR gRNA sequence
gttaaacacaatctaaagga

SEQ ID NO: 569317 - DNA, 20 bp, Artificial
  CRISPR gRNA sequence
aacacaatctaaaggagaat

SEQ ID NO: 569318 - DNA, 20 bp, Artificial
  CRISPR gRNA sequence
aaggagaattttagagacag

SEQ ID NO: 569319 - DNA, 20 bp, Artificial
  CRISPR gRNA sequence
tagagacagttaagattgag

SEQ ID NO: 569320 - DNA, 20 bp, Artificial
  CRISPR gRNA sequence
agagacagttaagattgagg

SEQ ID NO: 569321 - DNA, 20 bp, Artificial
  CRISPR gRNA sequence
gagacagttaagattgagga

SEQ ID NO: 569322 - DNA, 20 bp, Artificial
  CRISPR gRNA sequence
agattgaggacagagttctt

SEQ ID NO: 569323 - DNA, 20 bp, Artificial
  CRISPR gRNA sequence
aggacagagttcttgtccaa

SEQ ID NO: 569324 - DNA, 20 bp, Artificial
  CRISPR gRNA sequence
ttgtccaactcgtattgtac

SEQ ID NO: 569325 - DNA, 20 bp, Artificial
  CRISPR gRNA sequence
gtccaactcgtattgtactg

SEQ ID NO: 569326 - DNA, 20 bp, Artificial
  CRISPR gRNA sequence
tccaactcgtattgtactgg

SEQ ID NO: 569327 - DNA, 20 bp, Artificial
  CRISPR gRNA sequence
gtattgtactgggggaatga

SEQ ID NO: 569328 - DNA, 20 bp, Artificial
  CRISPR gRNA sequence
tactgggggaatgaactaat

SEQ ID NO: 569329 - DNA, 20 bp, Artificial
  CRISPR gRNA sequence
ggggaatgaactaatactta

SEQ ID NO: 569330 - DNA, 20 bp, Artificial
  CRISPR gRNA sequence
atacttactgaaggcctgct

SEQ ID NO: 569331 - DNA, 20 bp, Artificial
  CRISPR gRNA sequence
actgaaggcctgctccacaa

SEQ ID NO: 569332 - DNA, 20 bp, Artificial
  CRISPR gRNA sequence
ctgaaggcctgctccacaac

SEQ ID NO: 569333 - DNA, 20 bp, Artificial
  CRISPR gRNA sequence
aaggcctgctccacaacaaa

SEQ ID NO: 569334 - DNA, 20 bp, Artificial
  CRISPR gRNA sequence
ctccacaacaaactcctgta

SEQ ID NO: 569335 - DNA, 20 bp, Artificial
  CRISPR gRNA sequence
cacaacaaactcctgtaaat

SEQ ID NO: 569336 - DNA, 20 bp, Artificial
  CRISPR gRNA sequence
ctgtaaatgatttacataaa

SEQ ID NO: 569337 - DNA, 20 bp, Artificial
  CRISPR gRNA sequence
taaatgatttacataaatgt

SEQ ID NO: 569338 - DNA, 20 bp, Artificial
  CRISPR gRNA sequence
acataaatgtgtcacattta

SEQ ID NO: 569339 - DNA, 20 bp, Artificial
  CRISPR gRNA sequence
cataaatgtgtcacatttaa

SEQ ID NO: 569340 - DNA, 20 bp, Artificial
  CRISPR gRNA sequence
aatccacacaacaacccagt

SEQ ID NO: 569341 - DNA, 20 bp, Artificial
  CRISPR gRNA sequence
atccacacaacaacccagtg

SEQ ID NO: 569342 - DNA, 20 bp, Artificial
  CRISPR gRNA sequence
ataaaggaggaatctgaggc

SEQ ID NO: 569343 - DNA, 20 bp, Artificial
  CRISPR gRNA sequence
taaaggaggaatctgaggca

SEQ ID NO: 569344 - DNA, 20 bp, Artificial
  CRISPR gRNA sequence
aggcacagtgaggttaaata

SEQ ID NO: 569345 - DNA, 20 bp, Artificial
  CRISPR gRNA sequence
aataacttgaccaaatatac

SEQ ID NO: 569346 - DNA, 20 bp, Artificial
  CRISPR gRNA sequence
gaccaaatatacacatttat

SEQ ID NO: 569347 - DNA, 20 bp, Artificial
  CRISPR gRNA sequence
accaaatatacacatttatt

SEQ ID NO: 569348 - DNA, 20 bp, Artificial
  CRISPR gRNA sequence
attaagagcaaagccaggat

SEQ ID NO: 569349 - DNA, 20 bp, Artificial
  CRISPR gRNA sequence
ttaagagcaaagccaggatt

SEQ ID NO: 569350 - DNA, 20 bp, Artificial
  CRISPR gRNA sequence
agagcaaagccaggatttga

SEQ ID NO: 569351 - DNA, 20 bp, Artificial
  CRISPR gRNA sequence
gacatccaactccatctgaa

SEQ ID NO: 569352 - DNA, 20 bp, Artificial
  CRISPR gRNA sequence
acatccaactccatctgaac

SEQ ID NO: 569353 - DNA, 20 bp, Artificial
  CRISPR gRNA sequence
catctgaactcaaagcactg

SEQ ID NO: 569354 - DNA, 20 bp, Artificial
  CRISPR gRNA sequence
aactcaaagcactgtgtctt

SEQ ID NO: 569355 - DNA, 20 bp, Artificial
  CRISPR gRNA sequence
aaagcactgtgtcttcccca

SEQ ID NO: 569356 - DNA, 20 bp, Artificial
  CRISPR gRNA sequence
tgtcttccccactgtactgg

SEQ ID NO: 569357 - DNA, 20 bp, Artificial
  CRISPR gRNA sequence
ccccactgtactgggaagta

SEQ ID NO: 569358 - DNA, 20 bp, Artificial
  CRISPR gRNA sequence
cccactgtactgggaagtaa

SEQ ID NO: 569359 - DNA, 20 bp, Artificial
  CRISPR gRNA sequence
tactgggaagtaaaagtaag

SEQ ID NO: 569360 - DNA, 20 bp, Artificial
  CRISPR gRNA sequence
ggaagtaaaagtaagaagat

SEQ ID NO: 569361 - DNA, 20 bp, Artificial
  CRISPR gRNA sequence
agagatggagaattataatc

SEQ ID NO: 569362 - DNA, 20 bp, Artificial
  CRISPR gRNA sequence
taatctggaatttggaattt

SEQ ID NO: 569363 - DNA, 20 bp, Artificial
  CRISPR gRNA sequence
gaatttggaatttacttcca

SEQ ID NO: 569364 - DNA, 20 bp, Artificial
  CRISPR gRNA sequence
ggaatttacttccattggtt

SEQ ID NO: 569365 - DNA, 20 bp, Artificial
  CRISPR gRNA sequence
gaatttacttccattggtta

SEQ ID NO: 569366 - DNA, 20 bp, Artificial
  CRISPR gRNA sequence
acttccattggttaaccgtt

SEQ ID NO: 569367 - DNA, 20 bp, Artificial
  CRISPR gRNA sequence
cttccattggttaaccgttt

SEQ ID NO: 569368 - DNA, 20 bp, Artificial
  CRISPR gRNA sequence
ccattggttaaccgtttgaa

SEQ ID NO: 569369 - DNA, 20 bp, Artificial
  CRISPR gRNA sequence
cattggttaaccgtttgaaa

SEQ ID NO: 569370 - DNA, 20 bp, Artificial
  CRISPR gRNA sequence
gttaaccgtttgaaaattgc

SEQ ID NO: 569371 - DNA, 20 bp, Artificial
  CRISPR gRNA sequence
accgtttgaaaattgcagct

SEQ ID NO: 569372 - DNA, 20 bp, Artificial
  CRISPR gRNA sequence
gaaaattgcagctccaaggc

SEQ ID NO: 569373 - DNA, 20 bp, Artificial
  CRISPR gRNA sequence
aaaattgcagctccaaggca

SEQ ID NO: 569374 - DNA, 20 bp, Artificial
  CRISPR gRNA sequence
cagctccaaggcattgggag

SEQ ID NO: 569375 - DNA, 20 bp, Artificial
  CRISPR gRNA sequence
caaggcattgggagatggaa

SEQ ID NO: 569376 - DNA, 20 bp, Artificial
  CRISPR gRNA sequence
ggagatggaaagaaagctag

SEQ ID NO: 569377 - DNA, 20 bp, Artificial
  CRISPR gRNA sequence
gtgagcaattatttcttgcc

SEQ ID NO: 569378 - DNA, 20 bp, Artificial
  CRISPR gRNA sequence
tttcttgcctttgtgtcatg

SEQ ID NO: 569379 - DNA, 20 bp, Artificial
  CRISPR gRNA sequence
cttgcctttgtgtcatgctc

SEQ ID NO: 569380 - DNA, 20 bp, Artificial
  CRISPR gRNA sequence
ttgcctttgtgtcatgctcc

SEQ ID NO: 569381 - DNA, 20 bp, Artificial
  CRISPR gRNA sequence
gcctttgtgtcatgctccta

SEQ ID NO: 569382 - DNA, 20 bp, Artificial
  CRISPR gRNA sequence
cctttgtgtcatgctcctac

SEQ ID NO: 569383 - DNA, 20 bp, Artificial
  CRISPR gRNA sequence
tgtgtcatgctcctacattt

SEQ ID NO: 569384 - DNA, 20 bp, Artificial
  CRISPR gRNA sequence
gtgtcatgctcctacatttt

SEQ ID NO: 569385 - DNA, 20 bp, Artificial
  CRISPR gRNA sequence
tgtcatgctcctacattttg

SEQ ID NO: 569386 - DNA, 20 bp, Artificial
  CRISPR gRNA sequence
ctacattttgctcctcctta

SEQ ID NO: 569387 - DNA, 20 bp, Artificial
  CRISPR gRNA sequence
cattttgctcctccttatct

SEQ ID NO: 569388 - DNA, 20 bp, Artificial
  CRISPR gRNA sequence
tgctcctccttatctcctta

SEQ ID NO: 569389 - DNA, 20 bp, Artificial
  CRISPR gRNA sequence
gctcctccttatctccttat

SEQ ID NO: 569390 - DNA, 20 bp, Artificial
  CRISPR gRNA sequence
ctcctccttatctccttatc

SEQ ID NO: 569391 - DNA, 20 bp, Artificial
  CRISPR gRNA sequence
ctccttatctccttatctgc

SEQ ID NO: 569392 - DNA, 20 bp, Artificial
  CRISPR gRNA sequence
cttatctccttatctgcggt

SEQ ID NO: 569393 - DNA, 20 bp, Artificial
  CRISPR gRNA sequence
atctccttatctgcggtcag

SEQ ID NO: 569394 - DNA, 20 bp, Artificial
  CRISPR gRNA sequence
tctccttatctgcggtcaga

SEQ ID NO: 569395 - DNA, 20 bp, Artificial
  CRISPR gRNA sequence
cttatctgcggtcagagtag

SEQ ID NO: 569396 - DNA, 20 bp, Artificial
  CRISPR gRNA sequence
atctgcggtcagagtagata

SEQ ID NO: 569397 - DNA, 20 bp, Artificial
  CRISPR gRNA sequence
tctgcggtcagagtagatag

SEQ ID NO: 569398 - DNA, 20 bp, Artificial
  CRISPR gRNA sequence
cggtcagagtagatagcatg

SEQ ID NO: 569399 - DNA, 20 bp, Artificial
  CRISPR gRNA sequence
tatgcccatgctacagatgt

SEQ ID NO: 569400 - DNA, 20 bp, Artificial
  CRISPR gRNA sequence
atgcccatgctacagatgtt

SEQ ID NO: 569401 - DNA, 20 bp, Artificial
  CRISPR gRNA sequence
tgcccatgctacagatgttc

SEQ ID NO: 569402 - DNA, 20 bp, Artificial
  CRISPR gRNA sequence
cagatgttcagagatctcaa

SEQ ID NO: 569403 - DNA, 20 bp, Artificial
  CRISPR gRNA sequence
agagatctcaaggtcagaaa

SEQ ID NO: 569404 - DNA, 20 bp, Artificial
  CRISPR gRNA sequence
aaggtcagaaagctggttta

SEQ ID NO: 569405 - DNA, 20 bp, Artificial
  CRISPR gRNA sequence
gtttatggcagcacgtgaat

SEQ ID NO: 569406 - DNA, 20 bp, Artificial
  CRISPR gRNA sequence
atggcagcacgtgaatatag

SEQ ID NO: 569407 - DNA, 20 bp, Artificial
  CRISPR gRNA sequence
tggcagcacgtgaatataga

SEQ ID NO: 569408 - DNA, 20 bp, Artificial
  CRISPR gRNA sequence
atacagattagaaaattgag

SEQ ID NO: 569409 - DNA, 20 bp, Artificial
  CRISPR gRNA sequence
tacagattagaaaattgaga

SEQ ID NO: 569410 - DNA, 20 bp, Artificial
  CRISPR gRNA sequence
gaaaattgagaagttgaggg

SEQ ID NO: 569411 - DNA, 20 bp, Artificial
  CRISPR gRNA sequence
agaagttgagggcaggagaa

SEQ ID NO: 569412 - DNA, 20 bp, Artificial
  CRISPR gRNA sequence
agggcaggagaaaattctgg

SEQ ID NO: 569413 - DNA, 20 bp, Artificial
  CRISPR gRNA sequence
tggatagaagagaacatggg

SEQ ID NO: 569414 - DNA, 20 bp, Artificial
  CRISPR gRNA sequence
gatagaagagaacatgggat

SEQ ID NO: 569415 - DNA, 20 bp, Artificial
  CRISPR gRNA sequence
ggagcaagaaaacctaggtc

SEQ ID NO: 569416 - DNA, 20 bp, Artificial
  CRISPR gRNA sequence
ggtcctagacctgatttcat

SEQ ID NO: 569417 - DNA, 20 bp, Artificial
  CRISPR gRNA sequence
gacctgatttcattgcttac

SEQ ID NO: 569418 - DNA, 20 bp, Artificial
  CRISPR gRNA sequence
atttcattgcttactggcag

SEQ ID NO: 569419 - DNA, 20 bp, Artificial
  CRISPR gRNA sequence
cattgcttactggcagtgtg

SEQ ID NO: 569420 - DNA, 20 bp, Artificial
  CRISPR gRNA sequence
attgcttactggcagtgtga

SEQ ID NO: 569421 - DNA, 20 bp, Artificial
  CRISPR gRNA sequence
cttactggcagtgtgaatgt

SEQ ID NO: 569422 - DNA, 20 bp, Artificial
  CRISPR gRNA sequence
actggcagtgtgaatgtggg

SEQ ID NO: 569423 - DNA, 20 bp, Artificial
  CRISPR gRNA sequence
ctggcagtgtgaatgtgggg

SEQ ID NO: 569424 - DNA, 20 bp, Artificial
  CRISPR gRNA sequence
gcagtgtgaatgtgggggat

SEQ ID NO: 569425 - DNA, 20 bp, Artificial
  CRISPR gRNA sequence
actttacaagggctgaggaa

SEQ ID NO: 569426 - DNA, 20 bp, Artificial
  CRISPR gRNA sequence
ctttacaagggctgaggaaa

SEQ ID NO: 569427 - DNA, 20 bp, Artificial
  CRISPR gRNA sequence
tacaagggctgaggaaatta

SEQ ID NO: 569428 - DNA, 20 bp, Artificial
  CRISPR gRNA sequence
acaagggctgaggaaattaa

SEQ ID NO: 569429 - DNA, 20 bp, Artificial
  CRISPR gRNA sequence
caagggctgaggaaattaaa

SEQ ID NO: 569430 - DNA, 20 bp, Artificial
  CRISPR gRNA sequence
aggaaattaaataaaatagc

SEQ ID NO: 569431 - DNA, 20 bp, Artificial
  CRISPR gRNA sequence
aataaaatagcatgtgggaa

SEQ ID NO: 569432 - DNA, 20 bp, Artificial
  CRISPR gRNA sequence
atggttagtcactataaaac

SEQ ID NO: 569433 - DNA, 20 bp, Artificial
  CRISPR gRNA sequence
gtcactataaaactgctagt

SEQ ID NO: 569434 - DNA, 20 bp, Artificial
  CRISPR gRNA sequence
taaaactgctagttgttatt

SEQ ID NO: 569435 - DNA, 20 bp, Artificial
  CRISPR gRNA sequence
ctagttgttattcaggatac

SEQ ID NO: 569436 - DNA, 20 bp, Artificial
  CRISPR gRNA sequence
gttgttattcaggatacagg

SEQ ID NO: 569437 - DNA, 20 bp, Artificial
  CRISPR gRNA sequence
ttattcaggatacaggaaga

SEQ ID NO: 569438 - DNA, 20 bp, Artificial
  CRISPR gRNA sequence
ttcaggatacaggaagagtt

SEQ ID NO: 569439 - DNA, 20 bp, Artificial
  CRISPR gRNA sequence
aggatacaggaagagtttca

SEQ ID NO: 569440 - DNA, 20 bp, Artificial
  CRISPR gRNA sequence
caagagaggacatttggtat

SEQ ID NO: 569441 - DNA, 20 bp, Artificial
  CRISPR gRNA sequence
aagagaggacatttggtata

SEQ ID NO: 569442 - DNA, 20 bp, Artificial
  CRISPR gRNA sequence
ggtataacattatatacagc

SEQ ID NO: 569443 - DNA, 20 bp, Artificial
  CRISPR gRNA sequence
gtataacattatatacagcc

SEQ ID NO: 569444 - DNA, 20 bp, Artificial
  CRISPR gRNA sequence
tatacagccaatggtttaag

SEQ ID NO: 569445 - DNA, 20 bp, Artificial
  CRISPR gRNA sequence
aaggaggacaatgtagaaga

SEQ ID NO: 569446 - DNA, 20 bp, Artificial
  CRISPR gRNA sequence
aggaggacaatgtagaagag

SEQ ID NO: 569447 - DNA, 20 bp, Artificial
  CRISPR gRNA sequence
tggatttggcacttaggagg

SEQ ID NO: 569448 - DNA, 20 bp, Artificial
  CRISPR gRNA sequence
ggcacttaggaggtcattgt

SEQ ID NO: 569449 - DNA, 20 bp, Artificial
  CRISPR gRNA sequence
gcacttaggaggtcattgtt

SEQ ID NO: 569450 - DNA, 20 bp, Artificial
  CRISPR gRNA sequence
aggaggtcattgttgacaga

SEQ ID NO: 569451 - DNA, 20 bp, Artificial
  CRISPR gRNA sequence
ggaggtcattgttgacagac

SEQ ID NO: 569452 - DNA, 20 bp, Artificial
  CRISPR gRNA sequence
ttgacagaccttgtgaatag

SEQ ID NO: 569453 - DNA, 20 bp, Artificial
  CRISPR gRNA sequence
acagaccttgtgaatagatg

SEQ ID NO: 569454 - DNA, 20 bp, Artificial
  CRISPR gRNA sequence
gtgaatagatgagggtagga

SEQ ID NO: 569455 - DNA, 20 bp, Artificial
  CRISPR gRNA sequence
tgaatagatgagggtaggaa

SEQ ID NO: 569456 - DNA, 20 bp, Artificial
  CRISPR gRNA sequence
ctgggctttaagtaagaaga

SEQ ID NO: 569457 - DNA, 20 bp, Artificial
  CRISPR gRNA sequence
ggctttaagtaagaagaggg

SEQ ID NO: 569458 - DNA, 20 bp, Artificial
  CRISPR gRNA sequence
taagtaagaagaggggtagt

SEQ ID NO: 569459 - DNA, 20 bp, Artificial
  CRISPR gRNA sequence
aagtaagaagaggggtagtc

SEQ ID NO: 569460 - DNA, 20 bp, Artificial
  CRISPR gRNA sequence
agtaagaagaggggtagtcc

SEQ ID NO: 569461 - DNA, 20 bp, Artificial
  CRISPR gRNA sequence
tatatttggctgtgaaagag

SEQ ID NO: 569462 - DNA, 20 bp, Artificial
  CRISPR gRNA sequence
ggctgtgaaagaggaaaata

SEQ ID NO: 569463 - DNA, 20 bp, Artificial
  CRISPR gRNA sequence
gctgtgaaagaggaaaataa

SEQ ID NO: 569464 - DNA, 20 bp, Artificial
  CRISPR gRNA sequence
tgaaagaggaaaataaaatc

SEQ ID NO: 569465 - DNA, 20 bp, Artificial
  CRISPR gRNA sequence
agtacctttgagagtcaaag

SEQ ID NO: 569466 - DNA, 20 bp, Artificial
  CRISPR gRNA sequence
tgagagtcaaaggctatttc

SEQ ID NO: 569467 - DNA, 20 bp, Artificial
  CRISPR gRNA sequence
gagagtcaaaggctatttcc

SEQ ID NO: 569468 - DNA, 20 bp, Artificial
  CRISPR gRNA sequence
agagtcaaaggctatttcca

SEQ ID NO: 569469 - DNA, 20 bp, Artificial
  CRISPR gRNA sequence
tttccaggtaaagaaaccca

SEQ ID NO: 569470 - DNA, 20 bp, Artificial
  CRISPR gRNA sequence
ccaggtaaagaaacccagtg

SEQ ID NO: 569471 - DNA, 20 bp, Artificial
  CRISPR gRNA sequence
caggtaaagaaacccagtgc

SEQ ID NO: 569472 - DNA, 20 bp, Artificial
  CRISPR gRNA sequence
caccattctcttttagataa

SEQ ID NO: 569473 - DNA, 20 bp, Artificial
  CRISPR gRNA sequence
accattctcttttagataac

SEQ ID NO: 569474 - DNA, 20 bp, Artificial
  CRISPR gRNA sequence
tcttttagataactgctggg

SEQ ID NO: 569475 - DNA, 20 bp, Artificial
  CRISPR gRNA sequence
ttttagataactgctgggaa

SEQ ID NO: 569476 - DNA, 20 bp, Artificial
  CRISPR gRNA sequence
ttagataactgctgggaaga

SEQ ID NO: 569477 - DNA, 20 bp, Artificial
  CRISPR gRNA sequence
tagataactgctgggaagaa

SEQ ID NO: 569478 - DNA, 20 bp, Artificial
  CRISPR gRNA sequence
agataactgctgggaagaag

SEQ ID NO: 569479 - DNA, 20 bp, Artificial
  CRISPR gRNA sequence
gataactgctgggaagaagt

SEQ ID NO: 569480 - DNA, 20 bp, Artificial
  CRISPR gRNA sequence
ctgggaagaagtaggatgat

SEQ ID NO: 569481 - DNA, 20 bp, Artificial
  CRISPR gRNA sequence
ggaagaagtaggatgattgt

SEQ ID NO: 569482 - DNA, 20 bp, Artificial
  CRISPR gRNA sequence
taacaccctccacattgaca

SEQ ID NO: 569483 - DNA, 20 bp, Artificial
  CRISPR gRNA sequence
cacattgacacagaactcta

SEQ ID NO: 569484 - DNA, 20 bp, Artificial
  CRISPR gRNA sequence
acacagaactctaaatggga

SEQ ID NO: 569485 - DNA, 20 bp, Artificial
  CRISPR gRNA sequence
taaatgggagcctagggaaa

SEQ ID NO: 569486 - DNA, 20 bp, Artificial
  CRISPR gRNA sequence
aatgggagcctagggaaagg

SEQ ID NO: 569487 - DNA, 20 bp, Artificial
  CRISPR gRNA sequence
gggaaagggcacattttttg

SEQ ID NO: 569488 - DNA, 20 bp, Artificial
  CRISPR gRNA sequence
tttgaaggggtaggcaagag

SEQ ID NO: 569489 - DNA, 20 bp, Artificial
  CRISPR gRNA sequence
ttgaaggggtaggcaagagg

SEQ ID NO: 569490 - DNA, 20 bp, Artificial
  CRISPR gRNA sequence
tgaaggggtaggcaagagga

SEQ ID NO: 569491 - DNA, 20 bp, Artificial
  CRISPR gRNA sequence
gaaggggtaggcaagaggat

SEQ ID NO: 569492 - DNA, 20 bp, Artificial
  CRISPR gRNA sequence
aaggggtaggcaagaggata

SEQ ID NO: 569493 - DNA, 20 bp, Artificial
  CRISPR gRNA sequence
tctagagtaccagtttccaa

SEQ ID NO: 569494 - DNA, 20 bp, Artificial
  CRISPR gRNA sequence
tagagtaccagtttccaact

SEQ ID NO: 569495 - DNA, 20 bp, Artificial
  CRISPR gRNA sequence
gagtaccagtttccaactgt

SEQ ID NO: 569496 - DNA, 20 bp, Artificial
  CRISPR gRNA sequence
ccaactgttgtacacattta

SEQ ID NO: 569497 - DNA, 20 bp, Artificial
  CRISPR gRNA sequence
caactgttgtacacatttat

SEQ ID NO: 569498 - DNA, 20 bp, Artificial
  CRISPR gRNA sequence
ttgtacacatttatggacca

SEQ ID NO: 569499 - DNA, 20 bp, Artificial
  CRISPR gRNA sequence
tacacatttatggaccaaga

SEQ ID NO: 569500 - DNA, 20 bp, Artificial
  CRISPR gRNA sequence
atggaccaagaacataaaag

SEQ ID NO: 569501 - DNA, 20 bp, Artificial
  CRISPR gRNA sequence
tggaccaagaacataaaaga

SEQ ID NO: 569502 - DNA, 20 bp, Artificial
  CRISPR gRNA sequence
ttcagttccgacctgaagtt

SEQ ID NO: 569503 - DNA, 20 bp, Artificial
  CRISPR gRNA sequence
agttccgacctgaagttatg

SEQ ID NO: 569504 - DNA, 20 bp, Artificial
  CRISPR gRNA sequence
cgacctgaagttatgtagaa

SEQ ID NO: 569505 - DNA, 20 bp, Artificial
  CRISPR gRNA sequence
aagttatgtagaacaaacat

SEQ ID NO: 569506 - DNA, 20 bp, Artificial
  CRISPR gRNA sequence
tgtagaacaaacattgttct

SEQ ID NO: 569507 - DNA, 20 bp, Artificial
  CRISPR gRNA sequence
ttctgagttcaactagatga

SEQ ID NO: 569508 - DNA, 20 bp, Artificial
  CRISPR gRNA sequence
tgagttcaactagatgatct

SEQ ID NO: 569509 - DNA, 20 bp, Artificial
  CRISPR gRNA sequence
agttcaactagatgatcttt

SEQ ID NO: 569510 - DNA, 20 bp, Artificial
  CRISPR gRNA sequence
aactagatgatctttctttc

SEQ ID NO: 569511 - DNA, 20 bp, Artificial
  CRISPR gRNA sequence
gatgatctttctttcatagc

SEQ ID NO: 569512 - DNA, 20 bp, Artificial
  CRISPR gRNA sequence
tctttcatagctgtgtggac

SEQ ID NO: 569513 - DNA, 20 bp, Artificial
  CRISPR gRNA sequence
ctttcatagctgtgtggaca

SEQ ID NO: 569514 - DNA, 20 bp, Artificial
  CRISPR gRNA sequence
tttcatagctgtgtggacat

SEQ ID NO: 569515 - DNA, 20 bp, Artificial
  CRISPR gRNA sequence
tcatagctgtgtggacatta

SEQ ID NO: 569516 - DNA, 20 bp, Artificial
  CRISPR gRNA sequence
catagctgtgtggacattat

SEQ ID NO: 569517 - DNA, 20 bp, Artificial
  CRISPR gRNA sequence
atagctgtgtggacattatg

SEQ ID NO: 569518 - DNA, 20 bp, Artificial
  CRISPR gRNA sequence
tgtggacattatgttacctg

SEQ ID NO: 569519 - DNA, 20 bp, Artificial
  CRISPR gRNA sequence
tgttacctgcagggagtaag

SEQ ID NO: 569520 - DNA, 20 bp, Artificial
  CRISPR gRNA sequence
cctgcagggagtaagtcact

SEQ ID NO: 569521 - DNA, 20 bp, Artificial
  CRISPR gRNA sequence
cagggagtaagtcactgaag

SEQ ID NO: 569522 - DNA, 20 bp, Artificial
  CRISPR gRNA sequence
aaggtagagcctcaaaaaaa

SEQ ID NO: 569523 - DNA, 20 bp, Artificial
  CRISPR gRNA sequence
aaaaaaacaccctttgatct

SEQ ID NO: 569524 - DNA, 20 bp, Artificial
  CRISPR gRNA sequence
tgatcttactcctaagaaaa

SEQ ID NO: 569525 - DNA, 20 bp, Artificial
  CRISPR gRNA sequence
gatcttactcctaagaaaaa

SEQ ID NO: 569526 - DNA, 20 bp, Artificial
  CRISPR gRNA sequence
atcttactcctaagaaaaaa

SEQ ID NO: 569527 - DNA, 20 bp, Artificial
  CRISPR gRNA sequence
actcctaagaaaaaagagag

SEQ ID NO: 569528 - DNA, 20 bp, Artificial
  CRISPR gRNA sequence
ctcctaagaaaaaagagaga

SEQ ID NO: 569529 - DNA, 20 bp, Artificial
  CRISPR gRNA sequence
ctaagaaaaaagagagaaat

SEQ ID NO: 569530 - DNA, 20 bp, Artificial
  CRISPR gRNA sequence
agaaaaaagagagaaattgg

SEQ ID NO: 569531 - DNA, 20 bp, Artificial
  CRISPR gRNA sequence
gaaaaattcatcatagaaac

SEQ ID NO: 569532 - DNA, 20 bp, Artificial
  CRISPR gRNA sequence
atcatagaaacacaaaaata

SEQ ID NO: 569533 - DNA, 20 bp, Artificial
  CRISPR gRNA sequence
tgtagactgagataaagaat

SEQ ID NO: 569534 - DNA, 20 bp, Artificial
  CRISPR gRNA sequence
agataaagaatgttaagaat

SEQ ID NO: 569535 - DNA, 20 bp, Artificial
  CRISPR gRNA sequence
agaatatttgaacaaagttt

SEQ ID NO: 569536 - DNA, 20 bp, Artificial
  CRISPR gRNA sequence
gaacaaagtttgaaccagat

SEQ ID NO: 569537 - DNA, 20 bp, Artificial
  CRISPR gRNA sequence
aacaaagtttgaaccagatg

SEQ ID NO: 569538 - DNA, 20 bp, Artificial
  CRISPR gRNA sequence
gaaccagatgaaatgtaaca

SEQ ID NO: 569539 - DNA, 20 bp, Artificial
  CRISPR gRNA sequence
aaccagatgaaatgtaacag

SEQ ID NO: 569540 - DNA, 20 bp, Artificial
  CRISPR gRNA sequence
ttggactgatttaagttggt

SEQ ID NO: 569541 - DNA, 20 bp, Artificial
  CRISPR gRNA sequence
tggactgatttaagttggtc

SEQ ID NO: 569542 - DNA, 20 bp, Artificial
  CRISPR gRNA sequence
ggactgatttaagttggtct

SEQ ID NO: 569543 - DNA, 20 bp, Artificial
  CRISPR gRNA sequence
gactgatttaagttggtctc

SEQ ID NO: 569544 - DNA, 20 bp, Artificial
  CRISPR gRNA sequence
atttaagttggtctcttgtg

SEQ ID NO: 569545 - DNA, 20 bp, Artificial
  CRISPR gRNA sequence
aagttggtctcttgtgactt

SEQ ID NO: 569546 - DNA, 20 bp, Artificial
  CRISPR gRNA sequence
agttggtctcttgtgacttt

SEQ ID NO: 569547 - DNA, 20 bp, Artificial
  CRISPR gRNA sequence
gtctcttgtgacttttatga

SEQ ID NO: 569548 - DNA, 20 bp, Artificial
  CRISPR gRNA sequence
ttgtgacttttatgactttc

SEQ ID NO: 569549 - DNA, 20 bp, Artificial
  CRISPR gRNA sequence
gtgacttttatgactttcca

SEQ ID NO: 569550 - DNA, 20 bp, Artificial
  CRISPR gRNA sequence
tgacttttatgactttccac

SEQ ID NO: 569551 - DNA, 20 bp, Artificial
  CRISPR gRNA sequence
ttatgactttccactgggaa

SEQ ID NO: 569552 - DNA, 20 bp, Artificial
  CRISPR gRNA sequence
tatgactttccactgggaag

SEQ ID NO: 569553 - DNA, 20 bp, Artificial
  CRISPR gRNA sequence
atgactttccactgggaaga

SEQ ID NO: 569554 - DNA, 20 bp, Artificial
  CRISPR gRNA sequence
tgactttccactgggaagaa

SEQ ID NO: 569555 - DNA, 20 bp, Artificial
  CRISPR gRNA sequence
tccactgggaagaatagtga

SEQ ID NO: 569556 - DNA, 20 bp, Artificial
  CRISPR gRNA sequence
ccactgggaagaatagtgat

SEQ ID NO: 569557 - DNA, 20 bp, Artificial
  CRISPR gRNA sequence
cactgggaagaatagtgatt

SEQ ID NO: 569558 - DNA, 20 bp, Artificial
  CRISPR gRNA sequence
ggaagaatagtgattaagaa

SEQ ID NO: 569559 - DNA, 20 bp, Artificial
  CRISPR gRNA sequence
agaatgttcactctgctttt

SEQ ID NO: 569560 - DNA, 20 bp, Artificial
  CRISPR gRNA sequence
actctgcttttaaaaattga

SEQ ID NO: 569561 - DNA, 20 bp, Artificial
  CRISPR gRNA sequence
tgcttttaaaaattgagaaa

SEQ ID NO: 569562 - DNA, 20 bp, Artificial
  CRISPR gRNA sequence
cttttaaaaattgagaaaga

SEQ ID NO: 569563 - DNA, 20 bp, Artificial
  CRISPR gRNA sequence
ttaaaaattgagaaagaacg

SEQ ID NO: 569564 - DNA, 20 bp, Artificial
  CRISPR gRNA sequence
taaaaattgagaaagaacgc

SEQ ID NO: 569565 - DNA, 20 bp, Artificial
  CRISPR gRNA sequence
aaaaattgagaaagaacgct

SEQ ID NO: 569566 - DNA, 20 bp, Artificial
  CRISPR gRNA sequence
aaaattgagaaagaacgctg

SEQ ID NO: 569567 - DNA, 20 bp, Artificial
  CRISPR gRNA sequence
agaaagaacgctgcgtgcag

SEQ ID NO: 569568 - DNA, 20 bp, Artificial
  CRISPR gRNA sequence
cgtgcagtggcttatgccta

SEQ ID NO: 569569 - DNA, 20 bp, Artificial
  CRISPR gRNA sequence
atgcctataatcccaacact

SEQ ID NO: 569570 - DNA, 20 bp, Artificial
  CRISPR gRNA sequence
tgcctataatcccaacactt

SEQ ID NO: 569571 - DNA, 20 bp, Artificial
  CRISPR gRNA sequence
taatcccaacactttgtgag

SEQ ID NO: 569572 - DNA, 20 bp, Artificial
  CRISPR gRNA sequence
tgtgaggccaagacgggagg

SEQ ID NO: 569573 - DNA, 20 bp, Artificial
  CRISPR gRNA sequence
gtgaggccaagacgggagga

SEQ ID NO: 569574 - DNA, 20 bp, Artificial
  CRISPR gRNA sequence
tgaggccaagacgggaggat

SEQ ID NO: 569575 - DNA, 20 bp, Artificial
  CRISPR gRNA sequence
cttgaggctgagagttcgag

SEQ ID NO: 569576 - DNA, 20 bp, Artificial
  CRISPR gRNA sequence
gaggctgagagttcgagacc

SEQ ID NO: 569577 - DNA, 20 bp, Artificial
  CRISPR gRNA sequence
aggctgagagttcgagacca

SEQ ID NO: 569578 - DNA, 20 bp, Artificial
  CRISPR gRNA sequence
agagttcgagaccagcctgg

SEQ ID NO: 569579 - DNA, 20 bp, Artificial
  CRISPR gRNA sequence
gagaccagcctgggcaacat

SEQ ID NO: 569580 - DNA, 20 bp, Artificial
  CRISPR gRNA sequence
ggcaacatagggagacccta

SEQ ID NO: 569581 - DNA, 20 bp, Artificial
  CRISPR gRNA sequence
tctctactaaaaattaaaaa

SEQ ID NO: 569582 - DNA, 20 bp, Artificial
  CRISPR gRNA sequence
tactaaaaattaaaaagtta

SEQ ID NO: 569583 - DNA, 20 bp, Artificial
  CRISPR gRNA sequence
ctaaaaattaaaaagttact

SEQ ID NO: 569584 - DNA, 20 bp, Artificial
  CRISPR gRNA sequence
aaaattaaaaagttactgag

SEQ ID NO: 569585 - DNA, 20 bp, Artificial
  CRISPR gRNA sequence
aaaagttactgaggtgttgt

SEQ ID NO: 569586 - DNA, 20 bp, Artificial
  CRISPR gRNA sequence
ctgaggtgttgtggcatgtg

SEQ ID NO: 569587 - DNA, 20 bp, Artificial
  CRISPR gRNA sequence
aggtgttgtggcatgtgtct

SEQ ID NO: 569588 - DNA, 20 bp, Artificial
  CRISPR gRNA sequence
tggcatgtgtctgtagtcct

SEQ ID NO: 569589 - DNA, 20 bp, Artificial
  CRISPR gRNA sequence
tagtcctagctacttgggag

SEQ ID NO: 569590 - DNA, 20 bp, Artificial
  CRISPR gRNA sequence
gctacttgggagactgaggt

SEQ ID NO: 569591 - DNA, 20 bp, Artificial
  CRISPR gRNA sequence
cttgggagactgaggtggga

SEQ ID NO: 569592 - DNA, 20 bp, Artificial
  CRISPR gRNA sequence
gggagactgaggtgggagga

SEQ ID NO: 569593 - DNA, 20 bp, Artificial
  CRISPR gRNA sequence
ggagactgaggtgggaggat

SEQ ID NO: 569594 - DNA, 20 bp, Artificial
  CRISPR gRNA sequence
aggtgggaggatcacttcag

SEQ ID NO: 569595 - DNA, 20 bp, Artificial
  CRISPR gRNA sequence
cagcctggcagtttaaataa

SEQ ID NO: 569596 - DNA, 20 bp, Artificial
  CRISPR gRNA sequence
agcctggcagtttaaataaa

SEQ ID NO: 569597 - DNA, 20 bp, Artificial
  CRISPR gRNA sequence
gcagtttaaataaatcagat

SEQ ID NO: 569598 - DNA, 20 bp, Artificial
  CRISPR gRNA sequence
aaataaatcagatcagtaat

SEQ ID NO: 569599 - DNA, 20 bp, Artificial
  CRISPR gRNA sequence
aataaatcagatcagtaatt

SEQ ID NO: 569600 - DNA, 20 bp, Artificial
  CRISPR gRNA sequence
ataatcttccaaaacagaaa

SEQ ID NO: 569601 - DNA, 20 bp, Artificial
  CRISPR gRNA sequence
ccaaaacagaaagcaccagg

SEQ ID NO: 569602 - DNA, 20 bp, Artificial
  CRISPR gRNA sequence
caaaacagaaagcaccaggt

SEQ ID NO: 569603 - DNA, 20 bp, Artificial
  CRISPR gRNA sequence
agatgggttcattggtgaat

SEQ ID NO: 569604 - DNA, 20 bp, Artificial
  CRISPR gRNA sequence
attggtgaattctaccagat

SEQ ID NO: 569605 - DNA, 20 bp, Artificial
  CRISPR gRNA sequence
gtgaattctaccagatattt

SEQ ID NO: 569606 - DNA, 20 bp, Artificial
  CRISPR gRNA sequence
taccagatatttaaggaaga

SEQ ID NO: 569607 - DNA, 20 bp, Artificial
  CRISPR gRNA sequence
ccagatatttaaggaagaaa

SEQ ID NO: 569608 - DNA, 20 bp, Artificial
  CRISPR gRNA sequence
aaggaagaaatactaattct

SEQ ID NO: 569609 - DNA, 20 bp, Artificial
  CRISPR gRNA sequence
aggaagaaatactaattctc

SEQ ID NO: 569610 - DNA, 20 bp, Artificial
  CRISPR gRNA sequence
attctctataatctctttta

SEQ ID NO: 569611 - DNA, 20 bp, Artificial
  CRISPR gRNA sequence
tctataatctcttttagaag

SEQ ID NO: 569612 - DNA, 20 bp, Artificial
  CRISPR gRNA sequence
tataatctcttttagaagat

SEQ ID NO: 569613 - DNA, 20 bp, Artificial
  CRISPR gRNA sequence
taatctcttttagaagatag

SEQ ID NO: 569614 - DNA, 20 bp, Artificial
  CRISPR gRNA sequence
ttttagaagatagaagcaga

SEQ ID NO: 569615 - DNA, 20 bp, Artificial
  CRISPR gRNA sequence
ttagaagatagaagcagagg

SEQ ID NO: 569616 - DNA, 20 bp, Artificial
  CRISPR gRNA sequence
tagaagatagaagcagaggg

SEQ ID NO: 569617 - DNA, 20 bp, Artificial
  CRISPR gRNA sequence
agaagatagaagcagagggc

SEQ ID NO: 569618 - DNA, 20 bp, Artificial
  CRISPR gRNA sequence
gaagatagaagcagagggca

SEQ ID NO: 569619 - DNA, 20 bp, Artificial
  CRISPR gRNA sequence
tccaattcattttatgaggc

SEQ ID NO: 569620 - DNA, 20 bp, Artificial
  CRISPR gRNA sequence
ccaattcattttatgaggcc

SEQ ID NO: 569621 - DNA, 20 bp, Artificial
  CRISPR gRNA sequence
caattcattttatgaggcca

SEQ ID NO: 569622 - DNA, 20 bp, Artificial
  CRISPR gRNA sequence
attttatgaggccagcatta

SEQ ID NO: 569623 - DNA, 20 bp, Artificial
  CRISPR gRNA sequence
tatgaggccagcattattct

SEQ ID NO: 569624 - DNA, 20 bp, Artificial
  CRISPR gRNA sequence
atgaggccagcattattctt

SEQ ID NO: 569625 - DNA, 20 bp, Artificial
  CRISPR gRNA sequence
tgaggccagcattattcttg

SEQ ID NO: 569626 - DNA, 20 bp, Artificial
  CRISPR gRNA sequence
ttcttgtgctaaaaccaaag

SEQ ID NO: 569627 - DNA, 20 bp, Artificial
  CRISPR gRNA sequence
ttgtgctaaaaccaaagaac

SEQ ID NO: 569628 - DNA, 20 bp, Artificial
  CRISPR gRNA sequence
gtgctaaaaccaaagaacaa

SEQ ID NO: 569629 - DNA, 20 bp, Artificial
  CRISPR gRNA sequence
tgctaaaaccaaagaacaat

SEQ ID NO: 569630 - DNA, 20 bp, Artificial
  CRISPR gRNA sequence
aaaccaaagaacaatacaag

SEQ ID NO: 569631 - DNA, 20 bp, Artificial
  CRISPR gRNA sequence
agacaaatatttctcatgaa

SEQ ID NO: 569632 - DNA, 20 bp, Artificial
  CRISPR gRNA sequence
ctcatgaacatacatgtaga

SEQ ID NO: 569633 - DNA, 20 bp, Artificial
  CRISPR gRNA sequence
tcatgaacatacatgtagaa

SEQ ID NO: 569634 - DNA, 20 bp, Artificial
  CRISPR gRNA sequence
atgaacatacatgtagaaac

SEQ ID NO: 569635 - DNA, 20 bp, Artificial
  CRISPR gRNA sequence
aaacaaaatattagcaaatt

SEQ ID NO: 569636 - DNA, 20 bp, Artificial
  CRISPR gRNA sequence
aacaaaatattagcaaattg

SEQ ID NO: 569637 - DNA, 20 bp, Artificial
  CRISPR gRNA sequence
gcaaattggatccaacagca

SEQ ID NO: 569638 - DNA, 20 bp, Artificial
  CRISPR gRNA sequence
gatccaacagcatatagaaa

SEQ ID NO: 569639 - DNA, 20 bp, Artificial
  CRISPR gRNA sequence
tacatcatgactaagtggta

SEQ ID NO: 569640 - DNA, 20 bp, Artificial
  CRISPR gRNA sequence
agtggtatttatctcaggtg

SEQ ID NO: 569641 - DNA, 20 bp, Artificial
  CRISPR gRNA sequence
atctcaggtgtgcaaggcag

SEQ ID NO: 569642 - DNA, 20 bp, Artificial
  CRISPR gRNA sequence
tctcaggtgtgcaaggcagg

SEQ ID NO: 569643 - DNA, 20 bp, Artificial
  CRISPR gRNA sequence
aggtgtgcaaggcaggttca

SEQ ID NO: 569644 - DNA, 20 bp, Artificial
  CRISPR gRNA sequence
aacatatgaaaatcaattaa

SEQ ID NO: 569645 - DNA, 20 bp, Artificial
  CRISPR gRNA sequence
atgtaatccatcacattgac

SEQ ID NO: 569646 - DNA, 20 bp, Artificial
  CRISPR gRNA sequence
acagactatgaaagaaaaat

SEQ ID NO: 569647 - DNA, 20 bp, Artificial
  CRISPR gRNA sequence
tgaaagaaaaatcacatgat

SEQ ID NO: 569648 - DNA, 20 bp, Artificial
  CRISPR gRNA sequence
gacaaaatccaacatcaatt

SEQ ID NO: 569649 - DNA, 20 bp, Artificial
  CRISPR gRNA sequence
acaaaatccaacatcaattt

SEQ ID NO: 569650 - DNA, 20 bp, Artificial
  CRISPR gRNA sequence
atgataaaaactctcagtaa

SEQ ID NO: 569651 - DNA, 20 bp, Artificial
  CRISPR gRNA sequence
tgataaaaactctcagtaaa

SEQ ID NO: 569652 - DNA, 20 bp, Artificial
  CRISPR gRNA sequence
tcagtaaactaggaatagag

SEQ ID NO: 569653 - DNA, 20 bp, Artificial
  CRISPR gRNA sequence
agtaaactaggaatagaggg

SEQ ID NO: 569654 - DNA, 20 bp, Artificial
  CRISPR gRNA sequence
ggaatagaggggaaactttt

SEQ ID NO: 569655 - DNA, 20 bp, Artificial
  CRISPR gRNA sequence
tttcaacttgttaacaaatg

SEQ ID NO: 569656 - DNA, 20 bp, Artificial
  CRISPR gRNA sequence
ttcaacttgttaacaaatgc

SEQ ID NO: 569657 - DNA, 20 bp, Artificial
  CRISPR gRNA sequence
tcaacttgttaacaaatgcc

SEQ ID NO: 569658 - DNA, 20 bp, Artificial
  CRISPR gRNA sequence
caacttgttaacaaatgcct

SEQ ID NO: 569659 - DNA, 20 bp, Artificial
  CRISPR gRNA sequence
aacttgttaacaaatgccta

SEQ ID NO: 569660 - DNA, 20 bp, Artificial
  CRISPR gRNA sequence
gttaacaaatgcctacaaaa

SEQ ID NO: 569661 - DNA, 20 bp, Artificial
  CRISPR gRNA sequence
ttaacaaatgcctacaaaaa

SEQ ID NO: 569662 - DNA, 20 bp, Artificial
  CRISPR gRNA sequence
acaaatgcctacaaaaaacc

SEQ ID NO: 569663 - DNA, 20 bp, Artificial
  CRISPR gRNA sequence
caaaaaaccctgcagctaac

SEQ ID NO: 569664 - DNA, 20 bp, Artificial
  CRISPR gRNA sequence
cagctaacatcatctgtaat

SEQ ID NO: 569665 - DNA, 20 bp, Artificial
  CRISPR gRNA sequence
acatcatctgtaatggtgag

SEQ ID NO: 569666 - DNA, 20 bp, Artificial
  CRISPR gRNA sequence
taatggtgagaaacttgaag

SEQ ID NO: 569667 - DNA, 20 bp, Artificial
  CRISPR gRNA sequence
gaagctttccaactaagacc

SEQ ID NO: 569668 - DNA, 20 bp, Artificial
  CRISPR gRNA sequence
aagctttccaactaagacca

SEQ ID NO: 569669 - DNA, 20 bp, Artificial
  CRISPR gRNA sequence
tccaactaagaccaagaata

SEQ ID NO: 569670 - DNA, 20 bp, Artificial
  CRISPR gRNA sequence
ccaactaagaccaagaataa

SEQ ID NO: 569671 - DNA, 20 bp, Artificial
  CRISPR gRNA sequence
caactaagaccaagaataag

SEQ ID NO: 569672 - DNA, 20 bp, Artificial
  CRISPR gRNA sequence
agaccaagaataaggaaata

SEQ ID NO: 569673 - DNA, 20 bp, Artificial
  CRISPR gRNA sequence
ttctcaccactccttttcag

SEQ ID NO: 569674 - DNA, 20 bp, Artificial
  CRISPR gRNA sequence
ctcaccactccttttcagta

SEQ ID NO: 569675 - DNA, 20 bp, Artificial
  CRISPR gRNA sequence
tcaccactccttttcagtat

SEQ ID NO: 569676 - DNA, 20 bp, Artificial
  CRISPR gRNA sequence
accactccttttcagtattg

SEQ ID NO: 569677 - DNA, 20 bp, Artificial
  CRISPR gRNA sequence
cttttcagtattgtactata

SEQ ID NO: 569678 - DNA, 20 bp, Artificial
  CRISPR gRNA sequence
ttcagtattgtactataagc

SEQ ID NO: 569679 - DNA, 20 bp, Artificial
  CRISPR gRNA sequence
tcagtattgtactataagca

SEQ ID NO: 569680 - DNA, 20 bp, Artificial
  CRISPR gRNA sequence
cagtattgtactataagcac

SEQ ID NO: 569681 - DNA, 20 bp, Artificial
  CRISPR gRNA sequence
agtattgtactataagcact

SEQ ID NO: 569682 - DNA, 20 bp, Artificial
  CRISPR gRNA sequence
tactataagcactaactaat

SEQ ID NO: 569683 - DNA, 20 bp, Artificial
  CRISPR gRNA sequence
taagcactaactaatgccat

SEQ ID NO: 569684 - DNA, 20 bp, Artificial
  CRISPR gRNA sequence
actaatgccataagacaaga

SEQ ID NO: 569685 - DNA, 20 bp, Artificial
  CRISPR gRNA sequence
atgccataagacaagaaaag

SEQ ID NO: 569686 - DNA, 20 bp, Artificial
  CRISPR gRNA sequence
tacagatgagaagaaagaaa

SEQ ID NO: 569687 - DNA, 20 bp, Artificial
  CRISPR gRNA sequence
ttttagttctcagatgacat

SEQ ID NO: 569688 - DNA, 20 bp, Artificial
  CRISPR gRNA sequence
tagttctcagatgacatgaa

SEQ ID NO: 569689 - DNA, 20 bp, Artificial
  CRISPR gRNA sequence
agttctcagatgacatgaat

SEQ ID NO: 569690 - DNA, 20 bp, Artificial
  CRISPR gRNA sequence
gttctcagatgacatgaata

SEQ ID NO: 569691 - DNA, 20 bp, Artificial
  CRISPR gRNA sequence
tcagatgacatgaatatcta

SEQ ID NO: 569692 - DNA, 20 bp, Artificial
  CRISPR gRNA sequence
agatgacatgaatatctatg

SEQ ID NO: 569693 - DNA, 20 bp, Artificial
  CRISPR gRNA sequence
tgtatacaatccaaacgaat

SEQ ID NO: 569694 - DNA, 20 bp, Artificial
  CRISPR gRNA sequence
accaaaaacctcctggaact

SEQ ID NO: 569695 - DNA, 20 bp, Artificial
  CRISPR gRNA sequence
ctggaactaataaaaaacta

SEQ ID NO: 569696 - DNA, 20 bp, Artificial
  CRISPR gRNA sequence
gaactaataaaaaactatag

SEQ ID NO: 569697 - DNA, 20 bp, Artificial
  CRISPR gRNA sequence
ataaaaaactatagcacatt

SEQ ID NO: 569698 - DNA, 20 bp, Artificial
  CRISPR gRNA sequence
tagcacatttgtaggataca

SEQ ID NO: 569699 - DNA, 20 bp, Artificial
  CRISPR gRNA sequence
gtaggatacaaagttaatat

SEQ ID NO: 569700 - DNA, 20 bp, Artificial
  CRISPR gRNA sequence
taggatacaaagttaatata

SEQ ID NO: 569701 - DNA, 20 bp, Artificial
  CRISPR gRNA sequence
atatacaaaagtcaatcact

SEQ ID NO: 569702 - DNA, 20 bp, Artificial
  CRISPR gRNA sequence
ttctataacagcaatgaaca

SEQ ID NO: 569703 - DNA, 20 bp, Artificial
  CRISPR gRNA sequence
tctataacagcaatgaacaa

SEQ ID NO: 569704 - DNA, 20 bp, Artificial
  CRISPR gRNA sequence
ctataacagcaatgaacaag

SEQ ID NO: 569705 - DNA, 20 bp, Artificial
  CRISPR gRNA sequence
tataacagcaatgaacaagt

SEQ ID NO: 569706 - DNA, 20 bp, Artificial
  CRISPR gRNA sequence
taacagcaatgaacaagtgg

SEQ ID NO: 569707 - DNA, 20 bp, Artificial
  CRISPR gRNA sequence
gaagtttaaaacacaacacc

SEQ ID NO: 569708 - DNA, 20 bp, Artificial
  CRISPR gRNA sequence
aagtttaaaacacaacacca

SEQ ID NO: 569709 - DNA, 20 bp, Artificial
  CRISPR gRNA sequence
aaaacacaacaccatttacc

SEQ ID NO: 569710 - DNA, 20 bp, Artificial
  CRISPR gRNA sequence
aaacacaacaccatttacct

SEQ ID NO: 569711 - DNA, 20 bp, Artificial
  CRISPR gRNA sequence
accttagcaccccaaaaatg

SEQ ID NO: 569712 - DNA, 20 bp, Artificial
  CRISPR gRNA sequence
ccttagcaccccaaaaatgc

SEQ ID NO: 569713 - DNA, 20 bp, Artificial
  CRISPR gRNA sequence
agcaccccaaaaatgcaata

SEQ ID NO: 569714 - DNA, 20 bp, Artificial
  CRISPR gRNA sequence
gcaccccaaaaatgcaatac

SEQ ID NO: 569715 - DNA, 20 bp, Artificial
  CRISPR gRNA sequence
aggtacaataacaaaatatg

SEQ ID NO: 569716 - DNA, 20 bp, Artificial
  CRISPR gRNA sequence
ggtacaataacaaaatatgt

SEQ ID NO: 569717 - DNA, 20 bp, Artificial
  CRISPR gRNA sequence
atatgagaaaatcaacaaaa

SEQ ID NO: 569718 - DNA, 20 bp, Artificial
  CRISPR gRNA sequence
tatgagaaaatcaacaaaac

SEQ ID NO: 569719 - DNA, 20 bp, Artificial
  CRISPR gRNA sequence
atgaacaaaatcaaagaaga

SEQ ID NO: 569720 - DNA, 20 bp, Artificial
  CRISPR gRNA sequence
aataaatggagagatattct

SEQ ID NO: 569721 - DNA, 20 bp, Artificial
  CRISPR gRNA sequence
tatgttcatagataggaaga

SEQ ID NO: 569722 - DNA, 20 bp, Artificial
  CRISPR gRNA sequence
tgttcatagataggaagact

SEQ ID NO: 569723 - DNA, 20 bp, Artificial
  CRISPR gRNA sequence
atagataggaagactcctta

SEQ ID NO: 569724 - DNA, 20 bp, Artificial
  CRISPR gRNA sequence
cttattgtgaagatgtcagt

SEQ ID NO: 569725 - DNA, 20 bp, Artificial
  CRISPR gRNA sequence
attgtgaagatgtcagttat

SEQ ID NO: 569726 - DNA, 20 bp, Artificial
  CRISPR gRNA sequence
ttgtgaagatgtcagttatt

SEQ ID NO: 569727 - DNA, 20 bp, Artificial
  CRISPR gRNA sequence
tgaagatgtcagttatttcc

SEQ ID NO: 569728 - DNA, 20 bp, Artificial
  CRISPR gRNA sequence
tttccaatttactctataaa

SEQ ID NO: 569729 - DNA, 20 bp, Artificial
  CRISPR gRNA sequence
ccaatttactctataaattc

SEQ ID NO: 569730 - DNA, 20 bp, Artificial
  CRISPR gRNA sequence
caatttactctataaattca

SEQ ID NO: 569731 - DNA, 20 bp, Artificial
  CRISPR gRNA sequence
actctataaattcagtgcaa

SEQ ID NO: 569732 - DNA, 20 bp, Artificial
  CRISPR gRNA sequence
ctctataaattcagtgcaat

SEQ ID NO: 569733 - DNA, 20 bp, Artificial
  CRISPR gRNA sequence
tataaattcagtgcaatccc

SEQ ID NO: 569734 - DNA, 20 bp, Artificial
  CRISPR gRNA sequence
taaattcagtgcaatcccaa

SEQ ID NO: 569735 - DNA, 20 bp, Artificial
  CRISPR gRNA sequence
agtgcaatcccaagcaaaat

SEQ ID NO: 569736 - DNA, 20 bp, Artificial
  CRISPR gRNA sequence
gtggatatcagcaaactgat

SEQ ID NO: 569737 - DNA, 20 bp, Artificial
  CRISPR gRNA sequence
tggatatcagcaaactgatt

SEQ ID NO: 569738 - DNA, 20 bp, Artificial
  CRISPR gRNA sequence
attttaaggttaaatgggca

SEQ ID NO: 569739 - DNA, 20 bp, Artificial
  CRISPR gRNA sequence
taaggttaaatgggcaggca

SEQ ID NO: 569740 - DNA, 20 bp, Artificial
  CRISPR gRNA sequence
aaggttaaatgggcaggcaa

SEQ ID NO: 569741 - DNA, 20 bp, Artificial
  CRISPR gRNA sequence
aggttaaatgggcaggcaaa

SEQ ID NO: 569742 - DNA, 20 bp, Artificial
  CRISPR gRNA sequence
aatgggcaggcaaaagacca

SEQ ID NO: 569743 - DNA, 20 bp, Artificial
  CRISPR gRNA sequence
aaggagaacaaaattgtagg

SEQ ID NO: 569744 - DNA, 20 bp, Artificial
  CRISPR gRNA sequence
taggactgatactactcaac

SEQ ID NO: 569745 - DNA, 20 bp, Artificial
  CRISPR gRNA sequence
atactactcaacttcaagac

SEQ ID NO: 569746 - DNA, 20 bp, Artificial
  CRISPR gRNA sequence
ctcaacttcaagacttacta

SEQ ID NO: 569747 - DNA, 20 bp, Artificial
  CRISPR gRNA sequence
aacttcaagacttactataa

SEQ ID NO: 569748 - DNA, 20 bp, Artificial
  CRISPR gRNA sequence
caagacttactataaagcta

SEQ ID NO: 569749 - DNA, 20 bp, Artificial
  CRISPR gRNA sequence
aagacttactataaagctac

SEQ ID NO: 569750 - DNA, 20 bp, Artificial
  CRISPR gRNA sequence
actataaagctacagtagtc

SEQ ID NO: 569751 - DNA, 20 bp, Artificial
  CRISPR gRNA sequence
ctataaagctacagtagtca

SEQ ID NO: 569752 - DNA, 20 bp, Artificial
  CRISPR gRNA sequence
taaagctacagtagtcaaca

SEQ ID NO: 569753 - DNA, 20 bp, Artificial
  CRISPR gRNA sequence
cagtagtcaacatagtgtgg

SEQ ID NO: 569754 - DNA, 20 bp, Artificial
  CRISPR gRNA sequence
gtggaaaaataaaagacaaa

SEQ ID NO: 569755 - DNA, 20 bp, Artificial
  CRISPR gRNA sequence
atctttgacaaaggagcaaa

SEQ ID NO: 569756 - DNA, 20 bp, Artificial
  CRISPR gRNA sequence
tgacaaaggagcaaaggcaa

SEQ ID NO: 569757 - DNA, 20 bp, Artificial
  CRISPR gRNA sequence
gacaaaggagcaaaggcaat

SEQ ID NO: 569758 - DNA, 20 bp, Artificial
  CRISPR gRNA sequence
acaaaggagcaaaggcaata

SEQ ID NO: 569759 - DNA, 20 bp, Artificial
  CRISPR gRNA sequence
ttcaacaaatagtgctgtaa

SEQ ID NO: 569760 - DNA, 20 bp, Artificial
  CRISPR gRNA sequence
tcaacaaatagtgctgtaac

SEQ ID NO: 569761 - DNA, 20 bp, Artificial
  CRISPR gRNA sequence
caacaaatagtgctgtaaca

SEQ ID NO: 569762 - DNA, 20 bp, Artificial
  CRISPR gRNA sequence
aacaaatagtgctgtaacaa

SEQ ID NO: 569763 - DNA, 20 bp, Artificial
  CRISPR gRNA sequence
taacaactggacatccacat

SEQ ID NO: 569764 - DNA, 20 bp, Artificial
  CRISPR gRNA sequence
gacatccacatgcaaaaaaa

SEQ ID NO: 569765 - DNA, 20 bp, Artificial
  CRISPR gRNA sequence
aacacagaccttatgccctt

SEQ ID NO: 569766 - DNA, 20 bp, Artificial
  CRISPR gRNA sequence
atgcccttcacaaaatttta

SEQ ID NO: 569767 - DNA, 20 bp, Artificial
  CRISPR gRNA sequence
tgcccttcacaaaattttac

SEQ ID NO: 569768 - DNA, 20 bp, Artificial
  CRISPR gRNA sequence
cacaaaattttactcaaaat

SEQ ID NO: 569769 - DNA, 20 bp, Artificial
  CRISPR gRNA sequence
acaaaattttactcaaaatg

SEQ ID NO: 569770 - DNA, 20 bp, Artificial
  CRISPR gRNA sequence
tactcaaaatggaccataga

SEQ ID NO: 569771 - DNA, 20 bp, Artificial
  CRISPR gRNA sequence
actcaaaatggaccatagat

SEQ ID NO: 569772 - DNA, 20 bp, Artificial
  CRISPR gRNA sequence
ctcaaaatggaccatagatc

SEQ ID NO: 569773 - DNA, 20 bp, Artificial
  CRISPR gRNA sequence
aaaatggaccatagatctaa

SEQ ID NO: 569774 - DNA, 20 bp, Artificial
  CRISPR gRNA sequence
aatgtaaaatgcaaaaccat

SEQ ID NO: 569775 - DNA, 20 bp, Artificial
  CRISPR gRNA sequence
ctaaaacataagagaaaacc

SEQ ID NO: 569776 - DNA, 20 bp, Artificial
  CRISPR gRNA sequence
aaacataagagaaaacctag

SEQ ID NO: 569777 - DNA, 20 bp, Artificial
  CRISPR gRNA sequence
gataactttggatatgatga

SEQ ID NO: 569778 - DNA, 20 bp, Artificial
  CRISPR gRNA sequence
tggatatgatgactttttag

SEQ ID NO: 569779 - DNA, 20 bp, Artificial
  CRISPR gRNA sequence
ggatatgatgactttttaga

SEQ ID NO: 569780 - DNA, 20 bp, Artificial
  CRISPR gRNA sequence
gatatgatgactttttagat

SEQ ID NO: 569781 - DNA, 20 bp, Artificial
  CRISPR gRNA sequence
tttagatacaacaccaaaga

SEQ ID NO: 569782 - DNA, 20 bp, Artificial
  CRISPR gRNA sequence
ttagatacaacaccaaagac

SEQ ID NO: 569783 - DNA, 20 bp, Artificial
  CRISPR gRNA sequence
tagatacaacaccaaagaca

SEQ ID NO: 569784 - DNA, 20 bp, Artificial
  CRISPR gRNA sequence
agatacaacaccaaagacat

SEQ ID NO: 569785 - DNA, 20 bp, Artificial
  CRISPR gRNA sequence
gatacaacaccaaagacatg

SEQ ID NO: 569786 - DNA, 20 bp, Artificial
  CRISPR gRNA sequence
atgaaagaaagaattggtaa

SEQ ID NO: 569787 - DNA, 20 bp, Artificial
  CRISPR gRNA sequence
gtaagctgtacttcattaaa

SEQ ID NO: 569788 - DNA, 20 bp, Artificial
  CRISPR gRNA sequence
tacttcattaaaattaaaaa

SEQ ID NO: 569789 - DNA, 20 bp, Artificial
  CRISPR gRNA sequence
cattaaaattaaaaacattg

SEQ ID NO: 569790 - DNA, 20 bp, Artificial
  CRISPR gRNA sequence
attaaaattaaaaacattgc

SEQ ID NO: 569791 - DNA, 20 bp, Artificial
  CRISPR gRNA sequence
aaattaaaaacattgctcta

SEQ ID NO: 569792 - DNA, 20 bp, Artificial
  CRISPR gRNA sequence
aaaacattgctctatgaaag

SEQ ID NO: 569793 - DNA, 20 bp, Artificial
  CRISPR gRNA sequence
ctctatgaaagacaatttca

SEQ ID NO: 569794 - DNA, 20 bp, Artificial
  CRISPR gRNA sequence
tatgaaagacaatttcaaga

SEQ ID NO: 569795 - DNA, 20 bp, Artificial
  CRISPR gRNA sequence
tgaaagacaatttcaagaga

SEQ ID NO: 569796 - DNA, 20 bp, Artificial
  CRISPR gRNA sequence
caagagaatgagaagccaag

SEQ ID NO: 569797 - DNA, 20 bp, Artificial
  CRISPR gRNA sequence
aagagaatgagaagccaagc

SEQ ID NO: 569798 - DNA, 20 bp, Artificial
  CRISPR gRNA sequence
ggagaaaatatttgcaaaag

SEQ ID NO: 569799 - DNA, 20 bp, Artificial
  CRISPR gRNA sequence
gcaaaagacacatctgataa

SEQ ID NO: 569800 - DNA, 20 bp, Artificial
  CRISPR gRNA sequence
caaaagacacatctgataaa

SEQ ID NO: 569801 - DNA, 20 bp, Artificial
  CRISPR gRNA sequence
ataaaagactgttatccaaa

SEQ ID NO: 569802 - DNA, 20 bp, Artificial
  CRISPR gRNA sequence
ttatccaaaatatacaaaaa

SEQ ID NO: 569803 - DNA, 20 bp, Artificial
  CRISPR gRNA sequence
tccaaaatatacaaaaaact

SEQ ID NO: 569804 - DNA, 20 bp, Artificial
  CRISPR gRNA sequence
ttaaaactcaacaagaaaaa

SEQ ID NO: 569805 - DNA, 20 bp, Artificial
  CRISPR gRNA sequence
taaaactcaacaagaaaaac

SEQ ID NO: 569806 - DNA, 20 bp, Artificial
  CRISPR gRNA sequence
aaaactcaacaagaaaaaca

SEQ ID NO: 569807 - DNA, 20 bp, Artificial
  CRISPR gRNA sequence
aaactcaacaagaaaaacac

SEQ ID NO: 569808 - DNA, 20 bp, Artificial
  CRISPR gRNA sequence
aacaagaaaaacacaaacaa

SEQ ID NO: 569809 - DNA, 20 bp, Artificial
  CRISPR gRNA sequence
aaaaatgagtcaaagatctc

SEQ ID NO: 569810 - DNA, 20 bp, Artificial
  CRISPR gRNA sequence
atcacacacttctccaagga

SEQ ID NO: 569811 - DNA, 20 bp, Artificial
  CRISPR gRNA sequence
ctccaaggaaggtatacaga

SEQ ID NO: 569812 - DNA, 20 bp, Artificial
  CRISPR gRNA sequence
tccaaggaaggtatacagat

SEQ ID NO: 569813 - DNA, 20 bp, Artificial
  CRISPR gRNA sequence
caaggaaggtatacagatgg

SEQ ID NO: 569814 - DNA, 20 bp, Artificial
  CRISPR gRNA sequence
ctgggccgggtgcggtggct

SEQ ID NO: 569815 - DNA, 20 bp, Artificial
  CRISPR gRNA sequence
ggccgggtgcggtggctcac

SEQ ID NO: 569816 - DNA, 20 bp, Artificial
  CRISPR gRNA sequence
acacctgtaatcccagcact

SEQ ID NO: 569817 - DNA, 20 bp, Artificial
  CRISPR gRNA sequence
taatcccagcactttgggag

SEQ ID NO: 569818 - DNA, 20 bp, Artificial
  CRISPR gRNA sequence
tgggaggccgaggcaggcgg

SEQ ID NO: 569819 - DNA, 20 bp, Artificial
  CRISPR gRNA sequence
gggaggccgaggcaggcgga

SEQ ID NO: 569820 - DNA, 20 bp, Artificial
  CRISPR gRNA sequence
ggaggccgaggcaggcggat

SEQ ID NO: 569821 - DNA, 20 bp, Artificial
  CRISPR gRNA sequence
aggtcaggagttcaagacca

SEQ ID NO: 569822 - DNA, 20 bp, Artificial
  CRISPR gRNA sequence
aagaccagcctggccaacat

SEQ ID NO: 569823 - DNA, 20 bp, Artificial
  CRISPR gRNA sequence
gccaacatggggaaacccca

SEQ ID NO: 569824 - DNA, 20 bp, Artificial
  CRISPR gRNA sequence
ctactattttctattttgta

SEQ ID NO: 569825 - DNA, 20 bp, Artificial
  CRISPR gRNA sequence
tactattttctattttgtaa

SEQ ID NO: 569826 - DNA, 20 bp, Artificial
  CRISPR gRNA sequence
ctattttctattttgtaaaa

SEQ ID NO: 569827 - DNA, 20 bp, Artificial
  CRISPR gRNA sequence
ttttctattttgtaaaaata

SEQ ID NO: 569828 - DNA, 20 bp, Artificial
  CRISPR gRNA sequence
tctattttgtaaaaatacaa

SEQ ID NO: 569829 - DNA, 20 bp, Artificial
  CRISPR gRNA sequence
ctattttgtaaaaatacaaa

SEQ ID NO: 569830 - DNA, 20 bp, Artificial
  CRISPR gRNA sequence
tattttgtaaaaatacaaaa

SEQ ID NO: 569831 - DNA, 20 bp, Artificial
  CRISPR gRNA sequence
ttttgtaaaaatacaaaaat

SEQ ID NO: 569832 - DNA, 20 bp, Artificial
  CRISPR gRNA sequence
tgtaaaaatacaaaaattag

SEQ ID NO: 569833 - DNA, 20 bp, Artificial
  CRISPR gRNA sequence
gtaaaaatacaaaaattagc

SEQ ID NO: 569834 - DNA, 20 bp, Artificial
  CRISPR gRNA sequence
taaaaatacaaaaattagct

SEQ ID NO: 569835 - DNA, 20 bp, Artificial
  CRISPR gRNA sequence
gctaggcatgtcctatgtca

SEQ ID NO: 569836 - DNA, 20 bp, Artificial
  CRISPR gRNA sequence
ggcatgtcctatgtcaacag

SEQ ID NO: 569837 - DNA, 20 bp, Artificial
  CRISPR gRNA sequence
tgtcaacaggcaacagggaa

SEQ ID NO: 569838 - DNA, 20 bp, Artificial
  CRISPR gRNA sequence
agacaacaatgaaataccac

SEQ ID NO: 569839 - DNA, 20 bp, Artificial
  CRISPR gRNA sequence
cacgcctatcacactggcca

SEQ ID NO: 569840 - DNA, 20 bp, Artificial
  CRISPR gRNA sequence
acgcctatcacactggccaa

SEQ ID NO: 569841 - DNA, 20 bp, Artificial
  CRISPR gRNA sequence
tcacactggccaaaatctag

SEQ ID NO: 569842 - DNA, 20 bp, Artificial
  CRISPR gRNA sequence
gccaaaatctagaacactga

SEQ ID NO: 569843 - DNA, 20 bp, Artificial
  CRISPR gRNA sequence
gaacactgacagcaccaaat

SEQ ID NO: 569844 - DNA, 20 bp, Artificial
  CRISPR gRNA sequence
acagcaccaaatgccagtga

SEQ ID NO: 569845 - DNA, 20 bp, Artificial
  CRISPR gRNA sequence
tcattcattgcaggtgggaa

SEQ ID NO: 569846 - DNA, 20 bp, Artificial
  CRISPR gRNA sequence
attcattgcaggtgggaatg

SEQ ID NO: 569847 - DNA, 20 bp, Artificial
  CRISPR gRNA sequence
attgcaggtgggaatgcaaa

SEQ ID NO: 569848 - DNA, 20 bp, Artificial
  CRISPR gRNA sequence
caggtgggaatgcaaaatgg

SEQ ID NO: 569849 - DNA, 20 bp, Artificial
  CRISPR gRNA sequence
tggaagacagtttggcagtt

SEQ ID NO: 569850 - DNA, 20 bp, Artificial
  CRISPR gRNA sequence
ggaagacagtttggcagttt

SEQ ID NO: 569851 - DNA, 20 bp, Artificial
  CRISPR gRNA sequence
gaagacagtttggcagtttc

SEQ ID NO: 569852 - DNA, 20 bp, Artificial
  CRISPR gRNA sequence
ggcagtttcttacaaaactg

SEQ ID NO: 569853 - DNA, 20 bp, Artificial
  CRISPR gRNA sequence
gcagtttcttacaaaactgt

SEQ ID NO: 569854 - DNA, 20 bp, Artificial
  CRISPR gRNA sequence
cttacaaaactgtatgtact

SEQ ID NO: 569855 - DNA, 20 bp, Artificial
  CRISPR gRNA sequence
ttacaaaactgtatgtactc

SEQ ID NO: 569856 - DNA, 20 bp, Artificial
  CRISPR gRNA sequence
acaaaactgtatgtactctt

SEQ ID NO: 569857 - DNA, 20 bp, Artificial
  CRISPR gRNA sequence
caaaactgtatgtactctta

SEQ ID NO: 569858 - DNA, 20 bp, Artificial
  CRISPR gRNA sequence
tatgtactcttaccattcaa

SEQ ID NO: 569859 - DNA, 20 bp, Artificial
  CRISPR gRNA sequence
ttaccattcaacacaactgt

SEQ ID NO: 569860 - DNA, 20 bp, Artificial
  CRISPR gRNA sequence
accattcaacacaactgtca

SEQ ID NO: 569861 - DNA, 20 bp, Artificial
  CRISPR gRNA sequence
ccattcaacacaactgtcat

SEQ ID NO: 569862 - DNA, 20 bp, Artificial
  CRISPR gRNA sequence
aacacaactgtcatgcttct

SEQ ID NO: 569863 - DNA, 20 bp, Artificial
  CRISPR gRNA sequence
tcatgcttcttgctatttac

SEQ ID NO: 569864 - DNA, 20 bp, Artificial
  CRISPR gRNA sequence
cttgctatttacccgaaggc

SEQ ID NO: 569865 - DNA, 20 bp, Artificial
  CRISPR gRNA sequence
ttgctatttacccgaaggca

SEQ ID NO: 569866 - DNA, 20 bp, Artificial
  CRISPR gRNA sequence
gctatttacccgaaggcatt

SEQ ID NO: 569867 - DNA, 20 bp, Artificial
  CRISPR gRNA sequence
ctatttacccgaaggcatta

SEQ ID NO: 569868 - DNA, 20 bp, Artificial
  CRISPR gRNA sequence
tttacccgaaggcattaaaa

SEQ ID NO: 569869 - DNA, 20 bp, Artificial
  CRISPR gRNA sequence
acccgaaggcattaaaaact

SEQ ID NO: 569870 - DNA, 20 bp, Artificial
  CRISPR gRNA sequence
cccgaaggcattaaaaactt

SEQ ID NO: 569871 - DNA, 20 bp, Artificial
  CRISPR gRNA sequence
aaaacttatgttgacataaa

SEQ ID NO: 569872 - DNA, 20 bp, Artificial
  CRISPR gRNA sequence
atgttgacataaaaaccttc

SEQ ID NO: 569873 - DNA, 20 bp, Artificial
  CRISPR gRNA sequence
tgttgacataaaaaccttca

SEQ ID NO: 569874 - DNA, 20 bp, Artificial
  CRISPR gRNA sequence
acataaaaaccttcacatgg

SEQ ID NO: 569875 - DNA, 20 bp, Artificial
  CRISPR gRNA sequence
cacatggatggttatagcat

SEQ ID NO: 569876 - DNA, 20 bp, Artificial
  CRISPR gRNA sequence
acatggatggttatagcatc

SEQ ID NO: 569877 - DNA, 20 bp, Artificial
  CRISPR gRNA sequence
tagcatctttattaataatt

SEQ ID NO: 569878 - DNA, 20 bp, Artificial
  CRISPR gRNA sequence
tattaataattgtcaaaact

SEQ ID NO: 569879 - DNA, 20 bp, Artificial
  CRISPR gRNA sequence
attaataattgtcaaaactt

SEQ ID NO: 569880 - DNA, 20 bp, Artificial
  CRISPR gRNA sequence
ttaataattgtcaaaacttg

SEQ ID NO: 569881 - DNA, 20 bp, Artificial
  CRISPR gRNA sequence
ataattgtcaaaacttggaa

SEQ ID NO: 569882 - DNA, 20 bp, Artificial
  CRISPR gRNA sequence
tcaaaacttggaagcaacca

SEQ ID NO: 569883 - DNA, 20 bp, Artificial
  CRISPR gRNA sequence
ggaagcaaccaagatgtcct

SEQ ID NO: 569884 - DNA, 20 bp, Artificial
  CRISPR gRNA sequence
gaagcaaccaagatgtcctt

SEQ ID NO: 569885 - DNA, 20 bp, Artificial
  CRISPR gRNA sequence
cagtaagtgaatggacaaat

SEQ ID NO: 569886 - DNA, 20 bp, Artificial
  CRISPR gRNA sequence
agtaagtgaatggacaaata

SEQ ID NO: 569887 - DNA, 20 bp, Artificial
  CRISPR gRNA sequence
tggtacatacagacaataga

SEQ ID NO: 569888 - DNA, 20 bp, Artificial
  CRISPR gRNA sequence
ttcagcactgaaaagaacta

SEQ ID NO: 569889 - DNA, 20 bp, Artificial
  CRISPR gRNA sequence
agcactgaaaagaactatca

SEQ ID NO: 569890 - DNA, 20 bp, Artificial
  CRISPR gRNA sequence
aaaagaactatcaagccatg

SEQ ID NO: 569891 - DNA, 20 bp, Artificial
  CRISPR gRNA sequence
tcaagccatgaaaagacatg

SEQ ID NO: 569892 - DNA, 20 bp, Artificial
  CRISPR gRNA sequence
aaatgcatattataagtcaa

SEQ ID NO: 569893 - DNA, 20 bp, Artificial
  CRISPR gRNA sequence
aatgcatattataagtcaaa

SEQ ID NO: 569894 - DNA, 20 bp, Artificial
  CRISPR gRNA sequence
taagtcaaagaatccaatct

SEQ ID NO: 569895 - DNA, 20 bp, Artificial
  CRISPR gRNA sequence
aacaggctacatgctatgca

SEQ ID NO: 569896 - DNA, 20 bp, Artificial
  CRISPR gRNA sequence
catgctatgcaaattttacc

SEQ ID NO: 569897 - DNA, 20 bp, Artificial
  CRISPR gRNA sequence
tgcaaattttacctatgtga

SEQ ID NO: 569898 - DNA, 20 bp, Artificial
  CRISPR gRNA sequence
tacctatgtgacattctgga

SEQ ID NO: 569899 - DNA, 20 bp, Artificial
  CRISPR gRNA sequence
acctatgtgacattctggaa

SEQ ID NO: 569900 - DNA, 20 bp, Artificial
  CRISPR gRNA sequence
cctatgtgacattctggaaa

SEQ ID NO: 569901 - DNA, 20 bp, Artificial
  CRISPR gRNA sequence
tgtgacattctggaaaaggc

SEQ ID NO: 569902 - DNA, 20 bp, Artificial
  CRISPR gRNA sequence
tggaaaaggcaaaactgtgg

SEQ ID NO: 569903 - DNA, 20 bp, Artificial
  CRISPR gRNA sequence
gaaaaggcaaaactgtggag

SEQ ID NO: 569904 - DNA, 20 bp, Artificial
  CRISPR gRNA sequence
tggagactgtaaaaagatta

SEQ ID NO: 569905 - DNA, 20 bp, Artificial
  CRISPR gRNA sequence
taaaaagattagtagttggc

SEQ ID NO: 569906 - DNA, 20 bp, Artificial
  CRISPR gRNA sequence
gtagttggcaggggatatga

SEQ ID NO: 569907 - DNA, 20 bp, Artificial
  CRISPR gRNA sequence
gcaggggatatgaataggtg

SEQ ID NO: 569908 - DNA, 20 bp, Artificial
  CRISPR gRNA sequence
gggggcagtgaaaatactct

SEQ ID NO: 569909 - DNA, 20 bp, Artificial
  CRISPR gRNA sequence
ggggcagtgaaaatactctg

SEQ ID NO: 569910 - DNA, 20 bp, Artificial
  CRISPR gRNA sequence
tgtatgatactgtaacgatg

SEQ ID NO: 569911 - DNA, 20 bp, Artificial
  CRISPR gRNA sequence
tatgatactgtaacgatgtt

SEQ ID NO: 569912 - DNA, 20 bp, Artificial
  CRISPR gRNA sequence
taacgatgttattatacatt

SEQ ID NO: 569913 - DNA, 20 bp, Artificial
  CRISPR gRNA sequence
ttatacatttgtccaaaccc

SEQ ID NO: 569914 - DNA, 20 bp, Artificial
  CRISPR gRNA sequence
tacatttgtccaaacccaca

SEQ ID NO: 569915 - DNA, 20 bp, Artificial
  CRISPR gRNA sequence
gtccaaacccacagaatgta

SEQ ID NO: 569916 - DNA, 20 bp, Artificial
  CRISPR gRNA sequence
tccaaacccacagaatgtac

SEQ ID NO: 569917 - DNA, 20 bp, Artificial
  CRISPR gRNA sequence
aatgctaatgtaaagtgtgg

SEQ ID NO: 569918 - DNA, 20 bp, Artificial
  CRISPR gRNA sequence
atgtaaagtgtggatttttt

SEQ ID NO: 569919 - DNA, 20 bp, Artificial
  CRISPR gRNA sequence
tttaatgataatgatgtatc

SEQ ID NO: 569920 - DNA, 20 bp, Artificial
  CRISPR gRNA sequence
ttaatgataatgatgtatca

SEQ ID NO: 569921 - DNA, 20 bp, Artificial
  CRISPR gRNA sequence
taatgataatgatgtatcag

SEQ ID NO: 569922 - DNA, 20 bp, Artificial
  CRISPR gRNA sequence
aatgataatgatgtatcaga

SEQ ID NO: 569923 - DNA, 20 bp, Artificial
  CRISPR gRNA sequence
atgataatgatgtatcagaa

SEQ ID NO: 569924 - DNA, 20 bp, Artificial
  CRISPR gRNA sequence
cattaattctaaaaaatgta

SEQ ID NO: 569925 - DNA, 20 bp, Artificial
  CRISPR gRNA sequence
attaattctaaaaaatgtac

SEQ ID NO: 569926 - DNA, 20 bp, Artificial
  CRISPR gRNA sequence
attctaaaaaatgtaccact

SEQ ID NO: 569927 - DNA, 20 bp, Artificial
  CRISPR gRNA sequence
taaaaaatgtaccactctgg

SEQ ID NO: 569928 - DNA, 20 bp, Artificial
  CRISPR gRNA sequence
aaaaatgtaccactctggtg

SEQ ID NO: 569929 - DNA, 20 bp, Artificial
  CRISPR gRNA sequence
tggtgagggatattgataat

SEQ ID NO: 569930 - DNA, 20 bp, Artificial
  CRISPR gRNA sequence
gtgagggatattgataatgg

SEQ ID NO: 569931 - DNA, 20 bp, Artificial
  CRISPR gRNA sequence
ataatggggaggctatgcat

SEQ ID NO: 569932 - DNA, 20 bp, Artificial
  CRISPR gRNA sequence
tgcatgtgtaggggcaggat

SEQ ID NO: 569933 - DNA, 20 bp, Artificial
  CRISPR gRNA sequence
tctgtaacttctgctcagtt

SEQ ID NO: 569934 - DNA, 20 bp, Artificial
  CRISPR gRNA sequence
ctgtaacttctgctcagttt

SEQ ID NO: 569935 - DNA, 20 bp, Artificial
  CRISPR gRNA sequence
tgtaacttctgctcagtttt

SEQ ID NO: 569936 - DNA, 20 bp, Artificial
  CRISPR gRNA sequence
taacttctgctcagttttgt

SEQ ID NO: 569937 - DNA, 20 bp, Artificial
  CRISPR gRNA sequence
ctgctcagttttgttgtgaa

SEQ ID NO: 569938 - DNA, 20 bp, Artificial
  CRISPR gRNA sequence
tgctcagttttgttgtgaac

SEQ ID NO: 569939 - DNA, 20 bp, Artificial
  CRISPR gRNA sequence
ctcagttttgttgtgaacct

SEQ ID NO: 569940 - DNA, 20 bp, Artificial
  CRISPR gRNA sequence
agttttgttgtgaacctgaa

SEQ ID NO: 569941 - DNA, 20 bp, Artificial
  CRISPR gRNA sequence
tgttgtgaacctgaaactca

SEQ ID NO: 569942 - DNA, 20 bp, Artificial
  CRISPR gRNA sequence
gttgtgaacctgaaactcaa

SEQ ID NO: 569943 - DNA, 20 bp, Artificial
  CRISPR gRNA sequence
ttgtgaacctgaaactcaaa

SEQ ID NO: 569944 - DNA, 20 bp, Artificial
  CRISPR gRNA sequence
tgaacctgaaactcaaaata

SEQ ID NO: 569945 - DNA, 20 bp, Artificial
  CRISPR gRNA sequence
aaactcaaaatatttaaagc

SEQ ID NO: 569946 - DNA, 20 bp, Artificial
  CRISPR gRNA sequence
aaaatatttaaagccaagtg

SEQ ID NO: 569947 - DNA, 20 bp, Artificial
  CRISPR gRNA sequence
aaagccaagtgaagctaact

SEQ ID NO: 569948 - DNA, 20 bp, Artificial
  CRISPR gRNA sequence
aagccaagtgaagctaactt

SEQ ID NO: 569949 - DNA, 20 bp, Artificial
  CRISPR gRNA sequence
acttactaagccatgaatca

SEQ ID NO: 569950 - DNA, 20 bp, Artificial
  CRISPR gRNA sequence
actaagccatgaatcaagtt

SEQ ID NO: 569951 - DNA, 20 bp, Artificial
  CRISPR gRNA sequence
ctaagccatgaatcaagttt

SEQ ID NO: 569952 - DNA, 20 bp, Artificial
  CRISPR gRNA sequence
agccatgaatcaagtttgtg

SEQ ID NO: 569953 - DNA, 20 bp, Artificial
  CRISPR gRNA sequence
gtggaataaccccaaataga

SEQ ID NO: 569954 - DNA, 20 bp, Artificial
  CRISPR gRNA sequence
tggaataaccccaaatagag

SEQ ID NO: 569955 - DNA, 20 bp, Artificial
  CRISPR gRNA sequence
caagtgttttcaaaacatag

SEQ ID NO: 569956 - DNA, 20 bp, Artificial
  CRISPR gRNA sequence
tcaaaacatagtaatttggg

SEQ ID NO: 569957 - DNA, 20 bp, Artificial
  CRISPR gRNA sequence
caaaacatagtaatttgggt

SEQ ID NO: 569958 - DNA, 20 bp, Artificial
  CRISPR gRNA sequence
aaaacatagtaatttgggtg

SEQ ID NO: 569959 - DNA, 20 bp, Artificial
  CRISPR gRNA sequence
gggtgcatatttcaaggggc

SEQ ID NO: 569960 - DNA, 20 bp, Artificial
  CRISPR gRNA sequence
ggtgcatatttcaaggggct

SEQ ID NO: 569961 - DNA, 20 bp, Artificial
  CRISPR gRNA sequence
caaggggctgcattctaagg

SEQ ID NO: 569962 - DNA, 20 bp, Artificial
  CRISPR gRNA sequence
aaggggctgcattctaagga

SEQ ID NO: 569963 - DNA, 20 bp, Artificial
  CRISPR gRNA sequence
cattctaaggataaaaagaa

SEQ ID NO: 569964 - DNA, 20 bp, Artificial
  CRISPR gRNA sequence
taaggataaaaagaactata

SEQ ID NO: 569965 - DNA, 20 bp, Artificial
  CRISPR gRNA sequence
aggataaaaagaactataaa

SEQ ID NO: 569966 - DNA, 20 bp, Artificial
  CRISPR gRNA sequence
taaagaaaaaaattgtaatg

SEQ ID NO: 569967 - DNA, 20 bp, Artificial
  CRISPR gRNA sequence
taatgttttaagtaattatg

SEQ ID NO: 569968 - DNA, 20 bp, Artificial
  CRISPR gRNA sequence
taagtaattatgtagttagc

SEQ ID NO: 569969 - DNA, 20 bp, Artificial
  CRISPR gRNA sequence
aagtaattatgtagttagca

SEQ ID NO: 569970 - DNA, 20 bp, Artificial
  CRISPR gRNA sequence
agtaattatgtagttagcag

SEQ ID NO: 569971 - DNA, 20 bp, Artificial
  CRISPR gRNA sequence
tgtagttagcagtaatgctg

SEQ ID NO: 569972 - DNA, 20 bp, Artificial
  CRISPR gRNA sequence
gcagtaatgctggtatttgg

SEQ ID NO: 569973 - DNA, 20 bp, Artificial
  CRISPR gRNA sequence
gtatttggttactgttgagt

SEQ ID NO: 569974 - DNA, 20 bp, Artificial
  CRISPR gRNA sequence
ggttactgttgagtatgtat

SEQ ID NO: 569975 - DNA, 20 bp, Artificial
  CRISPR gRNA sequence
gttactgttgagtatgtatt

SEQ ID NO: 569976 - DNA, 20 bp, Artificial
  CRISPR gRNA sequence
ctgttgagtatgtattgcag

SEQ ID NO: 569977 - DNA, 20 bp, Artificial
  CRISPR gRNA sequence
ttgagtatgtattgcaggaa

SEQ ID NO: 569978 - DNA, 20 bp, Artificial
  CRISPR gRNA sequence
agtatgtattgcaggaaaat

SEQ ID NO: 569979 - DNA, 20 bp, Artificial
  CRISPR gRNA sequence
caggaaaatgcaaatgaata

SEQ ID NO: 569980 - DNA, 20 bp, Artificial
  CRISPR gRNA sequence
atattgttgttattgaatat

SEQ ID NO: 569981 - DNA, 20 bp, Artificial
  CRISPR gRNA sequence
tattgttgttattgaatatt

SEQ ID NO: 569982 - DNA, 20 bp, Artificial
  CRISPR gRNA sequence
ttgttattgaatattgggat

SEQ ID NO: 569983 - DNA, 20 bp, Artificial
  CRISPR gRNA sequence
ttattgaatattgggatgtt

SEQ ID NO: 569984 - DNA, 20 bp, Artificial
  CRISPR gRNA sequence
ttgaatattgggatgtttgg

SEQ ID NO: 569985 - DNA, 20 bp, Artificial
  CRISPR gRNA sequence
aatattgggatgtttggcat

SEQ ID NO: 569986 - DNA, 20 bp, Artificial
  CRISPR gRNA sequence
ggatgtttggcatgaaagaa

SEQ ID NO: 569987 - DNA, 20 bp, Artificial
  CRISPR gRNA sequence
ggcatgaaagaaaggagatt

SEQ ID NO: 569988 - DNA, 20 bp, Artificial
  CRISPR gRNA sequence
gcatgaaagaaaggagattc

SEQ ID NO: 569989 - DNA, 20 bp, Artificial
  CRISPR gRNA sequence
agctgtaaattgattaggtt

SEQ ID NO: 569990 - DNA, 20 bp, Artificial
  CRISPR gRNA sequence
taaattgattaggttaagta

SEQ ID NO: 569991 - DNA, 20 bp, Artificial
  CRISPR gRNA sequence
attaggttaagtaaacattg

SEQ ID NO: 569992 - DNA, 20 bp, Artificial
  CRISPR gRNA sequence
ggttaagtaaacattgtagc

SEQ ID NO: 569993 - DNA, 20 bp, Artificial
  CRISPR gRNA sequence
agtaaacattgtagccctgg

SEQ ID NO: 569994 - DNA, 20 bp, Artificial
  CRISPR gRNA sequence
tagccctggatttatttaaa

SEQ ID NO: 569995 - DNA, 20 bp, Artificial
  CRISPR gRNA sequence
gatttatttaaaggtattaa

SEQ ID NO: 569996 - DNA, 20 bp, Artificial
  CRISPR gRNA sequence
atttaaaggtattaatttga

SEQ ID NO: 569997 - DNA, 20 bp, Artificial
  CRISPR gRNA sequence
tttaaaggtattaatttgaa

SEQ ID NO: 569998 - DNA, 20 bp, Artificial
  CRISPR gRNA sequence
aaaggtattaatttgaacca

SEQ ID NO: 569999 - DNA, 20 bp, Artificial
  CRISPR gRNA sequence
aaggtattaatttgaaccat

SEQ ID NO: 570000 - DNA, 20 bp, Artificial
  CRISPR gRNA sequence
atttgaaccatatgaaattg

SEQ ID NO: 570001 - DNA, 20 bp, Artificial
  CRISPR gRNA sequence
gaaccatatgaaattgctgt

SEQ ID NO: 570002 - DNA, 20 bp, Artificial
  CRISPR gRNA sequence
aaccatatgaaattgctgtt

SEQ ID NO: 570003 - DNA, 20 bp, Artificial
  CRISPR gRNA sequence
ctgtttctctagtcaaaaac

SEQ ID NO: 570004 - DNA, 20 bp, Artificial
  CRISPR gRNA sequence
tttctctagtcaaaaaccat

SEQ ID NO: 570005 - DNA, 20 bp, Artificial
  CRISPR gRNA sequence
ctctagtcaaaaaccattga

SEQ ID NO: 570006 - DNA, 20 bp, Artificial
  CRISPR gRNA sequence
tctagtcaaaaaccattgaa

SEQ ID NO: 570007 - DNA, 20 bp, Artificial
  CRISPR gRNA sequence
tagtcaaaaaccattgaatc

SEQ ID NO: 570008 - DNA, 20 bp, Artificial
  CRISPR gRNA sequence
gtcaaaaaccattgaatctt

SEQ ID NO: 570009 - DNA, 20 bp, Artificial
  CRISPR gRNA sequence
aatcttggcagcttaatagg

SEQ ID NO: 570010 - DNA, 20 bp, Artificial
  CRISPR gRNA sequence
ggcagcttaatagggttcag

SEQ ID NO: 570011 - DNA, 20 bp, Artificial
  CRISPR gRNA sequence
gcagcttaatagggttcagc

SEQ ID NO: 570012 - DNA, 20 bp, Artificial
  CRISPR gRNA sequence
aatagggttcagcataatgc

SEQ ID NO: 570013 - DNA, 20 bp, Artificial
  CRISPR gRNA sequence
atagggttcagcataatgcc

SEQ ID NO: 570014 - DNA, 20 bp, Artificial
  CRISPR gRNA sequence
agcataatgccagcatgacc

SEQ ID NO: 570015 - DNA, 20 bp, Artificial
  CRISPR gRNA sequence
atgtattttgtctcttagaa

SEQ ID NO: 570016 - DNA, 20 bp, Artificial
  CRISPR gRNA sequence
tgtctcttagaaaattgtgt

SEQ ID NO: 570017 - DNA, 20 bp, Artificial
  CRISPR gRNA sequence
gtctcttagaaaattgtgta

SEQ ID NO: 570018 - DNA, 20 bp, Artificial
  CRISPR gRNA sequence
tctcttagaaaattgtgtat

SEQ ID NO: 570019 - DNA, 20 bp, Artificial
  CRISPR gRNA sequence
ttagaaaattgtgtatttcc

SEQ ID NO: 570020 - DNA, 20 bp, Artificial
  CRISPR gRNA sequence
agaaaattgtgtatttcctg

SEQ ID NO: 570021 - DNA, 20 bp, Artificial
  CRISPR gRNA sequence
gaaaattgtgtatttcctgg

SEQ ID NO: 570022 - DNA, 20 bp, Artificial
  CRISPR gRNA sequence
tgtatttcctggttctgtcc

SEQ ID NO: 570023 - DNA, 20 bp, Artificial
  CRISPR gRNA sequence
cctggttctgtccattgaaa

SEQ ID NO: 570024 - DNA, 20 bp, Artificial
  CRISPR gRNA sequence
ctggttctgtccattgaaat

SEQ ID NO: 570025 - DNA, 20 bp, Artificial
  CRISPR gRNA sequence
gttctgtccattgaaatgtt

SEQ ID NO: 570026 - DNA, 20 bp, Artificial
  CRISPR gRNA sequence
tgtccattgaaatgttctag

SEQ ID NO: 570027 - DNA, 20 bp, Artificial
  CRISPR gRNA sequence
tccattgaaatgttctagaa

SEQ ID NO: 570028 - DNA, 20 bp, Artificial
  CRISPR gRNA sequence
aaatgttctagaaacaagag

SEQ ID NO: 570029 - DNA, 20 bp, Artificial
  CRISPR gRNA sequence
tagaaacaagagccagtcct

SEQ ID NO: 570030 - DNA, 20 bp, Artificial
  CRISPR gRNA sequence
gaaacaagagccagtcctgt

SEQ ID NO: 570031 - DNA, 20 bp, Artificial
  CRISPR gRNA sequence
tagcaatttgcatgcttctt

SEQ ID NO: 570032 - DNA, 20 bp, Artificial
  CRISPR gRNA sequence
gcatgcttcttggttcttgg

SEQ ID NO: 570033 - DNA, 20 bp, Artificial
  CRISPR gRNA sequence
catgcttcttggttcttgga

SEQ ID NO: 570034 - DNA, 20 bp, Artificial
  CRISPR gRNA sequence
cttggttcttggacccagat

SEQ ID NO: 570035 - DNA, 20 bp, Artificial
  CRISPR gRNA sequence
ttggttcttggacccagatt

SEQ ID NO: 570036 - DNA, 20 bp, Artificial
  CRISPR gRNA sequence
ggttcttggacccagatttg

SEQ ID NO: 570037 - DNA, 20 bp, Artificial
  CRISPR gRNA sequence
gttcttggacccagatttga

SEQ ID NO: 570038 - DNA, 20 bp, Artificial
  CRISPR gRNA sequence
ttggacccagatttgagtga

SEQ ID NO: 570039 - DNA, 20 bp, Artificial
  CRISPR gRNA sequence
ggacccagatttgagtgacc

SEQ ID NO: 570040 - DNA, 20 bp, Artificial
  CRISPR gRNA sequence
gacccagatttgagtgacca

SEQ ID NO: 570041 - DNA, 20 bp, Artificial
  CRISPR gRNA sequence
gagtgaccagtgttacctgg

SEQ ID NO: 570042 - DNA, 20 bp, Artificial
  CRISPR gRNA sequence
agtgaccagtgttacctggt

SEQ ID NO: 570043 - DNA, 20 bp, Artificial
  CRISPR gRNA sequence
cctggtgtgcccagacttcc

SEQ ID NO: 570044 - DNA, 20 bp, Artificial
  CRISPR gRNA sequence
gtgtgcccagacttcccagt

SEQ ID NO: 570045 - DNA, 20 bp, Artificial
  CRISPR gRNA sequence
cccagtttcagcacccgaat

SEQ ID NO: 570046 - DNA, 20 bp, Artificial
  CRISPR gRNA sequence
ccagtttcagcacccgaatt

SEQ ID NO: 570047 - DNA, 20 bp, Artificial
  CRISPR gRNA sequence
cagcacccgaatttcatatc

SEQ ID NO: 570048 - DNA, 20 bp, Artificial
  CRISPR gRNA sequence
agcacccgaatttcatatcc

SEQ ID NO: 570049 - DNA, 20 bp, Artificial
  CRISPR gRNA sequence
catatcccaggaaactcttc

SEQ ID NO: 570050 - DNA, 20 bp, Artificial
  CRISPR gRNA sequence
atatcccaggaaactcttca

SEQ ID NO: 570051 - DNA, 20 bp, Artificial
  CRISPR gRNA sequence
ttcagtttcaggaaaaccag

SEQ ID NO: 570052 - DNA, 20 bp, Artificial
  CRISPR gRNA sequence
cagtttcaggaaaaccagga

SEQ ID NO: 570053 - DNA, 20 bp, Artificial
  CRISPR gRNA sequence
agtttcaggaaaaccaggat

SEQ ID NO: 570054 - DNA, 20 bp, Artificial
  CRISPR gRNA sequence
caggaaaaccaggatgattg

SEQ ID NO: 570055 - DNA, 20 bp, Artificial
  CRISPR gRNA sequence
aggaaaaccaggatgattgg

SEQ ID NO: 570056 - DNA, 20 bp, Artificial
  CRISPR gRNA sequence
gccaccttcacccagattat

SEQ ID NO: 570057 - DNA, 20 bp, Artificial
  CRISPR gRNA sequence
cacccagattatggtaccta

SEQ ID NO: 570058 - DNA, 20 bp, Artificial
  CRISPR gRNA sequence
acccagattatggtacctaa

SEQ ID NO: 570059 - DNA, 20 bp, Artificial
  CRISPR gRNA sequence
tggtacctaattatcatttc

SEQ ID NO: 570060 - DNA, 20 bp, Artificial
  CRISPR gRNA sequence
attatcatttcccatgaaaa

SEQ ID NO: 570061 - DNA, 20 bp, Artificial
  CRISPR gRNA sequence
tcatttcccatgaaaatgaa

SEQ ID NO: 570062 - DNA, 20 bp, Artificial
  CRISPR gRNA sequence
cccatgaaaatgaactaggg

SEQ ID NO: 570063 - DNA, 20 bp, Artificial
  CRISPR gRNA sequence
ccatgaaaatgaactagggc

SEQ ID NO: 570064 - DNA, 20 bp, Artificial
  CRISPR gRNA sequence
gggcctttgggacagttggc

SEQ ID NO: 570065 - DNA, 20 bp, Artificial
  CRISPR gRNA sequence
tgggacagttggctgattcc

SEQ ID NO: 570066 - DNA, 20 bp, Artificial
  CRISPR gRNA sequence
gggacagttggctgattcca

SEQ ID NO: 570067 - DNA, 20 bp, Artificial
  CRISPR gRNA sequence
ggacagttggctgattccat

SEQ ID NO: 570068 - DNA, 20 bp, Artificial
  CRISPR gRNA sequence
gctgattccatacctggggc

SEQ ID NO: 570069 - DNA, 20 bp, Artificial
  CRISPR gRNA sequence
attccatacctggggcatgg

SEQ ID NO: 570070 - DNA, 20 bp, Artificial
  CRISPR gRNA sequence
catacctggggcatggaatg

SEQ ID NO: 570071 - DNA, 20 bp, Artificial
  CRISPR gRNA sequence
gggcatggaatgcattaaaa

SEQ ID NO: 570072 - DNA, 20 bp, Artificial
  CRISPR gRNA sequence
aaataagccttgagtatctt

SEQ ID NO: 570073 - DNA, 20 bp, Artificial
  CRISPR gRNA sequence
gagtatcttattttaccaca

SEQ ID NO: 570074 - DNA, 20 bp, Artificial
  CRISPR gRNA sequence
agtatcttattttaccacag

SEQ ID NO: 570075 - DNA, 20 bp, Artificial
  CRISPR gRNA sequence
attttaccacagaacaagaa

SEQ ID NO: 570076 - DNA, 20 bp, Artificial
  CRISPR gRNA sequence
ttttaccacagaacaagaaa

SEQ ID NO: 570077 - DNA, 20 bp, Artificial
  CRISPR gRNA sequence
taccacagaacaagaaagct

SEQ ID NO: 570078 - DNA, 20 bp, Artificial
  CRISPR gRNA sequence
accacagaacaagaaagcta

SEQ ID NO: 570079 - DNA, 20 bp, Artificial
  CRISPR gRNA sequence
ccacagaacaagaaagctat

SEQ ID NO: 570080 - DNA, 20 bp, Artificial
  CRISPR gRNA sequence
tcaaaaagacttaacatgat

SEQ ID NO: 570081 - DNA, 20 bp, Artificial
  CRISPR gRNA sequence
aacatgatggtacgaacagg

SEQ ID NO: 570082 - DNA, 20 bp, Artificial
  CRISPR gRNA sequence
acatgatggtacgaacagga

SEQ ID NO: 570083 - DNA, 20 bp, Artificial
  CRISPR gRNA sequence
aggagccactctgaagaggt

SEQ ID NO: 570084 - DNA, 20 bp, Artificial
  CRISPR gRNA sequence
tgaagaggttccctctggcc

SEQ ID NO: 570085 - DNA, 20 bp, Artificial
  CRISPR gRNA sequence
aagaggttccctctggccaa

SEQ ID NO: 570086 - DNA, 20 bp, Artificial
  CRISPR gRNA sequence
cctctggccaaaaataagac

SEQ ID NO: 570087 - DNA, 20 bp, Artificial
  CRISPR gRNA sequence
tggccaaaaataagacaatt

SEQ ID NO: 570088 - DNA, 20 bp, Artificial
  CRISPR gRNA sequence
gccaaaaataagacaattgg

SEQ ID NO: 570089 - DNA, 20 bp, Artificial
  CRISPR gRNA sequence
gaacatcaataagaataaca

SEQ ID NO: 570090 - DNA, 20 bp, Artificial
  CRISPR gRNA sequence
cagtagattgaaacacatca

SEQ ID NO: 570091 - DNA, 20 bp, Artificial
  CRISPR gRNA sequence
agtagattgaaacacatcag

SEQ ID NO: 570092 - DNA, 20 bp, Artificial
  CRISPR gRNA sequence
aaacacatcagttgtgctca

SEQ ID NO: 570093 - DNA, 20 bp, Artificial
  CRISPR gRNA sequence
tgctcagttcatgcgttcat

SEQ ID NO: 570094 - DNA, 20 bp, Artificial
  CRISPR gRNA sequence
agttcatgcgttcataatgt

SEQ ID NO: 570095 - DNA, 20 bp, Artificial
  CRISPR gRNA sequence
atgcgttcataatgtactaa

SEQ ID NO: 570096 - DNA, 20 bp, Artificial
  CRISPR gRNA sequence
ataatgtactaaaaacaaat

SEQ ID NO: 570097 - DNA, 20 bp, Artificial
  CRISPR gRNA sequence
aaaacaaatttaaaaactca

SEQ ID NO: 570098 - DNA, 20 bp, Artificial
  CRISPR gRNA sequence
aaaaactcactggtcatctc

SEQ ID NO: 570099 - DNA, 20 bp, Artificial
  CRISPR gRNA sequence
aaaactcactggtcatctct

SEQ ID NO: 570100 - DNA, 20 bp, Artificial
  CRISPR gRNA sequence
actggtcatctctagagaat

SEQ ID NO: 570101 - DNA, 20 bp, Artificial
  CRISPR gRNA sequence
gtcatctctagagaatgctt

SEQ ID NO: 570102 - DNA, 20 bp, Artificial
  CRISPR gRNA sequence
tagagaatgcttgggagcta

SEQ ID NO: 570103 - DNA, 20 bp, Artificial
  CRISPR gRNA sequence
gagaatgcttgggagctaac

SEQ ID NO: 570104 - DNA, 20 bp, Artificial
  CRISPR gRNA sequence
gggagctaactcattatttt

SEQ ID NO: 570105 - DNA, 20 bp, Artificial
  CRISPR gRNA sequence
ggagctaactcattattttg

SEQ ID NO: 570106 - DNA, 20 bp, Artificial
  CRISPR gRNA sequence
actcattattttgaaaaacg

SEQ ID NO: 570107 - DNA, 20 bp, Artificial
  CRISPR gRNA sequence
attattttgaaaaacgataa

SEQ ID NO: 570108 - DNA, 20 bp, Artificial
  CRISPR gRNA sequence
ttttgaaaaacgataaagaa

SEQ ID NO: 570109 - DNA, 20 bp, Artificial
  CRISPR gRNA sequence
tgaaaaacgataaagaaaga

SEQ ID NO: 570110 - DNA, 20 bp, Artificial
  CRISPR gRNA sequence
gaaaaacgataaagaaagag

SEQ ID NO: 570111 - DNA, 20 bp, Artificial
  CRISPR gRNA sequence
aaaaacgataaagaaagaga

SEQ ID NO: 570112 - DNA, 20 bp, Artificial
  CRISPR gRNA sequence
cttttcctatataaattgaa

SEQ ID NO: 570113 - DNA, 20 bp, Artificial
  CRISPR gRNA sequence
ttcctatataaattgaacct

SEQ ID NO: 570114 - DNA, 20 bp, Artificial
  CRISPR gRNA sequence
tcctatataaattgaacctc

SEQ ID NO: 570115 - DNA, 20 bp, Artificial
  CRISPR gRNA sequence
cctatataaattgaacctca

SEQ ID NO: 570116 - DNA, 20 bp, Artificial
  CRISPR gRNA sequence
ctatataaattgaacctcag

SEQ ID NO: 570117 - DNA, 20 bp, Artificial
  CRISPR gRNA sequence
tataaattgaacctcagagt

SEQ ID NO: 570118 - DNA, 20 bp, Artificial
  CRISPR gRNA sequence
aacctcagagtaaccacatt

SEQ ID NO: 570119 - DNA, 20 bp, Artificial
  CRISPR gRNA sequence
agagtaaccacattgttgat

SEQ ID NO: 570120 - DNA, 20 bp, Artificial
  CRISPR gRNA sequence
ttgatgaggggcagtttatc

SEQ ID NO: 570121 - DNA, 20 bp, Artificial
  CRISPR gRNA sequence
atgaggggcagtttatcttt

SEQ ID NO: 570122 - DNA, 20 bp, Artificial
  CRISPR gRNA sequence
atctttatgtgaagattgta

SEQ ID NO: 570123 - DNA, 20 bp, Artificial
  CRISPR gRNA sequence
tctttatgtgaagattgtag

SEQ ID NO: 570124 - DNA, 20 bp, Artificial
  CRISPR gRNA sequence
tatgtgaagattgtagttag

SEQ ID NO: 570125 - DNA, 20 bp, Artificial
  CRISPR gRNA sequence
atgtgaagattgtagttagt

SEQ ID NO: 570126 - DNA, 20 bp, Artificial
  CRISPR gRNA sequence
tgtgaagattgtagttagta

SEQ ID NO: 570127 - DNA, 20 bp, Artificial
  CRISPR gRNA sequence
tagttagtaaagaaggaatg

SEQ ID NO: 570128 - DNA, 20 bp, Artificial
  CRISPR gRNA sequence
gtaaagaaggaatgatagac

SEQ ID NO: 570129 - DNA, 20 bp, Artificial
  CRISPR gRNA sequence
aaccactttgcaaacccttg

SEQ ID NO: 570130 - DNA, 20 bp, Artificial
  CRISPR gRNA sequence
tgcaaacccttgatgaactt

SEQ ID NO: 570131 - DNA, 20 bp, Artificial
  CRISPR gRNA sequence
gcaaacccttgatgaactta

SEQ ID NO: 570132 - DNA, 20 bp, Artificial
  CRISPR gRNA sequence
caaacccttgatgaacttat

SEQ ID NO: 570133 - DNA, 20 bp, Artificial
  CRISPR gRNA sequence
gatgaacttatggctctaga

SEQ ID NO: 570134 - DNA, 20 bp, Artificial
  CRISPR gRNA sequence
atgaacttatggctctagac

SEQ ID NO: 570135 - DNA, 20 bp, Artificial
  CRISPR gRNA sequence
atggctctagacaatgatct

SEQ ID NO: 570136 - DNA, 20 bp, Artificial
  CRISPR gRNA sequence
tggctctagacaatgatctt

SEQ ID NO: 570137 - DNA, 20 bp, Artificial
  CRISPR gRNA sequence
tagacaatgatcttcagtgg

SEQ ID NO: 570138 - DNA, 20 bp, Artificial
  CRISPR gRNA sequence
gacaatgatcttcagtggca

SEQ ID NO: 570139 - DNA, 20 bp, Artificial
  CRISPR gRNA sequence
cagtggcactgacatcatga

SEQ ID NO: 570140 - DNA, 20 bp, Artificial
  CRISPR gRNA sequence
agtggcactgacatcatgaa

SEQ ID NO: 570141 - DNA, 20 bp, Artificial
  CRISPR gRNA sequence
acatcatgaaaagaaaagca

SEQ ID NO: 570142 - DNA, 20 bp, Artificial
  CRISPR gRNA sequence
agggaagtatacaaacacta

SEQ ID NO: 570143 - DNA, 20 bp, Artificial
  CRISPR gRNA sequence
cttggggagtattattgcca

SEQ ID NO: 570144 - DNA, 20 bp, Artificial
  CRISPR gRNA sequence
ggggagtattattgccaagg

SEQ ID NO: 570145 - DNA, 20 bp, Artificial
  CRISPR gRNA sequence
gggagtattattgccaagga

SEQ ID NO: 570146 - DNA, 20 bp, Artificial
  CRISPR gRNA sequence
ttgccaaggaatatctgaat

SEQ ID NO: 570147 - DNA, 20 bp, Artificial
  CRISPR gRNA sequence
ccaaggaatatctgaatttt

SEQ ID NO: 570148 - DNA, 20 bp, Artificial
  CRISPR gRNA sequence
aattttgctactaaagaagg

SEQ ID NO: 570149 - DNA, 20 bp, Artificial
  CRISPR gRNA sequence
tgctactaaagaagggaaaa

SEQ ID NO: 570150 - DNA, 20 bp, Artificial
  CRISPR gRNA sequence
gctactaaagaagggaaaat

SEQ ID NO: 570151 - DNA, 20 bp, Artificial
  CRISPR gRNA sequence
ctactaaagaagggaaaatg

SEQ ID NO: 570152 - DNA, 20 bp, Artificial
  CRISPR gRNA sequence
ctaaagaagggaaaatgatg

SEQ ID NO: 570153 - DNA, 20 bp, Artificial
  CRISPR gRNA sequence
aagaagggaaaatgatgttc

SEQ ID NO: 570154 - DNA, 20 bp, Artificial
  CRISPR gRNA sequence
gggggcacctagcagtttct

SEQ ID NO: 570155 - DNA, 20 bp, Artificial
  CRISPR gRNA sequence
gcagtttctggccagggtct

SEQ ID NO: 570156 - DNA, 20 bp, Artificial
  CRISPR gRNA sequence
ctggccagggtcttctcaaa

SEQ ID NO: 570157 - DNA, 20 bp, Artificial
  CRISPR gRNA sequence
tggccagggtcttctcaaat

SEQ ID NO: 570158 - DNA, 20 bp, Artificial
  CRISPR gRNA sequence
gccagggtcttctcaaatct

SEQ ID NO: 570159 - DNA, 20 bp, Artificial
  CRISPR gRNA sequence
ctcaaatctgaccaataggt

SEQ ID NO: 570160 - DNA, 20 bp, Artificial
  CRISPR gRNA sequence
tcaaatctgaccaataggtg

SEQ ID NO: 570161 - DNA, 20 bp, Artificial
  CRISPR gRNA sequence
aaatctgaccaataggtgac

SEQ ID NO: 570162 - DNA, 20 bp, Artificial
  CRISPR gRNA sequence
accaataggtgactgcctat

SEQ ID NO: 570163 - DNA, 20 bp, Artificial
  CRISPR gRNA sequence
cctatttgctccaacacacc

SEQ ID NO: 570164 - DNA, 20 bp, Artificial
  CRISPR gRNA sequence
tttgctccaacacacctgtg

SEQ ID NO: 570165 - DNA, 20 bp, Artificial
  CRISPR gRNA sequence
gctccaacacacctgtgttc

SEQ ID NO: 570166 - DNA, 20 bp, Artificial
  CRISPR gRNA sequence
ctccaacacacctgtgttcc

SEQ ID NO: 570167 - DNA, 20 bp, Artificial
  CRISPR gRNA sequence
caacacacctgtgttcctaa

SEQ ID NO: 570168 - DNA, 20 bp, Artificial
  CRISPR gRNA sequence
tgttcctaataaaaggaaag

SEQ ID NO: 570169 - DNA, 20 bp, Artificial
  CRISPR gRNA sequence
ctaataaaaggaaagtgtga

SEQ ID NO: 570170 - DNA, 20 bp, Artificial
  CRISPR gRNA sequence
ataaaaggaaagtgtgatca

SEQ ID NO: 570171 - DNA, 20 bp, Artificial
  CRISPR gRNA sequence
attctcatttattcattcat

SEQ ID NO: 570172 - DNA, 20 bp, Artificial
  CRISPR gRNA sequence
ttctcatttattcattcatt

SEQ ID NO: 570173 - DNA, 20 bp, Artificial
  CRISPR gRNA sequence
tcatttattcattcattttc

SEQ ID NO: 570174 - DNA, 20 bp, Artificial
  CRISPR gRNA sequence
atttattcattcattttctc

SEQ ID NO: 570175 - DNA, 20 bp, Artificial
  CRISPR gRNA sequence
attcattcattttctctctc

SEQ ID NO: 570176 - DNA, 20 bp, Artificial
  CRISPR gRNA sequence
ttcattcattttctctctct

SEQ ID NO: 570177 - DNA, 20 bp, Artificial
  CRISPR gRNA sequence
attcattttctctctctctt

SEQ ID NO: 570178 - DNA, 20 bp, Artificial
  CRISPR gRNA sequence
attttctctctctcttcctc

SEQ ID NO: 570179 - DNA, 20 bp, Artificial
  CRISPR gRNA sequence
tctctctctcttcctcctct

SEQ ID NO: 570180 - DNA, 20 bp, Artificial
  CRISPR gRNA sequence
ctctctctcttcctcctctc

SEQ ID NO: 570181 - DNA, 20 bp, Artificial
  CRISPR gRNA sequence
tctctctcttcctcctctcc

SEQ ID NO: 570182 - DNA, 20 bp, Artificial
  CRISPR gRNA sequence
tctctcttcctcctctccct

SEQ ID NO: 570183 - DNA, 20 bp, Artificial
  CRISPR gRNA sequence
tctcttcctcctctcccttc

SEQ ID NO: 570184 - DNA, 20 bp, Artificial
  CRISPR gRNA sequence
tcttcctcctctcccttcct

SEQ ID NO: 570185 - DNA, 20 bp, Artificial
  CRISPR gRNA sequence
ttcctcctctcccttccttt

SEQ ID NO: 570186 - DNA, 20 bp, Artificial
  CRISPR gRNA sequence
cctcctctcccttcctttcc

SEQ ID NO: 570187 - DNA, 20 bp, Artificial
  CRISPR gRNA sequence
ctcctctcccttcctttccc

SEQ ID NO: 570188 - DNA, 20 bp, Artificial
  CRISPR gRNA sequence
ctctcccttcctttcccttc

SEQ ID NO: 570189 - DNA, 20 bp, Artificial
  CRISPR gRNA sequence
tcccttcctttcccttcctt

SEQ ID NO: 570190 - DNA, 20 bp, Artificial
  CRISPR gRNA sequence
ccttcctttcccttcctttc

SEQ ID NO: 570191 - DNA, 20 bp, Artificial
  CRISPR gRNA sequence
cctttcccttcctttcccat

SEQ ID NO: 570192 - DNA, 20 bp, Artificial
  CRISPR gRNA sequence
ctttcccttcctttcccata

SEQ ID NO: 570193 - DNA, 20 bp, Artificial
  CRISPR gRNA sequence
tcccttcctttcccatatcc

SEQ ID NO: 570194 - DNA, 20 bp, Artificial
  CRISPR gRNA sequence
cccttcctttcccatatcca

SEQ ID NO: 570195 - DNA, 20 bp, Artificial
  CRISPR gRNA sequence
ccttcctttcccatatccat

SEQ ID NO: 570196 - DNA, 20 bp, Artificial
  CRISPR gRNA sequence
cctttcccatatccatgtca

SEQ ID NO: 570197 - DNA, 20 bp, Artificial
  CRISPR gRNA sequence
ctttcccatatccatgtcac

SEQ ID NO: 570198 - DNA, 20 bp, Artificial
  CRISPR gRNA sequence
tcccatatccatgtcacatt

SEQ ID NO: 570199 - DNA, 20 bp, Artificial
  CRISPR gRNA sequence
cccatatccatgtcacattt

SEQ ID NO: 570200 - DNA, 20 bp, Artificial
  CRISPR gRNA sequence
ccatatccatgtcacatttg

SEQ ID NO: 570201 - DNA, 20 bp, Artificial
  CRISPR gRNA sequence
gttcttagtgacccctcccc

SEQ ID NO: 570202 - DNA, 20 bp, Artificial
  CRISPR gRNA sequence
ttcttagtgacccctcccca

SEQ ID NO: 570203 - DNA, 20 bp, Artificial
  CRISPR gRNA sequence
ttagtgacccctccccaatc

SEQ ID NO: 570204 - DNA, 20 bp, Artificial
  CRISPR gRNA sequence
agtgacccctccccaatcct

SEQ ID NO: 570205 - DNA, 20 bp, Artificial
  CRISPR gRNA sequence
gtgacccctccccaatcctt

SEQ ID NO: 570206 - DNA, 20 bp, Artificial
  CRISPR gRNA sequence
cccaatcctttagcagtgca

SEQ ID NO: 570207 - DNA, 20 bp, Artificial
  CRISPR gRNA sequence
tagcagtgcattgtgtactc

SEQ ID NO: 570208 - DNA, 20 bp, Artificial
  CRISPR gRNA sequence
agcagtgcattgtgtactct

SEQ ID NO: 570209 - DNA, 20 bp, Artificial
  CRISPR gRNA sequence
gcagtgcattgtgtactctg

SEQ ID NO: 570210 - DNA, 20 bp, Artificial
  CRISPR gRNA sequence
tgtactctgattttggattt

SEQ ID NO: 570211 - DNA, 20 bp, Artificial
  CRISPR gRNA sequence
tgattttggattttcaatag

SEQ ID NO: 570212 - DNA, 20 bp, Artificial
  CRISPR gRNA sequence
attttggattttcaatagct

SEQ ID NO: 570213 - DNA, 20 bp, Artificial
  CRISPR gRNA sequence
tggattttcaatagctggat

SEQ ID NO: 570214 - DNA, 20 bp, Artificial
  CRISPR gRNA sequence
ggattttcaatagctggata

SEQ ID NO: 570215 - DNA, 20 bp, Artificial
  CRISPR gRNA sequence
gattttcaatagctggatag

SEQ ID NO: 570216 - DNA, 20 bp, Artificial
  CRISPR gRNA sequence
tcaatagctggatagagttt

SEQ ID NO: 570217 - DNA, 20 bp, Artificial
  CRISPR gRNA sequence
caatagctggatagagttta

SEQ ID NO: 570218 - DNA, 20 bp, Artificial
  CRISPR gRNA sequence
aatagctggatagagtttac

SEQ ID NO: 570219 - DNA, 20 bp, Artificial
  CRISPR gRNA sequence
gatagagtttaccttgtgaa

SEQ ID NO: 570220 - DNA, 20 bp, Artificial
  CRISPR gRNA sequence
accttgtgaacataccacag

SEQ ID NO: 570221 - DNA, 20 bp, Artificial
  CRISPR gRNA sequence
ccttgtgaacataccacagt

SEQ ID NO: 570222 - DNA, 20 bp, Artificial
  CRISPR gRNA sequence
gtgaacataccacagttttt

SEQ ID NO: 570223 - DNA, 20 bp, Artificial
  CRISPR gRNA sequence
tgaacataccacagtttttt

SEQ ID NO: 570224 - DNA, 20 bp, Artificial
  CRISPR gRNA sequence
tttgtgaaaacaaggagctg

SEQ ID NO: 570225 - DNA, 20 bp, Artificial
  CRISPR gRNA sequence
ttgtgaaaacaaggagctgc

SEQ ID NO: 570226 - DNA, 20 bp, Artificial
  CRISPR gRNA sequence
tgtgaaaacaaggagctgct

SEQ ID NO: 570227 - DNA, 20 bp, Artificial
  CRISPR gRNA sequence
gtgaaaacaaggagctgctg

SEQ ID NO: 570228 - DNA, 20 bp, Artificial
  CRISPR gRNA sequence
tgaaaacaaggagctgctgt

SEQ ID NO: 570229 - DNA, 20 bp, Artificial
  CRISPR gRNA sequence
ctgtgaaaacaacttaggtt

SEQ ID NO: 570230 - DNA, 20 bp, Artificial
  CRISPR gRNA sequence
tgaaaacaacttaggttgtt

SEQ ID NO: 570231 - DNA, 20 bp, Artificial
  CRISPR gRNA sequence
aggttgtttttgccttatgg

SEQ ID NO: 570232 - DNA, 20 bp, Artificial
  CRISPR gRNA sequence
ggttgtttttgccttatggt

SEQ ID NO: 570233 - DNA, 20 bp, Artificial
  CRISPR gRNA sequence
tttttgccttatggtatatt

SEQ ID NO: 570234 - DNA, 20 bp, Artificial
  CRISPR gRNA sequence
ttgccttatggtatattaag

SEQ ID NO: 570235 - DNA, 20 bp, Artificial
  CRISPR gRNA sequence
tgccttatggtatattaagt

SEQ ID NO: 570236 - DNA, 20 bp, Artificial
  CRISPR gRNA sequence
gccttatggtatattaagta

SEQ ID NO: 570237 - DNA, 20 bp, Artificial
  CRISPR gRNA sequence
ccttatggtatattaagtaa

SEQ ID NO: 570238 - DNA, 20 bp, Artificial
  CRISPR gRNA sequence
atggtatattaagtaaggct

SEQ ID NO: 570239 - DNA, 20 bp, Artificial
  CRISPR gRNA sequence
tggtatattaagtaaggctg

SEQ ID NO: 570240 - DNA, 20 bp, Artificial
  CRISPR gRNA sequence
agtaaggctgcagtaaatat

SEQ ID NO: 570241 - DNA, 20 bp, Artificial
  CRISPR gRNA sequence
cagtaaatatctttgtgcct

SEQ ID NO: 570242 - DNA, 20 bp, Artificial
  CRISPR gRNA sequence
tgtgcctttttgcggggagt

SEQ ID NO: 570243 - DNA, 20 bp, Artificial
  CRISPR gRNA sequence
gtgcctttttgcggggagta

SEQ ID NO: 570244 - DNA, 20 bp, Artificial
  CRISPR gRNA sequence
tgcctttttgcggggagtag

SEQ ID NO: 570245 - DNA, 20 bp, Artificial
  CRISPR gRNA sequence
tttgcggggagtagaagggc

SEQ ID NO: 570246 - DNA, 20 bp, Artificial
  CRISPR gRNA sequence
ttgcggggagtagaagggca

SEQ ID NO: 570247 - DNA, 20 bp, Artificial
  CRISPR gRNA sequence
tgcggggagtagaagggcac

SEQ ID NO: 570248 - DNA, 20 bp, Artificial
  CRISPR gRNA sequence
gcggggagtagaagggcaca

SEQ ID NO: 570249 - DNA, 20 bp, Artificial
  CRISPR gRNA sequence
cggggagtagaagggcacat

SEQ ID NO: 570250 - DNA, 20 bp, Artificial
  CRISPR gRNA sequence
atattttccccaggataaca

SEQ ID NO: 570251 - DNA, 20 bp, Artificial
  CRISPR gRNA sequence
tccccaggataacatcttag

SEQ ID NO: 570252 - DNA, 20 bp, Artificial
  CRISPR gRNA sequence
ccccaggataacatcttaga

SEQ ID NO: 570253 - DNA, 20 bp, Artificial
  CRISPR gRNA sequence
cccaggataacatcttagaa

SEQ ID NO: 570254 - DNA, 20 bp, Artificial
  CRISPR gRNA sequence
agaaatggaattgcagagtc

SEQ ID NO: 570255 - DNA, 20 bp, Artificial
  CRISPR gRNA sequence
gaaatggaattgcagagtca

SEQ ID NO: 570256 - DNA, 20 bp, Artificial
  CRISPR gRNA sequence
cagagtcacaagatattaat

SEQ ID NO: 570257 - DNA, 20 bp, Artificial
  CRISPR gRNA sequence
atagagataccaataacatc

SEQ ID NO: 570258 - DNA, 20 bp, Artificial
  CRISPR gRNA sequence
ctcaataggttaatgacagt

SEQ ID NO: 570259 - DNA, 20 bp, Artificial
  CRISPR gRNA sequence
aataggttaatgacagtata

SEQ ID NO: 570260 - DNA, 20 bp, Artificial
  CRISPR gRNA sequence
atgacagtatataacagctg

SEQ ID NO: 570261 - DNA, 20 bp, Artificial
  CRISPR gRNA sequence
ttcttaaatgcaactaccct

SEQ ID NO: 570262 - DNA, 20 bp, Artificial
  CRISPR gRNA sequence
ttaaatgcaactaccctatg

SEQ ID NO: 570263 - DNA, 20 bp, Artificial
  CRISPR gRNA sequence
aaatgcaactaccctatgag

SEQ ID NO: 570264 - DNA, 20 bp, Artificial
  CRISPR gRNA sequence
aatgcaactaccctatgaga

SEQ ID NO: 570265 - DNA, 20 bp, Artificial
  CRISPR gRNA sequence
ccctatgagataagtatatt

SEQ ID NO: 570266 - DNA, 20 bp, Artificial
  CRISPR gRNA sequence
tgagataagtatatttatta

SEQ ID NO: 570267 - DNA, 20 bp, Artificial
  CRISPR gRNA sequence
attagtctcgagtatagtta

SEQ ID NO: 570268 - DNA, 20 bp, Artificial
  CRISPR gRNA sequence
ttagtctcgagtatagttac

SEQ ID NO: 570269 - DNA, 20 bp, Artificial
  CRISPR gRNA sequence
gtctcgagtatagttaccct

SEQ ID NO: 570270 - DNA, 20 bp, Artificial
  CRISPR gRNA sequence
gagtatagttaccctgtgag

SEQ ID NO: 570271 - DNA, 20 bp, Artificial
  CRISPR gRNA sequence
ccctgtgagaaaatggaggc

SEQ ID NO: 570272 - DNA, 20 bp, Artificial
  CRISPR gRNA sequence
tgagaaaatggaggcactga

SEQ ID NO: 570273 - DNA, 20 bp, Artificial
  CRISPR gRNA sequence
agaggttaaggcacttgccc

SEQ ID NO: 570274 - DNA, 20 bp, Artificial
  CRISPR gRNA sequence
aggcacttgcccaacattgt

SEQ ID NO: 570275 - DNA, 20 bp, Artificial
  CRISPR gRNA sequence
gcccaacattgtaatgactt

SEQ ID NO: 570276 - DNA, 20 bp, Artificial
  CRISPR gRNA sequence
cccaacattgtaatgactta

SEQ ID NO: 570277 - DNA, 20 bp, Artificial
  CRISPR gRNA sequence
taatgacttagtgagactat

SEQ ID NO: 570278 - DNA, 20 bp, Artificial
  CRISPR gRNA sequence
agtgagactataggcacatg

SEQ ID NO: 570279 - DNA, 20 bp, Artificial
  CRISPR gRNA sequence
gtgagactataggcacatga

SEQ ID NO: 570280 - DNA, 20 bp, Artificial
  CRISPR gRNA sequence
taggcacatgacttagtgca

SEQ ID NO: 570281 - DNA, 20 bp, Artificial
  CRISPR gRNA sequence
agtgcaatgtctagatgctt

SEQ ID NO: 570282 - DNA, 20 bp, Artificial
  CRISPR gRNA sequence
gtgcaatgtctagatgcttc

SEQ ID NO: 570283 - DNA, 20 bp, Artificial
  CRISPR gRNA sequence
gatgcttcatgataaatatt

SEQ ID NO: 570284 - DNA, 20 bp, Artificial
  CRISPR gRNA sequence
catgataaatatttttaagg

SEQ ID NO: 570285 - DNA, 20 bp, Artificial
  CRISPR gRNA sequence
atgataaatatttttaaggc

SEQ ID NO: 570286 - DNA, 20 bp, Artificial
  CRISPR gRNA sequence
ttaaggcttattatatacaa

SEQ ID NO: 570287 - DNA, 20 bp, Artificial
  CRISPR gRNA sequence
taaggcttattatatacaac

SEQ ID NO: 570288 - DNA, 20 bp, Artificial
  CRISPR gRNA sequence
aaggcttattatatacaact

SEQ ID NO: 570289 - DNA, 20 bp, Artificial
  CRISPR gRNA sequence
aggcttattatatacaactg

SEQ ID NO: 570290 - DNA, 20 bp, Artificial
  CRISPR gRNA sequence
attatatacaactgccagaa

SEQ ID NO: 570291 - DNA, 20 bp, Artificial
  CRISPR gRNA sequence
ttatatacaactgccagaat

SEQ ID NO: 570292 - DNA, 20 bp, Artificial
  CRISPR gRNA sequence
tatacaactgccagaattgc

SEQ ID NO: 570293 - DNA, 20 bp, Artificial
  CRISPR gRNA sequence
ccagaattgccctaccaaac

SEQ ID NO: 570294 - DNA, 20 bp, Artificial
  CRISPR gRNA sequence
ccctaccaaacacaatgcca

SEQ ID NO: 570295 - DNA, 20 bp, Artificial
  CRISPR gRNA sequence
ccaaacacaatgccaagttc

SEQ ID NO: 570296 - DNA, 20 bp, Artificial
  CRISPR gRNA sequence
tgcttccactggcagtatga

SEQ ID NO: 570297 - DNA, 20 bp, Artificial
  CRISPR gRNA sequence
cttccactggcagtatgaga

SEQ ID NO: 570298 - DNA, 20 bp, Artificial
  CRISPR gRNA sequence
ccactggcagtatgagatgg

SEQ ID NO: 570299 - DNA, 20 bp, Artificial
  CRISPR gRNA sequence
cactggcagtatgagatggt

SEQ ID NO: 570300 - DNA, 20 bp, Artificial
  CRISPR gRNA sequence
gcagtatgagatggtcagaa

SEQ ID NO: 570301 - DNA, 20 bp, Artificial
  CRISPR gRNA sequence
ctagtggaacacttgcttct

SEQ ID NO: 570302 - DNA, 20 bp, Artificial
  CRISPR gRNA sequence
tagtggaacacttgcttctt

SEQ ID NO: 570303 - DNA, 20 bp, Artificial
  CRISPR gRNA sequence
gtggaacacttgcttctttt

SEQ ID NO: 570304 - DNA, 20 bp, Artificial
  CRISPR gRNA sequence
gcttcttttattaaataaca

SEQ ID NO: 570305 - DNA, 20 bp, Artificial
  CRISPR gRNA sequence
cttcttttattaaataacac

SEQ ID NO: 570306 - DNA, 20 bp, Artificial
  CRISPR gRNA sequence
cttttattaaataacacagg

SEQ ID NO: 570307 - DNA, 20 bp, Artificial
  CRISPR gRNA sequence
ttttattaaataacacaggg

SEQ ID NO: 570308 - DNA, 20 bp, Artificial
  CRISPR gRNA sequence
ttattaaataacacagggtc

SEQ ID NO: 570309 - DNA, 20 bp, Artificial
  CRISPR gRNA sequence
tattaaataacacagggtct

SEQ ID NO: 570310 - DNA, 20 bp, Artificial
  CRISPR gRNA sequence
attaaataacacagggtctg

SEQ ID NO: 570311 - DNA, 20 bp, Artificial
  CRISPR gRNA sequence
ttaaataacacagggtctgg

SEQ ID NO: 570312 - DNA, 20 bp, Artificial
  CRISPR gRNA sequence
aataacacagggtctggaat

SEQ ID NO: 570313 - DNA, 20 bp, Artificial
  CRISPR gRNA sequence
gaatgtatcaagcttgtgca

SEQ ID NO: 570314 - DNA, 20 bp, Artificial
  CRISPR gRNA sequence
gtgcatataagtttgtttag

SEQ ID NO: 570315 - DNA, 20 bp, Artificial
  CRISPR gRNA sequence
tgcatataagtttgtttaga

SEQ ID NO: 570316 - DNA, 20 bp, Artificial
  CRISPR gRNA sequence
gtttagaaatagtcgaatct

SEQ ID NO: 570317 - DNA, 20 bp, Artificial
  CRISPR gRNA sequence
tttagaaatagtcgaatctt

SEQ ID NO: 570318 - DNA, 20 bp, Artificial
  CRISPR gRNA sequence
agaaatagtcgaatcttgtt

SEQ ID NO: 570319 - DNA, 20 bp, Artificial
  CRISPR gRNA sequence
gaaatagtcgaatcttgtta

SEQ ID NO: 570320 - DNA, 20 bp, Artificial
  CRISPR gRNA sequence
gttattcatattagttctac

SEQ ID NO: 570321 - DNA, 20 bp, Artificial
  CRISPR gRNA sequence
ttattcatattagttctaca

SEQ ID NO: 570322 - DNA, 20 bp, Artificial
  CRISPR gRNA sequence
ttcatattagttctacagag

SEQ ID NO: 570323 - DNA, 20 bp, Artificial
  CRISPR gRNA sequence
atattagttctacagagtca

SEQ ID NO: 570324 - DNA, 20 bp, Artificial
  CRISPR gRNA sequence
gttctacagagtcaagttaa

SEQ ID NO: 570325 - DNA, 20 bp, Artificial
  CRISPR gRNA sequence
tacagagtcaagttaacagt

SEQ ID NO: 570326 - DNA, 20 bp, Artificial
  CRISPR gRNA sequence
cagagtcaagttaacagtga

SEQ ID NO: 570327 - DNA, 20 bp, Artificial
  CRISPR gRNA sequence
acagtgaaatagcaagtagt

SEQ ID NO: 570328 - DNA, 20 bp, Artificial
  CRISPR gRNA sequence
ctgggggaaatacaggggta

SEQ ID NO: 570329 - DNA, 20 bp, Artificial
  CRISPR gRNA sequence
ggggaaatacaggggtaggt

SEQ ID NO: 570330 - DNA, 20 bp, Artificial
  CRISPR gRNA sequence
ctgtgagcctctagtcataa

SEQ ID NO: 570331 - DNA, 20 bp, Artificial
  CRISPR gRNA sequence
tgagcctctagtcataagat

SEQ ID NO: 570332 - DNA, 20 bp, Artificial
  CRISPR gRNA sequence
tagtcataagatttttgtta

SEQ ID NO: 570333 - DNA, 20 bp, Artificial
  CRISPR gRNA sequence
gtcataagatttttgttaat

SEQ ID NO: 570334 - DNA, 20 bp, Artificial
  CRISPR gRNA sequence
ttgttaatgatctgtttata

SEQ ID NO: 570335 - DNA, 20 bp, Artificial
  CRISPR gRNA sequence
tgttaatgatctgtttataa

SEQ ID NO: 570336 - DNA, 20 bp, Artificial
  CRISPR gRNA sequence
gttaatgatctgtttataac

SEQ ID NO: 570337 - DNA, 20 bp, Artificial
  CRISPR gRNA sequence
ttaatgatctgtttataacc

SEQ ID NO: 570338 - DNA, 20 bp, Artificial
  CRISPR gRNA sequence
atgatctgtttataaccttg

SEQ ID NO: 570339 - DNA, 20 bp, Artificial
  CRISPR gRNA sequence
tttataaccttgttttatgt

SEQ ID NO: 570340 - DNA, 20 bp, Artificial
  CRISPR gRNA sequence
ataaccttgttttatgtgtg

SEQ ID NO: 570341 - DNA, 20 bp, Artificial
  CRISPR gRNA sequence
taaccttgttttatgtgtgt

SEQ ID NO: 570342 - DNA, 20 bp, Artificial
  CRISPR gRNA sequence
gttttatgtgtgtctctgtt

SEQ ID NO: 570343 - DNA, 20 bp, Artificial
  CRISPR gRNA sequence
ttttatgtgtgtctctgttt

SEQ ID NO: 570344 - DNA, 20 bp, Artificial
  CRISPR gRNA sequence
tatgtgtgtctctgtttaaa

SEQ ID NO: 570345 - DNA, 20 bp, Artificial
  CRISPR gRNA sequence
atgtgtgtctctgtttaaat

SEQ ID NO: 570346 - DNA, 20 bp, Artificial
  CRISPR gRNA sequence
tgtgtgtctctgtttaaata

SEQ ID NO: 570347 - DNA, 20 bp, Artificial
  CRISPR gRNA sequence
tgtttaaataaaccttaata

SEQ ID NO: 570348 - DNA, 20 bp, Artificial
  CRISPR gRNA sequence
tttaaataaaccttaatata

SEQ ID NO: 570349 - DNA, 20 bp, Artificial
  CRISPR gRNA sequence
aaataaaccttaatatatag

SEQ ID NO: 570350 - DNA, 20 bp, Artificial
  CRISPR gRNA sequence
aataaaccttaatatatagt

SEQ ID NO: 570351 - DNA, 20 bp, Artificial
  CRISPR gRNA sequence
aatatatagtgttgatttat

SEQ ID NO: 570352 - DNA, 20 bp, Artificial
  CRISPR gRNA sequence
atatatagtgttgatttatt

SEQ ID NO: 570353 - DNA, 20 bp, Artificial
  CRISPR gRNA sequence
atttattgaccttgaactca

SEQ ID NO: 570354 - DNA, 20 bp, Artificial
  CRISPR gRNA sequence
attgaccttgaactcatagc

SEQ ID NO: 570355 - DNA, 20 bp, Artificial
  CRISPR gRNA sequence
ttgaccttgaactcatagcc

SEQ ID NO: 570356 - DNA, 20 bp, Artificial
  CRISPR gRNA sequence
accttgaactcatagccaac

SEQ ID NO: 570357 - DNA, 20 bp, Artificial
  CRISPR gRNA sequence
gaactcatagccaacagcac

SEQ ID NO: 570358 - DNA, 20 bp, Artificial
  CRISPR gRNA sequence
aactcatagccaacagcact

SEQ ID NO: 570359 - DNA, 20 bp, Artificial
  CRISPR gRNA sequence
atagccaacagcactgtaac

SEQ ID NO: 570360 - DNA, 20 bp, Artificial
  CRISPR gRNA sequence
taactcatgcctaagtgaag

SEQ ID NO: 570361 - DNA, 20 bp, Artificial
  CRISPR gRNA sequence
atgcctaagtgaagcttatc

SEQ ID NO: 570362 - DNA, 20 bp, Artificial
  CRISPR gRNA sequence
agtgaagcttatctaataca

SEQ ID NO: 570363 - DNA, 20 bp, Artificial
  CRISPR gRNA sequence
atctaatacacctattttct

SEQ ID NO: 570364 - DNA, 20 bp, Artificial
  CRISPR gRNA sequence
tctaatacacctattttctc

SEQ ID NO: 570365 - DNA, 20 bp, Artificial
  CRISPR gRNA sequence
atacacctattttctctgca

SEQ ID NO: 570366 - DNA, 20 bp, Artificial
  CRISPR gRNA sequence
ttttctctgcaaggcacatc

SEQ ID NO: 570367 - DNA, 20 bp, Artificial
  CRISPR gRNA sequence
tctctgcaaggcacatcgca

SEQ ID NO: 570368 - DNA, 20 bp, Artificial
  CRISPR gRNA sequence
ctctgcaaggcacatcgcag

SEQ ID NO: 570369 - DNA, 20 bp, Artificial
  CRISPR gRNA sequence
tctgcaaggcacatcgcagc

SEQ ID NO: 570370 - DNA, 20 bp, Artificial
  CRISPR gRNA sequence
tgcaaggcacatcgcagcct

SEQ ID NO: 570371 - DNA, 20 bp, Artificial
  CRISPR gRNA sequence
caaggcacatcgcagccttc

SEQ ID NO: 570372 - DNA, 20 bp, Artificial
  CRISPR gRNA sequence
cttgcacttaggaactcttg

SEQ ID NO: 570373 - DNA, 20 bp, Artificial
  CRISPR gRNA sequence
ttgcacttaggaactcttgt

SEQ ID NO: 570374 - DNA, 20 bp, Artificial
  CRISPR gRNA sequence
gcacttaggaactcttgtca

SEQ ID NO: 570375 - DNA, 20 bp, Artificial
  CRISPR gRNA sequence
cacttaggaactcttgtcag

SEQ ID NO: 570376 - DNA, 20 bp, Artificial
  CRISPR gRNA sequence
aggaactcttgtcagccctt

SEQ ID NO: 570377 - DNA, 20 bp, Artificial
  CRISPR gRNA sequence
ggaactcttgtcagcccttc

SEQ ID NO: 570378 - DNA, 20 bp, Artificial
  CRISPR gRNA sequence
ttgtcagcccttcaacacta

SEQ ID NO: 570379 - DNA, 20 bp, Artificial
  CRISPR gRNA sequence
gtcagcccttcaacactata

SEQ ID NO: 570380 - DNA, 20 bp, Artificial
  CRISPR gRNA sequence
tcagcccttcaacactatac

SEQ ID NO: 570381 - DNA, 20 bp, Artificial
  CRISPR gRNA sequence
caacactatactttgggacc

SEQ ID NO: 570382 - DNA, 20 bp, Artificial
  CRISPR gRNA sequence
aacactatactttgggacca

SEQ ID NO: 570383 - DNA, 20 bp, Artificial
  CRISPR gRNA sequence
tactttgggaccacttaaaa

SEQ ID NO: 570384 - DNA, 20 bp, Artificial
  CRISPR gRNA sequence
tgggaccacttaaaatagtg

SEQ ID NO: 570385 - DNA, 20 bp, Artificial
  CRISPR gRNA sequence
gggaccacttaaaatagtga

SEQ ID NO: 570386 - DNA, 20 bp, Artificial
  CRISPR gRNA sequence
ggaccacttaaaatagtgaa

SEQ ID NO: 570387 - DNA, 20 bp, Artificial
  CRISPR gRNA sequence
aaaatagtgaaatcaccaac

SEQ ID NO: 570388 - DNA, 20 bp, Artificial
  CRISPR gRNA sequence
aaatagtgaaatcaccaaca

SEQ ID NO: 570389 - DNA, 20 bp, Artificial
  CRISPR gRNA sequence
aatagactgcaaataggaca

SEQ ID NO: 570390 - DNA, 20 bp, Artificial
  CRISPR gRNA sequence
caaataggacacttgttaac

SEQ ID NO: 570391 - DNA, 20 bp, Artificial
  CRISPR gRNA sequence
gttaacagtgtaagaacttg

SEQ ID NO: 570392 - DNA, 20 bp, Artificial
  CRISPR gRNA sequence
ttaacagtgtaagaacttga

SEQ ID NO: 570393 - DNA, 20 bp, Artificial
  CRISPR gRNA sequence
acagtgtaagaacttgaaac

SEQ ID NO: 570394 - DNA, 20 bp, Artificial
  CRISPR gRNA sequence
gaaacaagaaggcagagctt

SEQ ID NO: 570395 - DNA, 20 bp, Artificial
  CRISPR gRNA sequence
aaacaagaaggcagagcttt

SEQ ID NO: 570396 - DNA, 20 bp, Artificial
  CRISPR gRNA sequence
tacctttttccacctctgct

SEQ ID NO: 570397 - DNA, 20 bp, Artificial
  CRISPR gRNA sequence
acctttttccacctctgctg

SEQ ID NO: 570398 - DNA, 20 bp, Artificial
  CRISPR gRNA sequence
cctttttccacctctgctgg

SEQ ID NO: 570399 - DNA, 20 bp, Artificial
  CRISPR gRNA sequence
tttccacctctgctgggaat

SEQ ID NO: 570400 - DNA, 20 bp, Artificial
  CRISPR gRNA sequence
ttccacctctgctgggaatc

SEQ ID NO: 570401 - DNA, 20 bp, Artificial
  CRISPR gRNA sequence
tccacctctgctgggaatct

SEQ ID NO: 570402 - DNA, 20 bp, Artificial
  CRISPR gRNA sequence
ccacctctgctgggaatctg

SEQ ID NO: 570403 - DNA, 20 bp, Artificial
  CRISPR gRNA sequence
cacctctgctgggaatctgc

SEQ ID NO: 570404 - DNA, 20 bp, Artificial
  CRISPR gRNA sequence
tgctgggaatctgcttattg

SEQ ID NO: 570405 - DNA, 20 bp, Artificial
  CRISPR gRNA sequence
ctgggaatctgcttattggg

SEQ ID NO: 570406 - DNA, 20 bp, Artificial
  CRISPR gRNA sequence
ggaatctgcttattgggtga

SEQ ID NO: 570407 - DNA, 20 bp, Artificial
  CRISPR gRNA sequence
cttattgggtgactcaaagt

SEQ ID NO: 570408 - DNA, 20 bp, Artificial
  CRISPR gRNA sequence
attgggtgactcaaagtttt

SEQ ID NO: 570409 - DNA, 20 bp, Artificial
  CRISPR gRNA sequence
ttgggtgactcaaagttttc

SEQ ID NO: 570410 - DNA, 20 bp, Artificial
  CRISPR gRNA sequence
ggtgactcaaagttttcatc

SEQ ID NO: 570411 - DNA, 20 bp, Artificial
  CRISPR gRNA sequence
aaagttttcatcactgttct

SEQ ID NO: 570412 - DNA, 20 bp, Artificial
  CRISPR gRNA sequence
tcatcactgttcttatgtct

SEQ ID NO: 570413 - DNA, 20 bp, Artificial
  CRISPR gRNA sequence
catcactgttcttatgtctg

SEQ ID NO: 570414 - DNA, 20 bp, Artificial
  CRISPR gRNA sequence
atcactgttcttatgtctga

SEQ ID NO: 570415 - DNA, 20 bp, Artificial
  CRISPR gRNA sequence
ttcttatgtctgagaatgac

SEQ ID NO: 570416 - DNA, 20 bp, Artificial
  CRISPR gRNA sequence
ttatgtctgagaatgactgc

SEQ ID NO: 570417 - DNA, 20 bp, Artificial
  CRISPR gRNA sequence
atgtctgagaatgactgctt

SEQ ID NO: 570418 - DNA, 20 bp, Artificial
  CRISPR gRNA sequence
tgtctgagaatgactgcttt

SEQ ID NO: 570419 - DNA, 20 bp, Artificial
  CRISPR gRNA sequence
agaatgactgctttgggtat

SEQ ID NO: 570420 - DNA, 20 bp, Artificial
  CRISPR gRNA sequence
ctttgggtattgatttgtgg

SEQ ID NO: 570421 - DNA, 20 bp, Artificial
  CRISPR gRNA sequence
tgggtattgatttgtggatt

SEQ ID NO: 570422 - DNA, 20 bp, Artificial
  CRISPR gRNA sequence
gggtattgatttgtggatta

SEQ ID NO: 570423 - DNA, 20 bp, Artificial
  CRISPR gRNA sequence
ggtattgatttgtggattac

SEQ ID NO: 570424 - DNA, 20 bp, Artificial
  CRISPR gRNA sequence
atttgtggattacaaataaa

SEQ ID NO: 570425 - DNA, 20 bp, Artificial
  CRISPR gRNA sequence
gtggattacaaataaatttc

SEQ ID NO: 570426 - DNA, 20 bp, Artificial
  CRISPR gRNA sequence
tggattacaaataaatttca

SEQ ID NO: 570427 - DNA, 20 bp, Artificial
  CRISPR gRNA sequence
caaataaatttcagtaaata

SEQ ID NO: 570428 - DNA, 20 bp, Artificial
  CRISPR gRNA sequence
cagtaaataagcaaaccgca

SEQ ID NO: 570429 - DNA, 20 bp, Artificial
  CRISPR gRNA sequence
agtaaataagcaaaccgcaa

SEQ ID NO: 570430 - DNA, 20 bp, Artificial
  CRISPR gRNA sequence
caaataatgaggatccattt

SEQ ID NO: 570431 - DNA, 20 bp, Artificial
  CRISPR gRNA sequence
tgatcagttcaactagttga

SEQ ID NO: 570432 - DNA, 20 bp, Artificial
  CRISPR gRNA sequence
gatcagttcaactagttgaa

SEQ ID NO: 570433 - DNA, 20 bp, Artificial
  CRISPR gRNA sequence
atcagttcaactagttgaat

SEQ ID NO: 570434 - DNA, 20 bp, Artificial
  CRISPR gRNA sequence
aactagttgaatttcttttc

SEQ ID NO: 570435 - DNA, 20 bp, Artificial
  CRISPR gRNA sequence
gttgaatttcttttcttttc

SEQ ID NO: 570436 - DNA, 20 bp, Artificial
  CRISPR gRNA sequence
aatttcttttcttttctttt

SEQ ID NO: 570437 - DNA, 20 bp, Artificial
  CRISPR gRNA sequence
cttttcttttcttttttata

SEQ ID NO: 570438 - DNA, 20 bp, Artificial
  CRISPR gRNA sequence
ttttcttttcttttttatag

SEQ ID NO: 570439 - DNA, 20 bp, Artificial
  CRISPR gRNA sequence
ttcttttcttttttataggt

SEQ ID NO: 570440 - DNA, 20 bp, Artificial
  CRISPR gRNA sequence
tcttttcttttttataggtc

SEQ ID NO: 570441 - DNA, 20 bp, Artificial
  CRISPR gRNA sequence
cttttcttttttataggtca

SEQ ID NO: 570442 - DNA, 20 bp, Artificial
  CRISPR gRNA sequence
ttttcttttttataggtcat

SEQ ID NO: 570443 - DNA, 20 bp, Artificial
  CRISPR gRNA sequence
ttcttttttataggtcattc

SEQ ID NO: 570444 - DNA, 20 bp, Artificial
  CRISPR gRNA sequence
tcttttttataggtcattca

SEQ ID NO: 570445 - DNA, 20 bp, Artificial
  CRISPR gRNA sequence
cttttttataggtcattcaa

SEQ ID NO: 570446 - DNA, 20 bp, Artificial
  CRISPR gRNA sequence
ttttttataggtcattcaag

SEQ ID NO: 570447 - DNA, 20 bp, Artificial
  CRISPR gRNA sequence
ttttataggtcattcaagac

SEQ ID NO: 570448 - DNA, 20 bp, Artificial
  CRISPR gRNA sequence
tttataggtcattcaagaca

SEQ ID NO: 570449 - DNA, 20 bp, Artificial
  CRISPR gRNA sequence
ttataggtcattcaagacac

SEQ ID NO: 570450 - DNA, 20 bp, Artificial
  CRISPR gRNA sequence
tataggtcattcaagacaca

SEQ ID NO: 570451 - DNA, 20 bp, Artificial
  CRISPR gRNA sequence
ataggtcattcaagacacag

SEQ ID NO: 570452 - DNA, 20 bp, Artificial
  CRISPR gRNA sequence
taggtcattcaagacacaga

SEQ ID NO: 570453 - DNA, 20 bp, Artificial
  CRISPR gRNA sequence
aagacacagatatgcactta

SEQ ID NO: 570454 - DNA, 20 bp, Artificial
  CRISPR gRNA sequence
atacccataccattagcagt

SEQ ID NO: 570455 - DNA, 20 bp, Artificial
  CRISPR gRNA sequence
tacccataccattagcagta

SEQ ID NO: 570456 - DNA, 20 bp, Artificial
  CRISPR gRNA sequence
gcagtaattacaacatgtat

SEQ ID NO: 570457 - DNA, 20 bp, Artificial
  CRISPR gRNA sequence
caacatgtattgtgctgtat

SEQ ID NO: 570458 - DNA, 20 bp, Artificial
  CRISPR gRNA sequence
tgctgtatatgaatggtatg

SEQ ID NO: 570459 - DNA, 20 bp, Artificial
  CRISPR gRNA sequence
tatatgaatggtatgtatgc

SEQ ID NO: 570460 - DNA, 20 bp, Artificial
  CRISPR gRNA sequence
tttaaaacaaaatagtttga

SEQ ID NO: 570461 - DNA, 20 bp, Artificial
  CRISPR gRNA sequence
ttaaaacaaaatagtttgaa

SEQ ID NO: 570462 - DNA, 20 bp, Artificial
  CRISPR gRNA sequence
taaaacaaaatagtttgaaa

SEQ ID NO: 570463 - DNA, 20 bp, Artificial
  CRISPR gRNA sequence
aaaacaaaatagtttgaaaa

SEQ ID NO: 570464 - DNA, 20 bp, Artificial
  CRISPR gRNA sequence
aaacaaaatagtttgaaaac

SEQ ID NO: 570465 - DNA, 20 bp, Artificial
  CRISPR gRNA sequence
gaaaacttgcattgttttcc

SEQ ID NO: 570466 - DNA, 20 bp, Artificial
  CRISPR gRNA sequence
aaaacttgcattgttttcca

SEQ ID NO: 570467 - DNA, 20 bp, Artificial
  CRISPR gRNA sequence
gcattgttttccaaaggtca

SEQ ID NO: 570468 - DNA, 20 bp, Artificial
  CRISPR gRNA sequence
cattgttttccaaaggtcag

SEQ ID NO: 570469 - DNA, 20 bp, Artificial
  CRISPR gRNA sequence
ttttccaaaggtcagaaaat

SEQ ID NO: 570470 - DNA, 20 bp, Artificial
  CRISPR gRNA sequence
tccaaaggtcagaaaatagt

SEQ ID NO: 570471 - DNA, 20 bp, Artificial
  CRISPR gRNA sequence
ccaaaggtcagaaaatagtt

SEQ ID NO: 570472 - DNA, 20 bp, Artificial
  CRISPR gRNA sequence
caaaggtcagaaaatagttt

SEQ ID NO: 570473 - DNA, 20 bp, Artificial
  CRISPR gRNA sequence
aaggatgaaaataaagtttg

SEQ ID NO: 570474 - DNA, 20 bp, Artificial
  CRISPR gRNA sequence
aggatgaaaataaagtttga

SEQ ID NO: 570475 - DNA, 20 bp, Artificial
  CRISPR gRNA sequence
gaaattttagacatttgaaa

SEQ ID NO: 570476 - DNA, 20 bp, Artificial
  CRISPR gRNA sequence
aaattttagacatttgaaaa

SEQ ID NO: 570477 - DNA, 20 bp, Artificial
  CRISPR gRNA sequence
tagacatttgaaaagaaaca

SEQ ID NO: 570478 - DNA, 20 bp, Artificial
  CRISPR gRNA sequence
agacatttgaaaagaaacaa

SEQ ID NO: 570479 - DNA, 20 bp, Artificial
  CRISPR gRNA sequence
gacatttgaaaagaaacaaa

SEQ ID NO: 570480 - DNA, 20 bp, Artificial
  CRISPR gRNA sequence
gaaaagaaacaaaaactttt

SEQ ID NO: 570481 - DNA, 20 bp, Artificial
  CRISPR gRNA sequence
aaaagaaacaaaaacttttt

SEQ ID NO: 570482 - DNA, 20 bp, Artificial
  CRISPR gRNA sequence
ttttgctttacgtgtgtggg

SEQ ID NO: 570483 - DNA, 20 bp, Artificial
  CRISPR gRNA sequence
tttgctttacgtgtgtggga

SEQ ID NO: 570484 - DNA, 20 bp, Artificial
  CRISPR gRNA sequence
ttgctttacgtgtgtgggac

SEQ ID NO: 570485 - DNA, 20 bp, Artificial
  CRISPR gRNA sequence
tgctttacgtgtgtgggact

SEQ ID NO: 570486 - DNA, 20 bp, Artificial
  CRISPR gRNA sequence
gctttacgtgtgtgggactg

SEQ ID NO: 570487 - DNA, 20 bp, Artificial
  CRISPR gRNA sequence
ctttacgtgtgtgggactgc

SEQ ID NO: 570488 - DNA, 20 bp, Artificial
  CRISPR gRNA sequence
tacgtgtgtgggactgctga

SEQ ID NO: 570489 - DNA, 20 bp, Artificial
  CRISPR gRNA sequence
acgtgtgtgggactgctgag

SEQ ID NO: 570490 - DNA, 20 bp, Artificial
  CRISPR gRNA sequence
cgtgtgtgggactgctgagc

SEQ ID NO: 570491 - DNA, 20 bp, Artificial
  CRISPR gRNA sequence
ctgagcatgctaggttcctc

SEQ ID NO: 570492 - DNA, 20 bp, Artificial
  CRISPR gRNA sequence
agcatgctaggttcctccaa

SEQ ID NO: 570493 - DNA, 20 bp, Artificial
  CRISPR gRNA sequence
ggttcctccaaagatccaca

SEQ ID NO: 570494 - DNA, 20 bp, Artificial
  CRISPR gRNA sequence
ctccaaagatccacattatc

SEQ ID NO: 570495 - DNA, 20 bp, Artificial
  CRISPR gRNA sequence
caaagatccacattatctca

SEQ ID NO: 570496 - DNA, 20 bp, Artificial
  CRISPR gRNA sequence
tctcaaggtagaatgaatcc

SEQ ID NO: 570497 - DNA, 20 bp, Artificial
  CRISPR gRNA sequence
aaggtagaatgaatccttag

SEQ ID NO: 570498 - DNA, 20 bp, Artificial
  CRISPR gRNA sequence
aggccacagagagctttaca

SEQ ID NO: 570499 - DNA, 20 bp, Artificial
  CRISPR gRNA sequence
ggccacagagagctttacag

SEQ ID NO: 570500 - DNA, 20 bp, Artificial
  CRISPR gRNA sequence
tacaggcctgggaacacagc

SEQ ID NO: 570501 - DNA, 20 bp, Artificial
  CRISPR gRNA sequence
acaggcctgggaacacagcc

SEQ ID NO: 570502 - DNA, 20 bp, Artificial
  CRISPR gRNA sequence
caggcctgggaacacagcct

SEQ ID NO: 570503 - DNA, 20 bp, Artificial
  CRISPR gRNA sequence
ggaacacagcctggacctgt

SEQ ID NO: 570504 - DNA, 20 bp, Artificial
  CRISPR gRNA sequence
gacctgttgcatagcctcct

SEQ ID NO: 570505 - DNA, 20 bp, Artificial
  CRISPR gRNA sequence
ttgcatagcctccttttacc

SEQ ID NO: 570506 - DNA, 20 bp, Artificial
  CRISPR gRNA sequence
catagcctccttttacctgt

SEQ ID NO: 570507 - DNA, 20 bp, Artificial
  CRISPR gRNA sequence
cttttacctgtgatctgctt

SEQ ID NO: 570508 - DNA, 20 bp, Artificial
  CRISPR gRNA sequence
ttacctgtgatctgcttcaa

SEQ ID NO: 570509 - DNA, 20 bp, Artificial
  CRISPR gRNA sequence
tacctgtgatctgcttcaaa

SEQ ID NO: 570510 - DNA, 20 bp, Artificial
  CRISPR gRNA sequence
acctgtgatctgcttcaaaa

SEQ ID NO: 570511 - DNA, 20 bp, Artificial
  CRISPR gRNA sequence
cctgtgatctgcttcaaaat

SEQ ID NO: 570512 - DNA, 20 bp, Artificial
  CRISPR gRNA sequence
tgatctgcttcaaaatatag

SEQ ID NO: 570513 - DNA, 20 bp, Artificial
  CRISPR gRNA sequence
cttcaaaatatagttaaact

SEQ ID NO: 570514 - DNA, 20 bp, Artificial
  CRISPR gRNA sequence
caaaatatagttaaacttct

SEQ ID NO: 570515 - DNA, 20 bp, Artificial
  CRISPR gRNA sequence
aaaatatagttaaacttctg

SEQ ID NO: 570516 - DNA, 20 bp, Artificial
  CRISPR gRNA sequence
aacttctggtctccaagtca

SEQ ID NO: 570517 - DNA, 20 bp, Artificial
  CRISPR gRNA sequence
ctggtctccaagtcagagtt

SEQ ID NO: 570518 - DNA, 20 bp, Artificial
  CRISPR gRNA sequence
tggtctccaagtcagagttt

SEQ ID NO: 570519 - DNA, 20 bp, Artificial
  CRISPR gRNA sequence
gtctccaagtcagagtttgc

SEQ ID NO: 570520 - DNA, 20 bp, Artificial
  CRISPR gRNA sequence
caagtcagagtttgctaaag

SEQ ID NO: 570521 - DNA, 20 bp, Artificial
  CRISPR gRNA sequence
gctaaagacctctttaggct

SEQ ID NO: 570522 - DNA, 20 bp, Artificial
  CRISPR gRNA sequence
ctaaagacctctttaggctg

SEQ ID NO: 570523 - DNA, 20 bp, Artificial
  CRISPR gRNA sequence
aagacctctttaggctgcca

SEQ ID NO: 570524 - DNA, 20 bp, Artificial
  CRISPR gRNA sequence
tttaggctgccacctctgta

SEQ ID NO: 570525 - DNA, 20 bp, Artificial
  CRISPR gRNA sequence
taggctgccacctctgtaat

SEQ ID NO: 570526 - DNA, 20 bp, Artificial
  CRISPR gRNA sequence
aggctgccacctctgtaatt

SEQ ID NO: 570527 - DNA, 20 bp, Artificial
  CRISPR gRNA sequence
ggctgccacctctgtaattt

SEQ ID NO: 570528 - DNA, 20 bp, Artificial
  CRISPR gRNA sequence
ccacctctgtaattttcatg

SEQ ID NO: 570529 - DNA, 20 bp, Artificial
  CRISPR gRNA sequence
tgtaattttcatgtcatata

SEQ ID NO: 570530 - DNA, 20 bp, Artificial
  CRISPR gRNA sequence
taattttcatgtcatataac

SEQ ID NO: 570531 - DNA, 20 bp, Artificial
  CRISPR gRNA sequence
tcatgtcatataacacgaat

SEQ ID NO: 570532 - DNA, 20 bp, Artificial
  CRISPR gRNA sequence
catgtcatataacacgaatg

SEQ ID NO: 570533 - DNA, 20 bp, Artificial
  CRISPR gRNA sequence
atgtcatataacacgaatgg

SEQ ID NO: 570534 - DNA, 20 bp, Artificial
  CRISPR gRNA sequence
ccaggtaggaagggagtttt

SEQ ID NO: 570535 - DNA, 20 bp, Artificial
  CRISPR gRNA sequence
tggttgagttaagtgactta

SEQ ID NO: 570536 - DNA, 20 bp, Artificial
  CRISPR gRNA sequence
ggttgagttaagtgacttac

SEQ ID NO: 570537 - DNA, 20 bp, Artificial
  CRISPR gRNA sequence
gttgagttaagtgacttacg

SEQ ID NO: 570538 - DNA, 20 bp, Artificial
  CRISPR gRNA sequence
agttaagtgacttacgtaat

SEQ ID NO: 570539 - DNA, 20 bp, Artificial
  CRISPR gRNA sequence
agtgacttacgtaatacaag

SEQ ID NO: 570540 - DNA, 20 bp, Artificial
  CRISPR gRNA sequence
acgtaatacaagtaattgtg

SEQ ID NO: 570541 - DNA, 20 bp, Artificial
  CRISPR gRNA sequence
cgtaatacaagtaattgtgc

SEQ ID NO: 570542 - DNA, 20 bp, Artificial
  CRISPR gRNA sequence
tgcttgtattacttcctgag

SEQ ID NO: 570543 - DNA, 20 bp, Artificial
  CRISPR gRNA sequence
gtattacttcctgagccttc

SEQ ID NO: 570544 - DNA, 20 bp, Artificial
  CRISPR gRNA sequence
tattacttcctgagccttct

SEQ ID NO: 570545 - DNA, 20 bp, Artificial
  CRISPR gRNA sequence
cttcctgagccttctcagtc

SEQ ID NO: 570546 - DNA, 20 bp, Artificial
  CRISPR gRNA sequence
cctgagccttctcagtcccc

SEQ ID NO: 570547 - DNA, 20 bp, Artificial
  CRISPR gRNA sequence
ctgagccttctcagtcccct

SEQ ID NO: 570548 - DNA, 20 bp, Artificial
  CRISPR gRNA sequence
agccttctcagtcccctagc

SEQ ID NO: 570549 - DNA, 20 bp, Artificial
  CRISPR gRNA sequence
ctcagtcccctagcaatctt

SEQ ID NO: 570550 - DNA, 20 bp, Artificial
  CRISPR gRNA sequence
tcagtcccctagcaatcttg

SEQ ID NO: 570551 - DNA, 20 bp, Artificial
  CRISPR gRNA sequence
agtcccctagcaatcttggg

SEQ ID NO: 570552 - DNA, 20 bp, Artificial
  CRISPR gRNA sequence
gcaatcttgggcagtcatac

SEQ ID NO: 570553 - DNA, 20 bp, Artificial
  CRISPR gRNA sequence
gggcagtcatacagcttgga

SEQ ID NO: 570554 - DNA, 20 bp, Artificial
  CRISPR gRNA sequence
ggcagtcatacagcttggag

SEQ ID NO: 570555 - DNA, 20 bp, Artificial
  CRISPR gRNA sequence
ggagaactgatgacttggag

SEQ ID NO: 570556 - DNA, 20 bp, Artificial
  CRISPR gRNA sequence
gagaactgatgacttggaga

SEQ ID NO: 570557 - DNA, 20 bp, Artificial
  CRISPR gRNA sequence
atgacttggagaatttgttc

SEQ ID NO: 570558 - DNA, 20 bp, Artificial
  CRISPR gRNA sequence
ggagaatttgttcccagcct

SEQ ID NO: 570559 - DNA, 20 bp, Artificial
  CRISPR gRNA sequence
gagaatttgttcccagcctg

SEQ ID NO: 570560 - DNA, 20 bp, Artificial
  CRISPR gRNA sequence
gttcccagcctgttcattcc

SEQ ID NO: 570561 - DNA, 20 bp, Artificial
  CRISPR gRNA sequence
ttcccagcctgttcattcct

SEQ ID NO: 570562 - DNA, 20 bp, Artificial
  CRISPR gRNA sequence
ccagcctgttcattcctggt

SEQ ID NO: 570563 - DNA, 20 bp, Artificial
  CRISPR gRNA sequence
ttcattcctggtaatgagta

SEQ ID NO: 570564 - DNA, 20 bp, Artificial
  CRISPR gRNA sequence
attcctggtaatgagtaatc

SEQ ID NO: 570565 - DNA, 20 bp, Artificial
  CRISPR gRNA sequence
ctggtaatgagtaatccctc

SEQ ID NO: 570566 - DNA, 20 bp, Artificial
  CRISPR gRNA sequence
gtaatgagtaatccctctca

SEQ ID NO: 570567 - DNA, 20 bp, Artificial
  CRISPR gRNA sequence
tcaaatcccaaaggacaggg

SEQ ID NO: 570568 - DNA, 20 bp, Artificial
  CRISPR gRNA sequence
aaatcccaaaggacagggag

SEQ ID NO: 570569 - DNA, 20 bp, Artificial
  CRISPR gRNA sequence
taattctgaagagtggatat

SEQ ID NO: 570570 - DNA, 20 bp, Artificial
  CRISPR gRNA sequence
tgaagagtggatattcttga

SEQ ID NO: 570571 - DNA, 20 bp, Artificial
  CRISPR gRNA sequence
aagagtggatattcttgatg

SEQ ID NO: 570572 - DNA, 20 bp, Artificial
  CRISPR gRNA sequence
ttgatgccacagcagtttcc

SEQ ID NO: 570573 - DNA, 20 bp, Artificial
  CRISPR gRNA sequence
gatgccacagcagtttccat

SEQ ID NO: 570574 - DNA, 20 bp, Artificial
  CRISPR gRNA sequence
atgccacagcagtttccata

SEQ ID NO: 570575 - DNA, 20 bp, Artificial
  CRISPR gRNA sequence
ccataccagccttcaccaaa

SEQ ID NO: 570576 - DNA, 20 bp, Artificial
  CRISPR gRNA sequence
cataccagccttcaccaaaa

SEQ ID NO: 570577 - DNA, 20 bp, Artificial
  CRISPR gRNA sequence
caccaaaaggaaatatgcca

SEQ ID NO: 570578 - DNA, 20 bp, Artificial
  CRISPR gRNA sequence
accaaaaggaaatatgccag

SEQ ID NO: 570579 - DNA, 20 bp, Artificial
  CRISPR gRNA sequence
tctacaagtgatagtatcta

SEQ ID NO: 570580 - DNA, 20 bp, Artificial
  CRISPR gRNA sequence
ctacaagtgatagtatctag

SEQ ID NO: 570581 - DNA, 20 bp, Artificial
  CRISPR gRNA sequence
tacaagtgatagtatctagg

SEQ ID NO: 570582 - DNA, 20 bp, Artificial
  CRISPR gRNA sequence
caagtgatagtatctaggat

SEQ ID NO: 570583 - DNA, 20 bp, Artificial
  CRISPR gRNA sequence
ggatccattgtgtcatgaat

SEQ ID NO: 570584 - DNA, 20 bp, Artificial
  CRISPR gRNA sequence
tgtcatgaatcaagtttata

SEQ ID NO: 570585 - DNA, 20 bp, Artificial
  CRISPR gRNA sequence
ataaactagatttcagtttc

SEQ ID NO: 570586 - DNA, 20 bp, Artificial
  CRISPR gRNA sequence
taaactagatttcagtttcc

SEQ ID NO: 570587 - DNA, 20 bp, Artificial
  CRISPR gRNA sequence
gatttcagtttccttagacc

SEQ ID NO: 570588 - DNA, 20 bp, Artificial
  CRISPR gRNA sequence
cagtttccttagacctgcac

SEQ ID NO: 570589 - DNA, 20 bp, Artificial
  CRISPR gRNA sequence
agtttccttagacctgcact

SEQ ID NO: 570590 - DNA, 20 bp, Artificial
  CRISPR gRNA sequence
ccttagacctgcactgttta

SEQ ID NO: 570591 - DNA, 20 bp, Artificial
  CRISPR gRNA sequence
cttagacctgcactgtttag

SEQ ID NO: 570592 - DNA, 20 bp, Artificial
  CRISPR gRNA sequence
agacctgcactgtttagtat

SEQ ID NO: 570593 - DNA, 20 bp, Artificial
  CRISPR gRNA sequence
gacctgcactgtttagtata

SEQ ID NO: 570594 - DNA, 20 bp, Artificial
  CRISPR gRNA sequence
cactgtttagtatagtagcc

SEQ ID NO: 570595 - DNA, 20 bp, Artificial
  CRISPR gRNA sequence
tttagtatagtagccaatta

SEQ ID NO: 570596 - DNA, 20 bp, Artificial
  CRISPR gRNA sequence
agtatagtagccaattagcc

SEQ ID NO: 570597 - DNA, 20 bp, Artificial
  CRISPR gRNA sequence
gtatagtagccaattagcca

SEQ ID NO: 570598 - DNA, 20 bp, Artificial
  CRISPR gRNA sequence
gccacatatgattatttaaa

SEQ ID NO: 570599 - DNA, 20 bp, Artificial
  CRISPR gRNA sequence
tttaaatatatcatttaaaa

SEQ ID NO: 570600 - DNA, 20 bp, Artificial
  CRISPR gRNA sequence
aaatatatcatttaaaatga

SEQ ID NO: 570601 - DNA, 20 bp, Artificial
  CRISPR gRNA sequence
aatatatcatttaaaatgaa

SEQ ID NO: 570602 - DNA, 20 bp, Artificial
  CRISPR gRNA sequence
aaaatgaaataccattaaat

SEQ ID NO: 570603 - DNA, 20 bp, Artificial
  CRISPR gRNA sequence
aaatgaaataccattaaatt

SEQ ID NO: 570604 - DNA, 20 bp, Artificial
  CRISPR gRNA sequence
aatttaagattcattcctca

SEQ ID NO: 570605 - DNA, 20 bp, Artificial
  CRISPR gRNA sequence
aagattcattcctcagttac

SEQ ID NO: 570606 - DNA, 20 bp, Artificial
  CRISPR gRNA sequence
agattcattcctcagttaca

SEQ ID NO: 570607 - DNA, 20 bp, Artificial
  CRISPR gRNA sequence
attcctcagttacactaacc

SEQ ID NO: 570608 - DNA, 20 bp, Artificial
  CRISPR gRNA sequence
ctcagttacactaaccacct

SEQ ID NO: 570609 - DNA, 20 bp, Artificial
  CRISPR gRNA sequence
agttacactaaccacctttc

SEQ ID NO: 570610 - DNA, 20 bp, Artificial
  CRISPR gRNA sequence
cactaaccacctttcaagtg

SEQ ID NO: 570611 - DNA, 20 bp, Artificial
  CRISPR gRNA sequence
accacctttcaagtgctcaa

SEQ ID NO: 570612 - DNA, 20 bp, Artificial
  CRISPR gRNA sequence
tcaagtgctcaatacctaca

SEQ ID NO: 570613 - DNA, 20 bp, Artificial
  CRISPR gRNA sequence
caagtgctcaatacctacat

SEQ ID NO: 570614 - DNA, 20 bp, Artificial
  CRISPR gRNA sequence
aagtgctcaatacctacatc

SEQ ID NO: 570615 - DNA, 20 bp, Artificial
  CRISPR gRNA sequence
aatacctacatctggctagt

SEQ ID NO: 570616 - DNA, 20 bp, Artificial
  CRISPR gRNA sequence
catctggctagtggctacca

SEQ ID NO: 570617 - DNA, 20 bp, Artificial
  CRISPR gRNA sequence
gctagtggctaccatactgg

SEQ ID NO: 570618 - DNA, 20 bp, Artificial
  CRISPR gRNA sequence
gtggctaccatactggatag

SEQ ID NO: 570619 - DNA, 20 bp, Artificial
  CRISPR gRNA sequence
ccatactggatagcccagat

SEQ ID NO: 570620 - DNA, 20 bp, Artificial
  CRISPR gRNA sequence
gatagcccagataaggaata

SEQ ID NO: 570621 - DNA, 20 bp, Artificial
  CRISPR gRNA sequence
tcattgcagaaagttttctt

SEQ ID NO: 570622 - DNA, 20 bp, Artificial
  CRISPR gRNA sequence
cagaaagttttcttggtcag

SEQ ID NO: 570623 - DNA, 20 bp, Artificial
  CRISPR gRNA sequence
tcttggtcagtgcagaacta

SEQ ID NO: 570624 - DNA, 20 bp, Artificial
  CRISPR gRNA sequence
cttggtcagtgcagaactag

SEQ ID NO: 570625 - DNA, 20 bp, Artificial
  CRISPR gRNA sequence
ttggtcagtgcagaactaga

SEQ ID NO: 570626 - DNA, 20 bp, Artificial
  CRISPR gRNA sequence
ggtcagtgcagaactagact

SEQ ID NO: 570627 - DNA, 20 bp, Artificial
  CRISPR gRNA sequence
gtcagtgcagaactagacta

SEQ ID NO: 570628 - DNA, 20 bp, Artificial
  CRISPR gRNA sequence
gactattttgcgatatcagt

SEQ ID NO: 570629 - DNA, 20 bp, Artificial
  CRISPR gRNA sequence
ttttgcgatatcagtgctaa

SEQ ID NO: 570630 - DNA, 20 bp, Artificial
  CRISPR gRNA sequence
tgcgatatcagtgctaaata

SEQ ID NO: 570631 - DNA, 20 bp, Artificial
  CRISPR gRNA sequence
gcgatatcagtgctaaatat

SEQ ID NO: 570632 - DNA, 20 bp, Artificial
  CRISPR gRNA sequence
cgatatcagtgctaaatata

SEQ ID NO: 570633 - DNA, 20 bp, Artificial
  CRISPR gRNA sequence
aatataatttcctgatgata

SEQ ID NO: 570634 - DNA, 20 bp, Artificial
  CRISPR gRNA sequence
cctgatgataacattttcat

SEQ ID NO: 570635 - DNA, 20 bp, Artificial
  CRISPR gRNA sequence
ctgatgataacattttcata

SEQ ID NO: 570636 - DNA, 20 bp, Artificial
  CRISPR gRNA sequence
atgataacattttcatatta

SEQ ID NO: 570637 - DNA, 20 bp, Artificial
  CRISPR gRNA sequence
tcatattataagttgtaaat

SEQ ID NO: 570638 - DNA, 20 bp, Artificial
  CRISPR gRNA sequence
catattataagttgtaaata

SEQ ID NO: 570639 - DNA, 20 bp, Artificial
  CRISPR gRNA sequence
atattataagttgtaaatac

SEQ ID NO: 570640 - DNA, 20 bp, Artificial
  CRISPR gRNA sequence
taagttgtaaataccatgaa

SEQ ID NO: 570641 - DNA, 20 bp, Artificial
  CRISPR gRNA sequence
taaataccatgaaaatccat

SEQ ID NO: 570642 - DNA, 20 bp, Artificial
  CRISPR gRNA sequence
agtaatagattatcagtcag

SEQ ID NO: 570643 - DNA, 20 bp, Artificial
  CRISPR gRNA sequence
tcagtcagttgactctccac

SEQ ID NO: 570644 - DNA, 20 bp, Artificial
  CRISPR gRNA sequence
actctccactaaacagtatt

SEQ ID NO: 570645 - DNA, 20 bp, Artificial
  CRISPR gRNA sequence
tccactaaacagtattataa

SEQ ID NO: 570646 - DNA, 20 bp, Artificial
  CRISPR gRNA sequence
cactaaacagtattataacg

SEQ ID NO: 570647 - DNA, 20 bp, Artificial
  CRISPR gRNA sequence
aacagtattataacgatcag

SEQ ID NO: 570648 - DNA, 20 bp, Artificial
  CRISPR gRNA sequence
taacgatcagctgaagaaag

SEQ ID NO: 570649 - DNA, 20 bp, Artificial
  CRISPR gRNA sequence
aagaaagttttcagctattg

SEQ ID NO: 570650 - DNA, 20 bp, Artificial
  CRISPR gRNA sequence
tcagctattgcccaatgcat

SEQ ID NO: 570651 - DNA, 20 bp, Artificial
  CRISPR gRNA sequence
cagctattgcccaatgcata

SEQ ID NO: 570652 - DNA, 20 bp, Artificial
  CRISPR gRNA sequence
agctattgcccaatgcataa

SEQ ID NO: 570653 - DNA, 20 bp, Artificial
  CRISPR gRNA sequence
ttgcccaatgcataaaatat

SEQ ID NO: 570654 - DNA, 20 bp, Artificial
  CRISPR gRNA sequence
cccaatgcataaaatatttt

SEQ ID NO: 570655 - DNA, 20 bp, Artificial
  CRISPR gRNA sequence
tgggagctcaaattttttaa

SEQ ID NO: 570656 - DNA, 20 bp, Artificial
  CRISPR gRNA sequence
gggagctcaaattttttaaa

SEQ ID NO: 570657 - DNA, 20 bp, Artificial
  CRISPR gRNA sequence
ggagctcaaattttttaaaa

SEQ ID NO: 570658 - DNA, 20 bp, Artificial
  CRISPR gRNA sequence
aaattttttaaaaatctatt

SEQ ID NO: 570659 - DNA, 20 bp, Artificial
  CRISPR gRNA sequence
tttaaaaatctattttaatc

SEQ ID NO: 570660 - DNA, 20 bp, Artificial
  CRISPR gRNA sequence
ttaaaaatctattttaatcc

SEQ ID NO: 570661 - DNA, 20 bp, Artificial
  CRISPR gRNA sequence
taaaaatctattttaatccc

SEQ ID NO: 570662 - DNA, 20 bp, Artificial
  CRISPR gRNA sequence
aaaaatctattttaatcccc

SEQ ID NO: 570663 - DNA, 20 bp, Artificial
  CRISPR gRNA sequence
aaaatctattttaatcccca

SEQ ID NO: 570664 - DNA, 20 bp, Artificial
  CRISPR gRNA sequence
ttttaatccccaaatagcag

SEQ ID NO: 570665 - DNA, 20 bp, Artificial
  CRISPR gRNA sequence
taatccccaaatagcagtat

SEQ ID NO: 570666 - DNA, 20 bp, Artificial
  CRISPR gRNA sequence
aatccccaaatagcagtata

SEQ ID NO: 570667 - DNA, 20 bp, Artificial
  CRISPR gRNA sequence
atccccaaatagcagtataa

SEQ ID NO: 570668 - DNA, 20 bp, Artificial
  CRISPR gRNA sequence
atcatctcctgaacaggttg

SEQ ID NO: 570669 - DNA, 20 bp, Artificial
  CRISPR gRNA sequence
ctgaacaggttggttcccag

SEQ ID NO: 570670 - DNA, 20 bp, Artificial
  CRISPR gRNA sequence
aacaggttggttcccagaaa

SEQ ID NO: 570671 - DNA, 20 bp, Artificial
  CRISPR gRNA sequence
gttcccagaaaccaaaatca

SEQ ID NO: 570672 - DNA, 20 bp, Artificial
  CRISPR gRNA sequence
ccagaaaccaaaatcatttt

SEQ ID NO: 570673 - DNA, 20 bp, Artificial
  CRISPR gRNA sequence
tccactcagtgttgttgtag

SEQ ID NO: 570674 - DNA, 20 bp, Artificial
  CRISPR gRNA sequence
ccactcagtgttgttgtaga

SEQ ID NO: 570675 - DNA, 20 bp, Artificial
  CRISPR gRNA sequence
cactcagtgttgttgtagat

SEQ ID NO: 570676 - DNA, 20 bp, Artificial
  CRISPR gRNA sequence
agtgttgttgtagatctcaa

SEQ ID NO: 570677 - DNA, 20 bp, Artificial
  CRISPR gRNA sequence
ttgtagatctcaattaaaga

SEQ ID NO: 570678 - DNA, 20 bp, Artificial
  CRISPR gRNA sequence
tagatctcaattaaagaact

SEQ ID NO: 570679 - DNA, 20 bp, Artificial
  CRISPR gRNA sequence
aattaaagaactaacccagg

SEQ ID NO: 570680 - DNA, 20 bp, Artificial
  CRISPR gRNA sequence
aagaactaacccaggatacc

SEQ ID NO: 570681 - DNA, 20 bp, Artificial
  CRISPR gRNA sequence
acccaggatacctgaactaa

SEQ ID NO: 570682 - DNA, 20 bp, Artificial
  CRISPR gRNA sequence
aactaaagagaggtggcact

SEQ ID NO: 570683 - DNA, 20 bp, Artificial
  CRISPR gRNA sequence
aagagaggtggcactgagtt

SEQ ID NO: 570684 - DNA, 20 bp, Artificial
  CRISPR gRNA sequence
agtttccatagaacttcaaa

SEQ ID NO: 570685 - DNA, 20 bp, Artificial
  CRISPR gRNA sequence
ccatagaacttcaaaacaat

SEQ ID NO: 570686 - DNA, 20 bp, Artificial
  CRISPR gRNA sequence
catagaacttcaaaacaatt

SEQ ID NO: 570687 - DNA, 20 bp, Artificial
  CRISPR gRNA sequence
caaaacaattggttgatttc

SEQ ID NO: 570688 - DNA, 20 bp, Artificial
  CRISPR gRNA sequence
aaaacaattggttgatttca

SEQ ID NO: 570689 - DNA, 20 bp, Artificial
  CRISPR gRNA sequence
gttgatttcacttaaaaaaa

SEQ ID NO: 570690 - DNA, 20 bp, Artificial
  CRISPR gRNA sequence
atttcacttaaaaaaaaaaa

SEQ ID NO: 570691 - DNA, 20 bp, Artificial
  CRISPR gRNA sequence
cacttaaaaaaaaaaaaaaa

SEQ ID NO: 570692 - DNA, 20 bp, Artificial
  CRISPR gRNA sequence
acttaaaaaaaaaaaaaaaa

SEQ ID NO: 570693 - DNA, 20 bp, Artificial
  CRISPR gRNA sequence
aaaaaaaaaaaaaaaagtca

SEQ ID NO: 570694 - DNA, 20 bp, Artificial
  CRISPR gRNA sequence
aaaaaaaaaaaaaaagtcat

SEQ ID NO: 570695 - DNA, 20 bp, Artificial
  CRISPR gRNA sequence
aatatacagaaaattactcc

SEQ ID NO: 570696 - DNA, 20 bp, Artificial
  CRISPR gRNA sequence
ctcccctggtcagtactgtt

SEQ ID NO: 570697 - DNA, 20 bp, Artificial
  CRISPR gRNA sequence
ccctggtcagtactgttagc

SEQ ID NO: 570698 - DNA, 20 bp, Artificial
  CRISPR gRNA sequence
gtcagtactgttagccccag

SEQ ID NO: 570699 - DNA, 20 bp, Artificial
  CRISPR gRNA sequence
ttagccccagataatctgaa

SEQ ID NO: 570700 - DNA, 20 bp, Artificial
  CRISPR gRNA sequence
gccccagataatctgaaaaa

SEQ ID NO: 570701 - DNA, 20 bp, Artificial
  CRISPR gRNA sequence
aaaaaatttgttcttaaaaa

SEQ ID NO: 570702 - DNA, 20 bp, Artificial
  CRISPR gRNA sequence
gttcttaaaaaaaaaaaaca

SEQ ID NO: 570703 - DNA, 20 bp, Artificial
  CRISPR gRNA sequence
ttcttaaaaaaaaaaaacaa

SEQ ID NO: 570704 - DNA, 20 bp, Artificial
  CRISPR gRNA sequence
ttaaaaaaaaaaaacaattt

SEQ ID NO: 570705 - DNA, 20 bp, Artificial
  CRISPR gRNA sequence
aaaaaaaaaaaacaatttgg

SEQ ID NO: 570706 - DNA, 20 bp, Artificial
  CRISPR gRNA sequence
aaaaaaaaaaacaatttgga

SEQ ID NO: 570707 - DNA, 20 bp, Artificial
  CRISPR gRNA sequence
ggaggccaggcatggtggct

SEQ ID NO: 570708 - DNA, 20 bp, Artificial
  CRISPR gRNA sequence
gaggccaggcatggtggctc

SEQ ID NO: 570709 - DNA, 20 bp, Artificial
  CRISPR gRNA sequence
atgcctgtaatcccagcaca

SEQ ID NO: 570710 - DNA, 20 bp, Artificial
  CRISPR gRNA sequence
taatcccagcacattgagag

SEQ ID NO: 570711 - DNA, 20 bp, Artificial
  CRISPR gRNA sequence
agaggtcgagttgtgtgcat

SEQ ID NO: 570712 - DNA, 20 bp, Artificial
  CRISPR gRNA sequence
tgtgcatcacttgagcccag

SEQ ID NO: 570713 - DNA, 20 bp, Artificial
  CRISPR gRNA sequence
gagcccaggagtttgagacc

SEQ ID NO: 570714 - DNA, 20 bp, Artificial
  CRISPR gRNA sequence
agcccaggagtttgagacca

SEQ ID NO: 570715 - DNA, 20 bp, Artificial
  CRISPR gRNA sequence
gagaccagcctggacaacat

SEQ ID NO: 570716 - DNA, 20 bp, Artificial
  CRISPR gRNA sequence
agaccagcctggacaacatg

SEQ ID NO: 570717 - DNA, 20 bp, Artificial
  CRISPR gRNA sequence
gacaacatggtgaaacacta

SEQ ID NO: 570718 - DNA, 20 bp, Artificial
  CRISPR gRNA sequence
tctctacaaaaaaatacaaa

SEQ ID NO: 570719 - DNA, 20 bp, Artificial
  CRISPR gRNA sequence
tacaaaaaaatacaaaaatt

SEQ ID NO: 570720 - DNA, 20 bp, Artificial
  CRISPR gRNA sequence
caaaaaaatacaaaaattag

SEQ ID NO: 570721 - DNA, 20 bp, Artificial
  CRISPR gRNA sequence
gccaggcatggtggtgcatg

SEQ ID NO: 570722 - DNA, 20 bp, Artificial
  CRISPR gRNA sequence
tagtcccagctactcaggag

SEQ ID NO: 570723 - DNA, 20 bp, Artificial
  CRISPR gRNA sequence
ctcaggaggctgaggcggga

SEQ ID NO: 570724 - DNA, 20 bp, Artificial
  CRISPR gRNA sequence
aggaggctgaggcgggaggg

SEQ ID NO: 570725 - DNA, 20 bp, Artificial
  CRISPR gRNA sequence
aggcgggagggaggcagatg

SEQ ID NO: 570726 - DNA, 20 bp, Artificial
  CRISPR gRNA sequence
cagtgagctgagattgtgcc

SEQ ID NO: 570727 - DNA, 20 bp, Artificial
  CRISPR gRNA sequence
agattgtgccactgcactcc

SEQ ID NO: 570728 - DNA, 20 bp, Artificial
  CRISPR gRNA sequence
tgccactgcactccagcctg

SEQ ID NO: 570729 - DNA, 20 bp, Artificial
  CRISPR gRNA sequence
cactccagcctgggtgatgg

SEQ ID NO: 570730 - DNA, 20 bp, Artificial
  CRISPR gRNA sequence
cagcctgggtgatggagtga

SEQ ID NO: 570731 - DNA, 20 bp, Artificial
  CRISPR gRNA sequence
ggtgatggagtgagaccctg

SEQ ID NO: 570732 - DNA, 20 bp, Artificial
  CRISPR gRNA sequence
tctcaaaaaacaaacaaaca

SEQ ID NO: 570733 - DNA, 20 bp, Artificial
  CRISPR gRNA sequence
aaaaaacaaacaaacaaaaa

SEQ ID NO: 570734 - DNA, 20 bp, Artificial
  CRISPR gRNA sequence
agcaagcatctcaaccttta

SEQ ID NO: 570735 - DNA, 20 bp, Artificial
  CRISPR gRNA sequence
aacctttaagcaaccttaaa

SEQ ID NO: 570736 - DNA, 20 bp, Artificial
  CRISPR gRNA sequence
taagcaaccttaaagtcatt

SEQ ID NO: 570737 - DNA, 20 bp, Artificial
  CRISPR gRNA sequence
aagcaaccttaaagtcatta

SEQ ID NO: 570738 - DNA, 20 bp, Artificial
  CRISPR gRNA sequence
agcaaccttaaagtcattaa

SEQ ID NO: 570739 - DNA, 20 bp, Artificial
  CRISPR gRNA sequence
aaagtcattaattgggaaat

SEQ ID NO: 570740 - DNA, 20 bp, Artificial
  CRISPR gRNA sequence
aagtcattaattgggaaata

SEQ ID NO: 570741 - DNA, 20 bp, Artificial
  CRISPR gRNA sequence
attgggaaatagtgagatgt

SEQ ID NO: 570742 - DNA, 20 bp, Artificial
  CRISPR gRNA sequence
ggaaatagtgagatgtttgg

SEQ ID NO: 570743 - DNA, 20 bp, Artificial
  CRISPR gRNA sequence
ggcatggaatcttcagaaga

SEQ ID NO: 570744 - DNA, 20 bp, Artificial
  CRISPR gRNA sequence
gcatggaatcttcagaagag

SEQ ID NO: 570745 - DNA, 20 bp, Artificial
  CRISPR gRNA sequence
cagaagaggaaagagttgaa

SEQ ID NO: 570746 - DNA, 20 bp, Artificial
  CRISPR gRNA sequence
agaagaggaaagagttgaat

SEQ ID NO: 570747 - DNA, 20 bp, Artificial
  CRISPR gRNA sequence
aatggaaacagctccagctg

SEQ ID NO: 570748 - DNA, 20 bp, Artificial
  CRISPR gRNA sequence
cagctgcctagttgtagttg

SEQ ID NO: 570749 - DNA, 20 bp, Artificial
  CRISPR gRNA sequence
cctagttgtagttgacagac

SEQ ID NO: 570750 - DNA, 20 bp, Artificial
  CRISPR gRNA sequence
gttgtagttgacagacaact

SEQ ID NO: 570751 - DNA, 20 bp, Artificial
  CRISPR gRNA sequence
tagttgacagacaactttat

SEQ ID NO: 570752 - DNA, 20 bp, Artificial
  CRISPR gRNA sequence
acagacaactttataagctc

SEQ ID NO: 570753 - DNA, 20 bp, Artificial
  CRISPR gRNA sequence
tataagctctagtcaaccct

SEQ ID NO: 570754 - DNA, 20 bp, Artificial
  CRISPR gRNA sequence
ataagctctagtcaacccta

SEQ ID NO: 570755 - DNA, 20 bp, Artificial
  CRISPR gRNA sequence
taagctctagtcaaccctat

SEQ ID NO: 570756 - DNA, 20 bp, Artificial
  CRISPR gRNA sequence
tagtcaaccctattgactaa

SEQ ID NO: 570757 - DNA, 20 bp, Artificial
  CRISPR gRNA sequence
gtcaaccctattgactaagc

SEQ ID NO: 570758 - DNA, 20 bp, Artificial
  CRISPR gRNA sequence
ttgactaagcttctgaacca

SEQ ID NO: 570759 - DNA, 20 bp, Artificial
  CRISPR gRNA sequence
actaagcttctgaaccacta

SEQ ID NO: 570760 - DNA, 20 bp, Artificial
  CRISPR gRNA sequence
agcttctgaaccactagcat

SEQ ID NO: 570761 - DNA, 20 bp, Artificial
  CRISPR gRNA sequence
ctgaaccactagcatagttc

SEQ ID NO: 570762 - DNA, 20 bp, Artificial
  CRISPR gRNA sequence
tgaaccactagcatagttct

SEQ ID NO: 570763 - DNA, 20 bp, Artificial
  CRISPR gRNA sequence
aaccactagcatagttctag

SEQ ID NO: 570764 - DNA, 20 bp, Artificial
  CRISPR gRNA sequence
gcatagttctagggtcaggc

SEQ ID NO: 570765 - DNA, 20 bp, Artificial
  CRISPR gRNA sequence
tagggtcaggcggatgccta

SEQ ID NO: 570766 - DNA, 20 bp, Artificial
  CRISPR gRNA sequence
gggtcaggcggatgcctact

SEQ ID NO: 570767 - DNA, 20 bp, Artificial
  CRISPR gRNA sequence
ctgtgggcaggaaagtgatg

SEQ ID NO: 570768 - DNA, 20 bp, Artificial
  CRISPR gRNA sequence
tgggcaggaaagtgatgcat

SEQ ID NO: 570769 - DNA, 20 bp, Artificial
  CRISPR gRNA sequence
aatgtctgaaatagtagcca

SEQ ID NO: 570770 - DNA, 20 bp, Artificial
  CRISPR gRNA sequence
atgtctgaaatagtagccat

SEQ ID NO: 570771 - DNA, 20 bp, Artificial
  CRISPR gRNA sequence
aaatagtagccatgagctac

SEQ ID NO: 570772 - DNA, 20 bp, Artificial
  CRISPR gRNA sequence
catgtggctatggagcactt

SEQ ID NO: 570773 - DNA, 20 bp, Artificial
  CRISPR gRNA sequence
tggagcacttgaaatgtggg

SEQ ID NO: 570774 - DNA, 20 bp, Artificial
  CRISPR gRNA sequence
gaaatgtgggagtccaaatt

SEQ ID NO: 570775 - DNA, 20 bp, Artificial
  CRISPR gRNA sequence
aaatgtgggagtccaaatta

SEQ ID NO: 570776 - DNA, 20 bp, Artificial
  CRISPR gRNA sequence
tcatgtgctgtgagtgtaaa

SEQ ID NO: 570777 - DNA, 20 bp, Artificial
  CRISPR gRNA sequence
tgagtgtaaaataatatgtt

SEQ ID NO: 570778 - DNA, 20 bp, Artificial
  CRISPR gRNA sequence
ctaagaccgtgtgtgaaaga

SEQ ID NO: 570779 - DNA, 20 bp, Artificial
  CRISPR gRNA sequence
taagaccgtgtgtgaaagaa

SEQ ID NO: 570780 - DNA, 20 bp, Artificial
  CRISPR gRNA sequence
agaccgtgtgtgaaagaata

SEQ ID NO: 570781 - DNA, 20 bp, Artificial
  CRISPR gRNA sequence
attaaaaaatgtttatattg

SEQ ID NO: 570782 - DNA, 20 bp, Artificial
  CRISPR gRNA sequence
aaaaatgtttatattgagta

SEQ ID NO: 570783 - DNA, 20 bp, Artificial
  CRISPR gRNA sequence
atattgagtacatgttgaaa

SEQ ID NO: 570784 - DNA, 20 bp, Artificial
  CRISPR gRNA sequence
tattgagtacatgttgaaat

SEQ ID NO: 570785 - DNA, 20 bp, Artificial
  CRISPR gRNA sequence
agtacatgttgaaataattt

SEQ ID NO: 570786 - DNA, 20 bp, Artificial
  CRISPR gRNA sequence
aaataattttatatttgtga

SEQ ID NO: 570787 - DNA, 20 bp, Artificial
  CRISPR gRNA sequence
tatatttgtgacacattgtg

SEQ ID NO: 570788 - DNA, 20 bp, Artificial
  CRISPR gRNA sequence
atatttgtgacacattgtgt

SEQ ID NO: 570789 - DNA, 20 bp, Artificial
  CRISPR gRNA sequence
tatttgtgacacattgtgtt

SEQ ID NO: 570790 - DNA, 20 bp, Artificial
  CRISPR gRNA sequence
gtgacacattgtgttaaata

SEQ ID NO: 570791 - DNA, 20 bp, Artificial
  CRISPR gRNA sequence
tgacacattgtgttaaataa

SEQ ID NO: 570792 - DNA, 20 bp, Artificial
  CRISPR gRNA sequence
tgttaaataaaatattaaaa

SEQ ID NO: 570793 - DNA, 20 bp, Artificial
  CRISPR gRNA sequence
aataaaatattaaaatttac

SEQ ID NO: 570794 - DNA, 20 bp, Artificial
  CRISPR gRNA sequence
aaatttacatttttttttac

SEQ ID NO: 570795 - DNA, 20 bp, Artificial
  CRISPR gRNA sequence
acatttttttttactttgta

SEQ ID NO: 570796 - DNA, 20 bp, Artificial
  CRISPR gRNA sequence
catttttttttactttgtaa

SEQ ID NO: 570797 - DNA, 20 bp, Artificial
  CRISPR gRNA sequence
ttttttactttgtaatgtgg

SEQ ID NO: 570798 - DNA, 20 bp, Artificial
  CRISPR gRNA sequence
tttttactttgtaatgtgga

SEQ ID NO: 570799 - DNA, 20 bp, Artificial
  CRISPR gRNA sequence
ttttactttgtaatgtggat

SEQ ID NO: 570800 - DNA, 20 bp, Artificial
  CRISPR gRNA sequence
tttactttgtaatgtggata

SEQ ID NO: 570801 - DNA, 20 bp, Artificial
  CRISPR gRNA sequence
ttactttgtaatgtggatac

SEQ ID NO: 570802 - DNA, 20 bp, Artificial
  CRISPR gRNA sequence
tactttgtaatgtggatacc

SEQ ID NO: 570803 - DNA, 20 bp, Artificial
  CRISPR gRNA sequence
actttgtaatgtggatacca

SEQ ID NO: 570804 - DNA, 20 bp, Artificial
  CRISPR gRNA sequence
ctttgtaatgtggataccaa

SEQ ID NO: 570805 - DNA, 20 bp, Artificial
  CRISPR gRNA sequence
tgtaatgtggataccaaaaa

SEQ ID NO: 570806 - DNA, 20 bp, Artificial
  CRISPR gRNA sequence
gtaatgtggataccaaaaat

SEQ ID NO: 570807 - DNA, 20 bp, Artificial
  CRISPR gRNA sequence
taatgtggataccaaaaatt

SEQ ID NO: 570808 - DNA, 20 bp, Artificial
  CRISPR gRNA sequence
taaattacttatgtggcttg

SEQ ID NO: 570809 - DNA, 20 bp, Artificial
  CRISPR gRNA sequence
aaattacttatgtggcttgc

SEQ ID NO: 570810 - DNA, 20 bp, Artificial
  CRISPR gRNA sequence
aattacttatgtggcttgca

SEQ ID NO: 570811 - DNA, 20 bp, Artificial
  CRISPR gRNA sequence
cttatgtggcttgcattata

SEQ ID NO: 570812 - DNA, 20 bp, Artificial
  CRISPR gRNA sequence
atgtggcttgcattatattt

SEQ ID NO: 570813 - DNA, 20 bp, Artificial
  CRISPR gRNA sequence
tgtggcttgcattatatttc

SEQ ID NO: 570814 - DNA, 20 bp, Artificial
  CRISPR gRNA sequence
gcattatatttctattggac

SEQ ID NO: 570815 - DNA, 20 bp, Artificial
  CRISPR gRNA sequence
cattatatttctattggaca

SEQ ID NO: 570816 - DNA, 20 bp, Artificial
  CRISPR gRNA sequence
tatttctattggacagcact

SEQ ID NO: 570817 - DNA, 20 bp, Artificial
  CRISPR gRNA sequence
ctattggacagcactggtcc

SEQ ID NO: 570818 - DNA, 20 bp, Artificial
  CRISPR gRNA sequence
tattggacagcactggtcca

SEQ ID NO: 570819 - DNA, 20 bp, Artificial
  CRISPR gRNA sequence
ttggacagcactggtccaaa

SEQ ID NO: 570820 - DNA, 20 bp, Artificial
  CRISPR gRNA sequence
gacagcactggtccaaacta

SEQ ID NO: 570821 - DNA, 20 bp, Artificial
  CRISPR gRNA sequence
gtccaaactattctagcctt

SEQ ID NO: 570822 - DNA, 20 bp, Artificial
  CRISPR gRNA sequence
ttctagccttccctgcatct

SEQ ID NO: 570823 - DNA, 20 bp, Artificial
  CRISPR gRNA sequence
tagccttccctgcatcttca

SEQ ID NO: 570824 - DNA, 20 bp, Artificial
  CRISPR gRNA sequence
gccttccctgcatcttcagc

SEQ ID NO: 570825 - DNA, 20 bp, Artificial
  CRISPR gRNA sequence
ccctgcatcttcagccttat

SEQ ID NO: 570826 - DNA, 20 bp, Artificial
  CRISPR gRNA sequence
cctgcatcttcagccttatg

SEQ ID NO: 570827 - DNA, 20 bp, Artificial
  CRISPR gRNA sequence
catcttcagccttatgcacg

SEQ ID NO: 570828 - DNA, 20 bp, Artificial
  CRISPR gRNA sequence
cagccttatgcacgaggtaa

SEQ ID NO: 570829 - DNA, 20 bp, Artificial
  CRISPR gRNA sequence
agccttatgcacgaggtaaa

SEQ ID NO: 570830 - DNA, 20 bp, Artificial
  CRISPR gRNA sequence
atgcacgaggtaaaattagc

SEQ ID NO: 570831 - DNA, 20 bp, Artificial
  CRISPR gRNA sequence
tgcacgaggtaaaattagcc

SEQ ID NO: 570832 - DNA, 20 bp, Artificial
  CRISPR gRNA sequence
gccattttgtcaacagtttt

SEQ ID NO: 570833 - DNA, 20 bp, Artificial
  CRISPR gRNA sequence
tgtcaacagtttttgcattt

SEQ ID NO: 570834 - DNA, 20 bp, Artificial
  CRISPR gRNA sequence
gtcaacagtttttgcatttg

SEQ ID NO: 570835 - DNA, 20 bp, Artificial
  CRISPR gRNA sequence
tcaacagtttttgcatttgg

SEQ ID NO: 570836 - DNA, 20 bp, Artificial
  CRISPR gRNA sequence
ttgcatttggttttctatca

SEQ ID NO: 570837 - DNA, 20 bp, Artificial
  CRISPR gRNA sequence
tgcatttggttttctatcat

SEQ ID NO: 570838 - DNA, 20 bp, Artificial
  CRISPR gRNA sequence
gcatttggttttctatcatg

SEQ ID NO: 570839 - DNA, 20 bp, Artificial
  CRISPR gRNA sequence
catttggttttctatcatgt

SEQ ID NO: 570840 - DNA, 20 bp, Artificial
  CRISPR gRNA sequence
ggttttctatcatgttctga

SEQ ID NO: 570841 - DNA, 20 bp, Artificial
  CRISPR gRNA sequence
gttttctatcatgttctgac

SEQ ID NO: 570842 - DNA, 20 bp, Artificial
  CRISPR gRNA sequence
tctatcatgttctgaccaat

SEQ ID NO: 570843 - DNA, 20 bp, Artificial
  CRISPR gRNA sequence
ctatcatgttctgaccaatt

SEQ ID NO: 570844 - DNA, 20 bp, Artificial
  CRISPR gRNA sequence
tatcatgttctgaccaattt

SEQ ID NO: 570845 - DNA, 20 bp, Artificial
  CRISPR gRNA sequence
tcatgttctgaccaattttt

SEQ ID NO: 570846 - DNA, 20 bp, Artificial
  CRISPR gRNA sequence
tgaccaatttttgaacaact

SEQ ID NO: 570847 - DNA, 20 bp, Artificial
  CRISPR gRNA sequence
accaatttttgaacaactct

SEQ ID NO: 570848 - DNA, 20 bp, Artificial
  CRISPR gRNA sequence
ttgaacaactctttggacca

SEQ ID NO: 570849 - DNA, 20 bp, Artificial
  CRISPR gRNA sequence
tgaacaactctttggaccag

SEQ ID NO: 570850 - DNA, 20 bp, Artificial
  CRISPR gRNA sequence
gaacaactctttggaccagc

SEQ ID NO: 570851 - DNA, 20 bp, Artificial
  CRISPR gRNA sequence
aacaactctttggaccagct

SEQ ID NO: 570852 - DNA, 20 bp, Artificial
  CRISPR gRNA sequence
tttggaccagctctgtagcc

SEQ ID NO: 570853 - DNA, 20 bp, Artificial
  CRISPR gRNA sequence
tggaccagctctgtagccga

SEQ ID NO: 570854 - DNA, 20 bp, Artificial
  CRISPR gRNA sequence
ggaccagctctgtagccgat

SEQ ID NO: 570855 - DNA, 20 bp, Artificial
  CRISPR gRNA sequence
gaccagctctgtagccgatt

SEQ ID NO: 570856 - DNA, 20 bp, Artificial
  CRISPR gRNA sequence
tgtagccgatttgatttaaa

SEQ ID NO: 570857 - DNA, 20 bp, Artificial
  CRISPR gRNA sequence
tagccgatttgatttaaagc

SEQ ID NO: 570858 - DNA, 20 bp, Artificial
  CRISPR gRNA sequence
gatttaaagcatataggata

SEQ ID NO: 570859 - DNA, 20 bp, Artificial
  CRISPR gRNA sequence
atttaaagcatataggatag

SEQ ID NO: 570860 - DNA, 20 bp, Artificial
  CRISPR gRNA sequence
aaagcatataggatagcagg

SEQ ID NO: 570861 - DNA, 20 bp, Artificial
  CRISPR gRNA sequence
aagcatataggatagcagga

SEQ ID NO: 570862 - DNA, 20 bp, Artificial
  CRISPR gRNA sequence
tggcttagttttccatattt

SEQ ID NO: 570863 - DNA, 20 bp, Artificial
  CRISPR gRNA sequence
gcttagttttccatatttag

SEQ ID NO: 570864 - DNA, 20 bp, Artificial
  CRISPR gRNA sequence
agttttccatatttaggcct

SEQ ID NO: 570865 - DNA, 20 bp, Artificial
  CRISPR gRNA sequence
gttttccatatttaggcctc

SEQ ID NO: 570866 - DNA, 20 bp, Artificial
  CRISPR gRNA sequence
tccatatttaggcctctaat

SEQ ID NO: 570867 - DNA, 20 bp, Artificial
  CRISPR gRNA sequence
ccatatttaggcctctaata

SEQ ID NO: 570868 - DNA, 20 bp, Artificial
  CRISPR gRNA sequence
catatttaggcctctaatag

SEQ ID NO: 570869 - DNA, 20 bp, Artificial
  CRISPR gRNA sequence
aggcctctaataggcagtca

SEQ ID NO: 570870 - DNA, 20 bp, Artificial
  CRISPR gRNA sequence
ggcctctaataggcagtcag

SEQ ID NO: 570871 - DNA, 20 bp, Artificial
  CRISPR gRNA sequence
taataggcagtcagtaactc

SEQ ID NO: 570872 - DNA, 20 bp, Artificial
  CRISPR gRNA sequence
ataggcagtcagtaactcca

SEQ ID NO: 570873 - DNA, 20 bp, Artificial
  CRISPR gRNA sequence
cacatttcaccttttctttt

SEQ ID NO: 570874 - DNA, 20 bp, Artificial
  CRISPR gRNA sequence
caccttttcttttcagttct

SEQ ID NO: 570875 - DNA, 20 bp, Artificial
  CRISPR gRNA sequence
accttttcttttcagttctt

SEQ ID NO: 570876 - DNA, 20 bp, Artificial
  CRISPR gRNA sequence
ttcttttcagttctttaatt

SEQ ID NO: 570877 - DNA, 20 bp, Artificial
  CRISPR gRNA sequence
tcttttcagttctttaattg

SEQ ID NO: 570878 - DNA, 20 bp, Artificial
  CRISPR gRNA sequence
cttttcagttctttaattga

SEQ ID NO: 570879 - DNA, 20 bp, Artificial
  CRISPR gRNA sequence
ttttcagttctttaattgag

SEQ ID NO: 570880 - DNA, 20 bp, Artificial
  CRISPR gRNA sequence
ttcagttctttaattgagaa

SEQ ID NO: 570881 - DNA, 20 bp, Artificial
  CRISPR gRNA sequence
tcagttctttaattgagaag

SEQ ID NO: 570882 - DNA, 20 bp, Artificial
  CRISPR gRNA sequence
cagttctttaattgagaaga

SEQ ID NO: 570883 - DNA, 20 bp, Artificial
  CRISPR gRNA sequence
agttctttaattgagaagac

SEQ ID NO: 570884 - DNA, 20 bp, Artificial
  CRISPR gRNA sequence
tttaattgagaagacaattt

SEQ ID NO: 570885 - DNA, 20 bp, Artificial
  CRISPR gRNA sequence
taattgagaagacaatttct

SEQ ID NO: 570886 - DNA, 20 bp, Artificial
  CRISPR gRNA sequence
aattgagaagacaatttctt

SEQ ID NO: 570887 - DNA, 20 bp, Artificial
  CRISPR gRNA sequence
attgagaagacaatttcttc

SEQ ID NO: 570888 - DNA, 20 bp, Artificial
  CRISPR gRNA sequence
agaagacaatttcttcattt

SEQ ID NO: 570889 - DNA, 20 bp, Artificial
  CRISPR gRNA sequence
cttcatttttaggtattctg

SEQ ID NO: 570890 - DNA, 20 bp, Artificial
  CRISPR gRNA sequence
ttcatttttaggtattctga

SEQ ID NO: 570891 - DNA, 20 bp, Artificial
  CRISPR gRNA sequence
catttttaggtattctgaaa

SEQ ID NO: 570892 - DNA, 20 bp, Artificial
  CRISPR gRNA sequence
atttttaggtattctgaaat

SEQ ID NO: 570893 - DNA, 20 bp, Artificial
  CRISPR gRNA sequence
ttaggtattctgaaatgtga

SEQ ID NO: 570894 - DNA, 20 bp, Artificial
  CRISPR gRNA sequence
taggtattctgaaatgtgac

SEQ ID NO: 570895 - DNA, 20 bp, Artificial
  CRISPR gRNA sequence
aggtattctgaaatgtgaca

SEQ ID NO: 570896 - DNA, 20 bp, Artificial
  CRISPR gRNA sequence
ggtattctgaaatgtgacag

SEQ ID NO: 570897 - DNA, 20 bp, Artificial
  CRISPR gRNA sequence
tgaaatgtgacagaaaacca

SEQ ID NO: 570898 - DNA, 20 bp, Artificial
  CRISPR gRNA sequence
aaatgtgacagaaaaccaga

SEQ ID NO: 570899 - DNA, 20 bp, Artificial
  CRISPR gRNA sequence
caggctgtgcactctgtgcc

SEQ ID NO: 570900 - DNA, 20 bp, Artificial
  CRISPR gRNA sequence
tgcactctgtgccagaacaa

SEQ ID NO: 570901 - DNA, 20 bp, Artificial
  CRISPR gRNA sequence
tgtgccagaacaacagcagc

SEQ ID NO: 570902 - DNA, 20 bp, Artificial
  CRISPR gRNA sequence
tgccagaacaacagcagccc

SEQ ID NO: 570903 - DNA, 20 bp, Artificial
  CRISPR gRNA sequence
ctgtagatgcccattacttg

SEQ ID NO: 570904 - DNA, 20 bp, Artificial
  CRISPR gRNA sequence
tagatgcccattacttggga

SEQ ID NO: 570905 - DNA, 20 bp, Artificial
  CRISPR gRNA sequence
cttgggaagccagattgtac

SEQ ID NO: 570906 - DNA, 20 bp, Artificial
  CRISPR gRNA sequence
gggaagccagattgtactca

SEQ ID NO: 570907 - DNA, 20 bp, Artificial
  CRISPR gRNA sequence
ggaagccagattgtactcat

SEQ ID NO: 570908 - DNA, 20 bp, Artificial
  CRISPR gRNA sequence
tactcatctgttggttgcct

SEQ ID NO: 570909 - DNA, 20 bp, Artificial
  CRISPR gRNA sequence
atctgttggttgccttgtac

SEQ ID NO: 570910 - DNA, 20 bp, Artificial
  CRISPR gRNA sequence
ttggttgccttgtacagtaa

SEQ ID NO: 570911 - DNA, 20 bp, Artificial
  CRISPR gRNA sequence
gttgccttgtacagtaataa

SEQ ID NO: 570912 - DNA, 20 bp, Artificial
  CRISPR gRNA sequence
ccttgtacagtaataagaag

SEQ ID NO: 570913 - DNA, 20 bp, Artificial
  CRISPR gRNA sequence
gtacagtaataagaagtaac

SEQ ID NO: 570914 - DNA, 20 bp, Artificial
  CRISPR gRNA sequence
tacagtaataagaagtaaca

SEQ ID NO: 570915 - DNA, 20 bp, Artificial
  CRISPR gRNA sequence
accatagtgtattaagtacc

SEQ ID NO: 570916 - DNA, 20 bp, Artificial
  CRISPR gRNA sequence
agtaccaactgtgtgccatg

SEQ ID NO: 570917 - DNA, 20 bp, Artificial
  CRISPR gRNA sequence
tgtgccatgcactgcactag

SEQ ID NO: 570918 - DNA, 20 bp, Artificial
  CRISPR gRNA sequence
cactagccactctctgcata

SEQ ID NO: 570919 - DNA, 20 bp, Artificial
  CRISPR gRNA sequence
gccactctctgcatatcgtt

SEQ ID NO: 570920 - DNA, 20 bp, Artificial
  CRISPR gRNA sequence
tctgcatatcgtttcctgga

SEQ ID NO: 570921 - DNA, 20 bp, Artificial
  CRISPR gRNA sequence
tgcatatcgtttcctggaac

SEQ ID NO: 570922 - DNA, 20 bp, Artificial
  CRISPR gRNA sequence
catatcgtttcctggaaccc

SEQ ID NO: 570923 - DNA, 20 bp, Artificial
  CRISPR gRNA sequence
cctggaaccctctcaatgag

SEQ ID NO: 570924 - DNA, 20 bp, Artificial
  CRISPR gRNA sequence
ctggaaccctctcaatgagc

SEQ ID NO: 570925 - DNA, 20 bp, Artificial
  CRISPR gRNA sequence
gaaccctctcaatgagcctt

SEQ ID NO: 570926 - DNA, 20 bp, Artificial
  CRISPR gRNA sequence
tcaatgagccttgcaggagg

SEQ ID NO: 570927 - DNA, 20 bp, Artificial
  CRISPR gRNA sequence
aatgagccttgcaggaggag

SEQ ID NO: 570928 - DNA, 20 bp, Artificial
  CRISPR gRNA sequence
gcaggaggagtatcataccc

SEQ ID NO: 570929 - DNA, 20 bp, Artificial
  CRISPR gRNA sequence
caggaggagtatcatacccc

SEQ ID NO: 570930 - DNA, 20 bp, Artificial
  CRISPR gRNA sequence
gcttagagacagcgcatatg

SEQ ID NO: 570931 - DNA, 20 bp, Artificial
  CRISPR gRNA sequence
cttagagacagcgcatatga

SEQ ID NO: 570932 - DNA, 20 bp, Artificial
  CRISPR gRNA sequence
agagacagcgcatatgagat

SEQ ID NO: 570933 - DNA, 20 bp, Artificial
  CRISPR gRNA sequence
gagacagcgcatatgagatt

SEQ ID NO: 570934 - DNA, 20 bp, Artificial
  CRISPR gRNA sequence
atagaagtcaagtgagatat

SEQ ID NO: 570935 - DNA, 20 bp, Artificial
  CRISPR gRNA sequence
ctagtaagtgatgggctggg

SEQ ID NO: 570936 - DNA, 20 bp, Artificial
  CRISPR gRNA sequence
gtaagtgatgggctgggatt

SEQ ID NO: 570937 - DNA, 20 bp, Artificial
  CRISPR gRNA sequence
ggatttaaatctaggtcttt

SEQ ID NO: 570938 - DNA, 20 bp, Artificial
  CRISPR gRNA sequence
aaatctaggtctttggactc

SEQ ID NO: 570939 - DNA, 20 bp, Artificial
  CRISPR gRNA sequence
aatctaggtctttggactcc

SEQ ID NO: 570940 - DNA, 20 bp, Artificial
  CRISPR gRNA sequence
ggtctttggactccaagagt

SEQ ID NO: 570941 - DNA, 20 bp, Artificial
  CRISPR gRNA sequence
tggactccaagagttatact

SEQ ID NO: 570942 - DNA, 20 bp, Artificial
  CRISPR gRNA sequence
ggactccaagagttatactg

SEQ ID NO: 570943 - DNA, 20 bp, Artificial
  CRISPR gRNA sequence
gactccaagagttatactgt

SEQ ID NO: 570944 - DNA, 20 bp, Artificial
  CRISPR gRNA sequence
caagagttatactgttaacc

SEQ ID NO: 570945 - DNA, 20 bp, Artificial
  CRISPR gRNA sequence
tactgttaaccactacaata

SEQ ID NO: 570946 - DNA, 20 bp, Artificial
  CRISPR gRNA sequence
ttaaccactacaatacactc

SEQ ID NO: 570947 - DNA, 20 bp, Artificial
  CRISPR gRNA sequence
accactacaatacactccct

SEQ ID NO: 570948 - DNA, 20 bp, Artificial
  CRISPR gRNA sequence
caatacactccctccacctc

SEQ ID NO: 570949 - DNA, 20 bp, Artificial
  CRISPR gRNA sequence
cctccacctcccatcccaga

SEQ ID NO: 570950 - DNA, 20 bp, Artificial
  CRISPR gRNA sequence
cacctcccatcccagaaaaa

SEQ ID NO: 570951 - DNA, 20 bp, Artificial
  CRISPR gRNA sequence
ccatcccagaaaaagttgga

SEQ ID NO: 570952 - DNA, 20 bp, Artificial
  CRISPR gRNA sequence
gatcagggatagggttcact

SEQ ID NO: 570953 - DNA, 20 bp, Artificial
  CRISPR gRNA sequence
acttcaggagccagggtcag

SEQ ID NO: 570954 - DNA, 20 bp, Artificial
  CRISPR gRNA sequence
caggagccagggtcagagct

SEQ ID NO: 570955 - DNA, 20 bp, Artificial
  CRISPR gRNA sequence
aggagccagggtcagagctg

SEQ ID NO: 570956 - DNA, 20 bp, Artificial
  CRISPR gRNA sequence
ggcctgtagtcacatataaa

SEQ ID NO: 570957 - DNA, 20 bp, Artificial
  CRISPR gRNA sequence
tagtcacatataaaagatag

SEQ ID NO: 570958 - DNA, 20 bp, Artificial
  CRISPR gRNA sequence
gcagcagtgttggtttaata

SEQ ID NO: 570959 - DNA, 20 bp, Artificial
  CRISPR gRNA sequence
gtttaataaaccgccgtagg

SEQ ID NO: 570960 - DNA, 20 bp, Artificial
  CRISPR gRNA sequence
aataaaccgccgtagggtgc

SEQ ID NO: 570961 - DNA, 20 bp, Artificial
  CRISPR gRNA sequence
ataaaccgccgtagggtgct

SEQ ID NO: 570962 - DNA, 20 bp, Artificial
  CRISPR gRNA sequence
caagaggccccctcctggca

SEQ ID NO: 570963 - DNA, 20 bp, Artificial
  CRISPR gRNA sequence
ctggcagatcccactggtgg

SEQ ID NO: 570964 - DNA, 20 bp, Artificial
  CRISPR gRNA sequence
gcagatcccactggtggtca

SEQ ID NO: 570965 - DNA, 20 bp, Artificial
  CRISPR gRNA sequence
gtggtcaggaggcagaggca

SEQ ID NO: 570966 - DNA, 20 bp, Artificial
  CRISPR gRNA sequence
ggtgttgagggatgagggga

SEQ ID NO: 570967 - DNA, 20 bp, Artificial
  CRISPR gRNA sequence
agggatgaggggaagagtta

SEQ ID NO: 570968 - DNA, 20 bp, Artificial
  CRISPR gRNA sequence
tagctacttcctccgctgtc

SEQ ID NO: 570969 - DNA, 20 bp, Artificial
  CRISPR gRNA sequence
ctgtccagttcctcctgctg

SEQ ID NO: 570970 - DNA, 20 bp, Artificial
  CRISPR gRNA sequence
agttcctcctgctgcggcct

SEQ ID NO: 570971 - DNA, 20 bp, Artificial
  CRISPR gRNA sequence
tcctgctgcggccttggacc

SEQ ID NO: 570972 - DNA, 20 bp, Artificial
  CRISPR gRNA sequence
cactgaccgcaacccttata

SEQ ID NO: 570973 - DNA, 20 bp, Artificial
  CRISPR gRNA sequence
actgaccgcaacccttatat

SEQ ID NO: 570974 - DNA, 20 bp, Artificial
  CRISPR gRNA sequence
ctgaccgcaacccttatatg

SEQ ID NO: 570975 - DNA, 20 bp, Artificial
  CRISPR gRNA sequence
gcaacccttatatggggtga

SEQ ID NO: 570976 - DNA, 20 bp, Artificial
  CRISPR gRNA sequence
ccttatatggggtgatagtc

SEQ ID NO: 570977 - DNA, 20 bp, Artificial
  CRISPR gRNA sequence
tggggtgatagtccagcatg

SEQ ID NO: 570978 - DNA, 20 bp, Artificial
  CRISPR gRNA sequence
ggggtgatagtccagcatgt

SEQ ID NO: 570979 - DNA, 20 bp, Artificial
  CRISPR gRNA sequence
gggtgatagtccagcatgtg

SEQ ID NO: 570980 - DNA, 20 bp, Artificial
  CRISPR gRNA sequence
gtgatagtccagcatgtggg

SEQ ID NO: 570981 - DNA, 20 bp, Artificial
  CRISPR gRNA sequence
agtccagcatgtggggagct

SEQ ID NO: 570982 - DNA, 20 bp, Artificial
  CRISPR gRNA sequence
gcatgtggggagctcggctg

SEQ ID NO: 570983 - DNA, 20 bp, Artificial
  CRISPR gRNA sequence
ggagctcggctgcagtttat

SEQ ID NO: 570984 - DNA, 20 bp, Artificial
  CRISPR gRNA sequence
gagctcggctgcagtttatt

SEQ ID NO: 570985 - DNA, 20 bp, Artificial
  CRISPR gRNA sequence
agctcggctgcagtttattg

SEQ ID NO: 570986 - DNA, 20 bp, Artificial
  CRISPR gRNA sequence
cggctgcagtttattgggga

SEQ ID NO: 570987 - DNA, 20 bp, Artificial
  CRISPR gRNA sequence
gtttattggggacggtactg

SEQ ID NO: 570988 - DNA, 20 bp, Artificial
  CRISPR gRNA sequence
tttattggggacggtactgt

SEQ ID NO: 570989 - DNA, 20 bp, Artificial
  CRISPR gRNA sequence
ttggggacggtactgtgggt

SEQ ID NO: 570990 - DNA, 20 bp, Artificial
  CRISPR gRNA sequence
tggggacggtactgtgggtt

SEQ ID NO: 570991 - DNA, 20 bp, Artificial
  CRISPR gRNA sequence
ggggacggtactgtgggttg

SEQ ID NO: 570992 - DNA, 20 bp, Artificial
  CRISPR gRNA sequence
gggacggtactgtgggttgg

SEQ ID NO: 570993 - DNA, 20 bp, Artificial
  CRISPR gRNA sequence
gtactgtgggttgggggcct

SEQ ID NO: 570994 - DNA, 20 bp, Artificial
  CRISPR gRNA sequence
gccttggatcccaaataaat

SEQ ID NO: 570995 - DNA, 20 bp, Artificial
  CRISPR gRNA sequence
ttggatcccaaataaatgag

SEQ ID NO: 570996 - DNA, 20 bp, Artificial
  CRISPR gRNA sequence
ataaatgagtagttcctctg

SEQ ID NO: 570997 - DNA, 20 bp, Artificial
  CRISPR gRNA sequence
gagtagttcctctgcagtct

SEQ ID NO: 570998 - DNA, 20 bp, Artificial
  CRISPR gRNA sequence
gttcctctgcagtctaagct

SEQ ID NO: 570999 - DNA, 20 bp, Artificial
  CRISPR gRNA sequence
ttcctctgcagtctaagctg

SEQ ID NO: 571000 - DNA, 20 bp, Artificial
  CRISPR gRNA sequence
ctgcagtctaagctgaggca

SEQ ID NO: 571001 - DNA, 20 bp, Artificial
  CRISPR gRNA sequence
gtctaagctgaggcatggat

SEQ ID NO: 571002 - DNA, 20 bp, Artificial
  CRISPR gRNA sequence
tctaagctgaggcatggatc

SEQ ID NO: 571003 - DNA, 20 bp, Artificial
  CRISPR gRNA sequence
ctaagctgaggcatggatca

SEQ ID NO: 571004 - DNA, 20 bp, Artificial
  CRISPR gRNA sequence
ctgaggcatggatcagggct

SEQ ID NO: 571005 - DNA, 20 bp, Artificial
  CRISPR gRNA sequence
tgaggcatggatcagggctc

SEQ ID NO: 571006 - DNA, 20 bp, Artificial
  CRISPR gRNA sequence
gaggcatggatcagggctca

SEQ ID NO: 571007 - DNA, 20 bp, Artificial
  CRISPR gRNA sequence
atggatcagggctcagggaa

SEQ ID NO: 571008 - DNA, 20 bp, Artificial
  CRISPR gRNA sequence
tggatcagggctcagggaat

SEQ ID NO: 571009 - DNA, 20 bp, Artificial
  CRISPR gRNA sequence
gatcagggctcagggaatgg

SEQ ID NO: 571010 - DNA, 20 bp, Artificial
  CRISPR gRNA sequence
agggctcagggaatgggagt

SEQ ID NO: 571011 - DNA, 20 bp, Artificial
  CRISPR gRNA sequence
gggctcagggaatgggagtg

SEQ ID NO: 571012 - DNA, 20 bp, Artificial
  CRISPR gRNA sequence
tcagggaatgggagtgaggt

SEQ ID NO: 571013 - DNA, 20 bp, Artificial
  CRISPR gRNA sequence
gggaatgggagtgaggtgag

SEQ ID NO: 571014 - DNA, 20 bp, Artificial
  CRISPR gRNA sequence
aatgggagtgaggtgagtgg

SEQ ID NO: 571015 - DNA, 20 bp, Artificial
  CRISPR gRNA sequence
atgggagtgaggtgagtggc

SEQ ID NO: 571016 - DNA, 20 bp, Artificial
  CRISPR gRNA sequence
tgggagtgaggtgagtggca

SEQ ID NO: 571017 - DNA, 20 bp, Artificial
  CRISPR gRNA sequence
gggagtgaggtgagtggcag

SEQ ID NO: 571018 - DNA, 20 bp, Artificial
  CRISPR gRNA sequence
gagtgaggtgagtggcaggg

SEQ ID NO: 571019 - DNA, 20 bp, Artificial
  CRISPR gRNA sequence
ggtgagtggcaggggagaca

SEQ ID NO: 571020 - DNA, 20 bp, Artificial
  CRISPR gRNA sequence
gtgagtggcaggggagacac

SEQ ID NO: 571021 - DNA, 20 bp, Artificial
  CRISPR gRNA sequence
tgagtggcaggggagacacg

SEQ ID NO: 571022 - DNA, 20 bp, Artificial
  CRISPR gRNA sequence
ggggagacacggggtatttt

SEQ ID NO: 571023 - DNA, 20 bp, Artificial
  CRISPR gRNA sequence
agacacggggtatttttggc

SEQ ID NO: 571024 - DNA, 20 bp, Artificial
  CRISPR gRNA sequence
gacacggggtatttttggca

SEQ ID NO: 571025 - DNA, 20 bp, Artificial
  CRISPR gRNA sequence
acggggtatttttggcaagg

SEQ ID NO: 571026 - DNA, 20 bp, Artificial
  CRISPR gRNA sequence
ttttggcaaggcagtgtgtg

SEQ ID NO: 571027 - DNA, 20 bp, Artificial
  CRISPR gRNA sequence
tgtggctgtgtgtgtctgca

SEQ ID NO: 571028 - DNA, 20 bp, Artificial
  CRISPR gRNA sequence
gtggctgtgtgtgtctgcac

SEQ ID NO: 571029 - DNA, 20 bp, Artificial
  CRISPR gRNA sequence
tgtgtgtctgcacgggactc

SEQ ID NO: 571030 - DNA, 20 bp, Artificial
  CRISPR gRNA sequence
tgtgtctgcacgggactcaa

SEQ ID NO: 571031 - DNA, 20 bp, Artificial
  CRISPR gRNA sequence
acgggactcaagagacccac

SEQ ID NO: 571032 - DNA, 20 bp, Artificial
  CRISPR gRNA sequence
cgggactcaagagacccact

SEQ ID NO: 571033 - DNA, 20 bp, Artificial
  CRISPR gRNA sequence
gggactcaagagacccactg

SEQ ID NO: 571034 - DNA, 20 bp, Artificial
  CRISPR gRNA sequence
ggactcaagagacccactgg

SEQ ID NO: 571035 - DNA, 20 bp, Artificial
  CRISPR gRNA sequence
gactcaagagacccactggg

SEQ ID NO: 571036 - DNA, 20 bp, Artificial
  CRISPR gRNA sequence
ctgtgcgtgtgcatatgcgt

SEQ ID NO: 571037 - DNA, 20 bp, Artificial
  CRISPR gRNA sequence
gtgcatatgcgtgagataca

SEQ ID NO: 571038 - DNA, 20 bp, Artificial
  CRISPR gRNA sequence
tgcatatgcgtgagatacac

SEQ ID NO: 571039 - DNA, 20 bp, Artificial
  CRISPR gRNA sequence
gatacacaggtgaattctaa

SEQ ID NO: 571040 - DNA, 20 bp, Artificial
  CRISPR gRNA sequence
atacacaggtgaattctaac

SEQ ID NO: 571041 - DNA, 20 bp, Artificial
  CRISPR gRNA sequence
ttctaacaggccgtgtgtgt

SEQ ID NO: 571042 - DNA, 20 bp, Artificial
  CRISPR gRNA sequence
aacaggccgtgtgtgtgagc

SEQ ID NO: 571043 - DNA, 20 bp, Artificial
  CRISPR gRNA sequence
gtgtgtgagcgagcacgtgt

SEQ ID NO: 571044 - DNA, 20 bp, Artificial
  CRISPR gRNA sequence
tgtgtgagcgagcacgtgtt

SEQ ID NO: 571045 - DNA, 20 bp, Artificial
  CRISPR gRNA sequence
gcgagcacgtgttgggacct

SEQ ID NO: 571046 - DNA, 20 bp, Artificial
  CRISPR gRNA sequence
gtgttgggacctcagatcct

SEQ ID NO: 571047 - DNA, 20 bp, Artificial
  CRISPR gRNA sequence
tgttgggacctcagatcctg

SEQ ID NO: 571048 - DNA, 20 bp, Artificial
  CRISPR gRNA sequence
gttgggacctcagatcctga

SEQ ID NO: 571049 - DNA, 20 bp, Artificial
  CRISPR gRNA sequence
gtactgacgctgcttctgtg

SEQ ID NO: 571050 - DNA, 20 bp, Artificial
  CRISPR gRNA sequence
tactgacgctgcttctgtgt

SEQ ID NO: 571051 - DNA, 20 bp, Artificial
  CRISPR gRNA sequence
gctgcttctgtgtaggcctc

SEQ ID NO: 571052 - DNA, 20 bp, Artificial
  CRISPR gRNA sequence
ctgcttctgtgtaggcctct

SEQ ID NO: 571053 - DNA, 20 bp, Artificial
  CRISPR gRNA sequence
tgggcacacccctgtgttga

SEQ ID NO: 571054 - DNA, 20 bp, Artificial
  CRISPR gRNA sequence
ctgtgttgacagtgcccctg

SEQ ID NO: 571055 - DNA, 20 bp, Artificial
  CRISPR gRNA sequence
tgtgttgacagtgcccctgt

SEQ ID NO: 571056 - DNA, 20 bp, Artificial
  CRISPR gRNA sequence
acagtgcccctgtgggccct

SEQ ID NO: 571057 - DNA, 20 bp, Artificial
  CRISPR gRNA sequence
cagtgcccctgtgggccctg

SEQ ID NO: 571058 - DNA, 20 bp, Artificial
  CRISPR gRNA sequence
gcccctgtgggccctgaggc

SEQ ID NO: 571059 - DNA, 20 bp, Artificial
  CRISPR gRNA sequence
gtgggccctgaggctggctg

SEQ ID NO: 571060 - DNA, 20 bp, Artificial
  CRISPR gRNA sequence
tgggccctgaggctggctgt

SEQ ID NO: 571061 - DNA, 20 bp, Artificial
  CRISPR gRNA sequence
ctggctgtgggtgcgtgcct

SEQ ID NO: 571062 - DNA, 20 bp, Artificial
  CRISPR gRNA sequence
tggctgtgggtgcgtgcctt

SEQ ID NO: 571063 - DNA, 20 bp, Artificial
  CRISPR gRNA sequence
ggctgtgggtgcgtgccttg

SEQ ID NO: 571064 - DNA, 20 bp, Artificial
  CRISPR gRNA sequence
ggtgcgtgccttggggtgtg

SEQ ID NO: 571065 - DNA, 20 bp, Artificial
  CRISPR gRNA sequence
gtgcgtgccttggggtgtgt

SEQ ID NO: 571066 - DNA, 20 bp, Artificial
  CRISPR gRNA sequence
ccttggggtgtgtgggttgt

SEQ ID NO: 571067 - DNA, 20 bp, Artificial
  CRISPR gRNA sequence
cttggggtgtgtgggttgtc
